United States Patent 7,250,289 (METHODS OF GENETIC ANALYSIS OF MOUSE) - sequence listing, part 3

SEQ ID NO: 79663 - DNA, 25 bp, Mus musculus
aatgacatcaccctggaggaaaggc

SEQ ID NO: 79664 - DNA, 25 bp, Mus musculus
aatgacatcaccgtggaggaaaggc

SEQ ID NO: 79665 - DNA, 25 bp, Mus musculus
aatgacatcatgctcctgaagctgg

SEQ ID NO: 79666 - DNA, 25 bp, Mus musculus
aatgacatcatggtcctgaagctgg

SEQ ID NO: 79667 - DNA, 25 bp, Mus musculus
aatgacatcctcaaggtctgacctg

SEQ ID NO: 79668 - DNA, 25 bp, Mus musculus
aatgacatcctctaggtctgacctg

SEQ ID NO: 79669 - DNA, 25 bp, Mus musculus
aatgacatccttccatgactagagg

SEQ ID NO: 79670 - DNA, 25 bp, Mus musculus
aatgacatccttgcatgactagagg

SEQ ID NO: 79671 - DNA, 25 bp, Mus musculus
aatgacatctcacgtggcagcatcc

SEQ ID NO: 79672 - DNA, 25 bp, Mus musculus
aatgacatctcaggtggcagcatcc

SEQ ID NO: 79673 - DNA, 25 bp, Mus musculus
aatgacatgagcaacctgggtccat

SEQ ID NO: 79674 - DNA, 25 bp, Mus musculus
aatgacatgagctacctgggtccat

SEQ ID NO: 79675 - DNA, 25 bp, Mus musculus
aatgacatgaggctcctatctccag

SEQ ID NO: 79676 - DNA, 25 bp, Mus musculus
aatgacatgagggtcctatctccag

SEQ ID NO: 79677 - DNA, 25 bp, Mus musculus
aatgacatgcccatctacgaagctg

SEQ ID NO: 79678 - DNA, 25 bp, Mus musculus
aatgacatgcccttctacgaagctg

SEQ ID NO: 79679 - DNA, 25 bp, Mus musculus
aatgacatgtcaccaagttagcttg

SEQ ID NO: 79680 - DNA, 25 bp, Mus musculus
aatgacatgtcagcaagttagcttg

SEQ ID NO: 79681 - DNA, 25 bp, Mus musculus
aatgacattcccctagaagtttcta

SEQ ID NO: 79682 - DNA, 25 bp, Mus musculus
aatgacattcccgtagaagtttcta

SEQ ID NO: 79683 - DNA, 25 bp, Mus musculus
aatgacattcctcggaggcccaggc

SEQ ID NO: 79684 - DNA, 25 bp, Mus musculus
aatgacattcctgggaggcccaggc

SEQ ID NO: 79685 - DNA, 25 bp, Mus musculus
aatgacatttaactccatgagtagg

SEQ ID NO: 79686 - DNA, 25 bp, Mus musculus
aatgacatttaagtccatgagtagg

SEQ ID NO: 79687 - DNA, 25 bp, Mus musculus
aatgacatttgcaccaagctttggc

SEQ ID NO: 79688 - DNA, 25 bp, Mus musculus
aatgacatttgctccaagctttggc

SEQ ID NO: 79689 - DNA, 25 bp, Mus musculus
aatgaccaaagcattacggttcaaa

SEQ ID NO: 79690 - DNA, 25 bp, Mus musculus
aatgaccaaagctttacggttcaaa

SEQ ID NO: 79691 - DNA, 25 bp, Mus musculus
aatgaccaacatacctcgagtagaa

SEQ ID NO: 79692 - DNA, 25 bp, Mus musculus
aatgaccaacattcctcgagtagaa

SEQ ID NO: 79693 - DNA, 25 bp, Mus musculus
aatgaccaattcaccgctatgtctt

SEQ ID NO: 79694 - DNA, 25 bp, Mus musculus
aatgaccaattctccgctatgtctt

SEQ ID NO: 79695 - DNA, 25 bp, Mus musculus
aatgaccacaacagaacacacatcc

SEQ ID NO: 79696 - DNA, 25 bp, Mus musculus
aatgaccacaactgaacacacatcc

SEQ ID NO: 79697 - DNA, 25 bp, Mus musculus
aatgaccacaagaatccttttgata

SEQ ID NO: 79698 - DNA, 25 bp, Mus musculus
aatgaccacaagtatccttttgata

SEQ ID NO: 79699 - DNA, 25 bp, Mus musculus
aatgaccacagtagaaggctggctt

SEQ ID NO: 79700 - DNA, 25 bp, Mus musculus
aatgaccacagttgaaggctggctt

SEQ ID NO: 79701 - DNA, 25 bp, Mus musculus
aatgaccactcccataagggctata

SEQ ID NO: 79702 - DNA, 25 bp, Mus musculus
aatgaccactccgataagggctata

SEQ ID NO: 79703 - DNA, 25 bp, Mus musculus
aatgaccagaacagtaacccttggg

SEQ ID NO: 79704 - DNA, 25 bp, Mus musculus
aatgaccagaactgtaacccttggg

SEQ ID NO: 79705 - DNA, 25 bp, Mus musculus
aatgaccagagtacctcggaccgaa

SEQ ID NO: 79706 - DNA, 25 bp, Mus musculus
aatgaccagagttcctcggaccgaa

SEQ ID NO: 79707 - DNA, 25 bp, Mus musculus
aatgaccagattagtggaccattct

SEQ ID NO: 79708 - DNA, 25 bp, Mus musculus
aatgaccagatttgtggaccattct

SEQ ID NO: 79709 - DNA, 25 bp, Mus musculus
aatgaccagctaagcacttgtccgc

SEQ ID NO: 79710 - DNA, 25 bp, Mus musculus
aatgaccagctatgcacttgtccgc

SEQ ID NO: 79711 - DNA, 25 bp, Mus musculus
aatgaccaggctaccatggacacat

SEQ ID NO: 79712 - DNA, 25 bp, Mus musculus
aatgaccaggcttccatggacacat

SEQ ID NO: 79713 - DNA, 25 bp, Mus musculus
aatgaccagtggacttgacttttag

SEQ ID NO: 79714 - DNA, 25 bp, Mus musculus
aatgaccagtggtcttgacttttag

SEQ ID NO: 79715 - DNA, 25 bp, Mus musculus
aatgaccataatcaagggctggctg

SEQ ID NO: 79716 - DNA, 25 bp, Mus musculus
aatgaccataatgaagggctggctg

SEQ ID NO: 79717 - DNA, 25 bp, Mus musculus
aatgaccatactatctagttgagtt

SEQ ID NO: 79718 - DNA, 25 bp, Mus musculus
aatgaccatactttctagttgagtt

SEQ ID NO: 79719 - DNA, 25 bp, Mus musculus
aatgaccatccaacctgaggaagag

SEQ ID NO: 79720 - DNA, 25 bp, Mus musculus
aatgaccatccatcctgaggaagag

SEQ ID NO: 79721 - DNA, 25 bp, Mus musculus
aatgaccattctccatatacctttc

SEQ ID NO: 79722 - DNA, 25 bp, Mus musculus
aatgaccattctgcatatacctttc

SEQ ID NO: 79723 - DNA, 25 bp, Mus musculus
aatgaccattttccaactactgcac

SEQ ID NO: 79724 - DNA, 25 bp, Mus musculus
aatgaccattttgcaactactgcac

SEQ ID NO: 79725 - DNA, 25 bp, Mus musculus
aatgacccaaggacaactgggctct

SEQ ID NO: 79726 - DNA, 25 bp, Mus musculus
aatgacccaaggtcaactgggctct

SEQ ID NO: 79727 - DNA, 25 bp, Mus musculus
aatgacccagctattgattttgcca

SEQ ID NO: 79728 - DNA, 25 bp, Mus musculus
aatgacccagcttttgattttgcca

SEQ ID NO: 79729 - DNA, 25 bp, Mus musculus
aatgacccagtactacagggtgtgc

SEQ ID NO: 79730 - DNA, 25 bp, Mus musculus
aatgacccagtagtacagggtgtgc

SEQ ID NO: 79731 - DNA, 25 bp, Mus musculus
aatgacccatacagagacctatagt

SEQ ID NO: 79732 - DNA, 25 bp, Mus musculus
aatgacccatactgagacctatagt

SEQ ID NO: 79733 - DNA, 25 bp, Mus musculus
aatgacccatttaatccgttgggag

SEQ ID NO: 79734 - DNA, 25 bp, Mus musculus
aatgacccattttatccgttgggag

SEQ ID NO: 79735 - DNA, 25 bp, Mus musculus
aatgaccccagtattgaggacatga

SEQ ID NO: 79736 - DNA, 25 bp, Mus musculus
aatgaccccagttttgaggacatga

SEQ ID NO: 79737 - DNA, 25 bp, Mus musculus
aatgacccctagatgtgagctgttg

SEQ ID NO: 79738 - DNA, 25 bp, Mus musculus
aatgacccctagttgtgagctgttg

SEQ ID NO: 79739 - DNA, 25 bp, Mus musculus
aatgaccctctcattcagtttcatc

SEQ ID NO: 79740 - DNA, 25 bp, Mus musculus
aatgaccctctctttcagtttcatc

SEQ ID NO: 79741 - DNA, 25 bp, Mus musculus
aatgaccctgcgaatagtgcggtta

SEQ ID NO: 79742 - DNA, 25 bp, Mus musculus
aatgaccctgcgtatagtgcggtta

SEQ ID NO: 79743 - DNA, 25 bp, Mus musculus
aatgacccttatctcatgtgttaag

SEQ ID NO: 79744 - DNA, 25 bp, Mus musculus
aatgacccttatgtcatgtgttaag

SEQ ID NO: 79745 - DNA, 25 bp, Mus musculus
aatgacccttcgctgggccatgtgg

SEQ ID NO: 79746 - DNA, 25 bp, Mus musculus
aatgacccttcggtgggccatgtgg

SEQ ID NO: 79747 - DNA, 25 bp, Mus musculus
aatgacccttgaagatcaagctaac

SEQ ID NO: 79748 - DNA, 25 bp, Mus musculus
aatgacccttgatgatcaagctaac

SEQ ID NO: 79749 - DNA, 25 bp, Mus musculus
aatgaccgacaacgactggcccaag

SEQ ID NO: 79750 - DNA, 25 bp, Mus musculus
aatgaccgacaaggactggcccaag

SEQ ID NO: 79751 - DNA, 25 bp, Mus musculus
aatgaccgtgcgacctggctcttgt

SEQ ID NO: 79752 - DNA, 25 bp, Mus musculus
aatgaccgtgcgtcctggctcttgt

SEQ ID NO: 79753 - DNA, 25 bp, Mus musculus
aatgacctaagaagatactgacgta

SEQ ID NO: 79754 - DNA, 25 bp, Mus musculus
aatgacctaagatgatactgacgta

SEQ ID NO: 79755 - DNA, 25 bp, Mus musculus
aatgacctaagtatgacacccagaa

SEQ ID NO: 79756 - DNA, 25 bp, Mus musculus
aatgacctaagtttgacacccagaa

SEQ ID NO: 79757 - DNA, 25 bp, Mus musculus
aatgacctaattaattaatctgaag

SEQ ID NO: 79758 - DNA, 25 bp, Mus musculus
aatgacctaatttattaatctgaag

SEQ ID NO: 79759 - DNA, 25 bp, Mus musculus
aatgacctaggcagccgcttttggc

SEQ ID NO: 79760 - DNA, 25 bp, Mus musculus
aatgacctaggctgccgcttttggc

SEQ ID NO: 79761 - DNA, 25 bp, Mus musculus
aatgacctatagactctttgataca

SEQ ID NO: 79762 - DNA, 25 bp, Mus musculus
aatgacctatagtctctttgataca

SEQ ID NO: 79763 - DNA, 25 bp, Mus musculus
aatgacctcaaaccctgtgtgatgc

SEQ ID NO: 79764 - DNA, 25 bp, Mus musculus
aatgacctcaaagcctgtgtgatgc

SEQ ID NO: 79765 - DNA, 25 bp, Mus musculus
aatgacctcaggatggatgtgacaa

SEQ ID NO: 79766 - DNA, 25 bp, Mus musculus
aatgacctcaggttggatgtgacaa

SEQ ID NO: 79767 - DNA, 25 bp, Mus musculus
aatgacctcattacagtgtgactgc

SEQ ID NO: 79768 - DNA, 25 bp, Mus musculus
aatgacctcattcaaagacctgcct

SEQ ID NO: 79769 - DNA, 25 bp, Mus musculus
aatgacctcattgaaagacctgcct

SEQ ID NO: 79770 - DNA, 25 bp, Mus musculus
aatgacctcatttcagtgtgactgc

SEQ ID NO: 79771 - DNA, 25 bp, Mus musculus
aatgacctccgtaacccgccttatg

SEQ ID NO: 79772 - DNA, 25 bp, Mus musculus
aatgacctccgttacccgccttatg

SEQ ID NO: 79773 - DNA, 25 bp, Mus musculus
aatgacctcgatagctgattccact

SEQ ID NO: 79774 - DNA, 25 bp, Mus musculus
aatgacctcgattgctgattccact

SEQ ID NO: 79775 - DNA, 25 bp, Mus musculus
aatgacctctaaccatcctgggtgt

SEQ ID NO: 79776 - DNA, 25 bp, Mus musculus
aatgacctctaagcatcctgggtgt

SEQ ID NO: 79777 - DNA, 25 bp, Mus musculus
aatgacctcttgatactacgaatat

SEQ ID NO: 79778 - DNA, 25 bp, Mus musculus
aatgacctcttgttactacgaatat

SEQ ID NO: 79779 - DNA, 25 bp, Mus musculus
aatgacctgaaaacctgtctgatgc

SEQ ID NO: 79780 - DNA, 25 bp, Mus musculus
aatgacctgaaatcctgtctgatgc

SEQ ID NO: 79781 - DNA, 25 bp, Mus musculus
aatgacctgactaccattgaccctg

SEQ ID NO: 79782 - DNA, 25 bp, Mus musculus
aatgacctgacttccattgaccctg

SEQ ID NO: 79783 - DNA, 25 bp, Mus musculus
aatgacctgattatctttcttgcaa

SEQ ID NO: 79784 - DNA, 25 bp, Mus musculus
aatgacctgattttctttcttgcaa

SEQ ID NO: 79785 - DNA, 25 bp, Mus musculus
aatgacctgcccaacaatctcactt

SEQ ID NO: 79786 - DNA, 25 bp, Mus musculus
aatgacctgccctacaatctcactt

SEQ ID NO: 79787 - DNA, 25 bp, Mus musculus
aatgacctggaacattgcctgaagt

SEQ ID NO: 79788 - DNA, 25 bp, Mus musculus
aatgacctggaagattgcctgaagt

SEQ ID NO: 79789 - DNA, 25 bp, Mus musculus
aatgacctgggtcccaaagatccct

SEQ ID NO: 79790 - DNA, 25 bp, Mus musculus
aatgacctgggtgccaaagatccct

SEQ ID NO: 79791 - DNA, 25 bp, Mus musculus
aatgaccttatgaagttttgtagtt

SEQ ID NO: 79792 - DNA, 25 bp, Mus musculus
aatgaccttatgctttacttagata

SEQ ID NO: 79793 - DNA, 25 bp, Mus musculus
aatgaccttatggtttacttagata

SEQ ID NO: 79794 - DNA, 25 bp, Mus musculus
aatgaccttatgtagttttgtagtt

SEQ ID NO: 79795 - DNA, 25 bp, Mus musculus
aatgaccttattacttggccctaat

SEQ ID NO: 79796 - DNA, 25 bp, Mus musculus
aatgaccttatttcttggccctaat

SEQ ID NO: 79797 - DNA, 25 bp, Mus musculus
aatgaccttcccacaaggtggaaag

SEQ ID NO: 79798 - DNA, 25 bp, Mus musculus
aatgaccttccctcaaggtggaaag

SEQ ID NO: 79799 - DNA, 25 bp, Mus musculus
aatgaccttcctatggacagccaat

SEQ ID NO: 79800 - DNA, 25 bp, Mus musculus
aatgaccttcctttggacagccaat

SEQ ID NO: 79801 - DNA, 25 bp, Mus musculus
aatgaccttctgcacactcttaatg

SEQ ID NO: 79802 - DNA, 25 bp, Mus musculus
aatgaccttctggacactcttaatg

SEQ ID NO: 79803 - DNA, 25 bp, Mus musculus
aatgaccttgaaccttagactgggt

SEQ ID NO: 79804 - DNA, 25 bp, Mus musculus
aatgaccttgaagcttagactgggt

SEQ ID NO: 79805 - DNA, 25 bp, Mus musculus
aatgaccttggactatcttgtaatt

SEQ ID NO: 79806 - DNA, 25 bp, Mus musculus
aatgaccttggagtatcttgtaatt

SEQ ID NO: 79807 - DNA, 25 bp, Mus musculus
aatgaccttgtccaaaccgttcagt

SEQ ID NO: 79808 - DNA, 25 bp, Mus musculus
aatgaccttgtcgaaaccgttcagt

SEQ ID NO: 79809 - DNA, 25 bp, Mus musculus
aatgaccttgttaggatagtccttt

SEQ ID NO: 79810 - DNA, 25 bp, Mus musculus
aatgaccttgtttggatagtccttt

SEQ ID NO: 79811 - DNA, 25 bp, Mus musculus
aatgacctttggattcttttgctaa

SEQ ID NO: 79812 - DNA, 25 bp, Mus musculus
aatgacctttggtttcttttgctaa

SEQ ID NO: 79813 - DNA, 25 bp, Mus musculus
aatgacgaccctcatgcaggctggg

SEQ ID NO: 79814 - DNA, 25 bp, Mus musculus
aatgacgaccctgatgcaggctggg

SEQ ID NO: 79815 - DNA, 25 bp, Mus musculus
aatgacgacgtcacaatgccaggat

SEQ ID NO: 79816 - DNA, 25 bp, Mus musculus
aatgacgacgtctcaatgccaggat

SEQ ID NO: 79817 - DNA, 25 bp, Mus musculus
aatgacgactgtcggacactcaaag

SEQ ID NO: 79818 - DNA, 25 bp, Mus musculus
aatgacgactgtgggacactcaaag

SEQ ID NO: 79819 - DNA, 25 bp, Mus musculus
aatgacgatgacctgtatggctaag

SEQ ID NO: 79820 - DNA, 25 bp, Mus musculus
aatgacgatgacgtgtatggctaag

SEQ ID NO: 79821 - DNA, 25 bp, Mus musculus
aatgacgattctcactgcccatact

SEQ ID NO: 79822 - DNA, 25 bp, Mus musculus
aatgacgattctgactgcccatact

SEQ ID NO: 79823 - DNA, 25 bp, Mus musculus
aatgacgcacgtctcaaagctgaga

SEQ ID NO: 79824 - DNA, 25 bp, Mus musculus
aatgacgcacgtgtcaaagctgaga

SEQ ID NO: 79825 - DNA, 25 bp, Mus musculus
aatgacgctggtatcctgtgttgac

SEQ ID NO: 79826 - DNA, 25 bp, Mus musculus
aatgacgctggtttcctgtgttgac

SEQ ID NO: 79827 - DNA, 25 bp, Mus musculus
aatgacgctgtcagctaccaggatg

SEQ ID NO: 79828 - DNA, 25 bp, Mus musculus
aatgacgctgtcctacaggcgagca

SEQ ID NO: 79829 - DNA, 25 bp, Mus musculus
aatgacgctgtcgtacaggcgagca

SEQ ID NO: 79830 - DNA, 25 bp, Mus musculus
aatgacgctgtctgctaccaggatg

SEQ ID NO: 79831 - DNA, 25 bp, Mus musculus
aatgacggccttcgattgtctgacc

SEQ ID NO: 79832 - DNA, 25 bp, Mus musculus
aatgacggccttggattgtctgacc

SEQ ID NO: 79833 - DNA, 25 bp, Mus musculus
aatgacggcgtgctgggtttggctc

SEQ ID NO: 79834 - DNA, 25 bp, Mus musculus
aatgacggcgtggtgggtttggctc

SEQ ID NO: 79835 - DNA, 25 bp, Mus musculus
aatgacggctcgctatcacagctct

SEQ ID NO: 79836 - DNA, 25 bp, Mus musculus
aatgacggctcggtatcacagctct

SEQ ID NO: 79837 - DNA, 25 bp, Mus musculus
aatgacggtttcatcgtggtctacc

SEQ ID NO: 79838 - DNA, 25 bp, Mus musculus
aatgacggtttcttcgtggtctacc

SEQ ID NO: 79839 - DNA, 25 bp, Mus musculus
aatgacgtagacactgctcctctgg

SEQ ID NO: 79840 - DNA, 25 bp, Mus musculus
aatgacgtagactctgctcctctgg

SEQ ID NO: 79841 - DNA, 25 bp, Mus musculus
aatgacgtcatcaggaggaacagga

SEQ ID NO: 79842 - DNA, 25 bp, Mus musculus
aatgacgtcatctggaggaacagga

SEQ ID NO: 79843 - DNA, 25 bp, Mus musculus
aatgacgtcatgaggcttttgcagt

SEQ ID NO: 79844 - DNA, 25 bp, Mus musculus
aatgacgtcatgtggcttttgcagt

SEQ ID NO: 79845 - DNA, 25 bp, Mus musculus
aatgacgtctgaatgccatgggcca

SEQ ID NO: 79846 - DNA, 25 bp, Mus musculus
aatgacgtctgattgccatgggcca

SEQ ID NO: 79847 - DNA, 25 bp, Mus musculus
aatgacgtgcatatctctgaacagt

SEQ ID NO: 79848 - DNA, 25 bp, Mus musculus
aatgacgtgcatttctctgaacagt

SEQ ID NO: 79849 - DNA, 25 bp, Mus musculus
aatgacgtggtcctgttttggcgaa

SEQ ID NO: 79850 - DNA, 25 bp, Mus musculus
aatgacgtggtcgtgttttggcgaa

SEQ ID NO: 79851 - DNA, 25 bp, Mus musculus
aatgacgttcagcaccgtttcgagg

SEQ ID NO: 79852 - DNA, 25 bp, Mus musculus
aatgacgttcaggaccgtttcgagg

SEQ ID NO: 79853 - DNA, 25 bp, Mus musculus
aatgacgttctacctgagcttctta

SEQ ID NO: 79854 - DNA, 25 bp, Mus musculus
aatgacgttctagctgagcttctta

SEQ ID NO: 79855 - DNA, 25 bp, Mus musculus
aatgacgttgggatgcttcctgggc

SEQ ID NO: 79856 - DNA, 25 bp, Mus musculus
aatgacgttgggttgcttcctgggc

SEQ ID NO: 79857 - DNA, 25 bp, Mus musculus
aatgactaaacaaagcgagcagcca

SEQ ID NO: 79858 - DNA, 25 bp, Mus musculus
aatgactaaacatagcgagcagcca

SEQ ID NO: 79859 - DNA, 25 bp, Mus musculus
aatgactaaccacgtcaccctttgt

SEQ ID NO: 79860 - DNA, 25 bp, Mus musculus
aatgactaaccaggtcaccctttgt

SEQ ID NO: 79861 - DNA, 25 bp, Mus musculus
aatgactaacgtcgtcccatcagtg

SEQ ID NO: 79862 - DNA, 25 bp, Mus musculus
aatgactaacgtggtcccatcagtg

SEQ ID NO: 79863 - DNA, 25 bp, Mus musculus
aatgactaagaccaccgcctttaat

SEQ ID NO: 79864 - DNA, 25 bp, Mus musculus
aatgactaagacgaccgcctttaat

SEQ ID NO: 79865 - DNA, 25 bp, Mus musculus
aatgactaatggctgaccgccctct

SEQ ID NO: 79866 - DNA, 25 bp, Mus musculus
aatgactaatgggtgaccgccctct

SEQ ID NO: 79867 - DNA, 25 bp, Mus musculus
aatgactacatcatctcctttgaca

SEQ ID NO: 79868 - DNA, 25 bp, Mus musculus
aatgactacatcttctcctttgaca

SEQ ID NO: 79869 - DNA, 25 bp, Mus musculus
aatgactaccaacaggaattccaga

SEQ ID NO: 79870 - DNA, 25 bp, Mus musculus
aatgactaccaagaggaattccaga

SEQ ID NO: 79871 - DNA, 25 bp, Mus musculus
aatgactactgtccccgtgacctaa

SEQ ID NO: 79872 - DNA, 25 bp, Mus musculus
aatgactactgtgcccgtgacctaa

SEQ ID NO: 79873 - DNA, 25 bp, Mus musculus
aatgactactttctcccttatcagc

SEQ ID NO: 79874 - DNA, 25 bp, Mus musculus
aatgactactttgtcccttatcagc

SEQ ID NO: 79875 - DNA, 25 bp, Mus musculus
aatgactaggagctgtctctccctt

SEQ ID NO: 79876 - DNA, 25 bp, Mus musculus
aatgactaggaggtgtctctccctt

SEQ ID NO: 79877 - DNA, 25 bp, Mus musculus
aatgactaggttccccggaatctgt

SEQ ID NO: 79878 - DNA, 25 bp, Mus musculus
aatgactaggttgcccggaatctgt

SEQ ID NO: 79879 - DNA, 25 bp, Mus musculus
aatgactatataatcctggtgtttg

SEQ ID NO: 79880 - DNA, 25 bp, Mus musculus
aatgactatatattcctggtgtttg

SEQ ID NO: 79881 - DNA, 25 bp, Mus musculus
aatgactatccgacgggttgtcttc

SEQ ID NO: 79882 - DNA, 25 bp, Mus musculus
aatgactatccgtcgggttgtcttc

SEQ ID NO: 79883 - DNA, 25 bp, Mus musculus
aatgactcacggctttcacctcctt

SEQ ID NO: 79884 - DNA, 25 bp, Mus musculus
aatgactcacgggtttcacctcctt

SEQ ID NO: 79885 - DNA, 25 bp, Mus musculus
aatgactccacaaaagtgaccctca

SEQ ID NO: 79886 - DNA, 25 bp, Mus musculus
aatgactccacataagtgaccctca

SEQ ID NO: 79887 - DNA, 25 bp, Mus musculus
aatgactccaccctctttgataagc

SEQ ID NO: 79888 - DNA, 25 bp, Mus musculus
aatgactccaccgtctttgataagc

SEQ ID NO: 79889 - DNA, 25 bp, Mus musculus
aatgactccagtagtgtctcttagt

SEQ ID NO: 79890 - DNA, 25 bp, Mus musculus
aatgactccagttgtgtctcttagt

SEQ ID NO: 79891 - DNA, 25 bp, Mus musculus
aatgactccctcagcaacaacaaag

SEQ ID NO: 79892 - DNA, 25 bp, Mus musculus
aatgactccctctgcaacaacaaag

SEQ ID NO: 79893 - DNA, 25 bp, Mus musculus
aatgactccctgaggaagcgctacg

SEQ ID NO: 79894 - DNA, 25 bp, Mus musculus
aatgactccctgtggaagcgctacg

SEQ ID NO: 79895 - DNA, 25 bp, Mus musculus
aatgactccgagaactaccctagag

SEQ ID NO: 79896 - DNA, 25 bp, Mus musculus
aatgactccgagtactaccctagag

SEQ ID NO: 79897 - DNA, 25 bp, Mus musculus
aatgactcctcaatatttcagacgt

SEQ ID NO: 79898 - DNA, 25 bp, Mus musculus
aatgactcctcaccttatggtttag

SEQ ID NO: 79899 - DNA, 25 bp, Mus musculus
aatgactcctcagcttatggtttag

SEQ ID NO: 79900 - DNA, 25 bp, Mus musculus
aatgactcctcattatttcagacgt

SEQ ID NO: 79901 - DNA, 25 bp, Mus musculus
aatgactccttgagagctcacggga

SEQ ID NO: 79902 - DNA, 25 bp, Mus musculus
aatgactccttgtgagctcacggga

SEQ ID NO: 79903 - DNA, 25 bp, Mus musculus
aatgactctgcgcacggtattattg

SEQ ID NO: 79904 - DNA, 25 bp, Mus musculus
aatgactctgcggacggtattattg

SEQ ID NO: 79905 - DNA, 25 bp, Mus musculus
aatgactctgttaccgctcggtggg

SEQ ID NO: 79906 - DNA, 25 bp, Mus musculus
aatgactctgtttccgctcggtggg

SEQ ID NO: 79907 - DNA, 25 bp, Mus musculus
aatgactcttaacttccatcccgtt

SEQ ID NO: 79908 - DNA, 25 bp, Mus musculus
aatgactcttaagttccatcccgtt

SEQ ID NO: 79909 - DNA, 25 bp, Mus musculus
aatgactcttcaaactgggaatggt

SEQ ID NO: 79910 - DNA, 25 bp, Mus musculus
aatgactcttcatactgggaatggt

SEQ ID NO: 79911 - DNA, 25 bp, Mus musculus
aatgactcttcccagcaacttttaa

SEQ ID NO: 79912 - DNA, 25 bp, Mus musculus
aatgactcttccgagcaacttttaa

SEQ ID NO: 79913 - DNA, 25 bp, Mus musculus
aatgactcttttaacttgcaaatgc

SEQ ID NO: 79914 - DNA, 25 bp, Mus musculus
aatgactcttttcgcttctttattc

SEQ ID NO: 79915 - DNA, 25 bp, Mus musculus
aatgactcttttggcttctttattc

SEQ ID NO: 79916 - DNA, 25 bp, Mus musculus
aatgactctttttacttgcaaatgc

SEQ ID NO: 79917 - DNA, 25 bp, Mus musculus
aatgactgactgaatcccagcactt

SEQ ID NO: 79918 - DNA, 25 bp, Mus musculus
aatgactgactgtatcccagcactt

SEQ ID NO: 79919 - DNA, 25 bp, Mus musculus
aatgactgagttatgtgctgctttc

SEQ ID NO: 79920 - DNA, 25 bp, Mus musculus
aatgactgagttttgtgctgctttc

SEQ ID NO: 79921 - DNA, 25 bp, Mus musculus
aatgactgcaaaccccatactgaag

SEQ ID NO: 79922 - DNA, 25 bp, Mus musculus
aatgactgcaaagcccatactgaag

SEQ ID NO: 79923 - DNA, 25 bp, Mus musculus
aatgactgcagtagagtcctgaagc

SEQ ID NO: 79924 - DNA, 25 bp, Mus musculus
aatgactgcagttgagtcctgaagc

SEQ ID NO: 79925 - DNA, 25 bp, Mus musculus
aatgactgcccacggtgactttagg

SEQ ID NO: 79926 - DNA, 25 bp, Mus musculus
aatgactgcccagggtgactttagg

SEQ ID NO: 79927 - DNA, 25 bp, Mus musculus
aatgactgctgcatgtatgtgaggc

SEQ ID NO: 79928 - DNA, 25 bp, Mus musculus
aatgactgctgcttgtatgtgaggc

SEQ ID NO: 79929 - DNA, 25 bp, Mus musculus
aatgactgctgtcctattagcaatt

SEQ ID NO: 79930 - DNA, 25 bp, Mus musculus
aatgactgctgtgctattagcaatt

SEQ ID NO: 79931 - DNA, 25 bp, Mus musculus
aatgactgggttcattcttgtcccc

SEQ ID NO: 79932 - DNA, 25 bp, Mus musculus
aatgactgggttgattcttgtcccc

SEQ ID NO: 79933 - DNA, 25 bp, Mus musculus
aatgactgtcctatccaacctctat

SEQ ID NO: 79934 - DNA, 25 bp, Mus musculus
aatgactgtcctttccaacctctat

SEQ ID NO: 79935 - DNA, 25 bp, Mus musculus
aatgactgtgacaggagcgtcctcc

SEQ ID NO: 79936 - DNA, 25 bp, Mus musculus
aatgactgtgactggagcgtcctcc

SEQ ID NO: 79937 - DNA, 25 bp, Mus musculus
aatgactgtgctctttttctccttt

SEQ ID NO: 79938 - DNA, 25 bp, Mus musculus
aatgactgtgctgtttttctccttt

SEQ ID NO: 79939 - DNA, 25 bp, Mus musculus
aatgactgtggaaacaccacctctg

SEQ ID NO: 79940 - DNA, 25 bp, Mus musculus
aatgactgtggatacaccacctctg

SEQ ID NO: 79941 - DNA, 25 bp, Mus musculus
aatgactgttatctggttgtaactc

SEQ ID NO: 79942 - DNA, 25 bp, Mus musculus
aatgactgttatgtggttgtaactc

SEQ ID NO: 79943 - DNA, 25 bp, Mus musculus
aatgactgttgtcatggcctcccca

SEQ ID NO: 79944 - DNA, 25 bp, Mus musculus
aatgactgttgtgatggcctcccca

SEQ ID NO: 79945 - DNA, 25 bp, Mus musculus
aatgactgtttcatcaattgtgctc

SEQ ID NO: 79946 - DNA, 25 bp, Mus musculus
aatgactgtttcttcaattgtgctc

SEQ ID NO: 79947 - DNA, 25 bp, Mus musculus
aatgacttaactacaattacatgag

SEQ ID NO: 79948 - DNA, 25 bp, Mus musculus
aatgacttaacttcaattacatgag

SEQ ID NO: 79949 - DNA, 25 bp, Mus musculus
aatgacttcaagctttgttgagctc

SEQ ID NO: 79950 - DNA, 25 bp, Mus musculus
aatgacttcaaggtttgttgagctc

SEQ ID NO: 79951 - DNA, 25 bp, Mus musculus
aatgacttcagtactcttagtggaa

SEQ ID NO: 79952 - DNA, 25 bp, Mus musculus
aatgacttcagtcttctgggctttc

SEQ ID NO: 79953 - DNA, 25 bp, Mus musculus
aatgacttcagtgttctgggctttc

SEQ ID NO: 79954 - DNA, 25 bp, Mus musculus
aatgacttcagttctcttagtggaa

SEQ ID NO: 79955 - DNA, 25 bp, Mus musculus
aatgacttcatgacttcctacaaga

SEQ ID NO: 79956 - DNA, 25 bp, Mus musculus
aatgacttcatgtcttcctacaaga

SEQ ID NO: 79957 - DNA, 25 bp, Mus musculus
aatgacttcattaagccaggtacat

SEQ ID NO: 79958 - DNA, 25 bp, Mus musculus
aatgacttcatttagccaggtacat

SEQ ID NO: 79959 - DNA, 25 bp, Mus musculus
aatgacttctaacggctggttcttc

SEQ ID NO: 79960 - DNA, 25 bp, Mus musculus
aatgacttctaagggctggttcttc

SEQ ID NO: 79961 - DNA, 25 bp, Mus musculus
aatgacttcttgacagcttcacttc

SEQ ID NO: 79962 - DNA, 25 bp, Mus musculus
aatgacttcttgtcagcttcacttc

SEQ ID NO: 79963 - DNA, 25 bp, Mus musculus
aatgacttctttcaccaccaactat

SEQ ID NO: 79964 - DNA, 25 bp, Mus musculus
aatgacttctttgaccaccaactat

SEQ ID NO: 79965 - DNA, 25 bp, Mus musculus
aatgacttgctgcttactggttcgg

SEQ ID NO: 79966 - DNA, 25 bp, Mus musculus
aatgacttgctggttactggttcgg

SEQ ID NO: 79967 - DNA, 25 bp, Mus musculus
aatgacttgggtagtatttctcctg

SEQ ID NO: 79968 - DNA, 25 bp, Mus musculus
aatgacttgggttgtatttctcctg

SEQ ID NO: 79969 - DNA, 25 bp, Mus musculus
aatgacttgtagaatactcttcatg

SEQ ID NO: 79970 - DNA, 25 bp, Mus musculus
aatgacttgtagtatactcttcatg

SEQ ID NO: 79971 - DNA, 25 bp, Mus musculus
aatgacttgtcacatctttaatgga

SEQ ID NO: 79972 - DNA, 25 bp, Mus musculus
aatgacttgtcagatctttaatgga

SEQ ID NO: 79973 - DNA, 25 bp, Mus musculus
aatgacttgtgcacttgtaatggaa

SEQ ID NO: 79974 - DNA, 25 bp, Mus musculus
aatgacttgtgctcttgtaatggaa

SEQ ID NO: 79975 - DNA, 25 bp, Mus musculus
aatgactttaggcacatgcagcagg

SEQ ID NO: 79976 - DNA, 25 bp, Mus musculus
aatgactttagggacatgcagcagg

SEQ ID NO: 79977 - DNA, 25 bp, Mus musculus
aatgactttgacacaccgagggcag

SEQ ID NO: 79978 - DNA, 25 bp, Mus musculus
aatgactttgacagatacagttatc

SEQ ID NO: 79979 - DNA, 25 bp, Mus musculus
aatgactttgactcaccgagggcag

SEQ ID NO: 79980 - DNA, 25 bp, Mus musculus
aatgactttgactgatacagttatc

SEQ ID NO: 79981 - DNA, 25 bp, Mus musculus
aatgactttgataactgtgtgctgc

SEQ ID NO: 79982 - DNA, 25 bp, Mus musculus
aatgactttgattactgtgtgctgc

SEQ ID NO: 79983 - DNA, 25 bp, Mus musculus
aatgactttgctcttatccttcaac

SEQ ID NO: 79984 - DNA, 25 bp, Mus musculus
aatgactttgctgttatccttcaac

SEQ ID NO: 79985 - DNA, 25 bp, Mus musculus
aatgactttgtcacacctaagccgc

SEQ ID NO: 79986 - DNA, 25 bp, Mus musculus
aatgactttgtctcacctaagccgc

SEQ ID NO: 79987 - DNA, 25 bp, Mus musculus
aatgagaaagtactgaaagacaagc

SEQ ID NO: 79988 - DNA, 25 bp, Mus musculus
aatgagaaagtagtgaaagacaagc

SEQ ID NO: 79989 - DNA, 25 bp, Mus musculus
aatgagaacaccctggacgtgtatg

SEQ ID NO: 79990 - DNA, 25 bp, Mus musculus
aatgagaacaccgtggacgtgtatg

SEQ ID NO: 79991 - DNA, 25 bp, Mus musculus
aatgagaaccaaccccaaggaacag

SEQ ID NO: 79992 - DNA, 25 bp, Mus musculus
aatgagaaccaagcccaaggaacag

SEQ ID NO: 79993 - DNA, 25 bp, Mus musculus
aatgagaacccgcaacagtgcaagg

SEQ ID NO: 79994 - DNA, 25 bp, Mus musculus
aatgagaacccggaacagtgcaagg

SEQ ID NO: 79995 - DNA, 25 bp, Mus musculus
aatgagaacctcctagcctgggtga

SEQ ID NO: 79996 - DNA, 25 bp, Mus musculus
aatgagaacctcgtagcctgggtga

SEQ ID NO: 79997 - DNA, 25 bp, Mus musculus
aatgagaactcaacttttccctcgt

SEQ ID NO: 79998 - DNA, 25 bp, Mus musculus
aatgagaactcatcttttccctcgt

SEQ ID NO: 79999 - DNA, 25 bp, Mus musculus
aatgagaagaccactcgatcctttc

SEQ ID NO: 80000 - DNA, 25 bp, Mus musculus
aatgagaagacctctcgatcctttc

SEQ ID NO: 80001 - DNA, 25 bp, Mus musculus
aatgagaagtggacccatgtgtcca

SEQ ID NO: 80002 - DNA, 25 bp, Mus musculus
aatgagaagtggtcccatgtgtcca

SEQ ID NO: 80003 - DNA, 25 bp, Mus musculus
aatgagaatgctactttccccagga

SEQ ID NO: 80004 - DNA, 25 bp, Mus musculus
aatgagaatgcttctttccccagga

SEQ ID NO: 80005 - DNA, 25 bp, Mus musculus
aatgagacagtcacactgcgccaga

SEQ ID NO: 80006 - DNA, 25 bp, Mus musculus
aatgagacagtctcactgcgccaga

SEQ ID NO: 80007 - DNA, 25 bp, Mus musculus
aatgagacccacagttgattgtatg

SEQ ID NO: 80008 - DNA, 25 bp, Mus musculus
aatgagacccactgttgattgtatg

SEQ ID NO: 80009 - DNA, 25 bp, Mus musculus
aatgagacccccaccaccaggaatt

SEQ ID NO: 80010 - DNA, 25 bp, Mus musculus
aatgagaccccctccaccaggaatt

SEQ ID NO: 80011 - DNA, 25 bp, Mus musculus
aatgagacctgcctgtgaagcaaac

SEQ ID NO: 80012 - DNA, 25 bp, Mus musculus
aatgagacctgcgtgtgaagcaaac

SEQ ID NO: 80013 - DNA, 25 bp, Mus musculus
aatgagaccttaattcagaattcaa

SEQ ID NO: 80014 - DNA, 25 bp, Mus musculus
aatgagaccttatttcagaattcaa

SEQ ID NO: 80015 - DNA, 25 bp, Mus musculus
aatgagactctgaccaggagggctg

SEQ ID NO: 80016 - DNA, 25 bp, Mus musculus
aatgagactctgtccaggagggctg

SEQ ID NO: 80017 - DNA, 25 bp, Mus musculus
aatgagagacctacacacccacagt

SEQ ID NO: 80018 - DNA, 25 bp, Mus musculus
aatgagagaccttcacacccacagt

SEQ ID NO: 80019 - DNA, 25 bp, Mus musculus
aatgagagaggtagccaggctgaac

SEQ ID NO: 80020 - DNA, 25 bp, Mus musculus
aatgagagaggttgccaggctgaac

SEQ ID NO: 80021 - DNA, 25 bp, Mus musculus
aatgagagcaaaaacatgcaaacag

SEQ ID NO: 80022 - DNA, 25 bp, Mus musculus
aatgagagcaaatacatgcaaacag

SEQ ID NO: 80023 - DNA, 25 bp, Mus musculus
aatgagagcacccaaggcgactgca

SEQ ID NO: 80024 - DNA, 25 bp, Mus musculus
aatgagagcaccgaaggcgactgca

SEQ ID NO: 80025 - DNA, 25 bp, Mus musculus
aatgagagccacctgctgccccggg

SEQ ID NO: 80026 - DNA, 25 bp, Mus musculus
aatgagagccacgtgctgccccggg

SEQ ID NO: 80027 - DNA, 25 bp, Mus musculus
aatgagaggattaccttctaccctt

SEQ ID NO: 80028 - DNA, 25 bp, Mus musculus
aatgagaggatttccttctaccctt

SEQ ID NO: 80029 - DNA, 25 bp, Mus musculus
aatgagaggctcatagtccttagta

SEQ ID NO: 80030 - DNA, 25 bp, Mus musculus
aatgagaggctcctatcaggctact

SEQ ID NO: 80031 - DNA, 25 bp, Mus musculus
aatgagaggctcgtatcaggctact

SEQ ID NO: 80032 - DNA, 25 bp, Mus musculus
aatgagaggctcttagtccttagta

SEQ ID NO: 80033 - DNA, 25 bp, Mus musculus
aatgagagtcctcccggtggtagtc

SEQ ID NO: 80034 - DNA, 25 bp, Mus musculus
aatgagagtcctgccggtggtagtc

SEQ ID NO: 80035 - DNA, 25 bp, Mus musculus
aatgagatagaaccatcaccttcct

SEQ ID NO: 80036 - DNA, 25 bp, Mus musculus
aatgagatagaagcatcaccttcct

SEQ ID NO: 80037 - DNA, 25 bp, Mus musculus
aatgagatatctcacttggaaccaa

SEQ ID NO: 80038 - DNA, 25 bp, Mus musculus
aatgagatatctgacttggaaccaa

SEQ ID NO: 80039 - DNA, 25 bp, Mus musculus
aatgagatgctcctaaacttctgtt

SEQ ID NO: 80040 - DNA, 25 bp, Mus musculus
aatgagatgctcgtaaacttctgtt

SEQ ID NO: 80041 - DNA, 25 bp, Mus musculus
aatgagattccacggtccacacagg

SEQ ID NO: 80042 - DNA, 25 bp, Mus musculus
aatgagattccagggtccacacagg

SEQ ID NO: 80043 - DNA, 25 bp, Mus musculus
aatgagattcgtatactgtgacaga

SEQ ID NO: 80044 - DNA, 25 bp, Mus musculus
aatgagattcgtttactgtgacaga

SEQ ID NO: 80045 - DNA, 25 bp, Mus musculus
aatgagcacagcacctattttgaat

SEQ ID NO: 80046 - DNA, 25 bp, Mus musculus
aatgagcacagctcctattttgaat

SEQ ID NO: 80047 - DNA, 25 bp, Mus musculus
aatgagcacccgaggcccctacgga

SEQ ID NO: 80048 - DNA, 25 bp, Mus musculus
aatgagcacccgtggcccctacgga

SEQ ID NO: 80049 - DNA, 25 bp, Mus musculus
aatgagcacgatcgagccacaccac

SEQ ID NO: 80050 - DNA, 25 bp, Mus musculus
aatgagcacgatggagccacaccac

SEQ ID NO: 80051 - DNA, 25 bp, Mus musculus
aatgagcacgctctttctgacacac

SEQ ID NO: 80052 - DNA, 25 bp, Mus musculus
aatgagcacgctgtttctgacacac

SEQ ID NO: 80053 - DNA, 25 bp, Mus musculus
aatgagcagagaatccgagggagcc

SEQ ID NO: 80054 - DNA, 25 bp, Mus musculus
aatgagcagagattccgagggagcc

SEQ ID NO: 80055 - DNA, 25 bp, Mus musculus
aatgagcagagcctctgccaggcac

SEQ ID NO: 80056 - DNA, 25 bp, Mus musculus
aatgagcagagcgtctgccaggcac

SEQ ID NO: 80057 - DNA, 25 bp, Mus musculus
aatgagcagcaacccactgggagac

SEQ ID NO: 80058 - DNA, 25 bp, Mus musculus
aatgagcagcaagccactgggagac

SEQ ID NO: 80059 - DNA, 25 bp, Mus musculus
aatgagcagcgcacagcacacacag

SEQ ID NO: 80060 - DNA, 25 bp, Mus musculus
aatgagcagcgctcagcacacacag

SEQ ID NO: 80061 - DNA, 25 bp, Mus musculus
aatgagcagctgattcccgagcctg

SEQ ID NO: 80062 - DNA, 25 bp, Mus musculus
aatgagcagctgtttcccgagcctg

SEQ ID NO: 80063 - DNA, 25 bp, Mus musculus
aatgagcaggataggcccgatggtc

SEQ ID NO: 80064 - DNA, 25 bp, Mus musculus
aatgagcaggattggcccgatggtc

SEQ ID NO: 80065 - DNA, 25 bp, Mus musculus
aatgagcaggctcggacccactgga

SEQ ID NO: 80066 - DNA, 25 bp, Mus musculus
aatgagcaggctgggacccactgga

SEQ ID NO: 80067 - DNA, 25 bp, Mus musculus
aatgagcatatactggagcctgtct

SEQ ID NO: 80068 - DNA, 25 bp, Mus musculus
aatgagcatatagtggagcctgtct

SEQ ID NO: 80069 - DNA, 25 bp, Mus musculus
aatgagcatccgctctcagaagagc

SEQ ID NO: 80070 - DNA, 25 bp, Mus musculus
aatgagcatccggtctcagaagagc

SEQ ID NO: 80071 - DNA, 25 bp, Mus musculus
aatgagcatgtgacggcctgacctt

SEQ ID NO: 80072 - DNA, 25 bp, Mus musculus
aatgagcatgtgtcggcctgacctt

SEQ ID NO: 80073 - DNA, 25 bp, Mus musculus
aatgagcattatcacgtcgcccgag

SEQ ID NO: 80074 - DNA, 25 bp, Mus musculus
aatgagcattatgacgtcgcccgag

SEQ ID NO: 80075 - DNA, 25 bp, Mus musculus
aatgagcattgtagacacccagcag

SEQ ID NO: 80076 - DNA, 25 bp, Mus musculus
aatgagcattgttgacacccagcag

SEQ ID NO: 80077 - DNA, 25 bp, Mus musculus
aatgagccacacaattatagaagga

SEQ ID NO: 80078 - DNA, 25 bp, Mus musculus
aatgagccacactattatagaagga

SEQ ID NO: 80079 - DNA, 25 bp, Mus musculus
aatgagcccacaaatgcatgccaac

SEQ ID NO: 80080 - DNA, 25 bp, Mus musculus
aatgagcccacatatgcatgccaac

SEQ ID NO: 80081 - DNA, 25 bp, Mus musculus
aatgagccccgactggtgaaatgac

SEQ ID NO: 80082 - DNA, 25 bp, Mus musculus
aatgagccccgagtggtgaaatgac

SEQ ID NO: 80083 - DNA, 25 bp, Mus musculus
aatgagccctttcataatctctctc

SEQ ID NO: 80084 - DNA, 25 bp, Mus musculus
aatgagccctttccgtgacagtatt

SEQ ID NO: 80085 - DNA, 25 bp, Mus musculus
aatgagccctttgataatctctctc

SEQ ID NO: 80086 - DNA, 25 bp, Mus musculus
aatgagccctttgcgtgacagtatt

SEQ ID NO: 80087 - DNA, 25 bp, Mus musculus
aatgagcctaatatcgatttcccgg

SEQ ID NO: 80088 - DNA, 25 bp, Mus musculus
aatgagcctaatttcgatttcccgg

SEQ ID NO: 80089 - DNA, 25 bp, Mus musculus
aatgagcctattactttctaaaaag

SEQ ID NO: 80090 - DNA, 25 bp, Mus musculus
aatgagcctatttctttctaaaaag

SEQ ID NO: 80091 - DNA, 25 bp, Mus musculus
aatgagcctcacaccttagacagta

SEQ ID NO: 80092 - DNA, 25 bp, Mus musculus
aatgagcctcactccttagacagta

SEQ ID NO: 80093 - DNA, 25 bp, Mus musculus
aatgagcctgcaacaggtggctgcg

SEQ ID NO: 80094 - DNA, 25 bp, Mus musculus
aatgagcctgcactgtcggtgccca

SEQ ID NO: 80095 - DNA, 25 bp, Mus musculus
aatgagcctgcagtgtcggtgccca

SEQ ID NO: 80096 - DNA, 25 bp, Mus musculus
aatgagcctgcatcaggtggctgcg

SEQ ID NO: 80097 - DNA, 25 bp, Mus musculus
aatgagcctgcccagagatgctttt

SEQ ID NO: 80098 - DNA, 25 bp, Mus musculus
aatgagcctgccgagagatgctttt

SEQ ID NO: 80099 - DNA, 25 bp, Mus musculus
aatgagcctgtgacacaccggaact

SEQ ID NO: 80100 - DNA, 25 bp, Mus musculus
aatgagcctgtgtcacaccggaact

SEQ ID NO: 80101 - DNA, 25 bp, Mus musculus
aatgagccttggatgctgtcggcaa

SEQ ID NO: 80102 - DNA, 25 bp, Mus musculus
aatgagccttggttgctgtcggcaa

SEQ ID NO: 80103 - DNA, 25 bp, Mus musculus
aatgagcctttcagacttggtggtc

SEQ ID NO: 80104 - DNA, 25 bp, Mus musculus
aatgagcctttctgacttggtggtc

SEQ ID NO: 80105 - DNA, 25 bp, Mus musculus
aatgagcgaaaaagtccctgcgccc

SEQ ID NO: 80106 - DNA, 25 bp, Mus musculus
aatgagcgaaaatgtccctgcgccc

SEQ ID NO: 80107 - DNA, 25 bp, Mus musculus
aatgagcgactaacaaaattgcaca

SEQ ID NO: 80108 - DNA, 25 bp, Mus musculus
aatgagcgactatcaaaattgcaca

SEQ ID NO: 80109 - DNA, 25 bp, Mus musculus
aatgagcgcataccaggccaggccc

SEQ ID NO: 80110 - DNA, 25 bp, Mus musculus
aatgagcgcatagcaggccaggccc

SEQ ID NO: 80111 - DNA, 25 bp, Mus musculus
aatgagcgccaacagattaaagcca

SEQ ID NO: 80112 - DNA, 25 bp, Mus musculus
aatgagcgccaagagattaaagcca

SEQ ID NO: 80113 - DNA, 25 bp, Mus musculus
aatgagcggcacaatggtggcctca

SEQ ID NO: 80114 - DNA, 25 bp, Mus musculus
aatgagcggcactatggtggcctca

SEQ ID NO: 80115 - DNA, 25 bp, Mus musculus
aatgagcggccacctgaggactgca

SEQ ID NO: 80116 - DNA, 25 bp, Mus musculus
aatgagcggccagctgaggactgca

SEQ ID NO: 80117 - DNA, 25 bp, Mus musculus
aatgagcggccgcttatgaggacaa

SEQ ID NO: 80118 - DNA, 25 bp, Mus musculus
aatgagcggccggttatgaggacaa

SEQ ID NO: 80119 - DNA, 25 bp, Mus musculus
aatgagctacctattgcacttccac

SEQ ID NO: 80120 - DNA, 25 bp, Mus musculus
aatgagctaccttttgcacttccac

SEQ ID NO: 80121 - DNA, 25 bp, Mus musculus
aatgagctagcactgagccatcaat

SEQ ID NO: 80122 - DNA, 25 bp, Mus musculus
aatgagctagcagtgagccatcaat

SEQ ID NO: 80123 - DNA, 25 bp, Mus musculus
aatgagctagcgaatttctggccct

SEQ ID NO: 80124 - DNA, 25 bp, Mus musculus
aatgagctagcgtatttctggccct

SEQ ID NO: 80125 - DNA, 25 bp, Mus musculus
aatgagctatccacttagttcgtaa

SEQ ID NO: 80126 - DNA, 25 bp, Mus musculus
aatgagctatcctcttagttcgtaa

SEQ ID NO: 80127 - DNA, 25 bp, Mus musculus
aatgagctccagacactgctgggct

SEQ ID NO: 80128 - DNA, 25 bp, Mus musculus
aatgagctccagtcactgctgggct

SEQ ID NO: 80129 - DNA, 25 bp, Mus musculus
aatgagctccgaagaatcttctcga

SEQ ID NO: 80130 - DNA, 25 bp, Mus musculus
aatgagctccgatgaatcttctcga

SEQ ID NO: 80131 - DNA, 25 bp, Mus musculus
aatgagctcctgatactcaggcgag

SEQ ID NO: 80132 - DNA, 25 bp, Mus musculus
aatgagctcctgcactgccagaatg

SEQ ID NO: 80133 - DNA, 25 bp, Mus musculus
aatgagctcctggactgccagaatg

SEQ ID NO: 80134 - DNA, 25 bp, Mus musculus
aatgagctcctgttactcaggcgag

SEQ ID NO: 80135 - DNA, 25 bp, Mus musculus
aatgagctctgtctcaaggctgtct

SEQ ID NO: 80136 - DNA, 25 bp, Mus musculus
aatgagctctgtgtcaaggctgtct

SEQ ID NO: 80137 - DNA, 25 bp, Mus musculus
aatgagctgaaccttgaaaacaacg

SEQ ID NO: 80138 - DNA, 25 bp, Mus musculus
aatgagctgaacgttgaaaacaacg

SEQ ID NO: 80139 - DNA, 25 bp, Mus musculus
aatgagctgaccattttgtaacaat

SEQ ID NO: 80140 - DNA, 25 bp, Mus musculus
aatgagctgacctttttgtaacaat

SEQ ID NO: 80141 - DNA, 25 bp, Mus musculus
aatgagctgaggcactgtctgttct

SEQ ID NO: 80142 - DNA, 25 bp, Mus musculus
aatgagctgagggactgtctgttct

SEQ ID NO: 80143 - DNA, 25 bp, Mus musculus
aatgagctgccaacctcattatggc

SEQ ID NO: 80144 - DNA, 25 bp, Mus musculus
aatgagctgccatcctcattatggc

SEQ ID NO: 80145 - DNA, 25 bp, Mus musculus
aatgagctggatcgcattcctctga

SEQ ID NO: 80146 - DNA, 25 bp, Mus musculus
aatgagctggatggcattcctctga

SEQ ID NO: 80147 - DNA, 25 bp, Mus musculus
aatgagctgggaccttcctcatgaa

SEQ ID NO: 80148 - DNA, 25 bp, Mus musculus
aatgagctgggagcttcctcatgaa

SEQ ID NO: 80149 - DNA, 25 bp, Mus musculus
aatgagctggttctgctgagcttcc

SEQ ID NO: 80150 - DNA, 25 bp, Mus musculus
aatgagctggttgtgctgagcttcc

SEQ ID NO: 80151 - DNA, 25 bp, Mus musculus
aatgagcttataaatggaccaactt

SEQ ID NO: 80152 - DNA, 25 bp, Mus musculus
aatgagcttatatatggaccaactt

SEQ ID NO: 80153 - DNA, 25 bp, Mus musculus
aatgagctttcccttagcctatact

SEQ ID NO: 80154 - DNA, 25 bp, Mus musculus
aatgagctttccgttagcctatact

SEQ ID NO: 80155 - DNA, 25 bp, Mus musculus
aatgaggaaagacgctgtttaggtt

SEQ ID NO: 80156 - DNA, 25 bp, Mus musculus
aatgaggaaagaggctgtttaggtt

SEQ ID NO: 80157 - DNA, 25 bp, Mus musculus
aatgaggaaggtctcttgtctccat

SEQ ID NO: 80158 - DNA, 25 bp, Mus musculus
aatgaggaaggtgtcttgtctccat

SEQ ID NO: 80159 - DNA, 25 bp, Mus musculus
aatgaggacaaaaggactttaataa

SEQ ID NO: 80160 - DNA, 25 bp, Mus musculus
aatgaggacaaatggactttaataa

SEQ ID NO: 80161 - DNA, 25 bp, Mus musculus
aatgaggacgcccactcttttgctt

SEQ ID NO: 80162 - DNA, 25 bp, Mus musculus
aatgaggacgccgactcttttgctt

SEQ ID NO: 80163 - DNA, 25 bp, Mus musculus
aatgaggactttacatttcccctgg

SEQ ID NO: 80164 - DNA, 25 bp, Mus musculus
aatgaggacttttcatttcccctgg

SEQ ID NO: 80165 - DNA, 25 bp, Mus musculus
aatgaggagctaagtctgaagaata

SEQ ID NO: 80166 - DNA, 25 bp, Mus musculus
aatgaggagctatgtctgaagaata

SEQ ID NO: 80167 - DNA, 25 bp, Mus musculus
aatgaggaggacacgctgcctctga

SEQ ID NO: 80168 - DNA, 25 bp, Mus musculus
aatgaggaggactcgctgcctctga

SEQ ID NO: 80169 - DNA, 25 bp, Mus musculus
aatgaggagggcaacttcgtcacac

SEQ ID NO: 80170 - DNA, 25 bp, Mus musculus
aatgaggagggctacttcgtcacac

SEQ ID NO: 80171 - DNA, 25 bp, Mus musculus
aatgaggagttcaagcccttgactt

SEQ ID NO: 80172 - DNA, 25 bp, Mus musculus
aatgaggagttctagcccttgactt

SEQ ID NO: 80173 - DNA, 25 bp, Mus musculus
aatgaggatccgatgctgtgttctg

SEQ ID NO: 80174 - DNA, 25 bp, Mus musculus
aatgaggatccgttgctgtgttctg

SEQ ID NO: 80175 - DNA, 25 bp, Mus musculus
aatgaggatctgacttgagttgcaa

SEQ ID NO: 80176 - DNA, 25 bp, Mus musculus
aatgaggatctgtcttgagttgcaa

SEQ ID NO: 80177 - DNA, 25 bp, Mus musculus
aatgaggatgcacagcgccgccgcc

SEQ ID NO: 80178 - DNA, 25 bp, Mus musculus
aatgaggatgcagagcgccgccgcc

SEQ ID NO: 80179 - DNA, 25 bp, Mus musculus
aatgaggatggaacaaaactgttga

SEQ ID NO: 80180 - DNA, 25 bp, Mus musculus
aatgaggatggatcaaaactgttga

SEQ ID NO: 80181 - DNA, 25 bp, Mus musculus
aatgaggatggcctgacgcctgaac

SEQ ID NO: 80182 - DNA, 25 bp, Mus musculus
aatgaggatggcgtgacgcctgaac

SEQ ID NO: 80183 - DNA, 25 bp, Mus musculus
aatgaggattcacacccacggtggc

SEQ ID NO: 80184 - DNA, 25 bp, Mus musculus
aatgaggattcagacccacggtggc

SEQ ID NO: 80185 - DNA, 25 bp, Mus musculus
aatgaggattctaggttctcacccc

SEQ ID NO: 80186 - DNA, 25 bp, Mus musculus
aatgaggattcttggttctcacccc

SEQ ID NO: 80187 - DNA, 25 bp, Mus musculus
aatgaggcagcaaagaccgattcgc

SEQ ID NO: 80188 - DNA, 25 bp, Mus musculus
aatgaggcagcatagaccgattcgc

SEQ ID NO: 80189 - DNA, 25 bp, Mus musculus
aatgaggcagctatgatggcacata

SEQ ID NO: 80190 - DNA, 25 bp, Mus musculus
aatgaggcagctttgatggcacata

SEQ ID NO: 80191 - DNA, 25 bp, Mus musculus
aatgaggcattcatcactaccctaa

SEQ ID NO: 80192 - DNA, 25 bp, Mus musculus
aatgaggcattcttcactaccctaa

SEQ ID NO: 80193 - DNA, 25 bp, Mus musculus
aatgaggcggccaatgacgttctca

SEQ ID NO: 80194 - DNA, 25 bp, Mus musculus
aatgaggcggcctatgacgttctca

SEQ ID NO: 80195 - DNA, 25 bp, Mus musculus
aatgaggctcagcacagcaacgctg

SEQ ID NO: 80196 - DNA, 25 bp, Mus musculus
aatgaggctcagcacctctaagcgg

SEQ ID NO: 80197 - DNA, 25 bp, Mus musculus
aatgaggctcaggacagcaacgctg

SEQ ID NO: 80198 - DNA, 25 bp, Mus musculus
aatgaggctcaggacctctaagcgg

SEQ ID NO: 80199 - DNA, 25 bp, Mus musculus
aatgaggctcctccggatacagcga

SEQ ID NO: 80200 - DNA, 25 bp, Mus musculus
aatgaggctcctgcggatacagcga

SEQ ID NO: 80201 - DNA, 25 bp, Mus musculus
aatgaggctgctcttggatgtctgt

SEQ ID NO: 80202 - DNA, 25 bp, Mus musculus
aatgaggctgctgttggatgtctgt

SEQ ID NO: 80203 - DNA, 25 bp, Mus musculus
aatgaggctggcaagatcacgtgct

SEQ ID NO: 80204 - DNA, 25 bp, Mus musculus
aatgaggctggctagatcacgtgct

SEQ ID NO: 80205 - DNA, 25 bp, Mus musculus
aatgagggaatgaccaatggtgttc

SEQ ID NO: 80206 - DNA, 25 bp, Mus musculus
aatgagggaatgtccaatggtgttc

SEQ ID NO: 80207 - DNA, 25 bp, Mus musculus
aatgagggataacccgcccagaaga

SEQ ID NO: 80208 - DNA, 25 bp, Mus musculus
aatgagggataagccgcccagaaga

SEQ ID NO: 80209 - DNA, 25 bp, Mus musculus
aatgagggcaccacgggatgtgacc

SEQ ID NO: 80210 - DNA, 25 bp, Mus musculus
aatgagggcacctcgggatgtgacc

SEQ ID NO: 80211 - DNA, 25 bp, Mus musculus
aatgagggcactagtgctccacaac

SEQ ID NO: 80212 - DNA, 25 bp, Mus musculus
aatgagggcacttgtgctccacaac

SEQ ID NO: 80213 - DNA, 25 bp, Mus musculus
aatgagggcaggcacccagttccat

SEQ ID NO: 80214 - DNA, 25 bp, Mus musculus
aatgagggcagggacccagttccat

SEQ ID NO: 80215 - DNA, 25 bp, Mus musculus
aatgagggccgcatgaagatctggt

SEQ ID NO: 80216 - DNA, 25 bp, Mus musculus
aatgagggccgcttgaagatctggt

SEQ ID NO: 80217 - DNA, 25 bp, Mus musculus
aatgagggcctaccatgtgtcagac

SEQ ID NO: 80218 - DNA, 25 bp, Mus musculus
aatgagggcctagcatgtgtcagac

SEQ ID NO: 80219 - DNA, 25 bp, Mus musculus
aatgagggctttcgcaagtccttca

SEQ ID NO: 80220 - DNA, 25 bp, Mus musculus
aatgagggctttggcaagtccttca

SEQ ID NO: 80221 - DNA, 25 bp, Mus musculus
aatgagggtcctcactcagacggcc

SEQ ID NO: 80222 - DNA, 25 bp, Mus musculus
aatgagggtcctgactcagacggcc

SEQ ID NO: 80223 - DNA, 25 bp, Mus musculus
aatgagggtctgaaggagccatgcc

SEQ ID NO: 80224 - DNA, 25 bp, Mus musculus
aatgagggtctgtaggagccatgcc

SEQ ID NO: 80225 - DNA, 25 bp, Mus musculus
aatgagggtgacaccagatgggctt

SEQ ID NO: 80226 - DNA, 25 bp, Mus musculus
aatgagggtgactccagatgggctt

SEQ ID NO: 80227 - DNA, 25 bp, Mus musculus
aatgagggtgtcagctccgtgcttc

SEQ ID NO: 80228 - DNA, 25 bp, Mus musculus
aatgagggtgtctgctccgtgcttc

SEQ ID NO: 80229 - DNA, 25 bp, Mus musculus
aatgaggtacacacaccctgatagc

SEQ ID NO: 80230 - DNA, 25 bp, Mus musculus
aatgaggtacactcaccctgatagc

SEQ ID NO: 80231 - DNA, 25 bp, Mus musculus
aatgaggtactcagcgtgctccacg

SEQ ID NO: 80232 - DNA, 25 bp, Mus musculus
aatgaggtactctgcgtgctccacg

SEQ ID NO: 80233 - DNA, 25 bp, Mus musculus
aatgaggtcatgctgggaattccct

SEQ ID NO: 80234 - DNA, 25 bp, Mus musculus
aatgaggtcatggtgggaattccct

SEQ ID NO: 80235 - DNA, 25 bp, Mus musculus
aatgaggtctctcttgggtacgcgt

SEQ ID NO: 80236 - DNA, 25 bp, Mus musculus
aatgaggtctctgttgggtacgcgt

SEQ ID NO: 80237 - DNA, 25 bp, Mus musculus
aatgaggtgcctacctctgatacag

SEQ ID NO: 80238 - DNA, 25 bp, Mus musculus
aatgaggtgccttcctctgatacag

SEQ ID NO: 80239 - DNA, 25 bp, Mus musculus
aatgaggtgggcaggatcccgtcct

SEQ ID NO: 80240 - DNA, 25 bp, Mus musculus
aatgaggtgggctggatcccgtcct

SEQ ID NO: 80241 - DNA, 25 bp, Mus musculus
aatgaggttgatctggctttataaa

SEQ ID NO: 80242 - DNA, 25 bp, Mus musculus
aatgaggttgatgtggctttataaa

SEQ ID NO: 80243 - DNA, 25 bp, Mus musculus
aatgagtatcatccctacactgacc

SEQ ID NO: 80244 - DNA, 25 bp, Mus musculus
aatgagtatcatgcctacactgacc

SEQ ID NO: 80245 - DNA, 25 bp, Mus musculus
aatgagtatctcatcgctcttcaga

SEQ ID NO: 80246 - DNA, 25 bp, Mus musculus
aatgagtatctcttcgctcttcaga

SEQ ID NO: 80247 - DNA, 25 bp, Mus musculus
aatgagtattatcgctcctgctcca

SEQ ID NO: 80248 - DNA, 25 bp, Mus musculus
aatgagtattatggctcctgctcca

SEQ ID NO: 80249 - DNA, 25 bp, Mus musculus
aatgagtcatgcagtacccttcatc

SEQ ID NO: 80250 - DNA, 25 bp, Mus musculus
aatgagtcatgctgtacccttcatc

SEQ ID NO: 80251 - DNA, 25 bp, Mus musculus
aatgagtcattcatacagggtttaa

SEQ ID NO: 80252 - DNA, 25 bp, Mus musculus
aatgagtcattcttacagggtttaa

SEQ ID NO: 80253 - DNA, 25 bp, Mus musculus
aatgagtccctaccagttgaaataa

SEQ ID NO: 80254 - DNA, 25 bp, Mus musculus
aatgagtccctagcagttgaaataa

SEQ ID NO: 80255 - DNA, 25 bp, Mus musculus
aatgagtctcccatcaagtcttttg

SEQ ID NO: 80256 - DNA, 25 bp, Mus musculus
aatgagtctcccttcaagtcttttg

SEQ ID NO: 80257 - DNA, 25 bp, Mus musculus
aatgagtctgtcagtatcccggtgg

SEQ ID NO: 80258 - DNA, 25 bp, Mus musculus
aatgagtctgtctgtatcccggtgg

SEQ ID NO: 80259 - DNA, 25 bp, Mus musculus
aatgagtgacacatcctttcatcct

SEQ ID NO: 80260 - DNA, 25 bp, Mus musculus
aatgagtgacacttcctttcatcct

SEQ ID NO: 80261 - DNA, 25 bp, Mus musculus
aatgagtgacccatagtcctctatc

SEQ ID NO: 80262 - DNA, 25 bp, Mus musculus
aatgagtgacccttagtcctctatc

SEQ ID NO: 80263 - DNA, 25 bp, Mus musculus
aatgagtgagtcagggtgatttccc

SEQ ID NO: 80264 - DNA, 25 bp, Mus musculus
aatgagtgagtctgggtgatttccc

SEQ ID NO: 80265 - DNA, 25 bp, Mus musculus
aatgagtgatcacgcaattcggtca

SEQ ID NO: 80266 - DNA, 25 bp, Mus musculus
aatgagtgatcaggcaattcggtca

SEQ ID NO: 80267 - DNA, 25 bp, Mus musculus
aatgagtgcaaaccctcttgagaac

SEQ ID NO: 80268 - DNA, 25 bp, Mus musculus
aatgagtgcaaagcctcttgagaac

SEQ ID NO: 80269 - DNA, 25 bp, Mus musculus
aatgagtgcttcatattctgttcaa

SEQ ID NO: 80270 - DNA, 25 bp, Mus musculus
aatgagtgcttcttattctgttcaa

SEQ ID NO: 80271 - DNA, 25 bp, Mus musculus
aatgagtgcttgattgcagtgccct

SEQ ID NO: 80272 - DNA, 25 bp, Mus musculus
aatgagtgcttgtttgcagtgccct

SEQ ID NO: 80273 - DNA, 25 bp, Mus musculus
aatgagtggctcctgccagcacgat

SEQ ID NO: 80274 - DNA, 25 bp, Mus musculus
aatgagtggctcgtgccagcacgat

SEQ ID NO: 80275 - DNA, 25 bp, Mus musculus
aatgagtgggccatttctccacaac

SEQ ID NO: 80276 - DNA, 25 bp, Mus musculus
aatgagtgggccttttctccacaac

SEQ ID NO: 80277 - DNA, 25 bp, Mus musculus
aatgagtggtaaagtcaaagtctgg

SEQ ID NO: 80278 - DNA, 25 bp, Mus musculus
aatgagtggtaatgtcaaagtctgg

SEQ ID NO: 80279 - DNA, 25 bp, Mus musculus
aatgagtgtatcagtgtcttctggt

SEQ ID NO: 80280 - DNA, 25 bp, Mus musculus
aatgagtgtatctgtgtcttctggt

SEQ ID NO: 80281 - DNA, 25 bp, Mus musculus
aatgagtgtatgaacctgctgcttg

SEQ ID NO: 80282 - DNA, 25 bp, Mus musculus
aatgagtgtatgtacctgctgcttg

SEQ ID NO: 80283 - DNA, 25 bp, Mus musculus
aatgagtgtgtcaggtacccacgtg

SEQ ID NO: 80284 - DNA, 25 bp, Mus musculus
aatgagtgtgtctggtacccacgtg

SEQ ID NO: 80285 - DNA, 25 bp, Mus musculus
aatgagtgttacatctgcatagaaa

SEQ ID NO: 80286 - DNA, 25 bp, Mus musculus
aatgagtgttacttctgcatagaaa

SEQ ID NO: 80287 - DNA, 25 bp, Mus musculus
aatgagtgttgcagacagggttttc

SEQ ID NO: 80288 - DNA, 25 bp, Mus musculus
aatgagtgttgctgacagggttttc

SEQ ID NO: 80289 - DNA, 25 bp, Mus musculus
aatgagttacatagccacctgagaa

SEQ ID NO: 80290 - DNA, 25 bp, Mus musculus
aatgagttacattgccacctgagaa

SEQ ID NO: 80291 - DNA, 25 bp, Mus musculus
aatgagttacctacaacctgagggt

SEQ ID NO: 80292 - DNA, 25 bp, Mus musculus
aatgagttaccttcaacctgagggt

SEQ ID NO: 80293 - DNA, 25 bp, Mus musculus
aatgagttactaattccacgagacc

SEQ ID NO: 80294 - DNA, 25 bp, Mus musculus
aatgagttactatttccacgagacc

SEQ ID NO: 80295 - DNA, 25 bp, Mus musculus
aatgagttcacgctagcctttacga

SEQ ID NO: 80296 - DNA, 25 bp, Mus musculus
aatgagttcacggtagcctttacga

SEQ ID NO: 80297 - DNA, 25 bp, Mus musculus
aatgagttcaggaccaagggcacgt

SEQ ID NO: 80298 - DNA, 25 bp, Mus musculus
aatgagttcaggtccaagggcacgt

SEQ ID NO: 80299 - DNA, 25 bp, Mus musculus
aatgagttcggcatgtggcccagag

SEQ ID NO: 80300 - DNA, 25 bp, Mus musculus
aatgagttcggcttgtggcccagag

SEQ ID NO: 80301 - DNA, 25 bp, Mus musculus
aatgagttgttcactattcacccca

SEQ ID NO: 80302 - DNA, 25 bp, Mus musculus
aatgagttgttctctattcacccca

SEQ ID NO: 80303 - DNA, 25 bp, Mus musculus
aatgagtttatgctctctacaaaga

SEQ ID NO: 80304 - DNA, 25 bp, Mus musculus
aatgagtttatggtctctacaaaga

SEQ ID NO: 80305 - DNA, 25 bp, Mus musculus
aatgagtttccgctcttaagcatgg

SEQ ID NO: 80306 - DNA, 25 bp, Mus musculus
aatgagtttccggtcttaagcatgg

SEQ ID NO: 80307 - DNA, 25 bp, Mus musculus
aatgagtttgtgacacttcaattac

SEQ ID NO: 80308 - DNA, 25 bp, Mus musculus
aatgagtttgtgcattgctgggcaa

SEQ ID NO: 80309 - DNA, 25 bp, Mus musculus
aatgagtttgtggattgctgggcaa

SEQ ID NO: 80310 - DNA, 25 bp, Mus musculus
aatgagtttgtgtcacttcaattac

SEQ ID NO: 80311 - DNA, 25 bp, Mus musculus
aatgagtttttcaattgttcctttg

SEQ ID NO: 80312 - DNA, 25 bp, Mus musculus
aatgagtttttctattgttcctttg

SEQ ID NO: 80313 - DNA, 25 bp, Mus musculus
aatgataaagataccatcctggcat

SEQ ID NO: 80314 - DNA, 25 bp, Mus musculus
aatgataaagattccatcctggcat

SEQ ID NO: 80315 - DNA, 25 bp, Mus musculus
aatgataactccaagggcctccaat

SEQ ID NO: 80316 - DNA, 25 bp, Mus musculus
aatgataactcctagggcctccaat

SEQ ID NO: 80317 - DNA, 25 bp, Mus musculus
aatgatacactaatgccacacagcc

SEQ ID NO: 80318 - DNA, 25 bp, Mus musculus
aatgatacactattgccacacagcc

SEQ ID NO: 80319 - DNA, 25 bp, Mus musculus
aatgatacactcatccctggttgag

SEQ ID NO: 80320 - DNA, 25 bp, Mus musculus
aatgatacactcttccctggttgag

SEQ ID NO: 80321 - DNA, 25 bp, Mus musculus
aatgataccactcatatttgggtta

SEQ ID NO: 80322 - DNA, 25 bp, Mus musculus
aatgataccactgatatttgggtta

SEQ ID NO: 80323 - DNA, 25 bp, Mus musculus
aatgataccattctattgcctcggg

SEQ ID NO: 80324 - DNA, 25 bp, Mus musculus
aatgataccattgtattgcctcggg

SEQ ID NO: 80325 - DNA, 25 bp, Mus musculus
aatgatacctcgatcgtgtcttaca

SEQ ID NO: 80326 - DNA, 25 bp, Mus musculus
aatgatacctcgttcgtgtcttaca

SEQ ID NO: 80327 - DNA, 25 bp, Mus musculus
aatgatacgttactcccgtcttcca

SEQ ID NO: 80328 - DNA, 25 bp, Mus musculus
aatgatacgttagtcccgtcttcca

SEQ ID NO: 80329 - DNA, 25 bp, Mus musculus
aatgatactacgctctgctgtcgaa

SEQ ID NO: 80330 - DNA, 25 bp, Mus musculus
aatgatactacggtctgctgtcgaa

SEQ ID NO: 80331 - DNA, 25 bp, Mus musculus
aatgatacttccaagttcagtggga

SEQ ID NO: 80332 - DNA, 25 bp, Mus musculus
aatgatacttcctagttcagtggga

SEQ ID NO: 80333 - DNA, 25 bp, Mus musculus
aatgatagaaaaatcgtgaactgaa

SEQ ID NO: 80334 - DNA, 25 bp, Mus musculus
aatgatagaaaattcgtgaactgaa

SEQ ID NO: 80335 - DNA, 25 bp, Mus musculus
aatgatagaattattgccagtttaa

SEQ ID NO: 80336 - DNA, 25 bp, Mus musculus
aatgatagaatttttgccagtttaa

SEQ ID NO: 80337 - DNA, 25 bp, Mus musculus
aatgatagccaacgatgccctctgg

SEQ ID NO: 80338 - DNA, 25 bp, Mus musculus
aatgatagccaaggatgccctctgg

SEQ ID NO: 80339 - DNA, 25 bp, Mus musculus
aatgatagctctctgttgtgtttcc

SEQ ID NO: 80340 - DNA, 25 bp, Mus musculus
aatgatagctctgtgttgtgtttcc

SEQ ID NO: 80341 - DNA, 25 bp, Mus musculus
aatgataggcttactctgacagggt

SEQ ID NO: 80342 - DNA, 25 bp, Mus musculus
aatgataggctttctctgacagggt

SEQ ID NO: 80343 - DNA, 25 bp, Mus musculus
aatgatagggacaacagacctcctc

SEQ ID NO: 80344 - DNA, 25 bp, Mus musculus
aatgatagggactacagacctcctc

SEQ ID NO: 80345 - DNA, 25 bp, Mus musculus
aatgataggtcaacccagaggccac

SEQ ID NO: 80346 - DNA, 25 bp, Mus musculus
aatgataggtcatcccagaggccac

SEQ ID NO: 80347 - DNA, 25 bp, Mus musculus
aatgatataacaactcaactggaga

SEQ ID NO: 80348 - DNA, 25 bp, Mus musculus
aatgatataacatctcaactggaga

SEQ ID NO: 80349 - DNA, 25 bp, Mus musculus
aatgatatcattaatcactgtcacc

SEQ ID NO: 80350 - DNA, 25 bp, Mus musculus
aatgatatcatttatcactgtcacc

SEQ ID NO: 80351 - DNA, 25 bp, Mus musculus
aatgatatctttcgcatgaccagga

SEQ ID NO: 80352 - DNA, 25 bp, Mus musculus
aatgatatctttggcatgaccagga

SEQ ID NO: 80353 - DNA, 25 bp, Mus musculus
aatgatatgactacccttgaggctg

SEQ ID NO: 80354 - DNA, 25 bp, Mus musculus
aatgatatgacttcccttgaggctg

SEQ ID NO: 80355 - DNA, 25 bp, Mus musculus
aatgatatggctatctgcctttgct

SEQ ID NO: 80356 - DNA, 25 bp, Mus musculus
aatgatatggctttctgcctttgct

SEQ ID NO: 80357 - DNA, 25 bp, Mus musculus
aatgatattgtgagttgttcctaat

SEQ ID NO: 80358 - DNA, 25 bp, Mus musculus
aatgatattgtgtgttgttcctaat

SEQ ID NO: 80359 - DNA, 25 bp, Mus musculus
aatgatatttacctatgcaacctaa

SEQ ID NO: 80360 - DNA, 25 bp, Mus musculus
aatgatatttacgtatgcaacctaa

SEQ ID NO: 80361 - DNA, 25 bp, Mus musculus
aatgatcaaacacagacccagggtt

SEQ ID NO: 80362 - DNA, 25 bp, Mus musculus
aatgatcaaacagagacccagggtt

SEQ ID NO: 80363 - DNA, 25 bp, Mus musculus
aatgatcaaaggaggcagcagtcag

SEQ ID NO: 80364 - DNA, 25 bp, Mus musculus
aatgatcaaaggtggcagcagtcag

SEQ ID NO: 80365 - DNA, 25 bp, Mus musculus
aatgatcaacacacacagtgcggag

SEQ ID NO: 80366 - DNA, 25 bp, Mus musculus
aatgatcaacactcacagtgcggag

SEQ ID NO: 80367 - DNA, 25 bp, Mus musculus
aatgatcaaggtaaaaagcagcagt

SEQ ID NO: 80368 - DNA, 25 bp, Mus musculus
aatgatcaaggttaaaagcagcagt

SEQ ID NO: 80369 - DNA, 25 bp, Mus musculus
aatgatcaatgtatcaatttcctgg

SEQ ID NO: 80370 - DNA, 25 bp, Mus musculus
aatgatcaatgtttcaatttcctgg

SEQ ID NO: 80371 - DNA, 25 bp, Mus musculus
aatgatcaattgcaaccggcttttc

SEQ ID NO: 80372 - DNA, 25 bp, Mus musculus
aatgatcaattggaaccggcttttc

SEQ ID NO: 80373 - DNA, 25 bp, Mus musculus
aatgatcacaagaggcccgtttgta

SEQ ID NO: 80374 - DNA, 25 bp, Mus musculus
aatgatcacaagtggcccgtttgta

SEQ ID NO: 80375 - DNA, 25 bp, Mus musculus
aatgatcactgaagactggcgacca

SEQ ID NO: 80376 - DNA, 25 bp, Mus musculus
aatgatcactgatgactggcgacca

SEQ ID NO: 80377 - DNA, 25 bp, Mus musculus
aatgatcacttgagcttagcgtagc

SEQ ID NO: 80378 - DNA, 25 bp, Mus musculus
aatgatcacttgtgcttagcgtagc

SEQ ID NO: 80379 - DNA, 25 bp, Mus musculus
aatgatcactttattgctgaacatc

SEQ ID NO: 80380 - DNA, 25 bp, Mus musculus
aatgatcacttttttgctgaacatc

SEQ ID NO: 80381 - DNA, 25 bp, Mus musculus
aatgatcagaaaagtgggtcttcac

SEQ ID NO: 80382 - DNA, 25 bp, Mus musculus
aatgatcagaaatgtgggtcttcac

SEQ ID NO: 80383 - DNA, 25 bp, Mus musculus
aatgatcagcagctctctgcacggg

SEQ ID NO: 80384 - DNA, 25 bp, Mus musculus
aatgatcagcaggtctctgcacggg

SEQ ID NO: 80385 - DNA, 25 bp, Mus musculus
aatgatcagcccagaaaaacatcca

SEQ ID NO: 80386 - DNA, 25 bp, Mus musculus
aatgatcagccctgaaaaacatcca

SEQ ID NO: 80387 - DNA, 25 bp, Mus musculus
aatgatcatctacttaacactcaat

SEQ ID NO: 80388 - DNA, 25 bp, Mus musculus
aatgatcatctagttaacactcaat

SEQ ID NO: 80389 - DNA, 25 bp, Mus musculus
aatgatcattaacaccctgtatcag

SEQ ID NO: 80390 - DNA, 25 bp, Mus musculus
aatgatcattaagaccctgtatcag

SEQ ID NO: 80391 - DNA, 25 bp, Mus musculus
aatgatcattagactccctctcaag

SEQ ID NO: 80392 - DNA, 25 bp, Mus musculus
aatgatcattagtctccctctcaag

SEQ ID NO: 80393 - DNA, 25 bp, Mus musculus
aatgatcattcaatgaagcccctga

SEQ ID NO: 80394 - DNA, 25 bp, Mus musculus
aatgatcattcattgaagcccctga

SEQ ID NO: 80395 - DNA, 25 bp, Mus musculus
aatgatcatttaattctgtcctctg

SEQ ID NO: 80396 - DNA, 25 bp, Mus musculus
aatgatcatttatttctgtcctctg

SEQ ID NO: 80397 - DNA, 25 bp, Mus musculus
aatgatccaacactctttcctgtga

SEQ ID NO: 80398 - DNA, 25 bp, Mus musculus
aatgatccaacagtctttcctgtga

SEQ ID NO: 80399 - DNA, 25 bp, Mus musculus
aatgatccacttctgccgactgccg

SEQ ID NO: 80400 - DNA, 25 bp, Mus musculus
aatgatccacttgtgccgactgccg

SEQ ID NO: 80401 - DNA, 25 bp, Mus musculus
aatgatccagtacatggccccacgg

SEQ ID NO: 80402 - DNA, 25 bp, Mus musculus
aatgatccagtagatggccccacgg

SEQ ID NO: 80403 - DNA, 25 bp, Mus musculus
aatgatccagtcagtcctagatgcc

SEQ ID NO: 80404 - DNA, 25 bp, Mus musculus
aatgatccagtctgtcctagatgcc

SEQ ID NO: 80405 - DNA, 25 bp, Mus musculus
aatgatccagtgacgtcagacgctt

SEQ ID NO: 80406 - DNA, 25 bp, Mus musculus
aatgatccagtgtcgtcagacgctt

SEQ ID NO: 80407 - DNA, 25 bp, Mus musculus
aatgatccattcatcagcccagatt

SEQ ID NO: 80408 - DNA, 25 bp, Mus musculus
aatgatccattcttcagcccagatt

SEQ ID NO: 80409 - DNA, 25 bp, Mus musculus
aatgatccatttcttgtccagcttg

SEQ ID NO: 80410 - DNA, 25 bp, Mus musculus
aatgatccatttgttgtccagcttg

SEQ ID NO: 80411 - DNA, 25 bp, Mus musculus
aatgatccgtacatgctattacagt

SEQ ID NO: 80412 - DNA, 25 bp, Mus musculus
aatgatccgtacttgctattacagt

SEQ ID NO: 80413 - DNA, 25 bp, Mus musculus
aatgatcctaggattctgctcaacg

SEQ ID NO: 80414 - DNA, 25 bp, Mus musculus
aatgatcctaggtttctgctcaacg

SEQ ID NO: 80415 - DNA, 25 bp, Mus musculus
aatgatcctattattgtcctcctgc

SEQ ID NO: 80416 - DNA, 25 bp, Mus musculus
aatgatcctatttttgtcctcctgc

SEQ ID NO: 80417 - DNA, 25 bp, Mus musculus
aatgatcctttcaactatgattggt

SEQ ID NO: 80418 - DNA, 25 bp, Mus musculus
aatgatcctttctactatgattggt

SEQ ID NO: 80419 - DNA, 25 bp, Mus musculus
aatgatcgattcactgcttgctact

SEQ ID NO: 80420 - DNA, 25 bp, Mus musculus
aatgatcgattctctgcttgctact

SEQ ID NO: 80421 - DNA, 25 bp, Mus musculus
aatgatcgcagacacatcaagcggt

SEQ ID NO: 80422 - DNA, 25 bp, Mus musculus
aatgatcgcagagacatcaagcggt

SEQ ID NO: 80423 - DNA, 25 bp, Mus musculus
aatgatctaaagacacctcactcct

SEQ ID NO: 80424 - DNA, 25 bp, Mus musculus
aatgatctaaagtcacctcactcct

SEQ ID NO: 80425 - DNA, 25 bp, Mus musculus
aatgatctacacagactgttgctgt

SEQ ID NO: 80426 - DNA, 25 bp, Mus musculus
aatgatctacactgactgttgctgt

SEQ ID NO: 80427 - DNA, 25 bp, Mus musculus
aatgatctacctagttacaccctgt

SEQ ID NO: 80428 - DNA, 25 bp, Mus musculus
aatgatctaccttgttacaccctgt

SEQ ID NO: 80429 - DNA, 25 bp, Mus musculus
aatgatctataacatgggccaaaac

SEQ ID NO: 80430 - DNA, 25 bp, Mus musculus
aatgatctataagatgggccaaaac

SEQ ID NO: 80431 - DNA, 25 bp, Mus musculus
aatgatctatgtactctccttaaag

SEQ ID NO: 80432 - DNA, 25 bp, Mus musculus
aatgatctatgttctctccttaaag

SEQ ID NO: 80433 - DNA, 25 bp, Mus musculus
aatgatctccctactaagattcagc

SEQ ID NO: 80434 - DNA, 25 bp, Mus musculus
aatgatctcccttctaagattcagc

SEQ ID NO: 80435 - DNA, 25 bp, Mus musculus
aatgatctcggtacctagcacacag

SEQ ID NO: 80436 - DNA, 25 bp, Mus musculus
aatgatctcggttcctagcacacag

SEQ ID NO: 80437 - DNA, 25 bp, Mus musculus
aatgatctgaggacggctctcccat

SEQ ID NO: 80438 - DNA, 25 bp, Mus musculus
aatgatctgaggtcggctctcccat

SEQ ID NO: 80439 - DNA, 25 bp, Mus musculus
aatgatctggatacagatgacccag

SEQ ID NO: 80440 - DNA, 25 bp, Mus musculus
aatgatctggattcagatgacccag

SEQ ID NO: 80441 - DNA, 25 bp, Mus musculus
aatgatcttgttactcactgtggtt

SEQ ID NO: 80442 - DNA, 25 bp, Mus musculus
aatgatcttgtttctcactgtggtt

SEQ ID NO: 80443 - DNA, 25 bp, Mus musculus
aatgatctttgcacgtagtttgaca

SEQ ID NO: 80444 - DNA, 25 bp, Mus musculus
aatgatctttgctcgtagtttgaca

SEQ ID NO: 80445 - DNA, 25 bp, Mus musculus
aatgatcttttaatggtccagacag

SEQ ID NO: 80446 - DNA, 25 bp, Mus musculus
aatgatcttttattggtccagacag

SEQ ID NO: 80447 - DNA, 25 bp, Mus musculus
aatgatgaacatcgcccggctcaac

SEQ ID NO: 80448 - DNA, 25 bp, Mus musculus
aatgatgaacatggcccggctcaac

SEQ ID NO: 80449 - DNA, 25 bp, Mus musculus
aatgatgacctgacatgtggcctca

SEQ ID NO: 80450 - DNA, 25 bp, Mus musculus
aatgatgacctgtcatgtggcctca

SEQ ID NO: 80451 - DNA, 25 bp, Mus musculus
aatgatgacgccagtctgcatttct

SEQ ID NO: 80452 - DNA, 25 bp, Mus musculus
aatgatgacgcctgtctgcatttct

SEQ ID NO: 80453 - DNA, 25 bp, Mus musculus
aatgatgactgtctgaatccatgaa

SEQ ID NO: 80454 - DNA, 25 bp, Mus musculus
aatgatgactgtgtgaatccatgaa

SEQ ID NO: 80455 - DNA, 25 bp, Mus musculus
aatgatgagccgagccccactgagt

SEQ ID NO: 80456 - DNA, 25 bp, Mus musculus
aatgatgagccgtgccccactgagt

SEQ ID NO: 80457 - DNA, 25 bp, Mus musculus
aatgatgagcttcgctggtgaagca

SEQ ID NO: 80458 - DNA, 25 bp, Mus musculus
aatgatgagcttggctggtgaagca

SEQ ID NO: 80459 - DNA, 25 bp, Mus musculus
aatgatgatatgatgccaaccctaa

SEQ ID NO: 80460 - DNA, 25 bp, Mus musculus
aatgatgatatgttgccaaccctaa

SEQ ID NO: 80461 - DNA, 25 bp, Mus musculus
aatgatgatattattggtactgtta

SEQ ID NO: 80462 - DNA, 25 bp, Mus musculus
aatgatgatatttttggtactgtta

SEQ ID NO: 80463 - DNA, 25 bp, Mus musculus
aatgatgatgaaccgctgtgctact

SEQ ID NO: 80464 - DNA, 25 bp, Mus musculus
aatgatgatgaagcgctgtgctact

SEQ ID NO: 80465 - DNA, 25 bp, Mus musculus
aatgatgatggccatctgccctccg

SEQ ID NO: 80466 - DNA, 25 bp, Mus musculus
aatgatgatggcgatctgccctccg

SEQ ID NO: 80467 - DNA, 25 bp, Mus musculus
aatgatgattgtctttcctgagcct

SEQ ID NO: 80468 - DNA, 25 bp, Mus musculus
aatgatgattgtgtttcctgagcct

SEQ ID NO: 80469 - DNA, 25 bp, Mus musculus
aatgatgcacaacctactgactggc

SEQ ID NO: 80470 - DNA, 25 bp, Mus musculus
aatgatgcacaagctactgactggc

SEQ ID NO: 80471 - DNA, 25 bp, Mus musculus
aatgatgcaggcatccatctcaaca

SEQ ID NO: 80472 - DNA, 25 bp, Mus musculus
aatgatgcaggcttccatctcaaca

SEQ ID NO: 80473 - DNA, 25 bp, Mus musculus
aatgatgcatctacattccttccat

SEQ ID NO: 80474 - DNA, 25 bp, Mus musculus
aatgatgcatcttcattccttccat

SEQ ID NO: 80475 - DNA, 25 bp, Mus musculus
aatgatgcatttaacctattccggt

SEQ ID NO: 80476 - DNA, 25 bp, Mus musculus
aatgatgcattttacctattccggt

SEQ ID NO: 80477 - DNA, 25 bp, Mus musculus
aatgatgcgcatagttttgacaata

SEQ ID NO: 80478 - DNA, 25 bp, Mus musculus
aatgatgcgcattgttttgacaata

SEQ ID NO: 80479 - DNA, 25 bp, Mus musculus
aatgatgcggaacactgctgcctgt

SEQ ID NO: 80480 - DNA, 25 bp, Mus musculus
aatgatgcggaagactgctgcctgt

SEQ ID NO: 80481 - DNA, 25 bp, Mus musculus
aatgatgcggcactttcagcagggt

SEQ ID NO: 80482 - DNA, 25 bp, Mus musculus
aatgatgcggcagtttcagcagggt

SEQ ID NO: 80483 - DNA, 25 bp, Mus musculus
aatgatgcgtataaacagggctaga

SEQ ID NO: 80484 - DNA, 25 bp, Mus musculus
aatgatgcgtattaacagggctaga

SEQ ID NO: 80485 - DNA, 25 bp, Mus musculus
aatgatgctaccatccctttaatcc

SEQ ID NO: 80486 - DNA, 25 bp, Mus musculus
aatgatgctaccttccctttaatcc

SEQ ID NO: 80487 - DNA, 25 bp, Mus musculus
aatgatgctatcaacaggctgaggc

SEQ ID NO: 80488 - DNA, 25 bp, Mus musculus
aatgatgctatctacaggctgaggc

SEQ ID NO: 80489 - DNA, 25 bp, Mus musculus
aatgatgctctacaggaacttcaca

SEQ ID NO: 80490 - DNA, 25 bp, Mus musculus
aatgatgctctagaggaacttcaca

SEQ ID NO: 80491 - DNA, 25 bp, Mus musculus
aatgatgcttggattacctgcctgg

SEQ ID NO: 80492 - DNA, 25 bp, Mus musculus
aatgatgcttggtttacctgcctgg

SEQ ID NO: 80493 - DNA, 25 bp, Mus musculus
aatgatgcttttacgttacaaactt

SEQ ID NO: 80494 - DNA, 25 bp, Mus musculus
aatgatgctttttcgttacaaactt

SEQ ID NO: 80495 - DNA, 25 bp, Mus musculus
aatgatggacccacgagttcttcat

SEQ ID NO: 80496 - DNA, 25 bp, Mus musculus
aatgatggaccctcgagttcttcat

SEQ ID NO: 80497 - DNA, 25 bp, Mus musculus
aatgatggagacctacttttttctt

SEQ ID NO: 80498 - DNA, 25 bp, Mus musculus
aatgatggagacgtacttttttctt

SEQ ID NO: 80499 - DNA, 25 bp, Mus musculus
aatgatggagtcacacagtgtcgat

SEQ ID NO: 80500 - DNA, 25 bp, Mus musculus
aatgatggagtctcacagtgtcgat

SEQ ID NO: 80501 - DNA, 25 bp, Mus musculus
aatgatggcagtactgtttctcccc

SEQ ID NO: 80502 - DNA, 25 bp, Mus musculus
aatgatggcagtaggctggtctcaa

SEQ ID NO: 80503 - DNA, 25 bp, Mus musculus
aatgatggcagttctgtttctcccc

SEQ ID NO: 80504 - DNA, 25 bp, Mus musculus
aatgatggcagttggctggtctcaa

SEQ ID NO: 80505 - DNA, 25 bp, Mus musculus
aatgatggcatcaacaggtctttga

SEQ ID NO: 80506 - DNA, 25 bp, Mus musculus
aatgatggcatctacaggtctttga

SEQ ID NO: 80507 - DNA, 25 bp, Mus musculus
aatgatggcatgaccagtctgcata

SEQ ID NO: 80508 - DNA, 25 bp, Mus musculus
aatgatggcatgtccagtctgcata

SEQ ID NO: 80509 - DNA, 25 bp, Mus musculus
aatgatggccatagcacctaacgtt

SEQ ID NO: 80510 - DNA, 25 bp, Mus musculus
aatgatggccattgcacctaacgtt

SEQ ID NO: 80511 - DNA, 25 bp, Mus musculus
aatgatgggaataggcctcataaaa

SEQ ID NO: 80512 - DNA, 25 bp, Mus musculus
aatgatgggaattggcctcataaaa

SEQ ID NO: 80513 - DNA, 25 bp, Mus musculus
aatgatgggctgatctgtgaggtca

SEQ ID NO: 80514 - DNA, 25 bp, Mus musculus
aatgatgggctgttctgtgaggtca

SEQ ID NO: 80515 - DNA, 25 bp, Mus musculus
aatgatgggtaacgtgcattatcac

SEQ ID NO: 80516 - DNA, 25 bp, Mus musculus
aatgatgggtaaggtgcattatcac

SEQ ID NO: 80517 - DNA, 25 bp, Mus musculus
aatgatggtatcacttagtaagttc

SEQ ID NO: 80518 - DNA, 25 bp, Mus musculus
aatgatggtatctcttagtaagttc

SEQ ID NO: 80519 - DNA, 25 bp, Mus musculus
aatgatggtgacagctggacagcac

SEQ ID NO: 80520 - DNA, 25 bp, Mus musculus
aatgatggtgacctcgtggttctgt

SEQ ID NO: 80521 - DNA, 25 bp, Mus musculus
aatgatggtgacgtcgtggttctgt

SEQ ID NO: 80522 - DNA, 25 bp, Mus musculus
aatgatggtgactgctggacagcac

SEQ ID NO: 80523 - DNA, 25 bp, Mus musculus
aatgatggttacaacgtgcccctta

SEQ ID NO: 80524 - DNA, 25 bp, Mus musculus
aatgatggttactacgtgcccctta

SEQ ID NO: 80525 - DNA, 25 bp, Mus musculus
aatgatggttttacaggccaaggcc

SEQ ID NO: 80526 - DNA, 25 bp, Mus musculus
aatgatggtttttcaggccaaggcc

SEQ ID NO: 80527 - DNA, 25 bp, Mus musculus
aatgatgtaactcaaggagcctaac

SEQ ID NO: 80528 - DNA, 25 bp, Mus musculus
aatgatgtaactgaaggagcctaac

SEQ ID NO: 80529 - DNA, 25 bp, Mus musculus
aatgatgtattcactcgctgaagct

SEQ ID NO: 80530 - DNA, 25 bp, Mus musculus
aatgatgtattctctcgctgaagct

SEQ ID NO: 80531 - DNA, 25 bp, Mus musculus
aatgatgtcaagagcccaggaaagt

SEQ ID NO: 80532 - DNA, 25 bp, Mus musculus
aatgatgtcaagtgcccaggaaagt

SEQ ID NO: 80533 - DNA, 25 bp, Mus musculus
aatgatgtcagtatgacctgttaca

SEQ ID NO: 80534 - DNA, 25 bp, Mus musculus
aatgatgtcagtttgacctgttaca

SEQ ID NO: 80535 - DNA, 25 bp, Mus musculus
aatgatgtcattagggcagcaacaa

SEQ ID NO: 80536 - DNA, 25 bp, Mus musculus
aatgatgtcatttgggcagcaacaa

SEQ ID NO: 80537 - DNA, 25 bp, Mus musculus
aatgatgtccccaaatggttccgtg

SEQ ID NO: 80538 - DNA, 25 bp, Mus musculus
aatgatgtcccctaatggttccgtg

SEQ ID NO: 80539 - DNA, 25 bp, Mus musculus
aatgatgtctaacaagatcccgagg

SEQ ID NO: 80540 - DNA, 25 bp, Mus musculus
aatgatgtctaagaagatcccgagg

SEQ ID NO: 80541 - DNA, 25 bp, Mus musculus
aatgatgtctacagggctaaggcac

SEQ ID NO: 80542 - DNA, 25 bp, Mus musculus
aatgatgtctactgggctaaggcac

SEQ ID NO: 80543 - DNA, 25 bp, Mus musculus
aatgatgtctggatcagtcagtcat

SEQ ID NO: 80544 - DNA, 25 bp, Mus musculus
aatgatgtctggttcagtcagtcat

SEQ ID NO: 80545 - DNA, 25 bp, Mus musculus
aatgatgtgcatctccaaactgcca

SEQ ID NO: 80546 - DNA, 25 bp, Mus musculus
aatgatgtgcatgtccaaactgcca

SEQ ID NO: 80547 - DNA, 25 bp, Mus musculus
aatgatgtggagctcagctgtccca

SEQ ID NO: 80548 - DNA, 25 bp, Mus musculus
aatgatgtggaggtcagctgtccca

SEQ ID NO: 80549 - DNA, 25 bp, Mus musculus
aatgatgtgtctagctgtgctggtc

SEQ ID NO: 80550 - DNA, 25 bp, Mus musculus
aatgatgtgtcttgctgtgctggtc

SEQ ID NO: 80551 - DNA, 25 bp, Mus musculus
aatgatgtgtgaacctcaggctggg

SEQ ID NO: 80552 - DNA, 25 bp, Mus musculus
aatgatgtgtgatcctcaggctggg

SEQ ID NO: 80553 - DNA, 25 bp, Mus musculus
aatgatgtgttcctgcctgtccatg

SEQ ID NO: 80554 - DNA, 25 bp, Mus musculus
aatgatgtgttcgtgcctgtccatg

SEQ ID NO: 80555 - DNA, 25 bp, Mus musculus
aatgatgttatcagttctgttgtga

SEQ ID NO: 80556 - DNA, 25 bp, Mus musculus
aatgatgttatctgttctgttgtga

SEQ ID NO: 80557 - DNA, 25 bp, Mus musculus
aatgatgttattacttgctctggtc

SEQ ID NO: 80558 - DNA, 25 bp, Mus musculus
aatgatgttatttcttgctctggtc

SEQ ID NO: 80559 - DNA, 25 bp, Mus musculus
aatgatgttcgacctatccgtagca

SEQ ID NO: 80560 - DNA, 25 bp, Mus musculus
aatgatgttcgagctatccgtagca

SEQ ID NO: 80561 - DNA, 25 bp, Mus musculus
aatgatgtttctagtcacatgctgc

SEQ ID NO: 80562 - DNA, 25 bp, Mus musculus
aatgatgtttcttgtcacatgctgc

SEQ ID NO: 80563 - DNA, 25 bp, Mus musculus
aatgatgtttgaactatctcagaca

SEQ ID NO: 80564 - DNA, 25 bp, Mus musculus
aatgatgtttgatctatctcagaca

SEQ ID NO: 80565 - DNA, 25 bp, Mus musculus
aatgattaaataatgtctcctcaag

SEQ ID NO: 80566 - DNA, 25 bp, Mus musculus
aatgattaaatattgtctcctcaag

SEQ ID NO: 80567 - DNA, 25 bp, Mus musculus
aatgattacactcaggccatgcaaa

SEQ ID NO: 80568 - DNA, 25 bp, Mus musculus
aatgattacactgaggccatgcaaa

SEQ ID NO: 80569 - DNA, 25 bp, Mus musculus
aatgattaccaaccattgcctacct

SEQ ID NO: 80570 - DNA, 25 bp, Mus musculus
aatgattaccaagcattgcctacct

SEQ ID NO: 80571 - DNA, 25 bp, Mus musculus
aatgattacccaacacggaggctct

SEQ ID NO: 80572 - DNA, 25 bp, Mus musculus
aatgattacccatcacggaggctct

SEQ ID NO: 80573 - DNA, 25 bp, Mus musculus
aatgattaccgccaggctgaagacc

SEQ ID NO: 80574 - DNA, 25 bp, Mus musculus
aatgattaccgcgaggctgaagacc

SEQ ID NO: 80575 - DNA, 25 bp, Mus musculus
aatgattacgctaagctgggcctaa

SEQ ID NO: 80576 - DNA, 25 bp, Mus musculus
aatgattacgcttagctgggcctaa

SEQ ID NO: 80577 - DNA, 25 bp, Mus musculus
aatgattacttgatttatctagtga

SEQ ID NO: 80578 - DNA, 25 bp, Mus musculus
aatgattacttgttttatctagtga

SEQ ID NO: 80579 - DNA, 25 bp, Mus musculus
aatgattaggcacttctttagcatc

SEQ ID NO: 80580 - DNA, 25 bp, Mus musculus
aatgattaggcagttctttagcatc

SEQ ID NO: 80581 - DNA, 25 bp, Mus musculus
aatgattcaacaatttcccctactc

SEQ ID NO: 80582 - DNA, 25 bp, Mus musculus
aatgattcaacattttcccctactc

SEQ ID NO: 80583 - DNA, 25 bp, Mus musculus
aatgattcaagccttgcacccggta

SEQ ID NO: 80584 - DNA, 25 bp, Mus musculus
aatgattcaagcgttgcacccggta

SEQ ID NO: 80585 - DNA, 25 bp, Mus musculus
aatgattcactgctgaggctccctt

SEQ ID NO: 80586 - DNA, 25 bp, Mus musculus
aatgattcactggtgaggctccctt

SEQ ID NO: 80587 - DNA, 25 bp, Mus musculus
aatgattcagtaatctgtggtatct

SEQ ID NO: 80588 - DNA, 25 bp, Mus musculus
aatgattcagtattctgtggtatct

SEQ ID NO: 80589 - DNA, 25 bp, Mus musculus
aatgattcatacctgtcacctagca

SEQ ID NO: 80590 - DNA, 25 bp, Mus musculus
aatgattcatacgtgtcacctagca

SEQ ID NO: 80591 - DNA, 25 bp, Mus musculus
aatgattcccaaacctacccagaga

SEQ ID NO: 80592 - DNA, 25 bp, Mus musculus
aatgattcccaatcctacccagaga

SEQ ID NO: 80593 - DNA, 25 bp, Mus musculus
aatgattcccagatcaagtgtctac

SEQ ID NO: 80594 - DNA, 25 bp, Mus musculus
aatgattcccagttcaagtgtctac

SEQ ID NO: 80595 - DNA, 25 bp, Mus musculus
aatgattccctaccagatcggagac

SEQ ID NO: 80596 - DNA, 25 bp, Mus musculus
aatgattccctactttgtgttggtc

SEQ ID NO: 80597 - DNA, 25 bp, Mus musculus
aatgattccctagcagatcggagac

SEQ ID NO: 80598 - DNA, 25 bp, Mus musculus
aatgattccctagtttgtgttggtc

SEQ ID NO: 80599 - DNA, 25 bp, Mus musculus
aatgattcgacaaggtgctacacat

SEQ ID NO: 80600 - DNA, 25 bp, Mus musculus
aatgattcgacatggtgctacacat

SEQ ID NO: 80601 - DNA, 25 bp, Mus musculus
aatgattcgccaatgattctgtgat

SEQ ID NO: 80602 - DNA, 25 bp, Mus musculus
aatgattcgccattgattctgtgat

SEQ ID NO: 80603 - DNA, 25 bp, Mus musculus
aatgattcgcttcgtggtcacctta

SEQ ID NO: 80604 - DNA, 25 bp, Mus musculus
aatgattcgcttggtggtcacctta

SEQ ID NO: 80605 - DNA, 25 bp, Mus musculus
aatgattctcagattttgcctggag

SEQ ID NO: 80606 - DNA, 25 bp, Mus musculus
aatgattctcagtttttgcctggag

SEQ ID NO: 80607 - DNA, 25 bp, Mus musculus
aatgattctccacactctgactcct

SEQ ID NO: 80608 - DNA, 25 bp, Mus musculus
aatgattctccagactctgactcct

SEQ ID NO: 80609 - DNA, 25 bp, Mus musculus
aatgattctcccaagcctgtcactt

SEQ ID NO: 80610 - DNA, 25 bp, Mus musculus
aatgattctccctagcctgtcactt

SEQ ID NO: 80611 - DNA, 25 bp, Mus musculus
aatgattctgagatgtgactgcata

SEQ ID NO: 80612 - DNA, 25 bp, Mus musculus
aatgattctgagttgtgactgcata

SEQ ID NO: 80613 - DNA, 25 bp, Mus musculus
aatgattctgttccctttttctaaa

SEQ ID NO: 80614 - DNA, 25 bp, Mus musculus
aatgattctgttgcctttttctaaa

SEQ ID NO: 80615 - DNA, 25 bp, Mus musculus
aatgattcttttacaactcagttta

SEQ ID NO: 80616 - DNA, 25 bp, Mus musculus
aatgattctttttcaactcagttta

SEQ ID NO: 80617 - DNA, 25 bp, Mus musculus
aatgattgcaagattcagttgcgaa

SEQ ID NO: 80618 - DNA, 25 bp, Mus musculus
aatgattgcaagtttcagttgcgaa

SEQ ID NO: 80619 - DNA, 25 bp, Mus musculus
aatgattgcactagaccttcagcca

SEQ ID NO: 80620 - DNA, 25 bp, Mus musculus
aatgattgcacttgaccttcagcca

SEQ ID NO: 80621 - DNA, 25 bp, Mus musculus
aatgattgccatcccgatttacatc

SEQ ID NO: 80622 - DNA, 25 bp, Mus musculus
aatgattgccatgccgatttacatc

SEQ ID NO: 80623 - DNA, 25 bp, Mus musculus
aatgattgctgcagacaggaacacc

SEQ ID NO: 80624 - DNA, 25 bp, Mus musculus
aatgattgctgctgacaggaacacc

SEQ ID NO: 80625 - DNA, 25 bp, Mus musculus
aatgattgctgtaggattctggaag

SEQ ID NO: 80626 - DNA, 25 bp, Mus musculus
aatgattgctgttggattctggaag

SEQ ID NO: 80627 - DNA, 25 bp, Mus musculus
aatgattgtgttagtcctctggttc

SEQ ID NO: 80628 - DNA, 25 bp, Mus musculus
aatgattgtgtttgtcctctggttc

SEQ ID NO: 80629 - DNA, 25 bp, Mus musculus
aatgatttaagcacagtatttactg

SEQ ID NO: 80630 - DNA, 25 bp, Mus musculus
aatgatttaagctcagtatttactg

SEQ ID NO: 80631 - DNA, 25 bp, Mus musculus
aatgatttacacagaagccttcgag

SEQ ID NO: 80632 - DNA, 25 bp, Mus musculus
aatgatttacactgaagccttcgag

SEQ ID NO: 80633 - DNA, 25 bp, Mus musculus
aatgatttagtcagtgctgctcttt

SEQ ID NO: 80634 - DNA, 25 bp, Mus musculus
aatgatttagtctgtgctgctcttt

SEQ ID NO: 80635 - DNA, 25 bp, Mus musculus
aatgatttatctccctggtccctaa

SEQ ID NO: 80636 - DNA, 25 bp, Mus musculus
aatgatttatctgcctggtccctaa

SEQ ID NO: 80637 - DNA, 25 bp, Mus musculus
aatgatttctagatcctctgctctc

SEQ ID NO: 80638 - DNA, 25 bp, Mus musculus
aatgatttctagttcctctgctctc

SEQ ID NO: 80639 - DNA, 25 bp, Mus musculus
aatgatttcttcagccctccatttt

SEQ ID NO: 80640 - DNA, 25 bp, Mus musculus
aatgatttcttctgccctccatttt

SEQ ID NO: 80641 - DNA, 25 bp, Mus musculus
aatgatttgaggctgatgtgaatac

SEQ ID NO: 80642 - DNA, 25 bp, Mus musculus
aatgatttgagggtgatgtgaatac

SEQ ID NO: 80643 - DNA, 25 bp, Mus musculus
aatgatttggacacctttggcttcc

SEQ ID NO: 80644 - DNA, 25 bp, Mus musculus
aatgatttggactcctttggcttcc

SEQ ID NO: 80645 - DNA, 25 bp, Mus musculus
aatgatttggttattgcaggcccct

SEQ ID NO: 80646 - DNA, 25 bp, Mus musculus
aatgatttggtttttgcaggcccct

SEQ ID NO: 80647 - DNA, 25 bp, Mus musculus
aatgattttaccagcatgtgcgtgt

SEQ ID NO: 80648 - DNA, 25 bp, Mus musculus
aatgattttacctgcatgtgcgtgt

SEQ ID NO: 80649 - DNA, 25 bp, Mus musculus
aatgattttcaccaacactcttact

SEQ ID NO: 80650 - DNA, 25 bp, Mus musculus
aatgattttcacgaacactcttact

SEQ ID NO: 80651 - DNA, 25 bp, Mus musculus
aatgattttcttagacatcactggg

SEQ ID NO: 80652 - DNA, 25 bp, Mus musculus
aatgattttctttgacatcactggg

SEQ ID NO: 80653 - DNA, 25 bp, Mus musculus
aatgattttgcacaaccacagccaa

SEQ ID NO: 80654 - DNA, 25 bp, Mus musculus
aatgattttgcacttctgaattcag

SEQ ID NO: 80655 - DNA, 25 bp, Mus musculus
aatgattttgcagaaccacagccaa

SEQ ID NO: 80656 - DNA, 25 bp, Mus musculus
aatgattttgcagttctgaattcag

SEQ ID NO: 80657 - DNA, 25 bp, Mus musculus
aatgattttgctagctacccttgta

SEQ ID NO: 80658 - DNA, 25 bp, Mus musculus
aatgattttgcttgctacccttgta

SEQ ID NO: 80659 - DNA, 25 bp, Mus musculus
aatgatttttagaactgctttctta

SEQ ID NO: 80660 - DNA, 25 bp, Mus musculus
aatgatttttagtactgctttctta

SEQ ID NO: 80661 - DNA, 25 bp, Mus musculus
aatgatttttccctgtcaattgaca

SEQ ID NO: 80662 - DNA, 25 bp, Mus musculus
aatgatttttccgtgtcaattgaca

SEQ ID NO: 80663 - DNA, 25 bp, Mus musculus
aatgcaaaaggacatgggtagccaa

SEQ ID NO: 80664 - DNA, 25 bp, Mus musculus
aatgcaaaaggagatgggtagccaa

SEQ ID NO: 80665 - DNA, 25 bp, Mus musculus
aatgcaaacattccttgctgagttt

SEQ ID NO: 80666 - DNA, 25 bp, Mus musculus
aatgcaaacattgcttgctgagttt

SEQ ID NO: 80667 - DNA, 25 bp, Mus musculus
aatgcaaaccaaatatccctgaagg

SEQ ID NO: 80668 - DNA, 25 bp, Mus musculus
aatgcaaaccaattatccctgaagg

SEQ ID NO: 80669 - DNA, 25 bp, Mus musculus
aatgcaaactctaatcttccctgaa

SEQ ID NO: 80670 - DNA, 25 bp, Mus musculus
aatgcaaactcttatcttccctgaa

SEQ ID NO: 80671 - DNA, 25 bp, Mus musculus
aatgcaaacttgctgttctgagact

SEQ ID NO: 80672 - DNA, 25 bp, Mus musculus
aatgcaaacttggtgttctgagact

SEQ ID NO: 80673 - DNA, 25 bp, Mus musculus
aatgcaaagaaaccgcgctggctgg

SEQ ID NO: 80674 - DNA, 25 bp, Mus musculus
aatgcaaagaaagcgcgctggctgg

SEQ ID NO: 80675 - DNA, 25 bp, Mus musculus
aatgcaaagcagaggcggtgtcaga

SEQ ID NO: 80676 - DNA, 25 bp, Mus musculus
aatgcaaagcagtggcggtgtcaga

SEQ ID NO: 80677 - DNA, 25 bp, Mus musculus
aatgcaaaggaacacgctgcttggg

SEQ ID NO: 80678 - DNA, 25 bp, Mus musculus
aatgcaaaggaagacgctgcttggg

SEQ ID NO: 80679 - DNA, 25 bp, Mus musculus
aatgcaaaggctcacgccatcctaa

SEQ ID NO: 80680 - DNA, 25 bp, Mus musculus
aatgcaaaggctgacgccatcctaa

SEQ ID NO: 80681 - DNA, 25 bp, Mus musculus
aatgcaaagtccctcgtggcctctt

SEQ ID NO: 80682 - DNA, 25 bp, Mus musculus
aatgcaaagtccgtcgtggcctctt

SEQ ID NO: 80683 - DNA, 25 bp, Mus musculus
aatgcaaagtgacaactttccctac

SEQ ID NO: 80684 - DNA, 25 bp, Mus musculus
aatgcaaagtgagaactttccctac

SEQ ID NO: 80685 - DNA, 25 bp, Mus musculus
aatgcaaatattatcaccctcctgc

SEQ ID NO: 80686 - DNA, 25 bp, Mus musculus
aatgcaaatattttcaccctcctgc

SEQ ID NO: 80687 - DNA, 25 bp, Mus musculus
aatgcaaatcctcaatgtcccgtct

SEQ ID NO: 80688 - DNA, 25 bp, Mus musculus
aatgcaaatcctgaatgtcccgtct

SEQ ID NO: 80689 - DNA, 25 bp, Mus musculus
aatgcaaatcgaaccaaccctgcaa

SEQ ID NO: 80690 - DNA, 25 bp, Mus musculus
aatgcaaatcgatccaaccctgcaa

SEQ ID NO: 80691 - DNA, 25 bp, Mus musculus
aatgcaaatcttatgccccttccct

SEQ ID NO: 80692 - DNA, 25 bp, Mus musculus
aatgcaaatcttttgccccttccct

SEQ ID NO: 80693 - DNA, 25 bp, Mus musculus
aatgcaaatgccagtcctaagatct

SEQ ID NO: 80694 - DNA, 25 bp, Mus musculus
aatgcaaatgcctgtcctaagatct

SEQ ID NO: 80695 - DNA, 25 bp, Mus musculus
aatgcaaatgtacttcctgcaagaa

SEQ ID NO: 80696 - DNA, 25 bp, Mus musculus
aatgcaaatgtagttcctgcaagaa

SEQ ID NO: 80697 - DNA, 25 bp, Mus musculus
aatgcaaattacatacttctggcgg

SEQ ID NO: 80698 - DNA, 25 bp, Mus musculus
aatgcaaattacttacttctggcgg

SEQ ID NO: 80699 - DNA, 25 bp, Mus musculus
aatgcaacacacatctctgctgcag

SEQ ID NO: 80700 - DNA, 25 bp, Mus musculus
aatgcaacacacttctctgctgcag

SEQ ID NO: 80701 - DNA, 25 bp, Mus musculus
aatgcaacagatacgctttccaagt

SEQ ID NO: 80702 - DNA, 25 bp, Mus musculus
aatgcaacagattcgctttccaagt

SEQ ID NO: 80703 - DNA, 25 bp, Mus musculus
aatgcaacagcacttttcccagact

SEQ ID NO: 80704 - DNA, 25 bp, Mus musculus
aatgcaacagcagttttcccagact

SEQ ID NO: 80705 - DNA, 25 bp, Mus musculus
aatgcaacatttaccgaccgtgtgc

SEQ ID NO: 80706 - DNA, 25 bp, Mus musculus
aatgcaacattttccgaccgtgtgc

SEQ ID NO: 80707 - DNA, 25 bp, Mus musculus
aatgcaaccatgagatgccacctct

SEQ ID NO: 80708 - DNA, 25 bp, Mus musculus
aatgcaaccatgtgatgccacctct

SEQ ID NO: 80709 - DNA, 25 bp, Mus musculus
aatgcaaccctgaatatatttgctg

SEQ ID NO: 80710 - DNA, 25 bp, Mus musculus
aatgcaaccctgtatatatttgctg

SEQ ID NO: 80711 - DNA, 25 bp, Mus musculus
aatgcaaccgctactcttgtttgaa

SEQ ID NO: 80712 - DNA, 25 bp, Mus musculus
aatgcaaccgcttctcttgtttgaa

SEQ ID NO: 80713 - DNA, 25 bp, Mus musculus
aatgcaactctaaaattggccttga

SEQ ID NO: 80714 - DNA, 25 bp, Mus musculus
aatgcaactctacgttaaggagctc

SEQ ID NO: 80715 - DNA, 25 bp, Mus musculus
aatgcaactctaggttaaggagctc

SEQ ID NO: 80716 - DNA, 25 bp, Mus musculus
aatgcaactctataattggccttga

SEQ ID NO: 80717 - DNA, 25 bp, Mus musculus
aatgcaactgccactttgtacgaat

SEQ ID NO: 80718 - DNA, 25 bp, Mus musculus
aatgcaactgcctctttgtacgaat

SEQ ID NO: 80719 - DNA, 25 bp, Mus musculus
aatgcaactggcatgaggaatcctc

SEQ ID NO: 80720 - DNA, 25 bp, Mus musculus
aatgcaactggcttgaggaatcctc

SEQ ID NO: 80721 - DNA, 25 bp, Mus musculus
aatgcaagacatagtgtgttgaaat

SEQ ID NO: 80722 - DNA, 25 bp, Mus musculus
aatgcaagacattgtgtgttgaaat

SEQ ID NO: 80723 - DNA, 25 bp, Mus musculus
aatgcaagacgcaagaccgtggcaa

SEQ ID NO: 80724 - DNA, 25 bp, Mus musculus
aatgcaagacgctagaccgtggcaa

SEQ ID NO: 80725 - DNA, 25 bp, Mus musculus
aatgcaagatgcctaggcccctggc

SEQ ID NO: 80726 - DNA, 25 bp, Mus musculus
aatgcaagatgcgtaggcccctggc

SEQ ID NO: 80727 - DNA, 25 bp, Mus musculus
aatgcaagcatccaagtagaaaggg

SEQ ID NO: 80728 - DNA, 25 bp, Mus musculus
aatgcaagcatcgaagtagaaaggg

SEQ ID NO: 80729 - DNA, 25 bp, Mus musculus
aatgcaagccggctgttccaatctc

SEQ ID NO: 80730 - DNA, 25 bp, Mus musculus
aatgcaagccgggtgttccaatctc

SEQ ID NO: 80731 - DNA, 25 bp, Mus musculus
aatgcaagctctccaaccggacttt

SEQ ID NO: 80732 - DNA, 25 bp, Mus musculus
aatgcaagctctgcaaccggacttt

SEQ ID NO: 80733 - DNA, 25 bp, Mus musculus
aatgcaagctgtattacccatcctg

SEQ ID NO: 80734 - DNA, 25 bp, Mus musculus
aatgcaagctgttttacccatcctg

SEQ ID NO: 80735 - DNA, 25 bp, Mus musculus
aatgcaaggacgaatgcctgctccc

SEQ ID NO: 80736 - DNA, 25 bp, Mus musculus
aatgcaaggacgtatgcctgctccc

SEQ ID NO: 80737 - DNA, 25 bp, Mus musculus
aatgcaaggtcaacaccacctcggt

SEQ ID NO: 80738 - DNA, 25 bp, Mus musculus
aatgcaaggtcatcaccacctcggt

SEQ ID NO: 80739 - DNA, 25 bp, Mus musculus
aatgcaagttgcctgtgccacctga

SEQ ID NO: 80740 - DNA, 25 bp, Mus musculus
aatgcaagttgcgtgtgccacctga

SEQ ID NO: 80741 - DNA, 25 bp, Mus musculus
aatgcaagtttgatttgtgtctgaa

SEQ ID NO: 80742 - DNA, 25 bp, Mus musculus
aatgcaagtttgttttgtgtctgaa

SEQ ID NO: 80743 - DNA, 25 bp, Mus musculus
aatgcaatatagagcacacctgtag

SEQ ID NO: 80744 - DNA, 25 bp, Mus musculus
aatgcaatatagtgcacacctgtag

SEQ ID NO: 80745 - DNA, 25 bp, Mus musculus
aatgcaatccgcagcgctcgcagcg

SEQ ID NO: 80746 - DNA, 25 bp, Mus musculus
aatgcaatccgctgcgctcgcagcg

SEQ ID NO: 80747 - DNA, 25 bp, Mus musculus
aatgcaatctcacaatcgaaccctt

SEQ ID NO: 80748 - DNA, 25 bp, Mus musculus
aatgcaatctcagaatcgaaccctt

SEQ ID NO: 80749 - DNA, 25 bp, Mus musculus
aatgcaatgaagaacttacctgtaa

SEQ ID NO: 80750 - DNA, 25 bp, Mus musculus
aatgcaatgaagtacttacctgtaa

SEQ ID NO: 80751 - DNA, 25 bp, Mus musculus
aatgcaatgacacctgggtccacgg

SEQ ID NO: 80752 - DNA, 25 bp, Mus musculus
aatgcaatgacagctgggtccacgg

SEQ ID NO: 80753 - DNA, 25 bp, Mus musculus
aatgcaatgcttcctggtacctctt

SEQ ID NO: 80754 - DNA, 25 bp, Mus musculus
aatgcaatgcttgctggtacctctt

SEQ ID NO: 80755 - DNA, 25 bp, Mus musculus
aatgcaattagtcaattcgcagata

SEQ ID NO: 80756 - DNA, 25 bp, Mus musculus
aatgcaattagtgaattcgcagata

SEQ ID NO: 80757 - DNA, 25 bp, Mus musculus
aatgcaattgcaaaggacgtcctag

SEQ ID NO: 80758 - DNA, 25 bp, Mus musculus
aatgcaattgcataggacgtcctag

SEQ ID NO: 80759 - DNA, 25 bp, Mus musculus
aatgcaattgcgaaccagctacggt

SEQ ID NO: 80760 - DNA, 25 bp, Mus musculus
aatgcaattgcgtaccagctacggt

SEQ ID NO: 80761 - DNA, 25 bp, Mus musculus
aatgcacaattacagtgtccctgaa

SEQ ID NO: 80762 - DNA, 25 bp, Mus musculus
aatgcacaattagagtgtccctgaa

SEQ ID NO: 80763 - DNA, 25 bp, Mus musculus
aatgcacacaacctacccagatggt

SEQ ID NO: 80764 - DNA, 25 bp, Mus musculus
aatgcacacaacgtacccagatggt

SEQ ID NO: 80765 - DNA, 25 bp, Mus musculus
aatgcacacacaccctatcaggaat

SEQ ID NO: 80766 - DNA, 25 bp, Mus musculus
aatgcacacacacggtgtttctccc

SEQ ID NO: 80767 - DNA, 25 bp, Mus musculus
aatgcacacacagcctatcaggaat

SEQ ID NO: 80768 - DNA, 25 bp, Mus musculus
aatgcacacacagggtgtttctccc

SEQ ID NO: 80769 - DNA, 25 bp, Mus musculus
aatgcacacacgactttaaatacac

SEQ ID NO: 80770 - DNA, 25 bp, Mus musculus
aatgcacacacgtctttaaatacac

SEQ ID NO: 80771 - DNA, 25 bp, Mus musculus
aatgcacacaggctggccatcacgc

SEQ ID NO: 80772 - DNA, 25 bp, Mus musculus
aatgcacacagggtggccatcacgc

SEQ ID NO: 80773 - DNA, 25 bp, Mus musculus
aatgcacaccacagagaggatctag

SEQ ID NO: 80774 - DNA, 25 bp, Mus musculus
aatgcacaccactgagaggatctag

SEQ ID NO: 80775 - DNA, 25 bp, Mus musculus
aatgcacacgggaggtgctagctcc

SEQ ID NO: 80776 - DNA, 25 bp, Mus musculus
aatgcacacgggtggtgctagctcc

SEQ ID NO: 80777 - DNA, 25 bp, Mus musculus
aatgcacactgcactctttgtaaga

SEQ ID NO: 80778 - DNA, 25 bp, Mus musculus
aatgcacactgctctctttgtaaga

SEQ ID NO: 80779 - DNA, 25 bp, Mus musculus
aatgcacacttcagtttattgaatg

SEQ ID NO: 80780 - DNA, 25 bp, Mus musculus
aatgcacacttctgtttattgaatg

SEQ ID NO: 80781 - DNA, 25 bp, Mus musculus
aatgcacactttcgcactgaccata

SEQ ID NO: 80782 - DNA, 25 bp, Mus musculus
aatgcacactttggcactgaccata

SEQ ID NO: 80783 - DNA, 25 bp, Mus musculus
aatgcacagagcctgcttgcctgca

SEQ ID NO: 80784 - DNA, 25 bp, Mus musculus
aatgcacagagcgtgcttgcctgca

SEQ ID NO: 80785 - DNA, 25 bp, Mus musculus
aatgcacagatccttccatttgcta

SEQ ID NO: 80786 - DNA, 25 bp, Mus musculus
aatgcacagatcgttccatttgcta

SEQ ID NO: 80787 - DNA, 25 bp, Mus musculus
aatgcacagcatccaactcagatgc

SEQ ID NO: 80788 - DNA, 25 bp, Mus musculus
aatgcacagcatgcaactcagatgc

SEQ ID NO: 80789 - DNA, 25 bp, Mus musculus
aatgcacagtagattcagaccttag

SEQ ID NO: 80790 - DNA, 25 bp, Mus musculus
aatgcacagtagtttcagaccttag

SEQ ID NO: 80791 - DNA, 25 bp, Mus musculus
aatgcacagtcccaaatttataggt

SEQ ID NO: 80792 - DNA, 25 bp, Mus musculus
aatgcacagtccgaaatttataggt

SEQ ID NO: 80793 - DNA, 25 bp, Mus musculus
aatgcacagtgcatcctaaatagta

SEQ ID NO: 80794 - DNA, 25 bp, Mus musculus
aatgcacagtgcttcctaaatagta

SEQ ID NO: 80795 - DNA, 25 bp, Mus musculus
aatgcacagttcaatttgatatccg

SEQ ID NO: 80796 - DNA, 25 bp, Mus musculus
aatgcacagttctatttgatatccg

SEQ ID NO: 80797 - DNA, 25 bp, Mus musculus
aatgcacatataactctgctagcaa

SEQ ID NO: 80798 - DNA, 25 bp, Mus musculus
aatgcacatatatctctgctagcaa

SEQ ID NO: 80799 - DNA, 25 bp, Mus musculus
aatgcacattcacagagtttcttag

SEQ ID NO: 80800 - DNA, 25 bp, Mus musculus
aatgcacattcagagagtttcttag

SEQ ID NO: 80801 - DNA, 25 bp, Mus musculus
aatgcacatttgagtccgtgatgaa

SEQ ID NO: 80802 - DNA, 25 bp, Mus musculus
aatgcacatttgtgtccgtgatgaa

SEQ ID NO: 80803 - DNA, 25 bp, Mus musculus
aatgcaccatcaaaggacaaccacc

SEQ ID NO: 80804 - DNA, 25 bp, Mus musculus
aatgcaccatcataggacaaccacc

SEQ ID NO: 80805 - DNA, 25 bp, Mus musculus
aatgcacccaagaggcctccttcgg

SEQ ID NO: 80806 - DNA, 25 bp, Mus musculus
aatgcacccaagtggcctccttcgg

SEQ ID NO: 80807 - DNA, 25 bp, Mus musculus
aatgcacccagacagccgctttctt

SEQ ID NO: 80808 - DNA, 25 bp, Mus musculus
aatgcacccagagagccgctttctt

SEQ ID NO: 80809 - DNA, 25 bp, Mus musculus
aatgcacccctgcactactatgaaa

SEQ ID NO: 80810 - DNA, 25 bp, Mus musculus
aatgcacccctggactactatgaaa

SEQ ID NO: 80811 - DNA, 25 bp, Mus musculus
aatgcaccctcaaggaatttctctc

SEQ ID NO: 80812 - DNA, 25 bp, Mus musculus
aatgcaccctcatggaatttctctc

SEQ ID NO: 80813 - DNA, 25 bp, Mus musculus
aatgcaccgaggcagaacctgacct

SEQ ID NO: 80814 - DNA, 25 bp, Mus musculus
aatgcaccgagggagaacctgacct

SEQ ID NO: 80815 - DNA, 25 bp, Mus musculus
aatgcacctaaacagcaggcacatt

SEQ ID NO: 80816 - DNA, 25 bp, Mus musculus
aatgcacctaaagagcaggcacatt

SEQ ID NO: 80817 - DNA, 25 bp, Mus musculus
aatgcacctcggagaaattactgta

SEQ ID NO: 80818 - DNA, 25 bp, Mus musculus
aatgcacctcggtgaaattactgta

SEQ ID NO: 80819 - DNA, 25 bp, Mus musculus
aatgcacctgccattgaaatacagt

SEQ ID NO: 80820 - DNA, 25 bp, Mus musculus
aatgcacctgcctttgaaatacagt

SEQ ID NO: 80821 - DNA, 25 bp, Mus musculus
aatgcaccttcgaactttctgacgg

SEQ ID NO: 80822 - DNA, 25 bp, Mus musculus
aatgcaccttcgtactttctgacgg

SEQ ID NO: 80823 - DNA, 25 bp, Mus musculus
aatgcaccttgcaattgccgtgttg

SEQ ID NO: 80824 - DNA, 25 bp, Mus musculus
aatgcaccttgccaacatttagcta

SEQ ID NO: 80825 - DNA, 25 bp, Mus musculus
aatgcaccttgcgaacatttagcta

SEQ ID NO: 80826 - DNA, 25 bp, Mus musculus
aatgcaccttgctattgccgtgttg

SEQ ID NO: 80827 - DNA, 25 bp, Mus musculus
aatgcacgaactccaagaagagctg

SEQ ID NO: 80828 - DNA, 25 bp, Mus musculus
aatgcacgaactgcaagaagagctg

SEQ ID NO: 80829 - DNA, 25 bp, Mus musculus
aatgcacgactgatactcgatatga

SEQ ID NO: 80830 - DNA, 25 bp, Mus musculus
aatgcacgactgttactcgatatga

SEQ ID NO: 80831 - DNA, 25 bp, Mus musculus
aatgcacgacttaaaggctccgttt

SEQ ID NO: 80832 - DNA, 25 bp, Mus musculus
aatgcacgactttaaggctccgttt

SEQ ID NO: 80833 - DNA, 25 bp, Mus musculus
aatgcacgagccaggttacctggga

SEQ ID NO: 80834 - DNA, 25 bp, Mus musculus
aatgcacgagcctggttacctggga

SEQ ID NO: 80835 - DNA, 25 bp, Mus musculus
aatgcacgctccagatacacagtgt

SEQ ID NO: 80836 - DNA, 25 bp, Mus musculus
aatgcacgctcctgatacacagtgt

SEQ ID NO: 80837 - DNA, 25 bp, Mus musculus
aatgcacggaagagctctgaccacc

SEQ ID NO: 80838 - DNA, 25 bp, Mus musculus
aatgcacggaagtgctctgaccacc

SEQ ID NO: 80839 - DNA, 25 bp, Mus musculus
aatgcacggtctaggcttctgtttc

SEQ ID NO: 80840 - DNA, 25 bp, Mus musculus
aatgcacggtcttggcttctgtttc

SEQ ID NO: 80841 - DNA, 25 bp, Mus musculus
aatgcactaggcaagtagcccttgc

SEQ ID NO: 80842 - DNA, 25 bp, Mus musculus
aatgcactaggctagtagcccttgc

SEQ ID NO: 80843 - DNA, 25 bp, Mus musculus
aatgcactatgaaagctatgtttca

SEQ ID NO: 80844 - DNA, 25 bp, Mus musculus
aatgcactatgatagctatgtttca

SEQ ID NO: 80845 - DNA, 25 bp, Mus musculus
aatgcactccaaaagccttggcttg

SEQ ID NO: 80846 - DNA, 25 bp, Mus musculus
aatgcactccaatagccttggcttg

SEQ ID NO: 80847 - DNA, 25 bp, Mus musculus
aatgcactcgagactgtgaactagg

SEQ ID NO: 80848 - DNA, 25 bp, Mus musculus
aatgcactcgagtctgtgaactagg

SEQ ID NO: 80849 - DNA, 25 bp, Mus musculus
aatgcactcttgatctgtctgtggt

SEQ ID NO: 80850 - DNA, 25 bp, Mus musculus
aatgcactcttgttctgtctgtggt

SEQ ID NO: 80851 - DNA, 25 bp, Mus musculus
aatgcactgaaaccacagtacaggg

SEQ ID NO: 80852 - DNA, 25 bp, Mus musculus
aatgcactgaaagcacagtacaggg

SEQ ID NO: 80853 - DNA, 25 bp, Mus musculus
aatgcactgattccatgttacccca

SEQ ID NO: 80854 - DNA, 25 bp, Mus musculus
aatgcactgattctctgcagcccct

SEQ ID NO: 80855 - DNA, 25 bp, Mus musculus
aatgcactgattgcatgttacccca

SEQ ID NO: 80856 - DNA, 25 bp, Mus musculus
aatgcactgattgtctgcagcccct

SEQ ID NO: 80857 - DNA, 25 bp, Mus musculus
aatgcactgcatagcttttctaaag

SEQ ID NO: 80858 - DNA, 25 bp, Mus musculus
aatgcactgcatataggcacactca

SEQ ID NO: 80859 - DNA, 25 bp, Mus musculus
aatgcactgcattgcttttctaaag

SEQ ID NO: 80860 - DNA, 25 bp, Mus musculus
aatgcactgcatttaggcacactca

SEQ ID NO: 80861 - DNA, 25 bp, Mus musculus
aatgcactgcctagtataccaggaa

SEQ ID NO: 80862 - DNA, 25 bp, Mus musculus
aatgcactgccttgtataccaggaa

SEQ ID NO: 80863 - DNA, 25 bp, Mus musculus
aatgcactgcgtcgattttccctgt

SEQ ID NO: 80864 - DNA, 25 bp, Mus musculus
aatgcactgcgtggattttccctgt

SEQ ID NO: 80865 - DNA, 25 bp, Mus musculus
aatgcactggacaaactcttgttta

SEQ ID NO: 80866 - DNA, 25 bp, Mus musculus
aatgcactggactaactcttgttta

SEQ ID NO: 80867 - DNA, 25 bp, Mus musculus
aatgcactgggcattcggccttaat

SEQ ID NO: 80868 - DNA, 25 bp, Mus musculus
aatgcactgggctttcggccttaat

SEQ ID NO: 80869 - DNA, 25 bp, Mus musculus
aatgcactgtcaagcagggccagac

SEQ ID NO: 80870 - DNA, 25 bp, Mus musculus
aatgcactgtcatgcagggccagac

SEQ ID NO: 80871 - DNA, 25 bp, Mus musculus
aatgcactgtgaagtggcaccaact

SEQ ID NO: 80872 - DNA, 25 bp, Mus musculus
aatgcactgtgaagttagctcaagt

SEQ ID NO: 80873 - DNA, 25 bp, Mus musculus
aatgcactgtgatgtggcaccaact

SEQ ID NO: 80874 - DNA, 25 bp, Mus musculus
aatgcactgtgatgttagctcaagt

SEQ ID NO: 80875 - DNA, 25 bp, Mus musculus
aatgcactgtgtattttgaagagac

SEQ ID NO: 80876 - DNA, 25 bp, Mus musculus
aatgcactgtgttttttgaagagac

SEQ ID NO: 80877 - DNA, 25 bp, Mus musculus
aatgcactgttaccacctacatagt

SEQ ID NO: 80878 - DNA, 25 bp, Mus musculus
aatgcactgttagcacctacatagt

SEQ ID NO: 80879 - DNA, 25 bp, Mus musculus
aatgcacttcaacataccgagcctt

SEQ ID NO: 80880 - DNA, 25 bp, Mus musculus
aatgcacttcaagataccgagcctt

SEQ ID NO: 80881 - DNA, 25 bp, Mus musculus
aatgcacttcacaggtcagttgact

SEQ ID NO: 80882 - DNA, 25 bp, Mus musculus
aatgcacttcactggtcagttgact

SEQ ID NO: 80883 - DNA, 25 bp, Mus musculus
aatgcacttccaaacaagctagctg

SEQ ID NO: 80884 - DNA, 25 bp, Mus musculus
aatgcacttccatacaagctagctg

SEQ ID NO: 80885 - DNA, 25 bp, Mus musculus
aatgcacttcctacaaaagacccca

SEQ ID NO: 80886 - DNA, 25 bp, Mus musculus
aatgcacttccttcaaaagacccca

SEQ ID NO: 80887 - DNA, 25 bp, Mus musculus
aatgcacttttacggaatcaccaac

SEQ ID NO: 80888 - DNA, 25 bp, Mus musculus
aatgcacttttagggaatcaccaac

SEQ ID NO: 80889 - DNA, 25 bp, Mus musculus
aatgcagaaatgactgcagtgcagc

SEQ ID NO: 80890 - DNA, 25 bp, Mus musculus
aatgcagaaatgtctgcagtgcagc

SEQ ID NO: 80891 - DNA, 25 bp, Mus musculus
aatgcagaacaaagccccttttctc

SEQ ID NO: 80892 - DNA, 25 bp, Mus musculus
aatgcagaacaatgccccttttctc

SEQ ID NO: 80893 - DNA, 25 bp, Mus musculus
aatgcagaacctatttggaccccat

SEQ ID NO: 80894 - DNA, 25 bp, Mus musculus
aatgcagaacctttttggaccccat

SEQ ID NO: 80895 - DNA, 25 bp, Mus musculus
aatgcagaacttcccgtgtgtgtgt

SEQ ID NO: 80896 - DNA, 25 bp, Mus musculus
aatgcagaacttgccgtgtgtgtgt

SEQ ID NO: 80897 - DNA, 25 bp, Mus musculus
aatgcagaagcaacctgggtcccgc

SEQ ID NO: 80898 - DNA, 25 bp, Mus musculus
aatgcagaagcatcctgggtcccgc

SEQ ID NO: 80899 - DNA, 25 bp, Mus musculus
aatgcagaatgcactctctcggagc

SEQ ID NO: 80900 - DNA, 25 bp, Mus musculus
aatgcagaatgctctctctcggagc

SEQ ID NO: 80901 - DNA, 25 bp, Mus musculus
aatgcagaattcatgctacccagta

SEQ ID NO: 80902 - DNA, 25 bp, Mus musculus
aatgcagaattcttgctacccagta

SEQ ID NO: 80903 - DNA, 25 bp, Mus musculus
aatgcagacaggagccaggcagtga

SEQ ID NO: 80904 - DNA, 25 bp, Mus musculus
aatgcagacaggtgccaggcagtga

SEQ ID NO: 80905 - DNA, 25 bp, Mus musculus
aatgcagacatcattctactcctgg

SEQ ID NO: 80906 - DNA, 25 bp, Mus musculus
aatgcagacatctttctactcctgg

SEQ ID NO: 80907 - DNA, 25 bp, Mus musculus
aatgcagaccctagtgggctgtact

SEQ ID NO: 80908 - DNA, 25 bp, Mus musculus
aatgcagacccttgtgggctgtact

SEQ ID NO: 80909 - DNA, 25 bp, Mus musculus
aatgcagaccttacacttctggcgc

SEQ ID NO: 80910 - DNA, 25 bp, Mus musculus
aatgcagacctttcacttctggcgc

SEQ ID NO: 80911 - DNA, 25 bp, Mus musculus
aatgcagacgcacagacagagtttc

SEQ ID NO: 80912 - DNA, 25 bp, Mus musculus
aatgcagacgcagagacagagtttc

SEQ ID NO: 80913 - DNA, 25 bp, Mus musculus
aatgcagacggcagatgctttccct

SEQ ID NO: 80914 - DNA, 25 bp, Mus musculus
aatgcagacggctgatgctttccct

SEQ ID NO: 80915 - DNA, 25 bp, Mus musculus
aatgcagactgtctgtgcatacaca

SEQ ID NO: 80916 - DNA, 25 bp, Mus musculus
aatgcagactgtgtgtgcatacaca

SEQ ID NO: 80917 - DNA, 25 bp, Mus musculus
aatgcagacttgatcgtgttttaga

SEQ ID NO: 80918 - DNA, 25 bp, Mus musculus
aatgcagacttgttcgtgttttaga

SEQ ID NO: 80919 - DNA, 25 bp, Mus musculus
aatgcagactttccagactcatcag

SEQ ID NO: 80920 - DNA, 25 bp, Mus musculus
aatgcagactttgcagactcatcag

SEQ ID NO: 80921 - DNA, 25 bp, Mus musculus
aatgcagagagcatcccaactggat

SEQ ID NO: 80922 - DNA, 25 bp, Mus musculus
aatgcagagagcttcccaactggat

SEQ ID NO: 80923 - DNA, 25 bp, Mus musculus
aatgcagagattcccacaggaagca

SEQ ID NO: 80924 - DNA, 25 bp, Mus musculus
aatgcagagattgccacaggaagca

SEQ ID NO: 80925 - DNA, 25 bp, Mus musculus
aatgcagaggccaatcgaacctccc

SEQ ID NO: 80926 - DNA, 25 bp, Mus musculus
aatgcagaggcctatcgaacctccc

SEQ ID NO: 80927 - DNA, 25 bp, Mus musculus
aatgcagagggtaatgaagaatttc

SEQ ID NO: 80928 - DNA, 25 bp, Mus musculus
aatgcagagggttatgaagaatttc

SEQ ID NO: 80929 - DNA, 25 bp, Mus musculus
aatgcagatattccttacgctacaa

SEQ ID NO: 80930 - DNA, 25 bp, Mus musculus
aatgcagatattgcttacgctacaa

SEQ ID NO: 80931 - DNA, 25 bp, Mus musculus
aatgcagatgataaggctaacagta

SEQ ID NO: 80932 - DNA, 25 bp, Mus musculus
aatgcagatgatccacaggctaaat

SEQ ID NO: 80933 - DNA, 25 bp, Mus musculus
aatgcagatgatgcacaggctaaat

SEQ ID NO: 80934 - DNA, 25 bp, Mus musculus
aatgcagatgattaggctaacagta

SEQ ID NO: 80935 - DNA, 25 bp, Mus musculus
aatgcagattccacggtgcttgcta

SEQ ID NO: 80936 - DNA, 25 bp, Mus musculus
aatgcagattcctcggtgcttgcta

SEQ ID NO: 80937 - DNA, 25 bp, Mus musculus
aatgcagattcgctggctgctttgc

SEQ ID NO: 80938 - DNA, 25 bp, Mus musculus
aatgcagattcggtggctgctttgc

SEQ ID NO: 80939 - DNA, 25 bp, Mus musculus
aatgcagatttgctccgtcttgctt

SEQ ID NO: 80940 - DNA, 25 bp, Mus musculus
aatgcagatttggtccgtcttgctt

SEQ ID NO: 80941 - DNA, 25 bp, Mus musculus
aatgcagcaatccaggcagccacta

SEQ ID NO: 80942 - DNA, 25 bp, Mus musculus
aatgcagcaatcgaggcagccacta

SEQ ID NO: 80943 - DNA, 25 bp, Mus musculus
aatgcagcagggaacagctccacct

SEQ ID NO: 80944 - DNA, 25 bp, Mus musculus
aatgcagcagggtacagctccacct

SEQ ID NO: 80945 - DNA, 25 bp, Mus musculus
aatgcagcatctacagaactcgtcc

SEQ ID NO: 80946 - DNA, 25 bp, Mus musculus
aatgcagcatcttcagaactcgtcc

SEQ ID NO: 80947 - DNA, 25 bp, Mus musculus
aatgcagcattacacgaacacacag

SEQ ID NO: 80948 - DNA, 25 bp, Mus musculus
aatgcagcattagacgaacacacag

SEQ ID NO: 80949 - DNA, 25 bp, Mus musculus
aatgcagcatttcgagcgctgtctc

SEQ ID NO: 80950 - DNA, 25 bp, Mus musculus
aatgcagcatttggagcgctgtctc

SEQ ID NO: 80951 - DNA, 25 bp, Mus musculus
aatgcagccactcgcacgtagggac

SEQ ID NO: 80952 - DNA, 25 bp, Mus musculus
aatgcagccactggcacgtagggac

SEQ ID NO: 80953 - DNA, 25 bp, Mus musculus
aatgcagccctcattgtatcagtaa

SEQ ID NO: 80954 - DNA, 25 bp, Mus musculus
aatgcagccctctttgtatcagtaa

SEQ ID NO: 80955 - DNA, 25 bp, Mus musculus
aatgcagccttcattacgcagcagt

SEQ ID NO: 80956 - DNA, 25 bp, Mus musculus
aatgcagccttctttacgcagcagt

SEQ ID NO: 80957 - DNA, 25 bp, Mus musculus
aatgcagcgatgacaagttcttcca

SEQ ID NO: 80958 - DNA, 25 bp, Mus musculus
aatgcagcgatgtcaagttcttcca

SEQ ID NO: 80959 - DNA, 25 bp, Mus musculus
aatgcagcgcgtagttgtgccatgt

SEQ ID NO: 80960 - DNA, 25 bp, Mus musculus
aatgcagcgcgttgttgtgccatgt

SEQ ID NO: 80961 - DNA, 25 bp, Mus musculus
aatgcagcgcttctgagagcaataa

SEQ ID NO: 80962 - DNA, 25 bp, Mus musculus
aatgcagcgcttgtgagagcaataa

SEQ ID NO: 80963 - DNA, 25 bp, Mus musculus
aatgcagcgtacaggctggcatccg

SEQ ID NO: 80964 - DNA, 25 bp, Mus musculus
aatgcagcgtactggctggcatccg

SEQ ID NO: 80965 - DNA, 25 bp, Mus musculus
aatgcagcgtgtcgatgctgctccc

SEQ ID NO: 80966 - DNA, 25 bp, Mus musculus
aatgcagcgtgtggatgctgctccc

SEQ ID NO: 80967 - DNA, 25 bp, Mus musculus
aatgcagctaaactccttgggaaag

SEQ ID NO: 80968 - DNA, 25 bp, Mus musculus
aatgcagctaaagtccttgggaaag

SEQ ID NO: 80969 - DNA, 25 bp, Mus musculus
aatgcagctagaatttcgcactccc

SEQ ID NO: 80970 - DNA, 25 bp, Mus musculus
aatgcagctagattttcgcactccc

SEQ ID NO: 80971 - DNA, 25 bp, Mus musculus
aatgcagctcaacgttctgcaccct

SEQ ID NO: 80972 - DNA, 25 bp, Mus musculus
aatgcagctcaaggttctgcaccct

SEQ ID NO: 80973 - DNA, 25 bp, Mus musculus
aatgcagctcatcaagtcccctgcg

SEQ ID NO: 80974 - DNA, 25 bp, Mus musculus
aatgcagctcatgaagtcccctgcg

SEQ ID NO: 80975 - DNA, 25 bp, Mus musculus
aatgcagctcctcggctggattttg

SEQ ID NO: 80976 - DNA, 25 bp, Mus musculus
aatgcagctcctgggctggattttg

SEQ ID NO: 80977 - DNA, 25 bp, Mus musculus
aatgcagctggaaatcacggtgaaa

SEQ ID NO: 80978 - DNA, 25 bp, Mus musculus
aatgcagctggatatcacggtgaaa

SEQ ID NO: 80979 - DNA, 25 bp, Mus musculus
aatgcagctgtcacttggagctcat

SEQ ID NO: 80980 - DNA, 25 bp, Mus musculus
aatgcagctgtctcttggagctcat

SEQ ID NO: 80981 - DNA, 25 bp, Mus musculus
aatgcagctgtgactactgccatga

SEQ ID NO: 80982 - DNA, 25 bp, Mus musculus
aatgcagctgtgagggtgacactca

SEQ ID NO: 80983 - DNA, 25 bp, Mus musculus
aatgcagctgtgtctactgccatga

SEQ ID NO: 80984 - DNA, 25 bp, Mus musculus
aatgcagctgtgtgggtgacactca

SEQ ID NO: 80985 - DNA, 25 bp, Mus musculus
aatgcagcttatagaaaaccagtaa

SEQ ID NO: 80986 - DNA, 25 bp, Mus musculus
aatgcagcttattgaaaaccagtaa

SEQ ID NO: 80987 - DNA, 25 bp, Mus musculus
aatgcaggaacacagccgagcaggt

SEQ ID NO: 80988 - DNA, 25 bp, Mus musculus
aatgcaggaacagagccgagcaggt

SEQ ID NO: 80989 - DNA, 25 bp, Mus musculus
aatgcaggaggacggcacccagaat

SEQ ID NO: 80990 - DNA, 25 bp, Mus musculus
aatgcaggaggagggcacccagaat

SEQ ID NO: 80991 - DNA, 25 bp, Mus musculus
aatgcaggagtcagaattgccttaa

SEQ ID NO: 80992 - DNA, 25 bp, Mus musculus
aatgcaggagtctgaattgccttaa

SEQ ID NO: 80993 - DNA, 25 bp, Mus musculus
aatgcaggatccacttgattccttc

SEQ ID NO: 80994 - DNA, 25 bp, Mus musculus
aatgcaggatcctcttgattccttc

SEQ ID NO: 80995 - DNA, 25 bp, Mus musculus
aatgcaggcccaaatggtcaagagt

SEQ ID NO: 80996 - DNA, 25 bp, Mus musculus
aatgcaggcccatatggtcaagagt

SEQ ID NO: 80997 - DNA, 25 bp, Mus musculus
aatgcaggctttccacgttagtcct

SEQ ID NO: 80998 - DNA, 25 bp, Mus musculus
aatgcaggctttgcacgttagtcct

SEQ ID NO: 80999 - DNA, 25 bp, Mus musculus
aatgcagggcctaggtttctggcaa

SEQ ID NO: 81000 - DNA, 25 bp, Mus musculus
aatgcagggccttggtttctggcaa

SEQ ID NO: 81001 - DNA, 25 bp, Mus musculus
aatgcagggcgcagactggcagtca

SEQ ID NO: 81002 - DNA, 25 bp, Mus musculus
aatgcagggcgctgactggcagtca

SEQ ID NO: 81003 - DNA, 25 bp, Mus musculus
aatgcagggctaaagtgatggctct

SEQ ID NO: 81004 - DNA, 25 bp, Mus musculus
aatgcagggctatagtgatggctct

SEQ ID NO: 81005 - DNA, 25 bp, Mus musculus
aatgcagggtctcgcatcctgcagc

SEQ ID NO: 81006 - DNA, 25 bp, Mus musculus
aatgcagggtctggcatcctgcagc

SEQ ID NO: 81007 - DNA, 25 bp, Mus musculus
aatgcaggtcctaacgtaacagaga

SEQ ID NO: 81008 - DNA, 25 bp, Mus musculus
aatgcaggtccttacgtaacagaga

SEQ ID NO: 81009 - DNA, 25 bp, Mus musculus
aatgcaggtgacacctatagagcaa

SEQ ID NO: 81010 - DNA, 25 bp, Mus musculus
aatgcaggtgactcctatagagcaa

SEQ ID NO: 81011 - DNA, 25 bp, Mus musculus
aatgcaggtgcgatctgtctgtctc

SEQ ID NO: 81012 - DNA, 25 bp, Mus musculus
aatgcaggtgcgttctgtctgtctc

SEQ ID NO: 81013 - DNA, 25 bp, Mus musculus
aatgcagtaatgagcctagtacaga

SEQ ID NO: 81014 - DNA, 25 bp, Mus musculus
aatgcagtaatgtgcctagtacaga

SEQ ID NO: 81015 - DNA, 25 bp, Mus musculus
aatgcagtaattaggttttgggagg

SEQ ID NO: 81016 - DNA, 25 bp, Mus musculus
aatgcagtaattctgttcgggtctc

SEQ ID NO: 81017 - DNA, 25 bp, Mus musculus
aatgcagtaattgtgttcgggtctc

SEQ ID NO: 81018 - DNA, 25 bp, Mus musculus
aatgcagtaatttggttttgggagg

SEQ ID NO: 81019 - DNA, 25 bp, Mus musculus
aatgcagtagtgcaccagctgccag

SEQ ID NO: 81020 - DNA, 25 bp, Mus musculus
aatgcagtagtggaccagctgccag

SEQ ID NO: 81021 - DNA, 25 bp, Mus musculus
aatgcagtcagcaccatcaaggcaa

SEQ ID NO: 81022 - DNA, 25 bp, Mus musculus
aatgcagtcagctccatcaaggcaa

SEQ ID NO: 81023 - DNA, 25 bp, Mus musculus
aatgcagtcaggagtgggcacatgt

SEQ ID NO: 81024 - DNA, 25 bp, Mus musculus
aatgcagtcaggtgtgggcacatgt

SEQ ID NO: 81025 - DNA, 25 bp, Mus musculus
aatgcagtcatgatacagagcacaa

SEQ ID NO: 81026 - DNA, 25 bp, Mus musculus
aatgcagtcatgttacagagcacaa

SEQ ID NO: 81027 - DNA, 25 bp, Mus musculus
aatgcagtccagagagtacagtaac

SEQ ID NO: 81028 - DNA, 25 bp, Mus musculus
aatgcagtccagatggctaccagat

SEQ ID NO: 81029 - DNA, 25 bp, Mus musculus
aatgcagtccagtgagtacagtaac

SEQ ID NO: 81030 - DNA, 25 bp, Mus musculus
aatgcagtccagttggctaccagat

SEQ ID NO: 81031 - DNA, 25 bp, Mus musculus
aatgcagtctctagtattagcctat

SEQ ID NO: 81032 - DNA, 25 bp, Mus musculus
aatgcagtctcttgtattagcctat

SEQ ID NO: 81033 - DNA, 25 bp, Mus musculus
aatgcagtctttattacatcaaatc

SEQ ID NO: 81034 - DNA, 25 bp, Mus musculus
aatgcagtcttttttacatcaaatc

SEQ ID NO: 81035 - DNA, 25 bp, Mus musculus
aatgcagtgaatacctatggctcct

SEQ ID NO: 81036 - DNA, 25 bp, Mus musculus
aatgcagtgaattcctatggctcct

SEQ ID NO: 81037 - DNA, 25 bp, Mus musculus
aatgcagtgatacattgttgtttcc

SEQ ID NO: 81038 - DNA, 25 bp, Mus musculus
aatgcagtgatagattgttgtttcc

SEQ ID NO: 81039 - DNA, 25 bp, Mus musculus
aatgcagtgccactgtctttctggg

SEQ ID NO: 81040 - DNA, 25 bp, Mus musculus
aatgcagtgccagtgtctttctggg

SEQ ID NO: 81041 - DNA, 25 bp, Mus musculus
aatgcagtggaaattttcctccctc

SEQ ID NO: 81042 - DNA, 25 bp, Mus musculus
aatgcagtggaatttttcctccctc

SEQ ID NO: 81043 - DNA, 25 bp, Mus musculus
aatgcagtgtcacaccctgtgacgg

SEQ ID NO: 81044 - DNA, 25 bp, Mus musculus
aatgcagtgtcagaccctgtgacgg

SEQ ID NO: 81045 - DNA, 25 bp, Mus musculus
aatgcagtgtctaagagcgaagtcc

SEQ ID NO: 81046 - DNA, 25 bp, Mus musculus
aatgcagtgtcttagagcgaagtcc

SEQ ID NO: 81047 - DNA, 25 bp, Mus musculus
aatgcagttaatccctagatatcgg

SEQ ID NO: 81048 - DNA, 25 bp, Mus musculus
aatgcagttaatgcctagatatcgg

SEQ ID NO: 81049 - DNA, 25 bp, Mus musculus
aatgcagttatcaaggtggtcctta

SEQ ID NO: 81050 - DNA, 25 bp, Mus musculus
aatgcagttatcctgatggcttcgg

SEQ ID NO: 81051 - DNA, 25 bp, Mus musculus
aatgcagttatcgtgatggcttcgg

SEQ ID NO: 81052 - DNA, 25 bp, Mus musculus
aatgcagttatctaggtggtcctta

SEQ ID NO: 81053 - DNA, 25 bp, Mus musculus
aatgcagttattcacccctttatat

SEQ ID NO: 81054 - DNA, 25 bp, Mus musculus
aatgcagttattgacccctttatat

SEQ ID NO: 81055 - DNA, 25 bp, Mus musculus
aatgcagttgatccgattgccaccg

SEQ ID NO: 81056 - DNA, 25 bp, Mus musculus
aatgcagttgatgcgattgccaccg

SEQ ID NO: 81057 - DNA, 25 bp, Mus musculus
aatgcagttgcacaactttcaggtt

SEQ ID NO: 81058 - DNA, 25 bp, Mus musculus
aatgcagttgcagaactttcaggtt

SEQ ID NO: 81059 - DNA, 25 bp, Mus musculus
aatgcagttggtatcgaagccccaa

SEQ ID NO: 81060 - DNA, 25 bp, Mus musculus
aatgcagttggtttcgaagccccaa

SEQ ID NO: 81061 - DNA, 25 bp, Mus musculus
aatgcagttgtgctcacagtggctc

SEQ ID NO: 81062 - DNA, 25 bp, Mus musculus
aatgcagttgtggtcacagtggctc

SEQ ID NO: 81063 - DNA, 25 bp, Mus musculus
aatgcagtttcgaaggtgtttcctt

SEQ ID NO: 81064 - DNA, 25 bp, Mus musculus
aatgcagtttcgtaggtgtttcctt

SEQ ID NO: 81065 - DNA, 25 bp, Mus musculus
aatgcagtttttaatggttcaaaat

SEQ ID NO: 81066 - DNA, 25 bp, Mus musculus
aatgcagtttttacgacttgtctaa

SEQ ID NO: 81067 - DNA, 25 bp, Mus musculus
aatgcagttttttatggttcaaaat

SEQ ID NO: 81068 - DNA, 25 bp, Mus musculus
aatgcagttttttcgacttgtctaa

SEQ ID NO: 81069 - DNA, 25 bp, Mus musculus
aatgcataagccatgtcctgagtct

SEQ ID NO: 81070 - DNA, 25 bp, Mus musculus
aatgcataagccttgtcctgagtct

SEQ ID NO: 81071 - DNA, 25 bp, Mus musculus
aatgcatacatcctttgatccccct

SEQ ID NO: 81072 - DNA, 25 bp, Mus musculus
aatgcatacatcgtttgatccccct

SEQ ID NO: 81073 - DNA, 25 bp, Mus musculus
aatgcatacctccatatttcccttt

SEQ ID NO: 81074 - DNA, 25 bp, Mus musculus
aatgcatacctcgatatttcccttt

SEQ ID NO: 81075 - DNA, 25 bp, Mus musculus
aatgcatagagtaatgtggacacaa

SEQ ID NO: 81076 - DNA, 25 bp, Mus musculus
aatgcatagagttatgtggacacaa

SEQ ID NO: 81077 - DNA, 25 bp, Mus musculus
aatgcatagcacactgcagagaaga

SEQ ID NO: 81078 - DNA, 25 bp, Mus musculus
aatgcatagcactctgcagagaaga

SEQ ID NO: 81079 - DNA, 25 bp, Mus musculus
aatgcatagtataccaccccatttt

SEQ ID NO: 81080 - DNA, 25 bp, Mus musculus
aatgcatagtattccaccccatttt

SEQ ID NO: 81081 - DNA, 25 bp, Mus musculus
aatgcatagtcactccatgggaaga

SEQ ID NO: 81082 - DNA, 25 bp, Mus musculus
aatgcatagtcagtccatgggaaga

SEQ ID NO: 81083 - DNA, 25 bp, Mus musculus
aatgcatagtgcagaccgagactca

SEQ ID NO: 81084 - DNA, 25 bp, Mus musculus
aatgcatagtgctgaccgagactca

SEQ ID NO: 81085 - DNA, 25 bp, Mus musculus
aatgcatatagtaaaggccactttt

SEQ ID NO: 81086 - DNA, 25 bp, Mus musculus
aatgcatatagttaaggccactttt

SEQ ID NO: 81087 - DNA, 25 bp, Mus musculus
aatgcatatattacaaaccatactg

SEQ ID NO: 81088 - DNA, 25 bp, Mus musculus
aatgcatatatttcaaaccatactg

SEQ ID NO: 81089 - DNA, 25 bp, Mus musculus
aatgcatatccgcaaagccaccaag

SEQ ID NO: 81090 - DNA, 25 bp, Mus musculus
aatgcatatccggaaagccaccaag

SEQ ID NO: 81091 - DNA, 25 bp, Mus musculus
aatgcatatcgacttcctgttgccc

SEQ ID NO: 81092 - DNA, 25 bp, Mus musculus
aatgcatatcgagttcctgttgccc

SEQ ID NO: 81093 - DNA, 25 bp, Mus musculus
aatgcatatggtaactacgacggct

SEQ ID NO: 81094 - DNA, 25 bp, Mus musculus
aatgcatatggttactacgacggct

SEQ ID NO: 81095 - DNA, 25 bp, Mus musculus
aatgcatattggacctctgtaccca

SEQ ID NO: 81096 - DNA, 25 bp, Mus musculus
aatgcatattggtcctctgtaccca

SEQ ID NO: 81097 - DNA, 25 bp, Mus musculus
aatgcatattgtcaaaccttttctg

SEQ ID NO: 81098 - DNA, 25 bp, Mus musculus
aatgcatattgtgaaaccttttctg

SEQ ID NO: 81099 - DNA, 25 bp, Mus musculus
aatgcatcaaatactcaaggagggc

SEQ ID NO: 81100 - DNA, 25 bp, Mus musculus
aatgcatcaaattctcaaggagggc

SEQ ID NO: 81101 - DNA, 25 bp, Mus musculus
aatgcatcacctctcgaggaactaa

SEQ ID NO: 81102 - DNA, 25 bp, Mus musculus
aatgcatcacctgtcgaggaactaa

SEQ ID NO: 81103 - DNA, 25 bp, Mus musculus
aatgcatcagataaaaaccacagaa

SEQ ID NO: 81104 - DNA, 25 bp, Mus musculus
aatgcatcagattaaaaccacagaa

SEQ ID NO: 81105 - DNA, 25 bp, Mus musculus
aatgcatccaacagtcaagtgctga

SEQ ID NO: 81106 - DNA, 25 bp, Mus musculus
aatgcatccaactgtcaagtgctga

SEQ ID NO: 81107 - DNA, 25 bp, Mus musculus
aatgcatccattagcaacacacggg

SEQ ID NO: 81108 - DNA, 25 bp, Mus musculus
aatgcatccatttgcaacacacggg

SEQ ID NO: 81109 - DNA, 25 bp, Mus musculus
aatgcatcccaaaaacgagaatctg

SEQ ID NO: 81110 - DNA, 25 bp, Mus musculus
aatgcatcccaactaaacctcagac

SEQ ID NO: 81111 - DNA, 25 bp, Mus musculus
aatgcatcccaagtaaacctcagac

SEQ ID NO: 81112 - DNA, 25 bp, Mus musculus
aatgcatcccaataacgagaatctg

SEQ ID NO: 81113 - DNA, 25 bp, Mus musculus
aatgcatcccgaccttcaattttta

SEQ ID NO: 81114 - DNA, 25 bp, Mus musculus
aatgcatcccgagcttcaattttta

SEQ ID NO: 81115 - DNA, 25 bp, Mus musculus
aatgcatccttgacatcagtgccag

SEQ ID NO: 81116 - DNA, 25 bp, Mus musculus
aatgcatccttgtcatcagtgccag

SEQ ID NO: 81117 - DNA, 25 bp, Mus musculus
aatgcatcgagtcaaaagccctgac

SEQ ID NO: 81118 - DNA, 25 bp, Mus musculus
aatgcatcgagtgaaaagccctgac

SEQ ID NO: 81119 - DNA, 25 bp, Mus musculus
aatgcatcttataatgtgtcccgat

SEQ ID NO: 81120 - DNA, 25 bp, Mus musculus
aatgcatcttattatgtgtcccgat

SEQ ID NO: 81121 - DNA, 25 bp, Mus musculus
aatgcatcttttaaacgtctgtcag

SEQ ID NO: 81122 - DNA, 25 bp, Mus musculus
aatgcatctttttaacgtctgtcag

SEQ ID NO: 81123 - DNA, 25 bp, Mus musculus
aatgcatgaaacaggtgtcccgttt

SEQ ID NO: 81124 - DNA, 25 bp, Mus musculus
aatgcatgaaactggtgtcccgttt

SEQ ID NO: 81125 - DNA, 25 bp, Mus musculus
aatgcatgaagacccctggacatct

SEQ ID NO: 81126 - DNA, 25 bp, Mus musculus
aatgcatgaagagccctggacatct

SEQ ID NO: 81127 - DNA, 25 bp, Mus musculus
aatgcatgcaagaacccattaggtt

SEQ ID NO: 81128 - DNA, 25 bp, Mus musculus
aatgcatgcaagtacccattaggtt

SEQ ID NO: 81129 - DNA, 25 bp, Mus musculus
aatgcatgcacgcttctaaatgaat

SEQ ID NO: 81130 - DNA, 25 bp, Mus musculus
aatgcatgcacggttctaaatgaat

SEQ ID NO: 81131 - DNA, 25 bp, Mus musculus
aatgcatgcactagagtcctgtgac

SEQ ID NO: 81132 - DNA, 25 bp, Mus musculus
aatgcatgcacttgagtcctgtgac

SEQ ID NO: 81133 - DNA, 25 bp, Mus musculus
aatgcatgcatgactctcagatcta

SEQ ID NO: 81134 - DNA, 25 bp, Mus musculus
aatgcatgcatgtctctcagatcta

SEQ ID NO: 81135 - DNA, 25 bp, Mus musculus
aatgcatgccaacattgtgcccgcg

SEQ ID NO: 81136 - DNA, 25 bp, Mus musculus
aatgcatgccaagattgtgcccgcg

SEQ ID NO: 81137 - DNA, 25 bp, Mus musculus
aatgcatgccagcaaagccactaca

SEQ ID NO: 81138 - DNA, 25 bp, Mus musculus
aatgcatgccaggaaagccactaca

SEQ ID NO: 81139 - DNA, 25 bp, Mus musculus
aatgcatgccctagctttactgctt

SEQ ID NO: 81140 - DNA, 25 bp, Mus musculus
aatgcatgcccttgctttactgctt

SEQ ID NO: 81141 - DNA, 25 bp, Mus musculus
aatgcatgcggcaagcccattgggc

SEQ ID NO: 81142 - DNA, 25 bp, Mus musculus
aatgcatgcggctagcccattgggc

SEQ ID NO: 81143 - DNA, 25 bp, Mus musculus
aatgcatgcggtctctacagcaaga

SEQ ID NO: 81144 - DNA, 25 bp, Mus musculus
aatgcatgcggtgtctacagcaaga

SEQ ID NO: 81145 - DNA, 25 bp, Mus musculus
aatgcatgctcaaagcctaacctca

SEQ ID NO: 81146 - DNA, 25 bp, Mus musculus
aatgcatgctcatagcctaacctca

SEQ ID NO: 81147 - DNA, 25 bp, Mus musculus
aatgcatgctgtatgtttttccaag

SEQ ID NO: 81148 - DNA, 25 bp, Mus musculus
aatgcatgctgtttgtttttccaag

SEQ ID NO: 81149 - DNA, 25 bp, Mus musculus
aatgcatgcttcctaatctgcttca

SEQ ID NO: 81150 - DNA, 25 bp, Mus musculus
aatgcatgcttcgtaatctgcttca

SEQ ID NO: 81151 - DNA, 25 bp, Mus musculus
aatgcatggcatatccttacagtca

SEQ ID NO: 81152 - DNA, 25 bp, Mus musculus
aatgcatggcatttccttacagtca

SEQ ID NO: 81153 - DNA, 25 bp, Mus musculus
aatgcatggctaattggactgagaa

SEQ ID NO: 81154 - DNA, 25 bp, Mus musculus
aatgcatggctatttggactgagaa

SEQ ID NO: 81155 - DNA, 25 bp, Mus musculus
aatgcatgggctccttgtgagtcca

SEQ ID NO: 81156 - DNA, 25 bp, Mus musculus
aatgcatgggctgcttgtgagtcca

SEQ ID NO: 81157 - DNA, 25 bp, Mus musculus
aatgcatggtagagctcagagccct

SEQ ID NO: 81158 - DNA, 25 bp, Mus musculus
aatgcatggtagtgctcagagccct

SEQ ID NO: 81159 - DNA, 25 bp, Mus musculus
aatgcatgtccgaggttgggtgcac

SEQ ID NO: 81160 - DNA, 25 bp, Mus musculus
aatgcatgtccgtggttgggtgcac

SEQ ID NO: 81161 - DNA, 25 bp, Mus musculus
aatgcatgtgataatagaactagaa

SEQ ID NO: 81162 - DNA, 25 bp, Mus musculus
aatgcatgtgatcaactctaactcc

SEQ ID NO: 81163 - DNA, 25 bp, Mus musculus
aatgcatgtgatgaactctaactcc

SEQ ID NO: 81164 - DNA, 25 bp, Mus musculus
aatgcatgtgattatagaactagaa

SEQ ID NO: 81165 - DNA, 25 bp, Mus musculus
aatgcatgtgcacatatgcagacaa

SEQ ID NO: 81166 - DNA, 25 bp, Mus musculus
aatgcatgtgcagatatgcagacaa

SEQ ID NO: 81167 - DNA, 25 bp, Mus musculus
aatgcatgtgcgatcattgaagtgt

SEQ ID NO: 81168 - DNA, 25 bp, Mus musculus
aatgcatgtgcgttcattgaagtgt

SEQ ID NO: 81169 - DNA, 25 bp, Mus musculus
aatgcatgtgctaccaatgtctaga

SEQ ID NO: 81170 - DNA, 25 bp, Mus musculus
aatgcatgtgcttccaatgtctaga

SEQ ID NO: 81171 - DNA, 25 bp, Mus musculus
aatgcatgtgtactgtgccagccct

SEQ ID NO: 81172 - DNA, 25 bp, Mus musculus
aatgcatgtgtagtgtgccagccct

SEQ ID NO: 81173 - DNA, 25 bp, Mus musculus
aatgcatgtgtgaacctaagagtgt

SEQ ID NO: 81174 - DNA, 25 bp, Mus musculus
aatgcatgtgtgacgttaagactag

SEQ ID NO: 81175 - DNA, 25 bp, Mus musculus
aatgcatgtgtgtacctaagagtgt

SEQ ID NO: 81176 - DNA, 25 bp, Mus musculus
aatgcatgtgtgtcgttaagactag

SEQ ID NO: 81177 - DNA, 25 bp, Mus musculus
aatgcatgttttagaaaattacctc

SEQ ID NO: 81178 - DNA, 25 bp, Mus musculus
aatgcatgtttttgaaaattacctc

SEQ ID NO: 81179 - DNA, 25 bp, Mus musculus
aatgcattacttaaccacaggctga

SEQ ID NO: 81180 - DNA, 25 bp, Mus musculus
aatgcattactttaccacaggctga

SEQ ID NO: 81181 - DNA, 25 bp, Mus musculus
aatgcattcaaaccgattccccact

SEQ ID NO: 81182 - DNA, 25 bp, Mus musculus
aatgcattcaaagcgattccccact

SEQ ID NO: 81183 - DNA, 25 bp, Mus musculus
aatgcattcagtatagcctcttatc

SEQ ID NO: 81184 - DNA, 25 bp, Mus musculus
aatgcattcagtttagcctcttatc

SEQ ID NO: 81185 - DNA, 25 bp, Mus musculus
aatgcattccctcatattttctcag

SEQ ID NO: 81186 - DNA, 25 bp, Mus musculus
aatgcattccctgatattttctcag

SEQ ID NO: 81187 - DNA, 25 bp, Mus musculus
aatgcattcctgatacttcttaata

SEQ ID NO: 81188 - DNA, 25 bp, Mus musculus
aatgcattcctgttacttcttaata

SEQ ID NO: 81189 - DNA, 25 bp, Mus musculus
aatgcattctgtcttgaactgccat

SEQ ID NO: 81190 - DNA, 25 bp, Mus musculus
aatgcattctgtgttgaactgccat

SEQ ID NO: 81191 - DNA, 25 bp, Mus musculus
aatgcattcttcaagactcccctaa

SEQ ID NO: 81192 - DNA, 25 bp, Mus musculus
aatgcattcttctagactcccctaa

SEQ ID NO: 81193 - DNA, 25 bp, Mus musculus
aatgcattgaaaagccgactcctcc

SEQ ID NO: 81194 - DNA, 25 bp, Mus musculus
aatgcattgaaaccttaccttacag

SEQ ID NO: 81195 - DNA, 25 bp, Mus musculus
aatgcattgaaagcttaccttacag

SEQ ID NO: 81196 - DNA, 25 bp, Mus musculus
aatgcattgaaatgccgactcctcc

SEQ ID NO: 81197 - DNA, 25 bp, Mus musculus
aatgcattgcaaacgtctgtcctac

SEQ ID NO: 81198 - DNA, 25 bp, Mus musculus
aatgcattgcaactcttaaccatag

SEQ ID NO: 81199 - DNA, 25 bp, Mus musculus
aatgcattgcaagtcttaaccatag

SEQ ID NO: 81200 - DNA, 25 bp, Mus musculus
aatgcattgcaatcgtctgtcctac

SEQ ID NO: 81201 - DNA, 25 bp, Mus musculus
aatgcattgcacatcacccactgtg

SEQ ID NO: 81202 - DNA, 25 bp, Mus musculus
aatgcattgcacttcacccactgtg

SEQ ID NO: 81203 - DNA, 25 bp, Mus musculus
aatgcattgcccatgttccagtaac

SEQ ID NO: 81204 - DNA, 25 bp, Mus musculus
aatgcattgcccttgttccagtaac

SEQ ID NO: 81205 - DNA, 25 bp, Mus musculus
aatgcattggaacctctggtgacgg

SEQ ID NO: 81206 - DNA, 25 bp, Mus musculus
aatgcattggaagctctggtgacgg

SEQ ID NO: 81207 - DNA, 25 bp, Mus musculus
aatgcattggctaggttggtagaaa

SEQ ID NO: 81208 - DNA, 25 bp, Mus musculus
aatgcattggcttggttggtagaaa

SEQ ID NO: 81209 - DNA, 25 bp, Mus musculus
aatgcattgttgctcttcacctaat

SEQ ID NO: 81210 - DNA, 25 bp, Mus musculus
aatgcattgttggtcttcacctaat

SEQ ID NO: 81211 - DNA, 25 bp, Mus musculus
aatgcattgtttaaagatatcagct

SEQ ID NO: 81212 - DNA, 25 bp, Mus musculus
aatgcattgttttaagatatcagct

SEQ ID NO: 81213 - DNA, 25 bp, Mus musculus
aatgcatttagccatgataactgtg

SEQ ID NO: 81214 - DNA, 25 bp, Mus musculus
aatgcatttagcgatgataactgtg

SEQ ID NO: 81215 - DNA, 25 bp, Mus musculus
aatgcatttatgctaagcttggaca

SEQ ID NO: 81216 - DNA, 25 bp, Mus musculus
aatgcatttatggtaagcttggaca

SEQ ID NO: 81217 - DNA, 25 bp, Mus musculus
aatgcatttattaagggccagtgta

SEQ ID NO: 81218 - DNA, 25 bp, Mus musculus
aatgcatttatttagggccagtgta

SEQ ID NO: 81219 - DNA, 25 bp, Mus musculus
aatgcatttccaaaggcacccctat

SEQ ID NO: 81220 - DNA, 25 bp, Mus musculus
aatgcatttccataggcacccctat

SEQ ID NO: 81221 - DNA, 25 bp, Mus musculus
aatgcatttgctattacatcatgag

SEQ ID NO: 81222 - DNA, 25 bp, Mus musculus
aatgcatttgcttttacatcatgag

SEQ ID NO: 81223 - DNA, 25 bp, Mus musculus
aatgccaaaatgagcctcggtgtca

SEQ ID NO: 81224 - DNA, 25 bp, Mus musculus
aatgccaaaatgtgcctcggtgtca

SEQ ID NO: 81225 - DNA, 25 bp, Mus musculus
aatgccaaacatagcctagatatag

SEQ ID NO: 81226 - DNA, 25 bp, Mus musculus
aatgccaaacattgcctagatatag

SEQ ID NO: 81227 - DNA, 25 bp, Mus musculus
aatgccaaacccaccattcattggt

SEQ ID NO: 81228 - DNA, 25 bp, Mus musculus
aatgccaaaccctccattcattggt

SEQ ID NO: 81229 - DNA, 25 bp, Mus musculus
aatgccaaagttaatctggttgctg

SEQ ID NO: 81230 - DNA, 25 bp, Mus musculus
aatgccaaagtttatctggttgctg

SEQ ID NO: 81231 - DNA, 25 bp, Mus musculus
aatgccaaatacacttcttgctctc

SEQ ID NO: 81232 - DNA, 25 bp, Mus musculus
aatgccaaatactcttcttgctctc

SEQ ID NO: 81233 - DNA, 25 bp, Mus musculus
aatgccaaatccaaactaagagcta

SEQ ID NO: 81234 - DNA, 25 bp, Mus musculus
aatgccaaatcctaactaagagcta

SEQ ID NO: 81235 - DNA, 25 bp, Mus musculus
aatgccaaatgtcaccaagtattag

SEQ ID NO: 81236 - DNA, 25 bp, Mus musculus
aatgccaaatgtgaccaagtattag

SEQ ID NO: 81237 - DNA, 25 bp, Mus musculus
aatgccaacagtcagggagttctcg

SEQ ID NO: 81238 - DNA, 25 bp, Mus musculus
aatgccaacagtgagggagttctcg

SEQ ID NO: 81239 - DNA, 25 bp, Mus musculus
aatgccaacatgcagcttgtaggct

SEQ ID NO: 81240 - DNA, 25 bp, Mus musculus
aatgccaacatggagcttgtaggct

SEQ ID NO: 81241 - DNA, 25 bp, Mus musculus
aatgccaacgcactaggtcccgtac

SEQ ID NO: 81242 - DNA, 25 bp, Mus musculus
aatgccaacgcagtaggtcccgtac

SEQ ID NO: 81243 - DNA, 25 bp, Mus musculus
aatgccaactgaaggccttgttttc

SEQ ID NO: 81244 - DNA, 25 bp, Mus musculus
aatgccaactgatggccttgttttc

SEQ ID NO: 81245 - DNA, 25 bp, Mus musculus
aatgccaactggatactgcctaacc

SEQ ID NO: 81246 - DNA, 25 bp, Mus musculus
aatgccaactggttactgcctaacc

SEQ ID NO: 81247 - DNA, 25 bp, Mus musculus
aatgccaagaatctcccaagctgag

SEQ ID NO: 81248 - DNA, 25 bp, Mus musculus
aatgccaagaatgtcccaagctgag

SEQ ID NO: 81249 - DNA, 25 bp, Mus musculus
aatgccaagagtccctagcctgcct

SEQ ID NO: 81250 - DNA, 25 bp, Mus musculus
aatgccaagagtgcctagcctgcct

SEQ ID NO: 81251 - DNA, 25 bp, Mus musculus
aatgccaaggaactgccatctatct

SEQ ID NO: 81252 - DNA, 25 bp, Mus musculus
aatgccaaggaagtgccatctatct

SEQ ID NO: 81253 - DNA, 25 bp, Mus musculus
aatgccaaggcgcaggctgagtccc

SEQ ID NO: 81254 - DNA, 25 bp, Mus musculus
aatgccaaggcggaggctgagtccc

SEQ ID NO: 81255 - DNA, 25 bp, Mus musculus
aatgccaaggctagccagactggac

SEQ ID NO: 81256 - DNA, 25 bp, Mus musculus
aatgccaaggcttgccagactggac

SEQ ID NO: 81257 - DNA, 25 bp, Mus musculus
aatgccaagtagagctgccaagccc

SEQ ID NO: 81258 - DNA, 25 bp, Mus musculus
aatgccaagtagtgctgccaagccc

SEQ ID NO: 81259 - DNA, 25 bp, Mus musculus
aatgccaatcacactggctacagag

SEQ ID NO: 81260 - DNA, 25 bp, Mus musculus
aatgccaatcactctggctacagag

SEQ ID NO: 81261 - DNA, 25 bp, Mus musculus
aatgccaattccagcagcatcagca

SEQ ID NO: 81262 - DNA, 25 bp, Mus musculus
aatgccaattcctgcagcatcagca

SEQ ID NO: 81263 - DNA, 25 bp, Mus musculus
aatgccacactgaatgtttctaaca

SEQ ID NO: 81264 - DNA, 25 bp, Mus musculus
aatgccacactgtatgtttctaaca

SEQ ID NO: 81265 - DNA, 25 bp, Mus musculus
aatgccacagcgacgaagattgagc

SEQ ID NO: 81266 - DNA, 25 bp, Mus musculus
aatgccacagcgtcgaagattgagc

SEQ ID NO: 81267 - DNA, 25 bp, Mus musculus
aatgccacaggaaggatgtcagcag

SEQ ID NO: 81268 - DNA, 25 bp, Mus musculus
aatgccacaggatggatgtcagcag

SEQ ID NO: 81269 - DNA, 25 bp, Mus musculus
aatgccacatgcatacaaggctaag

SEQ ID NO: 81270 - DNA, 25 bp, Mus musculus
aatgccacatgcttacaaggctaag

SEQ ID NO: 81271 - DNA, 25 bp, Mus musculus
aatgccaccaagctcctgcagaaga

SEQ ID NO: 81272 - DNA, 25 bp, Mus musculus
aatgccaccaaggtcctgcagaaga

SEQ ID NO: 81273 - DNA, 25 bp, Mus musculus
aatgccacccagcttgaaagttctt

SEQ ID NO: 81274 - DNA, 25 bp, Mus musculus
aatgccacccaggttgaaagttctt

SEQ ID NO: 81275 - DNA, 25 bp, Mus musculus
aatgccacctgtaatatcctagtcc

SEQ ID NO: 81276 - DNA, 25 bp, Mus musculus
aatgccacctgttatatcctagtcc

SEQ ID NO: 81277 - DNA, 25 bp, Mus musculus
aatgccacgcgcaagggaccacatc

SEQ ID NO: 81278 - DNA, 25 bp, Mus musculus
aatgccacgcgctagggaccacatc

SEQ ID NO: 81279 - DNA, 25 bp, Mus musculus
aatgccacgtggcactgaggttctt

SEQ ID NO: 81280 - DNA, 25 bp, Mus musculus
aatgccacgtgggactgaggttctt

SEQ ID NO: 81281 - DNA, 25 bp, Mus musculus
aatgccactataatcctgagtccgt

SEQ ID NO: 81282 - DNA, 25 bp, Mus musculus
aatgccactatattcctgagtccgt

SEQ ID NO: 81283 - DNA, 25 bp, Mus musculus
aatgccactgtaagcccacaccgtg

SEQ ID NO: 81284 - DNA, 25 bp, Mus musculus
aatgccactgtatgcccacaccgtg

SEQ ID NO: 81285 - DNA, 25 bp, Mus musculus
aatgccacttttactggaactcctc

SEQ ID NO: 81286 - DNA, 25 bp, Mus musculus
aatgccacttttccttgggtaatgc

SEQ ID NO: 81287 - DNA, 25 bp, Mus musculus
aatgccacttttgcttgggtaatgc

SEQ ID NO: 81288 - DNA, 25 bp, Mus musculus
aatgccactttttctggaactcctc

SEQ ID NO: 81289 - DNA, 25 bp, Mus musculus
aatgccagacatacactactgctaa

SEQ ID NO: 81290 - DNA, 25 bp, Mus musculus
aatgccagacattcactactgctaa

SEQ ID NO: 81291 - DNA, 25 bp, Mus musculus
aatgccagagccaaaacactttcag

SEQ ID NO: 81292 - DNA, 25 bp, Mus musculus
aatgccagagccaggttcgtgggaa

SEQ ID NO: 81293 - DNA, 25 bp, Mus musculus
aatgccagagcctaaacactttcag

SEQ ID NO: 81294 - DNA, 25 bp, Mus musculus
aatgccagagcctggttcgtgggaa

SEQ ID NO: 81295 - DNA, 25 bp, Mus musculus
aatgccagaggacagttcgggttct

SEQ ID NO: 81296 - DNA, 25 bp, Mus musculus
aatgccagaggagagttcgggttct

SEQ ID NO: 81297 - DNA, 25 bp, Mus musculus
aatgccagatgacaatgtacagact

SEQ ID NO: 81298 - DNA, 25 bp, Mus musculus
aatgccagatgagaatgtacagact

SEQ ID NO: 81299 - DNA, 25 bp, Mus musculus
aatgccagatggaatcctctgcggg

SEQ ID NO: 81300 - DNA, 25 bp, Mus musculus
aatgccagatggtatcctctgcggg

SEQ ID NO: 81301 - DNA, 25 bp, Mus musculus
aatgccagcactaagagtctgaagc

SEQ ID NO: 81302 - DNA, 25 bp, Mus musculus
aatgccagcacttagagtctgaagc

SEQ ID NO: 81303 - DNA, 25 bp, Mus musculus
aatgccagcattccattggtagagt

SEQ ID NO: 81304 - DNA, 25 bp, Mus musculus
aatgccagcattgcattggtagagt

SEQ ID NO: 81305 - DNA, 25 bp, Mus musculus
aatgccagccagcaacgatggctag

SEQ ID NO: 81306 - DNA, 25 bp, Mus musculus
aatgccagccaggaacgatggctag

SEQ ID NO: 81307 - DNA, 25 bp, Mus musculus
aatgccagctttagtagtcacttct

SEQ ID NO: 81308 - DNA, 25 bp, Mus musculus
aatgccagcttttgtagtcacttct

SEQ ID NO: 81309 - DNA, 25 bp, Mus musculus
aatgccaggagccaacagggagcct

SEQ ID NO: 81310 - DNA, 25 bp, Mus musculus
aatgccaggagcgaacagggagcct

SEQ ID NO: 81311 - DNA, 25 bp, Mus musculus
aatgccaggccactggtgtgcatgc

SEQ ID NO: 81312 - DNA, 25 bp, Mus musculus
aatgccaggccagtggtgtgcatgc

SEQ ID NO: 81313 - DNA, 25 bp, Mus musculus
aatgccaggccccaggctagtttgc

SEQ ID NO: 81314 - DNA, 25 bp, Mus musculus
aatgccaggcccgaggctagtttgc

SEQ ID NO: 81315 - DNA, 25 bp, Mus musculus
aatgccaggccgagaagcaaatagc

SEQ ID NO: 81316 - DNA, 25 bp, Mus musculus
aatgccaggccgtgaagcaaatagc

SEQ ID NO: 81317 - DNA, 25 bp, Mus musculus
aatgccagggctattcttgggttcc

SEQ ID NO: 81318 - DNA, 25 bp, Mus musculus
aatgccagggcttttcttgggttcc

SEQ ID NO: 81319 - DNA, 25 bp, Mus musculus
aatgccaggtttcctgtgcctccca

SEQ ID NO: 81320 - DNA, 25 bp, Mus musculus
aatgccaggtttgctgtgcctccca

SEQ ID NO: 81321 - DNA, 25 bp, Mus musculus
aatgccagtaagaccatttgggaaa

SEQ ID NO: 81322 - DNA, 25 bp, Mus musculus
aatgccagtaagtccatttgggaaa

SEQ ID NO: 81323 - DNA, 25 bp, Mus musculus
aatgccagtcacacagttctgggtc

SEQ ID NO: 81324 - DNA, 25 bp, Mus musculus
aatgccagtcactcagttctgggtc

SEQ ID NO: 81325 - DNA, 25 bp, Mus musculus
aatgccagtccacgaaaccgggctg

SEQ ID NO: 81326 - DNA, 25 bp, Mus musculus
aatgccagtccaggaaaccgggctg

SEQ ID NO: 81327 - DNA, 25 bp, Mus musculus
aatgccagttacacagactctgggc

SEQ ID NO: 81328 - DNA, 25 bp, Mus musculus
aatgccagttactcagactctgggc

SEQ ID NO: 81329 - DNA, 25 bp, Mus musculus
aatgccataatacaaaggctccttt

SEQ ID NO: 81330 - DNA, 25 bp, Mus musculus
aatgccataatagaaaggctccttt

SEQ ID NO: 81331 - DNA, 25 bp, Mus musculus
aatgccataatgacagttgtccttc

SEQ ID NO: 81332 - DNA, 25 bp, Mus musculus
aatgccataatgtcagttgtccttc

SEQ ID NO: 81333 - DNA, 25 bp, Mus musculus
aatgccatacctccttggctgatac

SEQ ID NO: 81334 - DNA, 25 bp, Mus musculus
aatgccatacctgcttggctgatac

SEQ ID NO: 81335 - DNA, 25 bp, Mus musculus
aatgccatagaacactagccccttg

SEQ ID NO: 81336 - DNA, 25 bp, Mus musculus
aatgccatagaagactagccccttg

SEQ ID NO: 81337 - DNA, 25 bp, Mus musculus
aatgccatcaccaattcctgtgaaa

SEQ ID NO: 81338 - DNA, 25 bp, Mus musculus
aatgccatcacctattcctgtgaaa

SEQ ID NO: 81339 - DNA, 25 bp, Mus musculus
aatgccatccttagactcaatattt

SEQ ID NO: 81340 - DNA, 25 bp, Mus musculus
aatgccatcctttgactcaatattt

SEQ ID NO: 81341 - DNA, 25 bp, Mus musculus
aatgccatctgcaccaacagcaagc

SEQ ID NO: 81342 - DNA, 25 bp, Mus musculus
aatgccatctgctccaacagcaagc

SEQ ID NO: 81343 - DNA, 25 bp, Mus musculus
aatgccatctggatctttgagctca

SEQ ID NO: 81344 - DNA, 25 bp, Mus musculus
aatgccatctggttctttgagctca

SEQ ID NO: 81345 - DNA, 25 bp, Mus musculus
aatgccatctttctagagtctttaa

SEQ ID NO: 81346 - DNA, 25 bp, Mus musculus
aatgccatctttgtagagtctttaa

SEQ ID NO: 81347 - DNA, 25 bp, Mus musculus
aatgccatgaatatcccctgcagga

SEQ ID NO: 81348 - DNA, 25 bp, Mus musculus
aatgccatgaatttcccctgcagga

SEQ ID NO: 81349 - DNA, 25 bp, Mus musculus
aatgccatgctgaaccagagtgtgg

SEQ ID NO: 81350 - DNA, 25 bp, Mus musculus
aatgccatgctgtaccagagtgtgg

SEQ ID NO: 81351 - DNA, 25 bp, Mus musculus
aatgccatgcttacaaaggtctata

SEQ ID NO: 81352 - DNA, 25 bp, Mus musculus
aatgccatgctttcaaaggtctata

SEQ ID NO: 81353 - DNA, 25 bp, Mus musculus
aatgccatgggcctctaaaagaatg

SEQ ID NO: 81354 - DNA, 25 bp, Mus musculus
aatgccatgggcgtctaaaagaatg

SEQ ID NO: 81355 - DNA, 25 bp, Mus musculus
aatgccatgggtaacatttctccag

SEQ ID NO: 81356 - DNA, 25 bp, Mus musculus
aatgccatgggttacatttctccag

SEQ ID NO: 81357 - DNA, 25 bp, Mus musculus
aatgccatgtgacgaccatctttca

SEQ ID NO: 81358 - DNA, 25 bp, Mus musculus
aatgccatgtgaggaccatctttca

SEQ ID NO: 81359 - DNA, 25 bp, Mus musculus
aatgccatgtgcaagggcagtctta

SEQ ID NO: 81360 - DNA, 25 bp, Mus musculus
aatgccatgtgctagggcagtctta

SEQ ID NO: 81361 - DNA, 25 bp, Mus musculus
aatgccatgtttcacttcagcgaga

SEQ ID NO: 81362 - DNA, 25 bp, Mus musculus
aatgccatgtttgacttcagcgaga

SEQ ID NO: 81363 - DNA, 25 bp, Mus musculus
aatgccattcttagtacactgttca

SEQ ID NO: 81364 - DNA, 25 bp, Mus musculus
aatgccattctttgtacactgttca

SEQ ID NO: 81365 - DNA, 25 bp, Mus musculus
aatgccattgtaagctggaaacctg

SEQ ID NO: 81366 - DNA, 25 bp, Mus musculus
aatgccattgtatgctggaaacctg

SEQ ID NO: 81367 - DNA, 25 bp, Mus musculus
aatgccattgttaaatatgaccgct

SEQ ID NO: 81368 - DNA, 25 bp, Mus musculus
aatgccattgtttaatatgaccgct

SEQ ID NO: 81369 - DNA, 25 bp, Mus musculus
aatgcccaactaatgtcccttgaat

SEQ ID NO: 81370 - DNA, 25 bp, Mus musculus
aatgcccaactattgtcccttgaat

SEQ ID NO: 81371 - DNA, 25 bp, Mus musculus
aatgcccaaggcactgatgagtagg

SEQ ID NO: 81372 - DNA, 25 bp, Mus musculus
aatgcccaaggctctgatgagtagg

SEQ ID NO: 81373 - DNA, 25 bp, Mus musculus
aatgcccacctgagggacttggatg

SEQ ID NO: 81374 - DNA, 25 bp, Mus musculus
aatgcccacctgtgggacttggatg

SEQ ID NO: 81375 - DNA, 25 bp, Mus musculus
aatgcccactggaattgcctgtatc

SEQ ID NO: 81376 - DNA, 25 bp, Mus musculus
aatgcccactggtattgcctgtatc

SEQ ID NO: 81377 - DNA, 25 bp, Mus musculus
aatgcccagaagatcctcagactag

SEQ ID NO: 81378 - DNA, 25 bp, Mus musculus
aatgcccagaagttcctcagactag

SEQ ID NO: 81379 - DNA, 25 bp, Mus musculus
aatgcccagacgaaatggtgatgca

SEQ ID NO: 81380 - DNA, 25 bp, Mus musculus
aatgcccagacgtaatggtgatgca

SEQ ID NO: 81381 - DNA, 25 bp, Mus musculus
aatgcccaggacatcaacgcatgca

SEQ ID NO: 81382 - DNA, 25 bp, Mus musculus
aatgcccaggacttcaacgcatgca

SEQ ID NO: 81383 - DNA, 25 bp, Mus musculus
aatgcccaggcacgaggactcttaa

SEQ ID NO: 81384 - DNA, 25 bp, Mus musculus
aatgcccaggcaggaggactcttaa

SEQ ID NO: 81385 - DNA, 25 bp, Mus musculus
aatgcccaggcccaaatgtaccgtc

SEQ ID NO: 81386 - DNA, 25 bp, Mus musculus
aatgcccaggccgaaatgtaccgtc

SEQ ID NO: 81387 - DNA, 25 bp, Mus musculus
aatgcccaggtgagggcacagtgct

SEQ ID NO: 81388 - DNA, 25 bp, Mus musculus
aatgcccaggtgtgggcacagtgct

SEQ ID NO: 81389 - DNA, 25 bp, Mus musculus
aatgcccagtgaatacgtccataga

SEQ ID NO: 81390 - DNA, 25 bp, Mus musculus
aatgcccagtgattacgtccataga

SEQ ID NO: 81391 - DNA, 25 bp, Mus musculus
aatgcccatcagaagctgttttcca

SEQ ID NO: 81392 - DNA, 25 bp, Mus musculus
aatgcccatcagtagctgttttcca

SEQ ID NO: 81393 - DNA, 25 bp, Mus musculus
aatgcccatttaaatcaacggaagc

SEQ ID NO: 81394 - DNA, 25 bp, Mus musculus
aatgcccatttatatcaacggaagc

SEQ ID NO: 81395 - DNA, 25 bp, Mus musculus
aatgccccacctaagtacagggtag

SEQ ID NO: 81396 - DNA, 25 bp, Mus musculus
aatgccccacctattatattagtag

SEQ ID NO: 81397 - DNA, 25 bp, Mus musculus
aatgccccaccttagtacagggtag

SEQ ID NO: 81398 - DNA, 25 bp, Mus musculus
aatgccccaccttttatattagtag

SEQ ID NO: 81399 - DNA, 25 bp, Mus musculus
aatgccccaggtatgagttaaatga

SEQ ID NO: 81400 - DNA, 25 bp, Mus musculus
aatgccccaggtttgagttaaatga

SEQ ID NO: 81401 - DNA, 25 bp, Mus musculus
aatgccccagtgattacagttagta

SEQ ID NO: 81402 - DNA, 25 bp, Mus musculus
aatgccccagtgtttacagttagta

SEQ ID NO: 81403 - DNA, 25 bp, Mus musculus
aatgccccatccaagtttgttcctt

SEQ ID NO: 81404 - DNA, 25 bp, Mus musculus
aatgccccatcctagtttgttcctt

SEQ ID NO: 81405 - DNA, 25 bp, Mus musculus
aatgccccatgaaactgtcctggta

SEQ ID NO: 81406 - DNA, 25 bp, Mus musculus
aatgccccatgatactgtcctggta

SEQ ID NO: 81407 - DNA, 25 bp, Mus musculus
aatgcccctaccaaacctatgacat

SEQ ID NO: 81408 - DNA, 25 bp, Mus musculus
aatgcccctacctaacctatgacat

SEQ ID NO: 81409 - DNA, 25 bp, Mus musculus
aatgcccctattatttgcacactgg

SEQ ID NO: 81410 - DNA, 25 bp, Mus musculus
aatgcccctattttttgcacactgg

SEQ ID NO: 81411 - DNA, 25 bp, Mus musculus
aatgcccctgggatgaagccactgt

SEQ ID NO: 81412 - DNA, 25 bp, Mus musculus
aatgcccctgggttgaagccactgt

SEQ ID NO: 81413 - DNA, 25 bp, Mus musculus
aatgccccttttatgctgctcagcc

SEQ ID NO: 81414 - DNA, 25 bp, Mus musculus
aatgccccttttttgctgctcagcc

SEQ ID NO: 81415 - DNA, 25 bp, Mus musculus
aatgcccgctgacaatgtggatcat

SEQ ID NO: 81416 - DNA, 25 bp, Mus musculus
aatgcccgctgagaatgtggatcat

SEQ ID NO: 81417 - DNA, 25 bp, Mus musculus
aatgcccgctgcagtgttttggcag

SEQ ID NO: 81418 - DNA, 25 bp, Mus musculus
aatgcccgctgctgtgttttggcag

SEQ ID NO: 81419 - DNA, 25 bp, Mus musculus
aatgcccgggctcgtatcgtagctg

SEQ ID NO: 81420 - DNA, 25 bp, Mus musculus
aatgcccgggctggtatcgtagctg

SEQ ID NO: 81421 - DNA, 25 bp, Mus musculus
aatgccctacaaagactctgctcag

SEQ ID NO: 81422 - DNA, 25 bp, Mus musculus
aatgccctacaatgactctgctcag

SEQ ID NO: 81423 - DNA, 25 bp, Mus musculus
aatgccctacagaaaaggacctcaa

SEQ ID NO: 81424 - DNA, 25 bp, Mus musculus
aatgccctacagtaaaggacctcaa

SEQ ID NO: 81425 - DNA, 25 bp, Mus musculus
aatgccctaggtatttctttctctc

SEQ ID NO: 81426 - DNA, 25 bp, Mus musculus
aatgccctaggtttttctttctctc

SEQ ID NO: 81427 - DNA, 25 bp, Mus musculus
aatgccctcagcatgtacgagagaa

SEQ ID NO: 81428 - DNA, 25 bp, Mus musculus
aatgccctcagcttgtacgagagaa

SEQ ID NO: 81429 - DNA, 25 bp, Mus musculus
aatgccctcagtcctaaagtggtat

SEQ ID NO: 81430 - DNA, 25 bp, Mus musculus
aatgccctcagtgctaaagtggtat

SEQ ID NO: 81431 - DNA, 25 bp, Mus musculus
aatgccctcataccatctctgcaaa

SEQ ID NO: 81432 - DNA, 25 bp, Mus musculus
aatgccctcatagcatctctgcaaa

SEQ ID NO: 81433 - DNA, 25 bp, Mus musculus
aatgccctcattatatatgcccttc

SEQ ID NO: 81434 - DNA, 25 bp, Mus musculus
aatgccctcattttatatgcccttc

SEQ ID NO: 81435 - DNA, 25 bp, Mus musculus
aatgccctccagctggtgtggtaga

SEQ ID NO: 81436 - DNA, 25 bp, Mus musculus
aatgccctccaggtggtgtggtaga

SEQ ID NO: 81437 - DNA, 25 bp, Mus musculus
aatgccctcggcacagtgtcaacag

SEQ ID NO: 81438 - DNA, 25 bp, Mus musculus
aatgccctcggctcagtgtcaacag

SEQ ID NO: 81439 - DNA, 25 bp, Mus musculus
aatgccctctggacttgatcctgag

SEQ ID NO: 81440 - DNA, 25 bp, Mus musculus
aatgccctctggtcttgatcctgag

SEQ ID NO: 81441 - DNA, 25 bp, Mus musculus
aatgccctctgtaccttgaggctca

SEQ ID NO: 81442 - DNA, 25 bp, Mus musculus
aatgccctctgttccttgaggctca

SEQ ID NO: 81443 - DNA, 25 bp, Mus musculus
aatgccctcttacatgattcctcag

SEQ ID NO: 81444 - DNA, 25 bp, Mus musculus
aatgccctcttagatgattcctcag

SEQ ID NO: 81445 - DNA, 25 bp, Mus musculus
aatgccctctttaccctagtgttag

SEQ ID NO: 81446 - DNA, 25 bp, Mus musculus
aatgccctcttttccctagtgttag

SEQ ID NO: 81447 - DNA, 25 bp, Mus musculus
aatgccctgacaagattttaaatag

SEQ ID NO: 81448 - DNA, 25 bp, Mus musculus
aatgccctgacatgattttaaatag

SEQ ID NO: 81449 - DNA, 25 bp, Mus musculus
aatgccctgagcattcatgtgactg

SEQ ID NO: 81450 - DNA, 25 bp, Mus musculus
aatgccctgagctttcatgtgactg

SEQ ID NO: 81451 - DNA, 25 bp, Mus musculus
aatgccctgatgaggaaaatccaaa

SEQ ID NO: 81452 - DNA, 25 bp, Mus musculus
aatgccctgatgtggaaaatccaaa

SEQ ID NO: 81453 - DNA, 25 bp, Mus musculus
aatgccctgggcaattaggaacaaa

SEQ ID NO: 81454 - DNA, 25 bp, Mus musculus
aatgccctgggctattaggaacaaa

SEQ ID NO: 81455 - DNA, 25 bp, Mus musculus
aatgccctggtaattttgttggaag

SEQ ID NO: 81456 - DNA, 25 bp, Mus musculus
aatgccctggtatttttgttggaag

SEQ ID NO: 81457 - DNA, 25 bp, Mus musculus
aatgccctgtctatacactgatgct

SEQ ID NO: 81458 - DNA, 25 bp, Mus musculus
aatgccctgtctttacactgatgct

SEQ ID NO: 81459 - DNA, 25 bp, Mus musculus
aatgcccttattcgcttgctggtta

SEQ ID NO: 81460 - DNA, 25 bp, Mus musculus
aatgcccttattggcttgctggtta

SEQ ID NO: 81461 - DNA, 25 bp, Mus musculus
aatgcccttctacgcaacaggtgcc

SEQ ID NO: 81462 - DNA, 25 bp, Mus musculus
aatgcccttctaggcaacaggtgcc

SEQ ID NO: 81463 - DNA, 25 bp, Mus musculus
aatgcccttgacagagaagcctggc

SEQ ID NO: 81464 - DNA, 25 bp, Mus musculus
aatgcccttgacagctggtggtctc

SEQ ID NO: 81465 - DNA, 25 bp, Mus musculus
aatgcccttgactgagaagcctggc

SEQ ID NO: 81466 - DNA, 25 bp, Mus musculus
aatgcccttgactgctggtggtctc

SEQ ID NO: 81467 - DNA, 25 bp, Mus musculus
aatgcccttgagatgatcctgcaga

SEQ ID NO: 81468 - DNA, 25 bp, Mus musculus
aatgcccttgagttgatcctgcaga

SEQ ID NO: 81469 - DNA, 25 bp, Mus musculus
aatgcccttgatctggtttcttaca

SEQ ID NO: 81470 - DNA, 25 bp, Mus musculus
aatgcccttgatgtggtttcttaca

SEQ ID NO: 81471 - DNA, 25 bp, Mus musculus
aatgcccttgcaacgttgtaatgag

SEQ ID NO: 81472 - DNA, 25 bp, Mus musculus
aatgcccttgcatcgttgtaatgag

SEQ ID NO: 81473 - DNA, 25 bp, Mus musculus
aatgcccttggactgggcagctgat

SEQ ID NO: 81474 - DNA, 25 bp, Mus musculus
aatgcccttggagtgggcagctgat

SEQ ID NO: 81475 - DNA, 25 bp, Mus musculus
aatgccctttggcttcaaatgcctc

SEQ ID NO: 81476 - DNA, 25 bp, Mus musculus
aatgccctttgggttcaaatgcctc

SEQ ID NO: 81477 - DNA, 25 bp, Mus musculus
aatgccgaactacccaatcgtatgt

SEQ ID NO: 81478 - DNA, 25 bp, Mus musculus
aatgccgaactagccaatcgtatgt

SEQ ID NO: 81479 - DNA, 25 bp, Mus musculus
aatgccgaagagagcgctgcagccc

SEQ ID NO: 81480 - DNA, 25 bp, Mus musculus
aatgccgaagagtgcgctgcagccc

SEQ ID NO: 81481 - DNA, 25 bp, Mus musculus
aatgccgaatcactcttagataatc

SEQ ID NO: 81482 - DNA, 25 bp, Mus musculus
aatgccgaatcagtcttagataatc

SEQ ID NO: 81483 - DNA, 25 bp, Mus musculus
aatgccgacagcatcagtgctcaga

SEQ ID NO: 81484 - DNA, 25 bp, Mus musculus
aatgccgacagcttcagtgctcaga

SEQ ID NO: 81485 - DNA, 25 bp, Mus musculus
aatgccgagataaatggagagccct

SEQ ID NO: 81486 - DNA, 25 bp, Mus musculus
aatgccgagatatatggagagccct

SEQ ID NO: 81487 - DNA, 25 bp, Mus musculus
aatgccgaggaacttcagggagatc

SEQ ID NO: 81488 - DNA, 25 bp, Mus musculus
aatgccgaggaagttcagggagatc

SEQ ID NO: 81489 - DNA, 25 bp, Mus musculus
aatgccgatcagaaacgaggttgac

SEQ ID NO: 81490 - DNA, 25 bp, Mus musculus
aatgccgatcagtaacgaggttgac

SEQ ID NO: 81491 - DNA, 25 bp, Mus musculus
aatgccgccaacactgaactcacgt

SEQ ID NO: 81492 - DNA, 25 bp, Mus musculus
aatgccgccaactctgaactcacgt

SEQ ID NO: 81493 - DNA, 25 bp, Mus musculus
aatgccgccatcataatgaaagtgg

SEQ ID NO: 81494 - DNA, 25 bp, Mus musculus
aatgccgccatcttaatgaaagtgg

SEQ ID NO: 81495 - DNA, 25 bp, Mus musculus
aatgccgctccaactctgaatccta

SEQ ID NO: 81496 - DNA, 25 bp, Mus musculus
aatgccgctccatctctgaatccta

SEQ ID NO: 81497 - DNA, 25 bp, Mus musculus
aatgccggcaccagagagtggtgga

SEQ ID NO: 81498 - DNA, 25 bp, Mus musculus
aatgccggcacctgagagtggtgga

SEQ ID NO: 81499 - DNA, 25 bp, Mus musculus
aatgccgggcccaagtccatggagg

SEQ ID NO: 81500 - DNA, 25 bp, Mus musculus
aatgccgggccccactttgaagcta

SEQ ID NO: 81501 - DNA, 25 bp, Mus musculus
aatgccgggcccgactttgaagcta

SEQ ID NO: 81502 - DNA, 25 bp, Mus musculus
aatgccgggccctagtccatggagg

SEQ ID NO: 81503 - DNA, 25 bp, Mus musculus
aatgccggtgcaagaaacttatgtc

SEQ ID NO: 81504 - DNA, 25 bp, Mus musculus
aatgccggtgcatgaaacttatgtc

SEQ ID NO: 81505 - DNA, 25 bp, Mus musculus
aatgccgtacgcctgcaagctgttg

SEQ ID NO: 81506 - DNA, 25 bp, Mus musculus
aatgccgtacgcgtgcaagctgttg

SEQ ID NO: 81507 - DNA, 25 bp, Mus musculus
aatgccgtactgactgggagtgccc

SEQ ID NO: 81508 - DNA, 25 bp, Mus musculus
aatgccgtactgtctgggagtgccc

SEQ ID NO: 81509 - DNA, 25 bp, Mus musculus
aatgccgtagccatgggtgtctcac

SEQ ID NO: 81510 - DNA, 25 bp, Mus musculus
aatgccgtagccttgggtgtctcac

SEQ ID NO: 81511 - DNA, 25 bp, Mus musculus
aatgccgtgagtcaagctgtggtca

SEQ ID NO: 81512 - DNA, 25 bp, Mus musculus
aatgccgtgagtgaagctgtggtca

SEQ ID NO: 81513 - DNA, 25 bp, Mus musculus
aatgccgtgcgcatggacgaggcta

SEQ ID NO: 81514 - DNA, 25 bp, Mus musculus
aatgccgtgcgcttggacgaggcta

SEQ ID NO: 81515 - DNA, 25 bp, Mus musculus
aatgccgtggccactttggactttt

SEQ ID NO: 81516 - DNA, 25 bp, Mus musculus
aatgccgtggcctctttggactttt

SEQ ID NO: 81517 - DNA, 25 bp, Mus musculus
aatgccgtggtcatagtacccagtg

SEQ ID NO: 81518 - DNA, 25 bp, Mus musculus
aatgccgtggtcttagtacccagtg

SEQ ID NO: 81519 - DNA, 25 bp, Mus musculus
aatgccgtgtttcttggctcagaaa

SEQ ID NO: 81520 - DNA, 25 bp, Mus musculus
aatgccgtgtttgttggctcagaaa

SEQ ID NO: 81521 - DNA, 25 bp, Mus musculus
aatgccgtttagcaacatgttcata

SEQ ID NO: 81522 - DNA, 25 bp, Mus musculus
aatgccgtttaggaacatgttcata

SEQ ID NO: 81523 - DNA, 25 bp, Mus musculus
aatgcctaaatgaggtgttgtgaaa

SEQ ID NO: 81524 - DNA, 25 bp, Mus musculus
aatgcctaaatgtggtgttgtgaaa

SEQ ID NO: 81525 - DNA, 25 bp, Mus musculus
aatgcctaactcatgacacctggat

SEQ ID NO: 81526 - DNA, 25 bp, Mus musculus
aatgcctaactcttgacacctggat

SEQ ID NO: 81527 - DNA, 25 bp, Mus musculus
aatgcctaataaccacccactatgt

SEQ ID NO: 81528 - DNA, 25 bp, Mus musculus
aatgcctaataagcacccactatgt

SEQ ID NO: 81529 - DNA, 25 bp, Mus musculus
aatgcctacactcgagtcgtgctac

SEQ ID NO: 81530 - DNA, 25 bp, Mus musculus
aatgcctacactggagtcgtgctac

SEQ ID NO: 81531 - DNA, 25 bp, Mus musculus
aatgcctacctccagggactcagac

SEQ ID NO: 81532 - DNA, 25 bp, Mus musculus
aatgcctacctcgagggactcagac

SEQ ID NO: 81533 - DNA, 25 bp, Mus musculus
aatgcctaccttacgatgtttcaag

SEQ ID NO: 81534 - DNA, 25 bp, Mus musculus
aatgcctacctttcgatgtttcaag

SEQ ID NO: 81535 - DNA, 25 bp, Mus musculus
aatgcctacgccatggctggcagaa

SEQ ID NO: 81536 - DNA, 25 bp, Mus musculus
aatgcctacgccttggctggcagaa

SEQ ID NO: 81537 - DNA, 25 bp, Mus musculus
aatgcctaggtcactcttatatctg

SEQ ID NO: 81538 - DNA, 25 bp, Mus musculus
aatgcctaggtctctcttatatctg

SEQ ID NO: 81539 - DNA, 25 bp, Mus musculus
aatgcctaggttctggctattttta

SEQ ID NO: 81540 - DNA, 25 bp, Mus musculus
aatgcctaggttgtggctattttta

SEQ ID NO: 81541 - DNA, 25 bp, Mus musculus
aatgcctatgatctgctgtcgtctg

SEQ ID NO: 81542 - DNA, 25 bp, Mus musculus
aatgcctatgatgtgctgtcgtctg

SEQ ID NO: 81543 - DNA, 25 bp, Mus musculus
aatgcctatggcatcctaaattact

SEQ ID NO: 81544 - DNA, 25 bp, Mus musculus
aatgcctatggcttcctaaattact

SEQ ID NO: 81545 - DNA, 25 bp, Mus musculus
aatgcctatttcactgtgacggaca

SEQ ID NO: 81546 - DNA, 25 bp, Mus musculus
aatgcctatttctctgtgacggaca

SEQ ID NO: 81547 - DNA, 25 bp, Mus musculus
aatgcctattttacttgtatcgatg

SEQ ID NO: 81548 - DNA, 25 bp, Mus musculus
aatgcctatttttcttgtatcgatg

SEQ ID NO: 81549 - DNA, 25 bp, Mus musculus
aatgcctcaccccactgaaggatat

SEQ ID NO: 81550 - DNA, 25 bp, Mus musculus
aatgcctcacccgactgaaggatat

SEQ ID NO: 81551 - DNA, 25 bp, Mus musculus
aatgcctcaggccagggaactggaa

SEQ ID NO: 81552 - DNA, 25 bp, Mus musculus
aatgcctcaggcgagggaactggaa

SEQ ID NO: 81553 - DNA, 25 bp, Mus musculus
aatgcctcatacactcgtctatgtg

SEQ ID NO: 81554 - DNA, 25 bp, Mus musculus
aatgcctcatacctgcaaagcacac

SEQ ID NO: 81555 - DNA, 25 bp, Mus musculus
aatgcctcatacgtgcaaagcacac

SEQ ID NO: 81556 - DNA, 25 bp, Mus musculus
aatgcctcatactctcgtctatgtg

SEQ ID NO: 81557 - DNA, 25 bp, Mus musculus
aatgcctcgtgccttgctagcatca

SEQ ID NO: 81558 - DNA, 25 bp, Mus musculus
aatgcctcgtgcgttgctagcatca

SEQ ID NO: 81559 - DNA, 25 bp, Mus musculus
aatgcctcgtttcgactggactact

SEQ ID NO: 81560 - DNA, 25 bp, Mus musculus
aatgcctcgtttggactggactact

SEQ ID NO: 81561 - DNA, 25 bp, Mus musculus
aatgcctctaaccttgtccaagaat

SEQ ID NO: 81562 - DNA, 25 bp, Mus musculus
aatgcctctaacgttgtccaagaat

SEQ ID NO: 81563 - DNA, 25 bp, Mus musculus
aatgcctctctcattctgatctgtt

SEQ ID NO: 81564 - DNA, 25 bp, Mus musculus
aatgcctctctctttctgatctgtt

SEQ ID NO: 81565 - DNA, 25 bp, Mus musculus
aatgcctctgcgcagttgtgggata

SEQ ID NO: 81566 - DNA, 25 bp, Mus musculus
aatgcctctgcggagttgtgggata

SEQ ID NO: 81567 - DNA, 25 bp, Mus musculus
aatgcctcttatctacattagtaag

SEQ ID NO: 81568 - DNA, 25 bp, Mus musculus
aatgcctcttatgtacattagtaag

SEQ ID NO: 81569 - DNA, 25 bp, Mus musculus
aatgcctcttgacctgttaaacaga

SEQ ID NO: 81570 - DNA, 25 bp, Mus musculus
aatgcctcttgagctgttaaacaga

SEQ ID NO: 81571 - DNA, 25 bp, Mus musculus
aatgcctgaaatcaagtgcctccca

SEQ ID NO: 81572 - DNA, 25 bp, Mus musculus
aatgcctgaaatgaagtgcctccca

SEQ ID NO: 81573 - DNA, 25 bp, Mus musculus
aatgcctgaacaccctacagttgta

SEQ ID NO: 81574 - DNA, 25 bp, Mus musculus
aatgcctgaacagcctacagttgta

SEQ ID NO: 81575 - DNA, 25 bp, Mus musculus
aatgcctgaagcaaatccgataaac

SEQ ID NO: 81576 - DNA, 25 bp, Mus musculus
aatgcctgaagctaatccgataaac

SEQ ID NO: 81577 - DNA, 25 bp, Mus musculus
aatgcctgaataacacattgtccca

SEQ ID NO: 81578 - DNA, 25 bp, Mus musculus
aatgcctgaatatcacattgtccca

SEQ ID NO: 81579 - DNA, 25 bp, Mus musculus
aatgcctgacagcatcgaacggtca

SEQ ID NO: 81580 - DNA, 25 bp, Mus musculus
aatgcctgacaggatcgaacggtca

SEQ ID NO: 81581 - DNA, 25 bp, Mus musculus
aatgcctgacatacaacaattgtgg

SEQ ID NO: 81582 - DNA, 25 bp, Mus musculus
aatgcctgacattcaacaattgtgg

SEQ ID NO: 81583 - DNA, 25 bp, Mus musculus
aatgcctgatagatgtccagacaga

SEQ ID NO: 81584 - DNA, 25 bp, Mus musculus
aatgcctgatagttgtccagacaga

SEQ ID NO: 81585 - DNA, 25 bp, Mus musculus
aatgcctgcaatatacttacctacc

SEQ ID NO: 81586 - DNA, 25 bp, Mus musculus
aatgcctgcaatttacttacctacc

SEQ ID NO: 81587 - DNA, 25 bp, Mus musculus
aatgcctgcctaatatgctatactg

SEQ ID NO: 81588 - DNA, 25 bp, Mus musculus
aatgcctgcctattatgctatactg

SEQ ID NO: 81589 - DNA, 25 bp, Mus musculus
aatgcctgcctcaacaagctgctac

SEQ ID NO: 81590 - DNA, 25 bp, Mus musculus
aatgcctgcctctacaagctgctac

SEQ ID NO: 81591 - DNA, 25 bp, Mus musculus
aatgcctgcctgataaatttccact

SEQ ID NO: 81592 - DNA, 25 bp, Mus musculus
aatgcctgcctgcaaatttcaggtg

SEQ ID NO: 81593 - DNA, 25 bp, Mus musculus
aatgcctgcctggaaatttcaggtg

SEQ ID NO: 81594 - DNA, 25 bp, Mus musculus
aatgcctgcctgttaaatttccact

SEQ ID NO: 81595 - DNA, 25 bp, Mus musculus
aatgcctggaaacagaacttgaaca

SEQ ID NO: 81596 - DNA, 25 bp, Mus musculus
aatgcctggaaagagaacttgaaca

SEQ ID NO: 81597 - DNA, 25 bp, Mus musculus
aatgcctggaccattagcaaccatg

SEQ ID NO: 81598 - DNA, 25 bp, Mus musculus
aatgcctggacctttagcaaccatg

SEQ ID NO: 81599 - DNA, 25 bp, Mus musculus
aatgcctggcagctagctctgttcc

SEQ ID NO: 81600 - DNA, 25 bp, Mus musculus
aatgcctggcaggtagctctgttcc

SEQ ID NO: 81601 - DNA, 25 bp, Mus musculus
aatgcctggcggacaccatatggag

SEQ ID NO: 81602 - DNA, 25 bp, Mus musculus
aatgcctggcggtcaccatatggag

SEQ ID NO: 81603 - DNA, 25 bp, Mus musculus
aatgcctggctgaggcaatttgtat

SEQ ID NO: 81604 - DNA, 25 bp, Mus musculus
aatgcctggctgtggcaatttgtat

SEQ ID NO: 81605 - DNA, 25 bp, Mus musculus
aatgcctgggacagtattgccacct

SEQ ID NO: 81606 - DNA, 25 bp, Mus musculus
aatgcctgggactgtattgccacct

SEQ ID NO: 81607 - DNA, 25 bp, Mus musculus
aatgcctggtgaccgacagccctga

SEQ ID NO: 81608 - DNA, 25 bp, Mus musculus
aatgcctggtgagcgacagccctga

SEQ ID NO: 81609 - DNA, 25 bp, Mus musculus
aatgcctgtacccactgcggcaaga

SEQ ID NO: 81610 - DNA, 25 bp, Mus musculus
aatgcctgtaccgactgcggcaaga

SEQ ID NO: 81611 - DNA, 25 bp, Mus musculus
aatgcctgtacgacaaggagcgtgt

SEQ ID NO: 81612 - DNA, 25 bp, Mus musculus
aatgcctgtacgtcaaggagcgtgt

SEQ ID NO: 81613 - DNA, 25 bp, Mus musculus
aatgcctgtcatactatggtcttga

SEQ ID NO: 81614 - DNA, 25 bp, Mus musculus
aatgcctgtcattctatggtcttga

SEQ ID NO: 81615 - DNA, 25 bp, Mus musculus
aatgcctgtgacaagcccattggac

SEQ ID NO: 81616 - DNA, 25 bp, Mus musculus
aatgcctgtgacatcatggtcttac

SEQ ID NO: 81617 - DNA, 25 bp, Mus musculus
aatgcctgtgaccatgcaaagtaca

SEQ ID NO: 81618 - DNA, 25 bp, Mus musculus
aatgcctgtgacgatgcaaagtaca

SEQ ID NO: 81619 - DNA, 25 bp, Mus musculus
aatgcctgtgactagcccattggac

SEQ ID NO: 81620 - DNA, 25 bp, Mus musculus
aatgcctgtgacttcatggtcttac

SEQ ID NO: 81621 - DNA, 25 bp, Mus musculus
aatgcctgtgtcagatctactgtaa

SEQ ID NO: 81622 - DNA, 25 bp, Mus musculus
aatgcctgtgtctgatctactgtaa

SEQ ID NO: 81623 - DNA, 25 bp, Mus musculus
aatgcctgtgtgagctgagctcagc

SEQ ID NO: 81624 - DNA, 25 bp, Mus musculus
aatgcctgtgtgtgctgagctcagc

SEQ ID NO: 81625 - DNA, 25 bp, Mus musculus
aatgccttaaacctcaattgcaagt

SEQ ID NO: 81626 - DNA, 25 bp, Mus musculus
aatgccttaaacgtcaattgcaagt

SEQ ID NO: 81627 - DNA, 25 bp, Mus musculus
aatgccttaatgctaccttagttag

SEQ ID NO: 81628 - DNA, 25 bp, Mus musculus
aatgccttaatggtaccttagttag

SEQ ID NO: 81629 - DNA, 25 bp, Mus musculus
aatgccttacagaggtatgacaggt

SEQ ID NO: 81630 - DNA, 25 bp, Mus musculus
aatgccttacagtggtatgacaggt

SEQ ID NO: 81631 - DNA, 25 bp, Mus musculus
aatgccttagaaagtaaactgctat

SEQ ID NO: 81632 - DNA, 25 bp, Mus musculus
aatgccttagaatgtaaactgctat

SEQ ID NO: 81633 - DNA, 25 bp, Mus musculus
aatgccttagagcagaccgggccag

SEQ ID NO: 81634 - DNA, 25 bp, Mus musculus
aatgccttagaggagaccgggccag

SEQ ID NO: 81635 - DNA, 25 bp, Mus musculus
aatgccttagctatggagttttctc

SEQ ID NO: 81636 - DNA, 25 bp, Mus musculus
aatgccttagctttggagttttctc

SEQ ID NO: 81637 - DNA, 25 bp, Mus musculus
aatgccttaggccttagagctatgc

SEQ ID NO: 81638 - DNA, 25 bp, Mus musculus
aatgccttaggcgttagagctatgc

SEQ ID NO: 81639 - DNA, 25 bp, Mus musculus
aatgccttaggtcctgcaaggcctt

SEQ ID NO: 81640 - DNA, 25 bp, Mus musculus
aatgccttaggtgctgcaaggcctt

SEQ ID NO: 81641 - DNA, 25 bp, Mus musculus
aatgccttcacgagcaagtagtttc

SEQ ID NO: 81642 - DNA, 25 bp, Mus musculus
aatgccttcacgtgcaagtagtttc

SEQ ID NO: 81643 - DNA, 25 bp, Mus musculus
aatgccttcatacgactgtcgcacc

SEQ ID NO: 81644 - DNA, 25 bp, Mus musculus
aatgccttcataggactgtcgcacc

SEQ ID NO: 81645 - DNA, 25 bp, Mus musculus
aatgccttctccagtgttttagatg

SEQ ID NO: 81646 - DNA, 25 bp, Mus musculus
aatgccttctcctgtgttttagatg

SEQ ID NO: 81647 - DNA, 25 bp, Mus musculus
aatgccttctgtcgtagctctgagt

SEQ ID NO: 81648 - DNA, 25 bp, Mus musculus
aatgccttctgtcgtctcagatcag

SEQ ID NO: 81649 - DNA, 25 bp, Mus musculus
aatgccttctgtggtagctctgagt

SEQ ID NO: 81650 - DNA, 25 bp, Mus musculus
aatgccttctgtggtctcagatcag

SEQ ID NO: 81651 - DNA, 25 bp, Mus musculus
aatgccttgacccttgaatacagtt

SEQ ID NO: 81652 - DNA, 25 bp, Mus musculus
aatgccttgaccgttgaatacagtt

SEQ ID NO: 81653 - DNA, 25 bp, Mus musculus
aatgccttgactatgctacagaaat

SEQ ID NO: 81654 - DNA, 25 bp, Mus musculus
aatgccttgactttgctacagaaat

SEQ ID NO: 81655 - DNA, 25 bp, Mus musculus
aatgccttgcatacacaaaacacgg

SEQ ID NO: 81656 - DNA, 25 bp, Mus musculus
aatgccttgcattcacaaaacacgg

SEQ ID NO: 81657 - DNA, 25 bp, Mus musculus
aatgccttggaaacaaacattattc

SEQ ID NO: 81658 - DNA, 25 bp, Mus musculus
aatgccttggaatcaaacattattc

SEQ ID NO: 81659 - DNA, 25 bp, Mus musculus
aatgccttggttactgtagtgctac

SEQ ID NO: 81660 - DNA, 25 bp, Mus musculus
aatgccttggtttctgtagtgctac

SEQ ID NO: 81661 - DNA, 25 bp, Mus musculus
aatgccttgtcaacctggcactagt

SEQ ID NO: 81662 - DNA, 25 bp, Mus musculus
aatgccttgtcatcctggcactagt

SEQ ID NO: 81663 - DNA, 25 bp, Mus musculus
aatgccttgtttcctttactgttgt

SEQ ID NO: 81664 - DNA, 25 bp, Mus musculus
aatgccttgtttgctttactgttgt

SEQ ID NO: 81665 - DNA, 25 bp, Mus musculus
aatgcctttaacacttgcatctgtc

SEQ ID NO: 81666 - DNA, 25 bp, Mus musculus
aatgcctttaactcttgcatctgtc

SEQ ID NO: 81667 - DNA, 25 bp, Mus musculus
aatgcctttaagactgagctacctg

SEQ ID NO: 81668 - DNA, 25 bp, Mus musculus
aatgcctttaagcacatgtttttaa

SEQ ID NO: 81669 - DNA, 25 bp, Mus musculus
aatgcctttaaggacatgtttttaa

SEQ ID NO: 81670 - DNA, 25 bp, Mus musculus
aatgcctttaagtctgagctacctg

SEQ ID NO: 81671 - DNA, 25 bp, Mus musculus
aatgcctttagtcagagttcccaac

SEQ ID NO: 81672 - DNA, 25 bp, Mus musculus
aatgcctttagtgagagttcccaac

SEQ ID NO: 81673 - DNA, 25 bp, Mus musculus
aatgcctttcagatccgttctggaa

SEQ ID NO: 81674 - DNA, 25 bp, Mus musculus
aatgcctttcagttccgttctggaa

SEQ ID NO: 81675 - DNA, 25 bp, Mus musculus
aatgcctttgagaagcccaggtccc

SEQ ID NO: 81676 - DNA, 25 bp, Mus musculus
aatgcctttgagacagtttcttagc

SEQ ID NO: 81677 - DNA, 25 bp, Mus musculus
aatgcctttgagagccattttctct

SEQ ID NO: 81678 - DNA, 25 bp, Mus musculus
aatgcctttgagtagcccaggtccc

SEQ ID NO: 81679 - DNA, 25 bp, Mus musculus
aatgcctttgagtcagtttcttagc

SEQ ID NO: 81680 - DNA, 25 bp, Mus musculus
aatgcctttgagtgccattttctct

SEQ ID NO: 81681 - DNA, 25 bp, Mus musculus
aatgcctttgtaattggtggcagca

SEQ ID NO: 81682 - DNA, 25 bp, Mus musculus
aatgcctttgtatttggtggcagca

SEQ ID NO: 81683 - DNA, 25 bp, Mus musculus
aatgccttttctcggacactccatc

SEQ ID NO: 81684 - DNA, 25 bp, Mus musculus
aatgccttttctgggacactccatc

SEQ ID NO: 81685 - DNA, 25 bp, Mus musculus
aatgcctttttgaagccaataatct

SEQ ID NO: 81686 - DNA, 25 bp, Mus musculus
aatgcctttttgtagccaataatct

SEQ ID NO: 81687 - DNA, 25 bp, Mus musculus
aatgcgaacttactggctcttggga

SEQ ID NO: 81688 - DNA, 25 bp, Mus musculus
aatgcgaacttagtggctcttggga

SEQ ID NO: 81689 - DNA, 25 bp, Mus musculus
aatgcgaagcctccagtttctaggg

SEQ ID NO: 81690 - DNA, 25 bp, Mus musculus
aatgcgaagcctgcagtttctaggg

SEQ ID NO: 81691 - DNA, 25 bp, Mus musculus
aatgcgaatgctaggaagaagctct

SEQ ID NO: 81692 - DNA, 25 bp, Mus musculus
aatgcgaatgcttggaagaagctct

SEQ ID NO: 81693 - DNA, 25 bp, Mus musculus
aatgcgacggtaccacgaacctgac

SEQ ID NO: 81694 - DNA, 25 bp, Mus musculus
aatgcgacggtagcacgaacctgac

SEQ ID NO: 81695 - DNA, 25 bp, Mus musculus
aatgcgactcacaggtctgtaggga

SEQ ID NO: 81696 - DNA, 25 bp, Mus musculus
aatgcgactcactggtctgtaggga

SEQ ID NO: 81697 - DNA, 25 bp, Mus musculus
aatgcgactcttccagtttgtgact

SEQ ID NO: 81698 - DNA, 25 bp, Mus musculus
aatgcgactcttgcagtttgtgact

SEQ ID NO: 81699 - DNA, 25 bp, Mus musculus
aatgcgagcagtctcacccagagtt

SEQ ID NO: 81700 - DNA, 25 bp, Mus musculus
aatgcgagcagtgtcacccagagtt

SEQ ID NO: 81701 - DNA, 25 bp, Mus musculus
aatgcgagcatcagtcccttgagca

SEQ ID NO: 81702 - DNA, 25 bp, Mus musculus
aatgcgagcatctgtcccttgagca

SEQ ID NO: 81703 - DNA, 25 bp, Mus musculus
aatgcgaggactacatttgcaactg

SEQ ID NO: 81704 - DNA, 25 bp, Mus musculus
aatgcgaggacttcatttgcaactg

SEQ ID NO: 81705 - DNA, 25 bp, Mus musculus
aatgcgatatggcacctgctggctg

SEQ ID NO: 81706 - DNA, 25 bp, Mus musculus
aatgcgatatgggacctgctggctg

SEQ ID NO: 81707 - DNA, 25 bp, Mus musculus
aatgcgatgcctccggcaagagttt

SEQ ID NO: 81708 - DNA, 25 bp, Mus musculus
aatgcgatgcctgcggcaagagttt

SEQ ID NO: 81709 - DNA, 25 bp, Mus musculus
aatgcgattcttaggctctggacta

SEQ ID NO: 81710 - DNA, 25 bp, Mus musculus
aatgcgattctttggctctggacta

SEQ ID NO: 81711 - DNA, 25 bp, Mus musculus
aatgcgattgccaccagctctttat

SEQ ID NO: 81712 - DNA, 25 bp, Mus musculus
aatgcgattgcctccagctctttat

SEQ ID NO: 81713 - DNA, 25 bp, Mus musculus
aatgcgcaaggcagaataccctctg

SEQ ID NO: 81714 - DNA, 25 bp, Mus musculus
aatgcgcaaggctgaataccctctg

SEQ ID NO: 81715 - DNA, 25 bp, Mus musculus
aatgcgcagagaagccgggtccata

SEQ ID NO: 81716 - DNA, 25 bp, Mus musculus
aatgcgcagagatgccgggtccata

SEQ ID NO: 81717 - DNA, 25 bp, Mus musculus
aatgcgcagtctcccaatatttcaa

SEQ ID NO: 81718 - DNA, 25 bp, Mus musculus
aatgcgcagtctgccaatatttcaa

SEQ ID NO: 81719 - DNA, 25 bp, Mus musculus
aatgcgccaggcctcttcacaaaac

SEQ ID NO: 81720 - DNA, 25 bp, Mus musculus
aatgcgccaggcgtcttcacaaaac

SEQ ID NO: 81721 - DNA, 25 bp, Mus musculus
aatgcgcccatccagaggactgact

SEQ ID NO: 81722 - DNA, 25 bp, Mus musculus
aatgcgcccatcgagaggactgact

SEQ ID NO: 81723 - DNA, 25 bp, Mus musculus
aatgcgcgttctattcactggttta

SEQ ID NO: 81724 - DNA, 25 bp, Mus musculus
aatgcgcgttcttttcactggttta

SEQ ID NO: 81725 - DNA, 25 bp, Mus musculus
aatgcgctcaatcagcttttcagaa

SEQ ID NO: 81726 - DNA, 25 bp, Mus musculus
aatgcgctcaatgagcttttcagaa

SEQ ID NO: 81727 - DNA, 25 bp, Mus musculus
aatgcgctgatacttgtgggtctct

SEQ ID NO: 81728 - DNA, 25 bp, Mus musculus
aatgcgctgatagttgtgggtctct

SEQ ID NO: 81729 - DNA, 25 bp, Mus musculus
aatgcgcttatccggcctctgcgtg

SEQ ID NO: 81730 - DNA, 25 bp, Mus musculus
aatgcgcttatcgggcctctgcgtg

SEQ ID NO: 81731 - DNA, 25 bp, Mus musculus
aatgcgcttgttcatcgtgtgagga

SEQ ID NO: 81732 - DNA, 25 bp, Mus musculus
aatgcgcttgttgatcgtgtgagga

SEQ ID NO: 81733 - DNA, 25 bp, Mus musculus
aatgcggaagtcctcatttgacaag

SEQ ID NO: 81734 - DNA, 25 bp, Mus musculus
aatgcggaagtcgtcatttgacaag

SEQ ID NO: 81735 - DNA, 25 bp, Mus musculus
aatgcggacccaaatactgcttgta

SEQ ID NO: 81736 - DNA, 25 bp, Mus musculus
aatgcggacccatatactgcttgta

SEQ ID NO: 81737 - DNA, 25 bp, Mus musculus
aatgcggaggctaatggctgaagat

SEQ ID NO: 81738 - DNA, 25 bp, Mus musculus
aatgcggaggcttatggctgaagat

SEQ ID NO: 81739 - DNA, 25 bp, Mus musculus
aatgcggcactgatgcttgccaata

SEQ ID NO: 81740 - DNA, 25 bp, Mus musculus
aatgcggcactgttgcttgccaata

SEQ ID NO: 81741 - DNA, 25 bp, Mus musculus
aatgcggccactccatacaacatgg

SEQ ID NO: 81742 - DNA, 25 bp, Mus musculus
aatgcggccactgcatacaacatgg

SEQ ID NO: 81743 - DNA, 25 bp, Mus musculus
aatgcggcctggagacctggcccag

SEQ ID NO: 81744 - DNA, 25 bp, Mus musculus
aatgcggcctggtgacctggcccag

SEQ ID NO: 81745 - DNA, 25 bp, Mus musculus
aatgcggctattagctttgctcctt

SEQ ID NO: 81746 - DNA, 25 bp, Mus musculus
aatgcggctatttgctttgctcctt

SEQ ID NO: 81747 - DNA, 25 bp, Mus musculus
aatgcgggccgtaaacagttacaca

SEQ ID NO: 81748 - DNA, 25 bp, Mus musculus
aatgcgggccgttaacagttacaca

SEQ ID NO: 81749 - DNA, 25 bp, Mus musculus
aatgcgggtcgtaaacaagtataca

SEQ ID NO: 81750 - DNA, 25 bp, Mus musculus
aatgcgggtcgttaacaagtataca

SEQ ID NO: 81751 - DNA, 25 bp, Mus musculus
aatgcggtcaccaaggaggatttcc

SEQ ID NO: 81752 - DNA, 25 bp, Mus musculus
aatgcggtcacctaggaggatttcc

SEQ ID NO: 81753 - DNA, 25 bp, Mus musculus
aatgcggtgactattttcatttttt

SEQ ID NO: 81754 - DNA, 25 bp, Mus musculus
aatgcggtgacttttttcatttttt

SEQ ID NO: 81755 - DNA, 25 bp, Mus musculus
aatgcggttctcagagcagaccctt

SEQ ID NO: 81756 - DNA, 25 bp, Mus musculus
aatgcggttctctgagcagaccctt

SEQ ID NO: 81757 - DNA, 25 bp, Mus musculus
aatgcggttttgctttaatcctagg

SEQ ID NO: 81758 - DNA, 25 bp, Mus musculus
aatgcggttttggtttaatcctagg

SEQ ID NO: 81759 - DNA, 25 bp, Mus musculus
aatgcgtagaacatggtttctgtac

SEQ ID NO: 81760 - DNA, 25 bp, Mus musculus
aatgcgtagaacttggtttctgtac

SEQ ID NO: 81761 - DNA, 25 bp, Mus musculus
aatgcgtcagctatctgtgattcca

SEQ ID NO: 81762 - DNA, 25 bp, Mus musculus
aatgcgtcagctttctgtgattcca

SEQ ID NO: 81763 - DNA, 25 bp, Mus musculus
aatgcgtccatgcagcctggaagca

SEQ ID NO: 81764 - DNA, 25 bp, Mus musculus
aatgcgtccatggagcctggaagca

SEQ ID NO: 81765 - DNA, 25 bp, Mus musculus
aatgcgtccttcaccaacgaacact

SEQ ID NO: 81766 - DNA, 25 bp, Mus musculus
aatgcgtccttctccaacgaacact

SEQ ID NO: 81767 - DNA, 25 bp, Mus musculus
aatgcgtcgatcagcaagattgtct

SEQ ID NO: 81768 - DNA, 25 bp, Mus musculus
aatgcgtcgatctgcaagattgtct

SEQ ID NO: 81769 - DNA, 25 bp, Mus musculus
aatgcgtgactgagggtgtttctca

SEQ ID NO: 81770 - DNA, 25 bp, Mus musculus
aatgcgtgactgtgggtgtttctca

SEQ ID NO: 81771 - DNA, 25 bp, Mus musculus
aatgcgtgcactagagggtgtttca

SEQ ID NO: 81772 - DNA, 25 bp, Mus musculus
aatgcgtgcacttgagggtgtttca

SEQ ID NO: 81773 - DNA, 25 bp, Mus musculus
aatgcgtgcatcatgaataacttta

SEQ ID NO: 81774 - DNA, 25 bp, Mus musculus
aatgcgtgcatcttgaataacttta

SEQ ID NO: 81775 - DNA, 25 bp, Mus musculus
aatgcgtggcacatctttgttgttg

SEQ ID NO: 81776 - DNA, 25 bp, Mus musculus
aatgcgtggcacttctttgttgttg

SEQ ID NO: 81777 - DNA, 25 bp, Mus musculus
aatgcgttacatcggctgaaaggac

SEQ ID NO: 81778 - DNA, 25 bp, Mus musculus
aatgcgttacatgggctgaaaggac

SEQ ID NO: 81779 - DNA, 25 bp, Mus musculus
aatgcgtttgcaatgagcccacagg

SEQ ID NO: 81780 - DNA, 25 bp, Mus musculus
aatgcgtttgcattgagcccacagg

SEQ ID NO: 81781 - DNA, 25 bp, Mus musculus
aatgcgtttttaaagtttatgtgac

SEQ ID NO: 81782 - DNA, 25 bp, Mus musculus
aatgcgtttttatagtttatgtgac

SEQ ID NO: 81783 - DNA, 25 bp, Mus musculus
aatgctaacagtaaaggccatcacc

SEQ ID NO: 81784 - DNA, 25 bp, Mus musculus
aatgctaacagtacttgctgtggaa

SEQ ID NO: 81785 - DNA, 25 bp, Mus musculus
aatgctaacagttaaggccatcacc

SEQ ID NO: 81786 - DNA, 25 bp, Mus musculus
aatgctaacagttcttgctgtggaa

SEQ ID NO: 81787 - DNA, 25 bp, Mus musculus
aatgctaaccacagcaagttatttt

SEQ ID NO: 81788 - DNA, 25 bp, Mus musculus
aatgctaaccactgcaagttatttt

SEQ ID NO: 81789 - DNA, 25 bp, Mus musculus
aatgctaacgctctcacaaactgta

SEQ ID NO: 81790 - DNA, 25 bp, Mus musculus
aatgctaacgctgtcacaaactgta

SEQ ID NO: 81791 - DNA, 25 bp, Mus musculus
aatgctaactctaccgctatcaaga

SEQ ID NO: 81792 - DNA, 25 bp, Mus musculus
aatgctaactcttccgctatcaaga

SEQ ID NO: 81793 - DNA, 25 bp, Mus musculus
aatgctaagaccctatactctggcc

SEQ ID NO: 81794 - DNA, 25 bp, Mus musculus
aatgctaagaccgtatactctggcc

SEQ ID NO: 81795 - DNA, 25 bp, Mus musculus
aatgctaagagcacacacccatttc

SEQ ID NO: 81796 - DNA, 25 bp, Mus musculus
aatgctaagagctcacacccatttc

SEQ ID NO: 81797 - DNA, 25 bp, Mus musculus
aatgctaagattcctttgcttcgaa

SEQ ID NO: 81798 - DNA, 25 bp, Mus musculus
aatgctaagattgctttgcttcgaa

SEQ ID NO: 81799 - DNA, 25 bp, Mus musculus
aatgctaagcgaaggccagctgtct

SEQ ID NO: 81800 - DNA, 25 bp, Mus musculus
aatgctaagcgatggccagctgtct

SEQ ID NO: 81801 - DNA, 25 bp, Mus musculus
aatgctaagggcaggcccagattat

SEQ ID NO: 81802 - DNA, 25 bp, Mus musculus
aatgctaagggctggcccagattat

SEQ ID NO: 81803 - DNA, 25 bp, Mus musculus
aatgctaagtgaactcggtgtagaa

SEQ ID NO: 81804 - DNA, 25 bp, Mus musculus
aatgctaagtgatctcggtgtagaa

SEQ ID NO: 81805 - DNA, 25 bp, Mus musculus
aatgctaatacaatgctctcttaag

SEQ ID NO: 81806 - DNA, 25 bp, Mus musculus
aatgctaatacattgctctcttaag

SEQ ID NO: 81807 - DNA, 25 bp, Mus musculus
aatgctaatcccagctttgaataag

SEQ ID NO: 81808 - DNA, 25 bp, Mus musculus
aatgctaatccctgctttgaataag

SEQ ID NO: 81809 - DNA, 25 bp, Mus musculus
aatgctaatgagatgtcagctaata

SEQ ID NO: 81810 - DNA, 25 bp, Mus musculus
aatgctaatgagttgtcagctaata

SEQ ID NO: 81811 - DNA, 25 bp, Mus musculus
aatgctaattacaacttccagtgta

SEQ ID NO: 81812 - DNA, 25 bp, Mus musculus
aatgctaattactacttccagtgta

SEQ ID NO: 81813 - DNA, 25 bp, Mus musculus
aatgctacaataccgcaattatgca

SEQ ID NO: 81814 - DNA, 25 bp, Mus musculus
aatgctacaatagcgcaattatgca

SEQ ID NO: 81815 - DNA, 25 bp, Mus musculus
aatgctacagctagctttttaaaaa

SEQ ID NO: 81816 - DNA, 25 bp, Mus musculus
aatgctacagctagtgttgcagccc

SEQ ID NO: 81817 - DNA, 25 bp, Mus musculus
aatgctacagcttgctttttaaaaa

SEQ ID NO: 81818 - DNA, 25 bp, Mus musculus
aatgctacagcttgtgttgcagccc

SEQ ID NO: 81819 - DNA, 25 bp, Mus musculus
aatgctaccaagagcaacacaaagg

SEQ ID NO: 81820 - DNA, 25 bp, Mus musculus
aatgctaccaagtgcaacacaaagg

SEQ ID NO: 81821 - DNA, 25 bp, Mus musculus
aatgctaccacaaatactcatgtat

SEQ ID NO: 81822 - DNA, 25 bp, Mus musculus
aatgctaccacatatactcatgtat

SEQ ID NO: 81823 - DNA, 25 bp, Mus musculus
aatgctaccagtattggccaacgga

SEQ ID NO: 81824 - DNA, 25 bp, Mus musculus
aatgctaccagttttggccaacgga

SEQ ID NO: 81825 - DNA, 25 bp, Mus musculus
aatgctacccacattccagatgttc

SEQ ID NO: 81826 - DNA, 25 bp, Mus musculus
aatgctacccactttccagatgttc

SEQ ID NO: 81827 - DNA, 25 bp, Mus musculus
aatgctaccgttatggtatctcctc

SEQ ID NO: 81828 - DNA, 25 bp, Mus musculus
aatgctaccgttttggtatctcctc

SEQ ID NO: 81829 - DNA, 25 bp, Mus musculus
aatgctacctctataatagctgcta

SEQ ID NO: 81830 - DNA, 25 bp, Mus musculus
aatgctacctctttaatagctgcta

SEQ ID NO: 81831 - DNA, 25 bp, Mus musculus
aatgctacggctacgacatcatcat

SEQ ID NO: 81832 - DNA, 25 bp, Mus musculus
aatgctacggcttcgacatcatcat

SEQ ID NO: 81833 - DNA, 25 bp, Mus musculus
aatgctacgggcactgttggtgtga

SEQ ID NO: 81834 - DNA, 25 bp, Mus musculus
aatgctacgggctctgttggtgtga

SEQ ID NO: 81835 - DNA, 25 bp, Mus musculus
aatgctactagccagggtgagtgta

SEQ ID NO: 81836 - DNA, 25 bp, Mus musculus
aatgctactagcgagggtgagtgta

SEQ ID NO: 81837 - DNA, 25 bp, Mus musculus
aatgctactatcatctacagtgaca

SEQ ID NO: 81838 - DNA, 25 bp, Mus musculus
aatgctactatcttctacagtgaca

SEQ ID NO: 81839 - DNA, 25 bp, Mus musculus
aatgctactgagattctactgtata

SEQ ID NO: 81840 - DNA, 25 bp, Mus musculus
aatgctactgagtttctactgtata

SEQ ID NO: 81841 - DNA, 25 bp, Mus musculus
aatgctacttacaggttttactcca

SEQ ID NO: 81842 - DNA, 25 bp, Mus musculus
aatgctacttactggttttactcca

SEQ ID NO: 81843 - DNA, 25 bp, Mus musculus
aatgctacttagataatgcttttag

SEQ ID NO: 81844 - DNA, 25 bp, Mus musculus
aatgctacttagttaatgcttttag

SEQ ID NO: 81845 - DNA, 25 bp, Mus musculus
aatgctacttatatgcttgtttatc

SEQ ID NO: 81846 - DNA, 25 bp, Mus musculus
aatgctacttatttgcttgtttatc

SEQ ID NO: 81847 - DNA, 25 bp, Mus musculus
aatgctacttctcttcgcattgctt

SEQ ID NO: 81848 - DNA, 25 bp, Mus musculus
aatgctacttctgttcgcattgctt

SEQ ID NO: 81849 - DNA, 25 bp, Mus musculus
aatgctagacatcttctcaagctaa

SEQ ID NO: 81850 - DNA, 25 bp, Mus musculus
aatgctagacatgttctcaagctaa

SEQ ID NO: 81851 - DNA, 25 bp, Mus musculus
aatgctagagtgcttgcttagtact

SEQ ID NO: 81852 - DNA, 25 bp, Mus musculus
aatgctagagtggttgcttagtact

SEQ ID NO: 81853 - DNA, 25 bp, Mus musculus
aatgctagatcaattctcatctcct

SEQ ID NO: 81854 - DNA, 25 bp, Mus musculus
aatgctagatcatttctcatctcct

SEQ ID NO: 81855 - DNA, 25 bp, Mus musculus
aatgctagccagacaggaactccat

SEQ ID NO: 81856 - DNA, 25 bp, Mus musculus
aatgctagccagtcaggaactccat

SEQ ID NO: 81857 - DNA, 25 bp, Mus musculus
aatgctagccgtcctctgaaatcac

SEQ ID NO: 81858 - DNA, 25 bp, Mus musculus
aatgctagccgtgctctgaaatcac

SEQ ID NO: 81859 - DNA, 25 bp, Mus musculus
aatgctagctgtcagggagcccgcc

SEQ ID NO: 81860 - DNA, 25 bp, Mus musculus
aatgctagctgtgagggagcccgcc

SEQ ID NO: 81861 - DNA, 25 bp, Mus musculus
aatgctaggccccacaggatagtgt

SEQ ID NO: 81862 - DNA, 25 bp, Mus musculus
aatgctaggcccgacaggatagtgt

SEQ ID NO: 81863 - DNA, 25 bp, Mus musculus
aatgctagttggatgggattctgtc

SEQ ID NO: 81864 - DNA, 25 bp, Mus musculus
aatgctagttggttgggattctgtc

SEQ ID NO: 81865 - DNA, 25 bp, Mus musculus
aatgctataactctccaatggaaag

SEQ ID NO: 81866 - DNA, 25 bp, Mus musculus
aatgctataactgtccaatggaaag

SEQ ID NO: 81867 - DNA, 25 bp, Mus musculus
aatgctatagggacacatgtcataa

SEQ ID NO: 81868 - DNA, 25 bp, Mus musculus
aatgctatagggtcacatgtcataa

SEQ ID NO: 81869 - DNA, 25 bp, Mus musculus
aatgctatatagagtgcccggaatg

SEQ ID NO: 81870 - DNA, 25 bp, Mus musculus
aatgctatatagtgtgcccggaatg

SEQ ID NO: 81871 - DNA, 25 bp, Mus musculus
aatgctatcagcattttgacatcta

SEQ ID NO: 81872 - DNA, 25 bp, Mus musculus
aatgctatcagctttttgacatcta

SEQ ID NO: 81873 - DNA, 25 bp, Mus musculus
aatgctatcattcaggtcttttata

SEQ ID NO: 81874 - DNA, 25 bp, Mus musculus
aatgctatcattgaggtcttttata

SEQ ID NO: 81875 - DNA, 25 bp, Mus musculus
aatgctatccataagtctccctgta

SEQ ID NO: 81876 - DNA, 25 bp, Mus musculus
aatgctatccattagtctccctgta

SEQ ID NO: 81877 - DNA, 25 bp, Mus musculus
aatgctatcccacgtacaggaccaa

SEQ ID NO: 81878 - DNA, 25 bp, Mus musculus
aatgctatcccaggtacaggaccaa

SEQ ID NO: 81879 - DNA, 25 bp, Mus musculus
aatgctatcctgcattgcctcgtac

SEQ ID NO: 81880 - DNA, 25 bp, Mus musculus
aatgctatcctggattgcctcgtac

SEQ ID NO: 81881 - DNA, 25 bp, Mus musculus
aatgctatcgaaccactcctggagt

SEQ ID NO: 81882 - DNA, 25 bp, Mus musculus
aatgctatcgaagcactcctggagt

SEQ ID NO: 81883 - DNA, 25 bp, Mus musculus
aatgctatcgacaccccagagtata

SEQ ID NO: 81884 - DNA, 25 bp, Mus musculus
aatgctatcgactccccagagtata

SEQ ID NO: 81885 - DNA, 25 bp, Mus musculus
aatgctatcggcagacacaaaaact

SEQ ID NO: 81886 - DNA, 25 bp, Mus musculus
aatgctatcggctgacacaaaaact

SEQ ID NO: 81887 - DNA, 25 bp, Mus musculus
aatgctatctaaatctccctaaatg

SEQ ID NO: 81888 - DNA, 25 bp, Mus musculus
aatgctatctaattctccctaaatg

SEQ ID NO: 81889 - DNA, 25 bp, Mus musculus
aatgctatctcacgacccaacgagt

SEQ ID NO: 81890 - DNA, 25 bp, Mus musculus
aatgctatctcaggacccaacgagt

SEQ ID NO: 81891 - DNA, 25 bp, Mus musculus
aatgctatcttacattccttatgaa

SEQ ID NO: 81892 - DNA, 25 bp, Mus musculus
aatgctatcttagattccttatgaa

SEQ ID NO: 81893 - DNA, 25 bp, Mus musculus
aatgctatgaaaagctatgtacatc

SEQ ID NO: 81894 - DNA, 25 bp, Mus musculus
aatgctatgaaatgctatgtacatc

SEQ ID NO: 81895 - DNA, 25 bp, Mus musculus
aatgctatgcacagaggatacacaa

SEQ ID NO: 81896 - DNA, 25 bp, Mus musculus
aatgctatgcactgaggatacacaa

SEQ ID NO: 81897 - DNA, 25 bp, Mus musculus
aatgctatgggaatggcctcttctc

SEQ ID NO: 81898 - DNA, 25 bp, Mus musculus
aatgctatgggacccaggctgtctt

SEQ ID NO: 81899 - DNA, 25 bp, Mus musculus
aatgctatgggagccaggctgtctt

SEQ ID NO: 81900 - DNA, 25 bp, Mus musculus
aatgctatgggattggcctcttctc

SEQ ID NO: 81901 - DNA, 25 bp, Mus musculus
aatgctatgtgtcaccagggataat

SEQ ID NO: 81902 - DNA, 25 bp, Mus musculus
aatgctatgtgtgaccagggataat

SEQ ID NO: 81903 - DNA, 25 bp, Mus musculus
aatgctatgttcagttgccatgcta

SEQ ID NO: 81904 - DNA, 25 bp, Mus musculus
aatgctatgttccagagtgctttct

SEQ ID NO: 81905 - DNA, 25 bp, Mus musculus
aatgctatgttcgagagtgctttct

SEQ ID NO: 81906 - DNA, 25 bp, Mus musculus
aatgctatgttctgttgccatgcta

SEQ ID NO: 81907 - DNA, 25 bp, Mus musculus
aatgctattcagaactcaattggct

SEQ ID NO: 81908 - DNA, 25 bp, Mus musculus
aatgctattcagtactcaattggct

SEQ ID NO: 81909 - DNA, 25 bp, Mus musculus
aatgctattcatagggtcacatatt

SEQ ID NO: 81910 - DNA, 25 bp, Mus musculus
aatgctattcatatgtgtactcgtg

SEQ ID NO: 81911 - DNA, 25 bp, Mus musculus
aatgctattcattgggtcacatatt

SEQ ID NO: 81912 - DNA, 25 bp, Mus musculus
aatgctattcatttgtgtactcgtg

SEQ ID NO: 81913 - DNA, 25 bp, Mus musculus
aatgctattcctcaccaaagagcta

SEQ ID NO: 81914 - DNA, 25 bp, Mus musculus
aatgctattcctgaccaaagagcta

SEQ ID NO: 81915 - DNA, 25 bp, Mus musculus
aatgctattgacctaccaaatgacc

SEQ ID NO: 81916 - DNA, 25 bp, Mus musculus
aatgctattgacgtaccaaatgacc

SEQ ID NO: 81917 - DNA, 25 bp, Mus musculus
aatgctattgcaaattgtcagcagt

SEQ ID NO: 81918 - DNA, 25 bp, Mus musculus
aatgctattgcatattgtcagcagt

SEQ ID NO: 81919 - DNA, 25 bp, Mus musculus
aatgctattggtcattcctttctgg

SEQ ID NO: 81920 - DNA, 25 bp, Mus musculus
aatgctattggtgattcctttctgg

SEQ ID NO: 81921 - DNA, 25 bp, Mus musculus
aatgctattgttatttcctatggcc

SEQ ID NO: 81922 - DNA, 25 bp, Mus musculus
aatgctattgttttttcctatggcc

SEQ ID NO: 81923 - DNA, 25 bp, Mus musculus
aatgctatttagatactcaattagg

SEQ ID NO: 81924 - DNA, 25 bp, Mus musculus
aatgctatttagttactcaattagg

SEQ ID NO: 81925 - DNA, 25 bp, Mus musculus
aatgctatttatacgtgtctgtaag

SEQ ID NO: 81926 - DNA, 25 bp, Mus musculus
aatgctatttattcgtgtctgtaag

SEQ ID NO: 81927 - DNA, 25 bp, Mus musculus
aatgctatttgcaaccacgattgct

SEQ ID NO: 81928 - DNA, 25 bp, Mus musculus
aatgctatttgctaccacgattgct

SEQ ID NO: 81929 - DNA, 25 bp, Mus musculus
aatgctatttgtcctattacccttc

SEQ ID NO: 81930 - DNA, 25 bp, Mus musculus
aatgctatttgtgctattacccttc

SEQ ID NO: 81931 - DNA, 25 bp, Mus musculus
aatgctcaaatcaacctgaacggca

SEQ ID NO: 81932 - DNA, 25 bp, Mus musculus
aatgctcaaatctacctgaacggca

SEQ ID NO: 81933 - DNA, 25 bp, Mus musculus
aatgctcaaggcaaaggcccaggcc

SEQ ID NO: 81934 - DNA, 25 bp, Mus musculus
aatgctcaaggctaaggcccaggcc

SEQ ID NO: 81935 - DNA, 25 bp, Mus musculus
aatgctcaattaagctctggttcac

SEQ ID NO: 81936 - DNA, 25 bp, Mus musculus
aatgctcaattatgctctggttcac

SEQ ID NO: 81937 - DNA, 25 bp, Mus musculus
aatgctcacagaaatgtccaccatg

SEQ ID NO: 81938 - DNA, 25 bp, Mus musculus
aatgctcacagaccggagatctaca

SEQ ID NO: 81939 - DNA, 25 bp, Mus musculus
aatgctcacagagcggagatctaca

SEQ ID NO: 81940 - DNA, 25 bp, Mus musculus
aatgctcacagatatgtccaccatg

SEQ ID NO: 81941 - DNA, 25 bp, Mus musculus
aatgctcacatcagagggcgtcctg

SEQ ID NO: 81942 - DNA, 25 bp, Mus musculus
aatgctcacatcatgcctagacttt

SEQ ID NO: 81943 - DNA, 25 bp, Mus musculus
aatgctcacatctgagggcgtcctg

SEQ ID NO: 81944 - DNA, 25 bp, Mus musculus
aatgctcacatcttgcctagacttt

SEQ ID NO: 81945 - DNA, 25 bp, Mus musculus
aatgctcacattacagaagctcaat

SEQ ID NO: 81946 - DNA, 25 bp, Mus musculus
aatgctcacatttcagaagctcaat

SEQ ID NO: 81947 - DNA, 25 bp, Mus musculus
aatgctcaccacctacctggaggtg

SEQ ID NO: 81948 - DNA, 25 bp, Mus musculus
aatgctcaccacgtacctggaggtg

SEQ ID NO: 81949 - DNA, 25 bp, Mus musculus
aatgctcacttccaatttgatgttg

SEQ ID NO: 81950 - DNA, 25 bp, Mus musculus
aatgctcacttcgaatttgatgttg

SEQ ID NO: 81951 - DNA, 25 bp, Mus musculus
aatgctcagaacagtgtgcactgta

SEQ ID NO: 81952 - DNA, 25 bp, Mus musculus
aatgctcagaactgtgtgcactgta

SEQ ID NO: 81953 - DNA, 25 bp, Mus musculus
aatgctcagactccaagaaaacttt

SEQ ID NO: 81954 - DNA, 25 bp, Mus musculus
aatgctcagactgcaagaaaacttt

SEQ ID NO: 81955 - DNA, 25 bp, Mus musculus
aatgctcagcgcacggaaggatccg

SEQ ID NO: 81956 - DNA, 25 bp, Mus musculus
aatgctcagcgccaaaccttggcaa

SEQ ID NO: 81957 - DNA, 25 bp, Mus musculus
aatgctcagcgcgaaaccttggcaa

SEQ ID NO: 81958 - DNA, 25 bp, Mus musculus
aatgctcagcgctcggaaggatccg

SEQ ID NO: 81959 - DNA, 25 bp, Mus musculus
aatgctcagcgtacatgttgttgga

SEQ ID NO: 81960 - DNA, 25 bp, Mus musculus
aatgctcagcgttcatgttgttgga

SEQ ID NO: 81961 - DNA, 25 bp, Mus musculus
aatgctcagctcatggcacagattg

SEQ ID NO: 81962 - DNA, 25 bp, Mus musculus
aatgctcagctcttggcacagattg

SEQ ID NO: 81963 - DNA, 25 bp, Mus musculus
aatgctcaggtccttgtgggtgtta

SEQ ID NO: 81964 - DNA, 25 bp, Mus musculus
aatgctcaggtcgttgtgggtgtta

SEQ ID NO: 81965 - DNA, 25 bp, Mus musculus
aatgctcagtgaacattctccagtc

SEQ ID NO: 81966 - DNA, 25 bp, Mus musculus
aatgctcagtgatcattctccagtc

SEQ ID NO: 81967 - DNA, 25 bp, Mus musculus
aatgctcagtgtcgacatcgctgga

SEQ ID NO: 81968 - DNA, 25 bp, Mus musculus
aatgctcagtgtggacatcgctgga

SEQ ID NO: 81969 - DNA, 25 bp, Mus musculus
aatgctcagttgaccatccattaga

SEQ ID NO: 81970 - DNA, 25 bp, Mus musculus
aatgctcagttgtccatccattaga

SEQ ID NO: 81971 - DNA, 25 bp, Mus musculus
aatgctcatataagcccatgtctgc

SEQ ID NO: 81972 - DNA, 25 bp, Mus musculus
aatgctcatatatgcccatgtctgc

SEQ ID NO: 81973 - DNA, 25 bp, Mus musculus
aatgctcatatgcttttgctttgct

SEQ ID NO: 81974 - DNA, 25 bp, Mus musculus
aatgctcatatggttttgctttgct

SEQ ID NO: 81975 - DNA, 25 bp, Mus musculus
aatgctcatattctggttctccatc

SEQ ID NO: 81976 - DNA, 25 bp, Mus musculus
aatgctcatattgtggttctccatc

SEQ ID NO: 81977 - DNA, 25 bp, Mus musculus
aatgctcatctgacatcttataatg

SEQ ID NO: 81978 - DNA, 25 bp, Mus musculus
aatgctcatctgtcatcttataatg

SEQ ID NO: 81979 - DNA, 25 bp, Mus musculus
aatgctcatcttctcaagctacctt

SEQ ID NO: 81980 - DNA, 25 bp, Mus musculus
aatgctcatcttgtcaagctacctt

SEQ ID NO: 81981 - DNA, 25 bp, Mus musculus
aatgctcatgtactggtgtcttact

SEQ ID NO: 81982 - DNA, 25 bp, Mus musculus
aatgctcatgtagtggtgtcttact

SEQ ID NO: 81983 - DNA, 25 bp, Mus musculus
aatgctcattggctgtcactacctc

SEQ ID NO: 81984 - DNA, 25 bp, Mus musculus
aatgctcattgggtgtcactacctc

SEQ ID NO: 81985 - DNA, 25 bp, Mus musculus
aatgctcattttagagacgtttata

SEQ ID NO: 81986 - DNA, 25 bp, Mus musculus
aatgctcatttttgagacgtttata

SEQ ID NO: 81987 - DNA, 25 bp, Mus musculus
aatgctccaaagacttgcctacagc

SEQ ID NO: 81988 - DNA, 25 bp, Mus musculus
aatgctccaaagtcttgcctacagc

SEQ ID NO: 81989 - DNA, 25 bp, Mus musculus
aatgctccactaagattccgaaggc

SEQ ID NO: 81990 - DNA, 25 bp, Mus musculus
aatgctccactatgattccgaaggc

SEQ ID NO: 81991 - DNA, 25 bp, Mus musculus
aatgctccagaacttgggctgctta

SEQ ID NO: 81992 - DNA, 25 bp, Mus musculus
aatgctccagaagttgggctgctta

SEQ ID NO: 81993 - DNA, 25 bp, Mus musculus
aatgctccagacacagcctgtgtga

SEQ ID NO: 81994 - DNA, 25 bp, Mus musculus
aatgctccagacatggctcacagct

SEQ ID NO: 81995 - DNA, 25 bp, Mus musculus
aatgctccagactcagcctgtgtga

SEQ ID NO: 81996 - DNA, 25 bp, Mus musculus
aatgctccagacttggctcacagct

SEQ ID NO: 81997 - DNA, 25 bp, Mus musculus
aatgctccatttcttttacttccaa

SEQ ID NO: 81998 - DNA, 25 bp, Mus musculus
aatgctccatttgttttacttccaa

SEQ ID NO: 81999 - DNA, 25 bp, Mus musculus
aatgctcccactctgacaggtgttt

SEQ ID NO: 82000 - DNA, 25 bp, Mus musculus
aatgctcccactgtgacaggtgttt

SEQ ID NO: 82001 - DNA, 25 bp, Mus musculus
aatgctcccattaactattagctta

SEQ ID NO: 82002 - DNA, 25 bp, Mus musculus
aatgctcccattctgaattataaat

SEQ ID NO: 82003 - DNA, 25 bp, Mus musculus
aatgctcccattgtgaattataaat

SEQ ID NO: 82004 - DNA, 25 bp, Mus musculus
aatgctcccatttactattagctta

SEQ ID NO: 82005 - DNA, 25 bp, Mus musculus
aatgctccctatacaggactgtcca

SEQ ID NO: 82006 - DNA, 25 bp, Mus musculus
aatgctccctattcaggactgtcca

SEQ ID NO: 82007 - DNA, 25 bp, Mus musculus
aatgctccctgaaagtgacctactt

SEQ ID NO: 82008 - DNA, 25 bp, Mus musculus
aatgctccctgatagtgacctactt

SEQ ID NO: 82009 - DNA, 25 bp, Mus musculus
aatgctcccttaagcttttgaaata

SEQ ID NO: 82010 - DNA, 25 bp, Mus musculus
aatgctcccttatgcttttgaaata

SEQ ID NO: 82011 - DNA, 25 bp, Mus musculus
aatgctccctttattatgtggtcat

SEQ ID NO: 82012 - DNA, 25 bp, Mus musculus
aatgctcccttttttatgtggtcat

SEQ ID NO: 82013 - DNA, 25 bp, Mus musculus
aatgctccgaagagaccaccgtctg

SEQ ID NO: 82014 - DNA, 25 bp, Mus musculus
aatgctccgaagtgaccaccgtctg

SEQ ID NO: 82015 - DNA, 25 bp, Mus musculus
aatgctccgaatagcacatggacac

SEQ ID NO: 82016 - DNA, 25 bp, Mus musculus
aatgctccgaattgcacatggacac

SEQ ID NO: 82017 - DNA, 25 bp, Mus musculus
aatgctcctagacactgaccgagtt

SEQ ID NO: 82018 - DNA, 25 bp, Mus musculus
aatgctcctagagactgaccgagtt

SEQ ID NO: 82019 - DNA, 25 bp, Mus musculus
aatgctcctgctatgtaacaggtgc

SEQ ID NO: 82020 - DNA, 25 bp, Mus musculus
aatgctcctgctttgtaacaggtgc

SEQ ID NO: 82021 - DNA, 25 bp, Mus musculus
aatgctcctgttctaatctcttgtg

SEQ ID NO: 82022 - DNA, 25 bp, Mus musculus
aatgctcctgttgtaatctcttgtg

SEQ ID NO: 82023 - DNA, 25 bp, Mus musculus
aatgctccttgtcctggccatcgcg

SEQ ID NO: 82024 - DNA, 25 bp, Mus musculus
aatgctccttgtgctggccatcgcg

SEQ ID NO: 82025 - DNA, 25 bp, Mus musculus
aatgctcgaacgactagctttaggt

SEQ ID NO: 82026 - DNA, 25 bp, Mus musculus
aatgctcgaacgtctagctttaggt

SEQ ID NO: 82027 - DNA, 25 bp, Mus musculus
aatgctcgactcaagtgtcccttgg

SEQ ID NO: 82028 - DNA, 25 bp, Mus musculus
aatgctcgactctagtgtcccttgg

SEQ ID NO: 82029 - DNA, 25 bp, Mus musculus
aatgctcgctccacgaggcggcaca

SEQ ID NO: 82030 - DNA, 25 bp, Mus musculus
aatgctcgctcctcgaggcggcaca

SEQ ID NO: 82031 - DNA, 25 bp, Mus musculus
aatgctcgctgacacagacactttc

SEQ ID NO: 82032 - DNA, 25 bp, Mus musculus
aatgctcgctgagacagacactttc

SEQ ID NO: 82033 - DNA, 25 bp, Mus musculus
aatgctcgctggcttgaggctcgca

SEQ ID NO: 82034 - DNA, 25 bp, Mus musculus
aatgctcgctgggttgaggctcgca

SEQ ID NO: 82035 - DNA, 25 bp, Mus musculus
aatgctcggcgcaagcttaaggcag

SEQ ID NO: 82036 - DNA, 25 bp, Mus musculus
aatgctcggcgctagcttaaggcag

SEQ ID NO: 82037 - DNA, 25 bp, Mus musculus
aatgctcggctgcataccttcagca

SEQ ID NO: 82038 - DNA, 25 bp, Mus musculus
aatgctcggctggataccttcagca

SEQ ID NO: 82039 - DNA, 25 bp, Mus musculus
aatgctcgggagattgccacttcca

SEQ ID NO: 82040 - DNA, 25 bp, Mus musculus
aatgctcgggagtttgccacttcca

SEQ ID NO: 82041 - DNA, 25 bp, Mus musculus
aatgctcgggtgattagtctcttct

SEQ ID NO: 82042 - DNA, 25 bp, Mus musculus
aatgctcgggtgtttagtctcttct

SEQ ID NO: 82043 - DNA, 25 bp, Mus musculus
aatgctcggtgaacaactgtgcctc

SEQ ID NO: 82044 - DNA, 25 bp, Mus musculus
aatgctcggtgatcaactgtgcctc

SEQ ID NO: 82045 - DNA, 25 bp, Mus musculus
aatgctcgtttgcaggtttgcactg

SEQ ID NO: 82046 - DNA, 25 bp, Mus musculus
aatgctcgtttggaggtttgcactg

SEQ ID NO: 82047 - DNA, 25 bp, Mus musculus
aatgctctacttactcctgcatgaa

SEQ ID NO: 82048 - DNA, 25 bp, Mus musculus
aatgctctactttctcctgcatgaa

SEQ ID NO: 82049 - DNA, 25 bp, Mus musculus
aatgctctagtgattgtagttctct

SEQ ID NO: 82050 - DNA, 25 bp, Mus musculus
aatgctctagtgtttgtagttctct

SEQ ID NO: 82051 - DNA, 25 bp, Mus musculus
aatgctctatgacaaatgctctgat

SEQ ID NO: 82052 - DNA, 25 bp, Mus musculus
aatgctctatgagaaatgctctgat

SEQ ID NO: 82053 - DNA, 25 bp, Mus musculus
aatgctctcatcaaagagaacccat

SEQ ID NO: 82054 - DNA, 25 bp, Mus musculus
aatgctctcatctaagagaacccat

SEQ ID NO: 82055 - DNA, 25 bp, Mus musculus
aatgctctccatcactgagggcttt

SEQ ID NO: 82056 - DNA, 25 bp, Mus musculus
aatgctctccatgactgagggcttt

SEQ ID NO: 82057 - DNA, 25 bp, Mus musculus
aatgctctcctaagtgagggcacct

SEQ ID NO: 82058 - DNA, 25 bp, Mus musculus
aatgctctcctatgtgagggcacct

SEQ ID NO: 82059 - DNA, 25 bp, Mus musculus
aatgctctcgctatggccatggaac

SEQ ID NO: 82060 - DNA, 25 bp, Mus musculus
aatgctctcgctttggccatggaac

SEQ ID NO: 82061 - DNA, 25 bp, Mus musculus
aatgctctcgttagcaaacctacag

SEQ ID NO: 82062 - DNA, 25 bp, Mus musculus
aatgctctcgtttgcaaacctacag

SEQ ID NO: 82063 - DNA, 25 bp, Mus musculus
aatgctctctaaaggcctcctctta

SEQ ID NO: 82064 - DNA, 25 bp, Mus musculus
aatgctctctaatggcctcctctta

SEQ ID NO: 82065 - DNA, 25 bp, Mus musculus
aatgctctctatcggaggcggttag

SEQ ID NO: 82066 - DNA, 25 bp, Mus musculus
aatgctctctatgggaggcggttag

SEQ ID NO: 82067 - DNA, 25 bp, Mus musculus
aatgctctgaccagcgctctgaggc

SEQ ID NO: 82068 - DNA, 25 bp, Mus musculus
aatgctctgacctgcgctctgaggc

SEQ ID NO: 82069 - DNA, 25 bp, Mus musculus
aatgctctgggccaagcggaagctt

SEQ ID NO: 82070 - DNA, 25 bp, Mus musculus
aatgctctgggcgaagcggaagctt

SEQ ID NO: 82071 - DNA, 25 bp, Mus musculus
aatgctctgtaaacccttactggac

SEQ ID NO: 82072 - DNA, 25 bp, Mus musculus
aatgctctgtaatcccttactggac

SEQ ID NO: 82073 - DNA, 25 bp, Mus musculus
aatgctctgtctatttaatcgtgta

SEQ ID NO: 82074 - DNA, 25 bp, Mus musculus
aatgctctgtctttttaatcgtgta

SEQ ID NO: 82075 - DNA, 25 bp, Mus musculus
aatgctctgtgtccagttacttcag

SEQ ID NO: 82076 - DNA, 25 bp, Mus musculus
aatgctctgtgtgcagttacttcag

SEQ ID NO: 82077 - DNA, 25 bp, Mus musculus
aatgctcttcttctctcctgagaga

SEQ ID NO: 82078 - DNA, 25 bp, Mus musculus
aatgctcttcttgtctcctgagaga

SEQ ID NO: 82079 - DNA, 25 bp, Mus musculus
aatgctctttccactctagtggtcc

SEQ ID NO: 82080 - DNA, 25 bp, Mus musculus
aatgctctttcctctctagtggtcc

SEQ ID NO: 82081 - DNA, 25 bp, Mus musculus
aatgctcttttgagttctattttaa

SEQ ID NO: 82082 - DNA, 25 bp, Mus musculus
aatgctcttttgtgttctattttaa

SEQ ID NO: 82083 - DNA, 25 bp, Mus musculus
aatgctgaaatgctactggagatta

SEQ ID NO: 82084 - DNA, 25 bp, Mus musculus
aatgctgaaatggtactggagatta

SEQ ID NO: 82085 - DNA, 25 bp, Mus musculus
aatgctgaattcatgtccaggaagt

SEQ ID NO: 82086 - DNA, 25 bp, Mus musculus
aatgctgaattcttgtccaggaagt

SEQ ID NO: 82087 - DNA, 25 bp, Mus musculus
aatgctgaatttaccatccgtctag

SEQ ID NO: 82088 - DNA, 25 bp, Mus musculus
aatgctgaattttccatccgtctag

SEQ ID NO: 82089 - DNA, 25 bp, Mus musculus
aatgctgacagccaagcgacatgtc

SEQ ID NO: 82090 - DNA, 25 bp, Mus musculus
aatgctgacagcgaagcgacatgtc

SEQ ID NO: 82091 - DNA, 25 bp, Mus musculus
aatgctgacatccaagaacccacta

SEQ ID NO: 82092 - DNA, 25 bp, Mus musculus
aatgctgacatcgaagaacccacta

SEQ ID NO: 82093 - DNA, 25 bp, Mus musculus
aatgctgacctgataatgctcccac

SEQ ID NO: 82094 - DNA, 25 bp, Mus musculus
aatgctgacctgttaatgctcccac

SEQ ID NO: 82095 - DNA, 25 bp, Mus musculus
aatgctgacggcatttggctcccag

SEQ ID NO: 82096 - DNA, 25 bp, Mus musculus
aatgctgacggcttttggctcccag

SEQ ID NO: 82097 - DNA, 25 bp, Mus musculus
aatgctgactacctggcagcccgcg

SEQ ID NO: 82098 - DNA, 25 bp, Mus musculus
aatgctgactacgtggcagcccgcg

SEQ ID NO: 82099 - DNA, 25 bp, Mus musculus
aatgctgactcgctctgtgagcgat

SEQ ID NO: 82100 - DNA, 25 bp, Mus musculus
aatgctgactcggtctgtgagcgat

SEQ ID NO: 82101 - DNA, 25 bp, Mus musculus
aatgctgacttgacttgtgggtcta

SEQ ID NO: 82102 - DNA, 25 bp, Mus musculus
aatgctgacttgtcttgtgggtcta

SEQ ID NO: 82103 - DNA, 25 bp, Mus musculus
aatgctgagaatcaacctccagaga

SEQ ID NO: 82104 - DNA, 25 bp, Mus musculus
aatgctgagaatgaacctccagaga

SEQ ID NO: 82105 - DNA, 25 bp, Mus musculus
aatgctgagagccaggccacaatct

SEQ ID NO: 82106 - DNA, 25 bp, Mus musculus
aatgctgagagcgaggccacaatct

SEQ ID NO: 82107 - DNA, 25 bp, Mus musculus
aatgctgagatacctgtgaccttcc

SEQ ID NO: 82108 - DNA, 25 bp, Mus musculus
aatgctgagatagctgtgaccttcc

SEQ ID NO: 82109 - DNA, 25 bp, Mus musculus
aatgctgagattaacctgtgtatgt

SEQ ID NO: 82110 - DNA, 25 bp, Mus musculus
aatgctgagatttacctgtgtatgt

SEQ ID NO: 82111 - DNA, 25 bp, Mus musculus
aatgctgagcagagtgacaactaaa

SEQ ID NO: 82112 - DNA, 25 bp, Mus musculus
aatgctgagcagtgtgacaactaaa

SEQ ID NO: 82113 - DNA, 25 bp, Mus musculus
aatgctgaggccctttgatacacct

SEQ ID NO: 82114 - DNA, 25 bp, Mus musculus
aatgctgaggccgtttgatacacct

SEQ ID NO: 82115 - DNA, 25 bp, Mus musculus
aatgctgaggctattacccttttgt

SEQ ID NO: 82116 - DNA, 25 bp, Mus musculus
aatgctgaggcttttacccttttgt

SEQ ID NO: 82117 - DNA, 25 bp, Mus musculus
aatgctgaggttcaacccactggta

SEQ ID NO: 82118 - DNA, 25 bp, Mus musculus
aatgctgaggttgaacccactggta

SEQ ID NO: 82119 - DNA, 25 bp, Mus musculus
aatgctgagtgcaggccaccagctg

SEQ ID NO: 82120 - DNA, 25 bp, Mus musculus
aatgctgagtgctggccaccagctg

SEQ ID NO: 82121 - DNA, 25 bp, Mus musculus
aatgctgatattccaagccacttaa

SEQ ID NO: 82122 - DNA, 25 bp, Mus musculus
aatgctgatattgcaagccacttaa

SEQ ID NO: 82123 - DNA, 25 bp, Mus musculus
aatgctgatcgcctacctctggtct

SEQ ID NO: 82124 - DNA, 25 bp, Mus musculus
aatgctgatcgcgtacctctggtct

SEQ ID NO: 82125 - DNA, 25 bp, Mus musculus
aatgctgcaactctgtgtactgaaa

SEQ ID NO: 82126 - DNA, 25 bp, Mus musculus
aatgctgcaactgtgtgtactgaaa

SEQ ID NO: 82127 - DNA, 25 bp, Mus musculus
aatgctgcacatactaacagtcaaa

SEQ ID NO: 82128 - DNA, 25 bp, Mus musculus
aatgctgcacattctaacagtcaaa

SEQ ID NO: 82129 - DNA, 25 bp, Mus musculus
aatgctgcacctcttttagttattt

SEQ ID NO: 82130 - DNA, 25 bp, Mus musculus
aatgctgcacctgttttagttattt

SEQ ID NO: 82131 - DNA, 25 bp, Mus musculus
aatgctgcactacaaaagtcaattg

SEQ ID NO: 82132 - DNA, 25 bp, Mus musculus
aatgctgcactagaaaagtcaattg

SEQ ID NO: 82133 - DNA, 25 bp, Mus musculus
aatgctgcactgctagacattgcta

SEQ ID NO: 82134 - DNA, 25 bp, Mus musculus
aatgctgcactggtagacattgcta

SEQ ID NO: 82135 - DNA, 25 bp, Mus musculus
aatgctgcaggtatcaacactgttg

SEQ ID NO: 82136 - DNA, 25 bp, Mus musculus
aatgctgcaggtcatccgagccgtc

SEQ ID NO: 82137 - DNA, 25 bp, Mus musculus
aatgctgcaggtgatccgagccgtc

SEQ ID NO: 82138 - DNA, 25 bp, Mus musculus
aatgctgcaggtttcaacactgttg

SEQ ID NO: 82139 - DNA, 25 bp, Mus musculus
aatgctgcagttacacaggttgtgt

SEQ ID NO: 82140 - DNA, 25 bp, Mus musculus
aatgctgcagtttcacaggttgtgt

SEQ ID NO: 82141 - DNA, 25 bp, Mus musculus
aatgctgcatttcatgagtccatgg

SEQ ID NO: 82142 - DNA, 25 bp, Mus musculus
aatgctgcatttgatgagtccatgg

SEQ ID NO: 82143 - DNA, 25 bp, Mus musculus
aatgctgccaagataactactctta

SEQ ID NO: 82144 - DNA, 25 bp, Mus musculus
aatgctgccaagttaactactctta

SEQ ID NO: 82145 - DNA, 25 bp, Mus musculus
aatgctgccaccataacaggtgcca

SEQ ID NO: 82146 - DNA, 25 bp, Mus musculus
aatgctgccaccttaacaggtgcca

SEQ ID NO: 82147 - DNA, 25 bp, Mus musculus
aatgctgccagactgacctatgcaa

SEQ ID NO: 82148 - DNA, 25 bp, Mus musculus
aatgctgccagagtgacctatgcaa

SEQ ID NO: 82149 - DNA, 25 bp, Mus musculus
aatgctgccagcactgattcagcaa

SEQ ID NO: 82150 - DNA, 25 bp, Mus musculus
aatgctgccagctctgattcagcaa

SEQ ID NO: 82151 - DNA, 25 bp, Mus musculus
aatgctgccaggacacttgtgagcc

SEQ ID NO: 82152 - DNA, 25 bp, Mus musculus
aatgctgccaggtcacttgtgagcc

SEQ ID NO: 82153 - DNA, 25 bp, Mus musculus
aatgctgccagtatacacttactta

SEQ ID NO: 82154 - DNA, 25 bp, Mus musculus
aatgctgccagtttacacttactta

SEQ ID NO: 82155 - DNA, 25 bp, Mus musculus
aatgctgccatcatgcttacatatg

SEQ ID NO: 82156 - DNA, 25 bp, Mus musculus
aatgctgccatcttgcttacatatg

SEQ ID NO: 82157 - DNA, 25 bp, Mus musculus
aatgctgccccaccaggaaagacta

SEQ ID NO: 82158 - DNA, 25 bp, Mus musculus
aatgctgccccagcaggaaagacta

SEQ ID NO: 82159 - DNA, 25 bp, Mus musculus
aatgctgccgaacaaagggactatg

SEQ ID NO: 82160 - DNA, 25 bp, Mus musculus
aatgctgccgaacaaccccatggtc

SEQ ID NO: 82161 - DNA, 25 bp, Mus musculus
aatgctgccgaagaaagggactatg

SEQ ID NO: 82162 - DNA, 25 bp, Mus musculus
aatgctgccgaagaaccccatggtc

SEQ ID NO: 82163 - DNA, 25 bp, Mus musculus
aatgctgccgatcaaatagccccgg

SEQ ID NO: 82164 - DNA, 25 bp, Mus musculus
aatgctgccgatgaaatagccccgg

SEQ ID NO: 82165 - DNA, 25 bp, Mus musculus
aatgctgcctacctgctgggactta

SEQ ID NO: 82166 - DNA, 25 bp, Mus musculus
aatgctgcctacgtgctgggactta

SEQ ID NO: 82167 - DNA, 25 bp, Mus musculus
aatgctgcctttacagatcaggttt

SEQ ID NO: 82168 - DNA, 25 bp, Mus musculus
aatgctgccttttcagatcaggttt

SEQ ID NO: 82169 - DNA, 25 bp, Mus musculus
aatgctgcgcataacttagaaataa

SEQ ID NO: 82170 - DNA, 25 bp, Mus musculus
aatgctgcgcattacttagaaataa

SEQ ID NO: 82171 - DNA, 25 bp, Mus musculus
aatgctgcgctcctggtttatgaca

SEQ ID NO: 82172 - DNA, 25 bp, Mus musculus
aatgctgcgctcgtggtttatgaca

SEQ ID NO: 82173 - DNA, 25 bp, Mus musculus
aatgctgcggaacatcggctaccct

SEQ ID NO: 82174 - DNA, 25 bp, Mus musculus
aatgctgcggaagatcggctaccct

SEQ ID NO: 82175 - DNA, 25 bp, Mus musculus
aatgctgcgtataaacaggtttaga

SEQ ID NO: 82176 - DNA, 25 bp, Mus musculus
aatgctgcgtattaacaggtttaga

SEQ ID NO: 82177 - DNA, 25 bp, Mus musculus
aatgctgctaaccatagcatcttga

SEQ ID NO: 82178 - DNA, 25 bp, Mus musculus
aatgctgctaacgatagcatcttga

SEQ ID NO: 82179 - DNA, 25 bp, Mus musculus
aatgctgctaggaggagggcacccc

SEQ ID NO: 82180 - DNA, 25 bp, Mus musculus
aatgctgctaggtggagggcacccc

SEQ ID NO: 82181 - DNA, 25 bp, Mus musculus
aatgctgctcagaaaacacccggaa

SEQ ID NO: 82182 - DNA, 25 bp, Mus musculus
aatgctgctcagataacccctatag

SEQ ID NO: 82183 - DNA, 25 bp, Mus musculus
aatgctgctcagtaaacacccggaa

SEQ ID NO: 82184 - DNA, 25 bp, Mus musculus
aatgctgctcagttaacccctatag

SEQ ID NO: 82185 - DNA, 25 bp, Mus musculus
aatgctgctcttcggagtgaacctt

SEQ ID NO: 82186 - DNA, 25 bp, Mus musculus
aatgctgctcttgggagtgaacctt

SEQ ID NO: 82187 - DNA, 25 bp, Mus musculus
aatgctgctgctagtaccagccttc

SEQ ID NO: 82188 - DNA, 25 bp, Mus musculus
aatgctgctgctcggagatttcgat

SEQ ID NO: 82189 - DNA, 25 bp, Mus musculus
aatgctgctgctgggagatttcgat

SEQ ID NO: 82190 - DNA, 25 bp, Mus musculus
aatgctgctgcttgtaccagccttc

SEQ ID NO: 82191 - DNA, 25 bp, Mus musculus
aatgctgctggtacgctgtaaggat

SEQ ID NO: 82192 - DNA, 25 bp, Mus musculus
aatgctgctggttcgctgtaaggat

SEQ ID NO: 82193 - DNA, 25 bp, Mus musculus
aatgctgctgtcacttgtatgaatg

SEQ ID NO: 82194 - DNA, 25 bp, Mus musculus
aatgctgctgtctcttgtatgaatg

SEQ ID NO: 82195 - DNA, 25 bp, Mus musculus
aatgctgcttacaagtgatgtcact

SEQ ID NO: 82196 - DNA, 25 bp, Mus musculus
aatgctgcttactagtgatgtcact

SEQ ID NO: 82197 - DNA, 25 bp, Mus musculus
aatgctgcttagagtagtggattga

SEQ ID NO: 82198 - DNA, 25 bp, Mus musculus
aatgctgcttagtgtagtggattga

SEQ ID NO: 82199 - DNA, 25 bp, Mus musculus
aatgctgcttctacactcctgtcct

SEQ ID NO: 82200 - DNA, 25 bp, Mus musculus
aatgctgcttcttcactcctgtcct

SEQ ID NO: 82201 - DNA, 25 bp, Mus musculus
aatgctgcttgtccccagtgctgct

SEQ ID NO: 82202 - DNA, 25 bp, Mus musculus
aatgctgcttgtgcccagtgctgct

SEQ ID NO: 82203 - DNA, 25 bp, Mus musculus
aatgctgcttttcaaggctctttcc

SEQ ID NO: 82204 - DNA, 25 bp, Mus musculus
aatgctgcttttgaaggctctttcc

SEQ ID NO: 82205 - DNA, 25 bp, Mus musculus
aatgctggaacaagcagaggctgca

SEQ ID NO: 82206 - DNA, 25 bp, Mus musculus
aatgctggaacatgcagaggctgca

SEQ ID NO: 82207 - DNA, 25 bp, Mus musculus
aatgctggagacacactcaaattgt

SEQ ID NO: 82208 - DNA, 25 bp, Mus musculus
aatgctggagactcactcaaattgt

SEQ ID NO: 82209 - DNA, 25 bp, Mus musculus
aatgctggagagactccactgccta

SEQ ID NO: 82210 - DNA, 25 bp, Mus musculus
aatgctggagagtctccactgccta

SEQ ID NO: 82211 - DNA, 25 bp, Mus musculus
aatgctggagcaagatcagtcccaa

SEQ ID NO: 82212 - DNA, 25 bp, Mus musculus
aatgctggagcatgatcagtcccaa

SEQ ID NO: 82213 - DNA, 25 bp, Mus musculus
aatgctggagtaaggttatttcttt

SEQ ID NO: 82214 - DNA, 25 bp, Mus musculus
aatgctggagtatggttatttcttt

SEQ ID NO: 82215 - DNA, 25 bp, Mus musculus
aatgctggcagtattcctcagttgc

SEQ ID NO: 82216 - DNA, 25 bp, Mus musculus
aatgctggcagttttcctcagttgc

SEQ ID NO: 82217 - DNA, 25 bp, Mus musculus
aatgctggccatagttttaggtata

SEQ ID NO: 82218 - DNA, 25 bp, Mus musculus
aatgctggccattgttttaggtata

SEQ ID NO: 82219 - DNA, 25 bp, Mus musculus
aatgctggccttaatggaaacttca

SEQ ID NO: 82220 - DNA, 25 bp, Mus musculus
aatgctggcctttatggaaacttca

SEQ ID NO: 82221 - DNA, 25 bp, Mus musculus
aatgctggctgcactcatataagca

SEQ ID NO: 82222 - DNA, 25 bp, Mus musculus
aatgctggctgctctcatataagca

SEQ ID NO: 82223 - DNA, 25 bp, Mus musculus
aatgctgggacactcaccgtagctt

SEQ ID NO: 82224 - DNA, 25 bp, Mus musculus
aatgctgggacagtcaccgtagctt

SEQ ID NO: 82225 - DNA, 25 bp, Mus musculus
aatgctgggatccttaccgtgggtt

SEQ ID NO: 82226 - DNA, 25 bp, Mus musculus
aatgctgggatcgttaccgtgggtt

SEQ ID NO: 82227 - DNA, 25 bp, Mus musculus
aatgctgggattaccggcaagtatc

SEQ ID NO: 82228 - DNA, 25 bp, Mus musculus
aatgctgggatttccggcaagtatc

SEQ ID NO: 82229 - DNA, 25 bp, Mus musculus
aatgctgggcagctgtacctgacag

SEQ ID NO: 82230 - DNA, 25 bp, Mus musculus
aatgctgggcaggtgtacctgacag

SEQ ID NO: 82231 - DNA, 25 bp, Mus musculus
aatgctgggcgtacactggacaagg

SEQ ID NO: 82232 - DNA, 25 bp, Mus musculus
aatgctgggcgtctgttttcttaca

SEQ ID NO: 82233 - DNA, 25 bp, Mus musculus
aatgctgggcgtgtgttttcttaca

SEQ ID NO: 82234 - DNA, 25 bp, Mus musculus
aatgctgggcgttcactggacaagg

SEQ ID NO: 82235 - DNA, 25 bp, Mus musculus
aatgctggtagcagtgtgccgccag

SEQ ID NO: 82236 - DNA, 25 bp, Mus musculus
aatgctggtagctgtgtgccgccag

SEQ ID NO: 82237 - DNA, 25 bp, Mus musculus
aatgctggtcctcataggctgggat

SEQ ID NO: 82238 - DNA, 25 bp, Mus musculus
aatgctggtcctgataggctgggat

SEQ ID NO: 82239 - DNA, 25 bp, Mus musculus
aatgctggtgcccatcggtgacaag

SEQ ID NO: 82240 - DNA, 25 bp, Mus musculus
aatgctggtgccgatcggtgacaag

SEQ ID NO: 82241 - DNA, 25 bp, Mus musculus
aatgctggttccatacctctaataa

SEQ ID NO: 82242 - DNA, 25 bp, Mus musculus
aatgctggttccttacctctaataa

SEQ ID NO: 82243 - DNA, 25 bp, Mus musculus
aatgctggttttccatctagaccaa

SEQ ID NO: 82244 - DNA, 25 bp, Mus musculus
aatgctggttttgcatctagaccaa

SEQ ID NO: 82245 - DNA, 25 bp, Mus musculus
aatgctgtaaggagttctggttgta

SEQ ID NO: 82246 - DNA, 25 bp, Mus musculus
aatgctgtaaggtgttctggttgta

SEQ ID NO: 82247 - DNA, 25 bp, Mus musculus
aatgctgtaagtcctcaaaaattca

SEQ ID NO: 82248 - DNA, 25 bp, Mus musculus
aatgctgtaagtgctcaaaaattca

SEQ ID NO: 82249 - DNA, 25 bp, Mus musculus
aatgctgtactgatctgctgagctc

SEQ ID NO: 82250 - DNA, 25 bp, Mus musculus
aatgctgtactgttctgctgagctc

SEQ ID NO: 82251 - DNA, 25 bp, Mus musculus
aatgctgtagtgaatcctaccccac

SEQ ID NO: 82252 - DNA, 25 bp, Mus musculus
aatgctgtagtgtatcctaccccac

SEQ ID NO: 82253 - DNA, 25 bp, Mus musculus
aatgctgtatgaattcactacctaa

SEQ ID NO: 82254 - DNA, 25 bp, Mus musculus
aatgctgtatgatttcactacctaa

SEQ ID NO: 82255 - DNA, 25 bp, Mus musculus
aatgctgtattgattttccgaacaa

SEQ ID NO: 82256 - DNA, 25 bp, Mus musculus
aatgctgtattgtttttccgaacaa

SEQ ID NO: 82257 - DNA, 25 bp, Mus musculus
aatgctgtcacaatttacacaggta

SEQ ID NO: 82258 - DNA, 25 bp, Mus musculus
aatgctgtcacattttacacaggta

SEQ ID NO: 82259 - DNA, 25 bp, Mus musculus
aatgctgtcagaagcaagtgccctg

SEQ ID NO: 82260 - DNA, 25 bp, Mus musculus
aatgctgtcagatgcaagtgccctg

SEQ ID NO: 82261 - DNA, 25 bp, Mus musculus
aatgctgtcagcaaacaaccccact

SEQ ID NO: 82262 - DNA, 25 bp, Mus musculus
aatgctgtcagcacattactcctta

SEQ ID NO: 82263 - DNA, 25 bp, Mus musculus
aatgctgtcagctaacaaccccact

SEQ ID NO: 82264 - DNA, 25 bp, Mus musculus
aatgctgtcagctcattactcctta

SEQ ID NO: 82265 - DNA, 25 bp, Mus musculus
aatgctgtcaggacattatttgctg

SEQ ID NO: 82266 - DNA, 25 bp, Mus musculus
aatgctgtcaggtcattatttgctg

SEQ ID NO: 82267 - DNA, 25 bp, Mus musculus
aatgctgtccatactgagtctggga

SEQ ID NO: 82268 - DNA, 25 bp, Mus musculus
aatgctgtccattctgagtctggga

SEQ ID NO: 82269 - DNA, 25 bp, Mus musculus
aatgctgtccctagaaattgtctag

SEQ ID NO: 82270 - DNA, 25 bp, Mus musculus
aatgctgtcccttgaaattgtctag

SEQ ID NO: 82271 - DNA, 25 bp, Mus musculus
aatgctgtcctactattattccaca

SEQ ID NO: 82272 - DNA, 25 bp, Mus musculus
aatgctgtcctagtattattccaca

SEQ ID NO: 82273 - DNA, 25 bp, Mus musculus
aatgctgtctaccatcctgtactca

SEQ ID NO: 82274 - DNA, 25 bp, Mus musculus
aatgctgtctacgatcctgtactca

SEQ ID NO: 82275 - DNA, 25 bp, Mus musculus
aatgctgtctatctaagcacacctg

SEQ ID NO: 82276 - DNA, 25 bp, Mus musculus
aatgctgtctatgtaagcacacctg

SEQ ID NO: 82277 - DNA, 25 bp, Mus musculus
aatgctgtctcactgggtgtatcaa

SEQ ID NO: 82278 - DNA, 25 bp, Mus musculus
aatgctgtctcagtgggtgtatcaa

SEQ ID NO: 82279 - DNA, 25 bp, Mus musculus
aatgctgtctggagtgtctctctga

SEQ ID NO: 82280 - DNA, 25 bp, Mus musculus
aatgctgtctggtgtgtctctctga

SEQ ID NO: 82281 - DNA, 25 bp, Mus musculus
aatgctgtcttacactgcctgatga

SEQ ID NO: 82282 - DNA, 25 bp, Mus musculus
aatgctgtcttagactgcctgatga

SEQ ID NO: 82283 - DNA, 25 bp, Mus musculus
aatgctgtctttatgtttaccacat

SEQ ID NO: 82284 - DNA, 25 bp, Mus musculus
aatgctgtctttttgtttaccacat

SEQ ID NO: 82285 - DNA, 25 bp, Mus musculus
aatgctgtgaatctcttcctgggaa

SEQ ID NO: 82286 - DNA, 25 bp, Mus musculus
aatgctgtgaatgtcttcctgggaa

SEQ ID NO: 82287 - DNA, 25 bp, Mus musculus
aatgctgtgacacacatgcctagat

SEQ ID NO: 82288 - DNA, 25 bp, Mus musculus
aatgctgtgacagacatgcctagat

SEQ ID NO: 82289 - DNA, 25 bp, Mus musculus
aatgctgtgcacacattcagtggaa

SEQ ID NO: 82290 - DNA, 25 bp, Mus musculus
aatgctgtgcactcattcagtggaa

SEQ ID NO: 82291 - DNA, 25 bp, Mus musculus
aatgctgtgctactttgggtgcttt

SEQ ID NO: 82292 - DNA, 25 bp, Mus musculus
aatgctgtgctagtttgggtgcttt

SEQ ID NO: 82293 - DNA, 25 bp, Mus musculus
aatgctgtggatattttctgagaga

SEQ ID NO: 82294 - DNA, 25 bp, Mus musculus
aatgctgtggattttttctgagaga

SEQ ID NO: 82295 - DNA, 25 bp, Mus musculus
aatgctgtggcaagtatagggccca

SEQ ID NO: 82296 - DNA, 25 bp, Mus musculus
aatgctgtggcatgtatagggccca

SEQ ID NO: 82297 - DNA, 25 bp, Mus musculus
aatgctgtggccaagttttcttgtt

SEQ ID NO: 82298 - DNA, 25 bp, Mus musculus
aatgctgtggcctagttttcttgtt

SEQ ID NO: 82299 - DNA, 25 bp, Mus musculus
aatgctgtgggaatgacctgctggc

SEQ ID NO: 82300 - DNA, 25 bp, Mus musculus
aatgctgtgggattgacctgctggc

SEQ ID NO: 82301 - DNA, 25 bp, Mus musculus
aatgctgtgggcatactggtttgtt

SEQ ID NO: 82302 - DNA, 25 bp, Mus musculus
aatgctgtgggcttactggtttgtt

SEQ ID NO: 82303 - DNA, 25 bp, Mus musculus
aatgctgtgggtattgcatccctaa

SEQ ID NO: 82304 - DNA, 25 bp, Mus musculus
aatgctgtgggttttgcatccctaa

SEQ ID NO: 82305 - DNA, 25 bp, Mus musculus
aatgctgtggtcatgctggcaggct

SEQ ID NO: 82306 - DNA, 25 bp, Mus musculus
aatgctgtggtcttgctggcaggct

SEQ ID NO: 82307 - DNA, 25 bp, Mus musculus
aatgctgtgtaacctccttgctggc

SEQ ID NO: 82308 - DNA, 25 bp, Mus musculus
aatgctgtgtaagctccttgctggc

SEQ ID NO: 82309 - DNA, 25 bp, Mus musculus
aatgctgtgtgaatttctggaggtt

SEQ ID NO: 82310 - DNA, 25 bp, Mus musculus
aatgctgtgtgattttctggaggtt

SEQ ID NO: 82311 - DNA, 25 bp, Mus musculus
aatgctgtgttacaagtttggacca

SEQ ID NO: 82312 - DNA, 25 bp, Mus musculus
aatgctgtgttagaagtttggacca

SEQ ID NO: 82313 - DNA, 25 bp, Mus musculus
aatgctgttaacctcgcagttttaa

SEQ ID NO: 82314 - DNA, 25 bp, Mus musculus
aatgctgttaacgtcgcagttttaa

SEQ ID NO: 82315 - DNA, 25 bp, Mus musculus
aatgctgttcagaggaatgatgctt

SEQ ID NO: 82316 - DNA, 25 bp, Mus musculus
aatgctgttcagtggaatgatgctt

SEQ ID NO: 82317 - DNA, 25 bp, Mus musculus
aatgctgttcatagcacggatctgc

SEQ ID NO: 82318 - DNA, 25 bp, Mus musculus
aatgctgttcattgcacggatctgc

SEQ ID NO: 82319 - DNA, 25 bp, Mus musculus
aatgctgttgaccacctgaaacagg

SEQ ID NO: 82320 - DNA, 25 bp, Mus musculus
aatgctgttgacgacctgaaacagg

SEQ ID NO: 82321 - DNA, 25 bp, Mus musculus
aatgctgttgccaaagcctgatgat

SEQ ID NO: 82322 - DNA, 25 bp, Mus musculus
aatgctgttgcctaagcctgatgat

SEQ ID NO: 82323 - DNA, 25 bp, Mus musculus
aatgctgttgttacactctgtcgat

SEQ ID NO: 82324 - DNA, 25 bp, Mus musculus
aatgctgttgtttcactctgtcgat

SEQ ID NO: 82325 - DNA, 25 bp, Mus musculus
aatgctgtttcaagattctgctgaa

SEQ ID NO: 82326 - DNA, 25 bp, Mus musculus
aatgctgtttcactggttatgcggc

SEQ ID NO: 82327 - DNA, 25 bp, Mus musculus
aatgctgtttcagtggttatgcggc

SEQ ID NO: 82328 - DNA, 25 bp, Mus musculus
aatgctgtttcatgattctgctgaa

SEQ ID NO: 82329 - DNA, 25 bp, Mus musculus
aatgctgtttccatcacctgggatg

SEQ ID NO: 82330 - DNA, 25 bp, Mus musculus
aatgctgtttccttcacctgggatg

SEQ ID NO: 82331 - DNA, 25 bp, Mus musculus
aatgctgtttgaaactgtgtgcgac

SEQ ID NO: 82332 - DNA, 25 bp, Mus musculus
aatgctgtttgatactgtgtgcgac

SEQ ID NO: 82333 - DNA, 25 bp, Mus musculus
aatgctgttttaaaaccctcaggct

SEQ ID NO: 82334 - DNA, 25 bp, Mus musculus
aatgctgttttataaccctcaggct

SEQ ID NO: 82335 - DNA, 25 bp, Mus musculus
aatgctgttttgagggcggaaactc

SEQ ID NO: 82336 - DNA, 25 bp, Mus musculus
aatgctgttttgattgggcaggaag

SEQ ID NO: 82337 - DNA, 25 bp, Mus musculus
aatgctgttttgtgggcggaaactc

SEQ ID NO: 82338 - DNA, 25 bp, Mus musculus
aatgctgttttgtttgggcaggaag

SEQ ID NO: 82339 - DNA, 25 bp, Mus musculus
aatgcttaaagtactagaggtgcct

SEQ ID NO: 82340 - DNA, 25 bp, Mus musculus
aatgcttaaagttctagaggtgcct

SEQ ID NO: 82341 - DNA, 25 bp, Mus musculus
aatgcttaatatctgcaaggcctgg

SEQ ID NO: 82342 - DNA, 25 bp, Mus musculus
aatgcttaatatgtgcaaggcctgg

SEQ ID NO: 82343 - DNA, 25 bp, Mus musculus
aatgcttaattgacctaacttgtaa

SEQ ID NO: 82344 - DNA, 25 bp, Mus musculus
aatgcttaattgtcctaacttgtaa

SEQ ID NO: 82345 - DNA, 25 bp, Mus musculus
aatgcttaccagaaaagtgagccaa

SEQ ID NO: 82346 - DNA, 25 bp, Mus musculus
aatgcttaccagaaagggcctgatt

SEQ ID NO: 82347 - DNA, 25 bp, Mus musculus
aatgcttaccagtaaagtgagccaa

SEQ ID NO: 82348 - DNA, 25 bp, Mus musculus
aatgcttaccagtaagggcctgatt

SEQ ID NO: 82349 - DNA, 25 bp, Mus musculus
aatgcttactacaatcccaggaggt

SEQ ID NO: 82350 - DNA, 25 bp, Mus musculus
aatgcttactactatcccaggaggt

SEQ ID NO: 82351 - DNA, 25 bp, Mus musculus
aatgcttactagaataacactgaag

SEQ ID NO: 82352 - DNA, 25 bp, Mus musculus
aatgcttactagtataacactgaag

SEQ ID NO: 82353 - DNA, 25 bp, Mus musculus
aatgcttactgcaccttcactggta

SEQ ID NO: 82354 - DNA, 25 bp, Mus musculus
aatgcttactgcactggtaccatag

SEQ ID NO: 82355 - DNA, 25 bp, Mus musculus
aatgcttactgctccttcactggta

SEQ ID NO: 82356 - DNA, 25 bp, Mus musculus
aatgcttactgctctggtaccatag

SEQ ID NO: 82357 - DNA, 25 bp, Mus musculus
aatgcttagcagaatagatgaccaa

SEQ ID NO: 82358 - DNA, 25 bp, Mus musculus
aatgcttagcagcttccataaggat

SEQ ID NO: 82359 - DNA, 25 bp, Mus musculus
aatgcttagcaggttccataaggat

SEQ ID NO: 82360 - DNA, 25 bp, Mus musculus
aatgcttagcagtatagatgaccaa

SEQ ID NO: 82361 - DNA, 25 bp, Mus musculus
aatgcttagtgcaagccctggttgc

SEQ ID NO: 82362 - DNA, 25 bp, Mus musculus
aatgcttagtgctagccctggttgc

SEQ ID NO: 82363 - DNA, 25 bp, Mus musculus
aatgcttagtggattgtgaatagat

SEQ ID NO: 82364 - DNA, 25 bp, Mus musculus
aatgcttagtggtttgtgaatagat

SEQ ID NO: 82365 - DNA, 25 bp, Mus musculus
aatgcttagttgactggttcctgta

SEQ ID NO: 82366 - DNA, 25 bp, Mus musculus
aatgcttagttgtctggttcctgta

SEQ ID NO: 82367 - DNA, 25 bp, Mus musculus
aatgcttatcaacttgggccatcag

SEQ ID NO: 82368 - DNA, 25 bp, Mus musculus
aatgcttatcaagttgggccatcag

SEQ ID NO: 82369 - DNA, 25 bp, Mus musculus
aatgcttatcatcgattctggcgta

SEQ ID NO: 82370 - DNA, 25 bp, Mus musculus
aatgcttatcatctttttgaagtgg

SEQ ID NO: 82371 - DNA, 25 bp, Mus musculus
aatgcttatcatggattctggcgta

SEQ ID NO: 82372 - DNA, 25 bp, Mus musculus
aatgcttatcatgtttttgaagtgg

SEQ ID NO: 82373 - DNA, 25 bp, Mus musculus
aatgcttatcttcagccaaagggac

SEQ ID NO: 82374 - DNA, 25 bp, Mus musculus
aatgcttatcttgagccaaagggac

SEQ ID NO: 82375 - DNA, 25 bp, Mus musculus
aatgcttatgatcctgtcccttgag

SEQ ID NO: 82376 - DNA, 25 bp, Mus musculus
aatgcttatgatgctgtcccttgag

SEQ ID NO: 82377 - DNA, 25 bp, Mus musculus
aatgcttatgttatcagactttgta

SEQ ID NO: 82378 - DNA, 25 bp, Mus musculus
aatgcttatgttttcagactttgta

SEQ ID NO: 82379 - DNA, 25 bp, Mus musculus
aatgcttcaagcaacactcaggttt

SEQ ID NO: 82380 - DNA, 25 bp, Mus musculus
aatgcttcaagctacactcaggttt

SEQ ID NO: 82381 - DNA, 25 bp, Mus musculus
aatgcttcaatcatcgtcttatacc

SEQ ID NO: 82382 - DNA, 25 bp, Mus musculus
aatgcttcaatcttcgtcttatacc

SEQ ID NO: 82383 - DNA, 25 bp, Mus musculus
aatgcttcaggaatttgctctcaaa

SEQ ID NO: 82384 - DNA, 25 bp, Mus musculus
aatgcttcaggattttgctctcaaa

SEQ ID NO: 82385 - DNA, 25 bp, Mus musculus
aatgcttcatatctggcgtttttgt

SEQ ID NO: 82386 - DNA, 25 bp, Mus musculus
aatgcttcatatgtggcgtttttgt

SEQ ID NO: 82387 - DNA, 25 bp, Mus musculus
aatgcttcatctcagcagcaaagag

SEQ ID NO: 82388 - DNA, 25 bp, Mus musculus
aatgcttcatctgagcagcaaagag

SEQ ID NO: 82389 - DNA, 25 bp, Mus musculus
aatgcttccaaaagcctctttgctc

SEQ ID NO: 82390 - DNA, 25 bp, Mus musculus
aatgcttccaaatgcctctttgctc

SEQ ID NO: 82391 - DNA, 25 bp, Mus musculus
aatgcttccaatcaaagatcatcga

SEQ ID NO: 82392 - DNA, 25 bp, Mus musculus
aatgcttccaatgaaagatcatcga

SEQ ID NO: 82393 - DNA, 25 bp, Mus musculus
aatgcttccattatttcagcttaag

SEQ ID NO: 82394 - DNA, 25 bp, Mus musculus
aatgcttccattttttcagcttaag

SEQ ID NO: 82395 - DNA, 25 bp, Mus musculus
aatgcttccctaaaatcagaaaaat

SEQ ID NO: 82396 - DNA, 25 bp, Mus musculus
aatgcttccctataatcagaaaaat

SEQ ID NO: 82397 - DNA, 25 bp, Mus musculus
aatgcttcctctcttgtagtcttta

SEQ ID NO: 82398 - DNA, 25 bp, Mus musculus
aatgcttcctctgttgtagtcttta

SEQ ID NO: 82399 - DNA, 25 bp, Mus musculus
aatgcttcctgcatatacaactgaa

SEQ ID NO: 82400 - DNA, 25 bp, Mus musculus
aatgcttcctgcttatacaactgaa

SEQ ID NO: 82401 - DNA, 25 bp, Mus musculus
aatgcttcctgtcattattgtacct

SEQ ID NO: 82402 - DNA, 25 bp, Mus musculus
aatgcttcctgtgattattgtacct

SEQ ID NO: 82403 - DNA, 25 bp, Mus musculus
aatgcttcggctaggattgtcagct

SEQ ID NO: 82404 - DNA, 25 bp, Mus musculus
aatgcttcggcttggattgtcagct

SEQ ID NO: 82405 - DNA, 25 bp, Mus musculus
aatgcttctacccactgtactgcat

SEQ ID NO: 82406 - DNA, 25 bp, Mus musculus
aatgcttctaccgactgtactgcat

SEQ ID NO: 82407 - DNA, 25 bp, Mus musculus
aatgcttctagacccagctttggca

SEQ ID NO: 82408 - DNA, 25 bp, Mus musculus
aatgcttctagagccagctttggca

SEQ ID NO: 82409 - DNA, 25 bp, Mus musculus
aatgcttctctgcaggagactcagg

SEQ ID NO: 82410 - DNA, 25 bp, Mus musculus
aatgcttctctggaggagactcagg

SEQ ID NO: 82411 - DNA, 25 bp, Mus musculus
aatgcttctgatcatttatatccaa

SEQ ID NO: 82412 - DNA, 25 bp, Mus musculus
aatgcttctgatgatttatatccaa

SEQ ID NO: 82413 - DNA, 25 bp, Mus musculus
aatgcttctgctcatctttttgatt

SEQ ID NO: 82414 - DNA, 25 bp, Mus musculus
aatgcttctgctgatctttttgatt

SEQ ID NO: 82415 - DNA, 25 bp, Mus musculus
aatgcttctgtgatctttgttggta

SEQ ID NO: 82416 - DNA, 25 bp, Mus musculus
aatgcttctgtgttctttgttggta

SEQ ID NO: 82417 - DNA, 25 bp, Mus musculus
aatgcttctgttattatctcccaag

SEQ ID NO: 82418 - DNA, 25 bp, Mus musculus
aatgcttctgtttttatctcccaag

SEQ ID NO: 82419 - DNA, 25 bp, Mus musculus
aatgcttcttgtactacaggtttga

SEQ ID NO: 82420 - DNA, 25 bp, Mus musculus
aatgcttcttgttctacaggtttga

SEQ ID NO: 82421 - DNA, 25 bp, Mus musculus
aatgcttgaactcagttgatacatt

SEQ ID NO: 82422 - DNA, 25 bp, Mus musculus
aatgcttgaactgagttgatacatt

SEQ ID NO: 82423 - DNA, 25 bp, Mus musculus
aatgcttgactcagttgtgtttcta

SEQ ID NO: 82424 - DNA, 25 bp, Mus musculus
aatgcttgactctgttgtgtttcta

SEQ ID NO: 82425 - DNA, 25 bp, Mus musculus
aatgcttgacttcttgcacaggcta

SEQ ID NO: 82426 - DNA, 25 bp, Mus musculus
aatgcttgacttgttgcacaggcta

SEQ ID NO: 82427 - DNA, 25 bp, Mus musculus
aatgcttgaggtctactcgtgcctg

SEQ ID NO: 82428 - DNA, 25 bp, Mus musculus
aatgcttgaggtgtactcgtgcctg

SEQ ID NO: 82429 - DNA, 25 bp, Mus musculus
aatgcttgatggatcttcttgctag

SEQ ID NO: 82430 - DNA, 25 bp, Mus musculus
aatgcttgatggttcttcttgctag

SEQ ID NO: 82431 - DNA, 25 bp, Mus musculus
aatgcttgatgtcccaactggtgga

SEQ ID NO: 82432 - DNA, 25 bp, Mus musculus
aatgcttgatgtgccaactggtgga

SEQ ID NO: 82433 - DNA, 25 bp, Mus musculus
aatgcttgcactacattgtttgttt

SEQ ID NO: 82434 - DNA, 25 bp, Mus musculus
aatgcttgcacttcattgtttgttt

SEQ ID NO: 82435 - DNA, 25 bp, Mus musculus
aatgcttgcatacattttcttagtt

SEQ ID NO: 82436 - DNA, 25 bp, Mus musculus
aatgcttgcatagattttcttagtt

SEQ ID NO: 82437 - DNA, 25 bp, Mus musculus
aatgcttgcattaccatgatgtgga

SEQ ID NO: 82438 - DNA, 25 bp, Mus musculus
aatgcttgcattcccttaagtcaaa

SEQ ID NO: 82439 - DNA, 25 bp, Mus musculus
aatgcttgcattgccttaagtcaaa

SEQ ID NO: 82440 - DNA, 25 bp, Mus musculus
aatgcttgcatttccatgatgtgga

SEQ ID NO: 82441 - DNA, 25 bp, Mus musculus
aatgcttgccacacacgagggagga

SEQ ID NO: 82442 - DNA, 25 bp, Mus musculus
aatgcttgccactcacgagggagga

SEQ ID NO: 82443 - DNA, 25 bp, Mus musculus
aatgcttgccagacattccaggaca

SEQ ID NO: 82444 - DNA, 25 bp, Mus musculus
aatgcttgccagtcattccaggaca

SEQ ID NO: 82445 - DNA, 25 bp, Mus musculus
aatgcttgccccagtttggacaaaa

SEQ ID NO: 82446 - DNA, 25 bp, Mus musculus
aatgcttgcccctgtttggacaaaa

SEQ ID NO: 82447 - DNA, 25 bp, Mus musculus
aatgcttgccgtcaccattgagtgg

SEQ ID NO: 82448 - DNA, 25 bp, Mus musculus
aatgcttgccgtgaccattgagtgg

SEQ ID NO: 82449 - DNA, 25 bp, Mus musculus
aatgcttgccttcccctgaactaat

SEQ ID NO: 82450 - DNA, 25 bp, Mus musculus
aatgcttgccttgccctgaactaat

SEQ ID NO: 82451 - DNA, 25 bp, Mus musculus
aatgcttgctatctggctgtttaca

SEQ ID NO: 82452 - DNA, 25 bp, Mus musculus
aatgcttgctatgtggctgtttaca

SEQ ID NO: 82453 - DNA, 25 bp, Mus musculus
aatgcttgctggcactggattggat

SEQ ID NO: 82454 - DNA, 25 bp, Mus musculus
aatgcttgctggcttgcagggtcct

SEQ ID NO: 82455 - DNA, 25 bp, Mus musculus
aatgcttgctgggactggattggat

SEQ ID NO: 82456 - DNA, 25 bp, Mus musculus
aatgcttgctgggttgcagggtcct

SEQ ID NO: 82457 - DNA, 25 bp, Mus musculus
aatgcttgctgtctttggcttgatc

SEQ ID NO: 82458 - DNA, 25 bp, Mus musculus
aatgcttgctgtgtttggcttgatc

SEQ ID NO: 82459 - DNA, 25 bp, Mus musculus
aatgcttgcttccagccagccaatc

SEQ ID NO: 82460 - DNA, 25 bp, Mus musculus
aatgcttgcttcgagccagccaatc

SEQ ID NO: 82461 - DNA, 25 bp, Mus musculus
aatgcttgctttcgaaacctcacat

SEQ ID NO: 82462 - DNA, 25 bp, Mus musculus
aatgcttgctttggaaacctcacat

SEQ ID NO: 82463 - DNA, 25 bp, Mus musculus
aatgcttggaatacctgtcatccgg

SEQ ID NO: 82464 - DNA, 25 bp, Mus musculus
aatgcttggaattcctgtcatccgg

SEQ ID NO: 82465 - DNA, 25 bp, Mus musculus
aatgcttgggagattggatacttgc

SEQ ID NO: 82466 - DNA, 25 bp, Mus musculus
aatgcttgggagtttggatacttgc

SEQ ID NO: 82467 - DNA, 25 bp, Mus musculus
aatgcttggtacatgtgcatctgtc

SEQ ID NO: 82468 - DNA, 25 bp, Mus musculus
aatgcttggtacttgtgcatctgtc

SEQ ID NO: 82469 - DNA, 25 bp, Mus musculus
aatgcttggtgacgctattggctga

SEQ ID NO: 82470 - DNA, 25 bp, Mus musculus
aatgcttggtgaggctattggctga

SEQ ID NO: 82471 - DNA, 25 bp, Mus musculus
aatgcttgtacacgccaaggccgtg

SEQ ID NO: 82472 - DNA, 25 bp, Mus musculus
aatgcttgtacaggccaaggccgtg

SEQ ID NO: 82473 - DNA, 25 bp, Mus musculus
aatgcttgtaccagccatactttat

SEQ ID NO: 82474 - DNA, 25 bp, Mus musculus
aatgcttgtaccagggatcctggaa

SEQ ID NO: 82475 - DNA, 25 bp, Mus musculus
aatgcttgtacctgccatactttat

SEQ ID NO: 82476 - DNA, 25 bp, Mus musculus
aatgcttgtacctgggatcctggaa

SEQ ID NO: 82477 - DNA, 25 bp, Mus musculus
aatgcttgtctgatacttatatatt

SEQ ID NO: 82478 - DNA, 25 bp, Mus musculus
aatgcttgtctgttacttatatatt

SEQ ID NO: 82479 - DNA, 25 bp, Mus musculus
aatgcttgtgaactgcttcccctta

SEQ ID NO: 82480 - DNA, 25 bp, Mus musculus
aatgcttgtgaagtgcttcccctta

SEQ ID NO: 82481 - DNA, 25 bp, Mus musculus
aatgcttgtgcaatatgttgacaaa

SEQ ID NO: 82482 - DNA, 25 bp, Mus musculus
aatgcttgtgcattatgttgacaaa

SEQ ID NO: 82483 - DNA, 25 bp, Mus musculus
aatgcttgtgtgaactacctcagga

SEQ ID NO: 82484 - DNA, 25 bp, Mus musculus
aatgcttgtgtgtactacctcagga

SEQ ID NO: 82485 - DNA, 25 bp, Mus musculus
aatgcttgtttgctggtgcatcttc

SEQ ID NO: 82486 - DNA, 25 bp, Mus musculus
aatgcttgtttggtggtgcatcttc

SEQ ID NO: 82487 - DNA, 25 bp, Mus musculus
aatgctttaacaactggcttaagac

SEQ ID NO: 82488 - DNA, 25 bp, Mus musculus
aatgctttaacatctggcttaagac

SEQ ID NO: 82489 - DNA, 25 bp, Mus musculus
aatgctttaactatccagacaccca

SEQ ID NO: 82490 - DNA, 25 bp, Mus musculus
aatgctttaactttccagacaccca

SEQ ID NO: 82491 - DNA, 25 bp, Mus musculus
aatgctttacatatgatacaactat

SEQ ID NO: 82492 - DNA, 25 bp, Mus musculus
aatgctttacatttgatacaactat

SEQ ID NO: 82493 - DNA, 25 bp, Mus musculus
aatgctttagaactacctggcccct

SEQ ID NO: 82494 - DNA, 25 bp, Mus musculus
aatgctttagaagtacctggcccct

SEQ ID NO: 82495 - DNA, 25 bp, Mus musculus
aatgctttaggtccagtggatcttt

SEQ ID NO: 82496 - DNA, 25 bp, Mus musculus
aatgctttaggtgcagtggatcttt

SEQ ID NO: 82497 - DNA, 25 bp, Mus musculus
aatgctttatgtctttatgggccag

SEQ ID NO: 82498 - DNA, 25 bp, Mus musculus
aatgctttatgtgtttatgggccag

SEQ ID NO: 82499 - DNA, 25 bp, Mus musculus
aatgctttcaacctcctatatgtag

SEQ ID NO: 82500 - DNA, 25 bp, Mus musculus
aatgctttcaacgtcctatatgtag

SEQ ID NO: 82501 - DNA, 25 bp, Mus musculus
aatgctttcctcagtgagtttacat

SEQ ID NO: 82502 - DNA, 25 bp, Mus musculus
aatgctttcctctgtgagtttacat

SEQ ID NO: 82503 - DNA, 25 bp, Mus musculus
aatgctttctctatccgacttacat

SEQ ID NO: 82504 - DNA, 25 bp, Mus musculus
aatgctttctctttccgacttacat

SEQ ID NO: 82505 - DNA, 25 bp, Mus musculus
aatgctttctggctgcatctggaga

SEQ ID NO: 82506 - DNA, 25 bp, Mus musculus
aatgctttctgggtgcatctggaga

SEQ ID NO: 82507 - DNA, 25 bp, Mus musculus
aatgctttctgtacaagcctcaaga

SEQ ID NO: 82508 - DNA, 25 bp, Mus musculus
aatgctttctgttcaagcctcaaga

SEQ ID NO: 82509 - DNA, 25 bp, Mus musculus
aatgctttcttcaattacagatgag

SEQ ID NO: 82510 - DNA, 25 bp, Mus musculus
aatgctttcttctattacagatgag

SEQ ID NO: 82511 - DNA, 25 bp, Mus musculus
aatgctttcttgactgttcaaggtc

SEQ ID NO: 82512 - DNA, 25 bp, Mus musculus
aatgctttcttgtctgttcaaggtc

SEQ ID NO: 82513 - DNA, 25 bp, Mus musculus
aatgctttgactactcttcattctg

SEQ ID NO: 82514 - DNA, 25 bp, Mus musculus
aatgctttgacttctcttcattctg

SEQ ID NO: 82515 - DNA, 25 bp, Mus musculus
aatgctttgccacaaggctgtgctt

SEQ ID NO: 82516 - DNA, 25 bp, Mus musculus
aatgctttgccagaaggctgtgctt

SEQ ID NO: 82517 - DNA, 25 bp, Mus musculus
aatgctttgcctagatttttgtcag

SEQ ID NO: 82518 - DNA, 25 bp, Mus musculus
aatgctttgccttgatttttgtcag

SEQ ID NO: 82519 - DNA, 25 bp, Mus musculus
aatgctttggatagtcttggacaga

SEQ ID NO: 82520 - DNA, 25 bp, Mus musculus
aatgctttggattgtcttggacaga

SEQ ID NO: 82521 - DNA, 25 bp, Mus musculus
aatgctttggcaatagtctttcaaa

SEQ ID NO: 82522 - DNA, 25 bp, Mus musculus
aatgctttggcattagtctttcaaa

SEQ ID NO: 82523 - DNA, 25 bp, Mus musculus
aatgctttgtggatgcacatacctt

SEQ ID NO: 82524 - DNA, 25 bp, Mus musculus
aatgctttgtggttgcacatacctt

SEQ ID NO: 82525 - DNA, 25 bp, Mus musculus
aatgctttgttaatgcccagcgtgg

SEQ ID NO: 82526 - DNA, 25 bp, Mus musculus
aatgctttgttattgcccagcgtgg

SEQ ID NO: 82527 - DNA, 25 bp, Mus musculus
aatgctttgttcctgttccagagaa

SEQ ID NO: 82528 - DNA, 25 bp, Mus musculus
aatgctttgttcgtgttccagagaa

SEQ ID NO: 82529 - DNA, 25 bp, Mus musculus
aatgctttgttgaatattgctcgaa

SEQ ID NO: 82530 - DNA, 25 bp, Mus musculus
aatgctttgttgtatattgctcgaa

SEQ ID NO: 82531 - DNA, 25 bp, Mus musculus
aatgcttttaagagtttgtcatgta

SEQ ID NO: 82532 - DNA, 25 bp, Mus musculus
aatgcttttaagtgtttgtcatgta

SEQ ID NO: 82533 - DNA, 25 bp, Mus musculus
aatgcttttatacagctctctgcta

SEQ ID NO: 82534 - DNA, 25 bp, Mus musculus
aatgcttttatagagctctctgcta

SEQ ID NO: 82535 - DNA, 25 bp, Mus musculus
aatgcttttattagtatcgaatgct

SEQ ID NO: 82536 - DNA, 25 bp, Mus musculus
aatgcttttatttgtatcgaatgct

SEQ ID NO: 82537 - DNA, 25 bp, Mus musculus
aatgcttttcctaagcagccaagat

SEQ ID NO: 82538 - DNA, 25 bp, Mus musculus
aatgcttttccttagcagccaagat

SEQ ID NO: 82539 - DNA, 25 bp, Mus musculus
aatgcttttctacacttctgctgga

SEQ ID NO: 82540 - DNA, 25 bp, Mus musculus
aatgcttttctagacttctgctgga

SEQ ID NO: 82541 - DNA, 25 bp, Mus musculus
aatgcttttctcatatcctactata

SEQ ID NO: 82542 - DNA, 25 bp, Mus musculus
aatgcttttctcttatcctactata

SEQ ID NO: 82543 - DNA, 25 bp, Mus musculus
aatgcttttcttcaccttgtttgag

SEQ ID NO: 82544 - DNA, 25 bp, Mus musculus
aatgcttttcttgaccttgtttgag

SEQ ID NO: 82545 - DNA, 25 bp, Mus musculus
aatgcttttgaacgcacaagtctcc

SEQ ID NO: 82546 - DNA, 25 bp, Mus musculus
aatgcttttgaaggcacaagtctcc

SEQ ID NO: 82547 - DNA, 25 bp, Mus musculus
aatgcttttggcactactaagtatt

SEQ ID NO: 82548 - DNA, 25 bp, Mus musculus
aatgcttttggctctactaagtatt

SEQ ID NO: 82549 - DNA, 25 bp, Mus musculus
aatgcttttgtccttaaatgcaact

SEQ ID NO: 82550 - DNA, 25 bp, Mus musculus
aatgcttttgtcgttaaatgcaact

SEQ ID NO: 82551 - DNA, 25 bp, Mus musculus
aatgctttttcacatcgtgagggat

SEQ ID NO: 82552 - DNA, 25 bp, Mus musculus
aatgctttttcagatcgtgagggat

SEQ ID NO: 82553 - DNA, 25 bp, Mus musculus
aatgctttttccactttgaatacca

SEQ ID NO: 82554 - DNA, 25 bp, Mus musculus
aatgctttttcctctttgaatacca

SEQ ID NO: 82555 - DNA, 25 bp, Mus musculus
aatgctttttctacaatacaggttc

SEQ ID NO: 82556 - DNA, 25 bp, Mus musculus
aatgctttttcttcaatacaggttc

SEQ ID NO: 82557 - DNA, 25 bp, Mus musculus
aatgctttttgtctcccgatgatgg

SEQ ID NO: 82558 - DNA, 25 bp, Mus musculus
aatgctttttgtgtcccgatgatgg

SEQ ID NO: 82559 - DNA, 25 bp, Mus musculus
aatggaaactgtacccagcccctct

SEQ ID NO: 82560 - DNA, 25 bp, Mus musculus
aatggaaactgttcccagcccctct

SEQ ID NO: 82561 - DNA, 25 bp, Mus musculus
aatggaaagcttctgcttctgtcct

SEQ ID NO: 82562 - DNA, 25 bp, Mus musculus
aatggaaagcttgtgcttctgtcct

SEQ ID NO: 82563 - DNA, 25 bp, Mus musculus
aatggaaatacaacattggtgattt

SEQ ID NO: 82564 - DNA, 25 bp, Mus musculus
aatggaaatacatcattggtgattt

SEQ ID NO: 82565 - DNA, 25 bp, Mus musculus
aatggaaatgacaggcggacactaa

SEQ ID NO: 82566 - DNA, 25 bp, Mus musculus
aatggaaatgactggcggacactaa

SEQ ID NO: 82567 - DNA, 25 bp, Mus musculus
aatggaaatgctctgccaggtcctg

SEQ ID NO: 82568 - DNA, 25 bp, Mus musculus
aatggaaatgctgtgccaggtcctg

SEQ ID NO: 82569 - DNA, 25 bp, Mus musculus
aatggaacaaccatccgattggaag

SEQ ID NO: 82570 - DNA, 25 bp, Mus musculus
aatggaacaaccttccgattggaag

SEQ ID NO: 82571 - DNA, 25 bp, Mus musculus
aatggaacacatacccttactgata

SEQ ID NO: 82572 - DNA, 25 bp, Mus musculus
aatggaacacattcccttactgata

SEQ ID NO: 82573 - DNA, 25 bp, Mus musculus
aatggaacactgacttagcggccag

SEQ ID NO: 82574 - DNA, 25 bp, Mus musculus
aatggaacactgtcttagcggccag

SEQ ID NO: 82575 - DNA, 25 bp, Mus musculus
aatggaacccagactgtgggactaa

SEQ ID NO: 82576 - DNA, 25 bp, Mus musculus
aatggaacccagtctgtgggactaa

SEQ ID NO: 82577 - DNA, 25 bp, Mus musculus
aatggaaccctaagtcctctgcaag

SEQ ID NO: 82578 - DNA, 25 bp, Mus musculus
aatggaaccctatgtcctctgcaag

SEQ ID NO: 82579 - DNA, 25 bp, Mus musculus
aatggaacccttcaaggccttctga

SEQ ID NO: 82580 - DNA, 25 bp, Mus musculus
aatggaacccttgaaggccttctga

SEQ ID NO: 82581 - DNA, 25 bp, Mus musculus
aatggaaccgatatgaggctaatat

SEQ ID NO: 82582 - DNA, 25 bp, Mus musculus
aatggaaccgatttgaggctaatat

SEQ ID NO: 82583 - DNA, 25 bp, Mus musculus
aatggaaccgttcctatatcgtttc

SEQ ID NO: 82584 - DNA, 25 bp, Mus musculus
aatggaaccgttgctatatcgtttc

SEQ ID NO: 82585 - DNA, 25 bp, Mus musculus
aatggaacctaaaccctgagggcat

SEQ ID NO: 82586 - DNA, 25 bp, Mus musculus
aatggaacctaatccctgagggcat

SEQ ID NO: 82587 - DNA, 25 bp, Mus musculus
aatggaacctgactggctgggaccc

SEQ ID NO: 82588 - DNA, 25 bp, Mus musculus
aatggaacctgagtggctgggaccc

SEQ ID NO: 82589 - DNA, 25 bp, Mus musculus
aatggaacctggctctagatcttct

SEQ ID NO: 82590 - DNA, 25 bp, Mus musculus
aatggaacctgggtctagatcttct

SEQ ID NO: 82591 - DNA, 25 bp, Mus musculus
aatggaacgcagcactttgtgcatg

SEQ ID NO: 82592 - DNA, 25 bp, Mus musculus
aatggaacgcaggactttgtgcatg

SEQ ID NO: 82593 - DNA, 25 bp, Mus musculus
aatggaacgcatatccaccctgtga

SEQ ID NO: 82594 - DNA, 25 bp, Mus musculus
aatggaacgcatttccaccctgtga

SEQ ID NO: 82595 - DNA, 25 bp, Mus musculus
aatggaacgctgactgatgagaaag

SEQ ID NO: 82596 - DNA, 25 bp, Mus musculus
aatggaacgctgtctgatgagaaag

SEQ ID NO: 82597 - DNA, 25 bp, Mus musculus
aatggaacggagacgatggacccag

SEQ ID NO: 82598 - DNA, 25 bp, Mus musculus
aatggaacggagtcgatggacccag

SEQ ID NO: 82599 - DNA, 25 bp, Mus musculus
aatggaacgttgaccccactgggct

SEQ ID NO: 82600 - DNA, 25 bp, Mus musculus
aatggaacgttgtccccactgggct

SEQ ID NO: 82601 - DNA, 25 bp, Mus musculus
aatggaactagtactgccttagagt

SEQ ID NO: 82602 - DNA, 25 bp, Mus musculus
aatggaactagttctgccttagagt

SEQ ID NO: 82603 - DNA, 25 bp, Mus musculus
aatggaactatgcaactgctggtgt

SEQ ID NO: 82604 - DNA, 25 bp, Mus musculus
aatggaactatggaactgctggtgt

SEQ ID NO: 82605 - DNA, 25 bp, Mus musculus
aatggaactcctctgtattcagact

SEQ ID NO: 82606 - DNA, 25 bp, Mus musculus
aatggaactcctgtgtattcagact

SEQ ID NO: 82607 - DNA, 25 bp, Mus musculus
aatggaactctgaaaccccatcatg

SEQ ID NO: 82608 - DNA, 25 bp, Mus musculus
aatggaactctgtaaccccatcatg

SEQ ID NO: 82609 - DNA, 25 bp, Mus musculus
aatggaactgcactacttgcttccc

SEQ ID NO: 82610 - DNA, 25 bp, Mus musculus
aatggaactgcagtacttgcttccc

SEQ ID NO: 82611 - DNA, 25 bp, Mus musculus
aatggaacttccagcagtcagctct

SEQ ID NO: 82612 - DNA, 25 bp, Mus musculus
aatggaacttcctgcagtcagctct

SEQ ID NO: 82613 - DNA, 25 bp, Mus musculus
aatggaagacccagtgctgcactta

SEQ ID NO: 82614 - DNA, 25 bp, Mus musculus
aatggaagaccctgtgctgcactta

SEQ ID NO: 82615 - DNA, 25 bp, Mus musculus
aatggaagaccgcttgacccctcat

SEQ ID NO: 82616 - DNA, 25 bp, Mus musculus
aatggaagaccggttgacccctcat

SEQ ID NO: 82617 - DNA, 25 bp, Mus musculus
aatggaagactcagctttgcagcta

SEQ ID NO: 82618 - DNA, 25 bp, Mus musculus
aatggaagactctgctttgcagcta

SEQ ID NO: 82619 - DNA, 25 bp, Mus musculus
aatggaagcaaaccctggcccagct

SEQ ID NO: 82620 - DNA, 25 bp, Mus musculus
aatggaagcaaagcctggcccagct

SEQ ID NO: 82621 - DNA, 25 bp, Mus musculus
aatggaagcagtactgcccatttaa

SEQ ID NO: 82622 - DNA, 25 bp, Mus musculus
aatggaagcagttctgcccatttaa

SEQ ID NO: 82623 - DNA, 25 bp, Mus musculus
aatggaagccgaccgctgattggcc

SEQ ID NO: 82624 - DNA, 25 bp, Mus musculus
aatggaagccgagcgctgattggcc

SEQ ID NO: 82625 - DNA, 25 bp, Mus musculus
aatggaagcctaagacgactacgaa

SEQ ID NO: 82626 - DNA, 25 bp, Mus musculus
aatggaagcctatgacgactacgaa

SEQ ID NO: 82627 - DNA, 25 bp, Mus musculus
aatggaagcctgaacacatagcgat

SEQ ID NO: 82628 - DNA, 25 bp, Mus musculus
aatggaagcctgtacacatagcgat

SEQ ID NO: 82629 - DNA, 25 bp, Mus musculus
aatggaagccttactacatctgcag

SEQ ID NO: 82630 - DNA, 25 bp, Mus musculus
aatggaagcctttctacatctgcag

SEQ ID NO: 82631 - DNA, 25 bp, Mus musculus
aatggaagctgcactctcagaagga

SEQ ID NO: 82632 - DNA, 25 bp, Mus musculus
aatggaagctgctctctcagaagga

SEQ ID NO: 82633 - DNA, 25 bp, Mus musculus
aatggaaggactcaagctactacat

SEQ ID NO: 82634 - DNA, 25 bp, Mus musculus
aatggaaggactgaagctactacat

SEQ ID NO: 82635 - DNA, 25 bp, Mus musculus
aatggaaggcctaatggagtaaact

SEQ ID NO: 82636 - DNA, 25 bp, Mus musculus
aatggaaggccttatggagtaaact

SEQ ID NO: 82637 - DNA, 25 bp, Mus musculus
aatggaagggagcagcctaaccgta

SEQ ID NO: 82638 - DNA, 25 bp, Mus musculus
aatggaagggaggagcctaaccgta

SEQ ID NO: 82639 - DNA, 25 bp, Mus musculus
aatggaagtcttagtgatcaggaaa

SEQ ID NO: 82640 - DNA, 25 bp, Mus musculus
aatggaagtctttgtgatcaggaaa

SEQ ID NO: 82641 - DNA, 25 bp, Mus musculus
aatggaagtgctacgatgcccttcg

SEQ ID NO: 82642 - DNA, 25 bp, Mus musculus
aatggaagtgcttcgatgcccttcg

SEQ ID NO: 82643 - DNA, 25 bp, Mus musculus
aatggaagtttcagcacaaccccga

SEQ ID NO: 82644 - DNA, 25 bp, Mus musculus
aatggaagtttctgcacaaccccga

SEQ ID NO: 82645 - DNA, 25 bp, Mus musculus
aatggaatactcaggaaattttgct

SEQ ID NO: 82646 - DNA, 25 bp, Mus musculus
aatggaatactctggaaattttgct

SEQ ID NO: 82647 - DNA, 25 bp, Mus musculus
aatggaatctacctggtctgtggca

SEQ ID NO: 82648 - DNA, 25 bp, Mus musculus
aatggaatctacgtggtctgtggca

SEQ ID NO: 82649 - DNA, 25 bp, Mus musculus
aatggaatcttccagctctggttcc

SEQ ID NO: 82650 - DNA, 25 bp, Mus musculus
aatggaatcttcgagctctggttcc

SEQ ID NO: 82651 - DNA, 25 bp, Mus musculus
aatggaatgacacctaaacccttag

SEQ ID NO: 82652 - DNA, 25 bp, Mus musculus
aatggaatgacagctaaacccttag

SEQ ID NO: 82653 - DNA, 25 bp, Mus musculus
aatggaatgattccacaggtttttg

SEQ ID NO: 82654 - DNA, 25 bp, Mus musculus
aatggaatgattgcacaggtttttg

SEQ ID NO: 82655 - DNA, 25 bp, Mus musculus
aatggaatgcataggtttctttttt

SEQ ID NO: 82656 - DNA, 25 bp, Mus musculus
aatggaatgcattggtttctttttt

SEQ ID NO: 82657 - DNA, 25 bp, Mus musculus
aatggaatgctcaaactgggtgtgt

SEQ ID NO: 82658 - DNA, 25 bp, Mus musculus
aatggaatgctctaactgggtgtgt

SEQ ID NO: 82659 - DNA, 25 bp, Mus musculus
aatggaattccaaacacttaacaca

SEQ ID NO: 82660 - DNA, 25 bp, Mus musculus
aatggaattccaatctgggagatca

SEQ ID NO: 82661 - DNA, 25 bp, Mus musculus
aatggaattccatacacttaacaca

SEQ ID NO: 82662 - DNA, 25 bp, Mus musculus
aatggaattccattctgggagatca

SEQ ID NO: 82663 - DNA, 25 bp, Mus musculus
aatggaattctcactcccaggtctg

SEQ ID NO: 82664 - DNA, 25 bp, Mus musculus
aatggaattctctctcccaggtctg

SEQ ID NO: 82665 - DNA, 25 bp, Mus musculus
aatggaattctgcagtcccctggga

SEQ ID NO: 82666 - DNA, 25 bp, Mus musculus
aatggaattctggagtcccctggga

SEQ ID NO: 82667 - DNA, 25 bp, Mus musculus
aatggaattgtacgcaaagcagggc

SEQ ID NO: 82668 - DNA, 25 bp, Mus musculus
aatggaattgtaggcaaagcagggc

SEQ ID NO: 82669 - DNA, 25 bp, Mus musculus
aatggacaacaaacagcacagtgga

SEQ ID NO: 82670 - DNA, 25 bp, Mus musculus
aatggacaacaatcagcacagtgga

SEQ ID NO: 82671 - DNA, 25 bp, Mus musculus
aatggacaccccagttaaagaacat

SEQ ID NO: 82672 - DNA, 25 bp, Mus musculus
aatggacacccctgttaaagaacat

SEQ ID NO: 82673 - DNA, 25 bp, Mus musculus
aatggacaccgtccgagggacctga

SEQ ID NO: 82674 - DNA, 25 bp, Mus musculus
aatggacaccgtgcgagggacctga

SEQ ID NO: 82675 - DNA, 25 bp, Mus musculus
aatggacagataaccttgttcaggt

SEQ ID NO: 82676 - DNA, 25 bp, Mus musculus
aatggacagatatccttgttcaggt

SEQ ID NO: 82677 - DNA, 25 bp, Mus musculus
aatggacagattctagtgaaccgta

SEQ ID NO: 82678 - DNA, 25 bp, Mus musculus
aatggacagattgtagtgaaccgta

SEQ ID NO: 82679 - DNA, 25 bp, Mus musculus
aatggacagcatcatcttcccaaag

SEQ ID NO: 82680 - DNA, 25 bp, Mus musculus
aatggacagcatgatcttcccaaag

SEQ ID NO: 82681 - DNA, 25 bp, Mus musculus
aatggacagccgatgcactgtacta

SEQ ID NO: 82682 - DNA, 25 bp, Mus musculus
aatggacagccgttgcactgtacta

SEQ ID NO: 82683 - DNA, 25 bp, Mus musculus
aatggacagctgctgttctccaagc

SEQ ID NO: 82684 - DNA, 25 bp, Mus musculus
aatggacagctggtgttctccaagc

SEQ ID NO: 82685 - DNA, 25 bp, Mus musculus
aatggacaggaacaccgccctgtgg

SEQ ID NO: 82686 - DNA, 25 bp, Mus musculus
aatggacaggaagaccgccctgtgg

SEQ ID NO: 82687 - DNA, 25 bp, Mus musculus
aatggacagtaacacttcataggta

SEQ ID NO: 82688 - DNA, 25 bp, Mus musculus
aatggacagtaagacttcataggta

SEQ ID NO: 82689 - DNA, 25 bp, Mus musculus
aatggacagtgtacccatgcttgat

SEQ ID NO: 82690 - DNA, 25 bp, Mus musculus
aatggacagtgttcccatgcttgat

SEQ ID NO: 82691 - DNA, 25 bp, Mus musculus
aatggacatctgagtgggacatcga

SEQ ID NO: 82692 - DNA, 25 bp, Mus musculus
aatggacatctgtgtgggacatcga

SEQ ID NO: 82693 - DNA, 25 bp, Mus musculus
aatggacattgcctacatctacccc

SEQ ID NO: 82694 - DNA, 25 bp, Mus musculus
aatggacattgcgtacatctacccc

SEQ ID NO: 82695 - DNA, 25 bp, Mus musculus
aatggacatttgctcagcgcctgta

SEQ ID NO: 82696 - DNA, 25 bp, Mus musculus
aatggacatttggtcagcgcctgta

SEQ ID NO: 82697 - DNA, 25 bp, Mus musculus
aatggaccacgcactcaggatgcag

SEQ ID NO: 82698 - DNA, 25 bp, Mus musculus
aatggaccacgctctcaggatgcag

SEQ ID NO: 82699 - DNA, 25 bp, Mus musculus
aatggaccacttcttgtatggcctc

SEQ ID NO: 82700 - DNA, 25 bp, Mus musculus
aatggaccacttgttgtatggcctc

SEQ ID NO: 82701 - DNA, 25 bp, Mus musculus
aatggaccagacattttatactgaa

SEQ ID NO: 82702 - DNA, 25 bp, Mus musculus
aatggaccagactttttatactgaa

SEQ ID NO: 82703 - DNA, 25 bp, Mus musculus
aatggaccaggtatgatcttctctg

SEQ ID NO: 82704 - DNA, 25 bp, Mus musculus
aatggaccaggtttgatcttctctg

SEQ ID NO: 82705 - DNA, 25 bp, Mus musculus
aatggaccagtcaccgagctttgct

SEQ ID NO: 82706 - DNA, 25 bp, Mus musculus
aatggaccagtctccgagctttgct

SEQ ID NO: 82707 - DNA, 25 bp, Mus musculus
aatggacccactattgtgtcctgaa

SEQ ID NO: 82708 - DNA, 25 bp, Mus musculus
aatggacccacttttgtgtcctgaa

SEQ ID NO: 82709 - DNA, 25 bp, Mus musculus
aatggacccaggagtagctgtgaca

SEQ ID NO: 82710 - DNA, 25 bp, Mus musculus
aatggacccaggtgtagctgtgaca

SEQ ID NO: 82711 - DNA, 25 bp, Mus musculus
aatggacccattagcagtacccttt

SEQ ID NO: 82712 - DNA, 25 bp, Mus musculus
aatggacccatttgcagtacccttt

SEQ ID NO: 82713 - DNA, 25 bp, Mus musculus
aatggaccctagagtcacacacggc

SEQ ID NO: 82714 - DNA, 25 bp, Mus musculus
aatggaccctagtgtcacacacggc

SEQ ID NO: 82715 - DNA, 25 bp, Mus musculus
aatggacccttacaggaccttgcag

SEQ ID NO: 82716 - DNA, 25 bp, Mus musculus
aatggacccttagaggaccttgcag

SEQ ID NO: 82717 - DNA, 25 bp, Mus musculus
aatggaccgacaatcatctgaattt

SEQ ID NO: 82718 - DNA, 25 bp, Mus musculus
aatggaccgacattcatctgaattt

SEQ ID NO: 82719 - DNA, 25 bp, Mus musculus
aatggaccgcaccagctcctgagtt

SEQ ID NO: 82720 - DNA, 25 bp, Mus musculus
aatggaccgcacgagctcctgagtt

SEQ ID NO: 82721 - DNA, 25 bp, Mus musculus
aatggacctcacacactagcggttt

SEQ ID NO: 82722 - DNA, 25 bp, Mus musculus
aatggacctcactcactagcggttt

SEQ ID NO: 82723 - DNA, 25 bp, Mus musculus
aatggacgatttcgagctagaagat

SEQ ID NO: 82724 - DNA, 25 bp, Mus musculus
aatggacgatttggagctagaagat

SEQ ID NO: 82725 - DNA, 25 bp, Mus musculus
aatggacggaggactccagctgctg

SEQ ID NO: 82726 - DNA, 25 bp, Mus musculus
aatggacggaggtctccagctgctg

SEQ ID NO: 82727 - DNA, 25 bp, Mus musculus
aatggacggtccatggtgcctcaga

SEQ ID NO: 82728 - DNA, 25 bp, Mus musculus
aatggacggtccttggtgcctcaga

SEQ ID NO: 82729 - DNA, 25 bp, Mus musculus
aatggacggttgctttccgctttca

SEQ ID NO: 82730 - DNA, 25 bp, Mus musculus
aatggacggttggtttccgctttca

SEQ ID NO: 82731 - DNA, 25 bp, Mus musculus
aatggacgtaacaacaaaggccttg

SEQ ID NO: 82732 - DNA, 25 bp, Mus musculus
aatggacgtaactacaaaggccttg

SEQ ID NO: 82733 - DNA, 25 bp, Mus musculus
aatggacgtaggagaacagacccaa

SEQ ID NO: 82734 - DNA, 25 bp, Mus musculus
aatggacgtaggtgaacagacccaa

SEQ ID NO: 82735 - DNA, 25 bp, Mus musculus
aatggacgtttgagccacgtgcggc

SEQ ID NO: 82736 - DNA, 25 bp, Mus musculus
aatggacgtttgtgccacgtgcggc

SEQ ID NO: 82737 - DNA, 25 bp, Mus musculus
aatggactacacagtagagatacaa

SEQ ID NO: 82738 - DNA, 25 bp, Mus musculus
aatggactacactgtagagatacaa

SEQ ID NO: 82739 - DNA, 25 bp, Mus musculus
aatggactagcaaggagctcagaga

SEQ ID NO: 82740 - DNA, 25 bp, Mus musculus
aatggactagcactgtgtcccttga

SEQ ID NO: 82741 - DNA, 25 bp, Mus musculus
aatggactagcagtgtgtcccttga

SEQ ID NO: 82742 - DNA, 25 bp, Mus musculus
aatggactagcatggagctcagaga

SEQ ID NO: 82743 - DNA, 25 bp, Mus musculus
aatggactatgtccacgtctgtaat

SEQ ID NO: 82744 - DNA, 25 bp, Mus musculus
aatggactatgtgcacgtctgtaat

SEQ ID NO: 82745 - DNA, 25 bp, Mus musculus
aatggactcagtctcgactgggctc

SEQ ID NO: 82746 - DNA, 25 bp, Mus musculus
aatggactcagtgtcgactgggctc

SEQ ID NO: 82747 - DNA, 25 bp, Mus musculus
aatggactcatgcactgggtggcct

SEQ ID NO: 82748 - DNA, 25 bp, Mus musculus
aatggactcatggactgggtggcct

SEQ ID NO: 82749 - DNA, 25 bp, Mus musculus
aatggactcccgagtttgaggttgt

SEQ ID NO: 82750 - DNA, 25 bp, Mus musculus
aatggactcccgtgtttgaggttgt

SEQ ID NO: 82751 - DNA, 25 bp, Mus musculus
aatggactcgtgaccagtttgcttt

SEQ ID NO: 82752 - DNA, 25 bp, Mus musculus
aatggactcgtgtccagtttgcttt

SEQ ID NO: 82753 - DNA, 25 bp, Mus musculus
aatggactctacagccttgaactgg

SEQ ID NO: 82754 - DNA, 25 bp, Mus musculus
aatggactctactgccttgaactgg

SEQ ID NO: 82755 - DNA, 25 bp, Mus musculus
aatggactctctcattcttggagtg

SEQ ID NO: 82756 - DNA, 25 bp, Mus musculus
aatggactctctgattcttggagtg

SEQ ID NO: 82757 - DNA, 25 bp, Mus musculus
aatggactctggcttgtgtaggctt

SEQ ID NO: 82758 - DNA, 25 bp, Mus musculus
aatggactctgggttgtgtaggctt

SEQ ID NO: 82759 - DNA, 25 bp, Mus musculus
aatggactctgtaaatcgtcagcta

SEQ ID NO: 82760 - DNA, 25 bp, Mus musculus
aatggactctgttaatcgtcagcta

SEQ ID NO: 82761 - DNA, 25 bp, Mus musculus
aatggactcttcatgtcaacttcta

SEQ ID NO: 82762 - DNA, 25 bp, Mus musculus
aatggactcttcttgtcaacttcta

SEQ ID NO: 82763 - DNA, 25 bp, Mus musculus
aatggactgaccacaagtgctgtat

SEQ ID NO: 82764 - DNA, 25 bp, Mus musculus
aatggactgacctcaagtgctgtat

SEQ ID NO: 82765 - DNA, 25 bp, Mus musculus
aatggactgccaatacatgactggg

SEQ ID NO: 82766 - DNA, 25 bp, Mus musculus
aatggactgccattacatgactggg

SEQ ID NO: 82767 - DNA, 25 bp, Mus musculus
aatggactgcttaacaagaccccgc

SEQ ID NO: 82768 - DNA, 25 bp, Mus musculus
aatggactgctttacaagaccccgc

SEQ ID NO: 82769 - DNA, 25 bp, Mus musculus
aatggactggagctttactgaatat

SEQ ID NO: 82770 - DNA, 25 bp, Mus musculus
aatggactggaggtttactgaatat

SEQ ID NO: 82771 - DNA, 25 bp, Mus musculus
aatggactggcaaggcgtgattatc

SEQ ID NO: 82772 - DNA, 25 bp, Mus musculus
aatggactggcatggcgtgattatc

SEQ ID NO: 82773 - DNA, 25 bp, Mus musculus
aatggactgtaccttccaatcaaat

SEQ ID NO: 82774 - DNA, 25 bp, Mus musculus
aatggactgtacgttccaatcaaat

SEQ ID NO: 82775 - DNA, 25 bp, Mus musculus
aatggactgtatcatgaccctacct

SEQ ID NO: 82776 - DNA, 25 bp, Mus musculus
aatggactgtatgatgaccctacct

SEQ ID NO: 82777 - DNA, 25 bp, Mus musculus
aatggacttagtatcaacaaggaca

SEQ ID NO: 82778 - DNA, 25 bp, Mus musculus
aatggacttagtttcaacaaggaca

SEQ ID NO: 82779 - DNA, 25 bp, Mus musculus
aatggacttattacagctctcctgg

SEQ ID NO: 82780 - DNA, 25 bp, Mus musculus
aatggacttatttcagctctcctgg

SEQ ID NO: 82781 - DNA, 25 bp, Mus musculus
aatggacttcctcatgttgtggcaa

SEQ ID NO: 82782 - DNA, 25 bp, Mus musculus
aatggacttcctgatgttgtggcaa

SEQ ID NO: 82783 - DNA, 25 bp, Mus musculus
aatggacttgcacagattaacacct

SEQ ID NO: 82784 - DNA, 25 bp, Mus musculus
aatggacttgcaccctctcttgtct

SEQ ID NO: 82785 - DNA, 25 bp, Mus musculus
aatggacttgcagagattaacacct

SEQ ID NO: 82786 - DNA, 25 bp, Mus musculus
aatggacttgcagcctctcttgtct

SEQ ID NO: 82787 - DNA, 25 bp, Mus musculus
aatggacttgcgattgttctctata

SEQ ID NO: 82788 - DNA, 25 bp, Mus musculus
aatggacttgcgtttgttctctata

SEQ ID NO: 82789 - DNA, 25 bp, Mus musculus
aatggacttgggactcagcagtttt

SEQ ID NO: 82790 - DNA, 25 bp, Mus musculus
aatggacttgggtctcagcagtttt

SEQ ID NO: 82791 - DNA, 25 bp, Mus musculus
aatggactttaactcaacttctttg

SEQ ID NO: 82792 - DNA, 25 bp, Mus musculus
aatggactttaagtcaacttctttg

SEQ ID NO: 82793 - DNA, 25 bp, Mus musculus
aatggagaagcaacctttatagtct

SEQ ID NO: 82794 - DNA, 25 bp, Mus musculus
aatggagaagcatcctttatagtct

SEQ ID NO: 82795 - DNA, 25 bp, Mus musculus
aatggagaagttagctgcacgatac

SEQ ID NO: 82796 - DNA, 25 bp, Mus musculus
aatggagaagtttgctgcacgatac

SEQ ID NO: 82797 - DNA, 25 bp, Mus musculus
aatggagaatcaacagccctacgct

SEQ ID NO: 82798 - DNA, 25 bp, Mus musculus
aatggagaatcatcagccctacgct

SEQ ID NO: 82799 - DNA, 25 bp, Mus musculus
aatggagacattccctccagctgtc

SEQ ID NO: 82800 - DNA, 25 bp, Mus musculus
aatggagacattgcctccagctgtc

SEQ ID NO: 82801 - DNA, 25 bp, Mus musculus
aatggagacggcatcggctacctgc

SEQ ID NO: 82802 - DNA, 25 bp, Mus musculus
aatggagacggcttcggctacctgc

SEQ ID NO: 82803 - DNA, 25 bp, Mus musculus
aatggagacggtagctcttgagcta

SEQ ID NO: 82804 - DNA, 25 bp, Mus musculus
aatggagacggttgctcttgagcta

SEQ ID NO: 82805 - DNA, 25 bp, Mus musculus
aatggagacttgacttcactgacag

SEQ ID NO: 82806 - DNA, 25 bp, Mus musculus
aatggagacttgtcttcactgacag

SEQ ID NO: 82807 - DNA, 25 bp, Mus musculus
aatggagagctgcttttcaacccac

SEQ ID NO: 82808 - DNA, 25 bp, Mus musculus
aatggagagctggttttcaacccac

SEQ ID NO: 82809 - DNA, 25 bp, Mus musculus
aatggagagggcctcacacagcact

SEQ ID NO: 82810 - DNA, 25 bp, Mus musculus
aatggagagggcgtcacacagcact

SEQ ID NO: 82811 - DNA, 25 bp, Mus musculus
aatggagaggttcctcagggcctgt

SEQ ID NO: 82812 - DNA, 25 bp, Mus musculus
aatggagaggttgctcagggcctgt

SEQ ID NO: 82813 - DNA, 25 bp, Mus musculus
aatggagatgcaccagcttcgctca

SEQ ID NO: 82814 - DNA, 25 bp, Mus musculus
aatggagatgcagcagcttcgctca

SEQ ID NO: 82815 - DNA, 25 bp, Mus musculus
aatggagatgccctaactcgggaag

SEQ ID NO: 82816 - DNA, 25 bp, Mus musculus
aatggagatgccgtaactcgggaag

SEQ ID NO: 82817 - DNA, 25 bp, Mus musculus
aatggagatggcactttccacgcat

SEQ ID NO: 82818 - DNA, 25 bp, Mus musculus
aatggagatggctctttccacgcat

SEQ ID NO: 82819 - DNA, 25 bp, Mus musculus
aatggagatggtcctcactggtgac

SEQ ID NO: 82820 - DNA, 25 bp, Mus musculus
aatggagatggtgctcactggtgac

SEQ ID NO: 82821 - DNA, 25 bp, Mus musculus
aatggagattatcattcccagacct

SEQ ID NO: 82822 - DNA, 25 bp, Mus musculus
aatggagattatgattcccagacct

SEQ ID NO: 82823 - DNA, 25 bp, Mus musculus
aatggagattcgcttattccctggg

SEQ ID NO: 82824 - DNA, 25 bp, Mus musculus
aatggagattcggttattccctggg

SEQ ID NO: 82825 - DNA, 25 bp, Mus musculus
aatggagattctatgcttagctgaa

SEQ ID NO: 82826 - DNA, 25 bp, Mus musculus
aatggagattctccttcttaccctc

SEQ ID NO: 82827 - DNA, 25 bp, Mus musculus
aatggagattctgcttcttaccctc

SEQ ID NO: 82828 - DNA, 25 bp, Mus musculus
aatggagattctttgcttagctgaa

SEQ ID NO: 82829 - DNA, 25 bp, Mus musculus
aatggagattgcctactagtgcgat

SEQ ID NO: 82830 - DNA, 25 bp, Mus musculus
aatggagattgcgtactagtgcgat

SEQ ID NO: 82831 - DNA, 25 bp, Mus musculus
aatggagcagcacatttcttgctgt

SEQ ID NO: 82832 - DNA, 25 bp, Mus musculus
aatggagcagcagatttcttgctgt

SEQ ID NO: 82833 - DNA, 25 bp, Mus musculus
aatggagcagggaacacatggtgta

SEQ ID NO: 82834 - DNA, 25 bp, Mus musculus
aatggagcagggtacacatggtgta

SEQ ID NO: 82835 - DNA, 25 bp, Mus musculus
aatggagcatgtccccacccacagg

SEQ ID NO: 82836 - DNA, 25 bp, Mus musculus
aatggagcatgtgcccacccacagg

SEQ ID NO: 82837 - DNA, 25 bp, Mus musculus
aatggagccaatacaggtttcagat

SEQ ID NO: 82838 - DNA, 25 bp, Mus musculus
aatggagccaattcaggtttcagat

SEQ ID NO: 82839 - DNA, 25 bp, Mus musculus
aatggagccagtccaagccctggag

SEQ ID NO: 82840 - DNA, 25 bp, Mus musculus
aatggagccagtgcaagccctggag

SEQ ID NO: 82841 - DNA, 25 bp, Mus musculus
aatggagcccagagcaaggccgtgt

SEQ ID NO: 82842 - DNA, 25 bp, Mus musculus
aatggagcccagtgcaaggccgtgt

SEQ ID NO: 82843 - DNA, 25 bp, Mus musculus
aatggagccggtctggaacagcaac

SEQ ID NO: 82844 - DNA, 25 bp, Mus musculus
aatggagccggtgtggaacagcaac

SEQ ID NO: 82845 - DNA, 25 bp, Mus musculus
aatggagcctgtaactaagtttatt

SEQ ID NO: 82846 - DNA, 25 bp, Mus musculus
aatggagcctgttactaagtttatt

SEQ ID NO: 82847 - DNA, 25 bp, Mus musculus
aatggagctgacaagacccgggaag

SEQ ID NO: 82848 - DNA, 25 bp, Mus musculus
aatggagctgactagacccgggaag

SEQ ID NO: 82849 - DNA, 25 bp, Mus musculus
aatggagctgtacctatggcctagc

SEQ ID NO: 82850 - DNA, 25 bp, Mus musculus
aatggagctgtagctatggcctagc

SEQ ID NO: 82851 - DNA, 25 bp, Mus musculus
aatggagcttttctcacgcgattgc

SEQ ID NO: 82852 - DNA, 25 bp, Mus musculus
aatggagcttttgtcacgcgattgc

SEQ ID NO: 82853 - DNA, 25 bp, Mus musculus
aatggaggaagaagctgagcccatc

SEQ ID NO: 82854 - DNA, 25 bp, Mus musculus
aatggaggaagatgctgagcccatc

SEQ ID NO: 82855 - DNA, 25 bp, Mus musculus
aatggaggagcacagatcccggcct

SEQ ID NO: 82856 - DNA, 25 bp, Mus musculus
aatggaggagcagagatcccggcct

SEQ ID NO: 82857 - DNA, 25 bp, Mus musculus
aatggaggcactaagaccccaactg

SEQ ID NO: 82858 - DNA, 25 bp, Mus musculus
aatggaggcacttagaccccaactg

SEQ ID NO: 82859 - DNA, 25 bp, Mus musculus
aatggaggcagtatgcagcccctaa

SEQ ID NO: 82860 - DNA, 25 bp, Mus musculus
aatggaggcagtttgcagcccctaa

SEQ ID NO: 82861 - DNA, 25 bp, Mus musculus
aatggaggccaaatccttgggcagc

SEQ ID NO: 82862 - DNA, 25 bp, Mus musculus
aatggaggccaattccttgggcagc

SEQ ID NO: 82863 - DNA, 25 bp, Mus musculus
aatggaggcgatactttgagcactg

SEQ ID NO: 82864 - DNA, 25 bp, Mus musculus
aatggaggcgattctttgagcactg

SEQ ID NO: 82865 - DNA, 25 bp, Mus musculus
aatggaggcgggacaccttatgccc

SEQ ID NO: 82866 - DNA, 25 bp, Mus musculus
aatggaggcgggtcaccttatgccc

SEQ ID NO: 82867 - DNA, 25 bp, Mus musculus
aatggagggatcacccctgcgggaa

SEQ ID NO: 82868 - DNA, 25 bp, Mus musculus
aatggagggatctcccctgcgggaa

SEQ ID NO: 82869 - DNA, 25 bp, Mus musculus
aatggagggctacactctgactggc

SEQ ID NO: 82870 - DNA, 25 bp, Mus musculus
aatggagggctagactctgactggc

SEQ ID NO: 82871 - DNA, 25 bp, Mus musculus
aatggaggtccactggccactttgt

SEQ ID NO: 82872 - DNA, 25 bp, Mus musculus
aatggaggtccagtggccactttgt

SEQ ID NO: 82873 - DNA, 25 bp, Mus musculus
aatggaggtctcatcatgatggatg

SEQ ID NO: 82874 - DNA, 25 bp, Mus musculus
aatggaggtctcttcatgatggatg

SEQ ID NO: 82875 - DNA, 25 bp, Mus musculus
aatggaggtctgacaggcactctgt

SEQ ID NO: 82876 - DNA, 25 bp, Mus musculus
aatggaggtctgtcaggcactctgt

SEQ ID NO: 82877 - DNA, 25 bp, Mus musculus
aatggaggtgccagtccttagcagt

SEQ ID NO: 82878 - DNA, 25 bp, Mus musculus
aatggaggtgcctgtccttagcagt

SEQ ID NO: 82879 - DNA, 25 bp, Mus musculus
aatggaggtgcgaacttcccgtggc

SEQ ID NO: 82880 - DNA, 25 bp, Mus musculus
aatggaggtgcgtacttcccgtggc

SEQ ID NO: 82881 - DNA, 25 bp, Mus musculus
aatggaggttacaccagttcttcct

SEQ ID NO: 82882 - DNA, 25 bp, Mus musculus
aatggaggttactccagttcttcct

SEQ ID NO: 82883 - DNA, 25 bp, Mus musculus
aatggagtcagacccacggttacca

SEQ ID NO: 82884 - DNA, 25 bp, Mus musculus
aatggagtcagagccacggttacca

SEQ ID NO: 82885 - DNA, 25 bp, Mus musculus
aatggagtcccgctttgagaaaatg

SEQ ID NO: 82886 - DNA, 25 bp, Mus musculus
aatggagtcccggtttgagaaaatg

SEQ ID NO: 82887 - DNA, 25 bp, Mus musculus
aatggagtccggatatgaacgacac

SEQ ID NO: 82888 - DNA, 25 bp, Mus musculus
aatggagtccggttatgaacgacac

SEQ ID NO: 82889 - DNA, 25 bp, Mus musculus
aatggagtccgtatctacaacgcct

SEQ ID NO: 82890 - DNA, 25 bp, Mus musculus
aatggagtccgtttctacaacgcct

SEQ ID NO: 82891 - DNA, 25 bp, Mus musculus
aatggagtcctacaggttttctgta

SEQ ID NO: 82892 - DNA, 25 bp, Mus musculus
aatggagtcctagaggttttctgta

SEQ ID NO: 82893 - DNA, 25 bp, Mus musculus
aatggagtccttcttctggacccca

SEQ ID NO: 82894 - DNA, 25 bp, Mus musculus
aatggagtccttgttctggacccca

SEQ ID NO: 82895 - DNA, 25 bp, Mus musculus
aatggagtcgaaaggccaagctcta

SEQ ID NO: 82896 - DNA, 25 bp, Mus musculus
aatggagtcgaatggccaagctcta

SEQ ID NO: 82897 - DNA, 25 bp, Mus musculus
aatggagtctagctccctttctact

SEQ ID NO: 82898 - DNA, 25 bp, Mus musculus
aatggagtctaggtccctttctact

SEQ ID NO: 82899 - DNA, 25 bp, Mus musculus
aatggagtgaatctcgccttcctgt

SEQ ID NO: 82900 - DNA, 25 bp, Mus musculus
aatggagtgaatgtcgccttcctgt

SEQ ID NO: 82901 - DNA, 25 bp, Mus musculus
aatggagtgacacgcctttctgcag

SEQ ID NO: 82902 - DNA, 25 bp, Mus musculus
aatggagtgacaggcctttctgcag

SEQ ID NO: 82903 - DNA, 25 bp, Mus musculus
aatggagttaccctctcgtgggagc

SEQ ID NO: 82904 - DNA, 25 bp, Mus musculus
aatggagttaccgtctcgtgggagc

SEQ ID NO: 82905 - DNA, 25 bp, Mus musculus
aatggagttagcacccattctgttc

SEQ ID NO: 82906 - DNA, 25 bp, Mus musculus
aatggagttagctcccattctgttc

SEQ ID NO: 82907 - DNA, 25 bp, Mus musculus
aatggagttcatcagctggtgaaaa

SEQ ID NO: 82908 - DNA, 25 bp, Mus musculus
aatggagttcatgagctggtgaaaa

SEQ ID NO: 82909 - DNA, 25 bp, Mus musculus
aatggagttcccaactggctggcag

SEQ ID NO: 82910 - DNA, 25 bp, Mus musculus
aatggagttccctactggctggcag

SEQ ID NO: 82911 - DNA, 25 bp, Mus musculus
aatggagttctacggtcctggctgt

SEQ ID NO: 82912 - DNA, 25 bp, Mus musculus
aatggagttctagggtcctggctgt

SEQ ID NO: 82913 - DNA, 25 bp, Mus musculus
aatggagtttgcatcggtggcagtt

SEQ ID NO: 82914 - DNA, 25 bp, Mus musculus
aatggagtttgcctcatggctctgc

SEQ ID NO: 82915 - DNA, 25 bp, Mus musculus
aatggagtttgcgtcatggctctgc

SEQ ID NO: 82916 - DNA, 25 bp, Mus musculus
aatggagtttgcttcggtggcagtt

SEQ ID NO: 82917 - DNA, 25 bp, Mus musculus
aatggataaagacgtgggcagcccc

SEQ ID NO: 82918 - DNA, 25 bp, Mus musculus
aatggataaagaggtgggcagcccc

SEQ ID NO: 82919 - DNA, 25 bp, Mus musculus
aatggataccagatccccaagggct

SEQ ID NO: 82920 - DNA, 25 bp, Mus musculus
aatggataccagttccccaagggct

SEQ ID NO: 82921 - DNA, 25 bp, Mus musculus
aatggatagtatactctgtctgtct

SEQ ID NO: 82922 - DNA, 25 bp, Mus musculus
aatggatagtattctctgtctgtct

SEQ ID NO: 82923 - DNA, 25 bp, Mus musculus
aatggatattgcactttgacttggt

SEQ ID NO: 82924 - DNA, 25 bp, Mus musculus
aatggatattgctctttgacttggt

SEQ ID NO: 82925 - DNA, 25 bp, Mus musculus
aatggatccaccaaatcatcccaga

SEQ ID NO: 82926 - DNA, 25 bp, Mus musculus
aatggatccacctaatcatcccaga

SEQ ID NO: 82927 - DNA, 25 bp, Mus musculus
aatggatcgtgtagaccctgagtga

SEQ ID NO: 82928 - DNA, 25 bp, Mus musculus
aatggatcgtgttgaccctgagtga

SEQ ID NO: 82929 - DNA, 25 bp, Mus musculus
aatggatctattattgcactggaat

SEQ ID NO: 82930 - DNA, 25 bp, Mus musculus
aatggatctatttttgcactggaat

SEQ ID NO: 82931 - DNA, 25 bp, Mus musculus
aatggatctcgaagttctctagtaa

SEQ ID NO: 82932 - DNA, 25 bp, Mus musculus
aatggatctcgatgttctctagtaa

SEQ ID NO: 82933 - DNA, 25 bp, Mus musculus
aatggatctgtgaggcacctggtgc

SEQ ID NO: 82934 - DNA, 25 bp, Mus musculus
aatggatctgtgtggcacctggtgc

SEQ ID NO: 82935 - DNA, 25 bp, Mus musculus
aatggatcttatattctcacaattg

SEQ ID NO: 82936 - DNA, 25 bp, Mus musculus
aatggatcttattttctcacaattg

SEQ ID NO: 82937 - DNA, 25 bp, Mus musculus
aatggatcttcaactccttgtatct

SEQ ID NO: 82938 - DNA, 25 bp, Mus musculus
aatggatcttcatctccttgtatct

SEQ ID NO: 82939 - DNA, 25 bp, Mus musculus
aatggatctttcataaaccttttga

SEQ ID NO: 82940 - DNA, 25 bp, Mus musculus
aatggatctttcttaaaccttttga

SEQ ID NO: 82941 - DNA, 25 bp, Mus musculus
aatggatgaagtccgagagttcgaa

SEQ ID NO: 82942 - DNA, 25 bp, Mus musculus
aatggatgaagtgcgagagttcgaa

SEQ ID NO: 82943 - DNA, 25 bp, Mus musculus
aatggatgacaaacattgtaaggaa

SEQ ID NO: 82944 - DNA, 25 bp, Mus musculus
aatggatgacaatcattgtaaggaa

SEQ ID NO: 82945 - DNA, 25 bp, Mus musculus
aatggatgacctccttcctccccat

SEQ ID NO: 82946 - DNA, 25 bp, Mus musculus
aatggatgacctgcttcctccccat

SEQ ID NO: 82947 - DNA, 25 bp, Mus musculus
aatggatgactgattgctgtacctc

SEQ ID NO: 82948 - DNA, 25 bp, Mus musculus
aatggatgactgtttgctgtacctc

SEQ ID NO: 82949 - DNA, 25 bp, Mus musculus
aatggatgcactccagttgccctga

SEQ ID NO: 82950 - DNA, 25 bp, Mus musculus
aatggatgcactgcagttgccctga

SEQ ID NO: 82951 - DNA, 25 bp, Mus musculus
aatggatgcatgcttctcagtgtaa

SEQ ID NO: 82952 - DNA, 25 bp, Mus musculus
aatggatgcatggttctcagtgtaa

SEQ ID NO: 82953 - DNA, 25 bp, Mus musculus
aatggatgcattattctatgtaaca

SEQ ID NO: 82954 - DNA, 25 bp, Mus musculus
aatggatgcatttttctatgtaaca

SEQ ID NO: 82955 - DNA, 25 bp, Mus musculus
aatggatgctagatttcttattttt

SEQ ID NO: 82956 - DNA, 25 bp, Mus musculus
aatggatgctagttttcttattttt

SEQ ID NO: 82957 - DNA, 25 bp, Mus musculus
aatggatggatacactcgcctggcc

SEQ ID NO: 82958 - DNA, 25 bp, Mus musculus
aatggatggatagactcgcctggcc

SEQ ID NO: 82959 - DNA, 25 bp, Mus musculus
aatggatggcctcagtccatagtcc

SEQ ID NO: 82960 - DNA, 25 bp, Mus musculus
aatggatggcctgagtccatagtcc

SEQ ID NO: 82961 - DNA, 25 bp, Mus musculus
aatggatggcttattgactatggtg

SEQ ID NO: 82962 - DNA, 25 bp, Mus musculus
aatggatggctttttgactatggtg

SEQ ID NO: 82963 - DNA, 25 bp, Mus musculus
aatggatggtaactctctttaacag

SEQ ID NO: 82964 - DNA, 25 bp, Mus musculus
aatggatggtaagtctctttaacag

SEQ ID NO: 82965 - DNA, 25 bp, Mus musculus
aatggatggtgcaacttgtggccct

SEQ ID NO: 82966 - DNA, 25 bp, Mus musculus
aatggatggtgctacttgtggccct

SEQ ID NO: 82967 - DNA, 25 bp, Mus musculus
aatggatggttacgctgggcttctc

SEQ ID NO: 82968 - DNA, 25 bp, Mus musculus
aatggatggttaggctgggcttctc

SEQ ID NO: 82969 - DNA, 25 bp, Mus musculus
aatggatgtcgtcagaagccttgct

SEQ ID NO: 82970 - DNA, 25 bp, Mus musculus
aatggatgtcgtgagaagccttgct

SEQ ID NO: 82971 - DNA, 25 bp, Mus musculus
aatggatgtgacaggctttacattt

SEQ ID NO: 82972 - DNA, 25 bp, Mus musculus
aatggatgtgactggctttacattt

SEQ ID NO: 82973 - DNA, 25 bp, Mus musculus
aatggatgtgcacagctgaggcaaa

SEQ ID NO: 82974 - DNA, 25 bp, Mus musculus
aatggatgtgcagagctgaggcaaa

SEQ ID NO: 82975 - DNA, 25 bp, Mus musculus
aatggatgtgcccaactgctctgta

SEQ ID NO: 82976 - DNA, 25 bp, Mus musculus
aatggatgtgccgaactgctctgta

SEQ ID NO: 82977 - DNA, 25 bp, Mus musculus
aatggatgtgtcagcactcatctct

SEQ ID NO: 82978 - DNA, 25 bp, Mus musculus
aatggatgtgtctgcactcatctct

SEQ ID NO: 82979 - DNA, 25 bp, Mus musculus
aatggatgtttgactgattcttcca

SEQ ID NO: 82980 - DNA, 25 bp, Mus musculus
aatggatgtttgtctgattcttcca

SEQ ID NO: 82981 - DNA, 25 bp, Mus musculus
aatggattacgactggcttctgccc

SEQ ID NO: 82982 - DNA, 25 bp, Mus musculus
aatggattacgagtggcttctgccc

SEQ ID NO: 82983 - DNA, 25 bp, Mus musculus
aatggattactcaactggattgtga

SEQ ID NO: 82984 - DNA, 25 bp, Mus musculus
aatggattactctactggattgtga

SEQ ID NO: 82985 - DNA, 25 bp, Mus musculus
aatggattataccactaaggcttag

SEQ ID NO: 82986 - DNA, 25 bp, Mus musculus
aatggattatacgactaaggcttag

SEQ ID NO: 82987 - DNA, 25 bp, Mus musculus
aatggattcattaccccagaagggc

SEQ ID NO: 82988 - DNA, 25 bp, Mus musculus
aatggattcatttccccagaagggc

SEQ ID NO: 82989 - DNA, 25 bp, Mus musculus
aatggattccacactgtctctgatg

SEQ ID NO: 82990 - DNA, 25 bp, Mus musculus
aatggattccactctgtctctgatg

SEQ ID NO: 82991 - DNA, 25 bp, Mus musculus
aatggattccggcacgatggttcga

SEQ ID NO: 82992 - DNA, 25 bp, Mus musculus
aatggattccgggacgatggttcga

SEQ ID NO: 82993 - DNA, 25 bp, Mus musculus
aatggattctgcaccaagccacagg

SEQ ID NO: 82994 - DNA, 25 bp, Mus musculus
aatggattctgctccaagccacagg

SEQ ID NO: 82995 - DNA, 25 bp, Mus musculus
aatggattgatcagacaccgtacga

SEQ ID NO: 82996 - DNA, 25 bp, Mus musculus
aatggattgatctgacaccgtacga

SEQ ID NO: 82997 - DNA, 25 bp, Mus musculus
aatggattgggcaattttctgagat

SEQ ID NO: 82998 - DNA, 25 bp, Mus musculus
aatggattgggctattttctgagat

SEQ ID NO: 82999 - DNA, 25 bp, Mus musculus
aatggattggtcaccttttgttatc

SEQ ID NO: 83000 - DNA, 25 bp, Mus musculus
aatggattggtctccttttgttatc

SEQ ID NO: 83001 - DNA, 25 bp, Mus musculus
aatggatttcaaaactgtggacaag

SEQ ID NO: 83002 - DNA, 25 bp, Mus musculus
aatggatttcaatactgtggacaag

SEQ ID NO: 83003 - DNA, 25 bp, Mus musculus
aatggatttcctcatatcctgccat

SEQ ID NO: 83004 - DNA, 25 bp, Mus musculus
aatggatttcctgatatcctgccat

SEQ ID NO: 83005 - DNA, 25 bp, Mus musculus
aatggatttctgcatgaccccaact

SEQ ID NO: 83006 - DNA, 25 bp, Mus musculus
aatggatttctgctgtgctgttggc

SEQ ID NO: 83007 - DNA, 25 bp, Mus musculus
aatggatttctggatgaccccaact

SEQ ID NO: 83008 - DNA, 25 bp, Mus musculus
aatggatttctggtgtgctgttggc

SEQ ID NO: 83009 - DNA, 25 bp, Mus musculus
aatggatttggacccttctgaggtc

SEQ ID NO: 83010 - DNA, 25 bp, Mus musculus
aatggatttggagccttctgaggtc

SEQ ID NO: 83011 - DNA, 25 bp, Mus musculus
aatggattttctaattagggcatgg

SEQ ID NO: 83012 - DNA, 25 bp, Mus musculus
aatggattttctcgacttttgtaat

SEQ ID NO: 83013 - DNA, 25 bp, Mus musculus
aatggattttctggacttttgtaat

SEQ ID NO: 83014 - DNA, 25 bp, Mus musculus
aatggattttcttattagggcatgg

SEQ ID NO: 83015 - DNA, 25 bp, Mus musculus
aatggcaaacctacacggaacagag

SEQ ID NO: 83016 - DNA, 25 bp, Mus musculus
aatggcaaaccttcacggaacagag

SEQ ID NO: 83017 - DNA, 25 bp, Mus musculus
aatggcaacaccacagacacagact

SEQ ID NO: 83018 - DNA, 25 bp, Mus musculus
aatggcaacacctcagacacagact

SEQ ID NO: 83019 - DNA, 25 bp, Mus musculus
aatggcaacagcaaaccggtgaaca

SEQ ID NO: 83020 - DNA, 25 bp, Mus musculus
aatggcaacagctaaccggtgaaca

SEQ ID NO: 83021 - DNA, 25 bp, Mus musculus
aatggcaacattattatatctaagc

SEQ ID NO: 83022 - DNA, 25 bp, Mus musculus
aatggcaacatttttatatctaagc

SEQ ID NO: 83023 - DNA, 25 bp, Mus musculus
aatggcaaccctaagtcttgagaac

SEQ ID NO: 83024 - DNA, 25 bp, Mus musculus
aatggcaacccttagtcttgagaac

SEQ ID NO: 83025 - DNA, 25 bp, Mus musculus
aatggcaacttcacaggaccggatt

SEQ ID NO: 83026 - DNA, 25 bp, Mus musculus
aatggcaacttctcaggaccggatt

SEQ ID NO: 83027 - DNA, 25 bp, Mus musculus
aatggcaagagaattcccacacctt

SEQ ID NO: 83028 - DNA, 25 bp, Mus musculus
aatggcaagagatttcccacacctt

SEQ ID NO: 83029 - DNA, 25 bp, Mus musculus
aatggcaagcttaggccagtgaaca

SEQ ID NO: 83030 - DNA, 25 bp, Mus musculus
aatggcaagctttggccagtgaaca

SEQ ID NO: 83031 - DNA, 25 bp, Mus musculus
aatggcaaggagaacaagccacaaa

SEQ ID NO: 83032 - DNA, 25 bp, Mus musculus
aatggcaaggagtacaagccacaaa

SEQ ID NO: 83033 - DNA, 25 bp, Mus musculus
aatggcaaggctcttgttcgtttta

SEQ ID NO: 83034 - DNA, 25 bp, Mus musculus
aatggcaaggctgttgttcgtttta

SEQ ID NO: 83035 - DNA, 25 bp, Mus musculus
aatggcaagtctaggcttaacgcct

SEQ ID NO: 83036 - DNA, 25 bp, Mus musculus
aatggcaagtcttggcttaacgcct

SEQ ID NO: 83037 - DNA, 25 bp, Mus musculus
aatggcaatgtcacttgaattccag

SEQ ID NO: 83038 - DNA, 25 bp, Mus musculus
aatggcaatgtctcttgaattccag

SEQ ID NO: 83039 - DNA, 25 bp, Mus musculus
aatggcaattggaaccaacagataa

SEQ ID NO: 83040 - DNA, 25 bp, Mus musculus
aatggcaattggtaccaacagataa

SEQ ID NO: 83041 - DNA, 25 bp, Mus musculus
aatggcacaaccctccatgtgggca

SEQ ID NO: 83042 - DNA, 25 bp, Mus musculus
aatggcacaaccgtccatgtgggca

SEQ ID NO: 83043 - DNA, 25 bp, Mus musculus
aatggcacacacacttaaacatcac

SEQ ID NO: 83044 - DNA, 25 bp, Mus musculus
aatggcacacactcttaaacatcac

SEQ ID NO: 83045 - DNA, 25 bp, Mus musculus
aatggcacaggcacccttgagtaag

SEQ ID NO: 83046 - DNA, 25 bp, Mus musculus
aatggcacaggctcccttgagtaag

SEQ ID NO: 83047 - DNA, 25 bp, Mus musculus
aatggcacatgcacttataaagggg

SEQ ID NO: 83048 - DNA, 25 bp, Mus musculus
aatggcacatgctcttataaagggg

SEQ ID NO: 83049 - DNA, 25 bp, Mus musculus
aatggcaccagcatcgggtgttctc

SEQ ID NO: 83050 - DNA, 25 bp, Mus musculus
aatggcaccagcttcgggtgttctc

SEQ ID NO: 83051 - DNA, 25 bp, Mus musculus
aatggcaccatgattgtctgcactg

SEQ ID NO: 83052 - DNA, 25 bp, Mus musculus
aatggcaccatgtttgtctgcactg

SEQ ID NO: 83053 - DNA, 25 bp, Mus musculus
aatggcaccctcagaattcttatgt

SEQ ID NO: 83054 - DNA, 25 bp, Mus musculus
aatggcaccctctgaattcttatgt

SEQ ID NO: 83055 - DNA, 25 bp, Mus musculus
aatggcaccgctccaaagagggtct

SEQ ID NO: 83056 - DNA, 25 bp, Mus musculus
aatggcaccgctgcaaagagggtct

SEQ ID NO: 83057 - DNA, 25 bp, Mus musculus
aatggcacgtaaataggacatttta

SEQ ID NO: 83058 - DNA, 25 bp, Mus musculus
aatggcacgtaattaggacatttta

SEQ ID NO: 83059 - DNA, 25 bp, Mus musculus
aatggcactacaatgaacgcatcat

SEQ ID NO: 83060 - DNA, 25 bp, Mus musculus
aatggcactacattgaacgcatcat

SEQ ID NO: 83061 - DNA, 25 bp, Mus musculus
aatggcactaggagctgccccaact

SEQ ID NO: 83062 - DNA, 25 bp, Mus musculus
aatggcactaggtgctgccccaact

SEQ ID NO: 83063 - DNA, 25 bp, Mus musculus
aatggcacttagatctgtccagctc

SEQ ID NO: 83064 - DNA, 25 bp, Mus musculus
aatggcacttagttctgtccagctc

SEQ ID NO: 83065 - DNA, 25 bp, Mus musculus
aatggcagaattcctgagagcagaa

SEQ ID NO: 83066 - DNA, 25 bp, Mus musculus
aatggcagaattgctgagagcagaa

SEQ ID NO: 83067 - DNA, 25 bp, Mus musculus
aatggcagacctctactcctagcac

SEQ ID NO: 83068 - DNA, 25 bp, Mus musculus
aatggcagacctgtactcctagcac

SEQ ID NO: 83069 - DNA, 25 bp, Mus musculus
aatggcagaggcattccccgaggca

SEQ ID NO: 83070 - DNA, 25 bp, Mus musculus
aatggcagaggctttccccgaggca

SEQ ID NO: 83071 - DNA, 25 bp, Mus musculus
aatggcagatggatctagttgctct

SEQ ID NO: 83072 - DNA, 25 bp, Mus musculus
aatggcagatggttctagttgctct

SEQ ID NO: 83073 - DNA, 25 bp, Mus musculus
aatggcagcaaaatctctaagagag

SEQ ID NO: 83074 - DNA, 25 bp, Mus musculus
aatggcagcaaattctctaagagag

SEQ ID NO: 83075 - DNA, 25 bp, Mus musculus
aatggcagcaaccactcagacggta

SEQ ID NO: 83076 - DNA, 25 bp, Mus musculus
aatggcagcaacgactcagacggta

SEQ ID NO: 83077 - DNA, 25 bp, Mus musculus
aatggcagcagcatcagcatttcct

SEQ ID NO: 83078 - DNA, 25 bp, Mus musculus
aatggcagcagccttgcagcccagg

SEQ ID NO: 83079 - DNA, 25 bp, Mus musculus
aatggcagcagcgttgcagcccagg

SEQ ID NO: 83080 - DNA, 25 bp, Mus musculus
aatggcagcagcttcagcatttcct

SEQ ID NO: 83081 - DNA, 25 bp, Mus musculus
aatggcagcatccatcattagatgc

SEQ ID NO: 83082 - DNA, 25 bp, Mus musculus
aatggcagcatcgatcattagatgc

SEQ ID NO: 83083 - DNA, 25 bp, Mus musculus
aatggcagcctaatagtacgagcat

SEQ ID NO: 83084 - DNA, 25 bp, Mus musculus
aatggcagcctattagtacgagcat

SEQ ID NO: 83085 - DNA, 25 bp, Mus musculus
aatggcagcctcagtaaaccttgaa

SEQ ID NO: 83086 - DNA, 25 bp, Mus musculus
aatggcagcctctgtaaaccttgaa

SEQ ID NO: 83087 - DNA, 25 bp, Mus musculus
aatggcagccttagactttctcgaa

SEQ ID NO: 83088 - DNA, 25 bp, Mus musculus
aatggcagcctttgactttctcgaa

SEQ ID NO: 83089 - DNA, 25 bp, Mus musculus
aatggcagcgccaatgctctcttca

SEQ ID NO: 83090 - DNA, 25 bp, Mus musculus
aatggcagcgcctatgctctcttca

SEQ ID NO: 83091 - DNA, 25 bp, Mus musculus
aatggcagcgtgctacaccgactct

SEQ ID NO: 83092 - DNA, 25 bp, Mus musculus
aatggcagcgtggtacaccgactct

SEQ ID NO: 83093 - DNA, 25 bp, Mus musculus
aatggcagcgttcgcatggttcaga

SEQ ID NO: 83094 - DNA, 25 bp, Mus musculus
aatggcagcgttggcatggttcaga

SEQ ID NO: 83095 - DNA, 25 bp, Mus musculus
aatggcagctgtcgctttatagcac

SEQ ID NO: 83096 - DNA, 25 bp, Mus musculus
aatggcagctgtggctttatagcac

SEQ ID NO: 83097 - DNA, 25 bp, Mus musculus
aatggcaggattatacagtgtttac

SEQ ID NO: 83098 - DNA, 25 bp, Mus musculus
aatggcaggattttacagtgtttac

SEQ ID NO: 83099 - DNA, 25 bp, Mus musculus
aatggcaggccaaggatacaatcct

SEQ ID NO: 83100 - DNA, 25 bp, Mus musculus
aatggcaggccatggatacaatcct

SEQ ID NO: 83101 - DNA, 25 bp, Mus musculus
aatggcagtagcagtctctcttata

SEQ ID NO: 83102 - DNA, 25 bp, Mus musculus
aatggcagtagctgtctctcttata

SEQ ID NO: 83103 - DNA, 25 bp, Mus musculus
aatggcagtagtcaccaaggacagt

SEQ ID NO: 83104 - DNA, 25 bp, Mus musculus
aatggcagtagtgaccaaggacagt

SEQ ID NO: 83105 - DNA, 25 bp, Mus musculus
aatggcagtatgacttcctcattgc

SEQ ID NO: 83106 - DNA, 25 bp, Mus musculus
aatggcagtatgtcttcctcattgc

SEQ ID NO: 83107 - DNA, 25 bp, Mus musculus
aatggcagtattagtccctagaccc

SEQ ID NO: 83108 - DNA, 25 bp, Mus musculus
aatggcagtatttgtccctagaccc

SEQ ID NO: 83109 - DNA, 25 bp, Mus musculus
aatggcagtcatcctttcttctgcc

SEQ ID NO: 83110 - DNA, 25 bp, Mus musculus
aatggcagtcatgctttcttctgcc

SEQ ID NO: 83111 - DNA, 25 bp, Mus musculus
aatggcagtggtaggcgtgccctca

SEQ ID NO: 83112 - DNA, 25 bp, Mus musculus
aatggcagtggttggcgtgccctca

SEQ ID NO: 83113 - DNA, 25 bp, Mus musculus
aatggcagtgtgcacgtctatgcta

SEQ ID NO: 83114 - DNA, 25 bp, Mus musculus
aatggcagtgtggacgtctatgcta

SEQ ID NO: 83115 - DNA, 25 bp, Mus musculus
aatggcatacccaaactctgaaagt

SEQ ID NO: 83116 - DNA, 25 bp, Mus musculus
aatggcataccctaactctgaaagt

SEQ ID NO: 83117 - DNA, 25 bp, Mus musculus
aatggcatcaagatgttccccagct

SEQ ID NO: 83118 - DNA, 25 bp, Mus musculus
aatggcatcaagttgttccccagct

SEQ ID NO: 83119 - DNA, 25 bp, Mus musculus
aatggcatcataaacccctttattg

SEQ ID NO: 83120 - DNA, 25 bp, Mus musculus
aatggcatcatatacccctttattg

SEQ ID NO: 83121 - DNA, 25 bp, Mus musculus
aatggcatcatgatgatccagacag

SEQ ID NO: 83122 - DNA, 25 bp, Mus musculus
aatggcatcatgttgatccagacag

SEQ ID NO: 83123 - DNA, 25 bp, Mus musculus
aatggcatccacctagacgggcaga

SEQ ID NO: 83124 - DNA, 25 bp, Mus musculus
aatggcatccacgtagacgggcaga

SEQ ID NO: 83125 - DNA, 25 bp, Mus musculus
aatggcatccttcggatttcctgca

SEQ ID NO: 83126 - DNA, 25 bp, Mus musculus
aatggcatccttgggatttcctgca

SEQ ID NO: 83127 - DNA, 25 bp, Mus musculus
aatggcatcggcattgcgcagatca

SEQ ID NO: 83128 - DNA, 25 bp, Mus musculus
aatggcatcggctttgcgcagatca

SEQ ID NO: 83129 - DNA, 25 bp, Mus musculus
aatggcatctctagcttctgctgaa

SEQ ID NO: 83130 - DNA, 25 bp, Mus musculus
aatggcatctctctacttttatcac

SEQ ID NO: 83131 - DNA, 25 bp, Mus musculus
aatggcatctctgtacttttatcac

SEQ ID NO: 83132 - DNA, 25 bp, Mus musculus
aatggcatctcttgcttctgctgaa

SEQ ID NO: 83133 - DNA, 25 bp, Mus musculus
aatggcatgctaaactattccttta

SEQ ID NO: 83134 - DNA, 25 bp, Mus musculus
aatggcatgctatactattccttta

SEQ ID NO: 83135 - DNA, 25 bp, Mus musculus
aatggcatgcttccccatctaagct

SEQ ID NO: 83136 - DNA, 25 bp, Mus musculus
aatggcatgcttcctctgattcagg

SEQ ID NO: 83137 - DNA, 25 bp, Mus musculus
aatggcatgcttgcccatctaagct

SEQ ID NO: 83138 - DNA, 25 bp, Mus musculus
aatggcatgcttgctctgattcagg

SEQ ID NO: 83139 - DNA, 25 bp, Mus musculus
aatggcatggttcgcctggtgccaa

SEQ ID NO: 83140 - DNA, 25 bp, Mus musculus
aatggcatggttggcctggtgccaa

SEQ ID NO: 83141 - DNA, 25 bp, Mus musculus
aatggcatgtggaaactgactccaa

SEQ ID NO: 83142 - DNA, 25 bp, Mus musculus
aatggcatgtggtaactgactccaa

SEQ ID NO: 83143 - DNA, 25 bp, Mus musculus
aatggcattaccaagaatgggctgg

SEQ ID NO: 83144 - DNA, 25 bp, Mus musculus
aatggcattacctagaatgggctgg

SEQ ID NO: 83145 - DNA, 25 bp, Mus musculus
aatggcattcaccttttcaacttct

SEQ ID NO: 83146 - DNA, 25 bp, Mus musculus
aatggcattcacgttttcaacttct

SEQ ID NO: 83147 - DNA, 25 bp, Mus musculus
aatggcattggaacatctacagaga

SEQ ID NO: 83148 - DNA, 25 bp, Mus musculus
aatggcattggatcatctacagaga

SEQ ID NO: 83149 - DNA, 25 bp, Mus musculus
aatggcatttctctagttgcacaag

SEQ ID NO: 83150 - DNA, 25 bp, Mus musculus
aatggcatttctgtagttgcacaag

SEQ ID NO: 83151 - DNA, 25 bp, Mus musculus
aatggcatttttcagatttctagaa

SEQ ID NO: 83152 - DNA, 25 bp, Mus musculus
aatggcatttttgagatttctagaa

SEQ ID NO: 83153 - DNA, 25 bp, Mus musculus
aatggccaaaatcatggacccacga

SEQ ID NO: 83154 - DNA, 25 bp, Mus musculus
aatggccaaaatcgctctgctcacc

SEQ ID NO: 83155 - DNA, 25 bp, Mus musculus
aatggccaaaatgatggacccacga

SEQ ID NO: 83156 - DNA, 25 bp, Mus musculus
aatggccaaaatggctctgctcacc

SEQ ID NO: 83157 - DNA, 25 bp, Mus musculus
aatggccaacatcccgaagaaaaca

SEQ ID NO: 83158 - DNA, 25 bp, Mus musculus
aatggccaacatgccgaagaaaaca

SEQ ID NO: 83159 - DNA, 25 bp, Mus musculus
aatggccaactgacttgcccattta

SEQ ID NO: 83160 - DNA, 25 bp, Mus musculus
aatggccaactgagtagatactgta

SEQ ID NO: 83161 - DNA, 25 bp, Mus musculus
aatggccaactgtcttgcccattta

SEQ ID NO: 83162 - DNA, 25 bp, Mus musculus
aatggccaactgtgtagatactgta

SEQ ID NO: 83163 - DNA, 25 bp, Mus musculus
aatggccaagcccaccttcaaaaga

SEQ ID NO: 83164 - DNA, 25 bp, Mus musculus
aatggccaagccgaccttcaaaaga

SEQ ID NO: 83165 - DNA, 25 bp, Mus musculus
aatggccaaggaagcctttgtccat

SEQ ID NO: 83166 - DNA, 25 bp, Mus musculus
aatggccaaggaccaccatacggac

SEQ ID NO: 83167 - DNA, 25 bp, Mus musculus
aatggccaaggagcaccatacggac

SEQ ID NO: 83168 - DNA, 25 bp, Mus musculus
aatggccaaggatgcctttgtccat

SEQ ID NO: 83169 - DNA, 25 bp, Mus musculus
aatggccaatgaccatcttatttta

SEQ ID NO: 83170 - DNA, 25 bp, Mus musculus
aatggccaatgagcatcttatttta

SEQ ID NO: 83171 - DNA, 25 bp, Mus musculus
aatggccaattgcacctcaacttgt

SEQ ID NO: 83172 - DNA, 25 bp, Mus musculus
aatggccaattggacctcaacttgt

SEQ ID NO: 83173 - DNA, 25 bp, Mus musculus
aatggccacaggattcgggaccagc

SEQ ID NO: 83174 - DNA, 25 bp, Mus musculus
aatggccacaggtttcgggaccagc

SEQ ID NO: 83175 - DNA, 25 bp, Mus musculus
aatggccacagtaatgtccagcaga

SEQ ID NO: 83176 - DNA, 25 bp, Mus musculus
aatggccacagttatgtccagcaga

SEQ ID NO: 83177 - DNA, 25 bp, Mus musculus
aatggccacatgcttgctaggccct

SEQ ID NO: 83178 - DNA, 25 bp, Mus musculus
aatggccacatggttgctaggccct

SEQ ID NO: 83179 - DNA, 25 bp, Mus musculus
aatggccaccaaatagaggagtcac

SEQ ID NO: 83180 - DNA, 25 bp, Mus musculus
aatggccaccaattagaggagtcac

SEQ ID NO: 83181 - DNA, 25 bp, Mus musculus
aatggccaccctctgttgtgggaac

SEQ ID NO: 83182 - DNA, 25 bp, Mus musculus
aatggccaccctgtgttgtgggaac

SEQ ID NO: 83183 - DNA, 25 bp, Mus musculus
aatggccaccgtcctttgtccactg

SEQ ID NO: 83184 - DNA, 25 bp, Mus musculus
aatggccaccgtgctttgtccactg

SEQ ID NO: 83185 - DNA, 25 bp, Mus musculus
aatggccactcaagagctcctagga

SEQ ID NO: 83186 - DNA, 25 bp, Mus musculus
aatggccactcatgagctcctagga

SEQ ID NO: 83187 - DNA, 25 bp, Mus musculus
aatggccagatcaaggcagtgcaca

SEQ ID NO: 83188 - DNA, 25 bp, Mus musculus
aatggccagatcagcctctgaggac

SEQ ID NO: 83189 - DNA, 25 bp, Mus musculus
aatggccagatctaggcagtgcaca

SEQ ID NO: 83190 - DNA, 25 bp, Mus musculus
aatggccagatctgcctctgaggac

SEQ ID NO: 83191 - DNA, 25 bp, Mus musculus
aatggccagccactgtgaatagact

SEQ ID NO: 83192 - DNA, 25 bp, Mus musculus
aatggccagccagtgtgaatagact

SEQ ID NO: 83193 - DNA, 25 bp, Mus musculus
aatggccaggaacttcttcttacaa

SEQ ID NO: 83194 - DNA, 25 bp, Mus musculus
aatggccaggaagttcttcttacaa

SEQ ID NO: 83195 - DNA, 25 bp, Mus musculus
aatggccaggcacacacccagggtc

SEQ ID NO: 83196 - DNA, 25 bp, Mus musculus
aatggccaggcagacacccagggtc

SEQ ID NO: 83197 - DNA, 25 bp, Mus musculus
aatggccatatacagctgtggccca

SEQ ID NO: 83198 - DNA, 25 bp, Mus musculus
aatggccatatagagctgtggccca

SEQ ID NO: 83199 - DNA, 25 bp, Mus musculus
aatggccatctacaaaagcaagctt

SEQ ID NO: 83200 - DNA, 25 bp, Mus musculus
aatggccatctagaaaagcaagctt

SEQ ID NO: 83201 - DNA, 25 bp, Mus musculus
aatggccattaccacaaccgttagt

SEQ ID NO: 83202 - DNA, 25 bp, Mus musculus
aatggccattacgacaaccgttagt

SEQ ID NO: 83203 - DNA, 25 bp, Mus musculus
aatggccattctcgtgatgtcataa

SEQ ID NO: 83204 - DNA, 25 bp, Mus musculus
aatggccattctggtgatgtcataa

SEQ ID NO: 83205 - DNA, 25 bp, Mus musculus
aatggcccaagtctcttaattcaaa

SEQ ID NO: 83206 - DNA, 25 bp, Mus musculus
aatggcccaagtgtcttaattcaaa

SEQ ID NO: 83207 - DNA, 25 bp, Mus musculus
aatggcccaccactcaaagtaaaga

SEQ ID NO: 83208 - DNA, 25 bp, Mus musculus
aatggcccaccagtcaaagtaaaga

SEQ ID NO: 83209 - DNA, 25 bp, Mus musculus
aatggcccagcactagtgtcacaga

SEQ ID NO: 83210 - DNA, 25 bp, Mus musculus
aatggcccagcagtagtgtcacaga

SEQ ID NO: 83211 - DNA, 25 bp, Mus musculus
aatggcccaggcctacagcatcatg

SEQ ID NO: 83212 - DNA, 25 bp, Mus musculus
aatggcccaggcgtacagcatcatg

SEQ ID NO: 83213 - DNA, 25 bp, Mus musculus
aatggcccattgagtatctgctcag

SEQ ID NO: 83214 - DNA, 25 bp, Mus musculus
aatggcccattgtgtatctgctcag

SEQ ID NO: 83215 - DNA, 25 bp, Mus musculus
aatggccccactcacacagaggcag

SEQ ID NO: 83216 - DNA, 25 bp, Mus musculus
aatggccccactgacacagaggcag

SEQ ID NO: 83217 - DNA, 25 bp, Mus musculus
aatggccccagtcggcttttgaggt

SEQ ID NO: 83218 - DNA, 25 bp, Mus musculus
aatggccccagtgggcttttgaggt

SEQ ID NO: 83219 - DNA, 25 bp, Mus musculus
aatggccccattacattaaccagga

SEQ ID NO: 83220 - DNA, 25 bp, Mus musculus
aatggccccattctggtccctattt

SEQ ID NO: 83221 - DNA, 25 bp, Mus musculus
aatggccccattgtggtccctattt

SEQ ID NO: 83222 - DNA, 25 bp, Mus musculus
aatggccccatttcattaaccagga

SEQ ID NO: 83223 - DNA, 25 bp, Mus musculus
aatggcccctgcataaatatttgct

SEQ ID NO: 83224 - DNA, 25 bp, Mus musculus
aatggcccctgcttaaatatttgct

SEQ ID NO: 83225 - DNA, 25 bp, Mus musculus
aatggccccttcagcgcagagcgag

SEQ ID NO: 83226 - DNA, 25 bp, Mus musculus
aatggccccttctgcgcagagcgag

SEQ ID NO: 83227 - DNA, 25 bp, Mus musculus
aatggccctcagatcactgaagatc

SEQ ID NO: 83228 - DNA, 25 bp, Mus musculus
aatggccctcagttcactgaagatc

SEQ ID NO: 83229 - DNA, 25 bp, Mus musculus
aatggccctgggattttgaggactc

SEQ ID NO: 83230 - DNA, 25 bp, Mus musculus
aatggccctgggtttttgaggactc

SEQ ID NO: 83231 - DNA, 25 bp, Mus musculus
aatggccctggtctccatcacggca

SEQ ID NO: 83232 - DNA, 25 bp, Mus musculus
aatggccctggtgtccatcacggca

SEQ ID NO: 83233 - DNA, 25 bp, Mus musculus
aatggccctgtcaacacccaggagt

SEQ ID NO: 83234 - DNA, 25 bp, Mus musculus
aatggccctgtctacacccaggagt

SEQ ID NO: 83235 - DNA, 25 bp, Mus musculus
aatggccgaatccaggtcctgagta

SEQ ID NO: 83236 - DNA, 25 bp, Mus musculus
aatggccgaatcgaggtcctgagta

SEQ ID NO: 83237 - DNA, 25 bp, Mus musculus
aatggccgacatcagctggcttgga

SEQ ID NO: 83238 - DNA, 25 bp, Mus musculus
aatggccgacatgagctggcttgga

SEQ ID NO: 83239 - DNA, 25 bp, Mus musculus
aatggccgagtactctcttcctcag

SEQ ID NO: 83240 - DNA, 25 bp, Mus musculus
aatggccgagtagtctcttcctcag

SEQ ID NO: 83241 - DNA, 25 bp, Mus musculus
aatggccgattcacgtagcttcctg

SEQ ID NO: 83242 - DNA, 25 bp, Mus musculus
aatggccgattctcgtagcttcctg

SEQ ID NO: 83243 - DNA, 25 bp, Mus musculus
aatggccgccgcatcgactacatgc

SEQ ID NO: 83244 - DNA, 25 bp, Mus musculus
aatggccgccgcttcgactacatgc

SEQ ID NO: 83245 - DNA, 25 bp, Mus musculus
aatggccggcttcagtgattgacat

SEQ ID NO: 83246 - DNA, 25 bp, Mus musculus
aatggccggcttgagtgattgacat

SEQ ID NO: 83247 - DNA, 25 bp, Mus musculus
aatggccgtagaccctggtggcatt

SEQ ID NO: 83248 - DNA, 25 bp, Mus musculus
aatggccgtagagcctggtggcatt

SEQ ID NO: 83249 - DNA, 25 bp, Mus musculus
aatggcctaaacctgtgcacctgta

SEQ ID NO: 83250 - DNA, 25 bp, Mus musculus
aatggcctaaacgtgtgcacctgta

SEQ ID NO: 83251 - DNA, 25 bp, Mus musculus
aatggcctaaatcagctgtactttt

SEQ ID NO: 83252 - DNA, 25 bp, Mus musculus
aatggcctaaatgagctgtactttt

SEQ ID NO: 83253 - DNA, 25 bp, Mus musculus
aatggcctcagcaagcagggctagt

SEQ ID NO: 83254 - DNA, 25 bp, Mus musculus
aatggcctcagctagcagggctagt

SEQ ID NO: 83255 - DNA, 25 bp, Mus musculus
aatggcctcatccttaaaatgttat

SEQ ID NO: 83256 - DNA, 25 bp, Mus musculus
aatggcctcatcgttaaaatgttat

SEQ ID NO: 83257 - DNA, 25 bp, Mus musculus
aatggcctccggcatgaatgcttca

SEQ ID NO: 83258 - DNA, 25 bp, Mus musculus
aatggcctccgggatgaatgcttca

SEQ ID NO: 83259 - DNA, 25 bp, Mus musculus
aatggcctcctgatcattcaggcga

SEQ ID NO: 83260 - DNA, 25 bp, Mus musculus
aatggcctcctgttcattcaggcga

SEQ ID NO: 83261 - DNA, 25 bp, Mus musculus
aatggcctcgatattatgacacttt

SEQ ID NO: 83262 - DNA, 25 bp, Mus musculus
aatggcctcgattttatgacacttt

SEQ ID NO: 83263 - DNA, 25 bp, Mus musculus
aatggcctcggcacagattcaagtc

SEQ ID NO: 83264 - DNA, 25 bp, Mus musculus
aatggcctcggctcagattcaagtc

SEQ ID NO: 83265 - DNA, 25 bp, Mus musculus
aatggcctctaaatcatgatgggac

SEQ ID NO: 83266 - DNA, 25 bp, Mus musculus
aatggcctctaattcatgatgggac

SEQ ID NO: 83267 - DNA, 25 bp, Mus musculus
aatggcctgaccagctatctagggt

SEQ ID NO: 83268 - DNA, 25 bp, Mus musculus
aatggcctgacctgctatctagggt

SEQ ID NO: 83269 - DNA, 25 bp, Mus musculus
aatggcctggacagcactacactgt

SEQ ID NO: 83270 - DNA, 25 bp, Mus musculus
aatggcctggactgcactacactgt

SEQ ID NO: 83271 - DNA, 25 bp, Mus musculus
aatggcctgggtagtccttgactgc

SEQ ID NO: 83272 - DNA, 25 bp, Mus musculus
aatggcctgggttgtccttgactgc

SEQ ID NO: 83273 - DNA, 25 bp, Mus musculus
aatggcctgtgcatattcacagcaa

SEQ ID NO: 83274 - DNA, 25 bp, Mus musculus
aatggcctgtgcttattcacagcaa

SEQ ID NO: 83275 - DNA, 25 bp, Mus musculus
aatggcctgtgtattcataggtcta

SEQ ID NO: 83276 - DNA, 25 bp, Mus musculus
aatggcctgtgttttcataggtcta

SEQ ID NO: 83277 - DNA, 25 bp, Mus musculus
aatggccttaccctcagcttgggag

SEQ ID NO: 83278 - DNA, 25 bp, Mus musculus
aatggccttaccgtcagcttgggag

SEQ ID NO: 83279 - DNA, 25 bp, Mus musculus
aatggccttcggctaaatgcaagat

SEQ ID NO: 83280 - DNA, 25 bp, Mus musculus
aatggccttcgggtaaatgcaagat

SEQ ID NO: 83281 - DNA, 25 bp, Mus musculus
aatggccttgcaccagccacaagat

SEQ ID NO: 83282 - DNA, 25 bp, Mus musculus
aatggccttgcagcagccacaagat

SEQ ID NO: 83283 - DNA, 25 bp, Mus musculus
aatggcctttgaattgcttcctctt

SEQ ID NO: 83284 - DNA, 25 bp, Mus musculus
aatggcctttgacgattacagtaga

SEQ ID NO: 83285 - DNA, 25 bp, Mus musculus
aatggcctttgaggattacagtaga

SEQ ID NO: 83286 - DNA, 25 bp, Mus musculus
aatggcctttgatttgcttcctctt

SEQ ID NO: 83287 - DNA, 25 bp, Mus musculus
aatggcctttgtaagcatgtgcaca

SEQ ID NO: 83288 - DNA, 25 bp, Mus musculus
aatggcctttgttagcatgtgcaca

SEQ ID NO: 83289 - DNA, 25 bp, Mus musculus
aatggccttttcatccatttggcac

SEQ ID NO: 83290 - DNA, 25 bp, Mus musculus
aatggccttttcttccatttggcac

SEQ ID NO: 83291 - DNA, 25 bp, Mus musculus
aatggcgaaggcaattctctggctc

SEQ ID NO: 83292 - DNA, 25 bp, Mus musculus
aatggcgaaggctattctctggctc

SEQ ID NO: 83293 - DNA, 25 bp, Mus musculus
aatggcgaatacaggctgggtaaca

SEQ ID NO: 83294 - DNA, 25 bp, Mus musculus
aatggcgaatactggctgggtaaca

SEQ ID NO: 83295 - DNA, 25 bp, Mus musculus
aatggcgcgtgaattgggtgtaaac

SEQ ID NO: 83296 - DNA, 25 bp, Mus musculus
aatggcgcgtgatttgggtgtaaac

SEQ ID NO: 83297 - DNA, 25 bp, Mus musculus
aatggcgctgcaaaggctgctcctg

SEQ ID NO: 83298 - DNA, 25 bp, Mus musculus
aatggcgctgcataggctgctcctg

SEQ ID NO: 83299 - DNA, 25 bp, Mus musculus
aatggcgcttcacaaaccgcagggc

SEQ ID NO: 83300 - DNA, 25 bp, Mus musculus
aatggcgcttcagaaaccgcagggc

SEQ ID NO: 83301 - DNA, 25 bp, Mus musculus
aatggcgggcatatcgagacaagct

SEQ ID NO: 83302 - DNA, 25 bp, Mus musculus
aatggcgggcatttcgagacaagct

SEQ ID NO: 83303 - DNA, 25 bp, Mus musculus
aatggcggtggcaactaccactact

SEQ ID NO: 83304 - DNA, 25 bp, Mus musculus
aatggcggtggctactaccactact

SEQ ID NO: 83305 - DNA, 25 bp, Mus musculus
aatggcgtcctaatcagaaagtcct

SEQ ID NO: 83306 - DNA, 25 bp, Mus musculus
aatggcgtcctattcagaaagtcct

SEQ ID NO: 83307 - DNA, 25 bp, Mus musculus
aatggcgtccttcattgttttctgt

SEQ ID NO: 83308 - DNA, 25 bp, Mus musculus
aatggcgtccttgattgttttctgt

SEQ ID NO: 83309 - DNA, 25 bp, Mus musculus
aatggcgtgaaaacagggtctctgg

SEQ ID NO: 83310 - DNA, 25 bp, Mus musculus
aatggcgtgaaatcagggtctctgg

SEQ ID NO: 83311 - DNA, 25 bp, Mus musculus
aatggcgtgaccattgtttgctctg

SEQ ID NO: 83312 - DNA, 25 bp, Mus musculus
aatggcgtgacctttgtttgctctg

SEQ ID NO: 83313 - DNA, 25 bp, Mus musculus
aatggcgtgctcacggccgccagcg

SEQ ID NO: 83314 - DNA, 25 bp, Mus musculus
aatggcgtgctctcggccgccagcg

SEQ ID NO: 83315 - DNA, 25 bp, Mus musculus
aatggcgtggtgctaccgagggcaa

SEQ ID NO: 83316 - DNA, 25 bp, Mus musculus
aatggcgtggtggtaccgagggcaa

SEQ ID NO: 83317 - DNA, 25 bp, Mus musculus
aatggcgttatcacatttactccgc

SEQ ID NO: 83318 - DNA, 25 bp, Mus musculus
aatggcgttatctcatttactccgc

SEQ ID NO: 83319 - DNA, 25 bp, Mus musculus
aatggctaacaccatccagcgggtg

SEQ ID NO: 83320 - DNA, 25 bp, Mus musculus
aatggctaacacgatccagcgggtg

SEQ ID NO: 83321 - DNA, 25 bp, Mus musculus
aatggctaactaagatgcctattta

SEQ ID NO: 83322 - DNA, 25 bp, Mus musculus
aatggctaactatgatgcctattta

SEQ ID NO: 83323 - DNA, 25 bp, Mus musculus
aatggctaattaagagatcaatttg

SEQ ID NO: 83324 - DNA, 25 bp, Mus musculus
aatggctaattatgagatcaatttg

SEQ ID NO: 83325 - DNA, 25 bp, Mus musculus
aatggctaccttagaccatttaagt

SEQ ID NO: 83326 - DNA, 25 bp, Mus musculus
aatggctacctttgaccatttaagt

SEQ ID NO: 83327 - DNA, 25 bp, Mus musculus
aatggctacgatcacctggaagtgt

SEQ ID NO: 83328 - DNA, 25 bp, Mus musculus
aatggctacgatgacctggaagtgt

SEQ ID NO: 83329 - DNA, 25 bp, Mus musculus
aatggctacgtactcatcaggcccc

SEQ ID NO: 83330 - DNA, 25 bp, Mus musculus
aatggctacgtagtcatcaggcccc

SEQ ID NO: 83331 - DNA, 25 bp, Mus musculus
aatggctatagactgggagcataac

SEQ ID NO: 83332 - DNA, 25 bp, Mus musculus
aatggctatagagtgggagcataac

SEQ ID NO: 83333 - DNA, 25 bp, Mus musculus
aatggctatcaacagctgctaataa

SEQ ID NO: 83334 - DNA, 25 bp, Mus musculus
aatggctatcaagagctgctaataa

SEQ ID NO: 83335 - DNA, 25 bp, Mus musculus
aatggctatcttctaagtgtgctgt

SEQ ID NO: 83336 - DNA, 25 bp, Mus musculus
aatggctatcttgtaagtgtgctgt

SEQ ID NO: 83337 - DNA, 25 bp, Mus musculus
aatggctatgcacatcgcctggtct

SEQ ID NO: 83338 - DNA, 25 bp, Mus musculus
aatggctatgcagatcgcctggtct

SEQ ID NO: 83339 - DNA, 25 bp, Mus musculus
aatggctatgggaggtaaacgagaa

SEQ ID NO: 83340 - DNA, 25 bp, Mus musculus
aatggctatgggtggtaaacgagaa

SEQ ID NO: 83341 - DNA, 25 bp, Mus musculus
aatggctattgcatgtgggtctcga

SEQ ID NO: 83342 - DNA, 25 bp, Mus musculus
aatggctattgcttgtgggtctcga

SEQ ID NO: 83343 - DNA, 25 bp, Mus musculus
aatggctcagtactcacgggtgctt

SEQ ID NO: 83344 - DNA, 25 bp, Mus musculus
aatggctcagtagtcacgggtgctt

SEQ ID NO: 83345 - DNA, 25 bp, Mus musculus
aatggctcagtgcactgaggctcct

SEQ ID NO: 83346 - DNA, 25 bp, Mus musculus
aatggctcagtggactgaggctcct

SEQ ID NO: 83347 - DNA, 25 bp, Mus musculus
aatggctcattaatagaggcactga

SEQ ID NO: 83348 - DNA, 25 bp, Mus musculus
aatggctcattattagaggcactga

SEQ ID NO: 83349 - DNA, 25 bp, Mus musculus
aatggctccaccattgactctgtga

SEQ ID NO: 83350 - DNA, 25 bp, Mus musculus
aatggctccacctttgactctgtga

SEQ ID NO: 83351 - DNA, 25 bp, Mus musculus
aatggctccagaattggctatctct

SEQ ID NO: 83352 - DNA, 25 bp, Mus musculus
aatggctccagatttggctatctct

SEQ ID NO: 83353 - DNA, 25 bp, Mus musculus
aatggctccataattcctactgaaa

SEQ ID NO: 83354 - DNA, 25 bp, Mus musculus
aatggctccatatttcctactgaaa

SEQ ID NO: 83355 - DNA, 25 bp, Mus musculus
aatggctcccatatgtttatatatt

SEQ ID NO: 83356 - DNA, 25 bp, Mus musculus
aatggctcccatttgtttatatatt

SEQ ID NO: 83357 - DNA, 25 bp, Mus musculus
aatggctcccctcatttaaattggg

SEQ ID NO: 83358 - DNA, 25 bp, Mus musculus
aatggctcccctgatttaaattggg

SEQ ID NO: 83359 - DNA, 25 bp, Mus musculus
aatggctccgccattaggaacactg

SEQ ID NO: 83360 - DNA, 25 bp, Mus musculus
aatggctccgcctttaggaacactg

SEQ ID NO: 83361 - DNA, 25 bp, Mus musculus
aatggctcctagaacacttgttctg

SEQ ID NO: 83362 - DNA, 25 bp, Mus musculus
aatggctcctagtacacttgttctg

SEQ ID NO: 83363 - DNA, 25 bp, Mus musculus
aatggctcctatacctttgttaaag

SEQ ID NO: 83364 - DNA, 25 bp, Mus musculus
aatggctcctattcctttgttaaag

SEQ ID NO: 83365 - DNA, 25 bp, Mus musculus
aatggctcggcacctagttttgaga

SEQ ID NO: 83366 - DNA, 25 bp, Mus musculus
aatggctcggcagctagttttgaga

SEQ ID NO: 83367 - DNA, 25 bp, Mus musculus
aatggctcgtcactgtaccccgttc

SEQ ID NO: 83368 - DNA, 25 bp, Mus musculus
aatggctcgtcagtgtaccccgttc

SEQ ID NO: 83369 - DNA, 25 bp, Mus musculus
aatggctctattatctctcatctct

SEQ ID NO: 83370 - DNA, 25 bp, Mus musculus
aatggctctattttctctcatctct

SEQ ID NO: 83371 - DNA, 25 bp, Mus musculus
aatggctctgcgatggagaaaggac

SEQ ID NO: 83372 - DNA, 25 bp, Mus musculus
aatggctctgcgttggagaaaggac

SEQ ID NO: 83373 - DNA, 25 bp, Mus musculus
aatggctctggcatgtcactagtgt

SEQ ID NO: 83374 - DNA, 25 bp, Mus musculus
aatggctctggcttgtcactagtgt

SEQ ID NO: 83375 - DNA, 25 bp, Mus musculus
aatggctcttccagctgtcactttt

SEQ ID NO: 83376 - DNA, 25 bp, Mus musculus
aatggctcttcctgctgtcactttt

SEQ ID NO: 83377 - DNA, 25 bp, Mus musculus
aatggctgaaacagaccaccaccag

SEQ ID NO: 83378 - DNA, 25 bp, Mus musculus
aatggctgaaactgaccaccaccag

SEQ ID NO: 83379 - DNA, 25 bp, Mus musculus
aatggctgaaagaaccccaggcaga

SEQ ID NO: 83380 - DNA, 25 bp, Mus musculus
aatggctgaaagtaccccaggcaga

SEQ ID NO: 83381 - DNA, 25 bp, Mus musculus
aatggctgacacagaacttgacgag

SEQ ID NO: 83382 - DNA, 25 bp, Mus musculus
aatggctgacactgaacttgacgag

SEQ ID NO: 83383 - DNA, 25 bp, Mus musculus
aatggctgaggacattctgtatccc

SEQ ID NO: 83384 - DNA, 25 bp, Mus musculus
aatggctgaggagattctgtatccc

SEQ ID NO: 83385 - DNA, 25 bp, Mus musculus
aatggctgatcaatgaatgctgttt

SEQ ID NO: 83386 - DNA, 25 bp, Mus musculus
aatggctgatcattgaatgctgttt

SEQ ID NO: 83387 - DNA, 25 bp, Mus musculus
aatggctgatgtactctttgagtac

SEQ ID NO: 83388 - DNA, 25 bp, Mus musculus
aatggctgatgttctctttgagtac

SEQ ID NO: 83389 - DNA, 25 bp, Mus musculus
aatggctgcacacagtaaaactgct

SEQ ID NO: 83390 - DNA, 25 bp, Mus musculus
aatggctgcacagagtaaaactgct

SEQ ID NO: 83391 - DNA, 25 bp, Mus musculus
aatggctgcagtccatcaacgtggc

SEQ ID NO: 83392 - DNA, 25 bp, Mus musculus
aatggctgcagtgcatcaacgtggc

SEQ ID NO: 83393 - DNA, 25 bp, Mus musculus
aatggctgcccgctaggcctagtgt

SEQ ID NO: 83394 - DNA, 25 bp, Mus musculus
aatggctgcccggtaggcctagtgt

SEQ ID NO: 83395 - DNA, 25 bp, Mus musculus
aatggctgccgaccccggaaggctc

SEQ ID NO: 83396 - DNA, 25 bp, Mus musculus
aatggctgccgagcccggaaggctc

SEQ ID NO: 83397 - DNA, 25 bp, Mus musculus
aatggctgccgtctgctatttaatt

SEQ ID NO: 83398 - DNA, 25 bp, Mus musculus
aatggctgccgtgtgctatttaatt

SEQ ID NO: 83399 - DNA, 25 bp, Mus musculus
aatggctgctctccgcatccacagg

SEQ ID NO: 83400 - DNA, 25 bp, Mus musculus
aatggctgctctgcgcatccacagg

SEQ ID NO: 83401 - DNA, 25 bp, Mus musculus
aatggctggcaacgacatggctgct

SEQ ID NO: 83402 - DNA, 25 bp, Mus musculus
aatggctggcaaggacatggctgct

SEQ ID NO: 83403 - DNA, 25 bp, Mus musculus
aatggctggcggaatctttgcgtgt

SEQ ID NO: 83404 - DNA, 25 bp, Mus musculus
aatggctggcggtatctttgcgtgt

SEQ ID NO: 83405 - DNA, 25 bp, Mus musculus
aatggctgtacacaactcctctaca

SEQ ID NO: 83406 - DNA, 25 bp, Mus musculus
aatggctgtacagaactcctctaca

SEQ ID NO: 83407 - DNA, 25 bp, Mus musculus
aatggctgtcagcaaacttcccggt

SEQ ID NO: 83408 - DNA, 25 bp, Mus musculus
aatggctgtcaggaaacttcccggt

SEQ ID NO: 83409 - DNA, 25 bp, Mus musculus
aatggctgtctgaactctttttaac

SEQ ID NO: 83410 - DNA, 25 bp, Mus musculus
aatggctgtctgtactctttttaac

SEQ ID NO: 83411 - DNA, 25 bp, Mus musculus
aatggctgtggtcatgcctgcaaac

SEQ ID NO: 83412 - DNA, 25 bp, Mus musculus
aatggctgtggtgatgcctgcaaac

SEQ ID NO: 83413 - DNA, 25 bp, Mus musculus
aatggctgttctcttcatgatagtc

SEQ ID NO: 83414 - DNA, 25 bp, Mus musculus
aatggctgttctgttcatgatagtc

SEQ ID NO: 83415 - DNA, 25 bp, Mus musculus
aatggctgttgacggccacatcttt

SEQ ID NO: 83416 - DNA, 25 bp, Mus musculus
aatggctgttgagggccacatcttt

SEQ ID NO: 83417 - DNA, 25 bp, Mus musculus
aatggctgttgcatgaggtgtttgc

SEQ ID NO: 83418 - DNA, 25 bp, Mus musculus
aatggctgttgcttgaggtgtttgc

SEQ ID NO: 83419 - DNA, 25 bp, Mus musculus
aatggctgtttgctactggttttca

SEQ ID NO: 83420 - DNA, 25 bp, Mus musculus
aatggctgtttggtactggttttca

SEQ ID NO: 83421 - DNA, 25 bp, Mus musculus
aatggcttacaaactgtagtctagc

SEQ ID NO: 83422 - DNA, 25 bp, Mus musculus
aatggcttacaatctgtagtctagc

SEQ ID NO: 83423 - DNA, 25 bp, Mus musculus
aatggcttacagatcttcacttaga

SEQ ID NO: 83424 - DNA, 25 bp, Mus musculus
aatggcttacagttcttcacttaga

SEQ ID NO: 83425 - DNA, 25 bp, Mus musculus
aatggcttagctaaccctataacag

SEQ ID NO: 83426 - DNA, 25 bp, Mus musculus
aatggcttagcttaccctataacag

SEQ ID NO: 83427 - DNA, 25 bp, Mus musculus
aatggcttaggcatggcagggacaa

SEQ ID NO: 83428 - DNA, 25 bp, Mus musculus
aatggcttaggcttggcagggacaa

SEQ ID NO: 83429 - DNA, 25 bp, Mus musculus
aatggcttagggattcacacgggtg

SEQ ID NO: 83430 - DNA, 25 bp, Mus musculus
aatggcttagggtttcacacgggtg

SEQ ID NO: 83431 - DNA, 25 bp, Mus musculus
aatggcttatacatgctgtcacctg

SEQ ID NO: 83432 - DNA, 25 bp, Mus musculus
aatggcttatacttgctgtcacctg

SEQ ID NO: 83433 - DNA, 25 bp, Mus musculus
aatggcttccagcacgttccataga

SEQ ID NO: 83434 - DNA, 25 bp, Mus musculus
aatggcttccaggacgttccataga

SEQ ID NO: 83435 - DNA, 25 bp, Mus musculus
aatggcttccggagaccatttgtgt

SEQ ID NO: 83436 - DNA, 25 bp, Mus musculus
aatggcttccggatgagatggacct

SEQ ID NO: 83437 - DNA, 25 bp, Mus musculus
aatggcttccggtgaccatttgtgt

SEQ ID NO: 83438 - DNA, 25 bp, Mus musculus
aatggcttccggttgagatggacct

SEQ ID NO: 83439 - DNA, 25 bp, Mus musculus
aatggcttctctaactgaaactcta

SEQ ID NO: 83440 - DNA, 25 bp, Mus musculus
aatggcttctcttactgaaactcta

SEQ ID NO: 83441 - DNA, 25 bp, Mus musculus
aatggcttgaacatgtcccctgtgg

SEQ ID NO: 83442 - DNA, 25 bp, Mus musculus
aatggcttgaacttgtcccctgtgg

SEQ ID NO: 83443 - DNA, 25 bp, Mus musculus
aatggcttgggtaagcccagccgtg

SEQ ID NO: 83444 - DNA, 25 bp, Mus musculus
aatggcttgggttagcccagccgtg

SEQ ID NO: 83445 - DNA, 25 bp, Mus musculus
aatggcttggtacctgagcaatgcc

SEQ ID NO: 83446 - DNA, 25 bp, Mus musculus
aatggcttggtagctgagcaatgcc

SEQ ID NO: 83447 - DNA, 25 bp, Mus musculus
aatggcttggtcaactgtgttcagt

SEQ ID NO: 83448 - DNA, 25 bp, Mus musculus
aatggcttggtctactgtgttcagt

SEQ ID NO: 83449 - DNA, 25 bp, Mus musculus
aatggcttgtctaccttatttgatg

SEQ ID NO: 83450 - DNA, 25 bp, Mus musculus
aatggcttgtcttccttatttgatg

SEQ ID NO: 83451 - DNA, 25 bp, Mus musculus
aatggcttgtgtatacttcatggca

SEQ ID NO: 83452 - DNA, 25 bp, Mus musculus
aatggcttgtgtttacttcatggca

SEQ ID NO: 83453 - DNA, 25 bp, Mus musculus
aatggctttaatatatttcaggaac

SEQ ID NO: 83454 - DNA, 25 bp, Mus musculus
aatggctttaatttatttcaggaac

SEQ ID NO: 83455 - DNA, 25 bp, Mus musculus
aatggctttactagtgacacgcccc

SEQ ID NO: 83456 - DNA, 25 bp, Mus musculus
aatggctttacttgtgacacgcccc

SEQ ID NO: 83457 - DNA, 25 bp, Mus musculus
aatggctttcataccgtatcactca

SEQ ID NO: 83458 - DNA, 25 bp, Mus musculus
aatggctttcattccgtatcactca

SEQ ID NO: 83459 - DNA, 25 bp, Mus musculus
aatggctttgcactaatgtgtatca

SEQ ID NO: 83460 - DNA, 25 bp, Mus musculus
aatggctttgcagtaatgtgtatca

SEQ ID NO: 83461 - DNA, 25 bp, Mus musculus
aatggctttgtccacatgttcctga

SEQ ID NO: 83462 - DNA, 25 bp, Mus musculus
aatggctttgtcgacatgttcctga

SEQ ID NO: 83463 - DNA, 25 bp, Mus musculus
aatggcttttatcggtgttctggga

SEQ ID NO: 83464 - DNA, 25 bp, Mus musculus
aatggcttttatgggtgttctggga

SEQ ID NO: 83465 - DNA, 25 bp, Mus musculus
aatggcttttcaactgacccttcag

SEQ ID NO: 83466 - DNA, 25 bp, Mus musculus
aatggcttttcatctgacccttcag

SEQ ID NO: 83467 - DNA, 25 bp, Mus musculus
aatggcttttgtcgtgttctctagt

SEQ ID NO: 83468 - DNA, 25 bp, Mus musculus
aatggcttttgtggtgttctctagt

SEQ ID NO: 83469 - DNA, 25 bp, Mus musculus
aatggctttttcagccctggagtcg

SEQ ID NO: 83470 - DNA, 25 bp, Mus musculus
aatggctttttctgccctggagtcg

SEQ ID NO: 83471 - DNA, 25 bp, Mus musculus
aatgggaaaataagctgaacacgag

SEQ ID NO: 83472 - DNA, 25 bp, Mus musculus
aatgggaaaatatgctgaacacgag

SEQ ID NO: 83473 - DNA, 25 bp, Mus musculus
aatgggaaactcaactccgtggatg

SEQ ID NO: 83474 - DNA, 25 bp, Mus musculus
aatgggaaactctactccgtggatg

SEQ ID NO: 83475 - DNA, 25 bp, Mus musculus
aatgggaaactgcaaatgactgtac

SEQ ID NO: 83476 - DNA, 25 bp, Mus musculus
aatgggaaactggaaatgactgtac

SEQ ID NO: 83477 - DNA, 25 bp, Mus musculus
aatgggaaagacaccgtcggcagga

SEQ ID NO: 83478 - DNA, 25 bp, Mus musculus
aatgggaaagactccgtcggcagga

SEQ ID NO: 83479 - DNA, 25 bp, Mus musculus
aatgggaaagctcgctagtgcccca

SEQ ID NO: 83480 - DNA, 25 bp, Mus musculus
aatgggaaagctggctagtgcccca

SEQ ID NO: 83481 - DNA, 25 bp, Mus musculus
aatgggaacagtcctgacaccctga

SEQ ID NO: 83482 - DNA, 25 bp, Mus musculus
aatgggaacagtgctgacaccctga

SEQ ID NO: 83483 - DNA, 25 bp, Mus musculus
aatgggaactcactgctgtgctgct

SEQ ID NO: 83484 - DNA, 25 bp, Mus musculus
aatgggaactcagtgctgtgctgct

SEQ ID NO: 83485 - DNA, 25 bp, Mus musculus
aatgggaagactcgccttttcccag

SEQ ID NO: 83486 - DNA, 25 bp, Mus musculus
aatgggaagactggccttttcccag

SEQ ID NO: 83487 - DNA, 25 bp, Mus musculus
aatgggaagcccatcatgctcatga

SEQ ID NO: 83488 - DNA, 25 bp, Mus musculus
aatgggaagcccttcatgctcatga

SEQ ID NO: 83489 - DNA, 25 bp, Mus musculus
aatgggaaggctctgtgtctagaac

SEQ ID NO: 83490 - DNA, 25 bp, Mus musculus
aatgggaaggctgtgtgtctagaac

SEQ ID NO: 83491 - DNA, 25 bp, Mus musculus
aatgggaagtccctcagctgtactt

SEQ ID NO: 83492 - DNA, 25 bp, Mus musculus
aatgggaagtccgtcagctgtactt

SEQ ID NO: 83493 - DNA, 25 bp, Mus musculus
aatgggaattctctgtctttgtgtg

SEQ ID NO: 83494 - DNA, 25 bp, Mus musculus
aatgggaattctgtgtctttgtgtg

SEQ ID NO: 83495 - DNA, 25 bp, Mus musculus
aatgggaattggcaagcctctgacc

SEQ ID NO: 83496 - DNA, 25 bp, Mus musculus
aatgggaattgggaagcctctgacc

SEQ ID NO: 83497 - DNA, 25 bp, Mus musculus
aatgggaccatccatggacattccc

SEQ ID NO: 83498 - DNA, 25 bp, Mus musculus
aatgggaccatcgatggacattccc

SEQ ID NO: 83499 - DNA, 25 bp, Mus musculus
aatgggaccatgagtcacacgaacg

SEQ ID NO: 83500 - DNA, 25 bp, Mus musculus
aatgggaccatgtgtcacacgaacg

SEQ ID NO: 83501 - DNA, 25 bp, Mus musculus
aatgggacccagcacagatgtttgt

SEQ ID NO: 83502 - DNA, 25 bp, Mus musculus
aatgggacccaggacagatgtttgt

SEQ ID NO: 83503 - DNA, 25 bp, Mus musculus
aatgggaccctaaactgccagccag

SEQ ID NO: 83504 - DNA, 25 bp, Mus musculus
aatgggaccctatactgccagccag

SEQ ID NO: 83505 - DNA, 25 bp, Mus musculus
aatgggactacacaggcccctggca

SEQ ID NO: 83506 - DNA, 25 bp, Mus musculus
aatgggactacagaggcccctggca

SEQ ID NO: 83507 - DNA, 25 bp, Mus musculus
aatgggactctactcttagaaacat

SEQ ID NO: 83508 - DNA, 25 bp, Mus musculus
aatgggactctagtcttagaaacat

SEQ ID NO: 83509 - DNA, 25 bp, Mus musculus
aatgggactctgatcctgttgctga

SEQ ID NO: 83510 - DNA, 25 bp, Mus musculus
aatgggactctgttcctgttgctga

SEQ ID NO: 83511 - DNA, 25 bp, Mus musculus
aatgggactgatattattgattgcc

SEQ ID NO: 83512 - DNA, 25 bp, Mus musculus
aatgggactgattttattgattgcc

SEQ ID NO: 83513 - DNA, 25 bp, Mus musculus
aatgggactgctaatttcaacatgc

SEQ ID NO: 83514 - DNA, 25 bp, Mus musculus
aatgggactgcttatttcaacatgc

SEQ ID NO: 83515 - DNA, 25 bp, Mus musculus
aatgggactttgagtagttgtaaat

SEQ ID NO: 83516 - DNA, 25 bp, Mus musculus
aatgggactttgtgtagttgtaaat

SEQ ID NO: 83517 - DNA, 25 bp, Mus musculus
aatgggagacgtacgcagcagtgct

SEQ ID NO: 83518 - DNA, 25 bp, Mus musculus
aatgggagacgttcgcagcagtgct

SEQ ID NO: 83519 - DNA, 25 bp, Mus musculus
aatgggagatccaggtcctcatggc

SEQ ID NO: 83520 - DNA, 25 bp, Mus musculus
aatgggagatcctggtcctcatggc

SEQ ID NO: 83521 - DNA, 25 bp, Mus musculus
aatgggagatctatttccttcattc

SEQ ID NO: 83522 - DNA, 25 bp, Mus musculus
aatgggagatctttttccttcattc

SEQ ID NO: 83523 - DNA, 25 bp, Mus musculus
aatgggagccccatgatgtcaacat

SEQ ID NO: 83524 - DNA, 25 bp, Mus musculus
aatgggagccccttgatgtcaacat

SEQ ID NO: 83525 - DNA, 25 bp, Mus musculus
aatgggagctctatctgtgttcttc

SEQ ID NO: 83526 - DNA, 25 bp, Mus musculus
aatgggagctctttctgtgttcttc

SEQ ID NO: 83527 - DNA, 25 bp, Mus musculus
aatgggaggactctcactcctgcaa

SEQ ID NO: 83528 - DNA, 25 bp, Mus musculus
aatgggaggactgtcactcctgcaa

SEQ ID NO: 83529 - DNA, 25 bp, Mus musculus
aatgggagtagccttgccactgata

SEQ ID NO: 83530 - DNA, 25 bp, Mus musculus
aatgggagtagcgttgccactgata

SEQ ID NO: 83531 - DNA, 25 bp, Mus musculus
aatgggagtcctcagctagtatagc

SEQ ID NO: 83532 - DNA, 25 bp, Mus musculus
aatgggagtcctgagctagtatagc

SEQ ID NO: 83533 - DNA, 25 bp, Mus musculus
aatgggataaagcttctacatatga

SEQ ID NO: 83534 - DNA, 25 bp, Mus musculus
aatgggataaaggttctacatatga

SEQ ID NO: 83535 - DNA, 25 bp, Mus musculus
aatgggatacatctctgcatggtct

SEQ ID NO: 83536 - DNA, 25 bp, Mus musculus
aatgggatacatgtctgcatggtct

SEQ ID NO: 83537 - DNA, 25 bp, Mus musculus
aatgggatcgtccagcccttctctg

SEQ ID NO: 83538 - DNA, 25 bp, Mus musculus
aatgggatcgtcgagcccttctctg

SEQ ID NO: 83539 - DNA, 25 bp, Mus musculus
aatgggatctacatagtggcgactg

SEQ ID NO: 83540 - DNA, 25 bp, Mus musculus
aatgggatctacctacatctcaaga

SEQ ID NO: 83541 - DNA, 25 bp, Mus musculus
aatgggatctacgtacatctcaaga

SEQ ID NO: 83542 - DNA, 25 bp, Mus musculus
aatgggatctacttagtggcgactg

SEQ ID NO: 83543 - DNA, 25 bp, Mus musculus
aatgggatctgcacttgtgttcaaa

SEQ ID NO: 83544 - DNA, 25 bp, Mus musculus
aatgggatctgctcttgtgttcaaa

SEQ ID NO: 83545 - DNA, 25 bp, Mus musculus
aatgggatgagcagggaccctcctc

SEQ ID NO: 83546 - DNA, 25 bp, Mus musculus
aatgggatgagctgggaccctcctc

SEQ ID NO: 83547 - DNA, 25 bp, Mus musculus
aatgggatgctcataattcatgact

SEQ ID NO: 83548 - DNA, 25 bp, Mus musculus
aatgggatgctcttaattcatgact

SEQ ID NO: 83549 - DNA, 25 bp, Mus musculus
aatgggatgctgaccgtgtgcagct

SEQ ID NO: 83550 - DNA, 25 bp, Mus musculus
aatgggatgctgtccgtgtgcagct

SEQ ID NO: 83551 - DNA, 25 bp, Mus musculus
aatgggatgcttcttccttcccgat

SEQ ID NO: 83552 - DNA, 25 bp, Mus musculus
aatgggatgcttgttccttcccgat

SEQ ID NO: 83553 - DNA, 25 bp, Mus musculus
aatgggatgtccacatcaaactcct

SEQ ID NO: 83554 - DNA, 25 bp, Mus musculus
aatgggatgtcctcatcaaactcct

SEQ ID NO: 83555 - DNA, 25 bp, Mus musculus
aatgggattcaaagtctttttctgg

SEQ ID NO: 83556 - DNA, 25 bp, Mus musculus
aatgggattcaatgtctttttctgg

SEQ ID NO: 83557 - DNA, 25 bp, Mus musculus
aatgggattcatcgctctagcagca

SEQ ID NO: 83558 - DNA, 25 bp, Mus musculus
aatgggattcatggctctagcagca

SEQ ID NO: 83559 - DNA, 25 bp, Mus musculus
aatgggattcctacacttggtggtg

SEQ ID NO: 83560 - DNA, 25 bp, Mus musculus
aatgggattccttcacttggtggtg

SEQ ID NO: 83561 - DNA, 25 bp, Mus musculus
aatgggatttccctggctactgcca

SEQ ID NO: 83562 - DNA, 25 bp, Mus musculus
aatgggatttccgtggctactgcca

SEQ ID NO: 83563 - DNA, 25 bp, Mus musculus
aatgggcaaagtcatcctgtctctc

SEQ ID NO: 83564 - DNA, 25 bp, Mus musculus
aatgggcaaagtgatcctgtctctc

SEQ ID NO: 83565 - DNA, 25 bp, Mus musculus
aatgggcaagagactgtcccctgtg

SEQ ID NO: 83566 - DNA, 25 bp, Mus musculus
aatgggcaagagtctgtcccctgtg

SEQ ID NO: 83567 - DNA, 25 bp, Mus musculus
aatgggcaaggcacatatgcagaat

SEQ ID NO: 83568 - DNA, 25 bp, Mus musculus
aatgggcaaggctcatatgcagaat

SEQ ID NO: 83569 - DNA, 25 bp, Mus musculus
aatgggcacaaacctgaggtctaga

SEQ ID NO: 83570 - DNA, 25 bp, Mus musculus
aatgggcacaaagctgaggtctaga

SEQ ID NO: 83571 - DNA, 25 bp, Mus musculus
aatgggcacaggagctgtctgcact

SEQ ID NO: 83572 - DNA, 25 bp, Mus musculus
aatgggcacaggtgctgtctgcact

SEQ ID NO: 83573 - DNA, 25 bp, Mus musculus
aatgggcactctatccacgttactc

SEQ ID NO: 83574 - DNA, 25 bp, Mus musculus
aatgggcactctttccacgttactc

SEQ ID NO: 83575 - DNA, 25 bp, Mus musculus
aatgggcactgcagtgttcagtaga

SEQ ID NO: 83576 - DNA, 25 bp, Mus musculus
aatgggcactgctgtgttcagtaga

SEQ ID NO: 83577 - DNA, 25 bp, Mus musculus
aatgggcacttacgactcttggcac

SEQ ID NO: 83578 - DNA, 25 bp, Mus musculus
aatgggcacttaggactcttggcac

SEQ ID NO: 83579 - DNA, 25 bp, Mus musculus
aatgggcagatcacatctcttcgct

SEQ ID NO: 83580 - DNA, 25 bp, Mus musculus
aatgggcagatctcatctcttcgct

SEQ ID NO: 83581 - DNA, 25 bp, Mus musculus
aatgggcagccacaagatgggccaa

SEQ ID NO: 83582 - DNA, 25 bp, Mus musculus
aatgggcagccagaagatgggccaa

SEQ ID NO: 83583 - DNA, 25 bp, Mus musculus
aatgggcagcctcagctaagtctaa

SEQ ID NO: 83584 - DNA, 25 bp, Mus musculus
aatgggcagcctgagctaagtctaa

SEQ ID NO: 83585 - DNA, 25 bp, Mus musculus
aatgggcagggcattgaccccatgc

SEQ ID NO: 83586 - DNA, 25 bp, Mus musculus
aatgggcagggctttgaccccatgc

SEQ ID NO: 83587 - DNA, 25 bp, Mus musculus
aatgggcaggttattggctcccgat

SEQ ID NO: 83588 - DNA, 25 bp, Mus musculus
aatgggcaggtttttggctcccgat

SEQ ID NO: 83589 - DNA, 25 bp, Mus musculus
aatgggcagtgcacctactgagggc

SEQ ID NO: 83590 - DNA, 25 bp, Mus musculus
aatgggcagtgctcctactgagggc

SEQ ID NO: 83591 - DNA, 25 bp, Mus musculus
aatgggcatagcaggcctcggccac

SEQ ID NO: 83592 - DNA, 25 bp, Mus musculus
aatgggcatagctggcctcggccac

SEQ ID NO: 83593 - DNA, 25 bp, Mus musculus
aatgggcatattcagggcagatttt

SEQ ID NO: 83594 - DNA, 25 bp, Mus musculus
aatgggcatattgagggcagatttt

SEQ ID NO: 83595 - DNA, 25 bp, Mus musculus
aatgggcattgtcttaggactagca

SEQ ID NO: 83596 - DNA, 25 bp, Mus musculus
aatgggcattgtgttaggactagca

SEQ ID NO: 83597 - DNA, 25 bp, Mus musculus
aatgggccagctcgtgtaatactct

SEQ ID NO: 83598 - DNA, 25 bp, Mus musculus
aatgggccagctggtgtaatactct

SEQ ID NO: 83599 - DNA, 25 bp, Mus musculus
aatgggccaggtacacacttttcat

SEQ ID NO: 83600 - DNA, 25 bp, Mus musculus
aatgggccaggttcacacttttcat

SEQ ID NO: 83601 - DNA, 25 bp, Mus musculus
aatgggccagtcactctttgacatt

SEQ ID NO: 83602 - DNA, 25 bp, Mus musculus
aatgggccagtctctctttgacatt

SEQ ID NO: 83603 - DNA, 25 bp, Mus musculus
aatgggccattgctcaagagagctg

SEQ ID NO: 83604 - DNA, 25 bp, Mus musculus
aatgggccattggtcaagagagctg

SEQ ID NO: 83605 - DNA, 25 bp, Mus musculus
aatgggcccataaaagctcttagct

SEQ ID NO: 83606 - DNA, 25 bp, Mus musculus
aatgggcccatataagctcttagct

SEQ ID NO: 83607 - DNA, 25 bp, Mus musculus
aatgggcccctactgaggccttgag

SEQ ID NO: 83608 - DNA, 25 bp, Mus musculus
aatgggcccctagtgaggccttgag

SEQ ID NO: 83609 - DNA, 25 bp, Mus musculus
aatgggcccgggaagctttgcttgt

SEQ ID NO: 83610 - DNA, 25 bp, Mus musculus
aatgggcccgggtagctttgcttgt

SEQ ID NO: 83611 - DNA, 25 bp, Mus musculus
aatgggccctgtacaaggtctgaat

SEQ ID NO: 83612 - DNA, 25 bp, Mus musculus
aatgggccctgttcaaggtctgaat

SEQ ID NO: 83613 - DNA, 25 bp, Mus musculus
aatgggccgagtattgacaagctgc

SEQ ID NO: 83614 - DNA, 25 bp, Mus musculus
aatgggccgagttttgacaagctgc

SEQ ID NO: 83615 - DNA, 25 bp, Mus musculus
aatgggccggctcctttggcatcaa

SEQ ID NO: 83616 - DNA, 25 bp, Mus musculus
aatgggccggctgctttggcatcaa

SEQ ID NO: 83617 - DNA, 25 bp, Mus musculus
aatgggcctgatagatgggatgcac

SEQ ID NO: 83618 - DNA, 25 bp, Mus musculus
aatgggcctgattgatgggatgcac

SEQ ID NO: 83619 - DNA, 25 bp, Mus musculus
aatgggcctgtaagatttttcttaa

SEQ ID NO: 83620 - DNA, 25 bp, Mus musculus
aatgggcctgtatgatttttcttaa

SEQ ID NO: 83621 - DNA, 25 bp, Mus musculus
aatgggcgccgacaaccaaacctgg

SEQ ID NO: 83622 - DNA, 25 bp, Mus musculus
aatgggcgccgagaaccaaacctgg

SEQ ID NO: 83623 - DNA, 25 bp, Mus musculus
aatgggcgtatcacagggctaacta

SEQ ID NO: 83624 - DNA, 25 bp, Mus musculus
aatgggcgtatctcagggctaacta

SEQ ID NO: 83625 - DNA, 25 bp, Mus musculus
aatgggcgtccgatttgcagcccag

SEQ ID NO: 83626 - DNA, 25 bp, Mus musculus
aatgggcgtccgttttgcagcccag

SEQ ID NO: 83627 - DNA, 25 bp, Mus musculus
aatgggcgtgatcactctggactgt

SEQ ID NO: 83628 - DNA, 25 bp, Mus musculus
aatgggcgtgatgactctggactgt

SEQ ID NO: 83629 - DNA, 25 bp, Mus musculus
aatgggctaatccagctgcggagca

SEQ ID NO: 83630 - DNA, 25 bp, Mus musculus
aatgggctaatcgagctgcggagca

SEQ ID NO: 83631 - DNA, 25 bp, Mus musculus
aatgggctacaactctcgaacagaa

SEQ ID NO: 83632 - DNA, 25 bp, Mus musculus
aatgggctacaagtctcgaacagaa

SEQ ID NO: 83633 - DNA, 25 bp, Mus musculus
aatgggctacttatggtctggacct

SEQ ID NO: 83634 - DNA, 25 bp, Mus musculus
aatgggctacttttggtctggacct

SEQ ID NO: 83635 - DNA, 25 bp, Mus musculus
aatgggctatgcaacctgcgtttac

SEQ ID NO: 83636 - DNA, 25 bp, Mus musculus
aatgggctatgctacctgcgtttac

SEQ ID NO: 83637 - DNA, 25 bp, Mus musculus
aatgggctcacaatgcggaggtcta

SEQ ID NO: 83638 - DNA, 25 bp, Mus musculus
aatgggctcacattgcggaggtcta

SEQ ID NO: 83639 - DNA, 25 bp, Mus musculus
aatgggctcatcagaacctaggcaa

SEQ ID NO: 83640 - DNA, 25 bp, Mus musculus
aatgggctcatctgaacctaggcaa

SEQ ID NO: 83641 - DNA, 25 bp, Mus musculus
aatgggctccagagaagggctcctg

SEQ ID NO: 83642 - DNA, 25 bp, Mus musculus
aatgggctccagtgaagggctcctg

SEQ ID NO: 83643 - DNA, 25 bp, Mus musculus
aatgggctccccaaaaccagagagg

SEQ ID NO: 83644 - DNA, 25 bp, Mus musculus
aatgggctcccctaaaccagagagg

SEQ ID NO: 83645 - DNA, 25 bp, Mus musculus
aatgggctctccctagactatggcc

SEQ ID NO: 83646 - DNA, 25 bp, Mus musculus
aatgggctctccgtagactatggcc

SEQ ID NO: 83647 - DNA, 25 bp, Mus musculus
aatgggctgcatattgacatagact

SEQ ID NO: 83648 - DNA, 25 bp, Mus musculus
aatgggctgcattttgacatagact

SEQ ID NO: 83649 - DNA, 25 bp, Mus musculus
aatgggctggtcaatcgcctcattg

SEQ ID NO: 83650 - DNA, 25 bp, Mus musculus
aatgggctggtctatcgcctcattg

SEQ ID NO: 83651 - DNA, 25 bp, Mus musculus
aatgggcttattcttaatgccttat

SEQ ID NO: 83652 - DNA, 25 bp, Mus musculus
aatgggcttattgttaatgccttat

SEQ ID NO: 83653 - DNA, 25 bp, Mus musculus
aatgggcttcgactgaatgtggcag

SEQ ID NO: 83654 - DNA, 25 bp, Mus musculus
aatgggcttcgagtgaatgtggcag

SEQ ID NO: 83655 - DNA, 25 bp, Mus musculus
aatgggctttaactctggtggcagc

SEQ ID NO: 83656 - DNA, 25 bp, Mus musculus
aatgggctttaagtctggtggcagc

SEQ ID NO: 83657 - DNA, 25 bp, Mus musculus
aatgggctttatctgctagatttta

SEQ ID NO: 83658 - DNA, 25 bp, Mus musculus
aatgggctttatgtgctagatttta

SEQ ID NO: 83659 - DNA, 25 bp, Mus musculus
aatgggctttgcacacaatgggttt

SEQ ID NO: 83660 - DNA, 25 bp, Mus musculus
aatgggctttgctcacaatgggttt

SEQ ID NO: 83661 - DNA, 25 bp, Mus musculus
aatggggacaccagatgtgcgcatt

SEQ ID NO: 83662 - DNA, 25 bp, Mus musculus
aatggggacacctgatgtgcgcatt

SEQ ID NO: 83663 - DNA, 25 bp, Mus musculus
aatggggatatcaagggctgcgcct

SEQ ID NO: 83664 - DNA, 25 bp, Mus musculus
aatggggatatctagggctgcgcct

SEQ ID NO: 83665 - DNA, 25 bp, Mus musculus
aatggggatctaatactctcttcta

SEQ ID NO: 83666 - DNA, 25 bp, Mus musculus
aatggggatctattactctcttcta

SEQ ID NO: 83667 - DNA, 25 bp, Mus musculus
aatgggtaaaggcacttatctccaa

SEQ ID NO: 83668 - DNA, 25 bp, Mus musculus
aatgggtaaagggacttatctccaa

SEQ ID NO: 83669 - DNA, 25 bp, Mus musculus
aatgggtagcatcttgcttgctgtc

SEQ ID NO: 83670 - DNA, 25 bp, Mus musculus
aatgggtagcatgttgcttgctgtc

SEQ ID NO: 83671 - DNA, 25 bp, Mus musculus
aatgggtatcacagtttttggcaac

SEQ ID NO: 83672 - DNA, 25 bp, Mus musculus
aatgggtatcactgtttttggcaac

SEQ ID NO: 83673 - DNA, 25 bp, Mus musculus
aatgggtatcatcagcctctgccac

SEQ ID NO: 83674 - DNA, 25 bp, Mus musculus
aatgggtatcatgagcctctgccac

SEQ ID NO: 83675 - DNA, 25 bp, Mus musculus
aatgggtatgtacttcgtgtcctct

SEQ ID NO: 83676 - DNA, 25 bp, Mus musculus
aatgggtatgtagttcgtgtcctct

SEQ ID NO: 83677 - DNA, 25 bp, Mus musculus
aatgggtcacacatgtcttacacat

SEQ ID NO: 83678 - DNA, 25 bp, Mus musculus
aatgggtcacacttgtcttacacat

SEQ ID NO: 83679 - DNA, 25 bp, Mus musculus
aatgggtcagacagcgtcatcatga

SEQ ID NO: 83680 - DNA, 25 bp, Mus musculus
aatgggtcagactgcgtcatcatga

SEQ ID NO: 83681 - DNA, 25 bp, Mus musculus
aatgggtcatgcaagcccgtgaaca

SEQ ID NO: 83682 - DNA, 25 bp, Mus musculus
aatgggtcatgctagcccgtgaaca

SEQ ID NO: 83683 - DNA, 25 bp, Mus musculus
aatgggtcatttctgtctcttagga

SEQ ID NO: 83684 - DNA, 25 bp, Mus musculus
aatgggtcatttgtgtctcttagga

SEQ ID NO: 83685 - DNA, 25 bp, Mus musculus
aatgggtccagcagtgcgcctggaa

SEQ ID NO: 83686 - DNA, 25 bp, Mus musculus
aatgggtccagctgtgcgcctggaa

SEQ ID NO: 83687 - DNA, 25 bp, Mus musculus
aatgggtcccatcagtctactacaa

SEQ ID NO: 83688 - DNA, 25 bp, Mus musculus
aatgggtcccatgagtctactacaa

SEQ ID NO: 83689 - DNA, 25 bp, Mus musculus
aatgggtcgtttccctagtagtcct

SEQ ID NO: 83690 - DNA, 25 bp, Mus musculus
aatgggtcgtttgcctagtagtcct

SEQ ID NO: 83691 - DNA, 25 bp, Mus musculus
aatgggtctaccacttttgtcctca

SEQ ID NO: 83692 - DNA, 25 bp, Mus musculus
aatgggtctacctcttttgtcctca

SEQ ID NO: 83693 - DNA, 25 bp, Mus musculus
aatgggtctgaccagcactctgtaa

SEQ ID NO: 83694 - DNA, 25 bp, Mus musculus
aatgggtctgacgagcactctgtaa

SEQ ID NO: 83695 - DNA, 25 bp, Mus musculus
aatgggtctgtccttcagcctgcag

SEQ ID NO: 83696 - DNA, 25 bp, Mus musculus
aatgggtctgtcgttcagcctgcag

SEQ ID NO: 83697 - DNA, 25 bp, Mus musculus
aatgggtcttgaatcccagctgtga

SEQ ID NO: 83698 - DNA, 25 bp, Mus musculus
aatgggtcttgattcccagctgtga

SEQ ID NO: 83699 - DNA, 25 bp, Mus musculus
aatgggtctttacacaccaatccac

SEQ ID NO: 83700 - DNA, 25 bp, Mus musculus
aatgggtctttagacaccaatccac

SEQ ID NO: 83701 - DNA, 25 bp, Mus musculus
aatgggtgaaaaccagtgttcttta

SEQ ID NO: 83702 - DNA, 25 bp, Mus musculus
aatgggtgaaaagcagtgttcttta

SEQ ID NO: 83703 - DNA, 25 bp, Mus musculus
aatgggtgaactctgcatgtgcgaa

SEQ ID NO: 83704 - DNA, 25 bp, Mus musculus
aatgggtgaactgtgcatgtgcgaa

SEQ ID NO: 83705 - DNA, 25 bp, Mus musculus
aatgggtgacttaggacttattaca

SEQ ID NO: 83706 - DNA, 25 bp, Mus musculus
aatgggtgactttggacttattaca

SEQ ID NO: 83707 - DNA, 25 bp, Mus musculus
aatgggtgccttattgtgtgagaat

SEQ ID NO: 83708 - DNA, 25 bp, Mus musculus
aatgggtgcctttttgtgtgagaat

SEQ ID NO: 83709 - DNA, 25 bp, Mus musculus
aatgggtggtatcctgtatatcaaa

SEQ ID NO: 83710 - DNA, 25 bp, Mus musculus
aatgggtggtatgctgtatatcaaa

SEQ ID NO: 83711 - DNA, 25 bp, Mus musculus
aatgggtggtgtaacctggctgcac

SEQ ID NO: 83712 - DNA, 25 bp, Mus musculus
aatgggtggtgttacctggctgcac

SEQ ID NO: 83713 - DNA, 25 bp, Mus musculus
aatgggtggtttacactgggtgcca

SEQ ID NO: 83714 - DNA, 25 bp, Mus musculus
aatgggtggttttcactgggtgcca

SEQ ID NO: 83715 - DNA, 25 bp, Mus musculus
aatgggtgtcccagaccacgaggac

SEQ ID NO: 83716 - DNA, 25 bp, Mus musculus
aatgggtgtccctgaccacgaggac

SEQ ID NO: 83717 - DNA, 25 bp, Mus musculus
aatgggtgtttcatttgcattgccg

SEQ ID NO: 83718 - DNA, 25 bp, Mus musculus
aatgggtgtttcttttgcattgccg

SEQ ID NO: 83719 - DNA, 25 bp, Mus musculus
aatgggttaataagcttcagacaga

SEQ ID NO: 83720 - DNA, 25 bp, Mus musculus
aatgggttaatatgcttcagacaga

SEQ ID NO: 83721 - DNA, 25 bp, Mus musculus
aatgggttagctcaggccaacaaga

SEQ ID NO: 83722 - DNA, 25 bp, Mus musculus
aatgggttagctgaggccaacaaga

SEQ ID NO: 83723 - DNA, 25 bp, Mus musculus
aatgggttatgccatgccttctgaa

SEQ ID NO: 83724 - DNA, 25 bp, Mus musculus
aatgggttatgcgatgccttctgaa

SEQ ID NO: 83725 - DNA, 25 bp, Mus musculus
aatgggttctcacaactctgttaca

SEQ ID NO: 83726 - DNA, 25 bp, Mus musculus
aatgggttctcagaactctgttaca

SEQ ID NO: 83727 - DNA, 25 bp, Mus musculus
aatgggttctgtctcccttgaagtt

SEQ ID NO: 83728 - DNA, 25 bp, Mus musculus
aatgggttctgtgtcccttgaagtt

SEQ ID NO: 83729 - DNA, 25 bp, Mus musculus
aatgggttcttacgtttgagctgga

SEQ ID NO: 83730 - DNA, 25 bp, Mus musculus
aatgggttcttaggtttgagctgga

SEQ ID NO: 83731 - DNA, 25 bp, Mus musculus
aatgggtttcccacaactactacag

SEQ ID NO: 83732 - DNA, 25 bp, Mus musculus
aatgggtttccctcaactactacag

SEQ ID NO: 83733 - DNA, 25 bp, Mus musculus
aatgggtttcggctatggattgtct

SEQ ID NO: 83734 - DNA, 25 bp, Mus musculus
aatgggtttcgggtatggattgtct

SEQ ID NO: 83735 - DNA, 25 bp, Mus musculus
aatgggtttcttcacaaggctcagg

SEQ ID NO: 83736 - DNA, 25 bp, Mus musculus
aatgggtttcttgacaaggctcagg

SEQ ID NO: 83737 - DNA, 25 bp, Mus musculus
aatgggtttgaaccctcagatccga

SEQ ID NO: 83738 - DNA, 25 bp, Mus musculus
aatgggtttgaagcctcagatccga

SEQ ID NO: 83739 - DNA, 25 bp, Mus musculus
aatgggtttgggattcacatcttca

SEQ ID NO: 83740 - DNA, 25 bp, Mus musculus
aatgggtttgggtttcacatcttca

SEQ ID NO: 83741 - DNA, 25 bp, Mus musculus
aatggtaacaacatcctcacctgtt

SEQ ID NO: 83742 - DNA, 25 bp, Mus musculus
aatggtaacaacttcctcacctgtt

SEQ ID NO: 83743 - DNA, 25 bp, Mus musculus
aatggtaacattcccctggcagagg

SEQ ID NO: 83744 - DNA, 25 bp, Mus musculus
aatggtaacattgccctggcagagg

SEQ ID NO: 83745 - DNA, 25 bp, Mus musculus
aatggtaaccctccagctgtattca

SEQ ID NO: 83746 - DNA, 25 bp, Mus musculus
aatggtaaccctgcagctgtattca

SEQ ID NO: 83747 - DNA, 25 bp, Mus musculus
aatggtaagtccagcatccttgaga

SEQ ID NO: 83748 - DNA, 25 bp, Mus musculus
aatggtaagtcctgcatccttgaga

SEQ ID NO: 83749 - DNA, 25 bp, Mus musculus
aatggtaatctcagggcaggatccc

SEQ ID NO: 83750 - DNA, 25 bp, Mus musculus
aatggtaatctctgggcaggatccc

SEQ ID NO: 83751 - DNA, 25 bp, Mus musculus
aatggtaatgccacttcccaaataa

SEQ ID NO: 83752 - DNA, 25 bp, Mus musculus
aatggtaatgcctcttcccaaataa

SEQ ID NO: 83753 - DNA, 25 bp, Mus musculus
aatggtacaccgatatttaagaagg

SEQ ID NO: 83754 - DNA, 25 bp, Mus musculus
aatggtacaccgttatttaagaagg

SEQ ID NO: 83755 - DNA, 25 bp, Mus musculus
aatggtaccctcatcataatggctt

SEQ ID NO: 83756 - DNA, 25 bp, Mus musculus
aatggtaccctcttcataatggctt

SEQ ID NO: 83757 - DNA, 25 bp, Mus musculus
aatggtacccttctttagcttccat

SEQ ID NO: 83758 - DNA, 25 bp, Mus musculus
aatggtacccttgtttagcttccat

SEQ ID NO: 83759 - DNA, 25 bp, Mus musculus
aatggtacctaacatttttctgagc

SEQ ID NO: 83760 - DNA, 25 bp, Mus musculus
aatggtacctaagatttttctgagc

SEQ ID NO: 83761 - DNA, 25 bp, Mus musculus
aatggtacctatattcacagcaaca

SEQ ID NO: 83762 - DNA, 25 bp, Mus musculus
aatggtacctattttcacagcaaca

SEQ ID NO: 83763 - DNA, 25 bp, Mus musculus
aatggtacctggctcatctcatcca

SEQ ID NO: 83764 - DNA, 25 bp, Mus musculus
aatggtacctgggtcatctcatcca

SEQ ID NO: 83765 - DNA, 25 bp, Mus musculus
aatggtacgacactgcctacttagg

SEQ ID NO: 83766 - DNA, 25 bp, Mus musculus
aatggtacgacagtgcctacttagg

SEQ ID NO: 83767 - DNA, 25 bp, Mus musculus
aatggtacgcatcgagggatgccct

SEQ ID NO: 83768 - DNA, 25 bp, Mus musculus
aatggtacgcatggagggatgccct

SEQ ID NO: 83769 - DNA, 25 bp, Mus musculus
aatggtactccaatctttgccatga

SEQ ID NO: 83770 - DNA, 25 bp, Mus musculus
aatggtactccattctttgccatga

SEQ ID NO: 83771 - DNA, 25 bp, Mus musculus
aatggtactgccaacattagcatgg

SEQ ID NO: 83772 - DNA, 25 bp, Mus musculus
aatggtactgcctacattagcatgg

SEQ ID NO: 83773 - DNA, 25 bp, Mus musculus
aatggtactttcattcatgtagttt

SEQ ID NO: 83774 - DNA, 25 bp, Mus musculus
aatggtactttctttcatgtagttt

SEQ ID NO: 83775 - DNA, 25 bp, Mus musculus
aatggtagatgtatttcccagttca

SEQ ID NO: 83776 - DNA, 25 bp, Mus musculus
aatggtagatgtttttcccagttca

SEQ ID NO: 83777 - DNA, 25 bp, Mus musculus
aatggtaggcacattccctctattt

SEQ ID NO: 83778 - DNA, 25 bp, Mus musculus
aatggtaggcactttccctctattt

SEQ ID NO: 83779 - DNA, 25 bp, Mus musculus
aatggtatagacaaagcatcaacta

SEQ ID NO: 83780 - DNA, 25 bp, Mus musculus
aatggtatagactaagcatcaacta

SEQ ID NO: 83781 - DNA, 25 bp, Mus musculus
aatggtatcgtgacagcaactcctg

SEQ ID NO: 83782 - DNA, 25 bp, Mus musculus
aatggtatcgtgtcagcaactcctg

SEQ ID NO: 83783 - DNA, 25 bp, Mus musculus
aatggtatcttcagctgaagtcaga

SEQ ID NO: 83784 - DNA, 25 bp, Mus musculus
aatggtatcttctgctgaagtcaga

SEQ ID NO: 83785 - DNA, 25 bp, Mus musculus
aatggtatcttgcacttttgcctca

SEQ ID NO: 83786 - DNA, 25 bp, Mus musculus
aatggtatcttggacttttgcctca

SEQ ID NO: 83787 - DNA, 25 bp, Mus musculus
aatggtatgaagcagggcgtcttta

SEQ ID NO: 83788 - DNA, 25 bp, Mus musculus
aatggtatgaaggagggcgtcttta

SEQ ID NO: 83789 - DNA, 25 bp, Mus musculus
aatggtattcagaacatggtgacga

SEQ ID NO: 83790 - DNA, 25 bp, Mus musculus
aatggtattcagtacatggtgacga

SEQ ID NO: 83791 - DNA, 25 bp, Mus musculus
aatggtattgatatctgccctcagc

SEQ ID NO: 83792 - DNA, 25 bp, Mus musculus
aatggtattgatttctgccctcagc

SEQ ID NO: 83793 - DNA, 25 bp, Mus musculus
aatggtattttgatgaacttgcaga

SEQ ID NO: 83794 - DNA, 25 bp, Mus musculus
aatggtattttgttgaacttgcaga

SEQ ID NO: 83795 - DNA, 25 bp, Mus musculus
aatggtcaagccatattgcaggaga

SEQ ID NO: 83796 - DNA, 25 bp, Mus musculus
aatggtcaagccttattgcaggaga

SEQ ID NO: 83797 - DNA, 25 bp, Mus musculus
aatggtcacagtagtttcacttcaa

SEQ ID NO: 83798 - DNA, 25 bp, Mus musculus
aatggtcacagtcacctgctgaaga

SEQ ID NO: 83799 - DNA, 25 bp, Mus musculus
aatggtcacagtgacctgctgaaga

SEQ ID NO: 83800 - DNA, 25 bp, Mus musculus
aatggtcacagttgtttcacttcaa

SEQ ID NO: 83801 - DNA, 25 bp, Mus musculus
aatggtcaccagacagcacgatgat

SEQ ID NO: 83802 - DNA, 25 bp, Mus musculus
aatggtcaccagtcagcacgatgat

SEQ ID NO: 83803 - DNA, 25 bp, Mus musculus
aatggtcaccctctttctaatgaaa

SEQ ID NO: 83804 - DNA, 25 bp, Mus musculus
aatggtcaccctgtttctaatgaaa

SEQ ID NO: 83805 - DNA, 25 bp, Mus musculus
aatggtcacctcagcatctttgggc

SEQ ID NO: 83806 - DNA, 25 bp, Mus musculus
aatggtcacctcaggcaggctggga

SEQ ID NO: 83807 - DNA, 25 bp, Mus musculus
aatggtcacctcaggttattgaata

SEQ ID NO: 83808 - DNA, 25 bp, Mus musculus
aatggtcacctctgcatctttgggc

SEQ ID NO: 83809 - DNA, 25 bp, Mus musculus
aatggtcacctctggcaggctggga

SEQ ID NO: 83810 - DNA, 25 bp, Mus musculus
aatggtcacctctggttattgaata

SEQ ID NO: 83811 - DNA, 25 bp, Mus musculus
aatggtcacgttcgtcttggtgtta

SEQ ID NO: 83812 - DNA, 25 bp, Mus musculus
aatggtcacgttggtcttggtgtta

SEQ ID NO: 83813 - DNA, 25 bp, Mus musculus
aatggtcactacagagtgtcctcag

SEQ ID NO: 83814 - DNA, 25 bp, Mus musculus
aatggtcactactgagtgtcctcag

SEQ ID NO: 83815 - DNA, 25 bp, Mus musculus
aatggtcactgaaaactggtcttca

SEQ ID NO: 83816 - DNA, 25 bp, Mus musculus
aatggtcactgataactggtcttca

SEQ ID NO: 83817 - DNA, 25 bp, Mus musculus
aatggtcacttgctactttgtgcag

SEQ ID NO: 83818 - DNA, 25 bp, Mus musculus
aatggtcacttggtactttgtgcag

SEQ ID NO: 83819 - DNA, 25 bp, Mus musculus
aatggtcagaccatgtgtttttggc

SEQ ID NO: 83820 - DNA, 25 bp, Mus musculus
aatggtcagaccttgtgtttttggc

SEQ ID NO: 83821 - DNA, 25 bp, Mus musculus
aatggtcagactatccttctgtgga

SEQ ID NO: 83822 - DNA, 25 bp, Mus musculus
aatggtcagactttccttctgtgga

SEQ ID NO: 83823 - DNA, 25 bp, Mus musculus
aatggtcagcacatctgtgattcca

SEQ ID NO: 83824 - DNA, 25 bp, Mus musculus
aatggtcagcacttctgtgattcca

SEQ ID NO: 83825 - DNA, 25 bp, Mus musculus
aatggtcagcctcagcaaactacag

SEQ ID NO: 83826 - DNA, 25 bp, Mus musculus
aatggtcagcctgagcaaactacag

SEQ ID NO: 83827 - DNA, 25 bp, Mus musculus
aatggtcagctaccaacccttaggg

SEQ ID NO: 83828 - DNA, 25 bp, Mus musculus
aatggtcagctagcaacccttaggg

SEQ ID NO: 83829 - DNA, 25 bp, Mus musculus
aatggtcataagatatttttgtgta

SEQ ID NO: 83830 - DNA, 25 bp, Mus musculus
aatggtcataagttatttttgtgta

SEQ ID NO: 83831 - DNA, 25 bp, Mus musculus
aatggtcatcgtcagcttatggttg

SEQ ID NO: 83832 - DNA, 25 bp, Mus musculus
aatggtcatcgtgagcttatggttg

SEQ ID NO: 83833 - DNA, 25 bp, Mus musculus
aatggtcatctcaactagctaccca

SEQ ID NO: 83834 - DNA, 25 bp, Mus musculus
aatggtcatctctactagctaccca

SEQ ID NO: 83835 - DNA, 25 bp, Mus musculus
aatggtcatgcccttttgtactaat

SEQ ID NO: 83836 - DNA, 25 bp, Mus musculus
aatggtcatgccgttttgtactaat

SEQ ID NO: 83837 - DNA, 25 bp, Mus musculus
aatggtcatgtgattgccttatatc

SEQ ID NO: 83838 - DNA, 25 bp, Mus musculus
aatggtcatgtgtttgccttatatc

SEQ ID NO: 83839 - DNA, 25 bp, Mus musculus
aatggtcattccctactggttatgt

SEQ ID NO: 83840 - DNA, 25 bp, Mus musculus
aatggtcattccgtactggttatgt

SEQ ID NO: 83841 - DNA, 25 bp, Mus musculus
aatggtccacagcacaatatgatag

SEQ ID NO: 83842 - DNA, 25 bp, Mus musculus
aatggtccacagcactaactggtaa

SEQ ID NO: 83843 - DNA, 25 bp, Mus musculus
aatggtccacaggacaatatgatag

SEQ ID NO: 83844 - DNA, 25 bp, Mus musculus
aatggtccacaggactaactggtaa

SEQ ID NO: 83845 - DNA, 25 bp, Mus musculus
aatggtccagctcaggtgtctatac

SEQ ID NO: 83846 - DNA, 25 bp, Mus musculus
aatggtccagctgaggtgtctatac

SEQ ID NO: 83847 - DNA, 25 bp, Mus musculus
aatggtccatcaacagtggtcacaa

SEQ ID NO: 83848 - DNA, 25 bp, Mus musculus
aatggtccatcatcagtggtcacaa

SEQ ID NO: 83849 - DNA, 25 bp, Mus musculus
aatggtcccaccacaagaaaacaag

SEQ ID NO: 83850 - DNA, 25 bp, Mus musculus
aatggtcccacctcaagaaaacaag

SEQ ID NO: 83851 - DNA, 25 bp, Mus musculus
aatggtcccgttaggagcttagatc

SEQ ID NO: 83852 - DNA, 25 bp, Mus musculus
aatggtcccgtttggagcttagatc

SEQ ID NO: 83853 - DNA, 25 bp, Mus musculus
aatggtccctgacttctatgttgac

SEQ ID NO: 83854 - DNA, 25 bp, Mus musculus
aatggtccctgagttctatgttgac

SEQ ID NO: 83855 - DNA, 25 bp, Mus musculus
aatggtccggtaaagtctctatcct

SEQ ID NO: 83856 - DNA, 25 bp, Mus musculus
aatggtccggtatagtctctatcct

SEQ ID NO: 83857 - DNA, 25 bp, Mus musculus
aatggtcctcagaacacttgggcaa

SEQ ID NO: 83858 - DNA, 25 bp, Mus musculus
aatggtcctcagctgtttacaatag

SEQ ID NO: 83859 - DNA, 25 bp, Mus musculus
aatggtcctcaggtgtttacaatag

SEQ ID NO: 83860 - DNA, 25 bp, Mus musculus
aatggtcctcagtacacttgggcaa

SEQ ID NO: 83861 - DNA, 25 bp, Mus musculus
aatggtcctccacattaatttgttt

SEQ ID NO: 83862 - DNA, 25 bp, Mus musculus
aatggtcctccagattaatttgttt

SEQ ID NO: 83863 - DNA, 25 bp, Mus musculus
aatggtcctgagaaagcgtctctac

SEQ ID NO: 83864 - DNA, 25 bp, Mus musculus
aatggtcctgagtaagcgtctctac

SEQ ID NO: 83865 - DNA, 25 bp, Mus musculus
aatggtcctgcaccctagggtcgag

SEQ ID NO: 83866 - DNA, 25 bp, Mus musculus
aatggtcctgcagcctagggtcgag

SEQ ID NO: 83867 - DNA, 25 bp, Mus musculus
aatggtcctttgaaactatctgtgt

SEQ ID NO: 83868 - DNA, 25 bp, Mus musculus
aatggtcctttgtaactatctgtgt

SEQ ID NO: 83869 - DNA, 25 bp, Mus musculus
aatggtcgaataatgtactgcccct

SEQ ID NO: 83870 - DNA, 25 bp, Mus musculus
aatggtcgaatattgtactgcccct

SEQ ID NO: 83871 - DNA, 25 bp, Mus musculus
aatggtcgcactcctggtcaccatc

SEQ ID NO: 83872 - DNA, 25 bp, Mus musculus
aatggtcgcactgctggtcaccatc

SEQ ID NO: 83873 - DNA, 25 bp, Mus musculus
aatggtcgctcaatgctggacctag

SEQ ID NO: 83874 - DNA, 25 bp, Mus musculus
aatggtcgctcattgctggacctag

SEQ ID NO: 83875 - DNA, 25 bp, Mus musculus
aatggtctagacacacattctaccc

SEQ ID NO: 83876 - DNA, 25 bp, Mus musculus
aatggtctagactcacattctaccc

SEQ ID NO: 83877 - DNA, 25 bp, Mus musculus
aatggtctagtacttttctacttat

SEQ ID NO: 83878 - DNA, 25 bp, Mus musculus
aatggtctagtagttttctacttat

SEQ ID NO: 83879 - DNA, 25 bp, Mus musculus
aatggtctccgcctggatctcccag

SEQ ID NO: 83880 - DNA, 25 bp, Mus musculus
aatggtctccgcgtggatctcccag

SEQ ID NO: 83881 - DNA, 25 bp, Mus musculus
aatggtctctgtaccaggactcttt

SEQ ID NO: 83882 - DNA, 25 bp, Mus musculus
aatggtctctgttccaggactcttt

SEQ ID NO: 83883 - DNA, 25 bp, Mus musculus
aatggtctgaagagcccaggcgagt

SEQ ID NO: 83884 - DNA, 25 bp, Mus musculus
aatggtctgaagtgcccaggcgagt

SEQ ID NO: 83885 - DNA, 25 bp, Mus musculus
aatggtctgaggctgtgtaccgcta

SEQ ID NO: 83886 - DNA, 25 bp, Mus musculus
aatggtctgagggtgtgtaccgcta

SEQ ID NO: 83887 - DNA, 25 bp, Mus musculus
aatggtctgattccttagccgtctc

SEQ ID NO: 83888 - DNA, 25 bp, Mus musculus
aatggtctgattgcttagccgtctc

SEQ ID NO: 83889 - DNA, 25 bp, Mus musculus
aatggtctgttaagatgttgtatcc

SEQ ID NO: 83890 - DNA, 25 bp, Mus musculus
aatggtctgttatgatgttgtatcc

SEQ ID NO: 83891 - DNA, 25 bp, Mus musculus
aatggtcttacgctgtcacatgaaa

SEQ ID NO: 83892 - DNA, 25 bp, Mus musculus
aatggtcttacggtgtcacatgaaa

SEQ ID NO: 83893 - DNA, 25 bp, Mus musculus
aatggtcttagcaatgtagcagctt

SEQ ID NO: 83894 - DNA, 25 bp, Mus musculus
aatggtcttagctatgtagcagctt

SEQ ID NO: 83895 - DNA, 25 bp, Mus musculus
aatggtcttcaaagcacatgcaaag

SEQ ID NO: 83896 - DNA, 25 bp, Mus musculus
aatggtcttcaatgcacatgcaaag

SEQ ID NO: 83897 - DNA, 25 bp, Mus musculus
aatggtcttccgagcaactttagta

SEQ ID NO: 83898 - DNA, 25 bp, Mus musculus
aatggtcttccgtgcaactttagta

SEQ ID NO: 83899 - DNA, 25 bp, Mus musculus
aatggtcttcgtaaccaggaggtct

SEQ ID NO: 83900 - DNA, 25 bp, Mus musculus
aatggtcttcgttaccaggaggtct

SEQ ID NO: 83901 - DNA, 25 bp, Mus musculus
aatggtcttctgaatgtctctggag

SEQ ID NO: 83902 - DNA, 25 bp, Mus musculus
aatggtcttctgtatgtctctggag

SEQ ID NO: 83903 - DNA, 25 bp, Mus musculus
aatggtctttgcaaatagtgatcag

SEQ ID NO: 83904 - DNA, 25 bp, Mus musculus
aatggtctttgctaatagtgatcag

SEQ ID NO: 83905 - DNA, 25 bp, Mus musculus
aatggtgaaccacattcctgctttc

SEQ ID NO: 83906 - DNA, 25 bp, Mus musculus
aatggtgaaccagattcctgctttc

SEQ ID NO: 83907 - DNA, 25 bp, Mus musculus
aatggtgaagctatagtttttagag

SEQ ID NO: 83908 - DNA, 25 bp, Mus musculus
aatggtgaagctttagtttttagag

SEQ ID NO: 83909 - DNA, 25 bp, Mus musculus
aatggtgaattaatcttctcctcgt

SEQ ID NO: 83910 - DNA, 25 bp, Mus musculus
aatggtgaattattcttctcctcgt

SEQ ID NO: 83911 - DNA, 25 bp, Mus musculus
aatggtgacatcaagtttctgacta

SEQ ID NO: 83912 - DNA, 25 bp, Mus musculus
aatggtgacatctagtttctgacta

SEQ ID NO: 83913 - DNA, 25 bp, Mus musculus
aatggtgacccgcttcaatgaggcc

SEQ ID NO: 83914 - DNA, 25 bp, Mus musculus
aatggtgacccggttcaatgaggcc

SEQ ID NO: 83915 - DNA, 25 bp, Mus musculus
aatggtgacctgatctgctactggc

SEQ ID NO: 83916 - DNA, 25 bp, Mus musculus
aatggtgacctgttctgctactggc

SEQ ID NO: 83917 - DNA, 25 bp, Mus musculus
aatggtgactcccaactacctgtaa

SEQ ID NO: 83918 - DNA, 25 bp, Mus musculus
aatggtgactccgaactacctgtaa

SEQ ID NO: 83919 - DNA, 25 bp, Mus musculus
aatggtgacttcatggtgcgagaga

SEQ ID NO: 83920 - DNA, 25 bp, Mus musculus
aatggtgacttcttggtgcgagaga

SEQ ID NO: 83921 - DNA, 25 bp, Mus musculus
aatggtgactttaattctgcaagag

SEQ ID NO: 83922 - DNA, 25 bp, Mus musculus
aatggtgacttttattctgcaagag

SEQ ID NO: 83923 - DNA, 25 bp, Mus musculus
aatggtgagaggatctacgcttgtc

SEQ ID NO: 83924 - DNA, 25 bp, Mus musculus
aatggtgagaggttctacgcttgtc

SEQ ID NO: 83925 - DNA, 25 bp, Mus musculus
aatggtgagcatcccacagggcagt

SEQ ID NO: 83926 - DNA, 25 bp, Mus musculus
aatggtgagcatgccacagggcagt

SEQ ID NO: 83927 - DNA, 25 bp, Mus musculus
aatggtgaggataccatctcatcag

SEQ ID NO: 83928 - DNA, 25 bp, Mus musculus
aatggtgaggattccatctcatcag

SEQ ID NO: 83929 - DNA, 25 bp, Mus musculus
aatggtgatagcctttgtagaaaga

SEQ ID NO: 83930 - DNA, 25 bp, Mus musculus
aatggtgatagcgtttgtagaaaga

SEQ ID NO: 83931 - DNA, 25 bp, Mus musculus
aatggtgatgagatacgcaagctgc

SEQ ID NO: 83932 - DNA, 25 bp, Mus musculus
aatggtgatgagttacgcaagctgc

SEQ ID NO: 83933 - DNA, 25 bp, Mus musculus
aatggtgattgacgcccaggaccca

SEQ ID NO: 83934 - DNA, 25 bp, Mus musculus
aatggtgattgaggcccaggaccca

SEQ ID NO: 83935 - DNA, 25 bp, Mus musculus
aatggtgcagcacttttcctgttta

SEQ ID NO: 83936 - DNA, 25 bp, Mus musculus
aatggtgcagcagttttcctgttta

SEQ ID NO: 83937 - DNA, 25 bp, Mus musculus
aatggtgcaggcactcactggagga

SEQ ID NO: 83938 - DNA, 25 bp, Mus musculus
aatggtgcaggctctcactggagga

SEQ ID NO: 83939 - DNA, 25 bp, Mus musculus
aatggtgccaataaattgtcagtga

SEQ ID NO: 83940 - DNA, 25 bp, Mus musculus
aatggtgccaattaattgtcagtga

SEQ ID NO: 83941 - DNA, 25 bp, Mus musculus
aatggtgccacaaacaggtatccac

SEQ ID NO: 83942 - DNA, 25 bp, Mus musculus
aatggtgccacatacaggtatccac

SEQ ID NO: 83943 - DNA, 25 bp, Mus musculus
aatggtgccaccaactgaagaccaa

SEQ ID NO: 83944 - DNA, 25 bp, Mus musculus
aatggtgccacctactgaagaccaa

SEQ ID NO: 83945 - DNA, 25 bp, Mus musculus
aatggtgccactactcactgtgaca

SEQ ID NO: 83946 - DNA, 25 bp, Mus musculus
aatggtgccacttctcactgtgaca

SEQ ID NO: 83947 - DNA, 25 bp, Mus musculus
aatggtgccatgagaagcccttgtt

SEQ ID NO: 83948 - DNA, 25 bp, Mus musculus
aatggtgccatgtgaagcccttgtt

SEQ ID NO: 83949 - DNA, 25 bp, Mus musculus
aatggtgcccttcagagtggtgcct

SEQ ID NO: 83950 - DNA, 25 bp, Mus musculus
aatggtgcccttccttgataggtgg

SEQ ID NO: 83951 - DNA, 25 bp, Mus musculus
aatggtgcccttgagagtggtgcct

SEQ ID NO: 83952 - DNA, 25 bp, Mus musculus
aatggtgcccttgcttgataggtgg

SEQ ID NO: 83953 - DNA, 25 bp, Mus musculus
aatggtgccggacatgccaagctgt

SEQ ID NO: 83954 - DNA, 25 bp, Mus musculus
aatggtgccggagatgccaagctgt

SEQ ID NO: 83955 - DNA, 25 bp, Mus musculus
aatggtgcctgaacctacactgatg

SEQ ID NO: 83956 - DNA, 25 bp, Mus musculus
aatggtgcctgatcctacactgatg

SEQ ID NO: 83957 - DNA, 25 bp, Mus musculus
aatggtgccttgctcattcttgagt

SEQ ID NO: 83958 - DNA, 25 bp, Mus musculus
aatggtgccttggtcattcttgagt

SEQ ID NO: 83959 - DNA, 25 bp, Mus musculus
aatggtgcgaaactcaattgctctg

SEQ ID NO: 83960 - DNA, 25 bp, Mus musculus
aatggtgcgaaagtcaattgctctg

SEQ ID NO: 83961 - DNA, 25 bp, Mus musculus
aatggtgcggccacggcaagaacct

SEQ ID NO: 83962 - DNA, 25 bp, Mus musculus
aatggtgcggcctcggcaagaacct

SEQ ID NO: 83963 - DNA, 25 bp, Mus musculus
aatggtgctacaagaatgcagtccc

SEQ ID NO: 83964 - DNA, 25 bp, Mus musculus
aatggtgctacatgaatgcagtccc

SEQ ID NO: 83965 - DNA, 25 bp, Mus musculus
aatggtgctcacatgttacgtttga

SEQ ID NO: 83966 - DNA, 25 bp, Mus musculus
aatggtgctcacttgttacgtttga

SEQ ID NO: 83967 - DNA, 25 bp, Mus musculus
aatggtgctccaaaccggttgtggt

SEQ ID NO: 83968 - DNA, 25 bp, Mus musculus
aatggtgctccataccggttgtggt

SEQ ID NO: 83969 - DNA, 25 bp, Mus musculus
aatggtgctcgtaatacctgcttgc

SEQ ID NO: 83970 - DNA, 25 bp, Mus musculus
aatggtgctcgttatacctgcttgc

SEQ ID NO: 83971 - DNA, 25 bp, Mus musculus
aatggtgctgcaagttataacttta

SEQ ID NO: 83972 - DNA, 25 bp, Mus musculus
aatggtgctgcatgttataacttta

SEQ ID NO: 83973 - DNA, 25 bp, Mus musculus
aatggtgctgtactcaggtctgtaa

SEQ ID NO: 83974 - DNA, 25 bp, Mus musculus
aatggtgctgtagtcaggtctgtaa

SEQ ID NO: 83975 - DNA, 25 bp, Mus musculus
aatggtgctgtcaaactgaatgtct

SEQ ID NO: 83976 - DNA, 25 bp, Mus musculus
aatggtgctgtctaactgaatgtct

SEQ ID NO: 83977 - DNA, 25 bp, Mus musculus
aatggtgcttacaatagtctttaga

SEQ ID NO: 83978 - DNA, 25 bp, Mus musculus
aatggtgcttactatagtctttaga

SEQ ID NO: 83979 - DNA, 25 bp, Mus musculus
aatggtgcttcgcaggctccgagca

SEQ ID NO: 83980 - DNA, 25 bp, Mus musculus
aatggtgcttcggaggctccgagca

SEQ ID NO: 83981 - DNA, 25 bp, Mus musculus
aatggtgcttgtctcaaagtgctgt

SEQ ID NO: 83982 - DNA, 25 bp, Mus musculus
aatggtgcttgtgtcaaagtgctgt

SEQ ID NO: 83983 - DNA, 25 bp, Mus musculus
aatggtggaccaccttcaaggaaca

SEQ ID NO: 83984 - DNA, 25 bp, Mus musculus
aatggtggaccagcttcaaggaaca

SEQ ID NO: 83985 - DNA, 25 bp, Mus musculus
aatggtggatacagtcttctgactc

SEQ ID NO: 83986 - DNA, 25 bp, Mus musculus
aatggtggatactgtcttctgactc

SEQ ID NO: 83987 - DNA, 25 bp, Mus musculus
aatggtggatctaggctctggtgat

SEQ ID NO: 83988 - DNA, 25 bp, Mus musculus
aatggtggatcttggctctggtgat

SEQ ID NO: 83989 - DNA, 25 bp, Mus musculus
aatggtggattcctttcgtcagcaa

SEQ ID NO: 83990 - DNA, 25 bp, Mus musculus
aatggtggattcgtttcgtcagcaa

SEQ ID NO: 83991 - DNA, 25 bp, Mus musculus
aatggtggatttaggccggctagcc

SEQ ID NO: 83992 - DNA, 25 bp, Mus musculus
aatggtggattttggccggctagcc

SEQ ID NO: 83993 - DNA, 25 bp, Mus musculus
aatggtggcaggcaacacctcctgt

SEQ ID NO: 83994 - DNA, 25 bp, Mus musculus
aatggtggcagggaacacctcctgt

SEQ ID NO: 83995 - DNA, 25 bp, Mus musculus
aatggtggccatagatcaggtccta

SEQ ID NO: 83996 - DNA, 25 bp, Mus musculus
aatggtggccattgatcaggtccta

SEQ ID NO: 83997 - DNA, 25 bp, Mus musculus
aatggtggcttacaaggctgagttc

SEQ ID NO: 83998 - DNA, 25 bp, Mus musculus
aatggtggcttagaaggctgagttc

SEQ ID NO: 83999 - DNA, 25 bp, Mus musculus
aatggtggctttacattccctccct

SEQ ID NO: 84000 - DNA, 25 bp, Mus musculus
aatggtggcttttcattccctccct

SEQ ID NO: 84001 - DNA, 25 bp, Mus musculus
aatggtgggcgcctcctttgaccca

SEQ ID NO: 84002 - DNA, 25 bp, Mus musculus
aatggtgggcgcgtcctttgaccca

SEQ ID NO: 84003 - DNA, 25 bp, Mus musculus
aatggtgggtatacctccagtttgg

SEQ ID NO: 84004 - DNA, 25 bp, Mus musculus
aatggtgggtattcctccagtttgg

SEQ ID NO: 84005 - DNA, 25 bp, Mus musculus
aatggtggtaacacccattactgaa

SEQ ID NO: 84006 - DNA, 25 bp, Mus musculus
aatggtggtaactcccattactgaa

SEQ ID NO: 84007 - DNA, 25 bp, Mus musculus
aatggtggtccaagagaaacaagat

SEQ ID NO: 84008 - DNA, 25 bp, Mus musculus
aatggtggtccatgagaaacaagat

SEQ ID NO: 84009 - DNA, 25 bp, Mus musculus
aatggtggtggccaaccccatactg

SEQ ID NO: 84010 - DNA, 25 bp, Mus musculus
aatggtggtggcgaaccccatactg

SEQ ID NO: 84011 - DNA, 25 bp, Mus musculus
aatggtggttccatggacagcatcc

SEQ ID NO: 84012 - DNA, 25 bp, Mus musculus
aatggtggttccttggacagcatcc

SEQ ID NO: 84013 - DNA, 25 bp, Mus musculus
aatggtggttgaattttccagccca

SEQ ID NO: 84014 - DNA, 25 bp, Mus musculus
aatggtggttgatttttccagccca

SEQ ID NO: 84015 - DNA, 25 bp, Mus musculus
aatggtggttgcacttgaaaatcat

SEQ ID NO: 84016 - DNA, 25 bp, Mus musculus
aatggtggttgctcttgaaaatcat

SEQ ID NO: 84017 - DNA, 25 bp, Mus musculus
aatggtgtaagccactatgcccagc

SEQ ID NO: 84018 - DNA, 25 bp, Mus musculus
aatggtgtaagcgactatgcccagc

SEQ ID NO: 84019 - DNA, 25 bp, Mus musculus
aatggtgtacgcattgccagagcaa

SEQ ID NO: 84020 - DNA, 25 bp, Mus musculus
aatggtgtacgctttgccagagcaa

SEQ ID NO: 84021 - DNA, 25 bp, Mus musculus
aatggtgtagaacccatgagcctcc

SEQ ID NO: 84022 - DNA, 25 bp, Mus musculus
aatggtgtagaagccatgagcctcc

SEQ ID NO: 84023 - DNA, 25 bp, Mus musculus
aatggtgtcaatcgatttctgttca

SEQ ID NO: 84024 - DNA, 25 bp, Mus musculus
aatggtgtcaatggatttctgttca

SEQ ID NO: 84025 - DNA, 25 bp, Mus musculus
aatggtgtcatgatcaactggtcag

SEQ ID NO: 84026 - DNA, 25 bp, Mus musculus
aatggtgtcatgttcaactggtcag

SEQ ID NO: 84027 - DNA, 25 bp, Mus musculus
aatggtgtccaaaaagctctgagca

SEQ ID NO: 84028 - DNA, 25 bp, Mus musculus
aatggtgtccaataagctctgagca

SEQ ID NO: 84029 - DNA, 25 bp, Mus musculus
aatggtgtcctcatctaaccagagg

SEQ ID NO: 84030 - DNA, 25 bp, Mus musculus
aatggtgtcctcttctaaccagagg

SEQ ID NO: 84031 - DNA, 25 bp, Mus musculus
aatggtgtctaaatgcacccctttg

SEQ ID NO: 84032 - DNA, 25 bp, Mus musculus
aatggtgtctaattgcacccctttg

SEQ ID NO: 84033 - DNA, 25 bp, Mus musculus
aatggtgtgatgagcatgcttttaa

SEQ ID NO: 84034 - DNA, 25 bp, Mus musculus
aatggtgtgatgtgcatgcttttaa

SEQ ID NO: 84035 - DNA, 25 bp, Mus musculus
aatggtgtgcacaacgtggccaata

SEQ ID NO: 84036 - DNA, 25 bp, Mus musculus
aatggtgtgcaccagtgccacaaag

SEQ ID NO: 84037 - DNA, 25 bp, Mus musculus
aatggtgtgcacgagtgccacaaag

SEQ ID NO: 84038 - DNA, 25 bp, Mus musculus
aatggtgtgcactacgtggccaata

SEQ ID NO: 84039 - DNA, 25 bp, Mus musculus
aatggtgtgccactgctgacagagt

SEQ ID NO: 84040 - DNA, 25 bp, Mus musculus
aatggtgtgccagtgctgacagagt

SEQ ID NO: 84041 - DNA, 25 bp, Mus musculus
aatggtgtgcctctttgcctgttgc

SEQ ID NO: 84042 - DNA, 25 bp, Mus musculus
aatggtgtgcctgtttgcctgttgc

SEQ ID NO: 84043 - DNA, 25 bp, Mus musculus
aatggtgtgtgcagggcttgacccc

SEQ ID NO: 84044 - DNA, 25 bp, Mus musculus
aatggtgtgtgctgggcttgacccc

SEQ ID NO: 84045 - DNA, 25 bp, Mus musculus
aatggtgtgtgtcagctgatccgaa

SEQ ID NO: 84046 - DNA, 25 bp, Mus musculus
aatggtgtgtgtgagctgatccgaa

SEQ ID NO: 84047 - DNA, 25 bp, Mus musculus
aatggtgttaaaagacgtcgagggc

SEQ ID NO: 84048 - DNA, 25 bp, Mus musculus
aatggtgttaaatgacgtcgagggc

SEQ ID NO: 84049 - DNA, 25 bp, Mus musculus
aatggtgttaccagccacattgttt

SEQ ID NO: 84050 - DNA, 25 bp, Mus musculus
aatggtgttacctgccacattgttt

SEQ ID NO: 84051 - DNA, 25 bp, Mus musculus
aatggtgttcacagcggctgtcatc

SEQ ID NO: 84052 - DNA, 25 bp, Mus musculus
aatggtgttcacatgcctaatcgga

SEQ ID NO: 84053 - DNA, 25 bp, Mus musculus
aatggtgttcactgcggctgtcatc

SEQ ID NO: 84054 - DNA, 25 bp, Mus musculus
aatggtgttcacttgcctaatcgga

SEQ ID NO: 84055 - DNA, 25 bp, Mus musculus
aatggtgttctgatctggacctaaa

SEQ ID NO: 84056 - DNA, 25 bp, Mus musculus
aatggtgttctgttctggacctaaa

SEQ ID NO: 84057 - DNA, 25 bp, Mus musculus
aatggtgttcttcctcacagtggtt

SEQ ID NO: 84058 - DNA, 25 bp, Mus musculus
aatggtgttcttgctcacagtggtt

SEQ ID NO: 84059 - DNA, 25 bp, Mus musculus
aatggtgttgaaagtcctgcctgct

SEQ ID NO: 84060 - DNA, 25 bp, Mus musculus
aatggtgttgaatgtcctgcctgct

SEQ ID NO: 84061 - DNA, 25 bp, Mus musculus
aatggtgttgctacaaatgttgctt

SEQ ID NO: 84062 - DNA, 25 bp, Mus musculus
aatggtgttgctacatgtactttga

SEQ ID NO: 84063 - DNA, 25 bp, Mus musculus
aatggtgttgcttcaaatgttgctt

SEQ ID NO: 84064 - DNA, 25 bp, Mus musculus
aatggtgttgcttcatgtactttga

SEQ ID NO: 84065 - DNA, 25 bp, Mus musculus
aatggtgtttacacacctccacctg

SEQ ID NO: 84066 - DNA, 25 bp, Mus musculus
aatggtgtttactcacctccacctg

SEQ ID NO: 84067 - DNA, 25 bp, Mus musculus
aatggtgtttctaaatagtcgctgg

SEQ ID NO: 84068 - DNA, 25 bp, Mus musculus
aatggtgtttcttaatagtcgctgg

SEQ ID NO: 84069 - DNA, 25 bp, Mus musculus
aatggttaccacaccatgtaaagaa

SEQ ID NO: 84070 - DNA, 25 bp, Mus musculus
aatggttaccactccatgtaaagaa

SEQ ID NO: 84071 - DNA, 25 bp, Mus musculus
aatggttacctcacttgcatgtaca

SEQ ID NO: 84072 - DNA, 25 bp, Mus musculus
aatggttacctctcttgcatgtaca

SEQ ID NO: 84073 - DNA, 25 bp, Mus musculus
aatggttactaacgcgtgctctgtt

SEQ ID NO: 84074 - DNA, 25 bp, Mus musculus
aatggttactaaggcgtgctctgtt

SEQ ID NO: 84075 - DNA, 25 bp, Mus musculus
aatggttagcccagaaaactcataa

SEQ ID NO: 84076 - DNA, 25 bp, Mus musculus
aatggttagccctgaaaactcataa

SEQ ID NO: 84077 - DNA, 25 bp, Mus musculus
aatggttatcaacaggtcacttcat

SEQ ID NO: 84078 - DNA, 25 bp, Mus musculus
aatggttatcaagaggtcacttcat

SEQ ID NO: 84079 - DNA, 25 bp, Mus musculus
aatggttatttgctgttacgtaaga

SEQ ID NO: 84080 - DNA, 25 bp, Mus musculus
aatggttatttggtgttacgtaaga

SEQ ID NO: 84081 - DNA, 25 bp, Mus musculus
aatggttcacagcagctcaggacag

SEQ ID NO: 84082 - DNA, 25 bp, Mus musculus
aatggttcacaggagctcaggacag

SEQ ID NO: 84083 - DNA, 25 bp, Mus musculus
aatggttcagtcactatggcaacag

SEQ ID NO: 84084 - DNA, 25 bp, Mus musculus
aatggttcagtctctatggcaacag

SEQ ID NO: 84085 - DNA, 25 bp, Mus musculus
aatggttcagttctctgccacttaa

SEQ ID NO: 84086 - DNA, 25 bp, Mus musculus
aatggttcagttgtctgccacttaa

SEQ ID NO: 84087 - DNA, 25 bp, Mus musculus
aatggttcatggcagtgactagcct

SEQ ID NO: 84088 - DNA, 25 bp, Mus musculus
aatggttcatgggagtgactagcct

SEQ ID NO: 84089 - DNA, 25 bp, Mus musculus
aatggttcattcctctacactggag

SEQ ID NO: 84090 - DNA, 25 bp, Mus musculus
aatggttcattcctgactgtttaga

SEQ ID NO: 84091 - DNA, 25 bp, Mus musculus
aatggttcattcgtctacactggag

SEQ ID NO: 84092 - DNA, 25 bp, Mus musculus
aatggttcattcgtgactgtttaga

SEQ ID NO: 84093 - DNA, 25 bp, Mus musculus
aatggttccatgctagggaatccta

SEQ ID NO: 84094 - DNA, 25 bp, Mus musculus
aatggttccatggtagggaatccta

SEQ ID NO: 84095 - DNA, 25 bp, Mus musculus
aatggttcccatatgtacagagact

SEQ ID NO: 84096 - DNA, 25 bp, Mus musculus
aatggttcccatcccaatgaaacaa

SEQ ID NO: 84097 - DNA, 25 bp, Mus musculus
aatggttcccatgccaatgaaacaa

SEQ ID NO: 84098 - DNA, 25 bp, Mus musculus
aatggttcccatttgtacagagact

SEQ ID NO: 84099 - DNA, 25 bp, Mus musculus
aatggttcctccctgtggtctaaca

SEQ ID NO: 84100 - DNA, 25 bp, Mus musculus
aatggttcctccgtgtggtctaaca

SEQ ID NO: 84101 - DNA, 25 bp, Mus musculus
aatggttccttcacatccaactgcc

SEQ ID NO: 84102 - DNA, 25 bp, Mus musculus
aatggttccttctcatccaactgcc

SEQ ID NO: 84103 - DNA, 25 bp, Mus musculus
aatggttcggaaattcctgtgcact

SEQ ID NO: 84104 - DNA, 25 bp, Mus musculus
aatggttcggaatttcctgtgcact

SEQ ID NO: 84105 - DNA, 25 bp, Mus musculus
aatggttcgtacagcagcggaagtg

SEQ ID NO: 84106 - DNA, 25 bp, Mus musculus
aatggttcgtactgcagcggaagtg

SEQ ID NO: 84107 - DNA, 25 bp, Mus musculus
aatggttctaggaaagtgctgcttt

SEQ ID NO: 84108 - DNA, 25 bp, Mus musculus
aatggttctaggtaagtgctgcttt

SEQ ID NO: 84109 - DNA, 25 bp, Mus musculus
aatggttctcacatttaagttatga

SEQ ID NO: 84110 - DNA, 25 bp, Mus musculus
aatggttctcacttttaagttatga

SEQ ID NO: 84111 - DNA, 25 bp, Mus musculus
aatggttctccacaaagccctgcag

SEQ ID NO: 84112 - DNA, 25 bp, Mus musculus
aatggttctccagaaagccctgcag

SEQ ID NO: 84113 - DNA, 25 bp, Mus musculus
aatggttctgaactatctgttgctt

SEQ ID NO: 84114 - DNA, 25 bp, Mus musculus
aatggttctgaagtatctgttgctt

SEQ ID NO: 84115 - DNA, 25 bp, Mus musculus
aatggttctgcacctttcaatggtg

SEQ ID NO: 84116 - DNA, 25 bp, Mus musculus
aatggttctgcagctttcaatggtg

SEQ ID NO: 84117 - DNA, 25 bp, Mus musculus
aatggttcttcacttgttatctctg

SEQ ID NO: 84118 - DNA, 25 bp, Mus musculus
aatggttcttcagttgttatctctg

SEQ ID NO: 84119 - DNA, 25 bp, Mus musculus
aatggttcttgtattcatctagtca

SEQ ID NO: 84120 - DNA, 25 bp, Mus musculus
aatggttcttgtctttctctgccta

SEQ ID NO: 84121 - DNA, 25 bp, Mus musculus
aatggttcttgtgtttctctgccta

SEQ ID NO: 84122 - DNA, 25 bp, Mus musculus
aatggttcttgttttcatctagtca

SEQ ID NO: 84123 - DNA, 25 bp, Mus musculus
aatggttctttgatgctcatcatct

SEQ ID NO: 84124 - DNA, 25 bp, Mus musculus
aatggttctttgttgctcatcatct

SEQ ID NO: 84125 - DNA, 25 bp, Mus musculus
aatggttgaattatgtgataatccc

SEQ ID NO: 84126 - DNA, 25 bp, Mus musculus
aatggttgaattttgtgataatccc

SEQ ID NO: 84127 - DNA, 25 bp, Mus musculus
aatggttgcataaccatgtttccag

SEQ ID NO: 84128 - DNA, 25 bp, Mus musculus
aatggttgcatatccatgtttccag

SEQ ID NO: 84129 - DNA, 25 bp, Mus musculus
aatggttgccaccagaggcttagga

SEQ ID NO: 84130 - DNA, 25 bp, Mus musculus
aatggttgccacgagaggcttagga

SEQ ID NO: 84131 - DNA, 25 bp, Mus musculus
aatggttgccgactcatgttaattg

SEQ ID NO: 84132 - DNA, 25 bp, Mus musculus
aatggttgccgagtcatgttaattg

SEQ ID NO: 84133 - DNA, 25 bp, Mus musculus
aatggttgccttataagtaggatca

SEQ ID NO: 84134 - DNA, 25 bp, Mus musculus
aatggttgccttttaagtaggatca

SEQ ID NO: 84135 - DNA, 25 bp, Mus musculus
aatggttgctagctctggtcttgat

SEQ ID NO: 84136 - DNA, 25 bp, Mus musculus
aatggttgctaggtctggtcttgat

SEQ ID NO: 84137 - DNA, 25 bp, Mus musculus
aatggttgctttaatccctgctgtc

SEQ ID NO: 84138 - DNA, 25 bp, Mus musculus
aatggttgcttttatccctgctgtc

SEQ ID NO: 84139 - DNA, 25 bp, Mus musculus
aatggttggcaaaggcacctctcat

SEQ ID NO: 84140 - DNA, 25 bp, Mus musculus
aatggttggcaatggcacctctcat

SEQ ID NO: 84141 - DNA, 25 bp, Mus musculus
aatggttgggagatcacatagtgat

SEQ ID NO: 84142 - DNA, 25 bp, Mus musculus
aatggttgggagttcacatagtgat

SEQ ID NO: 84143 - DNA, 25 bp, Mus musculus
aatggttggtcccattcccagagct

SEQ ID NO: 84144 - DNA, 25 bp, Mus musculus
aatggttggtccgattcccagagct

SEQ ID NO: 84145 - DNA, 25 bp, Mus musculus
aatggttgtggcctaatcccactct

SEQ ID NO: 84146 - DNA, 25 bp, Mus musculus
aatggttgtggcgtaatcccactct

SEQ ID NO: 84147 - DNA, 25 bp, Mus musculus
aatggttgttatctggctggctctc

SEQ ID NO: 84148 - DNA, 25 bp, Mus musculus
aatggttgttatgtggctggctctc

SEQ ID NO: 84149 - DNA, 25 bp, Mus musculus
aatggttgttggatactgttgctcc

SEQ ID NO: 84150 - DNA, 25 bp, Mus musculus
aatggttgttggcatccactagaga

SEQ ID NO: 84151 - DNA, 25 bp, Mus musculus
aatggttgttgggatccactagaga

SEQ ID NO: 84152 - DNA, 25 bp, Mus musculus
aatggttgttggttactgttgctcc

SEQ ID NO: 84153 - DNA, 25 bp, Mus musculus
aatggtttaagcaggttctggagaa

SEQ ID NO: 84154 - DNA, 25 bp, Mus musculus
aatggtttaagctggttctggagaa

SEQ ID NO: 84155 - DNA, 25 bp, Mus musculus
aatggtttactgctgtcattgtcca

SEQ ID NO: 84156 - DNA, 25 bp, Mus musculus
aatggtttactggtgtcattgtcca

SEQ ID NO: 84157 - DNA, 25 bp, Mus musculus
aatggtttccttaatggcgtccttg

SEQ ID NO: 84158 - DNA, 25 bp, Mus musculus
aatggtttcctttatggcgtccttg

SEQ ID NO: 84159 - DNA, 25 bp, Mus musculus
aatggtttctaactccctccttgct

SEQ ID NO: 84160 - DNA, 25 bp, Mus musculus
aatggtttctaagtccctccttgct

SEQ ID NO: 84161 - DNA, 25 bp, Mus musculus
aatggtttctgtaaagttctggatc

SEQ ID NO: 84162 - DNA, 25 bp, Mus musculus
aatggtttctgttaagttctggatc

SEQ ID NO: 84163 - DNA, 25 bp, Mus musculus
aatggtttggagattcactatcctc

SEQ ID NO: 84164 - DNA, 25 bp, Mus musculus
aatggtttggagtttcactatcctc

SEQ ID NO: 84165 - DNA, 25 bp, Mus musculus
aatggtttgtatcttactgttcata

SEQ ID NO: 84166 - DNA, 25 bp, Mus musculus
aatggtttgtatgttactgttcata

SEQ ID NO: 84167 - DNA, 25 bp, Mus musculus
aatggtttgtcaagtgttgcccggg

SEQ ID NO: 84168 - DNA, 25 bp, Mus musculus
aatggtttgtcatgtgttgcccggg

SEQ ID NO: 84169 - DNA, 25 bp, Mus musculus
aatggtttgtctcaatctgacccag

SEQ ID NO: 84170 - DNA, 25 bp, Mus musculus
aatggtttgtctgaatctgacccag

SEQ ID NO: 84171 - DNA, 25 bp, Mus musculus
aatggtttgtgtcttttctcatcct

SEQ ID NO: 84172 - DNA, 25 bp, Mus musculus
aatggtttgtgtgttttctcatcct

SEQ ID NO: 84173 - DNA, 25 bp, Mus musculus
aatggttttcagcaagtcatcttaa

SEQ ID NO: 84174 - DNA, 25 bp, Mus musculus
aatggttttcaggaagtcatcttaa

SEQ ID NO: 84175 - DNA, 25 bp, Mus musculus
aatggttttgctctaaactgtgttt

SEQ ID NO: 84176 - DNA, 25 bp, Mus musculus
aatggttttgctgtaaactgtgttt

SEQ ID NO: 84177 - DNA, 25 bp, Mus musculus
aatggttttgtaactcagaatgagt

SEQ ID NO: 84178 - DNA, 25 bp, Mus musculus
aatggttttgtacgtggcctctgcc

SEQ ID NO: 84179 - DNA, 25 bp, Mus musculus
aatggttttgtaggtggcctctgcc

SEQ ID NO: 84180 - DNA, 25 bp, Mus musculus
aatggttttgtatctcagaatgagt

SEQ ID NO: 84181 - DNA, 25 bp, Mus musculus
aatggttttttacattctgttccag

SEQ ID NO: 84182 - DNA, 25 bp, Mus musculus
aatggttttttagattctgttccag

SEQ ID NO: 84183 - DNA, 25 bp, Mus musculus
aatgtaaaacctcgccacctctgac

SEQ ID NO: 84184 - DNA, 25 bp, Mus musculus
aatgtaaaacctggccacctctgac

SEQ ID NO: 84185 - DNA, 25 bp, Mus musculus
aatgtaaaactaactcctcgaccag

SEQ ID NO: 84186 - DNA, 25 bp, Mus musculus
aatgtaaaactatctcctcgaccag

SEQ ID NO: 84187 - DNA, 25 bp, Mus musculus
aatgtaaacagaccataaacccatt

SEQ ID NO: 84188 - DNA, 25 bp, Mus musculus
aatgtaaacagagcataaacccatt

SEQ ID NO: 84189 - DNA, 25 bp, Mus musculus
aatgtaaacgacatcgtcacccctt

SEQ ID NO: 84190 - DNA, 25 bp, Mus musculus
aatgtaaacgacttcgtcacccctt

SEQ ID NO: 84191 - DNA, 25 bp, Mus musculus
aatgtaaagcctctccatatgtttt

SEQ ID NO: 84192 - DNA, 25 bp, Mus musculus
aatgtaaagcctgtccatatgtttt

SEQ ID NO: 84193 - DNA, 25 bp, Mus musculus
aatgtaaagcgtctgtccgggccgt

SEQ ID NO: 84194 - DNA, 25 bp, Mus musculus
aatgtaaagcgtgtgtccgggccgt

SEQ ID NO: 84195 - DNA, 25 bp, Mus musculus
aatgtaaatacgaagtatccttgtt

SEQ ID NO: 84196 - DNA, 25 bp, Mus musculus
aatgtaaatacgtagtatccttgtt

SEQ ID NO: 84197 - DNA, 25 bp, Mus musculus
aatgtaaatgctcccttatgctttt

SEQ ID NO: 84198 - DNA, 25 bp, Mus musculus
aatgtaaatgctgccttatgctttt

SEQ ID NO: 84199 - DNA, 25 bp, Mus musculus
aatgtaacaaatagccccatagccc

SEQ ID NO: 84200 - DNA, 25 bp, Mus musculus
aatgtaacaaattgccccatagccc

SEQ ID NO: 84201 - DNA, 25 bp, Mus musculus
aatgtaacacagaccagctacctgt

SEQ ID NO: 84202 - DNA, 25 bp, Mus musculus
aatgtaacacagtccagctacctgt

SEQ ID NO: 84203 - DNA, 25 bp, Mus musculus
aatgtaacatgtctgtcctattcca

SEQ ID NO: 84204 - DNA, 25 bp, Mus musculus
aatgtaacatgtgtgtcctattcca

SEQ ID NO: 84205 - DNA, 25 bp, Mus musculus
aatgtaacgggcactttggatcaag

SEQ ID NO: 84206 - DNA, 25 bp, Mus musculus
aatgtaacgggctctttggatcaag

SEQ ID NO: 84207 - DNA, 25 bp, Mus musculus
aatgtaactcagcagggccggaaga

SEQ ID NO: 84208 - DNA, 25 bp, Mus musculus
aatgtaactcaggagggccggaaga

SEQ ID NO: 84209 - DNA, 25 bp, Mus musculus
aatgtaactcccacagttttgagag

SEQ ID NO: 84210 - DNA, 25 bp, Mus musculus
aatgtaactccctcagttttgagag

SEQ ID NO: 84211 - DNA, 25 bp, Mus musculus
aatgtaactgttatcaccgcgcttg

SEQ ID NO: 84212 - DNA, 25 bp, Mus musculus
aatgtaactgttttcaccgcgcttg

SEQ ID NO: 84213 - DNA, 25 bp, Mus musculus
aatgtaagtgctacacagtgctttg

SEQ ID NO: 84214 - DNA, 25 bp, Mus musculus
aatgtaagtgcttcacagtgctttg

SEQ ID NO: 84215 - DNA, 25 bp, Mus musculus
aatgtaagttcacgacatcgtgcct

SEQ ID NO: 84216 - DNA, 25 bp, Mus musculus
aatgtaagttcaggacatcgtgcct

SEQ ID NO: 84217 - DNA, 25 bp, Mus musculus
aatgtaatagcacggctcctcttga

SEQ ID NO: 84218 - DNA, 25 bp, Mus musculus
aatgtaatagcagggctcctcttga

SEQ ID NO: 84219 - DNA, 25 bp, Mus musculus
aatgtaatagccctcttctgtactg

SEQ ID NO: 84220 - DNA, 25 bp, Mus musculus
aatgtaatagccgtcttctgtactg

SEQ ID NO: 84221 - DNA, 25 bp, Mus musculus
aatgtaattattacacccttgtgct

SEQ ID NO: 84222 - DNA, 25 bp, Mus musculus
aatgtaattatttcacccttgtgct

SEQ ID NO: 84223 - DNA, 25 bp, Mus musculus
aatgtaattctgaccagtgctgcag

SEQ ID NO: 84224 - DNA, 25 bp, Mus musculus
aatgtaattctgtccagtgctgcag

SEQ ID NO: 84225 - DNA, 25 bp, Mus musculus
aatgtacacagacactaatctataa

SEQ ID NO: 84226 - DNA, 25 bp, Mus musculus
aatgtacacagagactaatctataa

SEQ ID NO: 84227 - DNA, 25 bp, Mus musculus
aatgtacacatcatcgtctccgagt

SEQ ID NO: 84228 - DNA, 25 bp, Mus musculus
aatgtacacatcttcgtctccgagt

SEQ ID NO: 84229 - DNA, 25 bp, Mus musculus
aatgtacagcccctggttgatctaa

SEQ ID NO: 84230 - DNA, 25 bp, Mus musculus
aatgtacagcccgtggttgatctaa

SEQ ID NO: 84231 - DNA, 25 bp, Mus musculus
aatgtacatggccattcatccttgg

SEQ ID NO: 84232 - DNA, 25 bp, Mus musculus
aatgtacatggcgattcatccttgg

SEQ ID NO: 84233 - DNA, 25 bp, Mus musculus
aatgtacatgtcaatggtgcctaat

SEQ ID NO: 84234 - DNA, 25 bp, Mus musculus
aatgtacatgtctatggtgcctaat

SEQ ID NO: 84235 - DNA, 25 bp, Mus musculus
aatgtacccctaccaagatttgcta

SEQ ID NO: 84236 - DNA, 25 bp, Mus musculus
aatgtacccctagcaagatttgcta

SEQ ID NO: 84237 - DNA, 25 bp, Mus musculus
aatgtaccctaaaggaggctgctgt

SEQ ID NO: 84238 - DNA, 25 bp, Mus musculus
aatgtaccctaatggaggctgctgt

SEQ ID NO: 84239 - DNA, 25 bp, Mus musculus
aatgtaccgcggctaccatagctac

SEQ ID NO: 84240 - DNA, 25 bp, Mus musculus
aatgtaccgcgggtaccatagctac

SEQ ID NO: 84241 - DNA, 25 bp, Mus musculus
aatgtacctcagaccatctcaggtg

SEQ ID NO: 84242 - DNA, 25 bp, Mus musculus
aatgtacctcagtccatctcaggtg

SEQ ID NO: 84243 - DNA, 25 bp, Mus musculus
aatgtacctgtaatgtctgcgtgct

SEQ ID NO: 84244 - DNA, 25 bp, Mus musculus
aatgtacctgtattgtctgcgtgct

SEQ ID NO: 84245 - DNA, 25 bp, Mus musculus
aatgtaccttatcccttttctaatg

SEQ ID NO: 84246 - DNA, 25 bp, Mus musculus
aatgtaccttatgccttttctaatg

SEQ ID NO: 84247 - DNA, 25 bp, Mus musculus
aatgtaccttcaatgtgcccaagcc

SEQ ID NO: 84248 - DNA, 25 bp, Mus musculus
aatgtaccttcaattgctctgacac

SEQ ID NO: 84249 - DNA, 25 bp, Mus musculus
aatgtaccttcattgtgcccaagcc

SEQ ID NO: 84250 - DNA, 25 bp, Mus musculus
aatgtaccttcatttgctctgacac

SEQ ID NO: 84251 - DNA, 25 bp, Mus musculus
aatgtaccttgaacaggctgccact

SEQ ID NO: 84252 - DNA, 25 bp, Mus musculus
aatgtaccttgatcaggctgccact

SEQ ID NO: 84253 - DNA, 25 bp, Mus musculus
aatgtacgagaaagcctcccctagg

SEQ ID NO: 84254 - DNA, 25 bp, Mus musculus
aatgtacgagaatgcctcccctagg

SEQ ID NO: 84255 - DNA, 25 bp, Mus musculus
aatgtacgatatcccttagagtgac

SEQ ID NO: 84256 - DNA, 25 bp, Mus musculus
aatgtacgatatgccttagagtgac

SEQ ID NO: 84257 - DNA, 25 bp, Mus musculus
aatgtacgtgtaatctagttgcaaa

SEQ ID NO: 84258 - DNA, 25 bp, Mus musculus
aatgtacgtgtattctagttgcaaa

SEQ ID NO: 84259 - DNA, 25 bp, Mus musculus
aatgtactccaacgagtggttggca

SEQ ID NO: 84260 - DNA, 25 bp, Mus musculus
aatgtactccaaggagtggttggca

SEQ ID NO: 84261 - DNA, 25 bp, Mus musculus
aatgtactctgcagctagccagtgt

SEQ ID NO: 84262 - DNA, 25 bp, Mus musculus
aatgtactctgctgctagccagtgt

SEQ ID NO: 84263 - DNA, 25 bp, Mus musculus
aatgtactcttaatcaatgacttct

SEQ ID NO: 84264 - DNA, 25 bp, Mus musculus
aatgtactcttattcaatgacttct

SEQ ID NO: 84265 - DNA, 25 bp, Mus musculus
aatgtactgaccatgcttattgcct

SEQ ID NO: 84266 - DNA, 25 bp, Mus musculus
aatgtactgaccttgcttattgcct

SEQ ID NO: 84267 - DNA, 25 bp, Mus musculus
aatgtactgacgagccgaggcagca

SEQ ID NO: 84268 - DNA, 25 bp, Mus musculus
aatgtactgacgtgccgaggcagca

SEQ ID NO: 84269 - DNA, 25 bp, Mus musculus
aatgtactgagcagggtttctcctc

SEQ ID NO: 84270 - DNA, 25 bp, Mus musculus
aatgtactgagctgggtttctcctc

SEQ ID NO: 84271 - DNA, 25 bp, Mus musculus
aatgtacttagccattgtagggccc

SEQ ID NO: 84272 - DNA, 25 bp, Mus musculus
aatgtacttagcgattgtagggccc

SEQ ID NO: 84273 - DNA, 25 bp, Mus musculus
aatgtacttagtacatctcccttac

SEQ ID NO: 84274 - DNA, 25 bp, Mus musculus
aatgtacttagttcatctcccttac

SEQ ID NO: 84275 - DNA, 25 bp, Mus musculus
aatgtactttccactcatcgtggag

SEQ ID NO: 84276 - DNA, 25 bp, Mus musculus
aatgtactttcctctcatcgtggag

SEQ ID NO: 84277 - DNA, 25 bp, Mus musculus
aatgtagaacttccctgtttctgaa

SEQ ID NO: 84278 - DNA, 25 bp, Mus musculus
aatgtagaacttgcctgtttctgaa

SEQ ID NO: 84279 - DNA, 25 bp, Mus musculus
aatgtagacgctccctaatttctcc

SEQ ID NO: 84280 - DNA, 25 bp, Mus musculus
aatgtagacgctgcctaatttctcc

SEQ ID NO: 84281 - DNA, 25 bp, Mus musculus
aatgtagactatcttctcatccacg

SEQ ID NO: 84282 - DNA, 25 bp, Mus musculus
aatgtagactatgttctcatccacg

SEQ ID NO: 84283 - DNA, 25 bp, Mus musculus
aatgtagacttcctattttgtacaa

SEQ ID NO: 84284 - DNA, 25 bp, Mus musculus
aatgtagacttcgtattttgtacaa

SEQ ID NO: 84285 - DNA, 25 bp, Mus musculus
aatgtagagactcaggctgcctgca

SEQ ID NO: 84286 - DNA, 25 bp, Mus musculus
aatgtagagactgaggctgcctgca

SEQ ID NO: 84287 - DNA, 25 bp, Mus musculus
aatgtagaggtacttcagttcagat

SEQ ID NO: 84288 - DNA, 25 bp, Mus musculus
aatgtagaggtagttcagttcagat

SEQ ID NO: 84289 - DNA, 25 bp, Mus musculus
aatgtagagtccagcaagcgtctcc

SEQ ID NO: 84290 - DNA, 25 bp, Mus musculus
aatgtagagtccctctttactgccg

SEQ ID NO: 84291 - DNA, 25 bp, Mus musculus
aatgtagagtccgtctttactgccg

SEQ ID NO: 84292 - DNA, 25 bp, Mus musculus
aatgtagagtcctgcaagcgtctcc

SEQ ID NO: 84293 - DNA, 25 bp, Mus musculus
aatgtagatctgctctctccaaaaa

SEQ ID NO: 84294 - DNA, 25 bp, Mus musculus
aatgtagatctggtctctccaaaaa

SEQ ID NO: 84295 - DNA, 25 bp, Mus musculus
aatgtagatgatatggctgtgatac

SEQ ID NO: 84296 - DNA, 25 bp, Mus musculus
aatgtagatgatttggctgtgatac

SEQ ID NO: 84297 - DNA, 25 bp, Mus musculus
aatgtagatgcacgctcggagcaga

SEQ ID NO: 84298 - DNA, 25 bp, Mus musculus
aatgtagatgcaggctcggagcaga

SEQ ID NO: 84299 - DNA, 25 bp, Mus musculus
aatgtagatgggactgtatattggc

SEQ ID NO: 84300 - DNA, 25 bp, Mus musculus
aatgtagatgggtctgtatattggc

SEQ ID NO: 84301 - DNA, 25 bp, Mus musculus
aatgtagcaaggcatgaggactgca

SEQ ID NO: 84302 - DNA, 25 bp, Mus musculus
aatgtagcaagggatgaggactgca

SEQ ID NO: 84303 - DNA, 25 bp, Mus musculus
aatgtagccaacaaaccacgctgca

SEQ ID NO: 84304 - DNA, 25 bp, Mus musculus
aatgtagccaactaaccacgctgca

SEQ ID NO: 84305 - DNA, 25 bp, Mus musculus
aatgtagccatgactcaccttgaca

SEQ ID NO: 84306 - DNA, 25 bp, Mus musculus
aatgtagccatgtctcaccttgaca

SEQ ID NO: 84307 - DNA, 25 bp, Mus musculus
aatgtagccgacatagcatcagcat

SEQ ID NO: 84308 - DNA, 25 bp, Mus musculus
aatgtagccgacttagcatcagcat

SEQ ID NO: 84309 - DNA, 25 bp, Mus musculus
aatgtagcctccatcttattgtata

SEQ ID NO: 84310 - DNA, 25 bp, Mus musculus
aatgtagcctccttcttattgtata

SEQ ID NO: 84311 - DNA, 25 bp, Mus musculus
aatgtagcgaacaatgacaccgttt

SEQ ID NO: 84312 - DNA, 25 bp, Mus musculus
aatgtagcgaactatgacaccgttt

SEQ ID NO: 84313 - DNA, 25 bp, Mus musculus
aatgtagctgcaaattgtggcacgt

SEQ ID NO: 84314 - DNA, 25 bp, Mus musculus
aatgtagctgcatattgtggcacgt

SEQ ID NO: 84315 - DNA, 25 bp, Mus musculus
aatgtagcttacctgttataatcca

SEQ ID NO: 84316 - DNA, 25 bp, Mus musculus
aatgtagcttacgtgttataatcca

SEQ ID NO: 84317 - DNA, 25 bp, Mus musculus
aatgtagctttcctgtgctcacaat

SEQ ID NO: 84318 - DNA, 25 bp, Mus musculus
aatgtagctttcgtgtgctcacaat

SEQ ID NO: 84319 - DNA, 25 bp, Mus musculus
aatgtagcttttcggcccagacttg

SEQ ID NO: 84320 - DNA, 25 bp, Mus musculus
aatgtagcttttgggcccagacttg

SEQ ID NO: 84321 - DNA, 25 bp, Mus musculus
aatgtaggcactctcttcacgtgct

SEQ ID NO: 84322 - DNA, 25 bp, Mus musculus
aatgtaggcactgtcttcacgtgct

SEQ ID NO: 84323 - DNA, 25 bp, Mus musculus
aatgtaggcccaattcctcactgtt

SEQ ID NO: 84324 - DNA, 25 bp, Mus musculus
aatgtaggcccatttcctcactgtt

SEQ ID NO: 84325 - DNA, 25 bp, Mus musculus
aatgtaggtacacgaagatttgact

SEQ ID NO: 84326 - DNA, 25 bp, Mus musculus
aatgtaggtacaggaagatttgact

SEQ ID NO: 84327 - DNA, 25 bp, Mus musculus
aatgtaggtattactccagtttatt

SEQ ID NO: 84328 - DNA, 25 bp, Mus musculus
aatgtaggtatttctccagtttatt

SEQ ID NO: 84329 - DNA, 25 bp, Mus musculus
aatgtagtcgctacctgtgcaggtg

SEQ ID NO: 84330 - DNA, 25 bp, Mus musculus
aatgtagtcgcttcctgtgcaggtg

SEQ ID NO: 84331 - DNA, 25 bp, Mus musculus
aatgtagtctgcaatacctggctgt

SEQ ID NO: 84332 - DNA, 25 bp, Mus musculus
aatgtagtctgctatacctggctgt

SEQ ID NO: 84333 - DNA, 25 bp, Mus musculus
aatgtagtgatcctgctgggcttca

SEQ ID NO: 84334 - DNA, 25 bp, Mus musculus
aatgtagtgatcgtgctgggcttca

SEQ ID NO: 84335 - DNA, 25 bp, Mus musculus
aatgtagttaccctctgcttgggaa

SEQ ID NO: 84336 - DNA, 25 bp, Mus musculus
aatgtagttaccgtctgcttgggaa

SEQ ID NO: 84337 - DNA, 25 bp, Mus musculus
aatgtagttttgactctgccttacc

SEQ ID NO: 84338 - DNA, 25 bp, Mus musculus
aatgtagttttgtctctgccttacc

SEQ ID NO: 84339 - DNA, 25 bp, Mus musculus
aatgtataaagtactctccctctca

SEQ ID NO: 84340 - DNA, 25 bp, Mus musculus
aatgtataaagttctctccctctca

SEQ ID NO: 84341 - DNA, 25 bp, Mus musculus
aatgtataacccatctgtaacccag

SEQ ID NO: 84342 - DNA, 25 bp, Mus musculus
aatgtataacccttctgtaacccag

SEQ ID NO: 84343 - DNA, 25 bp, Mus musculus
aatgtataacgaagcctcctgggag

SEQ ID NO: 84344 - DNA, 25 bp, Mus musculus
aatgtataacgatgcctcctgggag

SEQ ID NO: 84345 - DNA, 25 bp, Mus musculus
aatgtataatgtcggcgaaggagtt

SEQ ID NO: 84346 - DNA, 25 bp, Mus musculus
aatgtataatgtgggcgaaggagtt

SEQ ID NO: 84347 - DNA, 25 bp, Mus musculus
aatgtataccatagtaccagtaggg

SEQ ID NO: 84348 - DNA, 25 bp, Mus musculus
aatgtataccattgtaccagtaggg

SEQ ID NO: 84349 - DNA, 25 bp, Mus musculus
aatgtataccctcttctacctgcag

SEQ ID NO: 84350 - DNA, 25 bp, Mus musculus
aatgtataccctgttctacctgcag

SEQ ID NO: 84351 - DNA, 25 bp, Mus musculus
aatgtatacctaccaagaaggcaga

SEQ ID NO: 84352 - DNA, 25 bp, Mus musculus
aatgtatacctagcaagaaggcaga

SEQ ID NO: 84353 - DNA, 25 bp, Mus musculus
aatgtatatattccacagctgtatt

SEQ ID NO: 84354 - DNA, 25 bp, Mus musculus
aatgtatatattgcacagctgtatt

SEQ ID NO: 84355 - DNA, 25 bp, Mus musculus
aatgtatattgtatttaccaagtag

SEQ ID NO: 84356 - DNA, 25 bp, Mus musculus
aatgtatattgtttttaccaagtag

SEQ ID NO: 84357 - DNA, 25 bp, Mus musculus
aatgtatattttcgtggctcctgac

SEQ ID NO: 84358 - DNA, 25 bp, Mus musculus
aatgtatattttggtggctcctgac

SEQ ID NO: 84359 - DNA, 25 bp, Mus musculus
aatgtatcacccaatccaataaaga

SEQ ID NO: 84360 - DNA, 25 bp, Mus musculus
aatgtatcaccctatccaataaaga

SEQ ID NO: 84361 - DNA, 25 bp, Mus musculus
aatgtatcacttcgctctctaaatg

SEQ ID NO: 84362 - DNA, 25 bp, Mus musculus
aatgtatcacttggctctctaaatg

SEQ ID NO: 84363 - DNA, 25 bp, Mus musculus
aatgtatccattctgtgggcaacga

SEQ ID NO: 84364 - DNA, 25 bp, Mus musculus
aatgtatccattgtgtgggcaacga

SEQ ID NO: 84365 - DNA, 25 bp, Mus musculus
aatgtatcccataccatttacttcc

SEQ ID NO: 84366 - DNA, 25 bp, Mus musculus
aatgtatcccattccatttacttcc

SEQ ID NO: 84367 - DNA, 25 bp, Mus musculus
aatgtatccccaaaagtgtgagctt

SEQ ID NO: 84368 - DNA, 25 bp, Mus musculus
aatgtatccccataagtgtgagctt

SEQ ID NO: 84369 - DNA, 25 bp, Mus musculus
aatgtatccgaccaggcagatctga

SEQ ID NO: 84370 - DNA, 25 bp, Mus musculus
aatgtatccgacgaggcagatctga

SEQ ID NO: 84371 - DNA, 25 bp, Mus musculus
aatgtatcctcccttgtaaccatgg

SEQ ID NO: 84372 - DNA, 25 bp, Mus musculus
aatgtatcctccgttgtaaccatgg

SEQ ID NO: 84373 - DNA, 25 bp, Mus musculus
aatgtatctcggatctggtgtgcct

SEQ ID NO: 84374 - DNA, 25 bp, Mus musculus
aatgtatctcggttctggtgtgcct

SEQ ID NO: 84375 - DNA, 25 bp, Mus musculus
aatgtatctcttatctatcacttga

SEQ ID NO: 84376 - DNA, 25 bp, Mus musculus
aatgtatctcttttctatcacttga

SEQ ID NO: 84377 - DNA, 25 bp, Mus musculus
aatgtatctgtcagcaccgctgggc

SEQ ID NO: 84378 - DNA, 25 bp, Mus musculus
aatgtatctgtctgcaccgctgggc

SEQ ID NO: 84379 - DNA, 25 bp, Mus musculus
aatgtatcttggaccatggtactaa

SEQ ID NO: 84380 - DNA, 25 bp, Mus musculus
aatgtatcttggtccatggtactaa

SEQ ID NO: 84381 - DNA, 25 bp, Mus musculus
aatgtatgaaccatgtgatatgcta

SEQ ID NO: 84382 - DNA, 25 bp, Mus musculus
aatgtatgaaccttgtgatatgcta

SEQ ID NO: 84383 - DNA, 25 bp, Mus musculus
aatgtatgaaggctccttttgcaca

SEQ ID NO: 84384 - DNA, 25 bp, Mus musculus
aatgtatgaagggtccttttgcaca

SEQ ID NO: 84385 - DNA, 25 bp, Mus musculus
aatgtatgagctagcaaggcttctt

SEQ ID NO: 84386 - DNA, 25 bp, Mus musculus
aatgtatgagcttgcaaggcttctt

SEQ ID NO: 84387 - DNA, 25 bp, Mus musculus
aatgtatgcatcatcctggttcctg

SEQ ID NO: 84388 - DNA, 25 bp, Mus musculus
aatgtatgcatcttcctggttcctg

SEQ ID NO: 84389 - DNA, 25 bp, Mus musculus
aatgtatgcttcatatgcagcacta

SEQ ID NO: 84390 - DNA, 25 bp, Mus musculus
aatgtatgcttcttatgcagcacta

SEQ ID NO: 84391 - DNA, 25 bp, Mus musculus
aatgtatggtgaacaaagcttacct

SEQ ID NO: 84392 - DNA, 25 bp, Mus musculus
aatgtatggtgatcaaagcttacct

SEQ ID NO: 84393 - DNA, 25 bp, Mus musculus
aatgtatgtaatcctttcagcccgt

SEQ ID NO: 84394 - DNA, 25 bp, Mus musculus
aatgtatgtaatgctttcagcccgt

SEQ ID NO: 84395 - DNA, 25 bp, Mus musculus
aatgtatgtacactgatgctgcccc

SEQ ID NO: 84396 - DNA, 25 bp, Mus musculus
aatgtatgtacagtgatgctgcccc

SEQ ID NO: 84397 - DNA, 25 bp, Mus musculus
aatgtatgtataatggccccagaat

SEQ ID NO: 84398 - DNA, 25 bp, Mus musculus
aatgtatgtatattggccccagaat

SEQ ID NO: 84399 - DNA, 25 bp, Mus musculus
aatgtatgtcagagggtgattttga

SEQ ID NO: 84400 - DNA, 25 bp, Mus musculus
aatgtatgtcagtgggtgattttga

SEQ ID NO: 84401 - DNA, 25 bp, Mus musculus
aatgtatgtcgtatatcccctgacc

SEQ ID NO: 84402 - DNA, 25 bp, Mus musculus
aatgtatgtcgtttatcccctgacc

SEQ ID NO: 84403 - DNA, 25 bp, Mus musculus
aatgtatgtgctactatgcccaccc

SEQ ID NO: 84404 - DNA, 25 bp, Mus musculus
aatgtatgtgcttctatgcccaccc

SEQ ID NO: 84405 - DNA, 25 bp, Mus musculus
aatgtatgttcaaagccatcctctg

SEQ ID NO: 84406 - DNA, 25 bp, Mus musculus
aatgtatgttcatagccatcctctg

SEQ ID NO: 84407 - DNA, 25 bp, Mus musculus
aatgtatgttgcagatgccagtgta

SEQ ID NO: 84408 - DNA, 25 bp, Mus musculus
aatgtatgttgctgatgccagtgta

SEQ ID NO: 84409 - DNA, 25 bp, Mus musculus
aatgtatgttttcagacatgaaatt

SEQ ID NO: 84410 - DNA, 25 bp, Mus musculus
aatgtatgttttctatccgcataaa

SEQ ID NO: 84411 - DNA, 25 bp, Mus musculus
aatgtatgttttgagacatgaaatt

SEQ ID NO: 84412 - DNA, 25 bp, Mus musculus
aatgtatgttttgtatccgcataaa

SEQ ID NO: 84413 - DNA, 25 bp, Mus musculus
aatgtattaagtagtctaccatgcc

SEQ ID NO: 84414 - DNA, 25 bp, Mus musculus
aatgtattaagttgtctaccatgcc

SEQ ID NO: 84415 - DNA, 25 bp, Mus musculus
aatgtattacgtagctctactcaaa

SEQ ID NO: 84416 - DNA, 25 bp, Mus musculus
aatgtattacgttgctctactcaaa

SEQ ID NO: 84417 - DNA, 25 bp, Mus musculus
aatgtattatcccatagttttgtaa

SEQ ID NO: 84418 - DNA, 25 bp, Mus musculus
aatgtattatccgatagttttgtaa

SEQ ID NO: 84419 - DNA, 25 bp, Mus musculus
aatgtattcagactttgatcactac

SEQ ID NO: 84420 - DNA, 25 bp, Mus musculus
aatgtattcagagtttgatcactac

SEQ ID NO: 84421 - DNA, 25 bp, Mus musculus
aatgtattcagtattggctttgcct

SEQ ID NO: 84422 - DNA, 25 bp, Mus musculus
aatgtattcagttttggctttgcct

SEQ ID NO: 84423 - DNA, 25 bp, Mus musculus
aatgtattctggcatcggcggcttg

SEQ ID NO: 84424 - DNA, 25 bp, Mus musculus
aatgtattctgggatcggcggcttg

SEQ ID NO: 84425 - DNA, 25 bp, Mus musculus
aatgtattctttctagccgcagtca

SEQ ID NO: 84426 - DNA, 25 bp, Mus musculus
aatgtattctttgtagccgcagtca

SEQ ID NO: 84427 - DNA, 25 bp, Mus musculus
aatgtattgctacttcgggcttttt

SEQ ID NO: 84428 - DNA, 25 bp, Mus musculus
aatgtattgctagttcgggcttttt

SEQ ID NO: 84429 - DNA, 25 bp, Mus musculus
aatgtattgtagctttccggtgtca

SEQ ID NO: 84430 - DNA, 25 bp, Mus musculus
aatgtattgtaggtttccggtgtca

SEQ ID NO: 84431 - DNA, 25 bp, Mus musculus
aatgtattgtccaggctgccgattc

SEQ ID NO: 84432 - DNA, 25 bp, Mus musculus
aatgtattgtcctggctgccgattc

SEQ ID NO: 84433 - DNA, 25 bp, Mus musculus
aatgtatttaacctgcttggagcaa

SEQ ID NO: 84434 - DNA, 25 bp, Mus musculus
aatgtatttaacgtgcttggagcaa

SEQ ID NO: 84435 - DNA, 25 bp, Mus musculus
aatgtatttcccaatcatgcagata

SEQ ID NO: 84436 - DNA, 25 bp, Mus musculus
aatgtatttcccatctctaaatccc

SEQ ID NO: 84437 - DNA, 25 bp, Mus musculus
aatgtatttccctatcatgcagata

SEQ ID NO: 84438 - DNA, 25 bp, Mus musculus
aatgtatttcccttctctaaatccc

SEQ ID NO: 84439 - DNA, 25 bp, Mus musculus
aatgtatttgacactctgaggcagt

SEQ ID NO: 84440 - DNA, 25 bp, Mus musculus
aatgtatttgactctctgaggcagt

SEQ ID NO: 84441 - DNA, 25 bp, Mus musculus
aatgtatttggacttcttgggagaa

SEQ ID NO: 84442 - DNA, 25 bp, Mus musculus
aatgtatttggagttcttgggagaa

SEQ ID NO: 84443 - DNA, 25 bp, Mus musculus
aatgtatttgtgatctacccctgcc

SEQ ID NO: 84444 - DNA, 25 bp, Mus musculus
aatgtatttgtgttctacccctgcc

SEQ ID NO: 84445 - DNA, 25 bp, Mus musculus
aatgtattttacctagagctgatgt

SEQ ID NO: 84446 - DNA, 25 bp, Mus musculus
aatgtattttacgtagagctgatgt

SEQ ID NO: 84447 - DNA, 25 bp, Mus musculus
aatgtatttttaaggactgtgctca

SEQ ID NO: 84448 - DNA, 25 bp, Mus musculus
aatgtatttttatggactgtgctca

SEQ ID NO: 84449 - DNA, 25 bp, Mus musculus
aatgtcaaaagacatcacccagcag

SEQ ID NO: 84450 - DNA, 25 bp, Mus musculus
aatgtcaaaagagatcacccagcag

SEQ ID NO: 84451 - DNA, 25 bp, Mus musculus
aatgtcaaactcacaggtctcttcc

SEQ ID NO: 84452 - DNA, 25 bp, Mus musculus
aatgtcaaactctcaggtctcttcc

SEQ ID NO: 84453 - DNA, 25 bp, Mus musculus
aatgtcaaatccatctgggactgga

SEQ ID NO: 84454 - DNA, 25 bp, Mus musculus
aatgtcaaatccttctgggactgga

SEQ ID NO: 84455 - DNA, 25 bp, Mus musculus
aatgtcaacatcacctcaatgggtc

SEQ ID NO: 84456 - DNA, 25 bp, Mus musculus
aatgtcaacatctcctcaatgggtc

SEQ ID NO: 84457 - DNA, 25 bp, Mus musculus
aatgtcaacatgaccttgcacgcac

SEQ ID NO: 84458 - DNA, 25 bp, Mus musculus
aatgtcaacatgtccttgcacgcac

SEQ ID NO: 84459 - DNA, 25 bp, Mus musculus
aatgtcaacctcattatgcatatcc

SEQ ID NO: 84460 - DNA, 25 bp, Mus musculus
aatgtcaacctctttatgcatatcc

SEQ ID NO: 84461 - DNA, 25 bp, Mus musculus
aatgtcaacgagaccctggtgaggc

SEQ ID NO: 84462 - DNA, 25 bp, Mus musculus
aatgtcaacgagtccctggtgaggc

SEQ ID NO: 84463 - DNA, 25 bp, Mus musculus
aatgtcaacgatcatgcacctctcc

SEQ ID NO: 84464 - DNA, 25 bp, Mus musculus
aatgtcaacgatgatgcacctctcc

SEQ ID NO: 84465 - DNA, 25 bp, Mus musculus
aatgtcaactatattttgcttgaag

SEQ ID NO: 84466 - DNA, 25 bp, Mus musculus
aatgtcaactattttttgcttgaag

SEQ ID NO: 84467 - DNA, 25 bp, Mus musculus
aatgtcaagagccagtcagtgtcaa

SEQ ID NO: 84468 - DNA, 25 bp, Mus musculus
aatgtcaagagcgagtcagtgtcaa

SEQ ID NO: 84469 - DNA, 25 bp, Mus musculus
aatgtcaagagtagggcaaccagat

SEQ ID NO: 84470 - DNA, 25 bp, Mus musculus
aatgtcaagagttgggcaaccagat

SEQ ID NO: 84471 - DNA, 25 bp, Mus musculus
aatgtcaagatcccgcagggtcttc

SEQ ID NO: 84472 - DNA, 25 bp, Mus musculus
aatgtcaagatcgcgcagggtcttc

SEQ ID NO: 84473 - DNA, 25 bp, Mus musculus
aatgtcaagccactcaagctgccct

SEQ ID NO: 84474 - DNA, 25 bp, Mus musculus
aatgtcaagccagtcaagctgccct

SEQ ID NO: 84475 - DNA, 25 bp, Mus musculus
aatgtcaagcccatggcatacgcca

SEQ ID NO: 84476 - DNA, 25 bp, Mus musculus
aatgtcaagcccttggcatacgcca

SEQ ID NO: 84477 - DNA, 25 bp, Mus musculus
aatgtcaagcctctcattcttagct

SEQ ID NO: 84478 - DNA, 25 bp, Mus musculus
aatgtcaagcctgtcattcttagct

SEQ ID NO: 84479 - DNA, 25 bp, Mus musculus
aatgtcaaggcaatggcaccccagt

SEQ ID NO: 84480 - DNA, 25 bp, Mus musculus
aatgtcaaggcattggcaccccagt

SEQ ID NO: 84481 - DNA, 25 bp, Mus musculus
aatgtcaagtacaacatagccactt

SEQ ID NO: 84482 - DNA, 25 bp, Mus musculus
aatgtcaagtactacatagccactt

SEQ ID NO: 84483 - DNA, 25 bp, Mus musculus
aatgtcaattgccaccgggttcggg

SEQ ID NO: 84484 - DNA, 25 bp, Mus musculus
aatgtcaattgcgaccgggttcggg

SEQ ID NO: 84485 - DNA, 25 bp, Mus musculus
aatgtcacaatcaccttacagtcca

SEQ ID NO: 84486 - DNA, 25 bp, Mus musculus
aatgtcacaatctccttacagtcca

SEQ ID NO: 84487 - DNA, 25 bp, Mus musculus
aatgtcacacaaatccaagatcagc

SEQ ID NO: 84488 - DNA, 25 bp, Mus musculus
aatgtcacacaattccaagatcagc

SEQ ID NO: 84489 - DNA, 25 bp, Mus musculus
aatgtcacagccaggtgttgtctct

SEQ ID NO: 84490 - DNA, 25 bp, Mus musculus
aatgtcacagcctggtgttgtctct

SEQ ID NO: 84491 - DNA, 25 bp, Mus musculus
aatgtcacatgaactctctcatctg

SEQ ID NO: 84492 - DNA, 25 bp, Mus musculus
aatgtcacatgatctctctcatctg

SEQ ID NO: 84493 - DNA, 25 bp, Mus musculus
aatgtcacattaattcctggaagcc

SEQ ID NO: 84494 - DNA, 25 bp, Mus musculus
aatgtcacattatttcctggaagcc

SEQ ID NO: 84495 - DNA, 25 bp, Mus musculus
aatgtcaccagaaggctagttggcc

SEQ ID NO: 84496 - DNA, 25 bp, Mus musculus
aatgtcaccagatggctagttggcc

SEQ ID NO: 84497 - DNA, 25 bp, Mus musculus
aatgtcaccatgctacagaaccctg

SEQ ID NO: 84498 - DNA, 25 bp, Mus musculus
aatgtcaccatggtacagaaccctg

SEQ ID NO: 84499 - DNA, 25 bp, Mus musculus
aatgtcacccatacaaggagcagca

SEQ ID NO: 84500 - DNA, 25 bp, Mus musculus
aatgtcacccattcaaggagcagca

SEQ ID NO: 84501 - DNA, 25 bp, Mus musculus
aatgtcaccgtccagagcctccttt

SEQ ID NO: 84502 - DNA, 25 bp, Mus musculus
aatgtcaccgtcgagagcctccttt

SEQ ID NO: 84503 - DNA, 25 bp, Mus musculus
aatgtcaccttgctctcttctgatt

SEQ ID NO: 84504 - DNA, 25 bp, Mus musculus
aatgtcaccttggtctcttctgatt

SEQ ID NO: 84505 - DNA, 25 bp, Mus musculus
aatgtcactatcattggcctcactt

SEQ ID NO: 84506 - DNA, 25 bp, Mus musculus
aatgtcactatctttggcctcactt

SEQ ID NO: 84507 - DNA, 25 bp, Mus musculus
aatgtcactcacaaacatggcagag

SEQ ID NO: 84508 - DNA, 25 bp, Mus musculus
aatgtcactcactaacatggcagag

SEQ ID NO: 84509 - DNA, 25 bp, Mus musculus
aatgtcactttaccctgtgcttaca

SEQ ID NO: 84510 - DNA, 25 bp, Mus musculus
aatgtcactttagcctgtgcttaca

SEQ ID NO: 84511 - DNA, 25 bp, Mus musculus
aatgtcacttttagcctgtcccttt

SEQ ID NO: 84512 - DNA, 25 bp, Mus musculus
aatgtcactttttgcctgtcccttt

SEQ ID NO: 84513 - DNA, 25 bp, Mus musculus
aatgtcagaacccagcgtatgtagc

SEQ ID NO: 84514 - DNA, 25 bp, Mus musculus
aatgtcagaaccgagcgtatgtagc

SEQ ID NO: 84515 - DNA, 25 bp, Mus musculus
aatgtcagacagaataggcttcccc

SEQ ID NO: 84516 - DNA, 25 bp, Mus musculus
aatgtcagacagtataggcttcccc

SEQ ID NO: 84517 - DNA, 25 bp, Mus musculus
aatgtcagataactacaggagctaa

SEQ ID NO: 84518 - DNA, 25 bp, Mus musculus
aatgtcagataagtacaggagctaa

SEQ ID NO: 84519 - DNA, 25 bp, Mus musculus
aatgtcagatcaactcttcagccac

SEQ ID NO: 84520 - DNA, 25 bp, Mus musculus
aatgtcagatcatctcttcagccac

SEQ ID NO: 84521 - DNA, 25 bp, Mus musculus
aatgtcagcattcctccttgactgc

SEQ ID NO: 84522 - DNA, 25 bp, Mus musculus
aatgtcagcattgctccttgactgc

SEQ ID NO: 84523 - DNA, 25 bp, Mus musculus
aatgtcagcctcatggtgacccgag

SEQ ID NO: 84524 - DNA, 25 bp, Mus musculus
aatgtcagcctcttggtgacccgag

SEQ ID NO: 84525 - DNA, 25 bp, Mus musculus
aatgtcagctgtcagtcacgctgtc

SEQ ID NO: 84526 - DNA, 25 bp, Mus musculus
aatgtcagctgtgagtcacgctgtc

SEQ ID NO: 84527 - DNA, 25 bp, Mus musculus
aatgtcaggatacccaatgccaaat

SEQ ID NO: 84528 - DNA, 25 bp, Mus musculus
aatgtcaggatagccaatgccaaat

SEQ ID NO: 84529 - DNA, 25 bp, Mus musculus
aatgtcaggcgccagacgtgaacaa

SEQ ID NO: 84530 - DNA, 25 bp, Mus musculus
aatgtcaggcgcgagacgtgaacaa

SEQ ID NO: 84531 - DNA, 25 bp, Mus musculus
aatgtcaggttgacaatgtttccat

SEQ ID NO: 84532 - DNA, 25 bp, Mus musculus
aatgtcaggttgtcaatgtttccat

SEQ ID NO: 84533 - DNA, 25 bp, Mus musculus
aatgtcagtcatactggtctggctc

SEQ ID NO: 84534 - DNA, 25 bp, Mus musculus
aatgtcagtcattctggtctggctc

SEQ ID NO: 84535 - DNA, 25 bp, Mus musculus
aatgtcagtggccactcagttcctg

SEQ ID NO: 84536 - DNA, 25 bp, Mus musculus
aatgtcagtggcgactcagttcctg

SEQ ID NO: 84537 - DNA, 25 bp, Mus musculus
aatgtcagttatattgttcctcaaa

SEQ ID NO: 84538 - DNA, 25 bp, Mus musculus
aatgtcagttattttgttcctcaaa

SEQ ID NO: 84539 - DNA, 25 bp, Mus musculus
aatgtcagtttcaagtaggtggtta

SEQ ID NO: 84540 - DNA, 25 bp, Mus musculus
aatgtcagtttctagtaggtggtta

SEQ ID NO: 84541 - DNA, 25 bp, Mus musculus
aatgtcatacatcgcctcagaattt

SEQ ID NO: 84542 - DNA, 25 bp, Mus musculus
aatgtcatacatggcctcagaattt

SEQ ID NO: 84543 - DNA, 25 bp, Mus musculus
aatgtcatagccactctaactgtat

SEQ ID NO: 84544 - DNA, 25 bp, Mus musculus
aatgtcatagcctctctaactgtat

SEQ ID NO: 84545 - DNA, 25 bp, Mus musculus
aatgtcataggcctgcagatgggca

SEQ ID NO: 84546 - DNA, 25 bp, Mus musculus
aatgtcataggcgtgcagatgggca

SEQ ID NO: 84547 - DNA, 25 bp, Mus musculus
aatgtcatatctacaggtccagctc

SEQ ID NO: 84548 - DNA, 25 bp, Mus musculus
aatgtcatatctatttatccttaaa

SEQ ID NO: 84549 - DNA, 25 bp, Mus musculus
aatgtcatatcttcaggtccagctc

SEQ ID NO: 84550 - DNA, 25 bp, Mus musculus
aatgtcatatctttttatccttaaa

SEQ ID NO: 84551 - DNA, 25 bp, Mus musculus
aatgtcatcaagaagcctcttaggc

SEQ ID NO: 84552 - DNA, 25 bp, Mus musculus
aatgtcatcaagtagcctcttaggc

SEQ ID NO: 84553 - DNA, 25 bp, Mus musculus
aatgtcatcagaattatgcttcata

SEQ ID NO: 84554 - DNA, 25 bp, Mus musculus
aatgtcatcagatttatgcttcata

SEQ ID NO: 84555 - DNA, 25 bp, Mus musculus
aatgtcatccagagagacctggcca

SEQ ID NO: 84556 - DNA, 25 bp, Mus musculus
aatgtcatccagtgagacctggcca

SEQ ID NO: 84557 - DNA, 25 bp, Mus musculus
aatgtcatcctgagtgtttcctaca

SEQ ID NO: 84558 - DNA, 25 bp, Mus musculus
aatgtcatcctgctctcattacaaa

SEQ ID NO: 84559 - DNA, 25 bp, Mus musculus
aatgtcatcctggtctcattacaaa

SEQ ID NO: 84560 - DNA, 25 bp, Mus musculus
aatgtcatcctgtgtgtttcctaca

SEQ ID NO: 84561 - DNA, 25 bp, Mus musculus
aatgtcatccttagtgaacacagca

SEQ ID NO: 84562 - DNA, 25 bp, Mus musculus
aatgtcatcctttgtgaacacagca

SEQ ID NO: 84563 - DNA, 25 bp, Mus musculus
aatgtcatctatcttcactttcagc

SEQ ID NO: 84564 - DNA, 25 bp, Mus musculus
aatgtcatctatgttcactttcagc

SEQ ID NO: 84565 - DNA, 25 bp, Mus musculus
aatgtcatctccaatggctactcgt

SEQ ID NO: 84566 - DNA, 25 bp, Mus musculus
aatgtcatctcctatggctactcgt

SEQ ID NO: 84567 - DNA, 25 bp, Mus musculus
aatgtcatctggaattgcatgccat

SEQ ID NO: 84568 - DNA, 25 bp, Mus musculus
aatgtcatctggtattgcatgccat

SEQ ID NO: 84569 - DNA, 25 bp, Mus musculus
aatgtcatcttccactggtatcatg

SEQ ID NO: 84570 - DNA, 25 bp, Mus musculus
aatgtcatcttcgactggtatcatg

SEQ ID NO: 84571 - DNA, 25 bp, Mus musculus
aatgtcatgaaaccacttccgtgtt

SEQ ID NO: 84572 - DNA, 25 bp, Mus musculus
aatgtcatgaaagcacttccgtgtt

SEQ ID NO: 84573 - DNA, 25 bp, Mus musculus
aatgtcatgagcctttgatgcagta

SEQ ID NO: 84574 - DNA, 25 bp, Mus musculus
aatgtcatgagcgtttgatgcagta

SEQ ID NO: 84575 - DNA, 25 bp, Mus musculus
aatgtcatgatgagaccgccgttgt

SEQ ID NO: 84576 - DNA, 25 bp, Mus musculus
aatgtcatgatgtgaccgccgttgt

SEQ ID NO: 84577 - DNA, 25 bp, Mus musculus
aatgtcatgattatgcctgcctata

SEQ ID NO: 84578 - DNA, 25 bp, Mus musculus
aatgtcatgattttgcctgcctata

SEQ ID NO: 84579 - DNA, 25 bp, Mus musculus
aatgtcatgtctcatgtgtcctggt

SEQ ID NO: 84580 - DNA, 25 bp, Mus musculus
aatgtcatgtctgatgtgtcctggt

SEQ ID NO: 84581 - DNA, 25 bp, Mus musculus
aatgtcatttcaccacagtggcctg

SEQ ID NO: 84582 - DNA, 25 bp, Mus musculus
aatgtcatttcagcacagtggcctg

SEQ ID NO: 84583 - DNA, 25 bp, Mus musculus
aatgtcatttctatacgttctttgg

SEQ ID NO: 84584 - DNA, 25 bp, Mus musculus
aatgtcatttctcgctttaagttta

SEQ ID NO: 84585 - DNA, 25 bp, Mus musculus
aatgtcatttctggctttaagttta

SEQ ID NO: 84586 - DNA, 25 bp, Mus musculus
aatgtcatttctttacgttctttgg

SEQ ID NO: 84587 - DNA, 25 bp, Mus musculus
aatgtcatttggaaggaacttcaac

SEQ ID NO: 84588 - DNA, 25 bp, Mus musculus
aatgtcatttggtaggaacttcaac

SEQ ID NO: 84589 - DNA, 25 bp, Mus musculus
aatgtcatttttcaggtactaccca

SEQ ID NO: 84590 - DNA, 25 bp, Mus musculus
aatgtcatttttgaggtactaccca

SEQ ID NO: 84591 - DNA, 25 bp, Mus musculus
aatgtccaatggaactgggaacaat

SEQ ID NO: 84592 - DNA, 25 bp, Mus musculus
aatgtccaatggtactgggaacaat

SEQ ID NO: 84593 - DNA, 25 bp, Mus musculus
aatgtccaatgtccacagcccgagg

SEQ ID NO: 84594 - DNA, 25 bp, Mus musculus
aatgtccaatgtgcacagcccgagg

SEQ ID NO: 84595 - DNA, 25 bp, Mus musculus
aatgtccacagtatatccaggttga

SEQ ID NO: 84596 - DNA, 25 bp, Mus musculus
aatgtccacagtttatccaggttga

SEQ ID NO: 84597 - DNA, 25 bp, Mus musculus
aatgtccacctgcactgaagctagc

SEQ ID NO: 84598 - DNA, 25 bp, Mus musculus
aatgtccacctggactgaagctagc

SEQ ID NO: 84599 - DNA, 25 bp, Mus musculus
aatgtccacgtcagatgaggccacc

SEQ ID NO: 84600 - DNA, 25 bp, Mus musculus
aatgtccacgtctgatgaggccacc

SEQ ID NO: 84601 - DNA, 25 bp, Mus musculus
aatgtccactctctactggccagga

SEQ ID NO: 84602 - DNA, 25 bp, Mus musculus
aatgtccactctgtactggccagga

SEQ ID NO: 84603 - DNA, 25 bp, Mus musculus
aatgtccagcgtcccgagtaatttt

SEQ ID NO: 84604 - DNA, 25 bp, Mus musculus
aatgtccagcgtgccgagtaatttt

SEQ ID NO: 84605 - DNA, 25 bp, Mus musculus
aatgtccagctcctgtggaaataga

SEQ ID NO: 84606 - DNA, 25 bp, Mus musculus
aatgtccagctcgtgtggaaataga

SEQ ID NO: 84607 - DNA, 25 bp, Mus musculus
aatgtccagggacatattttgcagt

SEQ ID NO: 84608 - DNA, 25 bp, Mus musculus
aatgtccagggagatattttgcagt

SEQ ID NO: 84609 - DNA, 25 bp, Mus musculus
aatgtccaggtgacattctctgcat

SEQ ID NO: 84610 - DNA, 25 bp, Mus musculus
aatgtccaggtgtcattctctgcat

SEQ ID NO: 84611 - DNA, 25 bp, Mus musculus
aatgtccagtagcatggccttcccc

SEQ ID NO: 84612 - DNA, 25 bp, Mus musculus
aatgtccagtaggatggccttcccc

SEQ ID NO: 84613 - DNA, 25 bp, Mus musculus
aatgtccagtgaaacgggagcggct

SEQ ID NO: 84614 - DNA, 25 bp, Mus musculus
aatgtccagtgatacgggagcggct

SEQ ID NO: 84615 - DNA, 25 bp, Mus musculus
aatgtccatactcacttgccttcca

SEQ ID NO: 84616 - DNA, 25 bp, Mus musculus
aatgtccatactgacttgccttcca

SEQ ID NO: 84617 - DNA, 25 bp, Mus musculus
aatgtccatgcacccaacatctgat

SEQ ID NO: 84618 - DNA, 25 bp, Mus musculus
aatgtccatgcagccaacatctgat

SEQ ID NO: 84619 - DNA, 25 bp, Mus musculus
aatgtccatggacctgtctagtcga

SEQ ID NO: 84620 - DNA, 25 bp, Mus musculus
aatgtccatggagctgtctagtcga

SEQ ID NO: 84621 - DNA, 25 bp, Mus musculus
aatgtccatgtgcaagttgtcccca

SEQ ID NO: 84622 - DNA, 25 bp, Mus musculus
aatgtccatgtggaagttgtcccca

SEQ ID NO: 84623 - DNA, 25 bp, Mus musculus
aatgtccattccctgccaagaaggc

SEQ ID NO: 84624 - DNA, 25 bp, Mus musculus
aatgtccattccgtgccaagaaggc

SEQ ID NO: 84625 - DNA, 25 bp, Mus musculus
aatgtccattggagcactgctatca

SEQ ID NO: 84626 - DNA, 25 bp, Mus musculus
aatgtccattggtgcactgctatca

SEQ ID NO: 84627 - DNA, 25 bp, Mus musculus
aatgtccattttccatgcaggctta

SEQ ID NO: 84628 - DNA, 25 bp, Mus musculus
aatgtccattttgcatgcaggctta

SEQ ID NO: 84629 - DNA, 25 bp, Mus musculus
aatgtcccaactcacagaacctcag

SEQ ID NO: 84630 - DNA, 25 bp, Mus musculus
aatgtcccaactgacagaacctcag

SEQ ID NO: 84631 - DNA, 25 bp, Mus musculus
aatgtcccaagcatcgtcctgcatc

SEQ ID NO: 84632 - DNA, 25 bp, Mus musculus
aatgtcccaagcttcgtcctgcatc

SEQ ID NO: 84633 - DNA, 25 bp, Mus musculus
aatgtcccacctactgcaaaatttg

SEQ ID NO: 84634 - DNA, 25 bp, Mus musculus
aatgtcccaccttctgcaaaatttg

SEQ ID NO: 84635 - DNA, 25 bp, Mus musculus
aatgtcccagaaaagtaccaccagc

SEQ ID NO: 84636 - DNA, 25 bp, Mus musculus
aatgtcccagaatagtaccaccagc

SEQ ID NO: 84637 - DNA, 25 bp, Mus musculus
aatgtcccagcgcaattgtcaacga

SEQ ID NO: 84638 - DNA, 25 bp, Mus musculus
aatgtcccagcggaattgtcaacga

SEQ ID NO: 84639 - DNA, 25 bp, Mus musculus
aatgtccccacaatgaattcaaaac

SEQ ID NO: 84640 - DNA, 25 bp, Mus musculus
aatgtccccacattgaattcaaaac

SEQ ID NO: 84641 - DNA, 25 bp, Mus musculus
aatgtccccacgcagtccggtgtgg

SEQ ID NO: 84642 - DNA, 25 bp, Mus musculus
aatgtccccacggagtccggtgtgg

SEQ ID NO: 84643 - DNA, 25 bp, Mus musculus
aatgtccccagcaagaatttaactt

SEQ ID NO: 84644 - DNA, 25 bp, Mus musculus
aatgtccccagctagaatttaactt

SEQ ID NO: 84645 - DNA, 25 bp, Mus musculus
aatgtccccaggagtgtgcacagtc

SEQ ID NO: 84646 - DNA, 25 bp, Mus musculus
aatgtccccaggtgtgtgcacagtc

SEQ ID NO: 84647 - DNA, 25 bp, Mus musculus
aatgtccccttacacctcaaattca

SEQ ID NO: 84648 - DNA, 25 bp, Mus musculus
aatgtccccttagacctcaaattca

SEQ ID NO: 84649 - DNA, 25 bp, Mus musculus
aatgtcccgttcatatccagatgaa

SEQ ID NO: 84650 - DNA, 25 bp, Mus musculus
aatgtcccgttcttatccagatgaa

SEQ ID NO: 84651 - DNA, 25 bp, Mus musculus
aatgtccctcatctagggtgcgctt

SEQ ID NO: 84652 - DNA, 25 bp, Mus musculus
aatgtccctcatgtagggtgcgctt

SEQ ID NO: 84653 - DNA, 25 bp, Mus musculus
aatgtccctgaaacaatctactcaa

SEQ ID NO: 84654 - DNA, 25 bp, Mus musculus
aatgtccctgaatcaatctactcaa

SEQ ID NO: 84655 - DNA, 25 bp, Mus musculus
aatgtccctggaacatgattctccc

SEQ ID NO: 84656 - DNA, 25 bp, Mus musculus
aatgtccctggatcatgattctccc

SEQ ID NO: 84657 - DNA, 25 bp, Mus musculus
aatgtccctggcagatcctgacgtc

SEQ ID NO: 84658 - DNA, 25 bp, Mus musculus
aatgtccctggctgatcctgacgtc

SEQ ID NO: 84659 - DNA, 25 bp, Mus musculus
aatgtccctgtacgttggaacaagc

SEQ ID NO: 84660 - DNA, 25 bp, Mus musculus
aatgtccctgtaggttggaacaagc

SEQ ID NO: 84661 - DNA, 25 bp, Mus musculus
aatgtccctgttctggttgagttac

SEQ ID NO: 84662 - DNA, 25 bp, Mus musculus
aatgtccctgttgtggttgagttac

SEQ ID NO: 84663 - DNA, 25 bp, Mus musculus
aatgtcccttgtctacgcacttggc

SEQ ID NO: 84664 - DNA, 25 bp, Mus musculus
aatgtcccttgtgtacgcacttggc

SEQ ID NO: 84665 - DNA, 25 bp, Mus musculus
aatgtccctttaatttctaagccat

SEQ ID NO: 84666 - DNA, 25 bp, Mus musculus
aatgtccctttattttctaagccat

SEQ ID NO: 84667 - DNA, 25 bp, Mus musculus
aatgtccctttgcatatttgttaag

SEQ ID NO: 84668 - DNA, 25 bp, Mus musculus
aatgtccctttggatatttgttaag

SEQ ID NO: 84669 - DNA, 25 bp, Mus musculus
aatgtccgccggagtgtcctcctga

SEQ ID NO: 84670 - DNA, 25 bp, Mus musculus
aatgtccgccggtgtgtcctcctga

SEQ ID NO: 84671 - DNA, 25 bp, Mus musculus
aatgtccggaccatcaatgtctaat

SEQ ID NO: 84672 - DNA, 25 bp, Mus musculus
aatgtccggaccttcaatgtctaat

SEQ ID NO: 84673 - DNA, 25 bp, Mus musculus
aatgtccggccacgcactgtctgta

SEQ ID NO: 84674 - DNA, 25 bp, Mus musculus
aatgtccggccaggcactgtctgta

SEQ ID NO: 84675 - DNA, 25 bp, Mus musculus
aatgtccggtttaggttgctctaag

SEQ ID NO: 84676 - DNA, 25 bp, Mus musculus
aatgtccggttttggttgctctaag

SEQ ID NO: 84677 - DNA, 25 bp, Mus musculus
aatgtcctaaacaagcctgtctgta

SEQ ID NO: 84678 - DNA, 25 bp, Mus musculus
aatgtcctaaactagcctgtctgta

SEQ ID NO: 84679 - DNA, 25 bp, Mus musculus
aatgtcctaaagaatcacgtgctta

SEQ ID NO: 84680 - DNA, 25 bp, Mus musculus
aatgtcctaaagtatcacgtgctta

SEQ ID NO: 84681 - DNA, 25 bp, Mus musculus
aatgtcctaagtccactcagcgagc

SEQ ID NO: 84682 - DNA, 25 bp, Mus musculus
aatgtcctaagtgcactcagcgagc

SEQ ID NO: 84683 - DNA, 25 bp, Mus musculus
aatgtcctagaacagactttgagcc

SEQ ID NO: 84684 - DNA, 25 bp, Mus musculus
aatgtcctagaagagactttgagcc

SEQ ID NO: 84685 - DNA, 25 bp, Mus musculus
aatgtcctcaaccaatgtcttgcta

SEQ ID NO: 84686 - DNA, 25 bp, Mus musculus
aatgtcctcaacgaatgtcttgcta

SEQ ID NO: 84687 - DNA, 25 bp, Mus musculus
aatgtcctcaagcaaaccactggct

SEQ ID NO: 84688 - DNA, 25 bp, Mus musculus
aatgtcctcaaggaaaccactggct

SEQ ID NO: 84689 - DNA, 25 bp, Mus musculus
aatgtcctcagtcattcggtggaga

SEQ ID NO: 84690 - DNA, 25 bp, Mus musculus
aatgtcctcagtgattcggtggaga

SEQ ID NO: 84691 - DNA, 25 bp, Mus musculus
aatgtcctcataaggactgcgttaa

SEQ ID NO: 84692 - DNA, 25 bp, Mus musculus
aatgtcctcatatggactgcgttaa

SEQ ID NO: 84693 - DNA, 25 bp, Mus musculus
aatgtcctcattcctaccgaaggcg

SEQ ID NO: 84694 - DNA, 25 bp, Mus musculus
aatgtcctcattgctaccgaaggcg

SEQ ID NO: 84695 - DNA, 25 bp, Mus musculus
aatgtcctccccagggaagataagc

SEQ ID NO: 84696 - DNA, 25 bp, Mus musculus
aatgtcctcccctgggaagataagc

SEQ ID NO: 84697 - DNA, 25 bp, Mus musculus
aatgtcctccctccaaatgtaaaat

SEQ ID NO: 84698 - DNA, 25 bp, Mus musculus
aatgtcctccctgcaaatgtaaaat

SEQ ID NO: 84699 - DNA, 25 bp, Mus musculus
aatgtcctccggcaaacgtggctag

SEQ ID NO: 84700 - DNA, 25 bp, Mus musculus
aatgtcctccggcttttgtaggcaa

SEQ ID NO: 84701 - DNA, 25 bp, Mus musculus
aatgtcctccgggaaacgtggctag

SEQ ID NO: 84702 - DNA, 25 bp, Mus musculus
aatgtcctccgggttttgtaggcaa

SEQ ID NO: 84703 - DNA, 25 bp, Mus musculus
aatgtcctctggagtccagtcaggg

SEQ ID NO: 84704 - DNA, 25 bp, Mus musculus
aatgtcctctggtgtccagtcaggg

SEQ ID NO: 84705 - DNA, 25 bp, Mus musculus
aatgtcctgcctctagtgttgtcta

SEQ ID NO: 84706 - DNA, 25 bp, Mus musculus
aatgtcctgcctgtagtgttgtcta

SEQ ID NO: 84707 - DNA, 25 bp, Mus musculus
aatgtcctggcgcatgacccagatg

SEQ ID NO: 84708 - DNA, 25 bp, Mus musculus
aatgtcctggcggatgacccagatg

SEQ ID NO: 84709 - DNA, 25 bp, Mus musculus
aatgtcctgtatccatgctcgtcat

SEQ ID NO: 84710 - DNA, 25 bp, Mus musculus
aatgtcctgtatgcatgctcgtcat

SEQ ID NO: 84711 - DNA, 25 bp, Mus musculus
aatgtccttagccagggacctggaa

SEQ ID NO: 84712 - DNA, 25 bp, Mus musculus
aatgtccttagcgagggacctggaa

SEQ ID NO: 84713 - DNA, 25 bp, Mus musculus
aatgtccttcacatgctatttgttt

SEQ ID NO: 84714 - DNA, 25 bp, Mus musculus
aatgtccttcacttgctatttgttt

SEQ ID NO: 84715 - DNA, 25 bp, Mus musculus
aatgtccttcatagatcctgtaaaa

SEQ ID NO: 84716 - DNA, 25 bp, Mus musculus
aatgtccttcattgatcctgtaaaa

SEQ ID NO: 84717 - DNA, 25 bp, Mus musculus
aatgtccttcttaaaaccatccaga

SEQ ID NO: 84718 - DNA, 25 bp, Mus musculus
aatgtccttctttaaaccatccaga

SEQ ID NO: 84719 - DNA, 25 bp, Mus musculus
aatgtccttgatatttggctccaga

SEQ ID NO: 84720 - DNA, 25 bp, Mus musculus
aatgtccttgatttttggctccaga

SEQ ID NO: 84721 - DNA, 25 bp, Mus musculus
aatgtccttgccacggtgtaccttg

SEQ ID NO: 84722 - DNA, 25 bp, Mus musculus
aatgtccttgccagggattctaccc

SEQ ID NO: 84723 - DNA, 25 bp, Mus musculus
aatgtccttgcctcggtgtaccttg

SEQ ID NO: 84724 - DNA, 25 bp, Mus musculus
aatgtccttgcctgggattctaccc

SEQ ID NO: 84725 - DNA, 25 bp, Mus musculus
aatgtccttggaacagccctgattt

SEQ ID NO: 84726 - DNA, 25 bp, Mus musculus
aatgtccttggatcagccctgattt

SEQ ID NO: 84727 - DNA, 25 bp, Mus musculus
aatgtccttgtgagccatttgggct

SEQ ID NO: 84728 - DNA, 25 bp, Mus musculus
aatgtccttgtgtgccatttgggct

SEQ ID NO: 84729 - DNA, 25 bp, Mus musculus
aatgtccttgttaacaatttgtggc

SEQ ID NO: 84730 - DNA, 25 bp, Mus musculus
aatgtccttgtttacaatttgtggc

SEQ ID NO: 84731 - DNA, 25 bp, Mus musculus
aatgtcctttggactggagtcaggc

SEQ ID NO: 84732 - DNA, 25 bp, Mus musculus
aatgtcctttggtctggagtcaggc

SEQ ID NO: 84733 - DNA, 25 bp, Mus musculus
aatgtcctttttacaatatctgtca

SEQ ID NO: 84734 - DNA, 25 bp, Mus musculus
aatgtccttttttcaatatctgtca

SEQ ID NO: 84735 - DNA, 25 bp, Mus musculus
aatgtcgacattccccgatctcgga

SEQ ID NO: 84736 - DNA, 25 bp, Mus musculus
aatgtcgacattgcccgatctcgga

SEQ ID NO: 84737 - DNA, 25 bp, Mus musculus
aatgtcgagacacctcagaggcccg

SEQ ID NO: 84738 - DNA, 25 bp, Mus musculus
aatgtcgagacagctcagaggcccg

SEQ ID NO: 84739 - DNA, 25 bp, Mus musculus
aatgtcgccattcctgccatcaaga

SEQ ID NO: 84740 - DNA, 25 bp, Mus musculus
aatgtcgccattgctgccatcaaga

SEQ ID NO: 84741 - DNA, 25 bp, Mus musculus
aatgtcgccctcaaccacaagggtg

SEQ ID NO: 84742 - DNA, 25 bp, Mus musculus
aatgtcgccctctaccacaagggtg

SEQ ID NO: 84743 - DNA, 25 bp, Mus musculus
aatgtcgcgatcctgtattgctata

SEQ ID NO: 84744 - DNA, 25 bp, Mus musculus
aatgtcgcgatcgtgtattgctata

SEQ ID NO: 84745 - DNA, 25 bp, Mus musculus
aatgtcgctgaactccgagagctct

SEQ ID NO: 84746 - DNA, 25 bp, Mus musculus
aatgtcgctgaagtccgagagctct

SEQ ID NO: 84747 - DNA, 25 bp, Mus musculus
aatgtcgctgcaacctgaagggctg

SEQ ID NO: 84748 - DNA, 25 bp, Mus musculus
aatgtcgctgcatcctgaagggctg

SEQ ID NO: 84749 - DNA, 25 bp, Mus musculus
aatgtcgctgtgatggttttctgta

SEQ ID NO: 84750 - DNA, 25 bp, Mus musculus
aatgtcgctgtgttggttttctgta

SEQ ID NO: 84751 - DNA, 25 bp, Mus musculus
aatgtcggtcctcacactgaaagct

SEQ ID NO: 84752 - DNA, 25 bp, Mus musculus
aatgtcggtcctgacactgaaagct

SEQ ID NO: 84753 - DNA, 25 bp, Mus musculus
aatgtcgtacttcaagtcagcctca

SEQ ID NO: 84754 - DNA, 25 bp, Mus musculus
aatgtcgtacttgaagtcagcctca

SEQ ID NO: 84755 - DNA, 25 bp, Mus musculus
aatgtcgtatcacttcttggaatca

SEQ ID NO: 84756 - DNA, 25 bp, Mus musculus
aatgtcgtatcagttcttggaatca

SEQ ID NO: 84757 - DNA, 25 bp, Mus musculus
aatgtcgtcccaccaatatcagcag

SEQ ID NO: 84758 - DNA, 25 bp, Mus musculus
aatgtcgtcccagcaatatcagcag

SEQ ID NO: 84759 - DNA, 25 bp, Mus musculus
aatgtcgtgtgtcctcttgggttgt

SEQ ID NO: 84760 - DNA, 25 bp, Mus musculus
aatgtcgtgtgtgctcttgggttgt

SEQ ID NO: 84761 - DNA, 25 bp, Mus musculus
aatgtcgtgttcagcctggagtgtg

SEQ ID NO: 84762 - DNA, 25 bp, Mus musculus
aatgtcgtgttctgcctggagtgtg

SEQ ID NO: 84763 - DNA, 25 bp, Mus musculus
aatgtcgttcccaagagtaagccct

SEQ ID NO: 84764 - DNA, 25 bp, Mus musculus
aatgtcgttccctagagtaagccct

SEQ ID NO: 84765 - DNA, 25 bp, Mus musculus
aatgtctaacatctctctgctgaaa

SEQ ID NO: 84766 - DNA, 25 bp, Mus musculus
aatgtctaacatgtctctgctgaaa

SEQ ID NO: 84767 - DNA, 25 bp, Mus musculus
aatgtctaaggcagcatccaagtca

SEQ ID NO: 84768 - DNA, 25 bp, Mus musculus
aatgtctaaggctgcatccaagtca

SEQ ID NO: 84769 - DNA, 25 bp, Mus musculus
aatgtctaggatatcaggttttaag

SEQ ID NO: 84770 - DNA, 25 bp, Mus musculus
aatgtctaggatttcaggttttaag

SEQ ID NO: 84771 - DNA, 25 bp, Mus musculus
aatgtctatcaaccctagagctagg

SEQ ID NO: 84772 - DNA, 25 bp, Mus musculus
aatgtctatcaagcctagagctagg

SEQ ID NO: 84773 - DNA, 25 bp, Mus musculus
aatgtctattttagtctcccgagga

SEQ ID NO: 84774 - DNA, 25 bp, Mus musculus
aatgtctatttttgtctcccgagga

SEQ ID NO: 84775 - DNA, 25 bp, Mus musculus
aatgtctcaaagaaaagtcaaccaa

SEQ ID NO: 84776 - DNA, 25 bp, Mus musculus
aatgtctcaaagtaaagtcaaccaa

SEQ ID NO: 84777 - DNA, 25 bp, Mus musculus
aatgtctcacatatcactgaagcaa

SEQ ID NO: 84778 - DNA, 25 bp, Mus musculus
aatgtctcacatatcttgtacgtta

SEQ ID NO: 84779 - DNA, 25 bp, Mus musculus
aatgtctcacatttcactgaagcaa

SEQ ID NO: 84780 - DNA, 25 bp, Mus musculus
aatgtctcacatttcttgtacgtta

SEQ ID NO: 84781 - DNA, 25 bp, Mus musculus
aatgtctcacgtatcgggcttctac

SEQ ID NO: 84782 - DNA, 25 bp, Mus musculus
aatgtctcacgtttcgggcttctac

SEQ ID NO: 84783 - DNA, 25 bp, Mus musculus
aatgtctcacttattctttgaaacg

SEQ ID NO: 84784 - DNA, 25 bp, Mus musculus
aatgtctcactttttctttgaaacg

SEQ ID NO: 84785 - DNA, 25 bp, Mus musculus
aatgtctcagcgatttgtaacctta

SEQ ID NO: 84786 - DNA, 25 bp, Mus musculus
aatgtctcagcgttttgtaacctta

SEQ ID NO: 84787 - DNA, 25 bp, Mus musculus
aatgtctcagtcaatttattctaag

SEQ ID NO: 84788 - DNA, 25 bp, Mus musculus
aatgtctcagtctatttattctaag

SEQ ID NO: 84789 - DNA, 25 bp, Mus musculus
aatgtctcagtgctctacagaaccc

SEQ ID NO: 84790 - DNA, 25 bp, Mus musculus
aatgtctcagtggtctacagaaccc

SEQ ID NO: 84791 - DNA, 25 bp, Mus musculus
aatgtctcattgatttgctgtcctg

SEQ ID NO: 84792 - DNA, 25 bp, Mus musculus
aatgtctcattgttttgctgtcctg

SEQ ID NO: 84793 - DNA, 25 bp, Mus musculus
aatgtctccaacatcacatttgctc

SEQ ID NO: 84794 - DNA, 25 bp, Mus musculus
aatgtctccaacttcacatttgctc

SEQ ID NO: 84795 - DNA, 25 bp, Mus musculus
aatgtctccacacggaaattgtgta

SEQ ID NO: 84796 - DNA, 25 bp, Mus musculus
aatgtctccacagggaaattgtgta

SEQ ID NO: 84797 - DNA, 25 bp, Mus musculus
aatgtctccaccagtctgcttggat

SEQ ID NO: 84798 - DNA, 25 bp, Mus musculus
aatgtctccacctgtctgcttggat

SEQ ID NO: 84799 - DNA, 25 bp, Mus musculus
aatgtctccactatttgtggtgtcc

SEQ ID NO: 84800 - DNA, 25 bp, Mus musculus
aatgtctccactttttgtggtgtcc

SEQ ID NO: 84801 - DNA, 25 bp, Mus musculus
aatgtctcccctcatgtggatacaa

SEQ ID NO: 84802 - DNA, 25 bp, Mus musculus
aatgtctcccctgatgtggatacaa

SEQ ID NO: 84803 - DNA, 25 bp, Mus musculus
aatgtctccctccaagtggaagtat

SEQ ID NO: 84804 - DNA, 25 bp, Mus musculus
aatgtctccctcgaagtggaagtat

SEQ ID NO: 84805 - DNA, 25 bp, Mus musculus
aatgtctcgtatcttattagcttag

SEQ ID NO: 84806 - DNA, 25 bp, Mus musculus
aatgtctcgtatgttattagcttag

SEQ ID NO: 84807 - DNA, 25 bp, Mus musculus
aatgtctctagcattctttttctca

SEQ ID NO: 84808 - DNA, 25 bp, Mus musculus
aatgtctctagctttctttttctca

SEQ ID NO: 84809 - DNA, 25 bp, Mus musculus
aatgtctctccgagattgtaaagcg

SEQ ID NO: 84810 - DNA, 25 bp, Mus musculus
aatgtctctccgtgattgtaaagcg

SEQ ID NO: 84811 - DNA, 25 bp, Mus musculus
aatgtctctgaaaactgcgcagcaa

SEQ ID NO: 84812 - DNA, 25 bp, Mus musculus
aatgtctctgaaatctggcttctga

SEQ ID NO: 84813 - DNA, 25 bp, Mus musculus
aatgtctctgaatactgcgcagcaa

SEQ ID NO: 84814 - DNA, 25 bp, Mus musculus
aatgtctctgaattctggcttctga

SEQ ID NO: 84815 - DNA, 25 bp, Mus musculus
aatgtctctgcccaaatccataagg

SEQ ID NO: 84816 - DNA, 25 bp, Mus musculus
aatgtctctgccgaaatccataagg

SEQ ID NO: 84817 - DNA, 25 bp, Mus musculus
aatgtctctgtaatgtttctgggtc

SEQ ID NO: 84818 - DNA, 25 bp, Mus musculus
aatgtctctgtattgtttctgggtc

SEQ ID NO: 84819 - DNA, 25 bp, Mus musculus
aatgtctgaatgaagttatgaactg

SEQ ID NO: 84820 - DNA, 25 bp, Mus musculus
aatgtctgaatgtagttatgaactg

SEQ ID NO: 84821 - DNA, 25 bp, Mus musculus
aatgtctgacaacgctattctctgc

SEQ ID NO: 84822 - DNA, 25 bp, Mus musculus
aatgtctgacaaggctattctctgc

SEQ ID NO: 84823 - DNA, 25 bp, Mus musculus
aatgtctgacataagctgctgcttc

SEQ ID NO: 84824 - DNA, 25 bp, Mus musculus
aatgtctgacattagctgctgcttc

SEQ ID NO: 84825 - DNA, 25 bp, Mus musculus
aatgtctgagccactgatgcatctt

SEQ ID NO: 84826 - DNA, 25 bp, Mus musculus
aatgtctgagcctctgatgcatctt

SEQ ID NO: 84827 - DNA, 25 bp, Mus musculus
aatgtctgagtaacctctctttaga

SEQ ID NO: 84828 - DNA, 25 bp, Mus musculus
aatgtctgagtatcctctctttaga

SEQ ID NO: 84829 - DNA, 25 bp, Mus musculus
aatgtctgatctcactactttggaa

SEQ ID NO: 84830 - DNA, 25 bp, Mus musculus
aatgtctgatctgactactttggaa

SEQ ID NO: 84831 - DNA, 25 bp, Mus musculus
aatgtctgccgacgccatgctgaag

SEQ ID NO: 84832 - DNA, 25 bp, Mus musculus
aatgtctgccgaggccatgctgaag

SEQ ID NO: 84833 - DNA, 25 bp, Mus musculus
aatgtctgcgatacgtccagaccaa

SEQ ID NO: 84834 - DNA, 25 bp, Mus musculus
aatgtctgcgattcgtccagaccaa

SEQ ID NO: 84835 - DNA, 25 bp, Mus musculus
aatgtctgctacaccagaaggcctc

SEQ ID NO: 84836 - DNA, 25 bp, Mus musculus
aatgtctgctactccagaaggcctc

SEQ ID NO: 84837 - DNA, 25 bp, Mus musculus
aatgtctgctgccaaagccatcgca

SEQ ID NO: 84838 - DNA, 25 bp, Mus musculus
aatgtctgctgcgaaagccatcgca

SEQ ID NO: 84839 - DNA, 25 bp, Mus musculus
aatgtctgcttactatttgggtgct

SEQ ID NO: 84840 - DNA, 25 bp, Mus musculus
aatgtctgcttagtatttgggtgct

SEQ ID NO: 84841 - DNA, 25 bp, Mus musculus
aatgtctggataacgctgtggatct

SEQ ID NO: 84842 - DNA, 25 bp, Mus musculus
aatgtctggatatcgctgtggatct

SEQ ID NO: 84843 - DNA, 25 bp, Mus musculus
aatgtctggcacaatctctactgag

SEQ ID NO: 84844 - DNA, 25 bp, Mus musculus
aatgtctggcacatggtcttttctc

SEQ ID NO: 84845 - DNA, 25 bp, Mus musculus
aatgtctggcactatctctactgag

SEQ ID NO: 84846 - DNA, 25 bp, Mus musculus
aatgtctggcacttggtcttttctc

SEQ ID NO: 84847 - DNA, 25 bp, Mus musculus
aatgtctgggtgattcagtgctggt

SEQ ID NO: 84848 - DNA, 25 bp, Mus musculus
aatgtctgggtgtttcagtgctggt

SEQ ID NO: 84849 - DNA, 25 bp, Mus musculus
aatgtctggtccacaattattagaa

SEQ ID NO: 84850 - DNA, 25 bp, Mus musculus
aatgtctggtcctcaattattagaa

SEQ ID NO: 84851 - DNA, 25 bp, Mus musculus
aatgtctggtgcaccagtctgtcca

SEQ ID NO: 84852 - DNA, 25 bp, Mus musculus
aatgtctggtgctccagtctgtcca

SEQ ID NO: 84853 - DNA, 25 bp, Mus musculus
aatgtctgtagtaagtgctggtgaa

SEQ ID NO: 84854 - DNA, 25 bp, Mus musculus
aatgtctgtagttagtgctggtgaa

SEQ ID NO: 84855 - DNA, 25 bp, Mus musculus
aatgtctgtcctcgtgccccagtgc

SEQ ID NO: 84856 - DNA, 25 bp, Mus musculus
aatgtctgtcctggtgccccagtgc

SEQ ID NO: 84857 - DNA, 25 bp, Mus musculus
aatgtctgtgagagacctgggcccc

SEQ ID NO: 84858 - DNA, 25 bp, Mus musculus
aatgtctgtgagtgacctgggcccc

SEQ ID NO: 84859 - DNA, 25 bp, Mus musculus
aatgtctgtgctcttaagttgctga

SEQ ID NO: 84860 - DNA, 25 bp, Mus musculus
aatgtctgtgctgttaagttgctga

SEQ ID NO: 84861 - DNA, 25 bp, Mus musculus
aatgtctgtggaagactctggcctc

SEQ ID NO: 84862 - DNA, 25 bp, Mus musculus
aatgtctgtggatgactctggcctc

SEQ ID NO: 84863 - DNA, 25 bp, Mus musculus
aatgtctgtgtacggctgagcacta

SEQ ID NO: 84864 - DNA, 25 bp, Mus musculus
aatgtctgtgtagggctgagcacta

SEQ ID NO: 84865 - DNA, 25 bp, Mus musculus
aatgtctgttcccaagtccatgaaa

SEQ ID NO: 84866 - DNA, 25 bp, Mus musculus
aatgtctgttccgaagtccatgaaa

SEQ ID NO: 84867 - DNA, 25 bp, Mus musculus
aatgtcttaaagagttctctctccc

SEQ ID NO: 84868 - DNA, 25 bp, Mus musculus
aatgtcttaaagtgttctctctccc

SEQ ID NO: 84869 - DNA, 25 bp, Mus musculus
aatgtcttagcaatggcttccatcc

SEQ ID NO: 84870 - DNA, 25 bp, Mus musculus
aatgtcttagcattggcttccatcc

SEQ ID NO: 84871 - DNA, 25 bp, Mus musculus
aatgtcttatgtccctggtgtatta

SEQ ID NO: 84872 - DNA, 25 bp, Mus musculus
aatgtcttatgtgcctggtgtatta

SEQ ID NO: 84873 - DNA, 25 bp, Mus musculus
aatgtcttcatgacacataaacaca

SEQ ID NO: 84874 - DNA, 25 bp, Mus musculus
aatgtcttcatgtcacataaacaca

SEQ ID NO: 84875 - DNA, 25 bp, Mus musculus
aatgtcttccaaatctgtcttttaa

SEQ ID NO: 84876 - DNA, 25 bp, Mus musculus
aatgtcttccaattctgtcttttaa

SEQ ID NO: 84877 - DNA, 25 bp, Mus musculus
aatgtcttccggaccctgagagagg

SEQ ID NO: 84878 - DNA, 25 bp, Mus musculus
aatgtcttccggtccctgagagagg

SEQ ID NO: 84879 - DNA, 25 bp, Mus musculus
aatgtcttcctcatacctgagacgg

SEQ ID NO: 84880 - DNA, 25 bp, Mus musculus
aatgtcttcctcttacctgagacgg

SEQ ID NO: 84881 - DNA, 25 bp, Mus musculus
aatgtcttctttccagttgtcttca

SEQ ID NO: 84882 - DNA, 25 bp, Mus musculus
aatgtcttctttgcagttgtcttca

SEQ ID NO: 84883 - DNA, 25 bp, Mus musculus
aatgtcttgcacaatcctaccaaat

SEQ ID NO: 84884 - DNA, 25 bp, Mus musculus
aatgtcttgcactatcctaccaaat

SEQ ID NO: 84885 - DNA, 25 bp, Mus musculus
aatgtcttggccattaccttttcac

SEQ ID NO: 84886 - DNA, 25 bp, Mus musculus
aatgtcttggcctttaccttttcac

SEQ ID NO: 84887 - DNA, 25 bp, Mus musculus
aatgtcttgttacttctactgcagg

SEQ ID NO: 84888 - DNA, 25 bp, Mus musculus
aatgtcttgttagttctactgcagg

SEQ ID NO: 84889 - DNA, 25 bp, Mus musculus
aatgtctttcatcttttctctaaat

SEQ ID NO: 84890 - DNA, 25 bp, Mus musculus
aatgtctttcatgttttctctaaat

SEQ ID NO: 84891 - DNA, 25 bp, Mus musculus
aatgtctttgacaggctaggccgga

SEQ ID NO: 84892 - DNA, 25 bp, Mus musculus
aatgtctttgactggctaggccgga

SEQ ID NO: 84893 - DNA, 25 bp, Mus musculus
aatgtctttggacatgtccgcatac

SEQ ID NO: 84894 - DNA, 25 bp, Mus musculus
aatgtctttggagatgtccgcatac

SEQ ID NO: 84895 - DNA, 25 bp, Mus musculus
aatgtctttgtcacatgcttcagtc

SEQ ID NO: 84896 - DNA, 25 bp, Mus musculus
aatgtctttgtctcatgcttcagtc

SEQ ID NO: 84897 - DNA, 25 bp, Mus musculus
aatgtgaaaagtccgtttggcagaa

SEQ ID NO: 84898 - DNA, 25 bp, Mus musculus
aatgtgaaaagtgcgtttggcagaa

SEQ ID NO: 84899 - DNA, 25 bp, Mus musculus
aatgtgaaacctctcaagtctgcct

SEQ ID NO: 84900 - DNA, 25 bp, Mus musculus
aatgtgaaacctgtcaagtctgcct

SEQ ID NO: 84901 - DNA, 25 bp, Mus musculus
aatgtgaaagacatcctccgagccc

SEQ ID NO: 84902 - DNA, 25 bp, Mus musculus
aatgtgaaagacttcctccgagccc

SEQ ID NO: 84903 - DNA, 25 bp, Mus musculus
aatgtgaaattactatcagtgtata

SEQ ID NO: 84904 - DNA, 25 bp, Mus musculus
aatgtgaaattagtatcagtgtata

SEQ ID NO: 84905 - DNA, 25 bp, Mus musculus
aatgtgaaattcagccctcagccaa

SEQ ID NO: 84906 - DNA, 25 bp, Mus musculus
aatgtgaaattctgccctcagccaa

SEQ ID NO: 84907 - DNA, 25 bp, Mus musculus
aatgtgaacacacggctcatatgaa

SEQ ID NO: 84908 - DNA, 25 bp, Mus musculus
aatgtgaacacagggctcatatgaa

SEQ ID NO: 84909 - DNA, 25 bp, Mus musculus
aatgtgaacactaccgaaccccata

SEQ ID NO: 84910 - DNA, 25 bp, Mus musculus
aatgtgaacacttccgaaccccata

SEQ ID NO: 84911 - DNA, 25 bp, Mus musculus
aatgtgaacttgcttacctgtttaa

SEQ ID NO: 84912 - DNA, 25 bp, Mus musculus
aatgtgaacttggttacctgtttaa

SEQ ID NO: 84913 - DNA, 25 bp, Mus musculus
aatgtgaagatcattgtcactctgt

SEQ ID NO: 84914 - DNA, 25 bp, Mus musculus
aatgtgaagatctttgtcactctgt

SEQ ID NO: 84915 - DNA, 25 bp, Mus musculus
aatgtgaagccacccgcaggatgca

SEQ ID NO: 84916 - DNA, 25 bp, Mus musculus
aatgtgaagccagccgcaggatgca

SEQ ID NO: 84917 - DNA, 25 bp, Mus musculus
aatgtgaatgtcacttgcagctggg

SEQ ID NO: 84918 - DNA, 25 bp, Mus musculus
aatgtgaatgtctcttgcagctggg

SEQ ID NO: 84919 - DNA, 25 bp, Mus musculus
aatgtgaatgttaaccacaggttcc

SEQ ID NO: 84920 - DNA, 25 bp, Mus musculus
aatgtgaatgtttaccacaggttcc

SEQ ID NO: 84921 - DNA, 25 bp, Mus musculus
aatgtgacaaatccactcttcagat

SEQ ID NO: 84922 - DNA, 25 bp, Mus musculus
aatgtgacaaatgcactcttcagat

SEQ ID NO: 84923 - DNA, 25 bp, Mus musculus
aatgtgacaatacctgatgccaccc

SEQ ID NO: 84924 - DNA, 25 bp, Mus musculus
aatgtgacaatagctgatgccaccc

SEQ ID NO: 84925 - DNA, 25 bp, Mus musculus
aatgtgacacttcatttggcccttt

SEQ ID NO: 84926 - DNA, 25 bp, Mus musculus
aatgtgacacttgatttggcccttt

SEQ ID NO: 84927 - DNA, 25 bp, Mus musculus
aatgtgacagtcaagatgaaccaac

SEQ ID NO: 84928 - DNA, 25 bp, Mus musculus
aatgtgacagtctagatgaaccaac

SEQ ID NO: 84929 - DNA, 25 bp, Mus musculus
aatgtgacagtgacacttgggtgta

SEQ ID NO: 84930 - DNA, 25 bp, Mus musculus
aatgtgacagtgtcacttgggtgta

SEQ ID NO: 84931 - DNA, 25 bp, Mus musculus
aatgtgacatctctaggccatctgt

SEQ ID NO: 84932 - DNA, 25 bp, Mus musculus
aatgtgacatctgtaggccatctgt

SEQ ID NO: 84933 - DNA, 25 bp, Mus musculus
aatgtgacatgcctggttttctatt

SEQ ID NO: 84934 - DNA, 25 bp, Mus musculus
aatgtgacatgcgtggttttctatt

SEQ ID NO: 84935 - DNA, 25 bp, Mus musculus
aatgtgaccaacacaatcaacccac

SEQ ID NO: 84936 - DNA, 25 bp, Mus musculus
aatgtgaccaactcaatcaacccac

SEQ ID NO: 84937 - DNA, 25 bp, Mus musculus
aatgtgaccacgagattttctttag

SEQ ID NO: 84938 - DNA, 25 bp, Mus musculus
aatgtgaccacgtgattttctttag

SEQ ID NO: 84939 - DNA, 25 bp, Mus musculus
aatgtgaccagcaggcatagcctgt

SEQ ID NO: 84940 - DNA, 25 bp, Mus musculus
aatgtgaccagctggcatagcctgt

SEQ ID NO: 84941 - DNA, 25 bp, Mus musculus
aatgtgaccaggatgaggcctttga

SEQ ID NO: 84942 - DNA, 25 bp, Mus musculus
aatgtgaccaggttgaggcctttga

SEQ ID NO: 84943 - DNA, 25 bp, Mus musculus
aatgtgacccaactctaactgacac

SEQ ID NO: 84944 - DNA, 25 bp, Mus musculus
aatgtgacccaagtctaactgacac

SEQ ID NO: 84945 - DNA, 25 bp, Mus musculus
aatgtgaccctgaaccctacgtgta

SEQ ID NO: 84946 - DNA, 25 bp, Mus musculus
aatgtgaccctgatcaaaggtgttt

SEQ ID NO: 84947 - DNA, 25 bp, Mus musculus
aatgtgaccctgtaccctacgtgta

SEQ ID NO: 84948 - DNA, 25 bp, Mus musculus
aatgtgaccctgttcaaaggtgttt

SEQ ID NO: 84949 - DNA, 25 bp, Mus musculus
aatgtgacctggattttgtgatttt

SEQ ID NO: 84950 - DNA, 25 bp, Mus musculus
aatgtgacctggtttttgtgatttt

SEQ ID NO: 84951 - DNA, 25 bp, Mus musculus
aatgtgactctcaccttgggaggtt

SEQ ID NO: 84952 - DNA, 25 bp, Mus musculus
aatgtgactctctccttgggaggtt

SEQ ID NO: 84953 - DNA, 25 bp, Mus musculus
aatgtgactgatagtacagatctga

SEQ ID NO: 84954 - DNA, 25 bp, Mus musculus
aatgtgactgattgtacagatctga

SEQ ID NO: 84955 - DNA, 25 bp, Mus musculus
aatgtgactgcaccgacagcttcaa

SEQ ID NO: 84956 - DNA, 25 bp, Mus musculus
aatgtgactgcagcgacagcttcaa

SEQ ID NO: 84957 - DNA, 25 bp, Mus musculus
aatgtgacttggcactggccttcct

SEQ ID NO: 84958 - DNA, 25 bp, Mus musculus
aatgtgacttgggactggccttcct

SEQ ID NO: 84959 - DNA, 25 bp, Mus musculus
aatgtgacttgtagctgccagtcct

SEQ ID NO: 84960 - DNA, 25 bp, Mus musculus
aatgtgacttgttgctgccagtcct

SEQ ID NO: 84961 - DNA, 25 bp, Mus musculus
aatgtgagacccagcggcagcaggt

SEQ ID NO: 84962 - DNA, 25 bp, Mus musculus
aatgtgagaccctgcggcagcaggt

SEQ ID NO: 84963 - DNA, 25 bp, Mus musculus
aatgtgagagatatccaactgttcc

SEQ ID NO: 84964 - DNA, 25 bp, Mus musculus
aatgtgagagatttccaactgttcc

SEQ ID NO: 84965 - DNA, 25 bp, Mus musculus
aatgtgagatctcgcgggagctctt

SEQ ID NO: 84966 - DNA, 25 bp, Mus musculus
aatgtgagatctggcgggagctctt

SEQ ID NO: 84967 - DNA, 25 bp, Mus musculus
aatgtgagccacaacgtttatttac

SEQ ID NO: 84968 - DNA, 25 bp, Mus musculus
aatgtgagccactacgtttatttac

SEQ ID NO: 84969 - DNA, 25 bp, Mus musculus
aatgtgagccatacatccatcccta

SEQ ID NO: 84970 - DNA, 25 bp, Mus musculus
aatgtgagccattcatccatcccta

SEQ ID NO: 84971 - DNA, 25 bp, Mus musculus
aatgtgagcgatactagatacgatc

SEQ ID NO: 84972 - DNA, 25 bp, Mus musculus
aatgtgagcgattctagatacgatc

SEQ ID NO: 84973 - DNA, 25 bp, Mus musculus
aatgtgagctatacactcactagct

SEQ ID NO: 84974 - DNA, 25 bp, Mus musculus
aatgtgagctattcactcactagct

SEQ ID NO: 84975 - DNA, 25 bp, Mus musculus
aatgtgagctgaccccattggcttc

SEQ ID NO: 84976 - DNA, 25 bp, Mus musculus
aatgtgagctgagcccattggcttc

SEQ ID NO: 84977 - DNA, 25 bp, Mus musculus
aatgtgaggacaagggccaggctac

SEQ ID NO: 84978 - DNA, 25 bp, Mus musculus
aatgtgaggacatgggccaggctac

SEQ ID NO: 84979 - DNA, 25 bp, Mus musculus
aatgtgaggcttaaccactgtctga

SEQ ID NO: 84980 - DNA, 25 bp, Mus musculus
aatgtgaggctttaccactgtctga

SEQ ID NO: 84981 - DNA, 25 bp, Mus musculus
aatgtgagggtcacgcccttcatca

SEQ ID NO: 84982 - DNA, 25 bp, Mus musculus
aatgtgagggtctcgcccttcatca

SEQ ID NO: 84983 - DNA, 25 bp, Mus musculus
aatgtgaggtctacaaccttgccag

SEQ ID NO: 84984 - DNA, 25 bp, Mus musculus
aatgtgaggtctccaacccagtcgg

SEQ ID NO: 84985 - DNA, 25 bp, Mus musculus
aatgtgaggtctgcaacccagtcgg

SEQ ID NO: 84986 - DNA, 25 bp, Mus musculus
aatgtgaggtcttcaaccttgccag

SEQ ID NO: 84987 - DNA, 25 bp, Mus musculus
aatgtgagtcaccttactgtaacgg

SEQ ID NO: 84988 - DNA, 25 bp, Mus musculus
aatgtgagtcacgttactgtaacgg

SEQ ID NO: 84989 - DNA, 25 bp, Mus musculus
aatgtgataactctaccctgaccct

SEQ ID NO: 84990 - DNA, 25 bp, Mus musculus
aatgtgataactgtaccctgaccct

SEQ ID NO: 84991 - DNA, 25 bp, Mus musculus
aatgtgatacgcatcaacccacttt

SEQ ID NO: 84992 - DNA, 25 bp, Mus musculus
aatgtgatacgcttcaacccacttt

SEQ ID NO: 84993 - DNA, 25 bp, Mus musculus
aatgtgatctgtcttttccatattc

SEQ ID NO: 84994 - DNA, 25 bp, Mus musculus
aatgtgatctgtgttttccatattc

SEQ ID NO: 84995 - DNA, 25 bp, Mus musculus
aatgtgatctttagtcagctgtccc

SEQ ID NO: 84996 - DNA, 25 bp, Mus musculus
aatgtgatcttttgtcagctgtccc

SEQ ID NO: 84997 - DNA, 25 bp, Mus musculus
aatgtgatgaacaccaatcttttcc

SEQ ID NO: 84998 - DNA, 25 bp, Mus musculus
aatgtgatgaactccaatcttttcc

SEQ ID NO: 84999 - DNA, 25 bp, Mus musculus
aatgtgatgctgcatcttactaaac

SEQ ID NO: 85000 - DNA, 25 bp, Mus musculus
aatgtgatgctggatcttactaaac

SEQ ID NO: 85001 - DNA, 25 bp, Mus musculus
aatgtgatgtaacgccttccgcaat

SEQ ID NO: 85002 - DNA, 25 bp, Mus musculus
aatgtgatgtaaggccttccgcaat

SEQ ID NO: 85003 - DNA, 25 bp, Mus musculus
aatgtgatgtcactcccggaaaagt

SEQ ID NO: 85004 - DNA, 25 bp, Mus musculus
aatgtgatgtcagtcccggaaaagt

SEQ ID NO: 85005 - DNA, 25 bp, Mus musculus
aatgtgatgtgaagtctgtctgtct

SEQ ID NO: 85006 - DNA, 25 bp, Mus musculus
aatgtgatgtgatgtctgtctgtct

SEQ ID NO: 85007 - DNA, 25 bp, Mus musculus
aatgtgatgtttaaagaccatcaaa

SEQ ID NO: 85008 - DNA, 25 bp, Mus musculus
aatgtgatgttttaagaccatcaaa

SEQ ID NO: 85009 - DNA, 25 bp, Mus musculus
aatgtgattatccaccatggtatgc

SEQ ID NO: 85010 - DNA, 25 bp, Mus musculus
aatgtgattatcgaccatggtatgc

SEQ ID NO: 85011 - DNA, 25 bp, Mus musculus
aatgtgattattaccctgttcctaa

SEQ ID NO: 85012 - DNA, 25 bp, Mus musculus
aatgtgattatttccctgttcctaa

SEQ ID NO: 85013 - DNA, 25 bp, Mus musculus
aatgtgatttctacttggcaacctt

SEQ ID NO: 85014 - DNA, 25 bp, Mus musculus
aatgtgatttcttcttggcaacctt

SEQ ID NO: 85015 - DNA, 25 bp, Mus musculus
aatgtgcaaatccaattcagaggta

SEQ ID NO: 85016 - DNA, 25 bp, Mus musculus
aatgtgcaaatcgaattcagaggta

SEQ ID NO: 85017 - DNA, 25 bp, Mus musculus
aatgtgcaagccacagaccacagct

SEQ ID NO: 85018 - DNA, 25 bp, Mus musculus
aatgtgcaagcctcagaccacagct

SEQ ID NO: 85019 - DNA, 25 bp, Mus musculus
aatgtgcacatcaatactatatttt

SEQ ID NO: 85020 - DNA, 25 bp, Mus musculus
aatgtgcacatcagcgatagccctt

SEQ ID NO: 85021 - DNA, 25 bp, Mus musculus
aatgtgcacatctatactatatttt

SEQ ID NO: 85022 - DNA, 25 bp, Mus musculus
aatgtgcacatctgcgatagccctt

SEQ ID NO: 85023 - DNA, 25 bp, Mus musculus
aatgtgcaccaacatgatgagctat

SEQ ID NO: 85024 - DNA, 25 bp, Mus musculus
aatgtgcaccaagatgatgagctat

SEQ ID NO: 85025 - DNA, 25 bp, Mus musculus
aatgtgcacgatctctcgcatggtg

SEQ ID NO: 85026 - DNA, 25 bp, Mus musculus
aatgtgcacgatgtctcgcatggtg

SEQ ID NO: 85027 - DNA, 25 bp, Mus musculus
aatgtgcacgctatgccctaaagcc

SEQ ID NO: 85028 - DNA, 25 bp, Mus musculus
aatgtgcacgctttgccctaaagcc

SEQ ID NO: 85029 - DNA, 25 bp, Mus musculus
aatgtgcagacgatgtcaggacctg

SEQ ID NO: 85030 - DNA, 25 bp, Mus musculus
aatgtgcagacgttgtcaggacctg

SEQ ID NO: 85031 - DNA, 25 bp, Mus musculus
aatgtgcagcccatcagctgaaagc

SEQ ID NO: 85032 - DNA, 25 bp, Mus musculus
aatgtgcagcccttcagctgaaagc

SEQ ID NO: 85033 - DNA, 25 bp, Mus musculus
aatgtgcagcgaccagttcccgccg

SEQ ID NO: 85034 - DNA, 25 bp, Mus musculus
aatgtgcagcgagcagttcccgccg

SEQ ID NO: 85035 - DNA, 25 bp, Mus musculus
aatgtgcagcgccaggaatcatgaa

SEQ ID NO: 85036 - DNA, 25 bp, Mus musculus
aatgtgcagcgcgaggaatcatgaa

SEQ ID NO: 85037 - DNA, 25 bp, Mus musculus
aatgtgcagcgtcttatgtggctct

SEQ ID NO: 85038 - DNA, 25 bp, Mus musculus
aatgtgcagcgtgttatgtggctct

SEQ ID NO: 85039 - DNA, 25 bp, Mus musculus
aatgtgcagctgatgtaactgccaa

SEQ ID NO: 85040 - DNA, 25 bp, Mus musculus
aatgtgcagctgttgtaactgccaa

SEQ ID NO: 85041 - DNA, 25 bp, Mus musculus
aatgtgcagcttaggaattgttgtc

SEQ ID NO: 85042 - DNA, 25 bp, Mus musculus
aatgtgcagctttggaattgttgtc

SEQ ID NO: 85043 - DNA, 25 bp, Mus musculus
aatgtgcagggtcagagatgttctt

SEQ ID NO: 85044 - DNA, 25 bp, Mus musculus
aatgtgcagggtgagagatgttctt

SEQ ID NO: 85045 - DNA, 25 bp, Mus musculus
aatgtgcatgcaatcctgtgcttga

SEQ ID NO: 85046 - DNA, 25 bp, Mus musculus
aatgtgcatgcattcctgtgcttga

SEQ ID NO: 85047 - DNA, 25 bp, Mus musculus
aatgtgcatggactgcccttgtgtt

SEQ ID NO: 85048 - DNA, 25 bp, Mus musculus
aatgtgcatggagtgcccttgtgtt

SEQ ID NO: 85049 - DNA, 25 bp, Mus musculus
aatgtgccaactatttcagcttttt

SEQ ID NO: 85050 - DNA, 25 bp, Mus musculus
aatgtgccaactttttcagcttttt

SEQ ID NO: 85051 - DNA, 25 bp, Mus musculus
aatgtgccagagattgccgtgtacc

SEQ ID NO: 85052 - DNA, 25 bp, Mus musculus
aatgtgccagagtttgccgtgtacc

SEQ ID NO: 85053 - DNA, 25 bp, Mus musculus
aatgtgccatatatggtcagtagac

SEQ ID NO: 85054 - DNA, 25 bp, Mus musculus
aatgtgccatatttggtcagtagac

SEQ ID NO: 85055 - DNA, 25 bp, Mus musculus
aatgtgccatttcccaggttgccac

SEQ ID NO: 85056 - DNA, 25 bp, Mus musculus
aatgtgccatttgccaggttgccac

SEQ ID NO: 85057 - DNA, 25 bp, Mus musculus
aatgtgcccatcacagtatctcaat

SEQ ID NO: 85058 - DNA, 25 bp, Mus musculus
aatgtgcccatctcagtatctcaat

SEQ ID NO: 85059 - DNA, 25 bp, Mus musculus
aatgtgccgaaaaccatggaatctg

SEQ ID NO: 85060 - DNA, 25 bp, Mus musculus
aatgtgccgaaatccatggaatctg

SEQ ID NO: 85061 - DNA, 25 bp, Mus musculus
aatgtgccgggcatgtatccttcct

SEQ ID NO: 85062 - DNA, 25 bp, Mus musculus
aatgtgccgggcttgtatccttcct

SEQ ID NO: 85063 - DNA, 25 bp, Mus musculus
aatgtgcctaccaaaccaggaggat

SEQ ID NO: 85064 - DNA, 25 bp, Mus musculus
aatgtgcctacctaaccaggaggat

SEQ ID NO: 85065 - DNA, 25 bp, Mus musculus
aatgtgcctattactagagctcctc

SEQ ID NO: 85066 - DNA, 25 bp, Mus musculus
aatgtgcctatttctagagctcctc

SEQ ID NO: 85067 - DNA, 25 bp, Mus musculus
aatgtgcctgctatgtcagagttca

SEQ ID NO: 85068 - DNA, 25 bp, Mus musculus
aatgtgcctgctttgtcagagttca

SEQ ID NO: 85069 - DNA, 25 bp, Mus musculus
aatgtgcctgttagcaggcttccag

SEQ ID NO: 85070 - DNA, 25 bp, Mus musculus
aatgtgcctgttatttaactcgata

SEQ ID NO: 85071 - DNA, 25 bp, Mus musculus
aatgtgcctgtttgcaggcttccag

SEQ ID NO: 85072 - DNA, 25 bp, Mus musculus
aatgtgcctgttttttaactcgata

SEQ ID NO: 85073 - DNA, 25 bp, Mus musculus
aatgtgccttaacgtgtgccagaga

SEQ ID NO: 85074 - DNA, 25 bp, Mus musculus
aatgtgccttaaggtgtgccagaga

SEQ ID NO: 85075 - DNA, 25 bp, Mus musculus
aatgtgccttatacaaatcaattgt

SEQ ID NO: 85076 - DNA, 25 bp, Mus musculus
aatgtgccttattcaaatcaattgt

SEQ ID NO: 85077 - DNA, 25 bp, Mus musculus
aatgtgccttcaagtggactggtcc

SEQ ID NO: 85078 - DNA, 25 bp, Mus musculus
aatgtgccttcatgtggactggtcc

SEQ ID NO: 85079 - DNA, 25 bp, Mus musculus
aatgtgcctttcattcgatgctttc

SEQ ID NO: 85080 - DNA, 25 bp, Mus musculus
aatgtgcctttctttcgatgctttc

SEQ ID NO: 85081 - DNA, 25 bp, Mus musculus
aatgtgcgtcctagtggccagtaga

SEQ ID NO: 85082 - DNA, 25 bp, Mus musculus
aatgtgcgtccttgtggccagtaga

SEQ ID NO: 85083 - DNA, 25 bp, Mus musculus
aatgtgctaatgcatgcttggcaaa

SEQ ID NO: 85084 - DNA, 25 bp, Mus musculus
aatgtgctaatggatgcttggcaaa

SEQ ID NO: 85085 - DNA, 25 bp, Mus musculus
aatgtgctactaaaatttgtctgag

SEQ ID NO: 85086 - DNA, 25 bp, Mus musculus
aatgtgctactataatttgtctgag

SEQ ID NO: 85087 - DNA, 25 bp, Mus musculus
aatgtgctactgatcaatttaatac

SEQ ID NO: 85088 - DNA, 25 bp, Mus musculus
aatgtgctactgttcaatttaatac

SEQ ID NO: 85089 - DNA, 25 bp, Mus musculus
aatgtgctatagaactttggttgtt

SEQ ID NO: 85090 - DNA, 25 bp, Mus musculus
aatgtgctatagtactttggttgtt

SEQ ID NO: 85091 - DNA, 25 bp, Mus musculus
aatgtgctatttacacagtaagtac

SEQ ID NO: 85092 - DNA, 25 bp, Mus musculus
aatgtgctatttatgatgtgttgtt

SEQ ID NO: 85093 - DNA, 25 bp, Mus musculus
aatgtgctattttcacagtaagtac

SEQ ID NO: 85094 - DNA, 25 bp, Mus musculus
aatgtgctatttttgatgtgttgtt

SEQ ID NO: 85095 - DNA, 25 bp, Mus musculus
aatgtgctcagaatgcccaagggcc

SEQ ID NO: 85096 - DNA, 25 bp, Mus musculus
aatgtgctcagattgcccaagggcc

SEQ ID NO: 85097 - DNA, 25 bp, Mus musculus
aatgtgctcattacgcattccttat

SEQ ID NO: 85098 - DNA, 25 bp, Mus musculus
aatgtgctcatttcgcattccttat

SEQ ID NO: 85099 - DNA, 25 bp, Mus musculus
aatgtgctccaacccatagtaaaat

SEQ ID NO: 85100 - DNA, 25 bp, Mus musculus
aatgtgctccaagccatagtaaaat

SEQ ID NO: 85101 - DNA, 25 bp, Mus musculus
aatgtgctgaccaaagacttgagat

SEQ ID NO: 85102 - DNA, 25 bp, Mus musculus
aatgtgctgacctaagacttgagat

SEQ ID NO: 85103 - DNA, 25 bp, Mus musculus
aatgtgctgcagatctgggcctgaa

SEQ ID NO: 85104 - DNA, 25 bp, Mus musculus
aatgtgctgcagttctgggcctgaa

SEQ ID NO: 85105 - DNA, 25 bp, Mus musculus
aatgtgctgcatatacttcccaata

SEQ ID NO: 85106 - DNA, 25 bp, Mus musculus
aatgtgctgcatttacttcccaata

SEQ ID NO: 85107 - DNA, 25 bp, Mus musculus
aatgtgctgccgagattcaggaagc

SEQ ID NO: 85108 - DNA, 25 bp, Mus musculus
aatgtgctgccgtgattcaggaagc

SEQ ID NO: 85109 - DNA, 25 bp, Mus musculus
aatgtgctgcctcgtactgttggcg

SEQ ID NO: 85110 - DNA, 25 bp, Mus musculus
aatgtgctgcctggtactgttggcg

SEQ ID NO: 85111 - DNA, 25 bp, Mus musculus
aatgtgctgcgaatccagtgtcttc

SEQ ID NO: 85112 - DNA, 25 bp, Mus musculus
aatgtgctgcgattccagtgtcttc

SEQ ID NO: 85113 - DNA, 25 bp, Mus musculus
aatgtgctgcgtccacctgcctatg

SEQ ID NO: 85114 - DNA, 25 bp, Mus musculus
aatgtgctgcgtgcacctgcctatg

SEQ ID NO: 85115 - DNA, 25 bp, Mus musculus
aatgtgctgggtattattccttaca

SEQ ID NO: 85116 - DNA, 25 bp, Mus musculus
aatgtgctgggttttattccttaca

SEQ ID NO: 85117 - DNA, 25 bp, Mus musculus
aatgtgctgtcccaacagctgtcaa

SEQ ID NO: 85118 - DNA, 25 bp, Mus musculus
aatgtgctgtccgaacagctgtcaa

SEQ ID NO: 85119 - DNA, 25 bp, Mus musculus
aatgtgctgtgtcggaatattcctc

SEQ ID NO: 85120 - DNA, 25 bp, Mus musculus
aatgtgctgtgtgggaatattcctc

SEQ ID NO: 85121 - DNA, 25 bp, Mus musculus
aatgtgcttaaccatctcagcgatg

SEQ ID NO: 85122 - DNA, 25 bp, Mus musculus
aatgtgcttaacgatctcagcgatg

SEQ ID NO: 85123 - DNA, 25 bp, Mus musculus
aatgtgcttcgcctgaccaagatgt

SEQ ID NO: 85124 - DNA, 25 bp, Mus musculus
aatgtgcttcgcgtgaccaagatgt

SEQ ID NO: 85125 - DNA, 25 bp, Mus musculus
aatgtgcttgtgaggaaagacccaa

SEQ ID NO: 85126 - DNA, 25 bp, Mus musculus
aatgtgcttgtgtggaaagacccaa

SEQ ID NO: 85127 - DNA, 25 bp, Mus musculus
aatgtgctttaaatacgttaccaat

SEQ ID NO: 85128 - DNA, 25 bp, Mus musculus
aatgtgctttaattacgttaccaat

SEQ ID NO: 85129 - DNA, 25 bp, Mus musculus
aatgtgctttgcagattaatcctag

SEQ ID NO: 85130 - DNA, 25 bp, Mus musculus
aatgtgctttgctgattaatcctag

SEQ ID NO: 85131 - DNA, 25 bp, Mus musculus
aatgtgcttttgcatcttagaaacc

SEQ ID NO: 85132 - DNA, 25 bp, Mus musculus
aatgtgcttttggatcttagaaacc

SEQ ID NO: 85133 - DNA, 25 bp, Mus musculus
aatgtggaacagctttccttgccta

SEQ ID NO: 85134 - DNA, 25 bp, Mus musculus
aatgtggaacaggtttccttgccta

SEQ ID NO: 85135 - DNA, 25 bp, Mus musculus
aatgtggaagacactccaggtcgcc

SEQ ID NO: 85136 - DNA, 25 bp, Mus musculus
aatgtggaagactctccaggtcgcc

SEQ ID NO: 85137 - DNA, 25 bp, Mus musculus
aatgtggaagcccatcacctgcagt

SEQ ID NO: 85138 - DNA, 25 bp, Mus musculus
aatgtggaagccgatcacctgcagt

SEQ ID NO: 85139 - DNA, 25 bp, Mus musculus
aatgtggaatctcctacctttcttt

SEQ ID NO: 85140 - DNA, 25 bp, Mus musculus
aatgtggaatctgctacctttcttt

SEQ ID NO: 85141 - DNA, 25 bp, Mus musculus
aatgtggaatttacactatttattc

SEQ ID NO: 85142 - DNA, 25 bp, Mus musculus
aatgtggaattttcactatttattc

SEQ ID NO: 85143 - DNA, 25 bp, Mus musculus
aatgtggaccgtccagtggccacac

SEQ ID NO: 85144 - DNA, 25 bp, Mus musculus
aatgtggaccgtgcagtggccacac

SEQ ID NO: 85145 - DNA, 25 bp, Mus musculus
aatgtggacggcatcatcggcgttg

SEQ ID NO: 85146 - DNA, 25 bp, Mus musculus
aatgtggacggcttcatcggcgttg

SEQ ID NO: 85147 - DNA, 25 bp, Mus musculus
aatgtggactgaactgccctgtaag

SEQ ID NO: 85148 - DNA, 25 bp, Mus musculus
aatgtggactgatctgccctgtaag

SEQ ID NO: 85149 - DNA, 25 bp, Mus musculus
aatgtggactggcagctttcaaagc

SEQ ID NO: 85150 - DNA, 25 bp, Mus musculus
aatgtggactgggagctttcaaagc

SEQ ID NO: 85151 - DNA, 25 bp, Mus musculus
aatgtggacttgaatatttgtacaa

SEQ ID NO: 85152 - DNA, 25 bp, Mus musculus
aatgtggacttgtatatttgtacaa

SEQ ID NO: 85153 - DNA, 25 bp, Mus musculus
aatgtggagaaccacaagctccctc

SEQ ID NO: 85154 - DNA, 25 bp, Mus musculus
aatgtggagaacgacaagctccctc

SEQ ID NO: 85155 - DNA, 25 bp, Mus musculus
aatgtggagactcactctgacttcc

SEQ ID NO: 85156 - DNA, 25 bp, Mus musculus
aatgtggagactgactctgacttcc

SEQ ID NO: 85157 - DNA, 25 bp, Mus musculus
aatgtggagattcctaagtcatcgc

SEQ ID NO: 85158 - DNA, 25 bp, Mus musculus
aatgtggagattgctaagtcatcgc

SEQ ID NO: 85159 - DNA, 25 bp, Mus musculus
aatgtggagctcagccgggaccaga

SEQ ID NO: 85160 - DNA, 25 bp, Mus musculus
aatgtggagctctgccgggaccaga

SEQ ID NO: 85161 - DNA, 25 bp, Mus musculus
aatgtggaggtcctgcaccacacta

SEQ ID NO: 85162 - DNA, 25 bp, Mus musculus
aatgtggaggtcgtgcaccacacta

SEQ ID NO: 85163 - DNA, 25 bp, Mus musculus
aatgtggatgttcttcacgcgcctg

SEQ ID NO: 85164 - DNA, 25 bp, Mus musculus
aatgtggatgttgttcacgcgcctg

SEQ ID NO: 85165 - DNA, 25 bp, Mus musculus
aatgtggcacatacccagtggcact

SEQ ID NO: 85166 - DNA, 25 bp, Mus musculus
aatgtggcacattcccagtggcact

SEQ ID NO: 85167 - DNA, 25 bp, Mus musculus
aatgtggcacttcctttgccaaaat

SEQ ID NO: 85168 - DNA, 25 bp, Mus musculus
aatgtggcacttgctttgccaaaat

SEQ ID NO: 85169 - DNA, 25 bp, Mus musculus
aatgtggcagcacctgacttttcta

SEQ ID NO: 85170 - DNA, 25 bp, Mus musculus
aatgtggcagcagctgacttttcta

SEQ ID NO: 85171 - DNA, 25 bp, Mus musculus
aatgtggcagccatcttagaactgg

SEQ ID NO: 85172 - DNA, 25 bp, Mus musculus
aatgtggcagccttcttagaactgg

SEQ ID NO: 85173 - DNA, 25 bp, Mus musculus
aatgtggcaggcaaacacctttacc

SEQ ID NO: 85174 - DNA, 25 bp, Mus musculus
aatgtggcaggctaacacctttacc

SEQ ID NO: 85175 - DNA, 25 bp, Mus musculus
aatgtggcagtaagcactggcctgt

SEQ ID NO: 85176 - DNA, 25 bp, Mus musculus
aatgtggcagtatgcactggcctgt

SEQ ID NO: 85177 - DNA, 25 bp, Mus musculus
aatgtggcagttaaacataccttca

SEQ ID NO: 85178 - DNA, 25 bp, Mus musculus
aatgtggcagtttaacataccttca

SEQ ID NO: 85179 - DNA, 25 bp, Mus musculus
aatgtggccacgacttctgtagcca

SEQ ID NO: 85180 - DNA, 25 bp, Mus musculus
aatgtggccacgtcttctgtagcca

SEQ ID NO: 85181 - DNA, 25 bp, Mus musculus
aatgtggccagactttccggcagca

SEQ ID NO: 85182 - DNA, 25 bp, Mus musculus
aatgtggccagagtttccggcagca

SEQ ID NO: 85183 - DNA, 25 bp, Mus musculus
aatgtggccctgatggcttataacc

SEQ ID NO: 85184 - DNA, 25 bp, Mus musculus
aatgtggccctgttggcttataacc

SEQ ID NO: 85185 - DNA, 25 bp, Mus musculus
aatgtggccgtcacaaaactacaaa

SEQ ID NO: 85186 - DNA, 25 bp, Mus musculus
aatgtggccgtctcaaaactacaaa

SEQ ID NO: 85187 - DNA, 25 bp, Mus musculus
aatgtggcctgtacccttgtatata

SEQ ID NO: 85188 - DNA, 25 bp, Mus musculus
aatgtggcctgttcccttgtatata

SEQ ID NO: 85189 - DNA, 25 bp, Mus musculus
aatgtggcctttaatctaaactata

SEQ ID NO: 85190 - DNA, 25 bp, Mus musculus
aatgtggccttttatctaaactata

SEQ ID NO: 85191 - DNA, 25 bp, Mus musculus
aatgtggctatccttcacctaccta

SEQ ID NO: 85192 - DNA, 25 bp, Mus musculus
aatgtggctatcgttcacctaccta

SEQ ID NO: 85193 - DNA, 25 bp, Mus musculus
aatgtggctctacctattgacccat

SEQ ID NO: 85194 - DNA, 25 bp, Mus musculus
aatgtggctctagctattgacccat

SEQ ID NO: 85195 - DNA, 25 bp, Mus musculus
aatgtggctgacattgttcatgtga

SEQ ID NO: 85196 - DNA, 25 bp, Mus musculus
aatgtggctgacctaatttaatccc

SEQ ID NO: 85197 - DNA, 25 bp, Mus musculus
aatgtggctgacgtaatttaatccc

SEQ ID NO: 85198 - DNA, 25 bp, Mus musculus
aatgtggctgactttgttcatgtga

SEQ ID NO: 85199 - DNA, 25 bp, Mus musculus
aatgtggctggcagttccaacccat

SEQ ID NO: 85200 - DNA, 25 bp, Mus musculus
aatgtggctggctgttccaacccat

SEQ ID NO: 85201 - DNA, 25 bp, Mus musculus
aatgtggcttcgaatccaggagccc

SEQ ID NO: 85202 - DNA, 25 bp, Mus musculus
aatgtggcttcgtatccaggagccc

SEQ ID NO: 85203 - DNA, 25 bp, Mus musculus
aatgtggcttggaggcagaactctt

SEQ ID NO: 85204 - DNA, 25 bp, Mus musculus
aatgtggcttggtggcagaactctt

SEQ ID NO: 85205 - DNA, 25 bp, Mus musculus
aatgtgggaccactcaccaggcagc

SEQ ID NO: 85206 - DNA, 25 bp, Mus musculus
aatgtgggaccagtcaccaggcagc

SEQ ID NO: 85207 - DNA, 25 bp, Mus musculus
aatgtgggacgaagtagcccagtgt

SEQ ID NO: 85208 - DNA, 25 bp, Mus musculus
aatgtgggacgatgtagcccagtgt

SEQ ID NO: 85209 - DNA, 25 bp, Mus musculus
aatgtgggaggtacacttccacccg

SEQ ID NO: 85210 - DNA, 25 bp, Mus musculus
aatgtgggaggttcacttccacccg

SEQ ID NO: 85211 - DNA, 25 bp, Mus musculus
aatgtgggatggactctggctccag

SEQ ID NO: 85212 - DNA, 25 bp, Mus musculus
aatgtgggatggtctctggctccag

SEQ ID NO: 85213 - DNA, 25 bp, Mus musculus
aatgtgggcaccagagactcggagc

SEQ ID NO: 85214 - DNA, 25 bp, Mus musculus
aatgtgggcaccagcggtgaagctc

SEQ ID NO: 85215 - DNA, 25 bp, Mus musculus
aatgtgggcacctgagactcggagc

SEQ ID NO: 85216 - DNA, 25 bp, Mus musculus
aatgtgggcacctgcggtgaagctc

SEQ ID NO: 85217 - DNA, 25 bp, Mus musculus
aatgtgggcagtatccttctggagc

SEQ ID NO: 85218 - DNA, 25 bp, Mus musculus
aatgtgggcagtttccttctggagc

SEQ ID NO: 85219 - DNA, 25 bp, Mus musculus
aatgtgggcgccaactacgcagtta

SEQ ID NO: 85220 - DNA, 25 bp, Mus musculus
aatgtgggcgcctactacgcagtta

SEQ ID NO: 85221 - DNA, 25 bp, Mus musculus
aatgtgggcgtgattctatactcaa

SEQ ID NO: 85222 - DNA, 25 bp, Mus musculus
aatgtgggcgtgtttctatactcaa

SEQ ID NO: 85223 - DNA, 25 bp, Mus musculus
aatgtgggctctagggctgtgcact

SEQ ID NO: 85224 - DNA, 25 bp, Mus musculus
aatgtgggctcttgggctgtgcact

SEQ ID NO: 85225 - DNA, 25 bp, Mus musculus
aatgtgggtacgcatgtgcccagta

SEQ ID NO: 85226 - DNA, 25 bp, Mus musculus
aatgtgggtacggatgtgcccagta

SEQ ID NO: 85227 - DNA, 25 bp, Mus musculus
aatgtgggtcatagagctggctgtt

SEQ ID NO: 85228 - DNA, 25 bp, Mus musculus
aatgtgggtcattgagctggctgtt

SEQ ID NO: 85229 - DNA, 25 bp, Mus musculus
aatgtgggtctgcagtgcctgtcac

SEQ ID NO: 85230 - DNA, 25 bp, Mus musculus
aatgtgggtctggagtgcctgtcac

SEQ ID NO: 85231 - DNA, 25 bp, Mus musculus
aatgtgggttatattctggccccgc

SEQ ID NO: 85232 - DNA, 25 bp, Mus musculus
aatgtgggttattttctggccccgc

SEQ ID NO: 85233 - DNA, 25 bp, Mus musculus
aatgtggtaaacatgtgtgtggacc

SEQ ID NO: 85234 - DNA, 25 bp, Mus musculus
aatgtggtaaacttgtgtgtggacc

SEQ ID NO: 85235 - DNA, 25 bp, Mus musculus
aatgtggtaactactaggtgccccg

SEQ ID NO: 85236 - DNA, 25 bp, Mus musculus
aatgtggtaacttctaggtgccccg

SEQ ID NO: 85237 - DNA, 25 bp, Mus musculus
aatgtggtaccacgaaaggagctat

SEQ ID NO: 85238 - DNA, 25 bp, Mus musculus
aatgtggtaccaggaaaggagctat

SEQ ID NO: 85239 - DNA, 25 bp, Mus musculus
aatgtggtactcaagctggcttctt

SEQ ID NO: 85240 - DNA, 25 bp, Mus musculus
aatgtggtactctagctggcttctt

SEQ ID NO: 85241 - DNA, 25 bp, Mus musculus
aatgtggtagagacagttcagcaaa

SEQ ID NO: 85242 - DNA, 25 bp, Mus musculus
aatgtggtagagtcagttcagcaaa

SEQ ID NO: 85243 - DNA, 25 bp, Mus musculus
aatgtggtatccatgtggttctgcc

SEQ ID NO: 85244 - DNA, 25 bp, Mus musculus
aatgtggtatccttgtggttctgcc

SEQ ID NO: 85245 - DNA, 25 bp, Mus musculus
aatgtggtatgcagacgagtctgat

SEQ ID NO: 85246 - DNA, 25 bp, Mus musculus
aatgtggtatgctgacgagtctgat

SEQ ID NO: 85247 - DNA, 25 bp, Mus musculus
aatgtggtcattaagttctgtgtct

SEQ ID NO: 85248 - DNA, 25 bp, Mus musculus
aatgtggtcatttagttctgtgtct

SEQ ID NO: 85249 - DNA, 25 bp, Mus musculus
aatgtggtccacagaagaatttcaa

SEQ ID NO: 85250 - DNA, 25 bp, Mus musculus
aatgtggtccactgaagaatttcaa

SEQ ID NO: 85251 - DNA, 25 bp, Mus musculus
aatgtggtccagagagcacacccat

SEQ ID NO: 85252 - DNA, 25 bp, Mus musculus
aatgtggtccagtgagcacacccat

SEQ ID NO: 85253 - DNA, 25 bp, Mus musculus
aatgtggtccgacttcttttatcta

SEQ ID NO: 85254 - DNA, 25 bp, Mus musculus
aatgtggtccgagttcttttatcta

SEQ ID NO: 85255 - DNA, 25 bp, Mus musculus
aatgtggtctgcatctgggtgaacc

SEQ ID NO: 85256 - DNA, 25 bp, Mus musculus
aatgtggtctgccaacctgtacaaa

SEQ ID NO: 85257 - DNA, 25 bp, Mus musculus
aatgtggtctgcgaacctgtacaaa

SEQ ID NO: 85258 - DNA, 25 bp, Mus musculus
aatgtggtctgcttctgggtgaacc

SEQ ID NO: 85259 - DNA, 25 bp, Mus musculus
aatgtggtctttctgggcacggtca

SEQ ID NO: 85260 - DNA, 25 bp, Mus musculus
aatgtggtctttgtgggcacggtca

SEQ ID NO: 85261 - DNA, 25 bp, Mus musculus
aatgtggtgaccaattctgtcctgc

SEQ ID NO: 85262 - DNA, 25 bp, Mus musculus
aatgtggtgacctattctgtcctgc

SEQ ID NO: 85263 - DNA, 25 bp, Mus musculus
aatgtggtgagcacaaggcccagcg

SEQ ID NO: 85264 - DNA, 25 bp, Mus musculus
aatgtggtgagctcaaggcccagcg

SEQ ID NO: 85265 - DNA, 25 bp, Mus musculus
aatgtggtgcttcccgaactaatag

SEQ ID NO: 85266 - DNA, 25 bp, Mus musculus
aatgtggtgcttgccgaactaatag

SEQ ID NO: 85267 - DNA, 25 bp, Mus musculus
aatgtggtgttactcgttctgggtc

SEQ ID NO: 85268 - DNA, 25 bp, Mus musculus
aatgtggtgttagtcgttctgggtc

SEQ ID NO: 85269 - DNA, 25 bp, Mus musculus
aatgtggttcatctcaaagcccttt

SEQ ID NO: 85270 - DNA, 25 bp, Mus musculus
aatgtggttcatgtcaaagcccttt

SEQ ID NO: 85271 - DNA, 25 bp, Mus musculus
aatgtggttcctattcatgttccgc

SEQ ID NO: 85272 - DNA, 25 bp, Mus musculus
aatgtggttccttttcatgttccgc

SEQ ID NO: 85273 - DNA, 25 bp, Mus musculus
aatgtggttcgtctccaacaagtac

SEQ ID NO: 85274 - DNA, 25 bp, Mus musculus
aatgtggttcgtgtccaacaagtac

SEQ ID NO: 85275 - DNA, 25 bp, Mus musculus
aatgtggttgccctgtattaaagct

SEQ ID NO: 85276 - DNA, 25 bp, Mus musculus
aatgtggttgccgtgtattaaagct

SEQ ID NO: 85277 - DNA, 25 bp, Mus musculus
aatgtggttggaagtctcagtcttc

SEQ ID NO: 85278 - DNA, 25 bp, Mus musculus
aatgtggttggatgtctcagtcttc

SEQ ID NO: 85279 - DNA, 25 bp, Mus musculus
aatgtggtttcccttagacccagct

SEQ ID NO: 85280 - DNA, 25 bp, Mus musculus
aatgtggtttccgttagacccagct

SEQ ID NO: 85281 - DNA, 25 bp, Mus musculus
aatgtggtttctccacatctggtct

SEQ ID NO: 85282 - DNA, 25 bp, Mus musculus
aatgtggtttctgcacatctggtct

SEQ ID NO: 85283 - DNA, 25 bp, Mus musculus
aatgtggttttgacagtcctttctg

SEQ ID NO: 85284 - DNA, 25 bp, Mus musculus
aatgtggttttgtcagtcctttctg

SEQ ID NO: 85285 - DNA, 25 bp, Mus musculus
aatgtgtaacacatcctctgaaatg

SEQ ID NO: 85286 - DNA, 25 bp, Mus musculus
aatgtgtaacacttcctctgaaatg

SEQ ID NO: 85287 - DNA, 25 bp, Mus musculus
aatgtgtaacatctgaccttccatc

SEQ ID NO: 85288 - DNA, 25 bp, Mus musculus
aatgtgtaacatgtgaccttccatc

SEQ ID NO: 85289 - DNA, 25 bp, Mus musculus
aatgtgtaagtcaaggcagtcctga

SEQ ID NO: 85290 - DNA, 25 bp, Mus musculus
aatgtgtaagtctaggcagtcctga

SEQ ID NO: 85291 - DNA, 25 bp, Mus musculus
aatgtgtacagtagacttctgggaa

SEQ ID NO: 85292 - DNA, 25 bp, Mus musculus
aatgtgtacagttgacttctgggaa

SEQ ID NO: 85293 - DNA, 25 bp, Mus musculus
aatgtgtacatccaattgtccctca

SEQ ID NO: 85294 - DNA, 25 bp, Mus musculus
aatgtgtacatcgaattgtccctca

SEQ ID NO: 85295 - DNA, 25 bp, Mus musculus
aatgtgtacattagtctatcctgaa

SEQ ID NO: 85296 - DNA, 25 bp, Mus musculus
aatgtgtacatttgtctatcctgaa

SEQ ID NO: 85297 - DNA, 25 bp, Mus musculus
aatgtgtacccacaagacatgattg

SEQ ID NO: 85298 - DNA, 25 bp, Mus musculus
aatgtgtacccagaagacatgattg

SEQ ID NO: 85299 - DNA, 25 bp, Mus musculus
aatgtgtactacctacaagtcctag

SEQ ID NO: 85300 - DNA, 25 bp, Mus musculus
aatgtgtactacgtacaagtcctag

SEQ ID NO: 85301 - DNA, 25 bp, Mus musculus
aatgtgtactgtaaccttgtatgaa

SEQ ID NO: 85302 - DNA, 25 bp, Mus musculus
aatgtgtactgttaccttgtatgaa

SEQ ID NO: 85303 - DNA, 25 bp, Mus musculus
aatgtgtagagcaggtgatgtttca

SEQ ID NO: 85304 - DNA, 25 bp, Mus musculus
aatgtgtagagctggtgatgtttca

SEQ ID NO: 85305 - DNA, 25 bp, Mus musculus
aatgtgtagctgagaccatggtctg

SEQ ID NO: 85306 - DNA, 25 bp, Mus musculus
aatgtgtagctgtgaccatggtctg

SEQ ID NO: 85307 - DNA, 25 bp, Mus musculus
aatgtgtagttcaccctgtagagat

SEQ ID NO: 85308 - DNA, 25 bp, Mus musculus
aatgtgtagttctccctgtagagat

SEQ ID NO: 85309 - DNA, 25 bp, Mus musculus
aatgtgtatcagactcttacctcct

SEQ ID NO: 85310 - DNA, 25 bp, Mus musculus
aatgtgtatcagtctcttacctcct

SEQ ID NO: 85311 - DNA, 25 bp, Mus musculus
aatgtgtatcctcgcagcatgtctc

SEQ ID NO: 85312 - DNA, 25 bp, Mus musculus
aatgtgtatcctggcagcatgtctc

SEQ ID NO: 85313 - DNA, 25 bp, Mus musculus
aatgtgtatgatcgctcttggcatc

SEQ ID NO: 85314 - DNA, 25 bp, Mus musculus
aatgtgtatgatggctcttggcatc

SEQ ID NO: 85315 - DNA, 25 bp, Mus musculus
aatgtgtcaatcactcagccagagt

SEQ ID NO: 85316 - DNA, 25 bp, Mus musculus
aatgtgtcaatctctcagccagagt

SEQ ID NO: 85317 - DNA, 25 bp, Mus musculus
aatgtgtcactaaaagttccatcaa

SEQ ID NO: 85318 - DNA, 25 bp, Mus musculus
aatgtgtcactaaagcatgttccta

SEQ ID NO: 85319 - DNA, 25 bp, Mus musculus
aatgtgtcactataagttccatcaa

SEQ ID NO: 85320 - DNA, 25 bp, Mus musculus
aatgtgtcactatagcatgttccta

SEQ ID NO: 85321 - DNA, 25 bp, Mus musculus
aatgtgtcactgaagtatgcctgag

SEQ ID NO: 85322 - DNA, 25 bp, Mus musculus
aatgtgtcactgtagtatgcctgag

SEQ ID NO: 85323 - DNA, 25 bp, Mus musculus
aatgtgtcagacagatccttcctga

SEQ ID NO: 85324 - DNA, 25 bp, Mus musculus
aatgtgtcagactgatccttcctga

SEQ ID NO: 85325 - DNA, 25 bp, Mus musculus
aatgtgtcagatcttctctataagc

SEQ ID NO: 85326 - DNA, 25 bp, Mus musculus
aatgtgtcagatgttctctataagc

SEQ ID NO: 85327 - DNA, 25 bp, Mus musculus
aatgtgtcagtaatggatgcagtca

SEQ ID NO: 85328 - DNA, 25 bp, Mus musculus
aatgtgtcagtaattcagggttcta

SEQ ID NO: 85329 - DNA, 25 bp, Mus musculus
aatgtgtcagtattggatgcagtca

SEQ ID NO: 85330 - DNA, 25 bp, Mus musculus
aatgtgtcagtatttcagggttcta

SEQ ID NO: 85331 - DNA, 25 bp, Mus musculus
aatgtgtcagtccacatccactaag

SEQ ID NO: 85332 - DNA, 25 bp, Mus musculus
aatgtgtcagtcgacatccactaag

SEQ ID NO: 85333 - DNA, 25 bp, Mus musculus
aatgtgtcatttccggctgctgtat

SEQ ID NO: 85334 - DNA, 25 bp, Mus musculus
aatgtgtcatttgcggctgctgtat

SEQ ID NO: 85335 - DNA, 25 bp, Mus musculus
aatgtgtccagtccacactctgtaa

SEQ ID NO: 85336 - DNA, 25 bp, Mus musculus
aatgtgtccagtgcacactctgtaa

SEQ ID NO: 85337 - DNA, 25 bp, Mus musculus
aatgtgtccatcatgattcaccctg

SEQ ID NO: 85338 - DNA, 25 bp, Mus musculus
aatgtgtccatcttgattcaccctg

SEQ ID NO: 85339 - DNA, 25 bp, Mus musculus
aatgtgtcccaacctactttgtgga

SEQ ID NO: 85340 - DNA, 25 bp, Mus musculus
aatgtgtcccaagctactttgtgga

SEQ ID NO: 85341 - DNA, 25 bp, Mus musculus
aatgtgtcccagcaactgtcagcgt

SEQ ID NO: 85342 - DNA, 25 bp, Mus musculus
aatgtgtcccaggaactgtcagcgt

SEQ ID NO: 85343 - DNA, 25 bp, Mus musculus
aatgtgtcccgtatagcacagcact

SEQ ID NO: 85344 - DNA, 25 bp, Mus musculus
aatgtgtcccgtttagcacagcact

SEQ ID NO: 85345 - DNA, 25 bp, Mus musculus
aatgtgtccgacatcccggagagga

SEQ ID NO: 85346 - DNA, 25 bp, Mus musculus
aatgtgtccgacttcccggagagga

SEQ ID NO: 85347 - DNA, 25 bp, Mus musculus
aatgtgtctacaaatgctttgttat

SEQ ID NO: 85348 - DNA, 25 bp, Mus musculus
aatgtgtctacatatgctttgttat

SEQ ID NO: 85349 - DNA, 25 bp, Mus musculus
aatgtgtctaccatgctgctcttgt

SEQ ID NO: 85350 - DNA, 25 bp, Mus musculus
aatgtgtctaccttgctgctcttgt

SEQ ID NO: 85351 - DNA, 25 bp, Mus musculus
aatgtgtctccaaaggctatgtctt

SEQ ID NO: 85352 - DNA, 25 bp, Mus musculus
aatgtgtctccataggctatgtctt

SEQ ID NO: 85353 - DNA, 25 bp, Mus musculus
aatgtgtctgcactgtagtttgtcc

SEQ ID NO: 85354 - DNA, 25 bp, Mus musculus
aatgtgtctgcagtgtagtttgtcc

SEQ ID NO: 85355 - DNA, 25 bp, Mus musculus
aatgtgtctgttaagcttcccatca

SEQ ID NO: 85356 - DNA, 25 bp, Mus musculus
aatgtgtctgtttagcttcccatca

SEQ ID NO: 85357 - DNA, 25 bp, Mus musculus
aatgtgtcttcaacattgcggagat

SEQ ID NO: 85358 - DNA, 25 bp, Mus musculus
aatgtgtcttcatcattgcggagat

SEQ ID NO: 85359 - DNA, 25 bp, Mus musculus
aatgtgtcttggcttctagcaaagt

SEQ ID NO: 85360 - DNA, 25 bp, Mus musculus
aatgtgtcttgggttctagcaaagt

SEQ ID NO: 85361 - DNA, 25 bp, Mus musculus
aatgtgtgacgtaccagctgtttaa

SEQ ID NO: 85362 - DNA, 25 bp, Mus musculus
aatgtgtgacgttccagctgtttaa

SEQ ID NO: 85363 - DNA, 25 bp, Mus musculus
aatgtgtgactacactgtttattta

SEQ ID NO: 85364 - DNA, 25 bp, Mus musculus
aatgtgtgactagactgtttattta

SEQ ID NO: 85365 - DNA, 25 bp, Mus musculus
aatgtgtgatggctgcctttgttat

SEQ ID NO: 85366 - DNA, 25 bp, Mus musculus
aatgtgtgatgggtgcctttgttat

SEQ ID NO: 85367 - DNA, 25 bp, Mus musculus
aatgtgtgcacccagaaactctttg

SEQ ID NO: 85368 - DNA, 25 bp, Mus musculus
aatgtgtgcaccgagaaactctttg

SEQ ID NO: 85369 - DNA, 25 bp, Mus musculus
aatgtgtgcagcagagtcggcctgt

SEQ ID NO: 85370 - DNA, 25 bp, Mus musculus
aatgtgtgcagcatggtcttcctaa

SEQ ID NO: 85371 - DNA, 25 bp, Mus musculus
aatgtgtgcagctgagtcggcctgt

SEQ ID NO: 85372 - DNA, 25 bp, Mus musculus
aatgtgtgcagcttggtcttcctaa

SEQ ID NO: 85373 - DNA, 25 bp, Mus musculus
aatgtgtgcctgaagtctccgaggg

SEQ ID NO: 85374 - DNA, 25 bp, Mus musculus
aatgtgtgcctgcatgggtacagct

SEQ ID NO: 85375 - DNA, 25 bp, Mus musculus
aatgtgtgcctggatgggtacagct

SEQ ID NO: 85376 - DNA, 25 bp, Mus musculus
aatgtgtgcctgtagtctccgaggg

SEQ ID NO: 85377 - DNA, 25 bp, Mus musculus
aatgtgtgcggcattgaacctgatc

SEQ ID NO: 85378 - DNA, 25 bp, Mus musculus
aatgtgtgcggctttgaacctgatc

SEQ ID NO: 85379 - DNA, 25 bp, Mus musculus
aatgtgtgctctagcatgccttgtt

SEQ ID NO: 85380 - DNA, 25 bp, Mus musculus
aatgtgtgctcttgcatgccttgtt

SEQ ID NO: 85381 - DNA, 25 bp, Mus musculus
aatgtgtggcctattctatgacgca

SEQ ID NO: 85382 - DNA, 25 bp, Mus musculus
aatgtgtggccttttctatgacgca

SEQ ID NO: 85383 - DNA, 25 bp, Mus musculus
aatgtgtggctccagactttgcatc

SEQ ID NO: 85384 - DNA, 25 bp, Mus musculus
aatgtgtggctcgagactttgcatc

SEQ ID NO: 85385 - DNA, 25 bp, Mus musculus
aatgtgtgggatagcagcacccttc

SEQ ID NO: 85386 - DNA, 25 bp, Mus musculus
aatgtgtgggattgcagcacccttc

SEQ ID NO: 85387 - DNA, 25 bp, Mus musculus
aatgtgtgtaacagacagggcctaa

SEQ ID NO: 85388 - DNA, 25 bp, Mus musculus
aatgtgtgtaactgacagggcctaa

SEQ ID NO: 85389 - DNA, 25 bp, Mus musculus
aatgtgtgtaatattgacgggtgga

SEQ ID NO: 85390 - DNA, 25 bp, Mus musculus
aatgtgtgtaattttgacgggtgga

SEQ ID NO: 85391 - DNA, 25 bp, Mus musculus
aatgtgtgtagaaacgctcttcctc

SEQ ID NO: 85392 - DNA, 25 bp, Mus musculus
aatgtgtgtagatacgctcttcctc

SEQ ID NO: 85393 - DNA, 25 bp, Mus musculus
aatgtgtgtcacacttggagtagat

SEQ ID NO: 85394 - DNA, 25 bp, Mus musculus
aatgtgtgtcactcttggagtagat

SEQ ID NO: 85395 - DNA, 25 bp, Mus musculus
aatgtgtgtctaacatatttttctt

SEQ ID NO: 85396 - DNA, 25 bp, Mus musculus
aatgtgtgtctatcatatttttctt

SEQ ID NO: 85397 - DNA, 25 bp, Mus musculus
aatgtgtgtgccagggatcctgaag

SEQ ID NO: 85398 - DNA, 25 bp, Mus musculus
aatgtgtgtgcctgggatcctgaag

SEQ ID NO: 85399 - DNA, 25 bp, Mus musculus
aatgtgttacaaacgcttctggaat

SEQ ID NO: 85400 - DNA, 25 bp, Mus musculus
aatgtgttacaatcgcttctggaat

SEQ ID NO: 85401 - DNA, 25 bp, Mus musculus
aatgtgttaggcactgtgttgatga

SEQ ID NO: 85402 - DNA, 25 bp, Mus musculus
aatgtgttaggctctgtgttgatga

SEQ ID NO: 85403 - DNA, 25 bp, Mus musculus
aatgtgttcaagaccttctcttata

SEQ ID NO: 85404 - DNA, 25 bp, Mus musculus
aatgtgttcaagtccttctcttata

SEQ ID NO: 85405 - DNA, 25 bp, Mus musculus
aatgtgttcagtctcccacggtgac

SEQ ID NO: 85406 - DNA, 25 bp, Mus musculus
aatgtgttcagtgtcccacggtgac

SEQ ID NO: 85407 - DNA, 25 bp, Mus musculus
aatgtgttccataactgccaatttc

SEQ ID NO: 85408 - DNA, 25 bp, Mus musculus
aatgtgttccattactgccaatttc

SEQ ID NO: 85409 - DNA, 25 bp, Mus musculus
aatgtgttccctaagtgttcatcag

SEQ ID NO: 85410 - DNA, 25 bp, Mus musculus
aatgtgttcccttagtgttcatcag

SEQ ID NO: 85411 - DNA, 25 bp, Mus musculus
aatgtgttccttctttgtacctgcc

SEQ ID NO: 85412 - DNA, 25 bp, Mus musculus
aatgtgttccttgtttgtacctgcc

SEQ ID NO: 85413 - DNA, 25 bp, Mus musculus
aatgtgttcttaatcctgattctaa

SEQ ID NO: 85414 - DNA, 25 bp, Mus musculus
aatgtgttcttattcctgattctaa

SEQ ID NO: 85415 - DNA, 25 bp, Mus musculus
aatgtgttgcccaaccaaagcttcc

SEQ ID NO: 85416 - DNA, 25 bp, Mus musculus
aatgtgttgccctaccaaagcttcc

SEQ ID NO: 85417 - DNA, 25 bp, Mus musculus
aatgtgttgcgacaagtggaaccat

SEQ ID NO: 85418 - DNA, 25 bp, Mus musculus
aatgtgttgcgagaagtggaaccat

SEQ ID NO: 85419 - DNA, 25 bp, Mus musculus
aatgtgttgctaacgcttctattgc

SEQ ID NO: 85420 - DNA, 25 bp, Mus musculus
aatgtgttgctatcgcttctattgc

SEQ ID NO: 85421 - DNA, 25 bp, Mus musculus
aatgtgttgttaaggcctgtgcaga

SEQ ID NO: 85422 - DNA, 25 bp, Mus musculus
aatgtgttgttatggcctgtgcaga

SEQ ID NO: 85423 - DNA, 25 bp, Mus musculus
aatgtgtttcctagttctgaccaca

SEQ ID NO: 85424 - DNA, 25 bp, Mus musculus
aatgtgtttccttgttctgaccaca

SEQ ID NO: 85425 - DNA, 25 bp, Mus musculus
aatgtgtttctaaaatccctctatt

SEQ ID NO: 85426 - DNA, 25 bp, Mus musculus
aatgtgtttctataatccctctatt

SEQ ID NO: 85427 - DNA, 25 bp, Mus musculus
aatgtgtttgtcagggagcacctgc

SEQ ID NO: 85428 - DNA, 25 bp, Mus musculus
aatgtgtttgtctgggagcacctgc

SEQ ID NO: 85429 - DNA, 25 bp, Mus musculus
aatgtgtttgtgcacatgagcacct

SEQ ID NO: 85430 - DNA, 25 bp, Mus musculus
aatgtgtttgtggacatgagcacct

SEQ ID NO: 85431 - DNA, 25 bp, Mus musculus
aatgttaaaaagcatgcgggcaggg

SEQ ID NO: 85432 - DNA, 25 bp, Mus musculus
aatgttaaaaaggatgcgggcaggg

SEQ ID NO: 85433 - DNA, 25 bp, Mus musculus
aatgttaaaacgaactgggcctatg

SEQ ID NO: 85434 - DNA, 25 bp, Mus musculus
aatgttaaaacgtactgggcctatg

SEQ ID NO: 85435 - DNA, 25 bp, Mus musculus
aatgttaaacccatgatgcttctct

SEQ ID NO: 85436 - DNA, 25 bp, Mus musculus
aatgttaaacccttgatgcttctct

SEQ ID NO: 85437 - DNA, 25 bp, Mus musculus
aatgttaaatccaacaacccaccat

SEQ ID NO: 85438 - DNA, 25 bp, Mus musculus
aatgttaaatcctacaacccaccat

SEQ ID NO: 85439 - DNA, 25 bp, Mus musculus
aatgttaaatgtatcttgtctggtc

SEQ ID NO: 85440 - DNA, 25 bp, Mus musculus
aatgttaaatgtttcttgtctggtc

SEQ ID NO: 85441 - DNA, 25 bp, Mus musculus
aatgttaacattattcattcccctg

SEQ ID NO: 85442 - DNA, 25 bp, Mus musculus
aatgttaacatttttcattcccctg

SEQ ID NO: 85443 - DNA, 25 bp, Mus musculus
aatgttaactatctactgggtaggt

SEQ ID NO: 85444 - DNA, 25 bp, Mus musculus
aatgttaactatgtactgggtaggt

SEQ ID NO: 85445 - DNA, 25 bp, Mus musculus
aatgttaactctatgctacctttcc

SEQ ID NO: 85446 - DNA, 25 bp, Mus musculus
aatgttaactctttgctacctttcc

SEQ ID NO: 85447 - DNA, 25 bp, Mus musculus
aatgttaaggatcttcgaccacgag

SEQ ID NO: 85448 - DNA, 25 bp, Mus musculus
aatgttaaggatgttcgaccacgag

SEQ ID NO: 85449 - DNA, 25 bp, Mus musculus
aatgttaaggttcagtgtcaggcaa

SEQ ID NO: 85450 - DNA, 25 bp, Mus musculus
aatgttaaggttgagtgtcaggcaa

SEQ ID NO: 85451 - DNA, 25 bp, Mus musculus
aatgttaagtggaaactcggatact

SEQ ID NO: 85452 - DNA, 25 bp, Mus musculus
aatgttaagtggtaactcggatact

SEQ ID NO: 85453 - DNA, 25 bp, Mus musculus
aatgttaatgagaactctctctggc

SEQ ID NO: 85454 - DNA, 25 bp, Mus musculus
aatgttaatgagtactctctctggc

SEQ ID NO: 85455 - DNA, 25 bp, Mus musculus
aatgttaattgtctggaatccacga

SEQ ID NO: 85456 - DNA, 25 bp, Mus musculus
aatgttaattgtgtggaatccacga

SEQ ID NO: 85457 - DNA, 25 bp, Mus musculus
aatgttacaacacatatatttttta

SEQ ID NO: 85458 - DNA, 25 bp, Mus musculus
aatgttacaacagatatatttttta

SEQ ID NO: 85459 - DNA, 25 bp, Mus musculus
aatgttacaagccagcaaatgctgc

SEQ ID NO: 85460 - DNA, 25 bp, Mus musculus
aatgttacaagcgagcaaatgctgc

SEQ ID NO: 85461 - DNA, 25 bp, Mus musculus
aatgttacagacagctgcctctctg

SEQ ID NO: 85462 - DNA, 25 bp, Mus musculus
aatgttacagactgctgcctctctg

SEQ ID NO: 85463 - DNA, 25 bp, Mus musculus
aatgttacagcacctggcttagctc

SEQ ID NO: 85464 - DNA, 25 bp, Mus musculus
aatgttacagcagctggcttagctc

SEQ ID NO: 85465 - DNA, 25 bp, Mus musculus
aatgttacatacatctatgcataga

SEQ ID NO: 85466 - DNA, 25 bp, Mus musculus
aatgttacatacttctatgcataga

SEQ ID NO: 85467 - DNA, 25 bp, Mus musculus
aatgttacatgtacacgggtgtgac

SEQ ID NO: 85468 - DNA, 25 bp, Mus musculus
aatgttacatgttcacgggtgtgac

SEQ ID NO: 85469 - DNA, 25 bp, Mus musculus
aatgttaccactccgaagttaccaa

SEQ ID NO: 85470 - DNA, 25 bp, Mus musculus
aatgttaccactgcgaagttaccaa

SEQ ID NO: 85471 - DNA, 25 bp, Mus musculus
aatgttacccacaaggcagttcctt

SEQ ID NO: 85472 - DNA, 25 bp, Mus musculus
aatgttacccactaggcagttcctt

SEQ ID NO: 85473 - DNA, 25 bp, Mus musculus
aatgttacctagctgagttttgtta

SEQ ID NO: 85474 - DNA, 25 bp, Mus musculus
aatgttacctaggtgagttttgtta

SEQ ID NO: 85475 - DNA, 25 bp, Mus musculus
aatgttacgaccatggctgttttca

SEQ ID NO: 85476 - DNA, 25 bp, Mus musculus
aatgttacgaccttggctgttttca

SEQ ID NO: 85477 - DNA, 25 bp, Mus musculus
aatgttacgatgacctcatggtcag

SEQ ID NO: 85478 - DNA, 25 bp, Mus musculus
aatgttacgatgtcctcatggtcag

SEQ ID NO: 85479 - DNA, 25 bp, Mus musculus
aatgttactaccactttgaagatac

SEQ ID NO: 85480 - DNA, 25 bp, Mus musculus
aatgttactacctctttgaagatac

SEQ ID NO: 85481 - DNA, 25 bp, Mus musculus
aatgttactatacctttcctatgag

SEQ ID NO: 85482 - DNA, 25 bp, Mus musculus
aatgttactatagctttcctatgag

SEQ ID NO: 85483 - DNA, 25 bp, Mus musculus
aatgttactattattctgatgacca

SEQ ID NO: 85484 - DNA, 25 bp, Mus musculus
aatgttactatttttctgatgacca

SEQ ID NO: 85485 - DNA, 25 bp, Mus musculus
aatgttactgtcactaagtgtctgt

SEQ ID NO: 85486 - DNA, 25 bp, Mus musculus
aatgttactgtctctaagtgtctgt

SEQ ID NO: 85487 - DNA, 25 bp, Mus musculus
aatgttacttcaaatcttctaaata

SEQ ID NO: 85488 - DNA, 25 bp, Mus musculus
aatgttacttcatatcttctaaata

SEQ ID NO: 85489 - DNA, 25 bp, Mus musculus
aatgttagattcatgtccctgggaa

SEQ ID NO: 85490 - DNA, 25 bp, Mus musculus
aatgttagattcttgtccctgggaa

SEQ ID NO: 85491 - DNA, 25 bp, Mus musculus
aatgttagcacgagagagagaaggt

SEQ ID NO: 85492 - DNA, 25 bp, Mus musculus
aatgttagcacgtgagagagaaggt

SEQ ID NO: 85493 - DNA, 25 bp, Mus musculus
aatgttagcatcaagcctctgcttt

SEQ ID NO: 85494 - DNA, 25 bp, Mus musculus
aatgttagcatctagcctctgcttt

SEQ ID NO: 85495 - DNA, 25 bp, Mus musculus
aatgttagccatatgtcctatgaaa

SEQ ID NO: 85496 - DNA, 25 bp, Mus musculus
aatgttagccatttgtcctatgaaa

SEQ ID NO: 85497 - DNA, 25 bp, Mus musculus
aatgttagctgtatgcctctactac

SEQ ID NO: 85498 - DNA, 25 bp, Mus musculus
aatgttagctgtttgcctctactac

SEQ ID NO: 85499 - DNA, 25 bp, Mus musculus
aatgttaggcttatccatgcgggat

SEQ ID NO: 85500 - DNA, 25 bp, Mus musculus
aatgttaggcttttccatgcgggat

SEQ ID NO: 85501 - DNA, 25 bp, Mus musculus
aatgttagtcacacgttcggtcact

SEQ ID NO: 85502 - DNA, 25 bp, Mus musculus
aatgttagtcactcgttcggtcact

SEQ ID NO: 85503 - DNA, 25 bp, Mus musculus
aatgttagtggactctgattttttc

SEQ ID NO: 85504 - DNA, 25 bp, Mus musculus
aatgttagtggagtctgattttttc

SEQ ID NO: 85505 - DNA, 25 bp, Mus musculus
aatgttagtggtctaaccgtccagg

SEQ ID NO: 85506 - DNA, 25 bp, Mus musculus
aatgttagtggtgtaaccgtccagg

SEQ ID NO: 85507 - DNA, 25 bp, Mus musculus
aatgttagtttgctcatctatgatc

SEQ ID NO: 85508 - DNA, 25 bp, Mus musculus
aatgttagtttgctccatgacccaa

SEQ ID NO: 85509 - DNA, 25 bp, Mus musculus
aatgttagtttggtcatctatgatc

SEQ ID NO: 85510 - DNA, 25 bp, Mus musculus
aatgttagtttggtccatgacccaa

SEQ ID NO: 85511 - DNA, 25 bp, Mus musculus
aatgttataacaatgtcctcctgca

SEQ ID NO: 85512 - DNA, 25 bp, Mus musculus
aatgttataacattgtcctcctgca

SEQ ID NO: 85513 - DNA, 25 bp, Mus musculus
aatgttataaccagcctcagaggcc

SEQ ID NO: 85514 - DNA, 25 bp, Mus musculus
aatgttataacctgcctcagaggcc

SEQ ID NO: 85515 - DNA, 25 bp, Mus musculus
aatgttatacttccagccttttcca

SEQ ID NO: 85516 - DNA, 25 bp, Mus musculus
aatgttatacttgcagccttttcca

SEQ ID NO: 85517 - DNA, 25 bp, Mus musculus
aatgttatcccgaatgtcctcggtc

SEQ ID NO: 85518 - DNA, 25 bp, Mus musculus
aatgttatcccgtatgtcctcggtc

SEQ ID NO: 85519 - DNA, 25 bp, Mus musculus
aatgttatctctagacccaaaatgc

SEQ ID NO: 85520 - DNA, 25 bp, Mus musculus
aatgttatctctcaagtgttggctt

SEQ ID NO: 85521 - DNA, 25 bp, Mus musculus
aatgttatctctgaagtgttggctt

SEQ ID NO: 85522 - DNA, 25 bp, Mus musculus
aatgttatctcttgacccaaaatgc

SEQ ID NO: 85523 - DNA, 25 bp, Mus musculus
aatgttatcttgagtagccagttag

SEQ ID NO: 85524 - DNA, 25 bp, Mus musculus
aatgttatcttgtgtagccagttag

SEQ ID NO: 85525 - DNA, 25 bp, Mus musculus
aatgttatctttatggtcatccata

SEQ ID NO: 85526 - DNA, 25 bp, Mus musculus
aatgttatctttttggtcatccata

SEQ ID NO: 85527 - DNA, 25 bp, Mus musculus
aatgttatggatctccacctcctga

SEQ ID NO: 85528 - DNA, 25 bp, Mus musculus
aatgttatggatgtccacctcctga

SEQ ID NO: 85529 - DNA, 25 bp, Mus musculus
aatgttatggctatactttggtcaa

SEQ ID NO: 85530 - DNA, 25 bp, Mus musculus
aatgttatggctttactttggtcaa

SEQ ID NO: 85531 - DNA, 25 bp, Mus musculus
aatgttattcctagttccctaaatg

SEQ ID NO: 85532 - DNA, 25 bp, Mus musculus
aatgttattccttgttccctaaatg

SEQ ID NO: 85533 - DNA, 25 bp, Mus musculus
aatgttattgttaatctacttcctg

SEQ ID NO: 85534 - DNA, 25 bp, Mus musculus
aatgttattgtttatctacttcctg

SEQ ID NO: 85535 - DNA, 25 bp, Mus musculus
aatgttatttcaagctttattggag

SEQ ID NO: 85536 - DNA, 25 bp, Mus musculus
aatgttatttcatgctttattggag

SEQ ID NO: 85537 - DNA, 25 bp, Mus musculus
aatgttatttctactctcaccctga

SEQ ID NO: 85538 - DNA, 25 bp, Mus musculus
aatgttatttcttctctcaccctga

SEQ ID NO: 85539 - DNA, 25 bp, Mus musculus
aatgttatttgacttagcctttggg

SEQ ID NO: 85540 - DNA, 25 bp, Mus musculus
aatgttatttgagttagcctttggg

SEQ ID NO: 85541 - DNA, 25 bp, Mus musculus
aatgttatttgtacacttttgtaag

SEQ ID NO: 85542 - DNA, 25 bp, Mus musculus
aatgttatttgttcacttttgtaag

SEQ ID NO: 85543 - DNA, 25 bp, Mus musculus
aatgttattttcaggctaccaagga

SEQ ID NO: 85544 - DNA, 25 bp, Mus musculus
aatgttattttctggctaccaagga

SEQ ID NO: 85545 - DNA, 25 bp, Mus musculus
aatgttcaacctagacatggtttca

SEQ ID NO: 85546 - DNA, 25 bp, Mus musculus
aatgttcaaccttgacatggtttca

SEQ ID NO: 85547 - DNA, 25 bp, Mus musculus
aatgttcaagttactacataactag

SEQ ID NO: 85548 - DNA, 25 bp, Mus musculus
aatgttcaagtttctacataactag

SEQ ID NO: 85549 - DNA, 25 bp, Mus musculus
aatgttcaatttcttctcataggaa

SEQ ID NO: 85550 - DNA, 25 bp, Mus musculus
aatgttcaatttgttctcataggaa

SEQ ID NO: 85551 - DNA, 25 bp, Mus musculus
aatgttcacaatattacgacactgg

SEQ ID NO: 85552 - DNA, 25 bp, Mus musculus
aatgttcacaattttacgacactgg

SEQ ID NO: 85553 - DNA, 25 bp, Mus musculus
aatgttcacacgacctacttcctgt

SEQ ID NO: 85554 - DNA, 25 bp, Mus musculus
aatgttcacacgtcctacttcctgt

SEQ ID NO: 85555 - DNA, 25 bp, Mus musculus
aatgttcacagcagcagggctctat

SEQ ID NO: 85556 - DNA, 25 bp, Mus musculus
aatgttcacagctgcagggctctat

SEQ ID NO: 85557 - DNA, 25 bp, Mus musculus
aatgttcacttcctttttctagctg

SEQ ID NO: 85558 - DNA, 25 bp, Mus musculus
aatgttcacttcgtttttctagctg

SEQ ID NO: 85559 - DNA, 25 bp, Mus musculus
aatgttcagccccaaaactgttaag

SEQ ID NO: 85560 - DNA, 25 bp, Mus musculus
aatgttcagcccgaaaactgttaag

SEQ ID NO: 85561 - DNA, 25 bp, Mus musculus
aatgttcatcacaccaattattcct

SEQ ID NO: 85562 - DNA, 25 bp, Mus musculus
aatgttcatcactccaattattcct

SEQ ID NO: 85563 - DNA, 25 bp, Mus musculus
aatgttcatctcaaggtcatgcctc

SEQ ID NO: 85564 - DNA, 25 bp, Mus musculus
aatgttcatctctaggtcatgcctc

SEQ ID NO: 85565 - DNA, 25 bp, Mus musculus
aatgttcatggaagcttctcggtgg

SEQ ID NO: 85566 - DNA, 25 bp, Mus musculus
aatgttcatggatgcttctcggtgg

SEQ ID NO: 85567 - DNA, 25 bp, Mus musculus
aatgttcatggcatttactctgttc

SEQ ID NO: 85568 - DNA, 25 bp, Mus musculus
aatgttcatggcttttactctgttc

SEQ ID NO: 85569 - DNA, 25 bp, Mus musculus
aatgttccaagcataaagattccac

SEQ ID NO: 85570 - DNA, 25 bp, Mus musculus
aatgttccaagcttaaagattccac

SEQ ID NO: 85571 - DNA, 25 bp, Mus musculus
aatgttccacatagaatcagcacag

SEQ ID NO: 85572 - DNA, 25 bp, Mus musculus
aatgttccacattgaatcagcacag

SEQ ID NO: 85573 - DNA, 25 bp, Mus musculus
aatgttccacgcagtgattgaagtc

SEQ ID NO: 85574 - DNA, 25 bp, Mus musculus
aatgttccacgctgtgattgaagtc

SEQ ID NO: 85575 - DNA, 25 bp, Mus musculus
aatgttccagtacttcagttccttt

SEQ ID NO: 85576 - DNA, 25 bp, Mus musculus
aatgttccagtagttcagttccttt

SEQ ID NO: 85577 - DNA, 25 bp, Mus musculus
aatgttccagtgctcatggcagcat

SEQ ID NO: 85578 - DNA, 25 bp, Mus musculus
aatgttccagtggtcatggcagcat

SEQ ID NO: 85579 - DNA, 25 bp, Mus musculus
aatgttccagttatcattgtctgca

SEQ ID NO: 85580 - DNA, 25 bp, Mus musculus
aatgttccagttttcattgtctgca

SEQ ID NO: 85581 - DNA, 25 bp, Mus musculus
aatgttccatatcatctctaccctt

SEQ ID NO: 85582 - DNA, 25 bp, Mus musculus
aatgttccatatgatctctaccctt

SEQ ID NO: 85583 - DNA, 25 bp, Mus musculus
aatgttcccaaccatatttggtggc

SEQ ID NO: 85584 - DNA, 25 bp, Mus musculus
aatgttcccaacgatatttggtggc

SEQ ID NO: 85585 - DNA, 25 bp, Mus musculus
aatgttccccccagttgatgctggt

SEQ ID NO: 85586 - DNA, 25 bp, Mus musculus
aatgttcccccctgttgatgctggt

SEQ ID NO: 85587 - DNA, 25 bp, Mus musculus
aatgttcccgctactgtacactgtg

SEQ ID NO: 85588 - DNA, 25 bp, Mus musculus
aatgttcccgcttctgtacactgtg

SEQ ID NO: 85589 - DNA, 25 bp, Mus musculus
aatgttccctcacacatgtaattag

SEQ ID NO: 85590 - DNA, 25 bp, Mus musculus
aatgttccctcagacatgtaattag

SEQ ID NO: 85591 - DNA, 25 bp, Mus musculus
aatgttccctctaggctgtgtagac

SEQ ID NO: 85592 - DNA, 25 bp, Mus musculus
aatgttccctcttggctgtgtagac

SEQ ID NO: 85593 - DNA, 25 bp, Mus musculus
aatgttccctgaatgcaacctttga

SEQ ID NO: 85594 - DNA, 25 bp, Mus musculus
aatgttccctgattgcaacctttga

SEQ ID NO: 85595 - DNA, 25 bp, Mus musculus
aatgttccgtctaaacaccacgagg

SEQ ID NO: 85596 - DNA, 25 bp, Mus musculus
aatgttccgtcttaacaccacgagg

SEQ ID NO: 85597 - DNA, 25 bp, Mus musculus
aatgttcctatcatcagagtgctgg

SEQ ID NO: 85598 - DNA, 25 bp, Mus musculus
aatgttcctatcttcagagtgctgg

SEQ ID NO: 85599 - DNA, 25 bp, Mus musculus
aatgttcctgacatcatttacatga

SEQ ID NO: 85600 - DNA, 25 bp, Mus musculus
aatgttcctgacttcatttacatga

SEQ ID NO: 85601 - DNA, 25 bp, Mus musculus
aatgttcctgtaagtctgacatact

SEQ ID NO: 85602 - DNA, 25 bp, Mus musculus
aatgttcctgtatgtctgacatact

SEQ ID NO: 85603 - DNA, 25 bp, Mus musculus
aatgttcctgtcaggactcttctaa

SEQ ID NO: 85604 - DNA, 25 bp, Mus musculus
aatgttcctgtcattctctcagtaa

SEQ ID NO: 85605 - DNA, 25 bp, Mus musculus
aatgttcctgtctggactcttctaa

SEQ ID NO: 85606 - DNA, 25 bp, Mus musculus
aatgttcctgtctttctctcagtaa

SEQ ID NO: 85607 - DNA, 25 bp, Mus musculus
aatgttccttcaagtattccccatc

SEQ ID NO: 85608 - DNA, 25 bp, Mus musculus
aatgttccttcatgtattccccatc

SEQ ID NO: 85609 - DNA, 25 bp, Mus musculus
aatgttccttccagtatggacagtg

SEQ ID NO: 85610 - DNA, 25 bp, Mus musculus
aatgttccttcctgtatggacagtg

SEQ ID NO: 85611 - DNA, 25 bp, Mus musculus
aatgttcctttcagctgaacccgga

SEQ ID NO: 85612 - DNA, 25 bp, Mus musculus
aatgttcctttctgctgaacccgga

SEQ ID NO: 85613 - DNA, 25 bp, Mus musculus
aatgttcgagttaggactgttcttg

SEQ ID NO: 85614 - DNA, 25 bp, Mus musculus
aatgttcgagtttggactgttcttg

SEQ ID NO: 85615 - DNA, 25 bp, Mus musculus
aatgttcggcggaacctccagttga

SEQ ID NO: 85616 - DNA, 25 bp, Mus musculus
aatgttcggcggtacctccagttga

SEQ ID NO: 85617 - DNA, 25 bp, Mus musculus
aatgttcgtcggcagatatttctgc

SEQ ID NO: 85618 - DNA, 25 bp, Mus musculus
aatgttcgtcgggagatatttctgc

SEQ ID NO: 85619 - DNA, 25 bp, Mus musculus
aatgttcgtgctattattaggacaa

SEQ ID NO: 85620 - DNA, 25 bp, Mus musculus
aatgttcgtgcttttattaggacaa

SEQ ID NO: 85621 - DNA, 25 bp, Mus musculus
aatgttctacagaatgtgctggctt

SEQ ID NO: 85622 - DNA, 25 bp, Mus musculus
aatgttctacagtatgtgctggctt

SEQ ID NO: 85623 - DNA, 25 bp, Mus musculus
aatgttctaccaacgagttccctgt

SEQ ID NO: 85624 - DNA, 25 bp, Mus musculus
aatgttctaccatcgagttccctgt

SEQ ID NO: 85625 - DNA, 25 bp, Mus musculus
aatgttctagtgattcctaagcaca

SEQ ID NO: 85626 - DNA, 25 bp, Mus musculus
aatgttctagtgtttcctaagcaca

SEQ ID NO: 85627 - DNA, 25 bp, Mus musculus
aatgttctcaacaaccagcagttcc

SEQ ID NO: 85628 - DNA, 25 bp, Mus musculus
aatgttctcaactaccagcagttcc

SEQ ID NO: 85629 - DNA, 25 bp, Mus musculus
aatgttctcaggcaggcagaataca

SEQ ID NO: 85630 - DNA, 25 bp, Mus musculus
aatgttctcagggaggcagaataca

SEQ ID NO: 85631 - DNA, 25 bp, Mus musculus
aatgttctcatcatgttctttggaa

SEQ ID NO: 85632 - DNA, 25 bp, Mus musculus
aatgttctcatcttgttctttggaa

SEQ ID NO: 85633 - DNA, 25 bp, Mus musculus
aatgttctccaaaagggctgataga

SEQ ID NO: 85634 - DNA, 25 bp, Mus musculus
aatgttctccaatagggctgataga

SEQ ID NO: 85635 - DNA, 25 bp, Mus musculus
aatgttctccatatgcagtacttta

SEQ ID NO: 85636 - DNA, 25 bp, Mus musculus
aatgttctccatttgcagtacttta

SEQ ID NO: 85637 - DNA, 25 bp, Mus musculus
aatgttctccgcaacatccagctga

SEQ ID NO: 85638 - DNA, 25 bp, Mus musculus
aatgttctccgctacatccagctga

SEQ ID NO: 85639 - DNA, 25 bp, Mus musculus
aatgttctggagatgggcctgctgt

SEQ ID NO: 85640 - DNA, 25 bp, Mus musculus
aatgttctggagttgggcctgctgt

SEQ ID NO: 85641 - DNA, 25 bp, Mus musculus
aatgttctgtgtagcactctctgaa

SEQ ID NO: 85642 - DNA, 25 bp, Mus musculus
aatgttctgtgtctatcttgtttta

SEQ ID NO: 85643 - DNA, 25 bp, Mus musculus
aatgttctgtgtgtatcttgtttta

SEQ ID NO: 85644 - DNA, 25 bp, Mus musculus
aatgttctgtgttgcactctctgaa

SEQ ID NO: 85645 - DNA, 25 bp, Mus musculus
aatgttctgttcctacagaccatgc

SEQ ID NO: 85646 - DNA, 25 bp, Mus musculus
aatgttctgttcgtacagaccatgc

SEQ ID NO: 85647 - DNA, 25 bp, Mus musculus
aatgttcttagccaagttcccatct

SEQ ID NO: 85648 - DNA, 25 bp, Mus musculus
aatgttcttagcgaagttcccatct

SEQ ID NO: 85649 - DNA, 25 bp, Mus musculus
aatgttcttcagattctcagagcag

SEQ ID NO: 85650 - DNA, 25 bp, Mus musculus
aatgttcttcagtttctcagagcag

SEQ ID NO: 85651 - DNA, 25 bp, Mus musculus
aatgttcttgcaccccaagtgcatg

SEQ ID NO: 85652 - DNA, 25 bp, Mus musculus
aatgttcttgcagcccaagtgcatg

SEQ ID NO: 85653 - DNA, 25 bp, Mus musculus
aatgttcttgctaatcctggtttta

SEQ ID NO: 85654 - DNA, 25 bp, Mus musculus
aatgttcttgcttatcctggtttta

SEQ ID NO: 85655 - DNA, 25 bp, Mus musculus
aatgttcttggaagaccctcgtgaa

SEQ ID NO: 85656 - DNA, 25 bp, Mus musculus
aatgttcttggatgaccctcgtgaa

SEQ ID NO: 85657 - DNA, 25 bp, Mus musculus
aatgttcttgttctgctatgcaatc

SEQ ID NO: 85658 - DNA, 25 bp, Mus musculus
aatgttcttgttgtgctatgcaatc

SEQ ID NO: 85659 - DNA, 25 bp, Mus musculus
aatgttctttctcttgtatctctgc

SEQ ID NO: 85660 - DNA, 25 bp, Mus musculus
aatgttctttctgttgtatctctgc

SEQ ID NO: 85661 - DNA, 25 bp, Mus musculus
aatgttctttgccagaaattggtag

SEQ ID NO: 85662 - DNA, 25 bp, Mus musculus
aatgttctttgcgagaaattggtag

SEQ ID NO: 85663 - DNA, 25 bp, Mus musculus
aatgttcttttaagaccagagcaat

SEQ ID NO: 85664 - DNA, 25 bp, Mus musculus
aatgttcttttaaggttatgctcag

SEQ ID NO: 85665 - DNA, 25 bp, Mus musculus
aatgttcttttatgaccagagcaat

SEQ ID NO: 85666 - DNA, 25 bp, Mus musculus
aatgttcttttatggttatgctcag

SEQ ID NO: 85667 - DNA, 25 bp, Mus musculus
aatgttcttttcataatagagccaa

SEQ ID NO: 85668 - DNA, 25 bp, Mus musculus
aatgttcttttccacttaatgccca

SEQ ID NO: 85669 - DNA, 25 bp, Mus musculus
aatgttcttttcgacttaatgccca

SEQ ID NO: 85670 - DNA, 25 bp, Mus musculus
aatgttcttttcttaatagagccaa

SEQ ID NO: 85671 - DNA, 25 bp, Mus musculus
aatgttgaagttatgtatttatgaa

SEQ ID NO: 85672 - DNA, 25 bp, Mus musculus
aatgttgaagttttgtatttatgaa

SEQ ID NO: 85673 - DNA, 25 bp, Mus musculus
aatgttgaatgaactctgctttgcc

SEQ ID NO: 85674 - DNA, 25 bp, Mus musculus
aatgttgaatgatctctgctttgcc

SEQ ID NO: 85675 - DNA, 25 bp, Mus musculus
aatgttgacattccctttatgcaga

SEQ ID NO: 85676 - DNA, 25 bp, Mus musculus
aatgttgacattgcctttatgcaga

SEQ ID NO: 85677 - DNA, 25 bp, Mus musculus
aatgttgaccctcgcacctacgtgt

SEQ ID NO: 85678 - DNA, 25 bp, Mus musculus
aatgttgaccctggcacctacgtgt

SEQ ID NO: 85679 - DNA, 25 bp, Mus musculus
aatgttgacgacaactactgctcaa

SEQ ID NO: 85680 - DNA, 25 bp, Mus musculus
aatgttgacgactactactgctcaa

SEQ ID NO: 85681 - DNA, 25 bp, Mus musculus
aatgttgagtaaatttctgagtaag

SEQ ID NO: 85682 - DNA, 25 bp, Mus musculus
aatgttgagtaattttctgagtaag

SEQ ID NO: 85683 - DNA, 25 bp, Mus musculus
aatgttgattcaccagtttgctgtt

SEQ ID NO: 85684 - DNA, 25 bp, Mus musculus
aatgttgattcagcagtttgctgtt

SEQ ID NO: 85685 - DNA, 25 bp, Mus musculus
aatgttgcaaatccgcccattggtt

SEQ ID NO: 85686 - DNA, 25 bp, Mus musculus
aatgttgcaaatgcgcccattggtt

SEQ ID NO: 85687 - DNA, 25 bp, Mus musculus
aatgttgcaccaagggcagcttggt

SEQ ID NO: 85688 - DNA, 25 bp, Mus musculus
aatgttgcaccatgggcagcttggt

SEQ ID NO: 85689 - DNA, 25 bp, Mus musculus
aatgttgcagatacccaaggcttga

SEQ ID NO: 85690 - DNA, 25 bp, Mus musculus
aatgttgcagatatggactccttcc

SEQ ID NO: 85691 - DNA, 25 bp, Mus musculus
aatgttgcagattcccaaggcttga

SEQ ID NO: 85692 - DNA, 25 bp, Mus musculus
aatgttgcagatttggactccttcc

SEQ ID NO: 85693 - DNA, 25 bp, Mus musculus
aatgttgccagaacatcttcctctg

SEQ ID NO: 85694 - DNA, 25 bp, Mus musculus
aatgttgccagatcatcttcctctg

SEQ ID NO: 85695 - DNA, 25 bp, Mus musculus
aatgttgccctaccacatgtatgtt

SEQ ID NO: 85696 - DNA, 25 bp, Mus musculus
aatgttgccctagcacatgtatgtt

SEQ ID NO: 85697 - DNA, 25 bp, Mus musculus
aatgttgcccttctgcactgtgtta

SEQ ID NO: 85698 - DNA, 25 bp, Mus musculus
aatgttgcccttgtgcactgtgtta

SEQ ID NO: 85699 - DNA, 25 bp, Mus musculus
aatgttgcgcacaagctgaaagcca

SEQ ID NO: 85700 - DNA, 25 bp, Mus musculus
aatgttgcgcactagctgaaagcca

SEQ ID NO: 85701 - DNA, 25 bp, Mus musculus
aatgttgcgtatatatgggactgaa

SEQ ID NO: 85702 - DNA, 25 bp, Mus musculus
aatgttgcgtatttatgggactgaa

SEQ ID NO: 85703 - DNA, 25 bp, Mus musculus
aatgttgcgttcagtcctgatgaca

SEQ ID NO: 85704 - DNA, 25 bp, Mus musculus
aatgttgcgttctgtcctgatgaca

SEQ ID NO: 85705 - DNA, 25 bp, Mus musculus
aatgttgctaggagttgcaggcact

SEQ ID NO: 85706 - DNA, 25 bp, Mus musculus
aatgttgctaggtgttgcaggcact

SEQ ID NO: 85707 - DNA, 25 bp, Mus musculus
aatgttgctgaactctttcctacac

SEQ ID NO: 85708 - DNA, 25 bp, Mus musculus
aatgttgctgaagtctttcctacac

SEQ ID NO: 85709 - DNA, 25 bp, Mus musculus
aatgttgctgatacacaaactcaat

SEQ ID NO: 85710 - DNA, 25 bp, Mus musculus
aatgttgctgattcacaaactcaat

SEQ ID NO: 85711 - DNA, 25 bp, Mus musculus
aatgttgctggtccactatgctcac

SEQ ID NO: 85712 - DNA, 25 bp, Mus musculus
aatgttgctggtgcactatgctcac

SEQ ID NO: 85713 - DNA, 25 bp, Mus musculus
aatgttgcttacagatttgctcctt

SEQ ID NO: 85714 - DNA, 25 bp, Mus musculus
aatgttgcttactgatttgctcctt

SEQ ID NO: 85715 - DNA, 25 bp, Mus musculus
aatgttgctttgatagtgccatggc

SEQ ID NO: 85716 - DNA, 25 bp, Mus musculus
aatgttgctttgttagtgccatggc

SEQ ID NO: 85717 - DNA, 25 bp, Mus musculus
aatgttggaatcaagcatgtagtta

SEQ ID NO: 85718 - DNA, 25 bp, Mus musculus
aatgttggaatctagcatgtagtta

SEQ ID NO: 85719 - DNA, 25 bp, Mus musculus
aatgttggactgatcaattcttagt

SEQ ID NO: 85720 - DNA, 25 bp, Mus musculus
aatgttggactgttcaattcttagt

SEQ ID NO: 85721 - DNA, 25 bp, Mus musculus
aatgttggagagatgtagctaataa

SEQ ID NO: 85722 - DNA, 25 bp, Mus musculus
aatgttggagagttgtagctaataa

SEQ ID NO: 85723 - DNA, 25 bp, Mus musculus
aatgttggcaatacctctagactct

SEQ ID NO: 85724 - DNA, 25 bp, Mus musculus
aatgttggcaattcctctagactct

SEQ ID NO: 85725 - DNA, 25 bp, Mus musculus
aatgttggcatgatctgaaccagcc

SEQ ID NO: 85726 - DNA, 25 bp, Mus musculus
aatgttggcatgttctgaaccagcc

SEQ ID NO: 85727 - DNA, 25 bp, Mus musculus
aatgttggcgctcacctggtcagtg

SEQ ID NO: 85728 - DNA, 25 bp, Mus musculus
aatgttggcgctgacctggtcagtg

SEQ ID NO: 85729 - DNA, 25 bp, Mus musculus
aatgttggctacctctcaatgtaca

SEQ ID NO: 85730 - DNA, 25 bp, Mus musculus
aatgttggctacgtctcaatgtaca

SEQ ID NO: 85731 - DNA, 25 bp, Mus musculus
aatgttggctggagcaaaaggcctg

SEQ ID NO: 85732 - DNA, 25 bp, Mus musculus
aatgttggctggtgcaaaaggcctg

SEQ ID NO: 85733 - DNA, 25 bp, Mus musculus
aatgttggcttacctctggtttaga

SEQ ID NO: 85734 - DNA, 25 bp, Mus musculus
aatgttggcttagctctggtttaga

SEQ ID NO: 85735 - DNA, 25 bp, Mus musculus
aatgttggcttcagactgttgtggg

SEQ ID NO: 85736 - DNA, 25 bp, Mus musculus
aatgttggcttctgactgttgtggg

SEQ ID NO: 85737 - DNA, 25 bp, Mus musculus
aatgttgggactaaagatatgtgcc

SEQ ID NO: 85738 - DNA, 25 bp, Mus musculus
aatgttgggacttaagatatgtgcc

SEQ ID NO: 85739 - DNA, 25 bp, Mus musculus
aatgttggtataagtatgtttatgg

SEQ ID NO: 85740 - DNA, 25 bp, Mus musculus
aatgttggtatatgtatgtttatgg

SEQ ID NO: 85741 - DNA, 25 bp, Mus musculus
aatgttggtatcactttacagcaat

SEQ ID NO: 85742 - DNA, 25 bp, Mus musculus
aatgttggtatctctttacagcaat

SEQ ID NO: 85743 - DNA, 25 bp, Mus musculus
aatgttggtattcctactgggccac

SEQ ID NO: 85744 - DNA, 25 bp, Mus musculus
aatgttggtattgctactgggccac

SEQ ID NO: 85745 - DNA, 25 bp, Mus musculus
aatgttggtggtctcctttgtgtaa

SEQ ID NO: 85746 - DNA, 25 bp, Mus musculus
aatgttggtggtgtcctttgtgtaa

SEQ ID NO: 85747 - DNA, 25 bp, Mus musculus
aatgttggtgtaaggcaccctttct

SEQ ID NO: 85748 - DNA, 25 bp, Mus musculus
aatgttggtgtatggcaccctttct

SEQ ID NO: 85749 - DNA, 25 bp, Mus musculus
aatgttggttgtacagggatagttc

SEQ ID NO: 85750 - DNA, 25 bp, Mus musculus
aatgttggttgttcagggatagttc

SEQ ID NO: 85751 - DNA, 25 bp, Mus musculus
aatgttgtacatagaacccagggct

SEQ ID NO: 85752 - DNA, 25 bp, Mus musculus
aatgttgtacattgaacccagggct

SEQ ID NO: 85753 - DNA, 25 bp, Mus musculus
aatgttgtataaaaatgcccctatg

SEQ ID NO: 85754 - DNA, 25 bp, Mus musculus
aatgttgtataataatgcccctatg

SEQ ID NO: 85755 - DNA, 25 bp, Mus musculus
aatgttgtatgaaagcccttctcca

SEQ ID NO: 85756 - DNA, 25 bp, Mus musculus
aatgttgtatgatagcccttctcca

SEQ ID NO: 85757 - DNA, 25 bp, Mus musculus
aatgttgtcaagacctgaagtccta

SEQ ID NO: 85758 - DNA, 25 bp, Mus musculus
aatgttgtcaagtcctgaagtccta

SEQ ID NO: 85759 - DNA, 25 bp, Mus musculus
aatgttgtcgtcagccagtatgata

SEQ ID NO: 85760 - DNA, 25 bp, Mus musculus
aatgttgtcgtctgccagtatgata

SEQ ID NO: 85761 - DNA, 25 bp, Mus musculus
aatgttgtctccaactttctgatgc

SEQ ID NO: 85762 - DNA, 25 bp, Mus musculus
aatgttgtctcctactttctgatgc

SEQ ID NO: 85763 - DNA, 25 bp, Mus musculus
aatgttgtctgtattgctttgtgaa

SEQ ID NO: 85764 - DNA, 25 bp, Mus musculus
aatgttgtctgttttgctttgtgaa

SEQ ID NO: 85765 - DNA, 25 bp, Mus musculus
aatgttgtctttcatcccttactcc

SEQ ID NO: 85766 - DNA, 25 bp, Mus musculus
aatgttgtctttgatcccttactcc

SEQ ID NO: 85767 - DNA, 25 bp, Mus musculus
aatgttgtgaacatcctggtttaga

SEQ ID NO: 85768 - DNA, 25 bp, Mus musculus
aatgttgtgaacttcctggtttaga

SEQ ID NO: 85769 - DNA, 25 bp, Mus musculus
aatgttgtgatgactcccaatcata

SEQ ID NO: 85770 - DNA, 25 bp, Mus musculus
aatgttgtgatgtctcccaatcata

SEQ ID NO: 85771 - DNA, 25 bp, Mus musculus
aatgttgtggctaattctagagaat

SEQ ID NO: 85772 - DNA, 25 bp, Mus musculus
aatgttgtggcttattctagagaat

SEQ ID NO: 85773 - DNA, 25 bp, Mus musculus
aatgttgtgggacccagacccatgt

SEQ ID NO: 85774 - DNA, 25 bp, Mus musculus
aatgttgtgggagccagacccatgt

SEQ ID NO: 85775 - DNA, 25 bp, Mus musculus
aatgttgtggttatattgctttgta

SEQ ID NO: 85776 - DNA, 25 bp, Mus musculus
aatgttgtggttttattgctttgta

SEQ ID NO: 85777 - DNA, 25 bp, Mus musculus
aatgttgtgtatactaattgttctt

SEQ ID NO: 85778 - DNA, 25 bp, Mus musculus
aatgttgtgtattctaattgttctt

SEQ ID NO: 85779 - DNA, 25 bp, Mus musculus
aatgttgttaatcgcggtcctccaa

SEQ ID NO: 85780 - DNA, 25 bp, Mus musculus
aatgttgttaatggcggtcctccaa

SEQ ID NO: 85781 - DNA, 25 bp, Mus musculus
aatgttgttatactgatgcctttat

SEQ ID NO: 85782 - DNA, 25 bp, Mus musculus
aatgttgttatagtgatgcctttat

SEQ ID NO: 85783 - DNA, 25 bp, Mus musculus
aatgttgttcgtccatgcctttaat

SEQ ID NO: 85784 - DNA, 25 bp, Mus musculus
aatgttgttcgtgcatgcctttaat

SEQ ID NO: 85785 - DNA, 25 bp, Mus musculus
aatgttgttctcagaatacactgca

SEQ ID NO: 85786 - DNA, 25 bp, Mus musculus
aatgttgttctctgaatacactgca

SEQ ID NO: 85787 - DNA, 25 bp, Mus musculus
aatgttgttgctaacccaccagttt

SEQ ID NO: 85788 - DNA, 25 bp, Mus musculus
aatgttgttgcttacccaccagttt

SEQ ID NO: 85789 - DNA, 25 bp, Mus musculus
aatgttgtttcaagtcctgtcaaga

SEQ ID NO: 85790 - DNA, 25 bp, Mus musculus
aatgttgtttcatgtcctgtcaaga

SEQ ID NO: 85791 - DNA, 25 bp, Mus musculus
aatgtttaacaaaagttctctaggt

SEQ ID NO: 85792 - DNA, 25 bp, Mus musculus
aatgtttaacaatagttctctaggt

SEQ ID NO: 85793 - DNA, 25 bp, Mus musculus
aatgtttaacctcagcccttttctg

SEQ ID NO: 85794 - DNA, 25 bp, Mus musculus
aatgtttaacctgagcccttttctg

SEQ ID NO: 85795 - DNA, 25 bp, Mus musculus
aatgtttaactaagcggggactgca

SEQ ID NO: 85796 - DNA, 25 bp, Mus musculus
aatgtttaactatgcggggactgca

SEQ ID NO: 85797 - DNA, 25 bp, Mus musculus
aatgtttacaatatgcctcaatcac

SEQ ID NO: 85798 - DNA, 25 bp, Mus musculus
aatgtttacaatttgcctcaatcac

SEQ ID NO: 85799 - DNA, 25 bp, Mus musculus
aatgtttacacaatacgaggccagt

SEQ ID NO: 85800 - DNA, 25 bp, Mus musculus
aatgtttacacattacgaggccagt

SEQ ID NO: 85801 - DNA, 25 bp, Mus musculus
aatgtttacactattgccaagagga

SEQ ID NO: 85802 - DNA, 25 bp, Mus musculus
aatgtttacacttttgccaagagga

SEQ ID NO: 85803 - DNA, 25 bp, Mus musculus
aatgtttacagaccagcctgccttg

SEQ ID NO: 85804 - DNA, 25 bp, Mus musculus
aatgtttacagagcagcctgccttg

SEQ ID NO: 85805 - DNA, 25 bp, Mus musculus
aatgtttaccatcagcgttatttta

SEQ ID NO: 85806 - DNA, 25 bp, Mus musculus
aatgtttaccatgagcgttatttta

SEQ ID NO: 85807 - DNA, 25 bp, Mus musculus
aatgtttactatcaaatgttccata

SEQ ID NO: 85808 - DNA, 25 bp, Mus musculus
aatgtttactatgaaatgttccata

SEQ ID NO: 85809 - DNA, 25 bp, Mus musculus
aatgtttactgtcagcgtcgatcca

SEQ ID NO: 85810 - DNA, 25 bp, Mus musculus
aatgtttactgtgagcgtcgatcca

SEQ ID NO: 85811 - DNA, 25 bp, Mus musculus
aatgtttactttcttccctgtctat

SEQ ID NO: 85812 - DNA, 25 bp, Mus musculus
aatgtttactttgttccctgtctat

SEQ ID NO: 85813 - DNA, 25 bp, Mus musculus
aatgtttagcgtccgtggtctctga

SEQ ID NO: 85814 - DNA, 25 bp, Mus musculus
aatgtttagcgtgcgtggtctctga

SEQ ID NO: 85815 - DNA, 25 bp, Mus musculus
aatgtttagggcaaatccagctggg

SEQ ID NO: 85816 - DNA, 25 bp, Mus musculus
aatgtttagggctaatccagctggg

SEQ ID NO: 85817 - DNA, 25 bp, Mus musculus
aatgtttagtttacctcttgtcatg

SEQ ID NO: 85818 - DNA, 25 bp, Mus musculus
aatgtttagttttcctcttgtcatg

SEQ ID NO: 85819 - DNA, 25 bp, Mus musculus
aatgtttatcagcagaaggtttgct

SEQ ID NO: 85820 - DNA, 25 bp, Mus musculus
aatgtttatcaggagaaggtttgct

SEQ ID NO: 85821 - DNA, 25 bp, Mus musculus
aatgtttatctaagactgttccaga

SEQ ID NO: 85822 - DNA, 25 bp, Mus musculus
aatgtttatctatgactgttccaga

SEQ ID NO: 85823 - DNA, 25 bp, Mus musculus
aatgtttatctcatgggcctatcta

SEQ ID NO: 85824 - DNA, 25 bp, Mus musculus
aatgtttatctcttgggcctatcta

SEQ ID NO: 85825 - DNA, 25 bp, Mus musculus
aatgtttatggcacctgacttgtaa

SEQ ID NO: 85826 - DNA, 25 bp, Mus musculus
aatgtttatggcatgctgtgaataa

SEQ ID NO: 85827 - DNA, 25 bp, Mus musculus
aatgtttatggctcctgacttgtaa

SEQ ID NO: 85828 - DNA, 25 bp, Mus musculus
aatgtttatggcttgctgtgaataa

SEQ ID NO: 85829 - DNA, 25 bp, Mus musculus
aatgtttattctcctactttggcga

SEQ ID NO: 85830 - DNA, 25 bp, Mus musculus
aatgtttattctctccatcacaagg

SEQ ID NO: 85831 - DNA, 25 bp, Mus musculus
aatgtttattctgctactttggcga

SEQ ID NO: 85832 - DNA, 25 bp, Mus musculus
aatgtttattctgtccatcacaagg

SEQ ID NO: 85833 - DNA, 25 bp, Mus musculus
aatgtttattgtcgtgtagctgtta

SEQ ID NO: 85834 - DNA, 25 bp, Mus musculus
aatgtttattgtggtgtagctgtta

SEQ ID NO: 85835 - DNA, 25 bp, Mus musculus
aatgtttatttccttccactgaagt

SEQ ID NO: 85836 - DNA, 25 bp, Mus musculus
aatgtttatttcgttccactgaagt

SEQ ID NO: 85837 - DNA, 25 bp, Mus musculus
aatgtttcaagacatgctggccata

SEQ ID NO: 85838 - DNA, 25 bp, Mus musculus
aatgtttcaagagatgctggccata

SEQ ID NO: 85839 - DNA, 25 bp, Mus musculus
aatgtttcacatcggctttcaagac

SEQ ID NO: 85840 - DNA, 25 bp, Mus musculus
aatgtttcacatgggctttcaagac

SEQ ID NO: 85841 - DNA, 25 bp, Mus musculus
aatgtttcaggcatgttgtaaccaa

SEQ ID NO: 85842 - DNA, 25 bp, Mus musculus
aatgtttcaggcttgttgtaaccaa

SEQ ID NO: 85843 - DNA, 25 bp, Mus musculus
aatgtttccagccatgacctgtctg

SEQ ID NO: 85844 - DNA, 25 bp, Mus musculus
aatgtttccagcgatgacctgtctg

SEQ ID NO: 85845 - DNA, 25 bp, Mus musculus
aatgtttccatgaatgttgtttgta

SEQ ID NO: 85846 - DNA, 25 bp, Mus musculus
aatgtttccatgtatgttgtttgta

SEQ ID NO: 85847 - DNA, 25 bp, Mus musculus
aatgtttccctaaggcttatgtaac

SEQ ID NO: 85848 - DNA, 25 bp, Mus musculus
aatgtttccctaagtgttcctgaag

SEQ ID NO: 85849 - DNA, 25 bp, Mus musculus
aatgtttccctatggcttatgtaac

SEQ ID NO: 85850 - DNA, 25 bp, Mus musculus
aatgtttccctatgtgttcctgaag

SEQ ID NO: 85851 - DNA, 25 bp, Mus musculus
aatgtttcccttagtgctataggaa

SEQ ID NO: 85852 - DNA, 25 bp, Mus musculus
aatgtttccctttgtgctataggaa

SEQ ID NO: 85853 - DNA, 25 bp, Mus musculus
aatgtttcggccactgagacttaat

SEQ ID NO: 85854 - DNA, 25 bp, Mus musculus
aatgtttcggcctctgagacttaat

SEQ ID NO: 85855 - DNA, 25 bp, Mus musculus
aatgtttcgtgtccagtttagtggg

SEQ ID NO: 85856 - DNA, 25 bp, Mus musculus
aatgtttcgtgtgcagtttagtggg

SEQ ID NO: 85857 - DNA, 25 bp, Mus musculus
aatgtttcgtttccctcagacaggt

SEQ ID NO: 85858 - DNA, 25 bp, Mus musculus
aatgtttcgtttgcctcagacaggt

SEQ ID NO: 85859 - DNA, 25 bp, Mus musculus
aatgtttctaatctttcctctctca

SEQ ID NO: 85860 - DNA, 25 bp, Mus musculus
aatgtttctaatgtttcctctctca

SEQ ID NO: 85861 - DNA, 25 bp, Mus musculus
aatgtttctattctacctcttggtt

SEQ ID NO: 85862 - DNA, 25 bp, Mus musculus
aatgtttctattgtacctcttggtt

SEQ ID NO: 85863 - DNA, 25 bp, Mus musculus
aatgtttctccaacctcaatgtaac

SEQ ID NO: 85864 - DNA, 25 bp, Mus musculus
aatgtttctccatcctcaatgtaac

SEQ ID NO: 85865 - DNA, 25 bp, Mus musculus
aatgtttctctgatggctctataca

SEQ ID NO: 85866 - DNA, 25 bp, Mus musculus
aatgtttctctgttggctctataca

SEQ ID NO: 85867 - DNA, 25 bp, Mus musculus
aatgtttcttcaatgtcgcaattca

SEQ ID NO: 85868 - DNA, 25 bp, Mus musculus
aatgtttcttcattgtcgcaattca

SEQ ID NO: 85869 - DNA, 25 bp, Mus musculus
aatgtttcttccataactatactgg

SEQ ID NO: 85870 - DNA, 25 bp, Mus musculus
aatgtttcttccttaactatactgg

SEQ ID NO: 85871 - DNA, 25 bp, Mus musculus
aatgtttcttgtctatggtttccca

SEQ ID NO: 85872 - DNA, 25 bp, Mus musculus
aatgtttcttgtgtatggtttccca

SEQ ID NO: 85873 - DNA, 25 bp, Mus musculus
aatgtttgaaaactcctaggctgaa

SEQ ID NO: 85874 - DNA, 25 bp, Mus musculus
aatgtttgaaaagtcctaggctgaa

SEQ ID NO: 85875 - DNA, 25 bp, Mus musculus
aatgtttgaattcttcgtccccaca

SEQ ID NO: 85876 - DNA, 25 bp, Mus musculus
aatgtttgaattgttcgtccccaca

SEQ ID NO: 85877 - DNA, 25 bp, Mus musculus
aatgtttgagtgatgccttctgttt

SEQ ID NO: 85878 - DNA, 25 bp, Mus musculus
aatgtttgagtgttgccttctgttt

SEQ ID NO: 85879 - DNA, 25 bp, Mus musculus
aatgtttgatcgagttttcccagaa

SEQ ID NO: 85880 - DNA, 25 bp, Mus musculus
aatgtttgatcgtgttttcccagaa

SEQ ID NO: 85881 - DNA, 25 bp, Mus musculus
aatgtttgcaaacaccttatccctt

SEQ ID NO: 85882 - DNA, 25 bp, Mus musculus
aatgtttgcaaagaccttatccctt

SEQ ID NO: 85883 - DNA, 25 bp, Mus musculus
aatgtttgccctaactgtgttatga

SEQ ID NO: 85884 - DNA, 25 bp, Mus musculus
aatgtttgcccttactgtgttatga

SEQ ID NO: 85885 - DNA, 25 bp, Mus musculus
aatgtttgctttagtctcttgagac

SEQ ID NO: 85886 - DNA, 25 bp, Mus musculus
aatgtttgcttttgtctcttgagac

SEQ ID NO: 85887 - DNA, 25 bp, Mus musculus
aatgtttggaaacagggcaaatgaa

SEQ ID NO: 85888 - DNA, 25 bp, Mus musculus
aatgtttggaaagagggcaaatgaa

SEQ ID NO: 85889 - DNA, 25 bp, Mus musculus
aatgtttggactatgttctcctgca

SEQ ID NO: 85890 - DNA, 25 bp, Mus musculus
aatgtttggactttgttctcctgca

SEQ ID NO: 85891 - DNA, 25 bp, Mus musculus
aatgtttggagcatgggatatgtta

SEQ ID NO: 85892 - DNA, 25 bp, Mus musculus
aatgtttggagcttgggatatgtta

SEQ ID NO: 85893 - DNA, 25 bp, Mus musculus
aatgtttggataagccactgtaatt

SEQ ID NO: 85894 - DNA, 25 bp, Mus musculus
aatgtttggatatgccactgtaatt

SEQ ID NO: 85895 - DNA, 25 bp, Mus musculus
aatgtttggcttattgtgacgggat

SEQ ID NO: 85896 - DNA, 25 bp, Mus musculus
aatgtttggctttttgtgacgggat

SEQ ID NO: 85897 - DNA, 25 bp, Mus musculus
aatgtttgtatcctttgaactccat

SEQ ID NO: 85898 - DNA, 25 bp, Mus musculus
aatgtttgtatcgtttgaactccat

SEQ ID NO: 85899 - DNA, 25 bp, Mus musculus
aatgtttgtatgattctcactcaat

SEQ ID NO: 85900 - DNA, 25 bp, Mus musculus
aatgtttgtatgtttctcactcaat

SEQ ID NO: 85901 - DNA, 25 bp, Mus musculus
aatgtttgtcatctagcctgggcca

SEQ ID NO: 85902 - DNA, 25 bp, Mus musculus
aatgtttgtcatgtagcctgggcca

SEQ ID NO: 85903 - DNA, 25 bp, Mus musculus
aatgtttgtctcaccttggaggatg

SEQ ID NO: 85904 - DNA, 25 bp, Mus musculus
aatgtttgtctctccttggaggatg

SEQ ID NO: 85905 - DNA, 25 bp, Mus musculus
aatgtttgtgcactgtaactcatga

SEQ ID NO: 85906 - DNA, 25 bp, Mus musculus
aatgtttgtgcagtgtaactcatga

SEQ ID NO: 85907 - DNA, 25 bp, Mus musculus
aatgtttgtggtattaggtttgcct

SEQ ID NO: 85908 - DNA, 25 bp, Mus musculus
aatgtttgtggttttaggtttgcct

SEQ ID NO: 85909 - DNA, 25 bp, Mus musculus
aatgtttgttggctttcacgtggag

SEQ ID NO: 85910 - DNA, 25 bp, Mus musculus
aatgtttgttgggtttcacgtggag

SEQ ID NO: 85911 - DNA, 25 bp, Mus musculus
aatgtttgttgtactggttcaggca

SEQ ID NO: 85912 - DNA, 25 bp, Mus musculus
aatgtttgttgtcgatggttttgct

SEQ ID NO: 85913 - DNA, 25 bp, Mus musculus
aatgtttgttgtggatggttttgct

SEQ ID NO: 85914 - DNA, 25 bp, Mus musculus
aatgtttgttgttctggttcaggca

SEQ ID NO: 85915 - DNA, 25 bp, Mus musculus
aatgttttaaccctgagcattgcgg

SEQ ID NO: 85916 - DNA, 25 bp, Mus musculus
aatgttttaaccgtgagcattgcgg

SEQ ID NO: 85917 - DNA, 25 bp, Mus musculus
aatgttttaaggctatagttggcat

SEQ ID NO: 85918 - DNA, 25 bp, Mus musculus
aatgttttaagggtatagttggcat

SEQ ID NO: 85919 - DNA, 25 bp, Mus musculus
aatgttttacacaggattgagatct

SEQ ID NO: 85920 - DNA, 25 bp, Mus musculus
aatgttttacactggattgagatct

SEQ ID NO: 85921 - DNA, 25 bp, Mus musculus
aatgttttacatcttgatacctata

SEQ ID NO: 85922 - DNA, 25 bp, Mus musculus
aatgttttacatgttgatacctata

SEQ ID NO: 85923 - DNA, 25 bp, Mus musculus
aatgttttactaactgagctgtatc

SEQ ID NO: 85924 - DNA, 25 bp, Mus musculus
aatgttttactatctgagctgtatc

SEQ ID NO: 85925 - DNA, 25 bp, Mus musculus
aatgttttagacagacttattggag

SEQ ID NO: 85926 - DNA, 25 bp, Mus musculus
aatgttttagacagccttttttgct

SEQ ID NO: 85927 - DNA, 25 bp, Mus musculus
aatgttttagactgacttattggag

SEQ ID NO: 85928 - DNA, 25 bp, Mus musculus
aatgttttagactgccttttttgct

SEQ ID NO: 85929 - DNA, 25 bp, Mus musculus
aatgttttatcgcttccatgtgaat

SEQ ID NO: 85930 - DNA, 25 bp, Mus musculus
aatgttttatcggttccatgtgaat

SEQ ID NO: 85931 - DNA, 25 bp, Mus musculus
aatgttttatctctggcgttttctg

SEQ ID NO: 85932 - DNA, 25 bp, Mus musculus
aatgttttatctgtggcgttttctg

SEQ ID NO: 85933 - DNA, 25 bp, Mus musculus
aatgttttatgcacttttcttcaac

SEQ ID NO: 85934 - DNA, 25 bp, Mus musculus
aatgttttatgctcttttcttcaac

SEQ ID NO: 85935 - DNA, 25 bp, Mus musculus
aatgttttcaacagtctgtccacaa

SEQ ID NO: 85936 - DNA, 25 bp, Mus musculus
aatgttttcaactgtctgtccacaa

SEQ ID NO: 85937 - DNA, 25 bp, Mus musculus
aatgttttcaggaagcggacgccgc

SEQ ID NO: 85938 - DNA, 25 bp, Mus musculus
aatgttttcaggtagcggacgccgc

SEQ ID NO: 85939 - DNA, 25 bp, Mus musculus
aatgttttcccactgatacaacaga

SEQ ID NO: 85940 - DNA, 25 bp, Mus musculus
aatgttttcccagtgatacaacaga

SEQ ID NO: 85941 - DNA, 25 bp, Mus musculus
aatgttttcctaatacctgatgtaa

SEQ ID NO: 85942 - DNA, 25 bp, Mus musculus
aatgttttcctattacctgatgtaa

SEQ ID NO: 85943 - DNA, 25 bp, Mus musculus
aatgttttcctccacatctaatgtg

SEQ ID NO: 85944 - DNA, 25 bp, Mus musculus
aatgttttcctcgacatctaatgtg

SEQ ID NO: 85945 - DNA, 25 bp, Mus musculus
aatgttttctatattcactccttaa

SEQ ID NO: 85946 - DNA, 25 bp, Mus musculus
aatgttttctattttcactccttaa

SEQ ID NO: 85947 - DNA, 25 bp, Mus musculus
aatgttttctcccatcagcagggtg

SEQ ID NO: 85948 - DNA, 25 bp, Mus musculus
aatgttttctccgatcagcagggtg

SEQ ID NO: 85949 - DNA, 25 bp, Mus musculus
aatgttttctggcagtctgattgtc

SEQ ID NO: 85950 - DNA, 25 bp, Mus musculus
aatgttttctgggagtctgattgtc

SEQ ID NO: 85951 - DNA, 25 bp, Mus musculus
aatgttttcttaactgattgtcagt

SEQ ID NO: 85952 - DNA, 25 bp, Mus musculus
aatgttttcttaccacatgtgttaa

SEQ ID NO: 85953 - DNA, 25 bp, Mus musculus
aatgttttcttagcacatgtgttaa

SEQ ID NO: 85954 - DNA, 25 bp, Mus musculus
aatgttttcttatctgattgtcagt

SEQ ID NO: 85955 - DNA, 25 bp, Mus musculus
aatgttttcttgatccctgccataa

SEQ ID NO: 85956 - DNA, 25 bp, Mus musculus
aatgttttcttgttccctgccataa

SEQ ID NO: 85957 - DNA, 25 bp, Mus musculus
aatgttttgattcccaattcatgtg

SEQ ID NO: 85958 - DNA, 25 bp, Mus musculus
aatgttttgattgccaattcatgtg

SEQ ID NO: 85959 - DNA, 25 bp, Mus musculus
aatgttttgccaagctgggcagtgg

SEQ ID NO: 85960 - DNA, 25 bp, Mus musculus
aatgttttgccatgctgggcagtgg

SEQ ID NO: 85961 - DNA, 25 bp, Mus musculus
aatgttttgcctagttcttctgcct

SEQ ID NO: 85962 - DNA, 25 bp, Mus musculus
aatgttttgccttgttcttctgcct

SEQ ID NO: 85963 - DNA, 25 bp, Mus musculus
aatgttttggcaattgtcctgcagt

SEQ ID NO: 85964 - DNA, 25 bp, Mus musculus
aatgttttggcatttgtcctgcagt

SEQ ID NO: 85965 - DNA, 25 bp, Mus musculus
aatgttttgtagagaacccagggtg

SEQ ID NO: 85966 - DNA, 25 bp, Mus musculus
aatgttttgtagtgaacccagggtg

SEQ ID NO: 85967 - DNA, 25 bp, Mus musculus
aatgttttgttcagcagttcttccc

SEQ ID NO: 85968 - DNA, 25 bp, Mus musculus
aatgttttgttccatcagcgccaat

SEQ ID NO: 85969 - DNA, 25 bp, Mus musculus
aatgttttgttcgatcagcgccaat

SEQ ID NO: 85970 - DNA, 25 bp, Mus musculus
aatgttttgttctgcagttcttccc

SEQ ID NO: 85971 - DNA, 25 bp, Mus musculus
aatgtttttacactttcattgtgaa

SEQ ID NO: 85972 - DNA, 25 bp, Mus musculus
aatgtttttacagtttcattgtgaa

SEQ ID NO: 85973 - DNA, 25 bp, Mus musculus
aatgtttttgagacgcctgtaggga

SEQ ID NO: 85974 - DNA, 25 bp, Mus musculus
aatgtttttgagtcgcctgtaggga

SEQ ID NO: 85975 - DNA, 25 bp, Mus musculus
aatgtttttgttacatccgagtgac

SEQ ID NO: 85976 - DNA, 25 bp, Mus musculus
aatgtttttgttctgtagctccttc

SEQ ID NO: 85977 - DNA, 25 bp, Mus musculus
aatgtttttgttgtgtagctccttc

SEQ ID NO: 85978 - DNA, 25 bp, Mus musculus
aatgtttttgtttcatccgagtgac

SEQ ID NO: 85979 - DNA, 25 bp, Mus musculus
aattaaaaaagtctctcactctgta

SEQ ID NO: 85980 - DNA, 25 bp, Mus musculus
aattaaaaaagtgtctcactctgta

SEQ ID NO: 85981 - DNA, 25 bp, Mus musculus
aattaaaacgtgcacctgggccagg

SEQ ID NO: 85982 - DNA, 25 bp, Mus musculus
aattaaaacgtggacctgggccagg

SEQ ID NO: 85983 - DNA, 25 bp, Mus musculus
aattaaaagtccctagatgcaaaat

SEQ ID NO: 85984 - DNA, 25 bp, Mus musculus
aattaaaagtccgtagatgcaaaat

SEQ ID NO: 85985 - DNA, 25 bp, Mus musculus
aattaaacggttacagcgaaggcat

SEQ ID NO: 85986 - DNA, 25 bp, Mus musculus
aattaaacggtttcagcgaaggcat

SEQ ID NO: 85987 - DNA, 25 bp, Mus musculus
aattaaactcggactgggctagctt

SEQ ID NO: 85988 - DNA, 25 bp, Mus musculus
aattaaactcggtctgggctagctt

SEQ ID NO: 85989 - DNA, 25 bp, Mus musculus
aattaaactgtgcagcggctggagc

SEQ ID NO: 85990 - DNA, 25 bp, Mus musculus
aattaaactgtggagcggctggagc

SEQ ID NO: 85991 - DNA, 25 bp, Mus musculus
aattaaacttagcatcttccctgcc

SEQ ID NO: 85992 - DNA, 25 bp, Mus musculus
aattaaacttaggatcttccctgcc

SEQ ID NO: 85993 - DNA, 25 bp, Mus musculus
aattaaaggcctcagatgtttctgg

SEQ ID NO: 85994 - DNA, 25 bp, Mus musculus
aattaaaggcctgagatgtttctgg

SEQ ID NO: 85995 - DNA, 25 bp, Mus musculus
aattaaataattcagccctccagca

SEQ ID NO: 85996 - DNA, 25 bp, Mus musculus
aattaaataattgagccctccagca

SEQ ID NO: 85997 - DNA, 25 bp, Mus musculus
aattaaatcacaaagagcagaacaa

SEQ ID NO: 85998 - DNA, 25 bp, Mus musculus
aattaaatcacatagagcagaacaa

SEQ ID NO: 85999 - DNA, 25 bp, Mus musculus
aattaaattcagagagccacacatg

SEQ ID NO: 86000 - DNA, 25 bp, Mus musculus
aattaaattcagtgagccacacatg

SEQ ID NO: 86001 - DNA, 25 bp, Mus musculus
aattaaattctacaggctttgacta

SEQ ID NO: 86002 - DNA, 25 bp, Mus musculus
aattaaattctagaggctttgacta

SEQ ID NO: 86003 - DNA, 25 bp, Mus musculus
aattaacacttgctgacttctaaaa

SEQ ID NO: 86004 - DNA, 25 bp, Mus musculus
aattaacacttggtgacttctaaaa

SEQ ID NO: 86005 - DNA, 25 bp, Mus musculus
aattaacactttacacctcttggct

SEQ ID NO: 86006 - DNA, 25 bp, Mus musculus
aattaacacttttcacctcttggct

SEQ ID NO: 86007 - DNA, 25 bp, Mus musculus
aattaacagtgtcttctgccatccc

SEQ ID NO: 86008 - DNA, 25 bp, Mus musculus
aattaacagtgtgttctgccatccc

SEQ ID NO: 86009 - DNA, 25 bp, Mus musculus
aattaacatcacactgcttttccac

SEQ ID NO: 86010 - DNA, 25 bp, Mus musculus
aattaacatcactctgcttttccac

SEQ ID NO: 86011 - DNA, 25 bp, Mus musculus
aattaacatcttcttttcctgctga

SEQ ID NO: 86012 - DNA, 25 bp, Mus musculus
aattaacatcttgttttcctgctga

SEQ ID NO: 86013 - DNA, 25 bp, Mus musculus
aattaaccaagtcatcttatttata

SEQ ID NO: 86014 - DNA, 25 bp, Mus musculus
aattaaccaagtgatcttatttata

SEQ ID NO: 86015 - DNA, 25 bp, Mus musculus
aattaaccaatcaatgtccgaaggg

SEQ ID NO: 86016 - DNA, 25 bp, Mus musculus
aattaaccaatctatgtccgaaggg

SEQ ID NO: 86017 - DNA, 25 bp, Mus musculus
aattaacccttcaatgctgctttct

SEQ ID NO: 86018 - DNA, 25 bp, Mus musculus
aattaacccttctatgctgctttct

SEQ ID NO: 86019 - DNA, 25 bp, Mus musculus
aattaacctgcacttattccaagcc

SEQ ID NO: 86020 - DNA, 25 bp, Mus musculus
aattaacctgcagttattccaagcc

SEQ ID NO: 86021 - DNA, 25 bp, Mus musculus
aattaactaaagcatcttgcaataa

SEQ ID NO: 86022 - DNA, 25 bp, Mus musculus
aattaactaaaggatcttgcaataa

SEQ ID NO: 86023 - DNA, 25 bp, Mus musculus
aattaactacccaggcagcaactgc

SEQ ID NO: 86024 - DNA, 25 bp, Mus musculus
aattaactaccctggcagcaactgc

SEQ ID NO: 86025 - DNA, 25 bp, Mus musculus
aattaactagctagccctgcacatg

SEQ ID NO: 86026 - DNA, 25 bp, Mus musculus
aattaactagcttgccctgcacatg

SEQ ID NO: 86027 - DNA, 25 bp, Mus musculus
aattaactatcaacggctgtcctga

SEQ ID NO: 86028 - DNA, 25 bp, Mus musculus
aattaactatcatcggctgtcctga

SEQ ID NO: 86029 - DNA, 25 bp, Mus musculus
aattaactatggactgggcagagcg

SEQ ID NO: 86030 - DNA, 25 bp, Mus musculus
aattaactatggtctgggcagagcg

SEQ ID NO: 86031 - DNA, 25 bp, Mus musculus
aattaactcataagtggccctgcca

SEQ ID NO: 86032 - DNA, 25 bp, Mus musculus
aattaactcatatgtggccctgcca

SEQ ID NO: 86033 - DNA, 25 bp, Mus musculus
aattaactcggcactctcaggtgac

SEQ ID NO: 86034 - DNA, 25 bp, Mus musculus
aattaactcggctctctcaggtgac

SEQ ID NO: 86035 - DNA, 25 bp, Mus musculus
aattaactcgtccatttgcttgtgt

SEQ ID NO: 86036 - DNA, 25 bp, Mus musculus
aattaactcgtcgatttgcttgtgt

SEQ ID NO: 86037 - DNA, 25 bp, Mus musculus
aattaactgaaaattcgatgggcaa

SEQ ID NO: 86038 - DNA, 25 bp, Mus musculus
aattaactgaaatttcgatgggcaa

SEQ ID NO: 86039 - DNA, 25 bp, Mus musculus
aattaactgccacagcaggcagaaa

SEQ ID NO: 86040 - DNA, 25 bp, Mus musculus
aattaactgccagagcaggcagaaa

SEQ ID NO: 86041 - DNA, 25 bp, Mus musculus
aattaactggaaatcagacatctcc

SEQ ID NO: 86042 - DNA, 25 bp, Mus musculus
aattaactggaattcagacatctcc

SEQ ID NO: 86043 - DNA, 25 bp, Mus musculus
aattaactgtatctttgtatgacag

SEQ ID NO: 86044 - DNA, 25 bp, Mus musculus
aattaactgtatgtttgtatgacag

SEQ ID NO: 86045 - DNA, 25 bp, Mus musculus
aattaactgttcacctcagctgggc

SEQ ID NO: 86046 - DNA, 25 bp, Mus musculus
aattaactgttctcctcagctgggc

SEQ ID NO: 86047 - DNA, 25 bp, Mus musculus
aattaacttattacctctcccacat

SEQ ID NO: 86048 - DNA, 25 bp, Mus musculus
aattaacttatttcctctcccacat

SEQ ID NO: 86049 - DNA, 25 bp, Mus musculus
aattaacttccaagtggtccgaatg

SEQ ID NO: 86050 - DNA, 25 bp, Mus musculus
aattaacttccatgtggtccgaatg

SEQ ID NO: 86051 - DNA, 25 bp, Mus musculus
aattaacttttgaacagtctgggca

SEQ ID NO: 86052 - DNA, 25 bp, Mus musculus
aattaacttttgtacagtctgggca

SEQ ID NO: 86053 - DNA, 25 bp, Mus musculus
aattaagaatccagtgtccgaccac

SEQ ID NO: 86054 - DNA, 25 bp, Mus musculus
aattaagaatcctgtgtccgaccac

SEQ ID NO: 86055 - DNA, 25 bp, Mus musculus
aattaagactttcccatgaccctag

SEQ ID NO: 86056 - DNA, 25 bp, Mus musculus
aattaagactttgccatgaccctag

SEQ ID NO: 86057 - DNA, 25 bp, Mus musculus
aattaagagcgcctgggtttatgca

SEQ ID NO: 86058 - DNA, 25 bp, Mus musculus
aattaagagcgcgtgggtttatgca

SEQ ID NO: 86059 - DNA, 25 bp, Mus musculus
aattaagaggccatcttcctagatg

SEQ ID NO: 86060 - DNA, 25 bp, Mus musculus
aattaagaggccttcttcctagatg

SEQ ID NO: 86061 - DNA, 25 bp, Mus musculus
aattaagagtgtacttgagccaggc

SEQ ID NO: 86062 - DNA, 25 bp, Mus musculus
aattaagagtgttcttgagccaggc

SEQ ID NO: 86063 - DNA, 25 bp, Mus musculus
aattaagattatcagccaggcagat

SEQ ID NO: 86064 - DNA, 25 bp, Mus musculus
aattaagattatgagccaggcagat

SEQ ID NO: 86065 - DNA, 25 bp, Mus musculus
aattaagcaagaccgctactccatt

SEQ ID NO: 86066 - DNA, 25 bp, Mus musculus
aattaagcaagagcgctactccatt

SEQ ID NO: 86067 - DNA, 25 bp, Mus musculus
aattaagcacttcaattcttgttaa

SEQ ID NO: 86068 - DNA, 25 bp, Mus musculus
aattaagcacttgaattcttgttaa

SEQ ID NO: 86069 - DNA, 25 bp, Mus musculus
aattaagcatgcctacgagtgccct

SEQ ID NO: 86070 - DNA, 25 bp, Mus musculus
aattaagcatgcgtacgagtgccct

SEQ ID NO: 86071 - DNA, 25 bp, Mus musculus
aattaagctccacaagaaggacttc

SEQ ID NO: 86072 - DNA, 25 bp, Mus musculus
aattaagctccagaagaaggacttc

SEQ ID NO: 86073 - DNA, 25 bp, Mus musculus
aattaagctgaaccctgcttagtcc

SEQ ID NO: 86074 - DNA, 25 bp, Mus musculus
aattaagctgaagcctgcttagtcc

SEQ ID NO: 86075 - DNA, 25 bp, Mus musculus
aattaagctgtcaccagaccatctg

SEQ ID NO: 86076 - DNA, 25 bp, Mus musculus
aattaagctgtctccagaccatctg

SEQ ID NO: 86077 - DNA, 25 bp, Mus musculus
aattaaggatcacgcacacacacac

SEQ ID NO: 86078 - DNA, 25 bp, Mus musculus
aattaaggatcaggcacacacacac

SEQ ID NO: 86079 - DNA, 25 bp, Mus musculus
aattaaggcagcactgtatcctccc

SEQ ID NO: 86080 - DNA, 25 bp, Mus musculus
aattaaggcagctctgtatcctccc

SEQ ID NO: 86081 - DNA, 25 bp, Mus musculus
aattaaggcgagagccccggagtcg

SEQ ID NO: 86082 - DNA, 25 bp, Mus musculus
aattaaggcgagtgccccggagtcg

SEQ ID NO: 86083 - DNA, 25 bp, Mus musculus
aattaagtattcacatcgtgccgtt

SEQ ID NO: 86084 - DNA, 25 bp, Mus musculus
aattaagtattctcatcgtgccgtt

SEQ ID NO: 86085 - DNA, 25 bp, Mus musculus
aattaagtatttaccagcagtccaa

SEQ ID NO: 86086 - DNA, 25 bp, Mus musculus
aattaagtattttccagcagtccaa

SEQ ID NO: 86087 - DNA, 25 bp, Mus musculus
aattaagtcaagcagcccctcggct

SEQ ID NO: 86088 - DNA, 25 bp, Mus musculus
aattaagtcaaggagcccctcggct

SEQ ID NO: 86089 - DNA, 25 bp, Mus musculus
aattaagtcattcaggacccctctc

SEQ ID NO: 86090 - DNA, 25 bp, Mus musculus
aattaagtcattgaggacccctctc

SEQ ID NO: 86091 - DNA, 25 bp, Mus musculus
aattaagtgaatatgcatctagagc

SEQ ID NO: 86092 - DNA, 25 bp, Mus musculus
aattaagtgaatttgcatctagagc

SEQ ID NO: 86093 - DNA, 25 bp, Mus musculus
aattaagtgagtccattctccatgg

SEQ ID NO: 86094 - DNA, 25 bp, Mus musculus
aattaagtgagtgcattctccatgg

SEQ ID NO: 86095 - DNA, 25 bp, Mus musculus
aattaagtgcatcggctaccacacc

SEQ ID NO: 86096 - DNA, 25 bp, Mus musculus
aattaagtgcatgggctaccacacc

SEQ ID NO: 86097 - DNA, 25 bp, Mus musculus
aattaagtggtgattgcaggcaagt

SEQ ID NO: 86098 - DNA, 25 bp, Mus musculus
aattaagtggtgtttgcaggcaagt

SEQ ID NO: 86099 - DNA, 25 bp, Mus musculus
aattaataccacatctgagcagcca

SEQ ID NO: 86100 - DNA, 25 bp, Mus musculus
aattaataccacttctgagcagcca

SEQ ID NO: 86101 - DNA, 25 bp, Mus musculus
aattaatacctcctcatagaagtgg

SEQ ID NO: 86102 - DNA, 25 bp, Mus musculus
aattaatacctcgtcatagaagtgg

SEQ ID NO: 86103 - DNA, 25 bp, Mus musculus
aattaatatcttctgatggccatga

SEQ ID NO: 86104 - DNA, 25 bp, Mus musculus
aattaatatcttgtgatggccatga

SEQ ID NO: 86105 - DNA, 25 bp, Mus musculus
aattaatattccaggcctccaggca

SEQ ID NO: 86106 - DNA, 25 bp, Mus musculus
aattaatattcctggcctccaggca

SEQ ID NO: 86107 - DNA, 25 bp, Mus musculus
aattaatccccactttccttctgtg

SEQ ID NO: 86108 - DNA, 25 bp, Mus musculus
aattaatccccagtttccttctgtg

SEQ ID NO: 86109 - DNA, 25 bp, Mus musculus
aattaatcctttctatctccttcat

SEQ ID NO: 86110 - DNA, 25 bp, Mus musculus
aattaatcctttgtatctccttcat

SEQ ID NO: 86111 - DNA, 25 bp, Mus musculus
aattaatctctgctatgacctcatt

SEQ ID NO: 86112 - DNA, 25 bp, Mus musculus
aattaatctctggtatgacctcatt

SEQ ID NO: 86113 - DNA, 25 bp, Mus musculus
aattaatgatgaagctgtgactctg

SEQ ID NO: 86114 - DNA, 25 bp, Mus musculus
aattaatgatgatgctgtgactctg

SEQ ID NO: 86115 - DNA, 25 bp, Mus musculus
aattaatgcatcagttaatcctgtg

SEQ ID NO: 86116 - DNA, 25 bp, Mus musculus
aattaatgcatctgttaatcctgtg

SEQ ID NO: 86117 - DNA, 25 bp, Mus musculus
aattaatgcccgatggaccacagag

SEQ ID NO: 86118 - DNA, 25 bp, Mus musculus
aattaatgcccgttggaccacagag

SEQ ID NO: 86119 - DNA, 25 bp, Mus musculus
aattaatgcctcaattttcctcttc

SEQ ID NO: 86120 - DNA, 25 bp, Mus musculus
aattaatgcctctattttcctcttc

SEQ ID NO: 86121 - DNA, 25 bp, Mus musculus
aattaatgcctgctggaggccttgc

SEQ ID NO: 86122 - DNA, 25 bp, Mus musculus
aattaatgcctggtggaggccttgc

SEQ ID NO: 86123 - DNA, 25 bp, Mus musculus
aattaatgctgtcgcggtttgtctc

SEQ ID NO: 86124 - DNA, 25 bp, Mus musculus
aattaatgctgtggcggtttgtctc

SEQ ID NO: 86125 - DNA, 25 bp, Mus musculus
aattaatgtattccgtatcccgctg

SEQ ID NO: 86126 - DNA, 25 bp, Mus musculus
aattaatgtattgcgtatcccgctg

SEQ ID NO: 86127 - DNA, 25 bp, Mus musculus
aattaatgtccaccacagatcttcc

SEQ ID NO: 86128 - DNA, 25 bp, Mus musculus
aattaatgtccagcacagatcttcc

SEQ ID NO: 86129 - DNA, 25 bp, Mus musculus
aattaatgtcccatcttgttataga

SEQ ID NO: 86130 - DNA, 25 bp, Mus musculus
aattaatgtcccttcttgttataga

SEQ ID NO: 86131 - DNA, 25 bp, Mus musculus
aattaattaccaaagcagcttgatg

SEQ ID NO: 86132 - DNA, 25 bp, Mus musculus
aattaattaccatagcagcttgatg

SEQ ID NO: 86133 - DNA, 25 bp, Mus musculus
aattaattagctcttatcgtgtgag

SEQ ID NO: 86134 - DNA, 25 bp, Mus musculus
aattaattagctgttatcgtgtgag

SEQ ID NO: 86135 - DNA, 25 bp, Mus musculus
aattaattcaacatcatctgtggtg

SEQ ID NO: 86136 - DNA, 25 bp, Mus musculus
aattaattcaacttcatctgtggtg

SEQ ID NO: 86137 - DNA, 25 bp, Mus musculus
aattaattcactagaccgcgggtgt

SEQ ID NO: 86138 - DNA, 25 bp, Mus musculus
aattaattcacttgaccgcgggtgt

SEQ ID NO: 86139 - DNA, 25 bp, Mus musculus
aattaattcctacgtgccagggaat

SEQ ID NO: 86140 - DNA, 25 bp, Mus musculus
aattaattcctaggtgccagggaat

SEQ ID NO: 86141 - DNA, 25 bp, Mus musculus
aattaattccttctccaaatcctga

SEQ ID NO: 86142 - DNA, 25 bp, Mus musculus
aattaattccttgtccaaatcctga

SEQ ID NO: 86143 - DNA, 25 bp, Mus musculus
aattaattctccattccaccatgtg

SEQ ID NO: 86144 - DNA, 25 bp, Mus musculus
aattaattctcctttccaccatgtg

SEQ ID NO: 86145 - DNA, 25 bp, Mus musculus
aattaattctcgagactggtccagg

SEQ ID NO: 86146 - DNA, 25 bp, Mus musculus
aattaattctcgtgactggtccagg

SEQ ID NO: 86147 - DNA, 25 bp, Mus musculus
aattaattgatgaaggtgtctccgg

SEQ ID NO: 86148 - DNA, 25 bp, Mus musculus
aattaattgatgtaggtgtctccgg

SEQ ID NO: 86149 - DNA, 25 bp, Mus musculus
aattaattgcctatcacagttgatt

SEQ ID NO: 86150 - DNA, 25 bp, Mus musculus
aattaattgcctttcacagttgatt

SEQ ID NO: 86151 - DNA, 25 bp, Mus musculus
aattaattgcttatccacttataga

SEQ ID NO: 86152 - DNA, 25 bp, Mus musculus
aattaattgcttttccacttataga

SEQ ID NO: 86153 - DNA, 25 bp, Mus musculus
aattaattttcacttcctgatattt

SEQ ID NO: 86154 - DNA, 25 bp, Mus musculus
aattaattttcagttcctgatattt

SEQ ID NO: 86155 - DNA, 25 bp, Mus musculus
aattacaacatgaacgatgccctct

SEQ ID NO: 86156 - DNA, 25 bp, Mus musculus
aattacaacatgtacgatgccctct

SEQ ID NO: 86157 - DNA, 25 bp, Mus musculus
aattacaactgtatgcctcactacc

SEQ ID NO: 86158 - DNA, 25 bp, Mus musculus
aattacaactgtttgcctcactacc

SEQ ID NO: 86159 - DNA, 25 bp, Mus musculus
aattacacagatctatttccctgga

SEQ ID NO: 86160 - DNA, 25 bp, Mus musculus
aattacacagatgtatttccctgga

SEQ ID NO: 86161 - DNA, 25 bp, Mus musculus
aattacacctgcaaccaggcgtagt

SEQ ID NO: 86162 - DNA, 25 bp, Mus musculus
aattacacctgctaccaggcgtagt

SEQ ID NO: 86163 - DNA, 25 bp, Mus musculus
aattacactgaccaagtcacaatgt

SEQ ID NO: 86164 - DNA, 25 bp, Mus musculus
aattacactgacgaagtcacaatgt

SEQ ID NO: 86165 - DNA, 25 bp, Mus musculus
aattacactgttccgatgccttggg

SEQ ID NO: 86166 - DNA, 25 bp, Mus musculus
aattacactgttgcgatgccttggg

SEQ ID NO: 86167 - DNA, 25 bp, Mus musculus
aattacagagtgagcttagtctcag

SEQ ID NO: 86168 - DNA, 25 bp, Mus musculus
aattacagagtgtgcttagtctcag

SEQ ID NO: 86169 - DNA, 25 bp, Mus musculus
aattacagcaccaaaccactggtcg

SEQ ID NO: 86170 - DNA, 25 bp, Mus musculus
aattacagcacctaaccactggtcg

SEQ ID NO: 86171 - DNA, 25 bp, Mus musculus
aattacagcctgaggtttgggcaat

SEQ ID NO: 86172 - DNA, 25 bp, Mus musculus
aattacagcctgtggtttgggcaat

SEQ ID NO: 86173 - DNA, 25 bp, Mus musculus
aattacaggctgacttgggcactag

SEQ ID NO: 86174 - DNA, 25 bp, Mus musculus
aattacaggctgtcttgggcactag

SEQ ID NO: 86175 - DNA, 25 bp, Mus musculus
aattacagtgtcattgcacaaagca

SEQ ID NO: 86176 - DNA, 25 bp, Mus musculus
aattacagtgtctttgcacaaagca

SEQ ID NO: 86177 - DNA, 25 bp, Mus musculus
aattacataagtccatctccacgca

SEQ ID NO: 86178 - DNA, 25 bp, Mus musculus
aattacataagtgcatctccacgca

SEQ ID NO: 86179 - DNA, 25 bp, Mus musculus
aattacatcactagttccactgtgt

SEQ ID NO: 86180 - DNA, 25 bp, Mus musculus
aattacatcacttgttccactgtgt

SEQ ID NO: 86181 - DNA, 25 bp, Mus musculus
aattacatccgcagcttgatccgca

SEQ ID NO: 86182 - DNA, 25 bp, Mus musculus
aattacatccgctgcttgatccgca

SEQ ID NO: 86183 - DNA, 25 bp, Mus musculus
aattacatgaaacccttctaaggtt

SEQ ID NO: 86184 - DNA, 25 bp, Mus musculus
aattacatgaaagccttctaaggtt

SEQ ID NO: 86185 - DNA, 25 bp, Mus musculus
aattacatgctgacgtgctctgcca

SEQ ID NO: 86186 - DNA, 25 bp, Mus musculus
aattacatgctgtcgtgctctgcca

SEQ ID NO: 86187 - DNA, 25 bp, Mus musculus
aattacatgtgtcggaggttcctaa

SEQ ID NO: 86188 - DNA, 25 bp, Mus musculus
aattacatgtgtgggaggttcctaa

SEQ ID NO: 86189 - DNA, 25 bp, Mus musculus
aattacattcacatgaacctgttca

SEQ ID NO: 86190 - DNA, 25 bp, Mus musculus
aattacattcacttgaacctgttca

SEQ ID NO: 86191 - DNA, 25 bp, Mus musculus
aattacattcctagtttgtgactgt

SEQ ID NO: 86192 - DNA, 25 bp, Mus musculus
aattacattccttgtttgtgactgt

SEQ ID NO: 86193 - DNA, 25 bp, Mus musculus
aattacattgtgctgtgacgggtta

SEQ ID NO: 86194 - DNA, 25 bp, Mus musculus
aattacattgtggtgtgacgggtta

SEQ ID NO: 86195 - DNA, 25 bp, Mus musculus
aattacatttctatatacaactttg

SEQ ID NO: 86196 - DNA, 25 bp, Mus musculus
aattacatttctttatacaactttg

SEQ ID NO: 86197 - DNA, 25 bp, Mus musculus
aattaccacattaagctctctgtcc

SEQ ID NO: 86198 - DNA, 25 bp, Mus musculus
aattaccacatttagctctctgtcc

SEQ ID NO: 86199 - DNA, 25 bp, Mus musculus
aattaccagcaacttcatatgtgat

SEQ ID NO: 86200 - DNA, 25 bp, Mus musculus
aattaccagcaagttcatatgtgat

SEQ ID NO: 86201 - DNA, 25 bp, Mus musculus
aattaccagcctaacttacaagcag

SEQ ID NO: 86202 - DNA, 25 bp, Mus musculus
aattaccagccttacttacaagcag

SEQ ID NO: 86203 - DNA, 25 bp, Mus musculus
aattaccagcttatattcttatcga

SEQ ID NO: 86204 - DNA, 25 bp, Mus musculus
aattaccagcttttattcttatcga

SEQ ID NO: 86205 - DNA, 25 bp, Mus musculus
aattaccagtatcctacgcctttgc

SEQ ID NO: 86206 - DNA, 25 bp, Mus musculus
aattaccagtatgctacgcctttgc

SEQ ID NO: 86207 - DNA, 25 bp, Mus musculus
aattaccataatagtcccgatttct

SEQ ID NO: 86208 - DNA, 25 bp, Mus musculus
aattaccataatatgcctaaaagca

SEQ ID NO: 86209 - DNA, 25 bp, Mus musculus
aattaccataattgtcccgatttct

SEQ ID NO: 86210 - DNA, 25 bp, Mus musculus
aattaccataatttgcctaaaagca

SEQ ID NO: 86211 - DNA, 25 bp, Mus musculus
aattaccatagcacactgggactgg

SEQ ID NO: 86212 - DNA, 25 bp, Mus musculus
aattaccatagctcactgggactgg

SEQ ID NO: 86213 - DNA, 25 bp, Mus musculus
aattaccatgtgcacaagggcccgt

SEQ ID NO: 86214 - DNA, 25 bp, Mus musculus
aattaccatgtggacaagggcccgt

SEQ ID NO: 86215 - DNA, 25 bp, Mus musculus
aattaccattctccatgtttctgac

SEQ ID NO: 86216 - DNA, 25 bp, Mus musculus
aattaccattctgcatgtttctgac

SEQ ID NO: 86217 - DNA, 25 bp, Mus musculus
aattaccccagaaatgtagttcatg

SEQ ID NO: 86218 - DNA, 25 bp, Mus musculus
aattaccccagatatgtagttcatg

SEQ ID NO: 86219 - DNA, 25 bp, Mus musculus
aattaccccgttaatctcagttgat

SEQ ID NO: 86220 - DNA, 25 bp, Mus musculus
aattaccccgtttatctcagttgat

SEQ ID NO: 86221 - DNA, 25 bp, Mus musculus
aattaccctctaaccatgagcagat

SEQ ID NO: 86222 - DNA, 25 bp, Mus musculus
aattaccctctatccatgagcagat

SEQ ID NO: 86223 - DNA, 25 bp, Mus musculus
aattaccctgtaatttgccatctct

SEQ ID NO: 86224 - DNA, 25 bp, Mus musculus
aattaccctgtattttgccatctct

SEQ ID NO: 86225 - DNA, 25 bp, Mus musculus
aattaccgatgtacctgtgaccctg

SEQ ID NO: 86226 - DNA, 25 bp, Mus musculus
aattaccgatgttcctgtgaccctg

SEQ ID NO: 86227 - DNA, 25 bp, Mus musculus
aattaccgctggatcaagtagtgaa

SEQ ID NO: 86228 - DNA, 25 bp, Mus musculus
aattaccgctggttcaagtagtgaa

SEQ ID NO: 86229 - DNA, 25 bp, Mus musculus
aattacctattgacaactcagccca

SEQ ID NO: 86230 - DNA, 25 bp, Mus musculus
aattacctattgtcaactcagccca

SEQ ID NO: 86231 - DNA, 25 bp, Mus musculus
aattacctctctcgttttggtggca

SEQ ID NO: 86232 - DNA, 25 bp, Mus musculus
aattacctctctggttttggtggca

SEQ ID NO: 86233 - DNA, 25 bp, Mus musculus
aattacctgctgactactgctgaaa

SEQ ID NO: 86234 - DNA, 25 bp, Mus musculus
aattacctgctgtctactgctgaaa

SEQ ID NO: 86235 - DNA, 25 bp, Mus musculus
aattacctgtacctttggacgacat

SEQ ID NO: 86236 - DNA, 25 bp, Mus musculus
aattacctgtacgtttggacgacat

SEQ ID NO: 86237 - DNA, 25 bp, Mus musculus
aattacctgtgacgtcacgtgctgc

SEQ ID NO: 86238 - DNA, 25 bp, Mus musculus
aattacctgtgaggtcacgtgctgc

SEQ ID NO: 86239 - DNA, 25 bp, Mus musculus
aattaccttaatccagtcagctctg

SEQ ID NO: 86240 - DNA, 25 bp, Mus musculus
aattaccttaatgcagtcagctctg

SEQ ID NO: 86241 - DNA, 25 bp, Mus musculus
aattaccttcagaggtctgtcttgt

SEQ ID NO: 86242 - DNA, 25 bp, Mus musculus
aattaccttcagtggtctgtcttgt

SEQ ID NO: 86243 - DNA, 25 bp, Mus musculus
aattaccttcgcagtgttcgcagaa

SEQ ID NO: 86244 - DNA, 25 bp, Mus musculus
aattaccttcgctgtgttcgcagaa

SEQ ID NO: 86245 - DNA, 25 bp, Mus musculus
aattaccttcttaccattacaatga

SEQ ID NO: 86246 - DNA, 25 bp, Mus musculus
aattaccttctttccattacaatga

SEQ ID NO: 86247 - DNA, 25 bp, Mus musculus
aattaccttgacattcacatcagaa

SEQ ID NO: 86248 - DNA, 25 bp, Mus musculus
aattaccttgactttcacatcagaa

SEQ ID NO: 86249 - DNA, 25 bp, Mus musculus
aattacgaaggtcgccacatctcgc

SEQ ID NO: 86250 - DNA, 25 bp, Mus musculus
aattacgaaggtggccacatctcgc

SEQ ID NO: 86251 - DNA, 25 bp, Mus musculus
aattacgagcagcagatcccagcac

SEQ ID NO: 86252 - DNA, 25 bp, Mus musculus
aattacgagcaggagatcccagcac

SEQ ID NO: 86253 - DNA, 25 bp, Mus musculus
aattacgccgttcatctgtcagagg

SEQ ID NO: 86254 - DNA, 25 bp, Mus musculus
aattacgccgttgatctgtcagagg

SEQ ID NO: 86255 - DNA, 25 bp, Mus musculus
aattacggaatcacatctgggacat

SEQ ID NO: 86256 - DNA, 25 bp, Mus musculus
aattacggaatctcatctgggacat

SEQ ID NO: 86257 - DNA, 25 bp, Mus musculus
aattacggaatgaactgcagacaga

SEQ ID NO: 86258 - DNA, 25 bp, Mus musculus
aattacggaatgtactgcagacaga

SEQ ID NO: 86259 - DNA, 25 bp, Mus musculus
aattacggccttcaacagcaggtgt

SEQ ID NO: 86260 - DNA, 25 bp, Mus musculus
aattacggccttgaacagcaggtgt

SEQ ID NO: 86261 - DNA, 25 bp, Mus musculus
aattacgtgttcaagactctgcttc

SEQ ID NO: 86262 - DNA, 25 bp, Mus musculus
aattacgtgttctagactctgcttc

SEQ ID NO: 86263 - DNA, 25 bp, Mus musculus
aattactaatttattcatctctgga

SEQ ID NO: 86264 - DNA, 25 bp, Mus musculus
aattactaattttttcatctctgga

SEQ ID NO: 86265 - DNA, 25 bp, Mus musculus
aattactacccaagttgtacaacag

SEQ ID NO: 86266 - DNA, 25 bp, Mus musculus
aattactacccatgttgtacaacag

SEQ ID NO: 86267 - DNA, 25 bp, Mus musculus
aattactactccagtgtgtctctcg

SEQ ID NO: 86268 - DNA, 25 bp, Mus musculus
aattactactcctgtgtgtctctcg

SEQ ID NO: 86269 - DNA, 25 bp, Mus musculus
aattactagtagctccaagttatat

SEQ ID NO: 86270 - DNA, 25 bp, Mus musculus
aattactagtaggtccaagttatat

SEQ ID NO: 86271 - DNA, 25 bp, Mus musculus
aattactagtgaccttctcttgctg

SEQ ID NO: 86272 - DNA, 25 bp, Mus musculus
aattactagtgagcttctcttgctg

SEQ ID NO: 86273 - DNA, 25 bp, Mus musculus
aattactattccatgcttttcttat

SEQ ID NO: 86274 - DNA, 25 bp, Mus musculus
aattactattccttgcttttcttat

SEQ ID NO: 86275 - DNA, 25 bp, Mus musculus
aattactattttactgttgcattca

SEQ ID NO: 86276 - DNA, 25 bp, Mus musculus
aattactatttttctgttgcattca

SEQ ID NO: 86277 - DNA, 25 bp, Mus musculus
aattactcaacgagacccaaagcca

SEQ ID NO: 86278 - DNA, 25 bp, Mus musculus
aattactcaacgtgacccaaagcca

SEQ ID NO: 86279 - DNA, 25 bp, Mus musculus
aattactcacgcagcatctgggtgt

SEQ ID NO: 86280 - DNA, 25 bp, Mus musculus
aattactcacgctgcatctgggtgt

SEQ ID NO: 86281 - DNA, 25 bp, Mus musculus
aattactcactgcagcagggcatga

SEQ ID NO: 86282 - DNA, 25 bp, Mus musculus
aattactcactggagcagggcatga

SEQ ID NO: 86283 - DNA, 25 bp, Mus musculus
aattactcagtcctcctcttaagag

SEQ ID NO: 86284 - DNA, 25 bp, Mus musculus
aattactcagtcgtcctcttaagag

SEQ ID NO: 86285 - DNA, 25 bp, Mus musculus
aattactcagttaaggtgacttaat

SEQ ID NO: 86286 - DNA, 25 bp, Mus musculus
aattactcagtttaggtgacttaat

SEQ ID NO: 86287 - DNA, 25 bp, Mus musculus
aattactcattaacctttcaatagg

SEQ ID NO: 86288 - DNA, 25 bp, Mus musculus
aattactcattatcctttcaatagg

SEQ ID NO: 86289 - DNA, 25 bp, Mus musculus
aattactccatgattcctacccagt

SEQ ID NO: 86290 - DNA, 25 bp, Mus musculus
aattactccatgtttcctacccagt

SEQ ID NO: 86291 - DNA, 25 bp, Mus musculus
aattactcgattctccgcggctgag

SEQ ID NO: 86292 - DNA, 25 bp, Mus musculus
aattactcgattgtccgcggctgag

SEQ ID NO: 86293 - DNA, 25 bp, Mus musculus
aattactctctaaatctctagcagg

SEQ ID NO: 86294 - DNA, 25 bp, Mus musculus
aattactctctatatctctagcagg

SEQ ID NO: 86295 - DNA, 25 bp, Mus musculus
aattactctgataattacctctcag

SEQ ID NO: 86296 - DNA, 25 bp, Mus musculus
aattactctgattattacctctcag

SEQ ID NO: 86297 - DNA, 25 bp, Mus musculus
aattactcttgcaactagagctgat

SEQ ID NO: 86298 - DNA, 25 bp, Mus musculus
aattactcttgctactagagctgat

SEQ ID NO: 86299 - DNA, 25 bp, Mus musculus
aattactcttgtagcacagtgggaa

SEQ ID NO: 86300 - DNA, 25 bp, Mus musculus
aattactcttgttgcacagtgggaa

SEQ ID NO: 86301 - DNA, 25 bp, Mus musculus
aattactcttttccttagaattcag

SEQ ID NO: 86302 - DNA, 25 bp, Mus musculus
aattactcttttgcttagaattcag

SEQ ID NO: 86303 - DNA, 25 bp, Mus musculus
aattactgacacaggacatgtccag

SEQ ID NO: 86304 - DNA, 25 bp, Mus musculus
aattactgacactggacatgtccag

SEQ ID NO: 86305 - DNA, 25 bp, Mus musculus
aattactgagatccatttgaatcaa

SEQ ID NO: 86306 - DNA, 25 bp, Mus musculus
aattactgagatgcatttgaatcaa

SEQ ID NO: 86307 - DNA, 25 bp, Mus musculus
aattactgctgtaacacctccattc

SEQ ID NO: 86308 - DNA, 25 bp, Mus musculus
aattactgctgttacacctccattc

SEQ ID NO: 86309 - DNA, 25 bp, Mus musculus
aattactgtaacctgagatgctgtc

SEQ ID NO: 86310 - DNA, 25 bp, Mus musculus
aattactgtaacgtgagatgctgtc

SEQ ID NO: 86311 - DNA, 25 bp, Mus musculus
aattactgtattacattggtgccta

SEQ ID NO: 86312 - DNA, 25 bp, Mus musculus
aattactgtatttcattggtgccta

SEQ ID NO: 86313 - DNA, 25 bp, Mus musculus
aattactgtgaaaatgaggtagcct

SEQ ID NO: 86314 - DNA, 25 bp, Mus musculus
aattactgtgaatatgaggtagcct

SEQ ID NO: 86315 - DNA, 25 bp, Mus musculus
aattactgtgtaatcatccctgata

SEQ ID NO: 86316 - DNA, 25 bp, Mus musculus
aattactgtgtattcatccctgata

SEQ ID NO: 86317 - DNA, 25 bp, Mus musculus
aattactgttatcaattcactcagg

SEQ ID NO: 86318 - DNA, 25 bp, Mus musculus
aattactgttatgaattcactcagg

SEQ ID NO: 86319 - DNA, 25 bp, Mus musculus
aattacttacagagtctctactccc

SEQ ID NO: 86320 - DNA, 25 bp, Mus musculus
aattacttacagtgtctctactccc

SEQ ID NO: 86321 - DNA, 25 bp, Mus musculus
aattacttatctctcatctgacatg

SEQ ID NO: 86322 - DNA, 25 bp, Mus musculus
aattacttatctgtcatctgacatg

SEQ ID NO: 86323 - DNA, 25 bp, Mus musculus
aattacttcactcccattagagcct

SEQ ID NO: 86324 - DNA, 25 bp, Mus musculus
aattacttcactgccattagagcct

SEQ ID NO: 86325 - DNA, 25 bp, Mus musculus
aattacttccaaatgcctgcagata

SEQ ID NO: 86326 - DNA, 25 bp, Mus musculus
aattacttccaattgcctgcagata

SEQ ID NO: 86327 - DNA, 25 bp, Mus musculus
aattacttcctgatgttgagcaaca

SEQ ID NO: 86328 - DNA, 25 bp, Mus musculus
aattacttcctgattatgtgcactg

SEQ ID NO: 86329 - DNA, 25 bp, Mus musculus
aattacttcctgttgttgagcaaca

SEQ ID NO: 86330 - DNA, 25 bp, Mus musculus
aattacttcctgtttatgtgcactg

SEQ ID NO: 86331 - DNA, 25 bp, Mus musculus
aattacttctccctaatatctatta

SEQ ID NO: 86332 - DNA, 25 bp, Mus musculus
aattacttctccgtaatatctatta

SEQ ID NO: 86333 - DNA, 25 bp, Mus musculus
aattacttgaagaatttgcctgctt

SEQ ID NO: 86334 - DNA, 25 bp, Mus musculus
aattacttgaagtatttgcctgctt

SEQ ID NO: 86335 - DNA, 25 bp, Mus musculus
aattactttcaaatggcccagccag

SEQ ID NO: 86336 - DNA, 25 bp, Mus musculus
aattactttcaattggcccagccag

SEQ ID NO: 86337 - DNA, 25 bp, Mus musculus
aattactttcagctgttttccatac

SEQ ID NO: 86338 - DNA, 25 bp, Mus musculus
aattactttcaggtgttttccatac

SEQ ID NO: 86339 - DNA, 25 bp, Mus musculus
aattacttttatctacaactgtttg

SEQ ID NO: 86340 - DNA, 25 bp, Mus musculus
aattacttttatgtacaactgtttg

SEQ ID NO: 86341 - DNA, 25 bp, Mus musculus
aattacttttcaatatctccccatc

SEQ ID NO: 86342 - DNA, 25 bp, Mus musculus
aattacttttcattatctccccatc

SEQ ID NO: 86343 - DNA, 25 bp, Mus musculus
aattagaaacctctgctggccgctg

SEQ ID NO: 86344 - DNA, 25 bp, Mus musculus
aattagaaacctgtgctggccgctg

SEQ ID NO: 86345 - DNA, 25 bp, Mus musculus
aattagaaggcacgcttctccgcag

SEQ ID NO: 86346 - DNA, 25 bp, Mus musculus
aattagaaggcaggcttctccgcag

SEQ ID NO: 86347 - DNA, 25 bp, Mus musculus
aattagaaggccctactccatcagc

SEQ ID NO: 86348 - DNA, 25 bp, Mus musculus
aattagaaggccgtactccatcagc

SEQ ID NO: 86349 - DNA, 25 bp, Mus musculus
aattagaatcctagagctcctcttg

SEQ ID NO: 86350 - DNA, 25 bp, Mus musculus
aattagaatccttgagctcctcttg

SEQ ID NO: 86351 - DNA, 25 bp, Mus musculus
aattagaatgcccagagagaaagcc

SEQ ID NO: 86352 - DNA, 25 bp, Mus musculus
aattagaatgccgagagagaaagcc

SEQ ID NO: 86353 - DNA, 25 bp, Mus musculus
aattagaatggacccagtggcgaca

SEQ ID NO: 86354 - DNA, 25 bp, Mus musculus
aattagaatggagccagtggcgaca

SEQ ID NO: 86355 - DNA, 25 bp, Mus musculus
aattagacagttctgtcacccaccc

SEQ ID NO: 86356 - DNA, 25 bp, Mus musculus
aattagacagttgtgtcacccaccc

SEQ ID NO: 86357 - DNA, 25 bp, Mus musculus
aattagacgctaagaatgtatgctc

SEQ ID NO: 86358 - DNA, 25 bp, Mus musculus
aattagacgctatgaatgtatgctc

SEQ ID NO: 86359 - DNA, 25 bp, Mus musculus
aattagagccacaacttggtgcctc

SEQ ID NO: 86360 - DNA, 25 bp, Mus musculus
aattagagccactacttggtgcctc

SEQ ID NO: 86361 - DNA, 25 bp, Mus musculus
aattagagcctgactgttctttaga

SEQ ID NO: 86362 - DNA, 25 bp, Mus musculus
aattagagcctgtctgttctttaga

SEQ ID NO: 86363 - DNA, 25 bp, Mus musculus
aattagagccttacacttcttcact

SEQ ID NO: 86364 - DNA, 25 bp, Mus musculus
aattagagcctttcacttcttcact

SEQ ID NO: 86365 - DNA, 25 bp, Mus musculus
aattagaggctgacctaggccatca

SEQ ID NO: 86366 - DNA, 25 bp, Mus musculus
aattagaggctgtcctaggccatca

SEQ ID NO: 86367 - DNA, 25 bp, Mus musculus
aattagatcacactctgctctgcca

SEQ ID NO: 86368 - DNA, 25 bp, Mus musculus
aattagatcacagtctgctctgcca

SEQ ID NO: 86369 - DNA, 25 bp, Mus musculus
aattagatgccacaccctataggtt

SEQ ID NO: 86370 - DNA, 25 bp, Mus musculus
aattagatgccagaccctataggtt

SEQ ID NO: 86371 - DNA, 25 bp, Mus musculus
aattagattttgaacactccctgga

SEQ ID NO: 86372 - DNA, 25 bp, Mus musculus
aattagattttgtacactccctgga

SEQ ID NO: 86373 - DNA, 25 bp, Mus musculus
aattagcaagctcactacctctata

SEQ ID NO: 86374 - DNA, 25 bp, Mus musculus
aattagcaagctgactacctctata

SEQ ID NO: 86375 - DNA, 25 bp, Mus musculus
aattagcaccagagtctttccaggc

SEQ ID NO: 86376 - DNA, 25 bp, Mus musculus
aattagcaccagtgtctttccaggc

SEQ ID NO: 86377 - DNA, 25 bp, Mus musculus
aattagcagctgcagatacaacccc

SEQ ID NO: 86378 - DNA, 25 bp, Mus musculus
aattagcagctggagatacaacccc

SEQ ID NO: 86379 - DNA, 25 bp, Mus musculus
aattagcaggccatcttgacctaaa

SEQ ID NO: 86380 - DNA, 25 bp, Mus musculus
aattagcaggccttcttgacctaaa

SEQ ID NO: 86381 - DNA, 25 bp, Mus musculus
aattagcaggctaggtggcacttgg

SEQ ID NO: 86382 - DNA, 25 bp, Mus musculus
aattagcaggcttggtggcacttgg

SEQ ID NO: 86383 - DNA, 25 bp, Mus musculus
aattagcagggtactgccccaaatc

SEQ ID NO: 86384 - DNA, 25 bp, Mus musculus
aattagcagggttctgccccaaatc

SEQ ID NO: 86385 - DNA, 25 bp, Mus musculus
aattagcaggttctcgctcagagaa

SEQ ID NO: 86386 - DNA, 25 bp, Mus musculus
aattagcaggttgtcgctcagagaa

SEQ ID NO: 86387 - DNA, 25 bp, Mus musculus
aattagcagtagagaatccatccca

SEQ ID NO: 86388 - DNA, 25 bp, Mus musculus
aattagcagtagtgaatccatccca

SEQ ID NO: 86389 - DNA, 25 bp, Mus musculus
aattagcatggtcagtggcggccac

SEQ ID NO: 86390 - DNA, 25 bp, Mus musculus
aattagcatggtgagtggcggccac

SEQ ID NO: 86391 - DNA, 25 bp, Mus musculus
aattagcattctcgcagcttccaag

SEQ ID NO: 86392 - DNA, 25 bp, Mus musculus
aattagcattctggcagcttccaag

SEQ ID NO: 86393 - DNA, 25 bp, Mus musculus
aattagccaagactgtgattgcggg

SEQ ID NO: 86394 - DNA, 25 bp, Mus musculus
aattagccaagagtgtgattgcggg

SEQ ID NO: 86395 - DNA, 25 bp, Mus musculus
aattagccaggcagctgtttgagaa

SEQ ID NO: 86396 - DNA, 25 bp, Mus musculus
aattagccaggctgctgtttgagaa

SEQ ID NO: 86397 - DNA, 25 bp, Mus musculus
aattagcctcaaaatgtgcagcatc

SEQ ID NO: 86398 - DNA, 25 bp, Mus musculus
aattagcctcaatatgtgcagcatc

SEQ ID NO: 86399 - DNA, 25 bp, Mus musculus
aattagcctgagaagacgccatcac

SEQ ID NO: 86400 - DNA, 25 bp, Mus musculus
aattagcctgagtagacgccatcac

SEQ ID NO: 86401 - DNA, 25 bp, Mus musculus
aattagctacagatcagggcggccc

SEQ ID NO: 86402 - DNA, 25 bp, Mus musculus
aattagctacagttcagggcggccc

SEQ ID NO: 86403 - DNA, 25 bp, Mus musculus
aattagctactacaaccccatggaa

SEQ ID NO: 86404 - DNA, 25 bp, Mus musculus
aattagctactagaaccccatggaa

SEQ ID NO: 86405 - DNA, 25 bp, Mus musculus
aattagctctagacctgtttccttt

SEQ ID NO: 86406 - DNA, 25 bp, Mus musculus
aattagctctagtcctgtttccttt

SEQ ID NO: 86407 - DNA, 25 bp, Mus musculus
aattagctgtcacagttgccacctg

SEQ ID NO: 86408 - DNA, 25 bp, Mus musculus
aattagctgtcagagttgccacctg

SEQ ID NO: 86409 - DNA, 25 bp, Mus musculus
aattagcttgccagtgctgttggag

SEQ ID NO: 86410 - DNA, 25 bp, Mus musculus
aattagcttgcctgtgctgttggag

SEQ ID NO: 86411 - DNA, 25 bp, Mus musculus
aattaggaacccagatgccaccttc

SEQ ID NO: 86412 - DNA, 25 bp, Mus musculus
aattaggaaccctgatgccaccttc

SEQ ID NO: 86413 - DNA, 25 bp, Mus musculus
aattaggaccatatacttcttttat

SEQ ID NO: 86414 - DNA, 25 bp, Mus musculus
aattaggaccatttacttcttttat

SEQ ID NO: 86415 - DNA, 25 bp, Mus musculus
aattaggaccttcacagggtgggct

SEQ ID NO: 86416 - DNA, 25 bp, Mus musculus
aattaggaccttgacagggtgggct

SEQ ID NO: 86417 - DNA, 25 bp, Mus musculus
aattaggagtacactctgcagctga

SEQ ID NO: 86418 - DNA, 25 bp, Mus musculus
aattaggagtactctctgcagctga

SEQ ID NO: 86419 - DNA, 25 bp, Mus musculus
aattaggatactccactttttgtga

SEQ ID NO: 86420 - DNA, 25 bp, Mus musculus
aattaggatactgcactttttgtga

SEQ ID NO: 86421 - DNA, 25 bp, Mus musculus
aattaggcaagtatacctactgtaa

SEQ ID NO: 86422 - DNA, 25 bp, Mus musculus
aattaggcaagtttacctactgtaa

SEQ ID NO: 86423 - DNA, 25 bp, Mus musculus
aattaggcacttatcctttgccttg

SEQ ID NO: 86424 - DNA, 25 bp, Mus musculus
aattaggcacttttcctttgccttg

SEQ ID NO: 86425 - DNA, 25 bp, Mus musculus
aattaggccacaaacctcacatgct

SEQ ID NO: 86426 - DNA, 25 bp, Mus musculus
aattaggccacatacctcacatgct

SEQ ID NO: 86427 - DNA, 25 bp, Mus musculus
aattaggcctgtactcagatggcat

SEQ ID NO: 86428 - DNA, 25 bp, Mus musculus
aattaggcctgttctcagatggcat

SEQ ID NO: 86429 - DNA, 25 bp, Mus musculus
aattaggcttgtatcctcagtcact

SEQ ID NO: 86430 - DNA, 25 bp, Mus musculus
aattaggcttgtttcctcagtcact

SEQ ID NO: 86431 - DNA, 25 bp, Mus musculus
aattagggaagcagccgcaggccgt

SEQ ID NO: 86432 - DNA, 25 bp, Mus musculus
aattagggaagctgccgcaggccgt

SEQ ID NO: 86433 - DNA, 25 bp, Mus musculus
aattagggcgcacgcaccaatgcat

SEQ ID NO: 86434 - DNA, 25 bp, Mus musculus
aattagggcgcaggcaccaatgcat

SEQ ID NO: 86435 - DNA, 25 bp, Mus musculus
aattagggttgactcctagcccagc

SEQ ID NO: 86436 - DNA, 25 bp, Mus musculus
aattagggttgagtcctagcccagc

SEQ ID NO: 86437 - DNA, 25 bp, Mus musculus
aattaggtacaccagatttcatttt

SEQ ID NO: 86438 - DNA, 25 bp, Mus musculus
aattaggtacacgagatttcatttt

SEQ ID NO: 86439 - DNA, 25 bp, Mus musculus
aattaggtatccaaggacaaccttg

SEQ ID NO: 86440 - DNA, 25 bp, Mus musculus
aattaggtatcctaggacaaccttg

SEQ ID NO: 86441 - DNA, 25 bp, Mus musculus
aattaggtcaggctggctgtccagt

SEQ ID NO: 86442 - DNA, 25 bp, Mus musculus
aattaggtcagggtggctgtccagt

SEQ ID NO: 86443 - DNA, 25 bp, Mus musculus
aattaggtccaaactctgtgtcccg

SEQ ID NO: 86444 - DNA, 25 bp, Mus musculus
aattaggtccaatctctgtgtcccg

SEQ ID NO: 86445 - DNA, 25 bp, Mus musculus
aattaggtcctaatctctaggatag

SEQ ID NO: 86446 - DNA, 25 bp, Mus musculus
aattaggtcctattctctaggatag

SEQ ID NO: 86447 - DNA, 25 bp, Mus musculus
aattaggtgtgaacattttcgttct

SEQ ID NO: 86448 - DNA, 25 bp, Mus musculus
aattaggtgtgatcattttcgttct

SEQ ID NO: 86449 - DNA, 25 bp, Mus musculus
aattaggttctaaagtgtttgacag

SEQ ID NO: 86450 - DNA, 25 bp, Mus musculus
aattaggttctatagtgtttgacag

SEQ ID NO: 86451 - DNA, 25 bp, Mus musculus
aattagtatatccttgtccctccca

SEQ ID NO: 86452 - DNA, 25 bp, Mus musculus
aattagtatatcgttgtccctccca

SEQ ID NO: 86453 - DNA, 25 bp, Mus musculus
aattagtatctgctggttcacggcc

SEQ ID NO: 86454 - DNA, 25 bp, Mus musculus
aattagtatctggtggttcacggcc

SEQ ID NO: 86455 - DNA, 25 bp, Mus musculus
aattagtcaccaatttatagtacca

SEQ ID NO: 86456 - DNA, 25 bp, Mus musculus
aattagtcaccattttatagtacca

SEQ ID NO: 86457 - DNA, 25 bp, Mus musculus
aattagtcatttatcctcctgacca

SEQ ID NO: 86458 - DNA, 25 bp, Mus musculus
aattagtcatttttcctcctgacca

SEQ ID NO: 86459 - DNA, 25 bp, Mus musculus
aattagtccacgataccaagccatg

SEQ ID NO: 86460 - DNA, 25 bp, Mus musculus
aattagtccacgttaccaagccatg

SEQ ID NO: 86461 - DNA, 25 bp, Mus musculus
aattagtgggcaacatgcttgtgga

SEQ ID NO: 86462 - DNA, 25 bp, Mus musculus
aattagtgggcatcatgcttgtgga

SEQ ID NO: 86463 - DNA, 25 bp, Mus musculus
aattagtggttgaaggttctctgtc

SEQ ID NO: 86464 - DNA, 25 bp, Mus musculus
aattagtggttgtaggttctctgtc

SEQ ID NO: 86465 - DNA, 25 bp, Mus musculus
aattagtgtctaattattcctggga

SEQ ID NO: 86466 - DNA, 25 bp, Mus musculus
aattagtgtctatttattcctggga

SEQ ID NO: 86467 - DNA, 25 bp, Mus musculus
aattagttaataacccacgcttcct

SEQ ID NO: 86468 - DNA, 25 bp, Mus musculus
aattagttaatatcccacgcttcct

SEQ ID NO: 86469 - DNA, 25 bp, Mus musculus
aattagttcaacacagtgggctcct

SEQ ID NO: 86470 - DNA, 25 bp, Mus musculus
aattagttcaactcagtgggctcct

SEQ ID NO: 86471 - DNA, 25 bp, Mus musculus
aattagttctctaagccctacacat

SEQ ID NO: 86472 - DNA, 25 bp, Mus musculus
aattagttctcttagccctacacat

SEQ ID NO: 86473 - DNA, 25 bp, Mus musculus
aattagttcttactagtgctgctaa

SEQ ID NO: 86474 - DNA, 25 bp, Mus musculus
aattagttcttagtagtgctgctaa

SEQ ID NO: 86475 - DNA, 25 bp, Mus musculus
aattagttcttgctttcagcctcca

SEQ ID NO: 86476 - DNA, 25 bp, Mus musculus
aattagttcttggtttcagcctcca

SEQ ID NO: 86477 - DNA, 25 bp, Mus musculus
aattataaccacaaattgccaactt

SEQ ID NO: 86478 - DNA, 25 bp, Mus musculus
aattataaccactaattgccaactt

SEQ ID NO: 86479 - DNA, 25 bp, Mus musculus
aattataacgaacgcatggagtacc

SEQ ID NO: 86480 - DNA, 25 bp, Mus musculus
aattataacgaaggcatggagtacc

SEQ ID NO: 86481 - DNA, 25 bp, Mus musculus
aattataactgtatcttctgtttgg

SEQ ID NO: 86482 - DNA, 25 bp, Mus musculus
aattataactgtttcttctgtttgg

SEQ ID NO: 86483 - DNA, 25 bp, Mus musculus
aattataatctacacactcatgcgt

SEQ ID NO: 86484 - DNA, 25 bp, Mus musculus
aattataatctagacactcatgcgt

SEQ ID NO: 86485 - DNA, 25 bp, Mus musculus
aattataatgcaactccccagagta

SEQ ID NO: 86486 - DNA, 25 bp, Mus musculus
aattataatgcatctccccagagta

SEQ ID NO: 86487 - DNA, 25 bp, Mus musculus
aattataatgctactgacagcccga

SEQ ID NO: 86488 - DNA, 25 bp, Mus musculus
aattataatgcttctgacagcccga

SEQ ID NO: 86489 - DNA, 25 bp, Mus musculus
aattataccaagattgctcctgaaa

SEQ ID NO: 86490 - DNA, 25 bp, Mus musculus
aattataccaagtttgctcctgaaa

SEQ ID NO: 86491 - DNA, 25 bp, Mus musculus
aattatacccatatgtgtgaattaa

SEQ ID NO: 86492 - DNA, 25 bp, Mus musculus
aattatacccatttgtgtgaattaa

SEQ ID NO: 86493 - DNA, 25 bp, Mus musculus
aattatacccttagatcctttccag

SEQ ID NO: 86494 - DNA, 25 bp, Mus musculus
aattataccctttgatcctttccag

SEQ ID NO: 86495 - DNA, 25 bp, Mus musculus
aattataccgttagtatgccctctg

SEQ ID NO: 86496 - DNA, 25 bp, Mus musculus
aattataccgtttgtatgccctctg

SEQ ID NO: 86497 - DNA, 25 bp, Mus musculus
aattatacctacagtggaaccttgt

SEQ ID NO: 86498 - DNA, 25 bp, Mus musculus
aattatacctactgtggaaccttgt

SEQ ID NO: 86499 - DNA, 25 bp, Mus musculus
aattatacctatatcctgcggagac

SEQ ID NO: 86500 - DNA, 25 bp, Mus musculus
aattatacctatttcctgcggagac

SEQ ID NO: 86501 - DNA, 25 bp, Mus musculus
aattataccttacagccattggctt

SEQ ID NO: 86502 - DNA, 25 bp, Mus musculus
aattataccttagagccattggctt

SEQ ID NO: 86503 - DNA, 25 bp, Mus musculus
aattatacggtacattggaatctaa

SEQ ID NO: 86504 - DNA, 25 bp, Mus musculus
aattatacggtagattggaatctaa

SEQ ID NO: 86505 - DNA, 25 bp, Mus musculus
aattatactccacgcttcttctgtt

SEQ ID NO: 86506 - DNA, 25 bp, Mus musculus
aattatactccaggcttcttctgtt

SEQ ID NO: 86507 - DNA, 25 bp, Mus musculus
aattatacttatagctgatggactc

SEQ ID NO: 86508 - DNA, 25 bp, Mus musculus
aattatacttattgctgatggactc

SEQ ID NO: 86509 - DNA, 25 bp, Mus musculus
aattatagtcagattgcgatcttct

SEQ ID NO: 86510 - DNA, 25 bp, Mus musculus
aattatagtcagtttgcgatcttct

SEQ ID NO: 86511 - DNA, 25 bp, Mus musculus
aattatatgcatcttcttttcttta

SEQ ID NO: 86512 - DNA, 25 bp, Mus musculus
aattatatgcatgttcttttcttta

SEQ ID NO: 86513 - DNA, 25 bp, Mus musculus
aattatattgttatccagtctggaa

SEQ ID NO: 86514 - DNA, 25 bp, Mus musculus
aattatattgttttccagtctggaa

SEQ ID NO: 86515 - DNA, 25 bp, Mus musculus
aattatatttccacattaccccagt

SEQ ID NO: 86516 - DNA, 25 bp, Mus musculus
aattatatttcctcattaccccagt

SEQ ID NO: 86517 - DNA, 25 bp, Mus musculus
aattatcaacagacgcctctgttcc

SEQ ID NO: 86518 - DNA, 25 bp, Mus musculus
aattatcaacagtcgcctctgttcc

SEQ ID NO: 86519 - DNA, 25 bp, Mus musculus
aattatcaacgaatcttttctcaga

SEQ ID NO: 86520 - DNA, 25 bp, Mus musculus
aattatcaacgattcttttctcaga

SEQ ID NO: 86521 - DNA, 25 bp, Mus musculus
aattatcaactgaccgaaactgcta

SEQ ID NO: 86522 - DNA, 25 bp, Mus musculus
aattatcaactgtccgaaactgcta

SEQ ID NO: 86523 - DNA, 25 bp, Mus musculus
aattatcacaatacactagtaaagg

SEQ ID NO: 86524 - DNA, 25 bp, Mus musculus
aattatcacaattcactagtaaagg

SEQ ID NO: 86525 - DNA, 25 bp, Mus musculus
aattatcacactagcacatgaagat

SEQ ID NO: 86526 - DNA, 25 bp, Mus musculus
aattatcacacttgcacatgaagat

SEQ ID NO: 86527 - DNA, 25 bp, Mus musculus
aattatcacttaccttttgtgtaat

SEQ ID NO: 86528 - DNA, 25 bp, Mus musculus
aattatcacttagcttttgtgtaat

SEQ ID NO: 86529 - DNA, 25 bp, Mus musculus
aattatcagggaaattatcagtgat

SEQ ID NO: 86530 - DNA, 25 bp, Mus musculus
aattatcagggatattatcagtgat

SEQ ID NO: 86531 - DNA, 25 bp, Mus musculus
aattatccagtcagcaatcagacag

SEQ ID NO: 86532 - DNA, 25 bp, Mus musculus
aattatccagtctgcaatcagacag

SEQ ID NO: 86533 - DNA, 25 bp, Mus musculus
aattatccatccatcacacatagtg

SEQ ID NO: 86534 - DNA, 25 bp, Mus musculus
aattatccatccttcacacatagtg

SEQ ID NO: 86535 - DNA, 25 bp, Mus musculus
aattatccatgcagtatacttgcat

SEQ ID NO: 86536 - DNA, 25 bp, Mus musculus
aattatccatgctgtatacttgcat

SEQ ID NO: 86537 - DNA, 25 bp, Mus musculus
aattatcctcccagtaagtaccata

SEQ ID NO: 86538 - DNA, 25 bp, Mus musculus
aattatcctccctgtaagtaccata

SEQ ID NO: 86539 - DNA, 25 bp, Mus musculus
aattatcctcttctttctgttgact

SEQ ID NO: 86540 - DNA, 25 bp, Mus musculus
aattatcctcttgtttctgttgact

SEQ ID NO: 86541 - DNA, 25 bp, Mus musculus
aattatcctgatagtatgtttgcat

SEQ ID NO: 86542 - DNA, 25 bp, Mus musculus
aattatcctgattgtatgtttgcat

SEQ ID NO: 86543 - DNA, 25 bp, Mus musculus
aattatcctggcacactgatgtaca

SEQ ID NO: 86544 - DNA, 25 bp, Mus musculus
aattatcctggctcactgatgtaca

SEQ ID NO: 86545 - DNA, 25 bp, Mus musculus
aattatccttgcataatccacatta

SEQ ID NO: 86546 - DNA, 25 bp, Mus musculus
aattatccttgcttaatccacatta

SEQ ID NO: 86547 - DNA, 25 bp, Mus musculus
aattatcctttgagtttccttgcag

SEQ ID NO: 86548 - DNA, 25 bp, Mus musculus
aattatcctttgtgtttccttgcag

SEQ ID NO: 86549 - DNA, 25 bp, Mus musculus
aattatcgttggattcttgctgtgc

SEQ ID NO: 86550 - DNA, 25 bp, Mus musculus
aattatcgttggtttcttgctgtgc

SEQ ID NO: 86551 - DNA, 25 bp, Mus musculus
aattatctaactatgtttggcctgg

SEQ ID NO: 86552 - DNA, 25 bp, Mus musculus
aattatctaactttgtttggcctgg

SEQ ID NO: 86553 - DNA, 25 bp, Mus musculus
aattatctcaacctatatctccctt

SEQ ID NO: 86554 - DNA, 25 bp, Mus musculus
aattatctcaacgtatatctccctt

SEQ ID NO: 86555 - DNA, 25 bp, Mus musculus
aattatctcattctctagaccctcc

SEQ ID NO: 86556 - DNA, 25 bp, Mus musculus
aattatctcattgtctagaccctcc

SEQ ID NO: 86557 - DNA, 25 bp, Mus musculus
aattatctcccaccgattaatggca

SEQ ID NO: 86558 - DNA, 25 bp, Mus musculus
aattatctcccagcgattaatggca

SEQ ID NO: 86559 - DNA, 25 bp, Mus musculus
aattatctccgtcacactgctgtta

SEQ ID NO: 86560 - DNA, 25 bp, Mus musculus
aattatctccgtgacactgctgtta

SEQ ID NO: 86561 - DNA, 25 bp, Mus musculus
aattatctcgtcataattcttttgt

SEQ ID NO: 86562 - DNA, 25 bp, Mus musculus
aattatctcgtcttaattcttttgt

SEQ ID NO: 86563 - DNA, 25 bp, Mus musculus
aattatctctagatgctgctttgct

SEQ ID NO: 86564 - DNA, 25 bp, Mus musculus
aattatctctagttgctgctttgct

SEQ ID NO: 86565 - DNA, 25 bp, Mus musculus
aattatctgggcatttccttattta

SEQ ID NO: 86566 - DNA, 25 bp, Mus musculus
aattatctgggcttttccttattta

SEQ ID NO: 86567 - DNA, 25 bp, Mus musculus
aattatctgtgcatttaaggcttac

SEQ ID NO: 86568 - DNA, 25 bp, Mus musculus
aattatctgtgcttttaaggcttac

SEQ ID NO: 86569 - DNA, 25 bp, Mus musculus
aattatcttaccaactaccatctga

SEQ ID NO: 86570 - DNA, 25 bp, Mus musculus
aattatcttacctactaccatctga

SEQ ID NO: 86571 - DNA, 25 bp, Mus musculus
aattatcttagaaatcctgatggtg

SEQ ID NO: 86572 - DNA, 25 bp, Mus musculus
aattatcttagatatcctgatggtg

SEQ ID NO: 86573 - DNA, 25 bp, Mus musculus
aattatcttgctatgtagcagggtg

SEQ ID NO: 86574 - DNA, 25 bp, Mus musculus
aattatcttgctttgtagcagggtg

SEQ ID NO: 86575 - DNA, 25 bp, Mus musculus
aattatcttggtaccctgatcagcc

SEQ ID NO: 86576 - DNA, 25 bp, Mus musculus
aattatcttggttccctgatcagcc

SEQ ID NO: 86577 - DNA, 25 bp, Mus musculus
aattatctttgtctcctctctggtg

SEQ ID NO: 86578 - DNA, 25 bp, Mus musculus
aattatctttgtgtcctctctggtg

SEQ ID NO: 86579 - DNA, 25 bp, Mus musculus
aattatgaaggcacagcacggactt

SEQ ID NO: 86580 - DNA, 25 bp, Mus musculus
aattatgaaggctcagcacggactt

SEQ ID NO: 86581 - DNA, 25 bp, Mus musculus
aattatgacagtatgcttgagacac

SEQ ID NO: 86582 - DNA, 25 bp, Mus musculus
aattatgacagtttgcttgagacac

SEQ ID NO: 86583 - DNA, 25 bp, Mus musculus
aattatgacattatcctgggatgaa

SEQ ID NO: 86584 - DNA, 25 bp, Mus musculus
aattatgacattttcctgggatgaa

SEQ ID NO: 86585 - DNA, 25 bp, Mus musculus
aattatgacgcacagccaacgcaat

SEQ ID NO: 86586 - DNA, 25 bp, Mus musculus
aattatgacgcagagccaacgcaat

SEQ ID NO: 86587 - DNA, 25 bp, Mus musculus
aattatgacttacttttcctgcatt

SEQ ID NO: 86588 - DNA, 25 bp, Mus musculus
aattatgacttagttttcctgcatt

SEQ ID NO: 86589 - DNA, 25 bp, Mus musculus
aattatgagcatctgtgagggcccc

SEQ ID NO: 86590 - DNA, 25 bp, Mus musculus
aattatgagcatgtgtgagggcccc

SEQ ID NO: 86591 - DNA, 25 bp, Mus musculus
aattatgattctctctgctcttgga

SEQ ID NO: 86592 - DNA, 25 bp, Mus musculus
aattatgattctgtctgctcttgga

SEQ ID NO: 86593 - DNA, 25 bp, Mus musculus
aattatgcagctcctcgatgtgcct

SEQ ID NO: 86594 - DNA, 25 bp, Mus musculus
aattatgcagctgctcgatgtgcct

SEQ ID NO: 86595 - DNA, 25 bp, Mus musculus
aattatgccaaaagatatccagcta

SEQ ID NO: 86596 - DNA, 25 bp, Mus musculus
aattatgccaaatgatatccagcta

SEQ ID NO: 86597 - DNA, 25 bp, Mus musculus
aattatgcccatcattagcccctac

SEQ ID NO: 86598 - DNA, 25 bp, Mus musculus
aattatgcccatgattagcccctac

SEQ ID NO: 86599 - DNA, 25 bp, Mus musculus
aattatgcctggattctcagtgtga

SEQ ID NO: 86600 - DNA, 25 bp, Mus musculus
aattatgcctggtttctcagtgtga

SEQ ID NO: 86601 - DNA, 25 bp, Mus musculus
aattatgctcatattcagaccaggc

SEQ ID NO: 86602 - DNA, 25 bp, Mus musculus
aattatgctcattttcagaccaggc

SEQ ID NO: 86603 - DNA, 25 bp, Mus musculus
aattatgctgtaagaccaattaagc

SEQ ID NO: 86604 - DNA, 25 bp, Mus musculus
aattatgctgtatgaccaattaagc

SEQ ID NO: 86605 - DNA, 25 bp, Mus musculus
aattatgcttagagtgcctggcctg

SEQ ID NO: 86606 - DNA, 25 bp, Mus musculus
aattatgcttagtgtgcctggcctg

SEQ ID NO: 86607 - DNA, 25 bp, Mus musculus
aattatgcttccaaccttgtatagg

SEQ ID NO: 86608 - DNA, 25 bp, Mus musculus
aattatgcttcctaccttgtatagg

SEQ ID NO: 86609 - DNA, 25 bp, Mus musculus
aattatgcttggattgttcatgaaa

SEQ ID NO: 86610 - DNA, 25 bp, Mus musculus
aattatgcttggtttgttcatgaaa

SEQ ID NO: 86611 - DNA, 25 bp, Mus musculus
aattatgctttcatgcaggctctga

SEQ ID NO: 86612 - DNA, 25 bp, Mus musculus
aattatgctttcttgcaggctctga

SEQ ID NO: 86613 - DNA, 25 bp, Mus musculus
aattatggaaagaccccactgcagg

SEQ ID NO: 86614 - DNA, 25 bp, Mus musculus
aattatggaaagtccccactgcagg

SEQ ID NO: 86615 - DNA, 25 bp, Mus musculus
aattatggatcccaacattgttggc

SEQ ID NO: 86616 - DNA, 25 bp, Mus musculus
aattatggatccgaacattgttggc

SEQ ID NO: 86617 - DNA, 25 bp, Mus musculus
aattatggcatcaacagttctgtac

SEQ ID NO: 86618 - DNA, 25 bp, Mus musculus
aattatggcatctacagttctgtac

SEQ ID NO: 86619 - DNA, 25 bp, Mus musculus
aattatggtcagagcttaagagaga

SEQ ID NO: 86620 - DNA, 25 bp, Mus musculus
aattatggtcagtgcttaagagaga

SEQ ID NO: 86621 - DNA, 25 bp, Mus musculus
aattatggttcacctaccctgatga

SEQ ID NO: 86622 - DNA, 25 bp, Mus musculus
aattatggttcagctaccctgatga

SEQ ID NO: 86623 - DNA, 25 bp, Mus musculus
aattatgtaacaccccaggcctctc

SEQ ID NO: 86624 - DNA, 25 bp, Mus musculus
aattatgtaacagcccaggcctctc

SEQ ID NO: 86625 - DNA, 25 bp, Mus musculus
aattatgtagaaccttgaggccagt

SEQ ID NO: 86626 - DNA, 25 bp, Mus musculus
aattatgtagaagcttgaggccagt

SEQ ID NO: 86627 - DNA, 25 bp, Mus musculus
aattatgtattgagccactgcgctc

SEQ ID NO: 86628 - DNA, 25 bp, Mus musculus
aattatgtattgtgccactgcgctc

SEQ ID NO: 86629 - DNA, 25 bp, Mus musculus
aattatgtatttaggtcagtcccca

SEQ ID NO: 86630 - DNA, 25 bp, Mus musculus
aattatgtattttggtcagtcccca

SEQ ID NO: 86631 - DNA, 25 bp, Mus musculus
aattatgtcaggcagtgtaagcaac

SEQ ID NO: 86632 - DNA, 25 bp, Mus musculus
aattatgtcagggagtgtaagcaac

SEQ ID NO: 86633 - DNA, 25 bp, Mus musculus
aattatgtcctaaggctgacccgta

SEQ ID NO: 86634 - DNA, 25 bp, Mus musculus
aattatgtcctatggctgacccgta

SEQ ID NO: 86635 - DNA, 25 bp, Mus musculus
aattatgtcctgcttccaaccagaa

SEQ ID NO: 86636 - DNA, 25 bp, Mus musculus
aattatgtcctggttccaaccagaa

SEQ ID NO: 86637 - DNA, 25 bp, Mus musculus
aattatgtgcagctgactgtctcag

SEQ ID NO: 86638 - DNA, 25 bp, Mus musculus
aattatgtgcaggtgactgtctcag

SEQ ID NO: 86639 - DNA, 25 bp, Mus musculus
aattatgtgcatatatgttctgttt

SEQ ID NO: 86640 - DNA, 25 bp, Mus musculus
aattatgtgcatttatgttctgttt

SEQ ID NO: 86641 - DNA, 25 bp, Mus musculus
aattatgtgcccaagtacccactgc

SEQ ID NO: 86642 - DNA, 25 bp, Mus musculus
aattatgtgccctagtacccactgc

SEQ ID NO: 86643 - DNA, 25 bp, Mus musculus
aattatgtgctcagttgagtcccct

SEQ ID NO: 86644 - DNA, 25 bp, Mus musculus
aattatgtgctctgttgagtcccct

SEQ ID NO: 86645 - DNA, 25 bp, Mus musculus
aattatgtgttacagcaggcggaca

SEQ ID NO: 86646 - DNA, 25 bp, Mus musculus
aattatgtgttagagcaggcggaca

SEQ ID NO: 86647 - DNA, 25 bp, Mus musculus
aattatgttctgcaaattgcagtat

SEQ ID NO: 86648 - DNA, 25 bp, Mus musculus
aattatgttctggaaattgcagtat

SEQ ID NO: 86649 - DNA, 25 bp, Mus musculus
aattatgttcttcttagctggttca

SEQ ID NO: 86650 - DNA, 25 bp, Mus musculus
aattatgttcttgttagctggttca

SEQ ID NO: 86651 - DNA, 25 bp, Mus musculus
aattatgttgagatcttttggacca

SEQ ID NO: 86652 - DNA, 25 bp, Mus musculus
aattatgttgagttcttttggacca

SEQ ID NO: 86653 - DNA, 25 bp, Mus musculus
aattatgttgctatggacaccgagt

SEQ ID NO: 86654 - DNA, 25 bp, Mus musculus
aattatgttgctttggacaccgagt

SEQ ID NO: 86655 - DNA, 25 bp, Mus musculus
aattatgtttacactcacgggccat

SEQ ID NO: 86656 - DNA, 25 bp, Mus musculus
aattatgtttactctcacgggccat

SEQ ID NO: 86657 - DNA, 25 bp, Mus musculus
aattatgtttctcggataggctgta

SEQ ID NO: 86658 - DNA, 25 bp, Mus musculus
aattatgtttctgggataggctgta

SEQ ID NO: 86659 - DNA, 25 bp, Mus musculus
aattattaaaggatgctcctgccct

SEQ ID NO: 86660 - DNA, 25 bp, Mus musculus
aattattaaaggttgctcctgccct

SEQ ID NO: 86661 - DNA, 25 bp, Mus musculus
aattattacaaactcctccctcatc

SEQ ID NO: 86662 - DNA, 25 bp, Mus musculus
aattattacaaagtcctccctcatc

SEQ ID NO: 86663 - DNA, 25 bp, Mus musculus
aattattacacaaccgtggtacacg

SEQ ID NO: 86664 - DNA, 25 bp, Mus musculus
aattattacacatccgtggtacacg

SEQ ID NO: 86665 - DNA, 25 bp, Mus musculus
aattattatcacagccttgccttga

SEQ ID NO: 86666 - DNA, 25 bp, Mus musculus
aattattatcactgccttgccttga

SEQ ID NO: 86667 - DNA, 25 bp, Mus musculus
aattattatcccaacatctttacac

SEQ ID NO: 86668 - DNA, 25 bp, Mus musculus
aattattatccctacatctttacac

SEQ ID NO: 86669 - DNA, 25 bp, Mus musculus
aattattcatttcgccacaccatca

SEQ ID NO: 86670 - DNA, 25 bp, Mus musculus
aattattcatttggccacaccatca

SEQ ID NO: 86671 - DNA, 25 bp, Mus musculus
aattattccaccctccagtctttga

SEQ ID NO: 86672 - DNA, 25 bp, Mus musculus
aattattccaccgtccagtctttga

SEQ ID NO: 86673 - DNA, 25 bp, Mus musculus
aattattccagaatgggcctcttga

SEQ ID NO: 86674 - DNA, 25 bp, Mus musculus
aattattccagattgggcctcttga

SEQ ID NO: 86675 - DNA, 25 bp, Mus musculus
aattattccatcctggtcctggcag

SEQ ID NO: 86676 - DNA, 25 bp, Mus musculus
aattattccatcgtggtcctggcag

SEQ ID NO: 86677 - DNA, 25 bp, Mus musculus
aattattccattcaatcttaaggta

SEQ ID NO: 86678 - DNA, 25 bp, Mus musculus
aattattccattgaatcttaaggta

SEQ ID NO: 86679 - DNA, 25 bp, Mus musculus
aattattccctgatgtaactgacaa

SEQ ID NO: 86680 - DNA, 25 bp, Mus musculus
aattattccctgttgtaactgacaa

SEQ ID NO: 86681 - DNA, 25 bp, Mus musculus
aattattccttcatggtagacttaa

SEQ ID NO: 86682 - DNA, 25 bp, Mus musculus
aattattccttcttggtagacttaa

SEQ ID NO: 86683 - DNA, 25 bp, Mus musculus
aattattcggtcagcattcccagtg

SEQ ID NO: 86684 - DNA, 25 bp, Mus musculus
aattattcggtctgcattcccagtg

SEQ ID NO: 86685 - DNA, 25 bp, Mus musculus
aattattcgtagctgttgccaaatc

SEQ ID NO: 86686 - DNA, 25 bp, Mus musculus
aattattcgtaggtgttgccaaatc

SEQ ID NO: 86687 - DNA, 25 bp, Mus musculus
aattattctactatgtcagaggcac

SEQ ID NO: 86688 - DNA, 25 bp, Mus musculus
aattattctactttgtcagaggcac

SEQ ID NO: 86689 - DNA, 25 bp, Mus musculus
aattattctccaagctaacactgcc

SEQ ID NO: 86690 - DNA, 25 bp, Mus musculus
aattattctccatgctaacactgcc

SEQ ID NO: 86691 - DNA, 25 bp, Mus musculus
aattattctcttacccatcggtttg

SEQ ID NO: 86692 - DNA, 25 bp, Mus musculus
aattattctctttcccatcggtttg

SEQ ID NO: 86693 - DNA, 25 bp, Mus musculus
aattattctgaaactcctggccctg

SEQ ID NO: 86694 - DNA, 25 bp, Mus musculus
aattattctgaatctcctggccctg

SEQ ID NO: 86695 - DNA, 25 bp, Mus musculus
aattattctggcctttatgtctgta

SEQ ID NO: 86696 - DNA, 25 bp, Mus musculus
aattattctggcgtttatgtctgta

SEQ ID NO: 86697 - DNA, 25 bp, Mus musculus
aattattctggtcctaccttacctg

SEQ ID NO: 86698 - DNA, 25 bp, Mus musculus
aattattctggtgctaccttacctg

SEQ ID NO: 86699 - DNA, 25 bp, Mus musculus
aattattgaataatccctaacctga

SEQ ID NO: 86700 - DNA, 25 bp, Mus musculus
aattattgaatattccctaacctga

SEQ ID NO: 86701 - DNA, 25 bp, Mus musculus
aattattgagccacagagcatccat

SEQ ID NO: 86702 - DNA, 25 bp, Mus musculus
aattattgagcctcagagcatccat

SEQ ID NO: 86703 - DNA, 25 bp, Mus musculus
aattattgcagaatcagcccatgag

SEQ ID NO: 86704 - DNA, 25 bp, Mus musculus
aattattgcagattcagcccatgag

SEQ ID NO: 86705 - DNA, 25 bp, Mus musculus
aattattgcctaattttctgcctaa

SEQ ID NO: 86706 - DNA, 25 bp, Mus musculus
aattattgcctatttttctgcctaa

SEQ ID NO: 86707 - DNA, 25 bp, Mus musculus
aattattgcttgcaggccttttcac

SEQ ID NO: 86708 - DNA, 25 bp, Mus musculus
aattattgcttggaggccttttcac

SEQ ID NO: 86709 - DNA, 25 bp, Mus musculus
aattattggagacttagcagagctg

SEQ ID NO: 86710 - DNA, 25 bp, Mus musculus
aattattggagagttagcagagctg

SEQ ID NO: 86711 - DNA, 25 bp, Mus musculus
aattattggctgcacacaaattgca

SEQ ID NO: 86712 - DNA, 25 bp, Mus musculus
aattattggctggacacaaattgca

SEQ ID NO: 86713 - DNA, 25 bp, Mus musculus
aattattgtctgagccctgatcatc

SEQ ID NO: 86714 - DNA, 25 bp, Mus musculus
aattattgtctgtgccctgatcatc

SEQ ID NO: 86715 - DNA, 25 bp, Mus musculus
aattattgtggtagtcattgtccct

SEQ ID NO: 86716 - DNA, 25 bp, Mus musculus
aattattgtggttgtcattgtccct

SEQ ID NO: 86717 - DNA, 25 bp, Mus musculus
aattattgtgttccagtgccaaagg

SEQ ID NO: 86718 - DNA, 25 bp, Mus musculus
aattattgtgttgcagtgccaaagg

SEQ ID NO: 86719 - DNA, 25 bp, Mus musculus
aattattgttctctgacaaaaacca

SEQ ID NO: 86720 - DNA, 25 bp, Mus musculus
aattattgttctgtgacaaaaacca

SEQ ID NO: 86721 - DNA, 25 bp, Mus musculus
aattatttcaaacgagttgctctaa

SEQ ID NO: 86722 - DNA, 25 bp, Mus musculus
aattatttcaaaggagttgctctaa

SEQ ID NO: 86723 - DNA, 25 bp, Mus musculus
aattatttcatcaaagtctcccatt

SEQ ID NO: 86724 - DNA, 25 bp, Mus musculus
aattatttcatctaagtctcccatt

SEQ ID NO: 86725 - DNA, 25 bp, Mus musculus
aattatttcattcctgcgtcctaac

SEQ ID NO: 86726 - DNA, 25 bp, Mus musculus
aattatttcattgctgcgtcctaac

SEQ ID NO: 86727 - DNA, 25 bp, Mus musculus
aattatttctggatcctctcattgc

SEQ ID NO: 86728 - DNA, 25 bp, Mus musculus
aattatttctggttcctctcattgc

SEQ ID NO: 86729 - DNA, 25 bp, Mus musculus
aattatttgtctcttgttagccaag

SEQ ID NO: 86730 - DNA, 25 bp, Mus musculus
aattatttgtctgttgttagccaag

SEQ ID NO: 86731 - DNA, 25 bp, Mus musculus
aattatttgttcaacctatgccaca

SEQ ID NO: 86732 - DNA, 25 bp, Mus musculus
aattatttgttctacctatgccaca

SEQ ID NO: 86733 - DNA, 25 bp, Mus musculus
aattattttccaatctagtgttcat

SEQ ID NO: 86734 - DNA, 25 bp, Mus musculus
aattattttccattctagtgttcat

SEQ ID NO: 86735 - DNA, 25 bp, Mus musculus
aattattttgtgacatagctatgcc

SEQ ID NO: 86736 - DNA, 25 bp, Mus musculus
aattattttgtgtcatagctatgcc

SEQ ID NO: 86737 - DNA, 25 bp, Mus musculus
aattattttgttaggccaggtggca

SEQ ID NO: 86738 - DNA, 25 bp, Mus musculus
aattattttgtttggccaggtggca

SEQ ID NO: 86739 - DNA, 25 bp, Mus musculus
aattattttttcacttgccatggaa

SEQ ID NO: 86740 - DNA, 25 bp, Mus musculus
aattattttttctcttgccatggaa

SEQ ID NO: 86741 - DNA, 25 bp, Mus musculus
aattattttttgctatgtctgtagc

SEQ ID NO: 86742 - DNA, 25 bp, Mus musculus
aattattttttggtatgtctgtagc

SEQ ID NO: 86743 - DNA, 25 bp, Mus musculus
aattcaaaaccgaagctgcaacaag

SEQ ID NO: 86744 - DNA, 25 bp, Mus musculus
aattcaaaaccgtagctgcaacaag

SEQ ID NO: 86745 - DNA, 25 bp, Mus musculus
aattcaaaacctcagtgtgcgctat

SEQ ID NO: 86746 - DNA, 25 bp, Mus musculus
aattcaaaacctgagtgtgcgctat

SEQ ID NO: 86747 - DNA, 25 bp, Mus musculus
aattcaaaagaaaaccgaccagaga

SEQ ID NO: 86748 - DNA, 25 bp, Mus musculus
aattcaaaagaataccgaccagaga

SEQ ID NO: 86749 - DNA, 25 bp, Mus musculus
aattcaaacacacttagaagcgaga

SEQ ID NO: 86750 - DNA, 25 bp, Mus musculus
aattcaaacacagttagaagcgaga

SEQ ID NO: 86751 - DNA, 25 bp, Mus musculus
aattcaaacggcctacgatgcatga

SEQ ID NO: 86752 - DNA, 25 bp, Mus musculus
aattcaaacggcgtacgatgcatga

SEQ ID NO: 86753 - DNA, 25 bp, Mus musculus
aattcaaactccataacaacttatg

SEQ ID NO: 86754 - DNA, 25 bp, Mus musculus
aattcaaactccttaacaacttatg

SEQ ID NO: 86755 - DNA, 25 bp, Mus musculus
aattcaaagaatcccacagcatccc

SEQ ID NO: 86756 - DNA, 25 bp, Mus musculus
aattcaaagaatgccacagcatccc

SEQ ID NO: 86757 - DNA, 25 bp, Mus musculus
aattcaaatcccactcaacattcac

SEQ ID NO: 86758 - DNA, 25 bp, Mus musculus
aattcaaatcccactggagctggaa

SEQ ID NO: 86759 - DNA, 25 bp, Mus musculus
aattcaaatccctctcaacattcac

SEQ ID NO: 86760 - DNA, 25 bp, Mus musculus
aattcaaatccctctggagctggaa

SEQ ID NO: 86761 - DNA, 25 bp, Mus musculus
aattcaaatgtgagcctgagctaca

SEQ ID NO: 86762 - DNA, 25 bp, Mus musculus
aattcaaatgtgtgcctgagctaca

SEQ ID NO: 86763 - DNA, 25 bp, Mus musculus
aattcaaatgttaccctctctgcac

SEQ ID NO: 86764 - DNA, 25 bp, Mus musculus
aattcaaatgtttccctctctgcac

SEQ ID NO: 86765 - DNA, 25 bp, Mus musculus
aattcaaatttcaatgcctccccag

SEQ ID NO: 86766 - DNA, 25 bp, Mus musculus
aattcaaatttctatgcctccccag

SEQ ID NO: 86767 - DNA, 25 bp, Mus musculus
aattcaacaagcatattttcagcct

SEQ ID NO: 86768 - DNA, 25 bp, Mus musculus
aattcaacaagcttattttcagcct

SEQ ID NO: 86769 - DNA, 25 bp, Mus musculus
aattcaaccaggcacttctgtctct

SEQ ID NO: 86770 - DNA, 25 bp, Mus musculus
aattcaaccagggacttctgtctct

SEQ ID NO: 86771 - DNA, 25 bp, Mus musculus
aattcaaccatcagtactgccttaa

SEQ ID NO: 86772 - DNA, 25 bp, Mus musculus
aattcaaccatctgtactgccttaa

SEQ ID NO: 86773 - DNA, 25 bp, Mus musculus
aattcaacgcttacttctggactcc

SEQ ID NO: 86774 - DNA, 25 bp, Mus musculus
aattcaacgctttcttctggactcc

SEQ ID NO: 86775 - DNA, 25 bp, Mus musculus
aattcaactgccataaacgctgtgc

SEQ ID NO: 86776 - DNA, 25 bp, Mus musculus
aattcaactgccttaaacgctgtgc

SEQ ID NO: 86777 - DNA, 25 bp, Mus musculus
aattcaacttggatgtacctctccc

SEQ ID NO: 86778 - DNA, 25 bp, Mus musculus
aattcaacttggttgtacctctccc

SEQ ID NO: 86779 - DNA, 25 bp, Mus musculus
aattcaagacaactctcctgttctc

SEQ ID NO: 86780 - DNA, 25 bp, Mus musculus
aattcaagacaagtctcctgttctc

SEQ ID NO: 86781 - DNA, 25 bp, Mus musculus
aattcaagacttctgagtctctgta

SEQ ID NO: 86782 - DNA, 25 bp, Mus musculus
aattcaagacttgtgagtctctgta

SEQ ID NO: 86783 - DNA, 25 bp, Mus musculus
aattcaagatcaagagtgtcctcct

SEQ ID NO: 86784 - DNA, 25 bp, Mus musculus
aattcaagatcatgagtgtcctcct

SEQ ID NO: 86785 - DNA, 25 bp, Mus musculus
aattcaagcacccaagtgctgggcc

SEQ ID NO: 86786 - DNA, 25 bp, Mus musculus
aattcaagcaccgaagtgctgggcc

SEQ ID NO: 86787 - DNA, 25 bp, Mus musculus
aattcaagctctacacagttccaga

SEQ ID NO: 86788 - DNA, 25 bp, Mus musculus
aattcaagctcttcacagttccaga

SEQ ID NO: 86789 - DNA, 25 bp, Mus musculus
aattcaagctgcctttgtaactcgg

SEQ ID NO: 86790 - DNA, 25 bp, Mus musculus
aattcaagctgcgtttgtaactcgg

SEQ ID NO: 86791 - DNA, 25 bp, Mus musculus
aattcaaggtacattctcatagtct

SEQ ID NO: 86792 - DNA, 25 bp, Mus musculus
aattcaaggtactttctcatagtct

SEQ ID NO: 86793 - DNA, 25 bp, Mus musculus
aattcaagtaatatctgttatccta

SEQ ID NO: 86794 - DNA, 25 bp, Mus musculus
aattcaagtaatttctgttatccta

SEQ ID NO: 86795 - DNA, 25 bp, Mus musculus
aattcaagtttaactctgggtatgt

SEQ ID NO: 86796 - DNA, 25 bp, Mus musculus
aattcaagtttatctctgggtatgt

SEQ ID NO: 86797 - DNA, 25 bp, Mus musculus
aattcaagtttcacctcgtagcatg

SEQ ID NO: 86798 - DNA, 25 bp, Mus musculus
aattcaagtttctcctcgtagcatg

SEQ ID NO: 86799 - DNA, 25 bp, Mus musculus
aattcaataccacaggtcgccttca

SEQ ID NO: 86800 - DNA, 25 bp, Mus musculus
aattcaataccagaggtcgccttca

SEQ ID NO: 86801 - DNA, 25 bp, Mus musculus
aattcaatataaacctcaggtaggt

SEQ ID NO: 86802 - DNA, 25 bp, Mus musculus
aattcaatataatcctcaggtaggt

SEQ ID NO: 86803 - DNA, 25 bp, Mus musculus
aattcaatccagaagcagttccagc

SEQ ID NO: 86804 - DNA, 25 bp, Mus musculus
aattcaatccagtagcagttccagc

SEQ ID NO: 86805 - DNA, 25 bp, Mus musculus
aattcaatctctatccaatgcctat

SEQ ID NO: 86806 - DNA, 25 bp, Mus musculus
aattcaatctctttccaatgcctat

SEQ ID NO: 86807 - DNA, 25 bp, Mus musculus
aattcaatgccaaattttatcctga

SEQ ID NO: 86808 - DNA, 25 bp, Mus musculus
aattcaatgccatattttatcctga

SEQ ID NO: 86809 - DNA, 25 bp, Mus musculus
aattcaatggttccaggttgctatc

SEQ ID NO: 86810 - DNA, 25 bp, Mus musculus
aattcaatggttgcaggttgctatc

SEQ ID NO: 86811 - DNA, 25 bp, Mus musculus
aattcaattagcactgcccttgggc

SEQ ID NO: 86812 - DNA, 25 bp, Mus musculus
aattcaattagctctgcccttgggc

SEQ ID NO: 86813 - DNA, 25 bp, Mus musculus
aattcaattatgactgtggctgagt

SEQ ID NO: 86814 - DNA, 25 bp, Mus musculus
aattcaattatgtctgtggctgagt

SEQ ID NO: 86815 - DNA, 25 bp, Mus musculus
aattcaattgtcatcttcattagag

SEQ ID NO: 86816 - DNA, 25 bp, Mus musculus
aattcaattgtcttcttcattagag

SEQ ID NO: 86817 - DNA, 25 bp, Mus musculus
aattcaattttacctcatatgtcaa

SEQ ID NO: 86818 - DNA, 25 bp, Mus musculus
aattcaattttagctcatatgtcaa

SEQ ID NO: 86819 - DNA, 25 bp, Mus musculus
aattcacaaagcagaccgggctggc

SEQ ID NO: 86820 - DNA, 25 bp, Mus musculus
aattcacaaagctgaccgggctggc

SEQ ID NO: 86821 - DNA, 25 bp, Mus musculus
aattcacaacctccttgatcttatg

SEQ ID NO: 86822 - DNA, 25 bp, Mus musculus
aattcacaacctgcttgatcttatg

SEQ ID NO: 86823 - DNA, 25 bp, Mus musculus
aattcacaagaacacatgggagctg

SEQ ID NO: 86824 - DNA, 25 bp, Mus musculus
aattcacaagaagacatgggagctg

SEQ ID NO: 86825 - DNA, 25 bp, Mus musculus
aattcacaagttcacgggctacctg

SEQ ID NO: 86826 - DNA, 25 bp, Mus musculus
aattcacaagttgacgggctacctg

SEQ ID NO: 86827 - DNA, 25 bp, Mus musculus
aattcacaatgaaggttctgctatt

SEQ ID NO: 86828 - DNA, 25 bp, Mus musculus
aattcacaatgatggttctgctatt

SEQ ID NO: 86829 - DNA, 25 bp, Mus musculus
aattcacacaagctgcatgacgcca

SEQ ID NO: 86830 - DNA, 25 bp, Mus musculus
aattcacacaaggtgcatgacgcca

SEQ ID NO: 86831 - DNA, 25 bp, Mus musculus
aattcacacgacagcgacagccatg

SEQ ID NO: 86832 - DNA, 25 bp, Mus musculus
aattcacacgactgcgacagccatg

SEQ ID NO: 86833 - DNA, 25 bp, Mus musculus
aattcacactacaaggctggcacca

SEQ ID NO: 86834 - DNA, 25 bp, Mus musculus
aattcacactactaggctggcacca

SEQ ID NO: 86835 - DNA, 25 bp, Mus musculus
aattcacagagcatttgccagccag

SEQ ID NO: 86836 - DNA, 25 bp, Mus musculus
aattcacagagcttttgccagccag

SEQ ID NO: 86837 - DNA, 25 bp, Mus musculus
aattcacagcacatgtttgcatttg

SEQ ID NO: 86838 - DNA, 25 bp, Mus musculus
aattcacagcacttgtttgcatttg

SEQ ID NO: 86839 - DNA, 25 bp, Mus musculus
aattcacagcccctttgtaacttct

SEQ ID NO: 86840 - DNA, 25 bp, Mus musculus
aattcacagcccgtttgtaacttct

SEQ ID NO: 86841 - DNA, 25 bp, Mus musculus
aattcacaggttaagtggtgttgat

SEQ ID NO: 86842 - DNA, 25 bp, Mus musculus
aattcacaggtttagtggtgttgat

SEQ ID NO: 86843 - DNA, 25 bp, Mus musculus
aattcacagtcacaactctgttcat

SEQ ID NO: 86844 - DNA, 25 bp, Mus musculus
aattcacagtcagaactctgttcat

SEQ ID NO: 86845 - DNA, 25 bp, Mus musculus
aattcacagtggaccatccgttcat

SEQ ID NO: 86846 - DNA, 25 bp, Mus musculus
aattcacagtggactggcactcgat

SEQ ID NO: 86847 - DNA, 25 bp, Mus musculus
aattcacagtggtccatccgttcat

SEQ ID NO: 86848 - DNA, 25 bp, Mus musculus
aattcacagtggtctggcactcgat

SEQ ID NO: 86849 - DNA, 25 bp, Mus musculus
aattcacatcagctttctttttcac

SEQ ID NO: 86850 - DNA, 25 bp, Mus musculus
aattcacatcaggtttctttttcac

SEQ ID NO: 86851 - DNA, 25 bp, Mus musculus
aattcacatggcagcagttccatag

SEQ ID NO: 86852 - DNA, 25 bp, Mus musculus
aattcacatggctgcagttccatag

SEQ ID NO: 86853 - DNA, 25 bp, Mus musculus
aattcacatgtcctttgactcagga

SEQ ID NO: 86854 - DNA, 25 bp, Mus musculus
aattcacatgtcgtttgactcagga

SEQ ID NO: 86855 - DNA, 25 bp, Mus musculus
aattcacatgtgagccactgcttat

SEQ ID NO: 86856 - DNA, 25 bp, Mus musculus
aattcacatgtgtgccactgcttat

SEQ ID NO: 86857 - DNA, 25 bp, Mus musculus
aattcacattaacgaatccatacta

SEQ ID NO: 86858 - DNA, 25 bp, Mus musculus
aattcacattaaggaatccatacta

SEQ ID NO: 86859 - DNA, 25 bp, Mus musculus
aattcaccatctatccataatgaga

SEQ ID NO: 86860 - DNA, 25 bp, Mus musculus
aattcaccatctttccataatgaga

SEQ ID NO: 86861 - DNA, 25 bp, Mus musculus
aattcacccaaacatgtatccaaaa

SEQ ID NO: 86862 - DNA, 25 bp, Mus musculus
aattcacccaaagatgtatccaaaa

SEQ ID NO: 86863 - DNA, 25 bp, Mus musculus
aattcacccaagaaagcacacacgt

SEQ ID NO: 86864 - DNA, 25 bp, Mus musculus
aattcacccaagtaagcacacacgt

SEQ ID NO: 86865 - DNA, 25 bp, Mus musculus
aattcaccccagaggtgcaggctgc

SEQ ID NO: 86866 - DNA, 25 bp, Mus musculus
aattcaccccagtggtgcaggctgc

SEQ ID NO: 86867 - DNA, 25 bp, Mus musculus
aattcaccgcagagcatcagaacct

SEQ ID NO: 86868 - DNA, 25 bp, Mus musculus
aattcaccgcagtgcatcagaacct

SEQ ID NO: 86869 - DNA, 25 bp, Mus musculus
aattcaccggatcctttgtgttgta

SEQ ID NO: 86870 - DNA, 25 bp, Mus musculus
aattcaccggatgctttgtgttgta

SEQ ID NO: 86871 - DNA, 25 bp, Mus musculus
aattcacctaggatgctgggccact

SEQ ID NO: 86872 - DNA, 25 bp, Mus musculus
aattcacctaggttgctgggccact

SEQ ID NO: 86873 - DNA, 25 bp, Mus musculus
aattcacctgcacacttttagcaca

SEQ ID NO: 86874 - DNA, 25 bp, Mus musculus
aattcacctgcagacttttagcaca

SEQ ID NO: 86875 - DNA, 25 bp, Mus musculus
aattcacctggtattgtcatgcctg

SEQ ID NO: 86876 - DNA, 25 bp, Mus musculus
aattcacctggttttgtcatgcctg

SEQ ID NO: 86877 - DNA, 25 bp, Mus musculus
aattcacctgttactcatgcgagtt

SEQ ID NO: 86878 - DNA, 25 bp, Mus musculus
aattcacctgtttctcatgcgagtt

SEQ ID NO: 86879 - DNA, 25 bp, Mus musculus
aattcaccttcacacgagattctta

SEQ ID NO: 86880 - DNA, 25 bp, Mus musculus
aattcaccttcacgaagcggcttcg

SEQ ID NO: 86881 - DNA, 25 bp, Mus musculus
aattcaccttcagacgagattctta

SEQ ID NO: 86882 - DNA, 25 bp, Mus musculus
aattcaccttcaggaagcggcttcg

SEQ ID NO: 86883 - DNA, 25 bp, Mus musculus
aattcaccttgcctgctgaatggca

SEQ ID NO: 86884 - DNA, 25 bp, Mus musculus
aattcaccttgcgtgctgaatggca

SEQ ID NO: 86885 - DNA, 25 bp, Mus musculus
aattcacgatccatgtggccttata

SEQ ID NO: 86886 - DNA, 25 bp, Mus musculus
aattcacgatccttgtggccttata

SEQ ID NO: 86887 - DNA, 25 bp, Mus musculus
aattcacgctctccataatgacttg

SEQ ID NO: 86888 - DNA, 25 bp, Mus musculus
aattcacgctctgcataatgacttg

SEQ ID NO: 86889 - DNA, 25 bp, Mus musculus
aattcacgtgttatatttatgttct

SEQ ID NO: 86890 - DNA, 25 bp, Mus musculus
aattcacgtgttttatttatgttct

SEQ ID NO: 86891 - DNA, 25 bp, Mus musculus
aattcactacagctctttgattttt

SEQ ID NO: 86892 - DNA, 25 bp, Mus musculus
aattcactacaggtctttgattttt

SEQ ID NO: 86893 - DNA, 25 bp, Mus musculus
aattcactacgactggtggacgccg

SEQ ID NO: 86894 - DNA, 25 bp, Mus musculus
aattcactacgagtggtggacgccg

SEQ ID NO: 86895 - DNA, 25 bp, Mus musculus
aattcactactcagaccttggttaa

SEQ ID NO: 86896 - DNA, 25 bp, Mus musculus
aattcactactctgaccttggttaa

SEQ ID NO: 86897 - DNA, 25 bp, Mus musculus
aattcactcactaccctaatttacg

SEQ ID NO: 86898 - DNA, 25 bp, Mus musculus
aattcactcacttccctaatttacg

SEQ ID NO: 86899 - DNA, 25 bp, Mus musculus
aattcactcataaactgctgtagct

SEQ ID NO: 86900 - DNA, 25 bp, Mus musculus
aattcactcatatactgctgtagct

SEQ ID NO: 86901 - DNA, 25 bp, Mus musculus
aattcactcatcctgtacgagcata

SEQ ID NO: 86902 - DNA, 25 bp, Mus musculus
aattcactcatcgtgtacgagcata

SEQ ID NO: 86903 - DNA, 25 bp, Mus musculus
aattcactcattcgttcttcctgac

SEQ ID NO: 86904 - DNA, 25 bp, Mus musculus
aattcactcattggttcttcctgac

SEQ ID NO: 86905 - DNA, 25 bp, Mus musculus
aattcactccgtagaggtctgtgca

SEQ ID NO: 86906 - DNA, 25 bp, Mus musculus
aattcactccgttgaggtctgtgca

SEQ ID NO: 86907 - DNA, 25 bp, Mus musculus
aattcactcctgacaaattgtcaga

SEQ ID NO: 86908 - DNA, 25 bp, Mus musculus
aattcactcctgtcaaattgtcaga

SEQ ID NO: 86909 - DNA, 25 bp, Mus musculus
aattcactctagaagcttcggtctc

SEQ ID NO: 86910 - DNA, 25 bp, Mus musculus
aattcactctagtagcttcggtctc

SEQ ID NO: 86911 - DNA, 25 bp, Mus musculus
aattcactctggctgtttgaacagc

SEQ ID NO: 86912 - DNA, 25 bp, Mus musculus
aattcactctgggtgtttgaacagc

SEQ ID NO: 86913 - DNA, 25 bp, Mus musculus
aattcactgaacaaccacattgtgc

SEQ ID NO: 86914 - DNA, 25 bp, Mus musculus
aattcactgaactaccacattgtgc

SEQ ID NO: 86915 - DNA, 25 bp, Mus musculus
aattcactgaagcaaaacgcagctc

SEQ ID NO: 86916 - DNA, 25 bp, Mus musculus
aattcactgaaggaaaacgcagctc

SEQ ID NO: 86917 - DNA, 25 bp, Mus musculus
aattcactgatgctgggaaagcctg

SEQ ID NO: 86918 - DNA, 25 bp, Mus musculus
aattcactgatggtgggaaagcctg

SEQ ID NO: 86919 - DNA, 25 bp, Mus musculus
aattcactgcgcaggtgcatcactt

SEQ ID NO: 86920 - DNA, 25 bp, Mus musculus
aattcactgcgctggtgcatcactt

SEQ ID NO: 86921 - DNA, 25 bp, Mus musculus
aattcactgcggctttggctcgagt

SEQ ID NO: 86922 - DNA, 25 bp, Mus musculus
aattcactgcgggtttggctcgagt

SEQ ID NO: 86923 - DNA, 25 bp, Mus musculus
aattcactgtgactgttctgagcac

SEQ ID NO: 86924 - DNA, 25 bp, Mus musculus
aattcactgtgagtgttctgagcac

SEQ ID NO: 86925 - DNA, 25 bp, Mus musculus
aattcactgttgaatgcctgtccca

SEQ ID NO: 86926 - DNA, 25 bp, Mus musculus
aattcactgttgtatgcctgtccca

SEQ ID NO: 86927 - DNA, 25 bp, Mus musculus
aattcacttctgaaagaccttatgt

SEQ ID NO: 86928 - DNA, 25 bp, Mus musculus
aattcacttctgtaagaccttatgt

SEQ ID NO: 86929 - DNA, 25 bp, Mus musculus
aattcacttgacatcttcagacctc

SEQ ID NO: 86930 - DNA, 25 bp, Mus musculus
aattcacttgacttcttcagacctc

SEQ ID NO: 86931 - DNA, 25 bp, Mus musculus
aattcacttgtacaacatcctttct

SEQ ID NO: 86932 - DNA, 25 bp, Mus musculus
aattcacttgtagaacatcctttct

SEQ ID NO: 86933 - DNA, 25 bp, Mus musculus
aattcactttgaagcccaagctgga

SEQ ID NO: 86934 - DNA, 25 bp, Mus musculus
aattcactttgatgcccaagctgga

SEQ ID NO: 86935 - DNA, 25 bp, Mus musculus
aattcactttttcaggatgcctgcc

SEQ ID NO: 86936 - DNA, 25 bp, Mus musculus
aattcactttttgaggatgcctgcc

SEQ ID NO: 86937 - DNA, 25 bp, Mus musculus
aattcagaaacgcagcagctggacg

SEQ ID NO: 86938 - DNA, 25 bp, Mus musculus
aattcagaaacggagcagctggacg

SEQ ID NO: 86939 - DNA, 25 bp, Mus musculus
aattcagaaactaccccactcagac

SEQ ID NO: 86940 - DNA, 25 bp, Mus musculus
aattcagaaacttccccactcagac

SEQ ID NO: 86941 - DNA, 25 bp, Mus musculus
aattcagaaagcacctgtggcatat

SEQ ID NO: 86942 - DNA, 25 bp, Mus musculus
aattcagaaagctcctgtggcatat

SEQ ID NO: 86943 - DNA, 25 bp, Mus musculus
aattcagaaggaacctggcttggta

SEQ ID NO: 86944 - DNA, 25 bp, Mus musculus
aattcagaaggatcctggcttggta

SEQ ID NO: 86945 - DNA, 25 bp, Mus musculus
aattcagaagtaaacctttcatagg

SEQ ID NO: 86946 - DNA, 25 bp, Mus musculus
aattcagaagtatacctttcatagg

SEQ ID NO: 86947 - DNA, 25 bp, Mus musculus
aattcagaattgcacaggaaggccc

SEQ ID NO: 86948 - DNA, 25 bp, Mus musculus
aattcagaattggacaggaaggccc

SEQ ID NO: 86949 - DNA, 25 bp, Mus musculus
aattcagacatacgccttcatgcta

SEQ ID NO: 86950 - DNA, 25 bp, Mus musculus
aattcagacataggccttcatgcta

SEQ ID NO: 86951 - DNA, 25 bp, Mus musculus
aattcagaccgtctgggaaacactg

SEQ ID NO: 86952 - DNA, 25 bp, Mus musculus
aattcagaccgtgtgggaaacactg

SEQ ID NO: 86953 - DNA, 25 bp, Mus musculus
aattcagactccattgtcaggacat

SEQ ID NO: 86954 - DNA, 25 bp, Mus musculus
aattcagactcctttgtcaggacat

SEQ ID NO: 86955 - DNA, 25 bp, Mus musculus
aattcagagtttactgaaggtctag

SEQ ID NO: 86956 - DNA, 25 bp, Mus musculus
aattcagagttttctgaaggtctag

SEQ ID NO: 86957 - DNA, 25 bp, Mus musculus
aattcagatattcaccgtagcaggt

SEQ ID NO: 86958 - DNA, 25 bp, Mus musculus
aattcagatattgaccgtagcaggt

SEQ ID NO: 86959 - DNA, 25 bp, Mus musculus
aattcagatcaaaacgcctttcagg

SEQ ID NO: 86960 - DNA, 25 bp, Mus musculus
aattcagatcaatacgcctttcagg

SEQ ID NO: 86961 - DNA, 25 bp, Mus musculus
aattcagatcctagtgggcaaggca

SEQ ID NO: 86962 - DNA, 25 bp, Mus musculus
aattcagatccttgtgggcaaggca

SEQ ID NO: 86963 - DNA, 25 bp, Mus musculus
aattcagatcgccagtgctaaataa

SEQ ID NO: 86964 - DNA, 25 bp, Mus musculus
aattcagatcgcgagtgctaaataa

SEQ ID NO: 86965 - DNA, 25 bp, Mus musculus
aattcagattcaccagtgctggagc

SEQ ID NO: 86966 - DNA, 25 bp, Mus musculus
aattcagattcagcagtgctggagc

SEQ ID NO: 86967 - DNA, 25 bp, Mus musculus
aattcagatttcatagcaaaggcaa

SEQ ID NO: 86968 - DNA, 25 bp, Mus musculus
aattcagatttcatgtagcccgaga

SEQ ID NO: 86969 - DNA, 25 bp, Mus musculus
aattcagatttcttagcaaaggcaa

SEQ ID NO: 86970 - DNA, 25 bp, Mus musculus
aattcagatttcttgtagcccgaga

SEQ ID NO: 86971 - DNA, 25 bp, Mus musculus
aattcagcacgtcagagcagcctgt

SEQ ID NO: 86972 - DNA, 25 bp, Mus musculus
aattcagcacgtgagagcagcctgt

SEQ ID NO: 86973 - DNA, 25 bp, Mus musculus
aattcagcagatctcctttctaggt

SEQ ID NO: 86974 - DNA, 25 bp, Mus musculus
aattcagcagatgtcctttctaggt

SEQ ID NO: 86975 - DNA, 25 bp, Mus musculus
aattcagcatacctgccagcaactt

SEQ ID NO: 86976 - DNA, 25 bp, Mus musculus
aattcagcatacgtgccagcaactt

SEQ ID NO: 86977 - DNA, 25 bp, Mus musculus
aattcagcatagatccagatgacgg

SEQ ID NO: 86978 - DNA, 25 bp, Mus musculus
aattcagcatagcatcacggcgcag

SEQ ID NO: 86979 - DNA, 25 bp, Mus musculus
aattcagcataggatcacggcgcag

SEQ ID NO: 86980 - DNA, 25 bp, Mus musculus
aattcagcatagttccagatgacgg

SEQ ID NO: 86981 - DNA, 25 bp, Mus musculus
aattcagcatgcatactcatctggg

SEQ ID NO: 86982 - DNA, 25 bp, Mus musculus
aattcagcatgcttactcatctggg

SEQ ID NO: 86983 - DNA, 25 bp, Mus musculus
aattcagcatgtctatgagactctg

SEQ ID NO: 86984 - DNA, 25 bp, Mus musculus
aattcagcatgtgtatgagactctg

SEQ ID NO: 86985 - DNA, 25 bp, Mus musculus
aattcagccccacgcttttacaaag

SEQ ID NO: 86986 - DNA, 25 bp, Mus musculus
aattcagccccaggcttttacaaag

SEQ ID NO: 86987 - DNA, 25 bp, Mus musculus
aattcagcctaaagactttcaccac

SEQ ID NO: 86988 - DNA, 25 bp, Mus musculus
aattcagcctaatgactttcaccac

SEQ ID NO: 86989 - DNA, 25 bp, Mus musculus
aattcagcctgcaggtcctggacaa

SEQ ID NO: 86990 - DNA, 25 bp, Mus musculus
aattcagcctgctggtcctggacaa

SEQ ID NO: 86991 - DNA, 25 bp, Mus musculus
aattcagcgaagagtgtcggcctgt

SEQ ID NO: 86992 - DNA, 25 bp, Mus musculus
aattcagcgaagtgtgtcggcctgt

SEQ ID NO: 86993 - DNA, 25 bp, Mus musculus
aattcagctctgaaccagtgccctg

SEQ ID NO: 86994 - DNA, 25 bp, Mus musculus
aattcagctctgtaccagtgccctg

SEQ ID NO: 86995 - DNA, 25 bp, Mus musculus
aattcagctgccatgttttacttgt

SEQ ID NO: 86996 - DNA, 25 bp, Mus musculus
aattcagctgccttgttttacttgt

SEQ ID NO: 86997 - DNA, 25 bp, Mus musculus
aattcagctgggatatgtgctaggg

SEQ ID NO: 86998 - DNA, 25 bp, Mus musculus
aattcagctgggttatgtgctaggg

SEQ ID NO: 86999 - DNA, 25 bp, Mus musculus
aattcagcttagaggccacagggcc

SEQ ID NO: 87000 - DNA, 25 bp, Mus musculus
aattcagcttagtggccacagggcc

SEQ ID NO: 87001 - DNA, 25 bp, Mus musculus
aattcagcttcgagcaggttttccc

SEQ ID NO: 87002 - DNA, 25 bp, Mus musculus
aattcagcttcgtgcaggttttccc

SEQ ID NO: 87003 - DNA, 25 bp, Mus musculus
aattcagcttgacgatcccggcaca

SEQ ID NO: 87004 - DNA, 25 bp, Mus musculus
aattcagcttgaggatcccggcaca

SEQ ID NO: 87005 - DNA, 25 bp, Mus musculus
aattcagcttggcagtgtcggctct

SEQ ID NO: 87006 - DNA, 25 bp, Mus musculus
aattcagcttgggagtgtcggctct

SEQ ID NO: 87007 - DNA, 25 bp, Mus musculus
aattcaggaacgagaatctacagca

SEQ ID NO: 87008 - DNA, 25 bp, Mus musculus
aattcaggaacgtgaatctacagca

SEQ ID NO: 87009 - DNA, 25 bp, Mus musculus
aattcaggaaggatgccccaggccc

SEQ ID NO: 87010 - DNA, 25 bp, Mus musculus
aattcaggaaggttgccccaggccc

SEQ ID NO: 87011 - DNA, 25 bp, Mus musculus
aattcaggacacagcatccaaccgt

SEQ ID NO: 87012 - DNA, 25 bp, Mus musculus
aattcaggacactgcatccaaccgt

SEQ ID NO: 87013 - DNA, 25 bp, Mus musculus
aattcaggactgatgtgacctacca

SEQ ID NO: 87014 - DNA, 25 bp, Mus musculus
aattcaggactgctgaggaagccca

SEQ ID NO: 87015 - DNA, 25 bp, Mus musculus
aattcaggactggtgaggaagccca

SEQ ID NO: 87016 - DNA, 25 bp, Mus musculus
aattcaggactgttgtgacctacca

SEQ ID NO: 87017 - DNA, 25 bp, Mus musculus
aattcaggagcaaccaatagcatct

SEQ ID NO: 87018 - DNA, 25 bp, Mus musculus
aattcaggagcaacctgtgtcctca

SEQ ID NO: 87019 - DNA, 25 bp, Mus musculus
aattcaggagcaatggattatttct

SEQ ID NO: 87020 - DNA, 25 bp, Mus musculus
aattcaggagcatccaatagcatct

SEQ ID NO: 87021 - DNA, 25 bp, Mus musculus
aattcaggagcatcctgtgtcctca

SEQ ID NO: 87022 - DNA, 25 bp, Mus musculus
aattcaggagcattggattatttct

SEQ ID NO: 87023 - DNA, 25 bp, Mus musculus
aattcaggatcacggtcaaggcggc

SEQ ID NO: 87024 - DNA, 25 bp, Mus musculus
aattcaggatcagggtcaaggcggc

SEQ ID NO: 87025 - DNA, 25 bp, Mus musculus
aattcaggcaagattgtctctagat

SEQ ID NO: 87026 - DNA, 25 bp, Mus musculus
aattcaggcaagtttgtctctagat

SEQ ID NO: 87027 - DNA, 25 bp, Mus musculus
aattcaggcctgaactccagactgg

SEQ ID NO: 87028 - DNA, 25 bp, Mus musculus
aattcaggcctgtactccagactgg

SEQ ID NO: 87029 - DNA, 25 bp, Mus musculus
aattcaggccttagtgctttgccca

SEQ ID NO: 87030 - DNA, 25 bp, Mus musculus
aattcaggcctttgtgctttgccca

SEQ ID NO: 87031 - DNA, 25 bp, Mus musculus
aattcaggctcacagcacagcagtg

SEQ ID NO: 87032 - DNA, 25 bp, Mus musculus
aattcaggctcagagcacagcagtg

SEQ ID NO: 87033 - DNA, 25 bp, Mus musculus
aattcagggaagacttgattaacac

SEQ ID NO: 87034 - DNA, 25 bp, Mus musculus
aattcagggaagtcttgattaacac

SEQ ID NO: 87035 - DNA, 25 bp, Mus musculus
aattcagggatcatgcattctttaa

SEQ ID NO: 87036 - DNA, 25 bp, Mus musculus
aattcagggatcttgcattctttaa

SEQ ID NO: 87037 - DNA, 25 bp, Mus musculus
aattcagggcacacacaggactgga

SEQ ID NO: 87038 - DNA, 25 bp, Mus musculus
aattcagggcactcacaggactgga

SEQ ID NO: 87039 - DNA, 25 bp, Mus musculus
aattcagggctcattctagggtgac

SEQ ID NO: 87040 - DNA, 25 bp, Mus musculus
aattcagggctctttctagggtgac

SEQ ID NO: 87041 - DNA, 25 bp, Mus musculus
aattcaggtcaccagattccgtggc

SEQ ID NO: 87042 - DNA, 25 bp, Mus musculus
aattcaggtcacgagattccgtggc

SEQ ID NO: 87043 - DNA, 25 bp, Mus musculus
aattcaggtcccagggcaaccataa

SEQ ID NO: 87044 - DNA, 25 bp, Mus musculus
aattcaggtccctgggcaaccataa

SEQ ID NO: 87045 - DNA, 25 bp, Mus musculus
aattcaggttgacaggccttttgca

SEQ ID NO: 87046 - DNA, 25 bp, Mus musculus
aattcaggttgagaggccttttgca

SEQ ID NO: 87047 - DNA, 25 bp, Mus musculus
aattcaggtttaacccagcgtctga

SEQ ID NO: 87048 - DNA, 25 bp, Mus musculus
aattcaggtttatcccagcgtctga

SEQ ID NO: 87049 - DNA, 25 bp, Mus musculus
aattcagtacgccacatttgtcaga

SEQ ID NO: 87050 - DNA, 25 bp, Mus musculus
aattcagtacgcgacatttgtcaga

SEQ ID NO: 87051 - DNA, 25 bp, Mus musculus
aattcagtacgtccacagcctggaa

SEQ ID NO: 87052 - DNA, 25 bp, Mus musculus
aattcagtacgtgcacagcctggaa

SEQ ID NO: 87053 - DNA, 25 bp, Mus musculus
aattcagtaggacatccagccccgg

SEQ ID NO: 87054 - DNA, 25 bp, Mus musculus
aattcagtaggagatccagccccgg

SEQ ID NO: 87055 - DNA, 25 bp, Mus musculus
aattcagtatcccctgacaagtggg

SEQ ID NO: 87056 - DNA, 25 bp, Mus musculus
aattcagtatccgctgacaagtggg

SEQ ID NO: 87057 - DNA, 25 bp, Mus musculus
aattcagtatgtcacagaacagtac

SEQ ID NO: 87058 - DNA, 25 bp, Mus musculus
aattcagtatgtgacagaacagtac

SEQ ID NO: 87059 - DNA, 25 bp, Mus musculus
aattcagtcaggctacagggtggta

SEQ ID NO: 87060 - DNA, 25 bp, Mus musculus
aattcagtcagggtacagggtggta

SEQ ID NO: 87061 - DNA, 25 bp, Mus musculus
aattcagtccaactgagggtcccat

SEQ ID NO: 87062 - DNA, 25 bp, Mus musculus
aattcagtccaagtgagggtcccat

SEQ ID NO: 87063 - DNA, 25 bp, Mus musculus
aattcagtctatagattatcaccac

SEQ ID NO: 87064 - DNA, 25 bp, Mus musculus
aattcagtctattgattatcaccac

SEQ ID NO: 87065 - DNA, 25 bp, Mus musculus
aattcagtctgtacttagccgtcaa

SEQ ID NO: 87066 - DNA, 25 bp, Mus musculus
aattcagtctgttcttagccgtcaa

SEQ ID NO: 87067 - DNA, 25 bp, Mus musculus
aattcagtgaatacggacgggatcg

SEQ ID NO: 87068 - DNA, 25 bp, Mus musculus
aattcagtgaattcggacgggatcg

SEQ ID NO: 87069 - DNA, 25 bp, Mus musculus
aattcagtgactccatgccaacaga

SEQ ID NO: 87070 - DNA, 25 bp, Mus musculus
aattcagtgactgcatgccaacaga

SEQ ID NO: 87071 - DNA, 25 bp, Mus musculus
aattcagtgatgaccaccttgttcc

SEQ ID NO: 87072 - DNA, 25 bp, Mus musculus
aattcagtgatgtccaccttgttcc

SEQ ID NO: 87073 - DNA, 25 bp, Mus musculus
aattcagtgcagctgttgcggctca

SEQ ID NO: 87074 - DNA, 25 bp, Mus musculus
aattcagtgcaggtgttgcggctca

SEQ ID NO: 87075 - DNA, 25 bp, Mus musculus
aattcagtgggaagcgcacaccctc

SEQ ID NO: 87076 - DNA, 25 bp, Mus musculus
aattcagtgggatgcgcacaccctc

SEQ ID NO: 87077 - DNA, 25 bp, Mus musculus
aattcagtggtacggcacttgccta

SEQ ID NO: 87078 - DNA, 25 bp, Mus musculus
aattcagtggtagggcacttgccta

SEQ ID NO: 87079 - DNA, 25 bp, Mus musculus
aattcagtgtagactgggcagtcag

SEQ ID NO: 87080 - DNA, 25 bp, Mus musculus
aattcagtgtagtctgggcagtcag

SEQ ID NO: 87081 - DNA, 25 bp, Mus musculus
aattcagtgtttagttggagtaaag

SEQ ID NO: 87082 - DNA, 25 bp, Mus musculus
aattcagtgttttgttggagtaaag

SEQ ID NO: 87083 - DNA, 25 bp, Mus musculus
aattcagttgtacccactgtctttg

SEQ ID NO: 87084 - DNA, 25 bp, Mus musculus
aattcagttgtagccactgtctttg

SEQ ID NO: 87085 - DNA, 25 bp, Mus musculus
aattcagttgtgagctgtctggctg

SEQ ID NO: 87086 - DNA, 25 bp, Mus musculus
aattcagttgtgtgctgtctggctg

SEQ ID NO: 87087 - DNA, 25 bp, Mus musculus
aattcagtttctctctgaagcccag

SEQ ID NO: 87088 - DNA, 25 bp, Mus musculus
aattcagtttctgtctgaagcccag

SEQ ID NO: 87089 - DNA, 25 bp, Mus musculus
aattcagtttgtccccttccattga

SEQ ID NO: 87090 - DNA, 25 bp, Mus musculus
aattcagtttgtgcccttccattga

SEQ ID NO: 87091 - DNA, 25 bp, Mus musculus
aattcagttttgagagcctgcccgg

SEQ ID NO: 87092 - DNA, 25 bp, Mus musculus
aattcagttttgtgagcctgcccgg

SEQ ID NO: 87093 - DNA, 25 bp, Mus musculus
aattcagtttttctatcttagggca

SEQ ID NO: 87094 - DNA, 25 bp, Mus musculus
aattcagtttttgtatcttagggca

SEQ ID NO: 87095 - DNA, 25 bp, Mus musculus
aattcatacatgcagttttaagact

SEQ ID NO: 87096 - DNA, 25 bp, Mus musculus
aattcatacatggagttttaagact

SEQ ID NO: 87097 - DNA, 25 bp, Mus musculus
aattcataccctcttttggctctct

SEQ ID NO: 87098 - DNA, 25 bp, Mus musculus
aattcataccctgttttggctctct

SEQ ID NO: 87099 - DNA, 25 bp, Mus musculus
aattcatactgcaagaagccttact

SEQ ID NO: 87100 - DNA, 25 bp, Mus musculus
aattcatactgctagaagccttact

SEQ ID NO: 87101 - DNA, 25 bp, Mus musculus
aattcatactggctcaccttactgc

SEQ ID NO: 87102 - DNA, 25 bp, Mus musculus
aattcatactgggtcaccttactgc

SEQ ID NO: 87103 - DNA, 25 bp, Mus musculus
aattcatagaaaaagcagctctggg

SEQ ID NO: 87104 - DNA, 25 bp, Mus musculus
aattcatagaaatagcagctctggg

SEQ ID NO: 87105 - DNA, 25 bp, Mus musculus
aattcatagcatacccttgtcttaa

SEQ ID NO: 87106 - DNA, 25 bp, Mus musculus
aattcatagcattcccttgtcttaa

SEQ ID NO: 87107 - DNA, 25 bp, Mus musculus
aattcatagggtatgactctgacat

SEQ ID NO: 87108 - DNA, 25 bp, Mus musculus
aattcatagggtttgactctgacat

SEQ ID NO: 87109 - DNA, 25 bp, Mus musculus
aattcatagtctcttcattgctcct

SEQ ID NO: 87110 - DNA, 25 bp, Mus musculus
aattcatagtctgttcattgctcct

SEQ ID NO: 87111 - DNA, 25 bp, Mus musculus
aattcatagtggcttctcttcatga

SEQ ID NO: 87112 - DNA, 25 bp, Mus musculus
aattcatagtgggttctcttcatga

SEQ ID NO: 87113 - DNA, 25 bp, Mus musculus
aattcatatgatctgggatcagact

SEQ ID NO: 87114 - DNA, 25 bp, Mus musculus
aattcatatgatgtgggatcagact

SEQ ID NO: 87115 - DNA, 25 bp, Mus musculus
aattcatatgtgcactgttcgggtg

SEQ ID NO: 87116 - DNA, 25 bp, Mus musculus
aattcatatgtggactgttcgggtg

SEQ ID NO: 87117 - DNA, 25 bp, Mus musculus
aattcatatttcaatctctgtgtag

SEQ ID NO: 87118 - DNA, 25 bp, Mus musculus
aattcatatttctatctctgtgtag

SEQ ID NO: 87119 - DNA, 25 bp, Mus musculus
aattcatcaactaaggctttccctt

SEQ ID NO: 87120 - DNA, 25 bp, Mus musculus
aattcatcaacttaggctttccctt

SEQ ID NO: 87121 - DNA, 25 bp, Mus musculus
aattcatcagagagccgggcagtgg

SEQ ID NO: 87122 - DNA, 25 bp, Mus musculus
aattcatcagagtgccgggcagtgg

SEQ ID NO: 87123 - DNA, 25 bp, Mus musculus
aattcatcagtgatactgtcactca

SEQ ID NO: 87124 - DNA, 25 bp, Mus musculus
aattcatcagtgttactgtcactca

SEQ ID NO: 87125 - DNA, 25 bp, Mus musculus
aattcatcattgctaatgtgtttga

SEQ ID NO: 87126 - DNA, 25 bp, Mus musculus
aattcatcattggtaatgtgtttga

SEQ ID NO: 87127 - DNA, 25 bp, Mus musculus
aattcatccatgagtgccaggcatc

SEQ ID NO: 87128 - DNA, 25 bp, Mus musculus
aattcatccatgtgtgccaggcatc

SEQ ID NO: 87129 - DNA, 25 bp, Mus musculus
aattcatcccatacacagttaccaa

SEQ ID NO: 87130 - DNA, 25 bp, Mus musculus
aattcatcccatctacactcttgtg

SEQ ID NO: 87131 - DNA, 25 bp, Mus musculus
aattcatcccatgtacactcttgtg

SEQ ID NO: 87132 - DNA, 25 bp, Mus musculus
aattcatcccattcacagttaccaa

SEQ ID NO: 87133 - DNA, 25 bp, Mus musculus
aattcatcctaaagtgtactagagc

SEQ ID NO: 87134 - DNA, 25 bp, Mus musculus
aattcatcctaatgtgtactagagc

SEQ ID NO: 87135 - DNA, 25 bp, Mus musculus
aattcatcctagatctccaaatgga

SEQ ID NO: 87136 - DNA, 25 bp, Mus musculus
aattcatcctagttctccaaatgga

SEQ ID NO: 87137 - DNA, 25 bp, Mus musculus
aattcatcctccatgagccacctgt

SEQ ID NO: 87138 - DNA, 25 bp, Mus musculus
aattcatcctccttgagccacctgt

SEQ ID NO: 87139 - DNA, 25 bp, Mus musculus
aattcatcgaaaatcagccattgag

SEQ ID NO: 87140 - DNA, 25 bp, Mus musculus
aattcatcgaaattcagccattgag

SEQ ID NO: 87141 - DNA, 25 bp, Mus musculus
aattcatcgaggactatagctctgg

SEQ ID NO: 87142 - DNA, 25 bp, Mus musculus
aattcatcgaggtctatagctctgg

SEQ ID NO: 87143 - DNA, 25 bp, Mus musculus
aattcatctactctctgggcactta

SEQ ID NO: 87144 - DNA, 25 bp, Mus musculus
aattcatctactgtctgggcactta

SEQ ID NO: 87145 - DNA, 25 bp, Mus musculus
aattcatctcaaccttctcaaactt

SEQ ID NO: 87146 - DNA, 25 bp, Mus musculus
aattcatctcaagcttctcaaactt

SEQ ID NO: 87147 - DNA, 25 bp, Mus musculus
aattcatctgagcaaccccagtctc

SEQ ID NO: 87148 - DNA, 25 bp, Mus musculus
aattcatctgaggaaccccagtctc

SEQ ID NO: 87149 - DNA, 25 bp, Mus musculus
aattcatctgctcagttcttaaact

SEQ ID NO: 87150 - DNA, 25 bp, Mus musculus
aattcatctgctgagttcttaaact

SEQ ID NO: 87151 - DNA, 25 bp, Mus musculus
aattcatctgttcattttgtttgct

SEQ ID NO: 87152 - DNA, 25 bp, Mus musculus
aattcatctgttgattttgtttgct

SEQ ID NO: 87153 - DNA, 25 bp, Mus musculus
aattcatgagaacccagtttagttt

SEQ ID NO: 87154 - DNA, 25 bp, Mus musculus
aattcatgagaagccagtttagttt

SEQ ID NO: 87155 - DNA, 25 bp, Mus musculus
aattcatgatttataggcagaggca

SEQ ID NO: 87156 - DNA, 25 bp, Mus musculus
aattcatgatttttaggcagaggca

SEQ ID NO: 87157 - DNA, 25 bp, Mus musculus
aattcatgcactacatccttttcaa

SEQ ID NO: 87158 - DNA, 25 bp, Mus musculus
aattcatgcacttcatccttttcaa

SEQ ID NO: 87159 - DNA, 25 bp, Mus musculus
aattcatgccgtagctggttttatt

SEQ ID NO: 87160 - DNA, 25 bp, Mus musculus
aattcatgccgttgctggttttatt

SEQ ID NO: 87161 - DNA, 25 bp, Mus musculus
aattcatgcctaaatagtctgtata

SEQ ID NO: 87162 - DNA, 25 bp, Mus musculus
aattcatgcctatatagtctgtata

SEQ ID NO: 87163 - DNA, 25 bp, Mus musculus
aattcatgctctatcatctgttcaa

SEQ ID NO: 87164 - DNA, 25 bp, Mus musculus
aattcatgctctttcatctgttcaa

SEQ ID NO: 87165 - DNA, 25 bp, Mus musculus
aattcatggacactggatgtttctt

SEQ ID NO: 87166 - DNA, 25 bp, Mus musculus
aattcatggacagtggatgtttctt

SEQ ID NO: 87167 - DNA, 25 bp, Mus musculus
aattcatggaccctggacaatgaca

SEQ ID NO: 87168 - DNA, 25 bp, Mus musculus
aattcatggaccgtggacaatgaca

SEQ ID NO: 87169 - DNA, 25 bp, Mus musculus
aattcatggatcacttcatcagaac

SEQ ID NO: 87170 - DNA, 25 bp, Mus musculus
aattcatggatctcttcatcagaac

SEQ ID NO: 87171 - DNA, 25 bp, Mus musculus
aattcatggccgctttttccttaat

SEQ ID NO: 87172 - DNA, 25 bp, Mus musculus
aattcatggccggtttttccttaat

SEQ ID NO: 87173 - DNA, 25 bp, Mus musculus
aattcatggcggacactgacctgga

SEQ ID NO: 87174 - DNA, 25 bp, Mus musculus
aattcatggcggtcactgacctgga

SEQ ID NO: 87175 - DNA, 25 bp, Mus musculus
aattcatgggagagctgtggcccct

SEQ ID NO: 87176 - DNA, 25 bp, Mus musculus
aattcatgggagtgctgtggcccct

SEQ ID NO: 87177 - DNA, 25 bp, Mus musculus
aattcatggttcaacatctggtcct

SEQ ID NO: 87178 - DNA, 25 bp, Mus musculus
aattcatggttctacatctggtcct

SEQ ID NO: 87179 - DNA, 25 bp, Mus musculus
aattcatgtaccagcacatgtgacc

SEQ ID NO: 87180 - DNA, 25 bp, Mus musculus
aattcatgtacctgcacatgtgacc

SEQ ID NO: 87181 - DNA, 25 bp, Mus musculus
aattcatgtcttacacctagtttac

SEQ ID NO: 87182 - DNA, 25 bp, Mus musculus
aattcatgtctttcacctagtttac

SEQ ID NO: 87183 - DNA, 25 bp, Mus musculus
aattcatgttgaattgctgttaaga

SEQ ID NO: 87184 - DNA, 25 bp, Mus musculus
aattcatgttgatttgctgttaaga

SEQ ID NO: 87185 - DNA, 25 bp, Mus musculus
aattcatgttttcagattagatcta

SEQ ID NO: 87186 - DNA, 25 bp, Mus musculus
aattcatgttttgagattagatcta

SEQ ID NO: 87187 - DNA, 25 bp, Mus musculus
aattcattaaggcagcttgtcctaa

SEQ ID NO: 87188 - DNA, 25 bp, Mus musculus
aattcattaagggagcttgtcctaa

SEQ ID NO: 87189 - DNA, 25 bp, Mus musculus
aattcattacatcgaggctcaatct

SEQ ID NO: 87190 - DNA, 25 bp, Mus musculus
aattcattacatggaggctcaatct

SEQ ID NO: 87191 - DNA, 25 bp, Mus musculus
aattcattaccactcatgcttggag

SEQ ID NO: 87192 - DNA, 25 bp, Mus musculus
aattcattaccagtcatgcttggag

SEQ ID NO: 87193 - DNA, 25 bp, Mus musculus
aattcattagacatgattcccttaa

SEQ ID NO: 87194 - DNA, 25 bp, Mus musculus
aattcattagacttgattcccttaa

SEQ ID NO: 87195 - DNA, 25 bp, Mus musculus
aattcattagctatatgcccgtccc

SEQ ID NO: 87196 - DNA, 25 bp, Mus musculus
aattcattagctttatgcccgtccc

SEQ ID NO: 87197 - DNA, 25 bp, Mus musculus
aattcattatatctcctgtaactat

SEQ ID NO: 87198 - DNA, 25 bp, Mus musculus
aattcattatatgtcctgtaactat

SEQ ID NO: 87199 - DNA, 25 bp, Mus musculus
aattcattatgtacgcaaccagtac

SEQ ID NO: 87200 - DNA, 25 bp, Mus musculus
aattcattatgttcgcaaccagtac

SEQ ID NO: 87201 - DNA, 25 bp, Mus musculus
aattcattcaatcgtcgtgtttgta

SEQ ID NO: 87202 - DNA, 25 bp, Mus musculus
aattcattcaatggtcgtgtttgta

SEQ ID NO: 87203 - DNA, 25 bp, Mus musculus
aattcattcctaccactatatctac

SEQ ID NO: 87204 - DNA, 25 bp, Mus musculus
aattcattcctagcactatatctac

SEQ ID NO: 87205 - DNA, 25 bp, Mus musculus
aattcattctagaagctgttcccct

SEQ ID NO: 87206 - DNA, 25 bp, Mus musculus
aattcattctagtagctgttcccct

SEQ ID NO: 87207 - DNA, 25 bp, Mus musculus
aattcattctgaatactcttgcccc

SEQ ID NO: 87208 - DNA, 25 bp, Mus musculus
aattcattctgattactcttgcccc

SEQ ID NO: 87209 - DNA, 25 bp, Mus musculus
aattcattgatgagccaaccctgtg

SEQ ID NO: 87210 - DNA, 25 bp, Mus musculus
aattcattgatgtgccaaccctgtg

SEQ ID NO: 87211 - DNA, 25 bp, Mus musculus
aattcattgtggcatccaggcgggt

SEQ ID NO: 87212 - DNA, 25 bp, Mus musculus
aattcattgtgggatccaggcgggt

SEQ ID NO: 87213 - DNA, 25 bp, Mus musculus
aattcattgtttacagccactgctg

SEQ ID NO: 87214 - DNA, 25 bp, Mus musculus
aattcattgttttcagccactgctg

SEQ ID NO: 87215 - DNA, 25 bp, Mus musculus
aattcatttactatggaattggaga

SEQ ID NO: 87216 - DNA, 25 bp, Mus musculus
aattcatttactttggaattggaga

SEQ ID NO: 87217 - DNA, 25 bp, Mus musculus
aattcatttataattcacacctcat

SEQ ID NO: 87218 - DNA, 25 bp, Mus musculus
aattcatttatatttcacacctcat

SEQ ID NO: 87219 - DNA, 25 bp, Mus musculus
aattcatttattcaaagtcctacaa

SEQ ID NO: 87220 - DNA, 25 bp, Mus musculus
aattcatttattgaaagtcctacaa

SEQ ID NO: 87221 - DNA, 25 bp, Mus musculus
aattcatttgggctgtgtacactaa

SEQ ID NO: 87222 - DNA, 25 bp, Mus musculus
aattcatttggggtgtgtacactaa

SEQ ID NO: 87223 - DNA, 25 bp, Mus musculus
aattcatttggtcctcacgacagtg

SEQ ID NO: 87224 - DNA, 25 bp, Mus musculus
aattcatttggtgctcacgacagtg

SEQ ID NO: 87225 - DNA, 25 bp, Mus musculus
aattcatttgtcatcagtttaatca

SEQ ID NO: 87226 - DNA, 25 bp, Mus musculus
aattcatttgtcttcagtttaatca

SEQ ID NO: 87227 - DNA, 25 bp, Mus musculus
aattcattttacaatcctgggcatg

SEQ ID NO: 87228 - DNA, 25 bp, Mus musculus
aattcattttactatcctgggcatg

SEQ ID NO: 87229 - DNA, 25 bp, Mus musculus
aattcattttgaaaggttgctggat

SEQ ID NO: 87230 - DNA, 25 bp, Mus musculus
aattcattttgataggttgctggat

SEQ ID NO: 87231 - DNA, 25 bp, Mus musculus
aattcattttggattctgtagagca

SEQ ID NO: 87232 - DNA, 25 bp, Mus musculus
aattcattttggtttctgtagagca

SEQ ID NO: 87233 - DNA, 25 bp, Mus musculus
aattcatttttgagctgtacagcca

SEQ ID NO: 87234 - DNA, 25 bp, Mus musculus
aattcatttttgtgctgtacagcca

SEQ ID NO: 87235 - DNA, 25 bp, Mus musculus
aattccaaaccccagatgatctcca

SEQ ID NO: 87236 - DNA, 25 bp, Mus musculus
aattccaaacccgagatgatctcca

SEQ ID NO: 87237 - DNA, 25 bp, Mus musculus
aattccaaacgcctagcttgggcgc

SEQ ID NO: 87238 - DNA, 25 bp, Mus musculus
aattccaaacgcgtagcttgggcgc

SEQ ID NO: 87239 - DNA, 25 bp, Mus musculus
aattccaaacttccttctcatggta

SEQ ID NO: 87240 - DNA, 25 bp, Mus musculus
aattccaaacttgcttctcatggta

SEQ ID NO: 87241 - DNA, 25 bp, Mus musculus
aattccaaagatcgctttgtttgct

SEQ ID NO: 87242 - DNA, 25 bp, Mus musculus
aattccaaagatggctttgtttgct

SEQ ID NO: 87243 - DNA, 25 bp, Mus musculus
aattccaacataccccagtgtggga

SEQ ID NO: 87244 - DNA, 25 bp, Mus musculus
aattccaacatagcccagtgtggga

SEQ ID NO: 87245 - DNA, 25 bp, Mus musculus
aattccaaccctcgcaaatctactt

SEQ ID NO: 87246 - DNA, 25 bp, Mus musculus
aattccaaccctggcaaatctactt

SEQ ID NO: 87247 - DNA, 25 bp, Mus musculus
aattccaacgctagggaggcaggag

SEQ ID NO: 87248 - DNA, 25 bp, Mus musculus
aattccaacgcttgggaggcaggag

SEQ ID NO: 87249 - DNA, 25 bp, Mus musculus
aattccaactgaacaccctggagcg

SEQ ID NO: 87250 - DNA, 25 bp, Mus musculus
aattccaactgatcaccctggagcg

SEQ ID NO: 87251 - DNA, 25 bp, Mus musculus
aattccaagagtcacttgctccctc

SEQ ID NO: 87252 - DNA, 25 bp, Mus musculus
aattccaagagtgacttgctccctc

SEQ ID NO: 87253 - DNA, 25 bp, Mus musculus
aattccaagcaaaacaggctgttaa

SEQ ID NO: 87254 - DNA, 25 bp, Mus musculus
aattccaagcaatacaggctgttaa

SEQ ID NO: 87255 - DNA, 25 bp, Mus musculus
aattccaagcagattgtggtcccca

SEQ ID NO: 87256 - DNA, 25 bp, Mus musculus
aattccaagcagtttgtggtcccca

SEQ ID NO: 87257 - DNA, 25 bp, Mus musculus
aattccaagcatatgttcactcgtg

SEQ ID NO: 87258 - DNA, 25 bp, Mus musculus
aattccaagcatttgttcactcgtg

SEQ ID NO: 87259 - DNA, 25 bp, Mus musculus
aattccaagccaatgccaggcctgt

SEQ ID NO: 87260 - DNA, 25 bp, Mus musculus
aattccaagccattgccaggcctgt

SEQ ID NO: 87261 - DNA, 25 bp, Mus musculus
aattccaagctaccatatgcattgt

SEQ ID NO: 87262 - DNA, 25 bp, Mus musculus
aattccaagctagcatatgcattgt

SEQ ID NO: 87263 - DNA, 25 bp, Mus musculus
aattccaagggcagatgtgggctaa

SEQ ID NO: 87264 - DNA, 25 bp, Mus musculus
aattccaagggcagggtgttctgcg

SEQ ID NO: 87265 - DNA, 25 bp, Mus musculus
aattccaagggctgatgtgggctaa

SEQ ID NO: 87266 - DNA, 25 bp, Mus musculus
aattccaagggctgggtgttctgcg

SEQ ID NO: 87267 - DNA, 25 bp, Mus musculus
aattccaagtacagagtcttaggct

SEQ ID NO: 87268 - DNA, 25 bp, Mus musculus
aattccaagtactgagtcttaggct

SEQ ID NO: 87269 - DNA, 25 bp, Mus musculus
aattccaagtccaagctttgtccat

SEQ ID NO: 87270 - DNA, 25 bp, Mus musculus
aattccaagtcctagctttgtccat

SEQ ID NO: 87271 - DNA, 25 bp, Mus musculus
aattccaagtgcacatattctgtgc

SEQ ID NO: 87272 - DNA, 25 bp, Mus musculus
aattccaagtgctcatattctgtgc

SEQ ID NO: 87273 - DNA, 25 bp, Mus musculus
aattccaagtggcatgtaccttccc

SEQ ID NO: 87274 - DNA, 25 bp, Mus musculus
aattccaagtgggatgtaccttccc

SEQ ID NO: 87275 - DNA, 25 bp, Mus musculus
aattccaatcaccaaaaagcatatt

SEQ ID NO: 87276 - DNA, 25 bp, Mus musculus
aattccaatcacgaaaaagcatatt

SEQ ID NO: 87277 - DNA, 25 bp, Mus musculus
aattccaatggacatcatggaacag

SEQ ID NO: 87278 - DNA, 25 bp, Mus musculus
aattccaatggagatcatggaacag

SEQ ID NO: 87279 - DNA, 25 bp, Mus musculus
aattccaatttcacctcaagagccc

SEQ ID NO: 87280 - DNA, 25 bp, Mus musculus
aattccaatttctcctcaagagccc

SEQ ID NO: 87281 - DNA, 25 bp, Mus musculus
aattccacactaagtcaagcttgag

SEQ ID NO: 87282 - DNA, 25 bp, Mus musculus
aattccacactatgtcaagcttgag

SEQ ID NO: 87283 - DNA, 25 bp, Mus musculus
aattccacagacctcaaaatatcca

SEQ ID NO: 87284 - DNA, 25 bp, Mus musculus
aattccacagacgtcaaaatatcca

SEQ ID NO: 87285 - DNA, 25 bp, Mus musculus
aattccacagggagcaatggctatt

SEQ ID NO: 87286 - DNA, 25 bp, Mus musculus
aattccacagggtgcaatggctatt

SEQ ID NO: 87287 - DNA, 25 bp, Mus musculus
aattccacagtgctaggctggctgg

SEQ ID NO: 87288 - DNA, 25 bp, Mus musculus
aattccacagtggtaggctggctgg

SEQ ID NO: 87289 - DNA, 25 bp, Mus musculus
aattccaccatcatcgtcatgctga

SEQ ID NO: 87290 - DNA, 25 bp, Mus musculus
aattccaccatcttcgtcatgctga

SEQ ID NO: 87291 - DNA, 25 bp, Mus musculus
aattccacctccagagaggctggga

SEQ ID NO: 87292 - DNA, 25 bp, Mus musculus
aattccacctcctgagaggctggga

SEQ ID NO: 87293 - DNA, 25 bp, Mus musculus
aattccacgatgaccgctacggcac

SEQ ID NO: 87294 - DNA, 25 bp, Mus musculus
aattccacgatgtccgctacggcac

SEQ ID NO: 87295 - DNA, 25 bp, Mus musculus
aattccactcatatagtcactgtct

SEQ ID NO: 87296 - DNA, 25 bp, Mus musculus
aattccactcatttagtcactgtct

SEQ ID NO: 87297 - DNA, 25 bp, Mus musculus
aattccactgataccactaaagccc

SEQ ID NO: 87298 - DNA, 25 bp, Mus musculus
aattccactgatatcggcccattga

SEQ ID NO: 87299 - DNA, 25 bp, Mus musculus
aattccactgattccactaaagccc

SEQ ID NO: 87300 - DNA, 25 bp, Mus musculus
aattccactgatttcggcccattga

SEQ ID NO: 87301 - DNA, 25 bp, Mus musculus
aattccactgccatatttattacaa

SEQ ID NO: 87302 - DNA, 25 bp, Mus musculus
aattccactgccttatttattacaa

SEQ ID NO: 87303 - DNA, 25 bp, Mus musculus
aattccactggccaagcgctttgga

SEQ ID NO: 87304 - DNA, 25 bp, Mus musculus
aattccactggcgaagcgctttgga

SEQ ID NO: 87305 - DNA, 25 bp, Mus musculus
aattccacttacaatatcctgcttc

SEQ ID NO: 87306 - DNA, 25 bp, Mus musculus
aattccacttactatatcctgcttc

SEQ ID NO: 87307 - DNA, 25 bp, Mus musculus
aattccagaattagtcaaccatcaa

SEQ ID NO: 87308 - DNA, 25 bp, Mus musculus
aattccagaatttgtcaaccatcaa

SEQ ID NO: 87309 - DNA, 25 bp, Mus musculus
aattccagagctcatttgttcactc

SEQ ID NO: 87310 - DNA, 25 bp, Mus musculus
aattccagagctgatttgttcactc

SEQ ID NO: 87311 - DNA, 25 bp, Mus musculus
aattccagagtcactgctgtggaga

SEQ ID NO: 87312 - DNA, 25 bp, Mus musculus
aattccagagtctctgctgtggaga

SEQ ID NO: 87313 - DNA, 25 bp, Mus musculus
aattccagatgcctccgaaaaatag

SEQ ID NO: 87314 - DNA, 25 bp, Mus musculus
aattccagatgcgtccgaaaaatag

SEQ ID NO: 87315 - DNA, 25 bp, Mus musculus
aattccagcactctgttggcaatcg

SEQ ID NO: 87316 - DNA, 25 bp, Mus musculus
aattccagcactgtgttggcaatcg

SEQ ID NO: 87317 - DNA, 25 bp, Mus musculus
aattccagcagtacaacaaaaccct

SEQ ID NO: 87318 - DNA, 25 bp, Mus musculus
aattccagcagttcaacaaaaccct

SEQ ID NO: 87319 - DNA, 25 bp, Mus musculus
aattccagcatgaatggtagtccac

SEQ ID NO: 87320 - DNA, 25 bp, Mus musculus
aattccagcatgtatggtagtccac

SEQ ID NO: 87321 - DNA, 25 bp, Mus musculus
aattccagctgaatatgtgtggtga

SEQ ID NO: 87322 - DNA, 25 bp, Mus musculus
aattccagctgactacgtagcttcc

SEQ ID NO: 87323 - DNA, 25 bp, Mus musculus
aattccagctgagtacgtagcttcc

SEQ ID NO: 87324 - DNA, 25 bp, Mus musculus
aattccagctgattatgtgtggtga

SEQ ID NO: 87325 - DNA, 25 bp, Mus musculus
aattccaggagacatcttgtttgta

SEQ ID NO: 87326 - DNA, 25 bp, Mus musculus
aattccaggagagatcttgtttgta

SEQ ID NO: 87327 - DNA, 25 bp, Mus musculus
aattccaggaggactagagcactca

SEQ ID NO: 87328 - DNA, 25 bp, Mus musculus
aattccaggaggtctagagcactca

SEQ ID NO: 87329 - DNA, 25 bp, Mus musculus
aattccaggtggagtgagcatgttc

SEQ ID NO: 87330 - DNA, 25 bp, Mus musculus
aattccaggtggtgtgagcatgttc

SEQ ID NO: 87331 - DNA, 25 bp, Mus musculus
aattccagtcacagatcagctccaa

SEQ ID NO: 87332 - DNA, 25 bp, Mus musculus
aattccagtcactgatcagctccaa

SEQ ID NO: 87333 - DNA, 25 bp, Mus musculus
aattccagtcagacctcctttttag

SEQ ID NO: 87334 - DNA, 25 bp, Mus musculus
aattccagtcagtcctcctttttag

SEQ ID NO: 87335 - DNA, 25 bp, Mus musculus
aattccagtctaaccacatgttacc

SEQ ID NO: 87336 - DNA, 25 bp, Mus musculus
aattccagtctatccacatgttacc

SEQ ID NO: 87337 - DNA, 25 bp, Mus musculus
aattccagtggaaacaactccctca

SEQ ID NO: 87338 - DNA, 25 bp, Mus musculus
aattccagtggatacaactccctca

SEQ ID NO: 87339 - DNA, 25 bp, Mus musculus
aattccagtgttaaatatgatttca

SEQ ID NO: 87340 - DNA, 25 bp, Mus musculus
aattccagtgtttaatatgatttca

SEQ ID NO: 87341 - DNA, 25 bp, Mus musculus
aattccagtttcaagggttccagtg

SEQ ID NO: 87342 - DNA, 25 bp, Mus musculus
aattccagtttctagggttccagtg

SEQ ID NO: 87343 - DNA, 25 bp, Mus musculus
aattccataagaagcccctatcctt

SEQ ID NO: 87344 - DNA, 25 bp, Mus musculus
aattccataagatgcccctatcctt

SEQ ID NO: 87345 - DNA, 25 bp, Mus musculus
aattccatatgtaaggcgggttctg

SEQ ID NO: 87346 - DNA, 25 bp, Mus musculus
aattccatatgttaggcgggttctg

SEQ ID NO: 87347 - DNA, 25 bp, Mus musculus
aattccatcaggaaatcgtccgagg

SEQ ID NO: 87348 - DNA, 25 bp, Mus musculus
aattccatcaggtaatcgtccgagg

SEQ ID NO: 87349 - DNA, 25 bp, Mus musculus
aattccatcatcaaccctgtcattt

SEQ ID NO: 87350 - DNA, 25 bp, Mus musculus
aattccatcatctaccctgtcattt

SEQ ID NO: 87351 - DNA, 25 bp, Mus musculus
aattccatcatgaacttcacagagg

SEQ ID NO: 87352 - DNA, 25 bp, Mus musculus
aattccatcatgtacttcacagagg

SEQ ID NO: 87353 - DNA, 25 bp, Mus musculus
aattccatccaaaaaacttgtgcaa

SEQ ID NO: 87354 - DNA, 25 bp, Mus musculus
aattccatccaataaacttgtgcaa

SEQ ID NO: 87355 - DNA, 25 bp, Mus musculus
aattccatccacattgatagcatca

SEQ ID NO: 87356 - DNA, 25 bp, Mus musculus
aattccatccactttgatagcatca

SEQ ID NO: 87357 - DNA, 25 bp, Mus musculus
aattccatccctagtgcatacacaa

SEQ ID NO: 87358 - DNA, 25 bp, Mus musculus
aattccatcccttgtgcatacacaa

SEQ ID NO: 87359 - DNA, 25 bp, Mus musculus
aattccatccttccagatccgaaat

SEQ ID NO: 87360 - DNA, 25 bp, Mus musculus
aattccatccttgcagatccgaaat

SEQ ID NO: 87361 - DNA, 25 bp, Mus musculus
aattccatcgctagagaggctgatt

SEQ ID NO: 87362 - DNA, 25 bp, Mus musculus
aattccatcgcttgagaggctgatt

SEQ ID NO: 87363 - DNA, 25 bp, Mus musculus
aattccatcgtaattcccaactcat

SEQ ID NO: 87364 - DNA, 25 bp, Mus musculus
aattccatcgtatttcccaactcat

SEQ ID NO: 87365 - DNA, 25 bp, Mus musculus
aattccatctggctacagctacatg

SEQ ID NO: 87366 - DNA, 25 bp, Mus musculus
aattccatctgggtacagctacatg

SEQ ID NO: 87367 - DNA, 25 bp, Mus musculus
aattccatcttcactttgcattgta

SEQ ID NO: 87368 - DNA, 25 bp, Mus musculus
aattccatcttctctttgcattgta

SEQ ID NO: 87369 - DNA, 25 bp, Mus musculus
aattccatgaatcgcttctctttgg

SEQ ID NO: 87370 - DNA, 25 bp, Mus musculus
aattccatgaatggcttctctttgg

SEQ ID NO: 87371 - DNA, 25 bp, Mus musculus
aattccatgcatactccaatatcgt

SEQ ID NO: 87372 - DNA, 25 bp, Mus musculus
aattccatgcattctccaatatcgt

SEQ ID NO: 87373 - DNA, 25 bp, Mus musculus
aattccatgccacatttcacactag

SEQ ID NO: 87374 - DNA, 25 bp, Mus musculus
aattccatgccagatttcacactag

SEQ ID NO: 87375 - DNA, 25 bp, Mus musculus
aattccatgcccactgaaacagcat

SEQ ID NO: 87376 - DNA, 25 bp, Mus musculus
aattccatgccctctgaaacagcat

SEQ ID NO: 87377 - DNA, 25 bp, Mus musculus
aattccatggtgattctgggacggc

SEQ ID NO: 87378 - DNA, 25 bp, Mus musculus
aattccatggtgtttctgggacggc

SEQ ID NO: 87379 - DNA, 25 bp, Mus musculus
aattccatgtccaaattttgaaatg

SEQ ID NO: 87380 - DNA, 25 bp, Mus musculus
aattccatgtcctaattttgaaatg

SEQ ID NO: 87381 - DNA, 25 bp, Mus musculus
aattccattaatacaccagatgcag

SEQ ID NO: 87382 - DNA, 25 bp, Mus musculus
aattccattaattcaccagatgcag

SEQ ID NO: 87383 - DNA, 25 bp, Mus musculus
aattccattataatccattgccaaa

SEQ ID NO: 87384 - DNA, 25 bp, Mus musculus
aattccattatattccattgccaaa

SEQ ID NO: 87385 - DNA, 25 bp, Mus musculus
aattccattggtaccatgttggcac

SEQ ID NO: 87386 - DNA, 25 bp, Mus musculus
aattccattggttccatgttggcac

SEQ ID NO: 87387 - DNA, 25 bp, Mus musculus
aattccatttccaggtaggtattca

SEQ ID NO: 87388 - DNA, 25 bp, Mus musculus
aattccatttcctggtaggtattca

SEQ ID NO: 87389 - DNA, 25 bp, Mus musculus
aattccatttctccttttagtcttt

SEQ ID NO: 87390 - DNA, 25 bp, Mus musculus
aattccatttctctgggtctcggca

SEQ ID NO: 87391 - DNA, 25 bp, Mus musculus
aattccatttctgcttttagtcttt

SEQ ID NO: 87392 - DNA, 25 bp, Mus musculus
aattccatttctgtgggtctcggca

SEQ ID NO: 87393 - DNA, 25 bp, Mus musculus
aattcccaaatacaaggatctgctg

SEQ ID NO: 87394 - DNA, 25 bp, Mus musculus
aattcccaaatagaaggatctgctg

SEQ ID NO: 87395 - DNA, 25 bp, Mus musculus
aattcccaagacctacagctcatga

SEQ ID NO: 87396 - DNA, 25 bp, Mus musculus
aattcccaagacgtacagctcatga

SEQ ID NO: 87397 - DNA, 25 bp, Mus musculus
aattcccaagggatcaagaacctgg

SEQ ID NO: 87398 - DNA, 25 bp, Mus musculus
aattcccaagggttcaagaacctgg

SEQ ID NO: 87399 - DNA, 25 bp, Mus musculus
aattcccactgcctcatttgttgtt

SEQ ID NO: 87400 - DNA, 25 bp, Mus musculus
aattcccactgcgtcatttgttgtt

SEQ ID NO: 87401 - DNA, 25 bp, Mus musculus
aattcccagaaaagacatcgtggct

SEQ ID NO: 87402 - DNA, 25 bp, Mus musculus
aattcccagaaatgacatcgtggct

SEQ ID NO: 87403 - DNA, 25 bp, Mus musculus
aattcccagaatcccgatacgtgta

SEQ ID NO: 87404 - DNA, 25 bp, Mus musculus
aattcccagaatgccgatacgtgta

SEQ ID NO: 87405 - DNA, 25 bp, Mus musculus
aattcccagacgatgaagctggacg

SEQ ID NO: 87406 - DNA, 25 bp, Mus musculus
aattcccagacgttgaagctggacg

SEQ ID NO: 87407 - DNA, 25 bp, Mus musculus
aattcccagagacagttgacttccc

SEQ ID NO: 87408 - DNA, 25 bp, Mus musculus
aattcccagagactacaggtgccag

SEQ ID NO: 87409 - DNA, 25 bp, Mus musculus
aattcccagagagagttgacttccc

SEQ ID NO: 87410 - DNA, 25 bp, Mus musculus
aattcccagagagtacaggtgccag

SEQ ID NO: 87411 - DNA, 25 bp, Mus musculus
aattcccagatcaatgtacataaaa

SEQ ID NO: 87412 - DNA, 25 bp, Mus musculus
aattcccagatctatgtacataaaa

SEQ ID NO: 87413 - DNA, 25 bp, Mus musculus
aattcccagatgacatagatgcctt

SEQ ID NO: 87414 - DNA, 25 bp, Mus musculus
aattcccagatgtcatagatgcctt

SEQ ID NO: 87415 - DNA, 25 bp, Mus musculus
aattcccagcagagtgggctgtgtt

SEQ ID NO: 87416 - DNA, 25 bp, Mus musculus
aattcccagcagtgtgggctgtgtt

SEQ ID NO: 87417 - DNA, 25 bp, Mus musculus
aattcccaggccagagatgtcaagg

SEQ ID NO: 87418 - DNA, 25 bp, Mus musculus
aattcccaggcctgagatgtcaagg

SEQ ID NO: 87419 - DNA, 25 bp, Mus musculus
aattcccagggtatgactggacctg

SEQ ID NO: 87420 - DNA, 25 bp, Mus musculus
aattcccagggtttgactggacctg

SEQ ID NO: 87421 - DNA, 25 bp, Mus musculus
aattcccagtagagaaaggcatttt

SEQ ID NO: 87422 - DNA, 25 bp, Mus musculus
aattcccagtagtgaaaggcatttt

SEQ ID NO: 87423 - DNA, 25 bp, Mus musculus
aattcccatcgaccaataggcacct

SEQ ID NO: 87424 - DNA, 25 bp, Mus musculus
aattcccatcgagcaataggcacct

SEQ ID NO: 87425 - DNA, 25 bp, Mus musculus
aattcccatgccagtgatttaacta

SEQ ID NO: 87426 - DNA, 25 bp, Mus musculus
aattcccatgcctgtgatttaacta

SEQ ID NO: 87427 - DNA, 25 bp, Mus musculus
aattcccatttcaatgttttcacca

SEQ ID NO: 87428 - DNA, 25 bp, Mus musculus
aattcccatttctatgttttcacca

SEQ ID NO: 87429 - DNA, 25 bp, Mus musculus
aattccccagcaatctaagaaatga

SEQ ID NO: 87430 - DNA, 25 bp, Mus musculus
aattccccagcattctaagaaatga

SEQ ID NO: 87431 - DNA, 25 bp, Mus musculus
aattccccaggactacatgcaaagc

SEQ ID NO: 87432 - DNA, 25 bp, Mus musculus
aattccccaggagtacatgcaaagc

SEQ ID NO: 87433 - DNA, 25 bp, Mus musculus
aattccccatagcttatgagcagtg

SEQ ID NO: 87434 - DNA, 25 bp, Mus musculus
aattccccataggttatgagcagtg

SEQ ID NO: 87435 - DNA, 25 bp, Mus musculus
aattccccatgcagattcacaggga

SEQ ID NO: 87436 - DNA, 25 bp, Mus musculus
aattccccatgctgattcacaggga

SEQ ID NO: 87437 - DNA, 25 bp, Mus musculus
aattccccattcatactgtgagcac

SEQ ID NO: 87438 - DNA, 25 bp, Mus musculus
aattccccattcttactgtgagcac

SEQ ID NO: 87439 - DNA, 25 bp, Mus musculus
aattccccgaggatggcagtgagcc

SEQ ID NO: 87440 - DNA, 25 bp, Mus musculus
aattccccgaggttggcagtgagcc

SEQ ID NO: 87441 - DNA, 25 bp, Mus musculus
aattcccctgatagtactattctat

SEQ ID NO: 87442 - DNA, 25 bp, Mus musculus
aattcccctgattgtactattctat

SEQ ID NO: 87443 - DNA, 25 bp, Mus musculus
aattcccctgccaaagattctcaat

SEQ ID NO: 87444 - DNA, 25 bp, Mus musculus
aattcccctgcctaagattctcaat

SEQ ID NO: 87445 - DNA, 25 bp, Mus musculus
aattcccgatctcctttttctatag

SEQ ID NO: 87446 - DNA, 25 bp, Mus musculus
aattcccgatctgctttttctatag

SEQ ID NO: 87447 - DNA, 25 bp, Mus musculus
aattcccgctctctagatctgtcgc

SEQ ID NO: 87448 - DNA, 25 bp, Mus musculus
aattcccgctctgtagatctgtcgc

SEQ ID NO: 87449 - DNA, 25 bp, Mus musculus
aattcccggaacactttcatccagc

SEQ ID NO: 87450 - DNA, 25 bp, Mus musculus
aattcccggaactctttcatccagc

SEQ ID NO: 87451 - DNA, 25 bp, Mus musculus
aattcccggaagatcgatcggccat

SEQ ID NO: 87452 - DNA, 25 bp, Mus musculus
aattcccggaagttcgatcggccat

SEQ ID NO: 87453 - DNA, 25 bp, Mus musculus
aattcccggatacccatggttgcac

SEQ ID NO: 87454 - DNA, 25 bp, Mus musculus
aattcccggatagccatggttgcac

SEQ ID NO: 87455 - DNA, 25 bp, Mus musculus
aattcccgtagactctgacaccgcg

SEQ ID NO: 87456 - DNA, 25 bp, Mus musculus
aattcccgtagagtctgacaccgcg

SEQ ID NO: 87457 - DNA, 25 bp, Mus musculus
aattccctaaatactggcgttctgc

SEQ ID NO: 87458 - DNA, 25 bp, Mus musculus
aattccctaaattctggcgttctgc

SEQ ID NO: 87459 - DNA, 25 bp, Mus musculus
aattccctactcactaattatcctt

SEQ ID NO: 87460 - DNA, 25 bp, Mus musculus
aattccctactctctaattatcctt

SEQ ID NO: 87461 - DNA, 25 bp, Mus musculus
aattccctaggaaatcatttttggt

SEQ ID NO: 87462 - DNA, 25 bp, Mus musculus
aattccctaggatatcatttttggt

SEQ ID NO: 87463 - DNA, 25 bp, Mus musculus
aattccctatatacatgctcccaaa

SEQ ID NO: 87464 - DNA, 25 bp, Mus musculus
aattccctatattcatgctcccaaa

SEQ ID NO: 87465 - DNA, 25 bp, Mus musculus
aattccctcacaaagtctttcattg

SEQ ID NO: 87466 - DNA, 25 bp, Mus musculus
aattccctcacaatgaatggaggtt

SEQ ID NO: 87467 - DNA, 25 bp, Mus musculus
aattccctcacatagtctttcattg

SEQ ID NO: 87468 - DNA, 25 bp, Mus musculus
aattccctcacattgaatggaggtt

SEQ ID NO: 87469 - DNA, 25 bp, Mus musculus
aattccctccagacatttgcagtat

SEQ ID NO: 87470 - DNA, 25 bp, Mus musculus
aattccctccagtcatttgcagtat

SEQ ID NO: 87471 - DNA, 25 bp, Mus musculus
aattccctgattaccagtggcttca

SEQ ID NO: 87472 - DNA, 25 bp, Mus musculus
aattccctgatttccagtggcttca

SEQ ID NO: 87473 - DNA, 25 bp, Mus musculus
aattccctgcaacgccgtggtttgg

SEQ ID NO: 87474 - DNA, 25 bp, Mus musculus
aattccctgcaaggccgtggtttgg

SEQ ID NO: 87475 - DNA, 25 bp, Mus musculus
aattccctgcacaccactggaaaat

SEQ ID NO: 87476 - DNA, 25 bp, Mus musculus
aattccctgcactccactggaaaat

SEQ ID NO: 87477 - DNA, 25 bp, Mus musculus
aattccctggacacagtagctgaac

SEQ ID NO: 87478 - DNA, 25 bp, Mus musculus
aattccctggactcagtagctgaac

SEQ ID NO: 87479 - DNA, 25 bp, Mus musculus
aattccctgtgactaaagctttgca

SEQ ID NO: 87480 - DNA, 25 bp, Mus musculus
aattccctgtgagtaaagctttgca

SEQ ID NO: 87481 - DNA, 25 bp, Mus musculus
aattcccttcagagggacatcgagg

SEQ ID NO: 87482 - DNA, 25 bp, Mus musculus
aattcccttcagtgggacatcgagg

SEQ ID NO: 87483 - DNA, 25 bp, Mus musculus
aattcccttctgatcacggaacatg

SEQ ID NO: 87484 - DNA, 25 bp, Mus musculus
aattcccttctgttcacggaacatg

SEQ ID NO: 87485 - DNA, 25 bp, Mus musculus
aattccctttgccttgtcttgactg

SEQ ID NO: 87486 - DNA, 25 bp, Mus musculus
aattccctttgcgttgtcttgactg

SEQ ID NO: 87487 - DNA, 25 bp, Mus musculus
aattccgaaaggatgtggagccctc

SEQ ID NO: 87488 - DNA, 25 bp, Mus musculus
aattccgaaaggttgtggagccctc

SEQ ID NO: 87489 - DNA, 25 bp, Mus musculus
aattccgacacgcagatctggtccg

SEQ ID NO: 87490 - DNA, 25 bp, Mus musculus
aattccgacacggagatctggtccg

SEQ ID NO: 87491 - DNA, 25 bp, Mus musculus
aattccgacctgacggtaaattgcg

SEQ ID NO: 87492 - DNA, 25 bp, Mus musculus
aattccgacctgtcggtaaattgcg

SEQ ID NO: 87493 - DNA, 25 bp, Mus musculus
aattccgagataaaccaggcgacat

SEQ ID NO: 87494 - DNA, 25 bp, Mus musculus
aattccgagatataccaggcgacat

SEQ ID NO: 87495 - DNA, 25 bp, Mus musculus
aattccgaggctaaggtctctgcga

SEQ ID NO: 87496 - DNA, 25 bp, Mus musculus
aattccgaggcttaggtctctgcga

SEQ ID NO: 87497 - DNA, 25 bp, Mus musculus
aattccgcaaaaacctacggtgcaa

SEQ ID NO: 87498 - DNA, 25 bp, Mus musculus
aattccgcaaaatcctacggtgcaa

SEQ ID NO: 87499 - DNA, 25 bp, Mus musculus
aattccgcagtgagctggtggtgac

SEQ ID NO: 87500 - DNA, 25 bp, Mus musculus
aattccgcagtgtgctggtggtgac

SEQ ID NO: 87501 - DNA, 25 bp, Mus musculus
aattccgccacgcttggcaacagag

SEQ ID NO: 87502 - DNA, 25 bp, Mus musculus
aattccgccacggttggcaacagag

SEQ ID NO: 87503 - DNA, 25 bp, Mus musculus
aattccgccagtactttggtctcaa

SEQ ID NO: 87504 - DNA, 25 bp, Mus musculus
aattccgccagttctttggtctcaa

SEQ ID NO: 87505 - DNA, 25 bp, Mus musculus
aattccgctatgctcaagatgattt

SEQ ID NO: 87506 - DNA, 25 bp, Mus musculus
aattccgctatggtcaagatgattt

SEQ ID NO: 87507 - DNA, 25 bp, Mus musculus
aattccggaaagacccataacgcag

SEQ ID NO: 87508 - DNA, 25 bp, Mus musculus
aattccggaaagtcccataacgcag

SEQ ID NO: 87509 - DNA, 25 bp, Mus musculus
aattccggacccagaggcgaggagt

SEQ ID NO: 87510 - DNA, 25 bp, Mus musculus
aattccggaccctgaggcgaggagt

SEQ ID NO: 87511 - DNA, 25 bp, Mus musculus
aattccggatcgaagattcccagcc

SEQ ID NO: 87512 - DNA, 25 bp, Mus musculus
aattccggatcgtagattcccagcc

SEQ ID NO: 87513 - DNA, 25 bp, Mus musculus
aattccgggaggaatgtgggcctct

SEQ ID NO: 87514 - DNA, 25 bp, Mus musculus
aattccgggaggtatgtgggcctct

SEQ ID NO: 87515 - DNA, 25 bp, Mus musculus
aattccgtacttcatttgatgacag

SEQ ID NO: 87516 - DNA, 25 bp, Mus musculus
aattccgtacttgatttgatgacag

SEQ ID NO: 87517 - DNA, 25 bp, Mus musculus
aattccgtagcaaagccactgcaga

SEQ ID NO: 87518 - DNA, 25 bp, Mus musculus
aattccgtagcatagccactgcaga

SEQ ID NO: 87519 - DNA, 25 bp, Mus musculus
aattccgtcaaaatcgacagcgagt

SEQ ID NO: 87520 - DNA, 25 bp, Mus musculus
aattccgtcaaattcgacagcgagt

SEQ ID NO: 87521 - DNA, 25 bp, Mus musculus
aattcctaaaccactctgtgtgaag

SEQ ID NO: 87522 - DNA, 25 bp, Mus musculus
aattcctaaacctctctgtgtgaag

SEQ ID NO: 87523 - DNA, 25 bp, Mus musculus
aattcctaaattccactgatttcgg

SEQ ID NO: 87524 - DNA, 25 bp, Mus musculus
aattcctaaattgcactgatttcgg

SEQ ID NO: 87525 - DNA, 25 bp, Mus musculus
aattcctaacctagaaagatggaca

SEQ ID NO: 87526 - DNA, 25 bp, Mus musculus
aattcctaaccttgaaagatggaca

SEQ ID NO: 87527 - DNA, 25 bp, Mus musculus
aattcctacattaaagctctgattc

SEQ ID NO: 87528 - DNA, 25 bp, Mus musculus
aattcctacatttaagctctgattc

SEQ ID NO: 87529 - DNA, 25 bp, Mus musculus
aattcctaccagaaccgcctggttg

SEQ ID NO: 87530 - DNA, 25 bp, Mus musculus
aattcctaccagtaccgcctggttg

SEQ ID NO: 87531 - DNA, 25 bp, Mus musculus
aattcctacccactgttttgattgt

SEQ ID NO: 87532 - DNA, 25 bp, Mus musculus
aattcctacccagtgttttgattgt

SEQ ID NO: 87533 - DNA, 25 bp, Mus musculus
aattcctacgtcagcactatgatgc

SEQ ID NO: 87534 - DNA, 25 bp, Mus musculus
aattcctacgtctgcactatgatgc

SEQ ID NO: 87535 - DNA, 25 bp, Mus musculus
aattcctactgtcggttggatgtga

SEQ ID NO: 87536 - DNA, 25 bp, Mus musculus
aattcctactgtgggttggatgtga

SEQ ID NO: 87537 - DNA, 25 bp, Mus musculus
aattcctagagccagtcctgtagtg

SEQ ID NO: 87538 - DNA, 25 bp, Mus musculus
aattcctagagcgagtcctgtagtg

SEQ ID NO: 87539 - DNA, 25 bp, Mus musculus
aattcctagataccacatcttctgc

SEQ ID NO: 87540 - DNA, 25 bp, Mus musculus
aattcctagatagcacatcttctgc

SEQ ID NO: 87541 - DNA, 25 bp, Mus musculus
aattcctagcttatctctagttact

SEQ ID NO: 87542 - DNA, 25 bp, Mus musculus
aattcctagcttttctctagttact

SEQ ID NO: 87543 - DNA, 25 bp, Mus musculus
aattcctagtgcagttctcattctc

SEQ ID NO: 87544 - DNA, 25 bp, Mus musculus
aattcctagtgctgttctcattctc

SEQ ID NO: 87545 - DNA, 25 bp, Mus musculus
aattcctataagacaaagttgccgt

SEQ ID NO: 87546 - DNA, 25 bp, Mus musculus
aattcctataagtcaaagttgccgt

SEQ ID NO: 87547 - DNA, 25 bp, Mus musculus
aattcctataccatctctatcttta

SEQ ID NO: 87548 - DNA, 25 bp, Mus musculus
aattcctataccttctctatcttta

SEQ ID NO: 87549 - DNA, 25 bp, Mus musculus
aattcctatagactagtgtgcatat

SEQ ID NO: 87550 - DNA, 25 bp, Mus musculus
aattcctatagagtagtgtgcatat

SEQ ID NO: 87551 - DNA, 25 bp, Mus musculus
aattcctatgaaattgaggcgcttc

SEQ ID NO: 87552 - DNA, 25 bp, Mus musculus
aattcctatgaatttgaggcgcttc

SEQ ID NO: 87553 - DNA, 25 bp, Mus musculus
aattcctatgctcaccttttgtatg

SEQ ID NO: 87554 - DNA, 25 bp, Mus musculus
aattcctatgctgaccttttgtatg

SEQ ID NO: 87555 - DNA, 25 bp, Mus musculus
aattcctattttacaaagtctcttg

SEQ ID NO: 87556 - DNA, 25 bp, Mus musculus
aattcctatttttcaaagtctcttg

SEQ ID NO: 87557 - DNA, 25 bp, Mus musculus
aattcctcaaatactggcacatcag

SEQ ID NO: 87558 - DNA, 25 bp, Mus musculus
aattcctcaaattctggcacatcag

SEQ ID NO: 87559 - DNA, 25 bp, Mus musculus
aattcctcaagtatatcgcatattt

SEQ ID NO: 87560 - DNA, 25 bp, Mus musculus
aattcctcaagtttatcgcatattt

SEQ ID NO: 87561 - DNA, 25 bp, Mus musculus
aattcctcaccaaggaagtggctgc

SEQ ID NO: 87562 - DNA, 25 bp, Mus musculus
aattcctcaccatggaagtggctgc

SEQ ID NO: 87563 - DNA, 25 bp, Mus musculus
aattcctcagaactcttcggctggt

SEQ ID NO: 87564 - DNA, 25 bp, Mus musculus
aattcctcagaagtcttcggctggt

SEQ ID NO: 87565 - DNA, 25 bp, Mus musculus
aattcctcaggtaatagttgtgtaa

SEQ ID NO: 87566 - DNA, 25 bp, Mus musculus
aattcctcaggttatagttgtgtaa

SEQ ID NO: 87567 - DNA, 25 bp, Mus musculus
aattcctcagtaatatgtgtttcca

SEQ ID NO: 87568 - DNA, 25 bp, Mus musculus
aattcctcagtattatgtgtttcca

SEQ ID NO: 87569 - DNA, 25 bp, Mus musculus
aattcctcatacctacataaccata

SEQ ID NO: 87570 - DNA, 25 bp, Mus musculus
aattcctcatacgtacataaccata

SEQ ID NO: 87571 - DNA, 25 bp, Mus musculus
aattcctcccaacagatctcaagtt

SEQ ID NO: 87572 - DNA, 25 bp, Mus musculus
aattcctcccaagagatctcaagtt

SEQ ID NO: 87573 - DNA, 25 bp, Mus musculus
aattcctcccacaatgctcaggata

SEQ ID NO: 87574 - DNA, 25 bp, Mus musculus
aattcctcccactatgctcaggata

SEQ ID NO: 87575 - DNA, 25 bp, Mus musculus
aattcctcccggctgcagtgtgtct

SEQ ID NO: 87576 - DNA, 25 bp, Mus musculus
aattcctcccgggtgcagtgtgtct

SEQ ID NO: 87577 - DNA, 25 bp, Mus musculus
aattcctccgacactgacatcgatt

SEQ ID NO: 87578 - DNA, 25 bp, Mus musculus
aattcctccgactctgacatcgatt

SEQ ID NO: 87579 - DNA, 25 bp, Mus musculus
aattcctccgagctccgggtcagct

SEQ ID NO: 87580 - DNA, 25 bp, Mus musculus
aattcctccgaggtccgggtcagct

SEQ ID NO: 87581 - DNA, 25 bp, Mus musculus
aattcctcctctacttgtttgatta

SEQ ID NO: 87582 - DNA, 25 bp, Mus musculus
aattcctcctcttcttgtttgatta

SEQ ID NO: 87583 - DNA, 25 bp, Mus musculus
aattcctcctgtagtgggagctcag

SEQ ID NO: 87584 - DNA, 25 bp, Mus musculus
aattcctcctgttgtgggagctcag

SEQ ID NO: 87585 - DNA, 25 bp, Mus musculus
aattcctcgagtagctttgcatcct

SEQ ID NO: 87586 - DNA, 25 bp, Mus musculus
aattcctcgagttgctttgcatcct

SEQ ID NO: 87587 - DNA, 25 bp, Mus musculus
aattcctctatgaaagctctctggc

SEQ ID NO: 87588 - DNA, 25 bp, Mus musculus
aattcctctatgtaagctctctggc

SEQ ID NO: 87589 - DNA, 25 bp, Mus musculus
aattcctctgagagagaccctgaag

SEQ ID NO: 87590 - DNA, 25 bp, Mus musculus
aattcctctgagtgagaccctgaag

SEQ ID NO: 87591 - DNA, 25 bp, Mus musculus
aattcctctgcactaaggcagccaa

SEQ ID NO: 87592 - DNA, 25 bp, Mus musculus
aattcctctgcagtaaggcagccaa

SEQ ID NO: 87593 - DNA, 25 bp, Mus musculus
aattcctctgccatctatttaaagc

SEQ ID NO: 87594 - DNA, 25 bp, Mus musculus
aattcctctgccttctatttaaagc

SEQ ID NO: 87595 - DNA, 25 bp, Mus musculus
aattcctctggactcatttttattt

SEQ ID NO: 87596 - DNA, 25 bp, Mus musculus
aattcctctggagtcatttttattt

SEQ ID NO: 87597 - DNA, 25 bp, Mus musculus
aattcctctgggactgcaacttttt

SEQ ID NO: 87598 - DNA, 25 bp, Mus musculus
aattcctctgggtctgcaacttttt

SEQ ID NO: 87599 - DNA, 25 bp, Mus musculus
aattcctcttgactgctcctccttt

SEQ ID NO: 87600 - DNA, 25 bp, Mus musculus
aattcctcttgagtgctcctccttt

SEQ ID NO: 87601 - DNA, 25 bp, Mus musculus
aattcctcttgcattagttttctga

SEQ ID NO: 87602 - DNA, 25 bp, Mus musculus
aattcctcttgctttagttttctga

SEQ ID NO: 87603 - DNA, 25 bp, Mus musculus
aattcctcttgtatcttacaggatg

SEQ ID NO: 87604 - DNA, 25 bp, Mus musculus
aattcctcttgtttcttacaggatg

SEQ ID NO: 87605 - DNA, 25 bp, Mus musculus
aattcctgaaatcgagaccttcact

SEQ ID NO: 87606 - DNA, 25 bp, Mus musculus
aattcctgaaatggagaccttcact

SEQ ID NO: 87607 - DNA, 25 bp, Mus musculus
aattcctgaaggctctggtagtatt

SEQ ID NO: 87608 - DNA, 25 bp, Mus musculus
aattcctgaagggtctggtagtatt

SEQ ID NO: 87609 - DNA, 25 bp, Mus musculus
aattcctgaatgcattcacctctca

SEQ ID NO: 87610 - DNA, 25 bp, Mus musculus
aattcctgaatggattcacctctca

SEQ ID NO: 87611 - DNA, 25 bp, Mus musculus
aattcctgacataacagaactaaac

SEQ ID NO: 87612 - DNA, 25 bp, Mus musculus
aattcctgacattacagaactaaac

SEQ ID NO: 87613 - DNA, 25 bp, Mus musculus
aattcctgaccaacgaaggcctgga

SEQ ID NO: 87614 - DNA, 25 bp, Mus musculus
aattcctgaccatcgaaggcctgga

SEQ ID NO: 87615 - DNA, 25 bp, Mus musculus
aattcctgagacaaacttttatgca

SEQ ID NO: 87616 - DNA, 25 bp, Mus musculus
aattcctgagactaacttttatgca

SEQ ID NO: 87617 - DNA, 25 bp, Mus musculus
aattcctgagagagtcctatatttg

SEQ ID NO: 87618 - DNA, 25 bp, Mus musculus
aattcctgagagtgtcctatatttg

SEQ ID NO: 87619 - DNA, 25 bp, Mus musculus
aattcctgagcccatatgacttgac

SEQ ID NO: 87620 - DNA, 25 bp, Mus musculus
aattcctgagccgatatgacttgac

SEQ ID NO: 87621 - DNA, 25 bp, Mus musculus
aattcctgagtcatttcactggagc

SEQ ID NO: 87622 - DNA, 25 bp, Mus musculus
aattcctgagtcttttcactggagc

SEQ ID NO: 87623 - DNA, 25 bp, Mus musculus
aattcctgataacaagacttggtga

SEQ ID NO: 87624 - DNA, 25 bp, Mus musculus
aattcctgataagaagacttggtga

SEQ ID NO: 87625 - DNA, 25 bp, Mus musculus
aattcctgatttacatggttctgag

SEQ ID NO: 87626 - DNA, 25 bp, Mus musculus
aattcctgattttcatggttctgag

SEQ ID NO: 87627 - DNA, 25 bp, Mus musculus
aattcctgcagtaagctctcagctt

SEQ ID NO: 87628 - DNA, 25 bp, Mus musculus
aattcctgcagttagctctcagctt

SEQ ID NO: 87629 - DNA, 25 bp, Mus musculus
aattcctgcattaagtgtgtggatt

SEQ ID NO: 87630 - DNA, 25 bp, Mus musculus
aattcctgcatttagtgtgtggatt

SEQ ID NO: 87631 - DNA, 25 bp, Mus musculus
aattcctgccataggtgctgccctg

SEQ ID NO: 87632 - DNA, 25 bp, Mus musculus
aattcctgccattggtgctgccctg

SEQ ID NO: 87633 - DNA, 25 bp, Mus musculus
aattcctgcctgctggttatactgc

SEQ ID NO: 87634 - DNA, 25 bp, Mus musculus
aattcctgcctggtggttatactgc

SEQ ID NO: 87635 - DNA, 25 bp, Mus musculus
aattcctgcgagagtgcaggctcaa

SEQ ID NO: 87636 - DNA, 25 bp, Mus musculus
aattcctgcgagtgtgcaggctcaa

SEQ ID NO: 87637 - DNA, 25 bp, Mus musculus
aattcctgcgtgagaattttaccag

SEQ ID NO: 87638 - DNA, 25 bp, Mus musculus
aattcctgcgtgtgaattttaccag

SEQ ID NO: 87639 - DNA, 25 bp, Mus musculus
aattcctggaaaccacggactcctt

SEQ ID NO: 87640 - DNA, 25 bp, Mus musculus
aattcctggaaagcacggactcctt

SEQ ID NO: 87641 - DNA, 25 bp, Mus musculus
aattcctggacacagtaaccctgca

SEQ ID NO: 87642 - DNA, 25 bp, Mus musculus
aattcctggacagagtaaccctgca

SEQ ID NO: 87643 - DNA, 25 bp, Mus musculus
aattcctggactaggccctctgact

SEQ ID NO: 87644 - DNA, 25 bp, Mus musculus
aattcctggacttggccctctgact

SEQ ID NO: 87645 - DNA, 25 bp, Mus musculus
aattcctggagcctgatagctggga

SEQ ID NO: 87646 - DNA, 25 bp, Mus musculus
aattcctggagcgtgatagctggga

SEQ ID NO: 87647 - DNA, 25 bp, Mus musculus
aattcctgggaaatacggcagtgca

SEQ ID NO: 87648 - DNA, 25 bp, Mus musculus
aattcctgggaattacggcagtgca

SEQ ID NO: 87649 - DNA, 25 bp, Mus musculus
aattcctgggacctagcgaggtcac

SEQ ID NO: 87650 - DNA, 25 bp, Mus musculus
aattcctgggacgtagcgaggtcac

SEQ ID NO: 87651 - DNA, 25 bp, Mus musculus
aattcctggtgaagtccgagcccgg

SEQ ID NO: 87652 - DNA, 25 bp, Mus musculus
aattcctggtgatgtccgagcccgg

SEQ ID NO: 87653 - DNA, 25 bp, Mus musculus
aattcctgtatgcacttgagatggc

SEQ ID NO: 87654 - DNA, 25 bp, Mus musculus
aattcctgtatggacttgagatggc

SEQ ID NO: 87655 - DNA, 25 bp, Mus musculus
aattcctgtcagaccagttccacag

SEQ ID NO: 87656 - DNA, 25 bp, Mus musculus
aattcctgtcagtccagttccacag

SEQ ID NO: 87657 - DNA, 25 bp, Mus musculus
aattcctgtccacggcttcaaaata

SEQ ID NO: 87658 - DNA, 25 bp, Mus musculus
aattcctgtccagggcttcaaaata

SEQ ID NO: 87659 - DNA, 25 bp, Mus musculus
aattcctgtcccagcaatgtagtaa

SEQ ID NO: 87660 - DNA, 25 bp, Mus musculus
aattcctgtccctgcaatgtagtaa

SEQ ID NO: 87661 - DNA, 25 bp, Mus musculus
aattcctgtggtaattggtgctaaa

SEQ ID NO: 87662 - DNA, 25 bp, Mus musculus
aattcctgtggttattggtgctaaa

SEQ ID NO: 87663 - DNA, 25 bp, Mus musculus
aattcctgtgtcacattccttttgg

SEQ ID NO: 87664 - DNA, 25 bp, Mus musculus
aattcctgtgtctcattccttttgg

SEQ ID NO: 87665 - DNA, 25 bp, Mus musculus
aattcctgtgtgactactgagttag

SEQ ID NO: 87666 - DNA, 25 bp, Mus musculus
aattcctgtgtgtctactgagttag

SEQ ID NO: 87667 - DNA, 25 bp, Mus musculus
aattcctgtttgctatgcctttgac

SEQ ID NO: 87668 - DNA, 25 bp, Mus musculus
aattcctgtttggtatgcctttgac

SEQ ID NO: 87669 - DNA, 25 bp, Mus musculus
aattccttaggcagtgggtgatccc

SEQ ID NO: 87670 - DNA, 25 bp, Mus musculus
aattccttaggctgtgggtgatccc

SEQ ID NO: 87671 - DNA, 25 bp, Mus musculus
aattccttatgccacacgagaaaga

SEQ ID NO: 87672 - DNA, 25 bp, Mus musculus
aattccttatgcgacacgagaaaga

SEQ ID NO: 87673 - DNA, 25 bp, Mus musculus
aattccttcaccagataactctctg

SEQ ID NO: 87674 - DNA, 25 bp, Mus musculus
aattccttcaccctccagcttcatt

SEQ ID NO: 87675 - DNA, 25 bp, Mus musculus
aattccttcaccgtccagcttcatt

SEQ ID NO: 87676 - DNA, 25 bp, Mus musculus
aattccttcacctgataactctctg

SEQ ID NO: 87677 - DNA, 25 bp, Mus musculus
aattccttcatacaagtatctatgt

SEQ ID NO: 87678 - DNA, 25 bp, Mus musculus
aattccttcatagaagtatctatgt

SEQ ID NO: 87679 - DNA, 25 bp, Mus musculus
aattccttcgaaagacgcacaatgg

SEQ ID NO: 87680 - DNA, 25 bp, Mus musculus
aattccttcgaatgacgcacaatgg

SEQ ID NO: 87681 - DNA, 25 bp, Mus musculus
aattccttgattagcattggtacct

SEQ ID NO: 87682 - DNA, 25 bp, Mus musculus
aattccttgatttgcattggtacct

SEQ ID NO: 87683 - DNA, 25 bp, Mus musculus
aattccttgcatagagacggtctcc

SEQ ID NO: 87684 - DNA, 25 bp, Mus musculus
aattccttgcattgagacggtctcc

SEQ ID NO: 87685 - DNA, 25 bp, Mus musculus
aattcctttcttcaggatgcctggg

SEQ ID NO: 87686 - DNA, 25 bp, Mus musculus
aattcctttcttgaggatgcctggg

SEQ ID NO: 87687 - DNA, 25 bp, Mus musculus
aattcctttgttaggcgaactctgc

SEQ ID NO: 87688 - DNA, 25 bp, Mus musculus
aattcctttgtttggcgaactctgc

SEQ ID NO: 87689 - DNA, 25 bp, Mus musculus
aattccttttccatgtattttactg

SEQ ID NO: 87690 - DNA, 25 bp, Mus musculus
aattccttttccttgtattttactg

SEQ ID NO: 87691 - DNA, 25 bp, Mus musculus
aattcgaaatgtaccatagctcagg

SEQ ID NO: 87692 - DNA, 25 bp, Mus musculus
aattcgaaatgttccatagctcagg

SEQ ID NO: 87693 - DNA, 25 bp, Mus musculus
aattcgaacatgcttgacgctccat

SEQ ID NO: 87694 - DNA, 25 bp, Mus musculus
aattcgaacatggttgacgctccat

SEQ ID NO: 87695 - DNA, 25 bp, Mus musculus
aattcgagaagcagcaaatgccatg

SEQ ID NO: 87696 - DNA, 25 bp, Mus musculus
aattcgagaagctgcaaatgccatg

SEQ ID NO: 87697 - DNA, 25 bp, Mus musculus
aattcgagatggcacttgcttgtgt

SEQ ID NO: 87698 - DNA, 25 bp, Mus musculus
aattcgagatgggacttgcttgtgt

SEQ ID NO: 87699 - DNA, 25 bp, Mus musculus
aattcgagcatcatgtgaggagcaa

SEQ ID NO: 87700 - DNA, 25 bp, Mus musculus
aattcgagcatcttgtgaggagcaa

SEQ ID NO: 87701 - DNA, 25 bp, Mus musculus
aattcgagcccaaagagggctgcgc

SEQ ID NO: 87702 - DNA, 25 bp, Mus musculus
aattcgagcccatagagggctgcgc

SEQ ID NO: 87703 - DNA, 25 bp, Mus musculus
aattcgatctggacttactggtgac

SEQ ID NO: 87704 - DNA, 25 bp, Mus musculus
aattcgatctggtcttactggtgac

SEQ ID NO: 87705 - DNA, 25 bp, Mus musculus
aattcgatgggcagtgcactgctct

SEQ ID NO: 87706 - DNA, 25 bp, Mus musculus
aattcgatgggctgtgcactgctct

SEQ ID NO: 87707 - DNA, 25 bp, Mus musculus
aattcgatgttaatgccttccgatc

SEQ ID NO: 87708 - DNA, 25 bp, Mus musculus
aattcgatgttattgccttccgatc

SEQ ID NO: 87709 - DNA, 25 bp, Mus musculus
aattcgattgtaagcctcttgttat

SEQ ID NO: 87710 - DNA, 25 bp, Mus musculus
aattcgattgtatgcctcttgttat

SEQ ID NO: 87711 - DNA, 25 bp, Mus musculus
aattcgcacattccgcagctcaact

SEQ ID NO: 87712 - DNA, 25 bp, Mus musculus
aattcgcacattgcgcagctcaact

SEQ ID NO: 87713 - DNA, 25 bp, Mus musculus
aattcgcagagaaccgcttgcttct

SEQ ID NO: 87714 - DNA, 25 bp, Mus musculus
aattcgcagagatccgcttgcttct

SEQ ID NO: 87715 - DNA, 25 bp, Mus musculus
aattcgcgagatagaggtggacccc

SEQ ID NO: 87716 - DNA, 25 bp, Mus musculus
aattcgcgagattgaggtggacccc

SEQ ID NO: 87717 - DNA, 25 bp, Mus musculus
aattcgcggatgaggttttcacagc

SEQ ID NO: 87718 - DNA, 25 bp, Mus musculus
aattcgcggatgtggttttcacagc

SEQ ID NO: 87719 - DNA, 25 bp, Mus musculus
aattcgcgggaaatgacagagtctc

SEQ ID NO: 87720 - DNA, 25 bp, Mus musculus
aattcgcgggaattgacagagtctc

SEQ ID NO: 87721 - DNA, 25 bp, Mus musculus
aattcgctcccaccggagtgtataa

SEQ ID NO: 87722 - DNA, 25 bp, Mus musculus
aattcgctcccagcggagtgtataa

SEQ ID NO: 87723 - DNA, 25 bp, Mus musculus
aattcgctgaaaccttatcttttta

SEQ ID NO: 87724 - DNA, 25 bp, Mus musculus
aattcgctgaaagcttatcttttta

SEQ ID NO: 87725 - DNA, 25 bp, Mus musculus
aattcggaaggccttctttgcgtct

SEQ ID NO: 87726 - DNA, 25 bp, Mus musculus
aattcggaaggcgttctttgcgtct

SEQ ID NO: 87727 - DNA, 25 bp, Mus musculus
aattcggaatgtatatgttggctgt

SEQ ID NO: 87728 - DNA, 25 bp, Mus musculus
aattcggaatgtttatgttggctgt

SEQ ID NO: 87729 - DNA, 25 bp, Mus musculus
aattcggactagacattggccctgc

SEQ ID NO: 87730 - DNA, 25 bp, Mus musculus
aattcggactagtcattggccctgc

SEQ ID NO: 87731 - DNA, 25 bp, Mus musculus
aattcggatcttctcaggccttgag

SEQ ID NO: 87732 - DNA, 25 bp, Mus musculus
aattcggatcttgtcaggccttgag

SEQ ID NO: 87733 - DNA, 25 bp, Mus musculus
aattcggcacctatgttcgtgtatt

SEQ ID NO: 87734 - DNA, 25 bp, Mus musculus
aattcggcacctttgttcgtgtatt

SEQ ID NO: 87735 - DNA, 25 bp, Mus musculus
aattcggcagaccacagggatcttt

SEQ ID NO: 87736 - DNA, 25 bp, Mus musculus
aattcggcagacgacagggatcttt

SEQ ID NO: 87737 - DNA, 25 bp, Mus musculus
aattcggccaggaaccttgtggtca

SEQ ID NO: 87738 - DNA, 25 bp, Mus musculus
aattcggccaggtaccttgtggtca

SEQ ID NO: 87739 - DNA, 25 bp, Mus musculus
aattcggctgtgctgggaaccatac

SEQ ID NO: 87740 - DNA, 25 bp, Mus musculus
aattcggctgtggtgggaaccatac

SEQ ID NO: 87741 - DNA, 25 bp, Mus musculus
aattcgggtcaacccaggctgaatt

SEQ ID NO: 87742 - DNA, 25 bp, Mus musculus
aattcgggtcaagccaggctgaatt

SEQ ID NO: 87743 - DNA, 25 bp, Mus musculus
aattcggtatacatgagaccctaag

SEQ ID NO: 87744 - DNA, 25 bp, Mus musculus
aattcggtatacttgagaccctaag

SEQ ID NO: 87745 - DNA, 25 bp, Mus musculus
aattcggtcattaacgttctcatta

SEQ ID NO: 87746 - DNA, 25 bp, Mus musculus
aattcggtcatttacgttctcatta

SEQ ID NO: 87747 - DNA, 25 bp, Mus musculus
aattcggtgaggagattcccgatta

SEQ ID NO: 87748 - DNA, 25 bp, Mus musculus
aattcggtgaggtgattcccgatta

SEQ ID NO: 87749 - DNA, 25 bp, Mus musculus
aattcggtgattattcggaggctta

SEQ ID NO: 87750 - DNA, 25 bp, Mus musculus
aattcggtgatttttcggaggctta

SEQ ID NO: 87751 - DNA, 25 bp, Mus musculus
aattcggtgttaatctagttgtagt

SEQ ID NO: 87752 - DNA, 25 bp, Mus musculus
aattcggtgttattctagttgtagt

SEQ ID NO: 87753 - DNA, 25 bp, Mus musculus
aattcgtaaactcaagagtgcaccg

SEQ ID NO: 87754 - DNA, 25 bp, Mus musculus
aattcgtaaactgaagagtgcaccg

SEQ ID NO: 87755 - DNA, 25 bp, Mus musculus
aattcgtacagcatttggctggcca

SEQ ID NO: 87756 - DNA, 25 bp, Mus musculus
aattcgtacagcttttggctggcca

SEQ ID NO: 87757 - DNA, 25 bp, Mus musculus
aattcgtatgtaagtggctgccaag

SEQ ID NO: 87758 - DNA, 25 bp, Mus musculus
aattcgtatgtatgtggctgccaag

SEQ ID NO: 87759 - DNA, 25 bp, Mus musculus
aattcgtcaaaaaagctcccttgta

SEQ ID NO: 87760 - DNA, 25 bp, Mus musculus
aattcgtcaaaatagctcccttgta

SEQ ID NO: 87761 - DNA, 25 bp, Mus musculus
aattcgtgagtccggtactacattc

SEQ ID NO: 87762 - DNA, 25 bp, Mus musculus
aattcgtgagtcgggtactacattc

SEQ ID NO: 87763 - DNA, 25 bp, Mus musculus
aattcgtgattcatgaacactggaa

SEQ ID NO: 87764 - DNA, 25 bp, Mus musculus
aattcgtgattccttttggccacca

SEQ ID NO: 87765 - DNA, 25 bp, Mus musculus
aattcgtgattcgttttggccacca

SEQ ID NO: 87766 - DNA, 25 bp, Mus musculus
aattcgtgattcttgaacactggaa

SEQ ID NO: 87767 - DNA, 25 bp, Mus musculus
aattcgtgtcttaacatctttgtaa

SEQ ID NO: 87768 - DNA, 25 bp, Mus musculus
aattcgtgtctttacatctttgtaa

SEQ ID NO: 87769 - DNA, 25 bp, Mus musculus
aattcgttagcaacagtgacctcct

SEQ ID NO: 87770 - DNA, 25 bp, Mus musculus
aattcgttagcatcagtgacctcct

SEQ ID NO: 87771 - DNA, 25 bp, Mus musculus
aattcgttatctagcagcctcagtg

SEQ ID NO: 87772 - DNA, 25 bp, Mus musculus
aattcgttatcttgcagcctcagtg

SEQ ID NO: 87773 - DNA, 25 bp, Mus musculus
aattcgttgaccaacgtagcgtgca

SEQ ID NO: 87774 - DNA, 25 bp, Mus musculus
aattcgttgacctacgtagcgtgca

SEQ ID NO: 87775 - DNA, 25 bp, Mus musculus
aattcgttttgcaaatcattcagta

SEQ ID NO: 87776 - DNA, 25 bp, Mus musculus
aattcgttttgctaatcattcagta

SEQ ID NO: 87777 - DNA, 25 bp, Mus musculus
aattctaacacaattctttccagac

SEQ ID NO: 87778 - DNA, 25 bp, Mus musculus
aattctaacacatttctttccagac

SEQ ID NO: 87779 - DNA, 25 bp, Mus musculus
aattctaaccagactcatatatcag

SEQ ID NO: 87780 - DNA, 25 bp, Mus musculus
aattctaaccagtctcatatatcag

SEQ ID NO: 87781 - DNA, 25 bp, Mus musculus
aattctaactgcctattaactgtca

SEQ ID NO: 87782 - DNA, 25 bp, Mus musculus
aattctaactgcgtattaactgtca

SEQ ID NO: 87783 - DNA, 25 bp, Mus musculus
aattctaactgtcggactctgcctc

SEQ ID NO: 87784 - DNA, 25 bp, Mus musculus
aattctaactgtgggactctgcctc

SEQ ID NO: 87785 - DNA, 25 bp, Mus musculus
aattctaagttaacggcactgtagg

SEQ ID NO: 87786 - DNA, 25 bp, Mus musculus
aattctaagttatcggcactgtagg

SEQ ID NO: 87787 - DNA, 25 bp, Mus musculus
aattctaatcataccttctaaaggc

SEQ ID NO: 87788 - DNA, 25 bp, Mus musculus
aattctaatcattccttctaaaggc

SEQ ID NO: 87789 - DNA, 25 bp, Mus musculus
aattctaatctcatctcttatgtat

SEQ ID NO: 87790 - DNA, 25 bp, Mus musculus
aattctaatctcttctcttatgtat

SEQ ID NO: 87791 - DNA, 25 bp, Mus musculus
aattctaatttcaccttaaggctgt

SEQ ID NO: 87792 - DNA, 25 bp, Mus musculus
aattctaatttctccttaaggctgt

SEQ ID NO: 87793 - DNA, 25 bp, Mus musculus
aattctacagaaccagtgtttcttt

SEQ ID NO: 87794 - DNA, 25 bp, Mus musculus
aattctacagaagcagtgtttcttt

SEQ ID NO: 87795 - DNA, 25 bp, Mus musculus
aattctacagccacagctctggaag

SEQ ID NO: 87796 - DNA, 25 bp, Mus musculus
aattctacagcctcagctctggaag

SEQ ID NO: 87797 - DNA, 25 bp, Mus musculus
aattctaccaaacttctccagctga

SEQ ID NO: 87798 - DNA, 25 bp, Mus musculus
aattctaccaaagttctccagctga

SEQ ID NO: 87799 - DNA, 25 bp, Mus musculus
aattctaccacaaagtctcatctcc

SEQ ID NO: 87800 - DNA, 25 bp, Mus musculus
aattctaccacatagtctcatctcc

SEQ ID NO: 87801 - DNA, 25 bp, Mus musculus
aattctaccactcttcggagcttga

SEQ ID NO: 87802 - DNA, 25 bp, Mus musculus
aattctaccactgttcggagcttga

SEQ ID NO: 87803 - DNA, 25 bp, Mus musculus
aattctacgtatcccctgaagactt

SEQ ID NO: 87804 - DNA, 25 bp, Mus musculus
aattctacgtatgccctgaagactt

SEQ ID NO: 87805 - DNA, 25 bp, Mus musculus
aattctacgtgacggtgacagggca

SEQ ID NO: 87806 - DNA, 25 bp, Mus musculus
aattctacgtgagggtgacagggca

SEQ ID NO: 87807 - DNA, 25 bp, Mus musculus
aattctactctacggatacctgcat

SEQ ID NO: 87808 - DNA, 25 bp, Mus musculus
aattctactctagggatacctgcat

SEQ ID NO: 87809 - DNA, 25 bp, Mus musculus
aattctactctgctacactctatag

SEQ ID NO: 87810 - DNA, 25 bp, Mus musculus
aattctactctggtacactctatag

SEQ ID NO: 87811 - DNA, 25 bp, Mus musculus
aattctacttggcattgcttgcctt

SEQ ID NO: 87812 - DNA, 25 bp, Mus musculus
aattctacttgggattgcttgcctt

SEQ ID NO: 87813 - DNA, 25 bp, Mus musculus
aattctagactcacattaggaaagc

SEQ ID NO: 87814 - DNA, 25 bp, Mus musculus
aattctagactctcattaggaaagc

SEQ ID NO: 87815 - DNA, 25 bp, Mus musculus
aattctagacttatttcatggttat

SEQ ID NO: 87816 - DNA, 25 bp, Mus musculus
aattctagacttttttcatggttat

SEQ ID NO: 87817 - DNA, 25 bp, Mus musculus
aattctagcaccaggtgggtgggac

SEQ ID NO: 87818 - DNA, 25 bp, Mus musculus
aattctagcacctggtgggtgggac

SEQ ID NO: 87819 - DNA, 25 bp, Mus musculus
aattctagccttacattattgccca

SEQ ID NO: 87820 - DNA, 25 bp, Mus musculus
aattctagcctttcattattgccca

SEQ ID NO: 87821 - DNA, 25 bp, Mus musculus
aattctagctggaaacttgtacggg

SEQ ID NO: 87822 - DNA, 25 bp, Mus musculus
aattctagctggcattcctcaaaca

SEQ ID NO: 87823 - DNA, 25 bp, Mus musculus
aattctagctgggattcctcaaaca

SEQ ID NO: 87824 - DNA, 25 bp, Mus musculus
aattctagctggtaacttgtacggg

SEQ ID NO: 87825 - DNA, 25 bp, Mus musculus
aattctaggcccactgagaaagcag

SEQ ID NO: 87826 - DNA, 25 bp, Mus musculus
aattctaggccctctgagaaagcag

SEQ ID NO: 87827 - DNA, 25 bp, Mus musculus
aattctaggctacctttcacaacca

SEQ ID NO: 87828 - DNA, 25 bp, Mus musculus
aattctaggctagctttcacaacca

SEQ ID NO: 87829 - DNA, 25 bp, Mus musculus
aattctagggctcgcaagacggctc

SEQ ID NO: 87830 - DNA, 25 bp, Mus musculus
aattctagggctggcaagacggctc

SEQ ID NO: 87831 - DNA, 25 bp, Mus musculus
aattctaggttcaggattgtgttcc

SEQ ID NO: 87832 - DNA, 25 bp, Mus musculus
aattctaggttctggattgtgttcc

SEQ ID NO: 87833 - DNA, 25 bp, Mus musculus
aattctagtctgctcactggtgaaa

SEQ ID NO: 87834 - DNA, 25 bp, Mus musculus
aattctagtctggtcactggtgaaa

SEQ ID NO: 87835 - DNA, 25 bp, Mus musculus
aattctagtgagcatggctccctgg

SEQ ID NO: 87836 - DNA, 25 bp, Mus musculus
aattctagtgaggatggctccctgg

SEQ ID NO: 87837 - DNA, 25 bp, Mus musculus
aattctagtgccactttcacatggg

SEQ ID NO: 87838 - DNA, 25 bp, Mus musculus
aattctagtgccagaaatcctttca

SEQ ID NO: 87839 - DNA, 25 bp, Mus musculus
aattctagtgcctctttcacatggg

SEQ ID NO: 87840 - DNA, 25 bp, Mus musculus
aattctagtgcctgaaatcctttca

SEQ ID NO: 87841 - DNA, 25 bp, Mus musculus
aattctagttgcatcatcgacacag

SEQ ID NO: 87842 - DNA, 25 bp, Mus musculus
aattctagttgcttcatcgacacag

SEQ ID NO: 87843 - DNA, 25 bp, Mus musculus
aattctataactagggttgtcccat

SEQ ID NO: 87844 - DNA, 25 bp, Mus musculus
aattctataacttgggttgtcccat

SEQ ID NO: 87845 - DNA, 25 bp, Mus musculus
aattctataccacgtcccgtggaga

SEQ ID NO: 87846 - DNA, 25 bp, Mus musculus
aattctataccaggtcccgtggaga

SEQ ID NO: 87847 - DNA, 25 bp, Mus musculus
aattctatactactctagcctgcta

SEQ ID NO: 87848 - DNA, 25 bp, Mus musculus
aattctatactagtctagcctgcta

SEQ ID NO: 87849 - DNA, 25 bp, Mus musculus
aattctatatagctctgtcccaccc

SEQ ID NO: 87850 - DNA, 25 bp, Mus musculus
aattctatataggtctgtcccaccc

SEQ ID NO: 87851 - DNA, 25 bp, Mus musculus
aattctatctaacagccagctaaag

SEQ ID NO: 87852 - DNA, 25 bp, Mus musculus
aattctatctaagagccagctaaag

SEQ ID NO: 87853 - DNA, 25 bp, Mus musculus
aattctatctatacctgcaatggtg

SEQ ID NO: 87854 - DNA, 25 bp, Mus musculus
aattctatctattcctgcaatggtg

SEQ ID NO: 87855 - DNA, 25 bp, Mus musculus
aattctatgcagctttactgggaca

SEQ ID NO: 87856 - DNA, 25 bp, Mus musculus
aattctatgcaggtttactgggaca

SEQ ID NO: 87857 - DNA, 25 bp, Mus musculus
aattctatggcacaagttctcgcta

SEQ ID NO: 87858 - DNA, 25 bp, Mus musculus
aattctatggcagaagttctcgcta

SEQ ID NO: 87859 - DNA, 25 bp, Mus musculus
aattctatgtgtaactgaactacag

SEQ ID NO: 87860 - DNA, 25 bp, Mus musculus
aattctatgtgttactgaactacag

SEQ ID NO: 87861 - DNA, 25 bp, Mus musculus
aattctattaacacctgcctgttgt

SEQ ID NO: 87862 - DNA, 25 bp, Mus musculus
aattctattaactcctgcctgttgt

SEQ ID NO: 87863 - DNA, 25 bp, Mus musculus
aattctattcacatctcccagaggt

SEQ ID NO: 87864 - DNA, 25 bp, Mus musculus
aattctattcacttctcccagaggt

SEQ ID NO: 87865 - DNA, 25 bp, Mus musculus
aattctattccaattgtactaggga

SEQ ID NO: 87866 - DNA, 25 bp, Mus musculus
aattctattccatttgtactaggga

SEQ ID NO: 87867 - DNA, 25 bp, Mus musculus
aattctattggtattctgacatggg

SEQ ID NO: 87868 - DNA, 25 bp, Mus musculus
aattctattggttttctgacatggg

SEQ ID NO: 87869 - DNA, 25 bp, Mus musculus
aattctattgtgagtttctctcctt

SEQ ID NO: 87870 - DNA, 25 bp, Mus musculus
aattctattgtgtgtttctctcctt

SEQ ID NO: 87871 - DNA, 25 bp, Mus musculus
aattctatttccattcaacccttga

SEQ ID NO: 87872 - DNA, 25 bp, Mus musculus
aattctatttcctttcaacccttga

SEQ ID NO: 87873 - DNA, 25 bp, Mus musculus
aattctatttctcagcgtgtgcagt

SEQ ID NO: 87874 - DNA, 25 bp, Mus musculus
aattctatttctgagcgtgtgcagt

SEQ ID NO: 87875 - DNA, 25 bp, Mus musculus
aattctatttgcaatgacagcttag

SEQ ID NO: 87876 - DNA, 25 bp, Mus musculus
aattctatttgctatgacagcttag

SEQ ID NO: 87877 - DNA, 25 bp, Mus musculus
aattctcaaagcatgactggagctg

SEQ ID NO: 87878 - DNA, 25 bp, Mus musculus
aattctcaaagcttgactggagctg

SEQ ID NO: 87879 - DNA, 25 bp, Mus musculus
aattctcaaagtactacatcgccag

SEQ ID NO: 87880 - DNA, 25 bp, Mus musculus
aattctcaaagttctacatcgccag

SEQ ID NO: 87881 - DNA, 25 bp, Mus musculus
aattctcaaatccatagccccttgg

SEQ ID NO: 87882 - DNA, 25 bp, Mus musculus
aattctcaaatcgatagccccttgg

SEQ ID NO: 87883 - DNA, 25 bp, Mus musculus
aattctcaacaaaatgccgccttca

SEQ ID NO: 87884 - DNA, 25 bp, Mus musculus
aattctcaacaatatgccgccttca

SEQ ID NO: 87885 - DNA, 25 bp, Mus musculus
aattctcaacgcactctgaagcaac

SEQ ID NO: 87886 - DNA, 25 bp, Mus musculus
aattctcaacgctctctgaagcaac

SEQ ID NO: 87887 - DNA, 25 bp, Mus musculus
aattctcaagaaaaccgtactgtgg

SEQ ID NO: 87888 - DNA, 25 bp, Mus musculus
aattctcaagaataccgtactgtgg

SEQ ID NO: 87889 - DNA, 25 bp, Mus musculus
aattctcaaggacggcttggtgttc

SEQ ID NO: 87890 - DNA, 25 bp, Mus musculus
aattctcaaggagggcttggtgttc

SEQ ID NO: 87891 - DNA, 25 bp, Mus musculus
aattctcaatggagcttttaggtca

SEQ ID NO: 87892 - DNA, 25 bp, Mus musculus
aattctcaatggtgcttttaggtca

SEQ ID NO: 87893 - DNA, 25 bp, Mus musculus
aattctcacaagcagctacatcacc

SEQ ID NO: 87894 - DNA, 25 bp, Mus musculus
aattctcacaaggagctacatcacc

SEQ ID NO: 87895 - DNA, 25 bp, Mus musculus
aattctcacagcaaggtgattctgt

SEQ ID NO: 87896 - DNA, 25 bp, Mus musculus
aattctcacagctaggtgattctgt

SEQ ID NO: 87897 - DNA, 25 bp, Mus musculus
aattctcacgaaccccacactgaaa

SEQ ID NO: 87898 - DNA, 25 bp, Mus musculus
aattctcacgaagcccacactgaaa

SEQ ID NO: 87899 - DNA, 25 bp, Mus musculus
aattctcagacgagctctgggtttc

SEQ ID NO: 87900 - DNA, 25 bp, Mus musculus
aattctcagacgtgctctgggtttc

SEQ ID NO: 87901 - DNA, 25 bp, Mus musculus
aattctcagactctatatgatgcag

SEQ ID NO: 87902 - DNA, 25 bp, Mus musculus
aattctcagactgtatatgatgcag

SEQ ID NO: 87903 - DNA, 25 bp, Mus musculus
aattctcagatactgaaagaacctg

SEQ ID NO: 87904 - DNA, 25 bp, Mus musculus
aattctcagatagtgaaagaacctg

SEQ ID NO: 87905 - DNA, 25 bp, Mus musculus
aattctcagcatctaggtttgcttt

SEQ ID NO: 87906 - DNA, 25 bp, Mus musculus
aattctcagcatgtaggtttgcttt

SEQ ID NO: 87907 - DNA, 25 bp, Mus musculus
aattctcagctactacttgagtatc

SEQ ID NO: 87908 - DNA, 25 bp, Mus musculus
aattctcagctagtacttgagtatc

SEQ ID NO: 87909 - DNA, 25 bp, Mus musculus
aattctcaggtaaccgagcttcgag

SEQ ID NO: 87910 - DNA, 25 bp, Mus musculus
aattctcaggtatccgagcttcgag

SEQ ID NO: 87911 - DNA, 25 bp, Mus musculus
aattctcagtgcaaccctaactaag

SEQ ID NO: 87912 - DNA, 25 bp, Mus musculus
aattctcagtgctaccctaactaag

SEQ ID NO: 87913 - DNA, 25 bp, Mus musculus
aattctcagtgtaggcaggtggatc

SEQ ID NO: 87914 - DNA, 25 bp, Mus musculus
aattctcagtgtatggcttggtgtg

SEQ ID NO: 87915 - DNA, 25 bp, Mus musculus
aattctcagtgttggcaggtggatc

SEQ ID NO: 87916 - DNA, 25 bp, Mus musculus
aattctcagtgtttggcttggtgtg

SEQ ID NO: 87917 - DNA, 25 bp, Mus musculus
aattctcagtttctagtgtcagaca

SEQ ID NO: 87918 - DNA, 25 bp, Mus musculus
aattctcagtttgtagtgtcagaca

SEQ ID NO: 87919 - DNA, 25 bp, Mus musculus
aattctcatcaaagggttttagtag

SEQ ID NO: 87920 - DNA, 25 bp, Mus musculus
aattctcatcaatgggttttagtag

SEQ ID NO: 87921 - DNA, 25 bp, Mus musculus
aattctcatcagctgttgtagaagt

SEQ ID NO: 87922 - DNA, 25 bp, Mus musculus
aattctcatcaggtgttgtagaagt

SEQ ID NO: 87923 - DNA, 25 bp, Mus musculus
aattctcatcatcgccctggctgga

SEQ ID NO: 87924 - DNA, 25 bp, Mus musculus
aattctcatcatggccctggctgga

SEQ ID NO: 87925 - DNA, 25 bp, Mus musculus
aattctcatcgtcgagatctttggc

SEQ ID NO: 87926 - DNA, 25 bp, Mus musculus
aattctcatcgtggagatctttggc

SEQ ID NO: 87927 - DNA, 25 bp, Mus musculus
aattctcatctcaagctcttcttct

SEQ ID NO: 87928 - DNA, 25 bp, Mus musculus
aattctcatctctagctcttcttct

SEQ ID NO: 87929 - DNA, 25 bp, Mus musculus
aattctcatgctcgcttcttcagat

SEQ ID NO: 87930 - DNA, 25 bp, Mus musculus
aattctcatgctggcttcttcagat

SEQ ID NO: 87931 - DNA, 25 bp, Mus musculus
aattctccaactacagtgcttaagg

SEQ ID NO: 87932 - DNA, 25 bp, Mus musculus
aattctccaactcgaggcctttggt

SEQ ID NO: 87933 - DNA, 25 bp, Mus musculus
aattctccaactggaggcctttggt

SEQ ID NO: 87934 - DNA, 25 bp, Mus musculus
aattctccaacttcagtgcttaagg

SEQ ID NO: 87935 - DNA, 25 bp, Mus musculus
aattctccacaaaagtcccaagtcg

SEQ ID NO: 87936 - DNA, 25 bp, Mus musculus
aattctccacaacaatttctatgac

SEQ ID NO: 87937 - DNA, 25 bp, Mus musculus
aattctccacaagaatttctatgac

SEQ ID NO: 87938 - DNA, 25 bp, Mus musculus
aattctccacaatagtcccaagtcg

SEQ ID NO: 87939 - DNA, 25 bp, Mus musculus
aattctccagcaacttctcaggttt

SEQ ID NO: 87940 - DNA, 25 bp, Mus musculus
aattctccagcatcttctcaggttt

SEQ ID NO: 87941 - DNA, 25 bp, Mus musculus
aattctccagtcaagtttatgtgta

SEQ ID NO: 87942 - DNA, 25 bp, Mus musculus
aattctccagtcatctattttccag

SEQ ID NO: 87943 - DNA, 25 bp, Mus musculus
aattctccagtctagtttatgtgta

SEQ ID NO: 87944 - DNA, 25 bp, Mus musculus
aattctccagtcttctattttccag

SEQ ID NO: 87945 - DNA, 25 bp, Mus musculus
aattctccatcaacatccgttttta

SEQ ID NO: 87946 - DNA, 25 bp, Mus musculus
aattctccatcatcatccgttttta

SEQ ID NO: 87947 - DNA, 25 bp, Mus musculus
aattctccatgcaatatctaggtga

SEQ ID NO: 87948 - DNA, 25 bp, Mus musculus
aattctccatgctatatctaggtga

SEQ ID NO: 87949 - DNA, 25 bp, Mus musculus
aattctcccagaagtataagctatg

SEQ ID NO: 87950 - DNA, 25 bp, Mus musculus
aattctcccagatgtataagctatg

SEQ ID NO: 87951 - DNA, 25 bp, Mus musculus
aattctcccccaataaaagaggcag

SEQ ID NO: 87952 - DNA, 25 bp, Mus musculus
aattctcccccattaaaagaggcag

SEQ ID NO: 87953 - DNA, 25 bp, Mus musculus
aattctccccttagcctaatgctaa

SEQ ID NO: 87954 - DNA, 25 bp, Mus musculus
aattctcccctttgcctaatgctaa

SEQ ID NO: 87955 - DNA, 25 bp, Mus musculus
aattctcccgctataagttactgtg

SEQ ID NO: 87956 - DNA, 25 bp, Mus musculus
aattctcccgctttaagttactgtg

SEQ ID NO: 87957 - DNA, 25 bp, Mus musculus
aattctccgcaaatttatcctattg

SEQ ID NO: 87958 - DNA, 25 bp, Mus musculus
aattctccgcaattttatcctattg

SEQ ID NO: 87959 - DNA, 25 bp, Mus musculus
aattctcctgtaatggcggctatga

SEQ ID NO: 87960 - DNA, 25 bp, Mus musculus
aattctcctgtattggcggctatga

SEQ ID NO: 87961 - DNA, 25 bp, Mus musculus
aattctcctgttatataatcctaat

SEQ ID NO: 87962 - DNA, 25 bp, Mus musculus
aattctcctgttttataatcctaat

SEQ ID NO: 87963 - DNA, 25 bp, Mus musculus
aattctccttgaattcttagtttat

SEQ ID NO: 87964 - DNA, 25 bp, Mus musculus
aattctccttgatttcttagtttat

SEQ ID NO: 87965 - DNA, 25 bp, Mus musculus
aattctccttgtaattcattttggg

SEQ ID NO: 87966 - DNA, 25 bp, Mus musculus
aattctccttgttattcattttggg

SEQ ID NO: 87967 - DNA, 25 bp, Mus musculus
aattctcgagttaatttctgctcac

SEQ ID NO: 87968 - DNA, 25 bp, Mus musculus
aattctcgagtttatttctgctcac

SEQ ID NO: 87969 - DNA, 25 bp, Mus musculus
aattctcgatcaacgatagtcatga

SEQ ID NO: 87970 - DNA, 25 bp, Mus musculus
aattctcgatcatcgatagtcatga

SEQ ID NO: 87971 - DNA, 25 bp, Mus musculus
aattctcggaagcaagaagcggagt

SEQ ID NO: 87972 - DNA, 25 bp, Mus musculus
aattctcggaaggaagaagcggagt

SEQ ID NO: 87973 - DNA, 25 bp, Mus musculus
aattctcgggcaaatggcgtcctaa

SEQ ID NO: 87974 - DNA, 25 bp, Mus musculus
aattctcgggcatatggcgtcctaa

SEQ ID NO: 87975 - DNA, 25 bp, Mus musculus
aattctctaccacaatgtttctctg

SEQ ID NO: 87976 - DNA, 25 bp, Mus musculus
aattctctaccagaatgtttctctg

SEQ ID NO: 87977 - DNA, 25 bp, Mus musculus
aattctctactaaatccctctttct

SEQ ID NO: 87978 - DNA, 25 bp, Mus musculus
aattctctactacctaagctacatt

SEQ ID NO: 87979 - DNA, 25 bp, Mus musculus
aattctctactagctaagctacatt

SEQ ID NO: 87980 - DNA, 25 bp, Mus musculus
aattctctactatatccctctttct

SEQ ID NO: 87981 - DNA, 25 bp, Mus musculus
aattctctagctctgacgtgctgta

SEQ ID NO: 87982 - DNA, 25 bp, Mus musculus
aattctctagctgtgacgtgctgta

SEQ ID NO: 87983 - DNA, 25 bp, Mus musculus
aattctctataaatacttggcttat

SEQ ID NO: 87984 - DNA, 25 bp, Mus musculus
aattctctataattacttggcttat

SEQ ID NO: 87985 - DNA, 25 bp, Mus musculus
aattctctcaagactccaaatgcat

SEQ ID NO: 87986 - DNA, 25 bp, Mus musculus
aattctctcaagtctccaaatgcat

SEQ ID NO: 87987 - DNA, 25 bp, Mus musculus
aattctctccccaatttattgactt

SEQ ID NO: 87988 - DNA, 25 bp, Mus musculus
aattctctcccctatttattgactt

SEQ ID NO: 87989 - DNA, 25 bp, Mus musculus
aattctctccctctatcttactata

SEQ ID NO: 87990 - DNA, 25 bp, Mus musculus
aattctctccctgtatcttactata

SEQ ID NO: 87991 - DNA, 25 bp, Mus musculus
aattctctctaaagcctggctttgg

SEQ ID NO: 87992 - DNA, 25 bp, Mus musculus
aattctctctaatgcctggctttgg

SEQ ID NO: 87993 - DNA, 25 bp, Mus musculus
aattctctctccagtaaatccacga

SEQ ID NO: 87994 - DNA, 25 bp, Mus musculus
aattctctctcctgtaaatccacga

SEQ ID NO: 87995 - DNA, 25 bp, Mus musculus
aattctctcttccacgtggtgaccg

SEQ ID NO: 87996 - DNA, 25 bp, Mus musculus
aattctctcttcgacgtggtgaccg

SEQ ID NO: 87997 - DNA, 25 bp, Mus musculus
aattctctgaaccaggctgtggtca

SEQ ID NO: 87998 - DNA, 25 bp, Mus musculus
aattctctgaacgaggctgtggtca

SEQ ID NO: 87999 - DNA, 25 bp, Mus musculus
aattctctggaactgcctacattat

SEQ ID NO: 88000 - DNA, 25 bp, Mus musculus
aattctctggaagtgcctacattat

SEQ ID NO: 88001 - DNA, 25 bp, Mus musculus
aattctctgtccatgtaccactgct

SEQ ID NO: 88002 - DNA, 25 bp, Mus musculus
aattctctgtccttgtaccactgct

SEQ ID NO: 88003 - DNA, 25 bp, Mus musculus
aattctctgtgaccgtggagcacgt

SEQ ID NO: 88004 - DNA, 25 bp, Mus musculus
aattctctgtgagcgtggagcacgt

SEQ ID NO: 88005 - DNA, 25 bp, Mus musculus
aattctcttaatcaggaaggctcct

SEQ ID NO: 88006 - DNA, 25 bp, Mus musculus
aattctcttaatgaggaaggctcct

SEQ ID NO: 88007 - DNA, 25 bp, Mus musculus
aattctcttagcatgatgctgagta

SEQ ID NO: 88008 - DNA, 25 bp, Mus musculus
aattctcttagcttgatgctgagta

SEQ ID NO: 88009 - DNA, 25 bp, Mus musculus
aattctcttataatcttagaacata

SEQ ID NO: 88010 - DNA, 25 bp, Mus musculus
aattctcttatattcttagaacata

SEQ ID NO: 88011 - DNA, 25 bp, Mus musculus
aattctcttcataaccaaggaggga

SEQ ID NO: 88012 - DNA, 25 bp, Mus musculus
aattctcttcattaccaaggaggga

SEQ ID NO: 88013 - DNA, 25 bp, Mus musculus
aattctcttcggcttgatactacta

SEQ ID NO: 88014 - DNA, 25 bp, Mus musculus
aattctcttcgggttgatactacta

SEQ ID NO: 88015 - DNA, 25 bp, Mus musculus
aattctcttgagacattgttacaag

SEQ ID NO: 88016 - DNA, 25 bp, Mus musculus
aattctcttgagtcattgttacaag

SEQ ID NO: 88017 - DNA, 25 bp, Mus musculus
aattctcttgctagtagcagggtga

SEQ ID NO: 88018 - DNA, 25 bp, Mus musculus
aattctcttgcttgtagcagggtga

SEQ ID NO: 88019 - DNA, 25 bp, Mus musculus
aattctcttggtcttcctattcata

SEQ ID NO: 88020 - DNA, 25 bp, Mus musculus
aattctcttggtgttcctattcata

SEQ ID NO: 88021 - DNA, 25 bp, Mus musculus
aattctgaaatcattgctcctcaaa

SEQ ID NO: 88022 - DNA, 25 bp, Mus musculus
aattctgaaatcatttgcactgatg

SEQ ID NO: 88023 - DNA, 25 bp, Mus musculus
aattctgaaatctttgctcctcaaa

SEQ ID NO: 88024 - DNA, 25 bp, Mus musculus
aattctgaaatcttttgcactgatg

SEQ ID NO: 88025 - DNA, 25 bp, Mus musculus
aattctgaccacatgtttcccctct

SEQ ID NO: 88026 - DNA, 25 bp, Mus musculus
aattctgaccacttgtttcccctct

SEQ ID NO: 88027 - DNA, 25 bp, Mus musculus
aattctgacggcattttcgtggata

SEQ ID NO: 88028 - DNA, 25 bp, Mus musculus
aattctgacggctttttcgtggata

SEQ ID NO: 88029 - DNA, 25 bp, Mus musculus
aattctgactacattcctgatggtg

SEQ ID NO: 88030 - DNA, 25 bp, Mus musculus
aattctgactactttcctgatggtg

SEQ ID NO: 88031 - DNA, 25 bp, Mus musculus
aattctgacttccttgtgggttggt

SEQ ID NO: 88032 - DNA, 25 bp, Mus musculus
aattctgacttcgttgtgggttggt

SEQ ID NO: 88033 - DNA, 25 bp, Mus musculus
aattctgagcaactctttgtcacag

SEQ ID NO: 88034 - DNA, 25 bp, Mus musculus
aattctgagcaagtctttgtcacag

SEQ ID NO: 88035 - DNA, 25 bp, Mus musculus
aattctgagcatattgaccatgtca

SEQ ID NO: 88036 - DNA, 25 bp, Mus musculus
aattctgagcattttgaccatgtca

SEQ ID NO: 88037 - DNA, 25 bp, Mus musculus
aattctgagcgtactcattcctgga

SEQ ID NO: 88038 - DNA, 25 bp, Mus musculus
aattctgagcgttctcattcctgga

SEQ ID NO: 88039 - DNA, 25 bp, Mus musculus
aattctgagcttaagaactgtcaca

SEQ ID NO: 88040 - DNA, 25 bp, Mus musculus
aattctgagcttcacttatccatca

SEQ ID NO: 88041 - DNA, 25 bp, Mus musculus
aattctgagcttgacttatccatca

SEQ ID NO: 88042 - DNA, 25 bp, Mus musculus
aattctgagctttagaactgtcaca

SEQ ID NO: 88043 - DNA, 25 bp, Mus musculus
aattctgagggacgtcgaacatcat

SEQ ID NO: 88044 - DNA, 25 bp, Mus musculus
aattctgagggaggtcgaacatcat

SEQ ID NO: 88045 - DNA, 25 bp, Mus musculus
aattctgatcaaatacgtggctgta

SEQ ID NO: 88046 - DNA, 25 bp, Mus musculus
aattctgatcaattacgtggctgta

SEQ ID NO: 88047 - DNA, 25 bp, Mus musculus
aattctgatgccagtactaccagct

SEQ ID NO: 88048 - DNA, 25 bp, Mus musculus
aattctgatgcctgtactaccagct

SEQ ID NO: 88049 - DNA, 25 bp, Mus musculus
aattctgattgtattctacctaaat

SEQ ID NO: 88050 - DNA, 25 bp, Mus musculus
aattctgattgttttctacctaaat

SEQ ID NO: 88051 - DNA, 25 bp, Mus musculus
aattctgatttcaagactgcttgga

SEQ ID NO: 88052 - DNA, 25 bp, Mus musculus
aattctgatttctagactgcttgga

SEQ ID NO: 88053 - DNA, 25 bp, Mus musculus
aattctgattttcccattgctgttc

SEQ ID NO: 88054 - DNA, 25 bp, Mus musculus
aattctgattttcctcagttccaat

SEQ ID NO: 88055 - DNA, 25 bp, Mus musculus
aattctgattttgccattgctgttc

SEQ ID NO: 88056 - DNA, 25 bp, Mus musculus
aattctgattttgctcagttccaat

SEQ ID NO: 88057 - DNA, 25 bp, Mus musculus
aattctgcaaggatatggccatagc

SEQ ID NO: 88058 - DNA, 25 bp, Mus musculus
aattctgcaaggttatggccatagc

SEQ ID NO: 88059 - DNA, 25 bp, Mus musculus
aattctgcaattaccatatctttgg

SEQ ID NO: 88060 - DNA, 25 bp, Mus musculus
aattctgcaatttccatatctttgg

SEQ ID NO: 88061 - DNA, 25 bp, Mus musculus
aattctgcacagagcctcaggatat

SEQ ID NO: 88062 - DNA, 25 bp, Mus musculus
aattctgcacagtgcctcaggatat

SEQ ID NO: 88063 - DNA, 25 bp, Mus musculus
aattctgcacatagggctcaagtat

SEQ ID NO: 88064 - DNA, 25 bp, Mus musculus
aattctgcacattgggctcaagtat

SEQ ID NO: 88065 - DNA, 25 bp, Mus musculus
aattctgcacgtcccagaggcaata

SEQ ID NO: 88066 - DNA, 25 bp, Mus musculus
aattctgcacgtgccagaggcaata

SEQ ID NO: 88067 - DNA, 25 bp, Mus musculus
aattctgcagtaccccagctgagaa

SEQ ID NO: 88068 - DNA, 25 bp, Mus musculus
aattctgcagtagcccagctgagaa

SEQ ID NO: 88069 - DNA, 25 bp, Mus musculus
aattctgcataaagaaacccctcag

SEQ ID NO: 88070 - DNA, 25 bp, Mus musculus
aattctgcataatgaaacccctcag

SEQ ID NO: 88071 - DNA, 25 bp, Mus musculus
aattctgccagacctttagtgcact

SEQ ID NO: 88072 - DNA, 25 bp, Mus musculus
aattctgccagagctttagtgcact

SEQ ID NO: 88073 - DNA, 25 bp, Mus musculus
aattctgccatcaggaagtgcgtca

SEQ ID NO: 88074 - DNA, 25 bp, Mus musculus
aattctgccatctggaagtgcgtca

SEQ ID NO: 88075 - DNA, 25 bp, Mus musculus
aattctgcccttcaaaattctataa

SEQ ID NO: 88076 - DNA, 25 bp, Mus musculus
aattctgcccttgaaaattctataa

SEQ ID NO: 88077 - DNA, 25 bp, Mus musculus
aattctgcctacacggagccgggag

SEQ ID NO: 88078 - DNA, 25 bp, Mus musculus
aattctgcctactcggagccgggag

SEQ ID NO: 88079 - DNA, 25 bp, Mus musculus
aattctgcctagcaggtgggacttg

SEQ ID NO: 88080 - DNA, 25 bp, Mus musculus
aattctgcctaggaggtgggacttg

SEQ ID NO: 88081 - DNA, 25 bp, Mus musculus
aattctgcctatattgatgtctaag

SEQ ID NO: 88082 - DNA, 25 bp, Mus musculus
aattctgcctattttgatgtctaag

SEQ ID NO: 88083 - DNA, 25 bp, Mus musculus
aattctgcgagtcgaagtgtggaca

SEQ ID NO: 88084 - DNA, 25 bp, Mus musculus
aattctgcgagtggaagtgtggaca

SEQ ID NO: 88085 - DNA, 25 bp, Mus musculus
aattctgcgattccttagcctggca

SEQ ID NO: 88086 - DNA, 25 bp, Mus musculus
aattctgcgattgcttagcctggca

SEQ ID NO: 88087 - DNA, 25 bp, Mus musculus
aattctgcgtagctcggaggccaag

SEQ ID NO: 88088 - DNA, 25 bp, Mus musculus
aattctgcgtaggtcggaggccaag

SEQ ID NO: 88089 - DNA, 25 bp, Mus musculus
aattctgctactaaattccgatagt

SEQ ID NO: 88090 - DNA, 25 bp, Mus musculus
aattctgctacttaattccgatagt

SEQ ID NO: 88091 - DNA, 25 bp, Mus musculus
aattctgctctcctacaaattcatg

SEQ ID NO: 88092 - DNA, 25 bp, Mus musculus
aattctgctctcgtacaaattcatg

SEQ ID NO: 88093 - DNA, 25 bp, Mus musculus
aattctgctctgcttatttcattga

SEQ ID NO: 88094 - DNA, 25 bp, Mus musculus
aattctgctctggttatttcattga

SEQ ID NO: 88095 - DNA, 25 bp, Mus musculus
aattctgctgagacctggagcgtca

SEQ ID NO: 88096 - DNA, 25 bp, Mus musculus
aattctgctgagtcctggagcgtca

SEQ ID NO: 88097 - DNA, 25 bp, Mus musculus
aattctgcttccagatagtctccac

SEQ ID NO: 88098 - DNA, 25 bp, Mus musculus
aattctgcttcctgatagtctccac

SEQ ID NO: 88099 - DNA, 25 bp, Mus musculus
aattctgctttacaggatactatca

SEQ ID NO: 88100 - DNA, 25 bp, Mus musculus
aattctgctttagaggatactatca

SEQ ID NO: 88101 - DNA, 25 bp, Mus musculus
aattctggacagctgtacgtttaaa

SEQ ID NO: 88102 - DNA, 25 bp, Mus musculus
aattctggacaggtgtacgtttaaa

SEQ ID NO: 88103 - DNA, 25 bp, Mus musculus
aattctggagtcactgtcccgggag

SEQ ID NO: 88104 - DNA, 25 bp, Mus musculus
aattctggagtctctgtcccgggag

SEQ ID NO: 88105 - DNA, 25 bp, Mus musculus
aattctggatgcctggtatgattta

SEQ ID NO: 88106 - DNA, 25 bp, Mus musculus
aattctggatgcgtggtatgattta

SEQ ID NO: 88107 - DNA, 25 bp, Mus musculus
aattctggattcacactggcttgga

SEQ ID NO: 88108 - DNA, 25 bp, Mus musculus
aattctggattctcactggcttgga

SEQ ID NO: 88109 - DNA, 25 bp, Mus musculus
aattctggcaacagagggcggcatg

SEQ ID NO: 88110 - DNA, 25 bp, Mus musculus
aattctggcaactgagggcggcatg

SEQ ID NO: 88111 - DNA, 25 bp, Mus musculus
aattctggcactatttcgcaaaccc

SEQ ID NO: 88112 - DNA, 25 bp, Mus musculus
aattctggcactttttcgcaaaccc

SEQ ID NO: 88113 - DNA, 25 bp, Mus musculus
aattctggcatcatggcttgctgat

SEQ ID NO: 88114 - DNA, 25 bp, Mus musculus
aattctggcatcttggcttgctgat

SEQ ID NO: 88115 - DNA, 25 bp, Mus musculus
aattctggcattccatcgagccgaa

SEQ ID NO: 88116 - DNA, 25 bp, Mus musculus
aattctggcattgcatcgagccgaa

SEQ ID NO: 88117 - DNA, 25 bp, Mus musculus
aattctggccaacaggatcaatgtg

SEQ ID NO: 88118 - DNA, 25 bp, Mus musculus
aattctggccaagaggatcaatgtg

SEQ ID NO: 88119 - DNA, 25 bp, Mus musculus
aattctggccttagagttagcccca

SEQ ID NO: 88120 - DNA, 25 bp, Mus musculus
aattctggcctttgagttagcccca

SEQ ID NO: 88121 - DNA, 25 bp, Mus musculus
aattctggcgttctgcagaatgaag

SEQ ID NO: 88122 - DNA, 25 bp, Mus musculus
aattctggcgttgtgcagaatgaag

SEQ ID NO: 88123 - DNA, 25 bp, Mus musculus
aattctggctctacattagaggctg

SEQ ID NO: 88124 - DNA, 25 bp, Mus musculus
aattctggctcttcattagaggctg

SEQ ID NO: 88125 - DNA, 25 bp, Mus musculus
aattctggctggacgtggtggtaca

SEQ ID NO: 88126 - DNA, 25 bp, Mus musculus
aattctggctggtcgtggtggtaca

SEQ ID NO: 88127 - DNA, 25 bp, Mus musculus
aattctgggaacaagatggtgatca

SEQ ID NO: 88128 - DNA, 25 bp, Mus musculus
aattctgggaactagatggtgatca

SEQ ID NO: 88129 - DNA, 25 bp, Mus musculus
aattctgggagaaccagggctcatc

SEQ ID NO: 88130 - DNA, 25 bp, Mus musculus
aattctgggagatccagggctcatc

SEQ ID NO: 88131 - DNA, 25 bp, Mus musculus
aattctgggcatatctagcaggttt

SEQ ID NO: 88132 - DNA, 25 bp, Mus musculus
aattctgggcatttctagcaggttt

SEQ ID NO: 88133 - DNA, 25 bp, Mus musculus
aattctgggctacctaggtatacgt

SEQ ID NO: 88134 - DNA, 25 bp, Mus musculus
aattctgggctagctaggtatacgt

SEQ ID NO: 88135 - DNA, 25 bp, Mus musculus
aattctgggtttagacgttctgtct

SEQ ID NO: 88136 - DNA, 25 bp, Mus musculus
aattctgggttttgacgttctgtct

SEQ ID NO: 88137 - DNA, 25 bp, Mus musculus
aattctggtcttacccagttcctct

SEQ ID NO: 88138 - DNA, 25 bp, Mus musculus
aattctggtctttcccagttcctct

SEQ ID NO: 88139 - DNA, 25 bp, Mus musculus
aattctggtgatcggactaggctgc

SEQ ID NO: 88140 - DNA, 25 bp, Mus musculus
aattctggtgatgggactaggctgc

SEQ ID NO: 88141 - DNA, 25 bp, Mus musculus
aattctggtgttatactatggtagt

SEQ ID NO: 88142 - DNA, 25 bp, Mus musculus
aattctggtgttttactatggtagt

SEQ ID NO: 88143 - DNA, 25 bp, Mus musculus
aattctggttttacgatgttgcatt

SEQ ID NO: 88144 - DNA, 25 bp, Mus musculus
aattctggttttcaatgcctggata

SEQ ID NO: 88145 - DNA, 25 bp, Mus musculus
aattctggttttgaatgcctggata

SEQ ID NO: 88146 - DNA, 25 bp, Mus musculus
aattctggtttttcgatgttgcatt

SEQ ID NO: 88147 - DNA, 25 bp, Mus musculus
aattctgtaccaactgaaagtagtt

SEQ ID NO: 88148 - DNA, 25 bp, Mus musculus
aattctgtaccatctgaaagtagtt

SEQ ID NO: 88149 - DNA, 25 bp, Mus musculus
aattctgtacgtaactcagccatga

SEQ ID NO: 88150 - DNA, 25 bp, Mus musculus
aattctgtacgttactcagccatga

SEQ ID NO: 88151 - DNA, 25 bp, Mus musculus
aattctgtagacactgtactccaaa

SEQ ID NO: 88152 - DNA, 25 bp, Mus musculus
aattctgtagactctgtactccaaa

SEQ ID NO: 88153 - DNA, 25 bp, Mus musculus
aattctgtagagacgtttcttatta

SEQ ID NO: 88154 - DNA, 25 bp, Mus musculus
aattctgtagagtcgtttcttatta

SEQ ID NO: 88155 - DNA, 25 bp, Mus musculus
aattctgtagcacacctcataggta

SEQ ID NO: 88156 - DNA, 25 bp, Mus musculus
aattctgtagcagacctcataggta

SEQ ID NO: 88157 - DNA, 25 bp, Mus musculus
aattctgtagttcctaggtgtgtgt

SEQ ID NO: 88158 - DNA, 25 bp, Mus musculus
aattctgtagttgctaggtgtgtgt

SEQ ID NO: 88159 - DNA, 25 bp, Mus musculus
aattctgtcaataagcaattgctag

SEQ ID NO: 88160 - DNA, 25 bp, Mus musculus
aattctgtcaattagcaattgctag

SEQ ID NO: 88161 - DNA, 25 bp, Mus musculus
aattctgtcagccatttttatttgt

SEQ ID NO: 88162 - DNA, 25 bp, Mus musculus
aattctgtcagcgatttttatttgt

SEQ ID NO: 88163 - DNA, 25 bp, Mus musculus
aattctgtccacactcattctgtaa

SEQ ID NO: 88164 - DNA, 25 bp, Mus musculus
aattctgtccactctcattctgtaa

SEQ ID NO: 88165 - DNA, 25 bp, Mus musculus
aattctgtcccaatctcaccagatg

SEQ ID NO: 88166 - DNA, 25 bp, Mus musculus
aattctgtcccattctcaccagatg

SEQ ID NO: 88167 - DNA, 25 bp, Mus musculus
aattctgtcttactgagttggaaca

SEQ ID NO: 88168 - DNA, 25 bp, Mus musculus
aattctgtcttagtgagttggaaca

SEQ ID NO: 88169 - DNA, 25 bp, Mus musculus
aattctgtcttgagtccatgttatc

SEQ ID NO: 88170 - DNA, 25 bp, Mus musculus
aattctgtcttgtgtccatgttatc

SEQ ID NO: 88171 - DNA, 25 bp, Mus musculus
aattctgtgaagattcagttatcta

SEQ ID NO: 88172 - DNA, 25 bp, Mus musculus
aattctgtgaagtttcagttatcta

SEQ ID NO: 88173 - DNA, 25 bp, Mus musculus
aattctgtgactaggatatggtgta

SEQ ID NO: 88174 - DNA, 25 bp, Mus musculus
aattctgtgacttggatatggtgta

SEQ ID NO: 88175 - DNA, 25 bp, Mus musculus
aattctgtgagcagcgcttcactga

SEQ ID NO: 88176 - DNA, 25 bp, Mus musculus
aattctgtgagcctaccttagcttt

SEQ ID NO: 88177 - DNA, 25 bp, Mus musculus
aattctgtgagcgtaccttagcttt

SEQ ID NO: 88178 - DNA, 25 bp, Mus musculus
aattctgtgagctgcgcttcactga

SEQ ID NO: 88179 - DNA, 25 bp, Mus musculus
aattctgtgcccagtgcatgtaata

SEQ ID NO: 88180 - DNA, 25 bp, Mus musculus
aattctgtgccctgtgcatgtaata

SEQ ID NO: 88181 - DNA, 25 bp, Mus musculus
aattctgtgcctagtttttcattcg

SEQ ID NO: 88182 - DNA, 25 bp, Mus musculus
aattctgtgccttgtttttcattcg

SEQ ID NO: 88183 - DNA, 25 bp, Mus musculus
aattctgtggatactgaccttataa

SEQ ID NO: 88184 - DNA, 25 bp, Mus musculus
aattctgtggattctgaccttataa

SEQ ID NO: 88185 - DNA, 25 bp, Mus musculus
aattctgtggcaatcttggacttta

SEQ ID NO: 88186 - DNA, 25 bp, Mus musculus
aattctgtggcattcttggacttta

SEQ ID NO: 88187 - DNA, 25 bp, Mus musculus
aattctgtggctacttgtgcactaa

SEQ ID NO: 88188 - DNA, 25 bp, Mus musculus
aattctgtggcttcttgtgcactaa

SEQ ID NO: 88189 - DNA, 25 bp, Mus musculus
aattctgtgtcgctcttttatgtcc

SEQ ID NO: 88190 - DNA, 25 bp, Mus musculus
aattctgtgtcggtcttttatgtcc

SEQ ID NO: 88191 - DNA, 25 bp, Mus musculus
aattctgtgtggagttgttaccata

SEQ ID NO: 88192 - DNA, 25 bp, Mus musculus
aattctgtgtggtgttgttaccata

SEQ ID NO: 88193 - DNA, 25 bp, Mus musculus
aattctgtgtgtatgtctcattgat

SEQ ID NO: 88194 - DNA, 25 bp, Mus musculus
aattctgtgtgtcaagcttggccac

SEQ ID NO: 88195 - DNA, 25 bp, Mus musculus
aattctgtgtgtgaagcttggccac

SEQ ID NO: 88196 - DNA, 25 bp, Mus musculus
aattctgtgtgtttgtctcattgat

SEQ ID NO: 88197 - DNA, 25 bp, Mus musculus
aattctgtgttgctggaagccccgg

SEQ ID NO: 88198 - DNA, 25 bp, Mus musculus
aattctgtgttggtggaagccccgg

SEQ ID NO: 88199 - DNA, 25 bp, Mus musculus
aattctgttattcttgtggcgacgg

SEQ ID NO: 88200 - DNA, 25 bp, Mus musculus
aattctgttattgttgtggcgacgg

SEQ ID NO: 88201 - DNA, 25 bp, Mus musculus
aattctgttcttctccactaccatc

SEQ ID NO: 88202 - DNA, 25 bp, Mus musculus
aattctgttcttgtccactaccatc

SEQ ID NO: 88203 - DNA, 25 bp, Mus musculus
aattctgttgagatggcattgtaca

SEQ ID NO: 88204 - DNA, 25 bp, Mus musculus
aattctgttgagttggcattgtaca

SEQ ID NO: 88205 - DNA, 25 bp, Mus musculus
aattctgtttacataatgtctcaca

SEQ ID NO: 88206 - DNA, 25 bp, Mus musculus
aattctgtttacttaatgtctcaca

SEQ ID NO: 88207 - DNA, 25 bp, Mus musculus
aattctgtttatactcacaactgag

SEQ ID NO: 88208 - DNA, 25 bp, Mus musculus
aattctgtttattctcacaactgag

SEQ ID NO: 88209 - DNA, 25 bp, Mus musculus
aattctgtttgtaccttgtttgcca

SEQ ID NO: 88210 - DNA, 25 bp, Mus musculus
aattctgtttgttccttgtttgcca

SEQ ID NO: 88211 - DNA, 25 bp, Mus musculus
aattcttaaagacgcccattgatag

SEQ ID NO: 88212 - DNA, 25 bp, Mus musculus
aattcttaaagaggcccattgatag

SEQ ID NO: 88213 - DNA, 25 bp, Mus musculus
aattcttaactacagagttcctgtg

SEQ ID NO: 88214 - DNA, 25 bp, Mus musculus
aattcttaactagagagttcctgtg

SEQ ID NO: 88215 - DNA, 25 bp, Mus musculus
aattcttaagtaagggcttgcccgt

SEQ ID NO: 88216 - DNA, 25 bp, Mus musculus
aattcttaagtatgggcttgcccgt

SEQ ID NO: 88217 - DNA, 25 bp, Mus musculus
aattcttaatttcttcctcagttag

SEQ ID NO: 88218 - DNA, 25 bp, Mus musculus
aattcttaatttgttcctcagttag

SEQ ID NO: 88219 - DNA, 25 bp, Mus musculus
aattcttactctctggttggcttta

SEQ ID NO: 88220 - DNA, 25 bp, Mus musculus
aattcttactctgtggttggcttta

SEQ ID NO: 88221 - DNA, 25 bp, Mus musculus
aattcttacttgaaaggagccccat

SEQ ID NO: 88222 - DNA, 25 bp, Mus musculus
aattcttacttgtaaggagccccat

SEQ ID NO: 88223 - DNA, 25 bp, Mus musculus
aattcttagaaacggcttggataat

SEQ ID NO: 88224 - DNA, 25 bp, Mus musculus
aattcttagaaagggcttggataat

SEQ ID NO: 88225 - DNA, 25 bp, Mus musculus
aattcttagagaaggcctgacatca

SEQ ID NO: 88226 - DNA, 25 bp, Mus musculus
aattcttagagatggcctgacatca

SEQ ID NO: 88227 - DNA, 25 bp, Mus musculus
aattcttagctacctggcactggcc

SEQ ID NO: 88228 - DNA, 25 bp, Mus musculus
aattcttagctagctggcactggcc

SEQ ID NO: 88229 - DNA, 25 bp, Mus musculus
aattcttaggtcagtgttatcacag

SEQ ID NO: 88230 - DNA, 25 bp, Mus musculus
aattcttaggtctgtgttatcacag

SEQ ID NO: 88231 - DNA, 25 bp, Mus musculus
aattcttagtctcttgtgctgtgcc

SEQ ID NO: 88232 - DNA, 25 bp, Mus musculus
aattcttagtctgttgtgctgtgcc

SEQ ID NO: 88233 - DNA, 25 bp, Mus musculus
aattcttagttgctgtggatttcca

SEQ ID NO: 88234 - DNA, 25 bp, Mus musculus
aattcttagttggtgtggatttcca

SEQ ID NO: 88235 - DNA, 25 bp, Mus musculus
aattcttatcatatcaggtcttaaa

SEQ ID NO: 88236 - DNA, 25 bp, Mus musculus
aattcttatcatttcaggtcttaaa

SEQ ID NO: 88237 - DNA, 25 bp, Mus musculus
aattcttatctgcatgtattagtta

SEQ ID NO: 88238 - DNA, 25 bp, Mus musculus
aattcttatctggatgtattagtta

SEQ ID NO: 88239 - DNA, 25 bp, Mus musculus
aattcttatttgcacccatctagtc

SEQ ID NO: 88240 - DNA, 25 bp, Mus musculus
aattcttatttggacccatctagtc

SEQ ID NO: 88241 - DNA, 25 bp, Mus musculus
aattcttcacctcaagggctcccag

SEQ ID NO: 88242 - DNA, 25 bp, Mus musculus
aattcttcacctgaagggctcccag

SEQ ID NO: 88243 - DNA, 25 bp, Mus musculus
aattcttcagagatgaggcgatcaa

SEQ ID NO: 88244 - DNA, 25 bp, Mus musculus
aattcttcagagttgaggcgatcaa

SEQ ID NO: 88245 - DNA, 25 bp, Mus musculus
aattcttcagggagtgtcacctcaa

SEQ ID NO: 88246 - DNA, 25 bp, Mus musculus
aattcttcagggtgtgtcacctcaa

SEQ ID NO: 88247 - DNA, 25 bp, Mus musculus
aattcttcatcaacgcattcagagg

SEQ ID NO: 88248 - DNA, 25 bp, Mus musculus
aattcttcatcatcgcattcagagg

SEQ ID NO: 88249 - DNA, 25 bp, Mus musculus
aattcttcatgtatgcattttccaa

SEQ ID NO: 88250 - DNA, 25 bp, Mus musculus
aattcttcatgtctgtgtccctgga

SEQ ID NO: 88251 - DNA, 25 bp, Mus musculus
aattcttcatgtgtgtgtccctgga

SEQ ID NO: 88252 - DNA, 25 bp, Mus musculus
aattcttcatgtttgcattttccaa

SEQ ID NO: 88253 - DNA, 25 bp, Mus musculus
aattcttccaggcttgcattaaatc

SEQ ID NO: 88254 - DNA, 25 bp, Mus musculus
aattcttccagggttgcattaaatc

SEQ ID NO: 88255 - DNA, 25 bp, Mus musculus
aattcttcccaaaatgtaggcagct

SEQ ID NO: 88256 - DNA, 25 bp, Mus musculus
aattcttcccaatatgtaggcagct

SEQ ID NO: 88257 - DNA, 25 bp, Mus musculus
aattcttccgctcgaatggccacaa

SEQ ID NO: 88258 - DNA, 25 bp, Mus musculus
aattcttccgctggaatggccacaa

SEQ ID NO: 88259 - DNA, 25 bp, Mus musculus
aattcttcctaacttctctgctcat

SEQ ID NO: 88260 - DNA, 25 bp, Mus musculus
aattcttcctaagttctctgctcat

SEQ ID NO: 88261 - DNA, 25 bp, Mus musculus
aattcttccttactgctgcattaat

SEQ ID NO: 88262 - DNA, 25 bp, Mus musculus
aattcttccttagtgctgcattaat

SEQ ID NO: 88263 - DNA, 25 bp, Mus musculus
aattcttcgttcctttgttcacagg

SEQ ID NO: 88264 - DNA, 25 bp, Mus musculus
aattcttcgttcgtttgttcacagg

SEQ ID NO: 88265 - DNA, 25 bp, Mus musculus
aattcttctatactttgttcccgag

SEQ ID NO: 88266 - DNA, 25 bp, Mus musculus
aattcttctatagtttgttcccgag

SEQ ID NO: 88267 - DNA, 25 bp, Mus musculus
aattcttctcaaatacttgtttcac

SEQ ID NO: 88268 - DNA, 25 bp, Mus musculus
aattcttctcaattacttgtttcac

SEQ ID NO: 88269 - DNA, 25 bp, Mus musculus
aattcttctcagcacagggttgctc

SEQ ID NO: 88270 - DNA, 25 bp, Mus musculus
aattcttctcaggacagggttgctc

SEQ ID NO: 88271 - DNA, 25 bp, Mus musculus
aattcttctctaatagtggccaata

SEQ ID NO: 88272 - DNA, 25 bp, Mus musculus
aattcttctctattagtggccaata

SEQ ID NO: 88273 - DNA, 25 bp, Mus musculus
aattcttctctcagtgccttaagtc

SEQ ID NO: 88274 - DNA, 25 bp, Mus musculus
aattcttctctctgtgccttaagtc

SEQ ID NO: 88275 - DNA, 25 bp, Mus musculus
aattcttctgacaactgtggtgtgc

SEQ ID NO: 88276 - DNA, 25 bp, Mus musculus
aattcttctgactactgtggtgtgc

SEQ ID NO: 88277 - DNA, 25 bp, Mus musculus
aattcttctggaatcagatcaaggc

SEQ ID NO: 88278 - DNA, 25 bp, Mus musculus
aattcttctggattcagatcaaggc

SEQ ID NO: 88279 - DNA, 25 bp, Mus musculus
aattcttctggtcggacatttgcct

SEQ ID NO: 88280 - DNA, 25 bp, Mus musculus
aattcttctggtgggacatttgcct

SEQ ID NO: 88281 - DNA, 25 bp, Mus musculus
aattcttgaaccagggtccctagtg

SEQ ID NO: 88282 - DNA, 25 bp, Mus musculus
aattcttgaacctgggtccctagtg

SEQ ID NO: 88283 - DNA, 25 bp, Mus musculus
aattcttgacagactgtgtcccatc

SEQ ID NO: 88284 - DNA, 25 bp, Mus musculus
aattcttgacagtctgtgtcccatc

SEQ ID NO: 88285 - DNA, 25 bp, Mus musculus
aattcttgaccaaccacttattttg

SEQ ID NO: 88286 - DNA, 25 bp, Mus musculus
aattcttgaccatccacttattttg

SEQ ID NO: 88287 - DNA, 25 bp, Mus musculus
aattcttgagctacactttggtcct

SEQ ID NO: 88288 - DNA, 25 bp, Mus musculus
aattcttgagcttcactttggtcct

SEQ ID NO: 88289 - DNA, 25 bp, Mus musculus
aattcttgatacaccttcatctacc

SEQ ID NO: 88290 - DNA, 25 bp, Mus musculus
aattcttgatactccttcatctacc

SEQ ID NO: 88291 - DNA, 25 bp, Mus musculus
aattcttgcagaccgtctggagctg

SEQ ID NO: 88292 - DNA, 25 bp, Mus musculus
aattcttgcagagcgtctggagctg

SEQ ID NO: 88293 - DNA, 25 bp, Mus musculus
aattcttgccaacaaatttcatttg

SEQ ID NO: 88294 - DNA, 25 bp, Mus musculus
aattcttgccaagaaatttcatttg

SEQ ID NO: 88295 - DNA, 25 bp, Mus musculus
aattcttgccggacgaggcccggag

SEQ ID NO: 88296 - DNA, 25 bp, Mus musculus
aattcttgccggtcgaggcccggag

SEQ ID NO: 88297 - DNA, 25 bp, Mus musculus
aattcttgggacagccagctcaggc

SEQ ID NO: 88298 - DNA, 25 bp, Mus musculus
aattcttgggactgccagctcaggc

SEQ ID NO: 88299 - DNA, 25 bp, Mus musculus
aattcttgtaatctgttgactccgt

SEQ ID NO: 88300 - DNA, 25 bp, Mus musculus
aattcttgtaatgtgttgactccgt

SEQ ID NO: 88301 - DNA, 25 bp, Mus musculus
aattcttgtcctccagaacttccag

SEQ ID NO: 88302 - DNA, 25 bp, Mus musculus
aattcttgtcctgcagaacttccag

SEQ ID NO: 88303 - DNA, 25 bp, Mus musculus
aattcttgtgaaaaccctataaatg

SEQ ID NO: 88304 - DNA, 25 bp, Mus musculus
aattcttgtgaataccctataaatg

SEQ ID NO: 88305 - DNA, 25 bp, Mus musculus
aattctttaaccactgttgggagca

SEQ ID NO: 88306 - DNA, 25 bp, Mus musculus
aattctttaacctctgttgggagca

SEQ ID NO: 88307 - DNA, 25 bp, Mus musculus
aattctttacaacacttgacgctcc

SEQ ID NO: 88308 - DNA, 25 bp, Mus musculus
aattctttacaagacttgacgctcc

SEQ ID NO: 88309 - DNA, 25 bp, Mus musculus
aattctttatccctcttgtcctgtt

SEQ ID NO: 88310 - DNA, 25 bp, Mus musculus
aattctttatccgtcttgtcctgtt

SEQ ID NO: 88311 - DNA, 25 bp, Mus musculus
aattctttcaatactagcctccagt

SEQ ID NO: 88312 - DNA, 25 bp, Mus musculus
aattctttcaattctagcctccagt

SEQ ID NO: 88313 - DNA, 25 bp, Mus musculus
aattctttcattctattgtgatttc

SEQ ID NO: 88314 - DNA, 25 bp, Mus musculus
aattctttcattgtattgtgatttc

SEQ ID NO: 88315 - DNA, 25 bp, Mus musculus
aattctttccaacctcagacatcag

SEQ ID NO: 88316 - DNA, 25 bp, Mus musculus
aattctttccaagctcagacatcag

SEQ ID NO: 88317 - DNA, 25 bp, Mus musculus
aattctttcctgaagggtgtctcat

SEQ ID NO: 88318 - DNA, 25 bp, Mus musculus
aattctttcctgtagggtgtctcat

SEQ ID NO: 88319 - DNA, 25 bp, Mus musculus
aattctttctatcttgggcactctc

SEQ ID NO: 88320 - DNA, 25 bp, Mus musculus
aattctttctatgttgggcactctc

SEQ ID NO: 88321 - DNA, 25 bp, Mus musculus
aattctttctgccactgttacgaaa

SEQ ID NO: 88322 - DNA, 25 bp, Mus musculus
aattctttctgcgactgttacgaaa

SEQ ID NO: 88323 - DNA, 25 bp, Mus musculus
aattctttgaggcactggcatccag

SEQ ID NO: 88324 - DNA, 25 bp, Mus musculus
aattctttgagggactggcatccag

SEQ ID NO: 88325 - DNA, 25 bp, Mus musculus
aattctttgctccaaggtctaataa

SEQ ID NO: 88326 - DNA, 25 bp, Mus musculus
aattctttgctcgaaggtctaataa

SEQ ID NO: 88327 - DNA, 25 bp, Mus musculus
aattctttggctcgttcttaagtat

SEQ ID NO: 88328 - DNA, 25 bp, Mus musculus
aattctttggctggttcttaagtat

SEQ ID NO: 88329 - DNA, 25 bp, Mus musculus
aattctttgttactcagtgtctccc

SEQ ID NO: 88330 - DNA, 25 bp, Mus musculus
aattctttgttagtcagtgtctccc

SEQ ID NO: 88331 - DNA, 25 bp, Mus musculus
aattcttttatgattctgagcaacc

SEQ ID NO: 88332 - DNA, 25 bp, Mus musculus
aattcttttatgtttctgagcaacc

SEQ ID NO: 88333 - DNA, 25 bp, Mus musculus
aattcttttattcatcactcactcc

SEQ ID NO: 88334 - DNA, 25 bp, Mus musculus
aattcttttattgatcactcactcc

SEQ ID NO: 88335 - DNA, 25 bp, Mus musculus
aattcttttcaaaccattccatgtg

SEQ ID NO: 88336 - DNA, 25 bp, Mus musculus
aattcttttcaatccattccatgtg

SEQ ID NO: 88337 - DNA, 25 bp, Mus musculus
aattcttttcagcttatggtcaggc

SEQ ID NO: 88338 - DNA, 25 bp, Mus musculus
aattcttttcaggttatggtcaggc

SEQ ID NO: 88339 - DNA, 25 bp, Mus musculus
aattcttttcataggtgcctatcct

SEQ ID NO: 88340 - DNA, 25 bp, Mus musculus
aattcttttcattggtgcctatcct

SEQ ID NO: 88341 - DNA, 25 bp, Mus musculus
aattcttttgagaatgcctgtgcca

SEQ ID NO: 88342 - DNA, 25 bp, Mus musculus
aattcttttgagtatgcctgtgcca

SEQ ID NO: 88343 - DNA, 25 bp, Mus musculus
aattcttttgcacctcatgcaggag

SEQ ID NO: 88344 - DNA, 25 bp, Mus musculus
aattcttttgcagctcatgcaggag

SEQ ID NO: 88345 - DNA, 25 bp, Mus musculus
aattcttttgtaagtgcgataggta

SEQ ID NO: 88346 - DNA, 25 bp, Mus musculus
aattcttttgtaattcctggaatag

SEQ ID NO: 88347 - DNA, 25 bp, Mus musculus
aattcttttgtatgtgcgataggta

SEQ ID NO: 88348 - DNA, 25 bp, Mus musculus
aattcttttgtatttcctggaatag

SEQ ID NO: 88349 - DNA, 25 bp, Mus musculus
aattcttttgtcagcatcaaaggag

SEQ ID NO: 88350 - DNA, 25 bp, Mus musculus
aattcttttgtctgcatcaaaggag

SEQ ID NO: 88351 - DNA, 25 bp, Mus musculus
aattctttttagacttgatctggct

SEQ ID NO: 88352 - DNA, 25 bp, Mus musculus
aattctttttagcacctcatcaaca

SEQ ID NO: 88353 - DNA, 25 bp, Mus musculus
aattctttttaggacctcatcaaca

SEQ ID NO: 88354 - DNA, 25 bp, Mus musculus
aattctttttagtcttgatctggct

SEQ ID NO: 88355 - DNA, 25 bp, Mus musculus
aattctttttccatctgagagacaa

SEQ ID NO: 88356 - DNA, 25 bp, Mus musculus
aattctttttccttctgagagacaa

SEQ ID NO: 88357 - DNA, 25 bp, Mus musculus
aattgaaaaggtccaccgcttctct

SEQ ID NO: 88358 - DNA, 25 bp, Mus musculus
aattgaaaaggtgcaccgcttctct

SEQ ID NO: 88359 - DNA, 25 bp, Mus musculus
aattgaaacattcgtcagcctggaa

SEQ ID NO: 88360 - DNA, 25 bp, Mus musculus
aattgaaacattggtcagcctggaa

SEQ ID NO: 88361 - DNA, 25 bp, Mus musculus
aattgaaactatctgttggcctttt

SEQ ID NO: 88362 - DNA, 25 bp, Mus musculus
aattgaaactatgtgttggcctttt

SEQ ID NO: 88363 - DNA, 25 bp, Mus musculus
aattgaaactccctgttgttttcat

SEQ ID NO: 88364 - DNA, 25 bp, Mus musculus
aattgaaactccgtgttgttttcat

SEQ ID NO: 88365 - DNA, 25 bp, Mus musculus
aattgaaactgtagccaggcctggt

SEQ ID NO: 88366 - DNA, 25 bp, Mus musculus
aattgaaactgttgccaggcctggt

SEQ ID NO: 88367 - DNA, 25 bp, Mus musculus
aattgaaaggccagttgaacacaca

SEQ ID NO: 88368 - DNA, 25 bp, Mus musculus
aattgaaaggcctgttgaacacaca

SEQ ID NO: 88369 - DNA, 25 bp, Mus musculus
aattgaaataccatcccgagcatag

SEQ ID NO: 88370 - DNA, 25 bp, Mus musculus
aattgaaataccttcccgagcatag

SEQ ID NO: 88371 - DNA, 25 bp, Mus musculus
aattgaaatcacaagcttgcttccc

SEQ ID NO: 88372 - DNA, 25 bp, Mus musculus
aattgaaatcactagcttgcttccc

SEQ ID NO: 88373 - DNA, 25 bp, Mus musculus
aattgaaatcgtactgccgccagtg

SEQ ID NO: 88374 - DNA, 25 bp, Mus musculus
aattgaaatcgttctgccgccagtg

SEQ ID NO: 88375 - DNA, 25 bp, Mus musculus
aattgaaatgtacctgacgtgctcc

SEQ ID NO: 88376 - DNA, 25 bp, Mus musculus
aattgaaatgtagctgacgtgctcc

SEQ ID NO: 88377 - DNA, 25 bp, Mus musculus
aattgaacagtaccgcctgcagagg

SEQ ID NO: 88378 - DNA, 25 bp, Mus musculus
aattgaacagtagcgcctgcagagg

SEQ ID NO: 88379 - DNA, 25 bp, Mus musculus
aattgaaccaagcactcgtgtccga

SEQ ID NO: 88380 - DNA, 25 bp, Mus musculus
aattgaaccaaggactcgtgtccga

SEQ ID NO: 88381 - DNA, 25 bp, Mus musculus
aattgaaccctaatcactagactgg

SEQ ID NO: 88382 - DNA, 25 bp, Mus musculus
aattgaaccctattcactagactgg

SEQ ID NO: 88383 - DNA, 25 bp, Mus musculus
aattgaaccgtcagtaatcagtaca

SEQ ID NO: 88384 - DNA, 25 bp, Mus musculus
aattgaaccgtctgtaatcagtaca

SEQ ID NO: 88385 - DNA, 25 bp, Mus musculus
aattgaacgtagctcatcaggtttg

SEQ ID NO: 88386 - DNA, 25 bp, Mus musculus
aattgaacgtaggtcatcaggtttg

SEQ ID NO: 88387 - DNA, 25 bp, Mus musculus
aattgaactcttatcctctggaatt

SEQ ID NO: 88388 - DNA, 25 bp, Mus musculus
aattgaactcttttcctctggaatt

SEQ ID NO: 88389 - DNA, 25 bp, Mus musculus
aattgaactgagctggtctttctac

SEQ ID NO: 88390 - DNA, 25 bp, Mus musculus
aattgaactgaggtggtctttctac

SEQ ID NO: 88391 - DNA, 25 bp, Mus musculus
aattgaactggtattctaacaggat

SEQ ID NO: 88392 - DNA, 25 bp, Mus musculus
aattgaactggtccctgcagatgcg

SEQ ID NO: 88393 - DNA, 25 bp, Mus musculus
aattgaactggtgcctgcagatgcg

SEQ ID NO: 88394 - DNA, 25 bp, Mus musculus
aattgaactggttttctaacaggat

SEQ ID NO: 88395 - DNA, 25 bp, Mus musculus
aattgaagcggtctggcctgatgtt

SEQ ID NO: 88396 - DNA, 25 bp, Mus musculus
aattgaagcggtgtggcctgatgtt

SEQ ID NO: 88397 - DNA, 25 bp, Mus musculus
aattgaagctggatacagttttcac

SEQ ID NO: 88398 - DNA, 25 bp, Mus musculus
aattgaagctggttacagttttcac

SEQ ID NO: 88399 - DNA, 25 bp, Mus musculus
aattgaaggcgtatatgcccgagat

SEQ ID NO: 88400 - DNA, 25 bp, Mus musculus
aattgaaggcgtttatgcccgagat

SEQ ID NO: 88401 - DNA, 25 bp, Mus musculus
aattgaagtagaactgcctcagctc

SEQ ID NO: 88402 - DNA, 25 bp, Mus musculus
aattgaagtagatctgcctcagctc

SEQ ID NO: 88403 - DNA, 25 bp, Mus musculus
aattgaagtctcagttcttcttctt

SEQ ID NO: 88404 - DNA, 25 bp, Mus musculus
aattgaagtctctgttcttcttctt

SEQ ID NO: 88405 - DNA, 25 bp, Mus musculus
aattgaataattccctctcttcctt

SEQ ID NO: 88406 - DNA, 25 bp, Mus musculus
aattgaataattgcctctcttcctt

SEQ ID NO: 88407 - DNA, 25 bp, Mus musculus
aattgaatactcctttgggactgta

SEQ ID NO: 88408 - DNA, 25 bp, Mus musculus
aattgaatactcgtttgggactgta

SEQ ID NO: 88409 - DNA, 25 bp, Mus musculus
aattgaatctcgaggtggttagcta

SEQ ID NO: 88410 - DNA, 25 bp, Mus musculus
aattgaatctcgtggtggttagcta

SEQ ID NO: 88411 - DNA, 25 bp, Mus musculus
aattgaatgagaacttaggtggcca

SEQ ID NO: 88412 - DNA, 25 bp, Mus musculus
aattgaatgagatcttaggtggcca

SEQ ID NO: 88413 - DNA, 25 bp, Mus musculus
aattgaatggccaccctgtgttgtg

SEQ ID NO: 88414 - DNA, 25 bp, Mus musculus
aattgaatggcctccctgtgttgtg

SEQ ID NO: 88415 - DNA, 25 bp, Mus musculus
aattgaatgtctccctttctaagat

SEQ ID NO: 88416 - DNA, 25 bp, Mus musculus
aattgaatgtctgcctttctaagat

SEQ ID NO: 88417 - DNA, 25 bp, Mus musculus
aattgaatgttgatcgtgcatgcct

SEQ ID NO: 88418 - DNA, 25 bp, Mus musculus
aattgaatgttgttcgtgcatgcct

SEQ ID NO: 88419 - DNA, 25 bp, Mus musculus
aattgaattcctatgggctccttag

SEQ ID NO: 88420 - DNA, 25 bp, Mus musculus
aattgaattcctttgggctccttag

SEQ ID NO: 88421 - DNA, 25 bp, Mus musculus
aattgaattcttaatcctctcctat

SEQ ID NO: 88422 - DNA, 25 bp, Mus musculus
aattgaattctttatcctctcctat

SEQ ID NO: 88423 - DNA, 25 bp, Mus musculus
aattgaattggcctgtagatggatc

SEQ ID NO: 88424 - DNA, 25 bp, Mus musculus
aattgaattggcgtgtagatggatc

SEQ ID NO: 88425 - DNA, 25 bp, Mus musculus
aattgaatttggagtcctccatggg

SEQ ID NO: 88426 - DNA, 25 bp, Mus musculus
aattgaatttggtgtcctccatggg

SEQ ID NO: 88427 - DNA, 25 bp, Mus musculus
aattgacaccatacactttagcaag

SEQ ID NO: 88428 - DNA, 25 bp, Mus musculus
aattgacaccattcactttagcaag

SEQ ID NO: 88429 - DNA, 25 bp, Mus musculus
aattgacagagacgcggtccctcca

SEQ ID NO: 88430 - DNA, 25 bp, Mus musculus
aattgacagagaggcggtccctcca

SEQ ID NO: 88431 - DNA, 25 bp, Mus musculus
aattgacaggatcatttatgtgccc

SEQ ID NO: 88432 - DNA, 25 bp, Mus musculus
aattgacaggatgatttatgtgccc

SEQ ID NO: 88433 - DNA, 25 bp, Mus musculus
aattgacagtggatgccattccttg

SEQ ID NO: 88434 - DNA, 25 bp, Mus musculus
aattgacagtggttgccattccttg

SEQ ID NO: 88435 - DNA, 25 bp, Mus musculus
aattgacatgttctctgtcctctct

SEQ ID NO: 88436 - DNA, 25 bp, Mus musculus
aattgacatgttgtctgtcctctct

SEQ ID NO: 88437 - DNA, 25 bp, Mus musculus
aattgacattccatgacctgtgctc

SEQ ID NO: 88438 - DNA, 25 bp, Mus musculus
aattgacattccttgacctgtgctc

SEQ ID NO: 88439 - DNA, 25 bp, Mus musculus
aattgaccacttctaatcagtacac

SEQ ID NO: 88440 - DNA, 25 bp, Mus musculus
aattgaccacttgtaatcagtacac

SEQ ID NO: 88441 - DNA, 25 bp, Mus musculus
aattgaccagccattgcttcagcct

SEQ ID NO: 88442 - DNA, 25 bp, Mus musculus
aattgaccagcctttgcttcagcct

SEQ ID NO: 88443 - DNA, 25 bp, Mus musculus
aattgaccagttacattcagtaaaa

SEQ ID NO: 88444 - DNA, 25 bp, Mus musculus
aattgaccagtttcattcagtaaaa

SEQ ID NO: 88445 - DNA, 25 bp, Mus musculus
aattgaccattacacttcactgagt

SEQ ID NO: 88446 - DNA, 25 bp, Mus musculus
aattgaccattagacttcactgagt

SEQ ID NO: 88447 - DNA, 25 bp, Mus musculus
aattgacccttacagagaaacctca

SEQ ID NO: 88448 - DNA, 25 bp, Mus musculus
aattgacccttagagagaaacctca

SEQ ID NO: 88449 - DNA, 25 bp, Mus musculus
aattgacctatgcaggccctaattg

SEQ ID NO: 88450 - DNA, 25 bp, Mus musculus
aattgacctatggaggccctaattg

SEQ ID NO: 88451 - DNA, 25 bp, Mus musculus
aattgacctgtaatgagtatgacat

SEQ ID NO: 88452 - DNA, 25 bp, Mus musculus
aattgacctgtattgagtatgacat

SEQ ID NO: 88453 - DNA, 25 bp, Mus musculus
aattgaccttcaagtgcttttaaaa

SEQ ID NO: 88454 - DNA, 25 bp, Mus musculus
aattgaccttcatgtgcttttaaaa

SEQ ID NO: 88455 - DNA, 25 bp, Mus musculus
aattgaccttgactttcaaccgcac

SEQ ID NO: 88456 - DNA, 25 bp, Mus musculus
aattgaccttgagtttcaaccgcac

SEQ ID NO: 88457 - DNA, 25 bp, Mus musculus
aattgacgaggaagattttgctgat

SEQ ID NO: 88458 - DNA, 25 bp, Mus musculus
aattgacgaggatgattttgctgat

SEQ ID NO: 88459 - DNA, 25 bp, Mus musculus
aattgacggattcgcttttgttctt

SEQ ID NO: 88460 - DNA, 25 bp, Mus musculus
aattgacggattggcttttgttctt

SEQ ID NO: 88461 - DNA, 25 bp, Mus musculus
aattgacgttaaagtgttttcactg

SEQ ID NO: 88462 - DNA, 25 bp, Mus musculus
aattgacgttaatgtgttttcactg

SEQ ID NO: 88463 - DNA, 25 bp, Mus musculus
aattgactgcagaacagggtcccct

SEQ ID NO: 88464 - DNA, 25 bp, Mus musculus
aattgactgcagtacagggtcccct

SEQ ID NO: 88465 - DNA, 25 bp, Mus musculus
aattgactgcatcttgcgggatacg

SEQ ID NO: 88466 - DNA, 25 bp, Mus musculus
aattgactgcatgttgcgggatacg

SEQ ID NO: 88467 - DNA, 25 bp, Mus musculus
aattgactgggaagacagccaccct

SEQ ID NO: 88468 - DNA, 25 bp, Mus musculus
aattgactgggatgacagccaccct

SEQ ID NO: 88469 - DNA, 25 bp, Mus musculus
aattgactgtctctaacatgctgtt

SEQ ID NO: 88470 - DNA, 25 bp, Mus musculus
aattgactgtctgtaacatgctgtt

SEQ ID NO: 88471 - DNA, 25 bp, Mus musculus
aattgactgttgaggtattgggcat

SEQ ID NO: 88472 - DNA, 25 bp, Mus musculus
aattgactgttgtggtattgggcat

SEQ ID NO: 88473 - DNA, 25 bp, Mus musculus
aattgacttttaagactcagactca

SEQ ID NO: 88474 - DNA, 25 bp, Mus musculus
aattgacttttatgactcagactca

SEQ ID NO: 88475 - DNA, 25 bp, Mus musculus
aattgagaacacactggctgggaca

SEQ ID NO: 88476 - DNA, 25 bp, Mus musculus
aattgagaacactctggctgggaca

SEQ ID NO: 88477 - DNA, 25 bp, Mus musculus
aattgagaacagagcctacatccca

SEQ ID NO: 88478 - DNA, 25 bp, Mus musculus
aattgagaacagtgcctacatccca

SEQ ID NO: 88479 - DNA, 25 bp, Mus musculus
aattgagaacctcgatgcggctgct

SEQ ID NO: 88480 - DNA, 25 bp, Mus musculus
aattgagaacctggatgcggctgct

SEQ ID NO: 88481 - DNA, 25 bp, Mus musculus
aattgagacaccatccacacagtga

SEQ ID NO: 88482 - DNA, 25 bp, Mus musculus
aattgagacaccttccacacagtga

SEQ ID NO: 88483 - DNA, 25 bp, Mus musculus
aattgagacagtacgcttcctgcta

SEQ ID NO: 88484 - DNA, 25 bp, Mus musculus
aattgagacagttcgcttcctgcta

SEQ ID NO: 88485 - DNA, 25 bp, Mus musculus
aattgagaccagaaacatccccacg

SEQ ID NO: 88486 - DNA, 25 bp, Mus musculus
aattgagaccagtaacatccccacg

SEQ ID NO: 88487 - DNA, 25 bp, Mus musculus
aattgagacctcagccgacttataa

SEQ ID NO: 88488 - DNA, 25 bp, Mus musculus
aattgagacctctgccgacttataa

SEQ ID NO: 88489 - DNA, 25 bp, Mus musculus
aattgagagacaattaactttacat

SEQ ID NO: 88490 - DNA, 25 bp, Mus musculus
aattgagagacatttaactttacat

SEQ ID NO: 88491 - DNA, 25 bp, Mus musculus
aattgagagccaaaagatgttcctg

SEQ ID NO: 88492 - DNA, 25 bp, Mus musculus
aattgagagccataagatgttcctg

SEQ ID NO: 88493 - DNA, 25 bp, Mus musculus
aattgagaggcgatagcttaaccca

SEQ ID NO: 88494 - DNA, 25 bp, Mus musculus
aattgagaggcgttagcttaaccca

SEQ ID NO: 88495 - DNA, 25 bp, Mus musculus
aattgagagtatagccgtggcggcc

SEQ ID NO: 88496 - DNA, 25 bp, Mus musculus
aattgagagtattgccgtggcggcc

SEQ ID NO: 88497 - DNA, 25 bp, Mus musculus
aattgagagtgacccgtttgactgg

SEQ ID NO: 88498 - DNA, 25 bp, Mus musculus
aattgagagtgagccgtttgactgg

SEQ ID NO: 88499 - DNA, 25 bp, Mus musculus
aattgagatgagagagaacccaaca

SEQ ID NO: 88500 - DNA, 25 bp, Mus musculus
aattgagatgagtgagaacccaaca

SEQ ID NO: 88501 - DNA, 25 bp, Mus musculus
aattgagcagatcctttcgggcagc

SEQ ID NO: 88502 - DNA, 25 bp, Mus musculus
aattgagcagatgctttcgggcagc

SEQ ID NO: 88503 - DNA, 25 bp, Mus musculus
aattgagccactaactatgcaccct

SEQ ID NO: 88504 - DNA, 25 bp, Mus musculus
aattgagccacttactatgcaccct

SEQ ID NO: 88505 - DNA, 25 bp, Mus musculus
aattgagcccaaccacaaagtgaag

SEQ ID NO: 88506 - DNA, 25 bp, Mus musculus
aattgagcccaagcacaaagtgaag

SEQ ID NO: 88507 - DNA, 25 bp, Mus musculus
aattgagcccacagggacctgtgcc

SEQ ID NO: 88508 - DNA, 25 bp, Mus musculus
aattgagcccactgggacctgtgcc

SEQ ID NO: 88509 - DNA, 25 bp, Mus musculus
aattgagcctagcactctctttggt

SEQ ID NO: 88510 - DNA, 25 bp, Mus musculus
aattgagcctaggactctctttggt

SEQ ID NO: 88511 - DNA, 25 bp, Mus musculus
aattgagcctgaaattaagctccag

SEQ ID NO: 88512 - DNA, 25 bp, Mus musculus
aattgagcctgatattaagctccag

SEQ ID NO: 88513 - DNA, 25 bp, Mus musculus
aattgagcggctccattcattcgac

SEQ ID NO: 88514 - DNA, 25 bp, Mus musculus
aattgagcggctgcattcattcgac

SEQ ID NO: 88515 - DNA, 25 bp, Mus musculus
aattgagctataacccaacctccat

SEQ ID NO: 88516 - DNA, 25 bp, Mus musculus
aattgagctatatcccaacctccat

SEQ ID NO: 88517 - DNA, 25 bp, Mus musculus
aattgagctgttagattaatccgtc

SEQ ID NO: 88518 - DNA, 25 bp, Mus musculus
aattgagctgtttgattaatccgtc

SEQ ID NO: 88519 - DNA, 25 bp, Mus musculus
aattgaggcgcaaagagtgtgcagt

SEQ ID NO: 88520 - DNA, 25 bp, Mus musculus
aattgaggcgcatagagtgtgcagt

SEQ ID NO: 88521 - DNA, 25 bp, Mus musculus
aattgaggcgccctaatctctgatg

SEQ ID NO: 88522 - DNA, 25 bp, Mus musculus
aattgaggcgccgtaatctctgatg

SEQ ID NO: 88523 - DNA, 25 bp, Mus musculus
aattgaggctacattgtgctgtata

SEQ ID NO: 88524 - DNA, 25 bp, Mus musculus
aattgaggctactttgtgctgtata

SEQ ID NO: 88525 - DNA, 25 bp, Mus musculus
aattgaggctcccacctatgtgaat

SEQ ID NO: 88526 - DNA, 25 bp, Mus musculus
aattgaggctccgacctatgtgaat

SEQ ID NO: 88527 - DNA, 25 bp, Mus musculus
aattgaggctgcacacaccagggag

SEQ ID NO: 88528 - DNA, 25 bp, Mus musculus
aattgaggctgctcacaccagggag

SEQ ID NO: 88529 - DNA, 25 bp, Mus musculus
aattgaggctggagccgtgtacacc

SEQ ID NO: 88530 - DNA, 25 bp, Mus musculus
aattgaggctggtgccgtgtacacc

SEQ ID NO: 88531 - DNA, 25 bp, Mus musculus
aattgagggcagctacctttaccca

SEQ ID NO: 88532 - DNA, 25 bp, Mus musculus
aattgagggcaggtacctttaccca

SEQ ID NO: 88533 - DNA, 25 bp, Mus musculus
aattgagggtccatgcctgtgagac

SEQ ID NO: 88534 - DNA, 25 bp, Mus musculus
aattgagggtccttgcctgtgagac

SEQ ID NO: 88535 - DNA, 25 bp, Mus musculus
aattgaggtcatcgccttgcacagc

SEQ ID NO: 88536 - DNA, 25 bp, Mus musculus
aattgaggtcatggccttgcacagc

SEQ ID NO: 88537 - DNA, 25 bp, Mus musculus
aattgaggtctgagccatctgtgag

SEQ ID NO: 88538 - DNA, 25 bp, Mus musculus
aattgaggtctgtgccatctgtgag

SEQ ID NO: 88539 - DNA, 25 bp, Mus musculus
aattgaggtttcaaatactgcacta

SEQ ID NO: 88540 - DNA, 25 bp, Mus musculus
aattgaggtttctaatactgcacta

SEQ ID NO: 88541 - DNA, 25 bp, Mus musculus
aattgagtaggtatgtttagagaca

SEQ ID NO: 88542 - DNA, 25 bp, Mus musculus
aattgagtaggtttgtttagagaca

SEQ ID NO: 88543 - DNA, 25 bp, Mus musculus
aattgagtatgcctccagattcgat

SEQ ID NO: 88544 - DNA, 25 bp, Mus musculus
aattgagtatgcgtccagattcgat

SEQ ID NO: 88545 - DNA, 25 bp, Mus musculus
aattgagtcctacttctcttcccta

SEQ ID NO: 88546 - DNA, 25 bp, Mus musculus
aattgagtcctagttctcttcccta

SEQ ID NO: 88547 - DNA, 25 bp, Mus musculus
aattgagtgactatattcatctgat

SEQ ID NO: 88548 - DNA, 25 bp, Mus musculus
aattgagtgactttattcatctgat

SEQ ID NO: 88549 - DNA, 25 bp, Mus musculus
aattgagtgccactagctgtttgct

SEQ ID NO: 88550 - DNA, 25 bp, Mus musculus
aattgagtgccagtagctgtttgct

SEQ ID NO: 88551 - DNA, 25 bp, Mus musculus
aattgagtgctcaccaacttactgg

SEQ ID NO: 88552 - DNA, 25 bp, Mus musculus
aattgagtgctctccaacttactgg

SEQ ID NO: 88553 - DNA, 25 bp, Mus musculus
aattgagtgcttatctgccctggaa

SEQ ID NO: 88554 - DNA, 25 bp, Mus musculus
aattgagtgcttttctgccctggaa

SEQ ID NO: 88555 - DNA, 25 bp, Mus musculus
aattgagtgtcacacaggcctctgg

SEQ ID NO: 88556 - DNA, 25 bp, Mus musculus
aattgagtgtcagacaggcctctgg

SEQ ID NO: 88557 - DNA, 25 bp, Mus musculus
aattgagttctcactgcagcctgca

SEQ ID NO: 88558 - DNA, 25 bp, Mus musculus
aattgagttctctctgcagcctgca

SEQ ID NO: 88559 - DNA, 25 bp, Mus musculus
aattgagttgatatgcgtgtcaccc

SEQ ID NO: 88560 - DNA, 25 bp, Mus musculus
aattgagttgatttgcgtgtcaccc

SEQ ID NO: 88561 - DNA, 25 bp, Mus musculus
aattgataccacattctttattata

SEQ ID NO: 88562 - DNA, 25 bp, Mus musculus
aattgataccactttctttattata

SEQ ID NO: 88563 - DNA, 25 bp, Mus musculus
aattgataccagattccactggaac

SEQ ID NO: 88564 - DNA, 25 bp, Mus musculus
aattgataccagtttccactggaac

SEQ ID NO: 88565 - DNA, 25 bp, Mus musculus
aattgatagtgcaccatagaaaccc

SEQ ID NO: 88566 - DNA, 25 bp, Mus musculus
aattgatagtgctccatagaaaccc

SEQ ID NO: 88567 - DNA, 25 bp, Mus musculus
aattgatatttcattggctgtttga

SEQ ID NO: 88568 - DNA, 25 bp, Mus musculus
aattgatatttctttggctgtttga

SEQ ID NO: 88569 - DNA, 25 bp, Mus musculus
aattgatcctttcttccatgtgtta

SEQ ID NO: 88570 - DNA, 25 bp, Mus musculus
aattgatcctttgttccatgtgtta

SEQ ID NO: 88571 - DNA, 25 bp, Mus musculus
aattgatctatgagactgaggccga

SEQ ID NO: 88572 - DNA, 25 bp, Mus musculus
aattgatctatgtgactgaggccga

SEQ ID NO: 88573 - DNA, 25 bp, Mus musculus
aattgatctattaaggacagcagca

SEQ ID NO: 88574 - DNA, 25 bp, Mus musculus
aattgatctatttaggacagcagca

SEQ ID NO: 88575 - DNA, 25 bp, Mus musculus
aattgatctcaaaggcttctggacc

SEQ ID NO: 88576 - DNA, 25 bp, Mus musculus
aattgatctcaatggcttctggacc

SEQ ID NO: 88577 - DNA, 25 bp, Mus musculus
aattgatctcccatagatactcagg

SEQ ID NO: 88578 - DNA, 25 bp, Mus musculus
aattgatctcccttagatactcagg

SEQ ID NO: 88579 - DNA, 25 bp, Mus musculus
aattgatctctgcattattttcagg

SEQ ID NO: 88580 - DNA, 25 bp, Mus musculus
aattgatctctggattattttcagg

SEQ ID NO: 88581 - DNA, 25 bp, Mus musculus
aattgatctgttatggatgttgcga

SEQ ID NO: 88582 - DNA, 25 bp, Mus musculus
aattgatctgttttggatgttgcga

SEQ ID NO: 88583 - DNA, 25 bp, Mus musculus
aattgatcttgcataccttttactg

SEQ ID NO: 88584 - DNA, 25 bp, Mus musculus
aattgatcttgcttaccttttactg

SEQ ID NO: 88585 - DNA, 25 bp, Mus musculus
aattgatgaaggagtctccggacga

SEQ ID NO: 88586 - DNA, 25 bp, Mus musculus
aattgatgaaggtgtctccggacga

SEQ ID NO: 88587 - DNA, 25 bp, Mus musculus
aattgatgagctacaggttcaatgg

SEQ ID NO: 88588 - DNA, 25 bp, Mus musculus
aattgatgagcttcaggttcaatgg

SEQ ID NO: 88589 - DNA, 25 bp, Mus musculus
aattgatgaggacgccgggcccctc

SEQ ID NO: 88590 - DNA, 25 bp, Mus musculus
aattgatgaggaggccgggcccctc

SEQ ID NO: 88591 - DNA, 25 bp, Mus musculus
aattgatgcactactcagttatgta

SEQ ID NO: 88592 - DNA, 25 bp, Mus musculus
aattgatgcacttctcagttatgta

SEQ ID NO: 88593 - DNA, 25 bp, Mus musculus
aattgatgcaggaaccacttcggtg

SEQ ID NO: 88594 - DNA, 25 bp, Mus musculus
aattgatgcaggtaccacttcggtg

SEQ ID NO: 88595 - DNA, 25 bp, Mus musculus
aattgatgctttattcggctgctcg

SEQ ID NO: 88596 - DNA, 25 bp, Mus musculus
aattgatgcttttttcggctgctcg

SEQ ID NO: 88597 - DNA, 25 bp, Mus musculus
aattgatgtagcatttgcaacttca

SEQ ID NO: 88598 - DNA, 25 bp, Mus musculus
aattgatgtagcttttgcaacttca

SEQ ID NO: 88599 - DNA, 25 bp, Mus musculus
aattgatgtgacacaggcacctgct

SEQ ID NO: 88600 - DNA, 25 bp, Mus musculus
aattgatgtgactcaggcacctgct

SEQ ID NO: 88601 - DNA, 25 bp, Mus musculus
aattgatgtgagaaccgactactac

SEQ ID NO: 88602 - DNA, 25 bp, Mus musculus
aattgatgtgagtaccgactactac

SEQ ID NO: 88603 - DNA, 25 bp, Mus musculus
aattgatgtgtccatctttctcagc

SEQ ID NO: 88604 - DNA, 25 bp, Mus musculus
aattgatgtgtcgatctttctcagc

SEQ ID NO: 88605 - DNA, 25 bp, Mus musculus
aattgatgttagaaaccctgagttg

SEQ ID NO: 88606 - DNA, 25 bp, Mus musculus
aattgatgttagtaaccctgagttg

SEQ ID NO: 88607 - DNA, 25 bp, Mus musculus
aattgattatttaccacacgctgca

SEQ ID NO: 88608 - DNA, 25 bp, Mus musculus
aattgattattttccacacgctgca

SEQ ID NO: 88609 - DNA, 25 bp, Mus musculus
aattgattcagcaacaactgtggct

SEQ ID NO: 88610 - DNA, 25 bp, Mus musculus
aattgattcagctacaactgtggct

SEQ ID NO: 88611 - DNA, 25 bp, Mus musculus
aattgattccatatccttatctgga

SEQ ID NO: 88612 - DNA, 25 bp, Mus musculus
aattgattccatttccttatctgga

SEQ ID NO: 88613 - DNA, 25 bp, Mus musculus
aattgattctctactttgaccgagt

SEQ ID NO: 88614 - DNA, 25 bp, Mus musculus
aattgattctcttctttgaccgagt

SEQ ID NO: 88615 - DNA, 25 bp, Mus musculus
aattgattcttcagacctcttttgg

SEQ ID NO: 88616 - DNA, 25 bp, Mus musculus
aattgattcttctgacctcttttgg

SEQ ID NO: 88617 - DNA, 25 bp, Mus musculus
aattgattcttgacctttctagtaa

SEQ ID NO: 88618 - DNA, 25 bp, Mus musculus
aattgattcttgactgtgtaggcta

SEQ ID NO: 88619 - DNA, 25 bp, Mus musculus
aattgattcttgtcctttctagtaa

SEQ ID NO: 88620 - DNA, 25 bp, Mus musculus
aattgattcttgtctgtgtaggcta

SEQ ID NO: 88621 - DNA, 25 bp, Mus musculus
aattgattgacaatttgaaaaggca

SEQ ID NO: 88622 - DNA, 25 bp, Mus musculus
aattgattgacattttgaaaaggca

SEQ ID NO: 88623 - DNA, 25 bp, Mus musculus
aattgattgcccattgtgtaagaac

SEQ ID NO: 88624 - DNA, 25 bp, Mus musculus
aattgattgccctttgtgtaagaac

SEQ ID NO: 88625 - DNA, 25 bp, Mus musculus
aattgattgggtcccagtcttgtct

SEQ ID NO: 88626 - DNA, 25 bp, Mus musculus
aattgattgggtgccagtcttgtct

SEQ ID NO: 88627 - DNA, 25 bp, Mus musculus
aattgattgtctctgccggaagcca

SEQ ID NO: 88628 - DNA, 25 bp, Mus musculus
aattgattgtctgtgccggaagcca

SEQ ID NO: 88629 - DNA, 25 bp, Mus musculus
aattgattgtgtcaactcgttggat

SEQ ID NO: 88630 - DNA, 25 bp, Mus musculus
aattgattgtgtgaactcgttggat

SEQ ID NO: 88631 - DNA, 25 bp, Mus musculus
aattgatttcccagaatttctgaca

SEQ ID NO: 88632 - DNA, 25 bp, Mus musculus
aattgatttccccattcgttcactt

SEQ ID NO: 88633 - DNA, 25 bp, Mus musculus
aattgatttcccgattcgttcactt

SEQ ID NO: 88634 - DNA, 25 bp, Mus musculus
aattgatttccctgaatttctgaca

SEQ ID NO: 88635 - DNA, 25 bp, Mus musculus
aattgatttcttccattggttttcg

SEQ ID NO: 88636 - DNA, 25 bp, Mus musculus
aattgatttcttgcattggttttcg

SEQ ID NO: 88637 - DNA, 25 bp, Mus musculus
aattgatttgtgatgcgatgcttta

SEQ ID NO: 88638 - DNA, 25 bp, Mus musculus
aattgatttgtgttgcgatgcttta

SEQ ID NO: 88639 - DNA, 25 bp, Mus musculus
aattgattttccaaggtccagtgga

SEQ ID NO: 88640 - DNA, 25 bp, Mus musculus
aattgattttcctaggtccagtgga

SEQ ID NO: 88641 - DNA, 25 bp, Mus musculus
aattgcaaaaggctgttcttataca

SEQ ID NO: 88642 - DNA, 25 bp, Mus musculus
aattgcaaaagggtgttcttataca

SEQ ID NO: 88643 - DNA, 25 bp, Mus musculus
aattgcaaataaatccactgtagag

SEQ ID NO: 88644 - DNA, 25 bp, Mus musculus
aattgcaaataattccactgtagag

SEQ ID NO: 88645 - DNA, 25 bp, Mus musculus
aattgcaacggaaatcgcctggagt

SEQ ID NO: 88646 - DNA, 25 bp, Mus musculus
aattgcaacggatatcgcctggagt

SEQ ID NO: 88647 - DNA, 25 bp, Mus musculus
aattgcaagtggaccttccagcgtt

SEQ ID NO: 88648 - DNA, 25 bp, Mus musculus
aattgcaagtggtccttccagcgtt

SEQ ID NO: 88649 - DNA, 25 bp, Mus musculus
aattgcaatatcagctgggcatggt

SEQ ID NO: 88650 - DNA, 25 bp, Mus musculus
aattgcaatatctgctgggcatggt

SEQ ID NO: 88651 - DNA, 25 bp, Mus musculus
aattgcaatcctataccctttgagg

SEQ ID NO: 88652 - DNA, 25 bp, Mus musculus
aattgcaatcctttaccctttgagg

SEQ ID NO: 88653 - DNA, 25 bp, Mus musculus
aattgcaattacattcccaccagat

SEQ ID NO: 88654 - DNA, 25 bp, Mus musculus
aattgcaattactttcccaccagat

SEQ ID NO: 88655 - DNA, 25 bp, Mus musculus
aattgcaattctcaggccgggcgtg

SEQ ID NO: 88656 - DNA, 25 bp, Mus musculus
aattgcaattctgaggccgggcgtg

SEQ ID NO: 88657 - DNA, 25 bp, Mus musculus
aattgcacacaaccagctaacatgt

SEQ ID NO: 88658 - DNA, 25 bp, Mus musculus
aattgcacacaagcagctaacatgt

SEQ ID NO: 88659 - DNA, 25 bp, Mus musculus
aattgcacaccaagcgcatgtacta

SEQ ID NO: 88660 - DNA, 25 bp, Mus musculus
aattgcacaccatgcgcatgtacta

SEQ ID NO: 88661 - DNA, 25 bp, Mus musculus
aattgcaccacaagttaagttctat

SEQ ID NO: 88662 - DNA, 25 bp, Mus musculus
aattgcaccacatgttaagttctat

SEQ ID NO: 88663 - DNA, 25 bp, Mus musculus
aattgcaccattactcacagttact

SEQ ID NO: 88664 - DNA, 25 bp, Mus musculus
aattgcaccatttctcacagttact

SEQ ID NO: 88665 - DNA, 25 bp, Mus musculus
aattgcaccttgactgttgctgtta

SEQ ID NO: 88666 - DNA, 25 bp, Mus musculus
aattgcaccttgtctgttgctgtta

SEQ ID NO: 88667 - DNA, 25 bp, Mus musculus
aattgcactgggattgtgtcactct

SEQ ID NO: 88668 - DNA, 25 bp, Mus musculus
aattgcactgggtttgtgtcactct

SEQ ID NO: 88669 - DNA, 25 bp, Mus musculus
aattgcactgttaaggacgaccact

SEQ ID NO: 88670 - DNA, 25 bp, Mus musculus
aattgcactgtttaggacgaccact

SEQ ID NO: 88671 - DNA, 25 bp, Mus musculus
aattgcacttctagtactgatcgag

SEQ ID NO: 88672 - DNA, 25 bp, Mus musculus
aattgcacttcttgtactgatcgag

SEQ ID NO: 88673 - DNA, 25 bp, Mus musculus
aattgcagaatcctttgagccccaa

SEQ ID NO: 88674 - DNA, 25 bp, Mus musculus
aattgcagaatcgtttgagccccaa

SEQ ID NO: 88675 - DNA, 25 bp, Mus musculus
aattgcagactgatggagctccttt

SEQ ID NO: 88676 - DNA, 25 bp, Mus musculus
aattgcagactgttggagctccttt

SEQ ID NO: 88677 - DNA, 25 bp, Mus musculus
aattgcagagacactgctcaacgct

SEQ ID NO: 88678 - DNA, 25 bp, Mus musculus
aattgcagagactctgctcaacgct

SEQ ID NO: 88679 - DNA, 25 bp, Mus musculus
aattgcagatccaatagcctaacag

SEQ ID NO: 88680 - DNA, 25 bp, Mus musculus
aattgcagatcctatagcctaacag

SEQ ID NO: 88681 - DNA, 25 bp, Mus musculus
aattgcagcaggattattgtctagc

SEQ ID NO: 88682 - DNA, 25 bp, Mus musculus
aattgcagcaggcacgttacagcag

SEQ ID NO: 88683 - DNA, 25 bp, Mus musculus
aattgcagcagggacgttacagcag

SEQ ID NO: 88684 - DNA, 25 bp, Mus musculus
aattgcagcaggtttattgtctagc

SEQ ID NO: 88685 - DNA, 25 bp, Mus musculus
aattgcagcagtaacctggtgccaa

SEQ ID NO: 88686 - DNA, 25 bp, Mus musculus
aattgcagcagttacctggtgccaa

SEQ ID NO: 88687 - DNA, 25 bp, Mus musculus
aattgcagcccaaattctgtctgaa

SEQ ID NO: 88688 - DNA, 25 bp, Mus musculus
aattgcagcccatattctgtctgaa

SEQ ID NO: 88689 - DNA, 25 bp, Mus musculus
aattgcaggctcctaaattgacttt

SEQ ID NO: 88690 - DNA, 25 bp, Mus musculus
aattgcaggctcgtaaattgacttt

SEQ ID NO: 88691 - DNA, 25 bp, Mus musculus
aattgcaggctgagagtaatctcat

SEQ ID NO: 88692 - DNA, 25 bp, Mus musculus
aattgcaggctgtgagtaatctcat

SEQ ID NO: 88693 - DNA, 25 bp, Mus musculus
aattgcagtcttacttagaagcctg

SEQ ID NO: 88694 - DNA, 25 bp, Mus musculus
aattgcagtctttcttagaagcctg

SEQ ID NO: 88695 - DNA, 25 bp, Mus musculus
aattgcagtgacatgtagtggacta

SEQ ID NO: 88696 - DNA, 25 bp, Mus musculus
aattgcagtgacttgtagtggacta

SEQ ID NO: 88697 - DNA, 25 bp, Mus musculus
aattgcagtgcgcaagactccttct

SEQ ID NO: 88698 - DNA, 25 bp, Mus musculus
aattgcagtgcggaagactccttct

SEQ ID NO: 88699 - DNA, 25 bp, Mus musculus
aattgcagtgtacagagtcgtgttt

SEQ ID NO: 88700 - DNA, 25 bp, Mus musculus
aattgcagtgtagagagtcgtgttt

SEQ ID NO: 88701 - DNA, 25 bp, Mus musculus
aattgcagttccaacggcatctctg

SEQ ID NO: 88702 - DNA, 25 bp, Mus musculus
aattgcagttcctacggcatctctg

SEQ ID NO: 88703 - DNA, 25 bp, Mus musculus
aattgcagttgcagctgacagacaa

SEQ ID NO: 88704 - DNA, 25 bp, Mus musculus
aattgcagttgctgctgacagacaa

SEQ ID NO: 88705 - DNA, 25 bp, Mus musculus
aattgcatacatactgtttttgaaa

SEQ ID NO: 88706 - DNA, 25 bp, Mus musculus
aattgcatacattctgtttttgaaa

SEQ ID NO: 88707 - DNA, 25 bp, Mus musculus
aattgcatccaacgcaggcagcatt

SEQ ID NO: 88708 - DNA, 25 bp, Mus musculus
aattgcatccaaggcaggcagcatt

SEQ ID NO: 88709 - DNA, 25 bp, Mus musculus
aattgcatccagacacactactgtg

SEQ ID NO: 88710 - DNA, 25 bp, Mus musculus
aattgcatccagtcacactactgtg

SEQ ID NO: 88711 - DNA, 25 bp, Mus musculus
aattgcatccatctctctaaaccat

SEQ ID NO: 88712 - DNA, 25 bp, Mus musculus
aattgcatccatgtctctaaaccat

SEQ ID NO: 88713 - DNA, 25 bp, Mus musculus
aattgcatcccaatggtgacttggt

SEQ ID NO: 88714 - DNA, 25 bp, Mus musculus
aattgcatcccattggtgacttggt

SEQ ID NO: 88715 - DNA, 25 bp, Mus musculus
aattgcatcttaacaacgatctttt

SEQ ID NO: 88716 - DNA, 25 bp, Mus musculus
aattgcatcttatcaacgatctttt

SEQ ID NO: 88717 - DNA, 25 bp, Mus musculus
aattgcatgctaacttcactcacaa

SEQ ID NO: 88718 - DNA, 25 bp, Mus musculus
aattgcatgctatcttcactcacaa

SEQ ID NO: 88719 - DNA, 25 bp, Mus musculus
aattgcatgtttcgacagggtccca

SEQ ID NO: 88720 - DNA, 25 bp, Mus musculus
aattgcatgtttggacagggtccca

SEQ ID NO: 88721 - DNA, 25 bp, Mus musculus
aattgcattgaaacttcaacagcta

SEQ ID NO: 88722 - DNA, 25 bp, Mus musculus
aattgcattgaatcttcaacagcta

SEQ ID NO: 88723 - DNA, 25 bp, Mus musculus
aattgcattgtgagaactgtgtaac

SEQ ID NO: 88724 - DNA, 25 bp, Mus musculus
aattgcattgtgtgaactgtgtaac

SEQ ID NO: 88725 - DNA, 25 bp, Mus musculus
aattgccaaagacccatcatggatc

SEQ ID NO: 88726 - DNA, 25 bp, Mus musculus
aattgccaaagagccatcatggatc

SEQ ID NO: 88727 - DNA, 25 bp, Mus musculus
aattgccaactgcagatctcgggac

SEQ ID NO: 88728 - DNA, 25 bp, Mus musculus
aattgccaactggagatctcgggac

SEQ ID NO: 88729 - DNA, 25 bp, Mus musculus
aattgccaagtaaaggagacactga

SEQ ID NO: 88730 - DNA, 25 bp, Mus musculus
aattgccaagtataggagacactga

SEQ ID NO: 88731 - DNA, 25 bp, Mus musculus
aattgccaagtgagagccagcgtgc

SEQ ID NO: 88732 - DNA, 25 bp, Mus musculus
aattgccaagtgtgagccagcgtgc

SEQ ID NO: 88733 - DNA, 25 bp, Mus musculus
aattgccaatatcttatgtctcagc

SEQ ID NO: 88734 - DNA, 25 bp, Mus musculus
aattgccaatatgttatgtctcagc

SEQ ID NO: 88735 - DNA, 25 bp, Mus musculus
aattgccaatggaggtggagttgca

SEQ ID NO: 88736 - DNA, 25 bp, Mus musculus
aattgccaatggtggtggagttgca

SEQ ID NO: 88737 - DNA, 25 bp, Mus musculus
aattgccacaacaggacccaatggt

SEQ ID NO: 88738 - DNA, 25 bp, Mus musculus
aattgccacaactggacccaatggt

SEQ ID NO: 88739 - DNA, 25 bp, Mus musculus
aattgccagagaaactcgacagcct

SEQ ID NO: 88740 - DNA, 25 bp, Mus musculus
aattgccagagatactcgacagcct

SEQ ID NO: 88741 - DNA, 25 bp, Mus musculus
aattgccagatgctgtaaagcctac

SEQ ID NO: 88742 - DNA, 25 bp, Mus musculus
aattgccagatggtgtaaagcctac

SEQ ID NO: 88743 - DNA, 25 bp, Mus musculus
aattgccaggatactactgaggaat

SEQ ID NO: 88744 - DNA, 25 bp, Mus musculus
aattgccaggattctactgaggaat

SEQ ID NO: 88745 - DNA, 25 bp, Mus musculus
aattgccaggtgcacctcgccttga

SEQ ID NO: 88746 - DNA, 25 bp, Mus musculus
aattgccaggtggacctcgccttga

SEQ ID NO: 88747 - DNA, 25 bp, Mus musculus
aattgccagtaaatttcttgcactt

SEQ ID NO: 88748 - DNA, 25 bp, Mus musculus
aattgccagtaattttcttgcactt

SEQ ID NO: 88749 - DNA, 25 bp, Mus musculus
aattgccatctaacaggtaccttaa

SEQ ID NO: 88750 - DNA, 25 bp, Mus musculus
aattgccatctatcaggtaccttaa

SEQ ID NO: 88751 - DNA, 25 bp, Mus musculus
aattgccatgacattgagtctcaga

SEQ ID NO: 88752 - DNA, 25 bp, Mus musculus
aattgccatgactttgagtctcaga

SEQ ID NO: 88753 - DNA, 25 bp, Mus musculus
aattgccatggtatctttatgttaa

SEQ ID NO: 88754 - DNA, 25 bp, Mus musculus
aattgccatggtttctttatgttaa

SEQ ID NO: 88755 - DNA, 25 bp, Mus musculus
aattgccattagaatacgagccatt

SEQ ID NO: 88756 - DNA, 25 bp, Mus musculus
aattgccattagtatacgagccatt

SEQ ID NO: 88757 - DNA, 25 bp, Mus musculus
aattgccatttgactctatgtggac

SEQ ID NO: 88758 - DNA, 25 bp, Mus musculus
aattgccatttgtctctatgtggac

SEQ ID NO: 88759 - DNA, 25 bp, Mus musculus
aattgccccacaatcaagttttgga

SEQ ID NO: 88760 - DNA, 25 bp, Mus musculus
aattgccccacattcaagttttgga

SEQ ID NO: 88761 - DNA, 25 bp, Mus musculus
aattgccccatcaagcgaggattat

SEQ ID NO: 88762 - DNA, 25 bp, Mus musculus
aattgccccatctagcgaggattat

SEQ ID NO: 88763 - DNA, 25 bp, Mus musculus
aattgccccttccatatgatttaca

SEQ ID NO: 88764 - DNA, 25 bp, Mus musculus
aattgccccttcgatatgatttaca

SEQ ID NO: 88765 - DNA, 25 bp, Mus musculus
aattgcccggagctgagtgtgctca

SEQ ID NO: 88766 - DNA, 25 bp, Mus musculus
aattgcccggaggtgagtgtgctca

SEQ ID NO: 88767 - DNA, 25 bp, Mus musculus
aattgccctgacaagaatcctggac

SEQ ID NO: 88768 - DNA, 25 bp, Mus musculus
aattgccctgactagaatcctggac

SEQ ID NO: 88769 - DNA, 25 bp, Mus musculus
aattgcccttagactttatttccag

SEQ ID NO: 88770 - DNA, 25 bp, Mus musculus
aattgcccttagtctttatttccag

SEQ ID NO: 88771 - DNA, 25 bp, Mus musculus
aattgcccttgaaagctgcaggttc

SEQ ID NO: 88772 - DNA, 25 bp, Mus musculus
aattgcccttgatagctgcaggttc

SEQ ID NO: 88773 - DNA, 25 bp, Mus musculus
aattgccgcctgattgttacgatgc

SEQ ID NO: 88774 - DNA, 25 bp, Mus musculus
aattgccgcctgtttgttacgatgc

SEQ ID NO: 88775 - DNA, 25 bp, Mus musculus
aattgccggcaccattttagtgctg

SEQ ID NO: 88776 - DNA, 25 bp, Mus musculus
aattgccggcacgattttagtgctg

SEQ ID NO: 88777 - DNA, 25 bp, Mus musculus
aattgccgtgctatcattgtacata

SEQ ID NO: 88778 - DNA, 25 bp, Mus musculus
aattgccgtgctttcattgtacata

SEQ ID NO: 88779 - DNA, 25 bp, Mus musculus
aattgcctaatcctcatcattcata

SEQ ID NO: 88780 - DNA, 25 bp, Mus musculus
aattgcctaatcgtcatcattcata

SEQ ID NO: 88781 - DNA, 25 bp, Mus musculus
aattgcctagtaagttgatttgttg

SEQ ID NO: 88782 - DNA, 25 bp, Mus musculus
aattgcctagtatgttgatttgttg

SEQ ID NO: 88783 - DNA, 25 bp, Mus musculus
aattgcctcattatggaaaattgtg

SEQ ID NO: 88784 - DNA, 25 bp, Mus musculus
aattgcctcattttggaaaattgtg

SEQ ID NO: 88785 - DNA, 25 bp, Mus musculus
aattgcctcccacaggctttcggga

SEQ ID NO: 88786 - DNA, 25 bp, Mus musculus
aattgcctcccagaggctttcggga

SEQ ID NO: 88787 - DNA, 25 bp, Mus musculus
aattgcctccccatgactaatcaac

SEQ ID NO: 88788 - DNA, 25 bp, Mus musculus
aattgcctccccttgactaatcaac

SEQ ID NO: 88789 - DNA, 25 bp, Mus musculus
aattgcctcctcaccagcatagatg

SEQ ID NO: 88790 - DNA, 25 bp, Mus musculus
aattgcctcctctccagcatagatg

SEQ ID NO: 88791 - DNA, 25 bp, Mus musculus
aattgcctcttcagactataacctc

SEQ ID NO: 88792 - DNA, 25 bp, Mus musculus
aattgcctcttctgactataacctc

SEQ ID NO: 88793 - DNA, 25 bp, Mus musculus
aattgcctgagactcacacctctgg

SEQ ID NO: 88794 - DNA, 25 bp, Mus musculus
aattgcctgagagtcacacctctgg

SEQ ID NO: 88795 - DNA, 25 bp, Mus musculus
aattgcctgcatatggcatcaaccc

SEQ ID NO: 88796 - DNA, 25 bp, Mus musculus
aattgcctgcatttggcatcaaccc

SEQ ID NO: 88797 - DNA, 25 bp, Mus musculus
aattgcctgcttcctaggaccttgg

SEQ ID NO: 88798 - DNA, 25 bp, Mus musculus
aattgcctgcttgctaggaccttgg

SEQ ID NO: 88799 - DNA, 25 bp, Mus musculus
aattgcctggatcatcacgctttgt

SEQ ID NO: 88800 - DNA, 25 bp, Mus musculus
aattgcctggatgatcacgctttgt

SEQ ID NO: 88801 - DNA, 25 bp, Mus musculus
aattgcctgtaaattctagcattca

SEQ ID NO: 88802 - DNA, 25 bp, Mus musculus
aattgcctgtaatttctagcattca

SEQ ID NO: 88803 - DNA, 25 bp, Mus musculus
aattgccttacgcacactttcacag

SEQ ID NO: 88804 - DNA, 25 bp, Mus musculus
aattgccttacggacactttcacag

SEQ ID NO: 88805 - DNA, 25 bp, Mus musculus
aattgccttactcgctggctgacgg

SEQ ID NO: 88806 - DNA, 25 bp, Mus musculus
aattgccttactggctggctgacgg

SEQ ID NO: 88807 - DNA, 25 bp, Mus musculus
aattgccttaggcttagacagactg

SEQ ID NO: 88808 - DNA, 25 bp, Mus musculus
aattgccttagggttagacagactg

SEQ ID NO: 88809 - DNA, 25 bp, Mus musculus
aattgccttatcatgaactcgtttt

SEQ ID NO: 88810 - DNA, 25 bp, Mus musculus
aattgccttatcttgaactcgtttt

SEQ ID NO: 88811 - DNA, 25 bp, Mus musculus
aattgccttatgacaccatgggttc

SEQ ID NO: 88812 - DNA, 25 bp, Mus musculus
aattgccttatgtcaccatgggttc

SEQ ID NO: 88813 - DNA, 25 bp, Mus musculus
aattgccttggaccgaggtgcagct

SEQ ID NO: 88814 - DNA, 25 bp, Mus musculus
aattgccttggagcgaggtgcagct

SEQ ID NO: 88815 - DNA, 25 bp, Mus musculus
aattgcctttttccgataagtgccc

SEQ ID NO: 88816 - DNA, 25 bp, Mus musculus
aattgcctttttgcgataagtgccc

SEQ ID NO: 88817 - DNA, 25 bp, Mus musculus
aattgcgaatgcctatcgaggccct

SEQ ID NO: 88818 - DNA, 25 bp, Mus musculus
aattgcgaatgcgtatcgaggccct

SEQ ID NO: 88819 - DNA, 25 bp, Mus musculus
aattgcgactctagacactggagga

SEQ ID NO: 88820 - DNA, 25 bp, Mus musculus
aattgcgactcttgacactggagga

SEQ ID NO: 88821 - DNA, 25 bp, Mus musculus
aattgcgaggacagagcgtcgccga

SEQ ID NO: 88822 - DNA, 25 bp, Mus musculus
aattgcgaggactgagcgtcgccga

SEQ ID NO: 88823 - DNA, 25 bp, Mus musculus
aattgcgccctgaaagactggctga

SEQ ID NO: 88824 - DNA, 25 bp, Mus musculus
aattgcgccctgtaagactggctga

SEQ ID NO: 88825 - DNA, 25 bp, Mus musculus
aattgcgccttcagagcacacataa

SEQ ID NO: 88826 - DNA, 25 bp, Mus musculus
aattgcgccttctgagcacacataa

SEQ ID NO: 88827 - DNA, 25 bp, Mus musculus
aattgcgcggtgattgtttgccagg

SEQ ID NO: 88828 - DNA, 25 bp, Mus musculus
aattgcgcggtgtttgtttgccagg

SEQ ID NO: 88829 - DNA, 25 bp, Mus musculus
aattgcgctataacctgattgatga

SEQ ID NO: 88830 - DNA, 25 bp, Mus musculus
aattgcgctatatcctgattgatga

SEQ ID NO: 88831 - DNA, 25 bp, Mus musculus
aattgcggagctcacagggcacacg

SEQ ID NO: 88832 - DNA, 25 bp, Mus musculus
aattgcggagctctttattcattta

SEQ ID NO: 88833 - DNA, 25 bp, Mus musculus
aattgcggagctgacagggcacacg

SEQ ID NO: 88834 - DNA, 25 bp, Mus musculus
aattgcggagctgtttattcattta

SEQ ID NO: 88835 - DNA, 25 bp, Mus musculus
aattgcggatatacacttttggcac

SEQ ID NO: 88836 - DNA, 25 bp, Mus musculus
aattgcggatattcacttttggcac

SEQ ID NO: 88837 - DNA, 25 bp, Mus musculus
aattgcgtatttcacatgccattag

SEQ ID NO: 88838 - DNA, 25 bp, Mus musculus
aattgcgtatttgacatgccattag

SEQ ID NO: 88839 - DNA, 25 bp, Mus musculus
aattgctaatggagccaaggccaag

SEQ ID NO: 88840 - DNA, 25 bp, Mus musculus
aattgctaatggtgccaaggccaag

SEQ ID NO: 88841 - DNA, 25 bp, Mus musculus
aattgctacagccactaggttggat

SEQ ID NO: 88842 - DNA, 25 bp, Mus musculus
aattgctacagcgactaggttggat

SEQ ID NO: 88843 - DNA, 25 bp, Mus musculus
aattgctacaggcaggtacatactt

SEQ ID NO: 88844 - DNA, 25 bp, Mus musculus
aattgctacagggaggtacatactt

SEQ ID NO: 88845 - DNA, 25 bp, Mus musculus
aattgctaccatcactgcagaccta

SEQ ID NO: 88846 - DNA, 25 bp, Mus musculus
aattgctaccatgactgcagaccta

SEQ ID NO: 88847 - DNA, 25 bp, Mus musculus
aattgctagcatagaactgtattat

SEQ ID NO: 88848 - DNA, 25 bp, Mus musculus
aattgctagcattgaactgtattat

SEQ ID NO: 88849 - DNA, 25 bp, Mus musculus
aattgctagcgtcgacttctcagat

SEQ ID NO: 88850 - DNA, 25 bp, Mus musculus
aattgctagcgtggacttctcagat

SEQ ID NO: 88851 - DNA, 25 bp, Mus musculus
aattgctaggcaaccaggcttaaca

SEQ ID NO: 88852 - DNA, 25 bp, Mus musculus
aattgctaggcatccaggcttaaca

SEQ ID NO: 88853 - DNA, 25 bp, Mus musculus
aattgctagtctcactgagtcccca

SEQ ID NO: 88854 - DNA, 25 bp, Mus musculus
aattgctagtctgactgagtcccca

SEQ ID NO: 88855 - DNA, 25 bp, Mus musculus
aattgctagtgcaagcaggtgctga

SEQ ID NO: 88856 - DNA, 25 bp, Mus musculus
aattgctagtgctagcaggtgctga

SEQ ID NO: 88857 - DNA, 25 bp, Mus musculus
aattgctagttcagcttcctttgat

SEQ ID NO: 88858 - DNA, 25 bp, Mus musculus
aattgctagttctgcttcctttgat

SEQ ID NO: 88859 - DNA, 25 bp, Mus musculus
aattgctatctgatctttgtccgga

SEQ ID NO: 88860 - DNA, 25 bp, Mus musculus
aattgctatctgttctttgtccgga

SEQ ID NO: 88861 - DNA, 25 bp, Mus musculus
aattgctatgcacaggtttcctttg

SEQ ID NO: 88862 - DNA, 25 bp, Mus musculus
aattgctatgcagaggtttcctttg

SEQ ID NO: 88863 - DNA, 25 bp, Mus musculus
aattgctatgctaccgtatcttcat

SEQ ID NO: 88864 - DNA, 25 bp, Mus musculus
aattgctatgcttccgtatcttcat

SEQ ID NO: 88865 - DNA, 25 bp, Mus musculus
aattgctatggaaactcactgaata

SEQ ID NO: 88866 - DNA, 25 bp, Mus musculus
aattgctatggatactcactgaata

SEQ ID NO: 88867 - DNA, 25 bp, Mus musculus
aattgctattacagcagtgctctgt

SEQ ID NO: 88868 - DNA, 25 bp, Mus musculus
aattgctattactgcagtgctctgt

SEQ ID NO: 88869 - DNA, 25 bp, Mus musculus
aattgctattatcactaagttgtaa

SEQ ID NO: 88870 - DNA, 25 bp, Mus musculus
aattgctattatgactaagttgtaa

SEQ ID NO: 88871 - DNA, 25 bp, Mus musculus
aattgctatttaactgtgtctactg

SEQ ID NO: 88872 - DNA, 25 bp, Mus musculus
aattgctatttatctgtgtctactg

SEQ ID NO: 88873 - DNA, 25 bp, Mus musculus
aattgctatttccagactttacctt

SEQ ID NO: 88874 - DNA, 25 bp, Mus musculus
aattgctatttcgagactttacctt

SEQ ID NO: 88875 - DNA, 25 bp, Mus musculus
aattgctatttgaaactcccttaat

SEQ ID NO: 88876 - DNA, 25 bp, Mus musculus
aattgctatttgtaactcccttaat

SEQ ID NO: 88877 - DNA, 25 bp, Mus musculus
aattgctattttcagcacccagccc

SEQ ID NO: 88878 - DNA, 25 bp, Mus musculus
aattgctattttgagcacccagccc

SEQ ID NO: 88879 - DNA, 25 bp, Mus musculus
aattgctcagccctatagtacagta

SEQ ID NO: 88880 - DNA, 25 bp, Mus musculus
aattgctcagccgtatagtacagta

SEQ ID NO: 88881 - DNA, 25 bp, Mus musculus
aattgctcaggcacctatgaatcct

SEQ ID NO: 88882 - DNA, 25 bp, Mus musculus
aattgctcaggctcctatgaatcct

SEQ ID NO: 88883 - DNA, 25 bp, Mus musculus
aattgctccaggattgtttgccacc

SEQ ID NO: 88884 - DNA, 25 bp, Mus musculus
aattgctccaggtttgtttgccacc

SEQ ID NO: 88885 - DNA, 25 bp, Mus musculus
aattgctcccacaatttcttgtatt

SEQ ID NO: 88886 - DNA, 25 bp, Mus musculus
aattgctcccactatttcttgtatt

SEQ ID NO: 88887 - DNA, 25 bp, Mus musculus
aattgctccgaccacgagtagttaa

SEQ ID NO: 88888 - DNA, 25 bp, Mus musculus
aattgctccgacgacgagtagttaa

SEQ ID NO: 88889 - DNA, 25 bp, Mus musculus
aattgctcctaactactgtgccatc

SEQ ID NO: 88890 - DNA, 25 bp, Mus musculus
aattgctcctaagtactgtgccatc

SEQ ID NO: 88891 - DNA, 25 bp, Mus musculus
aattgctcctgtatttctgtgttcc

SEQ ID NO: 88892 - DNA, 25 bp, Mus musculus
aattgctcctgtttttctgtgttcc

SEQ ID NO: 88893 - DNA, 25 bp, Mus musculus
aattgctctcccattgtgccaataa

SEQ ID NO: 88894 - DNA, 25 bp, Mus musculus
aattgctctccctttgtgccaataa

SEQ ID NO: 88895 - DNA, 25 bp, Mus musculus
aattgctctgtaattgcaagtgact

SEQ ID NO: 88896 - DNA, 25 bp, Mus musculus
aattgctctgtatttgcaagtgact

SEQ ID NO: 88897 - DNA, 25 bp, Mus musculus
aattgctctgtccttacaaagacca

SEQ ID NO: 88898 - DNA, 25 bp, Mus musculus
aattgctctgtcgttacaaagacca

SEQ ID NO: 88899 - DNA, 25 bp, Mus musculus
aattgctcttcaactagggtataga

SEQ ID NO: 88900 - DNA, 25 bp, Mus musculus
aattgctcttcatctagggtataga

SEQ ID NO: 88901 - DNA, 25 bp, Mus musculus
aattgctgaataccacatctctatg

SEQ ID NO: 88902 - DNA, 25 bp, Mus musculus
aattgctgaatagcacatctctatg

SEQ ID NO: 88903 - DNA, 25 bp, Mus musculus
aattgctgaatgctacatccaacat

SEQ ID NO: 88904 - DNA, 25 bp, Mus musculus
aattgctgaatggtacatccaacat

SEQ ID NO: 88905 - DNA, 25 bp, Mus musculus
aattgctgacaactagagaacccta

SEQ ID NO: 88906 - DNA, 25 bp, Mus musculus
aattgctgacaagtagagaacccta

SEQ ID NO: 88907 - DNA, 25 bp, Mus musculus
aattgctgagatctttagtagctga

SEQ ID NO: 88908 - DNA, 25 bp, Mus musculus
aattgctgagatgtttagtagctga

SEQ ID NO: 88909 - DNA, 25 bp, Mus musculus
aattgctgagccacttctacagttt

SEQ ID NO: 88910 - DNA, 25 bp, Mus musculus
aattgctgagcctcttctacagttt

SEQ ID NO: 88911 - DNA, 25 bp, Mus musculus
aattgctgatccatttgaggctctc

SEQ ID NO: 88912 - DNA, 25 bp, Mus musculus
aattgctgatccttttgaggctctc

SEQ ID NO: 88913 - DNA, 25 bp, Mus musculus
aattgctgcaagaagccgtgtgatc

SEQ ID NO: 88914 - DNA, 25 bp, Mus musculus
aattgctgcaagtagccgtgtgatc

SEQ ID NO: 88915 - DNA, 25 bp, Mus musculus
aattgctggagcatttaggccatta

SEQ ID NO: 88916 - DNA, 25 bp, Mus musculus
aattgctggagcttttaggccatta

SEQ ID NO: 88917 - DNA, 25 bp, Mus musculus
aattgctggcatagtatttctggta

SEQ ID NO: 88918 - DNA, 25 bp, Mus musculus
aattgctggcattgtatttctggta

SEQ ID NO: 88919 - DNA, 25 bp, Mus musculus
aattgctggcttaaatcgccttcgg

SEQ ID NO: 88920 - DNA, 25 bp, Mus musculus
aattgctggctttaatcgccttcgg

SEQ ID NO: 88921 - DNA, 25 bp, Mus musculus
aattgctgggaacagtattccgaga

SEQ ID NO: 88922 - DNA, 25 bp, Mus musculus
aattgctgggaagagtattccgaga

SEQ ID NO: 88923 - DNA, 25 bp, Mus musculus
aattgctgggttcaggactcactca

SEQ ID NO: 88924 - DNA, 25 bp, Mus musculus
aattgctgggttgaggactcactca

SEQ ID NO: 88925 - DNA, 25 bp, Mus musculus
aattgctggtcacaaatacctccct

SEQ ID NO: 88926 - DNA, 25 bp, Mus musculus
aattgctggtcagaaatacctccct

SEQ ID NO: 88927 - DNA, 25 bp, Mus musculus
aattgctgtcttcaggtttgtttac

SEQ ID NO: 88928 - DNA, 25 bp, Mus musculus
aattgctgtcttgaggtttgtttac

SEQ ID NO: 88929 - DNA, 25 bp, Mus musculus
aattgctgtgaacttacccacttct

SEQ ID NO: 88930 - DNA, 25 bp, Mus musculus
aattgctgtgaagttacccacttct

SEQ ID NO: 88931 - DNA, 25 bp, Mus musculus
aattgctgtgccatgtcacaagaaa

SEQ ID NO: 88932 - DNA, 25 bp, Mus musculus
aattgctgtgccttgtcacaagaaa

SEQ ID NO: 88933 - DNA, 25 bp, Mus musculus
aattgctgtggcaggcttgactagc

SEQ ID NO: 88934 - DNA, 25 bp, Mus musculus
aattgctgtggctggcttgactagc

SEQ ID NO: 88935 - DNA, 25 bp, Mus musculus
aattgctgtggtaggttgcattaca

SEQ ID NO: 88936 - DNA, 25 bp, Mus musculus
aattgctgtggttggttgcattaca

SEQ ID NO: 88937 - DNA, 25 bp, Mus musculus
aattgcttatataagattggcctgt

SEQ ID NO: 88938 - DNA, 25 bp, Mus musculus
aattgcttatattagattggcctgt

SEQ ID NO: 88939 - DNA, 25 bp, Mus musculus
aattgcttcaagcagctgtgtgctc

SEQ ID NO: 88940 - DNA, 25 bp, Mus musculus
aattgcttcaagctgttgccaagta

SEQ ID NO: 88941 - DNA, 25 bp, Mus musculus
aattgcttcaaggagctgtgtgctc

SEQ ID NO: 88942 - DNA, 25 bp, Mus musculus
aattgcttcaaggtgttgccaagta

SEQ ID NO: 88943 - DNA, 25 bp, Mus musculus
aattgcttcagcacctgcttctgtc

SEQ ID NO: 88944 - DNA, 25 bp, Mus musculus
aattgcttcagctcctgcttctgtc

SEQ ID NO: 88945 - DNA, 25 bp, Mus musculus
aattgcttccaaactggcgattcac

SEQ ID NO: 88946 - DNA, 25 bp, Mus musculus
aattgcttccaatctggcgattcac

SEQ ID NO: 88947 - DNA, 25 bp, Mus musculus
aattgcttccatcagactggccata

SEQ ID NO: 88948 - DNA, 25 bp, Mus musculus
aattgcttccatgagactggccata

SEQ ID NO: 88949 - DNA, 25 bp, Mus musculus
aattgcttcctgatgccagtctggc

SEQ ID NO: 88950 - DNA, 25 bp, Mus musculus
aattgcttcctgttgccagtctggc

SEQ ID NO: 88951 - DNA, 25 bp, Mus musculus
aattgcttcgtaacgtgtgagacag

SEQ ID NO: 88952 - DNA, 25 bp, Mus musculus
aattgcttcgtatcgtgtgagacag

SEQ ID NO: 88953 - DNA, 25 bp, Mus musculus
aattgcttctatagcggttctactc

SEQ ID NO: 88954 - DNA, 25 bp, Mus musculus
aattgcttctattgcggttctactc

SEQ ID NO: 88955 - DNA, 25 bp, Mus musculus
aattgcttctccattatcatctttt

SEQ ID NO: 88956 - DNA, 25 bp, Mus musculus
aattgcttctcctttatcatctttt

SEQ ID NO: 88957 - DNA, 25 bp, Mus musculus
aattgcttcttgattttctgtgggc

SEQ ID NO: 88958 - DNA, 25 bp, Mus musculus
aattgcttcttgtttttctgtgggc

SEQ ID NO: 88959 - DNA, 25 bp, Mus musculus
aattgcttgaaacgactggtgggaa

SEQ ID NO: 88960 - DNA, 25 bp, Mus musculus
aattgcttgaaaggactggtgggaa

SEQ ID NO: 88961 - DNA, 25 bp, Mus musculus
aattgcttggacactgacttttcaa

SEQ ID NO: 88962 - DNA, 25 bp, Mus musculus
aattgcttggactctgacttttcaa

SEQ ID NO: 88963 - DNA, 25 bp, Mus musculus
aattgcttgggcacacatgtaaaga

SEQ ID NO: 88964 - DNA, 25 bp, Mus musculus
aattgcttgggctcacatgtaaaga

SEQ ID NO: 88965 - DNA, 25 bp, Mus musculus
aattgctttaatcgctttgaattgt

SEQ ID NO: 88966 - DNA, 25 bp, Mus musculus
aattgctttaatggctttgaattgt

SEQ ID NO: 88967 - DNA, 25 bp, Mus musculus
aattgctttggccatctcagctaca

SEQ ID NO: 88968 - DNA, 25 bp, Mus musculus
aattgctttggcgatctcagctaca

SEQ ID NO: 88969 - DNA, 25 bp, Mus musculus
aattgctttggtatgccttaaatag

SEQ ID NO: 88970 - DNA, 25 bp, Mus musculus
aattgctttggtttgccttaaatag

SEQ ID NO: 88971 - DNA, 25 bp, Mus musculus
aattgcttttatcgtataaggctac

SEQ ID NO: 88972 - DNA, 25 bp, Mus musculus
aattgcttttatggtataaggctac

SEQ ID NO: 88973 - DNA, 25 bp, Mus musculus
aattgcttttgcatccaagagagag

SEQ ID NO: 88974 - DNA, 25 bp, Mus musculus
aattgcttttgcttccaagagagag

SEQ ID NO: 88975 - DNA, 25 bp, Mus musculus
aattggaaacctcgcttcgtgggct

SEQ ID NO: 88976 - DNA, 25 bp, Mus musculus
aattggaaacctggcttcgtgggct

SEQ ID NO: 88977 - DNA, 25 bp, Mus musculus
aattggaaatagagcgactggagaa

SEQ ID NO: 88978 - DNA, 25 bp, Mus musculus
aattggaaatagtgcgactggagaa

SEQ ID NO: 88979 - DNA, 25 bp, Mus musculus
aattggaacagcctcccctgaaagc

SEQ ID NO: 88980 - DNA, 25 bp, Mus musculus
aattggaacagcgtcccctgaaagc

SEQ ID NO: 88981 - DNA, 25 bp, Mus musculus
aattggaacagtcctccgtgggccg

SEQ ID NO: 88982 - DNA, 25 bp, Mus musculus
aattggaacagtgctccgtgggccg

SEQ ID NO: 88983 - DNA, 25 bp, Mus musculus
aattggaagccccagtgttggtgtc

SEQ ID NO: 88984 - DNA, 25 bp, Mus musculus
aattggaagcccgagtgttggtgtc

SEQ ID NO: 88985 - DNA, 25 bp, Mus musculus
aattggaagcctccgtgagaccctg

SEQ ID NO: 88986 - DNA, 25 bp, Mus musculus
aattggaagcctgcgtgagaccctg

SEQ ID NO: 88987 - DNA, 25 bp, Mus musculus
aattggaatctcagctacatctacc

SEQ ID NO: 88988 - DNA, 25 bp, Mus musculus
aattggaatctctgctacatctacc

SEQ ID NO: 88989 - DNA, 25 bp, Mus musculus
aattggaatcttacttgcctactgc

SEQ ID NO: 88990 - DNA, 25 bp, Mus musculus
aattggaatctttcttgcctactgc

SEQ ID NO: 88991 - DNA, 25 bp, Mus musculus
aattggaattccacccgagcttgag

SEQ ID NO: 88992 - DNA, 25 bp, Mus musculus
aattggaattcctcccgagcttgag

SEQ ID NO: 88993 - DNA, 25 bp, Mus musculus
aattggaattctctttctgggtctt

SEQ ID NO: 88994 - DNA, 25 bp, Mus musculus
aattggaattctgtttctgggtctt

SEQ ID NO: 88995 - DNA, 25 bp, Mus musculus
aattggacatggatgacattctagt

SEQ ID NO: 88996 - DNA, 25 bp, Mus musculus
aattggacatggttgacattctagt

SEQ ID NO: 88997 - DNA, 25 bp, Mus musculus
aattggaccaaccagaggacccagt

SEQ ID NO: 88998 - DNA, 25 bp, Mus musculus
aattggaccaacgagaggacccagt

SEQ ID NO: 88999 - DNA, 25 bp, Mus musculus
aattggaccaggctttggtgtgcaa

SEQ ID NO: 89000 - DNA, 25 bp, Mus musculus
aattggaccagggtttggtgtgcaa

SEQ ID NO: 89001 - DNA, 25 bp, Mus musculus
aattggaccattcctgctgtgtctg

SEQ ID NO: 89002 - DNA, 25 bp, Mus musculus
aattggaccattgctgctgtgtctg

SEQ ID NO: 89003 - DNA, 25 bp, Mus musculus
aattggaccgacacagtggcttatt

SEQ ID NO: 89004 - DNA, 25 bp, Mus musculus
aattggaccgactcagtggcttatt

SEQ ID NO: 89005 - DNA, 25 bp, Mus musculus
aattggactattaagtgtggccttg

SEQ ID NO: 89006 - DNA, 25 bp, Mus musculus
aattggactatttagtgtggccttg

SEQ ID NO: 89007 - DNA, 25 bp, Mus musculus
aattggactccgaggcctagagaaa

SEQ ID NO: 89008 - DNA, 25 bp, Mus musculus
aattggactccgtggcctagagaaa

SEQ ID NO: 89009 - DNA, 25 bp, Mus musculus
aattggactgcacaaccacttcctg

SEQ ID NO: 89010 - DNA, 25 bp, Mus musculus
aattggactgcagaaccacttcctg

SEQ ID NO: 89011 - DNA, 25 bp, Mus musculus
aattggagcgatcttggcctacacg

SEQ ID NO: 89012 - DNA, 25 bp, Mus musculus
aattggagcgatgttggcctacacg

SEQ ID NO: 89013 - DNA, 25 bp, Mus musculus
aattggaggtgtacttctgagttag

SEQ ID NO: 89014 - DNA, 25 bp, Mus musculus
aattggaggtgttcttctgagttag

SEQ ID NO: 89015 - DNA, 25 bp, Mus musculus
aattggatatgtctaccgactccct

SEQ ID NO: 89016 - DNA, 25 bp, Mus musculus
aattggatatgtctcccgaaagccc

SEQ ID NO: 89017 - DNA, 25 bp, Mus musculus
aattggatatgtgtaccgactccct

SEQ ID NO: 89018 - DNA, 25 bp, Mus musculus
aattggatatgtgtcccgaaagccc

SEQ ID NO: 89019 - DNA, 25 bp, Mus musculus
aattggatccagatccaagacaact

SEQ ID NO: 89020 - DNA, 25 bp, Mus musculus
aattggatccagttccaagacaact

SEQ ID NO: 89021 - DNA, 25 bp, Mus musculus
aattggatcccaaagatctgtgtat

SEQ ID NO: 89022 - DNA, 25 bp, Mus musculus
aattggatcccaactctctgatatt

SEQ ID NO: 89023 - DNA, 25 bp, Mus musculus
aattggatcccatagatctgtgtat

SEQ ID NO: 89024 - DNA, 25 bp, Mus musculus
aattggatcccatctctctgatatt

SEQ ID NO: 89025 - DNA, 25 bp, Mus musculus
aattggatccccctcagaaggaacg

SEQ ID NO: 89026 - DNA, 25 bp, Mus musculus
aattggatccccgtcagaaggaacg

SEQ ID NO: 89027 - DNA, 25 bp, Mus musculus
aattggatgcctaggtgcagtgtaa

SEQ ID NO: 89028 - DNA, 25 bp, Mus musculus
aattggatgccttggtgcagtgtaa

SEQ ID NO: 89029 - DNA, 25 bp, Mus musculus
aattggattcttctgatccccttaa

SEQ ID NO: 89030 - DNA, 25 bp, Mus musculus
aattggattcttgtgatccccttaa

SEQ ID NO: 89031 - DNA, 25 bp, Mus musculus
aattggatttgaccttatccctcac

SEQ ID NO: 89032 - DNA, 25 bp, Mus musculus
aattggatttgagcttatccctcac

SEQ ID NO: 89033 - DNA, 25 bp, Mus musculus
aattggcaaaatagatttcattgtt

SEQ ID NO: 89034 - DNA, 25 bp, Mus musculus
aattggcaaaattgatttcattgtt

SEQ ID NO: 89035 - DNA, 25 bp, Mus musculus
aattggcaaataccagttgactgac

SEQ ID NO: 89036 - DNA, 25 bp, Mus musculus
aattggcaaatagcagttgactgac

SEQ ID NO: 89037 - DNA, 25 bp, Mus musculus
aattggcacaccagccatgaacatg

SEQ ID NO: 89038 - DNA, 25 bp, Mus musculus
aattggcacacctgccatgaacatg

SEQ ID NO: 89039 - DNA, 25 bp, Mus musculus
aattggcacaggctcttgcctgcac

SEQ ID NO: 89040 - DNA, 25 bp, Mus musculus
aattggcacagggtcttgcctgcac

SEQ ID NO: 89041 - DNA, 25 bp, Mus musculus
aattggcagagcattttcccttcgg

SEQ ID NO: 89042 - DNA, 25 bp, Mus musculus
aattggcagagctttttcccttcgg

SEQ ID NO: 89043 - DNA, 25 bp, Mus musculus
aattggcaggagacatgatggttaa

SEQ ID NO: 89044 - DNA, 25 bp, Mus musculus
aattggcaggagtcatgatggttaa

SEQ ID NO: 89045 - DNA, 25 bp, Mus musculus
aattggcaggtcctgaatcctgtcc

SEQ ID NO: 89046 - DNA, 25 bp, Mus musculus
aattggcaggtcgtgaatcctgtcc

SEQ ID NO: 89047 - DNA, 25 bp, Mus musculus
aattggcatctcattttcgggaccg

SEQ ID NO: 89048 - DNA, 25 bp, Mus musculus
aattggcatctctttttcgggaccg

SEQ ID NO: 89049 - DNA, 25 bp, Mus musculus
aattggcatcttattcgcttcttat

SEQ ID NO: 89050 - DNA, 25 bp, Mus musculus
aattggcatctttttcgcttcttat

SEQ ID NO: 89051 - DNA, 25 bp, Mus musculus
aattggcatggcaccacaataccac

SEQ ID NO: 89052 - DNA, 25 bp, Mus musculus
aattggcatggctccacaataccac

SEQ ID NO: 89053 - DNA, 25 bp, Mus musculus
aattggccaaaaatgattgtccctc

SEQ ID NO: 89054 - DNA, 25 bp, Mus musculus
aattggccaaaattgattgtccctc

SEQ ID NO: 89055 - DNA, 25 bp, Mus musculus
aattggccaagtacacggtgtgaca

SEQ ID NO: 89056 - DNA, 25 bp, Mus musculus
aattggccaagttcacggtgtgaca

SEQ ID NO: 89057 - DNA, 25 bp, Mus musculus
aattggccacagagttaacagtagt

SEQ ID NO: 89058 - DNA, 25 bp, Mus musculus
aattggccacagtgttaacagtagt

SEQ ID NO: 89059 - DNA, 25 bp, Mus musculus
aattggccacataatctcattcttt

SEQ ID NO: 89060 - DNA, 25 bp, Mus musculus
aattggccacattatctcattcttt

SEQ ID NO: 89061 - DNA, 25 bp, Mus musculus
aattggccactgctcttgagacaga

SEQ ID NO: 89062 - DNA, 25 bp, Mus musculus
aattggccactggtcttgagacaga

SEQ ID NO: 89063 - DNA, 25 bp, Mus musculus
aattggccagacaactgatatcgga

SEQ ID NO: 89064 - DNA, 25 bp, Mus musculus
aattggccagactactgatatcgga

SEQ ID NO: 89065 - DNA, 25 bp, Mus musculus
aattggccagagaccgatggtgtct

SEQ ID NO: 89066 - DNA, 25 bp, Mus musculus
aattggccagagtccgatggtgtct

SEQ ID NO: 89067 - DNA, 25 bp, Mus musculus
aattggccaggtatgagctctttat

SEQ ID NO: 89068 - DNA, 25 bp, Mus musculus
aattggccaggtttgagctctttat

SEQ ID NO: 89069 - DNA, 25 bp, Mus musculus
aattggcccagaagttgtcacgact

SEQ ID NO: 89070 - DNA, 25 bp, Mus musculus
aattggcccagatgttgtcacgact

SEQ ID NO: 89071 - DNA, 25 bp, Mus musculus
aattggcccagcctgtggatgtcag

SEQ ID NO: 89072 - DNA, 25 bp, Mus musculus
aattggcccagcgtgtggatgtcag

SEQ ID NO: 89073 - DNA, 25 bp, Mus musculus
aattggccctatccttagggcaggc

SEQ ID NO: 89074 - DNA, 25 bp, Mus musculus
aattggccctatgcttagggcaggc

SEQ ID NO: 89075 - DNA, 25 bp, Mus musculus
aattggcccttgcttatcaggtggt

SEQ ID NO: 89076 - DNA, 25 bp, Mus musculus
aattggcccttggttatcaggtggt

SEQ ID NO: 89077 - DNA, 25 bp, Mus musculus
aattggcctagacatgcctagctat

SEQ ID NO: 89078 - DNA, 25 bp, Mus musculus
aattggcctagagatgcctagctat

SEQ ID NO: 89079 - DNA, 25 bp, Mus musculus
aattggcctcctagcaagctgagat

SEQ ID NO: 89080 - DNA, 25 bp, Mus musculus
aattggcctccttgcaagctgagat

SEQ ID NO: 89081 - DNA, 25 bp, Mus musculus
aattggcctggtctagctgtcttga

SEQ ID NO: 89082 - DNA, 25 bp, Mus musculus
aattggcctggtgtagctgtcttga

SEQ ID NO: 89083 - DNA, 25 bp, Mus musculus
aattggcctgtgaggaacttgtgga

SEQ ID NO: 89084 - DNA, 25 bp, Mus musculus
aattggcctgtgtggaacttgtgga

SEQ ID NO: 89085 - DNA, 25 bp, Mus musculus
aattggcgaatgaggacctgcccta

SEQ ID NO: 89086 - DNA, 25 bp, Mus musculus
aattggcgaatgtggacctgcccta

SEQ ID NO: 89087 - DNA, 25 bp, Mus musculus
aattggcgacctaatgctagcagct

SEQ ID NO: 89088 - DNA, 25 bp, Mus musculus
aattggcgaccttatgctagcagct

SEQ ID NO: 89089 - DNA, 25 bp, Mus musculus
aattggcgcatgctttatcctacca

SEQ ID NO: 89090 - DNA, 25 bp, Mus musculus
aattggcgcatggtttatcctacca

SEQ ID NO: 89091 - DNA, 25 bp, Mus musculus
aattggcgggtcatgctggtctttc

SEQ ID NO: 89092 - DNA, 25 bp, Mus musculus
aattggcgggtcttgctggtctttc

SEQ ID NO: 89093 - DNA, 25 bp, Mus musculus
aattggctagttagagcttagtggt

SEQ ID NO: 89094 - DNA, 25 bp, Mus musculus
aattggctagtttgagcttagtggt

SEQ ID NO: 89095 - DNA, 25 bp, Mus musculus
aattggctcccaaacgcaaggctgt

SEQ ID NO: 89096 - DNA, 25 bp, Mus musculus
aattggctcccatacgcaaggctgt

SEQ ID NO: 89097 - DNA, 25 bp, Mus musculus
aattggctctgaagttccagcatgt

SEQ ID NO: 89098 - DNA, 25 bp, Mus musculus
aattggctctgacaaagcaccccag

SEQ ID NO: 89099 - DNA, 25 bp, Mus musculus
aattggctctgagaaagcaccccag

SEQ ID NO: 89100 - DNA, 25 bp, Mus musculus
aattggctctgatgttccagcatgt

SEQ ID NO: 89101 - DNA, 25 bp, Mus musculus
aattggctgagcaagttgttctccc

SEQ ID NO: 89102 - DNA, 25 bp, Mus musculus
aattggctgagctagttgttctccc

SEQ ID NO: 89103 - DNA, 25 bp, Mus musculus
aattggctgataattacccattgta

SEQ ID NO: 89104 - DNA, 25 bp, Mus musculus
aattggctgatatttacccattgta

SEQ ID NO: 89105 - DNA, 25 bp, Mus musculus
aattggctgattactttagctgaca

SEQ ID NO: 89106 - DNA, 25 bp, Mus musculus
aattggctgatttctttagctgaca

SEQ ID NO: 89107 - DNA, 25 bp, Mus musculus
aattggctgccaaggcttcgggtga

SEQ ID NO: 89108 - DNA, 25 bp, Mus musculus
aattggctgccatggcttcgggtga

SEQ ID NO: 89109 - DNA, 25 bp, Mus musculus
aattggctggagagttgtggaaacc

SEQ ID NO: 89110 - DNA, 25 bp, Mus musculus
aattggctggagtgttgtggaaacc

SEQ ID NO: 89111 - DNA, 25 bp, Mus musculus
aattggctgtcactgtttgcttcca

SEQ ID NO: 89112 - DNA, 25 bp, Mus musculus
aattggctgtcagtgtttgcttcca

SEQ ID NO: 89113 - DNA, 25 bp, Mus musculus
aattggcttgtcattattggaatgc

SEQ ID NO: 89114 - DNA, 25 bp, Mus musculus
aattggcttgtctttattggaatgc

SEQ ID NO: 89115 - DNA, 25 bp, Mus musculus
aattggctttggagaccggaccagc

SEQ ID NO: 89116 - DNA, 25 bp, Mus musculus
aattggctttggtgaccggaccagc

SEQ ID NO: 89117 - DNA, 25 bp, Mus musculus
aattggcttttgcaattctctagct

SEQ ID NO: 89118 - DNA, 25 bp, Mus musculus
aattggcttttggaattctctagct

SEQ ID NO: 89119 - DNA, 25 bp, Mus musculus
aattgggaaatgacagcacactgag

SEQ ID NO: 89120 - DNA, 25 bp, Mus musculus
aattgggaaatgtcagcacactgag

SEQ ID NO: 89121 - DNA, 25 bp, Mus musculus
aattgggaacacaaggcgatgcctg

SEQ ID NO: 89122 - DNA, 25 bp, Mus musculus
aattgggaacactaggcgatgcctg

SEQ ID NO: 89123 - DNA, 25 bp, Mus musculus
aattgggaagccactgacccgccag

SEQ ID NO: 89124 - DNA, 25 bp, Mus musculus
aattgggaagcctctgacccgccag

SEQ ID NO: 89125 - DNA, 25 bp, Mus musculus
aattgggacatcacagggttggcct

SEQ ID NO: 89126 - DNA, 25 bp, Mus musculus
aattgggacatctcagggttggcct

SEQ ID NO: 89127 - DNA, 25 bp, Mus musculus
aattgggacgtcacgttttcaaatg

SEQ ID NO: 89128 - DNA, 25 bp, Mus musculus
aattgggacgtctcgttttcaaatg

SEQ ID NO: 89129 - DNA, 25 bp, Mus musculus
aattgggacttgacacgggcactgc

SEQ ID NO: 89130 - DNA, 25 bp, Mus musculus
aattgggacttgtcacgggcactgc

SEQ ID NO: 89131 - DNA, 25 bp, Mus musculus
aattgggagataacctgcttcctct

SEQ ID NO: 89132 - DNA, 25 bp, Mus musculus
aattgggagatatcctgcttcctct

SEQ ID NO: 89133 - DNA, 25 bp, Mus musculus
aattgggagcccctgagaactagga

SEQ ID NO: 89134 - DNA, 25 bp, Mus musculus
aattgggagcccgtgagaactagga

SEQ ID NO: 89135 - DNA, 25 bp, Mus musculus
aattgggaggccactgggtccatgt

SEQ ID NO: 89136 - DNA, 25 bp, Mus musculus
aattgggaggcctctgggtccatgt

SEQ ID NO: 89137 - DNA, 25 bp, Mus musculus
aattgggaggtgctcattcagaaac

SEQ ID NO: 89138 - DNA, 25 bp, Mus musculus
aattgggaggtggtcattcagaaac

SEQ ID NO: 89139 - DNA, 25 bp, Mus musculus
aattgggatatgaccggtataaaat

SEQ ID NO: 89140 - DNA, 25 bp, Mus musculus
aattgggatatgtccggtataaaat

SEQ ID NO: 89141 - DNA, 25 bp, Mus musculus
aattgggatcaaaggctttgatgca

SEQ ID NO: 89142 - DNA, 25 bp, Mus musculus
aattgggatcaatggctttgatgca

SEQ ID NO: 89143 - DNA, 25 bp, Mus musculus
aattgggatctgatcatctgatctt

SEQ ID NO: 89144 - DNA, 25 bp, Mus musculus
aattgggatctgttcatctgatctt

SEQ ID NO: 89145 - DNA, 25 bp, Mus musculus
aattgggatgatctcttggcccgcc

SEQ ID NO: 89146 - DNA, 25 bp, Mus musculus
aattgggatgatgtcttggcccgcc

SEQ ID NO: 89147 - DNA, 25 bp, Mus musculus
aattgggatgctcacacaccttgct

SEQ ID NO: 89148 - DNA, 25 bp, Mus musculus
aattgggatgctgacacaccttgct

SEQ ID NO: 89149 - DNA, 25 bp, Mus musculus
aattgggattggactcactctctgt

SEQ ID NO: 89150 - DNA, 25 bp, Mus musculus
aattgggattggtctcactctctgt

SEQ ID NO: 89151 - DNA, 25 bp, Mus musculus
aattgggcaatgcacacagttggac

SEQ ID NO: 89152 - DNA, 25 bp, Mus musculus
aattgggcaatggacacagttggac

SEQ ID NO: 89153 - DNA, 25 bp, Mus musculus
aattgggcacacaggcacattctgt

SEQ ID NO: 89154 - DNA, 25 bp, Mus musculus
aattgggcacactggcacattctgt

SEQ ID NO: 89155 - DNA, 25 bp, Mus musculus
aattgggcagtgcactatccggcct

SEQ ID NO: 89156 - DNA, 25 bp, Mus musculus
aattgggcagtggactatccggcct

SEQ ID NO: 89157 - DNA, 25 bp, Mus musculus
aattgggcccttcatacctgacata

SEQ ID NO: 89158 - DNA, 25 bp, Mus musculus
aattgggcccttgatacctgacata

SEQ ID NO: 89159 - DNA, 25 bp, Mus musculus
aattgggcctgacagcatcttggtc

SEQ ID NO: 89160 - DNA, 25 bp, Mus musculus
aattgggcctgagagcatcttggtc

SEQ ID NO: 89161 - DNA, 25 bp, Mus musculus
aattgggctcaaatcatgttccttt

SEQ ID NO: 89162 - DNA, 25 bp, Mus musculus
aattgggctcaattcatgttccttt

SEQ ID NO: 89163 - DNA, 25 bp, Mus musculus
aattgggctcataactacagcgcct

SEQ ID NO: 89164 - DNA, 25 bp, Mus musculus
aattgggctcattactacagcgcct

SEQ ID NO: 89165 - DNA, 25 bp, Mus musculus
aattgggctgcaactgtagttcata

SEQ ID NO: 89166 - DNA, 25 bp, Mus musculus
aattgggctgcacaattgcccggtt

SEQ ID NO: 89167 - DNA, 25 bp, Mus musculus
aattgggctgcagaattgcccggtt

SEQ ID NO: 89168 - DNA, 25 bp, Mus musculus
aattgggctgcatctgtagttcata

SEQ ID NO: 89169 - DNA, 25 bp, Mus musculus
aattgggctgctagggatttccaaa

SEQ ID NO: 89170 - DNA, 25 bp, Mus musculus
aattgggctgctcactgttaagtca

SEQ ID NO: 89171 - DNA, 25 bp, Mus musculus
aattgggctgctgactgttaagtca

SEQ ID NO: 89172 - DNA, 25 bp, Mus musculus
aattgggctgcttgggatttccaaa

SEQ ID NO: 89173 - DNA, 25 bp, Mus musculus
aattgggcttcacccaatctcagac

SEQ ID NO: 89174 - DNA, 25 bp, Mus musculus
aattgggcttcagccaatctcagac

SEQ ID NO: 89175 - DNA, 25 bp, Mus musculus
aattgggctttcaggttcttgccgg

SEQ ID NO: 89176 - DNA, 25 bp, Mus musculus
aattgggctttctggttcttgccgg

SEQ ID NO: 89177 - DNA, 25 bp, Mus musculus
aattgggtacaactggttctataga

SEQ ID NO: 89178 - DNA, 25 bp, Mus musculus
aattgggtacaagtggttctataga

SEQ ID NO: 89179 - DNA, 25 bp, Mus musculus
aattgggtcatgaggccattcagtt

SEQ ID NO: 89180 - DNA, 25 bp, Mus musculus
aattgggtcatgtggccattcagtt

SEQ ID NO: 89181 - DNA, 25 bp, Mus musculus
aattgggtcctgcccatgtggtgta

SEQ ID NO: 89182 - DNA, 25 bp, Mus musculus
aattgggtcctggccatgtggtgta

SEQ ID NO: 89183 - DNA, 25 bp, Mus musculus
aattgggtctggcaacttgggctca

SEQ ID NO: 89184 - DNA, 25 bp, Mus musculus
aattgggtctgggaacttgggctca

SEQ ID NO: 89185 - DNA, 25 bp, Mus musculus
aattgggtgtcaccttcttactcgc

SEQ ID NO: 89186 - DNA, 25 bp, Mus musculus
aattgggtgtcagcttcttactcgc

SEQ ID NO: 89187 - DNA, 25 bp, Mus musculus
aattgggtgttaccttgaggtgttt

SEQ ID NO: 89188 - DNA, 25 bp, Mus musculus
aattgggtgttagcttgaggtgttt

SEQ ID NO: 89189 - DNA, 25 bp, Mus musculus
aattggtaaagcacactgtgatcag

SEQ ID NO: 89190 - DNA, 25 bp, Mus musculus
aattggtaaagctcactgtgatcag

SEQ ID NO: 89191 - DNA, 25 bp, Mus musculus
aattggtaatttagtttgtgctgct

SEQ ID NO: 89192 - DNA, 25 bp, Mus musculus
aattggtaattttgtttgtgctgct

SEQ ID NO: 89193 - DNA, 25 bp, Mus musculus
aattggtacatccttatgcctctag

SEQ ID NO: 89194 - DNA, 25 bp, Mus musculus
aattggtacatcgttatgcctctag

SEQ ID NO: 89195 - DNA, 25 bp, Mus musculus
aattggtaccaacagataagaatca

SEQ ID NO: 89196 - DNA, 25 bp, Mus musculus
aattggtaccaagagataagaatca

SEQ ID NO: 89197 - DNA, 25 bp, Mus musculus
aattggtacctaccagtgtcctgga

SEQ ID NO: 89198 - DNA, 25 bp, Mus musculus
aattggtacctagcagtgtcctgga

SEQ ID NO: 89199 - DNA, 25 bp, Mus musculus
aattggtaccttcattcaagccata

SEQ ID NO: 89200 - DNA, 25 bp, Mus musculus
aattggtaccttgattcaagccata

SEQ ID NO: 89201 - DNA, 25 bp, Mus musculus
aattggtagtgcaccagcgaggcag

SEQ ID NO: 89202 - DNA, 25 bp, Mus musculus
aattggtagtgctccagcgaggcag

SEQ ID NO: 89203 - DNA, 25 bp, Mus musculus
aattggtatcctcatttcagttgct

SEQ ID NO: 89204 - DNA, 25 bp, Mus musculus
aattggtatcctgatttcagttgct

SEQ ID NO: 89205 - DNA, 25 bp, Mus musculus
aattggtatgtaagacttgggtata

SEQ ID NO: 89206 - DNA, 25 bp, Mus musculus
aattggtatgtatgacttgggtata

SEQ ID NO: 89207 - DNA, 25 bp, Mus musculus
aattggtcaccaaagtcaagattat

SEQ ID NO: 89208 - DNA, 25 bp, Mus musculus
aattggtcaccatagtcaagattat

SEQ ID NO: 89209 - DNA, 25 bp, Mus musculus
aattggtcagtccaggtgcacccat

SEQ ID NO: 89210 - DNA, 25 bp, Mus musculus
aattggtcagtcgaggtgcacccat

SEQ ID NO: 89211 - DNA, 25 bp, Mus musculus
aattggtcctgccttgggctctgtt

SEQ ID NO: 89212 - DNA, 25 bp, Mus musculus
aattggtcctgcgttgggctctgtt

SEQ ID NO: 89213 - DNA, 25 bp, Mus musculus
aattggtctagaattcttttgcagc

SEQ ID NO: 89214 - DNA, 25 bp, Mus musculus
aattggtctagatttcttttgcagc

SEQ ID NO: 89215 - DNA, 25 bp, Mus musculus
aattggtctaggcttgttacaacaa

SEQ ID NO: 89216 - DNA, 25 bp, Mus musculus
aattggtctagggttgttacaacaa

SEQ ID NO: 89217 - DNA, 25 bp, Mus musculus
aattggtcttcactatcgactgaga

SEQ ID NO: 89218 - DNA, 25 bp, Mus musculus
aattggtcttcagtatcgactgaga

SEQ ID NO: 89219 - DNA, 25 bp, Mus musculus
aattggtgaggccttgacttaaagc

SEQ ID NO: 89220 - DNA, 25 bp, Mus musculus
aattggtgaggcgttgacttaaagc

SEQ ID NO: 89221 - DNA, 25 bp, Mus musculus
aattggtgatccaagtgactgagtc

SEQ ID NO: 89222 - DNA, 25 bp, Mus musculus
aattggtgatcctagtgactgagtc

SEQ ID NO: 89223 - DNA, 25 bp, Mus musculus
aattggtggcagaggcctgtaatct

SEQ ID NO: 89224 - DNA, 25 bp, Mus musculus
aattggtggcagtggcctgtaatct

SEQ ID NO: 89225 - DNA, 25 bp, Mus musculus
aattggtgtcttactcatttgttcc

SEQ ID NO: 89226 - DNA, 25 bp, Mus musculus
aattggtgtctttctcatttgttcc

SEQ ID NO: 89227 - DNA, 25 bp, Mus musculus
aattggttactcaaatcatgctaat

SEQ ID NO: 89228 - DNA, 25 bp, Mus musculus
aattggttactctaatcatgctaat

SEQ ID NO: 89229 - DNA, 25 bp, Mus musculus
aattggttagcgcttcactgctgct

SEQ ID NO: 89230 - DNA, 25 bp, Mus musculus
aattggttagcggttcactgctgct

SEQ ID NO: 89231 - DNA, 25 bp, Mus musculus
aattggttccctaattgatgtcaac

SEQ ID NO: 89232 - DNA, 25 bp, Mus musculus
aattggttcccttattgatgtcaac

SEQ ID NO: 89233 - DNA, 25 bp, Mus musculus
aattggttcctaccaagcaggttgc

SEQ ID NO: 89234 - DNA, 25 bp, Mus musculus
aattggttcctagcaagcaggttgc

SEQ ID NO: 89235 - DNA, 25 bp, Mus musculus
aattggttcgctatgatgtttctaa

SEQ ID NO: 89236 - DNA, 25 bp, Mus musculus
aattggttcgctttgatgtttctaa

SEQ ID NO: 89237 - DNA, 25 bp, Mus musculus
aattggttctatacttttgtatgac

SEQ ID NO: 89238 - DNA, 25 bp, Mus musculus
aattggttctattcttttgtatgac

SEQ ID NO: 89239 - DNA, 25 bp, Mus musculus
aattggttctctcatgtattccctg

SEQ ID NO: 89240 - DNA, 25 bp, Mus musculus
aattggttctctgatgtattccctg

SEQ ID NO: 89241 - DNA, 25 bp, Mus musculus
aattggttggttagctctccagata

SEQ ID NO: 89242 - DNA, 25 bp, Mus musculus
aattggttggtttgctctccagata

SEQ ID NO: 89243 - DNA, 25 bp, Mus musculus
aattggtttccaactccagatggtt

SEQ ID NO: 89244 - DNA, 25 bp, Mus musculus
aattggtttccatctccagatggtt

SEQ ID NO: 89245 - DNA, 25 bp, Mus musculus
aattggtttgaaccccttgtcactg

SEQ ID NO: 89246 - DNA, 25 bp, Mus musculus
aattggtttgaagcccttgtcactg

SEQ ID NO: 89247 - DNA, 25 bp, Mus musculus
aattggtttgtactcactgggctgt

SEQ ID NO: 89248 - DNA, 25 bp, Mus musculus
aattggtttgtagtcactgggctgt

SEQ ID NO: 89249 - DNA, 25 bp, Mus musculus
aattgtaaaagaagtctctctcctt

SEQ ID NO: 89250 - DNA, 25 bp, Mus musculus
aattgtaaaagatgtctctctcctt

SEQ ID NO: 89251 - DNA, 25 bp, Mus musculus
aattgtaaataacccagcctctcct

SEQ ID NO: 89252 - DNA, 25 bp, Mus musculus
aattgtaaataagccagcctctcct

SEQ ID NO: 89253 - DNA, 25 bp, Mus musculus
aattgtaacctactggctattcaaa

SEQ ID NO: 89254 - DNA, 25 bp, Mus musculus
aattgtaacctagtggctattcaaa

SEQ ID NO: 89255 - DNA, 25 bp, Mus musculus
aattgtaactaaagtcactgaccta

SEQ ID NO: 89256 - DNA, 25 bp, Mus musculus
aattgtaactaatgtcactgaccta

SEQ ID NO: 89257 - DNA, 25 bp, Mus musculus
aattgtaatagcattcatcttttaa

SEQ ID NO: 89258 - DNA, 25 bp, Mus musculus
aattgtaatagctttcatcttttaa

SEQ ID NO: 89259 - DNA, 25 bp, Mus musculus
aattgtaatctgaaggtgacctcgg

SEQ ID NO: 89260 - DNA, 25 bp, Mus musculus
aattgtaatctgtaggtgacctcgg

SEQ ID NO: 89261 - DNA, 25 bp, Mus musculus
aattgtaatgttaccctttgtgcta

SEQ ID NO: 89262 - DNA, 25 bp, Mus musculus
aattgtaatgtttccctttgtgcta

SEQ ID NO: 89263 - DNA, 25 bp, Mus musculus
aattgtacaacaaagaggctcttca

SEQ ID NO: 89264 - DNA, 25 bp, Mus musculus
aattgtacaacatagaggctcttca

SEQ ID NO: 89265 - DNA, 25 bp, Mus musculus
aattgtacaacgacaagagcatctt

SEQ ID NO: 89266 - DNA, 25 bp, Mus musculus
aattgtacaacgtcaagagcatctt

SEQ ID NO: 89267 - DNA, 25 bp, Mus musculus
aattgtacaataccagacaccctcc

SEQ ID NO: 89268 - DNA, 25 bp, Mus musculus
aattgtacaatagcagacaccctcc

SEQ ID NO: 89269 - DNA, 25 bp, Mus musculus
aattgtacacttatctgaggagctg

SEQ ID NO: 89270 - DNA, 25 bp, Mus musculus
aattgtacacttttctgaggagctg

SEQ ID NO: 89271 - DNA, 25 bp, Mus musculus
aattgtacagtaagtgacaagtcct

SEQ ID NO: 89272 - DNA, 25 bp, Mus musculus
aattgtacagtatgtgacaagtcct

SEQ ID NO: 89273 - DNA, 25 bp, Mus musculus
aattgtaccattacgactgactcat

SEQ ID NO: 89274 - DNA, 25 bp, Mus musculus
aattgtaccatttcgactgactcat

SEQ ID NO: 89275 - DNA, 25 bp, Mus musculus
aattgtaccgttactcaccattgca

SEQ ID NO: 89276 - DNA, 25 bp, Mus musculus
aattgtaccgtttctcaccattgca

SEQ ID NO: 89277 - DNA, 25 bp, Mus musculus
aattgtactcaaaactttccttatt

SEQ ID NO: 89278 - DNA, 25 bp, Mus musculus
aattgtactcaatactttccttatt

SEQ ID NO: 89279 - DNA, 25 bp, Mus musculus
aattgtactgaacagcccagcagga

SEQ ID NO: 89280 - DNA, 25 bp, Mus musculus
aattgtactgaacttgtgtgtcgat

SEQ ID NO: 89281 - DNA, 25 bp, Mus musculus
aattgtactgaagagcccagcagga

SEQ ID NO: 89282 - DNA, 25 bp, Mus musculus
aattgtactgaagttgtgtgtcgat

SEQ ID NO: 89283 - DNA, 25 bp, Mus musculus
aattgtactgggacccgctgggatt

SEQ ID NO: 89284 - DNA, 25 bp, Mus musculus
aattgtactgggtcccgctgggatt

SEQ ID NO: 89285 - DNA, 25 bp, Mus musculus
aattgtactgtcactcatttctgat

SEQ ID NO: 89286 - DNA, 25 bp, Mus musculus
aattgtactgtctctcatttctgat

SEQ ID NO: 89287 - DNA, 25 bp, Mus musculus
aattgtactgtgattcactcccaaa

SEQ ID NO: 89288 - DNA, 25 bp, Mus musculus
aattgtactgtgattcccttaccct

SEQ ID NO: 89289 - DNA, 25 bp, Mus musculus
aattgtactgtgtttcactcccaaa

SEQ ID NO: 89290 - DNA, 25 bp, Mus musculus
aattgtactgtgtttcccttaccct

SEQ ID NO: 89291 - DNA, 25 bp, Mus musculus
aattgtactttgatccattgttaat

SEQ ID NO: 89292 - DNA, 25 bp, Mus musculus
aattgtactttgttccattgttaat

SEQ ID NO: 89293 - DNA, 25 bp, Mus musculus
aattgtagacccatgcatgctggat

SEQ ID NO: 89294 - DNA, 25 bp, Mus musculus
aattgtagacccttgcatgctggat

SEQ ID NO: 89295 - DNA, 25 bp, Mus musculus
aattgtagcactagcgtgaccgagg

SEQ ID NO: 89296 - DNA, 25 bp, Mus musculus
aattgtagcacttgcgtgaccgagg

SEQ ID NO: 89297 - DNA, 25 bp, Mus musculus
aattgtagcagaattactgagctga

SEQ ID NO: 89298 - DNA, 25 bp, Mus musculus
aattgtagcagatttactgagctga

SEQ ID NO: 89299 - DNA, 25 bp, Mus musculus
aattgtagctgtacttgtggtaggt

SEQ ID NO: 89300 - DNA, 25 bp, Mus musculus
aattgtagctgttcttgtggtaggt

SEQ ID NO: 89301 - DNA, 25 bp, Mus musculus
aattgtaggctgacacactcctttc

SEQ ID NO: 89302 - DNA, 25 bp, Mus musculus
aattgtaggctgtcacactcctttc

SEQ ID NO: 89303 - DNA, 25 bp, Mus musculus
aattgtagtctaatgctgctttgta

SEQ ID NO: 89304 - DNA, 25 bp, Mus musculus
aattgtagtctattgctgctttgta

SEQ ID NO: 89305 - DNA, 25 bp, Mus musculus
aattgtatacccatgtaaatcttaa

SEQ ID NO: 89306 - DNA, 25 bp, Mus musculus
aattgtatacccttgtaaatcttaa

SEQ ID NO: 89307 - DNA, 25 bp, Mus musculus
aattgtatatctcatgtctgtggag

SEQ ID NO: 89308 - DNA, 25 bp, Mus musculus
aattgtatatctgatgtctgtggag

SEQ ID NO: 89309 - DNA, 25 bp, Mus musculus
aattgtatatgacttacccacgtat

SEQ ID NO: 89310 - DNA, 25 bp, Mus musculus
aattgtatatgagttacccacgtat

SEQ ID NO: 89311 - DNA, 25 bp, Mus musculus
aattgtatatttacccacatgccaa

SEQ ID NO: 89312 - DNA, 25 bp, Mus musculus
aattgtatattttcccacatgccaa

SEQ ID NO: 89313 - DNA, 25 bp, Mus musculus
aattgtatcaagctctcatgccaaa

SEQ ID NO: 89314 - DNA, 25 bp, Mus musculus
aattgtatcaaggtctcatgccaaa

SEQ ID NO: 89315 - DNA, 25 bp, Mus musculus
aattgtatccagcaatttccccatc

SEQ ID NO: 89316 - DNA, 25 bp, Mus musculus
aattgtatccaggaatttccccatc

SEQ ID NO: 89317 - DNA, 25 bp, Mus musculus
aattgtatcgataacctaggtggga

SEQ ID NO: 89318 - DNA, 25 bp, Mus musculus
aattgtatcgattacctaggtggga

SEQ ID NO: 89319 - DNA, 25 bp, Mus musculus
aattgtatctcacggttggacctcc

SEQ ID NO: 89320 - DNA, 25 bp, Mus musculus
aattgtatctcagggttggacctcc

SEQ ID NO: 89321 - DNA, 25 bp, Mus musculus
aattgtatgattacacactcgctca

SEQ ID NO: 89322 - DNA, 25 bp, Mus musculus
aattgtatgatttcacactcgctca

SEQ ID NO: 89323 - DNA, 25 bp, Mus musculus
aattgtatgcatacttcctgactct

SEQ ID NO: 89324 - DNA, 25 bp, Mus musculus
aattgtatgcattcttcctgactct

SEQ ID NO: 89325 - DNA, 25 bp, Mus musculus
aattgtatgcctcgccccgaagagg

SEQ ID NO: 89326 - DNA, 25 bp, Mus musculus
aattgtatgcctggccccgaagagg

SEQ ID NO: 89327 - DNA, 25 bp, Mus musculus
aattgtatgctgagatttctgcctg

SEQ ID NO: 89328 - DNA, 25 bp, Mus musculus
aattgtatgctgtgatttctgcctg

SEQ ID NO: 89329 - DNA, 25 bp, Mus musculus
aattgtattctgatgattcactgat

SEQ ID NO: 89330 - DNA, 25 bp, Mus musculus
aattgtattctgttgattcactgat

SEQ ID NO: 89331 - DNA, 25 bp, Mus musculus
aattgtattttgacagcttgggaag

SEQ ID NO: 89332 - DNA, 25 bp, Mus musculus
aattgtattttgtcagcttgggaag

SEQ ID NO: 89333 - DNA, 25 bp, Mus musculus
aattgtcaacttacagcgtaccttc

SEQ ID NO: 89334 - DNA, 25 bp, Mus musculus
aattgtcaactttcagcgtaccttc

SEQ ID NO: 89335 - DNA, 25 bp, Mus musculus
aattgtcaattccactgtaagaagc

SEQ ID NO: 89336 - DNA, 25 bp, Mus musculus
aattgtcaattcgactgtaagaagc

SEQ ID NO: 89337 - DNA, 25 bp, Mus musculus
aattgtcacacgcttttcatattac

SEQ ID NO: 89338 - DNA, 25 bp, Mus musculus
aattgtcacacggttttcatattac

SEQ ID NO: 89339 - DNA, 25 bp, Mus musculus
aattgtcacagcatagctctgattc

SEQ ID NO: 89340 - DNA, 25 bp, Mus musculus
aattgtcacagcttagctctgattc

SEQ ID NO: 89341 - DNA, 25 bp, Mus musculus
aattgtcactctacaccatttgtat

SEQ ID NO: 89342 - DNA, 25 bp, Mus musculus
aattgtcactcttcaccatttgtat

SEQ ID NO: 89343 - DNA, 25 bp, Mus musculus
aattgtcacttaatccatggactga

SEQ ID NO: 89344 - DNA, 25 bp, Mus musculus
aattgtcacttattccatggactga

SEQ ID NO: 89345 - DNA, 25 bp, Mus musculus
aattgtcactttcccatgtgcttgg

SEQ ID NO: 89346 - DNA, 25 bp, Mus musculus
aattgtcactttgccatgtgcttgg

SEQ ID NO: 89347 - DNA, 25 bp, Mus musculus
aattgtcagaaaatccagtcctagg

SEQ ID NO: 89348 - DNA, 25 bp, Mus musculus
aattgtcagaaattccagtcctagg

SEQ ID NO: 89349 - DNA, 25 bp, Mus musculus
aattgtcaggataacttaacttggt

SEQ ID NO: 89350 - DNA, 25 bp, Mus musculus
aattgtcaggattacttaacttggt

SEQ ID NO: 89351 - DNA, 25 bp, Mus musculus
aattgtcagtgcatccttagtccca

SEQ ID NO: 89352 - DNA, 25 bp, Mus musculus
aattgtcagtgcttccttagtccca

SEQ ID NO: 89353 - DNA, 25 bp, Mus musculus
aattgtcatcctattcttactgtgg

SEQ ID NO: 89354 - DNA, 25 bp, Mus musculus
aattgtcatccttttcttactgtgg

SEQ ID NO: 89355 - DNA, 25 bp, Mus musculus
aattgtcatcgtatgttatagcctc

SEQ ID NO: 89356 - DNA, 25 bp, Mus musculus
aattgtcatcgtttgttatagcctc

SEQ ID NO: 89357 - DNA, 25 bp, Mus musculus
aattgtcatgctagtttggttagaa

SEQ ID NO: 89358 - DNA, 25 bp, Mus musculus
aattgtcatgcttgtttggttagaa

SEQ ID NO: 89359 - DNA, 25 bp, Mus musculus
aattgtcattccattgcaacatatg

SEQ ID NO: 89360 - DNA, 25 bp, Mus musculus
aattgtcattcctttgcaacatatg

SEQ ID NO: 89361 - DNA, 25 bp, Mus musculus
aattgtccactgagggctgcttatg

SEQ ID NO: 89362 - DNA, 25 bp, Mus musculus
aattgtccactgtgggctgcttatg

SEQ ID NO: 89363 - DNA, 25 bp, Mus musculus
aattgtccagcactagcagtctcag

SEQ ID NO: 89364 - DNA, 25 bp, Mus musculus
aattgtccagcagtagcagtctcag

SEQ ID NO: 89365 - DNA, 25 bp, Mus musculus
aattgtccagtcatgtttctaatgt

SEQ ID NO: 89366 - DNA, 25 bp, Mus musculus
aattgtccagtcttgtttctaatgt

SEQ ID NO: 89367 - DNA, 25 bp, Mus musculus
aattgtccattactgatttctaaac

SEQ ID NO: 89368 - DNA, 25 bp, Mus musculus
aattgtccattagtgatttctaaac

SEQ ID NO: 89369 - DNA, 25 bp, Mus musculus
aattgtccatttacagtgttctgtt

SEQ ID NO: 89370 - DNA, 25 bp, Mus musculus
aattgtccattttcagtgttctgtt

SEQ ID NO: 89371 - DNA, 25 bp, Mus musculus
aattgtcccaggcaatagagggact

SEQ ID NO: 89372 - DNA, 25 bp, Mus musculus
aattgtcccagggaatagagggact

SEQ ID NO: 89373 - DNA, 25 bp, Mus musculus
aattgtcccataccccatatttgaa

SEQ ID NO: 89374 - DNA, 25 bp, Mus musculus
aattgtcccatagcccatatttgaa

SEQ ID NO: 89375 - DNA, 25 bp, Mus musculus
aattgtccctttagcttatgctcaa

SEQ ID NO: 89376 - DNA, 25 bp, Mus musculus
aattgtcccttttgcttatgctcaa

SEQ ID NO: 89377 - DNA, 25 bp, Mus musculus
aattgtccgacaatggtccaggaac

SEQ ID NO: 89378 - DNA, 25 bp, Mus musculus
aattgtccgacattggtccaggaac

SEQ ID NO: 89379 - DNA, 25 bp, Mus musculus
aattgtcctcgtcatccgggactaa

SEQ ID NO: 89380 - DNA, 25 bp, Mus musculus
aattgtcctcgtgatccgggactaa

SEQ ID NO: 89381 - DNA, 25 bp, Mus musculus
aattgtcctctgagggtcaccttag

SEQ ID NO: 89382 - DNA, 25 bp, Mus musculus
aattgtcctctgatcattgtaccca

SEQ ID NO: 89383 - DNA, 25 bp, Mus musculus
aattgtcctctgctgtgtttgtgca

SEQ ID NO: 89384 - DNA, 25 bp, Mus musculus
aattgtcctctggtgtgtttgtgca

SEQ ID NO: 89385 - DNA, 25 bp, Mus musculus
aattgtcctctgtgggtcaccttag

SEQ ID NO: 89386 - DNA, 25 bp, Mus musculus
aattgtcctctgttcattgtaccca

SEQ ID NO: 89387 - DNA, 25 bp, Mus musculus
aattgtcctgtgagactttgctcgg

SEQ ID NO: 89388 - DNA, 25 bp, Mus musculus
aattgtcctgtgtgactttgctcgg

SEQ ID NO: 89389 - DNA, 25 bp, Mus musculus
aattgtcctgttaatcctctatgca

SEQ ID NO: 89390 - DNA, 25 bp, Mus musculus
aattgtcctgtttatcctctatgca

SEQ ID NO: 89391 - DNA, 25 bp, Mus musculus
aattgtccttatccctaaggtggtc

SEQ ID NO: 89392 - DNA, 25 bp, Mus musculus
aattgtccttatgcctaaggtggtc

SEQ ID NO: 89393 - DNA, 25 bp, Mus musculus
aattgtcgcaaaagcaacgcagtgc

SEQ ID NO: 89394 - DNA, 25 bp, Mus musculus
aattgtcgcaaatgcaacgcagtgc

SEQ ID NO: 89395 - DNA, 25 bp, Mus musculus
aattgtctaagtccccaggtcattc

SEQ ID NO: 89396 - DNA, 25 bp, Mus musculus
aattgtctaagtgcccaggtcattc

SEQ ID NO: 89397 - DNA, 25 bp, Mus musculus
aattgtctacataattcttttaaag

SEQ ID NO: 89398 - DNA, 25 bp, Mus musculus
aattgtctacattattcttttaaag

SEQ ID NO: 89399 - DNA, 25 bp, Mus musculus
aattgtctagatcaggttgccctat

SEQ ID NO: 89400 - DNA, 25 bp, Mus musculus
aattgtctagatgaggttgccctat

SEQ ID NO: 89401 - DNA, 25 bp, Mus musculus
aattgtctatcccatttaatgctat

SEQ ID NO: 89402 - DNA, 25 bp, Mus musculus
aattgtctatccgatttaatgctat

SEQ ID NO: 89403 - DNA, 25 bp, Mus musculus
aattgtctcagcctaattccccgtt

SEQ ID NO: 89404 - DNA, 25 bp, Mus musculus
aattgtctcagcgtaattccccgtt

SEQ ID NO: 89405 - DNA, 25 bp, Mus musculus
aattgtctccctaagagtgctggcc

SEQ ID NO: 89406 - DNA, 25 bp, Mus musculus
aattgtctcccttagagtgctggcc

SEQ ID NO: 89407 - DNA, 25 bp, Mus musculus
aattgtctctcacgcttaagagcta

SEQ ID NO: 89408 - DNA, 25 bp, Mus musculus
aattgtctctcaggcttaagagcta

SEQ ID NO: 89409 - DNA, 25 bp, Mus musculus
aattgtctctcccagtatctttcta

SEQ ID NO: 89410 - DNA, 25 bp, Mus musculus
aattgtctctccgagtatctttcta

SEQ ID NO: 89411 - DNA, 25 bp, Mus musculus
aattgtctgactctactgttgagct

SEQ ID NO: 89412 - DNA, 25 bp, Mus musculus
aattgtctgactgtactgttgagct

SEQ ID NO: 89413 - DNA, 25 bp, Mus musculus
aattgtctgagcagcattcgcgttt

SEQ ID NO: 89414 - DNA, 25 bp, Mus musculus
aattgtctgagctgcattcgcgttt

SEQ ID NO: 89415 - DNA, 25 bp, Mus musculus
aattgtctgatactttctctcaggt

SEQ ID NO: 89416 - DNA, 25 bp, Mus musculus
aattgtctgatagtttctctcaggt

SEQ ID NO: 89417 - DNA, 25 bp, Mus musculus
aattgtctgcaacttttgccctgga

SEQ ID NO: 89418 - DNA, 25 bp, Mus musculus
aattgtctgcaagttttgccctgga

SEQ ID NO: 89419 - DNA, 25 bp, Mus musculus
aattgtcttagactgaggaacccta

SEQ ID NO: 89420 - DNA, 25 bp, Mus musculus
aattgtcttagagtgaggaacccta

SEQ ID NO: 89421 - DNA, 25 bp, Mus musculus
aattgtcttcataatccttttggta

SEQ ID NO: 89422 - DNA, 25 bp, Mus musculus
aattgtcttcattatccttttggta

SEQ ID NO: 89423 - DNA, 25 bp, Mus musculus
aattgtcttcctcgtttatggcttt

SEQ ID NO: 89424 - DNA, 25 bp, Mus musculus
aattgtcttcctctcttctttactt

SEQ ID NO: 89425 - DNA, 25 bp, Mus musculus
aattgtcttcctggtttatggcttt

SEQ ID NO: 89426 - DNA, 25 bp, Mus musculus
aattgtcttcctgtcttctttactt

SEQ ID NO: 89427 - DNA, 25 bp, Mus musculus
aattgtcttcgtattccaccaatca

SEQ ID NO: 89428 - DNA, 25 bp, Mus musculus
aattgtcttcgttttccaccaatca

SEQ ID NO: 89429 - DNA, 25 bp, Mus musculus
aattgtcttggccttcctcatgatc

SEQ ID NO: 89430 - DNA, 25 bp, Mus musculus
aattgtcttggcgttcctcatgatc

SEQ ID NO: 89431 - DNA, 25 bp, Mus musculus
aattgtcttgggaggtgtctccggc

SEQ ID NO: 89432 - DNA, 25 bp, Mus musculus
aattgtcttgggtggtgtctccggc

SEQ ID NO: 89433 - DNA, 25 bp, Mus musculus
aattgtgaaatgctattacagcgct

SEQ ID NO: 89434 - DNA, 25 bp, Mus musculus
aattgtgaaatggtattacagcgct

SEQ ID NO: 89435 - DNA, 25 bp, Mus musculus
aattgtgaaggtatgtctgggcacc

SEQ ID NO: 89436 - DNA, 25 bp, Mus musculus
aattgtgaaggtttgtctgggcacc

SEQ ID NO: 89437 - DNA, 25 bp, Mus musculus
aattgtgaatttagtgctcattttc

SEQ ID NO: 89438 - DNA, 25 bp, Mus musculus
aattgtgaattttgtgctcattttc

SEQ ID NO: 89439 - DNA, 25 bp, Mus musculus
aattgtgacaagcttcccattaatg

SEQ ID NO: 89440 - DNA, 25 bp, Mus musculus
aattgtgacaaggttcccattaatg

SEQ ID NO: 89441 - DNA, 25 bp, Mus musculus
aattgtgacatgcttctatcactac

SEQ ID NO: 89442 - DNA, 25 bp, Mus musculus
aattgtgacatggttctatcactac

SEQ ID NO: 89443 - DNA, 25 bp, Mus musculus
aattgtgaccccaatgcggtgacag

SEQ ID NO: 89444 - DNA, 25 bp, Mus musculus
aattgtgacccctatgcggtgacag

SEQ ID NO: 89445 - DNA, 25 bp, Mus musculus
aattgtgacctcagaatggcccctg

SEQ ID NO: 89446 - DNA, 25 bp, Mus musculus
aattgtgacctctgaatggcccctg

SEQ ID NO: 89447 - DNA, 25 bp, Mus musculus
aattgtgacttgacttcacacacag

SEQ ID NO: 89448 - DNA, 25 bp, Mus musculus
aattgtgacttgtcttcacacacag

SEQ ID NO: 89449 - DNA, 25 bp, Mus musculus
aattgtgagaatccaaccaaccccg

SEQ ID NO: 89450 - DNA, 25 bp, Mus musculus
aattgtgagaatgcaaccaaccccg

SEQ ID NO: 89451 - DNA, 25 bp, Mus musculus
aattgtgagaccatggcccaaagag

SEQ ID NO: 89452 - DNA, 25 bp, Mus musculus
aattgtgagaccttggcccaaagag

SEQ ID NO: 89453 - DNA, 25 bp, Mus musculus
aattgtgagatacttgtccagacca

SEQ ID NO: 89454 - DNA, 25 bp, Mus musculus
aattgtgagatagttgtccagacca

SEQ ID NO: 89455 - DNA, 25 bp, Mus musculus
aattgtgagcggaaggtatgtttaa

SEQ ID NO: 89456 - DNA, 25 bp, Mus musculus
aattgtgagcggtaggtatgtttaa

SEQ ID NO: 89457 - DNA, 25 bp, Mus musculus
aattgtgaggaaactcatttttaga

SEQ ID NO: 89458 - DNA, 25 bp, Mus musculus
aattgtgaggaatctcatttttaga

SEQ ID NO: 89459 - DNA, 25 bp, Mus musculus
aattgtgaggtcatgcaccggctga

SEQ ID NO: 89460 - DNA, 25 bp, Mus musculus
aattgtgaggtcttgcaccggctga

SEQ ID NO: 89461 - DNA, 25 bp, Mus musculus
aattgtgagtagcttaatctgttta

SEQ ID NO: 89462 - DNA, 25 bp, Mus musculus
aattgtgagtaggttaatctgttta

SEQ ID NO: 89463 - DNA, 25 bp, Mus musculus
aattgtgagtccattccttgagtat

SEQ ID NO: 89464 - DNA, 25 bp, Mus musculus
aattgtgagtcctttccttgagtat

SEQ ID NO: 89465 - DNA, 25 bp, Mus musculus
aattgtgagttgagaccatggaaca

SEQ ID NO: 89466 - DNA, 25 bp, Mus musculus
aattgtgagttgtgaccatggaaca

SEQ ID NO: 89467 - DNA, 25 bp, Mus musculus
aattgtgatcacactttttacttaa

SEQ ID NO: 89468 - DNA, 25 bp, Mus musculus
aattgtgatcactctttttacttaa

SEQ ID NO: 89469 - DNA, 25 bp, Mus musculus
aattgtgatcggagattagctgcca

SEQ ID NO: 89470 - DNA, 25 bp, Mus musculus
aattgtgatcggtgattagctgcca

SEQ ID NO: 89471 - DNA, 25 bp, Mus musculus
aattgtgcactgcttttcactcaac

SEQ ID NO: 89472 - DNA, 25 bp, Mus musculus
aattgtgcactggttttcactcaac

SEQ ID NO: 89473 - DNA, 25 bp, Mus musculus
aattgtgcatggcttgggcattcaa

SEQ ID NO: 89474 - DNA, 25 bp, Mus musculus
aattgtgcatgggttgggcattcaa

SEQ ID NO: 89475 - DNA, 25 bp, Mus musculus
aattgtgccaaacgctggcctggcc

SEQ ID NO: 89476 - DNA, 25 bp, Mus musculus
aattgtgccaaaggctggcctggcc

SEQ ID NO: 89477 - DNA, 25 bp, Mus musculus
aattgtgcctttacggtattcctct

SEQ ID NO: 89478 - DNA, 25 bp, Mus musculus
aattgtgccttttcggtattcctct

SEQ ID NO: 89479 - DNA, 25 bp, Mus musculus
aattgtgctcagattttcggatgtc

SEQ ID NO: 89480 - DNA, 25 bp, Mus musculus
aattgtgctcagtttttcggatgtc

SEQ ID NO: 89481 - DNA, 25 bp, Mus musculus
aattgtgctgccatagctagccaga

SEQ ID NO: 89482 - DNA, 25 bp, Mus musculus
aattgtgctgccttagctagccaga

SEQ ID NO: 89483 - DNA, 25 bp, Mus musculus
aattgtgctgtgattattctgaata

SEQ ID NO: 89484 - DNA, 25 bp, Mus musculus
aattgtgctgtgtttattctgaata

SEQ ID NO: 89485 - DNA, 25 bp, Mus musculus
aattgtgcttacactcaatcaaaag

SEQ ID NO: 89486 - DNA, 25 bp, Mus musculus
aattgtgcttactctcaatcaaaag

SEQ ID NO: 89487 - DNA, 25 bp, Mus musculus
aattgtggaattcgcctcggtacga

SEQ ID NO: 89488 - DNA, 25 bp, Mus musculus
aattgtggaattggcctcggtacga

SEQ ID NO: 89489 - DNA, 25 bp, Mus musculus
aattgtggaggtcgtgcacccttgt

SEQ ID NO: 89490 - DNA, 25 bp, Mus musculus
aattgtggaggtggtgcacccttgt

SEQ ID NO: 89491 - DNA, 25 bp, Mus musculus
aattgtggagttcggctccgtgaac

SEQ ID NO: 89492 - DNA, 25 bp, Mus musculus
aattgtggagttgggctccgtgaac

SEQ ID NO: 89493 - DNA, 25 bp, Mus musculus
aattgtggatccagcttttaccgcc

SEQ ID NO: 89494 - DNA, 25 bp, Mus musculus
aattgtggatcctgcttttaccgcc

SEQ ID NO: 89495 - DNA, 25 bp, Mus musculus
aattgtggatgaacgccctatctcc

SEQ ID NO: 89496 - DNA, 25 bp, Mus musculus
aattgtggatgatcgccctatctcc

SEQ ID NO: 89497 - DNA, 25 bp, Mus musculus
aattgtggcatactcactattggat

SEQ ID NO: 89498 - DNA, 25 bp, Mus musculus
aattgtggcatagtcactattggat

SEQ ID NO: 89499 - DNA, 25 bp, Mus musculus
aattgtggccacagatcagtccaga

SEQ ID NO: 89500 - DNA, 25 bp, Mus musculus
aattgtggccactgatcagtccaga

SEQ ID NO: 89501 - DNA, 25 bp, Mus musculus
aattgtggcccaagcaaagctgata

SEQ ID NO: 89502 - DNA, 25 bp, Mus musculus
aattgtggcccatgcaaagctgata

SEQ ID NO: 89503 - DNA, 25 bp, Mus musculus
aattgtggctgtcctcggaatctct

SEQ ID NO: 89504 - DNA, 25 bp, Mus musculus
aattgtggctgtgctcggaatctct

SEQ ID NO: 89505 - DNA, 25 bp, Mus musculus
aattgtgggattccttcagtcagcc

SEQ ID NO: 89506 - DNA, 25 bp, Mus musculus
aattgtgggattgcttcagtcagcc

SEQ ID NO: 89507 - DNA, 25 bp, Mus musculus
aattgtgggtgtcctctgatattac

SEQ ID NO: 89508 - DNA, 25 bp, Mus musculus
aattgtgggtgtgctctgatattac

SEQ ID NO: 89509 - DNA, 25 bp, Mus musculus
aattgtgggtttagactttgatggc

SEQ ID NO: 89510 - DNA, 25 bp, Mus musculus
aattgtgggttttgactttgatggc

SEQ ID NO: 89511 - DNA, 25 bp, Mus musculus
aattgtggtgcaccctccagaggag

SEQ ID NO: 89512 - DNA, 25 bp, Mus musculus
aattgtggtgcagcctccagaggag

SEQ ID NO: 89513 - DNA, 25 bp, Mus musculus
aattgtggtggaaatgtctgtgttc

SEQ ID NO: 89514 - DNA, 25 bp, Mus musculus
aattgtggtggaattctgtggtcta

SEQ ID NO: 89515 - DNA, 25 bp, Mus musculus
aattgtggtggatatgtctgtgttc

SEQ ID NO: 89516 - DNA, 25 bp, Mus musculus
aattgtggtggatttctgtggtcta

SEQ ID NO: 89517 - DNA, 25 bp, Mus musculus
aattgtggttctctcttctcagata

SEQ ID NO: 89518 - DNA, 25 bp, Mus musculus
aattgtggttctgtcttctcagata

SEQ ID NO: 89519 - DNA, 25 bp, Mus musculus
aattgtgtacatatgactttgctat

SEQ ID NO: 89520 - DNA, 25 bp, Mus musculus
aattgtgtacatttgactttgctat

SEQ ID NO: 89521 - DNA, 25 bp, Mus musculus
aattgtgtacctccaagctttttga

SEQ ID NO: 89522 - DNA, 25 bp, Mus musculus
aattgtgtacctgcaagctttttga

SEQ ID NO: 89523 - DNA, 25 bp, Mus musculus
aattgtgtacgtctctgtgcgtgca

SEQ ID NO: 89524 - DNA, 25 bp, Mus musculus
aattgtgtacgtgtctgtgcgtgca

SEQ ID NO: 89525 - DNA, 25 bp, Mus musculus
aattgtgtagcaattatcttgttga

SEQ ID NO: 89526 - DNA, 25 bp, Mus musculus
aattgtgtagcatttatcttgttga

SEQ ID NO: 89527 - DNA, 25 bp, Mus musculus
aattgtgtagccaacaccgcagtct

SEQ ID NO: 89528 - DNA, 25 bp, Mus musculus
aattgtgtagcctacaccgcagtct

SEQ ID NO: 89529 - DNA, 25 bp, Mus musculus
aattgtgtccacagaaggccagaag

SEQ ID NO: 89530 - DNA, 25 bp, Mus musculus
aattgtgtccactgaaggccagaag

SEQ ID NO: 89531 - DNA, 25 bp, Mus musculus
aattgtgtccctagttgaacgctgt

SEQ ID NO: 89532 - DNA, 25 bp, Mus musculus
aattgtgtcccttgttgaacgctgt

SEQ ID NO: 89533 - DNA, 25 bp, Mus musculus
aattgtgtctggagagtacttcccc

SEQ ID NO: 89534 - DNA, 25 bp, Mus musculus
aattgtgtctggtgagtacttcccc

SEQ ID NO: 89535 - DNA, 25 bp, Mus musculus
aattgtgtgcagaatacttggtagt

SEQ ID NO: 89536 - DNA, 25 bp, Mus musculus
aattgtgtgcagtatacttggtagt

SEQ ID NO: 89537 - DNA, 25 bp, Mus musculus
aattgtgtgcctactgataacttat

SEQ ID NO: 89538 - DNA, 25 bp, Mus musculus
aattgtgtgccttctgataacttat

SEQ ID NO: 89539 - DNA, 25 bp, Mus musculus
aattgtgtggccaaaaacataaatg

SEQ ID NO: 89540 - DNA, 25 bp, Mus musculus
aattgtgtggcctaaaacataaatg

SEQ ID NO: 89541 - DNA, 25 bp, Mus musculus
aattgtgtgggcatcttgatccggc

SEQ ID NO: 89542 - DNA, 25 bp, Mus musculus
aattgtgtgggcttcttgatccggc

SEQ ID NO: 89543 - DNA, 25 bp, Mus musculus
aattgtgtggtcagtggctggctct

SEQ ID NO: 89544 - DNA, 25 bp, Mus musculus
aattgtgtggtctgtggctggctct

SEQ ID NO: 89545 - DNA, 25 bp, Mus musculus
aattgtgttaggaatatgcttactg

SEQ ID NO: 89546 - DNA, 25 bp, Mus musculus
aattgtgttaggtatatgcttactg

SEQ ID NO: 89547 - DNA, 25 bp, Mus musculus
aattgtgttccacgagatccctcct

SEQ ID NO: 89548 - DNA, 25 bp, Mus musculus
aattgtgttccaggagatccctcct

SEQ ID NO: 89549 - DNA, 25 bp, Mus musculus
aattgtgttcccctgcaggtagact

SEQ ID NO: 89550 - DNA, 25 bp, Mus musculus
aattgtgttcccgtgcaggtagact

SEQ ID NO: 89551 - DNA, 25 bp, Mus musculus
aattgtgttctaatggcctgagccg

SEQ ID NO: 89552 - DNA, 25 bp, Mus musculus
aattgtgttctattggcctgagccg

SEQ ID NO: 89553 - DNA, 25 bp, Mus musculus
aattgtgttgcacaaagggacattt

SEQ ID NO: 89554 - DNA, 25 bp, Mus musculus
aattgtgttgcagaaagggacattt

SEQ ID NO: 89555 - DNA, 25 bp, Mus musculus
aattgtgttgctatctatttgttga

SEQ ID NO: 89556 - DNA, 25 bp, Mus musculus
aattgtgttgctttctatttgttga

SEQ ID NO: 89557 - DNA, 25 bp, Mus musculus
aattgtgttggtcccaggccaccca

SEQ ID NO: 89558 - DNA, 25 bp, Mus musculus
aattgtgttggtgccaggccaccca

SEQ ID NO: 89559 - DNA, 25 bp, Mus musculus
aattgtgttgtgaactttcctgtta

SEQ ID NO: 89560 - DNA, 25 bp, Mus musculus
aattgtgttgtgtactttcctgtta

SEQ ID NO: 89561 - DNA, 25 bp, Mus musculus
aattgtgtttcgattgtggaatctt

SEQ ID NO: 89562 - DNA, 25 bp, Mus musculus
aattgtgtttcgtttgtggaatctt

SEQ ID NO: 89563 - DNA, 25 bp, Mus musculus
aattgtgtttggaccgacactgttt

SEQ ID NO: 89564 - DNA, 25 bp, Mus musculus
aattgtgtttggtccgacactgttt

SEQ ID NO: 89565 - DNA, 25 bp, Mus musculus
aattgttaaatgacaggtttgctgc

SEQ ID NO: 89566 - DNA, 25 bp, Mus musculus
aattgttaaatgtcaggtttgctgc

SEQ ID NO: 89567 - DNA, 25 bp, Mus musculus
aattgttaagccctggtcttccata

SEQ ID NO: 89568 - DNA, 25 bp, Mus musculus
aattgttaagccgtggtcttccata

SEQ ID NO: 89569 - DNA, 25 bp, Mus musculus
aattgttaatgtcctttggcttggt

SEQ ID NO: 89570 - DNA, 25 bp, Mus musculus
aattgttaatgtgctttggcttggt

SEQ ID NO: 89571 - DNA, 25 bp, Mus musculus
aattgttaccagacagcaccttgct

SEQ ID NO: 89572 - DNA, 25 bp, Mus musculus
aattgttaccagtcagcaccttgct

SEQ ID NO: 89573 - DNA, 25 bp, Mus musculus
aattgttaccgaagtgacctcagcc

SEQ ID NO: 89574 - DNA, 25 bp, Mus musculus
aattgttaccgatgtgacctcagcc

SEQ ID NO: 89575 - DNA, 25 bp, Mus musculus
aattgttaccttatagctctgaatg

SEQ ID NO: 89576 - DNA, 25 bp, Mus musculus
aattgttaccttttagctctgaatg

SEQ ID NO: 89577 - DNA, 25 bp, Mus musculus
aattgttactttatcctggctcata

SEQ ID NO: 89578 - DNA, 25 bp, Mus musculus
aattgttactttttcctggctcata

SEQ ID NO: 89579 - DNA, 25 bp, Mus musculus
aattgttagccaattctgtatccag

SEQ ID NO: 89580 - DNA, 25 bp, Mus musculus
aattgttagccatttctgtatccag

SEQ ID NO: 89581 - DNA, 25 bp, Mus musculus
aattgttaggtcctttgctatctga

SEQ ID NO: 89582 - DNA, 25 bp, Mus musculus
aattgttaggtcgtttgctatctga

SEQ ID NO: 89583 - DNA, 25 bp, Mus musculus
aattgttatcatccctttccacaaa

SEQ ID NO: 89584 - DNA, 25 bp, Mus musculus
aattgttatcatgcctttccacaaa

SEQ ID NO: 89585 - DNA, 25 bp, Mus musculus
aattgttatgtcagtcctgtgtgtc

SEQ ID NO: 89586 - DNA, 25 bp, Mus musculus
aattgttatgtctgtcctgtgtgtc

SEQ ID NO: 89587 - DNA, 25 bp, Mus musculus
aattgttattacattggcatggaaa

SEQ ID NO: 89588 - DNA, 25 bp, Mus musculus
aattgttattactttggcatggaaa

SEQ ID NO: 89589 - DNA, 25 bp, Mus musculus
aattgttattcaactcgttctgagc

SEQ ID NO: 89590 - DNA, 25 bp, Mus musculus
aattgttattcatctcgttctgagc

SEQ ID NO: 89591 - DNA, 25 bp, Mus musculus
aattgttatttacatttctcaaaga

SEQ ID NO: 89592 - DNA, 25 bp, Mus musculus
aattgttatttagatttctcaaaga

SEQ ID NO: 89593 - DNA, 25 bp, Mus musculus
aattgttatttgctttcctacacag

SEQ ID NO: 89594 - DNA, 25 bp, Mus musculus
aattgttatttggtttcctacacag

SEQ ID NO: 89595 - DNA, 25 bp, Mus musculus
aattgttcaaatatccttgtctcaa

SEQ ID NO: 89596 - DNA, 25 bp, Mus musculus
aattgttcaaatttccttgtctcaa

SEQ ID NO: 89597 - DNA, 25 bp, Mus musculus
aattgttcaagtactggcagagggc

SEQ ID NO: 89598 - DNA, 25 bp, Mus musculus
aattgttcaagttctggcagagggc

SEQ ID NO: 89599 - DNA, 25 bp, Mus musculus
aattgttcacagagcagaccttgca

SEQ ID NO: 89600 - DNA, 25 bp, Mus musculus
aattgttcacagtgcagaccttgca

SEQ ID NO: 89601 - DNA, 25 bp, Mus musculus
aattgttcagttaacgtgtttctag

SEQ ID NO: 89602 - DNA, 25 bp, Mus musculus
aattgttcagtttacgtgtttctag

SEQ ID NO: 89603 - DNA, 25 bp, Mus musculus
aattgttcataacaggtgggcccta

SEQ ID NO: 89604 - DNA, 25 bp, Mus musculus
aattgttcataagaggtgggcccta

SEQ ID NO: 89605 - DNA, 25 bp, Mus musculus
aattgttcatcaacaagccggcgac

SEQ ID NO: 89606 - DNA, 25 bp, Mus musculus
aattgttcatcatcaagccggcgac

SEQ ID NO: 89607 - DNA, 25 bp, Mus musculus
aattgttcatgaatgtacttcaaga

SEQ ID NO: 89608 - DNA, 25 bp, Mus musculus
aattgttcatgattgtacttcaaga

SEQ ID NO: 89609 - DNA, 25 bp, Mus musculus
aattgttcattcctctacatcaatg

SEQ ID NO: 89610 - DNA, 25 bp, Mus musculus
aattgttcattcgtctacatcaatg

SEQ ID NO: 89611 - DNA, 25 bp, Mus musculus
aattgttccacaatcctgtgtgtca

SEQ ID NO: 89612 - DNA, 25 bp, Mus musculus
aattgttccacattcctgtgtgtca

SEQ ID NO: 89613 - DNA, 25 bp, Mus musculus
aattgttccaccaacatctccatga

SEQ ID NO: 89614 - DNA, 25 bp, Mus musculus
aattgttccacctacatctccatga

SEQ ID NO: 89615 - DNA, 25 bp, Mus musculus
aattgttccatgaagttcctgcctt

SEQ ID NO: 89616 - DNA, 25 bp, Mus musculus
aattgttccatgtagttcctgcctt

SEQ ID NO: 89617 - DNA, 25 bp, Mus musculus
aattgttcctatcccttgagcaact

SEQ ID NO: 89618 - DNA, 25 bp, Mus musculus
aattgttcctatgccttgagcaact

SEQ ID NO: 89619 - DNA, 25 bp, Mus musculus
aattgttcctcactgggtctggagc

SEQ ID NO: 89620 - DNA, 25 bp, Mus musculus
aattgttcctcagtgggtctggagc

SEQ ID NO: 89621 - DNA, 25 bp, Mus musculus
aattgttcctgtcatttggttgggc

SEQ ID NO: 89622 - DNA, 25 bp, Mus musculus
aattgttcctgtgatttggttgggc

SEQ ID NO: 89623 - DNA, 25 bp, Mus musculus
aattgttccttgattgtactggttc

SEQ ID NO: 89624 - DNA, 25 bp, Mus musculus
aattgttccttgtttgtactggttc

SEQ ID NO: 89625 - DNA, 25 bp, Mus musculus
aattgttctgtaacgtcactgtgga

SEQ ID NO: 89626 - DNA, 25 bp, Mus musculus
aattgttctgtatcgtcactgtgga

SEQ ID NO: 89627 - DNA, 25 bp, Mus musculus
aattgttctgtcactatggctaccc

SEQ ID NO: 89628 - DNA, 25 bp, Mus musculus
aattgttctgtctctatggctaccc

SEQ ID NO: 89629 - DNA, 25 bp, Mus musculus
aattgttcttctctctgagtcttga

SEQ ID NO: 89630 - DNA, 25 bp, Mus musculus
aattgttcttctgtctgagtcttga

SEQ ID NO: 89631 - DNA, 25 bp, Mus musculus
aattgttgaagcctcttccaaacaa

SEQ ID NO: 89632 - DNA, 25 bp, Mus musculus
aattgttgaagcgtcttccaaacaa

SEQ ID NO: 89633 - DNA, 25 bp, Mus musculus
aattgttgacatcttttgactgctc

SEQ ID NO: 89634 - DNA, 25 bp, Mus musculus
aattgttgacatgttttgactgctc

SEQ ID NO: 89635 - DNA, 25 bp, Mus musculus
aattgttgagagactcctccacatc

SEQ ID NO: 89636 - DNA, 25 bp, Mus musculus
aattgttgagagtctcctccacatc

SEQ ID NO: 89637 - DNA, 25 bp, Mus musculus
aattgttgatgtatggcttggtggc

SEQ ID NO: 89638 - DNA, 25 bp, Mus musculus
aattgttgatgtttggcttggtggc

SEQ ID NO: 89639 - DNA, 25 bp, Mus musculus
aattgttgatttcttggctatgtgc

SEQ ID NO: 89640 - DNA, 25 bp, Mus musculus
aattgttgatttgttggctatgtgc

SEQ ID NO: 89641 - DNA, 25 bp, Mus musculus
aattgttgcagccagcaccctgaat

SEQ ID NO: 89642 - DNA, 25 bp, Mus musculus
aattgttgcagcgagcaccctgaat

SEQ ID NO: 89643 - DNA, 25 bp, Mus musculus
aattgttggaatacgctgcttgttc

SEQ ID NO: 89644 - DNA, 25 bp, Mus musculus
aattgttggaattcgctgcttgttc

SEQ ID NO: 89645 - DNA, 25 bp, Mus musculus
aattgttggagaagagctgcttttc

SEQ ID NO: 89646 - DNA, 25 bp, Mus musculus
aattgttggagatgagctgcttttc

SEQ ID NO: 89647 - DNA, 25 bp, Mus musculus
aattgttgtccacgcagcagcctga

SEQ ID NO: 89648 - DNA, 25 bp, Mus musculus
aattgttgtccaggcagcagcctga

SEQ ID NO: 89649 - DNA, 25 bp, Mus musculus
aattgttgtctgaggattactgcga

SEQ ID NO: 89650 - DNA, 25 bp, Mus musculus
aattgttgtctgtggattactgcga

SEQ ID NO: 89651 - DNA, 25 bp, Mus musculus
aattgttgtgtgagatacctgtata

SEQ ID NO: 89652 - DNA, 25 bp, Mus musculus
aattgttgtgtgtgatacctgtata

SEQ ID NO: 89653 - DNA, 25 bp, Mus musculus
aattgtttaactcggcttacttctg

SEQ ID NO: 89654 - DNA, 25 bp, Mus musculus
aattgtttaactgggcttacttctg

SEQ ID NO: 89655 - DNA, 25 bp, Mus musculus
aattgtttacccacaaatatttcat

SEQ ID NO: 89656 - DNA, 25 bp, Mus musculus
aattgtttaccctcaaatatttcat

SEQ ID NO: 89657 - DNA, 25 bp, Mus musculus
aattgtttatagaggccatgagaga

SEQ ID NO: 89658 - DNA, 25 bp, Mus musculus
aattgtttatagtggccatgagaga

SEQ ID NO: 89659 - DNA, 25 bp, Mus musculus
aattgtttatccctatatgtggaac

SEQ ID NO: 89660 - DNA, 25 bp, Mus musculus
aattgtttatccgtatatgtggaac

SEQ ID NO: 89661 - DNA, 25 bp, Mus musculus
aattgtttattacttccatgctatg

SEQ ID NO: 89662 - DNA, 25 bp, Mus musculus
aattgtttattagttccatgctatg

SEQ ID NO: 89663 - DNA, 25 bp, Mus musculus
aattgtttcaaaccatcacttgttg

SEQ ID NO: 89664 - DNA, 25 bp, Mus musculus
aattgtttcaaagcatcacttgttg

SEQ ID NO: 89665 - DNA, 25 bp, Mus musculus
aattgtttccaacgcacttcaggta

SEQ ID NO: 89666 - DNA, 25 bp, Mus musculus
aattgtttccaaggcacttcaggta

SEQ ID NO: 89667 - DNA, 25 bp, Mus musculus
aattgtttctatctatccttcaaac

SEQ ID NO: 89668 - DNA, 25 bp, Mus musculus
aattgtttctatgtatccttcaaac

SEQ ID NO: 89669 - DNA, 25 bp, Mus musculus
aattgtttggccacctagaatcagc

SEQ ID NO: 89670 - DNA, 25 bp, Mus musculus
aattgtttggcctcctagaatcagc

SEQ ID NO: 89671 - DNA, 25 bp, Mus musculus
aattgtttggtcaagtaggtctcac

SEQ ID NO: 89672 - DNA, 25 bp, Mus musculus
aattgtttggtctagtaggtctcac

SEQ ID NO: 89673 - DNA, 25 bp, Mus musculus
aattgtttgtatattctcacagggt

SEQ ID NO: 89674 - DNA, 25 bp, Mus musculus
aattgtttgtattttctcacagggt

SEQ ID NO: 89675 - DNA, 25 bp, Mus musculus
aattgttttaacacagaccctgcaa

SEQ ID NO: 89676 - DNA, 25 bp, Mus musculus
aattgttttaactcagaccctgcaa

SEQ ID NO: 89677 - DNA, 25 bp, Mus musculus
aattgttttacaacctcttggaatg

SEQ ID NO: 89678 - DNA, 25 bp, Mus musculus
aattgttttacatcctcttggaatg

SEQ ID NO: 89679 - DNA, 25 bp, Mus musculus
aattgttttactctctgcgtgttga

SEQ ID NO: 89680 - DNA, 25 bp, Mus musculus
aattgttttactgtctgcgtgttga

SEQ ID NO: 89681 - DNA, 25 bp, Mus musculus
aattgttttatcacttgcttttcac

SEQ ID NO: 89682 - DNA, 25 bp, Mus musculus
aattgttttatctcttgcttttcac

SEQ ID NO: 89683 - DNA, 25 bp, Mus musculus
aattgttttcctaatttctcctgca

SEQ ID NO: 89684 - DNA, 25 bp, Mus musculus
aattgttttccttatttctcctgca

SEQ ID NO: 89685 - DNA, 25 bp, Mus musculus
aattgttttgaccaatcccgtgtgc

SEQ ID NO: 89686 - DNA, 25 bp, Mus musculus
aattgttttgacgaatcccgtgtgc

SEQ ID NO: 89687 - DNA, 25 bp, Mus musculus
aattgttttgagattgagcgaccta

SEQ ID NO: 89688 - DNA, 25 bp, Mus musculus
aattgttttgagtttgagcgaccta

SEQ ID NO: 89689 - DNA, 25 bp, Mus musculus
aattgttttgtacatgcctttaagt

SEQ ID NO: 89690 - DNA, 25 bp, Mus musculus
aattgttttgtagatgcctttaagt

SEQ ID NO: 89691 - DNA, 25 bp, Mus musculus
aatttaaagtgtagcaatagcaaca

SEQ ID NO: 89692 - DNA, 25 bp, Mus musculus
aatttaaagtgttgcaatagcaaca

SEQ ID NO: 89693 - DNA, 25 bp, Mus musculus
aatttaaattacatgcagctaaggt

SEQ ID NO: 89694 - DNA, 25 bp, Mus musculus
aatttaaattacttgcagctaaggt

SEQ ID NO: 89695 - DNA, 25 bp, Mus musculus
aatttaaattctctccatctatcta

SEQ ID NO: 89696 - DNA, 25 bp, Mus musculus
aatttaaattctgtccatctatcta

SEQ ID NO: 89697 - DNA, 25 bp, Mus musculus
aatttaacaacacacagacacccag

SEQ ID NO: 89698 - DNA, 25 bp, Mus musculus
aatttaacaacagacagacacccag

SEQ ID NO: 89699 - DNA, 25 bp, Mus musculus
aatttaacatgacctcacgctggca

SEQ ID NO: 89700 - DNA, 25 bp, Mus musculus
aatttaacatgagctcacgctggca

SEQ ID NO: 89701 - DNA, 25 bp, Mus musculus
aatttaacccacattttcacatagt

SEQ ID NO: 89702 - DNA, 25 bp, Mus musculus
aatttaacccactttttcacatagt

SEQ ID NO: 89703 - DNA, 25 bp, Mus musculus
aatttaacggccacacgtcgtgcag

SEQ ID NO: 89704 - DNA, 25 bp, Mus musculus
aatttaacggcctcacgtcgtgcag

SEQ ID NO: 89705 - DNA, 25 bp, Mus musculus
aatttaactattagccaattgtgct

SEQ ID NO: 89706 - DNA, 25 bp, Mus musculus
aatttaactatttgccaattgtgct

SEQ ID NO: 89707 - DNA, 25 bp, Mus musculus
aatttaactctaccctctttggtgg

SEQ ID NO: 89708 - DNA, 25 bp, Mus musculus
aatttaactctagcctctttggtgg

SEQ ID NO: 89709 - DNA, 25 bp, Mus musculus
aatttaactgatcgcctcttgctgc

SEQ ID NO: 89710 - DNA, 25 bp, Mus musculus
aatttaactgatggcctcttgctgc

SEQ ID NO: 89711 - DNA, 25 bp, Mus musculus
aatttaagagtcagtgaataaccat

SEQ ID NO: 89712 - DNA, 25 bp, Mus musculus
aatttaagagtctgtgaataaccat

SEQ ID NO: 89713 - DNA, 25 bp, Mus musculus
aatttaagatggatgctttctgagg

SEQ ID NO: 89714 - DNA, 25 bp, Mus musculus
aatttaagatggttgctttctgagg

SEQ ID NO: 89715 - DNA, 25 bp, Mus musculus
aatttaatcacccttacagcttctg

SEQ ID NO: 89716 - DNA, 25 bp, Mus musculus
aatttaatcaccgttacagcttctg

SEQ ID NO: 89717 - DNA, 25 bp, Mus musculus
aatttaatccgaccatgtgggtggc

SEQ ID NO: 89718 - DNA, 25 bp, Mus musculus
aatttaatccgagcatgtgggtggc

SEQ ID NO: 89719 - DNA, 25 bp, Mus musculus
aatttaatgcacagggactgctggg

SEQ ID NO: 89720 - DNA, 25 bp, Mus musculus
aatttaatgcactgggactgctggg

SEQ ID NO: 89721 - DNA, 25 bp, Mus musculus
aatttaattaatcggcacttcctgc

SEQ ID NO: 89722 - DNA, 25 bp, Mus musculus
aatttaattaatgggcacttcctgc

SEQ ID NO: 89723 - DNA, 25 bp, Mus musculus
aatttacaaagccacatgccccatt

SEQ ID NO: 89724 - DNA, 25 bp, Mus musculus
aatttacaaagcgacatgccccatt

SEQ ID NO: 89725 - DNA, 25 bp, Mus musculus
aatttacaagtgagcgagccccaaa

SEQ ID NO: 89726 - DNA, 25 bp, Mus musculus
aatttacaagtgtgcgagccccaaa

SEQ ID NO: 89727 - DNA, 25 bp, Mus musculus
aatttacacgtgcagtcccaactgt

SEQ ID NO: 89728 - DNA, 25 bp, Mus musculus
aatttacacgtggagtcccaactgt

SEQ ID NO: 89729 - DNA, 25 bp, Mus musculus
aatttacactggaagctctcccatg

SEQ ID NO: 89730 - DNA, 25 bp, Mus musculus
aatttacactggatacccgctgagt

SEQ ID NO: 89731 - DNA, 25 bp, Mus musculus
aatttacactggtagctctcccatg

SEQ ID NO: 89732 - DNA, 25 bp, Mus musculus
aatttacactggttacccgctgagt

SEQ ID NO: 89733 - DNA, 25 bp, Mus musculus
aatttacagtttctgcgtgtatgga

SEQ ID NO: 89734 - DNA, 25 bp, Mus musculus
aatttacagtttgtgcgtgtatgga

SEQ ID NO: 89735 - DNA, 25 bp, Mus musculus
aatttacatattcgacagagtctga

SEQ ID NO: 89736 - DNA, 25 bp, Mus musculus
aatttacatattggacagagtctga

SEQ ID NO: 89737 - DNA, 25 bp, Mus musculus
aatttacatgttacactgcctcact

SEQ ID NO: 89738 - DNA, 25 bp, Mus musculus
aatttacatgtttcactgcctcact

SEQ ID NO: 89739 - DNA, 25 bp, Mus musculus
aatttacattcactgggcatagctg

SEQ ID NO: 89740 - DNA, 25 bp, Mus musculus
aatttacattcagtgggcatagctg

SEQ ID NO: 89741 - DNA, 25 bp, Mus musculus
aatttaccaagccatctgtgagagt

SEQ ID NO: 89742 - DNA, 25 bp, Mus musculus
aatttaccaagcgatctgtgagagt

SEQ ID NO: 89743 - DNA, 25 bp, Mus musculus
aatttaccaattagagatgcataca

SEQ ID NO: 89744 - DNA, 25 bp, Mus musculus
aatttaccaatttgagatgcataca

SEQ ID NO: 89745 - DNA, 25 bp, Mus musculus
aatttaccacatatgacatcccgag

SEQ ID NO: 89746 - DNA, 25 bp, Mus musculus
aatttaccacatttgacatcccgag

SEQ ID NO: 89747 - DNA, 25 bp, Mus musculus
aatttaccataaaccttaagctctg

SEQ ID NO: 89748 - DNA, 25 bp, Mus musculus
aatttaccataatccttaagctctg

SEQ ID NO: 89749 - DNA, 25 bp, Mus musculus
aatttaccatttattctccttgaag

SEQ ID NO: 89750 - DNA, 25 bp, Mus musculus
aatttaccattttttctccttgaag

SEQ ID NO: 89751 - DNA, 25 bp, Mus musculus
aatttacccagaatagacactcccg

SEQ ID NO: 89752 - DNA, 25 bp, Mus musculus
aatttacccagattagacactcccg

SEQ ID NO: 89753 - DNA, 25 bp, Mus musculus
aatttacccattctgcttagctttg

SEQ ID NO: 89754 - DNA, 25 bp, Mus musculus
aatttacccattgtgcttagctttg

SEQ ID NO: 89755 - DNA, 25 bp, Mus musculus
aatttaccctgcagtttcattgcct

SEQ ID NO: 89756 - DNA, 25 bp, Mus musculus
aatttaccctgctgtttcattgcct

SEQ ID NO: 89757 - DNA, 25 bp, Mus musculus
aatttacctctgaaatgccagtccc

SEQ ID NO: 89758 - DNA, 25 bp, Mus musculus
aatttacctctgatcccattggtga

SEQ ID NO: 89759 - DNA, 25 bp, Mus musculus
aatttacctctgtaatgccagtccc

SEQ ID NO: 89760 - DNA, 25 bp, Mus musculus
aatttacctctgttcccattggtga

SEQ ID NO: 89761 - DNA, 25 bp, Mus musculus
aatttaccttctaagttgtcttgtg

SEQ ID NO: 89762 - DNA, 25 bp, Mus musculus
aatttaccttcttagttgtcttgtg

SEQ ID NO: 89763 - DNA, 25 bp, Mus musculus
aatttacgcataaagcagactgcat

SEQ ID NO: 89764 - DNA, 25 bp, Mus musculus
aatttacgcatatagcagactgcat

SEQ ID NO: 89765 - DNA, 25 bp, Mus musculus
aatttacgggttcgtgactctgctg

SEQ ID NO: 89766 - DNA, 25 bp, Mus musculus
aatttacgggttggtgactctgctg

SEQ ID NO: 89767 - DNA, 25 bp, Mus musculus
aatttactaatacctggctgcttct

SEQ ID NO: 89768 - DNA, 25 bp, Mus musculus
aatttactaatagctggctgcttct

SEQ ID NO: 89769 - DNA, 25 bp, Mus musculus
aatttactagtcagaagctttctgt

SEQ ID NO: 89770 - DNA, 25 bp, Mus musculus
aatttactagtctgaagctttctgt

SEQ ID NO: 89771 - DNA, 25 bp, Mus musculus
aatttactcacaatcacacgcgatt

SEQ ID NO: 89772 - DNA, 25 bp, Mus musculus
aatttactcacattcacacgcgatt

SEQ ID NO: 89773 - DNA, 25 bp, Mus musculus
aatttactcaggaactcactgtgat

SEQ ID NO: 89774 - DNA, 25 bp, Mus musculus
aatttactcaggtactcactgtgat

SEQ ID NO: 89775 - DNA, 25 bp, Mus musculus
aatttactccaactgcactactgcc

SEQ ID NO: 89776 - DNA, 25 bp, Mus musculus
aatttactccaagtgcactactgcc

SEQ ID NO: 89777 - DNA, 25 bp, Mus musculus
aatttactcgttctagctacaatga

SEQ ID NO: 89778 - DNA, 25 bp, Mus musculus
aatttactcgttgtagctacaatga

SEQ ID NO: 89779 - DNA, 25 bp, Mus musculus
aatttactgtgtcacctgtctctgc

SEQ ID NO: 89780 - DNA, 25 bp, Mus musculus
aatttactgtgtgacctgtctctgc

SEQ ID NO: 89781 - DNA, 25 bp, Mus musculus
aatttacttactctcctagcaataa

SEQ ID NO: 89782 - DNA, 25 bp, Mus musculus
aatttacttactgtcctagcaataa

SEQ ID NO: 89783 - DNA, 25 bp, Mus musculus
aatttacttcctacacatttgcttc

SEQ ID NO: 89784 - DNA, 25 bp, Mus musculus
aatttacttccttcacatttgcttc

SEQ ID NO: 89785 - DNA, 25 bp, Mus musculus
aatttactttaaccctgagtggtct

SEQ ID NO: 89786 - DNA, 25 bp, Mus musculus
aatttactttaagcctgagtggtct

SEQ ID NO: 89787 - DNA, 25 bp, Mus musculus
aatttagaacacactgtggcacatt

SEQ ID NO: 89788 - DNA, 25 bp, Mus musculus
aatttagaacactctgtggcacatt

SEQ ID NO: 89789 - DNA, 25 bp, Mus musculus
aatttagaacatcaagctcagcagc

SEQ ID NO: 89790 - DNA, 25 bp, Mus musculus
aatttagaacatgaagctcagcagc

SEQ ID NO: 89791 - DNA, 25 bp, Mus musculus
aatttagaatccctgaccaccgctc

SEQ ID NO: 89792 - DNA, 25 bp, Mus musculus
aatttagaatccgtgaccaccgctc

SEQ ID NO: 89793 - DNA, 25 bp, Mus musculus
aatttagacggcattttatgccaat

SEQ ID NO: 89794 - DNA, 25 bp, Mus musculus
aatttagacggctttttatgccaat

SEQ ID NO: 89795 - DNA, 25 bp, Mus musculus
aatttagagactacaggtgccagtt

SEQ ID NO: 89796 - DNA, 25 bp, Mus musculus
aatttagagacttcaggtgccagtt

SEQ ID NO: 89797 - DNA, 25 bp, Mus musculus
aatttagagcaaccatgttgttttt

SEQ ID NO: 89798 - DNA, 25 bp, Mus musculus
aatttagagcaagcatgttgttttt

SEQ ID NO: 89799 - DNA, 25 bp, Mus musculus
aatttagcacctcagagaaagcaat

SEQ ID NO: 89800 - DNA, 25 bp, Mus musculus
aatttagcacctgagagaaagcaat

SEQ ID NO: 89801 - DNA, 25 bp, Mus musculus
aatttagccattccgaagctctggg

SEQ ID NO: 89802 - DNA, 25 bp, Mus musculus
aatttagccattgcgaagctctggg

SEQ ID NO: 89803 - DNA, 25 bp, Mus musculus
aatttagctgtgcttaggcactctg

SEQ ID NO: 89804 - DNA, 25 bp, Mus musculus
aatttagctgtggttaggcactctg

SEQ ID NO: 89805 - DNA, 25 bp, Mus musculus
aatttaggcagtacaaggctctgtc

SEQ ID NO: 89806 - DNA, 25 bp, Mus musculus
aatttaggcagttcaaggctctgtc

SEQ ID NO: 89807 - DNA, 25 bp, Mus musculus
aatttaggttttcctttccctgcat

SEQ ID NO: 89808 - DNA, 25 bp, Mus musculus
aatttaggttttgctttccctgcat

SEQ ID NO: 89809 - DNA, 25 bp, Mus musculus
aatttagtatccctctgcaatgcag

SEQ ID NO: 89810 - DNA, 25 bp, Mus musculus
aatttagtatccgtctgcaatgcag

SEQ ID NO: 89811 - DNA, 25 bp, Mus musculus
aatttagtcgccagtatgggagttc

SEQ ID NO: 89812 - DNA, 25 bp, Mus musculus
aatttagtcgcctgtatgggagttc

SEQ ID NO: 89813 - DNA, 25 bp, Mus musculus
aatttagtctacattgatctctcag

SEQ ID NO: 89814 - DNA, 25 bp, Mus musculus
aatttagtctactttgatctctcag

SEQ ID NO: 89815 - DNA, 25 bp, Mus musculus
aatttagtctgtacttcttacaaga

SEQ ID NO: 89816 - DNA, 25 bp, Mus musculus
aatttagtctgttcttcttacaaga

SEQ ID NO: 89817 - DNA, 25 bp, Mus musculus
aatttagtgcctctgccgtctctgg

SEQ ID NO: 89818 - DNA, 25 bp, Mus musculus
aatttagtgcctgtgccgtctctgg

SEQ ID NO: 89819 - DNA, 25 bp, Mus musculus
aatttagtgcttacagagctgactt

SEQ ID NO: 89820 - DNA, 25 bp, Mus musculus
aatttagtgctttcagagctgactt

SEQ ID NO: 89821 - DNA, 25 bp, Mus musculus
aatttagttcataaggccaggcagt

SEQ ID NO: 89822 - DNA, 25 bp, Mus musculus
aatttagttcatatgggctgtagta

SEQ ID NO: 89823 - DNA, 25 bp, Mus musculus
aatttagttcattaggccaggcagt

SEQ ID NO: 89824 - DNA, 25 bp, Mus musculus
aatttagttcatttgggctgtagta

SEQ ID NO: 89825 - DNA, 25 bp, Mus musculus
aatttagtttgtagcttccatttga

SEQ ID NO: 89826 - DNA, 25 bp, Mus musculus
aatttagtttgttgcttccatttga

SEQ ID NO: 89827 - DNA, 25 bp, Mus musculus
aatttagttttcactgcaacccagt

SEQ ID NO: 89828 - DNA, 25 bp, Mus musculus
aatttagttttctctgcaacccagt

SEQ ID NO: 89829 - DNA, 25 bp, Mus musculus
aatttataagctacatcacgtcgga

SEQ ID NO: 89830 - DNA, 25 bp, Mus musculus
aatttataagcttcatcacgtcgga

SEQ ID NO: 89831 - DNA, 25 bp, Mus musculus
aatttataatgaaccctaccctctt

SEQ ID NO: 89832 - DNA, 25 bp, Mus musculus
aatttataatgatccctaccctctt

SEQ ID NO: 89833 - DNA, 25 bp, Mus musculus
aatttataccctatggcattcctgg

SEQ ID NO: 89834 - DNA, 25 bp, Mus musculus
aatttataccctttggcattcctgg

SEQ ID NO: 89835 - DNA, 25 bp, Mus musculus
aatttatagctcaagcctgtgcctc

SEQ ID NO: 89836 - DNA, 25 bp, Mus musculus
aatttatagctctagcctgtgcctc

SEQ ID NO: 89837 - DNA, 25 bp, Mus musculus
aatttatagtacattatccctcata

SEQ ID NO: 89838 - DNA, 25 bp, Mus musculus
aatttatagtactttatccctcata

SEQ ID NO: 89839 - DNA, 25 bp, Mus musculus
aatttatatcaccatttccttattg

SEQ ID NO: 89840 - DNA, 25 bp, Mus musculus
aatttatatcacgatttccttattg

SEQ ID NO: 89841 - DNA, 25 bp, Mus musculus
aatttatatccaagtatctcaccca

SEQ ID NO: 89842 - DNA, 25 bp, Mus musculus
aatttatatccatgtatctcaccca

SEQ ID NO: 89843 - DNA, 25 bp, Mus musculus
aatttatcaagcattaacttagcat

SEQ ID NO: 89844 - DNA, 25 bp, Mus musculus
aatttatcaagctttaacttagcat

SEQ ID NO: 89845 - DNA, 25 bp, Mus musculus
aatttatcatttcttaggccttctg

SEQ ID NO: 89846 - DNA, 25 bp, Mus musculus
aatttatcatttgttaggccttctg

SEQ ID NO: 89847 - DNA, 25 bp, Mus musculus
aatttatcccgtctgaccttgagtc

SEQ ID NO: 89848 - DNA, 25 bp, Mus musculus
aatttatcccgtgtgaccttgagtc

SEQ ID NO: 89849 - DNA, 25 bp, Mus musculus
aatttatctgtaaccgttgcaatgg

SEQ ID NO: 89850 - DNA, 25 bp, Mus musculus
aatttatctgtatccgttgcaatgg

SEQ ID NO: 89851 - DNA, 25 bp, Mus musculus
aatttatgcacaatctcactcgcgt

SEQ ID NO: 89852 - DNA, 25 bp, Mus musculus
aatttatgcacattctcactcgcgt

SEQ ID NO: 89853 - DNA, 25 bp, Mus musculus
aatttatgccacagtatatcccgag

SEQ ID NO: 89854 - DNA, 25 bp, Mus musculus
aatttatgccactgtatatcccgag

SEQ ID NO: 89855 - DNA, 25 bp, Mus musculus
aatttatgctctctgtgttggctcg

SEQ ID NO: 89856 - DNA, 25 bp, Mus musculus
aatttatgctctgtgtgttggctcg

SEQ ID NO: 89857 - DNA, 25 bp, Mus musculus
aatttatggagactggcgtttacca

SEQ ID NO: 89858 - DNA, 25 bp, Mus musculus
aatttatggagagtggcgtttacca

SEQ ID NO: 89859 - DNA, 25 bp, Mus musculus
aatttatgtagtcgtcaaagagccc

SEQ ID NO: 89860 - DNA, 25 bp, Mus musculus
aatttatgtagtggtcaaagagccc

SEQ ID NO: 89861 - DNA, 25 bp, Mus musculus
aatttatgtcataacgctcccgcag

SEQ ID NO: 89862 - DNA, 25 bp, Mus musculus
aatttatgtcattacgctcccgcag

SEQ ID NO: 89863 - DNA, 25 bp, Mus musculus
aatttatgttcgaaggactctgcct

SEQ ID NO: 89864 - DNA, 25 bp, Mus musculus
aatttatgttcgtaggactctgcct

SEQ ID NO: 89865 - DNA, 25 bp, Mus musculus
aatttatgttgcagttcccacgtac

SEQ ID NO: 89866 - DNA, 25 bp, Mus musculus
aatttatgttgctgttcccacgtac

SEQ ID NO: 89867 - DNA, 25 bp, Mus musculus
aatttattaaacacacctggtctag

SEQ ID NO: 89868 - DNA, 25 bp, Mus musculus
aatttattaaactcacctggtctag

SEQ ID NO: 89869 - DNA, 25 bp, Mus musculus
aatttattacagaacagggaacatg

SEQ ID NO: 89870 - DNA, 25 bp, Mus musculus
aatttattacagtacagggaacatg

SEQ ID NO: 89871 - DNA, 25 bp, Mus musculus
aatttattactgcattatacactat

SEQ ID NO: 89872 - DNA, 25 bp, Mus musculus
aatttattactggattatacactat

SEQ ID NO: 89873 - DNA, 25 bp, Mus musculus
aatttattcactctgtcaggaaaag

SEQ ID NO: 89874 - DNA, 25 bp, Mus musculus
aatttattcactgtgtcaggaaaag

SEQ ID NO: 89875 - DNA, 25 bp, Mus musculus
aatttattgcacagaatttgggagc

SEQ ID NO: 89876 - DNA, 25 bp, Mus musculus
aatttattgcactgaatttgggagc

SEQ ID NO: 89877 - DNA, 25 bp, Mus musculus
aatttatttccactccatcagactc

SEQ ID NO: 89878 - DNA, 25 bp, Mus musculus
aatttatttccagtccatcagactc

SEQ ID NO: 89879 - DNA, 25 bp, Mus musculus
aatttatttgtaagcctgaactgca

SEQ ID NO: 89880 - DNA, 25 bp, Mus musculus
aatttatttgtatgcctgaactgca

SEQ ID NO: 89881 - DNA, 25 bp, Mus musculus
aatttatttgtcatgctggtctgtt

SEQ ID NO: 89882 - DNA, 25 bp, Mus musculus
aatttatttgtcttgctggtctgtt

SEQ ID NO: 89883 - DNA, 25 bp, Mus musculus
aatttattttccagtgtcactgagt

SEQ ID NO: 89884 - DNA, 25 bp, Mus musculus
aatttattttcctgtgtcactgagt

SEQ ID NO: 89885 - DNA, 25 bp, Mus musculus
aatttcaacgttacctcaagagctt

SEQ ID NO: 89886 - DNA, 25 bp, Mus musculus
aatttcaacgtttcctcaagagctt

SEQ ID NO: 89887 - DNA, 25 bp, Mus musculus
aatttcaactgcatcttgaacccta

SEQ ID NO: 89888 - DNA, 25 bp, Mus musculus
aatttcaactgcttcttgaacccta

SEQ ID NO: 89889 - DNA, 25 bp, Mus musculus
aatttcaaggcaactttccaccgag

SEQ ID NO: 89890 - DNA, 25 bp, Mus musculus
aatttcaaggcatctttccaccgag

SEQ ID NO: 89891 - DNA, 25 bp, Mus musculus
aatttcaagttcagacataccagtg

SEQ ID NO: 89892 - DNA, 25 bp, Mus musculus
aatttcaagttctgacataccagtg

SEQ ID NO: 89893 - DNA, 25 bp, Mus musculus
aatttcaataccacgacttttgcag

SEQ ID NO: 89894 - DNA, 25 bp, Mus musculus
aatttcaatacctcgacttttgcag

SEQ ID NO: 89895 - DNA, 25 bp, Mus musculus
aatttcaatgaaacccttatctctt

SEQ ID NO: 89896 - DNA, 25 bp, Mus musculus
aatttcaatgaatcccttatctctt

SEQ ID NO: 89897 - DNA, 25 bp, Mus musculus
aatttcaatgttaacactgtttgtt

SEQ ID NO: 89898 - DNA, 25 bp, Mus musculus
aatttcaatgtttacactgtttgtt

SEQ ID NO: 89899 - DNA, 25 bp, Mus musculus
aatttcaattacctcttcctgcaga

SEQ ID NO: 89900 - DNA, 25 bp, Mus musculus
aatttcaattacgtcttcctgcaga

SEQ ID NO: 89901 - DNA, 25 bp, Mus musculus
aatttcacagtgactaatcattata

SEQ ID NO: 89902 - DNA, 25 bp, Mus musculus
aatttcacagtgtctaatcattata

SEQ ID NO: 89903 - DNA, 25 bp, Mus musculus
aatttcaccgccctgggagagaata

SEQ ID NO: 89904 - DNA, 25 bp, Mus musculus
aatttcaccgccgtgggagagaata

SEQ ID NO: 89905 - DNA, 25 bp, Mus musculus
aatttcacctacagccctgacaaca

SEQ ID NO: 89906 - DNA, 25 bp, Mus musculus
aatttcacctactgccctgacaaca

SEQ ID NO: 89907 - DNA, 25 bp, Mus musculus
aatttcactcacaagtcagtctacc

SEQ ID NO: 89908 - DNA, 25 bp, Mus musculus
aatttcactcactagtcagtctacc

SEQ ID NO: 89909 - DNA, 25 bp, Mus musculus
aatttcacttatcttgctgggtgtg

SEQ ID NO: 89910 - DNA, 25 bp, Mus musculus
aatttcacttatgttgctgggtgtg

SEQ ID NO: 89911 - DNA, 25 bp, Mus musculus
aatttcagatagacccatgcacctt

SEQ ID NO: 89912 - DNA, 25 bp, Mus musculus
aatttcagatagtcccatgcacctt

SEQ ID NO: 89913 - DNA, 25 bp, Mus musculus
aatttcagatgtccccatgactttt

SEQ ID NO: 89914 - DNA, 25 bp, Mus musculus
aatttcagatgtgcccatgactttt

SEQ ID NO: 89915 - DNA, 25 bp, Mus musculus
aatttcagcagcaccgagcagttta

SEQ ID NO: 89916 - DNA, 25 bp, Mus musculus
aatttcagcagctccgagcagttta

SEQ ID NO: 89917 - DNA, 25 bp, Mus musculus
aatttcagccatcgacaggtcaggt

SEQ ID NO: 89918 - DNA, 25 bp, Mus musculus
aatttcagccatggacaggtcaggt

SEQ ID NO: 89919 - DNA, 25 bp, Mus musculus
aatttcaggactatgccattcttca

SEQ ID NO: 89920 - DNA, 25 bp, Mus musculus
aatttcaggactttgccattcttca

SEQ ID NO: 89921 - DNA, 25 bp, Mus musculus
aatttcaggcagaatatttatcata

SEQ ID NO: 89922 - DNA, 25 bp, Mus musculus
aatttcaggcagtatatttatcata

SEQ ID NO: 89923 - DNA, 25 bp, Mus musculus
aatttcagtactactgggagtgaga

SEQ ID NO: 89924 - DNA, 25 bp, Mus musculus
aatttcagtacttctgggagtgaga

SEQ ID NO: 89925 - DNA, 25 bp, Mus musculus
aatttcagtcttagttattctgatg

SEQ ID NO: 89926 - DNA, 25 bp, Mus musculus
aatttcagtctttgttattctgatg

SEQ ID NO: 89927 - DNA, 25 bp, Mus musculus
aatttcagtggccaagcagccttca

SEQ ID NO: 89928 - DNA, 25 bp, Mus musculus
aatttcagtggcgaagcagccttca

SEQ ID NO: 89929 - DNA, 25 bp, Mus musculus
aatttcagttcacggcatgaccttc

SEQ ID NO: 89930 - DNA, 25 bp, Mus musculus
aatttcagttcagggcatgaccttc

SEQ ID NO: 89931 - DNA, 25 bp, Mus musculus
aatttcatacatatagtcttcattg

SEQ ID NO: 89932 - DNA, 25 bp, Mus musculus
aatttcatacatttagtcttcattg

SEQ ID NO: 89933 - DNA, 25 bp, Mus musculus
aatttcataccaatctttttccact

SEQ ID NO: 89934 - DNA, 25 bp, Mus musculus
aatttcataccattctttttccact

SEQ ID NO: 89935 - DNA, 25 bp, Mus musculus
aatttcatactgactacctagcaag

SEQ ID NO: 89936 - DNA, 25 bp, Mus musculus
aatttcatactgtctacctagcaag

SEQ ID NO: 89937 - DNA, 25 bp, Mus musculus
aatttcatatgtcctttttgctaat

SEQ ID NO: 89938 - DNA, 25 bp, Mus musculus
aatttcatatgtgctttttgctaat

SEQ ID NO: 89939 - DNA, 25 bp, Mus musculus
aatttcatatttagggcggcatttc

SEQ ID NO: 89940 - DNA, 25 bp, Mus musculus
aatttcatattttgggcggcatttc

SEQ ID NO: 89941 - DNA, 25 bp, Mus musculus
aatttcatcacccaaggtccttacg

SEQ ID NO: 89942 - DNA, 25 bp, Mus musculus
aatttcatcaccgaaggtccttacg

SEQ ID NO: 89943 - DNA, 25 bp, Mus musculus
aatttcatcctaacactacagtaga

SEQ ID NO: 89944 - DNA, 25 bp, Mus musculus
aatttcatcctatcactacagtaga

SEQ ID NO: 89945 - DNA, 25 bp, Mus musculus
aatttcatgaaaaacttgtagtttt

SEQ ID NO: 89946 - DNA, 25 bp, Mus musculus
aatttcatgaaatacttgtagtttt

SEQ ID NO: 89947 - DNA, 25 bp, Mus musculus
aatttcatgaagagccctcctgctg

SEQ ID NO: 89948 - DNA, 25 bp, Mus musculus
aatttcatgaagtgccctcctgctg

SEQ ID NO: 89949 - DNA, 25 bp, Mus musculus
aatttcatgatcaacacactccctt

SEQ ID NO: 89950 - DNA, 25 bp, Mus musculus
aatttcatgatctacacactccctt

SEQ ID NO: 89951 - DNA, 25 bp, Mus musculus
aatttcatggctagaagtgttcacc

SEQ ID NO: 89952 - DNA, 25 bp, Mus musculus
aatttcatggcttgaagtgttcacc

SEQ ID NO: 89953 - DNA, 25 bp, Mus musculus
aatttcatgtagcacttggccctgc

SEQ ID NO: 89954 - DNA, 25 bp, Mus musculus
aatttcatgtaggacttggccctgc

SEQ ID NO: 89955 - DNA, 25 bp, Mus musculus
aatttcatgtctctgtgtgcatttg

SEQ ID NO: 89956 - DNA, 25 bp, Mus musculus
aatttcatgtctgtgtgtgcatttg

SEQ ID NO: 89957 - DNA, 25 bp, Mus musculus
aatttcatgtggatcgcccatgcca

SEQ ID NO: 89958 - DNA, 25 bp, Mus musculus
aatttcatgtggttcgcccatgcca

SEQ ID NO: 89959 - DNA, 25 bp, Mus musculus
aatttcattcacctcatttggcaaa

SEQ ID NO: 89960 - DNA, 25 bp, Mus musculus
aatttcattcacgtcatttggcaaa

SEQ ID NO: 89961 - DNA, 25 bp, Mus musculus
aatttcattccgaggccatcttgcc

SEQ ID NO: 89962 - DNA, 25 bp, Mus musculus
aatttcattccgtggccatcttgcc

SEQ ID NO: 89963 - DNA, 25 bp, Mus musculus
aatttcattgccaagttcctctgac

SEQ ID NO: 89964 - DNA, 25 bp, Mus musculus
aatttcattgcctagttcctctgac

SEQ ID NO: 89965 - DNA, 25 bp, Mus musculus
aatttcatttcaagctgcattgtag

SEQ ID NO: 89966 - DNA, 25 bp, Mus musculus
aatttcatttcatgctgcattgtag

SEQ ID NO: 89967 - DNA, 25 bp, Mus musculus
aatttcattttgaaatgtaccccag

SEQ ID NO: 89968 - DNA, 25 bp, Mus musculus
aatttcattttgtaatgtaccccag

SEQ ID NO: 89969 - DNA, 25 bp, Mus musculus
aatttccaaactaccgtgattcctg

SEQ ID NO: 89970 - DNA, 25 bp, Mus musculus
aatttccaaacttccgtgattcctg

SEQ ID NO: 89971 - DNA, 25 bp, Mus musculus
aatttccaaatgacctcacaactgc

SEQ ID NO: 89972 - DNA, 25 bp, Mus musculus
aatttccaaatgtcctcacaactgc

SEQ ID NO: 89973 - DNA, 25 bp, Mus musculus
aatttccaagtaagtgagtctgtgt

SEQ ID NO: 89974 - DNA, 25 bp, Mus musculus
aatttccaagtatgtgagtctgtgt

SEQ ID NO: 89975 - DNA, 25 bp, Mus musculus
aatttccaatgcactcctaacagat

SEQ ID NO: 89976 - DNA, 25 bp, Mus musculus
aatttccaatgctctcctaacagat

SEQ ID NO: 89977 - DNA, 25 bp, Mus musculus
aatttccaatgtcttctccaaccat

SEQ ID NO: 89978 - DNA, 25 bp, Mus musculus
aatttccaatgtgttctccaaccat

SEQ ID NO: 89979 - DNA, 25 bp, Mus musculus
aatttccacaaaactatccgctcag

SEQ ID NO: 89980 - DNA, 25 bp, Mus musculus
aatttccacaaatctatccgctcag

SEQ ID NO: 89981 - DNA, 25 bp, Mus musculus
aatttccacataatctcacactcat

SEQ ID NO: 89982 - DNA, 25 bp, Mus musculus
aatttccacatattctcacactcat

SEQ ID NO: 89983 - DNA, 25 bp, Mus musculus
aatttccacttgatctcatgggata

SEQ ID NO: 89984 - DNA, 25 bp, Mus musculus
aatttccacttgttctcatgggata

SEQ ID NO: 89985 - DNA, 25 bp, Mus musculus
aatttccagagaagcccgacactat

SEQ ID NO: 89986 - DNA, 25 bp, Mus musculus
aatttccagagatgcccgacactat

SEQ ID NO: 89987 - DNA, 25 bp, Mus musculus
aatttccagatcattgccatgactg

SEQ ID NO: 89988 - DNA, 25 bp, Mus musculus
aatttccagatctttgccatgactg

SEQ ID NO: 89989 - DNA, 25 bp, Mus musculus
aatttccagcataaactaacgtcag

SEQ ID NO: 89990 - DNA, 25 bp, Mus musculus
aatttccagcattaactaacgtcag

SEQ ID NO: 89991 - DNA, 25 bp, Mus musculus
aatttccagtttatcttgtttgcat

SEQ ID NO: 89992 - DNA, 25 bp, Mus musculus
aatttccagtttttcttgtttgcat

SEQ ID NO: 89993 - DNA, 25 bp, Mus musculus
aatttccatattaaagttgaacaag

SEQ ID NO: 89994 - DNA, 25 bp, Mus musculus
aatttccatatttaagttgaacaag

SEQ ID NO: 89995 - DNA, 25 bp, Mus musculus
aatttcccaagcacaaagccttatt

SEQ ID NO: 89996 - DNA, 25 bp, Mus musculus
aatttcccaagcagtactcaaactc

SEQ ID NO: 89997 - DNA, 25 bp, Mus musculus
aatttcccaagcattccaataggat

SEQ ID NO: 89998 - DNA, 25 bp, Mus musculus
aatttcccaagctcaaagccttatt

SEQ ID NO: 89999 - DNA, 25 bp, Mus musculus
aatttcccaagctgtactcaaactc

SEQ ID NO: 90000 - DNA, 25 bp, Mus musculus
aatttcccaagctttccaataggat

SEQ ID NO: 90001 - DNA, 25 bp, Mus musculus
aatttcccaaggaacctctgtgctt

SEQ ID NO: 90002 - DNA, 25 bp, Mus musculus
aatttcccaaggtacctctgtgctt

SEQ ID NO: 90003 - DNA, 25 bp, Mus musculus
aatttccccataagtcaggcttggg

SEQ ID NO: 90004 - DNA, 25 bp, Mus musculus
aatttccccatatgtcaggcttggg

SEQ ID NO: 90005 - DNA, 25 bp, Mus musculus
aatttccccatgagtaccattgcat

SEQ ID NO: 90006 - DNA, 25 bp, Mus musculus
aatttccccatgtgtaccattgcat

SEQ ID NO: 90007 - DNA, 25 bp, Mus musculus
aatttccccggaacttccgattctg

SEQ ID NO: 90008 - DNA, 25 bp, Mus musculus
aatttccccggatcttccgattctg

SEQ ID NO: 90009 - DNA, 25 bp, Mus musculus
aatttcccctaacccagggcagaag

SEQ ID NO: 90010 - DNA, 25 bp, Mus musculus
aatttcccctaagccagggcagaag

SEQ ID NO: 90011 - DNA, 25 bp, Mus musculus
aatttccctaacacatgcatttctg

SEQ ID NO: 90012 - DNA, 25 bp, Mus musculus
aatttccctaactcatgcatttctg

SEQ ID NO: 90013 - DNA, 25 bp, Mus musculus
aatttccctattaggcccttctcat

SEQ ID NO: 90014 - DNA, 25 bp, Mus musculus
aatttccctatttggcccttctcat

SEQ ID NO: 90015 - DNA, 25 bp, Mus musculus
aatttccctcacattggcaagctga

SEQ ID NO: 90016 - DNA, 25 bp, Mus musculus
aatttccctcactttggcaagctga

SEQ ID NO: 90017 - DNA, 25 bp, Mus musculus
aatttccctgcgcattctgtaagaa

SEQ ID NO: 90018 - DNA, 25 bp, Mus musculus
aatttccctgcggattctgtaagaa

SEQ ID NO: 90019 - DNA, 25 bp, Mus musculus
aatttccctgtaattgagccaagta

SEQ ID NO: 90020 - DNA, 25 bp, Mus musculus
aatttccctgtacttgtcttctcat

SEQ ID NO: 90021 - DNA, 25 bp, Mus musculus
aatttccctgtagttgtcttctcat

SEQ ID NO: 90022 - DNA, 25 bp, Mus musculus
aatttccctgtatttgagccaagta

SEQ ID NO: 90023 - DNA, 25 bp, Mus musculus
aatttcctactaccaggtcactgag

SEQ ID NO: 90024 - DNA, 25 bp, Mus musculus
aatttcctactagcaggtcactgag

SEQ ID NO: 90025 - DNA, 25 bp, Mus musculus
aatttcctatagcacttcatatcgg

SEQ ID NO: 90026 - DNA, 25 bp, Mus musculus
aatttcctataggacttcatatcgg

SEQ ID NO: 90027 - DNA, 25 bp, Mus musculus
aatttcctattcaatacattccatg

SEQ ID NO: 90028 - DNA, 25 bp, Mus musculus
aatttcctattctatacattccatg

SEQ ID NO: 90029 - DNA, 25 bp, Mus musculus
aatttcctccctagtgagactcctg

SEQ ID NO: 90030 - DNA, 25 bp, Mus musculus
aatttcctcccttgtgagactcctg

SEQ ID NO: 90031 - DNA, 25 bp, Mus musculus
aatttcctcctgacttaaggccatg

SEQ ID NO: 90032 - DNA, 25 bp, Mus musculus
aatttcctcctgtcttaaggccatg

SEQ ID NO: 90033 - DNA, 25 bp, Mus musculus
aatttcctccttcagagttcagaga

SEQ ID NO: 90034 - DNA, 25 bp, Mus musculus
aatttcctccttgagagttcagaga

SEQ ID NO: 90035 - DNA, 25 bp, Mus musculus
aatttcctcttcacgttcagtgaaa

SEQ ID NO: 90036 - DNA, 25 bp, Mus musculus
aatttcctcttctcgttcagtgaaa

SEQ ID NO: 90037 - DNA, 25 bp, Mus musculus
aatttcctctttatcactagcagct

SEQ ID NO: 90038 - DNA, 25 bp, Mus musculus
aatttcctctttttcactagcagct

SEQ ID NO: 90039 - DNA, 25 bp, Mus musculus
aatttcctgcctcgattccttccat

SEQ ID NO: 90040 - DNA, 25 bp, Mus musculus
aatttcctgcctggattccttccat

SEQ ID NO: 90041 - DNA, 25 bp, Mus musculus
aatttcctgtatactagattttata

SEQ ID NO: 90042 - DNA, 25 bp, Mus musculus
aatttcctgtatagcctttgtaggg

SEQ ID NO: 90043 - DNA, 25 bp, Mus musculus
aatttcctgtattctagattttata

SEQ ID NO: 90044 - DNA, 25 bp, Mus musculus
aatttcctgtattgcctttgtaggg

SEQ ID NO: 90045 - DNA, 25 bp, Mus musculus
aatttcctgtcaccttacgattgta

SEQ ID NO: 90046 - DNA, 25 bp, Mus musculus
aatttcctgtcagcttacgattgta

SEQ ID NO: 90047 - DNA, 25 bp, Mus musculus
aatttcctgtgacgagagactggga

SEQ ID NO: 90048 - DNA, 25 bp, Mus musculus
aatttcctgtgaggagagactggga

SEQ ID NO: 90049 - DNA, 25 bp, Mus musculus
aatttcctgtggctcatcatggaga

SEQ ID NO: 90050 - DNA, 25 bp, Mus musculus
aatttcctgtgggtcatcatggaga

SEQ ID NO: 90051 - DNA, 25 bp, Mus musculus
aatttcctgttgattggcatgtgta

SEQ ID NO: 90052 - DNA, 25 bp, Mus musculus
aatttcctgttgtttggcatgtgta

SEQ ID NO: 90053 - DNA, 25 bp, Mus musculus
aatttccttatcaaacatgcttaaa

SEQ ID NO: 90054 - DNA, 25 bp, Mus musculus
aatttccttatctaacatgcttaaa

SEQ ID NO: 90055 - DNA, 25 bp, Mus musculus
aatttccttctgcagtatagtttga

SEQ ID NO: 90056 - DNA, 25 bp, Mus musculus
aatttccttctggagtatagtttga

SEQ ID NO: 90057 - DNA, 25 bp, Mus musculus
aatttccttgcacagtttggcctta

SEQ ID NO: 90058 - DNA, 25 bp, Mus musculus
aatttccttgcagagtttggcctta

SEQ ID NO: 90059 - DNA, 25 bp, Mus musculus
aatttccttttgagtactctcgact

SEQ ID NO: 90060 - DNA, 25 bp, Mus musculus
aatttccttttgtgtactctcgact

SEQ ID NO: 90061 - DNA, 25 bp, Mus musculus
aatttcgacgagccgttacatattc

SEQ ID NO: 90062 - DNA, 25 bp, Mus musculus
aatttcgacgaggcgttacatattc

SEQ ID NO: 90063 - DNA, 25 bp, Mus musculus
aatttcgagatactgtttggtactc

SEQ ID NO: 90064 - DNA, 25 bp, Mus musculus
aatttcgagatagtgtttggtactc

SEQ ID NO: 90065 - DNA, 25 bp, Mus musculus
aatttcgaggagaacctgcgcgcgc

SEQ ID NO: 90066 - DNA, 25 bp, Mus musculus
aatttcgaggagtacctgcgcgcgc

SEQ ID NO: 90067 - DNA, 25 bp, Mus musculus
aatttcggagacaaaactagtactg

SEQ ID NO: 90068 - DNA, 25 bp, Mus musculus
aatttcggagactaaactagtactg

SEQ ID NO: 90069 - DNA, 25 bp, Mus musculus
aatttcgtagtgctcaattgcaacg

SEQ ID NO: 90070 - DNA, 25 bp, Mus musculus
aatttcgtagtggtcaattgcaacg

SEQ ID NO: 90071 - DNA, 25 bp, Mus musculus
aatttcgtctgtcctgacttactag

SEQ ID NO: 90072 - DNA, 25 bp, Mus musculus
aatttcgtctgtgctgacttactag

SEQ ID NO: 90073 - DNA, 25 bp, Mus musculus
aatttctaagtaaacccatgcctat

SEQ ID NO: 90074 - DNA, 25 bp, Mus musculus
aatttctaagtatacccatgcctat

SEQ ID NO: 90075 - DNA, 25 bp, Mus musculus
aatttctactgtatattcccatctt

SEQ ID NO: 90076 - DNA, 25 bp, Mus musculus
aatttctactgtttattcccatctt

SEQ ID NO: 90077 - DNA, 25 bp, Mus musculus
aatttctagacgctgttacagctgt

SEQ ID NO: 90078 - DNA, 25 bp, Mus musculus
aatttctagacggtgttacagctgt

SEQ ID NO: 90079 - DNA, 25 bp, Mus musculus
aatttctagagcatcttgcagacct

SEQ ID NO: 90080 - DNA, 25 bp, Mus musculus
aatttctagagcttcttgcagacct

SEQ ID NO: 90081 - DNA, 25 bp, Mus musculus
aatttctagggactctcctgtctct

SEQ ID NO: 90082 - DNA, 25 bp, Mus musculus
aatttctagggagtctcctgtctct

SEQ ID NO: 90083 - DNA, 25 bp, Mus musculus
aatttctatatgatttggcaagcac

SEQ ID NO: 90084 - DNA, 25 bp, Mus musculus
aatttctatatgttttggcaagcac

SEQ ID NO: 90085 - DNA, 25 bp, Mus musculus
aatttctcaacccacaacattccga

SEQ ID NO: 90086 - DNA, 25 bp, Mus musculus
aatttctcaaccgacaacattccga

SEQ ID NO: 90087 - DNA, 25 bp, Mus musculus
aatttctcacatcctcattggcggg

SEQ ID NO: 90088 - DNA, 25 bp, Mus musculus
aatttctcacatgctcattggcggg

SEQ ID NO: 90089 - DNA, 25 bp, Mus musculus
aatttctcaggaccattgcaaggca

SEQ ID NO: 90090 - DNA, 25 bp, Mus musculus
aatttctcaggagcattgcaaggca

SEQ ID NO: 90091 - DNA, 25 bp, Mus musculus
aatttctcattaccataactttcag

SEQ ID NO: 90092 - DNA, 25 bp, Mus musculus
aatttctcattagcataactttcag

SEQ ID NO: 90093 - DNA, 25 bp, Mus musculus
aatttctcattccatttctcaggat

SEQ ID NO: 90094 - DNA, 25 bp, Mus musculus
aatttctcattcgatttctcaggat

SEQ ID NO: 90095 - DNA, 25 bp, Mus musculus
aatttctccctgacccagtatataa

SEQ ID NO: 90096 - DNA, 25 bp, Mus musculus
aatttctccctgtcccagtatataa

SEQ ID NO: 90097 - DNA, 25 bp, Mus musculus
aatttctcccttaaatgtggaccag

SEQ ID NO: 90098 - DNA, 25 bp, Mus musculus
aatttctcccttatgtgttcattgt

SEQ ID NO: 90099 - DNA, 25 bp, Mus musculus
aatttctcccttcacaaagctttga

SEQ ID NO: 90100 - DNA, 25 bp, Mus musculus
aatttctcccttgacaaagctttga

SEQ ID NO: 90101 - DNA, 25 bp, Mus musculus
aatttctccctttaatgtggaccag

SEQ ID NO: 90102 - DNA, 25 bp, Mus musculus
aatttctcccttttgtgttcattgt

SEQ ID NO: 90103 - DNA, 25 bp, Mus musculus
aatttctcctttatcttgccccatt

SEQ ID NO: 90104 - DNA, 25 bp, Mus musculus
aatttctcctttttcttgccccatt

SEQ ID NO: 90105 - DNA, 25 bp, Mus musculus
aatttctcgacaattagcccttagc

SEQ ID NO: 90106 - DNA, 25 bp, Mus musculus
aatttctcgacatttagcccttagc

SEQ ID NO: 90107 - DNA, 25 bp, Mus musculus
aatttctcgttaattatgcccctag

SEQ ID NO: 90108 - DNA, 25 bp, Mus musculus
aatttctcgttatttatgcccctag

SEQ ID NO: 90109 - DNA, 25 bp, Mus musculus
aatttctctagcatgctaaacactt

SEQ ID NO: 90110 - DNA, 25 bp, Mus musculus
aatttctctagcttgctaaacactt

SEQ ID NO: 90111 - DNA, 25 bp, Mus musculus
aatttctctccaatctaacttttga

SEQ ID NO: 90112 - DNA, 25 bp, Mus musculus
aatttctctccattctaacttttga

SEQ ID NO: 90113 - DNA, 25 bp, Mus musculus
aatttctctcttcgagtcgttgctg

SEQ ID NO: 90114 - DNA, 25 bp, Mus musculus
aatttctctcttggagtcgttgctg

SEQ ID NO: 90115 - DNA, 25 bp, Mus musculus
aatttctctgaaagtctagatgcat

SEQ ID NO: 90116 - DNA, 25 bp, Mus musculus
aatttctctgaatgtctagatgcat

SEQ ID NO: 90117 - DNA, 25 bp, Mus musculus
aatttctcttctctatattcccatg

SEQ ID NO: 90118 - DNA, 25 bp, Mus musculus
aatttctcttctgtatattcccatg

SEQ ID NO: 90119 - DNA, 25 bp, Mus musculus
aatttctgaagaagataccaccaac

SEQ ID NO: 90120 - DNA, 25 bp, Mus musculus
aatttctgaagatgataccaccaac

SEQ ID NO: 90121 - DNA, 25 bp, Mus musculus
aatttctgagcactcattagccctg

SEQ ID NO: 90122 - DNA, 25 bp, Mus musculus
aatttctgagcagtcattagccctg

SEQ ID NO: 90123 - DNA, 25 bp, Mus musculus
aatttctgagtaatcctgtgcctgc

SEQ ID NO: 90124 - DNA, 25 bp, Mus musculus
aatttctgagtattcctgtgcctgc

SEQ ID NO: 90125 - DNA, 25 bp, Mus musculus
aatttctgccatccatatgtaatgc

SEQ ID NO: 90126 - DNA, 25 bp, Mus musculus
aatttctgccatgcatatgtaatgc

SEQ ID NO: 90127 - DNA, 25 bp, Mus musculus
aatttctgccctacacactgtagaa

SEQ ID NO: 90128 - DNA, 25 bp, Mus musculus
aatttctgcccttcacactgtagaa

SEQ ID NO: 90129 - DNA, 25 bp, Mus musculus
aatttctgccgtctagactggttct

SEQ ID NO: 90130 - DNA, 25 bp, Mus musculus
aatttctgccgtgtagactggttct

SEQ ID NO: 90131 - DNA, 25 bp, Mus musculus
aatttctgcctgatattgaacccaa

SEQ ID NO: 90132 - DNA, 25 bp, Mus musculus
aatttctgcctgttattgaacccaa

SEQ ID NO: 90133 - DNA, 25 bp, Mus musculus
aatttctgctccctgggagatcagt

SEQ ID NO: 90134 - DNA, 25 bp, Mus musculus
aatttctgctccgtgggagatcagt

SEQ ID NO: 90135 - DNA, 25 bp, Mus musculus
aatttctggatcatttgtactatgt

SEQ ID NO: 90136 - DNA, 25 bp, Mus musculus
aatttctggatcttttgtactatgt

SEQ ID NO: 90137 - DNA, 25 bp, Mus musculus
aatttctgggcccttctgacctact

SEQ ID NO: 90138 - DNA, 25 bp, Mus musculus
aatttctgggccgttctgacctact

SEQ ID NO: 90139 - DNA, 25 bp, Mus musculus
aatttctggtatcgtatttatccac

SEQ ID NO: 90140 - DNA, 25 bp, Mus musculus
aatttctggtatggtatttatccac

SEQ ID NO: 90141 - DNA, 25 bp, Mus musculus
aatttctggtccctaattgtgaaga

SEQ ID NO: 90142 - DNA, 25 bp, Mus musculus
aatttctggtccgtaattgtgaaga

SEQ ID NO: 90143 - DNA, 25 bp, Mus musculus
aatttctggtcgcatgtgtgccttt

SEQ ID NO: 90144 - DNA, 25 bp, Mus musculus
aatttctggtcggatgtgtgccttt

SEQ ID NO: 90145 - DNA, 25 bp, Mus musculus
aatttctggtgcagtttgtttctgt

SEQ ID NO: 90146 - DNA, 25 bp, Mus musculus
aatttctggtgctgtttgtttctgt

SEQ ID NO: 90147 - DNA, 25 bp, Mus musculus
aatttctgtcttagtttctctcaat

SEQ ID NO: 90148 - DNA, 25 bp, Mus musculus
aatttctgtctttgtttctctcaat

SEQ ID NO: 90149 - DNA, 25 bp, Mus musculus
aatttctgtgacacttaacccaaag

SEQ ID NO: 90150 - DNA, 25 bp, Mus musculus
aatttctgtgactcttaacccaaag

SEQ ID NO: 90151 - DNA, 25 bp, Mus musculus
aatttctgtgtgcattctcatcata

SEQ ID NO: 90152 - DNA, 25 bp, Mus musculus
aatttctgtgtggattctcatcata

SEQ ID NO: 90153 - DNA, 25 bp, Mus musculus
aatttcttacacaactagggctgtt

SEQ ID NO: 90154 - DNA, 25 bp, Mus musculus
aatttcttacactactagggctgtt

SEQ ID NO: 90155 - DNA, 25 bp, Mus musculus
aatttcttacctaatcttgtgctac

SEQ ID NO: 90156 - DNA, 25 bp, Mus musculus
aatttcttaccttatcttgtgctac

SEQ ID NO: 90157 - DNA, 25 bp, Mus musculus
aatttcttactgaatgacatatgtt

SEQ ID NO: 90158 - DNA, 25 bp, Mus musculus
aatttcttactgtatgacatatgtt

SEQ ID NO: 90159 - DNA, 25 bp, Mus musculus
aatttcttaggtatcaggaactctg

SEQ ID NO: 90160 - DNA, 25 bp, Mus musculus
aatttcttaggtttcaggaactctg

SEQ ID NO: 90161 - DNA, 25 bp, Mus musculus
aatttcttatccacacctcttgagt

SEQ ID NO: 90162 - DNA, 25 bp, Mus musculus
aatttcttatcctcacctcttgagt

SEQ ID NO: 90163 - DNA, 25 bp, Mus musculus
aatttcttcaacagtgcttcttcca

SEQ ID NO: 90164 - DNA, 25 bp, Mus musculus
aatttcttcaactgtgcttcttcca

SEQ ID NO: 90165 - DNA, 25 bp, Mus musculus
aatttcttcataatatggactcacc

SEQ ID NO: 90166 - DNA, 25 bp, Mus musculus
aatttcttcatattatggactcacc

SEQ ID NO: 90167 - DNA, 25 bp, Mus musculus
aatttcttcattagtttagtctgga

SEQ ID NO: 90168 - DNA, 25 bp, Mus musculus
aatttcttcatttgtttagtctgga

SEQ ID NO: 90169 - DNA, 25 bp, Mus musculus
aatttcttcctaatgctcgctctgt

SEQ ID NO: 90170 - DNA, 25 bp, Mus musculus
aatttcttcctattgctcgctctgt

SEQ ID NO: 90171 - DNA, 25 bp, Mus musculus
aatttcttctaaacccttctggatg

SEQ ID NO: 90172 - DNA, 25 bp, Mus musculus
aatttcttctaatcccttctggatg

SEQ ID NO: 90173 - DNA, 25 bp, Mus musculus
aatttcttctgacaggctttatcca

SEQ ID NO: 90174 - DNA, 25 bp, Mus musculus
aatttcttctgagaggctttatcca

SEQ ID NO: 90175 - DNA, 25 bp, Mus musculus
aatttcttctgccactgaatgtcct

SEQ ID NO: 90176 - DNA, 25 bp, Mus musculus
aatttcttctgcgactgaatgtcct

SEQ ID NO: 90177 - DNA, 25 bp, Mus musculus
aatttcttctggctaaatctccacc

SEQ ID NO: 90178 - DNA, 25 bp, Mus musculus
aatttcttctgggtaaatctccacc

SEQ ID NO: 90179 - DNA, 25 bp, Mus musculus
aatttcttgaagacggtcatgcgta

SEQ ID NO: 90180 - DNA, 25 bp, Mus musculus
aatttcttgaagtcggtcatgcgta

SEQ ID NO: 90181 - DNA, 25 bp, Mus musculus
aatttcttgcatattatcctcccag

SEQ ID NO: 90182 - DNA, 25 bp, Mus musculus
aatttcttgcattttatcctcccag

SEQ ID NO: 90183 - DNA, 25 bp, Mus musculus
aatttcttggtcagtagtcacctgt

SEQ ID NO: 90184 - DNA, 25 bp, Mus musculus
aatttcttggtctgtagtcacctgt

SEQ ID NO: 90185 - DNA, 25 bp, Mus musculus
aatttctttaatcctttgctgttgc

SEQ ID NO: 90186 - DNA, 25 bp, Mus musculus
aatttctttaatgctttgctgttgc

SEQ ID NO: 90187 - DNA, 25 bp, Mus musculus
aatttctttactatggctcctacca

SEQ ID NO: 90188 - DNA, 25 bp, Mus musculus
aatttctttactttggctcctacca

SEQ ID NO: 90189 - DNA, 25 bp, Mus musculus
aatttctttatcatctcctcacaac

SEQ ID NO: 90190 - DNA, 25 bp, Mus musculus
aatttctttatcttctcctcacaac

SEQ ID NO: 90191 - DNA, 25 bp, Mus musculus
aatttctttctaaagttcttggcac

SEQ ID NO: 90192 - DNA, 25 bp, Mus musculus
aatttctttctatagttcttggcac

SEQ ID NO: 90193 - DNA, 25 bp, Mus musculus
aatttctttctgcactcataatcat

SEQ ID NO: 90194 - DNA, 25 bp, Mus musculus
aatttctttctggactcataatcat

SEQ ID NO: 90195 - DNA, 25 bp, Mus musculus
aatttctttgagaaacgagtttctg

SEQ ID NO: 90196 - DNA, 25 bp, Mus musculus
aatttctttgagtaacgagtttctg

SEQ ID NO: 90197 - DNA, 25 bp, Mus musculus
aatttctttggtctatcgtggatca

SEQ ID NO: 90198 - DNA, 25 bp, Mus musculus
aatttctttggtgtatcgtggatca

SEQ ID NO: 90199 - DNA, 25 bp, Mus musculus
aatttcttttatccattattggaga

SEQ ID NO: 90200 - DNA, 25 bp, Mus musculus
aatttcttttatgcattattggaga

SEQ ID NO: 90201 - DNA, 25 bp, Mus musculus
aatttcttttctctatcttctgctc

SEQ ID NO: 90202 - DNA, 25 bp, Mus musculus
aatttcttttctgtatcttctgctc

SEQ ID NO: 90203 - DNA, 25 bp, Mus musculus
aatttcttttgcaagagcatgctag

SEQ ID NO: 90204 - DNA, 25 bp, Mus musculus
aatttcttttgctagagcatgctag

SEQ ID NO: 90205 - DNA, 25 bp, Mus musculus
aatttgaaacaacccactccaacct

SEQ ID NO: 90206 - DNA, 25 bp, Mus musculus
aatttgaaacaagccactccaacct

SEQ ID NO: 90207 - DNA, 25 bp, Mus musculus
aatttgaacctgagtatttggcaca

SEQ ID NO: 90208 - DNA, 25 bp, Mus musculus
aatttgaacctgtgtatttggcaca

SEQ ID NO: 90209 - DNA, 25 bp, Mus musculus
aatttgaactgcagtggcttccgga

SEQ ID NO: 90210 - DNA, 25 bp, Mus musculus
aatttgaactgctgtggcttccgga

SEQ ID NO: 90211 - DNA, 25 bp, Mus musculus
aatttgaagcaaatgtgggccacaa

SEQ ID NO: 90212 - DNA, 25 bp, Mus musculus
aatttgaagcaattgtgggccacaa

SEQ ID NO: 90213 - DNA, 25 bp, Mus musculus
aatttgaaggaaagctaacagccac

SEQ ID NO: 90214 - DNA, 25 bp, Mus musculus
aatttgaaggaatgctaacagccac

SEQ ID NO: 90215 - DNA, 25 bp, Mus musculus
aatttgaaggccagcaggagcctcc

SEQ ID NO: 90216 - DNA, 25 bp, Mus musculus
aatttgaaggcctgcaggagcctcc

SEQ ID NO: 90217 - DNA, 25 bp, Mus musculus
aatttgaatcacaagaacccacata

SEQ ID NO: 90218 - DNA, 25 bp, Mus musculus
aatttgaatcactagaacccacata

SEQ ID NO: 90219 - DNA, 25 bp, Mus musculus
aatttgaattggaccctcttattat

SEQ ID NO: 90220 - DNA, 25 bp, Mus musculus
aatttgaattggtccctcttattat

SEQ ID NO: 90221 - DNA, 25 bp, Mus musculus
aatttgaattttaagcagaacccag

SEQ ID NO: 90222 - DNA, 25 bp, Mus musculus
aatttgaatttttagcagaacccag

SEQ ID NO: 90223 - DNA, 25 bp, Mus musculus
aatttgacaagaaagtgctggtctt

SEQ ID NO: 90224 - DNA, 25 bp, Mus musculus
aatttgacaagatagtgctggtctt

SEQ ID NO: 90225 - DNA, 25 bp, Mus musculus
aatttgacacctcattcttcctctt

SEQ ID NO: 90226 - DNA, 25 bp, Mus musculus
aatttgacacctgattcttcctctt

SEQ ID NO: 90227 - DNA, 25 bp, Mus musculus
aatttgaccaggcaagacctcctga

SEQ ID NO: 90228 - DNA, 25 bp, Mus musculus
aatttgaccagggaagacctcctga

SEQ ID NO: 90229 - DNA, 25 bp, Mus musculus
aatttgacccttaacatgctgctaa

SEQ ID NO: 90230 - DNA, 25 bp, Mus musculus
aatttgaccctttacatgctgctaa

SEQ ID NO: 90231 - DNA, 25 bp, Mus musculus
aatttgacgatgcatctggatcagt

SEQ ID NO: 90232 - DNA, 25 bp, Mus musculus
aatttgacgatggatctggatcagt

SEQ ID NO: 90233 - DNA, 25 bp, Mus musculus
aatttgactccccatagaaactgga

SEQ ID NO: 90234 - DNA, 25 bp, Mus musculus
aatttgactcccgatagaaactgga

SEQ ID NO: 90235 - DNA, 25 bp, Mus musculus
aatttgactctgctgggtcatctgc

SEQ ID NO: 90236 - DNA, 25 bp, Mus musculus
aatttgactctggtgggtcatctgc

SEQ ID NO: 90237 - DNA, 25 bp, Mus musculus
aatttgactgtgaacttgatttccc

SEQ ID NO: 90238 - DNA, 25 bp, Mus musculus
aatttgactgtgtacttgatttccc

SEQ ID NO: 90239 - DNA, 25 bp, Mus musculus
aatttgactgttagctcgttctttc

SEQ ID NO: 90240 - DNA, 25 bp, Mus musculus
aatttgactgtttgctcgttctttc

SEQ ID NO: 90241 - DNA, 25 bp, Mus musculus
aatttgagacaaaacgccgtgagca

SEQ ID NO: 90242 - DNA, 25 bp, Mus musculus
aatttgagacaatacgccgtgagca

SEQ ID NO: 90243 - DNA, 25 bp, Mus musculus
aatttgagccgcagcatcgacgccg

SEQ ID NO: 90244 - DNA, 25 bp, Mus musculus
aatttgagccgctgcatcgacgccg

SEQ ID NO: 90245 - DNA, 25 bp, Mus musculus
aatttgagcctaattaagttgaaag

SEQ ID NO: 90246 - DNA, 25 bp, Mus musculus
aatttgagcctatttaagttgaaag

SEQ ID NO: 90247 - DNA, 25 bp, Mus musculus
aatttgaggacaacttctttggaaa

SEQ ID NO: 90248 - DNA, 25 bp, Mus musculus
aatttgaggacatcttctttggaaa

SEQ ID NO: 90249 - DNA, 25 bp, Mus musculus
aatttgaggcaacttttccctgaag

SEQ ID NO: 90250 - DNA, 25 bp, Mus musculus
aatttgaggcaagttttccctgaag

SEQ ID NO: 90251 - DNA, 25 bp, Mus musculus
aatttgaggcccacaggctgtgtgc

SEQ ID NO: 90252 - DNA, 25 bp, Mus musculus
aatttgaggccctcaggctgtgtgc

SEQ ID NO: 90253 - DNA, 25 bp, Mus musculus
aatttgaggcctaatggctctgtcc

SEQ ID NO: 90254 - DNA, 25 bp, Mus musculus
aatttgaggccttatggctctgtcc

SEQ ID NO: 90255 - DNA, 25 bp, Mus musculus
aatttgaggcgcatctcctcttatt

SEQ ID NO: 90256 - DNA, 25 bp, Mus musculus
aatttgaggcgcttctcctcttatt

SEQ ID NO: 90257 - DNA, 25 bp, Mus musculus
aatttgaggcttatgacaacgcggt

SEQ ID NO: 90258 - DNA, 25 bp, Mus musculus
aatttgaggcttttgacaacgcggt

SEQ ID NO: 90259 - DNA, 25 bp, Mus musculus
aatttgagtagtacagtttccacca

SEQ ID NO: 90260 - DNA, 25 bp, Mus musculus
aatttgagtagttcagtttccacca

SEQ ID NO: 90261 - DNA, 25 bp, Mus musculus
aatttgagtcctagcgatgattctg

SEQ ID NO: 90262 - DNA, 25 bp, Mus musculus
aatttgagtccttgcgatgattctg

SEQ ID NO: 90263 - DNA, 25 bp, Mus musculus
aatttgagtcgtcgtcgagactcct

SEQ ID NO: 90264 - DNA, 25 bp, Mus musculus
aatttgagtcgtggtcgagactcct

SEQ ID NO: 90265 - DNA, 25 bp, Mus musculus
aatttgagttttcacttagcatagc

SEQ ID NO: 90266 - DNA, 25 bp, Mus musculus
aatttgagttttgacttagcatagc

SEQ ID NO: 90267 - DNA, 25 bp, Mus musculus
aatttgatacggaccttgtggctat

SEQ ID NO: 90268 - DNA, 25 bp, Mus musculus
aatttgatacggtccttgtggctat

SEQ ID NO: 90269 - DNA, 25 bp, Mus musculus
aatttgatcccaccctatctcaaaa

SEQ ID NO: 90270 - DNA, 25 bp, Mus musculus
aatttgatcccagcctatctcaaaa

SEQ ID NO: 90271 - DNA, 25 bp, Mus musculus
aatttgatcctcatcatccaagtct

SEQ ID NO: 90272 - DNA, 25 bp, Mus musculus
aatttgatcctcttcatccaagtct

SEQ ID NO: 90273 - DNA, 25 bp, Mus musculus
aatttgatccttattgcttctagca

SEQ ID NO: 90274 - DNA, 25 bp, Mus musculus
aatttgatcctttttgcttctagca

SEQ ID NO: 90275 - DNA, 25 bp, Mus musculus
aatttgatctaccatgtcctctgaa

SEQ ID NO: 90276 - DNA, 25 bp, Mus musculus
aatttgatctacgatgtcctctgaa

SEQ ID NO: 90277 - DNA, 25 bp, Mus musculus
aatttgatctcaatggttggacctc

SEQ ID NO: 90278 - DNA, 25 bp, Mus musculus
aatttgatctcattggttggacctc

SEQ ID NO: 90279 - DNA, 25 bp, Mus musculus
aatttgatgaaactgccaccctttg

SEQ ID NO: 90280 - DNA, 25 bp, Mus musculus
aatttgatgaaagtgccaccctttg

SEQ ID NO: 90281 - DNA, 25 bp, Mus musculus
aatttgatgaacacacgacaggtgt

SEQ ID NO: 90282 - DNA, 25 bp, Mus musculus
aatttgatgaactcacgacaggtgt

SEQ ID NO: 90283 - DNA, 25 bp, Mus musculus
aatttgatgcgtccaaacccaggaa

SEQ ID NO: 90284 - DNA, 25 bp, Mus musculus
aatttgatgcgtgcaaacccaggaa

SEQ ID NO: 90285 - DNA, 25 bp, Mus musculus
aatttgatgggaactctgcttttaa

SEQ ID NO: 90286 - DNA, 25 bp, Mus musculus
aatttgatgggatctctgcttttaa

SEQ ID NO: 90287 - DNA, 25 bp, Mus musculus
aatttgatggtgatgtagctgctgt

SEQ ID NO: 90288 - DNA, 25 bp, Mus musculus
aatttgatggtgttgtagctgctgt

SEQ ID NO: 90289 - DNA, 25 bp, Mus musculus
aatttgattatcactgcccttcagt

SEQ ID NO: 90290 - DNA, 25 bp, Mus musculus
aatttgattatctctgcccttcagt

SEQ ID NO: 90291 - DNA, 25 bp, Mus musculus
aatttgattgatacctgtcacatga

SEQ ID NO: 90292 - DNA, 25 bp, Mus musculus
aatttgattgattcctgtcacatga

SEQ ID NO: 90293 - DNA, 25 bp, Mus musculus
aatttgattggcctagatccctgct

SEQ ID NO: 90294 - DNA, 25 bp, Mus musculus
aatttgattggcgtagatccctgct

SEQ ID NO: 90295 - DNA, 25 bp, Mus musculus
aatttgcaaccccagggacatgcac

SEQ ID NO: 90296 - DNA, 25 bp, Mus musculus
aatttgcaacccgagggacatgcac

SEQ ID NO: 90297 - DNA, 25 bp, Mus musculus
aatttgcaagccagaagacagacag

SEQ ID NO: 90298 - DNA, 25 bp, Mus musculus
aatttgcaagcctgaagacagacag

SEQ ID NO: 90299 - DNA, 25 bp, Mus musculus
aatttgcaagctatcaagactccag

SEQ ID NO: 90300 - DNA, 25 bp, Mus musculus
aatttgcaagctttcaagactccag

SEQ ID NO: 90301 - DNA, 25 bp, Mus musculus
aatttgcacaagaagtttatgacac

SEQ ID NO: 90302 - DNA, 25 bp, Mus musculus
aatttgcacaagtagtttatgacac

SEQ ID NO: 90303 - DNA, 25 bp, Mus musculus
aatttgcacctgatgtcacttagaa

SEQ ID NO: 90304 - DNA, 25 bp, Mus musculus
aatttgcacctgttgtcacttagaa

SEQ ID NO: 90305 - DNA, 25 bp, Mus musculus
aatttgcactggatagagtctactg

SEQ ID NO: 90306 - DNA, 25 bp, Mus musculus
aatttgcactggttagagtctactg

SEQ ID NO: 90307 - DNA, 25 bp, Mus musculus
aatttgcactgtaccgttctggttg

SEQ ID NO: 90308 - DNA, 25 bp, Mus musculus
aatttgcactgttccgttctggttg

SEQ ID NO: 90309 - DNA, 25 bp, Mus musculus
aatttgcactttaatcgcccgacaa

SEQ ID NO: 90310 - DNA, 25 bp, Mus musculus
aatttgcactttcccagactggatg

SEQ ID NO: 90311 - DNA, 25 bp, Mus musculus
aatttgcactttgccagactggatg

SEQ ID NO: 90312 - DNA, 25 bp, Mus musculus
aatttgcacttttatcgcccgacaa

SEQ ID NO: 90313 - DNA, 25 bp, Mus musculus
aatttgcagcatacataaccttgaa

SEQ ID NO: 90314 - DNA, 25 bp, Mus musculus
aatttgcagcatattagtacttatt

SEQ ID NO: 90315 - DNA, 25 bp, Mus musculus
aatttgcagcattcataaccttgaa

SEQ ID NO: 90316 - DNA, 25 bp, Mus musculus
aatttgcagcattttagtacttatt

SEQ ID NO: 90317 - DNA, 25 bp, Mus musculus
aatttgcagtgcatttccatcttcc

SEQ ID NO: 90318 - DNA, 25 bp, Mus musculus
aatttgcagtgcttttccatcttcc

SEQ ID NO: 90319 - DNA, 25 bp, Mus musculus
aatttgcatcaaaacgactcccact

SEQ ID NO: 90320 - DNA, 25 bp, Mus musculus
aatttgcatcaatacgactcccact

SEQ ID NO: 90321 - DNA, 25 bp, Mus musculus
aatttgcatcacagtctacagtagt

SEQ ID NO: 90322 - DNA, 25 bp, Mus musculus
aatttgcatcactgtctacagtagt

SEQ ID NO: 90323 - DNA, 25 bp, Mus musculus
aatttgcatcagcaaacttttacat

SEQ ID NO: 90324 - DNA, 25 bp, Mus musculus
aatttgcatcaggaaacttttacat

SEQ ID NO: 90325 - DNA, 25 bp, Mus musculus
aatttgcatcttcctgtcgtcatgt

SEQ ID NO: 90326 - DNA, 25 bp, Mus musculus
aatttgcatcttgctgtcgtcatgt

SEQ ID NO: 90327 - DNA, 25 bp, Mus musculus
aatttgcattctcatgtggttcata

SEQ ID NO: 90328 - DNA, 25 bp, Mus musculus
aatttgcattctgatgtggttcata

SEQ ID NO: 90329 - DNA, 25 bp, Mus musculus
aatttgccaagaccgtgaagcgccc

SEQ ID NO: 90330 - DNA, 25 bp, Mus musculus
aatttgccaagagcgtgaagcgccc

SEQ ID NO: 90331 - DNA, 25 bp, Mus musculus
aatttgccaattagctctttccagc

SEQ ID NO: 90332 - DNA, 25 bp, Mus musculus
aatttgccaatttgctctttccagc

SEQ ID NO: 90333 - DNA, 25 bp, Mus musculus
aatttgccactgaattcacgggtta

SEQ ID NO: 90334 - DNA, 25 bp, Mus musculus
aatttgccactgattatggcagaca

SEQ ID NO: 90335 - DNA, 25 bp, Mus musculus
aatttgccactgtattcacgggtta

SEQ ID NO: 90336 - DNA, 25 bp, Mus musculus
aatttgccactgtttatggcagaca

SEQ ID NO: 90337 - DNA, 25 bp, Mus musculus
aatttgccatagacgcgggacggtt

SEQ ID NO: 90338 - DNA, 25 bp, Mus musculus
aatttgccatagtcgcgggacggtt

SEQ ID NO: 90339 - DNA, 25 bp, Mus musculus
aatttgccattgctggagtcctact

SEQ ID NO: 90340 - DNA, 25 bp, Mus musculus
aatttgccattggtggagtcctact

SEQ ID NO: 90341 - DNA, 25 bp, Mus musculus
aatttgcccagacttactgatcacc

SEQ ID NO: 90342 - DNA, 25 bp, Mus musculus
aatttgcccagagttactgatcacc

SEQ ID NO: 90343 - DNA, 25 bp, Mus musculus
aatttgccccaaacaggaacacata

SEQ ID NO: 90344 - DNA, 25 bp, Mus musculus
aatttgccccaatcaggaacacata

SEQ ID NO: 90345 - DNA, 25 bp, Mus musculus
aatttgcctgcgcagcagtttttga

SEQ ID NO: 90346 - DNA, 25 bp, Mus musculus
aatttgcctgcggagcagtttttga

SEQ ID NO: 90347 - DNA, 25 bp, Mus musculus
aatttgcgagcacggttggatttcc

SEQ ID NO: 90348 - DNA, 25 bp, Mus musculus
aatttgcgagcagggttggatttcc

SEQ ID NO: 90349 - DNA, 25 bp, Mus musculus
aatttgcgtgggagggcgatcttaa

SEQ ID NO: 90350 - DNA, 25 bp, Mus musculus
aatttgcgtgggtgggcgatcttaa

SEQ ID NO: 90351 - DNA, 25 bp, Mus musculus
aatttgctaccaatttgttctttat

SEQ ID NO: 90352 - DNA, 25 bp, Mus musculus
aatttgctaccattttgttctttat

SEQ ID NO: 90353 - DNA, 25 bp, Mus musculus
aatttgctactcatacagaccacaa

SEQ ID NO: 90354 - DNA, 25 bp, Mus musculus
aatttgctactcttacagaccacaa

SEQ ID NO: 90355 - DNA, 25 bp, Mus musculus
aatttgctattaacacaccgtgcgt

SEQ ID NO: 90356 - DNA, 25 bp, Mus musculus
aatttgctattatcacaccgtgcgt

SEQ ID NO: 90357 - DNA, 25 bp, Mus musculus
aatttgctcgtgagaagactggcta

SEQ ID NO: 90358 - DNA, 25 bp, Mus musculus
aatttgctcgtgtgaagactggcta

SEQ ID NO: 90359 - DNA, 25 bp, Mus musculus
aatttgctctaaagctgagccaccc

SEQ ID NO: 90360 - DNA, 25 bp, Mus musculus
aatttgctctaatgctgagccaccc

SEQ ID NO: 90361 - DNA, 25 bp, Mus musculus
aatttgctctatccaatgttcactt

SEQ ID NO: 90362 - DNA, 25 bp, Mus musculus
aatttgctctatgcaatgttcactt

SEQ ID NO: 90363 - DNA, 25 bp, Mus musculus
aatttgctggcacatttcgtttggt

SEQ ID NO: 90364 - DNA, 25 bp, Mus musculus
aatttgctggcagatttcgtttggt

SEQ ID NO: 90365 - DNA, 25 bp, Mus musculus
aatttgctggctattcaaaccctgc

SEQ ID NO: 90366 - DNA, 25 bp, Mus musculus
aatttgctggcttttcaaaccctgc

SEQ ID NO: 90367 - DNA, 25 bp, Mus musculus
aatttgctgggacccattcactgct

SEQ ID NO: 90368 - DNA, 25 bp, Mus musculus
aatttgctgggagccattcactgct

SEQ ID NO: 90369 - DNA, 25 bp, Mus musculus
aatttgctgggtaatgctggagtaa

SEQ ID NO: 90370 - DNA, 25 bp, Mus musculus
aatttgctgggttatgctggagtaa

SEQ ID NO: 90371 - DNA, 25 bp, Mus musculus
aatttgctgtcccagcttcatgtgg

SEQ ID NO: 90372 - DNA, 25 bp, Mus musculus
aatttgctgtccgagcttcatgtgg

SEQ ID NO: 90373 - DNA, 25 bp, Mus musculus
aatttgctgtggctgtctgtaatct

SEQ ID NO: 90374 - DNA, 25 bp, Mus musculus
aatttgctgtgggtgtctgtaatct

SEQ ID NO: 90375 - DNA, 25 bp, Mus musculus
aatttgctgtttcaaaattagtcct

SEQ ID NO: 90376 - DNA, 25 bp, Mus musculus
aatttgctgtttgaaaattagtcct

SEQ ID NO: 90377 - DNA, 25 bp, Mus musculus
aatttgcttattctggacacttcat

SEQ ID NO: 90378 - DNA, 25 bp, Mus musculus
aatttgcttattgtggacacttcat

SEQ ID NO: 90379 - DNA, 25 bp, Mus musculus
aatttgcttcggatgacggacccaa

SEQ ID NO: 90380 - DNA, 25 bp, Mus musculus
aatttgcttcggttgacggacccaa

SEQ ID NO: 90381 - DNA, 25 bp, Mus musculus
aatttgctttagctggtgttttatg

SEQ ID NO: 90382 - DNA, 25 bp, Mus musculus
aatttgctttaggtggtgttttatg

SEQ ID NO: 90383 - DNA, 25 bp, Mus musculus
aatttgctttctatctgcgtgtctt

SEQ ID NO: 90384 - DNA, 25 bp, Mus musculus
aatttgctttctttctgcgtgtctt

SEQ ID NO: 90385 - DNA, 25 bp, Mus musculus
aatttgcttttgaggttccatgccc

SEQ ID NO: 90386 - DNA, 25 bp, Mus musculus
aatttgcttttgtggttccatgccc

SEQ ID NO: 90387 - DNA, 25 bp, Mus musculus
aatttggaacacaatgagaagacca

SEQ ID NO: 90388 - DNA, 25 bp, Mus musculus
aatttggaacactatgagaagacca

SEQ ID NO: 90389 - DNA, 25 bp, Mus musculus
aatttggaagaaaggtcaggcctgt

SEQ ID NO: 90390 - DNA, 25 bp, Mus musculus
aatttggaagaatggtcaggcctgt

SEQ ID NO: 90391 - DNA, 25 bp, Mus musculus
aatttggaagcgagtgtgtgcacat

SEQ ID NO: 90392 - DNA, 25 bp, Mus musculus
aatttggaagcgtgtgtgtgcacat

SEQ ID NO: 90393 - DNA, 25 bp, Mus musculus
aatttggacccactcaggaccttag

SEQ ID NO: 90394 - DNA, 25 bp, Mus musculus
aatttggacccagtcaggaccttag

SEQ ID NO: 90395 - DNA, 25 bp, Mus musculus
aatttggaggtcatgtgagcttctg

SEQ ID NO: 90396 - DNA, 25 bp, Mus musculus
aatttggaggtcttgtgagcttctg

SEQ ID NO: 90397 - DNA, 25 bp, Mus musculus
aatttggaggttatggttctgtcag

SEQ ID NO: 90398 - DNA, 25 bp, Mus musculus
aatttggaggttttggttctgtcag

SEQ ID NO: 90399 - DNA, 25 bp, Mus musculus
aatttggataacagttcttctttca

SEQ ID NO: 90400 - DNA, 25 bp, Mus musculus
aatttggataactgttcttctttca

SEQ ID NO: 90401 - DNA, 25 bp, Mus musculus
aatttggatacgagctgagctaact

SEQ ID NO: 90402 - DNA, 25 bp, Mus musculus
aatttggatacgtgctgagctaact

SEQ ID NO: 90403 - DNA, 25 bp, Mus musculus
aatttggatactatgcttcagctat

SEQ ID NO: 90404 - DNA, 25 bp, Mus musculus
aatttggatactttgcttcagctat

SEQ ID NO: 90405 - DNA, 25 bp, Mus musculus
aatttggatccacacttgccttata

SEQ ID NO: 90406 - DNA, 25 bp, Mus musculus
aatttggatccagacttgccttata

SEQ ID NO: 90407 - DNA, 25 bp, Mus musculus
aatttggatcccaagaggacacatc

SEQ ID NO: 90408 - DNA, 25 bp, Mus musculus
aatttggatccctagaggacacatc

SEQ ID NO: 90409 - DNA, 25 bp, Mus musculus
aatttggatttcatgactatatgga

SEQ ID NO: 90410 - DNA, 25 bp, Mus musculus
aatttggatttcttgactatatgga

SEQ ID NO: 90411 - DNA, 25 bp, Mus musculus
aatttggcaaatatctcagattcta

SEQ ID NO: 90412 - DNA, 25 bp, Mus musculus
aatttggcaaatttctcagattcta

SEQ ID NO: 90413 - DNA, 25 bp, Mus musculus
aatttggcaattcttgaaggacaga

SEQ ID NO: 90414 - DNA, 25 bp, Mus musculus
aatttggcaattgttgaaggacaga

SEQ ID NO: 90415 - DNA, 25 bp, Mus musculus
aatttggcacacaaggctactattc

SEQ ID NO: 90416 - DNA, 25 bp, Mus musculus
aatttggcacactaggctactattc

SEQ ID NO: 90417 - DNA, 25 bp, Mus musculus
aatttggcacctattcctcacttgt

SEQ ID NO: 90418 - DNA, 25 bp, Mus musculus
aatttggcaccttttcctcacttgt

SEQ ID NO: 90419 - DNA, 25 bp, Mus musculus
aatttggcagccatgtgtagctccc

SEQ ID NO: 90420 - DNA, 25 bp, Mus musculus
aatttggcagccttgtgtagctccc

SEQ ID NO: 90421 - DNA, 25 bp, Mus musculus
aatttggcataactgtgttccttgt

SEQ ID NO: 90422 - DNA, 25 bp, Mus musculus
aatttggcataagtgtgttccttgt

SEQ ID NO: 90423 - DNA, 25 bp, Mus musculus
aatttggcattacaataagtcactt

SEQ ID NO: 90424 - DNA, 25 bp, Mus musculus
aatttggcattagaataagtcactt

SEQ ID NO: 90425 - DNA, 25 bp, Mus musculus
aatttggccttgctgattctcctgc

SEQ ID NO: 90426 - DNA, 25 bp, Mus musculus
aatttggccttggtgattctcctgc

SEQ ID NO: 90427 - DNA, 25 bp, Mus musculus
aatttggcgtctcagtcgtgcattc

SEQ ID NO: 90428 - DNA, 25 bp, Mus musculus
aatttggcgtctgagtcgtgcattc

SEQ ID NO: 90429 - DNA, 25 bp, Mus musculus
aatttggctcatatggctgcaatat

SEQ ID NO: 90430 - DNA, 25 bp, Mus musculus
aatttggctcatttggctgcaatat

SEQ ID NO: 90431 - DNA, 25 bp, Mus musculus
aatttggctctaagtgaaagttcct

SEQ ID NO: 90432 - DNA, 25 bp, Mus musculus
aatttggctctaccactgtctctgc

SEQ ID NO: 90433 - DNA, 25 bp, Mus musculus
aatttggctctagcactgtctctgc

SEQ ID NO: 90434 - DNA, 25 bp, Mus musculus
aatttggctctatgtgaaagttcct

SEQ ID NO: 90435 - DNA, 25 bp, Mus musculus
aatttggctgctcacgatcatatac

SEQ ID NO: 90436 - DNA, 25 bp, Mus musculus
aatttggctgctgacgatcatatac

SEQ ID NO: 90437 - DNA, 25 bp, Mus musculus
aatttggctttgacttattgatcag

SEQ ID NO: 90438 - DNA, 25 bp, Mus musculus
aatttggctttgtcttattgatcag

SEQ ID NO: 90439 - DNA, 25 bp, Mus musculus
aatttgggacatactgggttagctc

SEQ ID NO: 90440 - DNA, 25 bp, Mus musculus
aatttgggacattctgggttagctc

SEQ ID NO: 90441 - DNA, 25 bp, Mus musculus
aatttgggacttatgctatttggca

SEQ ID NO: 90442 - DNA, 25 bp, Mus musculus
aatttgggacttttgctatttggca

SEQ ID NO: 90443 - DNA, 25 bp, Mus musculus
aatttgggcacacgaagcacacaga

SEQ ID NO: 90444 - DNA, 25 bp, Mus musculus
aatttgggcacaggaagcacacaga

SEQ ID NO: 90445 - DNA, 25 bp, Mus musculus
aatttgggcctacagttccctgctg

SEQ ID NO: 90446 - DNA, 25 bp, Mus musculus
aatttgggcctagagttccctgctg

SEQ ID NO: 90447 - DNA, 25 bp, Mus musculus
aatttgggctgactggtttgcacgt

SEQ ID NO: 90448 - DNA, 25 bp, Mus musculus
aatttgggctgagtggtttgcacgt

SEQ ID NO: 90449 - DNA, 25 bp, Mus musculus
aatttgggtccaactaactctcacg

SEQ ID NO: 90450 - DNA, 25 bp, Mus musculus
aatttgggtccatctaactctcacg

SEQ ID NO: 90451 - DNA, 25 bp, Mus musculus
aatttgggtgacacatcttgaaaca

SEQ ID NO: 90452 - DNA, 25 bp, Mus musculus
aatttgggtgactcatcttgaaaca

SEQ ID NO: 90453 - DNA, 25 bp, Mus musculus
aatttgggttcaatgtggctgctgt

SEQ ID NO: 90454 - DNA, 25 bp, Mus musculus
aatttgggttcattgtggctgctgt

SEQ ID NO: 90455 - DNA, 25 bp, Mus musculus
aatttgggttggaggtttctgcata

SEQ ID NO: 90456 - DNA, 25 bp, Mus musculus
aatttgggttggtggtttctgcata

SEQ ID NO: 90457 - DNA, 25 bp, Mus musculus
aatttggtaataaagccctcctgct

SEQ ID NO: 90458 - DNA, 25 bp, Mus musculus
aatttggtaatatagccctcctgct

SEQ ID NO: 90459 - DNA, 25 bp, Mus musculus
aatttggtacgtcttattcctgata

SEQ ID NO: 90460 - DNA, 25 bp, Mus musculus
aatttggtacgtgttattcctgata

SEQ ID NO: 90461 - DNA, 25 bp, Mus musculus
aatttggtatatcgcagattttttc

SEQ ID NO: 90462 - DNA, 25 bp, Mus musculus
aatttggtatatggcagattttttc

SEQ ID NO: 90463 - DNA, 25 bp, Mus musculus
aatttggtccttacagtggagctcc

SEQ ID NO: 90464 - DNA, 25 bp, Mus musculus
aatttggtcctttcagtggagctcc

SEQ ID NO: 90465 - DNA, 25 bp, Mus musculus
aatttggtgacgattgggctgctga

SEQ ID NO: 90466 - DNA, 25 bp, Mus musculus
aatttggtgacgtttgggctgctga

SEQ ID NO: 90467 - DNA, 25 bp, Mus musculus
aatttggtgttacccatgggcctgg

SEQ ID NO: 90468 - DNA, 25 bp, Mus musculus
aatttggtgttagccatgggcctgg

SEQ ID NO: 90469 - DNA, 25 bp, Mus musculus
aatttggttatgaggactttgagtc

SEQ ID NO: 90470 - DNA, 25 bp, Mus musculus
aatttggttatgtggactttgagtc

SEQ ID NO: 90471 - DNA, 25 bp, Mus musculus
aatttggttctaaaaacacccatag

SEQ ID NO: 90472 - DNA, 25 bp, Mus musculus
aatttggttctataaacacccatag

SEQ ID NO: 90473 - DNA, 25 bp, Mus musculus
aatttggttgccatctaatcttcag

SEQ ID NO: 90474 - DNA, 25 bp, Mus musculus
aatttggttgccttctaatcttcag

SEQ ID NO: 90475 - DNA, 25 bp, Mus musculus
aatttggttggcatggtagactatc

SEQ ID NO: 90476 - DNA, 25 bp, Mus musculus
aatttggttggcttggtagactatc

SEQ ID NO: 90477 - DNA, 25 bp, Mus musculus
aatttgtaacgaatgtcagacctgg

SEQ ID NO: 90478 - DNA, 25 bp, Mus musculus
aatttgtaacgattgtcagacctgg

SEQ ID NO: 90479 - DNA, 25 bp, Mus musculus
aatttgtaagtactctggcacctct

SEQ ID NO: 90480 - DNA, 25 bp, Mus musculus
aatttgtaagtagtctggcacctct

SEQ ID NO: 90481 - DNA, 25 bp, Mus musculus
aatttgtacatcattgtcaatctgt

SEQ ID NO: 90482 - DNA, 25 bp, Mus musculus
aatttgtacatctttgtcaatctgt

SEQ ID NO: 90483 - DNA, 25 bp, Mus musculus
aatttgtactatccagactgcgggc

SEQ ID NO: 90484 - DNA, 25 bp, Mus musculus
aatttgtactatgcagactgcgggc

SEQ ID NO: 90485 - DNA, 25 bp, Mus musculus
aatttgtagtttaagacatagcaac

SEQ ID NO: 90486 - DNA, 25 bp, Mus musculus
aatttgtagttttagacatagcaac

SEQ ID NO: 90487 - DNA, 25 bp, Mus musculus
aatttgtcaaaacgagtgtttcttg

SEQ ID NO: 90488 - DNA, 25 bp, Mus musculus
aatttgtcaaaaggagtgtttcttg

SEQ ID NO: 90489 - DNA, 25 bp, Mus musculus
aatttgtcactgcactgtctctggg

SEQ ID NO: 90490 - DNA, 25 bp, Mus musculus
aatttgtcactggactgtctctggg

SEQ ID NO: 90491 - DNA, 25 bp, Mus musculus
aatttgtcagaaagacggtcatcat

SEQ ID NO: 90492 - DNA, 25 bp, Mus musculus
aatttgtcagaatgacggtcatcat

SEQ ID NO: 90493 - DNA, 25 bp, Mus musculus
aatttgtcatggacgtggattcctc

SEQ ID NO: 90494 - DNA, 25 bp, Mus musculus
aatttgtcatggtcgtggattcctc

SEQ ID NO: 90495 - DNA, 25 bp, Mus musculus
aatttgtccataatcctaccacatg

SEQ ID NO: 90496 - DNA, 25 bp, Mus musculus
aatttgtccatattcctaccacatg

SEQ ID NO: 90497 - DNA, 25 bp, Mus musculus
aatttgtccctcatcgatgtactgc

SEQ ID NO: 90498 - DNA, 25 bp, Mus musculus
aatttgtccctcttcgatgtactgc

SEQ ID NO: 90499 - DNA, 25 bp, Mus musculus
aatttgtcctgtaaaccacatgcta

SEQ ID NO: 90500 - DNA, 25 bp, Mus musculus
aatttgtcctgttaaccacatgcta

SEQ ID NO: 90501 - DNA, 25 bp, Mus musculus
aatttgtctaatctctcaggctgac

SEQ ID NO: 90502 - DNA, 25 bp, Mus musculus
aatttgtctaatgtctcaggctgac

SEQ ID NO: 90503 - DNA, 25 bp, Mus musculus
aatttgtctcagactcagaaaaggc

SEQ ID NO: 90504 - DNA, 25 bp, Mus musculus
aatttgtctcagtctcagaaaaggc

SEQ ID NO: 90505 - DNA, 25 bp, Mus musculus
aatttgtctctcattgctgtggcac

SEQ ID NO: 90506 - DNA, 25 bp, Mus musculus
aatttgtctctctttgctgtggcac

SEQ ID NO: 90507 - DNA, 25 bp, Mus musculus
aatttgtctgtccattggagctctc

SEQ ID NO: 90508 - DNA, 25 bp, Mus musculus
aatttgtctgtcgattggagctctc

SEQ ID NO: 90509 - DNA, 25 bp, Mus musculus
aatttgtcttcacgcttcatcggtc

SEQ ID NO: 90510 - DNA, 25 bp, Mus musculus
aatttgtcttcaggcttcatcggtc

SEQ ID NO: 90511 - DNA, 25 bp, Mus musculus
aatttgtgaccccagattatttcta

SEQ ID NO: 90512 - DNA, 25 bp, Mus musculus
aatttgtgacccgagattatttcta

SEQ ID NO: 90513 - DNA, 25 bp, Mus musculus
aatttgtgccagaccacctgctgaa

SEQ ID NO: 90514 - DNA, 25 bp, Mus musculus
aatttgtgccagtccacctgctgaa

SEQ ID NO: 90515 - DNA, 25 bp, Mus musculus
aatttgtgcttacatcccagttcca

SEQ ID NO: 90516 - DNA, 25 bp, Mus musculus
aatttgtgcttagatcccagttcca

SEQ ID NO: 90517 - DNA, 25 bp, Mus musculus
aatttgtggcttctatctactagac

SEQ ID NO: 90518 - DNA, 25 bp, Mus musculus
aatttgtggcttgtatctactagac

SEQ ID NO: 90519 - DNA, 25 bp, Mus musculus
aatttgtggttaatatgattttcag

SEQ ID NO: 90520 - DNA, 25 bp, Mus musculus
aatttgtggttattatgattttcag

SEQ ID NO: 90521 - DNA, 25 bp, Mus musculus
aatttgtgttcactccatatatttg

SEQ ID NO: 90522 - DNA, 25 bp, Mus musculus
aatttgtgttcagtccatatatttg

SEQ ID NO: 90523 - DNA, 25 bp, Mus musculus
aatttgtgtttccatttctctctct

SEQ ID NO: 90524 - DNA, 25 bp, Mus musculus
aatttgtgtttcgatttctctctct

SEQ ID NO: 90525 - DNA, 25 bp, Mus musculus
aatttgtgtttgagcactgcaccac

SEQ ID NO: 90526 - DNA, 25 bp, Mus musculus
aatttgtgtttgtgcactgcaccac

SEQ ID NO: 90527 - DNA, 25 bp, Mus musculus
aatttgttagcaattctttccagga

SEQ ID NO: 90528 - DNA, 25 bp, Mus musculus
aatttgttagcatttctttccagga

SEQ ID NO: 90529 - DNA, 25 bp, Mus musculus
aatttgttcaataccaggtccttgt

SEQ ID NO: 90530 - DNA, 25 bp, Mus musculus
aatttgttcaattccaggtccttgt

SEQ ID NO: 90531 - DNA, 25 bp, Mus musculus
aatttgttcacaagcacctaccgaa

SEQ ID NO: 90532 - DNA, 25 bp, Mus musculus
aatttgttcacatgcacctaccgaa

SEQ ID NO: 90533 - DNA, 25 bp, Mus musculus
aatttgttccgcatgtgtagtctcc

SEQ ID NO: 90534 - DNA, 25 bp, Mus musculus
aatttgttccgcttgtgtagtctcc

SEQ ID NO: 90535 - DNA, 25 bp, Mus musculus
aatttgttcctgcaggccggtgttg

SEQ ID NO: 90536 - DNA, 25 bp, Mus musculus
aatttgttcctggaggccggtgttg

SEQ ID NO: 90537 - DNA, 25 bp, Mus musculus
aatttgttctgtatctaagcccgtg

SEQ ID NO: 90538 - DNA, 25 bp, Mus musculus
aatttgttctgtttctaagcccgtg

SEQ ID NO: 90539 - DNA, 25 bp, Mus musculus
aatttgttctttatcctgcacttaa

SEQ ID NO: 90540 - DNA, 25 bp, Mus musculus
aatttgttctttttcctgcacttaa

SEQ ID NO: 90541 - DNA, 25 bp, Mus musculus
aatttgttgagaactctcggatgta

SEQ ID NO: 90542 - DNA, 25 bp, Mus musculus
aatttgttgagatctctcggatgta

SEQ ID NO: 90543 - DNA, 25 bp, Mus musculus
aatttgttgcttatttgaatgaggg

SEQ ID NO: 90544 - DNA, 25 bp, Mus musculus
aatttgttgcttttttgaatgaggg

SEQ ID NO: 90545 - DNA, 25 bp, Mus musculus
aatttgttggtgatgccctgggata

SEQ ID NO: 90546 - DNA, 25 bp, Mus musculus
aatttgttggtgttgccctgggata

SEQ ID NO: 90547 - DNA, 25 bp, Mus musculus
aatttgtttcatccctagctgtgag

SEQ ID NO: 90548 - DNA, 25 bp, Mus musculus
aatttgtttcatgcctagctgtgag

SEQ ID NO: 90549 - DNA, 25 bp, Mus musculus
aatttgtttcgtcttgtgcttctgc

SEQ ID NO: 90550 - DNA, 25 bp, Mus musculus
aatttgtttcgtgttgtgcttctgc

SEQ ID NO: 90551 - DNA, 25 bp, Mus musculus
aatttgtttctcctttctaatgcag

SEQ ID NO: 90552 - DNA, 25 bp, Mus musculus
aatttgtttctcgtttctaatgcag

SEQ ID NO: 90553 - DNA, 25 bp, Mus musculus
aatttgtttgacattccatgttaaa

SEQ ID NO: 90554 - DNA, 25 bp, Mus musculus
aatttgtttgactttccatgttaaa

SEQ ID NO: 90555 - DNA, 25 bp, Mus musculus
aatttgttttccattgtgccagagc

SEQ ID NO: 90556 - DNA, 25 bp, Mus musculus
aatttgttttcctttgtgccagagc

SEQ ID NO: 90557 - DNA, 25 bp, Mus musculus
aattttaatactatgtgcccaggct

SEQ ID NO: 90558 - DNA, 25 bp, Mus musculus
aattttaatactttgtgcccaggct

SEQ ID NO: 90559 - DNA, 25 bp, Mus musculus
aattttaatggacctaaacttgcta

SEQ ID NO: 90560 - DNA, 25 bp, Mus musculus
aattttaatggagctaaacttgcta

SEQ ID NO: 90561 - DNA, 25 bp, Mus musculus
aattttacaactatgttactgccag

SEQ ID NO: 90562 - DNA, 25 bp, Mus musculus
aattttacaactttgttactgccag

SEQ ID NO: 90563 - DNA, 25 bp, Mus musculus
aattttacaatcaagacacacgaca

SEQ ID NO: 90564 - DNA, 25 bp, Mus musculus
aattttacaatctagacacacgaca

SEQ ID NO: 90565 - DNA, 25 bp, Mus musculus
aattttacacacactctgaagttca

SEQ ID NO: 90566 - DNA, 25 bp, Mus musculus
aattttacacacatgctaatgggat

SEQ ID NO: 90567 - DNA, 25 bp, Mus musculus
aattttacacactctctgaagttca

SEQ ID NO: 90568 - DNA, 25 bp, Mus musculus
aattttacacacttgctaatgggat

SEQ ID NO: 90569 - DNA, 25 bp, Mus musculus
aattttacactgattatagcctgct

SEQ ID NO: 90570 - DNA, 25 bp, Mus musculus
aattttacactgcatattcttgaga

SEQ ID NO: 90571 - DNA, 25 bp, Mus musculus
aattttacactggatattcttgaga

SEQ ID NO: 90572 - DNA, 25 bp, Mus musculus
aattttacactgtttatagcctgct

SEQ ID NO: 90573 - DNA, 25 bp, Mus musculus
aattttacagcgactgcagctcaga

SEQ ID NO: 90574 - DNA, 25 bp, Mus musculus
aattttacagcgtctgcagctcaga

SEQ ID NO: 90575 - DNA, 25 bp, Mus musculus
aattttacagttacggctctgcagc

SEQ ID NO: 90576 - DNA, 25 bp, Mus musculus
aattttacagtttcggctctgcagc

SEQ ID NO: 90577 - DNA, 25 bp, Mus musculus
aattttacatagatatagcttagaa

SEQ ID NO: 90578 - DNA, 25 bp, Mus musculus
aattttacatagttatagcttagaa

SEQ ID NO: 90579 - DNA, 25 bp, Mus musculus
aattttaccacacttttctgcacgg

SEQ ID NO: 90580 - DNA, 25 bp, Mus musculus
aattttaccacagttttctgcacgg

SEQ ID NO: 90581 - DNA, 25 bp, Mus musculus
aattttaccaccactttgttgcttg

SEQ ID NO: 90582 - DNA, 25 bp, Mus musculus
aattttaccacctctttgttgcttg

SEQ ID NO: 90583 - DNA, 25 bp, Mus musculus
aattttacccacatggccttggaca

SEQ ID NO: 90584 - DNA, 25 bp, Mus musculus
aattttacccacttggccttggaca

SEQ ID NO: 90585 - DNA, 25 bp, Mus musculus
aattttaccgagctctgtacatcca

SEQ ID NO: 90586 - DNA, 25 bp, Mus musculus
aattttaccgaggtctgtacatcca

SEQ ID NO: 90587 - DNA, 25 bp, Mus musculus
aattttaccttgagcttgtgaagac

SEQ ID NO: 90588 - DNA, 25 bp, Mus musculus
aattttaccttgtgcttgtgaagac

SEQ ID NO: 90589 - DNA, 25 bp, Mus musculus
aattttactccaatactgtcttatt

SEQ ID NO: 90590 - DNA, 25 bp, Mus musculus
aattttactccattactgtcttatt

SEQ ID NO: 90591 - DNA, 25 bp, Mus musculus
aattttagattcctggatacagaag

SEQ ID NO: 90592 - DNA, 25 bp, Mus musculus
aattttagattcgtggatacagaag

SEQ ID NO: 90593 - DNA, 25 bp, Mus musculus
aattttagccaaatgtgagtccctg

SEQ ID NO: 90594 - DNA, 25 bp, Mus musculus
aattttagccaattgtgagtccctg

SEQ ID NO: 90595 - DNA, 25 bp, Mus musculus
aattttagcgttattgtgatcattt

SEQ ID NO: 90596 - DNA, 25 bp, Mus musculus
aattttagcgtttttgtgatcattt

SEQ ID NO: 90597 - DNA, 25 bp, Mus musculus
aattttagtcaacgtcagaggcagc

SEQ ID NO: 90598 - DNA, 25 bp, Mus musculus
aattttagtcaaggtcagaggcagc

SEQ ID NO: 90599 - DNA, 25 bp, Mus musculus
aattttagtgtgatgccttggctgt

SEQ ID NO: 90600 - DNA, 25 bp, Mus musculus
aattttagtgtgttgccttggctgt

SEQ ID NO: 90601 - DNA, 25 bp, Mus musculus
aattttataaagctcagttaccctg

SEQ ID NO: 90602 - DNA, 25 bp, Mus musculus
aattttataaaggtcagttaccctg

SEQ ID NO: 90603 - DNA, 25 bp, Mus musculus
aattttatacatactcaagactgtc

SEQ ID NO: 90604 - DNA, 25 bp, Mus musculus
aattttatacattctcaagactgtc

SEQ ID NO: 90605 - DNA, 25 bp, Mus musculus
aattttataccacctccgatcagtg

SEQ ID NO: 90606 - DNA, 25 bp, Mus musculus
aattttataccagctccgatcagtg

SEQ ID NO: 90607 - DNA, 25 bp, Mus musculus
aattttatactcctctggtcttcag

SEQ ID NO: 90608 - DNA, 25 bp, Mus musculus
aattttatactcgtctggtcttcag

SEQ ID NO: 90609 - DNA, 25 bp, Mus musculus
aattttatatgcatgtgatccctgt

SEQ ID NO: 90610 - DNA, 25 bp, Mus musculus
aattttatatgcttgtgatccctgt

SEQ ID NO: 90611 - DNA, 25 bp, Mus musculus
aattttatcatactcactttccatc

SEQ ID NO: 90612 - DNA, 25 bp, Mus musculus
aattttatcatagtcactttccatc

SEQ ID NO: 90613 - DNA, 25 bp, Mus musculus
aattttatccaccagggacctctcg

SEQ ID NO: 90614 - DNA, 25 bp, Mus musculus
aattttatccacgagggacctctcg

SEQ ID NO: 90615 - DNA, 25 bp, Mus musculus
aattttatggcaccttttctataag

SEQ ID NO: 90616 - DNA, 25 bp, Mus musculus
aattttatggcagcttttctataag

SEQ ID NO: 90617 - DNA, 25 bp, Mus musculus
aattttatgtaaacctctgccagtt

SEQ ID NO: 90618 - DNA, 25 bp, Mus musculus
aattttatgtaatcctctgccagtt

SEQ ID NO: 90619 - DNA, 25 bp, Mus musculus
aattttattctacttgctctggtga

SEQ ID NO: 90620 - DNA, 25 bp, Mus musculus
aattttattctagttgctctggtga

SEQ ID NO: 90621 - DNA, 25 bp, Mus musculus
aattttatttacatcaactatatag

SEQ ID NO: 90622 - DNA, 25 bp, Mus musculus
aattttatttacttcaactatatag

SEQ ID NO: 90623 - DNA, 25 bp, Mus musculus
aattttatttttacgcgcgtgtgtg

SEQ ID NO: 90624 - DNA, 25 bp, Mus musculus
aattttattttttcgcgcgtgtgtg

SEQ ID NO: 90625 - DNA, 25 bp, Mus musculus
aattttcaaagtcgagcttagtaat

SEQ ID NO: 90626 - DNA, 25 bp, Mus musculus
aattttcaaagtggagcttagtaat

SEQ ID NO: 90627 - DNA, 25 bp, Mus musculus
aattttcaaattcggcactgcctgt

SEQ ID NO: 90628 - DNA, 25 bp, Mus musculus
aattttcaaattgggcactgcctgt

SEQ ID NO: 90629 - DNA, 25 bp, Mus musculus
aattttcaactacatccctctacta

SEQ ID NO: 90630 - DNA, 25 bp, Mus musculus
aattttcaactagatccctctacta

SEQ ID NO: 90631 - DNA, 25 bp, Mus musculus
aattttcaactcatgtgttccacta

SEQ ID NO: 90632 - DNA, 25 bp, Mus musculus
aattttcaactcttgtgttccacta

SEQ ID NO: 90633 - DNA, 25 bp, Mus musculus
aattttcaattgcttcttagcacag

SEQ ID NO: 90634 - DNA, 25 bp, Mus musculus
aattttcaattggttcttagcacag

SEQ ID NO: 90635 - DNA, 25 bp, Mus musculus
aattttcactagactttcaaagaca

SEQ ID NO: 90636 - DNA, 25 bp, Mus musculus
aattttcactagtctttcaaagaca

SEQ ID NO: 90637 - DNA, 25 bp, Mus musculus
aattttcaggaaagggacggcttag

SEQ ID NO: 90638 - DNA, 25 bp, Mus musculus
aattttcaggaatgggacggcttag

SEQ ID NO: 90639 - DNA, 25 bp, Mus musculus
aattttcaggctatcccagaagatc

SEQ ID NO: 90640 - DNA, 25 bp, Mus musculus
aattttcaggctttcccagaagatc

SEQ ID NO: 90641 - DNA, 25 bp, Mus musculus
aattttcaggtactctcattcttag

SEQ ID NO: 90642 - DNA, 25 bp, Mus musculus
aattttcaggtagtctcattcttag

SEQ ID NO: 90643 - DNA, 25 bp, Mus musculus
aattttcaggtcctctgccactgac

SEQ ID NO: 90644 - DNA, 25 bp, Mus musculus
aattttcaggtcgtctgccactgac

SEQ ID NO: 90645 - DNA, 25 bp, Mus musculus
aattttcagtcgcaggtgggcaata

SEQ ID NO: 90646 - DNA, 25 bp, Mus musculus
aattttcagtcggaggtgggcaata

SEQ ID NO: 90647 - DNA, 25 bp, Mus musculus
aattttcataacattctcttgcccc

SEQ ID NO: 90648 - DNA, 25 bp, Mus musculus
aattttcataactttctcttgcccc

SEQ ID NO: 90649 - DNA, 25 bp, Mus musculus
aattttcataagatgcatgcctgca

SEQ ID NO: 90650 - DNA, 25 bp, Mus musculus
aattttcataagttgcatgcctgca

SEQ ID NO: 90651 - DNA, 25 bp, Mus musculus
aattttcatcacagatttgcaaatg

SEQ ID NO: 90652 - DNA, 25 bp, Mus musculus
aattttcatcactgatttgcaaatg

SEQ ID NO: 90653 - DNA, 25 bp, Mus musculus
aattttcatccgcagacttcaagga

SEQ ID NO: 90654 - DNA, 25 bp, Mus musculus
aattttcatccggagacttcaagga

SEQ ID NO: 90655 - DNA, 25 bp, Mus musculus
aattttcatcctctaattggactaa

SEQ ID NO: 90656 - DNA, 25 bp, Mus musculus
aattttcatcctgtaattggactaa

SEQ ID NO: 90657 - DNA, 25 bp, Mus musculus
aattttccacctatgtgtgagtgtg

SEQ ID NO: 90658 - DNA, 25 bp, Mus musculus
aattttccacctttgtgtgagtgtg

SEQ ID NO: 90659 - DNA, 25 bp, Mus musculus
aattttccactaactttcatgtgta

SEQ ID NO: 90660 - DNA, 25 bp, Mus musculus
aattttccactatctttcatgtgta

SEQ ID NO: 90661 - DNA, 25 bp, Mus musculus
aattttccaggtccttcatacttgt

SEQ ID NO: 90662 - DNA, 25 bp, Mus musculus
aattttccaggtgcttcatacttgt

SEQ ID NO: 90663 - DNA, 25 bp, Mus musculus
aattttccagtcacgattgcaataa

SEQ ID NO: 90664 - DNA, 25 bp, Mus musculus
aattttccagtctcgattgcaataa

SEQ ID NO: 90665 - DNA, 25 bp, Mus musculus
aattttcccagccagttttctgcca

SEQ ID NO: 90666 - DNA, 25 bp, Mus musculus
aattttcccagcgagttttctgcca

SEQ ID NO: 90667 - DNA, 25 bp, Mus musculus
aattttccctatcatatttctgctg

SEQ ID NO: 90668 - DNA, 25 bp, Mus musculus
aattttccctatgatatttctgctg

SEQ ID NO: 90669 - DNA, 25 bp, Mus musculus
aattttccctccacgtgtggttatg

SEQ ID NO: 90670 - DNA, 25 bp, Mus musculus
aattttccctcctcgtgtggttatg

SEQ ID NO: 90671 - DNA, 25 bp, Mus musculus
aattttccggatagacattctatat

SEQ ID NO: 90672 - DNA, 25 bp, Mus musculus
aattttccggattgacattctatat

SEQ ID NO: 90673 - DNA, 25 bp, Mus musculus
aattttcctaaccttgtggcagctg

SEQ ID NO: 90674 - DNA, 25 bp, Mus musculus
aattttcctaacgttgtggcagctg

SEQ ID NO: 90675 - DNA, 25 bp, Mus musculus
aattttcctggcaaattacatggca

SEQ ID NO: 90676 - DNA, 25 bp, Mus musculus
aattttcctggctaattacatggca

SEQ ID NO: 90677 - DNA, 25 bp, Mus musculus
aattttcctgttcttcaagtgtgca

SEQ ID NO: 90678 - DNA, 25 bp, Mus musculus
aattttcctgttgttcaagtgtgca

SEQ ID NO: 90679 - DNA, 25 bp, Mus musculus
aattttccttacagagtgttcacac

SEQ ID NO: 90680 - DNA, 25 bp, Mus musculus
aattttccttactgagtgttcacac

SEQ ID NO: 90681 - DNA, 25 bp, Mus musculus
aattttccttggagtctcccatcta

SEQ ID NO: 90682 - DNA, 25 bp, Mus musculus
aattttccttggtgtctcccatcta

SEQ ID NO: 90683 - DNA, 25 bp, Mus musculus
aattttcgtgctatatcagtagccc

SEQ ID NO: 90684 - DNA, 25 bp, Mus musculus
aattttcgtgctttatcagtagccc

SEQ ID NO: 90685 - DNA, 25 bp, Mus musculus
aattttctaagtctggcagcccata

SEQ ID NO: 90686 - DNA, 25 bp, Mus musculus
aattttctaagtgtggcagcccata

SEQ ID NO: 90687 - DNA, 25 bp, Mus musculus
aattttctaattcgtccagaactca

SEQ ID NO: 90688 - DNA, 25 bp, Mus musculus
aattttctaattggtccagaactca

SEQ ID NO: 90689 - DNA, 25 bp, Mus musculus
aattttctacatctgtgcctaccgg

SEQ ID NO: 90690 - DNA, 25 bp, Mus musculus
aattttctacatgtgtgcctaccgg

SEQ ID NO: 90691 - DNA, 25 bp, Mus musculus
aattttctacccataaattcactgg

SEQ ID NO: 90692 - DNA, 25 bp, Mus musculus
aattttctacccttaaattcactgg

SEQ ID NO: 90693 - DNA, 25 bp, Mus musculus
aattttctacctactgaacctgcca

SEQ ID NO: 90694 - DNA, 25 bp, Mus musculus
aattttctaccttctgaacctgcca

SEQ ID NO: 90695 - DNA, 25 bp, Mus musculus
aattttctcattctgtgcgtgacat

SEQ ID NO: 90696 - DNA, 25 bp, Mus musculus
aattttctcattgtgtgcgtgacat

SEQ ID NO: 90697 - DNA, 25 bp, Mus musculus
aattttctccagagaaaccaataga

SEQ ID NO: 90698 - DNA, 25 bp, Mus musculus
aattttctccagtgaaaccaataga

SEQ ID NO: 90699 - DNA, 25 bp, Mus musculus
aattttctctgtaaggacctctgtc

SEQ ID NO: 90700 - DNA, 25 bp, Mus musculus
aattttctctgttaggacctctgtc

SEQ ID NO: 90701 - DNA, 25 bp, Mus musculus
aattttctgaatacctgtgatgctc

SEQ ID NO: 90702 - DNA, 25 bp, Mus musculus
aattttctgaattcctgtgatgctc

SEQ ID NO: 90703 - DNA, 25 bp, Mus musculus
aattttctgaccatattcactgagg

SEQ ID NO: 90704 - DNA, 25 bp, Mus musculus
aattttctgaccttattcactgagg

SEQ ID NO: 90705 - DNA, 25 bp, Mus musculus
aattttctgactaatgcgatggtgg

SEQ ID NO: 90706 - DNA, 25 bp, Mus musculus
aattttctgacttatgcgatggtgg

SEQ ID NO: 90707 - DNA, 25 bp, Mus musculus
aattttctgaggctgggtactttat

SEQ ID NO: 90708 - DNA, 25 bp, Mus musculus
aattttctgaggctttctactgctg

SEQ ID NO: 90709 - DNA, 25 bp, Mus musculus
aattttctgagggtgggtactttat

SEQ ID NO: 90710 - DNA, 25 bp, Mus musculus
aattttctgagggtttctactgctg

SEQ ID NO: 90711 - DNA, 25 bp, Mus musculus
aattttctgcataacagtggttaac

SEQ ID NO: 90712 - DNA, 25 bp, Mus musculus
aattttctgcattacagtggttaac

SEQ ID NO: 90713 - DNA, 25 bp, Mus musculus
aattttctggaactccctacagcca

SEQ ID NO: 90714 - DNA, 25 bp, Mus musculus
aattttctggaagtccctacagcca

SEQ ID NO: 90715 - DNA, 25 bp, Mus musculus
aattttctgtaaagcctgctctgac

SEQ ID NO: 90716 - DNA, 25 bp, Mus musculus
aattttctgtaatgcctgctctgac

SEQ ID NO: 90717 - DNA, 25 bp, Mus musculus
aattttcttaatctgggtgctcaat

SEQ ID NO: 90718 - DNA, 25 bp, Mus musculus
aattttcttaatgtgggtgctcaat

SEQ ID NO: 90719 - DNA, 25 bp, Mus musculus
aattttcttactctgccctttcatc

SEQ ID NO: 90720 - DNA, 25 bp, Mus musculus
aattttcttactgtgccctttcatc

SEQ ID NO: 90721 - DNA, 25 bp, Mus musculus
aattttcttcctatgagcatcctcc

SEQ ID NO: 90722 - DNA, 25 bp, Mus musculus
aattttcttcctttgagcatcctcc

SEQ ID NO: 90723 - DNA, 25 bp, Mus musculus
aattttcttgccagcatcttggtgc

SEQ ID NO: 90724 - DNA, 25 bp, Mus musculus
aattttcttgcctgcatcttggtgc

SEQ ID NO: 90725 - DNA, 25 bp, Mus musculus
aattttcttgttaatctgcagtagc

SEQ ID NO: 90726 - DNA, 25 bp, Mus musculus
aattttcttgttctacatcctaagt

SEQ ID NO: 90727 - DNA, 25 bp, Mus musculus
aattttcttgttgtacatcctaagt

SEQ ID NO: 90728 - DNA, 25 bp, Mus musculus
aattttcttgtttatctgcagtagc

SEQ ID NO: 90729 - DNA, 25 bp, Mus musculus
aattttctttacatgtatcatcttg

SEQ ID NO: 90730 - DNA, 25 bp, Mus musculus
aattttctttacttgtatcatcttg

SEQ ID NO: 90731 - DNA, 25 bp, Mus musculus
aattttgaacccattgcgtgcatgc

SEQ ID NO: 90732 - DNA, 25 bp, Mus musculus
aattttgaaccctttgcgtgcatgc

SEQ ID NO: 90733 - DNA, 25 bp, Mus musculus
aattttgaacctcctcagtatccgt

SEQ ID NO: 90734 - DNA, 25 bp, Mus musculus
aattttgaacctgctcagtatccgt

SEQ ID NO: 90735 - DNA, 25 bp, Mus musculus
aattttgaagctcagcttgcagaaa

SEQ ID NO: 90736 - DNA, 25 bp, Mus musculus
aattttgaagctgagcttgcagaaa

SEQ ID NO: 90737 - DNA, 25 bp, Mus musculus
aattttgacacgcacacattggcct

SEQ ID NO: 90738 - DNA, 25 bp, Mus musculus
aattttgacacggacacattggcct

SEQ ID NO: 90739 - DNA, 25 bp, Mus musculus
aattttgacataatttgtagcagaa

SEQ ID NO: 90740 - DNA, 25 bp, Mus musculus
aattttgacatattttgtagcagaa

SEQ ID NO: 90741 - DNA, 25 bp, Mus musculus
aattttgaccagactcttcgtgtac

SEQ ID NO: 90742 - DNA, 25 bp, Mus musculus
aattttgaccagtctcttcgtgtac

SEQ ID NO: 90743 - DNA, 25 bp, Mus musculus
aattttgacccgatatgcttgcttc

SEQ ID NO: 90744 - DNA, 25 bp, Mus musculus
aattttgacccgttatgcttgcttc

SEQ ID NO: 90745 - DNA, 25 bp, Mus musculus
aattttgagcatatccaggcgtttg

SEQ ID NO: 90746 - DNA, 25 bp, Mus musculus
aattttgagcatttccaggcgtttg

SEQ ID NO: 90747 - DNA, 25 bp, Mus musculus
aattttgatagcaaccacccatagt

SEQ ID NO: 90748 - DNA, 25 bp, Mus musculus
aattttgatagctaccacccatagt

SEQ ID NO: 90749 - DNA, 25 bp, Mus musculus
aattttgataggagggtcacagtca

SEQ ID NO: 90750 - DNA, 25 bp, Mus musculus
aattttgataggtgggtcacagtca

SEQ ID NO: 90751 - DNA, 25 bp, Mus musculus
aattttgattttctagcctttgagc

SEQ ID NO: 90752 - DNA, 25 bp, Mus musculus
aattttgattttgtagcctttgagc

SEQ ID NO: 90753 - DNA, 25 bp, Mus musculus
aattttgcaactcttcattatacag

SEQ ID NO: 90754 - DNA, 25 bp, Mus musculus
aattttgcaactgttcattatacag

SEQ ID NO: 90755 - DNA, 25 bp, Mus musculus
aattttgcaattctttttatggatc

SEQ ID NO: 90756 - DNA, 25 bp, Mus musculus
aattttgcaattgtttttatggatc

SEQ ID NO: 90757 - DNA, 25 bp, Mus musculus
aattttgcacagatgcttccggaca

SEQ ID NO: 90758 - DNA, 25 bp, Mus musculus
aattttgcacagttgcttccggaca

SEQ ID NO: 90759 - DNA, 25 bp, Mus musculus
aattttgcacatagaaggaccatga

SEQ ID NO: 90760 - DNA, 25 bp, Mus musculus
aattttgcacattgaaggaccatga

SEQ ID NO: 90761 - DNA, 25 bp, Mus musculus
aattttgcacttagccatggtcggg

SEQ ID NO: 90762 - DNA, 25 bp, Mus musculus
aattttgcactttgccatggtcggg

SEQ ID NO: 90763 - DNA, 25 bp, Mus musculus
aattttgccactattttgacacgta

SEQ ID NO: 90764 - DNA, 25 bp, Mus musculus
aattttgccacttttttgacacgta

SEQ ID NO: 90765 - DNA, 25 bp, Mus musculus
aattttgccggtacggagctgctga

SEQ ID NO: 90766 - DNA, 25 bp, Mus musculus
aattttgccggttcggagctgctga

SEQ ID NO: 90767 - DNA, 25 bp, Mus musculus
aattttgcctttctagaacgctaag

SEQ ID NO: 90768 - DNA, 25 bp, Mus musculus
aattttgcctttgtagaacgctaag

SEQ ID NO: 90769 - DNA, 25 bp, Mus musculus
aattttgctagcatgggaagaaggc

SEQ ID NO: 90770 - DNA, 25 bp, Mus musculus
aattttgctagcttgggaagaaggc

SEQ ID NO: 90771 - DNA, 25 bp, Mus musculus
aattttgctcaacggctgtgtacat

SEQ ID NO: 90772 - DNA, 25 bp, Mus musculus
aattttgctcaagggctgtgtacat

SEQ ID NO: 90773 - DNA, 25 bp, Mus musculus
aattttgctgaaaagatcttttcta

SEQ ID NO: 90774 - DNA, 25 bp, Mus musculus
aattttgctgaatagatcttttcta

SEQ ID NO: 90775 - DNA, 25 bp, Mus musculus
aattttgctgatctatttcctctgt

SEQ ID NO: 90776 - DNA, 25 bp, Mus musculus
aattttgctgatgtatttcctctgt

SEQ ID NO: 90777 - DNA, 25 bp, Mus musculus
aattttgctgccaagcaaccacagg

SEQ ID NO: 90778 - DNA, 25 bp, Mus musculus
aattttgctgcctagcaaccacagg

SEQ ID NO: 90779 - DNA, 25 bp, Mus musculus
aattttgctgtgatgctagtgttat

SEQ ID NO: 90780 - DNA, 25 bp, Mus musculus
aattttgctgtgctgttttctacta

SEQ ID NO: 90781 - DNA, 25 bp, Mus musculus
aattttgctgtggtgttttctacta

SEQ ID NO: 90782 - DNA, 25 bp, Mus musculus
aattttgctgtgttgctagtgttat

SEQ ID NO: 90783 - DNA, 25 bp, Mus musculus
aattttgcttttccccagcatgaag

SEQ ID NO: 90784 - DNA, 25 bp, Mus musculus
aattttgcttttgcccagcatgaag

SEQ ID NO: 90785 - DNA, 25 bp, Mus musculus
aattttggattcaggccttcttgct

SEQ ID NO: 90786 - DNA, 25 bp, Mus musculus
aattttggattctggccttcttgct

SEQ ID NO: 90787 - DNA, 25 bp, Mus musculus
aattttggcaccactacaggcggaa

SEQ ID NO: 90788 - DNA, 25 bp, Mus musculus
aattttggcacctctacaggcggaa

SEQ ID NO: 90789 - DNA, 25 bp, Mus musculus
aattttggcactcggatatacatat

SEQ ID NO: 90790 - DNA, 25 bp, Mus musculus
aattttggcactgggatatacatat

SEQ ID NO: 90791 - DNA, 25 bp, Mus musculus
aattttggctggacctgttaggtca

SEQ ID NO: 90792 - DNA, 25 bp, Mus musculus
aattttggctggtcctgttaggtca

SEQ ID NO: 90793 - DNA, 25 bp, Mus musculus
aattttgggctaccgatttgccctc

SEQ ID NO: 90794 - DNA, 25 bp, Mus musculus
aattttgggctagcgatttgccctc

SEQ ID NO: 90795 - DNA, 25 bp, Mus musculus
aattttgtaagaacattttgcccca

SEQ ID NO: 90796 - DNA, 25 bp, Mus musculus
aattttgtaagatcattttgcccca

SEQ ID NO: 90797 - DNA, 25 bp, Mus musculus
aattttgtacaacagaacagagatt

SEQ ID NO: 90798 - DNA, 25 bp, Mus musculus
aattttgtacaagagaacagagatt

SEQ ID NO: 90799 - DNA, 25 bp, Mus musculus
aattttgtatggactttgtgttggg

SEQ ID NO: 90800 - DNA, 25 bp, Mus musculus
aattttgtatggtctttgtgttggg

SEQ ID NO: 90801 - DNA, 25 bp, Mus musculus
aattttgtattgattgcctggtttg

SEQ ID NO: 90802 - DNA, 25 bp, Mus musculus
aattttgtattgtttgcctggtttg

SEQ ID NO: 90803 - DNA, 25 bp, Mus musculus
aattttgtcataactattaggccag

SEQ ID NO: 90804 - DNA, 25 bp, Mus musculus
aattttgtcatatctattaggccag

SEQ ID NO: 90805 - DNA, 25 bp, Mus musculus
aattttgtcattacttggtgccata

SEQ ID NO: 90806 - DNA, 25 bp, Mus musculus
aattttgtcatttcttggtgccata

SEQ ID NO: 90807 - DNA, 25 bp, Mus musculus
aattttgtccagcagtagaccctta

SEQ ID NO: 90808 - DNA, 25 bp, Mus musculus
aattttgtccagcttgatgtacata

SEQ ID NO: 90809 - DNA, 25 bp, Mus musculus
aattttgtccaggagtagaccctta

SEQ ID NO: 90810 - DNA, 25 bp, Mus musculus
aattttgtccaggttgatgtacata

SEQ ID NO: 90811 - DNA, 25 bp, Mus musculus
aattttgtccccagtgtcgtagcaa

SEQ ID NO: 90812 - DNA, 25 bp, Mus musculus
aattttgtcccctgtgtcgtagcaa

SEQ ID NO: 90813 - DNA, 25 bp, Mus musculus
aattttgtcccgaactcctggatat

SEQ ID NO: 90814 - DNA, 25 bp, Mus musculus
aattttgtcccgtactcctggatat

SEQ ID NO: 90815 - DNA, 25 bp, Mus musculus
aattttgtccttcaagccagccatg

SEQ ID NO: 90816 - DNA, 25 bp, Mus musculus
aattttgtccttgaagccagccatg

SEQ ID NO: 90817 - DNA, 25 bp, Mus musculus
aattttgtctaaatgccccacattc

SEQ ID NO: 90818 - DNA, 25 bp, Mus musculus
aattttgtctaattgccccacattc

SEQ ID NO: 90819 - DNA, 25 bp, Mus musculus
aattttgtcttgcatattcttgaaa

SEQ ID NO: 90820 - DNA, 25 bp, Mus musculus
aattttgtcttggatattcttgaaa

SEQ ID NO: 90821 - DNA, 25 bp, Mus musculus
aattttgtgaatcgcttactttggt

SEQ ID NO: 90822 - DNA, 25 bp, Mus musculus
aattttgtgaatggcttactttggt

SEQ ID NO: 90823 - DNA, 25 bp, Mus musculus
aattttgtgactcccttattagaac

SEQ ID NO: 90824 - DNA, 25 bp, Mus musculus
aattttgtgactcgcttctagtgcc

SEQ ID NO: 90825 - DNA, 25 bp, Mus musculus
aattttgtgactgccttattagaac

SEQ ID NO: 90826 - DNA, 25 bp, Mus musculus
aattttgtgactggcttctagtgcc

SEQ ID NO: 90827 - DNA, 25 bp, Mus musculus
aattttgtggaaccacttgctatgt

SEQ ID NO: 90828 - DNA, 25 bp, Mus musculus
aattttgtggaagcacttgctatgt

SEQ ID NO: 90829 - DNA, 25 bp, Mus musculus
aattttgtggtactgggacttgagc

SEQ ID NO: 90830 - DNA, 25 bp, Mus musculus
aattttgtggtagtgggacttgagc

SEQ ID NO: 90831 - DNA, 25 bp, Mus musculus
aattttgtgtacatgttctcgagaa

SEQ ID NO: 90832 - DNA, 25 bp, Mus musculus
aattttgtgtacttgttctcgagaa

SEQ ID NO: 90833 - DNA, 25 bp, Mus musculus
aattttgtgtgcaacaggaatccaa

SEQ ID NO: 90834 - DNA, 25 bp, Mus musculus
aattttgtgtgctacaggaatccaa

SEQ ID NO: 90835 - DNA, 25 bp, Mus musculus
aattttgtgtttccgtactgtacta

SEQ ID NO: 90836 - DNA, 25 bp, Mus musculus
aattttgtgtttgcgtactgtacta

SEQ ID NO: 90837 - DNA, 25 bp, Mus musculus
aattttgttactagcccatatccac

SEQ ID NO: 90838 - DNA, 25 bp, Mus musculus
aattttgttacttgcccatatccac

SEQ ID NO: 90839 - DNA, 25 bp, Mus musculus
aattttgttgaaacctatcaccttt

SEQ ID NO: 90840 - DNA, 25 bp, Mus musculus
aattttgttgaatcctatcaccttt

SEQ ID NO: 90841 - DNA, 25 bp, Mus musculus
aattttgttggcagtatgaatgcat

SEQ ID NO: 90842 - DNA, 25 bp, Mus musculus
aattttgttggctgtatgaatgcat

SEQ ID NO: 90843 - DNA, 25 bp, Mus musculus
aattttgttgttcagggtgtccaag

SEQ ID NO: 90844 - DNA, 25 bp, Mus musculus
aattttgttgttgagggtgtccaag

SEQ ID NO: 90845 - DNA, 25 bp, Mus musculus
aattttgtttgtccatcctaaccaa

SEQ ID NO: 90846 - DNA, 25 bp, Mus musculus
aattttgtttgtgcatcctaaccaa

SEQ ID NO: 90847 - DNA, 25 bp, Mus musculus
aatttttaaactctgtgcataggtg

SEQ ID NO: 90848 - DNA, 25 bp, Mus musculus
aatttttaaactgtgtgcataggtg

SEQ ID NO: 90849 - DNA, 25 bp, Mus musculus
aatttttaaatgacaatgagtgaca

SEQ ID NO: 90850 - DNA, 25 bp, Mus musculus
aatttttaaatgtcaatgagtgaca

SEQ ID NO: 90851 - DNA, 25 bp, Mus musculus
aatttttacagtagtgggtcaccat

SEQ ID NO: 90852 - DNA, 25 bp, Mus musculus
aatttttacagttgtgggtcaccat

SEQ ID NO: 90853 - DNA, 25 bp, Mus musculus
aatttttacattcatttgcctaagg

SEQ ID NO: 90854 - DNA, 25 bp, Mus musculus
aatttttacattgatttgcctaagg

SEQ ID NO: 90855 - DNA, 25 bp, Mus musculus
aatttttactcacggtgttctcagg

SEQ ID NO: 90856 - DNA, 25 bp, Mus musculus
aatttttactcagggtgttctcagg

SEQ ID NO: 90857 - DNA, 25 bp, Mus musculus
aatttttactctagttcagcttgca

SEQ ID NO: 90858 - DNA, 25 bp, Mus musculus
aatttttactcttgttcagcttgca

SEQ ID NO: 90859 - DNA, 25 bp, Mus musculus
aatttttagcagattagagtcagtc

SEQ ID NO: 90860 - DNA, 25 bp, Mus musculus
aatttttagcagtttagagtcagtc

SEQ ID NO: 90861 - DNA, 25 bp, Mus musculus
aatttttagcatctccattccagga

SEQ ID NO: 90862 - DNA, 25 bp, Mus musculus
aatttttagcatgtccattccagga

SEQ ID NO: 90863 - DNA, 25 bp, Mus musculus
aatttttagctacattcttcataga

SEQ ID NO: 90864 - DNA, 25 bp, Mus musculus
aatttttagctagattcttcataga

SEQ ID NO: 90865 - DNA, 25 bp, Mus musculus
aatttttatctgaatgtgggccatt

SEQ ID NO: 90866 - DNA, 25 bp, Mus musculus
aatttttatctgagtgatgatgctc

SEQ ID NO: 90867 - DNA, 25 bp, Mus musculus
aatttttatctgtatgtgggccatt

SEQ ID NO: 90868 - DNA, 25 bp, Mus musculus
aatttttatctgtgtgatgatgctc

SEQ ID NO: 90869 - DNA, 25 bp, Mus musculus
aatttttattatacagccgggcgtg

SEQ ID NO: 90870 - DNA, 25 bp, Mus musculus
aatttttattattcagccgggcgtg

SEQ ID NO: 90871 - DNA, 25 bp, Mus musculus
aatttttcaagcacgtgggcagaac

SEQ ID NO: 90872 - DNA, 25 bp, Mus musculus
aatttttcaagctcgtgggcagaac

SEQ ID NO: 90873 - DNA, 25 bp, Mus musculus
aatttttcaaggacacggagcagca

SEQ ID NO: 90874 - DNA, 25 bp, Mus musculus
aatttttcaaggtcacggagcagca

SEQ ID NO: 90875 - DNA, 25 bp, Mus musculus
aatttttcactgatacctcctagct

SEQ ID NO: 90876 - DNA, 25 bp, Mus musculus
aatttttcactgttacctcctagct

SEQ ID NO: 90877 - DNA, 25 bp, Mus musculus
aatttttcagtgagtaaaagccatt

SEQ ID NO: 90878 - DNA, 25 bp, Mus musculus
aatttttcagtgtgtaaaagccatt

SEQ ID NO: 90879 - DNA, 25 bp, Mus musculus
aatttttccagtctattgctcatat

SEQ ID NO: 90880 - DNA, 25 bp, Mus musculus
aatttttccagtgtattgctcatat

SEQ ID NO: 90881 - DNA, 25 bp, Mus musculus
aatttttccatgagagacttctctg

SEQ ID NO: 90882 - DNA, 25 bp, Mus musculus
aatttttccatgtgagacttctctg

SEQ ID NO: 90883 - DNA, 25 bp, Mus musculus
aatttttccattatgcagtatgcat

SEQ ID NO: 90884 - DNA, 25 bp, Mus musculus
aatttttccattttgcagtatgcat

SEQ ID NO: 90885 - DNA, 25 bp, Mus musculus
aatttttcctgcagttgggtggtag

SEQ ID NO: 90886 - DNA, 25 bp, Mus musculus
aatttttcctgctgttgggtggtag

SEQ ID NO: 90887 - DNA, 25 bp, Mus musculus
aatttttctatcctctactaagatg

SEQ ID NO: 90888 - DNA, 25 bp, Mus musculus
aatttttctatcgtctactaagatg

SEQ ID NO: 90889 - DNA, 25 bp, Mus musculus
aatttttctcccaatatgggtctgt

SEQ ID NO: 90890 - DNA, 25 bp, Mus musculus
aatttttctccctatatgggtctgt

SEQ ID NO: 90891 - DNA, 25 bp, Mus musculus
aatttttctctcactgatttggaaa

SEQ ID NO: 90892 - DNA, 25 bp, Mus musculus
aatttttctctctctgatttggaaa

SEQ ID NO: 90893 - DNA, 25 bp, Mus musculus
aatttttctggtactgtgtattgag

SEQ ID NO: 90894 - DNA, 25 bp, Mus musculus
aatttttctggttctgtgtattgag

SEQ ID NO: 90895 - DNA, 25 bp, Mus musculus
aatttttcttaacatgggcattatg

SEQ ID NO: 90896 - DNA, 25 bp, Mus musculus
aatttttcttaagatgggcattatg

SEQ ID NO: 90897 - DNA, 25 bp, Mus musculus
aatttttcttatcatgctattggct

SEQ ID NO: 90898 - DNA, 25 bp, Mus musculus
aatttttcttatgatgctattggct

SEQ ID NO: 90899 - DNA, 25 bp, Mus musculus
aatttttcttcacagcccagaggag

SEQ ID NO: 90900 - DNA, 25 bp, Mus musculus
aatttttcttcagagcccagaggag

SEQ ID NO: 90901 - DNA, 25 bp, Mus musculus
aatttttgaaatccctgatgcctgg

SEQ ID NO: 90902 - DNA, 25 bp, Mus musculus
aatttttgaaatgcctgatgcctgg

SEQ ID NO: 90903 - DNA, 25 bp, Mus musculus
aatttttgactaccttctttctatg

SEQ ID NO: 90904 - DNA, 25 bp, Mus musculus
aatttttgactagcttctttctatg

SEQ ID NO: 90905 - DNA, 25 bp, Mus musculus
aatttttgacttatcacaaatgagt

SEQ ID NO: 90906 - DNA, 25 bp, Mus musculus
aatttttgacttttcacaaatgagt

SEQ ID NO: 90907 - DNA, 25 bp, Mus musculus
aatttttgagctatggaacatcagg

SEQ ID NO: 90908 - DNA, 25 bp, Mus musculus
aatttttgagctttggaacatcagg

SEQ ID NO: 90909 - DNA, 25 bp, Mus musculus
aatttttgccttacaggagagtaag

SEQ ID NO: 90910 - DNA, 25 bp, Mus musculus
aatttttgccttcagtttaccagag

SEQ ID NO: 90911 - DNA, 25 bp, Mus musculus
aatttttgccttcctacacaactgt

SEQ ID NO: 90912 - DNA, 25 bp, Mus musculus
aatttttgccttgagtttaccagag

SEQ ID NO: 90913 - DNA, 25 bp, Mus musculus
aatttttgccttgctacacaactgt

SEQ ID NO: 90914 - DNA, 25 bp, Mus musculus
aatttttgcctttcaggagagtaag

SEQ ID NO: 90915 - DNA, 25 bp, Mus musculus
aatttttgtcacattcagggtgcag

SEQ ID NO: 90916 - DNA, 25 bp, Mus musculus
aatttttgtcactttcagggtgcag

SEQ ID NO: 90917 - DNA, 25 bp, Mus musculus
aatttttgtgaccatataccgcccg

SEQ ID NO: 90918 - DNA, 25 bp, Mus musculus
aatttttgtgacgatataccgcccg

SEQ ID NO: 90919 - DNA, 25 bp, Mus musculus
aatttttgtgctctctttcgcaagc

SEQ ID NO: 90920 - DNA, 25 bp, Mus musculus
aatttttgtgctgtctttcgcaagc

SEQ ID NO: 90921 - DNA, 25 bp, Mus musculus
aattttttatctcgctggtctgtct

SEQ ID NO: 90922 - DNA, 25 bp, Mus musculus
aattttttatctggctggtctgtct

SEQ ID NO: 90923 - DNA, 25 bp, Mus musculus
aattttttcatacactgactgttat

SEQ ID NO: 90924 - DNA, 25 bp, Mus musculus
aattttttcatagactgactgttat

SEQ ID NO: 90925 - DNA, 25 bp, Mus musculus
aattttttctagattcacagccata

SEQ ID NO: 90926 - DNA, 25 bp, Mus musculus
aattttttctagtttcacagccata

SEQ ID NO: 90927 - DNA, 25 bp, Mus musculus
aattttttctccaattcagccttgt

SEQ ID NO: 90928 - DNA, 25 bp, Mus musculus
aattttttctcctattcagccttgt

SEQ ID NO: 90929 - DNA, 25 bp, Mus musculus
aattttttgtgtatagaccctgagg

SEQ ID NO: 90930 - DNA, 25 bp, Mus musculus
aattttttgtgtttagaccctgagg

SEQ ID NO: 90931 - DNA, 25 bp, Mus musculus
acaaaaaacgatatccatgaacctc

SEQ ID NO: 90932 - DNA, 25 bp, Mus musculus
acaaaaaacgatttccatgaacctc

SEQ ID NO: 90933 - DNA, 25 bp, Mus musculus
acaaaaaagggcatggccaccgcca

SEQ ID NO: 90934 - DNA, 25 bp, Mus musculus
acaaaaaagggcttggccaccgcca

SEQ ID NO: 90935 - DNA, 25 bp, Mus musculus
acaaaaacactactgatgacctctc

SEQ ID NO: 90936 - DNA, 25 bp, Mus musculus
acaaaaacactagtgatgacctctc

SEQ ID NO: 90937 - DNA, 25 bp, Mus musculus
acaaaaacagacaaggcccacaggt

SEQ ID NO: 90938 - DNA, 25 bp, Mus musculus
acaaaaacagactaggcccacaggt

SEQ ID NO: 90939 - DNA, 25 bp, Mus musculus
acaaaaacatccaccattgcatgaa

SEQ ID NO: 90940 - DNA, 25 bp, Mus musculus
acaaaaacatcctccattgcatgaa

SEQ ID NO: 90941 - DNA, 25 bp, Mus musculus
acaaaaaccccacatgttctcactt

SEQ ID NO: 90942 - DNA, 25 bp, Mus musculus
acaaaaaccccagatgttctcactt

SEQ ID NO: 90943 - DNA, 25 bp, Mus musculus
acaaaaacctttcccacctgtagtg

SEQ ID NO: 90944 - DNA, 25 bp, Mus musculus
acaaaaacctttgccacctgtagtg

SEQ ID NO: 90945 - DNA, 25 bp, Mus musculus
acaaaaacgtggaagccctctgtgt

SEQ ID NO: 90946 - DNA, 25 bp, Mus musculus
acaaaaacgtggtagccctctgtgt

SEQ ID NO: 90947 - DNA, 25 bp, Mus musculus
acaaaaactctcatcacttcagcta

SEQ ID NO: 90948 - DNA, 25 bp, Mus musculus
acaaaaactctcttcacttcagcta

SEQ ID NO: 90949 - DNA, 25 bp, Mus musculus
acaaaaagaggcaataggcacctgt

SEQ ID NO: 90950 - DNA, 25 bp, Mus musculus
acaaaaagaggctataggcacctgt

SEQ ID NO: 90951 - DNA, 25 bp, Mus musculus
acaaaaagcagactccgttgggatt

SEQ ID NO: 90952 - DNA, 25 bp, Mus musculus
acaaaaagcagagtccgttgggatt

SEQ ID NO: 90953 - DNA, 25 bp, Mus musculus
acaaaaatcctcagttgatgtgaca

SEQ ID NO: 90954 - DNA, 25 bp, Mus musculus
acaaaaatcctctgttgatgtgaca

SEQ ID NO: 90955 - DNA, 25 bp, Mus musculus
acaaaaattcaacggtaagtatgct

SEQ ID NO: 90956 - DNA, 25 bp, Mus musculus
acaaaaattcaagggtaagtatgct

SEQ ID NO: 90957 - DNA, 25 bp, Mus musculus
acaaaacaacacaactctccatgct

SEQ ID NO: 90958 - DNA, 25 bp, Mus musculus
acaaaacaacactactctccatgct

SEQ ID NO: 90959 - DNA, 25 bp, Mus musculus
acaaaacaaggcattctctacccct

SEQ ID NO: 90960 - DNA, 25 bp, Mus musculus
acaaaacaaggctttctctacccct

SEQ ID NO: 90961 - DNA, 25 bp, Mus musculus
acaaaacacggcatgctcaggcttg

SEQ ID NO: 90962 - DNA, 25 bp, Mus musculus
acaaaacacggcttgctcaggcttg

SEQ ID NO: 90963 - DNA, 25 bp, Mus musculus
acaaaacagacgacttggagaacga

SEQ ID NO: 90964 - DNA, 25 bp, Mus musculus
acaaaacagacgtcttggagaacga

SEQ ID NO: 90965 - DNA, 25 bp, Mus musculus
acaaaacataacaggtgtcttcact

SEQ ID NO: 90966 - DNA, 25 bp, Mus musculus
acaaaacataactggtgtcttcact

SEQ ID NO: 90967 - DNA, 25 bp, Mus musculus
acaaaacatccacggatacgcccaa

SEQ ID NO: 90968 - DNA, 25 bp, Mus musculus
acaaaacatccagggatacgcccaa

SEQ ID NO: 90969 - DNA, 25 bp, Mus musculus
acaaaacatggcatttctcctctgg

SEQ ID NO: 90970 - DNA, 25 bp, Mus musculus
acaaaacatggcttttctcctctgg

SEQ ID NO: 90971 - DNA, 25 bp, Mus musculus
acaaaaccaaagattctggctgctt

SEQ ID NO: 90972 - DNA, 25 bp, Mus musculus
acaaaaccaaagtttctggctgctt

SEQ ID NO: 90973 - DNA, 25 bp, Mus musculus
acaaaaccaggtcagcctaccagct

SEQ ID NO: 90974 - DNA, 25 bp, Mus musculus
acaaaaccaggtgagcctaccagct

SEQ ID NO: 90975 - DNA, 25 bp, Mus musculus
acaaaaccagtgctatggtcatacc

SEQ ID NO: 90976 - DNA, 25 bp, Mus musculus
acaaaaccagtggtatggtcatacc

SEQ ID NO: 90977 - DNA, 25 bp, Mus musculus
acaaaacccaagatgctgcagcact

SEQ ID NO: 90978 - DNA, 25 bp, Mus musculus
acaaaacccaagttgctgcagcact

SEQ ID NO: 90979 - DNA, 25 bp, Mus musculus
acaaaacctagactatcccgctatt

SEQ ID NO: 90980 - DNA, 25 bp, Mus musculus
acaaaacctagagtatcccgctatt

SEQ ID NO: 90981 - DNA, 25 bp, Mus musculus
acaaaaccttgacactattactgaa

SEQ ID NO: 90982 - DNA, 25 bp, Mus musculus
acaaaaccttgagactattactgaa

SEQ ID NO: 90983 - DNA, 25 bp, Mus musculus
acaaaacgcccgacgtatttgctct

SEQ ID NO: 90984 - DNA, 25 bp, Mus musculus
acaaaacgcccgtcgtatttgctct

SEQ ID NO: 90985 - DNA, 25 bp, Mus musculus
acaaaacgccttagaccaggtggct

SEQ ID NO: 90986 - DNA, 25 bp, Mus musculus
acaaaacgcctttgaccaggtggct

SEQ ID NO: 90987 - DNA, 25 bp, Mus musculus
acaaaacgttatcccagtgtaacaa

SEQ ID NO: 90988 - DNA, 25 bp, Mus musculus
acaaaacgttatgccagtgtaacaa

SEQ ID NO: 90989 - DNA, 25 bp, Mus musculus
acaaaactaagtatttgcctcatgt

SEQ ID NO: 90990 - DNA, 25 bp, Mus musculus
acaaaactaagtttttgcctcatgt

SEQ ID NO: 90991 - DNA, 25 bp, Mus musculus
acaaaactagtcaactcccgtctgt

SEQ ID NO: 90992 - DNA, 25 bp, Mus musculus
acaaaactagtctactcccgtctgt

SEQ ID NO: 90993 - DNA, 25 bp, Mus musculus
acaaaactcaagaatgtcgagactt

SEQ ID NO: 90994 - DNA, 25 bp, Mus musculus
acaaaactcaagtatgtcgagactt

SEQ ID NO: 90995 - DNA, 25 bp, Mus musculus
acaaaactcaccaagagggccaggt

SEQ ID NO: 90996 - DNA, 25 bp, Mus musculus
acaaaactcacctagagggccaggt

SEQ ID NO: 90997 - DNA, 25 bp, Mus musculus
acaaaactcgacatctcggctcagc

SEQ ID NO: 90998 - DNA, 25 bp, Mus musculus
acaaaactcgacttctcggctcagc

SEQ ID NO: 90999 - DNA, 25 bp, Mus musculus
acaaaactgcccacgggtcttgagg

SEQ ID NO: 91000 - DNA, 25 bp, Mus musculus
acaaaactgccctcgggtcttgagg

SEQ ID NO: 91001 - DNA, 25 bp, Mus musculus
acaaaactgtaacggtgctgtccct

SEQ ID NO: 91002 - DNA, 25 bp, Mus musculus
acaaaactgtaagggtgctgtccct

SEQ ID NO: 91003 - DNA, 25 bp, Mus musculus
acaaaacttacaacagtgctggaaa

SEQ ID NO: 91004 - DNA, 25 bp, Mus musculus
acaaaacttacatcagtgctggaaa

SEQ ID NO: 91005 - DNA, 25 bp, Mus musculus
acaaaacttgtgacgtagcggtagt

SEQ ID NO: 91006 - DNA, 25 bp, Mus musculus
acaaaacttgtgtcgtagcggtagt

SEQ ID NO: 91007 - DNA, 25 bp, Mus musculus
acaaaagaatagcagctgctcagta

SEQ ID NO: 91008 - DNA, 25 bp, Mus musculus
acaaaagaataggagctgctcagta

SEQ ID NO: 91009 - DNA, 25 bp, Mus musculus
acaaaagagcccctagttgctggtg

SEQ ID NO: 91010 - DNA, 25 bp, Mus musculus
acaaaagagcccgtagttgctggtg

SEQ ID NO: 91011 - DNA, 25 bp, Mus musculus
acaaaagaggttagtctccctcatc

SEQ ID NO: 91012 - DNA, 25 bp, Mus musculus
acaaaagaggtttgtctccctcatc

SEQ ID NO: 91013 - DNA, 25 bp, Mus musculus
acaaaagagtgtcatgtggccatgg

SEQ ID NO: 91014 - DNA, 25 bp, Mus musculus
acaaaagagtgtgatgtggccatgg

SEQ ID NO: 91015 - DNA, 25 bp, Mus musculus
acaaaagatgacagagtgggctcag

SEQ ID NO: 91016 - DNA, 25 bp, Mus musculus
acaaaagatgactgagtgggctcag

SEQ ID NO: 91017 - DNA, 25 bp, Mus musculus
acaaaagccaaacccgcctttcagg

SEQ ID NO: 91018 - DNA, 25 bp, Mus musculus
acaaaagccaaagccgcctttcagg

SEQ ID NO: 91019 - DNA, 25 bp, Mus musculus
acaaaagccattcttcgtctccagt

SEQ ID NO: 91020 - DNA, 25 bp, Mus musculus
acaaaagccattgttcgtctccagt

SEQ ID NO: 91021 - DNA, 25 bp, Mus musculus
acaaaagcctctagaagcttcaaaa

SEQ ID NO: 91022 - DNA, 25 bp, Mus musculus
acaaaagcctcttgaagcttcaaaa

SEQ ID NO: 91023 - DNA, 25 bp, Mus musculus
acaaaagctatgatctccagaagag

SEQ ID NO: 91024 - DNA, 25 bp, Mus musculus
acaaaagctatgttctccagaagag

SEQ ID NO: 91025 - DNA, 25 bp, Mus musculus
acaaaagcttcaattagccacaaaa

SEQ ID NO: 91026 - DNA, 25 bp, Mus musculus
acaaaagcttcatttagccacaaaa

SEQ ID NO: 91027 - DNA, 25 bp, Mus musculus
acaaaagcttgcagcctctgatttt

SEQ ID NO: 91028 - DNA, 25 bp, Mus musculus
acaaaagcttgctgcctctgatttt

SEQ ID NO: 91029 - DNA, 25 bp, Mus musculus
acaaaagcttgtattctggcactct

SEQ ID NO: 91030 - DNA, 25 bp, Mus musculus
acaaaagcttgttttctggcactct

SEQ ID NO: 91031 - DNA, 25 bp, Mus musculus
acaaaaggcagcacatcctcttaac

SEQ ID NO: 91032 - DNA, 25 bp, Mus musculus
acaaaaggcagctcatcctcttaac

SEQ ID NO: 91033 - DNA, 25 bp, Mus musculus
acaaaagggatcatgagccactcat

SEQ ID NO: 91034 - DNA, 25 bp, Mus musculus
acaaaagggatcttgagccactcat

SEQ ID NO: 91035 - DNA, 25 bp, Mus musculus
acaaaagtgcaaaaccaggcgtggg

SEQ ID NO: 91036 - DNA, 25 bp, Mus musculus
acaaaagtgcaataccaggcgtggg

SEQ ID NO: 91037 - DNA, 25 bp, Mus musculus
acaaaagttctgatacctgtacaca

SEQ ID NO: 91038 - DNA, 25 bp, Mus musculus
acaaaagttctgttacctgtacaca

SEQ ID NO: 91039 - DNA, 25 bp, Mus musculus
acaaaataagtgatctccttcttga

SEQ ID NO: 91040 - DNA, 25 bp, Mus musculus
acaaaataagtgttctccttcttga

SEQ ID NO: 91041 - DNA, 25 bp, Mus musculus
acaaaatatgtgaatttgctgcttc

SEQ ID NO: 91042 - DNA, 25 bp, Mus musculus
acaaaatatgtgtatttgctgcttc

SEQ ID NO: 91043 - DNA, 25 bp, Mus musculus
acaaaatcgccgctaagctgctgcc

SEQ ID NO: 91044 - DNA, 25 bp, Mus musculus
acaaaatcgccggtaagctgctgcc

SEQ ID NO: 91045 - DNA, 25 bp, Mus musculus
acaaaatctactaggacttctccct

SEQ ID NO: 91046 - DNA, 25 bp, Mus musculus
acaaaatctacttggacttctccct

SEQ ID NO: 91047 - DNA, 25 bp, Mus musculus
acaaaatctctgacacaggctcaca

SEQ ID NO: 91048 - DNA, 25 bp, Mus musculus
acaaaatctctgtcacaggctcaca

SEQ ID NO: 91049 - DNA, 25 bp, Mus musculus
acaaaatctttcaacagggaattgt

SEQ ID NO: 91050 - DNA, 25 bp, Mus musculus
acaaaatctttctacagggaattgt

SEQ ID NO: 91051 - DNA, 25 bp, Mus musculus
acaaaatgcccactgtttggccctg

SEQ ID NO: 91052 - DNA, 25 bp, Mus musculus
acaaaatgcccagtgtttggccctg

SEQ ID NO: 91053 - DNA, 25 bp, Mus musculus
acaaaatgctgacaggtgtgcttca

SEQ ID NO: 91054 - DNA, 25 bp, Mus musculus
acaaaatgctgagaggtgtgcttca

SEQ ID NO: 91055 - DNA, 25 bp, Mus musculus
acaaaatgctgtctgggcccaggaa

SEQ ID NO: 91056 - DNA, 25 bp, Mus musculus
acaaaatgctgtgtgggcccaggaa

SEQ ID NO: 91057 - DNA, 25 bp, Mus musculus
acaaaatggcgtctgcctctgccag

SEQ ID NO: 91058 - DNA, 25 bp, Mus musculus
acaaaatggcgtgtgcctctgccag

SEQ ID NO: 91059 - DNA, 25 bp, Mus musculus
acaaaatggttgatcaaaacaactg

SEQ ID NO: 91060 - DNA, 25 bp, Mus musculus
acaaaatggttgttcaaaacaactg

SEQ ID NO: 91061 - DNA, 25 bp, Mus musculus
acaaaatgttcccatggccttcctg

SEQ ID NO: 91062 - DNA, 25 bp, Mus musculus
acaaaatgttccgatggccttcctg

SEQ ID NO: 91063 - DNA, 25 bp, Mus musculus
acaaaattcaaacctatggtagttt

SEQ ID NO: 91064 - DNA, 25 bp, Mus musculus
acaaaattcaaagctatggtagttt

SEQ ID NO: 91065 - DNA, 25 bp, Mus musculus
acaaaattgattacttccattggtt

SEQ ID NO: 91066 - DNA, 25 bp, Mus musculus
acaaaattgatttcttccattggtt

SEQ ID NO: 91067 - DNA, 25 bp, Mus musculus
acaaaattggcgaaactgtttcatc

SEQ ID NO: 91068 - DNA, 25 bp, Mus musculus
acaaaattggcgtaactgtttcatc

SEQ ID NO: 91069 - DNA, 25 bp, Mus musculus
acaaaatttcatacagctacatgtg

SEQ ID NO: 91070 - DNA, 25 bp, Mus musculus
acaaaatttcattcagctacatgtg

SEQ ID NO: 91071 - DNA, 25 bp, Mus musculus
acaaacaaaaccacaccattctgag

SEQ ID NO: 91072 - DNA, 25 bp, Mus musculus
acaaacaaaacctcaccattctgag

SEQ ID NO: 91073 - DNA, 25 bp, Mus musculus
acaaacaaaagcatttggctgaaga

SEQ ID NO: 91074 - DNA, 25 bp, Mus musculus
acaaacaaaagcttttggctgaaga

SEQ ID NO: 91075 - DNA, 25 bp, Mus musculus
acaaacaaatagagccagtgctgag

SEQ ID NO: 91076 - DNA, 25 bp, Mus musculus
acaaacaaatagtgccagtgctgag

SEQ ID NO: 91077 - DNA, 25 bp, Mus musculus
acaaacaaccttcacctgggcaagg

SEQ ID NO: 91078 - DNA, 25 bp, Mus musculus
acaaacaaccttgacctgggcaagg

SEQ ID NO: 91079 - DNA, 25 bp, Mus musculus
acaaacaactttcccttttcggcag

SEQ ID NO: 91080 - DNA, 25 bp, Mus musculus
acaaacaactttgccttttcggcag

SEQ ID NO: 91081 - DNA, 25 bp, Mus musculus
acaaacaagcgcctctctgtggaga

SEQ ID NO: 91082 - DNA, 25 bp, Mus musculus
acaaacaagcgcgtctctgtggaga

SEQ ID NO: 91083 - DNA, 25 bp, Mus musculus
acaaacaagctcatctgttctgctc

SEQ ID NO: 91084 - DNA, 25 bp, Mus musculus
acaaacaagctcttctgttctgctc

SEQ ID NO: 91085 - DNA, 25 bp, Mus musculus
acaaacaataaccttctccttgctg

SEQ ID NO: 91086 - DNA, 25 bp, Mus musculus
acaaacaataacgttctccttgctg

SEQ ID NO: 91087 - DNA, 25 bp, Mus musculus
acaaacacaatcataagcacatggg

SEQ ID NO: 91088 - DNA, 25 bp, Mus musculus
acaaacacaatcttaagcacatggg

SEQ ID NO: 91089 - DNA, 25 bp, Mus musculus
acaaacacagggaggatcgtggtga

SEQ ID NO: 91090 - DNA, 25 bp, Mus musculus
acaaacacagggtggatcgtggtga

SEQ ID NO: 91091 - DNA, 25 bp, Mus musculus
acaaacaccaaaaacactcttcttc

SEQ ID NO: 91092 - DNA, 25 bp, Mus musculus
acaaacaccaaatacactcttcttc

SEQ ID NO: 91093 - DNA, 25 bp, Mus musculus
acaaacaccatcactgcttgtgggt

SEQ ID NO: 91094 - DNA, 25 bp, Mus musculus
acaaacaccatctctgcttgtgggt

SEQ ID NO: 91095 - DNA, 25 bp, Mus musculus
acaaacacccaaaatccagttccag

SEQ ID NO: 91096 - DNA, 25 bp, Mus musculus
acaaacacccaatatccagttccag

SEQ ID NO: 91097 - DNA, 25 bp, Mus musculus
acaaacaccttgaccatggcacgag

SEQ ID NO: 91098 - DNA, 25 bp, Mus musculus
acaaacaccttgtccatggcacgag

SEQ ID NO: 91099 - DNA, 25 bp, Mus musculus
acaaacacggctaggtgcctgggct

SEQ ID NO: 91100 - DNA, 25 bp, Mus musculus
acaaacacggcttggtgcctgggct

SEQ ID NO: 91101 - DNA, 25 bp, Mus musculus
acaaacactcctcatagcatctctt

SEQ ID NO: 91102 - DNA, 25 bp, Mus musculus
acaaacactcctgatagcatctctt

SEQ ID NO: 91103 - DNA, 25 bp, Mus musculus
acaaacactggcactcgtggctgtt

SEQ ID NO: 91104 - DNA, 25 bp, Mus musculus
acaaacactggcagttttgcctaaa

SEQ ID NO: 91105 - DNA, 25 bp, Mus musculus
acaaacactggctctcgtggctgtt

SEQ ID NO: 91106 - DNA, 25 bp, Mus musculus
acaaacactggctgttttgcctaaa

SEQ ID NO: 91107 - DNA, 25 bp, Mus musculus
acaaacacttctctggtccactatg

SEQ ID NO: 91108 - DNA, 25 bp, Mus musculus
acaaacacttctgtggtccactatg

SEQ ID NO: 91109 - DNA, 25 bp, Mus musculus
acaaacactttacatggaccttcat

SEQ ID NO: 91110 - DNA, 25 bp, Mus musculus
acaaacactttagatggaccttcat

SEQ ID NO: 91111 - DNA, 25 bp, Mus musculus
acaaacagagtcaaccagcttcctt

SEQ ID NO: 91112 - DNA, 25 bp, Mus musculus
acaaacagagtctaccagcttcctt

SEQ ID NO: 91113 - DNA, 25 bp, Mus musculus
acaaacagccagcatctactttctc

SEQ ID NO: 91114 - DNA, 25 bp, Mus musculus
acaaacagccaggatctactttctc

SEQ ID NO: 91115 - DNA, 25 bp, Mus musculus
acaaacagcgggacttcaaccagaa

SEQ ID NO: 91116 - DNA, 25 bp, Mus musculus
acaaacagcgggtcttcaaccagaa

SEQ ID NO: 91117 - DNA, 25 bp, Mus musculus
acaaacaggaaactgcttcttgaca

SEQ ID NO: 91118 - DNA, 25 bp, Mus musculus
acaaacaggaaagtgcttcttgaca

SEQ ID NO: 91119 - DNA, 25 bp, Mus musculus
acaaacaggcagactttatgttcgt

SEQ ID NO: 91120 - DNA, 25 bp, Mus musculus
acaaacaggcagtctttatgttcgt

SEQ ID NO: 91121 - DNA, 25 bp, Mus musculus
acaaacaggctgatagctgccctac

SEQ ID NO: 91122 - DNA, 25 bp, Mus musculus
acaaacaggctgttagctgccctac

SEQ ID NO: 91123 - DNA, 25 bp, Mus musculus
acaaacagggttccgtgctccagcc

SEQ ID NO: 91124 - DNA, 25 bp, Mus musculus
acaaacagggttgcgtgctccagcc

SEQ ID NO: 91125 - DNA, 25 bp, Mus musculus
acaaacagttgtcccgatgtatcaa

SEQ ID NO: 91126 - DNA, 25 bp, Mus musculus
acaaacagttgtgccgatgtatcaa

SEQ ID NO: 91127 - DNA, 25 bp, Mus musculus
acaaacataatcacgcgacgccttc

SEQ ID NO: 91128 - DNA, 25 bp, Mus musculus
acaaacataatctcgcgacgccttc

SEQ ID NO: 91129 - DNA, 25 bp, Mus musculus
acaaacatagccacactttcaattg

SEQ ID NO: 91130 - DNA, 25 bp, Mus musculus
acaaacatagcctcactttcaattg

SEQ ID NO: 91131 - DNA, 25 bp, Mus musculus
acaaacatagttccatcttatgaga

SEQ ID NO: 91132 - DNA, 25 bp, Mus musculus
acaaacatagttgcatcttatgaga

SEQ ID NO: 91133 - DNA, 25 bp, Mus musculus
acaaacatcaaccaaatacaattca

SEQ ID NO: 91134 - DNA, 25 bp, Mus musculus
acaaacatcaacgaaatacaattca

SEQ ID NO: 91135 - DNA, 25 bp, Mus musculus
acaaacatcctcaacaagctgcggg

SEQ ID NO: 91136 - DNA, 25 bp, Mus musculus
acaaacatcctctacaagctgcggg

SEQ ID NO: 91137 - DNA, 25 bp, Mus musculus
acaaacatggtacaagctcacttgc

SEQ ID NO: 91138 - DNA, 25 bp, Mus musculus
acaaacatggtagaagctcacttgc

SEQ ID NO: 91139 - DNA, 25 bp, Mus musculus
acaaacatgtctccctgaaggtagg

SEQ ID NO: 91140 - DNA, 25 bp, Mus musculus
acaaacatgtctgcctgaaggtagg

SEQ ID NO: 91141 - DNA, 25 bp, Mus musculus
acaaacattagcaactcctatccaa

SEQ ID NO: 91142 - DNA, 25 bp, Mus musculus
acaaacattagctactcctatccaa

SEQ ID NO: 91143 - DNA, 25 bp, Mus musculus
acaaacatttttagtgctcatcaaa

SEQ ID NO: 91144 - DNA, 25 bp, Mus musculus
acaaacattttttgtgctcatcaaa

SEQ ID NO: 91145 - DNA, 25 bp, Mus musculus
acaaaccaagatctttctccccaag

SEQ ID NO: 91146 - DNA, 25 bp, Mus musculus
acaaaccaagatgtttctccccaag

SEQ ID NO: 91147 - DNA, 25 bp, Mus musculus
acaaaccaccacagtatgcatctgt

SEQ ID NO: 91148 - DNA, 25 bp, Mus musculus
acaaaccaccactgtatgcatctgt

SEQ ID NO: 91149 - DNA, 25 bp, Mus musculus
acaaaccaggaaccacagtgccgaa

SEQ ID NO: 91150 - DNA, 25 bp, Mus musculus
acaaaccaggaagcacagtgccgaa

SEQ ID NO: 91151 - DNA, 25 bp, Mus musculus
acaaaccagtagaatttcataagag

SEQ ID NO: 91152 - DNA, 25 bp, Mus musculus
acaaaccagtagtatttcataagag

SEQ ID NO: 91153 - DNA, 25 bp, Mus musculus
acaaaccagtcacgtgatcacacta

SEQ ID NO: 91154 - DNA, 25 bp, Mus musculus
acaaaccagtcaggtgatcacacta

SEQ ID NO: 91155 - DNA, 25 bp, Mus musculus
acaaaccagtgcctctgtgcagaac

SEQ ID NO: 91156 - DNA, 25 bp, Mus musculus
acaaaccagtgcgtctgtgcagaac

SEQ ID NO: 91157 - DNA, 25 bp, Mus musculus
acaaaccatcagcaatgcctgtgga

SEQ ID NO: 91158 - DNA, 25 bp, Mus musculus
acaaaccatcaggaatgcctgtgga

SEQ ID NO: 91159 - DNA, 25 bp, Mus musculus
acaaaccatctgctctgctctacaa

SEQ ID NO: 91160 - DNA, 25 bp, Mus musculus
acaaaccatctggtctgctctacaa

SEQ ID NO: 91161 - DNA, 25 bp, Mus musculus
acaaacccatttctctcccaatgat

SEQ ID NO: 91162 - DNA, 25 bp, Mus musculus
acaaacccatttgtctcccaatgat

SEQ ID NO: 91163 - DNA, 25 bp, Mus musculus
acaaaccccgtgactcaggtggaat

SEQ ID NO: 91164 - DNA, 25 bp, Mus musculus
acaaaccccgtgtctcaggtggaat

SEQ ID NO: 91165 - DNA, 25 bp, Mus musculus
acaaacccctaccatatgctggtaa

SEQ ID NO: 91166 - DNA, 25 bp, Mus musculus
acaaacccctacgatatgctggtaa

SEQ ID NO: 91167 - DNA, 25 bp, Mus musculus
acaaaccctaacctccaggctagag

SEQ ID NO: 91168 - DNA, 25 bp, Mus musculus
acaaaccctaacgtccaggctagag

SEQ ID NO: 91169 - DNA, 25 bp, Mus musculus
acaaaccgtgtgagactctgtcaac

SEQ ID NO: 91170 - DNA, 25 bp, Mus musculus
acaaaccgtgtgtgactctgtcaac

SEQ ID NO: 91171 - DNA, 25 bp, Mus musculus
acaaacctaggtctgctgccatcaa

SEQ ID NO: 91172 - DNA, 25 bp, Mus musculus
acaaacctaggtgtgctgccatcaa

SEQ ID NO: 91173 - DNA, 25 bp, Mus musculus
acaaacctcacaagtcctcagggag

SEQ ID NO: 91174 - DNA, 25 bp, Mus musculus
acaaacctcacatgtcctcagggag

SEQ ID NO: 91175 - DNA, 25 bp, Mus musculus
acaaacctcatacactgggcatagt

SEQ ID NO: 91176 - DNA, 25 bp, Mus musculus
acaaacctcatagactgggcatagt

SEQ ID NO: 91177 - DNA, 25 bp, Mus musculus
acaaacctctggacccgaactctga

SEQ ID NO: 91178 - DNA, 25 bp, Mus musculus
acaaacctctggtcccgaactctga

SEQ ID NO: 91179 - DNA, 25 bp, Mus musculus
acaaacctgcatcattgcacatgta

SEQ ID NO: 91180 - DNA, 25 bp, Mus musculus
acaaacctgcatgattgcacatgta

SEQ ID NO: 91181 - DNA, 25 bp, Mus musculus
acaaacctggagagggtcctagccg

SEQ ID NO: 91182 - DNA, 25 bp, Mus musculus
acaaacctggagtgggtcctagccg

SEQ ID NO: 91183 - DNA, 25 bp, Mus musculus
acaaacctgtttctcagggcttcag

SEQ ID NO: 91184 - DNA, 25 bp, Mus musculus
acaaacctgtttgtcagggcttcag

SEQ ID NO: 91185 - DNA, 25 bp, Mus musculus
acaaaccttaggagacgatcacgat

SEQ ID NO: 91186 - DNA, 25 bp, Mus musculus
acaaaccttaggtgacgatcacgat

SEQ ID NO: 91187 - DNA, 25 bp, Mus musculus
acaaaccttcagaatttgcagtatg

SEQ ID NO: 91188 - DNA, 25 bp, Mus musculus
acaaaccttcagtatttgcagtatg

SEQ ID NO: 91189 - DNA, 25 bp, Mus musculus
acaaacctttgaagcctgagtccta

SEQ ID NO: 91190 - DNA, 25 bp, Mus musculus
acaaacctttgatgcctgagtccta

SEQ ID NO: 91191 - DNA, 25 bp, Mus musculus
acaaacgccatcagctgatgagcat

SEQ ID NO: 91192 - DNA, 25 bp, Mus musculus
acaaacgccatctgctgatgagcat

SEQ ID NO: 91193 - DNA, 25 bp, Mus musculus
acaaacggcgctccagggtctgttg

SEQ ID NO: 91194 - DNA, 25 bp, Mus musculus
acaaacggcgctgcagggtctgttg

SEQ ID NO: 91195 - DNA, 25 bp, Mus musculus
acaaacgtgtgccaactccatgact

SEQ ID NO: 91196 - DNA, 25 bp, Mus musculus
acaaacgtgtgcgaactccatgact

SEQ ID NO: 91197 - DNA, 25 bp, Mus musculus
acaaacgttctaccccaggatacag

SEQ ID NO: 91198 - DNA, 25 bp, Mus musculus
acaaacgttctagcccaggatacag

SEQ ID NO: 91199 - DNA, 25 bp, Mus musculus
acaaactaactgcatggcctgggct

SEQ ID NO: 91200 - DNA, 25 bp, Mus musculus
acaaactaactggatggcctgggct

SEQ ID NO: 91201 - DNA, 25 bp, Mus musculus
acaaactaatctagggctgggcgtg

SEQ ID NO: 91202 - DNA, 25 bp, Mus musculus
acaaactaatcttgggctgggcgtg

SEQ ID NO: 91203 - DNA, 25 bp, Mus musculus
acaaactagctgcatgtaactttct

SEQ ID NO: 91204 - DNA, 25 bp, Mus musculus
acaaactagctggatgtaactttct

SEQ ID NO: 91205 - DNA, 25 bp, Mus musculus
acaaactaggatcggcatggtggct

SEQ ID NO: 91206 - DNA, 25 bp, Mus musculus
acaaactaggatgggcatggtggct

SEQ ID NO: 91207 - DNA, 25 bp, Mus musculus
acaaactcaatcatacatacctcct

SEQ ID NO: 91208 - DNA, 25 bp, Mus musculus
acaaactcaatcttacatacctcct

SEQ ID NO: 91209 - DNA, 25 bp, Mus musculus
acaaactcagtccatcggtccatgg

SEQ ID NO: 91210 - DNA, 25 bp, Mus musculus
acaaactcagtcgatcggtccatgg

SEQ ID NO: 91211 - DNA, 25 bp, Mus musculus
acaaactccccgaagcttttgcttg

SEQ ID NO: 91212 - DNA, 25 bp, Mus musculus
acaaactccccgtagcttttgcttg

SEQ ID NO: 91213 - DNA, 25 bp, Mus musculus
acaaactctgacaagttgtcctctg

SEQ ID NO: 91214 - DNA, 25 bp, Mus musculus
acaaactctgactagttgtcctctg

SEQ ID NO: 91215 - DNA, 25 bp, Mus musculus
acaaactctgtgacgtgcttgggac

SEQ ID NO: 91216 - DNA, 25 bp, Mus musculus
acaaactctgtgtcgtgcttgggac

SEQ ID NO: 91217 - DNA, 25 bp, Mus musculus
acaaactctgttataattcacttca

SEQ ID NO: 91218 - DNA, 25 bp, Mus musculus
acaaactctgttttaattcacttca

SEQ ID NO: 91219 - DNA, 25 bp, Mus musculus
acaaactcttgactctgcagtactg

SEQ ID NO: 91220 - DNA, 25 bp, Mus musculus
acaaactcttgagtctgcagtactg

SEQ ID NO: 91221 - DNA, 25 bp, Mus musculus
acaaactgcattcgaatgtggcttc

SEQ ID NO: 91222 - DNA, 25 bp, Mus musculus
acaaactgcattggaatgtggcttc

SEQ ID NO: 91223 - DNA, 25 bp, Mus musculus
acaaactgcttcacgcatttgactg

SEQ ID NO: 91224 - DNA, 25 bp, Mus musculus
acaaactgcttctcgcatttgactg

SEQ ID NO: 91225 - DNA, 25 bp, Mus musculus
acaaactggatcctactctgtattt

SEQ ID NO: 91226 - DNA, 25 bp, Mus musculus
acaaactggatcgtactctgtattt

SEQ ID NO: 91227 - DNA, 25 bp, Mus musculus
acaaactgggcacggatcatcccca

SEQ ID NO: 91228 - DNA, 25 bp, Mus musculus
acaaactgggcagggatcatcccca

SEQ ID NO: 91229 - DNA, 25 bp, Mus musculus
acaaactgtcatacgtatgggacct

SEQ ID NO: 91230 - DNA, 25 bp, Mus musculus
acaaactgtcattcgtatgggacct

SEQ ID NO: 91231 - DNA, 25 bp, Mus musculus
acaaactgtgatactcagccactaa

SEQ ID NO: 91232 - DNA, 25 bp, Mus musculus
acaaactgtgattctcagccactaa

SEQ ID NO: 91233 - DNA, 25 bp, Mus musculus
acaaactgtgctataattttcatat

SEQ ID NO: 91234 - DNA, 25 bp, Mus musculus
acaaactgtgctttaattttcatat

SEQ ID NO: 91235 - DNA, 25 bp, Mus musculus
acaaacttacgactgaaatgaatat

SEQ ID NO: 91236 - DNA, 25 bp, Mus musculus
acaaacttacgagtgaaatgaatat

SEQ ID NO: 91237 - DNA, 25 bp, Mus musculus
acaaacttcctaaacacgtgacctt

SEQ ID NO: 91238 - DNA, 25 bp, Mus musculus
acaaacttcctatacacgtgacctt

SEQ ID NO: 91239 - DNA, 25 bp, Mus musculus
acaaactttacgaggatgatacata

SEQ ID NO: 91240 - DNA, 25 bp, Mus musculus
acaaactttacgtggatgatacata

SEQ ID NO: 91241 - DNA, 25 bp, Mus musculus
acaaactttatcactgttcacacct

SEQ ID NO: 91242 - DNA, 25 bp, Mus musculus
acaaactttatctctgttcacacct

SEQ ID NO: 91243 - DNA, 25 bp, Mus musculus
acaaactttgcactaagcggacaga

SEQ ID NO: 91244 - DNA, 25 bp, Mus musculus
acaaactttgcagtaagcggacaga

SEQ ID NO: 91245 - DNA, 25 bp, Mus musculus
acaaactttgtgaccaatgcaagga

SEQ ID NO: 91246 - DNA, 25 bp, Mus musculus
acaaactttgtgtccaatgcaagga

SEQ ID NO: 91247 - DNA, 25 bp, Mus musculus
acaaacttttgtaaggtcaggtgtg

SEQ ID NO: 91248 - DNA, 25 bp, Mus musculus
acaaacttttgttaggtcaggtgtg

SEQ ID NO: 91249 - DNA, 25 bp, Mus musculus
acaaagaaaaagctccagtccatct

SEQ ID NO: 91250 - DNA, 25 bp, Mus musculus
acaaagaaaaaggtccagtccatct

SEQ ID NO: 91251 - DNA, 25 bp, Mus musculus
acaaagaagcccctaggactagaag

SEQ ID NO: 91252 - DNA, 25 bp, Mus musculus
acaaagaagcccgtaggactagaag

SEQ ID NO: 91253 - DNA, 25 bp, Mus musculus
acaaagaatgtaccccgcagtgcag

SEQ ID NO: 91254 - DNA, 25 bp, Mus musculus
acaaagaatgtagcccgcagtgcag

SEQ ID NO: 91255 - DNA, 25 bp, Mus musculus
acaaagaattctacgctcagctcag

SEQ ID NO: 91256 - DNA, 25 bp, Mus musculus
acaaagaattcttcgctcagctcag

SEQ ID NO: 91257 - DNA, 25 bp, Mus musculus
acaaagacagttcagctccagacac

SEQ ID NO: 91258 - DNA, 25 bp, Mus musculus
acaaagacagttgagctccagacac

SEQ ID NO: 91259 - DNA, 25 bp, Mus musculus
acaaagacattcatctacttctggg

SEQ ID NO: 91260 - DNA, 25 bp, Mus musculus
acaaagacattcttctacttctggg

SEQ ID NO: 91261 - DNA, 25 bp, Mus musculus
acaaagaccccgaggctgcactcta

SEQ ID NO: 91262 - DNA, 25 bp, Mus musculus
acaaagaccccgtggctgcactcta

SEQ ID NO: 91263 - DNA, 25 bp, Mus musculus
acaaagaccggcagatggtggtgct

SEQ ID NO: 91264 - DNA, 25 bp, Mus musculus
acaaagaccggctgatggtggtgct

SEQ ID NO: 91265 - DNA, 25 bp, Mus musculus
acaaagacctctagtgctgcactta

SEQ ID NO: 91266 - DNA, 25 bp, Mus musculus
acaaagacctcttgtgctgcactta

SEQ ID NO: 91267 - DNA, 25 bp, Mus musculus
acaaagacctgtatagctgcctaga

SEQ ID NO: 91268 - DNA, 25 bp, Mus musculus
acaaagacctgtttagctgcctaga

SEQ ID NO: 91269 - DNA, 25 bp, Mus musculus
acaaagacgtcaatggcggtctcct

SEQ ID NO: 91270 - DNA, 25 bp, Mus musculus
acaaagacgtcattggcggtctcct

SEQ ID NO: 91271 - DNA, 25 bp, Mus musculus
acaaagactgggaagacaacactga

SEQ ID NO: 91272 - DNA, 25 bp, Mus musculus
acaaagactgggtagacaacactga

SEQ ID NO: 91273 - DNA, 25 bp, Mus musculus
acaaagagagcaagacttccccgcc

SEQ ID NO: 91274 - DNA, 25 bp, Mus musculus
acaaagagagcatgacttccccgcc

SEQ ID NO: 91275 - DNA, 25 bp, Mus musculus
acaaagagagtccttccctatgctg

SEQ ID NO: 91276 - DNA, 25 bp, Mus musculus
acaaagagagtcgttccctatgctg

SEQ ID NO: 91277 - DNA, 25 bp, Mus musculus
acaaagagatcgaggcggcccgtcg

SEQ ID NO: 91278 - DNA, 25 bp, Mus musculus
acaaagagatcgtggcggcccgtcg

SEQ ID NO: 91279 - DNA, 25 bp, Mus musculus
acaaagagatgaccgagaatcaata

SEQ ID NO: 91280 - DNA, 25 bp, Mus musculus
acaaagagatgaccgccaccttcag

SEQ ID NO: 91281 - DNA, 25 bp, Mus musculus
acaaagagatgagcgagaatcaata

SEQ ID NO: 91282 - DNA, 25 bp, Mus musculus
acaaagagatgagcgccaccttcag

SEQ ID NO: 91283 - DNA, 25 bp, Mus musculus
acaaagagggctagaatggatgtgt

SEQ ID NO: 91284 - DNA, 25 bp, Mus musculus
acaaagagggcttgaatggatgtgt

SEQ ID NO: 91285 - DNA, 25 bp, Mus musculus
acaaagagtcgaagggctggcattt

SEQ ID NO: 91286 - DNA, 25 bp, Mus musculus
acaaagagtcgatgggctggcattt

SEQ ID NO: 91287 - DNA, 25 bp, Mus musculus
acaaagagttccaatccctctcggt

SEQ ID NO: 91288 - DNA, 25 bp, Mus musculus
acaaagagttcctatccctctcggt

SEQ ID NO: 91289 - DNA, 25 bp, Mus musculus
acaaagatcaaacgccactcaaggt

SEQ ID NO: 91290 - DNA, 25 bp, Mus musculus
acaaagatcaaaggccactcaaggt

SEQ ID NO: 91291 - DNA, 25 bp, Mus musculus
acaaagatgaccctggtgaaccaat

SEQ ID NO: 91292 - DNA, 25 bp, Mus musculus
acaaagatgaccgtggtgaaccaat

SEQ ID NO: 91293 - DNA, 25 bp, Mus musculus
acaaagatgatcctgttgatcttcg

SEQ ID NO: 91294 - DNA, 25 bp, Mus musculus
acaaagatgatcgtgttgatcttcg

SEQ ID NO: 91295 - DNA, 25 bp, Mus musculus
acaaagatgcagagatggtccggct

SEQ ID NO: 91296 - DNA, 25 bp, Mus musculus
acaaagatgcagtgatggtccggct

SEQ ID NO: 91297 - DNA, 25 bp, Mus musculus
acaaagatgctgcatgctaacttga

SEQ ID NO: 91298 - DNA, 25 bp, Mus musculus
acaaagatgctggatgctaacttga

SEQ ID NO: 91299 - DNA, 25 bp, Mus musculus
acaaagatgtccaagagccagagtt

SEQ ID NO: 91300 - DNA, 25 bp, Mus musculus
acaaagatgtcctagagccagagtt

SEQ ID NO: 91301 - DNA, 25 bp, Mus musculus
acaaagatgttgagtctgacttcca

SEQ ID NO: 91302 - DNA, 25 bp, Mus musculus
acaaagatgttgtgtctgacttcca

SEQ ID NO: 91303 - DNA, 25 bp, Mus musculus
acaaagattctacctcattctgggc

SEQ ID NO: 91304 - DNA, 25 bp, Mus musculus
acaaagattctagctcattctgggc

SEQ ID NO: 91305 - DNA, 25 bp, Mus musculus
acaaagcaacgtatagagccaggaa

SEQ ID NO: 91306 - DNA, 25 bp, Mus musculus
acaaagcaacgtttagagccaggaa

SEQ ID NO: 91307 - DNA, 25 bp, Mus musculus
acaaagcaatcaaacaccttctggg

SEQ ID NO: 91308 - DNA, 25 bp, Mus musculus
acaaagcaatcatacaccttctggg

SEQ ID NO: 91309 - DNA, 25 bp, Mus musculus
acaaagcacaagaggtcacgggact

SEQ ID NO: 91310 - DNA, 25 bp, Mus musculus
acaaagcacaagtggtcacgggact

SEQ ID NO: 91311 - DNA, 25 bp, Mus musculus
acaaagcagcgtccgccatcgcggt

SEQ ID NO: 91312 - DNA, 25 bp, Mus musculus
acaaagcagcgtgcgccatcgcggt

SEQ ID NO: 91313 - DNA, 25 bp, Mus musculus
acaaagcagtctacagccataccac

SEQ ID NO: 91314 - DNA, 25 bp, Mus musculus
acaaagcagtcttcagccataccac

SEQ ID NO: 91315 - DNA, 25 bp, Mus musculus
acaaagcatattctctttccatcag

SEQ ID NO: 91316 - DNA, 25 bp, Mus musculus
acaaagcatattgtctttccatcag

SEQ ID NO: 91317 - DNA, 25 bp, Mus musculus
acaaagcatcaacagcctggcgtgg

SEQ ID NO: 91318 - DNA, 25 bp, Mus musculus
acaaagcatcaagagcctggcgtgg

SEQ ID NO: 91319 - DNA, 25 bp, Mus musculus
acaaagcatcttacgcgtttgggcg

SEQ ID NO: 91320 - DNA, 25 bp, Mus musculus
acaaagcatctttcgcgtttgggcg

SEQ ID NO: 91321 - DNA, 25 bp, Mus musculus
acaaagccagatatgagcctaggta

SEQ ID NO: 91322 - DNA, 25 bp, Mus musculus
acaaagccagatttgagcctaggta

SEQ ID NO: 91323 - DNA, 25 bp, Mus musculus
acaaagccagcgattgttctctcac

SEQ ID NO: 91324 - DNA, 25 bp, Mus musculus
acaaagccagcgtttgttctctcac

SEQ ID NO: 91325 - DNA, 25 bp, Mus musculus
acaaagccagtgaacatgccagtaa

SEQ ID NO: 91326 - DNA, 25 bp, Mus musculus
acaaagccagtgtacatgccagtaa

SEQ ID NO: 91327 - DNA, 25 bp, Mus musculus
acaaagccatctatgggactgaact

SEQ ID NO: 91328 - DNA, 25 bp, Mus musculus
acaaagccatctttgggactgaact

SEQ ID NO: 91329 - DNA, 25 bp, Mus musculus
acaaagcccacgctggcaagcatac

SEQ ID NO: 91330 - DNA, 25 bp, Mus musculus
acaaagcccacggtggcaagcatac

SEQ ID NO: 91331 - DNA, 25 bp, Mus musculus
acaaagcccctaaacagctgttttg

SEQ ID NO: 91332 - DNA, 25 bp, Mus musculus
acaaagcccctatacagctgttttg

SEQ ID NO: 91333 - DNA, 25 bp, Mus musculus
acaaagccgccgactcgaagcgcga

SEQ ID NO: 91334 - DNA, 25 bp, Mus musculus
acaaagccgccgtctcgaagcgcga

SEQ ID NO: 91335 - DNA, 25 bp, Mus musculus
acaaagcctaagatgagcgcaagtt

SEQ ID NO: 91336 - DNA, 25 bp, Mus musculus
acaaagcctaagttgagcgcaagtt

SEQ ID NO: 91337 - DNA, 25 bp, Mus musculus
acaaagcctgtaacctggaggtgct

SEQ ID NO: 91338 - DNA, 25 bp, Mus musculus
acaaagcctgtatcctggaggtgct

SEQ ID NO: 91339 - DNA, 25 bp, Mus musculus
acaaagcgccggctcacgtgggcgg

SEQ ID NO: 91340 - DNA, 25 bp, Mus musculus
acaaagcgccgggtcacgtgggcgg

SEQ ID NO: 91341 - DNA, 25 bp, Mus musculus
acaaagcgctgtactggatgattcc

SEQ ID NO: 91342 - DNA, 25 bp, Mus musculus
acaaagcgctgttctggatgattcc

SEQ ID NO: 91343 - DNA, 25 bp, Mus musculus
acaaagcggagacctacctgcgggt

SEQ ID NO: 91344 - DNA, 25 bp, Mus musculus
acaaagcggagagctacctgcgggt

SEQ ID NO: 91345 - DNA, 25 bp, Mus musculus
acaaagctaccccagggctgagttt

SEQ ID NO: 91346 - DNA, 25 bp, Mus musculus
acaaagctacccgagggctgagttt

SEQ ID NO: 91347 - DNA, 25 bp, Mus musculus
acaaagctcctgctggactgtggcg

SEQ ID NO: 91348 - DNA, 25 bp, Mus musculus
acaaagctcctggtggactgtggcg

SEQ ID NO: 91349 - DNA, 25 bp, Mus musculus
acaaagctctgtagccttgtgtcta

SEQ ID NO: 91350 - DNA, 25 bp, Mus musculus
acaaagctctgtctatacctggaag

SEQ ID NO: 91351 - DNA, 25 bp, Mus musculus
acaaagctctgtgtatacctggaag

SEQ ID NO: 91352 - DNA, 25 bp, Mus musculus
acaaagctctgttgccttgtgtcta

SEQ ID NO: 91353 - DNA, 25 bp, Mus musculus
acaaagctgaagactcctgaaacaa

SEQ ID NO: 91354 - DNA, 25 bp, Mus musculus
acaaagctgaagtctcctgaaacaa

SEQ ID NO: 91355 - DNA, 25 bp, Mus musculus
acaaagctggaactacctctgtgcc

SEQ ID NO: 91356 - DNA, 25 bp, Mus musculus
acaaagctggaagtacctctgtgcc

SEQ ID NO: 91357 - DNA, 25 bp, Mus musculus
acaaagcttgcacgagaaaacaaat

SEQ ID NO: 91358 - DNA, 25 bp, Mus musculus
acaaagcttgcaggagaaaacaaat

SEQ ID NO: 91359 - DNA, 25 bp, Mus musculus
acaaagcttgtcatcctaagagcag

SEQ ID NO: 91360 - DNA, 25 bp, Mus musculus
acaaagcttgtcttcctaagagcag

SEQ ID NO: 91361 - DNA, 25 bp, Mus musculus
acaaaggaaccgcttggactcttct

SEQ ID NO: 91362 - DNA, 25 bp, Mus musculus
acaaaggaaccggttggactcttct

SEQ ID NO: 91363 - DNA, 25 bp, Mus musculus
acaaaggaagtcatctgctcaccct

SEQ ID NO: 91364 - DNA, 25 bp, Mus musculus
acaaaggaagtcttctgctcaccct

SEQ ID NO: 91365 - DNA, 25 bp, Mus musculus
acaaaggaatcacgcacttcactcc

SEQ ID NO: 91366 - DNA, 25 bp, Mus musculus
acaaaggaatcaggcacttcactcc

SEQ ID NO: 91367 - DNA, 25 bp, Mus musculus
acaaaggaggccaccgcggcgccag

SEQ ID NO: 91368 - DNA, 25 bp, Mus musculus
acaaaggaggcctccgcggcgccag

SEQ ID NO: 91369 - DNA, 25 bp, Mus musculus
acaaaggatctaatgctcgttccaa

SEQ ID NO: 91370 - DNA, 25 bp, Mus musculus
acaaaggatctattgctcgttccaa

SEQ ID NO: 91371 - DNA, 25 bp, Mus musculus
acaaaggcaagcagcctcgcagagt

SEQ ID NO: 91372 - DNA, 25 bp, Mus musculus
acaaaggcaagctgcctcgcagagt

SEQ ID NO: 91373 - DNA, 25 bp, Mus musculus
acaaaggcagtgacctagacttggg

SEQ ID NO: 91374 - DNA, 25 bp, Mus musculus
acaaaggcagtgtcctagacttggg

SEQ ID NO: 91375 - DNA, 25 bp, Mus musculus
acaaaggccagaccagctgagcttc

SEQ ID NO: 91376 - DNA, 25 bp, Mus musculus
acaaaggccagagcagctgagcttc

SEQ ID NO: 91377 - DNA, 25 bp, Mus musculus
acaaaggccaggctgtcctagggca

SEQ ID NO: 91378 - DNA, 25 bp, Mus musculus
acaaaggccagggtgtcctagggca

SEQ ID NO: 91379 - DNA, 25 bp, Mus musculus
acaaaggccattctcgttcaaacca

SEQ ID NO: 91380 - DNA, 25 bp, Mus musculus
acaaaggccattgtcgttcaaacca

SEQ ID NO: 91381 - DNA, 25 bp, Mus musculus
acaaaggcctggaagctaagctgct

SEQ ID NO: 91382 - DNA, 25 bp, Mus musculus
acaaaggcctggtagctaagctgct

SEQ ID NO: 91383 - DNA, 25 bp, Mus musculus
acaaaggcgttcatttccatggagg

SEQ ID NO: 91384 - DNA, 25 bp, Mus musculus
acaaaggcgttcttttccatggagg

SEQ ID NO: 91385 - DNA, 25 bp, Mus musculus
acaaaggctatgctcagttctactg

SEQ ID NO: 91386 - DNA, 25 bp, Mus musculus
acaaaggctatggtcagttctactg

SEQ ID NO: 91387 - DNA, 25 bp, Mus musculus
acaaaggctctgaagtcttctggaa

SEQ ID NO: 91388 - DNA, 25 bp, Mus musculus
acaaaggctctgtagtcttctggaa

SEQ ID NO: 91389 - DNA, 25 bp, Mus musculus
acaaaggctgctacatggctgggtg

SEQ ID NO: 91390 - DNA, 25 bp, Mus musculus
acaaaggctgcttcatggctgggtg

SEQ ID NO: 91391 - DNA, 25 bp, Mus musculus
acaaaggctgggaagtcgcctggcc

SEQ ID NO: 91392 - DNA, 25 bp, Mus musculus
acaaaggctgggagctggagacaca

SEQ ID NO: 91393 - DNA, 25 bp, Mus musculus
acaaaggctgggtagtcgcctggcc

SEQ ID NO: 91394 - DNA, 25 bp, Mus musculus
acaaaggctgggtgctggagacaca

SEQ ID NO: 91395 - DNA, 25 bp, Mus musculus
acaaaggctgtccttgagtctgttg

SEQ ID NO: 91396 - DNA, 25 bp, Mus musculus
acaaaggctgtcgttgagtctgttg

SEQ ID NO: 91397 - DNA, 25 bp, Mus musculus
acaaaggcttggcagcaccatgtgg

SEQ ID NO: 91398 - DNA, 25 bp, Mus musculus
acaaaggcttgggagcaccatgtgg

SEQ ID NO: 91399 - DNA, 25 bp, Mus musculus
acaaagggaccaagagactctgagg

SEQ ID NO: 91400 - DNA, 25 bp, Mus musculus
acaaagggaccatgagactctgagg

SEQ ID NO: 91401 - DNA, 25 bp, Mus musculus
acaaagggactgactctatcaggac

SEQ ID NO: 91402 - DNA, 25 bp, Mus musculus
acaaagggactgtctctatcaggac

SEQ ID NO: 91403 - DNA, 25 bp, Mus musculus
acaaagggatggctagcttgagcat

SEQ ID NO: 91404 - DNA, 25 bp, Mus musculus
acaaagggatgggtagcttgagcat

SEQ ID NO: 91405 - DNA, 25 bp, Mus musculus
acaaagggattcctcgttcgcctgc

SEQ ID NO: 91406 - DNA, 25 bp, Mus musculus
acaaagggattcgtcgttcgcctgc

SEQ ID NO: 91407 - DNA, 25 bp, Mus musculus
acaaagggccagaggtgtgtatctt

SEQ ID NO: 91408 - DNA, 25 bp, Mus musculus
acaaagggccagtggtgtgtatctt

SEQ ID NO: 91409 - DNA, 25 bp, Mus musculus
acaaagggcgctatgagatcacaga

SEQ ID NO: 91410 - DNA, 25 bp, Mus musculus
acaaagggcgctttgagatcacaga

SEQ ID NO: 91411 - DNA, 25 bp, Mus musculus
acaaagggctccctgtgtgcttgca

SEQ ID NO: 91412 - DNA, 25 bp, Mus musculus
acaaagggctccgtgtgtgcttgca

SEQ ID NO: 91413 - DNA, 25 bp, Mus musculus
acaaagggcttgagaaccatggaag

SEQ ID NO: 91414 - DNA, 25 bp, Mus musculus
acaaagggcttgtgaaccatggaag

SEQ ID NO: 91415 - DNA, 25 bp, Mus musculus
acaaaggtcactatcctaggtggtg

SEQ ID NO: 91416 - DNA, 25 bp, Mus musculus
acaaaggtcactttcctaggtggtg

SEQ ID NO: 91417 - DNA, 25 bp, Mus musculus
acaaaggtcctgctctgatcttgct

SEQ ID NO: 91418 - DNA, 25 bp, Mus musculus
acaaaggtcctggtctgatcttgct

SEQ ID NO: 91419 - DNA, 25 bp, Mus musculus
acaaaggtgggtcaagaaagcacaa

SEQ ID NO: 91420 - DNA, 25 bp, Mus musculus
acaaaggtgggtgaagaaagcacaa

SEQ ID NO: 91421 - DNA, 25 bp, Mus musculus
acaaaggttactctggcttctggtt

SEQ ID NO: 91422 - DNA, 25 bp, Mus musculus
acaaaggttactgtggcttctggtt

SEQ ID NO: 91423 - DNA, 25 bp, Mus musculus
acaaagtaagctctttgcctcacct

SEQ ID NO: 91424 - DNA, 25 bp, Mus musculus
acaaagtaagctgtttgcctcacct

SEQ ID NO: 91425 - DNA, 25 bp, Mus musculus
acaaagtaagttctagttcagcctc

SEQ ID NO: 91426 - DNA, 25 bp, Mus musculus
acaaagtaagttgtagttcagcctc

SEQ ID NO: 91427 - DNA, 25 bp, Mus musculus
acaaagtaccgcacctagtcgtagg

SEQ ID NO: 91428 - DNA, 25 bp, Mus musculus
acaaagtaccgctcctagtcgtagg

SEQ ID NO: 91429 - DNA, 25 bp, Mus musculus
acaaagtacgcgcaaggcccaggat

SEQ ID NO: 91430 - DNA, 25 bp, Mus musculus
acaaagtacgcggaaggcccaggat

SEQ ID NO: 91431 - DNA, 25 bp, Mus musculus
acaaagtactgtatgtgctaacatt

SEQ ID NO: 91432 - DNA, 25 bp, Mus musculus
acaaagtactgtttgtgctaacatt

SEQ ID NO: 91433 - DNA, 25 bp, Mus musculus
acaaagtagcggatgaaagtctctc

SEQ ID NO: 91434 - DNA, 25 bp, Mus musculus
acaaagtagcggttgaaagtctctc

SEQ ID NO: 91435 - DNA, 25 bp, Mus musculus
acaaagtcatgtctccacctggaat

SEQ ID NO: 91436 - DNA, 25 bp, Mus musculus
acaaagtcatgtgtccacctggaat

SEQ ID NO: 91437 - DNA, 25 bp, Mus musculus
acaaagtccatgatgacagcaggga

SEQ ID NO: 91438 - DNA, 25 bp, Mus musculus
acaaagtccatgttgacagcaggga

SEQ ID NO: 91439 - DNA, 25 bp, Mus musculus
acaaagtctccacgcaggtgctagt

SEQ ID NO: 91440 - DNA, 25 bp, Mus musculus
acaaagtctccaggcaggtgctagt

SEQ ID NO: 91441 - DNA, 25 bp, Mus musculus
acaaagtctcttctgggcttgcatt

SEQ ID NO: 91442 - DNA, 25 bp, Mus musculus
acaaagtctcttgtgggcttgcatt

SEQ ID NO: 91443 - DNA, 25 bp, Mus musculus
acaaagtcttggagttgttttctgt

SEQ ID NO: 91444 - DNA, 25 bp, Mus musculus
acaaagtcttggtgttgttttctgt

SEQ ID NO: 91445 - DNA, 25 bp, Mus musculus
acaaagtgaactaggctttcaccaa

SEQ ID NO: 91446 - DNA, 25 bp, Mus musculus
acaaagtgaacttggctttcaccaa

SEQ ID NO: 91447 - DNA, 25 bp, Mus musculus
acaaagtgaatcattatcctggtga

SEQ ID NO: 91448 - DNA, 25 bp, Mus musculus
acaaagtgaatctttatcctggtga

SEQ ID NO: 91449 - DNA, 25 bp, Mus musculus
acaaagtgcactctaactctttatg

SEQ ID NO: 91450 - DNA, 25 bp, Mus musculus
acaaagtgcactgtaactctttatg

SEQ ID NO: 91451 - DNA, 25 bp, Mus musculus
acaaagtgcctcattgagtctccta

SEQ ID NO: 91452 - DNA, 25 bp, Mus musculus
acaaagtgcctctttgagtctccta

SEQ ID NO: 91453 - DNA, 25 bp, Mus musculus
acaaagtggatgatctgccctggat

SEQ ID NO: 91454 - DNA, 25 bp, Mus musculus
acaaagtggatgttctgccctggat

SEQ ID NO: 91455 - DNA, 25 bp, Mus musculus
acaaagtggcaacggtagcaaggat

SEQ ID NO: 91456 - DNA, 25 bp, Mus musculus
acaaagtggcaagggtagcaaggat

SEQ ID NO: 91457 - DNA, 25 bp, Mus musculus
acaaagtgtcttaatgtcattttat

SEQ ID NO: 91458 - DNA, 25 bp, Mus musculus
acaaagtgtctttatgtcattttat

SEQ ID NO: 91459 - DNA, 25 bp, Mus musculus
acaaagttactaagtcagtgtgaga

SEQ ID NO: 91460 - DNA, 25 bp, Mus musculus
acaaagttactatgtcagtgtgaga

SEQ ID NO: 91461 - DNA, 25 bp, Mus musculus
acaaagttctagacgcagatctgga

SEQ ID NO: 91462 - DNA, 25 bp, Mus musculus
acaaagttctagtcgcagatctgga

SEQ ID NO: 91463 - DNA, 25 bp, Mus musculus
acaaagttgcctctggtcctataga

SEQ ID NO: 91464 - DNA, 25 bp, Mus musculus
acaaagttgcctgtggtcctataga

SEQ ID NO: 91465 - DNA, 25 bp, Mus musculus
acaaagtttaaaactttcagtgtat

SEQ ID NO: 91466 - DNA, 25 bp, Mus musculus
acaaagtttaaatctttcagtgtat

SEQ ID NO: 91467 - DNA, 25 bp, Mus musculus
acaaagtttatgaccttatgtcctt

SEQ ID NO: 91468 - DNA, 25 bp, Mus musculus
acaaagtttatgtccttatgtcctt

SEQ ID NO: 91469 - DNA, 25 bp, Mus musculus
acaaagtttccaaaggcagtcctga

SEQ ID NO: 91470 - DNA, 25 bp, Mus musculus
acaaagtttccataggcagtcctga

SEQ ID NO: 91471 - DNA, 25 bp, Mus musculus
acaaagtttgtgactatctctctct

SEQ ID NO: 91472 - DNA, 25 bp, Mus musculus
acaaagtttgtgtctatctctctct

SEQ ID NO: 91473 - DNA, 25 bp, Mus musculus
acaaagtttttacacactcctgcct

SEQ ID NO: 91474 - DNA, 25 bp, Mus musculus
acaaagtttttagacactcctgcct

SEQ ID NO: 91475 - DNA, 25 bp, Mus musculus
acaaataagtcacagcttcctacaa

SEQ ID NO: 91476 - DNA, 25 bp, Mus musculus
acaaataagtcagagcttcctacaa

SEQ ID NO: 91477 - DNA, 25 bp, Mus musculus
acaaataccaggaggctcaaagccc

SEQ ID NO: 91478 - DNA, 25 bp, Mus musculus
acaaataccaggtggctcaaagccc

SEQ ID NO: 91479 - DNA, 25 bp, Mus musculus
acaaatacccgtatatcctgccaca

SEQ ID NO: 91480 - DNA, 25 bp, Mus musculus
acaaatacccgtttatcctgccaca

SEQ ID NO: 91481 - DNA, 25 bp, Mus musculus
acaaatacttgtacttagcactttc

SEQ ID NO: 91482 - DNA, 25 bp, Mus musculus
acaaatacttgttcttagcactttc

SEQ ID NO: 91483 - DNA, 25 bp, Mus musculus
acaaatatagatccatactgtacta

SEQ ID NO: 91484 - DNA, 25 bp, Mus musculus
acaaatatagatgcatactgtacta

SEQ ID NO: 91485 - DNA, 25 bp, Mus musculus
acaaatatatccatgccttcgtctc

SEQ ID NO: 91486 - DNA, 25 bp, Mus musculus
acaaatatatccttgccttcgtctc

SEQ ID NO: 91487 - DNA, 25 bp, Mus musculus
acaaatatctacatcccatggcaaa

SEQ ID NO: 91488 - DNA, 25 bp, Mus musculus
acaaatatctacttcccatggcaaa

SEQ ID NO: 91489 - DNA, 25 bp, Mus musculus
acaaatattattcctggcctgcacc

SEQ ID NO: 91490 - DNA, 25 bp, Mus musculus
acaaatattattgctggcctgcacc

SEQ ID NO: 91491 - DNA, 25 bp, Mus musculus
acaaatattttcaatgacgcataca

SEQ ID NO: 91492 - DNA, 25 bp, Mus musculus
acaaatattttctatgacgcataca

SEQ ID NO: 91493 - DNA, 25 bp, Mus musculus
acaaatcaaagtcccggcagactga

SEQ ID NO: 91494 - DNA, 25 bp, Mus musculus
acaaatcaaagtgccggcagactga

SEQ ID NO: 91495 - DNA, 25 bp, Mus musculus
acaaatcaaattctccactgccttg

SEQ ID NO: 91496 - DNA, 25 bp, Mus musculus
acaaatcaaattgtccactgccttg

SEQ ID NO: 91497 - DNA, 25 bp, Mus musculus
acaaatcacatcaacgggagcccgg

SEQ ID NO: 91498 - DNA, 25 bp, Mus musculus
acaaatcacatctacgggagcccgg

SEQ ID NO: 91499 - DNA, 25 bp, Mus musculus
acaaatcacattatttcagtctaaa

SEQ ID NO: 91500 - DNA, 25 bp, Mus musculus
acaaatcacattttttcagtctaaa

SEQ ID NO: 91501 - DNA, 25 bp, Mus musculus
acaaatcaccataagccatgctagt

SEQ ID NO: 91502 - DNA, 25 bp, Mus musculus
acaaatcaccattagccatgctagt

SEQ ID NO: 91503 - DNA, 25 bp, Mus musculus
acaaatcacccaacgggacataagg

SEQ ID NO: 91504 - DNA, 25 bp, Mus musculus
acaaatcacccatcgggacataagg

SEQ ID NO: 91505 - DNA, 25 bp, Mus musculus
acaaatcatacaatcccattccttt

SEQ ID NO: 91506 - DNA, 25 bp, Mus musculus
acaaatcatacattcccattccttt

SEQ ID NO: 91507 - DNA, 25 bp, Mus musculus
acaaatccatgaagtgcagtaccca

SEQ ID NO: 91508 - DNA, 25 bp, Mus musculus
acaaatccatgatgtgcagtaccca

SEQ ID NO: 91509 - DNA, 25 bp, Mus musculus
acaaatccccaaatcgtattgcagc

SEQ ID NO: 91510 - DNA, 25 bp, Mus musculus
acaaatccccaattcgtattgcagc

SEQ ID NO: 91511 - DNA, 25 bp, Mus musculus
acaaatcccgtaccgagtcgaagcg

SEQ ID NO: 91512 - DNA, 25 bp, Mus musculus
acaaatcccgtagcgagtcgaagcg

SEQ ID NO: 91513 - DNA, 25 bp, Mus musculus
acaaatccctggcattttctcatac

SEQ ID NO: 91514 - DNA, 25 bp, Mus musculus
acaaatccctgggattttctcatac

SEQ ID NO: 91515 - DNA, 25 bp, Mus musculus
acaaatccgtttcgtccatctgctt

SEQ ID NO: 91516 - DNA, 25 bp, Mus musculus
acaaatccgtttggtccatctgctt

SEQ ID NO: 91517 - DNA, 25 bp, Mus musculus
acaaatcctgggatattcatattcc

SEQ ID NO: 91518 - DNA, 25 bp, Mus musculus
acaaatcctgggttattcatattcc

SEQ ID NO: 91519 - DNA, 25 bp, Mus musculus
acaaatcctggtacacacctggagc

SEQ ID NO: 91520 - DNA, 25 bp, Mus musculus
acaaatcctggttcacacctggagc

SEQ ID NO: 91521 - DNA, 25 bp, Mus musculus
acaaatcctgtgaggatccctggct

SEQ ID NO: 91522 - DNA, 25 bp, Mus musculus
acaaatcctgtgtggatccctggct

SEQ ID NO: 91523 - DNA, 25 bp, Mus musculus
acaaatcctttaaccagcgttcaaa

SEQ ID NO: 91524 - DNA, 25 bp, Mus musculus
acaaatcctttatccagcgttcaaa

SEQ ID NO: 91525 - DNA, 25 bp, Mus musculus
acaaatcggccccagtgtgtggaga

SEQ ID NO: 91526 - DNA, 25 bp, Mus musculus
acaaatcggcccgagtgtgtggaga

SEQ ID NO: 91527 - DNA, 25 bp, Mus musculus
acaaatcttaacaaccttatcctga

SEQ ID NO: 91528 - DNA, 25 bp, Mus musculus
acaaatcttaactaccttatcctga

SEQ ID NO: 91529 - DNA, 25 bp, Mus musculus
acaaatcttctaactatgggtgaaa

SEQ ID NO: 91530 - DNA, 25 bp, Mus musculus
acaaatcttctatctatgggtgaaa

SEQ ID NO: 91531 - DNA, 25 bp, Mus musculus
acaaatcttgtcctgatgcacctga

SEQ ID NO: 91532 - DNA, 25 bp, Mus musculus
acaaatcttgtcgtgatgcacctga

SEQ ID NO: 91533 - DNA, 25 bp, Mus musculus
acaaatcttgttcctgatttgtcca

SEQ ID NO: 91534 - DNA, 25 bp, Mus musculus
acaaatcttgttgctgatttgtcca

SEQ ID NO: 91535 - DNA, 25 bp, Mus musculus
acaaatcttttcctactcagttcaa

SEQ ID NO: 91536 - DNA, 25 bp, Mus musculus
acaaatcttttcgtactcagttcaa

SEQ ID NO: 91537 - DNA, 25 bp, Mus musculus
acaaatgaaaggcagctggccgtgc

SEQ ID NO: 91538 - DNA, 25 bp, Mus musculus
acaaatgaaagggagctggccgtgc

SEQ ID NO: 91539 - DNA, 25 bp, Mus musculus
acaaatgaactcagcttcgatcccc

SEQ ID NO: 91540 - DNA, 25 bp, Mus musculus
acaaatgaactctgcttcgatcccc

SEQ ID NO: 91541 - DNA, 25 bp, Mus musculus
acaaatgacgcactctggagcccat

SEQ ID NO: 91542 - DNA, 25 bp, Mus musculus
acaaatgacgcagtctggagcccat

SEQ ID NO: 91543 - DNA, 25 bp, Mus musculus
acaaatgaggtaacccactccaggg

SEQ ID NO: 91544 - DNA, 25 bp, Mus musculus
acaaatgaggtatcccactccaggg

SEQ ID NO: 91545 - DNA, 25 bp, Mus musculus
acaaatgattccatgctgtttagac

SEQ ID NO: 91546 - DNA, 25 bp, Mus musculus
acaaatgattccttgctgtttagac

SEQ ID NO: 91547 - DNA, 25 bp, Mus musculus
acaaatgcaaatacagttctctaaa

SEQ ID NO: 91548 - DNA, 25 bp, Mus musculus
acaaatgcaaattcagttctctaaa

SEQ ID NO: 91549 - DNA, 25 bp, Mus musculus
acaaatgcaacccagtatactttaa

SEQ ID NO: 91550 - DNA, 25 bp, Mus musculus
acaaatgcaaccgagtatactttaa

SEQ ID NO: 91551 - DNA, 25 bp, Mus musculus
acaaatgcaagtccaagggctgcaa

SEQ ID NO: 91552 - DNA, 25 bp, Mus musculus
acaaatgcaagtgcaagggctgcaa

SEQ ID NO: 91553 - DNA, 25 bp, Mus musculus
acaaatgcacgcagttcgctgggtt

SEQ ID NO: 91554 - DNA, 25 bp, Mus musculus
acaaatgcacgctgttcgctgggtt

SEQ ID NO: 91555 - DNA, 25 bp, Mus musculus
acaaatgcacttagggtgtgttttg

SEQ ID NO: 91556 - DNA, 25 bp, Mus musculus
acaaatgcactttgggtgtgttttg

SEQ ID NO: 91557 - DNA, 25 bp, Mus musculus
acaaatgcctcactagtgggaacgg

SEQ ID NO: 91558 - DNA, 25 bp, Mus musculus
acaaatgcctcagtagtgggaacgg

SEQ ID NO: 91559 - DNA, 25 bp, Mus musculus
acaaatgccttgaggacttgaagta

SEQ ID NO: 91560 - DNA, 25 bp, Mus musculus
acaaatgccttgtggacttgaagta

SEQ ID NO: 91561 - DNA, 25 bp, Mus musculus
acaaatgcgccaccatcctggagaa

SEQ ID NO: 91562 - DNA, 25 bp, Mus musculus
acaaatgcgccagcatcctggagaa

SEQ ID NO: 91563 - DNA, 25 bp, Mus musculus
acaaatgctcagagccttgtttctg

SEQ ID NO: 91564 - DNA, 25 bp, Mus musculus
acaaatgctcagtgccttgtttctg

SEQ ID NO: 91565 - DNA, 25 bp, Mus musculus
acaaatgctcgtatgaatgagatca

SEQ ID NO: 91566 - DNA, 25 bp, Mus musculus
acaaatgctcgtttgaatgagatca

SEQ ID NO: 91567 - DNA, 25 bp, Mus musculus
acaaatgctgttaacccacaactgc

SEQ ID NO: 91568 - DNA, 25 bp, Mus musculus
acaaatgctgtttacccacaactgc

SEQ ID NO: 91569 - DNA, 25 bp, Mus musculus
acaaatgcttctaatttcctctcac

SEQ ID NO: 91570 - DNA, 25 bp, Mus musculus
acaaatgcttcttatttcctctcac

SEQ ID NO: 91571 - DNA, 25 bp, Mus musculus
acaaatgctttaccgggagcgtgca

SEQ ID NO: 91572 - DNA, 25 bp, Mus musculus
acaaatgctttagcgggagcgtgca

SEQ ID NO: 91573 - DNA, 25 bp, Mus musculus
acaaatgctttgagacagttacaag

SEQ ID NO: 91574 - DNA, 25 bp, Mus musculus
acaaatgctttgtgacagttacaag

SEQ ID NO: 91575 - DNA, 25 bp, Mus musculus
acaaatggactcatgttccgtcgtt

SEQ ID NO: 91576 - DNA, 25 bp, Mus musculus
acaaatggactcttgttccgtcgtt

SEQ ID NO: 91577 - DNA, 25 bp, Mus musculus
acaaatggagtgaccctgtctctgg

SEQ ID NO: 91578 - DNA, 25 bp, Mus musculus
acaaatggagtgtccctgtctctgg

SEQ ID NO: 91579 - DNA, 25 bp, Mus musculus
acaaatggcattatctcctctgaat

SEQ ID NO: 91580 - DNA, 25 bp, Mus musculus
acaaatggcattttctcctctgaat

SEQ ID NO: 91581 - DNA, 25 bp, Mus musculus
acaaatggccatctactctggttgc

SEQ ID NO: 91582 - DNA, 25 bp, Mus musculus
acaaatggccatgtactctggttgc

SEQ ID NO: 91583 - DNA, 25 bp, Mus musculus
acaaatggccttaaattctcacaga

SEQ ID NO: 91584 - DNA, 25 bp, Mus musculus
acaaatggcctttaattctcacaga

SEQ ID NO: 91585 - DNA, 25 bp, Mus musculus
acaaatgggcaaaccggcacacgca

SEQ ID NO: 91586 - DNA, 25 bp, Mus musculus
acaaatgggcaatccggcacacgca

SEQ ID NO: 91587 - DNA, 25 bp, Mus musculus
acaaatgggcatctttcttgaggag

SEQ ID NO: 91588 - DNA, 25 bp, Mus musculus
acaaatgggcatgtttcttgaggag

SEQ ID NO: 91589 - DNA, 25 bp, Mus musculus
acaaatggtaccctcttcataatgg

SEQ ID NO: 91590 - DNA, 25 bp, Mus musculus
acaaatggtaccgtcttcataatgg

SEQ ID NO: 91591 - DNA, 25 bp, Mus musculus
acaaatgtagtgaaaccagaataat

SEQ ID NO: 91592 - DNA, 25 bp, Mus musculus
acaaatgtagtgtaaccagaataat

SEQ ID NO: 91593 - DNA, 25 bp, Mus musculus
acaaatgtataacggttcttgagaa

SEQ ID NO: 91594 - DNA, 25 bp, Mus musculus
acaaatgtataagggttcttgagaa

SEQ ID NO: 91595 - DNA, 25 bp, Mus musculus
acaaatgtcaggatacccaatgcca

SEQ ID NO: 91596 - DNA, 25 bp, Mus musculus
acaaatgtcaggcacggaagcccct

SEQ ID NO: 91597 - DNA, 25 bp, Mus musculus
acaaatgtcagggacggaagcccct

SEQ ID NO: 91598 - DNA, 25 bp, Mus musculus
acaaatgtcaggttacccaatgcca

SEQ ID NO: 91599 - DNA, 25 bp, Mus musculus
acaaatgtccacaggtgggttcctc

SEQ ID NO: 91600 - DNA, 25 bp, Mus musculus
acaaatgtccactggtgggttcctc

SEQ ID NO: 91601 - DNA, 25 bp, Mus musculus
acaaatgtccccaggtgtgatgtca

SEQ ID NO: 91602 - DNA, 25 bp, Mus musculus
acaaatgtcccctggtgtgatgtca

SEQ ID NO: 91603 - DNA, 25 bp, Mus musculus
acaaatgtgtgtcgagtggagctct

SEQ ID NO: 91604 - DNA, 25 bp, Mus musculus
acaaatgtgtgtggagtggagctct

SEQ ID NO: 91605 - DNA, 25 bp, Mus musculus
acaaatgttcatcgctgtgctccag

SEQ ID NO: 91606 - DNA, 25 bp, Mus musculus
acaaatgttcatggctgtgctccag

SEQ ID NO: 91607 - DNA, 25 bp, Mus musculus
acaaatgtttttcccactgagctat

SEQ ID NO: 91608 - DNA, 25 bp, Mus musculus
acaaatgtttttgccactgagctat

SEQ ID NO: 91609 - DNA, 25 bp, Mus musculus
acaaattcaaaaagtacgcctgatt

SEQ ID NO: 91610 - DNA, 25 bp, Mus musculus
acaaattcaaaatgtacgcctgatt

SEQ ID NO: 91611 - DNA, 25 bp, Mus musculus
acaaattcaagcagtggcctctaac

SEQ ID NO: 91612 - DNA, 25 bp, Mus musculus
acaaattcaagctgtggcctctaac

SEQ ID NO: 91613 - DNA, 25 bp, Mus musculus
acaaattcatctagccatctctaac

SEQ ID NO: 91614 - DNA, 25 bp, Mus musculus
acaaattcatcttgccatctctaac

SEQ ID NO: 91615 - DNA, 25 bp, Mus musculus
acaaattcatgtatcttagtctcag

SEQ ID NO: 91616 - DNA, 25 bp, Mus musculus
acaaattcatgtttcttagtctcag

SEQ ID NO: 91617 - DNA, 25 bp, Mus musculus
acaaattccaggctgtctgcaacaa

SEQ ID NO: 91618 - DNA, 25 bp, Mus musculus
acaaattccagggtgtctgcaacaa

SEQ ID NO: 91619 - DNA, 25 bp, Mus musculus
acaaattcctagcttgattttagtg

SEQ ID NO: 91620 - DNA, 25 bp, Mus musculus
acaaattcctaggttgattttagtg

SEQ ID NO: 91621 - DNA, 25 bp, Mus musculus
acaaattctacgatggtgcaggcac

SEQ ID NO: 91622 - DNA, 25 bp, Mus musculus
acaaattctacgttggtgcaggcac

SEQ ID NO: 91623 - DNA, 25 bp, Mus musculus
acaaattctattatcttccttcctt

SEQ ID NO: 91624 - DNA, 25 bp, Mus musculus
acaaattctattttcttccttcctt

SEQ ID NO: 91625 - DNA, 25 bp, Mus musculus
acaaattctgttagcttagttgcaa

SEQ ID NO: 91626 - DNA, 25 bp, Mus musculus
acaaattctgtttgcttagttgcaa

SEQ ID NO: 91627 - DNA, 25 bp, Mus musculus
acaaattgaagcagggtgttgacca

SEQ ID NO: 91628 - DNA, 25 bp, Mus musculus
acaaattgaagctgggtgttgacca

SEQ ID NO: 91629 - DNA, 25 bp, Mus musculus
acaaattgacttatacttcaagcaa

SEQ ID NO: 91630 - DNA, 25 bp, Mus musculus
acaaattgacttttacttcaagcaa

SEQ ID NO: 91631 - DNA, 25 bp, Mus musculus
acaaattgatcccaccttttctggt

SEQ ID NO: 91632 - DNA, 25 bp, Mus musculus
acaaattgatccgaccttttctggt

SEQ ID NO: 91633 - DNA, 25 bp, Mus musculus
acaaattgttgtcctctgtttaatg

SEQ ID NO: 91634 - DNA, 25 bp, Mus musculus
acaaattgttgtgctctgtttaatg

SEQ ID NO: 91635 - DNA, 25 bp, Mus musculus
acaaatttaaggcatctgtggtttc

SEQ ID NO: 91636 - DNA, 25 bp, Mus musculus
acaaatttaagggatctgtggtttc

SEQ ID NO: 91637 - DNA, 25 bp, Mus musculus
acaaatttacggacctgaggcacag

SEQ ID NO: 91638 - DNA, 25 bp, Mus musculus
acaaatttacggtcctgaggcacag

SEQ ID NO: 91639 - DNA, 25 bp, Mus musculus
acaaatttagacatcctcttctcca

SEQ ID NO: 91640 - DNA, 25 bp, Mus musculus
acaaatttagacttcctcttctcca

SEQ ID NO: 91641 - DNA, 25 bp, Mus musculus
acaaatttcatgctgtacatctgaa

SEQ ID NO: 91642 - DNA, 25 bp, Mus musculus
acaaatttcatggtgtacatctgaa

SEQ ID NO: 91643 - DNA, 25 bp, Mus musculus
acaaatttctttaccgctcgtcagt

SEQ ID NO: 91644 - DNA, 25 bp, Mus musculus
acaaatttcttttccgctcgtcagt

SEQ ID NO: 91645 - DNA, 25 bp, Mus musculus
acaaatttgactaactttcctctat

SEQ ID NO: 91646 - DNA, 25 bp, Mus musculus
acaaatttgacttactttcctctat

SEQ ID NO: 91647 - DNA, 25 bp, Mus musculus
acaaattttctaccagctttattct

SEQ ID NO: 91648 - DNA, 25 bp, Mus musculus
acaaattttctagcagctttattct

SEQ ID NO: 91649 - DNA, 25 bp, Mus musculus
acaacaaaatcacagggtccaccat

SEQ ID NO: 91650 - DNA, 25 bp, Mus musculus
acaacaaaatcagagggtccaccat

SEQ ID NO: 91651 - DNA, 25 bp, Mus musculus
acaacaaagatgctcttctcaccta

SEQ ID NO: 91652 - DNA, 25 bp, Mus musculus
acaacaaagatggtcttctcaccta

SEQ ID NO: 91653 - DNA, 25 bp, Mus musculus
acaacaaagcccagacccaagtgtc

SEQ ID NO: 91654 - DNA, 25 bp, Mus musculus
acaacaaagccctgacccaagtgtc

SEQ ID NO: 91655 - DNA, 25 bp, Mus musculus
acaacaaatccaaattcacacaata

SEQ ID NO: 91656 - DNA, 25 bp, Mus musculus
acaacaaatccatattcacacaata

SEQ ID NO: 91657 - DNA, 25 bp, Mus musculus
acaacaaatctacccattcagtgcg

SEQ ID NO: 91658 - DNA, 25 bp, Mus musculus
acaacaaatctagccattcagtgcg

SEQ ID NO: 91659 - DNA, 25 bp, Mus musculus
acaacaacaaacactacccgctatg

SEQ ID NO: 91660 - DNA, 25 bp, Mus musculus
acaacaacaaactctacccgctatg

SEQ ID NO: 91661 - DNA, 25 bp, Mus musculus
acaacaacagctccagaagtccatc

SEQ ID NO: 91662 - DNA, 25 bp, Mus musculus
acaacaacagctgcagaagtccatc

SEQ ID NO: 91663 - DNA, 25 bp, Mus musculus
acaacaacatcacttgtgctggccc

SEQ ID NO: 91664 - DNA, 25 bp, Mus musculus
acaacaacatcagttgtgctggccc

SEQ ID NO: 91665 - DNA, 25 bp, Mus musculus
acaacaaccatacagaataaagcaa

SEQ ID NO: 91666 - DNA, 25 bp, Mus musculus
acaacaaccatagagaataaagcaa

SEQ ID NO: 91667 - DNA, 25 bp, Mus musculus
acaacaaccgagagtgcttgatgga

SEQ ID NO: 91668 - DNA, 25 bp, Mus musculus
acaacaaccgagtgtgcttgatgga

SEQ ID NO: 91669 - DNA, 25 bp, Mus musculus
acaacaacctggaaccaattggcaa

SEQ ID NO: 91670 - DNA, 25 bp, Mus musculus
acaacaacctggtaccaattggcaa

SEQ ID NO: 91671 - DNA, 25 bp, Mus musculus
acaacaaccttcaagagtttctgca

SEQ ID NO: 91672 - DNA, 25 bp, Mus musculus
acaacaaccttctagagtttctgca

SEQ ID NO: 91673 - DNA, 25 bp, Mus musculus
acaacaactttgacacacttttttg

SEQ ID NO: 91674 - DNA, 25 bp, Mus musculus
acaacaactttgattttctggatct

SEQ ID NO: 91675 - DNA, 25 bp, Mus musculus
acaacaactttgtcacacttttttg

SEQ ID NO: 91676 - DNA, 25 bp, Mus musculus
acaacaactttgtttttctggatct

SEQ ID NO: 91677 - DNA, 25 bp, Mus musculus
acaacaagaactctctggtgctggg

SEQ ID NO: 91678 - DNA, 25 bp, Mus musculus
acaacaagaactgtctggtgctggg

SEQ ID NO: 91679 - DNA, 25 bp, Mus musculus
acaacaagaccgagggtttgtcata

SEQ ID NO: 91680 - DNA, 25 bp, Mus musculus
acaacaagaccgtgggtttgtcata

SEQ ID NO: 91681 - DNA, 25 bp, Mus musculus
acaacaagcactaggcagtaccctg

SEQ ID NO: 91682 - DNA, 25 bp, Mus musculus
acaacaagcacttggcagtaccctg

SEQ ID NO: 91683 - DNA, 25 bp, Mus musculus
acaacaaggaccacgagctcgggca

SEQ ID NO: 91684 - DNA, 25 bp, Mus musculus
acaacaaggacctcgagctcgggca

SEQ ID NO: 91685 - DNA, 25 bp, Mus musculus
acaacaagtacaacaacgttcggaa

SEQ ID NO: 91686 - DNA, 25 bp, Mus musculus
acaacaagtacatcaacgttcggaa

SEQ ID NO: 91687 - DNA, 25 bp, Mus musculus
acaacaagtcgtctgagcagtataa

SEQ ID NO: 91688 - DNA, 25 bp, Mus musculus
acaacaagtcgtgtgagcagtataa

SEQ ID NO: 91689 - DNA, 25 bp, Mus musculus
acaacaagtggtctgtctcggtgac

SEQ ID NO: 91690 - DNA, 25 bp, Mus musculus
acaacaagtggtgtgtctcggtgac

SEQ ID NO: 91691 - DNA, 25 bp, Mus musculus
acaacaataactcacacagtgaaat

SEQ ID NO: 91692 - DNA, 25 bp, Mus musculus
acaacaataactgacacagtgaaat

SEQ ID NO: 91693 - DNA, 25 bp, Mus musculus
acaacaatattaacctgttccctca

SEQ ID NO: 91694 - DNA, 25 bp, Mus musculus
acaacaatattatcctgttccctca

SEQ ID NO: 91695 - DNA, 25 bp, Mus musculus
acaacaatctccaaactgaagtgcc

SEQ ID NO: 91696 - DNA, 25 bp, Mus musculus
acaacaatctcctaactgaagtgcc

SEQ ID NO: 91697 - DNA, 25 bp, Mus musculus
acaacaatgctaaggctgtcatctg

SEQ ID NO: 91698 - DNA, 25 bp, Mus musculus
acaacaatgctatggctgtcatctg

SEQ ID NO: 91699 - DNA, 25 bp, Mus musculus
acaacaatgtatattccgagtctgc

SEQ ID NO: 91700 - DNA, 25 bp, Mus musculus
acaacaatgtattttccgagtctgc

SEQ ID NO: 91701 - DNA, 25 bp, Mus musculus
acaacaattcccaaatgtcagcaga

SEQ ID NO: 91702 - DNA, 25 bp, Mus musculus
acaacaattccctaatgtcagcaga

SEQ ID NO: 91703 - DNA, 25 bp, Mus musculus
acaacacaacatccggctatttgaa

SEQ ID NO: 91704 - DNA, 25 bp, Mus musculus
acaacacaacatgcggctatttgaa

SEQ ID NO: 91705 - DNA, 25 bp, Mus musculus
acaacacaagatcctcataagcaga

SEQ ID NO: 91706 - DNA, 25 bp, Mus musculus
acaacacaagatgctcataagcaga

SEQ ID NO: 91707 - DNA, 25 bp, Mus musculus
acaacacacaagcatccttcagttc

SEQ ID NO: 91708 - DNA, 25 bp, Mus musculus
acaacacacaaggatccttcagttc

SEQ ID NO: 91709 - DNA, 25 bp, Mus musculus
acaacacaccgtacagccaagtcaa

SEQ ID NO: 91710 - DNA, 25 bp, Mus musculus
acaacacaccgttcagccaagtcaa

SEQ ID NO: 91711 - DNA, 25 bp, Mus musculus
acaacacacgagatcctggacatga

SEQ ID NO: 91712 - DNA, 25 bp, Mus musculus
acaacacacgagttcctggacatga

SEQ ID NO: 91713 - DNA, 25 bp, Mus musculus
acaacacagacaaccatctgcactt

SEQ ID NO: 91714 - DNA, 25 bp, Mus musculus
acaacacagacatccatctgcactt

SEQ ID NO: 91715 - DNA, 25 bp, Mus musculus
acaacacagcaccaacttaatgatt

SEQ ID NO: 91716 - DNA, 25 bp, Mus musculus
acaacacagcacgaacttaatgatt

SEQ ID NO: 91717 - DNA, 25 bp, Mus musculus
acaacacaggatcatgacacagcaa

SEQ ID NO: 91718 - DNA, 25 bp, Mus musculus
acaacacaggatgatgacacagcaa

SEQ ID NO: 91719 - DNA, 25 bp, Mus musculus
acaacacagtccacaaatgagtcac

SEQ ID NO: 91720 - DNA, 25 bp, Mus musculus
acaacacagtcccagattgttttgg

SEQ ID NO: 91721 - DNA, 25 bp, Mus musculus
acaacacagtccgagattgttttgg

SEQ ID NO: 91722 - DNA, 25 bp, Mus musculus
acaacacagtcctcaaatgagtcac

SEQ ID NO: 91723 - DNA, 25 bp, Mus musculus
acaacacatcctcatcttggaccag

SEQ ID NO: 91724 - DNA, 25 bp, Mus musculus
acaacacatcctgatcttggaccag

SEQ ID NO: 91725 - DNA, 25 bp, Mus musculus
acaacacatctcattcagctgcagt

SEQ ID NO: 91726 - DNA, 25 bp, Mus musculus
acaacacatctctttcagctgcagt

SEQ ID NO: 91727 - DNA, 25 bp, Mus musculus
acaacaccagtgacatcatgctatt

SEQ ID NO: 91728 - DNA, 25 bp, Mus musculus
acaacaccagtgtcatcatgctatt

SEQ ID NO: 91729 - DNA, 25 bp, Mus musculus
acaacaccatcaattctgaatgtat

SEQ ID NO: 91730 - DNA, 25 bp, Mus musculus
acaacaccatcatttctgaatgtat

SEQ ID NO: 91731 - DNA, 25 bp, Mus musculus
acaacacccatgaagtcaggcacgt

SEQ ID NO: 91732 - DNA, 25 bp, Mus musculus
acaacacccatgtagtcaggcacgt

SEQ ID NO: 91733 - DNA, 25 bp, Mus musculus
acaacacccgagcacgacaggctgt

SEQ ID NO: 91734 - DNA, 25 bp, Mus musculus
acaacacccgaggacgacaggctgt

SEQ ID NO: 91735 - DNA, 25 bp, Mus musculus
acaacacccggcctgaaattccagt

SEQ ID NO: 91736 - DNA, 25 bp, Mus musculus
acaacacccggcgtgaaattccagt

SEQ ID NO: 91737 - DNA, 25 bp, Mus musculus
acaacacctcgcagtatcttaacat

SEQ ID NO: 91738 - DNA, 25 bp, Mus musculus
acaacacctcgctgtatcttaacat

SEQ ID NO: 91739 - DNA, 25 bp, Mus musculus
acaacacctggtcagccggccagaa

SEQ ID NO: 91740 - DNA, 25 bp, Mus musculus
acaacacctggtgagccggccagaa

SEQ ID NO: 91741 - DNA, 25 bp, Mus musculus
acaacacctgtcagtatgagagtat

SEQ ID NO: 91742 - DNA, 25 bp, Mus musculus
acaacacctgtctgtatgagagtat

SEQ ID NO: 91743 - DNA, 25 bp, Mus musculus
acaacacgccggactgactctggcg

SEQ ID NO: 91744 - DNA, 25 bp, Mus musculus
acaacacgccggtctgactctggcg

SEQ ID NO: 91745 - DNA, 25 bp, Mus musculus
acaacactacaccttttgaataaga

SEQ ID NO: 91746 - DNA, 25 bp, Mus musculus
acaacactacacgttttgaataaga

SEQ ID NO: 91747 - DNA, 25 bp, Mus musculus
acaacactctatcctccacagaaat

SEQ ID NO: 91748 - DNA, 25 bp, Mus musculus
acaacactctatgctccacagaaat

SEQ ID NO: 91749 - DNA, 25 bp, Mus musculus
acaacactgaatataacagcttgta

SEQ ID NO: 91750 - DNA, 25 bp, Mus musculus
acaacactgaatttaacagcttgta

SEQ ID NO: 91751 - DNA, 25 bp, Mus musculus
acaacactgggacatgtgtttgcca

SEQ ID NO: 91752 - DNA, 25 bp, Mus musculus
acaacactgggagatgtgtttgcca

SEQ ID NO: 91753 - DNA, 25 bp, Mus musculus
acaacactgtcgcaaggctctgcac

SEQ ID NO: 91754 - DNA, 25 bp, Mus musculus
acaacactgtcggaaggctctgcac

SEQ ID NO: 91755 - DNA, 25 bp, Mus musculus
acaacacttacacaggagctagggt

SEQ ID NO: 91756 - DNA, 25 bp, Mus musculus
acaacacttacagaggagctagggt

SEQ ID NO: 91757 - DNA, 25 bp, Mus musculus
acaacacttcgtcgcagctaagcaa

SEQ ID NO: 91758 - DNA, 25 bp, Mus musculus
acaacacttcgtggcagctaagcaa

SEQ ID NO: 91759 - DNA, 25 bp, Mus musculus
acaacactttaacatcctccattaa

SEQ ID NO: 91760 - DNA, 25 bp, Mus musculus
acaacactttaagatcctccattaa

SEQ ID NO: 91761 - DNA, 25 bp, Mus musculus
acaacagaagctcacctttctctga

SEQ ID NO: 91762 - DNA, 25 bp, Mus musculus
acaacagaagctgacctttctctga

SEQ ID NO: 91763 - DNA, 25 bp, Mus musculus
acaacagaatgaccagtgcctgcca

SEQ ID NO: 91764 - DNA, 25 bp, Mus musculus
acaacagaatgagcagtgcctgcca

SEQ ID NO: 91765 - DNA, 25 bp, Mus musculus
acaacagaccctagggcttgtgtgc

SEQ ID NO: 91766 - DNA, 25 bp, Mus musculus
acaacagacccttgggcttgtgtgc

SEQ ID NO: 91767 - DNA, 25 bp, Mus musculus
acaacagacctcctccctactcttg

SEQ ID NO: 91768 - DNA, 25 bp, Mus musculus
acaacagacctcgtccctactcttg

SEQ ID NO: 91769 - DNA, 25 bp, Mus musculus
acaacagagcgaccagtttgcctct

SEQ ID NO: 91770 - DNA, 25 bp, Mus musculus
acaacagagcgagcagtttgcctct

SEQ ID NO: 91771 - DNA, 25 bp, Mus musculus
acaacagaggacaccctgtgccgct

SEQ ID NO: 91772 - DNA, 25 bp, Mus musculus
acaacagaggactccctgtgccgct

SEQ ID NO: 91773 - DNA, 25 bp, Mus musculus
acaacagagttccacaaaaagaaag

SEQ ID NO: 91774 - DNA, 25 bp, Mus musculus
acaacagagttcgacaaaaagaaag

SEQ ID NO: 91775 - DNA, 25 bp, Mus musculus
acaacagataaacatacacacagag

SEQ ID NO: 91776 - DNA, 25 bp, Mus musculus
acaacagataaagatacacacagag

SEQ ID NO: 91777 - DNA, 25 bp, Mus musculus
acaacagatggcctgctgatccaat

SEQ ID NO: 91778 - DNA, 25 bp, Mus musculus
acaacagatggcgtgctgatccaat

SEQ ID NO: 91779 - DNA, 25 bp, Mus musculus
acaacagcaacgacttgaacaggcg

SEQ ID NO: 91780 - DNA, 25 bp, Mus musculus
acaacagcaacgtcttgaacaggcg

SEQ ID NO: 91781 - DNA, 25 bp, Mus musculus
acaacagcacatattaaccacagat

SEQ ID NO: 91782 - DNA, 25 bp, Mus musculus
acaacagcacattttaaccacagat

SEQ ID NO: 91783 - DNA, 25 bp, Mus musculus
acaacagcagctattactactccat

SEQ ID NO: 91784 - DNA, 25 bp, Mus musculus
acaacagcagcttttactactccat

SEQ ID NO: 91785 - DNA, 25 bp, Mus musculus
acaacagcatccacacatgctggga

SEQ ID NO: 91786 - DNA, 25 bp, Mus musculus
acaacagcatcctcacatgctggga

SEQ ID NO: 91787 - DNA, 25 bp, Mus musculus
acaacagccgctactggaacggtgt

SEQ ID NO: 91788 - DNA, 25 bp, Mus musculus
acaacagccgcttctggaacggtgt

SEQ ID NO: 91789 - DNA, 25 bp, Mus musculus
acaacagcctccatgatggcagtga

SEQ ID NO: 91790 - DNA, 25 bp, Mus musculus
acaacagcctccttgatggcagtga

SEQ ID NO: 91791 - DNA, 25 bp, Mus musculus
acaacagcctggagtatggagcgaa

SEQ ID NO: 91792 - DNA, 25 bp, Mus musculus
acaacagcctggtgtatggagcgaa

SEQ ID NO: 91793 - DNA, 25 bp, Mus musculus
acaacagcgagcatacaactttccc

SEQ ID NO: 91794 - DNA, 25 bp, Mus musculus
acaacagcgagcttacaactttccc

SEQ ID NO: 91795 - DNA, 25 bp, Mus musculus
acaacagcgctcaccaatacaaaaa

SEQ ID NO: 91796 - DNA, 25 bp, Mus musculus
acaacagcgctctccaatacaaaaa

SEQ ID NO: 91797 - DNA, 25 bp, Mus musculus
acaacagctgtgaggtcatcgctca

SEQ ID NO: 91798 - DNA, 25 bp, Mus musculus
acaacagctgtgcttacctgcatga

SEQ ID NO: 91799 - DNA, 25 bp, Mus musculus
acaacagctgtggttacctgcatga

SEQ ID NO: 91800 - DNA, 25 bp, Mus musculus
acaacagctgtgtggtcatcgctca

SEQ ID NO: 91801 - DNA, 25 bp, Mus musculus
acaacagcttcgctatgtgatggaa

SEQ ID NO: 91802 - DNA, 25 bp, Mus musculus
acaacagcttcggtatgtgatggaa

SEQ ID NO: 91803 - DNA, 25 bp, Mus musculus
acaacaggacagagcatctaacaga

SEQ ID NO: 91804 - DNA, 25 bp, Mus musculus
acaacaggacagtgcatctaacaga

SEQ ID NO: 91805 - DNA, 25 bp, Mus musculus
acaacaggaccacgcagcaccgatg

SEQ ID NO: 91806 - DNA, 25 bp, Mus musculus
acaacaggaccaggcagcaccgatg

SEQ ID NO: 91807 - DNA, 25 bp, Mus musculus
acaacaggagagacgtagctaaaac

SEQ ID NO: 91808 - DNA, 25 bp, Mus musculus
acaacaggagagtcgtagctaaaac

SEQ ID NO: 91809 - DNA, 25 bp, Mus musculus
acaacaggcactactgggcttacac

SEQ ID NO: 91810 - DNA, 25 bp, Mus musculus
acaacaggcacttctgggcttacac

SEQ ID NO: 91811 - DNA, 25 bp, Mus musculus
acaacaggccaaacatatttgcaag

SEQ ID NO: 91812 - DNA, 25 bp, Mus musculus
acaacaggccaacagcagcagaaca

SEQ ID NO: 91813 - DNA, 25 bp, Mus musculus
acaacaggccaagagcagcagaaca

SEQ ID NO: 91814 - DNA, 25 bp, Mus musculus
acaacaggccaatcatatttgcaag

SEQ ID NO: 91815 - DNA, 25 bp, Mus musculus
acaacagggcataggagcccctata

SEQ ID NO: 91816 - DNA, 25 bp, Mus musculus
acaacagggcattggagcccctata

SEQ ID NO: 91817 - DNA, 25 bp, Mus musculus
acaacagggcttccactaaagaatt

SEQ ID NO: 91818 - DNA, 25 bp, Mus musculus
acaacagggcttgcactaaagaatt

SEQ ID NO: 91819 - DNA, 25 bp, Mus musculus
acaacagggtcacacctttcatctt

SEQ ID NO: 91820 - DNA, 25 bp, Mus musculus
acaacagggtcagacctttcatctt

SEQ ID NO: 91821 - DNA, 25 bp, Mus musculus
acaacaggtatgacttgcccgatgg

SEQ ID NO: 91822 - DNA, 25 bp, Mus musculus
acaacaggtatgtcttgcccgatgg

SEQ ID NO: 91823 - DNA, 25 bp, Mus musculus
acaacaggtctgacccatttgggta

SEQ ID NO: 91824 - DNA, 25 bp, Mus musculus
acaacaggtctgtcccatttgggta

SEQ ID NO: 91825 - DNA, 25 bp, Mus musculus
acaacaggttggagacagaggtctc

SEQ ID NO: 91826 - DNA, 25 bp, Mus musculus
acaacaggttggtgacagaggtctc

SEQ ID NO: 91827 - DNA, 25 bp, Mus musculus
acaacaggtttcactccacactttt

SEQ ID NO: 91828 - DNA, 25 bp, Mus musculus
acaacaggtttctctccacactttt

SEQ ID NO: 91829 - DNA, 25 bp, Mus musculus
acaacagtacctaccgagtggtcag

SEQ ID NO: 91830 - DNA, 25 bp, Mus musculus
acaacagtaccttccgagtggtcag

SEQ ID NO: 91831 - DNA, 25 bp, Mus musculus
acaacagtaggtagcattttgtgcc

SEQ ID NO: 91832 - DNA, 25 bp, Mus musculus
acaacagtaggttgcattttgtgcc

SEQ ID NO: 91833 - DNA, 25 bp, Mus musculus
acaacagtcctgagcaaaccttttc

SEQ ID NO: 91834 - DNA, 25 bp, Mus musculus
acaacagtcctgtgcaaaccttttc

SEQ ID NO: 91835 - DNA, 25 bp, Mus musculus
acaacagtctggaactcttatctca

SEQ ID NO: 91836 - DNA, 25 bp, Mus musculus
acaacagtctggtactcttatctca

SEQ ID NO: 91837 - DNA, 25 bp, Mus musculus
acaacagtggtcacccagctaggat

SEQ ID NO: 91838 - DNA, 25 bp, Mus musculus
acaacagtggtctcccagctaggat

SEQ ID NO: 91839 - DNA, 25 bp, Mus musculus
acaacagtgtgtacacggccctgtt

SEQ ID NO: 91840 - DNA, 25 bp, Mus musculus
acaacagtgtgttcacggccctgtt

SEQ ID NO: 91841 - DNA, 25 bp, Mus musculus
acaacagttaaactcgcccttccag

SEQ ID NO: 91842 - DNA, 25 bp, Mus musculus
acaacagttaaagtcgcccttccag

SEQ ID NO: 91843 - DNA, 25 bp, Mus musculus
acaacagttactaccttatcctcag

SEQ ID NO: 91844 - DNA, 25 bp, Mus musculus
acaacagttacttccttatcctcag

SEQ ID NO: 91845 - DNA, 25 bp, Mus musculus
acaacagttcccagaatcccctgaa

SEQ ID NO: 91846 - DNA, 25 bp, Mus musculus
acaacagttccctgaatcccctgaa

SEQ ID NO: 91847 - DNA, 25 bp, Mus musculus
acaacataacggcactctatcttca

SEQ ID NO: 91848 - DNA, 25 bp, Mus musculus
acaacataacgggactctatcttca

SEQ ID NO: 91849 - DNA, 25 bp, Mus musculus
acaacataccctcgcgtatgggaca

SEQ ID NO: 91850 - DNA, 25 bp, Mus musculus
acaacataccctggcgtatgggaca

SEQ ID NO: 91851 - DNA, 25 bp, Mus musculus
acaacatactttagctcttctctgt

SEQ ID NO: 91852 - DNA, 25 bp, Mus musculus
acaacatacttttgctcttctctgt

SEQ ID NO: 91853 - DNA, 25 bp, Mus musculus
acaacatatacgcacccttggaatc

SEQ ID NO: 91854 - DNA, 25 bp, Mus musculus
acaacatatacggacccttggaatc

SEQ ID NO: 91855 - DNA, 25 bp, Mus musculus
acaacatattcacccactttgtctc

SEQ ID NO: 91856 - DNA, 25 bp, Mus musculus
acaacatattcagccactttgtctc

SEQ ID NO: 91857 - DNA, 25 bp, Mus musculus
acaacatcaagaactggcacaggac

SEQ ID NO: 91858 - DNA, 25 bp, Mus musculus
acaacatcaagatctggcacaggac

SEQ ID NO: 91859 - DNA, 25 bp, Mus musculus
acaacatcacagactactttgaggg

SEQ ID NO: 91860 - DNA, 25 bp, Mus musculus
acaacatcacagtctactttgaggg

SEQ ID NO: 91861 - DNA, 25 bp, Mus musculus
acaacatcacatacttctgaaatag

SEQ ID NO: 91862 - DNA, 25 bp, Mus musculus
acaacatcacattcttctgaaatag

SEQ ID NO: 91863 - DNA, 25 bp, Mus musculus
acaacatccagcacttagttgtggg

SEQ ID NO: 91864 - DNA, 25 bp, Mus musculus
acaacatccagctcttagttgtggg

SEQ ID NO: 91865 - DNA, 25 bp, Mus musculus
acaacatccaggaagaaggcggcga

SEQ ID NO: 91866 - DNA, 25 bp, Mus musculus
acaacatccaggtagaaggcggcga

SEQ ID NO: 91867 - DNA, 25 bp, Mus musculus
acaacatcctttacaatagtcacaa

SEQ ID NO: 91868 - DNA, 25 bp, Mus musculus
acaacatccttttcaatagtcacaa

SEQ ID NO: 91869 - DNA, 25 bp, Mus musculus
acaacatcgaagaggcttctctcac

SEQ ID NO: 91870 - DNA, 25 bp, Mus musculus
acaacatcgaagtggcttctctcac

SEQ ID NO: 91871 - DNA, 25 bp, Mus musculus
acaacatgagcaacaccgtgtccat

SEQ ID NO: 91872 - DNA, 25 bp, Mus musculus
acaacatgagcatcaccgtgtccat

SEQ ID NO: 91873 - DNA, 25 bp, Mus musculus
acaacatgcactaagatcctacaca

SEQ ID NO: 91874 - DNA, 25 bp, Mus musculus
acaacatgcacttagatcctacaca

SEQ ID NO: 91875 - DNA, 25 bp, Mus musculus
acaacatgtcgcagttcaggaacga

SEQ ID NO: 91876 - DNA, 25 bp, Mus musculus
acaacatgtcgctgttcaggaacga

SEQ ID NO: 91877 - DNA, 25 bp, Mus musculus
acaacatgtgaacccacaaaagcaa

SEQ ID NO: 91878 - DNA, 25 bp, Mus musculus
acaacatgtgaagccacaaaagcaa

SEQ ID NO: 91879 - DNA, 25 bp, Mus musculus
acaacattactactctgagcctaag

SEQ ID NO: 91880 - DNA, 25 bp, Mus musculus
acaacattactagtctgagcctaag

SEQ ID NO: 91881 - DNA, 25 bp, Mus musculus
acaacattcactctgtatggtcctg

SEQ ID NO: 91882 - DNA, 25 bp, Mus musculus
acaacattcactgtgtatggtcctg

SEQ ID NO: 91883 - DNA, 25 bp, Mus musculus
acaacattcattaggctcgttctga

SEQ ID NO: 91884 - DNA, 25 bp, Mus musculus
acaacattcatttggctcgttctga

SEQ ID NO: 91885 - DNA, 25 bp, Mus musculus
acaacattccgaacccaatgagcaa

SEQ ID NO: 91886 - DNA, 25 bp, Mus musculus
acaacattccgatcccaatgagcaa

SEQ ID NO: 91887 - DNA, 25 bp, Mus musculus
acaacattcgtgcacaagagccaga

SEQ ID NO: 91888 - DNA, 25 bp, Mus musculus
acaacattcgtggacaagagccaga

SEQ ID NO: 91889 - DNA, 25 bp, Mus musculus
acaacattctacatagcttgcccca

SEQ ID NO: 91890 - DNA, 25 bp, Mus musculus
acaacattctacttagcttgcccca

SEQ ID NO: 91891 - DNA, 25 bp, Mus musculus
acaacattctctcttttttctgagg

SEQ ID NO: 91892 - DNA, 25 bp, Mus musculus
acaacattctctgttttttctgagg

SEQ ID NO: 91893 - DNA, 25 bp, Mus musculus
acaacattgtccacatgaattccat

SEQ ID NO: 91894 - DNA, 25 bp, Mus musculus
acaacattgtcctcatgaattccat

SEQ ID NO: 91895 - DNA, 25 bp, Mus musculus
acaacattgtgaagtcccctggtgt

SEQ ID NO: 91896 - DNA, 25 bp, Mus musculus
acaacattgtgatgtcccctggtgt

SEQ ID NO: 91897 - DNA, 25 bp, Mus musculus
acaacattgtggagtgtctcctcat

SEQ ID NO: 91898 - DNA, 25 bp, Mus musculus
acaacattgtggtgtgtctcctcat

SEQ ID NO: 91899 - DNA, 25 bp, Mus musculus
acaacattgtgtacagcctgcaagt

SEQ ID NO: 91900 - DNA, 25 bp, Mus musculus
acaacattgtgttcagcctgcaagt

SEQ ID NO: 91901 - DNA, 25 bp, Mus musculus
acaacatttcataaggtcaggctta

SEQ ID NO: 91902 - DNA, 25 bp, Mus musculus
acaacatttcattaggtcaggctta

SEQ ID NO: 91903 - DNA, 25 bp, Mus musculus
acaacatttctgctacaaagggagt

SEQ ID NO: 91904 - DNA, 25 bp, Mus musculus
acaacatttctggtacaaagggagt

SEQ ID NO: 91905 - DNA, 25 bp, Mus musculus
acaacatttttgagaggcagggtca

SEQ ID NO: 91906 - DNA, 25 bp, Mus musculus
acaacatttttgtgaggcagggtca

SEQ ID NO: 91907 - DNA, 25 bp, Mus musculus
acaaccaaagatctgaccattcatg

SEQ ID NO: 91908 - DNA, 25 bp, Mus musculus
acaaccaaagatgtgaccattcatg

SEQ ID NO: 91909 - DNA, 25 bp, Mus musculus
acaaccaaagcgactgaatttccag

SEQ ID NO: 91910 - DNA, 25 bp, Mus musculus
acaaccaaagcgtctgaatttccag

SEQ ID NO: 91911 - DNA, 25 bp, Mus musculus
acaaccaaatgaacactggtggcag

SEQ ID NO: 91912 - DNA, 25 bp, Mus musculus
acaaccaaatgatcactggtggcag

SEQ ID NO: 91913 - DNA, 25 bp, Mus musculus
acaaccaatcctcacactgaaatag

SEQ ID NO: 91914 - DNA, 25 bp, Mus musculus
acaaccaatcctgacactgaaatag

SEQ ID NO: 91915 - DNA, 25 bp, Mus musculus
acaaccacaaccaatgactgcagtg

SEQ ID NO: 91916 - DNA, 25 bp, Mus musculus
acaaccacaacctatgactgcagtg

SEQ ID NO: 91917 - DNA, 25 bp, Mus musculus
acaaccacaccaatagatatcttcc

SEQ ID NO: 91918 - DNA, 25 bp, Mus musculus
acaaccacaccattagatatcttcc

SEQ ID NO: 91919 - DNA, 25 bp, Mus musculus
acaaccacacgtacttctgtatagt

SEQ ID NO: 91920 - DNA, 25 bp, Mus musculus
acaaccacacgttcttctgtatagt

SEQ ID NO: 91921 - DNA, 25 bp, Mus musculus
acaaccacaggactgtcacactttg

SEQ ID NO: 91922 - DNA, 25 bp, Mus musculus
acaaccacaggagtgtcacactttg

SEQ ID NO: 91923 - DNA, 25 bp, Mus musculus
acaaccacatagagaggctgtctgg

SEQ ID NO: 91924 - DNA, 25 bp, Mus musculus
acaaccacatagtgaggctgtctgg

SEQ ID NO: 91925 - DNA, 25 bp, Mus musculus
acaaccacatcgaggtgcgggctga

SEQ ID NO: 91926 - DNA, 25 bp, Mus musculus
acaaccacatcgtggtgcgggctga

SEQ ID NO: 91927 - DNA, 25 bp, Mus musculus
acaaccaccggtacattttgcacag

SEQ ID NO: 91928 - DNA, 25 bp, Mus musculus
acaaccaccggttcattttgcacag

SEQ ID NO: 91929 - DNA, 25 bp, Mus musculus
acaaccacgatgagaaggcgtttga

SEQ ID NO: 91930 - DNA, 25 bp, Mus musculus
acaaccacgatgtgaaggcgtttga

SEQ ID NO: 91931 - DNA, 25 bp, Mus musculus
acaaccacgtgtccaagtactgtgc

SEQ ID NO: 91932 - DNA, 25 bp, Mus musculus
acaaccacgtgtgcaagtactgtgc

SEQ ID NO: 91933 - DNA, 25 bp, Mus musculus
acaaccactacaagccggatttgca

SEQ ID NO: 91934 - DNA, 25 bp, Mus musculus
acaaccactacatgccggatttgca

SEQ ID NO: 91935 - DNA, 25 bp, Mus musculus
acaaccactggtcatgcatcaagaa

SEQ ID NO: 91936 - DNA, 25 bp, Mus musculus
acaaccactggtgatgcatcaagaa

SEQ ID NO: 91937 - DNA, 25 bp, Mus musculus
acaaccacttctattcctcggctat

SEQ ID NO: 91938 - DNA, 25 bp, Mus musculus
acaaccacttcttttcctcggctat

SEQ ID NO: 91939 - DNA, 25 bp, Mus musculus
acaaccactttcagtgcaagtcatg

SEQ ID NO: 91940 - DNA, 25 bp, Mus musculus
acaaccactttctgtgcaagtcatg

SEQ ID NO: 91941 - DNA, 25 bp, Mus musculus
acaaccagccaccacatgagatgtg

SEQ ID NO: 91942 - DNA, 25 bp, Mus musculus
acaaccagccacgacatgagatgtg

SEQ ID NO: 91943 - DNA, 25 bp, Mus musculus
acaaccagccatcagcaggtggata

SEQ ID NO: 91944 - DNA, 25 bp, Mus musculus
acaaccagccatgagcaggtggata

SEQ ID NO: 91945 - DNA, 25 bp, Mus musculus
acaaccagcgcacactggcgcgccc

SEQ ID NO: 91946 - DNA, 25 bp, Mus musculus
acaaccagcgcagactggcgcgccc

SEQ ID NO: 91947 - DNA, 25 bp, Mus musculus
acaaccagctgtctttgtactcatc

SEQ ID NO: 91948 - DNA, 25 bp, Mus musculus
acaaccagctgtgtttgtactcatc

SEQ ID NO: 91949 - DNA, 25 bp, Mus musculus
acaaccaggaacatctcagggcatt

SEQ ID NO: 91950 - DNA, 25 bp, Mus musculus
acaaccaggaacttctcagggcatt

SEQ ID NO: 91951 - DNA, 25 bp, Mus musculus
acaaccaggatgatcagacgcccca

SEQ ID NO: 91952 - DNA, 25 bp, Mus musculus
acaaccaggatgttcagacgcccca

SEQ ID NO: 91953 - DNA, 25 bp, Mus musculus
acaaccagggctccatagaaaagcc

SEQ ID NO: 91954 - DNA, 25 bp, Mus musculus
acaaccagggctgcatagaaaagcc

SEQ ID NO: 91955 - DNA, 25 bp, Mus musculus
acaaccaggtaccaggtgaccgaat

SEQ ID NO: 91956 - DNA, 25 bp, Mus musculus
acaaccaggtacgaggtgaccgaat

SEQ ID NO: 91957 - DNA, 25 bp, Mus musculus
acaaccagtattcgcacatctcgat

SEQ ID NO: 91958 - DNA, 25 bp, Mus musculus
acaaccagtattggcacatctcgat

SEQ ID NO: 91959 - DNA, 25 bp, Mus musculus
acaaccagtgcacactggcgtggcc

SEQ ID NO: 91960 - DNA, 25 bp, Mus musculus
acaaccagtgcagactggcgtggcc

SEQ ID NO: 91961 - DNA, 25 bp, Mus musculus
acaaccagtttacttcaagcttcaa

SEQ ID NO: 91962 - DNA, 25 bp, Mus musculus
acaaccagtttagttcaagcttcaa

SEQ ID NO: 91963 - DNA, 25 bp, Mus musculus
acaaccatcaacatcttccttacat

SEQ ID NO: 91964 - DNA, 25 bp, Mus musculus
acaaccatcaacttcttccttacat

SEQ ID NO: 91965 - DNA, 25 bp, Mus musculus
acaaccatcaggattccatctgcga

SEQ ID NO: 91966 - DNA, 25 bp, Mus musculus
acaaccatcaggtttccatctgcga

SEQ ID NO: 91967 - DNA, 25 bp, Mus musculus
acaaccatctgtccgatgcactctt

SEQ ID NO: 91968 - DNA, 25 bp, Mus musculus
acaaccatctgtgcgatgcactctt

SEQ ID NO: 91969 - DNA, 25 bp, Mus musculus
acaaccatgagcctttcttcagttt

SEQ ID NO: 91970 - DNA, 25 bp, Mus musculus
acaaccatgagcgtttcttcagttt

SEQ ID NO: 91971 - DNA, 25 bp, Mus musculus
acaaccatgccacgtgcaggcagga

SEQ ID NO: 91972 - DNA, 25 bp, Mus musculus
acaaccatgccaggtgcaggcagga

SEQ ID NO: 91973 - DNA, 25 bp, Mus musculus
acaaccatggacatagggcctgaaa

SEQ ID NO: 91974 - DNA, 25 bp, Mus musculus
acaaccatggacttagggcctgaaa

SEQ ID NO: 91975 - DNA, 25 bp, Mus musculus
acaaccatggctatgactgctgttc

SEQ ID NO: 91976 - DNA, 25 bp, Mus musculus
acaaccatggctttgactgctgttc

SEQ ID NO: 91977 - DNA, 25 bp, Mus musculus
acaacccaaatacctatcatggatg

SEQ ID NO: 91978 - DNA, 25 bp, Mus musculus
acaacccaaatagctatcatggatg

SEQ ID NO: 91979 - DNA, 25 bp, Mus musculus
acaacccaagtcaagagatcagctt

SEQ ID NO: 91980 - DNA, 25 bp, Mus musculus
acaacccaagtctagagatcagctt

SEQ ID NO: 91981 - DNA, 25 bp, Mus musculus
acaacccagagactgccacagtggt

SEQ ID NO: 91982 - DNA, 25 bp, Mus musculus
acaacccagagagtgccacagtggt

SEQ ID NO: 91983 - DNA, 25 bp, Mus musculus
acaacccagctgattcctgctcttg

SEQ ID NO: 91984 - DNA, 25 bp, Mus musculus
acaacccagctgtttcctgctcttg

SEQ ID NO: 91985 - DNA, 25 bp, Mus musculus
acaacccagggcatcgtgcatgtca

SEQ ID NO: 91986 - DNA, 25 bp, Mus musculus
acaacccagggcttcgtgcatgtca

SEQ ID NO: 91987 - DNA, 25 bp, Mus musculus
acaacccatccacgcctgtttttgt

SEQ ID NO: 91988 - DNA, 25 bp, Mus musculus
acaacccatccaggcctgtttttgt

SEQ ID NO: 91989 - DNA, 25 bp, Mus musculus
acaacccatcctaagactccagaag

SEQ ID NO: 91990 - DNA, 25 bp, Mus musculus
acaacccatccttagactccagaag

SEQ ID NO: 91991 - DNA, 25 bp, Mus musculus
acaacccatgccaattacacttgta

SEQ ID NO: 91992 - DNA, 25 bp, Mus musculus
acaacccatgcctattacacttgta

SEQ ID NO: 91993 - DNA, 25 bp, Mus musculus
acaaccccaggtataggtgtgacat

SEQ ID NO: 91994 - DNA, 25 bp, Mus musculus
acaaccccaggtttaggtgtgacat

SEQ ID NO: 91995 - DNA, 25 bp, Mus musculus
acaaccccataaaggctcataacca

SEQ ID NO: 91996 - DNA, 25 bp, Mus musculus
acaaccccataatggctcataacca

SEQ ID NO: 91997 - DNA, 25 bp, Mus musculus
acaaccccatgtacagtgagcctgt

SEQ ID NO: 91998 - DNA, 25 bp, Mus musculus
acaaccccatgttcagtgagcctgt

SEQ ID NO: 91999 - DNA, 25 bp, Mus musculus
acaaccccggggacaggtgcagtgg

SEQ ID NO: 92000 - DNA, 25 bp, Mus musculus
acaaccccggggtcaggtgcagtgg

SEQ ID NO: 92001 - DNA, 25 bp, Mus musculus
acaacccgcatgcatatggctgttc

SEQ ID NO: 92002 - DNA, 25 bp, Mus musculus
acaacccgcatggatatggctgttc

SEQ ID NO: 92003 - DNA, 25 bp, Mus musculus
acaaccctcgtgcaaatgttttcat

SEQ ID NO: 92004 - DNA, 25 bp, Mus musculus
acaaccctcgtggaaatgttttcat

SEQ ID NO: 92005 - DNA, 25 bp, Mus musculus
acaaccctctggctttctagatggg

SEQ ID NO: 92006 - DNA, 25 bp, Mus musculus
acaaccctctgggtttctagatggg

SEQ ID NO: 92007 - DNA, 25 bp, Mus musculus
acaaccctgagaagaactgaggtga

SEQ ID NO: 92008 - DNA, 25 bp, Mus musculus
acaaccctgagatgaactgaggtga

SEQ ID NO: 92009 - DNA, 25 bp, Mus musculus
acaaccctggctaggcaccgagtga

SEQ ID NO: 92010 - DNA, 25 bp, Mus musculus
acaaccctggcttggcaccgagtga

SEQ ID NO: 92011 - DNA, 25 bp, Mus musculus
acaacccttcctaagtttcagattg

SEQ ID NO: 92012 - DNA, 25 bp, Mus musculus
acaacccttccttagtttcagattg

SEQ ID NO: 92013 - DNA, 25 bp, Mus musculus
acaaccgcaccaagaagcatgacct

SEQ ID NO: 92014 - DNA, 25 bp, Mus musculus
acaaccgcaccatgaagcatgacct

SEQ ID NO: 92015 - DNA, 25 bp, Mus musculus
acaaccgccagactgtcagccaagg

SEQ ID NO: 92016 - DNA, 25 bp, Mus musculus
acaaccgccagagtgtcagccaagg

SEQ ID NO: 92017 - DNA, 25 bp, Mus musculus
acaaccggatgtcttgattgattta

SEQ ID NO: 92018 - DNA, 25 bp, Mus musculus
acaaccggatgtgttgattgattta

SEQ ID NO: 92019 - DNA, 25 bp, Mus musculus
acaaccggtgacagggacatacgaa

SEQ ID NO: 92020 - DNA, 25 bp, Mus musculus
acaaccggtgactgggacatacgaa

SEQ ID NO: 92021 - DNA, 25 bp, Mus musculus
acaaccggtgtcaggtggacgtcaa

SEQ ID NO: 92022 - DNA, 25 bp, Mus musculus
acaaccggtgtctggtggacgtcaa

SEQ ID NO: 92023 - DNA, 25 bp, Mus musculus
acaaccggtttcacagaagctgatt

SEQ ID NO: 92024 - DNA, 25 bp, Mus musculus
acaaccggtttctcagaagctgatt

SEQ ID NO: 92025 - DNA, 25 bp, Mus musculus
acaaccgtagcgagacttacatcac

SEQ ID NO: 92026 - DNA, 25 bp, Mus musculus
acaaccgtagcgtgacttacatcac

SEQ ID NO: 92027 - DNA, 25 bp, Mus musculus
acaaccgtctgtaatatgatctaat

SEQ ID NO: 92028 - DNA, 25 bp, Mus musculus
acaaccgtctgttatatgatctaat

SEQ ID NO: 92029 - DNA, 25 bp, Mus musculus
acaaccgtgtaaagcttgactacat

SEQ ID NO: 92030 - DNA, 25 bp, Mus musculus
acaaccgtgtaatgcttgactacat

SEQ ID NO: 92031 - DNA, 25 bp, Mus musculus
acaaccgttttgctccatattaaat

SEQ ID NO: 92032 - DNA, 25 bp, Mus musculus
acaaccgttttggtccatattaaat

SEQ ID NO: 92033 - DNA, 25 bp, Mus musculus
acaacctaagctcgttctctgacct

SEQ ID NO: 92034 - DNA, 25 bp, Mus musculus
acaacctaagctggttctctgacct

SEQ ID NO: 92035 - DNA, 25 bp, Mus musculus
acaacctacagtcttcaatttccat

SEQ ID NO: 92036 - DNA, 25 bp, Mus musculus
acaacctacagtgttcaatttccat

SEQ ID NO: 92037 - DNA, 25 bp, Mus musculus
acaacctacatcatttttctttcct

SEQ ID NO: 92038 - DNA, 25 bp, Mus musculus
acaacctacatcttttttctttcct

SEQ ID NO: 92039 - DNA, 25 bp, Mus musculus
acaacctagtctaaactgctgctca

SEQ ID NO: 92040 - DNA, 25 bp, Mus musculus
acaacctagtcttaactgctgctca

SEQ ID NO: 92041 - DNA, 25 bp, Mus musculus
acaacctataccctaagcaagcaga

SEQ ID NO: 92042 - DNA, 25 bp, Mus musculus
acaacctataccgtaagcaagcaga

SEQ ID NO: 92043 - DNA, 25 bp, Mus musculus
acaacctatggtctagttattctct

SEQ ID NO: 92044 - DNA, 25 bp, Mus musculus
acaacctatggtgtagttattctct

SEQ ID NO: 92045 - DNA, 25 bp, Mus musculus
acaacctattaaagatttcttgagt

SEQ ID NO: 92046 - DNA, 25 bp, Mus musculus
acaacctattaatgatttcttgagt

SEQ ID NO: 92047 - DNA, 25 bp, Mus musculus
acaacctattcgaggatctctactt

SEQ ID NO: 92048 - DNA, 25 bp, Mus musculus
acaacctattcgtggatctctactt

SEQ ID NO: 92049 - DNA, 25 bp, Mus musculus
acaacctcaactcggcgctggatgc

SEQ ID NO: 92050 - DNA, 25 bp, Mus musculus
acaacctcaactgggcgctggatgc

SEQ ID NO: 92051 - DNA, 25 bp, Mus musculus
acaacctcctcgacagggtgatgga

SEQ ID NO: 92052 - DNA, 25 bp, Mus musculus
acaacctcctcgtcagggtgatgga

SEQ ID NO: 92053 - DNA, 25 bp, Mus musculus
acaacctcctgtcacggtagatcta

SEQ ID NO: 92054 - DNA, 25 bp, Mus musculus
acaacctcctgtgacggtagatcta

SEQ ID NO: 92055 - DNA, 25 bp, Mus musculus
acaacctctgtcctagaacccgtgg

SEQ ID NO: 92056 - DNA, 25 bp, Mus musculus
acaacctctgtcgtagaacccgtgg

SEQ ID NO: 92057 - DNA, 25 bp, Mus musculus
acaacctgaaggactgtggcctctt

SEQ ID NO: 92058 - DNA, 25 bp, Mus musculus
acaacctgaaggtctgtggcctctt

SEQ ID NO: 92059 - DNA, 25 bp, Mus musculus
acaacctgaagtccttaagaataca

SEQ ID NO: 92060 - DNA, 25 bp, Mus musculus
acaacctgaagtgcttaagaataca

SEQ ID NO: 92061 - DNA, 25 bp, Mus musculus
acaacctgaattcgattgctggact

SEQ ID NO: 92062 - DNA, 25 bp, Mus musculus
acaacctgaattggattgctggact

SEQ ID NO: 92063 - DNA, 25 bp, Mus musculus
acaacctgagcgataggactgccca

SEQ ID NO: 92064 - DNA, 25 bp, Mus musculus
acaacctgagcgttaggactgccca

SEQ ID NO: 92065 - DNA, 25 bp, Mus musculus
acaacctgcctcctaattgatcaag

SEQ ID NO: 92066 - DNA, 25 bp, Mus musculus
acaacctgcctcgtaattgatcaag

SEQ ID NO: 92067 - DNA, 25 bp, Mus musculus
acaacctgctatcagcggatgctga

SEQ ID NO: 92068 - DNA, 25 bp, Mus musculus
acaacctgctatgagcggatgctga

SEQ ID NO: 92069 - DNA, 25 bp, Mus musculus
acaacctgctcacgcttagttttca

SEQ ID NO: 92070 - DNA, 25 bp, Mus musculus
acaacctgctcaggcttagttttca

SEQ ID NO: 92071 - DNA, 25 bp, Mus musculus
acaacctggctgagctctgagggcc

SEQ ID NO: 92072 - DNA, 25 bp, Mus musculus
acaacctggctgtgctctgagggcc

SEQ ID NO: 92073 - DNA, 25 bp, Mus musculus
acaacctgggctaactcaactcttt

SEQ ID NO: 92074 - DNA, 25 bp, Mus musculus
acaacctgggcttactcaactcttt

SEQ ID NO: 92075 - DNA, 25 bp, Mus musculus
acaacctgttgtcaattacctaaag

SEQ ID NO: 92076 - DNA, 25 bp, Mus musculus
acaacctgttgtgaattacctaaag

SEQ ID NO: 92077 - DNA, 25 bp, Mus musculus
acaacctgtttccatagttatcaat

SEQ ID NO: 92078 - DNA, 25 bp, Mus musculus
acaacctgtttcgatagttatcaat

SEQ ID NO: 92079 - DNA, 25 bp, Mus musculus
acaaccttaaggactgcagctctac

SEQ ID NO: 92080 - DNA, 25 bp, Mus musculus
acaaccttaaggtctgcagctctac

SEQ ID NO: 92081 - DNA, 25 bp, Mus musculus
acaaccttagaactccttggacact

SEQ ID NO: 92082 - DNA, 25 bp, Mus musculus
acaaccttagaagtccttggacact

SEQ ID NO: 92083 - DNA, 25 bp, Mus musculus
acaaccttcctgagctggcgaagat

SEQ ID NO: 92084 - DNA, 25 bp, Mus musculus
acaaccttcctgtgctggcgaagat

SEQ ID NO: 92085 - DNA, 25 bp, Mus musculus
acaaccttgaatatctcagcccact

SEQ ID NO: 92086 - DNA, 25 bp, Mus musculus
acaaccttgaatttctcagcccact

SEQ ID NO: 92087 - DNA, 25 bp, Mus musculus
acaaccttggtgctggcaactccca

SEQ ID NO: 92088 - DNA, 25 bp, Mus musculus
acaaccttggtggtggcaactccca

SEQ ID NO: 92089 - DNA, 25 bp, Mus musculus
acaaccttgtaaagccatcactcag

SEQ ID NO: 92090 - DNA, 25 bp, Mus musculus
acaaccttgtaatgccatcactcag

SEQ ID NO: 92091 - DNA, 25 bp, Mus musculus
acaaccttgtttatcccttcaggat

SEQ ID NO: 92092 - DNA, 25 bp, Mus musculus
acaaccttgtttttcccttcaggat

SEQ ID NO: 92093 - DNA, 25 bp, Mus musculus
acaacctttatgagcaatagggaaa

SEQ ID NO: 92094 - DNA, 25 bp, Mus musculus
acaacctttatgtgcaatagggaaa

SEQ ID NO: 92095 - DNA, 25 bp, Mus musculus
acaacgaagtctatgatgtcatctg

SEQ ID NO: 92096 - DNA, 25 bp, Mus musculus
acaacgaagtctttgatgtcatctg

SEQ ID NO: 92097 - DNA, 25 bp, Mus musculus
acaacgacctctacctccagctcgt

SEQ ID NO: 92098 - DNA, 25 bp, Mus musculus
acaacgacctcttcctccagctcgt

SEQ ID NO: 92099 - DNA, 25 bp, Mus musculus
acaacgactatcaccagtgtgggat

SEQ ID NO: 92100 - DNA, 25 bp, Mus musculus
acaacgactatctccagtgtgggat

SEQ ID NO: 92101 - DNA, 25 bp, Mus musculus
acaacgactgagacccgatttttga

SEQ ID NO: 92102 - DNA, 25 bp, Mus musculus
acaacgactgagtcccgatttttga

SEQ ID NO: 92103 - DNA, 25 bp, Mus musculus
acaacgaggccaacatctttgacat

SEQ ID NO: 92104 - DNA, 25 bp, Mus musculus
acaacgaggccatcatctttgacat

SEQ ID NO: 92105 - DNA, 25 bp, Mus musculus
acaacgatacccaatattaaaggat

SEQ ID NO: 92106 - DNA, 25 bp, Mus musculus
acaacgataccctatattaaaggat

SEQ ID NO: 92107 - DNA, 25 bp, Mus musculus
acaacgcacattatgcttcatttat

SEQ ID NO: 92108 - DNA, 25 bp, Mus musculus
acaacgcacattttgcttcatttat

SEQ ID NO: 92109 - DNA, 25 bp, Mus musculus
acaacgcagaggcacgctgatccct

SEQ ID NO: 92110 - DNA, 25 bp, Mus musculus
acaacgcagagggacgctgatccct

SEQ ID NO: 92111 - DNA, 25 bp, Mus musculus
acaacgcgaaccctgcttgagtgtc

SEQ ID NO: 92112 - DNA, 25 bp, Mus musculus
acaacgcgaaccgtgcttgagtgtc

SEQ ID NO: 92113 - DNA, 25 bp, Mus musculus
acaacgctgggtcttattctgggac

SEQ ID NO: 92114 - DNA, 25 bp, Mus musculus
acaacgctgggtgttattctgggac

SEQ ID NO: 92115 - DNA, 25 bp, Mus musculus
acaacgcttcgacagtggtctacca

SEQ ID NO: 92116 - DNA, 25 bp, Mus musculus
acaacgcttcgagagtggtctacca

SEQ ID NO: 92117 - DNA, 25 bp, Mus musculus
acaacggaagagataattgcctctt

SEQ ID NO: 92118 - DNA, 25 bp, Mus musculus
acaacggaagagttaattgcctctt

SEQ ID NO: 92119 - DNA, 25 bp, Mus musculus
acaacggcccttcaaggcaagtact

SEQ ID NO: 92120 - DNA, 25 bp, Mus musculus
acaacggcccttgaaggcaagtact

SEQ ID NO: 92121 - DNA, 25 bp, Mus musculus
acaacggctgcaattcaacaaggga

SEQ ID NO: 92122 - DNA, 25 bp, Mus musculus
acaacggctgcatttcaacaaggga

SEQ ID NO: 92123 - DNA, 25 bp, Mus musculus
acaacgggatgccaccgattccaaa

SEQ ID NO: 92124 - DNA, 25 bp, Mus musculus
acaacgggatgcgaccgattccaaa

SEQ ID NO: 92125 - DNA, 25 bp, Mus musculus
acaacggtggccacagggtgcagtt

SEQ ID NO: 92126 - DNA, 25 bp, Mus musculus
acaacggtggcctcagggtgcagtt

SEQ ID NO: 92127 - DNA, 25 bp, Mus musculus
acaacgtcaagaagttccaggcaca

SEQ ID NO: 92128 - DNA, 25 bp, Mus musculus
acaacgtcaagatgttccaggcaca

SEQ ID NO: 92129 - DNA, 25 bp, Mus musculus
acaacgtctacactggttcttctaa

SEQ ID NO: 92130 - DNA, 25 bp, Mus musculus
acaacgtctacagtggttcttctaa

SEQ ID NO: 92131 - DNA, 25 bp, Mus musculus
acaacgtgggccctgcgaggcacac

SEQ ID NO: 92132 - DNA, 25 bp, Mus musculus
acaacgtgggccgtgcgaggcacac

SEQ ID NO: 92133 - DNA, 25 bp, Mus musculus
acaacgttatttccctaagtgcagt

SEQ ID NO: 92134 - DNA, 25 bp, Mus musculus
acaacgttatttgcctaagtgcagt

SEQ ID NO: 92135 - DNA, 25 bp, Mus musculus
acaacgttggacaactggcgcatga

SEQ ID NO: 92136 - DNA, 25 bp, Mus musculus
acaacgttggactactggcgcatga

SEQ ID NO: 92137 - DNA, 25 bp, Mus musculus
acaacgttggagatgaagctgggct

SEQ ID NO: 92138 - DNA, 25 bp, Mus musculus
acaacgttggagttgaagctgggct

SEQ ID NO: 92139 - DNA, 25 bp, Mus musculus
acaactaaccatctctctgctgctt

SEQ ID NO: 92140 - DNA, 25 bp, Mus musculus
acaactaaccatgtctctgctgctt

SEQ ID NO: 92141 - DNA, 25 bp, Mus musculus
acaactaacctgctgtgtctatgag

SEQ ID NO: 92142 - DNA, 25 bp, Mus musculus
acaactaacctggtgtgtctatgag

SEQ ID NO: 92143 - DNA, 25 bp, Mus musculus
acaactaagctaacacccctatttt

SEQ ID NO: 92144 - DNA, 25 bp, Mus musculus
acaactaagctatcacccctatttt

SEQ ID NO: 92145 - DNA, 25 bp, Mus musculus
acaactaattgtacaggctatcatc

SEQ ID NO: 92146 - DNA, 25 bp, Mus musculus
acaactaattgttcaggctatcatc

SEQ ID NO: 92147 - DNA, 25 bp, Mus musculus
acaactacaagcctcatcagaaggt

SEQ ID NO: 92148 - DNA, 25 bp, Mus musculus
acaactacaagcgtcatcagaaggt

SEQ ID NO: 92149 - DNA, 25 bp, Mus musculus
acaactacacctattggtactcgag

SEQ ID NO: 92150 - DNA, 25 bp, Mus musculus
acaactacaccttttggtactcgag

SEQ ID NO: 92151 - DNA, 25 bp, Mus musculus
acaactacagataagttggaccagc

SEQ ID NO: 92152 - DNA, 25 bp, Mus musculus
acaactacagattagttggaccagc

SEQ ID NO: 92153 - DNA, 25 bp, Mus musculus
acaactacctgaagcttttcggcac

SEQ ID NO: 92154 - DNA, 25 bp, Mus musculus
acaactacctgatgcttttcggcac

SEQ ID NO: 92155 - DNA, 25 bp, Mus musculus
acaactacgcatctgtttcttgctg

SEQ ID NO: 92156 - DNA, 25 bp, Mus musculus
acaactacgcatgtgtttcttgctg

SEQ ID NO: 92157 - DNA, 25 bp, Mus musculus
acaactactacaactctgcctaggg

SEQ ID NO: 92158 - DNA, 25 bp, Mus musculus
acaactactacatctctgcctaggg

SEQ ID NO: 92159 - DNA, 25 bp, Mus musculus
acaactactccgaataccatcaatt

SEQ ID NO: 92160 - DNA, 25 bp, Mus musculus
acaactactccgtataccatcaatt

SEQ ID NO: 92161 - DNA, 25 bp, Mus musculus
acaactactgttctgctaaaatgat

SEQ ID NO: 92162 - DNA, 25 bp, Mus musculus
acaactactgttgtgctaaaatgat

SEQ ID NO: 92163 - DNA, 25 bp, Mus musculus
acaactactttgcttctctagaagg

SEQ ID NO: 92164 - DNA, 25 bp, Mus musculus
acaactactttggttctctagaagg

SEQ ID NO: 92165 - DNA, 25 bp, Mus musculus
acaactagttaaaaatcttagggag

SEQ ID NO: 92166 - DNA, 25 bp, Mus musculus
acaactagttaataatcttagggag

SEQ ID NO: 92167 - DNA, 25 bp, Mus musculus
acaactagttgtacaggtccaaatt

SEQ ID NO: 92168 - DNA, 25 bp, Mus musculus
acaactagttgttcaggtccaaatt

SEQ ID NO: 92169 - DNA, 25 bp, Mus musculus
acaactatagttcgtcttcttgaga

SEQ ID NO: 92170 - DNA, 25 bp, Mus musculus
acaactatagttggtcttcttgaga

SEQ ID NO: 92171 - DNA, 25 bp, Mus musculus
acaactatccccaggtcactatttt

SEQ ID NO: 92172 - DNA, 25 bp, Mus musculus
acaactatcccctggtcactatttt

SEQ ID NO: 92173 - DNA, 25 bp, Mus musculus
acaactatgcatattggttcactgt

SEQ ID NO: 92174 - DNA, 25 bp, Mus musculus
acaactatgcattttggttcactgt

SEQ ID NO: 92175 - DNA, 25 bp, Mus musculus
acaactatggtcactgcctgcatct

SEQ ID NO: 92176 - DNA, 25 bp, Mus musculus
acaactatggtctctgcctgcatct

SEQ ID NO: 92177 - DNA, 25 bp, Mus musculus
acaactattgcaactactgagccct

SEQ ID NO: 92178 - DNA, 25 bp, Mus musculus
acaactattgcatctactgagccct

SEQ ID NO: 92179 - DNA, 25 bp, Mus musculus
acaactattgtaacagctctctggt

SEQ ID NO: 92180 - DNA, 25 bp, Mus musculus
acaactattgtatcagctctctggt

SEQ ID NO: 92181 - DNA, 25 bp, Mus musculus
acaactattttgacaccaggactca

SEQ ID NO: 92182 - DNA, 25 bp, Mus musculus
acaactattttgtcaccaggactca

SEQ ID NO: 92183 - DNA, 25 bp, Mus musculus
acaactcaagttctcagttcatccc

SEQ ID NO: 92184 - DNA, 25 bp, Mus musculus
acaactcaagttgtcagttcatccc

SEQ ID NO: 92185 - DNA, 25 bp, Mus musculus
acaactcaccacagctatggcaaat

SEQ ID NO: 92186 - DNA, 25 bp, Mus musculus
acaactcaccactgctatggcaaat

SEQ ID NO: 92187 - DNA, 25 bp, Mus musculus
acaactcacgtccttcatattgaag

SEQ ID NO: 92188 - DNA, 25 bp, Mus musculus
acaactcacgtcgttcatattgaag

SEQ ID NO: 92189 - DNA, 25 bp, Mus musculus
acaactcagagtcaactatcggtga

SEQ ID NO: 92190 - DNA, 25 bp, Mus musculus
acaactcagagtgaactatcggtga

SEQ ID NO: 92191 - DNA, 25 bp, Mus musculus
acaactcagcacacagtcatttctt

SEQ ID NO: 92192 - DNA, 25 bp, Mus musculus
acaactcagcactcagtcatttctt

SEQ ID NO: 92193 - DNA, 25 bp, Mus musculus
acaactcagcttacactgggtcaaa

SEQ ID NO: 92194 - DNA, 25 bp, Mus musculus
acaactcagctttcactgggtcaaa

SEQ ID NO: 92195 - DNA, 25 bp, Mus musculus
acaactcaggtaagcatgtcattcg

SEQ ID NO: 92196 - DNA, 25 bp, Mus musculus
acaactcaggtatgcatgtcattcg

SEQ ID NO: 92197 - DNA, 25 bp, Mus musculus
acaactcaggtgacgaggtgtttca

SEQ ID NO: 92198 - DNA, 25 bp, Mus musculus
acaactcaggtgtcgaggtgtttca

SEQ ID NO: 92199 - DNA, 25 bp, Mus musculus
acaactcagtgacctagacttctct

SEQ ID NO: 92200 - DNA, 25 bp, Mus musculus
acaactcagtgagctagacttctct

SEQ ID NO: 92201 - DNA, 25 bp, Mus musculus
acaactcagtgcataccttcggtta

SEQ ID NO: 92202 - DNA, 25 bp, Mus musculus
acaactcagtgcttaccttcggtta

SEQ ID NO: 92203 - DNA, 25 bp, Mus musculus
acaactccaatcctttgtgcttttt

SEQ ID NO: 92204 - DNA, 25 bp, Mus musculus
acaactccaatcgtttgtgcttttt

SEQ ID NO: 92205 - DNA, 25 bp, Mus musculus
acaactccaattctctacaaatgaa

SEQ ID NO: 92206 - DNA, 25 bp, Mus musculus
acaactccaattgtctacaaatgaa

SEQ ID NO: 92207 - DNA, 25 bp, Mus musculus
acaactccagctatggaggatccaa

SEQ ID NO: 92208 - DNA, 25 bp, Mus musculus
acaactccagctttggaggatccaa

SEQ ID NO: 92209 - DNA, 25 bp, Mus musculus
acaactccccacacaaagaacatga

SEQ ID NO: 92210 - DNA, 25 bp, Mus musculus
acaactccccactcaaagaacatga

SEQ ID NO: 92211 - DNA, 25 bp, Mus musculus
acaactcccttcaagtttccaatgg

SEQ ID NO: 92212 - DNA, 25 bp, Mus musculus
acaactcccttctagtttccaatgg

SEQ ID NO: 92213 - DNA, 25 bp, Mus musculus
acaactctacaactgacaagactgg

SEQ ID NO: 92214 - DNA, 25 bp, Mus musculus
acaactctacaagtgacaagactgg

SEQ ID NO: 92215 - DNA, 25 bp, Mus musculus
acaactctatataactccagctaca

SEQ ID NO: 92216 - DNA, 25 bp, Mus musculus
acaactctatattactccagctaca

SEQ ID NO: 92217 - DNA, 25 bp, Mus musculus
acaactctattaatgcctttctgcc

SEQ ID NO: 92218 - DNA, 25 bp, Mus musculus
acaactctattattgcctttctgcc

SEQ ID NO: 92219 - DNA, 25 bp, Mus musculus
acaactctctgccaaccttcaaggg

SEQ ID NO: 92220 - DNA, 25 bp, Mus musculus
acaactctctgcgaaccttcaaggg

SEQ ID NO: 92221 - DNA, 25 bp, Mus musculus
acaactctgaagcatgctcttgcat

SEQ ID NO: 92222 - DNA, 25 bp, Mus musculus
acaactctgaaggatgctcttgcat

SEQ ID NO: 92223 - DNA, 25 bp, Mus musculus
acaactctggtcataacagcctcct

SEQ ID NO: 92224 - DNA, 25 bp, Mus musculus
acaactctggtcttaacagcctcct

SEQ ID NO: 92225 - DNA, 25 bp, Mus musculus
acaactctgttcagagatcactgaa

SEQ ID NO: 92226 - DNA, 25 bp, Mus musculus
acaactctgttctgagatcactgaa

SEQ ID NO: 92227 - DNA, 25 bp, Mus musculus
acaactcttacaatctctctgttca

SEQ ID NO: 92228 - DNA, 25 bp, Mus musculus
acaactcttacattctctctgttca

SEQ ID NO: 92229 - DNA, 25 bp, Mus musculus
acaactcttacgaactgtgtcctga

SEQ ID NO: 92230 - DNA, 25 bp, Mus musculus
acaactcttacgtactgtgtcctga

SEQ ID NO: 92231 - DNA, 25 bp, Mus musculus
acaactcttatgaattccgagggct

SEQ ID NO: 92232 - DNA, 25 bp, Mus musculus
acaactcttatgtattccgagggct

SEQ ID NO: 92233 - DNA, 25 bp, Mus musculus
acaactcttgcaatgcctctcaagc

SEQ ID NO: 92234 - DNA, 25 bp, Mus musculus
acaactcttgcattgcctctcaagc

SEQ ID NO: 92235 - DNA, 25 bp, Mus musculus
acaactgaagaccaattgtgacttt

SEQ ID NO: 92236 - DNA, 25 bp, Mus musculus
acaactgaagacgaattgtgacttt

SEQ ID NO: 92237 - DNA, 25 bp, Mus musculus
acaactgaagccagtttctgcattc

SEQ ID NO: 92238 - DNA, 25 bp, Mus musculus
acaactgaagcctgtttctgcattc

SEQ ID NO: 92239 - DNA, 25 bp, Mus musculus
acaactgacagtaggtaggacatta

SEQ ID NO: 92240 - DNA, 25 bp, Mus musculus
acaactgacagttggtaggacatta

SEQ ID NO: 92241 - DNA, 25 bp, Mus musculus
acaactgacccaccactgtggtaca

SEQ ID NO: 92242 - DNA, 25 bp, Mus musculus
acaactgacccagcactgtggtaca

SEQ ID NO: 92243 - DNA, 25 bp, Mus musculus
acaactgactacatttagtaatagg

SEQ ID NO: 92244 - DNA, 25 bp, Mus musculus
acaactgactacttttagtaatagg

SEQ ID NO: 92245 - DNA, 25 bp, Mus musculus
acaactgactgtatgcctcgcggtc

SEQ ID NO: 92246 - DNA, 25 bp, Mus musculus
acaactgactgtttgcctcgcggtc

SEQ ID NO: 92247 - DNA, 25 bp, Mus musculus
acaactgaggtccaagtgttcaaat

SEQ ID NO: 92248 - DNA, 25 bp, Mus musculus
acaactgaggtcgaagtgttcaaat

SEQ ID NO: 92249 - DNA, 25 bp, Mus musculus
acaactgatgatacatttgtctgtc

SEQ ID NO: 92250 - DNA, 25 bp, Mus musculus
acaactgatgattcatttgtctgtc

SEQ ID NO: 92251 - DNA, 25 bp, Mus musculus
acaactgattctcactttttaggat

SEQ ID NO: 92252 - DNA, 25 bp, Mus musculus
acaactgattctgactttttaggat

SEQ ID NO: 92253 - DNA, 25 bp, Mus musculus
acaactgattgtacttacgcatttt

SEQ ID NO: 92254 - DNA, 25 bp, Mus musculus
acaactgattgttcttacgcatttt

SEQ ID NO: 92255 - DNA, 25 bp, Mus musculus
acaactgattttcataatgctgaga

SEQ ID NO: 92256 - DNA, 25 bp, Mus musculus
acaactgattttgataatgctgaga

SEQ ID NO: 92257 - DNA, 25 bp, Mus musculus
acaactgcacacacaacctgagaaa

SEQ ID NO: 92258 - DNA, 25 bp, Mus musculus
acaactgcacactcaacctgagaaa

SEQ ID NO: 92259 - DNA, 25 bp, Mus musculus
acaactgcacataatctgcattggg

SEQ ID NO: 92260 - DNA, 25 bp, Mus musculus
acaactgcacattatctgcattggg

SEQ ID NO: 92261 - DNA, 25 bp, Mus musculus
acaactgcacctctcgtgcaagtgt

SEQ ID NO: 92262 - DNA, 25 bp, Mus musculus
acaactgcacctgtcgtgcaagtgt

SEQ ID NO: 92263 - DNA, 25 bp, Mus musculus
acaactgcagacatcttcagcattc

SEQ ID NO: 92264 - DNA, 25 bp, Mus musculus
acaactgcagacttcttcagcattc

SEQ ID NO: 92265 - DNA, 25 bp, Mus musculus
acaactgcagagaagtgatcatcac

SEQ ID NO: 92266 - DNA, 25 bp, Mus musculus
acaactgcagagtagtgatcatcac

SEQ ID NO: 92267 - DNA, 25 bp, Mus musculus
acaactgcagcacgacagcggcggc

SEQ ID NO: 92268 - DNA, 25 bp, Mus musculus
acaactgcagcaggacagcggcggc

SEQ ID NO: 92269 - DNA, 25 bp, Mus musculus
acaactgcaggtatgggcttctttt

SEQ ID NO: 92270 - DNA, 25 bp, Mus musculus
acaactgcaggtttgggcttctttt

SEQ ID NO: 92271 - DNA, 25 bp, Mus musculus
acaactgcagttccattggcttgtg

SEQ ID NO: 92272 - DNA, 25 bp, Mus musculus
acaactgcagttgcattggcttgtg

SEQ ID NO: 92273 - DNA, 25 bp, Mus musculus
acaactgccattaccaactgctgag

SEQ ID NO: 92274 - DNA, 25 bp, Mus musculus
acaactgccatttccaactgctgag

SEQ ID NO: 92275 - DNA, 25 bp, Mus musculus
acaactgccgttcaattgacatgga

SEQ ID NO: 92276 - DNA, 25 bp, Mus musculus
acaactgccgttgaattgacatgga

SEQ ID NO: 92277 - DNA, 25 bp, Mus musculus
acaactgcctatatggtactgccca

SEQ ID NO: 92278 - DNA, 25 bp, Mus musculus
acaactgcctatttggtactgccca

SEQ ID NO: 92279 - DNA, 25 bp, Mus musculus
acaactgcctcacgagtgacactga

SEQ ID NO: 92280 - DNA, 25 bp, Mus musculus
acaactgcctcaggagtgacactga

SEQ ID NO: 92281 - DNA, 25 bp, Mus musculus
acaactgcgtgacctcctgggaaaa

SEQ ID NO: 92282 - DNA, 25 bp, Mus musculus
acaactgcgtgagctcctgggaaaa

SEQ ID NO: 92283 - DNA, 25 bp, Mus musculus
acaactgctattctgccctgggaat

SEQ ID NO: 92284 - DNA, 25 bp, Mus musculus
acaactgctattgtgccctgggaat

SEQ ID NO: 92285 - DNA, 25 bp, Mus musculus
acaactgctcttctagcctttggtt

SEQ ID NO: 92286 - DNA, 25 bp, Mus musculus
acaactgctcttgtagcctttggtt

SEQ ID NO: 92287 - DNA, 25 bp, Mus musculus
acaactgcttataacagctcctggg

SEQ ID NO: 92288 - DNA, 25 bp, Mus musculus
acaactgcttattacagctcctggg

SEQ ID NO: 92289 - DNA, 25 bp, Mus musculus
acaactgcttccatttctatggctc

SEQ ID NO: 92290 - DNA, 25 bp, Mus musculus
acaactgcttccttttctatggctc

SEQ ID NO: 92291 - DNA, 25 bp, Mus musculus
acaactgcttggagacctgaaactc

SEQ ID NO: 92292 - DNA, 25 bp, Mus musculus
acaactgcttggtgacctgaaactc

SEQ ID NO: 92293 - DNA, 25 bp, Mus musculus
acaactgctttcaggactgtacgac

SEQ ID NO: 92294 - DNA, 25 bp, Mus musculus
acaactgctttctggactgtacgac

SEQ ID NO: 92295 - DNA, 25 bp, Mus musculus
acaactggaacaactcagtgccatg

SEQ ID NO: 92296 - DNA, 25 bp, Mus musculus
acaactggaacatctcagtgccatg

SEQ ID NO: 92297 - DNA, 25 bp, Mus musculus
acaactggacagagacccttagctt

SEQ ID NO: 92298 - DNA, 25 bp, Mus musculus
acaactggacagtgacccttagctt

SEQ ID NO: 92299 - DNA, 25 bp, Mus musculus
acaactggacctattgtctttcatc

SEQ ID NO: 92300 - DNA, 25 bp, Mus musculus
acaactggaccttttgtctttcatc

SEQ ID NO: 92301 - DNA, 25 bp, Mus musculus
acaactggacgcactgtgcatgcat

SEQ ID NO: 92302 - DNA, 25 bp, Mus musculus
acaactggacgctctgtgcatgcat

SEQ ID NO: 92303 - DNA, 25 bp, Mus musculus
acaactggacttcttctatcttccc

SEQ ID NO: 92304 - DNA, 25 bp, Mus musculus
acaactggacttgttctatcttccc

SEQ ID NO: 92305 - DNA, 25 bp, Mus musculus
acaactggaggaccttgggtctcct

SEQ ID NO: 92306 - DNA, 25 bp, Mus musculus
acaactggaggagcttgggtctcct

SEQ ID NO: 92307 - DNA, 25 bp, Mus musculus
acaactggcagcatcctttactgag

SEQ ID NO: 92308 - DNA, 25 bp, Mus musculus
acaactggcagcttcctttactgag

SEQ ID NO: 92309 - DNA, 25 bp, Mus musculus
acaactggcaggagccgatgccctt

SEQ ID NO: 92310 - DNA, 25 bp, Mus musculus
acaactggcaggtgccgatgccctt

SEQ ID NO: 92311 - DNA, 25 bp, Mus musculus
acaactggccacagaaggagattgc

SEQ ID NO: 92312 - DNA, 25 bp, Mus musculus
acaactggccactgaaggagattgc

SEQ ID NO: 92313 - DNA, 25 bp, Mus musculus
acaactggcgttaatcaggtacctt

SEQ ID NO: 92314 - DNA, 25 bp, Mus musculus
acaactggcgtttatcaggtacctt

SEQ ID NO: 92315 - DNA, 25 bp, Mus musculus
acaactggctgtactgtctgggtga

SEQ ID NO: 92316 - DNA, 25 bp, Mus musculus
acaactggctgttctgtctgggtga

SEQ ID NO: 92317 - DNA, 25 bp, Mus musculus
acaactgggcctaggagtcacctgg

SEQ ID NO: 92318 - DNA, 25 bp, Mus musculus
acaactgggccttggagtcacctgg

SEQ ID NO: 92319 - DNA, 25 bp, Mus musculus
acaactgggctgagcgaccttgggc

SEQ ID NO: 92320 - DNA, 25 bp, Mus musculus
acaactgggctgtgcgaccttgggc

SEQ ID NO: 92321 - DNA, 25 bp, Mus musculus
acaactgggtaccaaagacaaagat

SEQ ID NO: 92322 - DNA, 25 bp, Mus musculus
acaactgggtacgaaagacaaagat

SEQ ID NO: 92323 - DNA, 25 bp, Mus musculus
acaactggtattccttcaacgacac

SEQ ID NO: 92324 - DNA, 25 bp, Mus musculus
acaactggtattgcttcaacgacac

SEQ ID NO: 92325 - DNA, 25 bp, Mus musculus
acaactggtcgacgatggacttcat

SEQ ID NO: 92326 - DNA, 25 bp, Mus musculus
acaactggtcgaggatggacttcat

SEQ ID NO: 92327 - DNA, 25 bp, Mus musculus
acaactggtcgtccagtgcctgcag

SEQ ID NO: 92328 - DNA, 25 bp, Mus musculus
acaactggtcgtgcagtgcctgcag

SEQ ID NO: 92329 - DNA, 25 bp, Mus musculus
acaactgtaaccctaccatgctagg

SEQ ID NO: 92330 - DNA, 25 bp, Mus musculus
acaactgtaaccgtaccatgctagg

SEQ ID NO: 92331 - DNA, 25 bp, Mus musculus
acaactgtactgctgctgtgtcaag

SEQ ID NO: 92332 - DNA, 25 bp, Mus musculus
acaactgtactggtgctgtgtcaag

SEQ ID NO: 92333 - DNA, 25 bp, Mus musculus
acaactgtagttaatagcaatggga

SEQ ID NO: 92334 - DNA, 25 bp, Mus musculus
acaactgtagtttatagcaatggga

SEQ ID NO: 92335 - DNA, 25 bp, Mus musculus
acaactgtatcacaacacacacgca

SEQ ID NO: 92336 - DNA, 25 bp, Mus musculus
acaactgtatcagaacacacacgca

SEQ ID NO: 92337 - DNA, 25 bp, Mus musculus
acaactgtatctcttccactggaga

SEQ ID NO: 92338 - DNA, 25 bp, Mus musculus
acaactgtatctgttccactggaga

SEQ ID NO: 92339 - DNA, 25 bp, Mus musculus
acaactgtcagtactcaggacacac

SEQ ID NO: 92340 - DNA, 25 bp, Mus musculus
acaactgtcagttctcaggacacac

SEQ ID NO: 92341 - DNA, 25 bp, Mus musculus
acaactgtcatgcttacccatctgg

SEQ ID NO: 92342 - DNA, 25 bp, Mus musculus
acaactgtcatggttacccatctgg

SEQ ID NO: 92343 - DNA, 25 bp, Mus musculus
acaactgtcattatcttgtgttatt

SEQ ID NO: 92344 - DNA, 25 bp, Mus musculus
acaactgtcattttcttgtgttatt

SEQ ID NO: 92345 - DNA, 25 bp, Mus musculus
acaactgtccggaagagctgtacca

SEQ ID NO: 92346 - DNA, 25 bp, Mus musculus
acaactgtccggtagagctgtacca

SEQ ID NO: 92347 - DNA, 25 bp, Mus musculus
acaactgtcttcaaagtagccctta

SEQ ID NO: 92348 - DNA, 25 bp, Mus musculus
acaactgtcttctaagtagccctta

SEQ ID NO: 92349 - DNA, 25 bp, Mus musculus
acaactgtgactcatgttccctggg

SEQ ID NO: 92350 - DNA, 25 bp, Mus musculus
acaactgtgactgatgttccctggg

SEQ ID NO: 92351 - DNA, 25 bp, Mus musculus
acaactgtgcatacactcctaacat

SEQ ID NO: 92352 - DNA, 25 bp, Mus musculus
acaactgtgcattcactcctaacat

SEQ ID NO: 92353 - DNA, 25 bp, Mus musculus
acaactgtggctccggcaactgccg

SEQ ID NO: 92354 - DNA, 25 bp, Mus musculus
acaactgtggctgcggcaactgccg

SEQ ID NO: 92355 - DNA, 25 bp, Mus musculus
acaactgtgtacctactgtatgctg

SEQ ID NO: 92356 - DNA, 25 bp, Mus musculus
acaactgtgtacgtactgtatgctg

SEQ ID NO: 92357 - DNA, 25 bp, Mus musculus
acaactgtgtctctcattcccaaaa

SEQ ID NO: 92358 - DNA, 25 bp, Mus musculus
acaactgtgtctgtcattcccaaaa

SEQ ID NO: 92359 - DNA, 25 bp, Mus musculus
acaacttaatacaagctggttttca

SEQ ID NO: 92360 - DNA, 25 bp, Mus musculus
acaacttaatactagctggttttca

SEQ ID NO: 92361 - DNA, 25 bp, Mus musculus
acaacttacattcctttgcttccag

SEQ ID NO: 92362 - DNA, 25 bp, Mus musculus
acaacttacattgctttgcttccag

SEQ ID NO: 92363 - DNA, 25 bp, Mus musculus
acaacttacccactttgtggaggca

SEQ ID NO: 92364 - DNA, 25 bp, Mus musculus
acaacttacccagtttgtggaggca

SEQ ID NO: 92365 - DNA, 25 bp, Mus musculus
acaacttacgataaattgcccaaag

SEQ ID NO: 92366 - DNA, 25 bp, Mus musculus
acaacttacgattaattgcccaaag

SEQ ID NO: 92367 - DNA, 25 bp, Mus musculus
acaacttactgtcttcaactgttag

SEQ ID NO: 92368 - DNA, 25 bp, Mus musculus
acaacttactgtgttcaactgttag

SEQ ID NO: 92369 - DNA, 25 bp, Mus musculus
acaacttaggccacattccttgaaa

SEQ ID NO: 92370 - DNA, 25 bp, Mus musculus
acaacttaggcctcattccttgaaa

SEQ ID NO: 92371 - DNA, 25 bp, Mus musculus
acaacttataaacacgcggcagcca

SEQ ID NO: 92372 - DNA, 25 bp, Mus musculus
acaacttataaagacgcggcagcca

SEQ ID NO: 92373 - DNA, 25 bp, Mus musculus
acaacttattttatcctgccctcca

SEQ ID NO: 92374 - DNA, 25 bp, Mus musculus
acaacttattttttcctgccctcca

SEQ ID NO: 92375 - DNA, 25 bp, Mus musculus
acaacttcaccaactgtagtaggca

SEQ ID NO: 92376 - DNA, 25 bp, Mus musculus
acaacttcaccatctgtagtaggca

SEQ ID NO: 92377 - DNA, 25 bp, Mus musculus
acaacttcagatcccgtcatttcta

SEQ ID NO: 92378 - DNA, 25 bp, Mus musculus
acaacttcagatgccgtcatttcta

SEQ ID NO: 92379 - DNA, 25 bp, Mus musculus
acaacttcatcccagacgttctaca

SEQ ID NO: 92380 - DNA, 25 bp, Mus musculus
acaacttcatccgagacgttctaca

SEQ ID NO: 92381 - DNA, 25 bp, Mus musculus
acaacttccaggagtggcgtggagt

SEQ ID NO: 92382 - DNA, 25 bp, Mus musculus
acaacttccaggcatttgtgtggga

SEQ ID NO: 92383 - DNA, 25 bp, Mus musculus
acaacttccagggatttgtgtggga

SEQ ID NO: 92384 - DNA, 25 bp, Mus musculus
acaacttccaggtgtggcgtggagt

SEQ ID NO: 92385 - DNA, 25 bp, Mus musculus
acaacttccatacaatgaatgacta

SEQ ID NO: 92386 - DNA, 25 bp, Mus musculus
acaacttccatagaatgaatgacta

SEQ ID NO: 92387 - DNA, 25 bp, Mus musculus
acaacttccattagaggtaagtaga

SEQ ID NO: 92388 - DNA, 25 bp, Mus musculus
acaacttccatttgaggtaagtaga

SEQ ID NO: 92389 - DNA, 25 bp, Mus musculus
acaacttcctacctttgcatgttaa

SEQ ID NO: 92390 - DNA, 25 bp, Mus musculus
acaacttcctacgtttgcatgttaa

SEQ ID NO: 92391 - DNA, 25 bp, Mus musculus
acaacttcctttagtggtcttcatt

SEQ ID NO: 92392 - DNA, 25 bp, Mus musculus
acaacttccttttgtggtcttcatt

SEQ ID NO: 92393 - DNA, 25 bp, Mus musculus
acaacttcggtgctcagtgtgtttg

SEQ ID NO: 92394 - DNA, 25 bp, Mus musculus
acaacttcggtggtcagtgtgtttg

SEQ ID NO: 92395 - DNA, 25 bp, Mus musculus
acaacttcgttgaggctcacagtca

SEQ ID NO: 92396 - DNA, 25 bp, Mus musculus
acaacttcgttgtggctcacagtca

SEQ ID NO: 92397 - DNA, 25 bp, Mus musculus
acaacttctcaaagttctggttttg

SEQ ID NO: 92398 - DNA, 25 bp, Mus musculus
acaacttctcaatgttctggttttg

SEQ ID NO: 92399 - DNA, 25 bp, Mus musculus
acaacttctcagattggccgctgta

SEQ ID NO: 92400 - DNA, 25 bp, Mus musculus
acaacttctcagtttggccgctgta

SEQ ID NO: 92401 - DNA, 25 bp, Mus musculus
acaacttctcatcccctaagtggga

SEQ ID NO: 92402 - DNA, 25 bp, Mus musculus
acaacttctcatgccctaagtggga

SEQ ID NO: 92403 - DNA, 25 bp, Mus musculus
acaacttctcctatgattaccatgc

SEQ ID NO: 92404 - DNA, 25 bp, Mus musculus
acaacttctcctttgattaccatgc

SEQ ID NO: 92405 - DNA, 25 bp, Mus musculus
acaacttctgctcaatagccaggct

SEQ ID NO: 92406 - DNA, 25 bp, Mus musculus
acaacttctgctgaatagccaggct

SEQ ID NO: 92407 - DNA, 25 bp, Mus musculus
acaacttgaaatccagcctgggcta

SEQ ID NO: 92408 - DNA, 25 bp, Mus musculus
acaacttgaaatcccagcttctctc

SEQ ID NO: 92409 - DNA, 25 bp, Mus musculus
acaacttgaaatccctggaagccca

SEQ ID NO: 92410 - DNA, 25 bp, Mus musculus
acaacttgaaatgcagcctgggcta

SEQ ID NO: 92411 - DNA, 25 bp, Mus musculus
acaacttgaaatgccagcttctctc

SEQ ID NO: 92412 - DNA, 25 bp, Mus musculus
acaacttgaaatgcctggaagccca

SEQ ID NO: 92413 - DNA, 25 bp, Mus musculus
acaacttgacctagattgtagtcca

SEQ ID NO: 92414 - DNA, 25 bp, Mus musculus
acaacttgaccttgattgtagtcca

SEQ ID NO: 92415 - DNA, 25 bp, Mus musculus
acaacttgatgtattgccacgtgta

SEQ ID NO: 92416 - DNA, 25 bp, Mus musculus
acaacttgatgttttgccacgtgta

SEQ ID NO: 92417 - DNA, 25 bp, Mus musculus
acaacttgattgaattcttcagtaa

SEQ ID NO: 92418 - DNA, 25 bp, Mus musculus
acaacttgattgtattcttcagtaa

SEQ ID NO: 92419 - DNA, 25 bp, Mus musculus
acaacttgcagtctgttatcttaac

SEQ ID NO: 92420 - DNA, 25 bp, Mus musculus
acaacttgcagtgtgttatcttaac

SEQ ID NO: 92421 - DNA, 25 bp, Mus musculus
acaacttgcatcatgttctcctcct

SEQ ID NO: 92422 - DNA, 25 bp, Mus musculus
acaacttgcatcttgttctcctcct

SEQ ID NO: 92423 - DNA, 25 bp, Mus musculus
acaacttgctgaacttgccattagt

SEQ ID NO: 92424 - DNA, 25 bp, Mus musculus
acaacttgctgatcttgccattagt

SEQ ID NO: 92425 - DNA, 25 bp, Mus musculus
acaacttggcaaaatcatgagtaat

SEQ ID NO: 92426 - DNA, 25 bp, Mus musculus
acaacttggcaatatcatgagtaat

SEQ ID NO: 92427 - DNA, 25 bp, Mus musculus
acaacttggcatccattcccttttt

SEQ ID NO: 92428 - DNA, 25 bp, Mus musculus
acaacttggcatgcattcccttttt

SEQ ID NO: 92429 - DNA, 25 bp, Mus musculus
acaacttgtaagctagcctggtctt

SEQ ID NO: 92430 - DNA, 25 bp, Mus musculus
acaacttgtaaggtagcctggtctt

SEQ ID NO: 92431 - DNA, 25 bp, Mus musculus
acaacttgtagtagctcgttctctc

SEQ ID NO: 92432 - DNA, 25 bp, Mus musculus
acaacttgtagttgctcgttctctc

SEQ ID NO: 92433 - DNA, 25 bp, Mus musculus
acaacttgtgggaggcggtccctgg

SEQ ID NO: 92434 - DNA, 25 bp, Mus musculus
acaacttgtgggtggcggtccctgg

SEQ ID NO: 92435 - DNA, 25 bp, Mus musculus
acaacttgtgtgaaactccaattca

SEQ ID NO: 92436 - DNA, 25 bp, Mus musculus
acaacttgtgtgtaactccaattca

SEQ ID NO: 92437 - DNA, 25 bp, Mus musculus
acaactttaacaaaggtgtggcttt

SEQ ID NO: 92438 - DNA, 25 bp, Mus musculus
acaactttaacataggtgtggcttt

SEQ ID NO: 92439 - DNA, 25 bp, Mus musculus
acaactttctgtccgtttttctagt

SEQ ID NO: 92440 - DNA, 25 bp, Mus musculus
acaactttctgtgcgtttttctagt

SEQ ID NO: 92441 - DNA, 25 bp, Mus musculus
acaactttgccacgattggacacct

SEQ ID NO: 92442 - DNA, 25 bp, Mus musculus
acaactttgccaggattggacacct

SEQ ID NO: 92443 - DNA, 25 bp, Mus musculus
acaactttggacaggatgggaataa

SEQ ID NO: 92444 - DNA, 25 bp, Mus musculus
acaactttggactggatgggaataa

SEQ ID NO: 92445 - DNA, 25 bp, Mus musculus
acaactttgtgaattgggattctca

SEQ ID NO: 92446 - DNA, 25 bp, Mus musculus
acaactttgtgatttgggattctca

SEQ ID NO: 92447 - DNA, 25 bp, Mus musculus
acaacttttagaccaggtccacaga

SEQ ID NO: 92448 - DNA, 25 bp, Mus musculus
acaacttttagagcaggtccacaga

SEQ ID NO: 92449 - DNA, 25 bp, Mus musculus
acaacttttcagacatggtgaccat

SEQ ID NO: 92450 - DNA, 25 bp, Mus musculus
acaacttttcagtcatggtgaccat

SEQ ID NO: 92451 - DNA, 25 bp, Mus musculus
acaagaaactatcctccatgctctt

SEQ ID NO: 92452 - DNA, 25 bp, Mus musculus
acaagaaactatgctccatgctctt

SEQ ID NO: 92453 - DNA, 25 bp, Mus musculus
acaagaaatattcacccagggctgg

SEQ ID NO: 92454 - DNA, 25 bp, Mus musculus
acaagaaatattgacccagggctgg

SEQ ID NO: 92455 - DNA, 25 bp, Mus musculus
acaagaacacagctagtcccctgat

SEQ ID NO: 92456 - DNA, 25 bp, Mus musculus
acaagaacacaggtagtcccctgat

SEQ ID NO: 92457 - DNA, 25 bp, Mus musculus
acaagaacacttaacctgaggtaca

SEQ ID NO: 92458 - DNA, 25 bp, Mus musculus
acaagaacactttacctgaggtaca

SEQ ID NO: 92459 - DNA, 25 bp, Mus musculus
acaagaacccttcagttcctctgtc

SEQ ID NO: 92460 - DNA, 25 bp, Mus musculus
acaagaacccttgagttcctctgtc

SEQ ID NO: 92461 - DNA, 25 bp, Mus musculus
acaagaacgggcagactctacaacc

SEQ ID NO: 92462 - DNA, 25 bp, Mus musculus
acaagaacgggctgactctacaacc

SEQ ID NO: 92463 - DNA, 25 bp, Mus musculus
acaagaactagaactatcccctcca

SEQ ID NO: 92464 - DNA, 25 bp, Mus musculus
acaagaactagatctatcccctcca

SEQ ID NO: 92465 - DNA, 25 bp, Mus musculus
acaagaactttcaggatgggaatca

SEQ ID NO: 92466 - DNA, 25 bp, Mus musculus
acaagaactttctggatgggaatca

SEQ ID NO: 92467 - DNA, 25 bp, Mus musculus
acaagaagacctaccagatcctgga

SEQ ID NO: 92468 - DNA, 25 bp, Mus musculus
acaagaagaccttccagatcctgga

SEQ ID NO: 92469 - DNA, 25 bp, Mus musculus
acaagaagaggcctcccgagagctg

SEQ ID NO: 92470 - DNA, 25 bp, Mus musculus
acaagaagaggcgtcccgagagctg

SEQ ID NO: 92471 - DNA, 25 bp, Mus musculus
acaagaagaggtaccccagtcagcc

SEQ ID NO: 92472 - DNA, 25 bp, Mus musculus
acaagaagaggttccccagtcagcc

SEQ ID NO: 92473 - DNA, 25 bp, Mus musculus
acaagaagatctaccgcattggccg

SEQ ID NO: 92474 - DNA, 25 bp, Mus musculus
acaagaagatcttccgcattggccg

SEQ ID NO: 92475 - DNA, 25 bp, Mus musculus
acaagaagcacgctgaggcggaaaa

SEQ ID NO: 92476 - DNA, 25 bp, Mus musculus
acaagaagcacggtgaggcggaaaa

SEQ ID NO: 92477 - DNA, 25 bp, Mus musculus
acaagaagccggcagctttcgttgc

SEQ ID NO: 92478 - DNA, 25 bp, Mus musculus
acaagaagccgggagctttcgttgc

SEQ ID NO: 92479 - DNA, 25 bp, Mus musculus
acaagaagcgcacaacaggctgcat

SEQ ID NO: 92480 - DNA, 25 bp, Mus musculus
acaagaagcgcagaacaggctgcat

SEQ ID NO: 92481 - DNA, 25 bp, Mus musculus
acaagaagctacatcttggcccagc

SEQ ID NO: 92482 - DNA, 25 bp, Mus musculus
acaagaagctacttcttggcccagc

SEQ ID NO: 92483 - DNA, 25 bp, Mus musculus
acaagaagctgtcattgtctctggt

SEQ ID NO: 92484 - DNA, 25 bp, Mus musculus
acaagaagctgtgattgtctctggt

SEQ ID NO: 92485 - DNA, 25 bp, Mus musculus
acaagaagcttaactcggcgtctga

SEQ ID NO: 92486 - DNA, 25 bp, Mus musculus
acaagaagcttatctcggcgtctga

SEQ ID NO: 92487 - DNA, 25 bp, Mus musculus
acaagaagggtcccttaggccgctg

SEQ ID NO: 92488 - DNA, 25 bp, Mus musculus
acaagaagggtcgcttaggccgctg

SEQ ID NO: 92489 - DNA, 25 bp, Mus musculus
acaagaaggtggctggaccagacta

SEQ ID NO: 92490 - DNA, 25 bp, Mus musculus
acaagaaggtgggtggaccagacta

SEQ ID NO: 92491 - DNA, 25 bp, Mus musculus
acaagaagtgctagtaacttctgag

SEQ ID NO: 92492 - DNA, 25 bp, Mus musculus
acaagaagtgcttgtaacttctgag

SEQ ID NO: 92493 - DNA, 25 bp, Mus musculus
acaagaataggcactctctacaaaa

SEQ ID NO: 92494 - DNA, 25 bp, Mus musculus
acaagaataggctctctctacaaaa

SEQ ID NO: 92495 - DNA, 25 bp, Mus musculus
acaagaattaccatcagggactttc

SEQ ID NO: 92496 - DNA, 25 bp, Mus musculus
acaagaattaccttcagggactttc

SEQ ID NO: 92497 - DNA, 25 bp, Mus musculus
acaagaattagcagtgccctagtca

SEQ ID NO: 92498 - DNA, 25 bp, Mus musculus
acaagaattagctgtgccctagtca

SEQ ID NO: 92499 - DNA, 25 bp, Mus musculus
acaagaattgtgacagcattttcca

SEQ ID NO: 92500 - DNA, 25 bp, Mus musculus
acaagaattgtgtcagcattttcca

SEQ ID NO: 92501 - DNA, 25 bp, Mus musculus
acaagacaaaccctaggctgcctga

SEQ ID NO: 92502 - DNA, 25 bp, Mus musculus
acaagacaaaccgtaggctgcctga

SEQ ID NO: 92503 - DNA, 25 bp, Mus musculus
acaagacaaccgctgtgacacagtg

SEQ ID NO: 92504 - DNA, 25 bp, Mus musculus
acaagacaaccggtgtgacacagtg

SEQ ID NO: 92505 - DNA, 25 bp, Mus musculus
acaagacaacctcaatgatgcagag

SEQ ID NO: 92506 - DNA, 25 bp, Mus musculus
acaagacaacctgaatgatgcagag

SEQ ID NO: 92507 - DNA, 25 bp, Mus musculus
acaagacacacactggatggtgctg

SEQ ID NO: 92508 - DNA, 25 bp, Mus musculus
acaagacacacagtggatggtgctg

SEQ ID NO: 92509 - DNA, 25 bp, Mus musculus
acaagacagatgaaccggcgctact

SEQ ID NO: 92510 - DNA, 25 bp, Mus musculus
acaagacagatgtaccggcgctact

SEQ ID NO: 92511 - DNA, 25 bp, Mus musculus
acaagacaggttcctttgcaattaa

SEQ ID NO: 92512 - DNA, 25 bp, Mus musculus
acaagacaggttgctttgcaattaa

SEQ ID NO: 92513 - DNA, 25 bp, Mus musculus
acaagacatgttcagttagctaact

SEQ ID NO: 92514 - DNA, 25 bp, Mus musculus
acaagacatgttgagttagctaact

SEQ ID NO: 92515 - DNA, 25 bp, Mus musculus
acaagaccaaatcaggcccaaactg

SEQ ID NO: 92516 - DNA, 25 bp, Mus musculus
acaagaccaaatgaggcccaaactg

SEQ ID NO: 92517 - DNA, 25 bp, Mus musculus
acaagaccacctattttgtctgtct

SEQ ID NO: 92518 - DNA, 25 bp, Mus musculus
acaagaccaccttttttgtctgtct

SEQ ID NO: 92519 - DNA, 25 bp, Mus musculus
acaagaccatgcagtatgtgccaaa

SEQ ID NO: 92520 - DNA, 25 bp, Mus musculus
acaagaccatgctgtatgtgccaaa

SEQ ID NO: 92521 - DNA, 25 bp, Mus musculus
acaagaccatgtactgcatcgtcag

SEQ ID NO: 92522 - DNA, 25 bp, Mus musculus
acaagaccatgttctgcatcgtcag

SEQ ID NO: 92523 - DNA, 25 bp, Mus musculus
acaagaccctgacaggctgccgtgc

SEQ ID NO: 92524 - DNA, 25 bp, Mus musculus
acaagaccctgagaggctgccgtgc

SEQ ID NO: 92525 - DNA, 25 bp, Mus musculus
acaagacccttcagccaagatcgtc

SEQ ID NO: 92526 - DNA, 25 bp, Mus musculus
acaagacccttctgccaagatcgtc

SEQ ID NO: 92527 - DNA, 25 bp, Mus musculus
acaagacctacaagaagtggagctc

SEQ ID NO: 92528 - DNA, 25 bp, Mus musculus
acaagacctacatgaagtggagctc

SEQ ID NO: 92529 - DNA, 25 bp, Mus musculus
acaagacctgagcaactcgctctct

SEQ ID NO: 92530 - DNA, 25 bp, Mus musculus
acaagacctgaggaactcgctctct

SEQ ID NO: 92531 - DNA, 25 bp, Mus musculus
acaagacctgcaaagactcaagcca

SEQ ID NO: 92532 - DNA, 25 bp, Mus musculus
acaagacctgcatagactcaagcca

SEQ ID NO: 92533 - DNA, 25 bp, Mus musculus
acaagacctgccagttccttagcat

SEQ ID NO: 92534 - DNA, 25 bp, Mus musculus
acaagacctgcctgttccttagcat

SEQ ID NO: 92535 - DNA, 25 bp, Mus musculus
acaagacggcttactactctttcta

SEQ ID NO: 92536 - DNA, 25 bp, Mus musculus
acaagacggctttctactctttcta

SEQ ID NO: 92537 - DNA, 25 bp, Mus musculus
acaagactaaagagccattcctcca

SEQ ID NO: 92538 - DNA, 25 bp, Mus musculus
acaagactaaagtgccattcctcca

SEQ ID NO: 92539 - DNA, 25 bp, Mus musculus
acaagactactgaccatgattctct

SEQ ID NO: 92540 - DNA, 25 bp, Mus musculus
acaagactactgtccatgattctct

SEQ ID NO: 92541 - DNA, 25 bp, Mus musculus
acaagactagctaggtctgtatagt

SEQ ID NO: 92542 - DNA, 25 bp, Mus musculus
acaagactagcttggtctgtatagt

SEQ ID NO: 92543 - DNA, 25 bp, Mus musculus
acaagactagttaccctgctacaat

SEQ ID NO: 92544 - DNA, 25 bp, Mus musculus
acaagactagtttccctgctacaat

SEQ ID NO: 92545 - DNA, 25 bp, Mus musculus
acaagactcaagaccttcaacccgt

SEQ ID NO: 92546 - DNA, 25 bp, Mus musculus
acaagactcaagtccttcaacccgt

SEQ ID NO: 92547 - DNA, 25 bp, Mus musculus
acaagactccagctcctgcggcata

SEQ ID NO: 92548 - DNA, 25 bp, Mus musculus
acaagactccaggtcctgcggcata

SEQ ID NO: 92549 - DNA, 25 bp, Mus musculus
acaagactgagtcctgaggtttccg

SEQ ID NO: 92550 - DNA, 25 bp, Mus musculus
acaagactgagtgctgaggtttccg

SEQ ID NO: 92551 - DNA, 25 bp, Mus musculus
acaagactggccagctgtgagtagt

SEQ ID NO: 92552 - DNA, 25 bp, Mus musculus
acaagactggcctgctgtgagtagt

SEQ ID NO: 92553 - DNA, 25 bp, Mus musculus
acaagactggttcggccatggtatc

SEQ ID NO: 92554 - DNA, 25 bp, Mus musculus
acaagactggttgggccatggtatc

SEQ ID NO: 92555 - DNA, 25 bp, Mus musculus
acaagacttcgtccagagatggaac

SEQ ID NO: 92556 - DNA, 25 bp, Mus musculus
acaagacttcgtgcagagatggaac

SEQ ID NO: 92557 - DNA, 25 bp, Mus musculus
acaagacttctcacaagcttttaaa

SEQ ID NO: 92558 - DNA, 25 bp, Mus musculus
acaagacttctctcaagcttttaaa

SEQ ID NO: 92559 - DNA, 25 bp, Mus musculus
acaagactttacacctttccattgg

SEQ ID NO: 92560 - DNA, 25 bp, Mus musculus
acaagactttactcctttccattgg

SEQ ID NO: 92561 - DNA, 25 bp, Mus musculus
acaagactttcccaatcaagcgatt

SEQ ID NO: 92562 - DNA, 25 bp, Mus musculus
acaagactttccgaatcaagcgatt

SEQ ID NO: 92563 - DNA, 25 bp, Mus musculus
acaagactttgcatcacgggctaaa

SEQ ID NO: 92564 - DNA, 25 bp, Mus musculus
acaagactttgcttcacgggctaaa

SEQ ID NO: 92565 - DNA, 25 bp, Mus musculus
acaagagaaatcaggtgttcctcat

SEQ ID NO: 92566 - DNA, 25 bp, Mus musculus
acaagagaaatctggtgttcctcat

SEQ ID NO: 92567 - DNA, 25 bp, Mus musculus
acaagagaagtcaaaactgtcataa

SEQ ID NO: 92568 - DNA, 25 bp, Mus musculus
acaagagaagtctaaactgtcataa

SEQ ID NO: 92569 - DNA, 25 bp, Mus musculus
acaagagacgcccaattctttctgc

SEQ ID NO: 92570 - DNA, 25 bp, Mus musculus
acaagagacgccgaattctttctgc

SEQ ID NO: 92571 - DNA, 25 bp, Mus musculus
acaagagactgcaggatcggtggca

SEQ ID NO: 92572 - DNA, 25 bp, Mus musculus
acaagagactgctggatcggtggca

SEQ ID NO: 92573 - DNA, 25 bp, Mus musculus
acaagagacttcagatcttaccctc

SEQ ID NO: 92574 - DNA, 25 bp, Mus musculus
acaagagacttctgatcttaccctc

SEQ ID NO: 92575 - DNA, 25 bp, Mus musculus
acaagagagccgacctttcttcaaa

SEQ ID NO: 92576 - DNA, 25 bp, Mus musculus
acaagagagccgtcctttcttcaaa

SEQ ID NO: 92577 - DNA, 25 bp, Mus musculus
acaagagagttgaaccgaaaggcaa

SEQ ID NO: 92578 - DNA, 25 bp, Mus musculus
acaagagagttgtaccgaaaggcaa

SEQ ID NO: 92579 - DNA, 25 bp, Mus musculus
acaagagatgctctctgggagtgac

SEQ ID NO: 92580 - DNA, 25 bp, Mus musculus
acaagagatgctgtctgggagtgac

SEQ ID NO: 92581 - DNA, 25 bp, Mus musculus
acaagagcaagtccgtgagcacatg

SEQ ID NO: 92582 - DNA, 25 bp, Mus musculus
acaagagcaagtgcgtgagcacatg

SEQ ID NO: 92583 - DNA, 25 bp, Mus musculus
acaagagcatctaggtcctggataa

SEQ ID NO: 92584 - DNA, 25 bp, Mus musculus
acaagagcatcttggtcctggataa

SEQ ID NO: 92585 - DNA, 25 bp, Mus musculus
acaagagcattgacattcgcccgct

SEQ ID NO: 92586 - DNA, 25 bp, Mus musculus
acaagagcattgtcattcgcccgct

SEQ ID NO: 92587 - DNA, 25 bp, Mus musculus
acaagagccacgattacactgtaaa

SEQ ID NO: 92588 - DNA, 25 bp, Mus musculus
acaagagccacgtttacactgtaaa

SEQ ID NO: 92589 - DNA, 25 bp, Mus musculus
acaagagccagccttgaccatcctg

SEQ ID NO: 92590 - DNA, 25 bp, Mus musculus
acaagagccagcgttgaccatcctg

SEQ ID NO: 92591 - DNA, 25 bp, Mus musculus
acaagagcccaaacactcccggaag

SEQ ID NO: 92592 - DNA, 25 bp, Mus musculus
acaagagcccaatcactcccggaag

SEQ ID NO: 92593 - DNA, 25 bp, Mus musculus
acaagagcccctaaatactgccaaa

SEQ ID NO: 92594 - DNA, 25 bp, Mus musculus
acaagagccccttaatactgccaaa

SEQ ID NO: 92595 - DNA, 25 bp, Mus musculus
acaagagccctcattgtctctggat

SEQ ID NO: 92596 - DNA, 25 bp, Mus musculus
acaagagccctctttgtctctggat

SEQ ID NO: 92597 - DNA, 25 bp, Mus musculus
acaagagcctagagaacctggctag

SEQ ID NO: 92598 - DNA, 25 bp, Mus musculus
acaagagcctagtgaacctggctag

SEQ ID NO: 92599 - DNA, 25 bp, Mus musculus
acaagagcctctctgtaatccaggg

SEQ ID NO: 92600 - DNA, 25 bp, Mus musculus
acaagagcctctgtgtaatccaggg

SEQ ID NO: 92601 - DNA, 25 bp, Mus musculus
acaagagcgccgagacaactgtggt

SEQ ID NO: 92602 - DNA, 25 bp, Mus musculus
acaagagcgccgtgacaactgtggt

SEQ ID NO: 92603 - DNA, 25 bp, Mus musculus
acaagagcggccaggacaagtatct

SEQ ID NO: 92604 - DNA, 25 bp, Mus musculus
acaagagcggcctggacaagtatct

SEQ ID NO: 92605 - DNA, 25 bp, Mus musculus
acaagagcgggaagatattctggca

SEQ ID NO: 92606 - DNA, 25 bp, Mus musculus
acaagagcgggatgatattctggca

SEQ ID NO: 92607 - DNA, 25 bp, Mus musculus
acaagagctcaaagccaagcgcagc

SEQ ID NO: 92608 - DNA, 25 bp, Mus musculus
acaagagctcaatgccaagcgcagc

SEQ ID NO: 92609 - DNA, 25 bp, Mus musculus
acaagagctgcgctgtcgctgagta

SEQ ID NO: 92610 - DNA, 25 bp, Mus musculus
acaagagctgcggtgtcgctgagta

SEQ ID NO: 92611 - DNA, 25 bp, Mus musculus
acaagagctgttccaaccactgaaa

SEQ ID NO: 92612 - DNA, 25 bp, Mus musculus
acaagagctgttgcaaccactgaaa

SEQ ID NO: 92613 - DNA, 25 bp, Mus musculus
acaagagcttcacgacaggtcccag

SEQ ID NO: 92614 - DNA, 25 bp, Mus musculus
acaagagcttcaggacaggtcccag

SEQ ID NO: 92615 - DNA, 25 bp, Mus musculus
acaagaggacacaagctcggtggaa

SEQ ID NO: 92616 - DNA, 25 bp, Mus musculus
acaagaggacactagctcggtggaa

SEQ ID NO: 92617 - DNA, 25 bp, Mus musculus
acaagaggagctattgccactgacc

SEQ ID NO: 92618 - DNA, 25 bp, Mus musculus
acaagaggagcttttgccactgacc

SEQ ID NO: 92619 - DNA, 25 bp, Mus musculus
acaagaggctctaattacagtgaag

SEQ ID NO: 92620 - DNA, 25 bp, Mus musculus
acaagaggctcttattacagtgaag

SEQ ID NO: 92621 - DNA, 25 bp, Mus musculus
acaagagggaagctgcacgccttta

SEQ ID NO: 92622 - DNA, 25 bp, Mus musculus
acaagagggaaggtgcacgccttta

SEQ ID NO: 92623 - DNA, 25 bp, Mus musculus
acaagagggaccaccgtgctgtgtt

SEQ ID NO: 92624 - DNA, 25 bp, Mus musculus
acaagagggacctccgtgctgtgtt

SEQ ID NO: 92625 - DNA, 25 bp, Mus musculus
acaagagggccactactgaggaccg

SEQ ID NO: 92626 - DNA, 25 bp, Mus musculus
acaagagggccagtactgaggaccg

SEQ ID NO: 92627 - DNA, 25 bp, Mus musculus
acaagaggtgggagagagatcttac

SEQ ID NO: 92628 - DNA, 25 bp, Mus musculus
acaagaggtgggtgagagatcttac

SEQ ID NO: 92629 - DNA, 25 bp, Mus musculus
acaagaggtgttctatttctttctc

SEQ ID NO: 92630 - DNA, 25 bp, Mus musculus
acaagaggtgttgtatttctttctc

SEQ ID NO: 92631 - DNA, 25 bp, Mus musculus
acaagaggttatagctccagttcta

SEQ ID NO: 92632 - DNA, 25 bp, Mus musculus
acaagaggttattgctccagttcta

SEQ ID NO: 92633 - DNA, 25 bp, Mus musculus
acaagaggttctagtcccactctgg

SEQ ID NO: 92634 - DNA, 25 bp, Mus musculus
acaagaggttcttgtcccactctgg

SEQ ID NO: 92635 - DNA, 25 bp, Mus musculus
acaagagtcagtccaggccgctatt

SEQ ID NO: 92636 - DNA, 25 bp, Mus musculus
acaagagtcagtgcaggccgctatt

SEQ ID NO: 92637 - DNA, 25 bp, Mus musculus
acaagagtctttagtcctggtcctt

SEQ ID NO: 92638 - DNA, 25 bp, Mus musculus
acaagagtcttttgtcctggtcctt

SEQ ID NO: 92639 - DNA, 25 bp, Mus musculus
acaagagtgacaccttgtggtcagt

SEQ ID NO: 92640 - DNA, 25 bp, Mus musculus
acaagagtgacagcttgtggtcagt

SEQ ID NO: 92641 - DNA, 25 bp, Mus musculus
acaagagtgagtagcaagccgacaa

SEQ ID NO: 92642 - DNA, 25 bp, Mus musculus
acaagagtgagtcctggagcctccc

SEQ ID NO: 92643 - DNA, 25 bp, Mus musculus
acaagagtgagtgctggagcctccc

SEQ ID NO: 92644 - DNA, 25 bp, Mus musculus
acaagagtgagttgcaagccgacaa

SEQ ID NO: 92645 - DNA, 25 bp, Mus musculus
acaagagtgattcttgctgctatta

SEQ ID NO: 92646 - DNA, 25 bp, Mus musculus
acaagagtgattgttgctgctatta

SEQ ID NO: 92647 - DNA, 25 bp, Mus musculus
acaagagtgcagaggagatgccata

SEQ ID NO: 92648 - DNA, 25 bp, Mus musculus
acaagagtgcagtggagatgccata

SEQ ID NO: 92649 - DNA, 25 bp, Mus musculus
acaagagtgttcaaggttgggatac

SEQ ID NO: 92650 - DNA, 25 bp, Mus musculus
acaagagtgttctaggttgggatac

SEQ ID NO: 92651 - DNA, 25 bp, Mus musculus
acaagagttgagcagcttgtccgac

SEQ ID NO: 92652 - DNA, 25 bp, Mus musculus
acaagagttgaggagcttgtccgac

SEQ ID NO: 92653 - DNA, 25 bp, Mus musculus
acaagagttgttatctttccatatt

SEQ ID NO: 92654 - DNA, 25 bp, Mus musculus
acaagagttgttttctttccatatt

SEQ ID NO: 92655 - DNA, 25 bp, Mus musculus
acaagatcaagacccgctttctgga

SEQ ID NO: 92656 - DNA, 25 bp, Mus musculus
acaagatcaagagccgctttctgga

SEQ ID NO: 92657 - DNA, 25 bp, Mus musculus
acaagatcacagactctagggcagt

SEQ ID NO: 92658 - DNA, 25 bp, Mus musculus
acaagatcacagtctctagggcagt

SEQ ID NO: 92659 - DNA, 25 bp, Mus musculus
acaagatcaccaccaggacgctgaa

SEQ ID NO: 92660 - DNA, 25 bp, Mus musculus
acaagatcaccagcaggacgctgaa

SEQ ID NO: 92661 - DNA, 25 bp, Mus musculus
acaagatcactgattgtgcctctgt

SEQ ID NO: 92662 - DNA, 25 bp, Mus musculus
acaagatcactgtttgtgcctctgt

SEQ ID NO: 92663 - DNA, 25 bp, Mus musculus
acaagatcagcaacgtgccggccat

SEQ ID NO: 92664 - DNA, 25 bp, Mus musculus
acaagatcagcatcgtgccggccat

SEQ ID NO: 92665 - DNA, 25 bp, Mus musculus
acaagatccattagccttcttggcc

SEQ ID NO: 92666 - DNA, 25 bp, Mus musculus
acaagatccatttgccttcttggcc

SEQ ID NO: 92667 - DNA, 25 bp, Mus musculus
acaagatcctatctgtaaccatcaa

SEQ ID NO: 92668 - DNA, 25 bp, Mus musculus
acaagatcctatgtgtaaccatcaa

SEQ ID NO: 92669 - DNA, 25 bp, Mus musculus
acaagatccttcagaatgcctgctg

SEQ ID NO: 92670 - DNA, 25 bp, Mus musculus
acaagatccttccagatcgccaaag

SEQ ID NO: 92671 - DNA, 25 bp, Mus musculus
acaagatccttcgagatcgccaaag

SEQ ID NO: 92672 - DNA, 25 bp, Mus musculus
acaagatccttctgaatgcctgctg

SEQ ID NO: 92673 - DNA, 25 bp, Mus musculus
acaagatctcatactgttttgggac

SEQ ID NO: 92674 - DNA, 25 bp, Mus musculus
acaagatctcattctgttttgggac

SEQ ID NO: 92675 - DNA, 25 bp, Mus musculus
acaagatctgccagtcggagctcaa

SEQ ID NO: 92676 - DNA, 25 bp, Mus musculus
acaagatctgcctgtcggagctcaa

SEQ ID NO: 92677 - DNA, 25 bp, Mus musculus
acaagatgatccctcacactgctca

SEQ ID NO: 92678 - DNA, 25 bp, Mus musculus
acaagatgatccgtcacactgctca

SEQ ID NO: 92679 - DNA, 25 bp, Mus musculus
acaagatgatctaagggcccaacaa

SEQ ID NO: 92680 - DNA, 25 bp, Mus musculus
acaagatgatcttagggcccaacaa

SEQ ID NO: 92681 - DNA, 25 bp, Mus musculus
acaagatgatggacagtactgggat

SEQ ID NO: 92682 - DNA, 25 bp, Mus musculus
acaagatgatggtcagtactgggat

SEQ ID NO: 92683 - DNA, 25 bp, Mus musculus
acaagatgcgcaacatcgcctttgt

SEQ ID NO: 92684 - DNA, 25 bp, Mus musculus
acaagatgcgcatcatcgcctttgt

SEQ ID NO: 92685 - DNA, 25 bp, Mus musculus
acaagatgcgttctggtctacttcc

SEQ ID NO: 92686 - DNA, 25 bp, Mus musculus
acaagatgcgttgtggtctacttcc

SEQ ID NO: 92687 - DNA, 25 bp, Mus musculus
acaagatgctctaactctgcttgca

SEQ ID NO: 92688 - DNA, 25 bp, Mus musculus
acaagatgctcttactctgcttgca

SEQ ID NO: 92689 - DNA, 25 bp, Mus musculus
acaagatgcttgacagatgagaggc

SEQ ID NO: 92690 - DNA, 25 bp, Mus musculus
acaagatgcttgtcagatgagaggc

SEQ ID NO: 92691 - DNA, 25 bp, Mus musculus
acaagatggcacatactggtagcaa

SEQ ID NO: 92692 - DNA, 25 bp, Mus musculus
acaagatggcacttactggtagcaa

SEQ ID NO: 92693 - DNA, 25 bp, Mus musculus
acaagatggcatatccttaattact

SEQ ID NO: 92694 - DNA, 25 bp, Mus musculus
acaagatggcatttccttaattact

SEQ ID NO: 92695 - DNA, 25 bp, Mus musculus
acaagatggccaccagaacactgaa

SEQ ID NO: 92696 - DNA, 25 bp, Mus musculus
acaagatggccagcagaacactgaa

SEQ ID NO: 92697 - DNA, 25 bp, Mus musculus
acaagatggcgcagctttcaataag

SEQ ID NO: 92698 - DNA, 25 bp, Mus musculus
acaagatggcgctgctttcaataag

SEQ ID NO: 92699 - DNA, 25 bp, Mus musculus
acaagatggctccaccggtttcggc

SEQ ID NO: 92700 - DNA, 25 bp, Mus musculus
acaagatggctcgaccggtttcggc

SEQ ID NO: 92701 - DNA, 25 bp, Mus musculus
acaagatggttgagattgtgcagtg

SEQ ID NO: 92702 - DNA, 25 bp, Mus musculus
acaagatggttgtgattgtgcagtg

SEQ ID NO: 92703 - DNA, 25 bp, Mus musculus
acaagatgtgtgactacgaccccaa

SEQ ID NO: 92704 - DNA, 25 bp, Mus musculus
acaagatgtgtgtctacgaccccaa

SEQ ID NO: 92705 - DNA, 25 bp, Mus musculus
acaagatgttggaacccaggcttcc

SEQ ID NO: 92706 - DNA, 25 bp, Mus musculus
acaagatgttggtacccaggcttcc

SEQ ID NO: 92707 - DNA, 25 bp, Mus musculus
acaagattagcaattctactgtctc

SEQ ID NO: 92708 - DNA, 25 bp, Mus musculus
acaagattagcatttctactgtctc

SEQ ID NO: 92709 - DNA, 25 bp, Mus musculus
acaagattattgacccccctcctga

SEQ ID NO: 92710 - DNA, 25 bp, Mus musculus
acaagattattgtcccccctcctga

SEQ ID NO: 92711 - DNA, 25 bp, Mus musculus
acaagattctttccggttctcagat

SEQ ID NO: 92712 - DNA, 25 bp, Mus musculus
acaagattctttgcggttctcagat

SEQ ID NO: 92713 - DNA, 25 bp, Mus musculus
acaagatttctcactaccagaggta

SEQ ID NO: 92714 - DNA, 25 bp, Mus musculus
acaagatttctctctaccagaggta

SEQ ID NO: 92715 - DNA, 25 bp, Mus musculus
acaagatttttcacccagacacctg

SEQ ID NO: 92716 - DNA, 25 bp, Mus musculus
acaagatttttctcccagacacctg

SEQ ID NO: 92717 - DNA, 25 bp, Mus musculus
acaagcaaaaggactggtaagccag

SEQ ID NO: 92718 - DNA, 25 bp, Mus musculus
acaagcaaaaggtctggtaagccag

SEQ ID NO: 92719 - DNA, 25 bp, Mus musculus
acaagcaaactgacaccatggcaac

SEQ ID NO: 92720 - DNA, 25 bp, Mus musculus
acaagcaaactgtcaccatggcaac

SEQ ID NO: 92721 - DNA, 25 bp, Mus musculus
acaagcaacggtatggcctggtgcc

SEQ ID NO: 92722 - DNA, 25 bp, Mus musculus
acaagcaacggtttggcctggtgcc

SEQ ID NO: 92723 - DNA, 25 bp, Mus musculus
acaagcaagatgagccctcagcctt

SEQ ID NO: 92724 - DNA, 25 bp, Mus musculus
acaagcaagatgtgccctcagcctt

SEQ ID NO: 92725 - DNA, 25 bp, Mus musculus
acaagcaagtcccagcattagtttc

SEQ ID NO: 92726 - DNA, 25 bp, Mus musculus
acaagcaagtccgagcattagtttc

SEQ ID NO: 92727 - DNA, 25 bp, Mus musculus
acaagcaattaacgtagagtctggg

SEQ ID NO: 92728 - DNA, 25 bp, Mus musculus
acaagcaattaaggtagagtctggg

SEQ ID NO: 92729 - DNA, 25 bp, Mus musculus
acaagcaattttatggccgccaccg

SEQ ID NO: 92730 - DNA, 25 bp, Mus musculus
acaagcaattttttggccgccaccg

SEQ ID NO: 92731 - DNA, 25 bp, Mus musculus
acaagcacaaacatctggaagtata

SEQ ID NO: 92732 - DNA, 25 bp, Mus musculus
acaagcacaaacttctggaagtata

SEQ ID NO: 92733 - DNA, 25 bp, Mus musculus
acaagcacacacataaaggcacata

SEQ ID NO: 92734 - DNA, 25 bp, Mus musculus
acaagcacacacttaaaggcacata

SEQ ID NO: 92735 - DNA, 25 bp, Mus musculus
acaagcacagcaaggtaaggccgtt

SEQ ID NO: 92736 - DNA, 25 bp, Mus musculus
acaagcacagcatggtaaggccgtt

SEQ ID NO: 92737 - DNA, 25 bp, Mus musculus
acaagcacaggtacgtcagtttgat

SEQ ID NO: 92738 - DNA, 25 bp, Mus musculus
acaagcacaggttcgtcagtttgat

SEQ ID NO: 92739 - DNA, 25 bp, Mus musculus
acaagcaccatactgtcttactcac

SEQ ID NO: 92740 - DNA, 25 bp, Mus musculus
acaagcaccatagtgtcttactcac

SEQ ID NO: 92741 - DNA, 25 bp, Mus musculus
acaagcacccggacaatctcaaggt

SEQ ID NO: 92742 - DNA, 25 bp, Mus musculus
acaagcacccggtcaatctcaaggt

SEQ ID NO: 92743 - DNA, 25 bp, Mus musculus
acaagcacggctactccttttggtt

SEQ ID NO: 92744 - DNA, 25 bp, Mus musculus
acaagcacggcttctccttttggtt

SEQ ID NO: 92745 - DNA, 25 bp, Mus musculus
acaagcacgtttaccccaacaatcg

SEQ ID NO: 92746 - DNA, 25 bp, Mus musculus
acaagcacgttttccccaacaatcg

SEQ ID NO: 92747 - DNA, 25 bp, Mus musculus
acaagcactccactaacaagtggat

SEQ ID NO: 92748 - DNA, 25 bp, Mus musculus
acaagcactccagtaacaagtggat

SEQ ID NO: 92749 - DNA, 25 bp, Mus musculus
acaagcactctcacttactaagcat

SEQ ID NO: 92750 - DNA, 25 bp, Mus musculus
acaagcactctctcttactaagcat

SEQ ID NO: 92751 - DNA, 25 bp, Mus musculus
acaagcactggcctcacgtgtggca

SEQ ID NO: 92752 - DNA, 25 bp, Mus musculus
acaagcactggcctgttgtcagctc

SEQ ID NO: 92753 - DNA, 25 bp, Mus musculus
acaagcactggcgtcacgtgtggca

SEQ ID NO: 92754 - DNA, 25 bp, Mus musculus
acaagcactggcgtgttgtcagctc

SEQ ID NO: 92755 - DNA, 25 bp, Mus musculus
acaagcactgtgatgagactggtga

SEQ ID NO: 92756 - DNA, 25 bp, Mus musculus
acaagcactgtgttgagactggtga

SEQ ID NO: 92757 - DNA, 25 bp, Mus musculus
acaagcacttaacctattttggcta

SEQ ID NO: 92758 - DNA, 25 bp, Mus musculus
acaagcacttaagctattttggcta

SEQ ID NO: 92759 - DNA, 25 bp, Mus musculus
acaagcagacaaacagcggacagtt

SEQ ID NO: 92760 - DNA, 25 bp, Mus musculus
acaagcagacaatcagcggacagtt

SEQ ID NO: 92761 - DNA, 25 bp, Mus musculus
acaagcagacttcgagcttgctggg

SEQ ID NO: 92762 - DNA, 25 bp, Mus musculus
acaagcagacttggagcttgctggg

SEQ ID NO: 92763 - DNA, 25 bp, Mus musculus
acaagcagcaggctcactcactgct

SEQ ID NO: 92764 - DNA, 25 bp, Mus musculus
acaagcagcagggtcactcactgct

SEQ ID NO: 92765 - DNA, 25 bp, Mus musculus
acaagcagccaccaaggacggaatt

SEQ ID NO: 92766 - DNA, 25 bp, Mus musculus
acaagcagccacgaaggacggaatt

SEQ ID NO: 92767 - DNA, 25 bp, Mus musculus
acaagcagccctatgagaagaaagc

SEQ ID NO: 92768 - DNA, 25 bp, Mus musculus
acaagcagccctttgagaagaaagc

SEQ ID NO: 92769 - DNA, 25 bp, Mus musculus
acaagcagcctgacttcagctttgg

SEQ ID NO: 92770 - DNA, 25 bp, Mus musculus
acaagcagcctgatccagatggaac

SEQ ID NO: 92771 - DNA, 25 bp, Mus musculus
acaagcagcctgtcttcagctttgg

SEQ ID NO: 92772 - DNA, 25 bp, Mus musculus
acaagcagcctgttccagatggaac

SEQ ID NO: 92773 - DNA, 25 bp, Mus musculus
acaagcagcgtcaggaggccagaaa

SEQ ID NO: 92774 - DNA, 25 bp, Mus musculus
acaagcagcgtctggaggccagaaa

SEQ ID NO: 92775 - DNA, 25 bp, Mus musculus
acaagcagctatcatcccttgatga

SEQ ID NO: 92776 - DNA, 25 bp, Mus musculus
acaagcagctatgatcccttgatga

SEQ ID NO: 92777 - DNA, 25 bp, Mus musculus
acaagcagggctactggcctaggta

SEQ ID NO: 92778 - DNA, 25 bp, Mus musculus
acaagcagggcttctggcctaggta

SEQ ID NO: 92779 - DNA, 25 bp, Mus musculus
acaagcagtacgaggcatggcaggt

SEQ ID NO: 92780 - DNA, 25 bp, Mus musculus
acaagcagtacgtggcatggcaggt

SEQ ID NO: 92781 - DNA, 25 bp, Mus musculus
acaagcagtagtatggtggcacctc

SEQ ID NO: 92782 - DNA, 25 bp, Mus musculus
acaagcagtagtttggtggcacctc

SEQ ID NO: 92783 - DNA, 25 bp, Mus musculus
acaagcagtatgacgtctcctatga

SEQ ID NO: 92784 - DNA, 25 bp, Mus musculus
acaagcagtatgtcgtctcctatga

SEQ ID NO: 92785 - DNA, 25 bp, Mus musculus
acaagcagtgaccatcagagggcag

SEQ ID NO: 92786 - DNA, 25 bp, Mus musculus
acaagcagtgacgatcagagggcag

SEQ ID NO: 92787 - DNA, 25 bp, Mus musculus
acaagcagtgggacctaggcaacag

SEQ ID NO: 92788 - DNA, 25 bp, Mus musculus
acaagcagtgggtcctaggcaacag

SEQ ID NO: 92789 - DNA, 25 bp, Mus musculus
acaagcatacggatctctgcacatg

SEQ ID NO: 92790 - DNA, 25 bp, Mus musculus
acaagcatacggttctctgcacatg

SEQ ID NO: 92791 - DNA, 25 bp, Mus musculus
acaagcatacttctcaccaaagcct

SEQ ID NO: 92792 - DNA, 25 bp, Mus musculus
acaagcatacttgtcaccaaagcct

SEQ ID NO: 92793 - DNA, 25 bp, Mus musculus
acaagcatagagctacctttccaaa

SEQ ID NO: 92794 - DNA, 25 bp, Mus musculus
acaagcatagaggtacctttccaaa

SEQ ID NO: 92795 - DNA, 25 bp, Mus musculus
acaagcatattgaagcagtcaagtt

SEQ ID NO: 92796 - DNA, 25 bp, Mus musculus
acaagcatattgtagcagtcaagtt

SEQ ID NO: 92797 - DNA, 25 bp, Mus musculus
acaagcatcacgctacatgggccca

SEQ ID NO: 92798 - DNA, 25 bp, Mus musculus
acaagcatcacggtacatgggccca

SEQ ID NO: 92799 - DNA, 25 bp, Mus musculus
acaagcatccttcagttcacggctt

SEQ ID NO: 92800 - DNA, 25 bp, Mus musculus
acaagcatccttgagttcacggctt

SEQ ID NO: 92801 - DNA, 25 bp, Mus musculus
acaagcatctagagactgtcaatgg

SEQ ID NO: 92802 - DNA, 25 bp, Mus musculus
acaagcatctagtgactgtcaatgg

SEQ ID NO: 92803 - DNA, 25 bp, Mus musculus
acaagcatcttacgcgttgcctcct

SEQ ID NO: 92804 - DNA, 25 bp, Mus musculus
acaagcatcttaggcgttgcctcct

SEQ ID NO: 92805 - DNA, 25 bp, Mus musculus
acaagcatgcatattctggaggaag

SEQ ID NO: 92806 - DNA, 25 bp, Mus musculus
acaagcatgcattttctggaggaag

SEQ ID NO: 92807 - DNA, 25 bp, Mus musculus
acaagcatggagcacgcgtcttcag

SEQ ID NO: 92808 - DNA, 25 bp, Mus musculus
acaagcatggaggacgcgtcttcag

SEQ ID NO: 92809 - DNA, 25 bp, Mus musculus
acaagcatgggcactctgccaggct

SEQ ID NO: 92810 - DNA, 25 bp, Mus musculus
acaagcatgggctctctgccaggct

SEQ ID NO: 92811 - DNA, 25 bp, Mus musculus
acaagcatggtaaatatcggagttc

SEQ ID NO: 92812 - DNA, 25 bp, Mus musculus
acaagcatggtatatatcggagttc

SEQ ID NO: 92813 - DNA, 25 bp, Mus musculus
acaagcatgtttaccttgccttacc

SEQ ID NO: 92814 - DNA, 25 bp, Mus musculus
acaagcatgttttccttgccttacc

SEQ ID NO: 92815 - DNA, 25 bp, Mus musculus
acaagcattgatattatttcctaca

SEQ ID NO: 92816 - DNA, 25 bp, Mus musculus
acaagcattgattttatttcctaca

SEQ ID NO: 92817 - DNA, 25 bp, Mus musculus
acaagcattgctacgggcaaattaa

SEQ ID NO: 92818 - DNA, 25 bp, Mus musculus
acaagcattgcttcgggcaaattaa

SEQ ID NO: 92819 - DNA, 25 bp, Mus musculus
acaagcattggtatttagcctgcct

SEQ ID NO: 92820 - DNA, 25 bp, Mus musculus
acaagcattggtttttagcctgcct

SEQ ID NO: 92821 - DNA, 25 bp, Mus musculus
acaagccaaagcagcatcagtctca

SEQ ID NO: 92822 - DNA, 25 bp, Mus musculus
acaagccaaagctgcatcagtctca

SEQ ID NO: 92823 - DNA, 25 bp, Mus musculus
acaagccaagacagctgaacccatt

SEQ ID NO: 92824 - DNA, 25 bp, Mus musculus
acaagccaagactgctgaacccatt

SEQ ID NO: 92825 - DNA, 25 bp, Mus musculus
acaagccaaggtcgcctcagtgatt

SEQ ID NO: 92826 - DNA, 25 bp, Mus musculus
acaagccaaggtggcctcagtgatt

SEQ ID NO: 92827 - DNA, 25 bp, Mus musculus
acaagccaatcgcagccggagttta

SEQ ID NO: 92828 - DNA, 25 bp, Mus musculus
acaagccaatcggagccggagttta

SEQ ID NO: 92829 - DNA, 25 bp, Mus musculus
acaagccaatgtcctttgactcttt

SEQ ID NO: 92830 - DNA, 25 bp, Mus musculus
acaagccaatgtgctttgactcttt

SEQ ID NO: 92831 - DNA, 25 bp, Mus musculus
acaagccagatacctctgggccctt

SEQ ID NO: 92832 - DNA, 25 bp, Mus musculus
acaagccagatagctctgggccctt

SEQ ID NO: 92833 - DNA, 25 bp, Mus musculus
acaagccagcaaatttttcaagcca

SEQ ID NO: 92834 - DNA, 25 bp, Mus musculus
acaagccagcaattttttcaagcca

SEQ ID NO: 92835 - DNA, 25 bp, Mus musculus
acaagccagtcgagggcatcactag

SEQ ID NO: 92836 - DNA, 25 bp, Mus musculus
acaagccagtcgtgggcatcactag

SEQ ID NO: 92837 - DNA, 25 bp, Mus musculus
acaagccatagaacttgtgtacatt

SEQ ID NO: 92838 - DNA, 25 bp, Mus musculus
acaagccatagatcttgtgtacatt

SEQ ID NO: 92839 - DNA, 25 bp, Mus musculus
acaagccatcctctgcgagaaaagc

SEQ ID NO: 92840 - DNA, 25 bp, Mus musculus
acaagccatcctgtgcgagaaaagc

SEQ ID NO: 92841 - DNA, 25 bp, Mus musculus
acaagccatgtgagtatagggatat

SEQ ID NO: 92842 - DNA, 25 bp, Mus musculus
acaagccatgtgtgtatagggatat

SEQ ID NO: 92843 - DNA, 25 bp, Mus musculus
acaagccatttaacaacttcccagc

SEQ ID NO: 92844 - DNA, 25 bp, Mus musculus
acaagccatttatcaacttcccagc

SEQ ID NO: 92845 - DNA, 25 bp, Mus musculus
acaagcccaatgattatgacttcaa

SEQ ID NO: 92846 - DNA, 25 bp, Mus musculus
acaagcccaatgtttatgacttcaa

SEQ ID NO: 92847 - DNA, 25 bp, Mus musculus
acaagcccacctatgatgagatctt

SEQ ID NO: 92848 - DNA, 25 bp, Mus musculus
acaagcccacctttgatgagatctt

SEQ ID NO: 92849 - DNA, 25 bp, Mus musculus
acaagcccatcacagctctttgaag

SEQ ID NO: 92850 - DNA, 25 bp, Mus musculus
acaagcccatcagagctctttgaag

SEQ ID NO: 92851 - DNA, 25 bp, Mus musculus
acaagcccctagactttgagtctgc

SEQ ID NO: 92852 - DNA, 25 bp, Mus musculus
acaagcccctagtctttgagtctgc

SEQ ID NO: 92853 - DNA, 25 bp, Mus musculus
acaagcccggagatgtcttcaggat

SEQ ID NO: 92854 - DNA, 25 bp, Mus musculus
acaagcccggagttgtcttcaggat

SEQ ID NO: 92855 - DNA, 25 bp, Mus musculus
acaagcccggccatagtgagagttt

SEQ ID NO: 92856 - DNA, 25 bp, Mus musculus
acaagcccggccttagtgagagttt

SEQ ID NO: 92857 - DNA, 25 bp, Mus musculus
acaagccctcatcgtttgagacagg

SEQ ID NO: 92858 - DNA, 25 bp, Mus musculus
acaagccctcatggtttgagacagg

SEQ ID NO: 92859 - DNA, 25 bp, Mus musculus
acaagccctccacgcggtagggtca

SEQ ID NO: 92860 - DNA, 25 bp, Mus musculus
acaagccctccaggcggtagggtca

SEQ ID NO: 92861 - DNA, 25 bp, Mus musculus
acaagcccttaactacatagtaata

SEQ ID NO: 92862 - DNA, 25 bp, Mus musculus
acaagcccttaagtacatagtaata

SEQ ID NO: 92863 - DNA, 25 bp, Mus musculus
acaagccgaagtcatatgataggag

SEQ ID NO: 92864 - DNA, 25 bp, Mus musculus
acaagccgaagtgatatgataggag

SEQ ID NO: 92865 - DNA, 25 bp, Mus musculus
acaagccgactcacagttcttagag

SEQ ID NO: 92866 - DNA, 25 bp, Mus musculus
acaagccgactctcagttcttagag

SEQ ID NO: 92867 - DNA, 25 bp, Mus musculus
acaagccgatatctttcccctaaag

SEQ ID NO: 92868 - DNA, 25 bp, Mus musculus
acaagccgatatgtttcccctaaag

SEQ ID NO: 92869 - DNA, 25 bp, Mus musculus
acaagccgcatcaattttgtccttc

SEQ ID NO: 92870 - DNA, 25 bp, Mus musculus
acaagccgcatctattttgtccttc

SEQ ID NO: 92871 - DNA, 25 bp, Mus musculus
acaagccggaggagatcccacctga

SEQ ID NO: 92872 - DNA, 25 bp, Mus musculus
acaagccggaggtgatcccacctga

SEQ ID NO: 92873 - DNA, 25 bp, Mus musculus
acaagccgtcccaactgatggtgtg

SEQ ID NO: 92874 - DNA, 25 bp, Mus musculus
acaagccgtccctactgatggtgtg

SEQ ID NO: 92875 - DNA, 25 bp, Mus musculus
acaagcctacctataagtgccagca

SEQ ID NO: 92876 - DNA, 25 bp, Mus musculus
acaagcctacctttaagtgccagca

SEQ ID NO: 92877 - DNA, 25 bp, Mus musculus
acaagcctcaccatttcttgagtag

SEQ ID NO: 92878 - DNA, 25 bp, Mus musculus
acaagcctcaccttttcttgagtag

SEQ ID NO: 92879 - DNA, 25 bp, Mus musculus
acaagcctcagtatattcctctata

SEQ ID NO: 92880 - DNA, 25 bp, Mus musculus
acaagcctcagtttattcctctata

SEQ ID NO: 92881 - DNA, 25 bp, Mus musculus
acaagcctctttccatgccagaggg

SEQ ID NO: 92882 - DNA, 25 bp, Mus musculus
acaagcctctttgcatgccagaggg

SEQ ID NO: 92883 - DNA, 25 bp, Mus musculus
acaagcctgggcatcacaagtactt

SEQ ID NO: 92884 - DNA, 25 bp, Mus musculus
acaagcctgggcttcacaagtactt

SEQ ID NO: 92885 - DNA, 25 bp, Mus musculus
acaagcctggtgagatcaaaggtca

SEQ ID NO: 92886 - DNA, 25 bp, Mus musculus
acaagcctggtgtgatcaaaggtca

SEQ ID NO: 92887 - DNA, 25 bp, Mus musculus
acaagccttacacgtgcccggagtg

SEQ ID NO: 92888 - DNA, 25 bp, Mus musculus
acaagccttacaggtgcccggagtg

SEQ ID NO: 92889 - DNA, 25 bp, Mus musculus
acaagccttgcgcatcgaggcgttt

SEQ ID NO: 92890 - DNA, 25 bp, Mus musculus
acaagccttgcggatcgaggcgttt

SEQ ID NO: 92891 - DNA, 25 bp, Mus musculus
acaagcctttgtatgacgctgtcgg

SEQ ID NO: 92892 - DNA, 25 bp, Mus musculus
acaagcctttgtttgacgctgtcgg

SEQ ID NO: 92893 - DNA, 25 bp, Mus musculus
acaagccttttcaaagtatctggtt

SEQ ID NO: 92894 - DNA, 25 bp, Mus musculus
acaagccttttctaagtatctggtt

SEQ ID NO: 92895 - DNA, 25 bp, Mus musculus
acaagcgaagaacaacaacaccaca

SEQ ID NO: 92896 - DNA, 25 bp, Mus musculus
acaagcgaagaagaacaacaccaca

SEQ ID NO: 92897 - DNA, 25 bp, Mus musculus
acaagcgatctcatattttcactcc

SEQ ID NO: 92898 - DNA, 25 bp, Mus musculus
acaagcgatctcttattttcactcc

SEQ ID NO: 92899 - DNA, 25 bp, Mus musculus
acaagcgcaagcacgagcggcggca

SEQ ID NO: 92900 - DNA, 25 bp, Mus musculus
acaagcgcaagctcgagcggcggca

SEQ ID NO: 92901 - DNA, 25 bp, Mus musculus
acaagcgcacaacccgggtcaacat

SEQ ID NO: 92902 - DNA, 25 bp, Mus musculus
acaagcgcacaagccgggtcaacat

SEQ ID NO: 92903 - DNA, 25 bp, Mus musculus
acaagcgcagtgctcacagtcagaa

SEQ ID NO: 92904 - DNA, 25 bp, Mus musculus
acaagcgcagtggtcacagtcagaa

SEQ ID NO: 92905 - DNA, 25 bp, Mus musculus
acaagcgcatccaacgcaagtttgc

SEQ ID NO: 92906 - DNA, 25 bp, Mus musculus
acaagcgcatcctacgcaagtttgc

SEQ ID NO: 92907 - DNA, 25 bp, Mus musculus
acaagcgcgccaacctggcgtcgga

SEQ ID NO: 92908 - DNA, 25 bp, Mus musculus
acaagcgcgccatcctggcgtcgga

SEQ ID NO: 92909 - DNA, 25 bp, Mus musculus
acaagcgcggcacttcctaaaaaga

SEQ ID NO: 92910 - DNA, 25 bp, Mus musculus
acaagcgcggcagttcctaaaaaga

SEQ ID NO: 92911 - DNA, 25 bp, Mus musculus
acaagcggaaacacagagccactgt

SEQ ID NO: 92912 - DNA, 25 bp, Mus musculus
acaagcggaaactcagagccactgt

SEQ ID NO: 92913 - DNA, 25 bp, Mus musculus
acaagcggatgcactatgtgactgc

SEQ ID NO: 92914 - DNA, 25 bp, Mus musculus
acaagcggatgctctatgtgactgc

SEQ ID NO: 92915 - DNA, 25 bp, Mus musculus
acaagcggtcggaggtgaaacacat

SEQ ID NO: 92916 - DNA, 25 bp, Mus musculus
acaagcggtcggtggtgaaacacat

SEQ ID NO: 92917 - DNA, 25 bp, Mus musculus
acaagcgtcctgagatgcgttttcc

SEQ ID NO: 92918 - DNA, 25 bp, Mus musculus
acaagcgtcctgtgatgcgttttcc

SEQ ID NO: 92919 - DNA, 25 bp, Mus musculus
acaagcgtgctgaagagaggctaga

SEQ ID NO: 92920 - DNA, 25 bp, Mus musculus
acaagcgtgctgtagagaggctaga

SEQ ID NO: 92921 - DNA, 25 bp, Mus musculus
acaagcgtgcttcgaaccccagaaa

SEQ ID NO: 92922 - DNA, 25 bp, Mus musculus
acaagcgtgcttggaaccccagaaa

SEQ ID NO: 92923 - DNA, 25 bp, Mus musculus
acaagcgttttgatcgtgtgacctt

SEQ ID NO: 92924 - DNA, 25 bp, Mus musculus
acaagcgttttgttcgtgtgacctt

SEQ ID NO: 92925 - DNA, 25 bp, Mus musculus
acaagctacaagatggcagtgtcaa

SEQ ID NO: 92926 - DNA, 25 bp, Mus musculus
acaagctacaagttggcagtgtcaa

SEQ ID NO: 92927 - DNA, 25 bp, Mus musculus
acaagctacagtccgactggccttc

SEQ ID NO: 92928 - DNA, 25 bp, Mus musculus
acaagctacagtgcgactggccttc

SEQ ID NO: 92929 - DNA, 25 bp, Mus musculus
acaagctacgtcactgatggctgtg

SEQ ID NO: 92930 - DNA, 25 bp, Mus musculus
acaagctacgtctctgatggctgtg

SEQ ID NO: 92931 - DNA, 25 bp, Mus musculus
acaagctactcaactgggcttacaa

SEQ ID NO: 92932 - DNA, 25 bp, Mus musculus
acaagctactcacacagtgcctaga

SEQ ID NO: 92933 - DNA, 25 bp, Mus musculus
acaagctactcagacagtgcctaga

SEQ ID NO: 92934 - DNA, 25 bp, Mus musculus
acaagctactcatctgggcttacaa

SEQ ID NO: 92935 - DNA, 25 bp, Mus musculus
acaagctagggcatctctctagaat

SEQ ID NO: 92936 - DNA, 25 bp, Mus musculus
acaagctagggcttctctctagaat

SEQ ID NO: 92937 - DNA, 25 bp, Mus musculus
acaagctcaggaagtccccagcctt

SEQ ID NO: 92938 - DNA, 25 bp, Mus musculus
acaagctcaggatgtccccagcctt

SEQ ID NO: 92939 - DNA, 25 bp, Mus musculus
acaagctcagtcatttgtctgcctg

SEQ ID NO: 92940 - DNA, 25 bp, Mus musculus
acaagctcagtcttttgtctgcctg

SEQ ID NO: 92941 - DNA, 25 bp, Mus musculus
acaagctcatctatgaggctttttg

SEQ ID NO: 92942 - DNA, 25 bp, Mus musculus
acaagctcatctttgaggctttttg

SEQ ID NO: 92943 - DNA, 25 bp, Mus musculus
acaagctcatttctgtgagatggaa

SEQ ID NO: 92944 - DNA, 25 bp, Mus musculus
acaagctcatttgtgtgagatggaa

SEQ ID NO: 92945 - DNA, 25 bp, Mus musculus
acaagctccaggatgctgcacagca

SEQ ID NO: 92946 - DNA, 25 bp, Mus musculus
acaagctccaggttgctgcacagca

SEQ ID NO: 92947 - DNA, 25 bp, Mus musculus
acaagctcccgtctggctttcgtga

SEQ ID NO: 92948 - DNA, 25 bp, Mus musculus
acaagctcccgtgtggctttcgtga

SEQ ID NO: 92949 - DNA, 25 bp, Mus musculus
acaagctccgagagttggacccaga

SEQ ID NO: 92950 - DNA, 25 bp, Mus musculus
acaagctccgagtgttggacccaga

SEQ ID NO: 92951 - DNA, 25 bp, Mus musculus
acaagctctggtcttttgccttggg

SEQ ID NO: 92952 - DNA, 25 bp, Mus musculus
acaagctctggtgttttgccttggg

SEQ ID NO: 92953 - DNA, 25 bp, Mus musculus
acaagctcttcaagtgtgtgaagca

SEQ ID NO: 92954 - DNA, 25 bp, Mus musculus
acaagctcttcatgtgtgtgaagca

SEQ ID NO: 92955 - DNA, 25 bp, Mus musculus
acaagctgaaacacttacccgagaa

SEQ ID NO: 92956 - DNA, 25 bp, Mus musculus
acaagctgaaactcttacccgagaa

SEQ ID NO: 92957 - DNA, 25 bp, Mus musculus
acaagctgaacacaggcgcccatac

SEQ ID NO: 92958 - DNA, 25 bp, Mus musculus
acaagctgaacagaggcgcccatac

SEQ ID NO: 92959 - DNA, 25 bp, Mus musculus
acaagctgaacgattgtgcttcccg

SEQ ID NO: 92960 - DNA, 25 bp, Mus musculus
acaagctgaacgtttgtgcttcccg

SEQ ID NO: 92961 - DNA, 25 bp, Mus musculus
acaagctgacggaggacactcggca

SEQ ID NO: 92962 - DNA, 25 bp, Mus musculus
acaagctgacggtggacactcggca

SEQ ID NO: 92963 - DNA, 25 bp, Mus musculus
acaagctgcactctgaaacccgggc

SEQ ID NO: 92964 - DNA, 25 bp, Mus musculus
acaagctgcactgtgaaacccgggc

SEQ ID NO: 92965 - DNA, 25 bp, Mus musculus
acaagctgcagcacttagctcacag

SEQ ID NO: 92966 - DNA, 25 bp, Mus musculus
acaagctgcagctcttagctcacag

SEQ ID NO: 92967 - DNA, 25 bp, Mus musculus
acaagctgcattacaaactctgaag

SEQ ID NO: 92968 - DNA, 25 bp, Mus musculus
acaagctgcattacagagacctgca

SEQ ID NO: 92969 - DNA, 25 bp, Mus musculus
acaagctgcatttcaaactctgaag

SEQ ID NO: 92970 - DNA, 25 bp, Mus musculus
acaagctgcatttcagagacctgca

SEQ ID NO: 92971 - DNA, 25 bp, Mus musculus
acaagctgccctacccttatgatga

SEQ ID NO: 92972 - DNA, 25 bp, Mus musculus
acaagctgcccttcccttatgatga

SEQ ID NO: 92973 - DNA, 25 bp, Mus musculus
acaagctgcggaaacgggaggcctt

SEQ ID NO: 92974 - DNA, 25 bp, Mus musculus
acaagctgcggacgttcaggcccca

SEQ ID NO: 92975 - DNA, 25 bp, Mus musculus
acaagctgcggaggttcaggcccca

SEQ ID NO: 92976 - DNA, 25 bp, Mus musculus
acaagctgcggatacgggaggcctt

SEQ ID NO: 92977 - DNA, 25 bp, Mus musculus
acaagctgcttgagggatgtgtcac

SEQ ID NO: 92978 - DNA, 25 bp, Mus musculus
acaagctgcttgtgggatgtgtcac

SEQ ID NO: 92979 - DNA, 25 bp, Mus musculus
acaagctggatgctgcacctggtct

SEQ ID NO: 92980 - DNA, 25 bp, Mus musculus
acaagctggatggtgcacctggtct

SEQ ID NO: 92981 - DNA, 25 bp, Mus musculus
acaagctggctcctgctcagtatat

SEQ ID NO: 92982 - DNA, 25 bp, Mus musculus
acaagctggctcgtgctcagtatat

SEQ ID NO: 92983 - DNA, 25 bp, Mus musculus
acaagctgggctcggttctgagcat

SEQ ID NO: 92984 - DNA, 25 bp, Mus musculus
acaagctgggctgggttctgagcat

SEQ ID NO: 92985 - DNA, 25 bp, Mus musculus
acaagctggttcatgggacggcgac

SEQ ID NO: 92986 - DNA, 25 bp, Mus musculus
acaagctggttcttgggacggcgac

SEQ ID NO: 92987 - DNA, 25 bp, Mus musculus
acaagctgtgtgagcgctacgccat

SEQ ID NO: 92988 - DNA, 25 bp, Mus musculus
acaagctgtgtgtgcgctacgccat

SEQ ID NO: 92989 - DNA, 25 bp, Mus musculus
acaagctgttcaactgtatttccaa

SEQ ID NO: 92990 - DNA, 25 bp, Mus musculus
acaagctgttcatctgtatttccaa

SEQ ID NO: 92991 - DNA, 25 bp, Mus musculus
acaagcttacagataggtgaccaga

SEQ ID NO: 92992 - DNA, 25 bp, Mus musculus
acaagcttacagttaggtgaccaga

SEQ ID NO: 92993 - DNA, 25 bp, Mus musculus
acaagcttagctcctgtccatcagt

SEQ ID NO: 92994 - DNA, 25 bp, Mus musculus
acaagcttagctgctgtccatcagt

SEQ ID NO: 92995 - DNA, 25 bp, Mus musculus
acaagcttattacatggatgaactt

SEQ ID NO: 92996 - DNA, 25 bp, Mus musculus
acaagcttattagatggatgaactt

SEQ ID NO: 92997 - DNA, 25 bp, Mus musculus
acaagcttcactattctcatttacc

SEQ ID NO: 92998 - DNA, 25 bp, Mus musculus
acaagcttcacttttctcatttacc

SEQ ID NO: 92999 - DNA, 25 bp, Mus musculus
acaagcttcaggacatcaggtcggt

SEQ ID NO: 93000 - DNA, 25 bp, Mus musculus
acaagcttcaggtcatcaggtcggt

SEQ ID NO: 93001 - DNA, 25 bp, Mus musculus
acaagcttccaaatctacaccaaaa

SEQ ID NO: 93002 - DNA, 25 bp, Mus musculus
acaagcttccaattctacaccaaaa

SEQ ID NO: 93003 - DNA, 25 bp, Mus musculus
acaagcttcctacagccacgacaag

SEQ ID NO: 93004 - DNA, 25 bp, Mus musculus
acaagcttcctagagccacgacaag

SEQ ID NO: 93005 - DNA, 25 bp, Mus musculus
acaagcttctatctgattttcctga

SEQ ID NO: 93006 - DNA, 25 bp, Mus musculus
acaagcttctatgtgattttcctga

SEQ ID NO: 93007 - DNA, 25 bp, Mus musculus
acaagcttcttgatttattccttct

SEQ ID NO: 93008 - DNA, 25 bp, Mus musculus
acaagcttcttgttttattccttct

SEQ ID NO: 93009 - DNA, 25 bp, Mus musculus
acaagcttgactcactgactcaggc

SEQ ID NO: 93010 - DNA, 25 bp, Mus musculus
acaagcttgactgactgactcaggc

SEQ ID NO: 93011 - DNA, 25 bp, Mus musculus
acaagcttgcgacatcctgcagcgt

SEQ ID NO: 93012 - DNA, 25 bp, Mus musculus
acaagcttgcgagatcctgcagcgt

SEQ ID NO: 93013 - DNA, 25 bp, Mus musculus
acaagcttgtcgaggtggacttctc

SEQ ID NO: 93014 - DNA, 25 bp, Mus musculus
acaagcttgtcgtggtggacttctc

SEQ ID NO: 93015 - DNA, 25 bp, Mus musculus
acaagctttactattgtgcagttaa

SEQ ID NO: 93016 - DNA, 25 bp, Mus musculus
acaagctttacttttgtgcagttaa

SEQ ID NO: 93017 - DNA, 25 bp, Mus musculus
acaagctttgtgatctggagagttt

SEQ ID NO: 93018 - DNA, 25 bp, Mus musculus
acaagctttgtgttctggagagttt

SEQ ID NO: 93019 - DNA, 25 bp, Mus musculus
acaagcttttccaatgatctccaaa

SEQ ID NO: 93020 - DNA, 25 bp, Mus musculus
acaagcttttcctatgatctccaaa

SEQ ID NO: 93021 - DNA, 25 bp, Mus musculus
acaaggaacccacacctgaaagaag

SEQ ID NO: 93022 - DNA, 25 bp, Mus musculus
acaaggaacccagacctgaaagaag

SEQ ID NO: 93023 - DNA, 25 bp, Mus musculus
acaaggaacttcaacgtgatgattt

SEQ ID NO: 93024 - DNA, 25 bp, Mus musculus
acaaggaacttctacgtgatgattt

SEQ ID NO: 93025 - DNA, 25 bp, Mus musculus
acaaggaagctccaccgggtgctga

SEQ ID NO: 93026 - DNA, 25 bp, Mus musculus
acaaggaagctcgaccgggtgctga

SEQ ID NO: 93027 - DNA, 25 bp, Mus musculus
acaaggaaggccagtggtctcccac

SEQ ID NO: 93028 - DNA, 25 bp, Mus musculus
acaaggaaggcctgtggtctcccac

SEQ ID NO: 93029 - DNA, 25 bp, Mus musculus
acaaggaaggttcctagccacaggg

SEQ ID NO: 93030 - DNA, 25 bp, Mus musculus
acaaggaaggttgctagccacaggg

SEQ ID NO: 93031 - DNA, 25 bp, Mus musculus
acaaggaagtatcagcaagtctggg

SEQ ID NO: 93032 - DNA, 25 bp, Mus musculus
acaaggaagtatgagcaagtctggg

SEQ ID NO: 93033 - DNA, 25 bp, Mus musculus
acaaggaattttctcgatttcacga

SEQ ID NO: 93034 - DNA, 25 bp, Mus musculus
acaaggaattttgtcgatttcacga

SEQ ID NO: 93035 - DNA, 25 bp, Mus musculus
acaaggacaaagctaccattgggtt

SEQ ID NO: 93036 - DNA, 25 bp, Mus musculus
acaaggacaaaggtaccattgggtt

SEQ ID NO: 93037 - DNA, 25 bp, Mus musculus
acaaggacaagtatctgcgagagca

SEQ ID NO: 93038 - DNA, 25 bp, Mus musculus
acaaggacaagtttctgcgagagca

SEQ ID NO: 93039 - DNA, 25 bp, Mus musculus
acaaggacagtgactgggtttggtc

SEQ ID NO: 93040 - DNA, 25 bp, Mus musculus
acaaggacagtgtctgggtttggtc

SEQ ID NO: 93041 - DNA, 25 bp, Mus musculus
acaaggaccaacctgcacccgtgtg

SEQ ID NO: 93042 - DNA, 25 bp, Mus musculus
acaaggaccaacgtgcacccgtgtg

SEQ ID NO: 93043 - DNA, 25 bp, Mus musculus
acaaggaccaccagaaatatacagt

SEQ ID NO: 93044 - DNA, 25 bp, Mus musculus
acaaggaccacctgaaatatacagt

SEQ ID NO: 93045 - DNA, 25 bp, Mus musculus
acaaggaccatgagatggtgcggct

SEQ ID NO: 93046 - DNA, 25 bp, Mus musculus
acaaggaccatgtgatggtgcggct

SEQ ID NO: 93047 - DNA, 25 bp, Mus musculus
acaaggacccatctagccatccagg

SEQ ID NO: 93048 - DNA, 25 bp, Mus musculus
acaaggacccatgtagccatccagg

SEQ ID NO: 93049 - DNA, 25 bp, Mus musculus
acaaggaccccaccagacactgtag

SEQ ID NO: 93050 - DNA, 25 bp, Mus musculus
acaaggaccccagcagacactgtag

SEQ ID NO: 93051 - DNA, 25 bp, Mus musculus
acaaggacccctagaaatagaacat

SEQ ID NO: 93052 - DNA, 25 bp, Mus musculus
acaaggaccccttgaaatagaacat

SEQ ID NO: 93053 - DNA, 25 bp, Mus musculus
acaaggaccgcacccaccgggaaga

SEQ ID NO: 93054 - DNA, 25 bp, Mus musculus
acaaggaccgcagccaccgggaaga

SEQ ID NO: 93055 - DNA, 25 bp, Mus musculus
acaaggacctctctggtattacggg

SEQ ID NO: 93056 - DNA, 25 bp, Mus musculus
acaaggacctctgtggtattacggg

SEQ ID NO: 93057 - DNA, 25 bp, Mus musculus
acaaggacggacatgcacagagaga

SEQ ID NO: 93058 - DNA, 25 bp, Mus musculus
acaaggacggacttgcacagagaga

SEQ ID NO: 93059 - DNA, 25 bp, Mus musculus
acaaggacggcgaggtgaccattga

SEQ ID NO: 93060 - DNA, 25 bp, Mus musculus
acaaggacggcgtggtgaccattga

SEQ ID NO: 93061 - DNA, 25 bp, Mus musculus
acaaggacgggacacatcatcaggg

SEQ ID NO: 93062 - DNA, 25 bp, Mus musculus
acaaggacgggagacatcatcaggg

SEQ ID NO: 93063 - DNA, 25 bp, Mus musculus
acaaggactgttcatgctaagcaaa

SEQ ID NO: 93064 - DNA, 25 bp, Mus musculus
acaaggactgttgatgctaagcaaa

SEQ ID NO: 93065 - DNA, 25 bp, Mus musculus
acaaggacttccagctgtctggtct

SEQ ID NO: 93066 - DNA, 25 bp, Mus musculus
acaaggacttcccttgtctgatggt

SEQ ID NO: 93067 - DNA, 25 bp, Mus musculus
acaaggacttccgttgtctgatggt

SEQ ID NO: 93068 - DNA, 25 bp, Mus musculus
acaaggacttcctgctgtctggtct

SEQ ID NO: 93069 - DNA, 25 bp, Mus musculus
acaaggactttacacactgccctat

SEQ ID NO: 93070 - DNA, 25 bp, Mus musculus
acaaggactttagacactgccctat

SEQ ID NO: 93071 - DNA, 25 bp, Mus musculus
acaaggagatctctggagtttttct

SEQ ID NO: 93072 - DNA, 25 bp, Mus musculus
acaaggagatctgtggagtttttct

SEQ ID NO: 93073 - DNA, 25 bp, Mus musculus
acaaggagattgacagtggcctcaa

SEQ ID NO: 93074 - DNA, 25 bp, Mus musculus
acaaggagattgtcagtggcctcaa

SEQ ID NO: 93075 - DNA, 25 bp, Mus musculus
acaaggagcaacctatgtggctaaa

SEQ ID NO: 93076 - DNA, 25 bp, Mus musculus
acaaggagcaacgtatgtggctaaa

SEQ ID NO: 93077 - DNA, 25 bp, Mus musculus
acaaggagcatgagaagatgaagca

SEQ ID NO: 93078 - DNA, 25 bp, Mus musculus
acaaggagcatgtgaagatgaagca

SEQ ID NO: 93079 - DNA, 25 bp, Mus musculus
acaaggagccaaacacagccaatag

SEQ ID NO: 93080 - DNA, 25 bp, Mus musculus
acaaggagccaatcacagccaatag

SEQ ID NO: 93081 - DNA, 25 bp, Mus musculus
acaaggagcctaaagataacgccaa

SEQ ID NO: 93082 - DNA, 25 bp, Mus musculus
acaaggagcctatagataacgccaa

SEQ ID NO: 93083 - DNA, 25 bp, Mus musculus
acaaggagcgccagcgtttccagtt

SEQ ID NO: 93084 - DNA, 25 bp, Mus musculus
acaaggagcgcctgcgtttccagtt

SEQ ID NO: 93085 - DNA, 25 bp, Mus musculus
acaaggagcgctctgtcatcagtta

SEQ ID NO: 93086 - DNA, 25 bp, Mus musculus
acaaggagcgctgtgtcatcagtta

SEQ ID NO: 93087 - DNA, 25 bp, Mus musculus
acaaggagtaacaccctgcccctgt

SEQ ID NO: 93088 - DNA, 25 bp, Mus musculus
acaaggagtaactccctgcccctgt

SEQ ID NO: 93089 - DNA, 25 bp, Mus musculus
acaaggagtcgcagcctgccgaaag

SEQ ID NO: 93090 - DNA, 25 bp, Mus musculus
acaaggagtcgctgcctgccgaaag

SEQ ID NO: 93091 - DNA, 25 bp, Mus musculus
acaaggagtgatcgcaccagcagga

SEQ ID NO: 93092 - DNA, 25 bp, Mus musculus
acaaggagtgatggcaccagcagga

SEQ ID NO: 93093 - DNA, 25 bp, Mus musculus
acaaggataaccagcaacgaccccg

SEQ ID NO: 93094 - DNA, 25 bp, Mus musculus
acaaggataacctgcaacgaccccg

SEQ ID NO: 93095 - DNA, 25 bp, Mus musculus
acaaggatccatcatcttggcacat

SEQ ID NO: 93096 - DNA, 25 bp, Mus musculus
acaaggatccatgatcttggcacat

SEQ ID NO: 93097 - DNA, 25 bp, Mus musculus
acaaggatctcgcacatgtgtgtgt

SEQ ID NO: 93098 - DNA, 25 bp, Mus musculus
acaaggatctcggacatgtgtgtgt

SEQ ID NO: 93099 - DNA, 25 bp, Mus musculus
acaaggatggtcacgcccagacgac

SEQ ID NO: 93100 - DNA, 25 bp, Mus musculus
acaaggatggtctcgcccagacgac

SEQ ID NO: 93101 - DNA, 25 bp, Mus musculus
acaaggatggttccatcaccaagga

SEQ ID NO: 93102 - DNA, 25 bp, Mus musculus
acaaggatggttgcatcaccaagga

SEQ ID NO: 93103 - DNA, 25 bp, Mus musculus
acaaggatgtgtacagggacccagc

SEQ ID NO: 93104 - DNA, 25 bp, Mus musculus
acaaggatgtgttcagggacccagc

SEQ ID NO: 93105 - DNA, 25 bp, Mus musculus
acaaggcaaaggagaactctgggtt

SEQ ID NO: 93106 - DNA, 25 bp, Mus musculus
acaaggcaaaggtgaactctgggtt

SEQ ID NO: 93107 - DNA, 25 bp, Mus musculus
acaaggcaagacaggaagccaccct

SEQ ID NO: 93108 - DNA, 25 bp, Mus musculus
acaaggcaagactggaagccaccct

SEQ ID NO: 93109 - DNA, 25 bp, Mus musculus
acaaggcacgggactaagcacacag

SEQ ID NO: 93110 - DNA, 25 bp, Mus musculus
acaaggcacgggtctaagcacacag

SEQ ID NO: 93111 - DNA, 25 bp, Mus musculus
acaaggcactcaaatgtcacctagg

SEQ ID NO: 93112 - DNA, 25 bp, Mus musculus
acaaggcactcatatgtcacctagg

SEQ ID NO: 93113 - DNA, 25 bp, Mus musculus
acaaggcactttccccttcatggtg

SEQ ID NO: 93114 - DNA, 25 bp, Mus musculus
acaaggcactttgcccttcatggtg

SEQ ID NO: 93115 - DNA, 25 bp, Mus musculus
acaaggcagactccccggtgtcttt

SEQ ID NO: 93116 - DNA, 25 bp, Mus musculus
acaaggcagactgcccggtgtcttt

SEQ ID NO: 93117 - DNA, 25 bp, Mus musculus
acaaggcagagcatagagtttcatt

SEQ ID NO: 93118 - DNA, 25 bp, Mus musculus
acaaggcagagcttagagtttcatt

SEQ ID NO: 93119 - DNA, 25 bp, Mus musculus
acaaggcagcagaatggtcaggact

SEQ ID NO: 93120 - DNA, 25 bp, Mus musculus
acaaggcagcagtatggtcaggact

SEQ ID NO: 93121 - DNA, 25 bp, Mus musculus
acaaggcagcttctctggacaggca

SEQ ID NO: 93122 - DNA, 25 bp, Mus musculus
acaaggcagcttgtctggacaggca

SEQ ID NO: 93123 - DNA, 25 bp, Mus musculus
acaaggcagtagatagcaaatataa

SEQ ID NO: 93124 - DNA, 25 bp, Mus musculus
acaaggcagtagttagcaaatataa

SEQ ID NO: 93125 - DNA, 25 bp, Mus musculus
acaaggcagtgtactatcgcaacct

SEQ ID NO: 93126 - DNA, 25 bp, Mus musculus
acaaggcagtgttctatcgcaacct

SEQ ID NO: 93127 - DNA, 25 bp, Mus musculus
acaaggcatggtatgtggttcctga

SEQ ID NO: 93128 - DNA, 25 bp, Mus musculus
acaaggcatggtttgtggttcctga

SEQ ID NO: 93129 - DNA, 25 bp, Mus musculus
acaaggccaagaagcgcaacctgga

SEQ ID NO: 93130 - DNA, 25 bp, Mus musculus
acaaggccaagatgcgcaacctgga

SEQ ID NO: 93131 - DNA, 25 bp, Mus musculus
acaaggccaatcatcatgctcttat

SEQ ID NO: 93132 - DNA, 25 bp, Mus musculus
acaaggccaatcttcatgctcttat

SEQ ID NO: 93133 - DNA, 25 bp, Mus musculus
acaaggccacatctatacaagatgt

SEQ ID NO: 93134 - DNA, 25 bp, Mus musculus
acaaggccacatgtatacaagatgt

SEQ ID NO: 93135 - DNA, 25 bp, Mus musculus
acaaggccagatatacccttctcgc

SEQ ID NO: 93136 - DNA, 25 bp, Mus musculus
acaaggccagatttacccttctcgc

SEQ ID NO: 93137 - DNA, 25 bp, Mus musculus
acaaggccaggtctccaggagcaca

SEQ ID NO: 93138 - DNA, 25 bp, Mus musculus
acaaggccaggtgtccaggagcaca

SEQ ID NO: 93139 - DNA, 25 bp, Mus musculus
acaaggcccacacatacggcgaatg

SEQ ID NO: 93140 - DNA, 25 bp, Mus musculus
acaaggcccacagatacggcgaatg

SEQ ID NO: 93141 - DNA, 25 bp, Mus musculus
acaaggcccagcaataagaaggtgc

SEQ ID NO: 93142 - DNA, 25 bp, Mus musculus
acaaggcccagccactttgaagagg

SEQ ID NO: 93143 - DNA, 25 bp, Mus musculus
acaaggcccagcgactttgaagagg

SEQ ID NO: 93144 - DNA, 25 bp, Mus musculus
acaaggcccagctataagaaggtgc

SEQ ID NO: 93145 - DNA, 25 bp, Mus musculus
acaaggccccggagtggaatgacga

SEQ ID NO: 93146 - DNA, 25 bp, Mus musculus
acaaggccccggtgtggaatgacga

SEQ ID NO: 93147 - DNA, 25 bp, Mus musculus
acaaggcccgtgagagctccagttg

SEQ ID NO: 93148 - DNA, 25 bp, Mus musculus
acaaggcccgtgtgagctccagttg

SEQ ID NO: 93149 - DNA, 25 bp, Mus musculus
acaaggcctacccaaagcacagaaa

SEQ ID NO: 93150 - DNA, 25 bp, Mus musculus
acaaggcctaccgaaagcacagaaa

SEQ ID NO: 93151 - DNA, 25 bp, Mus musculus
acaaggcctcccactgttgacagct

SEQ ID NO: 93152 - DNA, 25 bp, Mus musculus
acaaggcctccctctgttgacagct

SEQ ID NO: 93153 - DNA, 25 bp, Mus musculus
acaaggcctggactcgggtcctgtc

SEQ ID NO: 93154 - DNA, 25 bp, Mus musculus
acaaggcctggagtcgggtcctgtc

SEQ ID NO: 93155 - DNA, 25 bp, Mus musculus
acaaggcctgtgcagaggaggaaga

SEQ ID NO: 93156 - DNA, 25 bp, Mus musculus
acaaggcctgtggagaggaggaaga

SEQ ID NO: 93157 - DNA, 25 bp, Mus musculus
acaaggccttagatgctgagcacct

SEQ ID NO: 93158 - DNA, 25 bp, Mus musculus
acaaggccttagttgctgagcacct

SEQ ID NO: 93159 - DNA, 25 bp, Mus musculus
acaaggccttctcgatcaggatgca

SEQ ID NO: 93160 - DNA, 25 bp, Mus musculus
acaaggccttctggatcaggatgca

SEQ ID NO: 93161 - DNA, 25 bp, Mus musculus
acaaggccttgcatttgagaaggtt

SEQ ID NO: 93162 - DNA, 25 bp, Mus musculus
acaaggccttgcttttgagaaggtt

SEQ ID NO: 93163 - DNA, 25 bp, Mus musculus
acaaggcgcctaagcacttcatggt

SEQ ID NO: 93164 - DNA, 25 bp, Mus musculus
acaaggcgcctatgcacttcatggt

SEQ ID NO: 93165 - DNA, 25 bp, Mus musculus
acaaggcgcgcacggtcattcagac

SEQ ID NO: 93166 - DNA, 25 bp, Mus musculus
acaaggcgcgcagggtcattcagac

SEQ ID NO: 93167 - DNA, 25 bp, Mus musculus
acaaggcgctcaagggtttcaggga

SEQ ID NO: 93168 - DNA, 25 bp, Mus musculus
acaaggcgctcatgggtttcaggga

SEQ ID NO: 93169 - DNA, 25 bp, Mus musculus
acaaggcgctggcaggtccctgtac

SEQ ID NO: 93170 - DNA, 25 bp, Mus musculus
acaaggcgctgggaggtccctgtac

SEQ ID NO: 93171 - DNA, 25 bp, Mus musculus
acaaggcggacgagggcgtgcttca

SEQ ID NO: 93172 - DNA, 25 bp, Mus musculus
acaaggcggacgtgggcgtgcttca

SEQ ID NO: 93173 - DNA, 25 bp, Mus musculus
acaaggcggaggagccactgctaac

SEQ ID NO: 93174 - DNA, 25 bp, Mus musculus
acaaggcggaggtgccactgctaac

SEQ ID NO: 93175 - DNA, 25 bp, Mus musculus
acaaggcgggccagtcatgtgcaag

SEQ ID NO: 93176 - DNA, 25 bp, Mus musculus
acaaggcgggcctgtcatgtgcaag

SEQ ID NO: 93177 - DNA, 25 bp, Mus musculus
acaaggctatgcatctcctgtcact

SEQ ID NO: 93178 - DNA, 25 bp, Mus musculus
acaaggctatgcttctcctgtcact

SEQ ID NO: 93179 - DNA, 25 bp, Mus musculus
acaaggctctgaagtggccctgtgt

SEQ ID NO: 93180 - DNA, 25 bp, Mus musculus
acaaggctctgatgtggccctgtgt

SEQ ID NO: 93181 - DNA, 25 bp, Mus musculus
acaaggctcttcaattcctgaaaga

SEQ ID NO: 93182 - DNA, 25 bp, Mus musculus
acaaggctcttctattcctgaaaga

SEQ ID NO: 93183 - DNA, 25 bp, Mus musculus
acaaggctgcatcggcgtgtacctt

SEQ ID NO: 93184 - DNA, 25 bp, Mus musculus
acaaggctgcatgggcgtgtacctt

SEQ ID NO: 93185 - DNA, 25 bp, Mus musculus
acaaggctgctgcattttcaaggct

SEQ ID NO: 93186 - DNA, 25 bp, Mus musculus
acaaggctgctggattttcaaggct

SEQ ID NO: 93187 - DNA, 25 bp, Mus musculus
acaaggctgcttacctgagtatgac

SEQ ID NO: 93188 - DNA, 25 bp, Mus musculus
acaaggctgctttcctgagtatgac

SEQ ID NO: 93189 - DNA, 25 bp, Mus musculus
acaaggctggagatgctctcagagc

SEQ ID NO: 93190 - DNA, 25 bp, Mus musculus
acaaggctggagttgctctcagagc

SEQ ID NO: 93191 - DNA, 25 bp, Mus musculus
acaaggctgggcatcaaacctccgg

SEQ ID NO: 93192 - DNA, 25 bp, Mus musculus
acaaggctgggcttcaaacctccgg

SEQ ID NO: 93193 - DNA, 25 bp, Mus musculus
acaaggctggtcatcctggactgaa

SEQ ID NO: 93194 - DNA, 25 bp, Mus musculus
acaaggctggtcttcctggactgaa

SEQ ID NO: 93195 - DNA, 25 bp, Mus musculus
acaaggctgtctatcagttgtaaca

SEQ ID NO: 93196 - DNA, 25 bp, Mus musculus
acaaggctgtctttcagttgtaaca

SEQ ID NO: 93197 - DNA, 25 bp, Mus musculus
acaaggctgtgcatccaatgtgtcc

SEQ ID NO: 93198 - DNA, 25 bp, Mus musculus
acaaggctgtgcttccaatgtgtcc

SEQ ID NO: 93199 - DNA, 25 bp, Mus musculus
acaaggcttacacggatgagctggt

SEQ ID NO: 93200 - DNA, 25 bp, Mus musculus
acaaggcttacagggatgagctggt

SEQ ID NO: 93201 - DNA, 25 bp, Mus musculus
acaaggcttccaagtccagtgagag

SEQ ID NO: 93202 - DNA, 25 bp, Mus musculus
acaaggcttccatgtccagtgagag

SEQ ID NO: 93203 - DNA, 25 bp, Mus musculus
acaaggcttcgaagtacctgcacgt

SEQ ID NO: 93204 - DNA, 25 bp, Mus musculus
acaaggcttcgatgtacctgcacgt

SEQ ID NO: 93205 - DNA, 25 bp, Mus musculus
acaaggcttctgagaatggccacta

SEQ ID NO: 93206 - DNA, 25 bp, Mus musculus
acaaggcttctgtgaatggccacta

SEQ ID NO: 93207 - DNA, 25 bp, Mus musculus
acaagggaacttactgcgttctgca

SEQ ID NO: 93208 - DNA, 25 bp, Mus musculus
acaagggaactttctgcgttctgca

SEQ ID NO: 93209 - DNA, 25 bp, Mus musculus
acaagggaccagagcaggtgatcca

SEQ ID NO: 93210 - DNA, 25 bp, Mus musculus
acaagggaccagtgcaggtgatcca

SEQ ID NO: 93211 - DNA, 25 bp, Mus musculus
acaagggaccctatggctaccattg

SEQ ID NO: 93212 - DNA, 25 bp, Mus musculus
acaagggaccctttggctaccattg

SEQ ID NO: 93213 - DNA, 25 bp, Mus musculus
acaagggactgtacactgctgtcat

SEQ ID NO: 93214 - DNA, 25 bp, Mus musculus
acaagggactgttcactgctgtcat

SEQ ID NO: 93215 - DNA, 25 bp, Mus musculus
acaagggagacaaattttactcata

SEQ ID NO: 93216 - DNA, 25 bp, Mus musculus
acaagggagacatattttactcata

SEQ ID NO: 93217 - DNA, 25 bp, Mus musculus
acaagggagacgacgccaggtgtca

SEQ ID NO: 93218 - DNA, 25 bp, Mus musculus
acaagggagacgtcgccaggtgtca

SEQ ID NO: 93219 - DNA, 25 bp, Mus musculus
acaagggagatcaggccccgcgtct

SEQ ID NO: 93220 - DNA, 25 bp, Mus musculus
acaagggagatctggccccgcgtct

SEQ ID NO: 93221 - DNA, 25 bp, Mus musculus
acaagggatcctcccctattctgac

SEQ ID NO: 93222 - DNA, 25 bp, Mus musculus
acaagggatcctgccctattctgac

SEQ ID NO: 93223 - DNA, 25 bp, Mus musculus
acaagggcaagcataaaacagcagg

SEQ ID NO: 93224 - DNA, 25 bp, Mus musculus
acaagggcaagcttaaaacagcagg

SEQ ID NO: 93225 - DNA, 25 bp, Mus musculus
acaagggcaccacgcaggcttagtg

SEQ ID NO: 93226 - DNA, 25 bp, Mus musculus
acaagggcaccaggcaggcttagtg

SEQ ID NO: 93227 - DNA, 25 bp, Mus musculus
acaagggcatttattctacattaga

SEQ ID NO: 93228 - DNA, 25 bp, Mus musculus
acaagggcattttttctacattaga

SEQ ID NO: 93229 - DNA, 25 bp, Mus musculus
acaagggcctagacctgagagtcca

SEQ ID NO: 93230 - DNA, 25 bp, Mus musculus
acaagggcctagtcctgagagtcca

SEQ ID NO: 93231 - DNA, 25 bp, Mus musculus
acaagggcgccacctatgtgttccg

SEQ ID NO: 93232 - DNA, 25 bp, Mus musculus
acaagggcgccagctatgtgttccg

SEQ ID NO: 93233 - DNA, 25 bp, Mus musculus
acaagggctgtcattttcacatcgg

SEQ ID NO: 93234 - DNA, 25 bp, Mus musculus
acaagggctgtctttttcacatcgg

SEQ ID NO: 93235 - DNA, 25 bp, Mus musculus
acaagggtagtgaagactcctctca

SEQ ID NO: 93236 - DNA, 25 bp, Mus musculus
acaagggtagtgtagactcctctca

SEQ ID NO: 93237 - DNA, 25 bp, Mus musculus
acaagggtcaaaatcgtattgcaag

SEQ ID NO: 93238 - DNA, 25 bp, Mus musculus
acaagggtcaaattcgtattgcaag

SEQ ID NO: 93239 - DNA, 25 bp, Mus musculus
acaagggtcctacacgtgtctgcac

SEQ ID NO: 93240 - DNA, 25 bp, Mus musculus
acaagggtcctagacgtgtctgcac

SEQ ID NO: 93241 - DNA, 25 bp, Mus musculus
acaagggtccttcttgtctatactc

SEQ ID NO: 93242 - DNA, 25 bp, Mus musculus
acaagggtccttgttgtctatactc

SEQ ID NO: 93243 - DNA, 25 bp, Mus musculus
acaagggtggacacactcagggctc

SEQ ID NO: 93244 - DNA, 25 bp, Mus musculus
acaagggtggactcactcagggctc

SEQ ID NO: 93245 - DNA, 25 bp, Mus musculus
acaagggtgtgtaactcgagttcta

SEQ ID NO: 93246 - DNA, 25 bp, Mus musculus
acaagggtgtgttactcgagttcta

SEQ ID NO: 93247 - DNA, 25 bp, Mus musculus
acaagggttcagaaccatgcgaggt

SEQ ID NO: 93248 - DNA, 25 bp, Mus musculus
acaagggttcagtaccatgcgaggt

SEQ ID NO: 93249 - DNA, 25 bp, Mus musculus
acaagggtttctcagcttactgtca

SEQ ID NO: 93250 - DNA, 25 bp, Mus musculus
acaagggtttctgagcttactgtca

SEQ ID NO: 93251 - DNA, 25 bp, Mus musculus
acaaggtaaagacagccattgagtt

SEQ ID NO: 93252 - DNA, 25 bp, Mus musculus
acaaggtaaagagagccattgagtt

SEQ ID NO: 93253 - DNA, 25 bp, Mus musculus
acaaggtaactgctgtcatttaaga

SEQ ID NO: 93254 - DNA, 25 bp, Mus musculus
acaaggtaactggtgtcatttaaga

SEQ ID NO: 93255 - DNA, 25 bp, Mus musculus
acaaggtaatagaggccctgcctac

SEQ ID NO: 93256 - DNA, 25 bp, Mus musculus
acaaggtaatagaggtgcctgccat

SEQ ID NO: 93257 - DNA, 25 bp, Mus musculus
acaaggtaatagtggccctgcctac

SEQ ID NO: 93258 - DNA, 25 bp, Mus musculus
acaaggtaatagtggtgcctgccat

SEQ ID NO: 93259 - DNA, 25 bp, Mus musculus
acaaggtactctctggatatcccct

SEQ ID NO: 93260 - DNA, 25 bp, Mus musculus
acaaggtactctgtggatatcccct

SEQ ID NO: 93261 - DNA, 25 bp, Mus musculus
acaaggtactgtagcacttcatcca

SEQ ID NO: 93262 - DNA, 25 bp, Mus musculus
acaaggtactgttgcacttcatcca

SEQ ID NO: 93263 - DNA, 25 bp, Mus musculus
acaaggtacttaacacctctgtatt

SEQ ID NO: 93264 - DNA, 25 bp, Mus musculus
acaaggtacttatcacctctgtatt

SEQ ID NO: 93265 - DNA, 25 bp, Mus musculus
acaaggtatctaatctgatctgaca

SEQ ID NO: 93266 - DNA, 25 bp, Mus musculus
acaaggtatctattctgatctgaca

SEQ ID NO: 93267 - DNA, 25 bp, Mus musculus
acaaggtcacgcactcatttgagat

SEQ ID NO: 93268 - DNA, 25 bp, Mus musculus
acaaggtcacgctctcatttgagat

SEQ ID NO: 93269 - DNA, 25 bp, Mus musculus
acaaggtcagccagtccttgtgtga

SEQ ID NO: 93270 - DNA, 25 bp, Mus musculus
acaaggtcagcctgtccttgtgtga

SEQ ID NO: 93271 - DNA, 25 bp, Mus musculus
acaaggtcaggcatagtagcacatt

SEQ ID NO: 93272 - DNA, 25 bp, Mus musculus
acaaggtcaggcttagtagcacatt

SEQ ID NO: 93273 - DNA, 25 bp, Mus musculus
acaaggtccttgacgaagatgccat

SEQ ID NO: 93274 - DNA, 25 bp, Mus musculus
acaaggtccttgtcgaagatgccat

SEQ ID NO: 93275 - DNA, 25 bp, Mus musculus
acaaggtcgtctctcggcaacaaat

SEQ ID NO: 93276 - DNA, 25 bp, Mus musculus
acaaggtcgtctgtcggcaacaaat

SEQ ID NO: 93277 - DNA, 25 bp, Mus musculus
acaaggtcgtgaattgtcccctcca

SEQ ID NO: 93278 - DNA, 25 bp, Mus musculus
acaaggtcgtgatttgtcccctcca

SEQ ID NO: 93279 - DNA, 25 bp, Mus musculus
acaaggtctagccaagttgtccaga

SEQ ID NO: 93280 - DNA, 25 bp, Mus musculus
acaaggtctagcgaagttgtccaga

SEQ ID NO: 93281 - DNA, 25 bp, Mus musculus
acaaggtctctaattggagcctggg

SEQ ID NO: 93282 - DNA, 25 bp, Mus musculus
acaaggtctctatttggagcctggg

SEQ ID NO: 93283 - DNA, 25 bp, Mus musculus
acaaggtctctcatgaccctagaga

SEQ ID NO: 93284 - DNA, 25 bp, Mus musculus
acaaggtctctcttgaccctagaga

SEQ ID NO: 93285 - DNA, 25 bp, Mus musculus
acaaggtctgtactctgtcacgtct

SEQ ID NO: 93286 - DNA, 25 bp, Mus musculus
acaaggtctgtagtctgtcacgtct

SEQ ID NO: 93287 - DNA, 25 bp, Mus musculus
acaaggtcttaactgggcctggaag

SEQ ID NO: 93288 - DNA, 25 bp, Mus musculus
acaaggtcttaagtgggcctggaag

SEQ ID NO: 93289 - DNA, 25 bp, Mus musculus
acaaggtgaaccagcagatggtata

SEQ ID NO: 93290 - DNA, 25 bp, Mus musculus
acaaggtgaacctgcagatggtata

SEQ ID NO: 93291 - DNA, 25 bp, Mus musculus
acaaggtgacctacggctcttttga

SEQ ID NO: 93292 - DNA, 25 bp, Mus musculus
acaaggtgaccttcggctcttttga

SEQ ID NO: 93293 - DNA, 25 bp, Mus musculus
acaaggtgacttactgctacaataa

SEQ ID NO: 93294 - DNA, 25 bp, Mus musculus
acaaggtgactttctgctacaataa

SEQ ID NO: 93295 - DNA, 25 bp, Mus musculus
acaaggtgcatgacgccagagggca

SEQ ID NO: 93296 - DNA, 25 bp, Mus musculus
acaaggtgcatgtcgccagagggca

SEQ ID NO: 93297 - DNA, 25 bp, Mus musculus
acaaggtgctctcttgccgttgaaa

SEQ ID NO: 93298 - DNA, 25 bp, Mus musculus
acaaggtgctctgttgccgttgaaa

SEQ ID NO: 93299 - DNA, 25 bp, Mus musculus
acaaggtggatgagccgtcttcctc

SEQ ID NO: 93300 - DNA, 25 bp, Mus musculus
acaaggtggatgtgccgtcttcctc

SEQ ID NO: 93301 - DNA, 25 bp, Mus musculus
acaaggtggcttatgactatctata

SEQ ID NO: 93302 - DNA, 25 bp, Mus musculus
acaaggtggcttttgactatctata

SEQ ID NO: 93303 - DNA, 25 bp, Mus musculus
acaaggtgggccaggttcagtgcac

SEQ ID NO: 93304 - DNA, 25 bp, Mus musculus
acaaggtgggcctggttcagtgcac

SEQ ID NO: 93305 - DNA, 25 bp, Mus musculus
acaaggtgtcaacgttttctctctc

SEQ ID NO: 93306 - DNA, 25 bp, Mus musculus
acaaggtgtcaaggttttctctctc

SEQ ID NO: 93307 - DNA, 25 bp, Mus musculus
acaaggtgtcctctgtgtcctcaga

SEQ ID NO: 93308 - DNA, 25 bp, Mus musculus
acaaggtgtcctgtgtgtcctcaga

SEQ ID NO: 93309 - DNA, 25 bp, Mus musculus
acaaggtgttcgaggccacagacgc

SEQ ID NO: 93310 - DNA, 25 bp, Mus musculus
acaaggtgttcgtggccacagacgc

SEQ ID NO: 93311 - DNA, 25 bp, Mus musculus
acaaggttcagaagcgaggctctct

SEQ ID NO: 93312 - DNA, 25 bp, Mus musculus
acaaggttcagatgcgaggctctct

SEQ ID NO: 93313 - DNA, 25 bp, Mus musculus
acaaggttccctatctctacaaaga

SEQ ID NO: 93314 - DNA, 25 bp, Mus musculus
acaaggttccctttctctacaaaga

SEQ ID NO: 93315 - DNA, 25 bp, Mus musculus
acaaggttctcaactacaatggcca

SEQ ID NO: 93316 - DNA, 25 bp, Mus musculus
acaaggttctcatctacaatggcca

SEQ ID NO: 93317 - DNA, 25 bp, Mus musculus
acaaggttctcccattgtgaccaac

SEQ ID NO: 93318 - DNA, 25 bp, Mus musculus
acaaggttctccgattgtgaccaac

SEQ ID NO: 93319 - DNA, 25 bp, Mus musculus
acaaggttgcatatagtcaaggctg

SEQ ID NO: 93320 - DNA, 25 bp, Mus musculus
acaaggttgcatttagtcaaggctg

SEQ ID NO: 93321 - DNA, 25 bp, Mus musculus
acaaggttggagacagtctggcgta

SEQ ID NO: 93322 - DNA, 25 bp, Mus musculus
acaaggttggagtcagtctggcgta

SEQ ID NO: 93323 - DNA, 25 bp, Mus musculus
acaaggttggatctccagctggcag

SEQ ID NO: 93324 - DNA, 25 bp, Mus musculus
acaaggttggatgtccagctggcag

SEQ ID NO: 93325 - DNA, 25 bp, Mus musculus
acaaggttgtgcatcacatgggcaa

SEQ ID NO: 93326 - DNA, 25 bp, Mus musculus
acaaggttgtgcttcacatgggcaa

SEQ ID NO: 93327 - DNA, 25 bp, Mus musculus
acaaggtttgaacgcccagcatggc

SEQ ID NO: 93328 - DNA, 25 bp, Mus musculus
acaaggtttgaaggcccagcatggc

SEQ ID NO: 93329 - DNA, 25 bp, Mus musculus
acaaggtttgcaatctcggtcggta

SEQ ID NO: 93330 - DNA, 25 bp, Mus musculus
acaaggtttgcattctcggtcggta

SEQ ID NO: 93331 - DNA, 25 bp, Mus musculus
acaaggtttggtcgaactatctcta

SEQ ID NO: 93332 - DNA, 25 bp, Mus musculus
acaaggtttggtggaactatctcta

SEQ ID NO: 93333 - DNA, 25 bp, Mus musculus
acaaggtttgtaagttccaacagag

SEQ ID NO: 93334 - DNA, 25 bp, Mus musculus
acaaggtttgtatgttccaacagag

SEQ ID NO: 93335 - DNA, 25 bp, Mus musculus
acaaggttttgaacccctgcttcat

SEQ ID NO: 93336 - DNA, 25 bp, Mus musculus
acaaggttttgatcccctgcttcat

SEQ ID NO: 93337 - DNA, 25 bp, Mus musculus
acaagtaaacagattgctgagcgaa

SEQ ID NO: 93338 - DNA, 25 bp, Mus musculus
acaagtaaacagtttgctgagcgaa

SEQ ID NO: 93339 - DNA, 25 bp, Mus musculus
acaagtaacaggacccagaagcctc

SEQ ID NO: 93340 - DNA, 25 bp, Mus musculus
acaagtaacaggtcccagaagcctc

SEQ ID NO: 93341 - DNA, 25 bp, Mus musculus
acaagtaaccaccagagagctccag

SEQ ID NO: 93342 - DNA, 25 bp, Mus musculus
acaagtaaccacgagagagctccag

SEQ ID NO: 93343 - DNA, 25 bp, Mus musculus
acaagtaaggttctgcagtctgaca

SEQ ID NO: 93344 - DNA, 25 bp, Mus musculus
acaagtaaggttgtgcagtctgaca

SEQ ID NO: 93345 - DNA, 25 bp, Mus musculus
acaagtacagccatgagtgctcaag

SEQ ID NO: 93346 - DNA, 25 bp, Mus musculus
acaagtacagccttgagtgctcaag

SEQ ID NO: 93347 - DNA, 25 bp, Mus musculus
acaagtacatcacgctgtttattga

SEQ ID NO: 93348 - DNA, 25 bp, Mus musculus
acaagtacatcaggctgtttattga

SEQ ID NO: 93349 - DNA, 25 bp, Mus musculus
acaagtacctctcaggcagcagctg

SEQ ID NO: 93350 - DNA, 25 bp, Mus musculus
acaagtacctctgaggcagcagctg

SEQ ID NO: 93351 - DNA, 25 bp, Mus musculus
acaagtacctgcatcgtgtgatctc

SEQ ID NO: 93352 - DNA, 25 bp, Mus musculus
acaagtacctgcttcgtgtgatctc

SEQ ID NO: 93353 - DNA, 25 bp, Mus musculus
acaagtacctgtatgctgtgcgctg

SEQ ID NO: 93354 - DNA, 25 bp, Mus musculus
acaagtacctgtttgctgtgcgctg

SEQ ID NO: 93355 - DNA, 25 bp, Mus musculus
acaagtacgacgaggcagccagcta

SEQ ID NO: 93356 - DNA, 25 bp, Mus musculus
acaagtacgacgtggcagccagcta

SEQ ID NO: 93357 - DNA, 25 bp, Mus musculus
acaagtacgcctccagtgtccgcag

SEQ ID NO: 93358 - DNA, 25 bp, Mus musculus
acaagtacgcctgcagtgtccgcag

SEQ ID NO: 93359 - DNA, 25 bp, Mus musculus
acaagtactactacctatgccaggt

SEQ ID NO: 93360 - DNA, 25 bp, Mus musculus
acaagtactacttcctatgccaggt

SEQ ID NO: 93361 - DNA, 25 bp, Mus musculus
acaagtacttgtaggactcgagata

SEQ ID NO: 93362 - DNA, 25 bp, Mus musculus
acaagtacttgttggactcgagata

SEQ ID NO: 93363 - DNA, 25 bp, Mus musculus
acaagtagaggtaaacatcttcctg

SEQ ID NO: 93364 - DNA, 25 bp, Mus musculus
acaagtagaggttaacatcttcctg

SEQ ID NO: 93365 - DNA, 25 bp, Mus musculus
acaagtaggactatgtggctaccat

SEQ ID NO: 93366 - DNA, 25 bp, Mus musculus
acaagtaggactttgtggctaccat

SEQ ID NO: 93367 - DNA, 25 bp, Mus musculus
acaagtagtatcaagagggctccca

SEQ ID NO: 93368 - DNA, 25 bp, Mus musculus
acaagtagtatctagagggctccca

SEQ ID NO: 93369 - DNA, 25 bp, Mus musculus
acaagtagtgttctcttcctctggt

SEQ ID NO: 93370 - DNA, 25 bp, Mus musculus
acaagtagtgttgtcttcctctggt

SEQ ID NO: 93371 - DNA, 25 bp, Mus musculus
acaagtataatcactatggttggat

SEQ ID NO: 93372 - DNA, 25 bp, Mus musculus
acaagtataatctctatggttggat

SEQ ID NO: 93373 - DNA, 25 bp, Mus musculus
acaagtatacatcttgccgccacca

SEQ ID NO: 93374 - DNA, 25 bp, Mus musculus
acaagtatacatgttgccgccacca

SEQ ID NO: 93375 - DNA, 25 bp, Mus musculus
acaagtatattactgcacatggagt

SEQ ID NO: 93376 - DNA, 25 bp, Mus musculus
acaagtatattagtgcacatggagt

SEQ ID NO: 93377 - DNA, 25 bp, Mus musculus
acaagtatgtgtcctgtggccgtac

SEQ ID NO: 93378 - DNA, 25 bp, Mus musculus
acaagtatgtgtgctgtggccgtac

SEQ ID NO: 93379 - DNA, 25 bp, Mus musculus
acaagtatgttgaacatttttgctg

SEQ ID NO: 93380 - DNA, 25 bp, Mus musculus
acaagtatgttgtacatttttgctg

SEQ ID NO: 93381 - DNA, 25 bp, Mus musculus
acaagtattagcatcctgtttgaat

SEQ ID NO: 93382 - DNA, 25 bp, Mus musculus
acaagtattagcttcctgtttgaat

SEQ ID NO: 93383 - DNA, 25 bp, Mus musculus
acaagtcaaacaactgccgcagtgc

SEQ ID NO: 93384 - DNA, 25 bp, Mus musculus
acaagtcaaacatctgccgcagtgc

SEQ ID NO: 93385 - DNA, 25 bp, Mus musculus
acaagtcaatttcggatgcttcatc

SEQ ID NO: 93386 - DNA, 25 bp, Mus musculus
acaagtcaatttgggatgcttcatc

SEQ ID NO: 93387 - DNA, 25 bp, Mus musculus
acaagtcacactcgtacacaaagca

SEQ ID NO: 93388 - DNA, 25 bp, Mus musculus
acaagtcacactggtacacaaagca

SEQ ID NO: 93389 - DNA, 25 bp, Mus musculus
acaagtcacattcctaactgctcta

SEQ ID NO: 93390 - DNA, 25 bp, Mus musculus
acaagtcacattgctaactgctcta

SEQ ID NO: 93391 - DNA, 25 bp, Mus musculus
acaagtcatcatcccatttacataa

SEQ ID NO: 93392 - DNA, 25 bp, Mus musculus
acaagtcatcatgccatttacataa

SEQ ID NO: 93393 - DNA, 25 bp, Mus musculus
acaagtcatctgagtcccttgacgg

SEQ ID NO: 93394 - DNA, 25 bp, Mus musculus
acaagtcatctgtgtcccttgacgg

SEQ ID NO: 93395 - DNA, 25 bp, Mus musculus
acaagtcatgcactattagcacatt

SEQ ID NO: 93396 - DNA, 25 bp, Mus musculus
acaagtcatgcagtattagcacatt

SEQ ID NO: 93397 - DNA, 25 bp, Mus musculus
acaagtccaagcctgcacttcaata

SEQ ID NO: 93398 - DNA, 25 bp, Mus musculus
acaagtccaagcgtgcacttcaata

SEQ ID NO: 93399 - DNA, 25 bp, Mus musculus
acaagtccacaactatattcactgt

SEQ ID NO: 93400 - DNA, 25 bp, Mus musculus
acaagtccacaagtatattcactgt

SEQ ID NO: 93401 - DNA, 25 bp, Mus musculus
acaagtccagccaagagttcccaag

SEQ ID NO: 93402 - DNA, 25 bp, Mus musculus
acaagtccagcctagagttcccaag

SEQ ID NO: 93403 - DNA, 25 bp, Mus musculus
acaagtcccagaaccgcagtgaaga

SEQ ID NO: 93404 - DNA, 25 bp, Mus musculus
acaagtcccagatccgcagtgaaga

SEQ ID NO: 93405 - DNA, 25 bp, Mus musculus
acaagtcccagtagtttatgcatac

SEQ ID NO: 93406 - DNA, 25 bp, Mus musculus
acaagtcccagtattagagtagaat

SEQ ID NO: 93407 - DNA, 25 bp, Mus musculus
acaagtcccagttgtttatgcatac

SEQ ID NO: 93408 - DNA, 25 bp, Mus musculus
acaagtcccagttttagagtagaat

SEQ ID NO: 93409 - DNA, 25 bp, Mus musculus
acaagtccccagaatggtgcctcat

SEQ ID NO: 93410 - DNA, 25 bp, Mus musculus
acaagtccccagtatggtgcctcat

SEQ ID NO: 93411 - DNA, 25 bp, Mus musculus
acaagtccctggacccatgttggaa

SEQ ID NO: 93412 - DNA, 25 bp, Mus musculus
acaagtccctggtcccatgttggaa

SEQ ID NO: 93413 - DNA, 25 bp, Mus musculus
acaagtcccttgcatgcgtttagcc

SEQ ID NO: 93414 - DNA, 25 bp, Mus musculus
acaagtcccttggatgcgtttagcc

SEQ ID NO: 93415 - DNA, 25 bp, Mus musculus
acaagtcctaagctgtctggccctg

SEQ ID NO: 93416 - DNA, 25 bp, Mus musculus
acaagtcctaaggtgtctggccctg

SEQ ID NO: 93417 - DNA, 25 bp, Mus musculus
acaagtcctctgagtaagcaagatt

SEQ ID NO: 93418 - DNA, 25 bp, Mus musculus
acaagtcctctgtgtaagcaagatt

SEQ ID NO: 93419 - DNA, 25 bp, Mus musculus
acaagtcctggaatccggagggagt

SEQ ID NO: 93420 - DNA, 25 bp, Mus musculus
acaagtcctggattccggagggagt

SEQ ID NO: 93421 - DNA, 25 bp, Mus musculus
acaagtccttctcaaagtccaatca

SEQ ID NO: 93422 - DNA, 25 bp, Mus musculus
acaagtccttctgaaagtccaatca

SEQ ID NO: 93423 - DNA, 25 bp, Mus musculus
acaagtcgacggattcgccctagtg

SEQ ID NO: 93424 - DNA, 25 bp, Mus musculus
acaagtcgacggtttcgccctagtg

SEQ ID NO: 93425 - DNA, 25 bp, Mus musculus
acaagtcgtgaacttctggaggcca

SEQ ID NO: 93426 - DNA, 25 bp, Mus musculus
acaagtcgtgaagttctggaggcca

SEQ ID NO: 93427 - DNA, 25 bp, Mus musculus
acaagtcgtgtgagcagtataaaac

SEQ ID NO: 93428 - DNA, 25 bp, Mus musculus
acaagtcgtgtgtgcagtataaaac

SEQ ID NO: 93429 - DNA, 25 bp, Mus musculus
acaagtctaagtcccgatcaaggta

SEQ ID NO: 93430 - DNA, 25 bp, Mus musculus
acaagtctaagtgccgatcaaggta

SEQ ID NO: 93431 - DNA, 25 bp, Mus musculus
acaagtctacataccctcagcatat

SEQ ID NO: 93432 - DNA, 25 bp, Mus musculus
acaagtctacattccctcagcatat

SEQ ID NO: 93433 - DNA, 25 bp, Mus musculus
acaagtctatgaacaggcatgccat

SEQ ID NO: 93434 - DNA, 25 bp, Mus musculus
acaagtctatgatcaggcatgccat

SEQ ID NO: 93435 - DNA, 25 bp, Mus musculus
acaagtctccttctaaatgatacac

SEQ ID NO: 93436 - DNA, 25 bp, Mus musculus
acaagtctccttgtaaatgatacac

SEQ ID NO: 93437 - DNA, 25 bp, Mus musculus
acaagtctcgtgattattattcctt

SEQ ID NO: 93438 - DNA, 25 bp, Mus musculus
acaagtctcgtgtttattattcctt

SEQ ID NO: 93439 - DNA, 25 bp, Mus musculus
acaagtctctagaacaacactctgg

SEQ ID NO: 93440 - DNA, 25 bp, Mus musculus
acaagtctctagtacaacactctgg

SEQ ID NO: 93441 - DNA, 25 bp, Mus musculus
acaagtctgaagctaggccactctt

SEQ ID NO: 93442 - DNA, 25 bp, Mus musculus
acaagtctgaaggtaggccactctt

SEQ ID NO: 93443 - DNA, 25 bp, Mus musculus
acaagtctgagcctgtagcctttgc

SEQ ID NO: 93444 - DNA, 25 bp, Mus musculus
acaagtctgagcgtgtagcctttgc

SEQ ID NO: 93445 - DNA, 25 bp, Mus musculus
acaagtctgggcaccgtgcagataa

SEQ ID NO: 93446 - DNA, 25 bp, Mus musculus
acaagtctgggctccgtgcagataa

SEQ ID NO: 93447 - DNA, 25 bp, Mus musculus
acaagtctgttaccgggtttccatt

SEQ ID NO: 93448 - DNA, 25 bp, Mus musculus
acaagtctgttagcgggtttccatt

SEQ ID NO: 93449 - DNA, 25 bp, Mus musculus
acaagtcttaggcactgcttctctc

SEQ ID NO: 93450 - DNA, 25 bp, Mus musculus
acaagtcttagggactgcttctctc

SEQ ID NO: 93451 - DNA, 25 bp, Mus musculus
acaagtcttgacacctagcagcaga

SEQ ID NO: 93452 - DNA, 25 bp, Mus musculus
acaagtcttgactcctagcagcaga

SEQ ID NO: 93453 - DNA, 25 bp, Mus musculus
acaagtcttgcaatcaaagccaggt

SEQ ID NO: 93454 - DNA, 25 bp, Mus musculus
acaagtcttgcattcaaagccaggt

SEQ ID NO: 93455 - DNA, 25 bp, Mus musculus
acaagtgaaggtacagtgggtgaca

SEQ ID NO: 93456 - DNA, 25 bp, Mus musculus
acaagtgaaggttcagtgggtgaca

SEQ ID NO: 93457 - DNA, 25 bp, Mus musculus
acaagtgaagtcaacgcttccctac

SEQ ID NO: 93458 - DNA, 25 bp, Mus musculus
acaagtgaagtctacgcttccctac

SEQ ID NO: 93459 - DNA, 25 bp, Mus musculus
acaagtgacaaaactgcgggacgag

SEQ ID NO: 93460 - DNA, 25 bp, Mus musculus
acaagtgacaaatctgcgggacgag

SEQ ID NO: 93461 - DNA, 25 bp, Mus musculus
acaagtgaccgacagacgtgcgtga

SEQ ID NO: 93462 - DNA, 25 bp, Mus musculus
acaagtgaccgagagacgtgcgtga

SEQ ID NO: 93463 - DNA, 25 bp, Mus musculus
acaagtgagaaaaagattggccttt

SEQ ID NO: 93464 - DNA, 25 bp, Mus musculus
acaagtgagaaatagattggccttt

SEQ ID NO: 93465 - DNA, 25 bp, Mus musculus
acaagtgagccacagggcggcttta

SEQ ID NO: 93466 - DNA, 25 bp, Mus musculus
acaagtgagccagagggcggcttta

SEQ ID NO: 93467 - DNA, 25 bp, Mus musculus
acaagtgattaacggtgactgctcc

SEQ ID NO: 93468 - DNA, 25 bp, Mus musculus
acaagtgattaagggtgactgctcc

SEQ ID NO: 93469 - DNA, 25 bp, Mus musculus
acaagtgattagctgtgaggaaatt

SEQ ID NO: 93470 - DNA, 25 bp, Mus musculus
acaagtgattaggtgtgaggaaatt

SEQ ID NO: 93471 - DNA, 25 bp, Mus musculus
acaagtgcaaagatccgacagtgga

SEQ ID NO: 93472 - DNA, 25 bp, Mus musculus
acaagtgcaaagttccgacagtgga

SEQ ID NO: 93473 - DNA, 25 bp, Mus musculus
acaagtgcaaccagacatccagaac

SEQ ID NO: 93474 - DNA, 25 bp, Mus musculus
acaagtgcaacctgacatccagaac

SEQ ID NO: 93475 - DNA, 25 bp, Mus musculus
acaagtgcacctatgttatatactt

SEQ ID NO: 93476 - DNA, 25 bp, Mus musculus
acaagtgcacctttgttatatactt

SEQ ID NO: 93477 - DNA, 25 bp, Mus musculus
acaagtgccaatactcactctggag

SEQ ID NO: 93478 - DNA, 25 bp, Mus musculus
acaagtgccaattctcactctggag

SEQ ID NO: 93479 - DNA, 25 bp, Mus musculus
acaagtgccagaaacacaggatcca

SEQ ID NO: 93480 - DNA, 25 bp, Mus musculus
acaagtgccagatacacaggatcca

SEQ ID NO: 93481 - DNA, 25 bp, Mus musculus
acaagtgccagcatttgactaaaga

SEQ ID NO: 93482 - DNA, 25 bp, Mus musculus
acaagtgccagcttttgactaaaga

SEQ ID NO: 93483 - DNA, 25 bp, Mus musculus
acaagtgccccacccttggtggtgt

SEQ ID NO: 93484 - DNA, 25 bp, Mus musculus
acaagtgccccagccttggtggtgt

SEQ ID NO: 93485 - DNA, 25 bp, Mus musculus
acaagtgcctgaattttcggaaaga

SEQ ID NO: 93486 - DNA, 25 bp, Mus musculus
acaagtgcctgatttttcggaaaga

SEQ ID NO: 93487 - DNA, 25 bp, Mus musculus
acaagtgccttaccaggagtcagca

SEQ ID NO: 93488 - DNA, 25 bp, Mus musculus
acaagtgccttagcaggagtcagca

SEQ ID NO: 93489 - DNA, 25 bp, Mus musculus
acaagtgcgaagactggtaagggct

SEQ ID NO: 93490 - DNA, 25 bp, Mus musculus
acaagtgcgaagtctggtaagggct

SEQ ID NO: 93491 - DNA, 25 bp, Mus musculus
acaagtgctggtcgtcagtgctttt

SEQ ID NO: 93492 - DNA, 25 bp, Mus musculus
acaagtgctggtggtcagtgctttt

SEQ ID NO: 93493 - DNA, 25 bp, Mus musculus
acaagtgcttccaggttaacctgaa

SEQ ID NO: 93494 - DNA, 25 bp, Mus musculus
acaagtgcttcctggttaacctgaa

SEQ ID NO: 93495 - DNA, 25 bp, Mus musculus
acaagtgcttctctgtggcagttca

SEQ ID NO: 93496 - DNA, 25 bp, Mus musculus
acaagtgcttctgtgtggcagttca

SEQ ID NO: 93497 - DNA, 25 bp, Mus musculus
acaagtgcttggagatcgttctata

SEQ ID NO: 93498 - DNA, 25 bp, Mus musculus
acaagtgcttggtgatcgttctata

SEQ ID NO: 93499 - DNA, 25 bp, Mus musculus
acaagtgcttgtccgcgtgtgcgta

SEQ ID NO: 93500 - DNA, 25 bp, Mus musculus
acaagtgcttgtgcgcgtgtgcgta

SEQ ID NO: 93501 - DNA, 25 bp, Mus musculus
acaagtgctttgctaactgagtcat

SEQ ID NO: 93502 - DNA, 25 bp, Mus musculus
acaagtgctttggtaactgagtcat

SEQ ID NO: 93503 - DNA, 25 bp, Mus musculus
acaagtggacatccagtgactgcac

SEQ ID NO: 93504 - DNA, 25 bp, Mus musculus
acaagtggacatgcagtgactgcac

SEQ ID NO: 93505 - DNA, 25 bp, Mus musculus
acaagtggacgccagtactcagctt

SEQ ID NO: 93506 - DNA, 25 bp, Mus musculus
acaagtggacgcgagtactcagctt

SEQ ID NO: 93507 - DNA, 25 bp, Mus musculus
acaagtggacttcggccctattcag

SEQ ID NO: 93508 - DNA, 25 bp, Mus musculus
acaagtggacttgggccctattcag

SEQ ID NO: 93509 - DNA, 25 bp, Mus musculus
acaagtggatacagttaagatgtag

SEQ ID NO: 93510 - DNA, 25 bp, Mus musculus
acaagtggatactgttaagatgtag

SEQ ID NO: 93511 - DNA, 25 bp, Mus musculus
acaagtggcagaccaggccctcgtg

SEQ ID NO: 93512 - DNA, 25 bp, Mus musculus
acaagtggcagagcaggccctcgtg

SEQ ID NO: 93513 - DNA, 25 bp, Mus musculus
acaagtggcattccgaggtctctga

SEQ ID NO: 93514 - DNA, 25 bp, Mus musculus
acaagtggcattgcgaggtctctga

SEQ ID NO: 93515 - DNA, 25 bp, Mus musculus
acaagtggctggacttctgggactc

SEQ ID NO: 93516 - DNA, 25 bp, Mus musculus
acaagtggctggtcttctgggactc

SEQ ID NO: 93517 - DNA, 25 bp, Mus musculus
acaagtgggagtactctgtcttcca

SEQ ID NO: 93518 - DNA, 25 bp, Mus musculus
acaagtgggagttctctgtcttcca

SEQ ID NO: 93519 - DNA, 25 bp, Mus musculus
acaagtgggccaccggatatgtata

SEQ ID NO: 93520 - DNA, 25 bp, Mus musculus
acaagtgggccagcggatatgtata

SEQ ID NO: 93521 - DNA, 25 bp, Mus musculus
acaagtgggtcaacgcccctaaggg

SEQ ID NO: 93522 - DNA, 25 bp, Mus musculus
acaagtgggtcatcgcccctaaggg

SEQ ID NO: 93523 - DNA, 25 bp, Mus musculus
acaagtgggtccagcacttgctgag

SEQ ID NO: 93524 - DNA, 25 bp, Mus musculus
acaagtgggtcctgcacttgctgag

SEQ ID NO: 93525 - DNA, 25 bp, Mus musculus
acaagtggtccaaccggtatccgca

SEQ ID NO: 93526 - DNA, 25 bp, Mus musculus
acaagtggtccatccggtatccgca

SEQ ID NO: 93527 - DNA, 25 bp, Mus musculus
acaagtgtagtaatgccattgacaa

SEQ ID NO: 93528 - DNA, 25 bp, Mus musculus
acaagtgtagtattgccattgacaa

SEQ ID NO: 93529 - DNA, 25 bp, Mus musculus
acaagtgtcactaactgtgagcaga

SEQ ID NO: 93530 - DNA, 25 bp, Mus musculus
acaagtgtcacttactgtgagcaga

SEQ ID NO: 93531 - DNA, 25 bp, Mus musculus
acaagtgtcattaacacacgtggca

SEQ ID NO: 93532 - DNA, 25 bp, Mus musculus
acaagtgtcatttacacacgtggca

SEQ ID NO: 93533 - DNA, 25 bp, Mus musculus
acaagtgtccccacaggtcaggaat

SEQ ID NO: 93534 - DNA, 25 bp, Mus musculus
acaagtgtcccctcaggtcaggaat

SEQ ID NO: 93535 - DNA, 25 bp, Mus musculus
acaagtgtcctaacttccactgcca

SEQ ID NO: 93536 - DNA, 25 bp, Mus musculus
acaagtgtcctatcttccactgcca

SEQ ID NO: 93537 - DNA, 25 bp, Mus musculus
acaagtgtcctgaactgctgagcca

SEQ ID NO: 93538 - DNA, 25 bp, Mus musculus
acaagtgtcctgagcgactccacct

SEQ ID NO: 93539 - DNA, 25 bp, Mus musculus
acaagtgtcctgtactgctgagcca

SEQ ID NO: 93540 - DNA, 25 bp, Mus musculus
acaagtgtcctgtgcgactccacct

SEQ ID NO: 93541 - DNA, 25 bp, Mus musculus
acaagtgtctcccaggttctgatgg

SEQ ID NO: 93542 - DNA, 25 bp, Mus musculus
acaagtgtctccgaggttctgatgg

SEQ ID NO: 93543 - DNA, 25 bp, Mus musculus
acaagtgtctgtaactccacacctc

SEQ ID NO: 93544 - DNA, 25 bp, Mus musculus
acaagtgtctgttactccacacctc

SEQ ID NO: 93545 - DNA, 25 bp, Mus musculus
acaagtgtgaccaggctgctcgcac

SEQ ID NO: 93546 - DNA, 25 bp, Mus musculus
acaagtgtgacctggctgctcgcac

SEQ ID NO: 93547 - DNA, 25 bp, Mus musculus
acaagtgtgcctacatgagctccaa

SEQ ID NO: 93548 - DNA, 25 bp, Mus musculus
acaagtgtgccttcatgagctccaa

SEQ ID NO: 93549 - DNA, 25 bp, Mus musculus
acaagtgtgcgtccttttctgtaac

SEQ ID NO: 93550 - DNA, 25 bp, Mus musculus
acaagtgtgcgtgcttttctgtaac

SEQ ID NO: 93551 - DNA, 25 bp, Mus musculus
acaagtgtgcttctgggtgatgaca

SEQ ID NO: 93552 - DNA, 25 bp, Mus musculus
acaagtgtgcttgtgggtgatgaca

SEQ ID NO: 93553 - DNA, 25 bp, Mus musculus
acaagtgtgggtatctatgtactga

SEQ ID NO: 93554 - DNA, 25 bp, Mus musculus
acaagtgtgggtttctatgtactga

SEQ ID NO: 93555 - DNA, 25 bp, Mus musculus
acaagtgtggttattcttggttcat

SEQ ID NO: 93556 - DNA, 25 bp, Mus musculus
acaagtgtggtttttcttggttcat

SEQ ID NO: 93557 - DNA, 25 bp, Mus musculus
acaagtgtgtctagtgcccacagag

SEQ ID NO: 93558 - DNA, 25 bp, Mus musculus
acaagtgtgtcttgtgcccacagag

SEQ ID NO: 93559 - DNA, 25 bp, Mus musculus
acaagtgtgtgacgcttcactggat

SEQ ID NO: 93560 - DNA, 25 bp, Mus musculus
acaagtgtgtgaggcttcactggat

SEQ ID NO: 93561 - DNA, 25 bp, Mus musculus
acaagtgttagacccgtgtgtgcgt

SEQ ID NO: 93562 - DNA, 25 bp, Mus musculus
acaagtgttagagccgtgtgtgcgt

SEQ ID NO: 93563 - DNA, 25 bp, Mus musculus
acaagtgttcatcacagctctgctc

SEQ ID NO: 93564 - DNA, 25 bp, Mus musculus
acaagtgttcatgacagctctgctc

SEQ ID NO: 93565 - DNA, 25 bp, Mus musculus
acaagtgttctgagtcccttgtacg

SEQ ID NO: 93566 - DNA, 25 bp, Mus musculus
acaagtgttctgtgtcccttgtacg

SEQ ID NO: 93567 - DNA, 25 bp, Mus musculus
acaagtgttgcaaggtcagtttgac

SEQ ID NO: 93568 - DNA, 25 bp, Mus musculus
acaagtgttgcatggtcagtttgac

SEQ ID NO: 93569 - DNA, 25 bp, Mus musculus
acaagtgttgctcctttctaagcga

SEQ ID NO: 93570 - DNA, 25 bp, Mus musculus
acaagtgttgctgctttctaagcga

SEQ ID NO: 93571 - DNA, 25 bp, Mus musculus
acaagtgttttaccattggacatag

SEQ ID NO: 93572 - DNA, 25 bp, Mus musculus
acaagtgttttagcattggacatag

SEQ ID NO: 93573 - DNA, 25 bp, Mus musculus
acaagtgttttgctggttctggaca

SEQ ID NO: 93574 - DNA, 25 bp, Mus musculus
acaagtgttttggtggttctggaca

SEQ ID NO: 93575 - DNA, 25 bp, Mus musculus
acaagttaatcacatgccaggtggt

SEQ ID NO: 93576 - DNA, 25 bp, Mus musculus
acaagttaatcagatgccaggtggt

SEQ ID NO: 93577 - DNA, 25 bp, Mus musculus
acaagttacttgctcacagctgaag

SEQ ID NO: 93578 - DNA, 25 bp, Mus musculus
acaagttacttggtcacagctgaag

SEQ ID NO: 93579 - DNA, 25 bp, Mus musculus
acaagttactttcacatctgatcat

SEQ ID NO: 93580 - DNA, 25 bp, Mus musculus
acaagttactttgacatctgatcat

SEQ ID NO: 93581 - DNA, 25 bp, Mus musculus
acaagttagccgagatcagcctcag

SEQ ID NO: 93582 - DNA, 25 bp, Mus musculus
acaagttagccgtgatcagcctcag

SEQ ID NO: 93583 - DNA, 25 bp, Mus musculus
acaagttagcctctgtagcgaagac

SEQ ID NO: 93584 - DNA, 25 bp, Mus musculus
acaagttagcctgtgtagcgaagac

SEQ ID NO: 93585 - DNA, 25 bp, Mus musculus
acaagttaggtcctcggccggagca

SEQ ID NO: 93586 - DNA, 25 bp, Mus musculus
acaagttaggtcgtcggccggagca

SEQ ID NO: 93587 - DNA, 25 bp, Mus musculus
acaagttcatccaccgattggtgtc

SEQ ID NO: 93588 - DNA, 25 bp, Mus musculus
acaagttcatcctccgattggtgtc

SEQ ID NO: 93589 - DNA, 25 bp, Mus musculus
acaagttccaaaccgtgtcctctga

SEQ ID NO: 93590 - DNA, 25 bp, Mus musculus
acaagttccaaagcgtgtcctctga

SEQ ID NO: 93591 - DNA, 25 bp, Mus musculus
acaagttccacaacattggagcagt

SEQ ID NO: 93592 - DNA, 25 bp, Mus musculus
acaagttccacatcattggagcagt

SEQ ID NO: 93593 - DNA, 25 bp, Mus musculus
acaagttccacgacttcccaaaatg

SEQ ID NO: 93594 - DNA, 25 bp, Mus musculus
acaagttccacgtcttcccaaaatg

SEQ ID NO: 93595 - DNA, 25 bp, Mus musculus
acaagttccactatagccacagttt

SEQ ID NO: 93596 - DNA, 25 bp, Mus musculus
acaagttccactttagccacagttt

SEQ ID NO: 93597 - DNA, 25 bp, Mus musculus
acaagttccaggatctcctggcaga

SEQ ID NO: 93598 - DNA, 25 bp, Mus musculus
acaagttccaggttctcctggcaga

SEQ ID NO: 93599 - DNA, 25 bp, Mus musculus
acaagttcctatactaggccgctgc

SEQ ID NO: 93600 - DNA, 25 bp, Mus musculus
acaagttcctattctaggccgctgc

SEQ ID NO: 93601 - DNA, 25 bp, Mus musculus
acaagttcgtccctgtcatgagtga

SEQ ID NO: 93602 - DNA, 25 bp, Mus musculus
acaagttcgtccgtgtcatgagtga

SEQ ID NO: 93603 - DNA, 25 bp, Mus musculus
acaagttcgtgtagatgcattggaa

SEQ ID NO: 93604 - DNA, 25 bp, Mus musculus
acaagttcgtgttgatgcattggaa

SEQ ID NO: 93605 - DNA, 25 bp, Mus musculus
acaagttctcgcaggaagaggcgta

SEQ ID NO: 93606 - DNA, 25 bp, Mus musculus
acaagttctcgctggaagaggcgta

SEQ ID NO: 93607 - DNA, 25 bp, Mus musculus
acaagttctctacatgctgagctca

SEQ ID NO: 93608 - DNA, 25 bp, Mus musculus
acaagttctctagatgctgagctca

SEQ ID NO: 93609 - DNA, 25 bp, Mus musculus
acaagttcttgacaccgcttcacaa

SEQ ID NO: 93610 - DNA, 25 bp, Mus musculus
acaagttcttgagaccgcttcacaa

SEQ ID NO: 93611 - DNA, 25 bp, Mus musculus
acaagttcttgtcattcctgcagca

SEQ ID NO: 93612 - DNA, 25 bp, Mus musculus
acaagttcttgtgattcctgcagca

SEQ ID NO: 93613 - DNA, 25 bp, Mus musculus
acaagttgatagcagggcccctcaa

SEQ ID NO: 93614 - DNA, 25 bp, Mus musculus
acaagttgataggagggcccctcaa

SEQ ID NO: 93615 - DNA, 25 bp, Mus musculus
acaagttgatgcagtctttggaaaa

SEQ ID NO: 93616 - DNA, 25 bp, Mus musculus
acaagttgatgctgtctttggaaaa

SEQ ID NO: 93617 - DNA, 25 bp, Mus musculus
acaagttgattgactcttacctgaa

SEQ ID NO: 93618 - DNA, 25 bp, Mus musculus
acaagttgattgtctcttacctgaa

SEQ ID NO: 93619 - DNA, 25 bp, Mus musculus
acaagttgctgtctcgtgattgctt

SEQ ID NO: 93620 - DNA, 25 bp, Mus musculus
acaagttgctgtgtcgtgattgctt

SEQ ID NO: 93621 - DNA, 25 bp, Mus musculus
acaagttggtggagatttccaccat

SEQ ID NO: 93622 - DNA, 25 bp, Mus musculus
acaagttggtggtgatttccaccat

SEQ ID NO: 93623 - DNA, 25 bp, Mus musculus
acaagttgtcatatgtcacacatgc

SEQ ID NO: 93624 - DNA, 25 bp, Mus musculus
acaagttgtcatttgtcacacatgc

SEQ ID NO: 93625 - DNA, 25 bp, Mus musculus
acaagttgtctgctattttcctaat

SEQ ID NO: 93626 - DNA, 25 bp, Mus musculus
acaagttgtctggtattttcctaat

SEQ ID NO: 93627 - DNA, 25 bp, Mus musculus
acaagttgtggtagctgttgctaaa

SEQ ID NO: 93628 - DNA, 25 bp, Mus musculus
acaagttgtggttgctgttgctaaa

SEQ ID NO: 93629 - DNA, 25 bp, Mus musculus
acaagttgtttcctgtgtttcaagt

SEQ ID NO: 93630 - DNA, 25 bp, Mus musculus
acaagttgtttcgtgtgtttcaagt

SEQ ID NO: 93631 - DNA, 25 bp, Mus musculus
acaagtttatttcacacccagcacc

SEQ ID NO: 93632 - DNA, 25 bp, Mus musculus
acaagtttatttgacacccagcacc

SEQ ID NO: 93633 - DNA, 25 bp, Mus musculus
acaagtttcattccactttgaataa

SEQ ID NO: 93634 - DNA, 25 bp, Mus musculus
acaagtttcattgcactttgaataa

SEQ ID NO: 93635 - DNA, 25 bp, Mus musculus
acaagtttctctaattgcctttcca

SEQ ID NO: 93636 - DNA, 25 bp, Mus musculus
acaagtttctcttattgcctttcca

SEQ ID NO: 93637 - DNA, 25 bp, Mus musculus
acaagtttgaggctcatcctaggct

SEQ ID NO: 93638 - DNA, 25 bp, Mus musculus
acaagtttgagggtcatcctaggct

SEQ ID NO: 93639 - DNA, 25 bp, Mus musculus
acaagtttgattcacagtacccaca

SEQ ID NO: 93640 - DNA, 25 bp, Mus musculus
acaagtttgattgacagtacccaca

SEQ ID NO: 93641 - DNA, 25 bp, Mus musculus
acaagtttgcacagttagggtggtt

SEQ ID NO: 93642 - DNA, 25 bp, Mus musculus
acaagtttgcactgttagggtggtt

SEQ ID NO: 93643 - DNA, 25 bp, Mus musculus
acaagtttgtctatcttctggacta

SEQ ID NO: 93644 - DNA, 25 bp, Mus musculus
acaagtttgtctttcttctggacta

SEQ ID NO: 93645 - DNA, 25 bp, Mus musculus
acaagtttgtgcaacgctttgctgt

SEQ ID NO: 93646 - DNA, 25 bp, Mus musculus
acaagtttgtgctacgctttgctgt

SEQ ID NO: 93647 - DNA, 25 bp, Mus musculus
acaagttttgtcacatccacagtgt

SEQ ID NO: 93648 - DNA, 25 bp, Mus musculus
acaagttttgtctcatccacagtgt

SEQ ID NO: 93649 - DNA, 25 bp, Mus musculus
acaataaaatcaattctgtgctccc

SEQ ID NO: 93650 - DNA, 25 bp, Mus musculus
acaataaaatcatttctgtgctccc

SEQ ID NO: 93651 - DNA, 25 bp, Mus musculus
acaataaccggcatattcttttctt

SEQ ID NO: 93652 - DNA, 25 bp, Mus musculus
acaataaccggcttattcttttctt

SEQ ID NO: 93653 - DNA, 25 bp, Mus musculus
acaataactcacacagtgaaataaa

SEQ ID NO: 93654 - DNA, 25 bp, Mus musculus
acaataactcactcagtgaaataaa

SEQ ID NO: 93655 - DNA, 25 bp, Mus musculus
acaataactgttatgctgctacatg

SEQ ID NO: 93656 - DNA, 25 bp, Mus musculus
acaataactgttttgctgctacatg

SEQ ID NO: 93657 - DNA, 25 bp, Mus musculus
acaataagagtcaccttctcttctc

SEQ ID NO: 93658 - DNA, 25 bp, Mus musculus
acaataagagtctccttctcttctc

SEQ ID NO: 93659 - DNA, 25 bp, Mus musculus
acaataagcccaaactgccagtggt

SEQ ID NO: 93660 - DNA, 25 bp, Mus musculus
acaataagcccatactgccagtggt

SEQ ID NO: 93661 - DNA, 25 bp, Mus musculus
acaataagggaactggagccctgga

SEQ ID NO: 93662 - DNA, 25 bp, Mus musculus
acaataagggaagtggagccctgga

SEQ ID NO: 93663 - DNA, 25 bp, Mus musculus
acaataatgtcacccttaccaacct

SEQ ID NO: 93664 - DNA, 25 bp, Mus musculus
acaataatgtcagccttaccaacct

SEQ ID NO: 93665 - DNA, 25 bp, Mus musculus
acaataatgtggctcctgtctttct

SEQ ID NO: 93666 - DNA, 25 bp, Mus musculus
acaataatgtgggtcctgtctttct

SEQ ID NO: 93667 - DNA, 25 bp, Mus musculus
acaatacaccctcttaagtgctcag

SEQ ID NO: 93668 - DNA, 25 bp, Mus musculus
acaatacaccctgttaagtgctcag

SEQ ID NO: 93669 - DNA, 25 bp, Mus musculus
acaatacagagactgatgctcacag

SEQ ID NO: 93670 - DNA, 25 bp, Mus musculus
acaatacagagagtgatgctcacag

SEQ ID NO: 93671 - DNA, 25 bp, Mus musculus
acaatacagatcagtggccaggtta

SEQ ID NO: 93672 - DNA, 25 bp, Mus musculus
acaatacagatctgtggccaggtta

SEQ ID NO: 93673 - DNA, 25 bp, Mus musculus
acaatacatgttaacttttcaactt

SEQ ID NO: 93674 - DNA, 25 bp, Mus musculus
acaatacatgtttacttttcaactt

SEQ ID NO: 93675 - DNA, 25 bp, Mus musculus
acaatacctactccaatgtcattga

SEQ ID NO: 93676 - DNA, 25 bp, Mus musculus
acaatacctactgcaatgtcattga

SEQ ID NO: 93677 - DNA, 25 bp, Mus musculus
acaatactacttaacccttcgagag

SEQ ID NO: 93678 - DNA, 25 bp, Mus musculus
acaatactactttacccttcgagag

SEQ ID NO: 93679 - DNA, 25 bp, Mus musculus
acaatactctgacatcctaccagta

SEQ ID NO: 93680 - DNA, 25 bp, Mus musculus
acaatactctgagatcctaccagta

SEQ ID NO: 93681 - DNA, 25 bp, Mus musculus
acaatactctgtactttaacctatt

SEQ ID NO: 93682 - DNA, 25 bp, Mus musculus
acaatactctgttctttaacctatt

SEQ ID NO: 93683 - DNA, 25 bp, Mus musculus
acaatactgtaaatgtggctggaga

SEQ ID NO: 93684 - DNA, 25 bp, Mus musculus
acaatactgtaattgtggctggaga

SEQ ID NO: 93685 - DNA, 25 bp, Mus musculus
acaatagaagctcccctgctattgg

SEQ ID NO: 93686 - DNA, 25 bp, Mus musculus
acaatagaagctgccctgctattgg

SEQ ID NO: 93687 - DNA, 25 bp, Mus musculus
acaatagctgtgctttaagaattca

SEQ ID NO: 93688 - DNA, 25 bp, Mus musculus
acaatagctgtggtttaagaattca

SEQ ID NO: 93689 - DNA, 25 bp, Mus musculus
acaataggagcaacacatggacaat

SEQ ID NO: 93690 - DNA, 25 bp, Mus musculus
acaataggagcatcacatggacaat

SEQ ID NO: 93691 - DNA, 25 bp, Mus musculus
acaataggcgttatcctgtgtggcc

SEQ ID NO: 93692 - DNA, 25 bp, Mus musculus
acaataggcgttttcctgtgtggcc

SEQ ID NO: 93693 - DNA, 25 bp, Mus musculus
acaatagtattaacttagccatgac

SEQ ID NO: 93694 - DNA, 25 bp, Mus musculus
acaatagtattatcttagccatgac

SEQ ID NO: 93695 - DNA, 25 bp, Mus musculus
acaatagtgcaccattttatccggg

SEQ ID NO: 93696 - DNA, 25 bp, Mus musculus
acaatagtgcacgattttatccggg

SEQ ID NO: 93697 - DNA, 25 bp, Mus musculus
acaatataaagtatcttggtgtgac

SEQ ID NO: 93698 - DNA, 25 bp, Mus musculus
acaatataaagtttcttggtgtgac

SEQ ID NO: 93699 - DNA, 25 bp, Mus musculus
acaatataagctcccgctgcaggtt

SEQ ID NO: 93700 - DNA, 25 bp, Mus musculus
acaatataagctgccgctgcaggtt

SEQ ID NO: 93701 - DNA, 25 bp, Mus musculus
acaatatagacacccactcttcctt

SEQ ID NO: 93702 - DNA, 25 bp, Mus musculus
acaatatagacagccactcttcctt

SEQ ID NO: 93703 - DNA, 25 bp, Mus musculus
acaatattcctcagcaaatctcaga

SEQ ID NO: 93704 - DNA, 25 bp, Mus musculus
acaatattcctctgcaaatctcaga

SEQ ID NO: 93705 - DNA, 25 bp, Mus musculus
acaatattgaatactcttagctcgt

SEQ ID NO: 93706 - DNA, 25 bp, Mus musculus
acaatattgaattctcttagctcgt

SEQ ID NO: 93707 - DNA, 25 bp, Mus musculus
acaatattgtataccttggcattca

SEQ ID NO: 93708 - DNA, 25 bp, Mus musculus
acaatattgtattccttggcattca

SEQ ID NO: 93709 - DNA, 25 bp, Mus musculus
acaatattgtgtctgatctcattca

SEQ ID NO: 93710 - DNA, 25 bp, Mus musculus
acaatattgtgtgtgatctcattca

SEQ ID NO: 93711 - DNA, 25 bp, Mus musculus
acaatatttaaccttgttctggcca

SEQ ID NO: 93712 - DNA, 25 bp, Mus musculus
acaatatttaacgttgttctggcca

SEQ ID NO: 93713 - DNA, 25 bp, Mus musculus
acaatatttttcatacggagtgctg

SEQ ID NO: 93714 - DNA, 25 bp, Mus musculus
acaatatttttcttacggagtgctg

SEQ ID NO: 93715 - DNA, 25 bp, Mus musculus
acaatcaaagaaaacacctggaggg

SEQ ID NO: 93716 - DNA, 25 bp, Mus musculus
acaatcaaagaatacacctggaggg

SEQ ID NO: 93717 - DNA, 25 bp, Mus musculus
acaatcaaaggaacctccctggagc

SEQ ID NO: 93718 - DNA, 25 bp, Mus musculus
acaatcaaaggatcctccctggagc

SEQ ID NO: 93719 - DNA, 25 bp, Mus musculus
acaatcaaatgtaaggtaagtgcaa

SEQ ID NO: 93720 - DNA, 25 bp, Mus musculus
acaatcaaatgttaggtaagtgcaa

SEQ ID NO: 93721 - DNA, 25 bp, Mus musculus
acaatcaacttgagcacttggttca

SEQ ID NO: 93722 - DNA, 25 bp, Mus musculus
acaatcaacttgtgcacttggttca

SEQ ID NO: 93723 - DNA, 25 bp, Mus musculus
acaatcaatgagaacaccatccgcc

SEQ ID NO: 93724 - DNA, 25 bp, Mus musculus
acaatcaatgagtacaccatccgcc

SEQ ID NO: 93725 - DNA, 25 bp, Mus musculus
acaatcacagagatgaacagggctt

SEQ ID NO: 93726 - DNA, 25 bp, Mus musculus
acaatcacagagttgaacagggctt

SEQ ID NO: 93727 - DNA, 25 bp, Mus musculus
acaatcaccaatcttgtgggaccca

SEQ ID NO: 93728 - DNA, 25 bp, Mus musculus
acaatcaccaatgttgtgggaccca

SEQ ID NO: 93729 - DNA, 25 bp, Mus musculus
acaatcactcataagaaaatttggg

SEQ ID NO: 93730 - DNA, 25 bp, Mus musculus
acaatcactcattagaaaatttggg

SEQ ID NO: 93731 - DNA, 25 bp, Mus musculus
acaatcactgtgaaactcttaggag

SEQ ID NO: 93732 - DNA, 25 bp, Mus musculus
acaatcactgtgctcatgctgtcca

SEQ ID NO: 93733 - DNA, 25 bp, Mus musculus
acaatcactgtggtcatgctgtcca

SEQ ID NO: 93734 - DNA, 25 bp, Mus musculus
acaatcactgtgtaactcttaggag

SEQ ID NO: 93735 - DNA, 25 bp, Mus musculus
acaatcacttgacttctatctgcct

SEQ ID NO: 93736 - DNA, 25 bp, Mus musculus
acaatcacttgagttctatctgcct

SEQ ID NO: 93737 - DNA, 25 bp, Mus musculus
acaatcagagttcaggctgctgctc

SEQ ID NO: 93738 - DNA, 25 bp, Mus musculus
acaatcagagttgaggctgctgctc

SEQ ID NO: 93739 - DNA, 25 bp, Mus musculus
acaatcagctctagatttcttatat

SEQ ID NO: 93740 - DNA, 25 bp, Mus musculus
acaatcagctcttgatttcttatat

SEQ ID NO: 93741 - DNA, 25 bp, Mus musculus
acaatcatgcttcacctttttatac

SEQ ID NO: 93742 - DNA, 25 bp, Mus musculus
acaatcatgcttgacctttttatac

SEQ ID NO: 93743 - DNA, 25 bp, Mus musculus
acaatcatggtgctgctctttggct

SEQ ID NO: 93744 - DNA, 25 bp, Mus musculus
acaatcatggtggtgctctttggct

SEQ ID NO: 93745 - DNA, 25 bp, Mus musculus
acaatccacatgatgagaacgacta

SEQ ID NO: 93746 - DNA, 25 bp, Mus musculus
acaatccacatgttgagaacgacta

SEQ ID NO: 93747 - DNA, 25 bp, Mus musculus
acaatccagaatcgcttttgcacca

SEQ ID NO: 93748 - DNA, 25 bp, Mus musculus
acaatccagaatggcttttgcacca

SEQ ID NO: 93749 - DNA, 25 bp, Mus musculus
acaatccagactcttcttaagggct

SEQ ID NO: 93750 - DNA, 25 bp, Mus musculus
acaatccagactgttcttaagggct

SEQ ID NO: 93751 - DNA, 25 bp, Mus musculus
acaatccagggacattcttctcaac

SEQ ID NO: 93752 - DNA, 25 bp, Mus musculus
acaatccagggagattcttctcaac

SEQ ID NO: 93753 - DNA, 25 bp, Mus musculus
acaatccattaaaatttcgatctgg

SEQ ID NO: 93754 - DNA, 25 bp, Mus musculus
acaatccattaatatttcgatctgg

SEQ ID NO: 93755 - DNA, 25 bp, Mus musculus
acaatccattgcatccatgagagat

SEQ ID NO: 93756 - DNA, 25 bp, Mus musculus
acaatccattgcttccatgagagat

SEQ ID NO: 93757 - DNA, 25 bp, Mus musculus
acaatccattgtatgtttccctcgg

SEQ ID NO: 93758 - DNA, 25 bp, Mus musculus
acaatccattgtttgtttccctcgg

SEQ ID NO: 93759 - DNA, 25 bp, Mus musculus
acaatccatttcacaggacaaggaa

SEQ ID NO: 93760 - DNA, 25 bp, Mus musculus
acaatccatttctcaggacaaggaa

SEQ ID NO: 93761 - DNA, 25 bp, Mus musculus
acaatcccactgagcgggtgctatt

SEQ ID NO: 93762 - DNA, 25 bp, Mus musculus
acaatcccactgtgcgggtgctatt

SEQ ID NO: 93763 - DNA, 25 bp, Mus musculus
acaatcccagctatgggctctgcag

SEQ ID NO: 93764 - DNA, 25 bp, Mus musculus
acaatcccagctttgggctctgcag

SEQ ID NO: 93765 - DNA, 25 bp, Mus musculus
acaatcccatctcccaggtaatttt

SEQ ID NO: 93766 - DNA, 25 bp, Mus musculus
acaatcccatctgccaggtaatttt

SEQ ID NO: 93767 - DNA, 25 bp, Mus musculus
acaatccctgagaaccctagttaat

SEQ ID NO: 93768 - DNA, 25 bp, Mus musculus
acaatccctgagtaccctagttaat

SEQ ID NO: 93769 - DNA, 25 bp, Mus musculus
acaatccgactccatatgatttagg

SEQ ID NO: 93770 - DNA, 25 bp, Mus musculus
acaatccgactcgatatgatttagg

SEQ ID NO: 93771 - DNA, 25 bp, Mus musculus
acaatcctaagtatttgctgccctg

SEQ ID NO: 93772 - DNA, 25 bp, Mus musculus
acaatcctaagtttttgctgccctg

SEQ ID NO: 93773 - DNA, 25 bp, Mus musculus
acaatcctacagctaaacctacggg

SEQ ID NO: 93774 - DNA, 25 bp, Mus musculus
acaatcctacaggtaaacctacggg

SEQ ID NO: 93775 - DNA, 25 bp, Mus musculus
acaatcctcaaacgaggtcccgcgg

SEQ ID NO: 93776 - DNA, 25 bp, Mus musculus
acaatcctcaaaggaggtcccgcgg

SEQ ID NO: 93777 - DNA, 25 bp, Mus musculus
acaatcctctacagtctttccaaat

SEQ ID NO: 93778 - DNA, 25 bp, Mus musculus
acaatcctctactgtctttccaaat

SEQ ID NO: 93779 - DNA, 25 bp, Mus musculus
acaatcctgggtacgtatgttggct

SEQ ID NO: 93780 - DNA, 25 bp, Mus musculus
acaatcctgggttcgtatgttggct

SEQ ID NO: 93781 - DNA, 25 bp, Mus musculus
acaatcctgtatcctgagtccagat

SEQ ID NO: 93782 - DNA, 25 bp, Mus musculus
acaatcctgtatgctgagtccagat

SEQ ID NO: 93783 - DNA, 25 bp, Mus musculus
acaatcctgtctcggcagaatcggc

SEQ ID NO: 93784 - DNA, 25 bp, Mus musculus
acaatcctgtctgggcagaatcggc

SEQ ID NO: 93785 - DNA, 25 bp, Mus musculus
acaatcctgtgcctgtgcattagca

SEQ ID NO: 93786 - DNA, 25 bp, Mus musculus
acaatcctgtgcgtgtgcattagca

SEQ ID NO: 93787 - DNA, 25 bp, Mus musculus
acaatccttagtctactctttccac

SEQ ID NO: 93788 - DNA, 25 bp, Mus musculus
acaatccttagtgtactctttccac

SEQ ID NO: 93789 - DNA, 25 bp, Mus musculus
acaatccttgtgaccagaatcccag

SEQ ID NO: 93790 - DNA, 25 bp, Mus musculus
acaatccttgtgcagctccattcta

SEQ ID NO: 93791 - DNA, 25 bp, Mus musculus
acaatccttgtggagctccattcta

SEQ ID NO: 93792 - DNA, 25 bp, Mus musculus
acaatccttgtgtccagaatcccag

SEQ ID NO: 93793 - DNA, 25 bp, Mus musculus
acaatcctttcgactccacacggtg

SEQ ID NO: 93794 - DNA, 25 bp, Mus musculus
acaatcctttcgtctccacacggtg

SEQ ID NO: 93795 - DNA, 25 bp, Mus musculus
acaatccttttgacttggagcaaac

SEQ ID NO: 93796 - DNA, 25 bp, Mus musculus
acaatccttttgtcttggagcaaac

SEQ ID NO: 93797 - DNA, 25 bp, Mus musculus
acaatcgacagcaatgcgaaagttg

SEQ ID NO: 93798 - DNA, 25 bp, Mus musculus
acaatcgacagctatgcgaaagttg

SEQ ID NO: 93799 - DNA, 25 bp, Mus musculus
acaatcgactgcagtgtcacgtgcc

SEQ ID NO: 93800 - DNA, 25 bp, Mus musculus
acaatcgactgctgtgtcacgtgcc

SEQ ID NO: 93801 - DNA, 25 bp, Mus musculus
acaatcgattcgcaagcactcactt

SEQ ID NO: 93802 - DNA, 25 bp, Mus musculus
acaatcgattcggaagcactcactt

SEQ ID NO: 93803 - DNA, 25 bp, Mus musculus
acaatcgcctatctggagtgaccat

SEQ ID NO: 93804 - DNA, 25 bp, Mus musculus
acaatcgcctatgtggagtgaccat

SEQ ID NO: 93805 - DNA, 25 bp, Mus musculus
acaatcgctctcatgtttagaagat

SEQ ID NO: 93806 - DNA, 25 bp, Mus musculus
acaatcgctctcttgtttagaagat

SEQ ID NO: 93807 - DNA, 25 bp, Mus musculus
acaatcgctgagaaaggtcttttag

SEQ ID NO: 93808 - DNA, 25 bp, Mus musculus
acaatcgctgagtaaggtcttttag

SEQ ID NO: 93809 - DNA, 25 bp, Mus musculus
acaatcgggcccagctttaaccata

SEQ ID NO: 93810 - DNA, 25 bp, Mus musculus
acaatcgggccctgctttaaccata

SEQ ID NO: 93811 - DNA, 25 bp, Mus musculus
acaatcgtgttgcttcatgtgctgc

SEQ ID NO: 93812 - DNA, 25 bp, Mus musculus
acaatcgtgttggttcatgtgctgc

SEQ ID NO: 93813 - DNA, 25 bp, Mus musculus
acaatcgttgcgactgaggtcaggt

SEQ ID NO: 93814 - DNA, 25 bp, Mus musculus
acaatcgttgcgtctgaggtcaggt

SEQ ID NO: 93815 - DNA, 25 bp, Mus musculus
acaatctaatccactcacctaaggt

SEQ ID NO: 93816 - DNA, 25 bp, Mus musculus
acaatctaatcctctcacctaaggt

SEQ ID NO: 93817 - DNA, 25 bp, Mus musculus
acaatctacttgactatgaagggat

SEQ ID NO: 93818 - DNA, 25 bp, Mus musculus
acaatctacttgtctatgaagggat

SEQ ID NO: 93819 - DNA, 25 bp, Mus musculus
acaatctataacactatctccagga

SEQ ID NO: 93820 - DNA, 25 bp, Mus musculus
acaatctataactctatctccagga

SEQ ID NO: 93821 - DNA, 25 bp, Mus musculus
acaatctattgtcctttctcagtcc

SEQ ID NO: 93822 - DNA, 25 bp, Mus musculus
acaatctattgtgctttctcagtcc

SEQ ID NO: 93823 - DNA, 25 bp, Mus musculus
acaatctcacttatcggtagcctat

SEQ ID NO: 93824 - DNA, 25 bp, Mus musculus
acaatctcacttttcggtagcctat

SEQ ID NO: 93825 - DNA, 25 bp, Mus musculus
acaatctcatcaacagctgttgaca

SEQ ID NO: 93826 - DNA, 25 bp, Mus musculus
acaatctcatcatcagctgttgaca

SEQ ID NO: 93827 - DNA, 25 bp, Mus musculus
acaatctcatgtagtctcagctggc

SEQ ID NO: 93828 - DNA, 25 bp, Mus musculus
acaatctcatgttgtctcagctggc

SEQ ID NO: 93829 - DNA, 25 bp, Mus musculus
acaatctcctaaatcttgctaccta

SEQ ID NO: 93830 - DNA, 25 bp, Mus musculus
acaatctcctaattcttgctaccta

SEQ ID NO: 93831 - DNA, 25 bp, Mus musculus
acaatctcgttgacgggaagcctgg

SEQ ID NO: 93832 - DNA, 25 bp, Mus musculus
acaatctcgttgtcgggaagcctgg

SEQ ID NO: 93833 - DNA, 25 bp, Mus musculus
acaatctcttcacgagtcttcacta

SEQ ID NO: 93834 - DNA, 25 bp, Mus musculus
acaatctcttcaggagtcttcacta

SEQ ID NO: 93835 - DNA, 25 bp, Mus musculus
acaatctctttcagactctagtcat

SEQ ID NO: 93836 - DNA, 25 bp, Mus musculus
acaatctctttctgactctagtcat

SEQ ID NO: 93837 - DNA, 25 bp, Mus musculus
acaatctgacttagagttactccat

SEQ ID NO: 93838 - DNA, 25 bp, Mus musculus
acaatctgactttgagttactccat

SEQ ID NO: 93839 - DNA, 25 bp, Mus musculus
acaatctgaggtcgtcaggccttct

SEQ ID NO: 93840 - DNA, 25 bp, Mus musculus
acaatctgaggtggtcaggccttct

SEQ ID NO: 93841 - DNA, 25 bp, Mus musculus
acaatctgcaagatttctcgggacc

SEQ ID NO: 93842 - DNA, 25 bp, Mus musculus
acaatctgcaagttttctcgggacc

SEQ ID NO: 93843 - DNA, 25 bp, Mus musculus
acaatctgcactacattctttcaac

SEQ ID NO: 93844 - DNA, 25 bp, Mus musculus
acaatctgcacttcattctttcaac

SEQ ID NO: 93845 - DNA, 25 bp, Mus musculus
acaatctgcatgagggtttcactgt

SEQ ID NO: 93846 - DNA, 25 bp, Mus musculus
acaatctgcatgtgggtttcactgt

SEQ ID NO: 93847 - DNA, 25 bp, Mus musculus
acaatctgggtgcaaacctgggcat

SEQ ID NO: 93848 - DNA, 25 bp, Mus musculus
acaatctgggtggaaacctgggcat

SEQ ID NO: 93849 - DNA, 25 bp, Mus musculus
acaatctgttagatctccagctcct

SEQ ID NO: 93850 - DNA, 25 bp, Mus musculus
acaatctgttagttctccagctcct

SEQ ID NO: 93851 - DNA, 25 bp, Mus musculus
acaatcttctacatcacaggtgctg

SEQ ID NO: 93852 - DNA, 25 bp, Mus musculus
acaatcttctacttcacaggtgctg

SEQ ID NO: 93853 - DNA, 25 bp, Mus musculus
acaatcttctcaaggaaaggtgccc

SEQ ID NO: 93854 - DNA, 25 bp, Mus musculus
acaatcttctcatggaaaggtgccc

SEQ ID NO: 93855 - DNA, 25 bp, Mus musculus
acaatcttgagacccaccaggagag

SEQ ID NO: 93856 - DNA, 25 bp, Mus musculus
acaatcttgagagccaccaggagag

SEQ ID NO: 93857 - DNA, 25 bp, Mus musculus
acaatcttgcttaatgtctctcctt

SEQ ID NO: 93858 - DNA, 25 bp, Mus musculus
acaatcttgctttatgtctctcctt

SEQ ID NO: 93859 - DNA, 25 bp, Mus musculus
acaatcttggtgatatattgattag

SEQ ID NO: 93860 - DNA, 25 bp, Mus musculus
acaatcttggtgttatattgattag

SEQ ID NO: 93861 - DNA, 25 bp, Mus musculus
acaatcttgttgaggaaactgcagt

SEQ ID NO: 93862 - DNA, 25 bp, Mus musculus
acaatcttgttgtggaaactgcagt

SEQ ID NO: 93863 - DNA, 25 bp, Mus musculus
acaatctttgccctgagttcagaca

SEQ ID NO: 93864 - DNA, 25 bp, Mus musculus
acaatctttgccgtgagttcagaca

SEQ ID NO: 93865 - DNA, 25 bp, Mus musculus
acaatgaaattgacactgcaagaaa

SEQ ID NO: 93866 - DNA, 25 bp, Mus musculus
acaatgaaattgtcactgcaagaaa

SEQ ID NO: 93867 - DNA, 25 bp, Mus musculus
acaatgaatcttatcctctactgga

SEQ ID NO: 93868 - DNA, 25 bp, Mus musculus
acaatgaatcttttcctctactgga

SEQ ID NO: 93869 - DNA, 25 bp, Mus musculus
acaatgaccttcctatggacagcca

SEQ ID NO: 93870 - DNA, 25 bp, Mus musculus
acaatgaccttcgtatggacagcca

SEQ ID NO: 93871 - DNA, 25 bp, Mus musculus
acaatgactagcagttgctctccaa

SEQ ID NO: 93872 - DNA, 25 bp, Mus musculus
acaatgactagctgttgctctccaa

SEQ ID NO: 93873 - DNA, 25 bp, Mus musculus
acaatgactccaatccagtgaggat

SEQ ID NO: 93874 - DNA, 25 bp, Mus musculus
acaatgactccattccagtgaggat

SEQ ID NO: 93875 - DNA, 25 bp, Mus musculus
acaatgactgcgctggtacccatgg

SEQ ID NO: 93876 - DNA, 25 bp, Mus musculus
acaatgactgcggtggtacccatgg

SEQ ID NO: 93877 - DNA, 25 bp, Mus musculus
acaatgagagtgaggtgcaggtcct

SEQ ID NO: 93878 - DNA, 25 bp, Mus musculus
acaatgagagtgtggtgcaggtcct

SEQ ID NO: 93879 - DNA, 25 bp, Mus musculus
acaatgagatgtatctgaggtcaaa

SEQ ID NO: 93880 - DNA, 25 bp, Mus musculus
acaatgagatgtttctgaggtcaaa

SEQ ID NO: 93881 - DNA, 25 bp, Mus musculus
acaatgagctgcctgtggcccctga

SEQ ID NO: 93882 - DNA, 25 bp, Mus musculus
acaatgagctgcgtgtggcccctga

SEQ ID NO: 93883 - DNA, 25 bp, Mus musculus
acaatgagctggctggcaggcctca

SEQ ID NO: 93884 - DNA, 25 bp, Mus musculus
acaatgagctgggtggcaggcctca

SEQ ID NO: 93885 - DNA, 25 bp, Mus musculus
acaatgagctttcccttagcctata

SEQ ID NO: 93886 - DNA, 25 bp, Mus musculus
acaatgagctttgccttagcctata

SEQ ID NO: 93887 - DNA, 25 bp, Mus musculus
acaatgaggacgactaccttctggg

SEQ ID NO: 93888 - DNA, 25 bp, Mus musculus
acaatgaggacgtctaccttctggg

SEQ ID NO: 93889 - DNA, 25 bp, Mus musculus
acaatgaggcaaatggcatcaagat

SEQ ID NO: 93890 - DNA, 25 bp, Mus musculus
acaatgaggcaattggcatcaagat

SEQ ID NO: 93891 - DNA, 25 bp, Mus musculus
acaatgagggccactgtgtgctgga

SEQ ID NO: 93892 - DNA, 25 bp, Mus musculus
acaatgagggcctctgtgtgctgga

SEQ ID NO: 93893 - DNA, 25 bp, Mus musculus
acaatgagtcatcgcatggtcccat

SEQ ID NO: 93894 - DNA, 25 bp, Mus musculus
acaatgagtcatggcatggtcccat

SEQ ID NO: 93895 - DNA, 25 bp, Mus musculus
acaatgagtgtgatgctccatgtct

SEQ ID NO: 93896 - DNA, 25 bp, Mus musculus
acaatgagtgtgttgctccatgtct

SEQ ID NO: 93897 - DNA, 25 bp, Mus musculus
acaatgagtttcagcctcaggagcc

SEQ ID NO: 93898 - DNA, 25 bp, Mus musculus
acaatgagtttctgcctcaggagcc

SEQ ID NO: 93899 - DNA, 25 bp, Mus musculus
acaatgataacaatgcgggcttttc

SEQ ID NO: 93900 - DNA, 25 bp, Mus musculus
acaatgataacattgcgggcttttc

SEQ ID NO: 93901 - DNA, 25 bp, Mus musculus
acaatgatatgtccttctcctgatc

SEQ ID NO: 93902 - DNA, 25 bp, Mus musculus
acaatgatatgtgcttctcctgatc

SEQ ID NO: 93903 - DNA, 25 bp, Mus musculus
acaatgatcgacacctggtctacgg

SEQ ID NO: 93904 - DNA, 25 bp, Mus musculus
acaatgatcgactcctggtctacgg

SEQ ID NO: 93905 - DNA, 25 bp, Mus musculus
acaatgatctctaaagtaaccctaa

SEQ ID NO: 93906 - DNA, 25 bp, Mus musculus
acaatgatctcttaagtaaccctaa

SEQ ID NO: 93907 - DNA, 25 bp, Mus musculus
acaatgatgcccctgtgcccatcat

SEQ ID NO: 93908 - DNA, 25 bp, Mus musculus
acaatgatgcccgtgtgcccatcat

SEQ ID NO: 93909 - DNA, 25 bp, Mus musculus
acaatgatgtcgaacttttccaaat

SEQ ID NO: 93910 - DNA, 25 bp, Mus musculus
acaatgatgtcgtacttttccaaat

SEQ ID NO: 93911 - DNA, 25 bp, Mus musculus
acaatgatgtggaccgcttcctcat

SEQ ID NO: 93912 - DNA, 25 bp, Mus musculus
acaatgatgtggtccgcttcctcat

SEQ ID NO: 93913 - DNA, 25 bp, Mus musculus
acaatgattaatcctgtgccgcctg

SEQ ID NO: 93914 - DNA, 25 bp, Mus musculus
acaatgattaatgctgtgccgcctg

SEQ ID NO: 93915 - DNA, 25 bp, Mus musculus
acaatgattcccaatcctacccaga

SEQ ID NO: 93916 - DNA, 25 bp, Mus musculus
acaatgattccctatcctacccaga

SEQ ID NO: 93917 - DNA, 25 bp, Mus musculus
acaatgattggtccttagccccgaa

SEQ ID NO: 93918 - DNA, 25 bp, Mus musculus
acaatgattggtgcttagccccgaa

SEQ ID NO: 93919 - DNA, 25 bp, Mus musculus
acaatgcaacagacacgggggagtg

SEQ ID NO: 93920 - DNA, 25 bp, Mus musculus
acaatgcaacagtcacgggggagtg

SEQ ID NO: 93921 - DNA, 25 bp, Mus musculus
acaatgcaagcactcctaagagtat

SEQ ID NO: 93922 - DNA, 25 bp, Mus musculus
acaatgcaagcagtcctaagagtat

SEQ ID NO: 93923 - DNA, 25 bp, Mus musculus
acaatgcagactcttccgtgtgggt

SEQ ID NO: 93924 - DNA, 25 bp, Mus musculus
acaatgcagactgttccgtgtgggt

SEQ ID NO: 93925 - DNA, 25 bp, Mus musculus
acaatgcattcaaacctggctggga

SEQ ID NO: 93926 - DNA, 25 bp, Mus musculus
acaatgcattcatacctggctggga

SEQ ID NO: 93927 - DNA, 25 bp, Mus musculus
acaatgccatagatagtcctctcct

SEQ ID NO: 93928 - DNA, 25 bp, Mus musculus
acaatgccatagttagtcctctcct

SEQ ID NO: 93929 - DNA, 25 bp, Mus musculus
acaatgccatctccggtgccaacta

SEQ ID NO: 93930 - DNA, 25 bp, Mus musculus
acaatgccatctgcggtgccaacta

SEQ ID NO: 93931 - DNA, 25 bp, Mus musculus
acaatgccatgtatttcctctcttt

SEQ ID NO: 93932 - DNA, 25 bp, Mus musculus
acaatgccatgtttttcctctcttt

SEQ ID NO: 93933 - DNA, 25 bp, Mus musculus
acaatgcccgggacatgccagatag

SEQ ID NO: 93934 - DNA, 25 bp, Mus musculus
acaatgcccgggtcatgccagatag

SEQ ID NO: 93935 - DNA, 25 bp, Mus musculus
acaatgcccgtgaccagtggttgca

SEQ ID NO: 93936 - DNA, 25 bp, Mus musculus
acaatgcccgtgtccagtggttgca

SEQ ID NO: 93937 - DNA, 25 bp, Mus musculus
acaatgccctagatgcccgtcatgc

SEQ ID NO: 93938 - DNA, 25 bp, Mus musculus
acaatgccctagttgcccgtcatgc

SEQ ID NO: 93939 - DNA, 25 bp, Mus musculus
acaatgccctataacagttgctgta

SEQ ID NO: 93940 - DNA, 25 bp, Mus musculus
acaatgccctattacagttgctgta

SEQ ID NO: 93941 - DNA, 25 bp, Mus musculus
acaatgccctctagttttgttttat

SEQ ID NO: 93942 - DNA, 25 bp, Mus musculus
acaatgccctcttgttttgttttat

SEQ ID NO: 93943 - DNA, 25 bp, Mus musculus
acaatgccgttaccgaagagccctt

SEQ ID NO: 93944 - DNA, 25 bp, Mus musculus
acaatgccgttagcgaagagccctt

SEQ ID NO: 93945 - DNA, 25 bp, Mus musculus
acaatgcctgatatagctagtactc

SEQ ID NO: 93946 - DNA, 25 bp, Mus musculus
acaatgcctgatttagctagtactc

SEQ ID NO: 93947 - DNA, 25 bp, Mus musculus
acaatgcctggtcctttctgtcata

SEQ ID NO: 93948 - DNA, 25 bp, Mus musculus
acaatgcctggtgctttctgtcata

SEQ ID NO: 93949 - DNA, 25 bp, Mus musculus
acaatgcctgtgatccaggtcagtg

SEQ ID NO: 93950 - DNA, 25 bp, Mus musculus
acaatgcctgtgttccaggtcagtg

SEQ ID NO: 93951 - DNA, 25 bp, Mus musculus
acaatgcctttaaaccagttgtggt

SEQ ID NO: 93952 - DNA, 25 bp, Mus musculus
acaatgcctttataccagttgtggt

SEQ ID NO: 93953 - DNA, 25 bp, Mus musculus
acaatgcgagttccttccgaaggct

SEQ ID NO: 93954 - DNA, 25 bp, Mus musculus
acaatgcgagttgcttccgaaggct

SEQ ID NO: 93955 - DNA, 25 bp, Mus musculus
acaatgcgggcaaaaccactcttct

SEQ ID NO: 93956 - DNA, 25 bp, Mus musculus
acaatgcgggcataaccactcttct

SEQ ID NO: 93957 - DNA, 25 bp, Mus musculus
acaatgctacaaaggtgtccccgct

SEQ ID NO: 93958 - DNA, 25 bp, Mus musculus
acaatgctacaatggtgtccccgct

SEQ ID NO: 93959 - DNA, 25 bp, Mus musculus
acaatgctatctctatctcagtggc

SEQ ID NO: 93960 - DNA, 25 bp, Mus musculus
acaatgctatctgtatctcagtggc

SEQ ID NO: 93961 - DNA, 25 bp, Mus musculus
acaatgctcaaaacactgccagaag

SEQ ID NO: 93962 - DNA, 25 bp, Mus musculus
acaatgctcaaatcactgccagaag

SEQ ID NO: 93963 - DNA, 25 bp, Mus musculus
acaatgctgcataaccgataggacc

SEQ ID NO: 93964 - DNA, 25 bp, Mus musculus
acaatgctgcattaccgataggacc

SEQ ID NO: 93965 - DNA, 25 bp, Mus musculus
acaatgctgtaccagcatctgctcc

SEQ ID NO: 93966 - DNA, 25 bp, Mus musculus
acaatgctgtacgagcatctgctcc

SEQ ID NO: 93967 - DNA, 25 bp, Mus musculus
acaatgctgtgtcgctttgaatgcc

SEQ ID NO: 93968 - DNA, 25 bp, Mus musculus
acaatgctgtgtggctttgaatgcc

SEQ ID NO: 93969 - DNA, 25 bp, Mus musculus
acaatgctgtttccttcacctggga

SEQ ID NO: 93970 - DNA, 25 bp, Mus musculus
acaatgctgtttgcttcacctggga

SEQ ID NO: 93971 - DNA, 25 bp, Mus musculus
acaatgcttgccaatgatgcctcca

SEQ ID NO: 93972 - DNA, 25 bp, Mus musculus
acaatgcttgcctatgatgcctcca

SEQ ID NO: 93973 - DNA, 25 bp, Mus musculus
acaatgctttagctgcagtggatct

SEQ ID NO: 93974 - DNA, 25 bp, Mus musculus
acaatgctttaggtgcagtggatct

SEQ ID NO: 93975 - DNA, 25 bp, Mus musculus
acaatgctttgcaccctgagtagga

SEQ ID NO: 93976 - DNA, 25 bp, Mus musculus
acaatgctttgctccctgagtagga

SEQ ID NO: 93977 - DNA, 25 bp, Mus musculus
acaatggaatgcactgccttttaaa

SEQ ID NO: 93978 - DNA, 25 bp, Mus musculus
acaatggaatgctctgccttttaaa

SEQ ID NO: 93979 - DNA, 25 bp, Mus musculus
acaatggactacatttcagctatga

SEQ ID NO: 93980 - DNA, 25 bp, Mus musculus
acaatggactacttttcagctatga

SEQ ID NO: 93981 - DNA, 25 bp, Mus musculus
acaatggagtccaggttccttggct

SEQ ID NO: 93982 - DNA, 25 bp, Mus musculus
acaatggagtcctggttccttggct

SEQ ID NO: 93983 - DNA, 25 bp, Mus musculus
acaatggagtcgactctgtcctgga

SEQ ID NO: 93984 - DNA, 25 bp, Mus musculus
acaatggagtcgtctctgtcctgga

SEQ ID NO: 93985 - DNA, 25 bp, Mus musculus
acaatggatcctatttcttgtccct

SEQ ID NO: 93986 - DNA, 25 bp, Mus musculus
acaatggatcctttttcttgtccct

SEQ ID NO: 93987 - DNA, 25 bp, Mus musculus
acaatggcacagacacacctggaca

SEQ ID NO: 93988 - DNA, 25 bp, Mus musculus
acaatggcacagtcacacctggaca

SEQ ID NO: 93989 - DNA, 25 bp, Mus musculus
acaatggcagggacctcctggaaca

SEQ ID NO: 93990 - DNA, 25 bp, Mus musculus
acaatggcagggtcctcctggaaca

SEQ ID NO: 93991 - DNA, 25 bp, Mus musculus
acaatggccattatattgtcctggg

SEQ ID NO: 93992 - DNA, 25 bp, Mus musculus
acaatggccattttattgtcctggg

SEQ ID NO: 93993 - DNA, 25 bp, Mus musculus
acaatggccttgatgactctgactc

SEQ ID NO: 93994 - DNA, 25 bp, Mus musculus
acaatggccttgttgactctgactc

SEQ ID NO: 93995 - DNA, 25 bp, Mus musculus
acaatggctatgaacctaggtgtta

SEQ ID NO: 93996 - DNA, 25 bp, Mus musculus
acaatggctatgtacctaggtgtta

SEQ ID NO: 93997 - DNA, 25 bp, Mus musculus
acaatgggaccgaactgctttcttc

SEQ ID NO: 93998 - DNA, 25 bp, Mus musculus
acaatgggaccgtactgctttcttc

SEQ ID NO: 93999 - DNA, 25 bp, Mus musculus
acaatgggcaatactgggcggtgac

SEQ ID NO: 94000 - DNA, 25 bp, Mus musculus
acaatgggcaattctgggcggtgac

SEQ ID NO: 94001 - DNA, 25 bp, Mus musculus
acaatgggccataccggttgatgct

SEQ ID NO: 94002 - DNA, 25 bp, Mus musculus
acaatgggccattccggttgatgct

SEQ ID NO: 94003 - DNA, 25 bp, Mus musculus
acaatgggctctactgtgtggacag

SEQ ID NO: 94004 - DNA, 25 bp, Mus musculus
acaatgggctcttctgtgtggacag

SEQ ID NO: 94005 - DNA, 25 bp, Mus musculus
acaatgggctgtcacacacacctca

SEQ ID NO: 94006 - DNA, 25 bp, Mus musculus
acaatgggctgtgacacacacctca

SEQ ID NO: 94007 - DNA, 25 bp, Mus musculus
acaatgggtacaccagtagccggaa

SEQ ID NO: 94008 - DNA, 25 bp, Mus musculus
acaatgggtacagcagtagccggaa

SEQ ID NO: 94009 - DNA, 25 bp, Mus musculus
acaatgggtagaaagccctcctcca

SEQ ID NO: 94010 - DNA, 25 bp, Mus musculus
acaatgggtagatagccctcctcca

SEQ ID NO: 94011 - DNA, 25 bp, Mus musculus
acaatggtaagaagctactgctcag

SEQ ID NO: 94012 - DNA, 25 bp, Mus musculus
acaatggtaagatgctactgctcag

SEQ ID NO: 94013 - DNA, 25 bp, Mus musculus
acaatggtcagtcttctcaaacgga

SEQ ID NO: 94014 - DNA, 25 bp, Mus musculus
acaatggtcagtgttctcaaacgga

SEQ ID NO: 94015 - DNA, 25 bp, Mus musculus
acaatggtcatgaacacctgctcgg

SEQ ID NO: 94016 - DNA, 25 bp, Mus musculus
acaatggtcatgtacacctgctcgg

SEQ ID NO: 94017 - DNA, 25 bp, Mus musculus
acaatggtcattcccgtgagtttaa

SEQ ID NO: 94018 - DNA, 25 bp, Mus musculus
acaatggtcattgccgtgagtttaa

SEQ ID NO: 94019 - DNA, 25 bp, Mus musculus
acaatggtctttcagtttcaaacgc

SEQ ID NO: 94020 - DNA, 25 bp, Mus musculus
acaatggtctttgagtttcaaacgc

SEQ ID NO: 94021 - DNA, 25 bp, Mus musculus
acaatggtggatcccagcaagactg

SEQ ID NO: 94022 - DNA, 25 bp, Mus musculus
acaatggtggatgccagcaagactg

SEQ ID NO: 94023 - DNA, 25 bp, Mus musculus
acaatggttgctcggatagtagact

SEQ ID NO: 94024 - DNA, 25 bp, Mus musculus
acaatggttgctgggatagtagact

SEQ ID NO: 94025 - DNA, 25 bp, Mus musculus
acaatggttgtgagcggtcttcgga

SEQ ID NO: 94026 - DNA, 25 bp, Mus musculus
acaatggttgtgtgcggtcttcgga

SEQ ID NO: 94027 - DNA, 25 bp, Mus musculus
acaatgtaaggtaccaggtggccac

SEQ ID NO: 94028 - DNA, 25 bp, Mus musculus
acaatgtaaggttccaggtggccac

SEQ ID NO: 94029 - DNA, 25 bp, Mus musculus
acaatgtacaggacctcttttccgc

SEQ ID NO: 94030 - DNA, 25 bp, Mus musculus
acaatgtacaggtcctcttttccgc

SEQ ID NO: 94031 - DNA, 25 bp, Mus musculus
acaatgtacgatatcccttagagtg

SEQ ID NO: 94032 - DNA, 25 bp, Mus musculus
acaatgtacgatttcccttagagtg

SEQ ID NO: 94033 - DNA, 25 bp, Mus musculus
acaatgtagaatatttcctttctca

SEQ ID NO: 94034 - DNA, 25 bp, Mus musculus
acaatgtagaatttttcctttctca

SEQ ID NO: 94035 - DNA, 25 bp, Mus musculus
acaatgtagattatgtatggtccat

SEQ ID NO: 94036 - DNA, 25 bp, Mus musculus
acaatgtagattttgtatggtccat

SEQ ID NO: 94037 - DNA, 25 bp, Mus musculus
acaatgtatatccttttgggtctgg

SEQ ID NO: 94038 - DNA, 25 bp, Mus musculus
acaatgtatatcgttttgggtctgg

SEQ ID NO: 94039 - DNA, 25 bp, Mus musculus
acaatgtcccataatgtatctcagg

SEQ ID NO: 94040 - DNA, 25 bp, Mus musculus
acaatgtcccattatgtatctcagg

SEQ ID NO: 94041 - DNA, 25 bp, Mus musculus
acaatgtcctatctggaggcaccac

SEQ ID NO: 94042 - DNA, 25 bp, Mus musculus
acaatgtcctatgtggaggcaccac

SEQ ID NO: 94043 - DNA, 25 bp, Mus musculus
acaatgtcgccgagatttgggctct

SEQ ID NO: 94044 - DNA, 25 bp, Mus musculus
acaatgtcgccgtgatttgggctct

SEQ ID NO: 94045 - DNA, 25 bp, Mus musculus
acaatgtctacactggtcgctgagt

SEQ ID NO: 94046 - DNA, 25 bp, Mus musculus
acaatgtctacagtggtcgctgagt

SEQ ID NO: 94047 - DNA, 25 bp, Mus musculus
acaatgtctgtgaactggacctggt

SEQ ID NO: 94048 - DNA, 25 bp, Mus musculus
acaatgtctgtgtactggacctggt

SEQ ID NO: 94049 - DNA, 25 bp, Mus musculus
acaatgtctttgaaccccatgtggc

SEQ ID NO: 94050 - DNA, 25 bp, Mus musculus
acaatgtctttgtaccccatgtggc

SEQ ID NO: 94051 - DNA, 25 bp, Mus musculus
acaatgtgaaacctcttgctgctgc

SEQ ID NO: 94052 - DNA, 25 bp, Mus musculus
acaatgtgaaacgtcttgctgctgc

SEQ ID NO: 94053 - DNA, 25 bp, Mus musculus
acaatgtgcattctgagggtacttc

SEQ ID NO: 94054 - DNA, 25 bp, Mus musculus
acaatgtgcattgtgagggtacttc

SEQ ID NO: 94055 - DNA, 25 bp, Mus musculus
acaatgtgccaacatggaggcccac

SEQ ID NO: 94056 - DNA, 25 bp, Mus musculus
acaatgtgccaagatggaggcccac

SEQ ID NO: 94057 - DNA, 25 bp, Mus musculus
acaatgtggaccaccctggaagtgc

SEQ ID NO: 94058 - DNA, 25 bp, Mus musculus
acaatgtggacctccctggaagtgc

SEQ ID NO: 94059 - DNA, 25 bp, Mus musculus
acaatgtgtactcgcctttggttca

SEQ ID NO: 94060 - DNA, 25 bp, Mus musculus
acaatgtgtactggcctttggttca

SEQ ID NO: 94061 - DNA, 25 bp, Mus musculus
acaatgtgtctgatgtgtcctgcat

SEQ ID NO: 94062 - DNA, 25 bp, Mus musculus
acaatgtgtctgttgtgtcctgcat

SEQ ID NO: 94063 - DNA, 25 bp, Mus musculus
acaatgttcttgcagcagcttgcaa

SEQ ID NO: 94064 - DNA, 25 bp, Mus musculus
acaatgttcttggagcagcttgcaa

SEQ ID NO: 94065 - DNA, 25 bp, Mus musculus
acaatgttgggcctgattttctaca

SEQ ID NO: 94066 - DNA, 25 bp, Mus musculus
acaatgttgggcgtgattttctaca

SEQ ID NO: 94067 - DNA, 25 bp, Mus musculus
acaatgttgtgcatggccttcaccc

SEQ ID NO: 94068 - DNA, 25 bp, Mus musculus
acaatgttgtgcttggccttcaccc

SEQ ID NO: 94069 - DNA, 25 bp, Mus musculus
acaatgttgtggaggccttgtgccc

SEQ ID NO: 94070 - DNA, 25 bp, Mus musculus
acaatgttgtggtggccttgtgccc

SEQ ID NO: 94071 - DNA, 25 bp, Mus musculus
acaatgttgttaccgtgtccccata

SEQ ID NO: 94072 - DNA, 25 bp, Mus musculus
acaatgttgttagcgtgtccccata

SEQ ID NO: 94073 - DNA, 25 bp, Mus musculus
acaatgtttccacgttagcgccaga

SEQ ID NO: 94074 - DNA, 25 bp, Mus musculus
acaatgtttccaggttagcgccaga

SEQ ID NO: 94075 - DNA, 25 bp, Mus musculus
acaatgtttcgtaggcacagaatcc

SEQ ID NO: 94076 - DNA, 25 bp, Mus musculus
acaatgtttcgttggcacagaatcc

SEQ ID NO: 94077 - DNA, 25 bp, Mus musculus
acaatgtttctccttatctttcctc

SEQ ID NO: 94078 - DNA, 25 bp, Mus musculus
acaatgtttctcgttatctttcctc

SEQ ID NO: 94079 - DNA, 25 bp, Mus musculus
acaatgtttctgactcaatgattca

SEQ ID NO: 94080 - DNA, 25 bp, Mus musculus
acaatgtttctgtctcaatgattca

SEQ ID NO: 94081 - DNA, 25 bp, Mus musculus
acaattaaggcacaggaacacagat

SEQ ID NO: 94082 - DNA, 25 bp, Mus musculus
acaattaaggcagaggaacacagat

SEQ ID NO: 94083 - DNA, 25 bp, Mus musculus
acaattacaagaaccccatctgtct

SEQ ID NO: 94084 - DNA, 25 bp, Mus musculus
acaattacaagatccccatctgtct

SEQ ID NO: 94085 - DNA, 25 bp, Mus musculus
acaattacacgtctggcaaggctct

SEQ ID NO: 94086 - DNA, 25 bp, Mus musculus
acaattacacgtgtggcaaggctct

SEQ ID NO: 94087 - DNA, 25 bp, Mus musculus
acaattaccaagcatgccgctcggc

SEQ ID NO: 94088 - DNA, 25 bp, Mus musculus
acaattaccaaggatgccgctcggc

SEQ ID NO: 94089 - DNA, 25 bp, Mus musculus
acaattaccggacctactgcataag

SEQ ID NO: 94090 - DNA, 25 bp, Mus musculus
acaattaccggagctactgcataag

SEQ ID NO: 94091 - DNA, 25 bp, Mus musculus
acaattacctccaacacctcagaga

SEQ ID NO: 94092 - DNA, 25 bp, Mus musculus
acaattacctccaatcaccatgttc

SEQ ID NO: 94093 - DNA, 25 bp, Mus musculus
acaattacctcctacacctcagaga

SEQ ID NO: 94094 - DNA, 25 bp, Mus musculus
acaattacctcctatcaccatgttc

SEQ ID NO: 94095 - DNA, 25 bp, Mus musculus
acaattactcaccaaattcctacag

SEQ ID NO: 94096 - DNA, 25 bp, Mus musculus
acaattactcacgaaattcctacag

SEQ ID NO: 94097 - DNA, 25 bp, Mus musculus
acaattacttctccgtaatatctat

SEQ ID NO: 94098 - DNA, 25 bp, Mus musculus
acaattacttctgcgtaatatctat

SEQ ID NO: 94099 - DNA, 25 bp, Mus musculus
acaattagcggtcatccatcacttc

SEQ ID NO: 94100 - DNA, 25 bp, Mus musculus
acaattagcggtgatccatcacttc

SEQ ID NO: 94101 - DNA, 25 bp, Mus musculus
acaattagtgaaccggtgggctgca

SEQ ID NO: 94102 - DNA, 25 bp, Mus musculus
acaattagtgaagcggtgggctgca

SEQ ID NO: 94103 - DNA, 25 bp, Mus musculus
acaattattgctactggtacctcgg

SEQ ID NO: 94104 - DNA, 25 bp, Mus musculus
acaattattgcttctggtacctcgg

SEQ ID NO: 94105 - DNA, 25 bp, Mus musculus
acaattcaggccaccggtcgggtcg

SEQ ID NO: 94106 - DNA, 25 bp, Mus musculus
acaattcaggcctccggtcgggtcg

SEQ ID NO: 94107 - DNA, 25 bp, Mus musculus
acaattcagggaacctcgtacctct

SEQ ID NO: 94108 - DNA, 25 bp, Mus musculus
acaattcagggatcctcgtacctct

SEQ ID NO: 94109 - DNA, 25 bp, Mus musculus
acaattcatagcctgtggtctccac

SEQ ID NO: 94110 - DNA, 25 bp, Mus musculus
acaattcatagcgtgtggtctccac

SEQ ID NO: 94111 - DNA, 25 bp, Mus musculus
acaattccaactattttcttacaga

SEQ ID NO: 94112 - DNA, 25 bp, Mus musculus
acaattccaacttttttcttacaga

SEQ ID NO: 94113 - DNA, 25 bp, Mus musculus
acaattccacacatttatcgagcac

SEQ ID NO: 94114 - DNA, 25 bp, Mus musculus
acaattccacacttttatcgagcac

SEQ ID NO: 94115 - DNA, 25 bp, Mus musculus
acaattccacctccagagaggctgg

SEQ ID NO: 94116 - DNA, 25 bp, Mus musculus
acaattccacctgcagagaggctgg

SEQ ID NO: 94117 - DNA, 25 bp, Mus musculus
acaattccagtgacttggccctctc

SEQ ID NO: 94118 - DNA, 25 bp, Mus musculus
acaattccagtgtcttggccctctc

SEQ ID NO: 94119 - DNA, 25 bp, Mus musculus
acaattccttggaagctgtttccta

SEQ ID NO: 94120 - DNA, 25 bp, Mus musculus
acaattccttggtagctgtttccta

SEQ ID NO: 94121 - DNA, 25 bp, Mus musculus
acaattctaagtcgctgggacaaac

SEQ ID NO: 94122 - DNA, 25 bp, Mus musculus
acaattctaagtggctgggacaaac

SEQ ID NO: 94123 - DNA, 25 bp, Mus musculus
acaattctaattacatgtggcaatc

SEQ ID NO: 94124 - DNA, 25 bp, Mus musculus
acaattctaatttcatgtggcaatc

SEQ ID NO: 94125 - DNA, 25 bp, Mus musculus
acaattctcatgctggtgatcacat

SEQ ID NO: 94126 - DNA, 25 bp, Mus musculus
acaattctcatggtggtgatcacat

SEQ ID NO: 94127 - DNA, 25 bp, Mus musculus
acaattctccgtcgccctgaaaact

SEQ ID NO: 94128 - DNA, 25 bp, Mus musculus
acaattctccgtggccctgaaaact

SEQ ID NO: 94129 - DNA, 25 bp, Mus musculus
acaattctctttctgtagggtcaat

SEQ ID NO: 94130 - DNA, 25 bp, Mus musculus
acaattctctttgtgtagggtcaat

SEQ ID NO: 94131 - DNA, 25 bp, Mus musculus
acaattctgtataccacgtttgatg

SEQ ID NO: 94132 - DNA, 25 bp, Mus musculus
acaattctgtattccacgtttgatg

SEQ ID NO: 94133 - DNA, 25 bp, Mus musculus
acaattctgtttccttggcattcca

SEQ ID NO: 94134 - DNA, 25 bp, Mus musculus
acaattctgtttgcttggcattcca

SEQ ID NO: 94135 - DNA, 25 bp, Mus musculus
acaattcttgagagtaacctcccct

SEQ ID NO: 94136 - DNA, 25 bp, Mus musculus
acaattcttgagtgtaacctcccct

SEQ ID NO: 94137 - DNA, 25 bp, Mus musculus
acaattgaatggaacagaatctgcc

SEQ ID NO: 94138 - DNA, 25 bp, Mus musculus
acaattgaatggtacagaatctgcc

SEQ ID NO: 94139 - DNA, 25 bp, Mus musculus
acaattgacagacaggcggtccctc

SEQ ID NO: 94140 - DNA, 25 bp, Mus musculus
acaattgacagagaggcggtccctc

SEQ ID NO: 94141 - DNA, 25 bp, Mus musculus
acaattgagcgcctcaccaagacgg

SEQ ID NO: 94142 - DNA, 25 bp, Mus musculus
acaattgagcgcgtcaccaagacgg

SEQ ID NO: 94143 - DNA, 25 bp, Mus musculus
acaattgatctcagaaggtttctct

SEQ ID NO: 94144 - DNA, 25 bp, Mus musculus
acaattgatctctgaaggtttctct

SEQ ID NO: 94145 - DNA, 25 bp, Mus musculus
acaattgattttcccggtgcttggt

SEQ ID NO: 94146 - DNA, 25 bp, Mus musculus
acaattgattttgccggtgcttggt

SEQ ID NO: 94147 - DNA, 25 bp, Mus musculus
acaattgccctcatgcctagaacag

SEQ ID NO: 94148 - DNA, 25 bp, Mus musculus
acaattgccctcttgcctagaacag

SEQ ID NO: 94149 - DNA, 25 bp, Mus musculus
acaattgcctcactcagctagtcgg

SEQ ID NO: 94150 - DNA, 25 bp, Mus musculus
acaattgcctcagtcagctagtcgg

SEQ ID NO: 94151 - DNA, 25 bp, Mus musculus
acaattgctattaaaatgtaactat

SEQ ID NO: 94152 - DNA, 25 bp, Mus musculus
acaattgctatttaaatgtaactat

SEQ ID NO: 94153 - DNA, 25 bp, Mus musculus
acaattgctgacaactagagaaccc

SEQ ID NO: 94154 - DNA, 25 bp, Mus musculus
acaattgctgactactagagaaccc

SEQ ID NO: 94155 - DNA, 25 bp, Mus musculus
acaattggagctcttactgcctttc

SEQ ID NO: 94156 - DNA, 25 bp, Mus musculus
acaattggagctgttactgcctttc

SEQ ID NO: 94157 - DNA, 25 bp, Mus musculus
acaattggcaagctactgcatgaca

SEQ ID NO: 94158 - DNA, 25 bp, Mus musculus
acaattggcaaggtactgcatgaca

SEQ ID NO: 94159 - DNA, 25 bp, Mus musculus
acaattgggcccagtggtgtaaaat

SEQ ID NO: 94160 - DNA, 25 bp, Mus musculus
acaattgggccctgtggtgtaaaat

SEQ ID NO: 94161 - DNA, 25 bp, Mus musculus
acaattgggtccagcccatgtggtg

SEQ ID NO: 94162 - DNA, 25 bp, Mus musculus
acaattgggtcctgcccatgtggtg

SEQ ID NO: 94163 - DNA, 25 bp, Mus musculus
acaattggtctcctccagtgcaaag

SEQ ID NO: 94164 - DNA, 25 bp, Mus musculus
acaattggtctcgtccagtgcaaag

SEQ ID NO: 94165 - DNA, 25 bp, Mus musculus
acaattgtcataatgttgctctggc

SEQ ID NO: 94166 - DNA, 25 bp, Mus musculus
acaattgtcatattgttgctctggc

SEQ ID NO: 94167 - DNA, 25 bp, Mus musculus
acaattgtccaaactccacattgct

SEQ ID NO: 94168 - DNA, 25 bp, Mus musculus
acaattgtccaatctccacattgct

SEQ ID NO: 94169 - DNA, 25 bp, Mus musculus
acaattgtggctatctgtaatggac

SEQ ID NO: 94170 - DNA, 25 bp, Mus musculus
acaattgtggctttctgtaatggac

SEQ ID NO: 94171 - DNA, 25 bp, Mus musculus
acaattgtgttgctccttttcggtg

SEQ ID NO: 94172 - DNA, 25 bp, Mus musculus
acaattgtgttggtccttttcggtg

SEQ ID NO: 94173 - DNA, 25 bp, Mus musculus
acaattgtgtttcctgatttgaagg

SEQ ID NO: 94174 - DNA, 25 bp, Mus musculus
acaattgtgtttgctgatttgaagg

SEQ ID NO: 94175 - DNA, 25 bp, Mus musculus
acaattgttcatagtggctcccagc

SEQ ID NO: 94176 - DNA, 25 bp, Mus musculus
acaattgttcattgtggctcccagc

SEQ ID NO: 94177 - DNA, 25 bp, Mus musculus
acaattgttgatactggctattgtg

SEQ ID NO: 94178 - DNA, 25 bp, Mus musculus
acaattgttgattctggctattgtg

SEQ ID NO: 94179 - DNA, 25 bp, Mus musculus
acaattgtttgaccgatctgtttaa

SEQ ID NO: 94180 - DNA, 25 bp, Mus musculus
acaattgtttgagcgatctgtttaa

SEQ ID NO: 94181 - DNA, 25 bp, Mus musculus
acaatttaatttcatactgtgctga

SEQ ID NO: 94182 - DNA, 25 bp, Mus musculus
acaatttaatttgatactgtgctga

SEQ ID NO: 94183 - DNA, 25 bp, Mus musculus
acaatttactccactgtcttagaaa

SEQ ID NO: 94184 - DNA, 25 bp, Mus musculus
acaatttactcctctgtcttagaaa

SEQ ID NO: 94185 - DNA, 25 bp, Mus musculus
acaatttactctacgccatcatgac

SEQ ID NO: 94186 - DNA, 25 bp, Mus musculus
acaatttactcttcgccatcatgac

SEQ ID NO: 94187 - DNA, 25 bp, Mus musculus
acaatttagaatcttgcctcagcct

SEQ ID NO: 94188 - DNA, 25 bp, Mus musculus
acaatttagaatgttgcctcagcct

SEQ ID NO: 94189 - DNA, 25 bp, Mus musculus
acaatttatccgacagttcatctgc

SEQ ID NO: 94190 - DNA, 25 bp, Mus musculus
acaatttatccgtcagttcatctgc

SEQ ID NO: 94191 - DNA, 25 bp, Mus musculus
acaatttatcctccctacaagatgt

SEQ ID NO: 94192 - DNA, 25 bp, Mus musculus
acaatttatcctgcctacaagatgt

SEQ ID NO: 94193 - DNA, 25 bp, Mus musculus
acaatttcaaatcccctgactttct

SEQ ID NO: 94194 - DNA, 25 bp, Mus musculus
acaatttcaaatgccctgactttct

SEQ ID NO: 94195 - DNA, 25 bp, Mus musculus
acaatttcaagcactgtcactgcga

SEQ ID NO: 94196 - DNA, 25 bp, Mus musculus
acaatttcaagctctgtcactgcga

SEQ ID NO: 94197 - DNA, 25 bp, Mus musculus
acaatttcagtacttcccaggctgg

SEQ ID NO: 94198 - DNA, 25 bp, Mus musculus
acaatttcagtagttcccaggctgg

SEQ ID NO: 94199 - DNA, 25 bp, Mus musculus
acaatttcagtgcacacagaataaa

SEQ ID NO: 94200 - DNA, 25 bp, Mus musculus
acaatttcagtggacacagaataaa

SEQ ID NO: 94201 - DNA, 25 bp, Mus musculus
acaatttcatctatagtgtcacaat

SEQ ID NO: 94202 - DNA, 25 bp, Mus musculus
acaatttcatctttagtgtcacaat

SEQ ID NO: 94203 - DNA, 25 bp, Mus musculus
acaatttcctgtaacccgcggccag

SEQ ID NO: 94204 - DNA, 25 bp, Mus musculus
acaatttcctgtcttttaccagaag

SEQ ID NO: 94205 - DNA, 25 bp, Mus musculus
acaatttcctgtgttttaccagaag

SEQ ID NO: 94206 - DNA, 25 bp, Mus musculus
acaatttcctgttacccgcggccag

SEQ ID NO: 94207 - DNA, 25 bp, Mus musculus
acaatttcttgacatatgtacaaac

SEQ ID NO: 94208 - DNA, 25 bp, Mus musculus
acaatttcttgagatatgtacaaac

SEQ ID NO: 94209 - DNA, 25 bp, Mus musculus
acaatttgacatctggactggctcc

SEQ ID NO: 94210 - DNA, 25 bp, Mus musculus
acaatttgacatgtggactggctcc

SEQ ID NO: 94211 - DNA, 25 bp, Mus musculus
acaatttgcatgctctcctgtattt

SEQ ID NO: 94212 - DNA, 25 bp, Mus musculus
acaatttgcatggtctcctgtattt

SEQ ID NO: 94213 - DNA, 25 bp, Mus musculus
acaatttgcctcaatcacttttata

SEQ ID NO: 94214 - DNA, 25 bp, Mus musculus
acaatttgcctctatcacttttata

SEQ ID NO: 94215 - DNA, 25 bp, Mus musculus
acaatttggcccatgagttcgagca

SEQ ID NO: 94216 - DNA, 25 bp, Mus musculus
acaatttggcccttgagttcgagca

SEQ ID NO: 94217 - DNA, 25 bp, Mus musculus
acaatttggcgacgacaccttcttc

SEQ ID NO: 94218 - DNA, 25 bp, Mus musculus
acaatttggcgaggacaccttcttc

SEQ ID NO: 94219 - DNA, 25 bp, Mus musculus
acaatttggctactgcctcataaat

SEQ ID NO: 94220 - DNA, 25 bp, Mus musculus
acaatttggctagtgcctcataaat

SEQ ID NO: 94221 - DNA, 25 bp, Mus musculus
acaatttgtagacaccccggcaggc

SEQ ID NO: 94222 - DNA, 25 bp, Mus musculus
acaatttgtagagaccccggcaggc

SEQ ID NO: 94223 - DNA, 25 bp, Mus musculus
acaatttgtgaacccactgagctat

SEQ ID NO: 94224 - DNA, 25 bp, Mus musculus
acaatttgtgaagccactgagctat

SEQ ID NO: 94225 - DNA, 25 bp, Mus musculus
acaatttgtggtcagaacttttaga

SEQ ID NO: 94226 - DNA, 25 bp, Mus musculus
acaatttgtggtgagaacttttaga

SEQ ID NO: 94227 - DNA, 25 bp, Mus musculus
acaatttgtttcaccatttctcatg

SEQ ID NO: 94228 - DNA, 25 bp, Mus musculus
acaatttgtttctccatttctcatg

SEQ ID NO: 94229 - DNA, 25 bp, Mus musculus
acaattttcaagcactgtcattgag

SEQ ID NO: 94230 - DNA, 25 bp, Mus musculus
acaattttcaaggactgtcattgag

SEQ ID NO: 94231 - DNA, 25 bp, Mus musculus
acaattttctggatctgcaagagac

SEQ ID NO: 94232 - DNA, 25 bp, Mus musculus
acaattttctggttctgcaagagac

SEQ ID NO: 94233 - DNA, 25 bp, Mus musculus
acaattttcttcaggactagaggcc

SEQ ID NO: 94234 - DNA, 25 bp, Mus musculus
acaattttcttctggactagaggcc

SEQ ID NO: 94235 - DNA, 25 bp, Mus musculus
acaattttgatactgttttcctgaa

SEQ ID NO: 94236 - DNA, 25 bp, Mus musculus
acaattttgatagtgttttcctgaa

SEQ ID NO: 94237 - DNA, 25 bp, Mus musculus
acaattttgtccatactgtgcgtaa

SEQ ID NO: 94238 - DNA, 25 bp, Mus musculus
acaattttgtccttactgtgcgtaa

SEQ ID NO: 94239 - DNA, 25 bp, Mus musculus
acaattttgttactcttggagtcca

SEQ ID NO: 94240 - DNA, 25 bp, Mus musculus
acaattttgttagtcttggagtcca

SEQ ID NO: 94241 - DNA, 25 bp, Mus musculus
acaatttttattccgactgtctagc

SEQ ID NO: 94242 - DNA, 25 bp, Mus musculus
acaatttttattgcgactgtctagc

SEQ ID NO: 94243 - DNA, 25 bp, Mus musculus
acaatttttctgaacttagtataag

SEQ ID NO: 94244 - DNA, 25 bp, Mus musculus
acaatttttctgtacttagtataag

SEQ ID NO: 94245 - DNA, 25 bp, Mus musculus
acaattttttgtcgctgtatttgat

SEQ ID NO: 94246 - DNA, 25 bp, Mus musculus
acaattttttgtggctgtatttgat

SEQ ID NO: 94247 - DNA, 25 bp, Mus musculus
acacaaaaatagatctgagaagctg

SEQ ID NO: 94248 - DNA, 25 bp, Mus musculus
acacaaaaatagttctgagaagctg

SEQ ID NO: 94249 - DNA, 25 bp, Mus musculus
acacaaaaattacgcctgagggtat

SEQ ID NO: 94250 - DNA, 25 bp, Mus musculus
acacaaaaattaggcctgagggtat

SEQ ID NO: 94251 - DNA, 25 bp, Mus musculus
acacaaaacacgctccagccagttg

SEQ ID NO: 94252 - DNA, 25 bp, Mus musculus
acacaaaacacggtccagccagttg

SEQ ID NO: 94253 - DNA, 25 bp, Mus musculus
acacaaaactcaacagctttatcat

SEQ ID NO: 94254 - DNA, 25 bp, Mus musculus
acacaaaactcatcagctttatcat

SEQ ID NO: 94255 - DNA, 25 bp, Mus musculus
acacaaaactgtacatcttcctctg

SEQ ID NO: 94256 - DNA, 25 bp, Mus musculus
acacaaaactgtcgtcaaggcaaaa

SEQ ID NO: 94257 - DNA, 25 bp, Mus musculus
acacaaaactgtggtcaaggcaaaa

SEQ ID NO: 94258 - DNA, 25 bp, Mus musculus
acacaaaactgttcatcttcctctg

SEQ ID NO: 94259 - DNA, 25 bp, Mus musculus
acacaaaaggacactgacttctgat

SEQ ID NO: 94260 - DNA, 25 bp, Mus musculus
acacaaaaggactctgacttctgat

SEQ ID NO: 94261 - DNA, 25 bp, Mus musculus
acacaaaaggctactggaatgttct

SEQ ID NO: 94262 - DNA, 25 bp, Mus musculus
acacaaaaggcttctggaatgttct

SEQ ID NO: 94263 - DNA, 25 bp, Mus musculus
acacaaaatcacacctagcagagaa

SEQ ID NO: 94264 - DNA, 25 bp, Mus musculus
acacaaaatcactcctagcagagaa

SEQ ID NO: 94265 - DNA, 25 bp, Mus musculus
acacaaaatgttaacaagttggcct

SEQ ID NO: 94266 - DNA, 25 bp, Mus musculus
acacaaaatgtttacaagttggcct

SEQ ID NO: 94267 - DNA, 25 bp, Mus musculus
acacaaacacatctcttgcctaagt

SEQ ID NO: 94268 - DNA, 25 bp, Mus musculus
acacaaacacatgtcttgcctaagt

SEQ ID NO: 94269 - DNA, 25 bp, Mus musculus
acacaaacatttatcataggcactg

SEQ ID NO: 94270 - DNA, 25 bp, Mus musculus
acacaaacatttttcataggcactg

SEQ ID NO: 94271 - DNA, 25 bp, Mus musculus
acacaaaccaccagcatttatttcc

SEQ ID NO: 94272 - DNA, 25 bp, Mus musculus
acacaaaccacctgcatttatttcc

SEQ ID NO: 94273 - DNA, 25 bp, Mus musculus
acacaaacctgtcgaaacctcaacg

SEQ ID NO: 94274 - DNA, 25 bp, Mus musculus
acacaaacctgtggaaacctcaacg

SEQ ID NO: 94275 - DNA, 25 bp, Mus musculus
acacaaaccttcatactaaattaat

SEQ ID NO: 94276 - DNA, 25 bp, Mus musculus
acacaaaccttcttactaaattaat

SEQ ID NO: 94277 - DNA, 25 bp, Mus musculus
acacaaacgccgacgtattgctctg

SEQ ID NO: 94278 - DNA, 25 bp, Mus musculus
acacaaacgccgtcgtattgctctg

SEQ ID NO: 94279 - DNA, 25 bp, Mus musculus
acacaaagctgaagatgcccactca

SEQ ID NO: 94280 - DNA, 25 bp, Mus musculus
acacaaagctgatgatgcccactca

SEQ ID NO: 94281 - DNA, 25 bp, Mus musculus
acacaaaggcagctcccagaggctt

SEQ ID NO: 94282 - DNA, 25 bp, Mus musculus
acacaaaggcaggtcccagaggctt

SEQ ID NO: 94283 - DNA, 25 bp, Mus musculus
acacaaatacaaaccagggcaatgg

SEQ ID NO: 94284 - DNA, 25 bp, Mus musculus
acacaaatacaatccagggcaatgg

SEQ ID NO: 94285 - DNA, 25 bp, Mus musculus
acacaaataccgcatgcttatcgca

SEQ ID NO: 94286 - DNA, 25 bp, Mus musculus
acacaaataccggatgcttatcgca

SEQ ID NO: 94287 - DNA, 25 bp, Mus musculus
acacaaatccccaaatccagtactg

SEQ ID NO: 94288 - DNA, 25 bp, Mus musculus
acacaaatccccaattctcagatta

SEQ ID NO: 94289 - DNA, 25 bp, Mus musculus
acacaaatcccctaatccagtactg

SEQ ID NO: 94290 - DNA, 25 bp, Mus musculus
acacaaatcccctattctcagatta

SEQ ID NO: 94291 - DNA, 25 bp, Mus musculus
acacaaatctctcccagacctggga

SEQ ID NO: 94292 - DNA, 25 bp, Mus musculus
acacaaatctctgccagacctggga

SEQ ID NO: 94293 - DNA, 25 bp, Mus musculus
acacaaatgtgtatcccaggcgctg

SEQ ID NO: 94294 - DNA, 25 bp, Mus musculus
acacaaatgtgtttcccaggcgctg

SEQ ID NO: 94295 - DNA, 25 bp, Mus musculus
acacaaattttcatgcacaatggtg

SEQ ID NO: 94296 - DNA, 25 bp, Mus musculus
acacaaattttcttgcacaatggtg

SEQ ID NO: 94297 - DNA, 25 bp, Mus musculus
acacaacaacaaccagacattcaca

SEQ ID NO: 94298 - DNA, 25 bp, Mus musculus
acacaacaacaagcagacattcaca

SEQ ID NO: 94299 - DNA, 25 bp, Mus musculus
acacaacaacctagagcctgacaga

SEQ ID NO: 94300 - DNA, 25 bp, Mus musculus
acacaacaaccttgagcctgacaga

SEQ ID NO: 94301 - DNA, 25 bp, Mus musculus
acacaacactgaagaactcgcagag

SEQ ID NO: 94302 - DNA, 25 bp, Mus musculus
acacaacactgatgaactcgcagag

SEQ ID NO: 94303 - DNA, 25 bp, Mus musculus
acacaacagattcctgactctctag

SEQ ID NO: 94304 - DNA, 25 bp, Mus musculus
acacaacagattgctgactctctag

SEQ ID NO: 94305 - DNA, 25 bp, Mus musculus
acacaacagcatcctcacatgctgg

SEQ ID NO: 94306 - DNA, 25 bp, Mus musculus
acacaacagcatgctcacatgctgg

SEQ ID NO: 94307 - DNA, 25 bp, Mus musculus
acacaacagctgcttttctgatttt

SEQ ID NO: 94308 - DNA, 25 bp, Mus musculus
acacaacagctggttttctgatttt

SEQ ID NO: 94309 - DNA, 25 bp, Mus musculus
acacaacatggaaaccagggtggtt

SEQ ID NO: 94310 - DNA, 25 bp, Mus musculus
acacaacatggataccagggtggtt

SEQ ID NO: 94311 - DNA, 25 bp, Mus musculus
acacaaccacctaatttcgagctgt

SEQ ID NO: 94312 - DNA, 25 bp, Mus musculus
acacaaccaccttatttcgagctgt

SEQ ID NO: 94313 - DNA, 25 bp, Mus musculus
acacaaccagcgatcttagcaggat

SEQ ID NO: 94314 - DNA, 25 bp, Mus musculus
acacaaccagcgttcttagcaggat

SEQ ID NO: 94315 - DNA, 25 bp, Mus musculus
acacaaccctaaccaaagcatgcat

SEQ ID NO: 94316 - DNA, 25 bp, Mus musculus
acacaaccctaagcaaagcatgcat

SEQ ID NO: 94317 - DNA, 25 bp, Mus musculus
acacaaccgatactgtcccaaattg

SEQ ID NO: 94318 - DNA, 25 bp, Mus musculus
acacaaccgatagtgtcccaaattg

SEQ ID NO: 94319 - DNA, 25 bp, Mus musculus
acacaaccgtgtaaagcttgactac

SEQ ID NO: 94320 - DNA, 25 bp, Mus musculus
acacaaccgtgtataatgagctcta

SEQ ID NO: 94321 - DNA, 25 bp, Mus musculus
acacaaccgtgtatgtttctcccag

SEQ ID NO: 94322 - DNA, 25 bp, Mus musculus
acacaaccgtgttaagcttgactac

SEQ ID NO: 94323 - DNA, 25 bp, Mus musculus
acacaaccgtgtttaatgagctcta

SEQ ID NO: 94324 - DNA, 25 bp, Mus musculus
acacaaccgtgtttgtttctcccag

SEQ ID NO: 94325 - DNA, 25 bp, Mus musculus
acacaacctcacattggcttcaata

SEQ ID NO: 94326 - DNA, 25 bp, Mus musculus
acacaacctcactttggcttcaata

SEQ ID NO: 94327 - DNA, 25 bp, Mus musculus
acacaacgcaggaccgctctagagc

SEQ ID NO: 94328 - DNA, 25 bp, Mus musculus
acacaacgcaggtccgctctagagc

SEQ ID NO: 94329 - DNA, 25 bp, Mus musculus
acacaactgcctatattgtcctttt

SEQ ID NO: 94330 - DNA, 25 bp, Mus musculus
acacaactgcctttattgtcctttt

SEQ ID NO: 94331 - DNA, 25 bp, Mus musculus
acacaactgtgccttttgggaaaca

SEQ ID NO: 94332 - DNA, 25 bp, Mus musculus
acacaactgtgcgttttgggaaaca

SEQ ID NO: 94333 - DNA, 25 bp, Mus musculus
acacaacttcgcaacaaccaatata

SEQ ID NO: 94334 - DNA, 25 bp, Mus musculus
acacaacttcgctacaaccaatata

SEQ ID NO: 94335 - DNA, 25 bp, Mus musculus
acacaacttcttactatcgtcttta

SEQ ID NO: 94336 - DNA, 25 bp, Mus musculus
acacaacttctttctatcgtcttta

SEQ ID NO: 94337 - DNA, 25 bp, Mus musculus
acacaacttggtctcaggccactga

SEQ ID NO: 94338 - DNA, 25 bp, Mus musculus
acacaacttggtgtcaggccactga

SEQ ID NO: 94339 - DNA, 25 bp, Mus musculus
acacaactttgcctttctcatataa

SEQ ID NO: 94340 - DNA, 25 bp, Mus musculus
acacaactttgcgtttctcatataa

SEQ ID NO: 94341 - DNA, 25 bp, Mus musculus
acacaagaactcaaaatagacacta

SEQ ID NO: 94342 - DNA, 25 bp, Mus musculus
acacaagaactctaaatagacacta

SEQ ID NO: 94343 - DNA, 25 bp, Mus musculus
acacaagaacttctgaggctcgtgg

SEQ ID NO: 94344 - DNA, 25 bp, Mus musculus
acacaagaacttgtgaggctcgtgg

SEQ ID NO: 94345 - DNA, 25 bp, Mus musculus
acacaagacattatgctgtcctttg

SEQ ID NO: 94346 - DNA, 25 bp, Mus musculus
acacaagacattttgctgtcctttg

SEQ ID NO: 94347 - DNA, 25 bp, Mus musculus
acacaagacgttctccagtctcggg

SEQ ID NO: 94348 - DNA, 25 bp, Mus musculus
acacaagacgttgtccagtctcggg

SEQ ID NO: 94349 - DNA, 25 bp, Mus musculus
acacaagagcatctttgccagctgg

SEQ ID NO: 94350 - DNA, 25 bp, Mus musculus
acacaagagcatgtttgccagctgg

SEQ ID NO: 94351 - DNA, 25 bp, Mus musculus
acacaagatctgagcccgcgctaag

SEQ ID NO: 94352 - DNA, 25 bp, Mus musculus
acacaagatctgtgcccgcgctaag

SEQ ID NO: 94353 - DNA, 25 bp, Mus musculus
acacaagcatccatcagttcacggc

SEQ ID NO: 94354 - DNA, 25 bp, Mus musculus
acacaagcatccttcagttcacggc

SEQ ID NO: 94355 - DNA, 25 bp, Mus musculus
acacaagcatgtactccccatagga

SEQ ID NO: 94356 - DNA, 25 bp, Mus musculus
acacaagcatgttctccccatagga

SEQ ID NO: 94357 - DNA, 25 bp, Mus musculus
acacaagccacactacccatgagga

SEQ ID NO: 94358 - DNA, 25 bp, Mus musculus
acacaagccacagtacccatgagga

SEQ ID NO: 94359 - DNA, 25 bp, Mus musculus
acacaagccatacagtcgcagagat

SEQ ID NO: 94360 - DNA, 25 bp, Mus musculus
acacaagccatagagtcgcagagat

SEQ ID NO: 94361 - DNA, 25 bp, Mus musculus
acacaagccatgcagagtcctcaga

SEQ ID NO: 94362 - DNA, 25 bp, Mus musculus
acacaagccatggagagtcctcaga

SEQ ID NO: 94363 - DNA, 25 bp, Mus musculus
acacaagccgttacaagtgacctta

SEQ ID NO: 94364 - DNA, 25 bp, Mus musculus
acacaagccgtttcaagtgacctta

SEQ ID NO: 94365 - DNA, 25 bp, Mus musculus
acacaagctgatccttttctcacct

SEQ ID NO: 94366 - DNA, 25 bp, Mus musculus
acacaagctgatctgattatgagat

SEQ ID NO: 94367 - DNA, 25 bp, Mus musculus
acacaagctgatgcttttctcacct

SEQ ID NO: 94368 - DNA, 25 bp, Mus musculus
acacaagctgatgtgattatgagat

SEQ ID NO: 94369 - DNA, 25 bp, Mus musculus
acacaagctggactgcgaccgcagt

SEQ ID NO: 94370 - DNA, 25 bp, Mus musculus
acacaagctggagtgcgaccgcagt

SEQ ID NO: 94371 - DNA, 25 bp, Mus musculus
acacaaggacctctgggagttccat

SEQ ID NO: 94372 - DNA, 25 bp, Mus musculus
acacaaggacctgtgggagttccat

SEQ ID NO: 94373 - DNA, 25 bp, Mus musculus
acacaaggagctccggttcatcatc

SEQ ID NO: 94374 - DNA, 25 bp, Mus musculus
acacaaggagctgcggttcatcatc

SEQ ID NO: 94375 - DNA, 25 bp, Mus musculus
acacaaggcgggagactgcttctga

SEQ ID NO: 94376 - DNA, 25 bp, Mus musculus
acacaaggcgggtgactgcttctga

SEQ ID NO: 94377 - DNA, 25 bp, Mus musculus
acacaaggctgtatgtttgatcgca

SEQ ID NO: 94378 - DNA, 25 bp, Mus musculus
acacaaggctgtttgtttgatcgca

SEQ ID NO: 94379 - DNA, 25 bp, Mus musculus
acacaagggttgagaaatttgacac

SEQ ID NO: 94380 - DNA, 25 bp, Mus musculus
acacaagggttgtgaaatttgacac

SEQ ID NO: 94381 - DNA, 25 bp, Mus musculus
acacaagtagacagggctagagaga

SEQ ID NO: 94382 - DNA, 25 bp, Mus musculus
acacaagtagactgggctagagaga

SEQ ID NO: 94383 - DNA, 25 bp, Mus musculus
acacaagtagccatctgtgttaaac

SEQ ID NO: 94384 - DNA, 25 bp, Mus musculus
acacaagtagccttctgtgttaaac

SEQ ID NO: 94385 - DNA, 25 bp, Mus musculus
acacaagtccgaaggcttcaaggta

SEQ ID NO: 94386 - DNA, 25 bp, Mus musculus
acacaagtccgatggcttcaaggta

SEQ ID NO: 94387 - DNA, 25 bp, Mus musculus
acacaagtcgttccagttctacaag

SEQ ID NO: 94388 - DNA, 25 bp, Mus musculus
acacaagtcgttgcagttctacaag

SEQ ID NO: 94389 - DNA, 25 bp, Mus musculus
acacaagtctgcagttgatacgagg

SEQ ID NO: 94390 - DNA, 25 bp, Mus musculus
acacaagtctgctgttgatacgagg

SEQ ID NO: 94391 - DNA, 25 bp, Mus musculus
acacaagtcttgactctcaaaatgg

SEQ ID NO: 94392 - DNA, 25 bp, Mus musculus
acacaagtcttgtctctcaaaatgg

SEQ ID NO: 94393 - DNA, 25 bp, Mus musculus
acacaagtgcacctttctttcggtc

SEQ ID NO: 94394 - DNA, 25 bp, Mus musculus
acacaagtgcacgtttctttcggtc

SEQ ID NO: 94395 - DNA, 25 bp, Mus musculus
acacaagtgcagatggtctcccctt

SEQ ID NO: 94396 - DNA, 25 bp, Mus musculus
acacaagtgcagttggtctcccctt

SEQ ID NO: 94397 - DNA, 25 bp, Mus musculus
acacaagtgtacacggatggaagcc

SEQ ID NO: 94398 - DNA, 25 bp, Mus musculus
acacaagtgtactcggatggaagcc

SEQ ID NO: 94399 - DNA, 25 bp, Mus musculus
acacaagttctgatcattatttgag

SEQ ID NO: 94400 - DNA, 25 bp, Mus musculus
acacaagttctgatctgtgtgctgc

SEQ ID NO: 94401 - DNA, 25 bp, Mus musculus
acacaagttctgttcattatttgag

SEQ ID NO: 94402 - DNA, 25 bp, Mus musculus
acacaagttctgttctgtgtgctgc

SEQ ID NO: 94403 - DNA, 25 bp, Mus musculus
acacaagttggcatagagccacatg

SEQ ID NO: 94404 - DNA, 25 bp, Mus musculus
acacaagttggcttagagccacatg

SEQ ID NO: 94405 - DNA, 25 bp, Mus musculus
acacaagttgtcatctaggctccag

SEQ ID NO: 94406 - DNA, 25 bp, Mus musculus
acacaagttgtcttctaggctccag

SEQ ID NO: 94407 - DNA, 25 bp, Mus musculus
acacaataaaggctgaggccggtga

SEQ ID NO: 94408 - DNA, 25 bp, Mus musculus
acacaataaagggtgaggccggtga

SEQ ID NO: 94409 - DNA, 25 bp, Mus musculus
acacaatacctgatcatgcttagcc

SEQ ID NO: 94410 - DNA, 25 bp, Mus musculus
acacaatacctgttcatgcttagcc

SEQ ID NO: 94411 - DNA, 25 bp, Mus musculus
acacaatagatcaagccccaaggct

SEQ ID NO: 94412 - DNA, 25 bp, Mus musculus
acacaatagatctagccccaaggct

SEQ ID NO: 94413 - DNA, 25 bp, Mus musculus
acacaatatctgactgctaggctcc

SEQ ID NO: 94414 - DNA, 25 bp, Mus musculus
acacaatatctgtctgctaggctcc

SEQ ID NO: 94415 - DNA, 25 bp, Mus musculus
acacaatatgtactggtcctgggat

SEQ ID NO: 94416 - DNA, 25 bp, Mus musculus
acacaatatgtagtggtcctgggat

SEQ ID NO: 94417 - DNA, 25 bp, Mus musculus
acacaatattaaaattcaccattcc

SEQ ID NO: 94418 - DNA, 25 bp, Mus musculus
acacaatattaatattcaccattcc

SEQ ID NO: 94419 - DNA, 25 bp, Mus musculus
acacaatccgttcacagtttctttg

SEQ ID NO: 94420 - DNA, 25 bp, Mus musculus
acacaatccgttgacagtttctttg

SEQ ID NO: 94421 - DNA, 25 bp, Mus musculus
acacaatctcagaataatcaaggaa

SEQ ID NO: 94422 - DNA, 25 bp, Mus musculus
acacaatctcagtataatcaaggaa

SEQ ID NO: 94423 - DNA, 25 bp, Mus musculus
acacaatctgggatttactcatgga

SEQ ID NO: 94424 - DNA, 25 bp, Mus musculus
acacaatctgggttttactcatgga

SEQ ID NO: 94425 - DNA, 25 bp, Mus musculus
acacaatgaaagaaagcagcactaa

SEQ ID NO: 94426 - DNA, 25 bp, Mus musculus
acacaatgaaagtaagcagcactaa

SEQ ID NO: 94427 - DNA, 25 bp, Mus musculus
acacaatgagctaaagtcacacaag

SEQ ID NO: 94428 - DNA, 25 bp, Mus musculus
acacaatgagctatcccttagccta

SEQ ID NO: 94429 - DNA, 25 bp, Mus musculus
acacaatgagcttaagtcacacaag

SEQ ID NO: 94430 - DNA, 25 bp, Mus musculus
acacaatgagctttcccttagccta

SEQ ID NO: 94431 - DNA, 25 bp, Mus musculus
acacaatgcatgatcttatggacac

SEQ ID NO: 94432 - DNA, 25 bp, Mus musculus
acacaatgcatgttcttatggacac

SEQ ID NO: 94433 - DNA, 25 bp, Mus musculus
acacaatgcattctccctggatgaa

SEQ ID NO: 94434 - DNA, 25 bp, Mus musculus
acacaatgcattgtccctggatgaa

SEQ ID NO: 94435 - DNA, 25 bp, Mus musculus
acacaatgccctcctccagaaagag

SEQ ID NO: 94436 - DNA, 25 bp, Mus musculus
acacaatgccctgctccagaaagag

SEQ ID NO: 94437 - DNA, 25 bp, Mus musculus
acacaatgctcgctagtgttccctt

SEQ ID NO: 94438 - DNA, 25 bp, Mus musculus
acacaatgctcggtagtgttccctt

SEQ ID NO: 94439 - DNA, 25 bp, Mus musculus
acacaatgctctcctgagtaagcgg

SEQ ID NO: 94440 - DNA, 25 bp, Mus musculus
acacaatgctctgctgagtaagcgg

SEQ ID NO: 94441 - DNA, 25 bp, Mus musculus
acacaatggcgtatgcggtgcgcat

SEQ ID NO: 94442 - DNA, 25 bp, Mus musculus
acacaatggcgtttgcggtgcgcat

SEQ ID NO: 94443 - DNA, 25 bp, Mus musculus
acacaatggtaaccggcgttgtttg

SEQ ID NO: 94444 - DNA, 25 bp, Mus musculus
acacaatggtaagcggcgttgtttg

SEQ ID NO: 94445 - DNA, 25 bp, Mus musculus
acacaatggtggattcctcctttgc

SEQ ID NO: 94446 - DNA, 25 bp, Mus musculus
acacaatggtggtttcctcctttgc

SEQ ID NO: 94447 - DNA, 25 bp, Mus musculus
acacaatgtcatacatatatacatg

SEQ ID NO: 94448 - DNA, 25 bp, Mus musculus
acacaatgtcattcatatatacatg

SEQ ID NO: 94449 - DNA, 25 bp, Mus musculus
acacaatgtccccaattcagagcaa

SEQ ID NO: 94450 - DNA, 25 bp, Mus musculus
acacaatgtccccatgatctgctgc

SEQ ID NO: 94451 - DNA, 25 bp, Mus musculus
acacaatgtcccgaattcagagcaa

SEQ ID NO: 94452 - DNA, 25 bp, Mus musculus
acacaatgtcccgatgatctgctgc

SEQ ID NO: 94453 - DNA, 25 bp, Mus musculus
acacaatgttctaagtggtccactt

SEQ ID NO: 94454 - DNA, 25 bp, Mus musculus
acacaatgttcttagtggtccactt

SEQ ID NO: 94455 - DNA, 25 bp, Mus musculus
acacaatgttttatctcccagtttt

SEQ ID NO: 94456 - DNA, 25 bp, Mus musculus
acacaatgttttttctcccagtttt

SEQ ID NO: 94457 - DNA, 25 bp, Mus musculus
acacaattacacaaaagacttaggg

SEQ ID NO: 94458 - DNA, 25 bp, Mus musculus
acacaattacactaaagacttaggg

SEQ ID NO: 94459 - DNA, 25 bp, Mus musculus
acacaattggctaatgagaatacta

SEQ ID NO: 94460 - DNA, 25 bp, Mus musculus
acacaattggcttatgagaatacta

SEQ ID NO: 94461 - DNA, 25 bp, Mus musculus
acacaatttatacctgggtgtggtg

SEQ ID NO: 94462 - DNA, 25 bp, Mus musculus
acacaatttatagctgggtgtggtg

SEQ ID NO: 94463 - DNA, 25 bp, Mus musculus
acacaatttccaaggccccagtggt

SEQ ID NO: 94464 - DNA, 25 bp, Mus musculus
acacaatttccatggccccagtggt

SEQ ID NO: 94465 - DNA, 25 bp, Mus musculus
acacacaaaacacggagctggaaag

SEQ ID NO: 94466 - DNA, 25 bp, Mus musculus
acacacaaaacagggagctggaaag

SEQ ID NO: 94467 - DNA, 25 bp, Mus musculus
acacacaaacatatgcacacactca

SEQ ID NO: 94468 - DNA, 25 bp, Mus musculus
acacacaaacatttgcacacactca

SEQ ID NO: 94469 - DNA, 25 bp, Mus musculus
acacacaaacccatagaagctgtca

SEQ ID NO: 94470 - DNA, 25 bp, Mus musculus
acacacaaacccttagaagctgtca

SEQ ID NO: 94471 - DNA, 25 bp, Mus musculus
acacacaaactacaggtatctgaaa

SEQ ID NO: 94472 - DNA, 25 bp, Mus musculus
acacacaaactagaggtatctgaaa

SEQ ID NO: 94473 - DNA, 25 bp, Mus musculus
acacacaaatttacattcccaatcc

SEQ ID NO: 94474 - DNA, 25 bp, Mus musculus
acacacaaattttcattcccaatcc

SEQ ID NO: 94475 - DNA, 25 bp, Mus musculus
acacacaacatgaggcttttctgca

SEQ ID NO: 94476 - DNA, 25 bp, Mus musculus
acacacaacatgtggcttttctgca

SEQ ID NO: 94477 - DNA, 25 bp, Mus musculus
acacacaactgtatctatgagagat

SEQ ID NO: 94478 - DNA, 25 bp, Mus musculus
acacacaactgtttctatgagagat

SEQ ID NO: 94479 - DNA, 25 bp, Mus musculus
acacacaacttcactcaaggctttg

SEQ ID NO: 94480 - DNA, 25 bp, Mus musculus
acacacaacttctctcaaggctttg

SEQ ID NO: 94481 - DNA, 25 bp, Mus musculus
acacacaactttctatgcctgtcaa

SEQ ID NO: 94482 - DNA, 25 bp, Mus musculus
acacacaactttgtatgcctgtcaa

SEQ ID NO: 94483 - DNA, 25 bp, Mus musculus
acacacaagcatccttcagttcacg

SEQ ID NO: 94484 - DNA, 25 bp, Mus musculus
acacacaagcatgcttcagttcacg

SEQ ID NO: 94485 - DNA, 25 bp, Mus musculus
acacacaagccactatctagacaca

SEQ ID NO: 94486 - DNA, 25 bp, Mus musculus
acacacaagccagtatctagacaca

SEQ ID NO: 94487 - DNA, 25 bp, Mus musculus
acacacaaggccatcctagctatat

SEQ ID NO: 94488 - DNA, 25 bp, Mus musculus
acacacaaggccttcctagctatat

SEQ ID NO: 94489 - DNA, 25 bp, Mus musculus
acacacaatccgatcacagtttctt

SEQ ID NO: 94490 - DNA, 25 bp, Mus musculus
acacacaatccgttcacagtttctt

SEQ ID NO: 94491 - DNA, 25 bp, Mus musculus
acacacaatcgaacaatgggattaa

SEQ ID NO: 94492 - DNA, 25 bp, Mus musculus
acacacaatcgatcaatgggattaa

SEQ ID NO: 94493 - DNA, 25 bp, Mus musculus
acacacaatgctcctgggtcctaat

SEQ ID NO: 94494 - DNA, 25 bp, Mus musculus
acacacaatgctgctgggtcctaat

SEQ ID NO: 94495 - DNA, 25 bp, Mus musculus
acacacaatggaagttatttctaaa

SEQ ID NO: 94496 - DNA, 25 bp, Mus musculus
acacacaatggatgttatttctaaa

SEQ ID NO: 94497 - DNA, 25 bp, Mus musculus
acacacaatgtgcacaaagaccaga

SEQ ID NO: 94498 - DNA, 25 bp, Mus musculus
acacacaatgtggacaaagaccaga

SEQ ID NO: 94499 - DNA, 25 bp, Mus musculus
acacacaatgttatatctcccagtt

SEQ ID NO: 94500 - DNA, 25 bp, Mus musculus
acacacaatgttttatctcccagtt

SEQ ID NO: 94501 - DNA, 25 bp, Mus musculus
acacacacaaatcctctatcaaaac

SEQ ID NO: 94502 - DNA, 25 bp, Mus musculus
acacacacaaatgctctatcaaaac

SEQ ID NO: 94503 - DNA, 25 bp, Mus musculus
acacacacaatgacctcttgatact

SEQ ID NO: 94504 - DNA, 25 bp, Mus musculus
acacacacaatgtcctcttgatact

SEQ ID NO: 94505 - DNA, 25 bp, Mus musculus
acacacacaccacagagcatcgtgt

SEQ ID NO: 94506 - DNA, 25 bp, Mus musculus
acacacacaccacagttaatggatg

SEQ ID NO: 94507 - DNA, 25 bp, Mus musculus
acacacacaccagagagcatcgtgt

SEQ ID NO: 94508 - DNA, 25 bp, Mus musculus
acacacacaccagagttaatggatg

SEQ ID NO: 94509 - DNA, 25 bp, Mus musculus
acacacacagaacttgagactcatg

SEQ ID NO: 94510 - DNA, 25 bp, Mus musculus
acacacacagaagttgagactcatg

SEQ ID NO: 94511 - DNA, 25 bp, Mus musculus
acacacacagatatgcatgatcact

SEQ ID NO: 94512 - DNA, 25 bp, Mus musculus
acacacacagatttgcatgatcact

SEQ ID NO: 94513 - DNA, 25 bp, Mus musculus
acacacacaggcactagactcagtc

SEQ ID NO: 94514 - DNA, 25 bp, Mus musculus
acacacacaggctctagactcagtc

SEQ ID NO: 94515 - DNA, 25 bp, Mus musculus
acacacacatccaagactcaggcaa

SEQ ID NO: 94516 - DNA, 25 bp, Mus musculus
acacacacatcctagactcaggcaa

SEQ ID NO: 94517 - DNA, 25 bp, Mus musculus
acacacacccttaagttccagaact

SEQ ID NO: 94518 - DNA, 25 bp, Mus musculus
acacacacccttctacatgtagaca

SEQ ID NO: 94519 - DNA, 25 bp, Mus musculus
acacacacccttgtacatgtagaca

SEQ ID NO: 94520 - DNA, 25 bp, Mus musculus
acacacaccctttagttccagaact

SEQ ID NO: 94521 - DNA, 25 bp, Mus musculus
acacacacgggcacagtactggcgg

SEQ ID NO: 94522 - DNA, 25 bp, Mus musculus
acacacacgggctcagtactggcgg

SEQ ID NO: 94523 - DNA, 25 bp, Mus musculus
acacacacgtgtccctggagaagtt

SEQ ID NO: 94524 - DNA, 25 bp, Mus musculus
acacacacgtgtgcctggagaagtt

SEQ ID NO: 94525 - DNA, 25 bp, Mus musculus
acacacactctaaatgcaaagcatt

SEQ ID NO: 94526 - DNA, 25 bp, Mus musculus
acacacactctatatgcaaagcatt

SEQ ID NO: 94527 - DNA, 25 bp, Mus musculus
acacacactgaaatggaatccctcc

SEQ ID NO: 94528 - DNA, 25 bp, Mus musculus
acacacactgaattggaatccctcc

SEQ ID NO: 94529 - DNA, 25 bp, Mus musculus
acacacactggcagaacctaggtac

SEQ ID NO: 94530 - DNA, 25 bp, Mus musculus
acacacactggctgaacctaggtac

SEQ ID NO: 94531 - DNA, 25 bp, Mus musculus
acacacactgtaacaccaaatcctt

SEQ ID NO: 94532 - DNA, 25 bp, Mus musculus
acacacactgtatcaccaaatcctt

SEQ ID NO: 94533 - DNA, 25 bp, Mus musculus
acacacacttgaaatttgtctattt

SEQ ID NO: 94534 - DNA, 25 bp, Mus musculus
acacacacttgatatttgtctattt

SEQ ID NO: 94535 - DNA, 25 bp, Mus musculus
acacacacttggaacacagactgct

SEQ ID NO: 94536 - DNA, 25 bp, Mus musculus
acacacacttggctatattcttttg

SEQ ID NO: 94537 - DNA, 25 bp, Mus musculus
acacacacttgggtatattcttttg

SEQ ID NO: 94538 - DNA, 25 bp, Mus musculus
acacacacttggtacacagactgct

SEQ ID NO: 94539 - DNA, 25 bp, Mus musculus
acacacagagtaacaggcaaaatgt

SEQ ID NO: 94540 - DNA, 25 bp, Mus musculus
acacacagagtatcaggcaaaatgt

SEQ ID NO: 94541 - DNA, 25 bp, Mus musculus
acacacagcagtagtgaccacctgt

SEQ ID NO: 94542 - DNA, 25 bp, Mus musculus
acacacagcagttgtgaccacctgt

SEQ ID NO: 94543 - DNA, 25 bp, Mus musculus
acacacagccagctattgccggcag

SEQ ID NO: 94544 - DNA, 25 bp, Mus musculus
acacacagccaggtattgccggcag

SEQ ID NO: 94545 - DNA, 25 bp, Mus musculus
acacacagcccgagaactggcagtt

SEQ ID NO: 94546 - DNA, 25 bp, Mus musculus
acacacagcccgtgaactggcagtt

SEQ ID NO: 94547 - DNA, 25 bp, Mus musculus
acacacagctaacagtgcctggcgg

SEQ ID NO: 94548 - DNA, 25 bp, Mus musculus
acacacagctaagagtgcctggcgg

SEQ ID NO: 94549 - DNA, 25 bp, Mus musculus
acacacagctggctgtcaggctaag

SEQ ID NO: 94550 - DNA, 25 bp, Mus musculus
acacacagctgggtgtcaggctaag

SEQ ID NO: 94551 - DNA, 25 bp, Mus musculus
acacacaggaacattgctgggctga

SEQ ID NO: 94552 - DNA, 25 bp, Mus musculus
acacacaggaactttgctgggctga

SEQ ID NO: 94553 - DNA, 25 bp, Mus musculus
acacacaggagcatggcatttgcaa

SEQ ID NO: 94554 - DNA, 25 bp, Mus musculus
acacacaggagcttggcatttgcaa

SEQ ID NO: 94555 - DNA, 25 bp, Mus musculus
acacacaggcacatatacgcgaaaa

SEQ ID NO: 94556 - DNA, 25 bp, Mus musculus
acacacaggcacttatacgcgaaaa

SEQ ID NO: 94557 - DNA, 25 bp, Mus musculus
acacacaggctcactcctttggaga

SEQ ID NO: 94558 - DNA, 25 bp, Mus musculus
acacacaggctctctcctttggaga

SEQ ID NO: 94559 - DNA, 25 bp, Mus musculus
acacacagggctatgatggcgttga

SEQ ID NO: 94560 - DNA, 25 bp, Mus musculus
acacacagggctttgatggcgttga

SEQ ID NO: 94561 - DNA, 25 bp, Mus musculus
acacacagggtcacgtgggacactt

SEQ ID NO: 94562 - DNA, 25 bp, Mus musculus
acacacagggtctcgtgggacactt

SEQ ID NO: 94563 - DNA, 25 bp, Mus musculus
acacacagtaggcagggacgaccct

SEQ ID NO: 94564 - DNA, 25 bp, Mus musculus
acacacagtagggagggacgaccct

SEQ ID NO: 94565 - DNA, 25 bp, Mus musculus
acacacagtgcaagctcagtccctg

SEQ ID NO: 94566 - DNA, 25 bp, Mus musculus
acacacagtgcatgctcagtccctg

SEQ ID NO: 94567 - DNA, 25 bp, Mus musculus
acacacagtgctcttttgtttggtt

SEQ ID NO: 94568 - DNA, 25 bp, Mus musculus
acacacagtgctgttttgtttggtt

SEQ ID NO: 94569 - DNA, 25 bp, Mus musculus
acacacagtggacctggagacagct

SEQ ID NO: 94570 - DNA, 25 bp, Mus musculus
acacacagtggagctggagacagct

SEQ ID NO: 94571 - DNA, 25 bp, Mus musculus
acacacagtgttaaggagcccagag

SEQ ID NO: 94572 - DNA, 25 bp, Mus musculus
acacacagtgtttaggagcccagag

SEQ ID NO: 94573 - DNA, 25 bp, Mus musculus
acacacagttcacggtggactccgt

SEQ ID NO: 94574 - DNA, 25 bp, Mus musculus
acacacagttcagggtggactccgt

SEQ ID NO: 94575 - DNA, 25 bp, Mus musculus
acacacagtttgcacagtcgatatt

SEQ ID NO: 94576 - DNA, 25 bp, Mus musculus
acacacagtttggacagtcgatatt

SEQ ID NO: 94577 - DNA, 25 bp, Mus musculus
acacacatacatctactcacaaagc

SEQ ID NO: 94578 - DNA, 25 bp, Mus musculus
acacacatacatgtactcacaaagc

SEQ ID NO: 94579 - DNA, 25 bp, Mus musculus
acacacatacctcggagggcgtggc

SEQ ID NO: 94580 - DNA, 25 bp, Mus musculus
acacacatacctgggagggcgtggc

SEQ ID NO: 94581 - DNA, 25 bp, Mus musculus
acacacatacttaggttggttgagc

SEQ ID NO: 94582 - DNA, 25 bp, Mus musculus
acacacatactttggttggttgagc

SEQ ID NO: 94583 - DNA, 25 bp, Mus musculus
acacacatatttacctgcaagtcat

SEQ ID NO: 94584 - DNA, 25 bp, Mus musculus
acacacatattttcctgcaagtcat

SEQ ID NO: 94585 - DNA, 25 bp, Mus musculus
acacacatctctacagtttggactc

SEQ ID NO: 94586 - DNA, 25 bp, Mus musculus
acacacatctcttcagtttggactc

SEQ ID NO: 94587 - DNA, 25 bp, Mus musculus
acacacatgaagacgggacgctttt

SEQ ID NO: 94588 - DNA, 25 bp, Mus musculus
acacacatgaagtcgggacgctttt

SEQ ID NO: 94589 - DNA, 25 bp, Mus musculus
acacacatgcagaggcacttgtcca

SEQ ID NO: 94590 - DNA, 25 bp, Mus musculus
acacacatgcagtggcacttgtcca

SEQ ID NO: 94591 - DNA, 25 bp, Mus musculus
acacacatgcatactcaaagtgagg

SEQ ID NO: 94592 - DNA, 25 bp, Mus musculus
acacacatgcattctcaaagtgagg

SEQ ID NO: 94593 - DNA, 25 bp, Mus musculus
acacacatgcccatgacagcaggga

SEQ ID NO: 94594 - DNA, 25 bp, Mus musculus
acacacatgcccttgacagcaggga

SEQ ID NO: 94595 - DNA, 25 bp, Mus musculus
acacacatgcgcagagatctctgga

SEQ ID NO: 94596 - DNA, 25 bp, Mus musculus
acacacatgcgctgagatctctgga

SEQ ID NO: 94597 - DNA, 25 bp, Mus musculus
acacacatgtatattatctacactt

SEQ ID NO: 94598 - DNA, 25 bp, Mus musculus
acacacatgtattttatctacactt

SEQ ID NO: 94599 - DNA, 25 bp, Mus musculus
acacacatgtcaccacgagtagtca

SEQ ID NO: 94600 - DNA, 25 bp, Mus musculus
acacacatgtcagcacgagtagtca

SEQ ID NO: 94601 - DNA, 25 bp, Mus musculus
acacacatgtgacactgacccagct

SEQ ID NO: 94602 - DNA, 25 bp, Mus musculus
acacacatgtgagactgacccagct

SEQ ID NO: 94603 - DNA, 25 bp, Mus musculus
acacacatgtgcatcaccacttata

SEQ ID NO: 94604 - DNA, 25 bp, Mus musculus
acacacatgtgcttcaccacttata

SEQ ID NO: 94605 - DNA, 25 bp, Mus musculus
acacacatgtgtagctcccaataaa

SEQ ID NO: 94606 - DNA, 25 bp, Mus musculus
acacacatgtgttgctcccaataaa

SEQ ID NO: 94607 - DNA, 25 bp, Mus musculus
acacacattcttcaggtcactgaag

SEQ ID NO: 94608 - DNA, 25 bp, Mus musculus
acacacattcttgaggtcactgaag

SEQ ID NO: 94609 - DNA, 25 bp, Mus musculus
acacacattgttcggttaaaggctt

SEQ ID NO: 94610 - DNA, 25 bp, Mus musculus
acacacattgttgggttaaaggctt

SEQ ID NO: 94611 - DNA, 25 bp, Mus musculus
acacacattttgaacacattagttt

SEQ ID NO: 94612 - DNA, 25 bp, Mus musculus
acacacattttgtacacattagttt

SEQ ID NO: 94613 - DNA, 25 bp, Mus musculus
acacaccaccctctatgaatttcta

SEQ ID NO: 94614 - DNA, 25 bp, Mus musculus
acacaccaccctgtatgaatttcta

SEQ ID NO: 94615 - DNA, 25 bp, Mus musculus
acacaccactggagctcttagcaaa

SEQ ID NO: 94616 - DNA, 25 bp, Mus musculus
acacaccactggtgctcttagcaaa

SEQ ID NO: 94617 - DNA, 25 bp, Mus musculus
acacaccacttcactgtaggatgta

SEQ ID NO: 94618 - DNA, 25 bp, Mus musculus
acacaccacttctctgtaggatgta

SEQ ID NO: 94619 - DNA, 25 bp, Mus musculus
acacaccagaggaggctaaacgaga

SEQ ID NO: 94620 - DNA, 25 bp, Mus musculus
acacaccagaggtggctaaacgaga

SEQ ID NO: 94621 - DNA, 25 bp, Mus musculus
acacaccagcctctggatctggaaa

SEQ ID NO: 94622 - DNA, 25 bp, Mus musculus
acacaccagcctgtggatctggaaa

SEQ ID NO: 94623 - DNA, 25 bp, Mus musculus
acacaccaggacaatgcaaaggata

SEQ ID NO: 94624 - DNA, 25 bp, Mus musculus
acacaccaggactatgcaaaggata

SEQ ID NO: 94625 - DNA, 25 bp, Mus musculus
acacaccaggctactagaactacta

SEQ ID NO: 94626 - DNA, 25 bp, Mus musculus
acacaccaggcttctagaactacta

SEQ ID NO: 94627 - DNA, 25 bp, Mus musculus
acacaccagggaacttcgccgggat

SEQ ID NO: 94628 - DNA, 25 bp, Mus musculus
acacaccagggatcttcgccgggat

SEQ ID NO: 94629 - DNA, 25 bp, Mus musculus
acacaccaggttatctgtgtggagg

SEQ ID NO: 94630 - DNA, 25 bp, Mus musculus
acacaccaggttttctgtgtggagg

SEQ ID NO: 94631 - DNA, 25 bp, Mus musculus
acacaccagtgaagctgtctgcggg

SEQ ID NO: 94632 - DNA, 25 bp, Mus musculus
acacaccagtgatgctgtctgcggg

SEQ ID NO: 94633 - DNA, 25 bp, Mus musculus
acacaccagtgcctgtagttcagtt

SEQ ID NO: 94634 - DNA, 25 bp, Mus musculus
acacaccagtgcgtgtagttcagtt

SEQ ID NO: 94635 - DNA, 25 bp, Mus musculus
acacaccatacgatttgagacataa

SEQ ID NO: 94636 - DNA, 25 bp, Mus musculus
acacaccatacgttttgagacataa

SEQ ID NO: 94637 - DNA, 25 bp, Mus musculus
acacaccattgcagcgttcctggga

SEQ ID NO: 94638 - DNA, 25 bp, Mus musculus
acacaccattgctgcgttcctggga

SEQ ID NO: 94639 - DNA, 25 bp, Mus musculus
acacaccattgtctttccgagaggt

SEQ ID NO: 94640 - DNA, 25 bp, Mus musculus
acacaccattgtgtttccgagaggt

SEQ ID NO: 94641 - DNA, 25 bp, Mus musculus
acacacccacacagacttggaaggg

SEQ ID NO: 94642 - DNA, 25 bp, Mus musculus
acacacccacactgacttggaaggg

SEQ ID NO: 94643 - DNA, 25 bp, Mus musculus
acacacccagttagaggaaatgacc

SEQ ID NO: 94644 - DNA, 25 bp, Mus musculus
acacacccagtttgaggaaatgacc

SEQ ID NO: 94645 - DNA, 25 bp, Mus musculus
acacacccatcccatgggagctgga

SEQ ID NO: 94646 - DNA, 25 bp, Mus musculus
acacacccatccgatgggagctgga

SEQ ID NO: 94647 - DNA, 25 bp, Mus musculus
acacacccatgacagtgttgcagtt

SEQ ID NO: 94648 - DNA, 25 bp, Mus musculus
acacacccatgagagtgttgcagtt

SEQ ID NO: 94649 - DNA, 25 bp, Mus musculus
acacacccatggacattaccacttt

SEQ ID NO: 94650 - DNA, 25 bp, Mus musculus
acacacccatggtcattaccacttt

SEQ ID NO: 94651 - DNA, 25 bp, Mus musculus
acacacccccttcgatttgatgatg

SEQ ID NO: 94652 - DNA, 25 bp, Mus musculus
acacacccccttggatttgatgatg

SEQ ID NO: 94653 - DNA, 25 bp, Mus musculus
acacaccccgtgatggttaggtgat

SEQ ID NO: 94654 - DNA, 25 bp, Mus musculus
acacaccccgtgttggttaggtgat

SEQ ID NO: 94655 - DNA, 25 bp, Mus musculus
acacacccctaacctcgtgtagaaa

SEQ ID NO: 94656 - DNA, 25 bp, Mus musculus
acacacccctaagctcgtgtagaaa

SEQ ID NO: 94657 - DNA, 25 bp, Mus musculus
acacaccctactcacggagaagctg

SEQ ID NO: 94658 - DNA, 25 bp, Mus musculus
acacaccctactgacggagaagctg

SEQ ID NO: 94659 - DNA, 25 bp, Mus musculus
acacaccctagcagaggtctcatta

SEQ ID NO: 94660 - DNA, 25 bp, Mus musculus
acacaccctagctgaggtctcatta

SEQ ID NO: 94661 - DNA, 25 bp, Mus musculus
acacaccctccgagagggtggaggc

SEQ ID NO: 94662 - DNA, 25 bp, Mus musculus
acacaccctccgtgagggtggaggc

SEQ ID NO: 94663 - DNA, 25 bp, Mus musculus
acacaccctgacataaactgctgat

SEQ ID NO: 94664 - DNA, 25 bp, Mus musculus
acacaccctgacttaaactgctgat

SEQ ID NO: 94665 - DNA, 25 bp, Mus musculus
acacaccctgttccaggaagagctg

SEQ ID NO: 94666 - DNA, 25 bp, Mus musculus
acacaccctgttgcaggaagagctg

SEQ ID NO: 94667 - DNA, 25 bp, Mus musculus
acacacccttcacaactcattttaa

SEQ ID NO: 94668 - DNA, 25 bp, Mus musculus
acacacccttcagaactcattttaa

SEQ ID NO: 94669 - DNA, 25 bp, Mus musculus
acacacccttttcttgttgctcaga

SEQ ID NO: 94670 - DNA, 25 bp, Mus musculus
acacacccttttgttgttgctcaga

SEQ ID NO: 94671 - DNA, 25 bp, Mus musculus
acacaccgaccacataccatcccag

SEQ ID NO: 94672 - DNA, 25 bp, Mus musculus
acacaccgaccagataccatcccag

SEQ ID NO: 94673 - DNA, 25 bp, Mus musculus
acacaccgcatccaggaagctgaag

SEQ ID NO: 94674 - DNA, 25 bp, Mus musculus
acacaccgcatcgaggaagctgaag

SEQ ID NO: 94675 - DNA, 25 bp, Mus musculus
acacaccggtaaaaaccagctttga

SEQ ID NO: 94676 - DNA, 25 bp, Mus musculus
acacaccggtaataaccagctttga

SEQ ID NO: 94677 - DNA, 25 bp, Mus musculus
acacacctacacaggagatggttgg

SEQ ID NO: 94678 - DNA, 25 bp, Mus musculus
acacacctacactggagatggttgg

SEQ ID NO: 94679 - DNA, 25 bp, Mus musculus
acacacctactgcttcttttatagg

SEQ ID NO: 94680 - DNA, 25 bp, Mus musculus
acacacctactggttcttttatagg

SEQ ID NO: 94681 - DNA, 25 bp, Mus musculus
acacacctagtcctgggagagtgcc

SEQ ID NO: 94682 - DNA, 25 bp, Mus musculus
acacacctagtcgtgggagagtgcc

SEQ ID NO: 94683 - DNA, 25 bp, Mus musculus
acacacctatgaaccaagtgctcct

SEQ ID NO: 94684 - DNA, 25 bp, Mus musculus
acacacctatgatccaagtgctcct

SEQ ID NO: 94685 - DNA, 25 bp, Mus musculus
acacacctcataaatccctaattaa

SEQ ID NO: 94686 - DNA, 25 bp, Mus musculus
acacacctcatatatccctaattaa

SEQ ID NO: 94687 - DNA, 25 bp, Mus musculus
acacacctcctaacgcaaagctgag

SEQ ID NO: 94688 - DNA, 25 bp, Mus musculus
acacacctcctatcgcaaagctgag

SEQ ID NO: 94689 - DNA, 25 bp, Mus musculus
acacacctgattccatcttgcgtgg

SEQ ID NO: 94690 - DNA, 25 bp, Mus musculus
acacacctgattgcatcttgcgtgg

SEQ ID NO: 94691 - DNA, 25 bp, Mus musculus
acacacctgctgctctgtacaaaaa

SEQ ID NO: 94692 - DNA, 25 bp, Mus musculus
acacacctgctggtctgtacaaaaa

SEQ ID NO: 94693 - DNA, 25 bp, Mus musculus
acacacctgcttatgatgctaagga

SEQ ID NO: 94694 - DNA, 25 bp, Mus musculus
acacacctgcttttgatgctaagga

SEQ ID NO: 94695 - DNA, 25 bp, Mus musculus
acacacctgtaactcaggctccaga

SEQ ID NO: 94696 - DNA, 25 bp, Mus musculus
acacacctgtaagtcaggctccaga

SEQ ID NO: 94697 - DNA, 25 bp, Mus musculus
acacacctgttaaatatgattctct

SEQ ID NO: 94698 - DNA, 25 bp, Mus musculus
acacacctgttatatatgattctct

SEQ ID NO: 94699 - DNA, 25 bp, Mus musculus
acacaccttagactttgccttatag

SEQ ID NO: 94700 - DNA, 25 bp, Mus musculus
acacaccttagagtttgccttatag

SEQ ID NO: 94701 - DNA, 25 bp, Mus musculus
acacaccttgctcctaatcagaaat

SEQ ID NO: 94702 - DNA, 25 bp, Mus musculus
acacaccttgctgctaatcagaaat

SEQ ID NO: 94703 - DNA, 25 bp, Mus musculus
acacaccttggaaccccaaactgag

SEQ ID NO: 94704 - DNA, 25 bp, Mus musculus
acacaccttggatccccaaactgag

SEQ ID NO: 94705 - DNA, 25 bp, Mus musculus
acacacctttaactctagcaaagag

SEQ ID NO: 94706 - DNA, 25 bp, Mus musculus
acacacctttaagtctagcaaagag

SEQ ID NO: 94707 - DNA, 25 bp, Mus musculus
acacacctttgtcatcctgaggatg

SEQ ID NO: 94708 - DNA, 25 bp, Mus musculus
acacacctttgtgatcctgaggatg

SEQ ID NO: 94709 - DNA, 25 bp, Mus musculus
acacaccttttacaacaggactcag

SEQ ID NO: 94710 - DNA, 25 bp, Mus musculus
acacaccttttagaacaggactcag

SEQ ID NO: 94711 - DNA, 25 bp, Mus musculus
acacacgaacacaggcaaagcagga

SEQ ID NO: 94712 - DNA, 25 bp, Mus musculus
acacacgaacactggcaaagcagga

SEQ ID NO: 94713 - DNA, 25 bp, Mus musculus
acacacgaacttctataccactaca

SEQ ID NO: 94714 - DNA, 25 bp, Mus musculus
acacacgaacttgtataccactaca

SEQ ID NO: 94715 - DNA, 25 bp, Mus musculus
acacacgaatgcaaagaaccctaca

SEQ ID NO: 94716 - DNA, 25 bp, Mus musculus
acacacgaatgctaagaaccctaca

SEQ ID NO: 94717 - DNA, 25 bp, Mus musculus
acacacgatgagcttctgcgcaaaa

SEQ ID NO: 94718 - DNA, 25 bp, Mus musculus
acacacgatgaggttctgcgcaaaa

SEQ ID NO: 94719 - DNA, 25 bp, Mus musculus
acacacgcaggtctgtttcccaatg

SEQ ID NO: 94720 - DNA, 25 bp, Mus musculus
acacacgcaggtgtgtttcccaatg

SEQ ID NO: 94721 - DNA, 25 bp, Mus musculus
acacacgcagttatgttgaggattt

SEQ ID NO: 94722 - DNA, 25 bp, Mus musculus
acacacgcagttttgttgaggattt

SEQ ID NO: 94723 - DNA, 25 bp, Mus musculus
acacacgccttcagtcagttaagtt

SEQ ID NO: 94724 - DNA, 25 bp, Mus musculus
acacacgccttctgtcagttaagtt

SEQ ID NO: 94725 - DNA, 25 bp, Mus musculus
acacacgctcagcatgtcgtcgaag

SEQ ID NO: 94726 - DNA, 25 bp, Mus musculus
acacacgctcaggatgtcgtcgaag

SEQ ID NO: 94727 - DNA, 25 bp, Mus musculus
acacacgctgcgcaactctggaaaa

SEQ ID NO: 94728 - DNA, 25 bp, Mus musculus
acacacgctgcggaactctggaaaa

SEQ ID NO: 94729 - DNA, 25 bp, Mus musculus
acacacgcttacacaaatttcataa

SEQ ID NO: 94730 - DNA, 25 bp, Mus musculus
acacacgcttactcaaatttcataa

SEQ ID NO: 94731 - DNA, 25 bp, Mus musculus
acacacgcttagcatagtggtgcac

SEQ ID NO: 94732 - DNA, 25 bp, Mus musculus
acacacgcttaggatagtggtgcac

SEQ ID NO: 94733 - DNA, 25 bp, Mus musculus
acacacggatttcggcttctgacta

SEQ ID NO: 94734 - DNA, 25 bp, Mus musculus
acacacggatttgggcttctgacta

SEQ ID NO: 94735 - DNA, 25 bp, Mus musculus
acacacggcaggcaggccaggcaca

SEQ ID NO: 94736 - DNA, 25 bp, Mus musculus
acacacggcagggaggccaggcaca

SEQ ID NO: 94737 - DNA, 25 bp, Mus musculus
acacacggccatattggtcaccgga

SEQ ID NO: 94738 - DNA, 25 bp, Mus musculus
acacacggccattttggtcaccgga

SEQ ID NO: 94739 - DNA, 25 bp, Mus musculus
acacacggctcacagactgcatatg

SEQ ID NO: 94740 - DNA, 25 bp, Mus musculus
acacacggctcagagactgcatatg

SEQ ID NO: 94741 - DNA, 25 bp, Mus musculus
acacacggtccaaagaggaggccat

SEQ ID NO: 94742 - DNA, 25 bp, Mus musculus
acacacggtccatagaggaggccat

SEQ ID NO: 94743 - DNA, 25 bp, Mus musculus
acacacggtctcatttgtggtccaa

SEQ ID NO: 94744 - DNA, 25 bp, Mus musculus
acacacggtctccaaatgctaacaa

SEQ ID NO: 94745 - DNA, 25 bp, Mus musculus
acacacggtctcgaaatgctaacaa

SEQ ID NO: 94746 - DNA, 25 bp, Mus musculus
acacacggtctcttttgtggtccaa

SEQ ID NO: 94747 - DNA, 25 bp, Mus musculus
acacacggtgaaagccaccgcttgt

SEQ ID NO: 94748 - DNA, 25 bp, Mus musculus
acacacggtgaatgccaccgcttgt

SEQ ID NO: 94749 - DNA, 25 bp, Mus musculus
acacacgtacatcaggcactccata

SEQ ID NO: 94750 - DNA, 25 bp, Mus musculus
acacacgtacatgaggcactccata

SEQ ID NO: 94751 - DNA, 25 bp, Mus musculus
acacacgtagtgaccagttttaaag

SEQ ID NO: 94752 - DNA, 25 bp, Mus musculus
acacacgtagtgtccagttttaaag

SEQ ID NO: 94753 - DNA, 25 bp, Mus musculus
acacacgtccaaccactaatgtatg

SEQ ID NO: 94754 - DNA, 25 bp, Mus musculus
acacacgtccaagcactaatgtatg

SEQ ID NO: 94755 - DNA, 25 bp, Mus musculus
acacacgtcctcatttcatagacaa

SEQ ID NO: 94756 - DNA, 25 bp, Mus musculus
acacacgtcctcttttcatagacaa

SEQ ID NO: 94757 - DNA, 25 bp, Mus musculus
acacacgtcgctcagtgcaagctgc

SEQ ID NO: 94758 - DNA, 25 bp, Mus musculus
acacacgtcgctgagtgcaagctgc

SEQ ID NO: 94759 - DNA, 25 bp, Mus musculus
acacacgtgagaccactgcagcaaa

SEQ ID NO: 94760 - DNA, 25 bp, Mus musculus
acacacgtgagagcactgcagcaaa

SEQ ID NO: 94761 - DNA, 25 bp, Mus musculus
acacacgtgctgatgtttacaagga

SEQ ID NO: 94762 - DNA, 25 bp, Mus musculus
acacacgtgctgttgtttacaagga

SEQ ID NO: 94763 - DNA, 25 bp, Mus musculus
acacacgtggatattctggcttcag

SEQ ID NO: 94764 - DNA, 25 bp, Mus musculus
acacacgtggattttctggcttcag

SEQ ID NO: 94765 - DNA, 25 bp, Mus musculus
acacacgtggtgaatatacatgtag

SEQ ID NO: 94766 - DNA, 25 bp, Mus musculus
acacacgtggtgtatatacatgtag

SEQ ID NO: 94767 - DNA, 25 bp, Mus musculus
acacacgttcagatgtaggttgcat

SEQ ID NO: 94768 - DNA, 25 bp, Mus musculus
acacacgttcagttgtaggttgcat

SEQ ID NO: 94769 - DNA, 25 bp, Mus musculus
acacacgttggcacttcttggtagc

SEQ ID NO: 94770 - DNA, 25 bp, Mus musculus
acacacgttggctcttcttggtagc

SEQ ID NO: 94771 - DNA, 25 bp, Mus musculus
acacacgtttccctagagctgatga

SEQ ID NO: 94772 - DNA, 25 bp, Mus musculus
acacacgtttccgtagagctgatga

SEQ ID NO: 94773 - DNA, 25 bp, Mus musculus
acacactaaccaaactagcagcatt

SEQ ID NO: 94774 - DNA, 25 bp, Mus musculus
acacactaaccatactagcagcatt

SEQ ID NO: 94775 - DNA, 25 bp, Mus musculus
acacactaagttacgttgggatcta

SEQ ID NO: 94776 - DNA, 25 bp, Mus musculus
acacactaagtttcgttgggatcta

SEQ ID NO: 94777 - DNA, 25 bp, Mus musculus
acacactaatatactaaagttcaag

SEQ ID NO: 94778 - DNA, 25 bp, Mus musculus
acacactaatattctaaagttcaag

SEQ ID NO: 94779 - DNA, 25 bp, Mus musculus
acacactacaaaactgcccacgggt

SEQ ID NO: 94780 - DNA, 25 bp, Mus musculus
acacactacaaatctgcccacgggt

SEQ ID NO: 94781 - DNA, 25 bp, Mus musculus
acacactacctgcaatggcctgccc

SEQ ID NO: 94782 - DNA, 25 bp, Mus musculus
acacactacctggaatggcctgccc

SEQ ID NO: 94783 - DNA, 25 bp, Mus musculus
acacactagcagctcttcggaggag

SEQ ID NO: 94784 - DNA, 25 bp, Mus musculus
acacactagcaggtcttcggaggag

SEQ ID NO: 94785 - DNA, 25 bp, Mus musculus
acacactaggaaattctttccaaag

SEQ ID NO: 94786 - DNA, 25 bp, Mus musculus
acacactaggaatttctttccaaag

SEQ ID NO: 94787 - DNA, 25 bp, Mus musculus
acacactataagatgcacgggatga

SEQ ID NO: 94788 - DNA, 25 bp, Mus musculus
acacactataagttgcacgggatga

SEQ ID NO: 94789 - DNA, 25 bp, Mus musculus
acacactatgtaaagagcctccagc

SEQ ID NO: 94790 - DNA, 25 bp, Mus musculus
acacactatgtatagagcctccagc

SEQ ID NO: 94791 - DNA, 25 bp, Mus musculus
acacactattatatccaggccagca

SEQ ID NO: 94792 - DNA, 25 bp, Mus musculus
acacactattatttccaggccagca

SEQ ID NO: 94793 - DNA, 25 bp, Mus musculus
acacactattgtcagggtctttcag

SEQ ID NO: 94794 - DNA, 25 bp, Mus musculus
acacactattgtgagggtctttcag

SEQ ID NO: 94795 - DNA, 25 bp, Mus musculus
acacactcacacctatatgtatgct

SEQ ID NO: 94796 - DNA, 25 bp, Mus musculus
acacactcacacgtatatgtatgct

SEQ ID NO: 94797 - DNA, 25 bp, Mus musculus
acacactcacgcctacttttaaatg

SEQ ID NO: 94798 - DNA, 25 bp, Mus musculus
acacactcacgcgtacttttaaatg

SEQ ID NO: 94799 - DNA, 25 bp, Mus musculus
acacactcactacatggagctactc

SEQ ID NO: 94800 - DNA, 25 bp, Mus musculus
acacactcactagatggagctactc

SEQ ID NO: 94801 - DNA, 25 bp, Mus musculus
acacactcatgaacctggagatgca

SEQ ID NO: 94802 - DNA, 25 bp, Mus musculus
acacactcatgatcctggagatgca

SEQ ID NO: 94803 - DNA, 25 bp, Mus musculus
acacactcatgcattcactctattg

SEQ ID NO: 94804 - DNA, 25 bp, Mus musculus
acacactcatgctttcactctattg

SEQ ID NO: 94805 - DNA, 25 bp, Mus musculus
acacactcccttcggtggatctgta

SEQ ID NO: 94806 - DNA, 25 bp, Mus musculus
acacactcccttctaaggctctgat

SEQ ID NO: 94807 - DNA, 25 bp, Mus musculus
acacactcccttgggtggatctgta

SEQ ID NO: 94808 - DNA, 25 bp, Mus musculus
acacactcccttgtaaggctctgat

SEQ ID NO: 94809 - DNA, 25 bp, Mus musculus
acacactccttcagcctgagatttt

SEQ ID NO: 94810 - DNA, 25 bp, Mus musculus
acacactccttctgcctgagatttt

SEQ ID NO: 94811 - DNA, 25 bp, Mus musculus
acacactcgaggatcagatcagatc

SEQ ID NO: 94812 - DNA, 25 bp, Mus musculus
acacactcgaggttcagatcagatc

SEQ ID NO: 94813 - DNA, 25 bp, Mus musculus
acacactcggtgatctattgacaat

SEQ ID NO: 94814 - DNA, 25 bp, Mus musculus
acacactcggtgatgaacttgggca

SEQ ID NO: 94815 - DNA, 25 bp, Mus musculus
acacactcggtgttctattgacaat

SEQ ID NO: 94816 - DNA, 25 bp, Mus musculus
acacactcggtgttgaacttgggca

SEQ ID NO: 94817 - DNA, 25 bp, Mus musculus
acacactctctgaccattaggtata

SEQ ID NO: 94818 - DNA, 25 bp, Mus musculus
acacactctctgtccattaggtata

SEQ ID NO: 94819 - DNA, 25 bp, Mus musculus
acacactctgagcatctgagctgag

SEQ ID NO: 94820 - DNA, 25 bp, Mus musculus
acacactctgaggatctgagctgag

SEQ ID NO: 94821 - DNA, 25 bp, Mus musculus
acacactctggcatagctcaggtaa

SEQ ID NO: 94822 - DNA, 25 bp, Mus musculus
acacactctggcttagctcaggtaa

SEQ ID NO: 94823 - DNA, 25 bp, Mus musculus
acacactctgggaaccaggaacgag

SEQ ID NO: 94824 - DNA, 25 bp, Mus musculus
acacactctgggtaccaggaacgag

SEQ ID NO: 94825 - DNA, 25 bp, Mus musculus
acacactctggtcaaacccttaaag

SEQ ID NO: 94826 - DNA, 25 bp, Mus musculus
acacactctggtgaaacccttaaag

SEQ ID NO: 94827 - DNA, 25 bp, Mus musculus
acacactctgtacaatctctccatt

SEQ ID NO: 94828 - DNA, 25 bp, Mus musculus
acacactctgtagaatctctccatt

SEQ ID NO: 94829 - DNA, 25 bp, Mus musculus
acacactctgtcactcaagaaggca

SEQ ID NO: 94830 - DNA, 25 bp, Mus musculus
acacactctgtctctcaagaaggca

SEQ ID NO: 94831 - DNA, 25 bp, Mus musculus
acacactcttggactttggaaggga

SEQ ID NO: 94832 - DNA, 25 bp, Mus musculus
acacactcttggtctttggaaggga

SEQ ID NO: 94833 - DNA, 25 bp, Mus musculus
acacactgactccacattgtctggt

SEQ ID NO: 94834 - DNA, 25 bp, Mus musculus
acacactgactcgacattgtctggt

SEQ ID NO: 94835 - DNA, 25 bp, Mus musculus
acacactgcagtatccacaacaaga

SEQ ID NO: 94836 - DNA, 25 bp, Mus musculus
acacactgcagtttccacaacaaga

SEQ ID NO: 94837 - DNA, 25 bp, Mus musculus
acacactgcatgaaattctctgcga

SEQ ID NO: 94838 - DNA, 25 bp, Mus musculus
acacactgcatgtaattctctgcga

SEQ ID NO: 94839 - DNA, 25 bp, Mus musculus
acacactgccttagctagacacaga

SEQ ID NO: 94840 - DNA, 25 bp, Mus musculus
acacactgcctttgctagacacaga

SEQ ID NO: 94841 - DNA, 25 bp, Mus musculus
acacactgctctagtatgtccagca

SEQ ID NO: 94842 - DNA, 25 bp, Mus musculus
acacactgctcttgtatgtccagca

SEQ ID NO: 94843 - DNA, 25 bp, Mus musculus
acacactggctgctttgctgatgga

SEQ ID NO: 94844 - DNA, 25 bp, Mus musculus
acacactggctggtttgctgatgga

SEQ ID NO: 94845 - DNA, 25 bp, Mus musculus
acacactgggacacatttgtggaga

SEQ ID NO: 94846 - DNA, 25 bp, Mus musculus
acacactgggactcatttgtggaga

SEQ ID NO: 94847 - DNA, 25 bp, Mus musculus
acacactggtatctaaggccatgac

SEQ ID NO: 94848 - DNA, 25 bp, Mus musculus
acacactggtatgtaaggccatgac

SEQ ID NO: 94849 - DNA, 25 bp, Mus musculus
acacactggtggatggaagtctgtt

SEQ ID NO: 94850 - DNA, 25 bp, Mus musculus
acacactggtggttggaagtctgtt

SEQ ID NO: 94851 - DNA, 25 bp, Mus musculus
acacactgtagtctcggtttctggg

SEQ ID NO: 94852 - DNA, 25 bp, Mus musculus
acacactgtagtgtcggtttctggg

SEQ ID NO: 94853 - DNA, 25 bp, Mus musculus
acacactgtcagaccctacagctaa

SEQ ID NO: 94854 - DNA, 25 bp, Mus musculus
acacactgtcagtccctacagctaa

SEQ ID NO: 94855 - DNA, 25 bp, Mus musculus
acacactgtgacaattgggagactg

SEQ ID NO: 94856 - DNA, 25 bp, Mus musculus
acacactgtgactattgggagactg

SEQ ID NO: 94857 - DNA, 25 bp, Mus musculus
acacactgtgatcatgactgtaatt

SEQ ID NO: 94858 - DNA, 25 bp, Mus musculus
acacactgtgatgatgactgtaatt

SEQ ID NO: 94859 - DNA, 25 bp, Mus musculus
acacactgtgctcaatgccttcatt

SEQ ID NO: 94860 - DNA, 25 bp, Mus musculus
acacactgtgctgaatgccttcatt

SEQ ID NO: 94861 - DNA, 25 bp, Mus musculus
acacactgttcaacagtagcaaaag

SEQ ID NO: 94862 - DNA, 25 bp, Mus musculus
acacactgttcatcagtagcaaaag

SEQ ID NO: 94863 - DNA, 25 bp, Mus musculus
acacacttaaatcttactgcccaaa

SEQ ID NO: 94864 - DNA, 25 bp, Mus musculus
acacacttaaatgttactgcccaaa

SEQ ID NO: 94865 - DNA, 25 bp, Mus musculus
acacacttatttagatgatcggcgt

SEQ ID NO: 94866 - DNA, 25 bp, Mus musculus
acacacttattttgatgatcggcgt

SEQ ID NO: 94867 - DNA, 25 bp, Mus musculus
acacacttcatgatagctgctccaa

SEQ ID NO: 94868 - DNA, 25 bp, Mus musculus
acacacttcatgttagctgctccaa

SEQ ID NO: 94869 - DNA, 25 bp, Mus musculus
acacacttccttccaggagatgaag

SEQ ID NO: 94870 - DNA, 25 bp, Mus musculus
acacacttccttgcaggagatgaag

SEQ ID NO: 94871 - DNA, 25 bp, Mus musculus
acacacttcgcacccaatgtgggct

SEQ ID NO: 94872 - DNA, 25 bp, Mus musculus
acacacttcgcagccaatgtgggct

SEQ ID NO: 94873 - DNA, 25 bp, Mus musculus
acacacttgaagacctgtttcctaa

SEQ ID NO: 94874 - DNA, 25 bp, Mus musculus
acacacttgaagtcctgtttcctaa

SEQ ID NO: 94875 - DNA, 25 bp, Mus musculus
acacacttgaccctgcaaaaagaag

SEQ ID NO: 94876 - DNA, 25 bp, Mus musculus
acacacttgaccgtgcaaaaagaag

SEQ ID NO: 94877 - DNA, 25 bp, Mus musculus
acacacttgattcgctgacccaaga

SEQ ID NO: 94878 - DNA, 25 bp, Mus musculus
acacacttgattggctgacccaaga

SEQ ID NO: 94879 - DNA, 25 bp, Mus musculus
acacacttgcacagaatggatgatt

SEQ ID NO: 94880 - DNA, 25 bp, Mus musculus
acacacttgcactgaatggatgatt

SEQ ID NO: 94881 - DNA, 25 bp, Mus musculus
acacacttggtaaacagacatgcat

SEQ ID NO: 94882 - DNA, 25 bp, Mus musculus
acacacttggtatacagacatgcat

SEQ ID NO: 94883 - DNA, 25 bp, Mus musculus
acacacttggttctagactatggca

SEQ ID NO: 94884 - DNA, 25 bp, Mus musculus
acacacttggttgtagactatggca

SEQ ID NO: 94885 - DNA, 25 bp, Mus musculus
acacacttgtctacatctggtcaga

SEQ ID NO: 94886 - DNA, 25 bp, Mus musculus
acacacttgtcttcatctggtcaga

SEQ ID NO: 94887 - DNA, 25 bp, Mus musculus
acacacttgttcacctcgagtaaga

SEQ ID NO: 94888 - DNA, 25 bp, Mus musculus
acacacttgttcatgggcgcagcaa

SEQ ID NO: 94889 - DNA, 25 bp, Mus musculus
acacacttgttctcctcgagtaaga

SEQ ID NO: 94890 - DNA, 25 bp, Mus musculus
acacacttgttcttgggcgcagcaa

SEQ ID NO: 94891 - DNA, 25 bp, Mus musculus
acacactttgcaattcagttctcag

SEQ ID NO: 94892 - DNA, 25 bp, Mus musculus
acacactttgcatttcagttctcag

SEQ ID NO: 94893 - DNA, 25 bp, Mus musculus
acacactttttcaatagcaagggtt

SEQ ID NO: 94894 - DNA, 25 bp, Mus musculus
acacactttttctatagcaagggtt

SEQ ID NO: 94895 - DNA, 25 bp, Mus musculus
acacagaaaaccacaagggctttca

SEQ ID NO: 94896 - DNA, 25 bp, Mus musculus
acacagaaaacctcaagggctttca

SEQ ID NO: 94897 - DNA, 25 bp, Mus musculus
acacagaaagttacatctcatgtcc

SEQ ID NO: 94898 - DNA, 25 bp, Mus musculus
acacagaaagtttcatctcatgtcc

SEQ ID NO: 94899 - DNA, 25 bp, Mus musculus
acacagaacatgaccagcagacctt

SEQ ID NO: 94900 - DNA, 25 bp, Mus musculus
acacagaacatgtccagcagacctt

SEQ ID NO: 94901 - DNA, 25 bp, Mus musculus
acacagaactttagctgggcctcta

SEQ ID NO: 94902 - DNA, 25 bp, Mus musculus
acacagaacttttgctgggcctcta

SEQ ID NO: 94903 - DNA, 25 bp, Mus musculus
acacagaagcacctgtgctcagcac

SEQ ID NO: 94904 - DNA, 25 bp, Mus musculus
acacagaagcacgtgtgctcagcac

SEQ ID NO: 94905 - DNA, 25 bp, Mus musculus
acacagaagcatccatccatcgagg

SEQ ID NO: 94906 - DNA, 25 bp, Mus musculus
acacagaagcatgcatccatcgagg

SEQ ID NO: 94907 - DNA, 25 bp, Mus musculus
acacagaagggcatacctcagcaag

SEQ ID NO: 94908 - DNA, 25 bp, Mus musculus
acacagaagggcttacctcagcaag

SEQ ID NO: 94909 - DNA, 25 bp, Mus musculus
acacagaagtcacccttctaggtaa

SEQ ID NO: 94910 - DNA, 25 bp, Mus musculus
acacagaagtcagccttctaggtaa

SEQ ID NO: 94911 - DNA, 25 bp, Mus musculus
acacagaataatccaagtttggttt

SEQ ID NO: 94912 - DNA, 25 bp, Mus musculus
acacagaataatgcaagtttggttt

SEQ ID NO: 94913 - DNA, 25 bp, Mus musculus
acacagaatcggagacttcattgat

SEQ ID NO: 94914 - DNA, 25 bp, Mus musculus
acacagaatcggtgacttcattgat

SEQ ID NO: 94915 - DNA, 25 bp, Mus musculus
acacagacacagctagatccctgga

SEQ ID NO: 94916 - DNA, 25 bp, Mus musculus
acacagacacaggtagatccctgga

SEQ ID NO: 94917 - DNA, 25 bp, Mus musculus
acacagacactccagttttgttttt

SEQ ID NO: 94918 - DNA, 25 bp, Mus musculus
acacagacactcgagttttgttttt

SEQ ID NO: 94919 - DNA, 25 bp, Mus musculus
acacagacactgccgaacagcatca

SEQ ID NO: 94920 - DNA, 25 bp, Mus musculus
acacagacactggcgaacagcatca

SEQ ID NO: 94921 - DNA, 25 bp, Mus musculus
acacagacaggcctttgcgtgggtt

SEQ ID NO: 94922 - DNA, 25 bp, Mus musculus
acacagacaggcgtttgcgtgggtt

SEQ ID NO: 94923 - DNA, 25 bp, Mus musculus
acacagacatacaatatgcatgcaa

SEQ ID NO: 94924 - DNA, 25 bp, Mus musculus
acacagacatactatatgcatgcaa

SEQ ID NO: 94925 - DNA, 25 bp, Mus musculus
acacagacatctatcatgtactggg

SEQ ID NO: 94926 - DNA, 25 bp, Mus musculus
acacagacatctttcatgtactggg

SEQ ID NO: 94927 - DNA, 25 bp, Mus musculus
acacagacatttcctatcagcatag

SEQ ID NO: 94928 - DNA, 25 bp, Mus musculus
acacagacatttgctatcagcatag

SEQ ID NO: 94929 - DNA, 25 bp, Mus musculus
acacagaccacaaattccttctggg

SEQ ID NO: 94930 - DNA, 25 bp, Mus musculus
acacagaccacatattccttctggg

SEQ ID NO: 94931 - DNA, 25 bp, Mus musculus
acacagaccatcagcggctggagct

SEQ ID NO: 94932 - DNA, 25 bp, Mus musculus
acacagaccatctgcggctggagct

SEQ ID NO: 94933 - DNA, 25 bp, Mus musculus
acacagacctgtaaattccaattta

SEQ ID NO: 94934 - DNA, 25 bp, Mus musculus
acacagacctgttaattccaattta

SEQ ID NO: 94935 - DNA, 25 bp, Mus musculus
acacagaccttaccgattttccata

SEQ ID NO: 94936 - DNA, 25 bp, Mus musculus
acacagaccttagcgattttccata

SEQ ID NO: 94937 - DNA, 25 bp, Mus musculus
acacagaccttgcactttcctgatt

SEQ ID NO: 94938 - DNA, 25 bp, Mus musculus
acacagaccttggactttcctgatt

SEQ ID NO: 94939 - DNA, 25 bp, Mus musculus
acacagacgaagctagccagtcaca

SEQ ID NO: 94940 - DNA, 25 bp, Mus musculus
acacagacgaaggtagccagtcaca

SEQ ID NO: 94941 - DNA, 25 bp, Mus musculus
acacagactacacgacaccaggagg

SEQ ID NO: 94942 - DNA, 25 bp, Mus musculus
acacagactacaggacaccaggagg

SEQ ID NO: 94943 - DNA, 25 bp, Mus musculus
acacagactgctacagccgtaggga

SEQ ID NO: 94944 - DNA, 25 bp, Mus musculus
acacagactgcttcagccgtaggga

SEQ ID NO: 94945 - DNA, 25 bp, Mus musculus
acacagactggcaagtggtgacggt

SEQ ID NO: 94946 - DNA, 25 bp, Mus musculus
acacagactggctagtggtgacggt

SEQ ID NO: 94947 - DNA, 25 bp, Mus musculus
acacagactgtgcaaactccatacc

SEQ ID NO: 94948 - DNA, 25 bp, Mus musculus
acacagactgtggaaactccatacc

SEQ ID NO: 94949 - DNA, 25 bp, Mus musculus
acacagagaactccttccactcagg

SEQ ID NO: 94950 - DNA, 25 bp, Mus musculus
acacagagaactgcttccactcagg

SEQ ID NO: 94951 - DNA, 25 bp, Mus musculus
acacagagagcactcccgggaaggt

SEQ ID NO: 94952 - DNA, 25 bp, Mus musculus
acacagagagcagtcccgggaaggt

SEQ ID NO: 94953 - DNA, 25 bp, Mus musculus
acacagagagcgctgctagagtctt

SEQ ID NO: 94954 - DNA, 25 bp, Mus musculus
acacagagagcggtgctagagtctt

SEQ ID NO: 94955 - DNA, 25 bp, Mus musculus
acacagagcaacaagactagtataa

SEQ ID NO: 94956 - DNA, 25 bp, Mus musculus
acacagagcaactagactagtataa

SEQ ID NO: 94957 - DNA, 25 bp, Mus musculus
acacagagcataagtggctgcccca

SEQ ID NO: 94958 - DNA, 25 bp, Mus musculus
acacagagcatatgtggctgcccca

SEQ ID NO: 94959 - DNA, 25 bp, Mus musculus
acacagagcttgaatactgcaagac

SEQ ID NO: 94960 - DNA, 25 bp, Mus musculus
acacagagcttgaggctgagttgga

SEQ ID NO: 94961 - DNA, 25 bp, Mus musculus
acacagagcttgtatactgcaagac

SEQ ID NO: 94962 - DNA, 25 bp, Mus musculus
acacagagcttgtggctgagttgga

SEQ ID NO: 94963 - DNA, 25 bp, Mus musculus
acacagaggatgaagcgagctcaag

SEQ ID NO: 94964 - DNA, 25 bp, Mus musculus
acacagaggatgtagcgagctcaag

SEQ ID NO: 94965 - DNA, 25 bp, Mus musculus
acacagaggtgaaaccactgtccct

SEQ ID NO: 94966 - DNA, 25 bp, Mus musculus
acacagaggtgataccactgtccct

SEQ ID NO: 94967 - DNA, 25 bp, Mus musculus
acacagagtaacaggaaaacacaaa

SEQ ID NO: 94968 - DNA, 25 bp, Mus musculus
acacagagtaactggaaaacacaaa

SEQ ID NO: 94969 - DNA, 25 bp, Mus musculus
acacagagtgatccccttagatctt

SEQ ID NO: 94970 - DNA, 25 bp, Mus musculus
acacagagtgatgcccttagatctt

SEQ ID NO: 94971 - DNA, 25 bp, Mus musculus
acacagatagggacgggtggccttc

SEQ ID NO: 94972 - DNA, 25 bp, Mus musculus
acacagatagggtcgggtggccttc

SEQ ID NO: 94973 - DNA, 25 bp, Mus musculus
acacagatatgaatacgcacacaaa

SEQ ID NO: 94974 - DNA, 25 bp, Mus musculus
acacagatatgattacgcacacaaa

SEQ ID NO: 94975 - DNA, 25 bp, Mus musculus
acacagatcatcagggctccaggga

SEQ ID NO: 94976 - DNA, 25 bp, Mus musculus
acacagatcatctgggctccaggga

SEQ ID NO: 94977 - DNA, 25 bp, Mus musculus
acacagatcatgacccaggtgggca

SEQ ID NO: 94978 - DNA, 25 bp, Mus musculus
acacagatcatgtcccaggtgggca

SEQ ID NO: 94979 - DNA, 25 bp, Mus musculus
acacagatccagctagtctctgcca

SEQ ID NO: 94980 - DNA, 25 bp, Mus musculus
acacagatccaggtagtctctgcca

SEQ ID NO: 94981 - DNA, 25 bp, Mus musculus
acacagatccgcctcgtgaaggcgt

SEQ ID NO: 94982 - DNA, 25 bp, Mus musculus
acacagatccgcgtcgtgaaggcgt

SEQ ID NO: 94983 - DNA, 25 bp, Mus musculus
acacagatctgcctcatggctggat

SEQ ID NO: 94984 - DNA, 25 bp, Mus musculus
acacagatctgcgtcatggctggat

SEQ ID NO: 94985 - DNA, 25 bp, Mus musculus
acacagatgcccatattgtgatgcc

SEQ ID NO: 94986 - DNA, 25 bp, Mus musculus
acacagatgcccttattgtgatgcc

SEQ ID NO: 94987 - DNA, 25 bp, Mus musculus
acacagatgtgcaggctcaggcggt

SEQ ID NO: 94988 - DNA, 25 bp, Mus musculus
acacagatgtgcagtgagcgggcca

SEQ ID NO: 94989 - DNA, 25 bp, Mus musculus
acacagatgtgctggctcaggcggt

SEQ ID NO: 94990 - DNA, 25 bp, Mus musculus
acacagatgtgctgtgagcgggcca

SEQ ID NO: 94991 - DNA, 25 bp, Mus musculus
acacagatgtggaacttagtagagc

SEQ ID NO: 94992 - DNA, 25 bp, Mus musculus
acacagatgtggtacttagtagagc

SEQ ID NO: 94993 - DNA, 25 bp, Mus musculus
acacagatttcaatgcagcagccgc

SEQ ID NO: 94994 - DNA, 25 bp, Mus musculus
acacagatttcattgcagcagccgc

SEQ ID NO: 94995 - DNA, 25 bp, Mus musculus
acacagcaatgtcgcctaccttaaa

SEQ ID NO: 94996 - DNA, 25 bp, Mus musculus
acacagcaatgtggcctaccttaaa

SEQ ID NO: 94997 - DNA, 25 bp, Mus musculus
acacagcaccagaggttccagacaa

SEQ ID NO: 94998 - DNA, 25 bp, Mus musculus
acacagcaccagtggttccagacaa

SEQ ID NO: 94999 - DNA, 25 bp, Mus musculus
acacagcaccctaggatatggacag

SEQ ID NO: 95000 - DNA, 25 bp, Mus musculus
acacagcacccttggatatggacag

SEQ ID NO: 95001 - DNA, 25 bp, Mus musculus
acacagcacgggacccagttggaga

SEQ ID NO: 95002 - DNA, 25 bp, Mus musculus
acacagcacgggtcccagttggaga

SEQ ID NO: 95003 - DNA, 25 bp, Mus musculus
acacagcagaacattattcatccat

SEQ ID NO: 95004 - DNA, 25 bp, Mus musculus
acacagcagaactttattcatccat

SEQ ID NO: 95005 - DNA, 25 bp, Mus musculus
acacagcagaagaggtcactagatc

SEQ ID NO: 95006 - DNA, 25 bp, Mus musculus
acacagcagaagtggtcactagatc

SEQ ID NO: 95007 - DNA, 25 bp, Mus musculus
acacagcagatgaggatgccgtgca

SEQ ID NO: 95008 - DNA, 25 bp, Mus musculus
acacagcagatgtggatgccgtgca

SEQ ID NO: 95009 - DNA, 25 bp, Mus musculus
acacagcagcacactcaggaatgac

SEQ ID NO: 95010 - DNA, 25 bp, Mus musculus
acacagcagcactctcaggaatgac

SEQ ID NO: 95011 - DNA, 25 bp, Mus musculus
acacagcagcttcatgtctaactct

SEQ ID NO: 95012 - DNA, 25 bp, Mus musculus
acacagcagcttgatgtctaactct

SEQ ID NO: 95013 - DNA, 25 bp, Mus musculus
acacagcaggacatacaagattact

SEQ ID NO: 95014 - DNA, 25 bp, Mus musculus
acacagcaggacttacaagattact

SEQ ID NO: 95015 - DNA, 25 bp, Mus musculus
acacagcaggcaactatatcatcaa

SEQ ID NO: 95016 - DNA, 25 bp, Mus musculus
acacagcaggcacggcgcattggca

SEQ ID NO: 95017 - DNA, 25 bp, Mus musculus
acacagcaggcagggcgcattggca

SEQ ID NO: 95018 - DNA, 25 bp, Mus musculus
acacagcaggcatctatatcatcaa

SEQ ID NO: 95019 - DNA, 25 bp, Mus musculus
acacagcaggctcctactctatctt

SEQ ID NO: 95020 - DNA, 25 bp, Mus musculus
acacagcaggctgctactctatctt

SEQ ID NO: 95021 - DNA, 25 bp, Mus musculus
acacagcagtcccagaggtttttga

SEQ ID NO: 95022 - DNA, 25 bp, Mus musculus
acacagcagtccgagaggtttttga

SEQ ID NO: 95023 - DNA, 25 bp, Mus musculus
acacagcatccaaccccttgaatgt

SEQ ID NO: 95024 - DNA, 25 bp, Mus musculus
acacagcatccatccccttgaatgt

SEQ ID NO: 95025 - DNA, 25 bp, Mus musculus
acacagcatggacggagcctggcaa

SEQ ID NO: 95026 - DNA, 25 bp, Mus musculus
acacagcatggagggagcctggcaa

SEQ ID NO: 95027 - DNA, 25 bp, Mus musculus
acacagccacctcacagctagaagg

SEQ ID NO: 95028 - DNA, 25 bp, Mus musculus
acacagccacctgacagctagaagg

SEQ ID NO: 95029 - DNA, 25 bp, Mus musculus
acacagccaggtctctagcagaggt

SEQ ID NO: 95030 - DNA, 25 bp, Mus musculus
acacagccaggtgtctagcagaggt

SEQ ID NO: 95031 - DNA, 25 bp, Mus musculus
acacagccagtgaacactccttgaa

SEQ ID NO: 95032 - DNA, 25 bp, Mus musculus
acacagccagtgtacactccttgaa

SEQ ID NO: 95033 - DNA, 25 bp, Mus musculus
acacagccagttaacattttaccta

SEQ ID NO: 95034 - DNA, 25 bp, Mus musculus
acacagccagtttacattttaccta

SEQ ID NO: 95035 - DNA, 25 bp, Mus musculus
acacagccataccaagtgagtatca

SEQ ID NO: 95036 - DNA, 25 bp, Mus musculus
acacagccatacgaagtgagtatca

SEQ ID NO: 95037 - DNA, 25 bp, Mus musculus
acacagccattaaggtcgtgctatg

SEQ ID NO: 95038 - DNA, 25 bp, Mus musculus
acacagccattatggtcgtgctatg

SEQ ID NO: 95039 - DNA, 25 bp, Mus musculus
acacagccccttcgttttctgaggc

SEQ ID NO: 95040 - DNA, 25 bp, Mus musculus
acacagccccttggttttctgaggc

SEQ ID NO: 95041 - DNA, 25 bp, Mus musculus
acacagccctaaagtacccagtaat

SEQ ID NO: 95042 - DNA, 25 bp, Mus musculus
acacagccctaatgtacccagtaat

SEQ ID NO: 95043 - DNA, 25 bp, Mus musculus
acacagccctgcagactcattagat

SEQ ID NO: 95044 - DNA, 25 bp, Mus musculus
acacagccctgctgactcattagat

SEQ ID NO: 95045 - DNA, 25 bp, Mus musculus
acacagccgacgcagcagaggtatg

SEQ ID NO: 95046 - DNA, 25 bp, Mus musculus
acacagccgacggagcagaggtatg

SEQ ID NO: 95047 - DNA, 25 bp, Mus musculus
acacagccgtgtcactggagacaag

SEQ ID NO: 95048 - DNA, 25 bp, Mus musculus
acacagccgtgtgactggagacaag

SEQ ID NO: 95049 - DNA, 25 bp, Mus musculus
acacagcctcggattaagagcactt

SEQ ID NO: 95050 - DNA, 25 bp, Mus musculus
acacagcctcggtttaagagcactt

SEQ ID NO: 95051 - DNA, 25 bp, Mus musculus
acacagcctggtctcttaggtacca

SEQ ID NO: 95052 - DNA, 25 bp, Mus musculus
acacagcctggtgtcttaggtacca

SEQ ID NO: 95053 - DNA, 25 bp, Mus musculus
acacagccttggacacatgagacta

SEQ ID NO: 95054 - DNA, 25 bp, Mus musculus
acacagccttggtcacatgagacta

SEQ ID NO: 95055 - DNA, 25 bp, Mus musculus
acacagcgaaagcaatctctcttgc

SEQ ID NO: 95056 - DNA, 25 bp, Mus musculus
acacagcgaaaggaatctctcttgc

SEQ ID NO: 95057 - DNA, 25 bp, Mus musculus
acacagcgacgtagctggactggct

SEQ ID NO: 95058 - DNA, 25 bp, Mus musculus
acacagcgacgttgctggactggct

SEQ ID NO: 95059 - DNA, 25 bp, Mus musculus
acacagcgcctccattacatggaaa

SEQ ID NO: 95060 - DNA, 25 bp, Mus musculus
acacagcgcctcgattacatggaaa

SEQ ID NO: 95061 - DNA, 25 bp, Mus musculus
acacagcgggtccttgggcacacag

SEQ ID NO: 95062 - DNA, 25 bp, Mus musculus
acacagcgggtcgttgggcacacag

SEQ ID NO: 95063 - DNA, 25 bp, Mus musculus
acacagcggtgcattctactgcgaa

SEQ ID NO: 95064 - DNA, 25 bp, Mus musculus
acacagcggtgctttctactgcgaa

SEQ ID NO: 95065 - DNA, 25 bp, Mus musculus
acacagcgtctcagatgggcaggca

SEQ ID NO: 95066 - DNA, 25 bp, Mus musculus
acacagcgtctctgatgggcaggca

SEQ ID NO: 95067 - DNA, 25 bp, Mus musculus
acacagcgtggtccgctgcgaagct

SEQ ID NO: 95068 - DNA, 25 bp, Mus musculus
acacagcgtggtgcgctgcgaagct

SEQ ID NO: 95069 - DNA, 25 bp, Mus musculus
acacagctaccacgagccaatcttg

SEQ ID NO: 95070 - DNA, 25 bp, Mus musculus
acacagctaccaggagccaatcttg

SEQ ID NO: 95071 - DNA, 25 bp, Mus musculus
acacagctatctacatcaacatcag

SEQ ID NO: 95072 - DNA, 25 bp, Mus musculus
acacagctatcttcatcaacatcag

SEQ ID NO: 95073 - DNA, 25 bp, Mus musculus
acacagctcactcgacagaagcaga

SEQ ID NO: 95074 - DNA, 25 bp, Mus musculus
acacagctcactggacagaagcaga

SEQ ID NO: 95075 - DNA, 25 bp, Mus musculus
acacagctcagcaacacatggaaca

SEQ ID NO: 95076 - DNA, 25 bp, Mus musculus
acacagctcagctacacatggaaca

SEQ ID NO: 95077 - DNA, 25 bp, Mus musculus
acacagctcaggctctcttctggag

SEQ ID NO: 95078 - DNA, 25 bp, Mus musculus
acacagctcagggtctcttctggag

SEQ ID NO: 95079 - DNA, 25 bp, Mus musculus
acacagctcgtgagcgtgcgggatc

SEQ ID NO: 95080 - DNA, 25 bp, Mus musculus
acacagctcgtgtgcgtgcgggatc

SEQ ID NO: 95081 - DNA, 25 bp, Mus musculus
acacagctgagcaggtcaagttcca

SEQ ID NO: 95082 - DNA, 25 bp, Mus musculus
acacagctgagctggtcaagttcca

SEQ ID NO: 95083 - DNA, 25 bp, Mus musculus
acacagctgcggcaactttttggcc

SEQ ID NO: 95084 - DNA, 25 bp, Mus musculus
acacagctgcgggaactttttggcc

SEQ ID NO: 95085 - DNA, 25 bp, Mus musculus
acacagctgctgcattgcagctgcc

SEQ ID NO: 95086 - DNA, 25 bp, Mus musculus
acacagctgctggattgcagctgcc

SEQ ID NO: 95087 - DNA, 25 bp, Mus musculus
acacagctgggaagtttgtattcat

SEQ ID NO: 95088 - DNA, 25 bp, Mus musculus
acacagctgggatgtttgtattcat

SEQ ID NO: 95089 - DNA, 25 bp, Mus musculus
acacagctggtaaagaggattattc

SEQ ID NO: 95090 - DNA, 25 bp, Mus musculus
acacagctggtatagaggattattc

SEQ ID NO: 95091 - DNA, 25 bp, Mus musculus
acacagctggttagatttgaggtga

SEQ ID NO: 95092 - DNA, 25 bp, Mus musculus
acacagctggtttgatttgaggtga

SEQ ID NO: 95093 - DNA, 25 bp, Mus musculus
acacagctgtgaccgggcttctgag

SEQ ID NO: 95094 - DNA, 25 bp, Mus musculus
acacagctgtgagcgggcttctgag

SEQ ID NO: 95095 - DNA, 25 bp, Mus musculus
acacagcttcatcacgttcctaaat

SEQ ID NO: 95096 - DNA, 25 bp, Mus musculus
acacagcttcatgacgttcctaaat

SEQ ID NO: 95097 - DNA, 25 bp, Mus musculus
acacagcttcggcaacagactgagg

SEQ ID NO: 95098 - DNA, 25 bp, Mus musculus
acacagcttcgggaacagactgagg

SEQ ID NO: 95099 - DNA, 25 bp, Mus musculus
acacagcttgggaagtttatctacc

SEQ ID NO: 95100 - DNA, 25 bp, Mus musculus
acacagcttgggtagtttatctacc

SEQ ID NO: 95101 - DNA, 25 bp, Mus musculus
acacagcttttgacacattgaaatg

SEQ ID NO: 95102 - DNA, 25 bp, Mus musculus
acacagcttttgtcacattgaaatg

SEQ ID NO: 95103 - DNA, 25 bp, Mus musculus
acacagctttttcaaattaccagta

SEQ ID NO: 95104 - DNA, 25 bp, Mus musculus
acacagctttttgaaattaccagta

SEQ ID NO: 95105 - DNA, 25 bp, Mus musculus
acacaggaacggagtcttcggctat

SEQ ID NO: 95106 - DNA, 25 bp, Mus musculus
acacaggaacggtgtcttcggctat

SEQ ID NO: 95107 - DNA, 25 bp, Mus musculus
acacaggacctcagcgcaaaggctg

SEQ ID NO: 95108 - DNA, 25 bp, Mus musculus
acacaggacctctgcgcaaaggctg

SEQ ID NO: 95109 - DNA, 25 bp, Mus musculus
acacaggaggtgagtctcgcatctg

SEQ ID NO: 95110 - DNA, 25 bp, Mus musculus
acacaggaggtgtgtctcgcatctg

SEQ ID NO: 95111 - DNA, 25 bp, Mus musculus
acacaggatcctctccatggatttt

SEQ ID NO: 95112 - DNA, 25 bp, Mus musculus
acacaggatcctgtccatggatttt

SEQ ID NO: 95113 - DNA, 25 bp, Mus musculus
acacaggatctgctcactttctgcc

SEQ ID NO: 95114 - DNA, 25 bp, Mus musculus
acacaggatctggtcactttctgcc

SEQ ID NO: 95115 - DNA, 25 bp, Mus musculus
acacaggattccatttgccaggtaa

SEQ ID NO: 95116 - DNA, 25 bp, Mus musculus
acacaggattccttttgccaggtaa

SEQ ID NO: 95117 - DNA, 25 bp, Mus musculus
acacaggcaaacacctgcaacctga

SEQ ID NO: 95118 - DNA, 25 bp, Mus musculus
acacaggcaaactcctgcaacctga

SEQ ID NO: 95119 - DNA, 25 bp, Mus musculus
acacaggcaaagaaagggccctggg

SEQ ID NO: 95120 - DNA, 25 bp, Mus musculus
acacaggcaaagtaagggccctggg

SEQ ID NO: 95121 - DNA, 25 bp, Mus musculus
acacaggcacgaagcctctcgttag

SEQ ID NO: 95122 - DNA, 25 bp, Mus musculus
acacaggcacgatgcctctcgttag

SEQ ID NO: 95123 - DNA, 25 bp, Mus musculus
acacaggcagacctgcatgagtgca

SEQ ID NO: 95124 - DNA, 25 bp, Mus musculus
acacaggcagacgtgcatgagtgca

SEQ ID NO: 95125 - DNA, 25 bp, Mus musculus
acacaggcagctacagctacagcta

SEQ ID NO: 95126 - DNA, 25 bp, Mus musculus
acacaggcagcttcagctacagcta

SEQ ID NO: 95127 - DNA, 25 bp, Mus musculus
acacaggcaggaagcctcgcttgga

SEQ ID NO: 95128 - DNA, 25 bp, Mus musculus
acacaggcaggatgcctcgcttgga

SEQ ID NO: 95129 - DNA, 25 bp, Mus musculus
acacaggcaggtcaccttctggaaa

SEQ ID NO: 95130 - DNA, 25 bp, Mus musculus
acacaggcaggtgaccttctggaaa

SEQ ID NO: 95131 - DNA, 25 bp, Mus musculus
acacaggccagtcatttctactgaa

SEQ ID NO: 95132 - DNA, 25 bp, Mus musculus
acacaggccagtgatttctactgaa

SEQ ID NO: 95133 - DNA, 25 bp, Mus musculus
acacaggccggccttgagtgatttc

SEQ ID NO: 95134 - DNA, 25 bp, Mus musculus
acacaggccggcgttgagtgatttc

SEQ ID NO: 95135 - DNA, 25 bp, Mus musculus
acacaggcctgcatgtggactggaa

SEQ ID NO: 95136 - DNA, 25 bp, Mus musculus
acacaggcctgcttgtggactggaa

SEQ ID NO: 95137 - DNA, 25 bp, Mus musculus
acacaggcctgtcacgaggactaag

SEQ ID NO: 95138 - DNA, 25 bp, Mus musculus
acacaggcctgtgacgaggactaag

SEQ ID NO: 95139 - DNA, 25 bp, Mus musculus
acacaggccttgaagtctcagcaga

SEQ ID NO: 95140 - DNA, 25 bp, Mus musculus
acacaggccttgtagtctcagcaga

SEQ ID NO: 95141 - DNA, 25 bp, Mus musculus
acacaggctctcatgctgaaaggaa

SEQ ID NO: 95142 - DNA, 25 bp, Mus musculus
acacaggctctcttgctgaaaggaa

SEQ ID NO: 95143 - DNA, 25 bp, Mus musculus
acacaggctctgatggataacaagt

SEQ ID NO: 95144 - DNA, 25 bp, Mus musculus
acacaggctctgttggataacaagt

SEQ ID NO: 95145 - DNA, 25 bp, Mus musculus
acacaggctgccagacagggtagaa

SEQ ID NO: 95146 - DNA, 25 bp, Mus musculus
acacaggctgcctgacagggtagaa

SEQ ID NO: 95147 - DNA, 25 bp, Mus musculus
acacaggctgtcaacaccatctaag

SEQ ID NO: 95148 - DNA, 25 bp, Mus musculus
acacaggctgtctacaccatctaag

SEQ ID NO: 95149 - DNA, 25 bp, Mus musculus
acacaggctttacctagctactctt

SEQ ID NO: 95150 - DNA, 25 bp, Mus musculus
acacaggctttagctagctactctt

SEQ ID NO: 95151 - DNA, 25 bp, Mus musculus
acacagggaaggatgatctgaccac

SEQ ID NO: 95152 - DNA, 25 bp, Mus musculus
acacagggaaggttgatctgaccac

SEQ ID NO: 95153 - DNA, 25 bp, Mus musculus
acacagggactgagggaagcatgaa

SEQ ID NO: 95154 - DNA, 25 bp, Mus musculus
acacagggactgtgggaagcatgaa

SEQ ID NO: 95155 - DNA, 25 bp, Mus musculus
acacagggagtaaggctttagcctg

SEQ ID NO: 95156 - DNA, 25 bp, Mus musculus
acacagggagtatggctttagcctg

SEQ ID NO: 95157 - DNA, 25 bp, Mus musculus
acacagggatgcactgtactgctgc

SEQ ID NO: 95158 - DNA, 25 bp, Mus musculus
acacagggatgctctgtactgctgc

SEQ ID NO: 95159 - DNA, 25 bp, Mus musculus
acacagggattaccccaggctgtat

SEQ ID NO: 95160 - DNA, 25 bp, Mus musculus
acacagggattagcccaggctgtat

SEQ ID NO: 95161 - DNA, 25 bp, Mus musculus
acacagggctctagtggacccctgg

SEQ ID NO: 95162 - DNA, 25 bp, Mus musculus
acacagggctcttgtggacccctgg

SEQ ID NO: 95163 - DNA, 25 bp, Mus musculus
acacagggctttcatggtagctgct

SEQ ID NO: 95164 - DNA, 25 bp, Mus musculus
acacagggctttgatggtagctgct

SEQ ID NO: 95165 - DNA, 25 bp, Mus musculus
acacagggtcatccagtttggaact

SEQ ID NO: 95166 - DNA, 25 bp, Mus musculus
acacagggtcatgcagtttggaact

SEQ ID NO: 95167 - DNA, 25 bp, Mus musculus
acacagggtctcaatgcatagctct

SEQ ID NO: 95168 - DNA, 25 bp, Mus musculus
acacagggtctctatgcatagctct

SEQ ID NO: 95169 - DNA, 25 bp, Mus musculus
acacaggtaagtatcattctttgca

SEQ ID NO: 95170 - DNA, 25 bp, Mus musculus
acacaggtaagtttcattctttgca

SEQ ID NO: 95171 - DNA, 25 bp, Mus musculus
acacaggtacacaacaaatcacatt

SEQ ID NO: 95172 - DNA, 25 bp, Mus musculus
acacaggtacactacaaatcacatt

SEQ ID NO: 95173 - DNA, 25 bp, Mus musculus
acacaggtccacacacttaaataca

SEQ ID NO: 95174 - DNA, 25 bp, Mus musculus
acacaggtccactcacttaaataca

SEQ ID NO: 95175 - DNA, 25 bp, Mus musculus
acacaggtccttatgctgcggagca

SEQ ID NO: 95176 - DNA, 25 bp, Mus musculus
acacaggtccttctgcctgggcact

SEQ ID NO: 95177 - DNA, 25 bp, Mus musculus
acacaggtccttgtgcctgggcact

SEQ ID NO: 95178 - DNA, 25 bp, Mus musculus
acacaggtccttttgctgcggagca

SEQ ID NO: 95179 - DNA, 25 bp, Mus musculus
acacaggtctctactgccgtggcag

SEQ ID NO: 95180 - DNA, 25 bp, Mus musculus
acacaggtctcttctgccgtggcag

SEQ ID NO: 95181 - DNA, 25 bp, Mus musculus
acacaggtctttcgtggacatcatt

SEQ ID NO: 95182 - DNA, 25 bp, Mus musculus
acacaggtctttggtggacatcatt

SEQ ID NO: 95183 - DNA, 25 bp, Mus musculus
acacaggtgaatctttgatcccggg

SEQ ID NO: 95184 - DNA, 25 bp, Mus musculus
acacaggtgaatgtttgatcccggg

SEQ ID NO: 95185 - DNA, 25 bp, Mus musculus
acacaggtgagacccactttctaga

SEQ ID NO: 95186 - DNA, 25 bp, Mus musculus
acacaggtgagagccactttctaga

SEQ ID NO: 95187 - DNA, 25 bp, Mus musculus
acacaggtggacattcagataggaa

SEQ ID NO: 95188 - DNA, 25 bp, Mus musculus
acacaggtggactttcagataggaa

SEQ ID NO: 95189 - DNA, 25 bp, Mus musculus
acacaggtggtgactgcagtcgctg

SEQ ID NO: 95190 - DNA, 25 bp, Mus musculus
acacaggtggtgacttcgtgcactg

SEQ ID NO: 95191 - DNA, 25 bp, Mus musculus
acacaggtggtgtctgcagtcgctg

SEQ ID NO: 95192 - DNA, 25 bp, Mus musculus
acacaggtggtgtcttcgtgcactg

SEQ ID NO: 95193 - DNA, 25 bp, Mus musculus
acacaggtgtggctatgtcagtatg

SEQ ID NO: 95194 - DNA, 25 bp, Mus musculus
acacaggtgtgggtatgtcagtatg

SEQ ID NO: 95195 - DNA, 25 bp, Mus musculus
acacaggtgttcacaaaagacccat

SEQ ID NO: 95196 - DNA, 25 bp, Mus musculus
acacaggtgttctcaaaagacccat

SEQ ID NO: 95197 - DNA, 25 bp, Mus musculus
acacaggttctcagagttggccaaa

SEQ ID NO: 95198 - DNA, 25 bp, Mus musculus
acacaggttctctgagttggccaaa

SEQ ID NO: 95199 - DNA, 25 bp, Mus musculus
acacaggttctgaggactggctcac

SEQ ID NO: 95200 - DNA, 25 bp, Mus musculus
acacaggttctgtggactggctcac

SEQ ID NO: 95201 - DNA, 25 bp, Mus musculus
acacaggttcttatggtcatcaaat

SEQ ID NO: 95202 - DNA, 25 bp, Mus musculus
acacaggttcttttggtcatcaaat

SEQ ID NO: 95203 - DNA, 25 bp, Mus musculus
acacaggttgggacctgggttcgat

SEQ ID NO: 95204 - DNA, 25 bp, Mus musculus
acacaggttgggtcctgggttcgat

SEQ ID NO: 95205 - DNA, 25 bp, Mus musculus
acacaggttgtcagacttatgcagt

SEQ ID NO: 95206 - DNA, 25 bp, Mus musculus
acacaggttgtctgacttatgcagt

SEQ ID NO: 95207 - DNA, 25 bp, Mus musculus
acacagtaaaggctccaggaggctc

SEQ ID NO: 95208 - DNA, 25 bp, Mus musculus
acacagtaaagggtccaggaggctc

SEQ ID NO: 95209 - DNA, 25 bp, Mus musculus
acacagtagcccagagccaagttgg

SEQ ID NO: 95210 - DNA, 25 bp, Mus musculus
acacagtagccctgagccaagttgg

SEQ ID NO: 95211 - DNA, 25 bp, Mus musculus
acacagtagcctaccgtacgtgtga

SEQ ID NO: 95212 - DNA, 25 bp, Mus musculus
acacagtagccttccgtacgtgtga

SEQ ID NO: 95213 - DNA, 25 bp, Mus musculus
acacagtaggcccacatagacaaaa

SEQ ID NO: 95214 - DNA, 25 bp, Mus musculus
acacagtaggccgacatagacaaaa

SEQ ID NO: 95215 - DNA, 25 bp, Mus musculus
acacagtagtgtagccagggcggca

SEQ ID NO: 95216 - DNA, 25 bp, Mus musculus
acacagtagtgttgccagggcggca

SEQ ID NO: 95217 - DNA, 25 bp, Mus musculus
acacagtataccagctcagatgctg

SEQ ID NO: 95218 - DNA, 25 bp, Mus musculus
acacagtatacctgctcagatgctg

SEQ ID NO: 95219 - DNA, 25 bp, Mus musculus
acacagtattacctcgtcagagccc

SEQ ID NO: 95220 - DNA, 25 bp, Mus musculus
acacagtattacgtcgtcagagccc

SEQ ID NO: 95221 - DNA, 25 bp, Mus musculus
acacagtattcccacagtcttatga

SEQ ID NO: 95222 - DNA, 25 bp, Mus musculus
acacagtattccctcaagatcaaca

SEQ ID NO: 95223 - DNA, 25 bp, Mus musculus
acacagtattccgacagtcttatga

SEQ ID NO: 95224 - DNA, 25 bp, Mus musculus
acacagtattccgtcaagatcaaca

SEQ ID NO: 95225 - DNA, 25 bp, Mus musculus
acacagtcagtgatttcccagggat

SEQ ID NO: 95226 - DNA, 25 bp, Mus musculus
acacagtcagtgttttcccagggat

SEQ ID NO: 95227 - DNA, 25 bp, Mus musculus
acacagtccccgagatgtggctaaa

SEQ ID NO: 95228 - DNA, 25 bp, Mus musculus
acacagtccccgtgatgtggctaaa

SEQ ID NO: 95229 - DNA, 25 bp, Mus musculus
acacagtcctggacagctttgaacg

SEQ ID NO: 95230 - DNA, 25 bp, Mus musculus
acacagtcctggtcagctttgaacg

SEQ ID NO: 95231 - DNA, 25 bp, Mus musculus
acacagtctcttaaaatccctaaca

SEQ ID NO: 95232 - DNA, 25 bp, Mus musculus
acacagtctctttaaatccctaaca

SEQ ID NO: 95233 - DNA, 25 bp, Mus musculus
acacagtctgcacgtttgggcgcat

SEQ ID NO: 95234 - DNA, 25 bp, Mus musculus
acacagtctgcaggtttgggcgcat

SEQ ID NO: 95235 - DNA, 25 bp, Mus musculus
acacagtctgtgattcagctcagtg

SEQ ID NO: 95236 - DNA, 25 bp, Mus musculus
acacagtctgtgtttcagctcagtg

SEQ ID NO: 95237 - DNA, 25 bp, Mus musculus
acacagtgaagaatgtgcccagcca

SEQ ID NO: 95238 - DNA, 25 bp, Mus musculus
acacagtgaagattgtgcccagcca

SEQ ID NO: 95239 - DNA, 25 bp, Mus musculus
acacagtgaaggactttgatctcag

SEQ ID NO: 95240 - DNA, 25 bp, Mus musculus
acacagtgaaggtctttgatctcag

SEQ ID NO: 95241 - DNA, 25 bp, Mus musculus
acacagtgacacatttcacagcaca

SEQ ID NO: 95242 - DNA, 25 bp, Mus musculus
acacagtgacacttttcacagcaca

SEQ ID NO: 95243 - DNA, 25 bp, Mus musculus
acacagtgagctcggactcgaaaca

SEQ ID NO: 95244 - DNA, 25 bp, Mus musculus
acacagtgagctgggactcgaaaca

SEQ ID NO: 95245 - DNA, 25 bp, Mus musculus
acacagtgaggacgacgggtccatc

SEQ ID NO: 95246 - DNA, 25 bp, Mus musculus
acacagtgaggaggacgggtccatc

SEQ ID NO: 95247 - DNA, 25 bp, Mus musculus
acacagtgatacctcgcttctctgt

SEQ ID NO: 95248 - DNA, 25 bp, Mus musculus
acacagtgatacgtcgcttctctgt

SEQ ID NO: 95249 - DNA, 25 bp, Mus musculus
acacagtgatctccaactcttcact

SEQ ID NO: 95250 - DNA, 25 bp, Mus musculus
acacagtgatctgcaactcttcact

SEQ ID NO: 95251 - DNA, 25 bp, Mus musculus
acacagtgcgcccagtgagaaccga

SEQ ID NO: 95252 - DNA, 25 bp, Mus musculus
acacagtgcgccgagtgagaaccga

SEQ ID NO: 95253 - DNA, 25 bp, Mus musculus
acacagtggccccacccgtgaccac

SEQ ID NO: 95254 - DNA, 25 bp, Mus musculus
acacagtggcccgacccgtgaccac

SEQ ID NO: 95255 - DNA, 25 bp, Mus musculus
acacagtggctaacatcttctgctc

SEQ ID NO: 95256 - DNA, 25 bp, Mus musculus
acacagtggctactttagttgcgaa

SEQ ID NO: 95257 - DNA, 25 bp, Mus musculus
acacagtggctagtttagttgcgaa

SEQ ID NO: 95258 - DNA, 25 bp, Mus musculus
acacagtggctatcatcttctgctc

SEQ ID NO: 95259 - DNA, 25 bp, Mus musculus
acacagtggctgatctgcgcctggg

SEQ ID NO: 95260 - DNA, 25 bp, Mus musculus
acacagtggctgttctgcgcctggg

SEQ ID NO: 95261 - DNA, 25 bp, Mus musculus
acacagtgggcactatacaaagtct

SEQ ID NO: 95262 - DNA, 25 bp, Mus musculus
acacagtgggcagtatacaaagtct

SEQ ID NO: 95263 - DNA, 25 bp, Mus musculus
acacagtggtgacgtccctgcaaga

SEQ ID NO: 95264 - DNA, 25 bp, Mus musculus
acacagtggtgaggtccctgcaaga

SEQ ID NO: 95265 - DNA, 25 bp, Mus musculus
acacagtgtagaatcctttgcagct

SEQ ID NO: 95266 - DNA, 25 bp, Mus musculus
acacagtgtagattcctttgcagct

SEQ ID NO: 95267 - DNA, 25 bp, Mus musculus
acacagtgtcgcaggaaggaagtgt

SEQ ID NO: 95268 - DNA, 25 bp, Mus musculus
acacagtgtcgctggaaggaagtgt

SEQ ID NO: 95269 - DNA, 25 bp, Mus musculus
acacagtgtctacgcctgatggctc

SEQ ID NO: 95270 - DNA, 25 bp, Mus musculus
acacagtgtctaggcctgatggctc

SEQ ID NO: 95271 - DNA, 25 bp, Mus musculus
acacagtgtggcatgttccttggca

SEQ ID NO: 95272 - DNA, 25 bp, Mus musculus
acacagtgtggcttgttccttggca

SEQ ID NO: 95273 - DNA, 25 bp, Mus musculus
acacagttacttcatgctgccaaac

SEQ ID NO: 95274 - DNA, 25 bp, Mus musculus
acacagttacttgatgctgccaaac

SEQ ID NO: 95275 - DNA, 25 bp, Mus musculus
acacagttatcactcccatgttgaa

SEQ ID NO: 95276 - DNA, 25 bp, Mus musculus
acacagttatcagtcccatgttgaa

SEQ ID NO: 95277 - DNA, 25 bp, Mus musculus
acacagttatctctgactacattaa

SEQ ID NO: 95278 - DNA, 25 bp, Mus musculus
acacagttatctgtgactacattaa

SEQ ID NO: 95279 - DNA, 25 bp, Mus musculus
acacagttcaacatcacacgggcat

SEQ ID NO: 95280 - DNA, 25 bp, Mus musculus
acacagttcaacttcacacgggcat

SEQ ID NO: 95281 - DNA, 25 bp, Mus musculus
acacagttcaagagtgaataactga

SEQ ID NO: 95282 - DNA, 25 bp, Mus musculus
acacagttcaagtgtgaataactga

SEQ ID NO: 95283 - DNA, 25 bp, Mus musculus
acacagttcactatgagtccgtgaa

SEQ ID NO: 95284 - DNA, 25 bp, Mus musculus
acacagttcactttgagtccgtgaa

SEQ ID NO: 95285 - DNA, 25 bp, Mus musculus
acacagttctgaaaatcatcaccat

SEQ ID NO: 95286 - DNA, 25 bp, Mus musculus
acacagttctgataatcatcaccat

SEQ ID NO: 95287 - DNA, 25 bp, Mus musculus
acacagttgagcctggtctaacaga

SEQ ID NO: 95288 - DNA, 25 bp, Mus musculus
acacagttgagcgtggtctaacaga

SEQ ID NO: 95289 - DNA, 25 bp, Mus musculus
acacagttgggacctgtctcctgtg

SEQ ID NO: 95290 - DNA, 25 bp, Mus musculus
acacagttgggagctgtctcctgtg

SEQ ID NO: 95291 - DNA, 25 bp, Mus musculus
acacagttgtgcctacttcatgaca

SEQ ID NO: 95292 - DNA, 25 bp, Mus musculus
acacagttgtgcgtacttcatgaca

SEQ ID NO: 95293 - DNA, 25 bp, Mus musculus
acacagtttccgaattcagctagct

SEQ ID NO: 95294 - DNA, 25 bp, Mus musculus
acacagtttccgtattcagctagct

SEQ ID NO: 95295 - DNA, 25 bp, Mus musculus
acacagtttgtgaggaggcgcctct

SEQ ID NO: 95296 - DNA, 25 bp, Mus musculus
acacagtttgtgatatgccactacg

SEQ ID NO: 95297 - DNA, 25 bp, Mus musculus
acacagtttgtgtggaggcgcctct

SEQ ID NO: 95298 - DNA, 25 bp, Mus musculus
acacagtttgtgttatgccactacg

SEQ ID NO: 95299 - DNA, 25 bp, Mus musculus
acacagttttccaggaaaaccatga

SEQ ID NO: 95300 - DNA, 25 bp, Mus musculus
acacagttttcctggaaaaccatga

SEQ ID NO: 95301 - DNA, 25 bp, Mus musculus
acacagttttgtcatattcactaca

SEQ ID NO: 95302 - DNA, 25 bp, Mus musculus
acacagttttgtgatattcactaca

SEQ ID NO: 95303 - DNA, 25 bp, Mus musculus
acacataacaacaccatataacctt

SEQ ID NO: 95304 - DNA, 25 bp, Mus musculus
acacataacaactccatataacctt

SEQ ID NO: 95305 - DNA, 25 bp, Mus musculus
acacataacataccctttcaacttg

SEQ ID NO: 95306 - DNA, 25 bp, Mus musculus
acacataacatagcctttcaacttg

SEQ ID NO: 95307 - DNA, 25 bp, Mus musculus
acacataacgcactggattcagcta

SEQ ID NO: 95308 - DNA, 25 bp, Mus musculus
acacataacgcagtggattcagcta

SEQ ID NO: 95309 - DNA, 25 bp, Mus musculus
acacataagcacaccagccatgtac

SEQ ID NO: 95310 - DNA, 25 bp, Mus musculus
acacataagcactccagccatgtac

SEQ ID NO: 95311 - DNA, 25 bp, Mus musculus
acacataagcctaactgtcctctgg

SEQ ID NO: 95312 - DNA, 25 bp, Mus musculus
acacataagccttactgtcctctgg

SEQ ID NO: 95313 - DNA, 25 bp, Mus musculus
acacataaggatcctcacttgggtt

SEQ ID NO: 95314 - DNA, 25 bp, Mus musculus
acacataaggatgctcacttgggtt

SEQ ID NO: 95315 - DNA, 25 bp, Mus musculus
acacatacaaggacatttttctaag

SEQ ID NO: 95316 - DNA, 25 bp, Mus musculus
acacatacaaggtcatttttctaag

SEQ ID NO: 95317 - DNA, 25 bp, Mus musculus
acacatacacacataccctattgta

SEQ ID NO: 95318 - DNA, 25 bp, Mus musculus
acacatacacacttaccctattgta

SEQ ID NO: 95319 - DNA, 25 bp, Mus musculus
acacatacacctacctggacctgaa

SEQ ID NO: 95320 - DNA, 25 bp, Mus musculus
acacatacaccttcctggacctgaa

SEQ ID NO: 95321 - DNA, 25 bp, Mus musculus
acacatacatcaaactccacaggga

SEQ ID NO: 95322 - DNA, 25 bp, Mus musculus
acacatacatcatactccacaggga

SEQ ID NO: 95323 - DNA, 25 bp, Mus musculus
acacatacatccacatatactcgca

SEQ ID NO: 95324 - DNA, 25 bp, Mus musculus
acacatacatcctcatatactcgca

SEQ ID NO: 95325 - DNA, 25 bp, Mus musculus
acacataccactcgtgcgtgtcctt

SEQ ID NO: 95326 - DNA, 25 bp, Mus musculus
acacataccactggtgcgtgtcctt

SEQ ID NO: 95327 - DNA, 25 bp, Mus musculus
acacataccattagtacacaatgaa

SEQ ID NO: 95328 - DNA, 25 bp, Mus musculus
acacataccatttgtacacaatgaa

SEQ ID NO: 95329 - DNA, 25 bp, Mus musculus
acacataccctgacataaagcctgt

SEQ ID NO: 95330 - DNA, 25 bp, Mus musculus
acacataccctgcacttgcacaagg

SEQ ID NO: 95331 - DNA, 25 bp, Mus musculus
acacataccctggacttgcacaagg

SEQ ID NO: 95332 - DNA, 25 bp, Mus musculus
acacataccctgtcataaagcctgt

SEQ ID NO: 95333 - DNA, 25 bp, Mus musculus
acacatacgcatcagttacttttga

SEQ ID NO: 95334 - DNA, 25 bp, Mus musculus
acacatacgcatgagttacttttga

SEQ ID NO: 95335 - DNA, 25 bp, Mus musculus
acacatactggtcattaataagcag

SEQ ID NO: 95336 - DNA, 25 bp, Mus musculus
acacatactggtgattaataagcag

SEQ ID NO: 95337 - DNA, 25 bp, Mus musculus
acacatactgtgcaatggctggcct

SEQ ID NO: 95338 - DNA, 25 bp, Mus musculus
acacatactgtggaatggctggcct

SEQ ID NO: 95339 - DNA, 25 bp, Mus musculus
acacatagatgcagtatgggttttt

SEQ ID NO: 95340 - DNA, 25 bp, Mus musculus
acacatagatgctgtatgggttttt

SEQ ID NO: 95341 - DNA, 25 bp, Mus musculus
acacatagccctagattcatcacaa

SEQ ID NO: 95342 - DNA, 25 bp, Mus musculus
acacatagcccttgattcatcacaa

SEQ ID NO: 95343 - DNA, 25 bp, Mus musculus
acacatagcgatcactcttggcacc

SEQ ID NO: 95344 - DNA, 25 bp, Mus musculus
acacatagcgatgactcttggcacc

SEQ ID NO: 95345 - DNA, 25 bp, Mus musculus
acacatagctccagtgcgcttcctt

SEQ ID NO: 95346 - DNA, 25 bp, Mus musculus
acacatagctcctgtgcgcttcctt

SEQ ID NO: 95347 - DNA, 25 bp, Mus musculus
acacatagctctctatgtctccaca

SEQ ID NO: 95348 - DNA, 25 bp, Mus musculus
acacatagctctgtatgtctccaca

SEQ ID NO: 95349 - DNA, 25 bp, Mus musculus
acacatagctttagagagtcaactt

SEQ ID NO: 95350 - DNA, 25 bp, Mus musculus
acacatagcttttgagagtcaactt

SEQ ID NO: 95351 - DNA, 25 bp, Mus musculus
acacataggaagatcacacctggct

SEQ ID NO: 95352 - DNA, 25 bp, Mus musculus
acacataggaagttcacacctggct

SEQ ID NO: 95353 - DNA, 25 bp, Mus musculus
acacataggattaaaacggaaggat

SEQ ID NO: 95354 - DNA, 25 bp, Mus musculus
acacataggatttaaacggaaggat

SEQ ID NO: 95355 - DNA, 25 bp, Mus musculus
acacataggcacagcgggacatttc

SEQ ID NO: 95356 - DNA, 25 bp, Mus musculus
acacataggcactgcgggacatttc

SEQ ID NO: 95357 - DNA, 25 bp, Mus musculus
acacataggctaatggaagaacgga

SEQ ID NO: 95358 - DNA, 25 bp, Mus musculus
acacataggctattggaagaacgga

SEQ ID NO: 95359 - DNA, 25 bp, Mus musculus
acacatagtagtaattggaaaccaa

SEQ ID NO: 95360 - DNA, 25 bp, Mus musculus
acacatagtagttattggaaaccaa

SEQ ID NO: 95361 - DNA, 25 bp, Mus musculus
acacatagtggtagtatcggcttta

SEQ ID NO: 95362 - DNA, 25 bp, Mus musculus
acacatagtggttgtatcggcttta

SEQ ID NO: 95363 - DNA, 25 bp, Mus musculus
acacatataccccaaggcactattt

SEQ ID NO: 95364 - DNA, 25 bp, Mus musculus
acacatatacccgaaggcactattt

SEQ ID NO: 95365 - DNA, 25 bp, Mus musculus
acacatataggccacattttagtaa

SEQ ID NO: 95366 - DNA, 25 bp, Mus musculus
acacatataggcgacattttagtaa

SEQ ID NO: 95367 - DNA, 25 bp, Mus musculus
acacatatatatctttgcctagagt

SEQ ID NO: 95368 - DNA, 25 bp, Mus musculus
acacatatatatgtttgcctagagt

SEQ ID NO: 95369 - DNA, 25 bp, Mus musculus
acacatatcacgatcagctttctaa

SEQ ID NO: 95370 - DNA, 25 bp, Mus musculus
acacatatcacgttcagctttctaa

SEQ ID NO: 95371 - DNA, 25 bp, Mus musculus
acacatatcatcactatccacgaat

SEQ ID NO: 95372 - DNA, 25 bp, Mus musculus
acacatatcatctctatccacgaat

SEQ ID NO: 95373 - DNA, 25 bp, Mus musculus
acacatatcttgcatagcttctcca

SEQ ID NO: 95374 - DNA, 25 bp, Mus musculus
acacatatcttggatagcttctcca

SEQ ID NO: 95375 - DNA, 25 bp, Mus musculus
acacatatgacaagccaggtgctct

SEQ ID NO: 95376 - DNA, 25 bp, Mus musculus
acacatatgacatgccaggtgctct

SEQ ID NO: 95377 - DNA, 25 bp, Mus musculus
acacatatggtacaggacttccggg

SEQ ID NO: 95378 - DNA, 25 bp, Mus musculus
acacatatggtagaggacttccggg

SEQ ID NO: 95379 - DNA, 25 bp, Mus musculus
acacatatggtgacttagtattgac

SEQ ID NO: 95380 - DNA, 25 bp, Mus musculus
acacatatggtgtcttagtattgac

SEQ ID NO: 95381 - DNA, 25 bp, Mus musculus
acacatatgtagctatgtacccaca

SEQ ID NO: 95382 - DNA, 25 bp, Mus musculus
acacatatgtaggtatgtacccaca

SEQ ID NO: 95383 - DNA, 25 bp, Mus musculus
acacatcaagaaattttcgagggag

SEQ ID NO: 95384 - DNA, 25 bp, Mus musculus
acacatcaagaatttttcgagggag

SEQ ID NO: 95385 - DNA, 25 bp, Mus musculus
acacatcaagataacactcaggagt

SEQ ID NO: 95386 - DNA, 25 bp, Mus musculus
acacatcaagattacactcaggagt

SEQ ID NO: 95387 - DNA, 25 bp, Mus musculus
acacatcaagcgcaagagaatgaag

SEQ ID NO: 95388 - DNA, 25 bp, Mus musculus
acacatcaagcggaagagaatgaag

SEQ ID NO: 95389 - DNA, 25 bp, Mus musculus
acacatcaaggtagtctctgtcacc

SEQ ID NO: 95390 - DNA, 25 bp, Mus musculus
acacatcaaggttgtctctgtcacc

SEQ ID NO: 95391 - DNA, 25 bp, Mus musculus
acacatcaagtaacctgggcccata

SEQ ID NO: 95392 - DNA, 25 bp, Mus musculus
acacatcaagtatcctgggcccata

SEQ ID NO: 95393 - DNA, 25 bp, Mus musculus
acacatcaagtcacacctgtagtga

SEQ ID NO: 95394 - DNA, 25 bp, Mus musculus
acacatcaagtctcacctgtagtga

SEQ ID NO: 95395 - DNA, 25 bp, Mus musculus
acacatcacaccactcaatttgcag

SEQ ID NO: 95396 - DNA, 25 bp, Mus musculus
acacatcacacctctcaatttgcag

SEQ ID NO: 95397 - DNA, 25 bp, Mus musculus
acacatcacccacccatggaggtgg

SEQ ID NO: 95398 - DNA, 25 bp, Mus musculus
acacatcacccagccatggaggtgg

SEQ ID NO: 95399 - DNA, 25 bp, Mus musculus
acacatcagcagaccttcactaggg

SEQ ID NO: 95400 - DNA, 25 bp, Mus musculus
acacatcagcagtccttcactaggg

SEQ ID NO: 95401 - DNA, 25 bp, Mus musculus
acacatcatgtcagctctgttcaaa

SEQ ID NO: 95402 - DNA, 25 bp, Mus musculus
acacatcatgtctgctctgttcaaa

SEQ ID NO: 95403 - DNA, 25 bp, Mus musculus
acacatccacttcgcctcaggattg

SEQ ID NO: 95404 - DNA, 25 bp, Mus musculus
acacatccacttggcctcaggattg

SEQ ID NO: 95405 - DNA, 25 bp, Mus musculus
acacatccagtcacttgaagtctag

SEQ ID NO: 95406 - DNA, 25 bp, Mus musculus
acacatccagtctcttgaagtctag

SEQ ID NO: 95407 - DNA, 25 bp, Mus musculus
acacatccagtgagggtgggagcct

SEQ ID NO: 95408 - DNA, 25 bp, Mus musculus
acacatccagtgtgggtgggagcct

SEQ ID NO: 95409 - DNA, 25 bp, Mus musculus
acacatccatggcattcctctgggt

SEQ ID NO: 95410 - DNA, 25 bp, Mus musculus
acacatccatgggattcctctgggt

SEQ ID NO: 95411 - DNA, 25 bp, Mus musculus
acacatccattaaagagtttgacct

SEQ ID NO: 95412 - DNA, 25 bp, Mus musculus
acacatccattatagagtttgacct

SEQ ID NO: 95413 - DNA, 25 bp, Mus musculus
acacatccctctcacctgggaggat

SEQ ID NO: 95414 - DNA, 25 bp, Mus musculus
acacatccctctgacctgggaggat

SEQ ID NO: 95415 - DNA, 25 bp, Mus musculus
acacatccgcctcttgtaatcaacg

SEQ ID NO: 95416 - DNA, 25 bp, Mus musculus
acacatccgcctgttgtaatcaacg

SEQ ID NO: 95417 - DNA, 25 bp, Mus musculus
acacatcctactccttctgaagcgg

SEQ ID NO: 95418 - DNA, 25 bp, Mus musculus
acacatcctactgcttctgaagcgg

SEQ ID NO: 95419 - DNA, 25 bp, Mus musculus
acacatcctagtatagcctttccct

SEQ ID NO: 95420 - DNA, 25 bp, Mus musculus
acacatcctagtttagcctttccct

SEQ ID NO: 95421 - DNA, 25 bp, Mus musculus
acacatcctgccagtttttcttaca

SEQ ID NO: 95422 - DNA, 25 bp, Mus musculus
acacatcctgcctgtttttcttaca

SEQ ID NO: 95423 - DNA, 25 bp, Mus musculus
acacatcctgtgacattgcttagca

SEQ ID NO: 95424 - DNA, 25 bp, Mus musculus
acacatcctgtgtcattgcttagca

SEQ ID NO: 95425 - DNA, 25 bp, Mus musculus
acacatcgactcacaggtacacaga

SEQ ID NO: 95426 - DNA, 25 bp, Mus musculus
acacatcgactctcaggtacacaga

SEQ ID NO: 95427 - DNA, 25 bp, Mus musculus
acacatcgcaggacacatacagcat

SEQ ID NO: 95428 - DNA, 25 bp, Mus musculus
acacatcgcaggtcacatacagcat

SEQ ID NO: 95429 - DNA, 25 bp, Mus musculus
acacatcggactctgcattacatgc

SEQ ID NO: 95430 - DNA, 25 bp, Mus musculus
acacatcggactgtgcattacatgc

SEQ ID NO: 95431 - DNA, 25 bp, Mus musculus
acacatctctctcccggaagaagaa

SEQ ID NO: 95432 - DNA, 25 bp, Mus musculus
acacatctctctgccggaagaagaa

SEQ ID NO: 95433 - DNA, 25 bp, Mus musculus
acacatctgagaaaaacagctgggt

SEQ ID NO: 95434 - DNA, 25 bp, Mus musculus
acacatctgagataaacagctgggt

SEQ ID NO: 95435 - DNA, 25 bp, Mus musculus
acacatctgatacctgatttgagac

SEQ ID NO: 95436 - DNA, 25 bp, Mus musculus
acacatctgatagctgatttgagac

SEQ ID NO: 95437 - DNA, 25 bp, Mus musculus
acacatctgcacatacacaaacacg

SEQ ID NO: 95438 - DNA, 25 bp, Mus musculus
acacatctgcacttacacaaacacg

SEQ ID NO: 95439 - DNA, 25 bp, Mus musculus
acacatctgccaagaaccgcttgac

SEQ ID NO: 95440 - DNA, 25 bp, Mus musculus
acacatctgccatgaaccgcttgac

SEQ ID NO: 95441 - DNA, 25 bp, Mus musculus
acacatctgctcagagttgtaatat

SEQ ID NO: 95442 - DNA, 25 bp, Mus musculus
acacatctgctctgagttgtaatat

SEQ ID NO: 95443 - DNA, 25 bp, Mus musculus
acacatctggccaaattaaaggatt

SEQ ID NO: 95444 - DNA, 25 bp, Mus musculus
acacatctggcctaattaaaggatt

SEQ ID NO: 95445 - DNA, 25 bp, Mus musculus
acacatctgggaaccatatccatga

SEQ ID NO: 95446 - DNA, 25 bp, Mus musculus
acacatctgggatccatatccatga

SEQ ID NO: 95447 - DNA, 25 bp, Mus musculus
acacatctgtaactcgggtctttgt

SEQ ID NO: 95448 - DNA, 25 bp, Mus musculus
acacatctgtaagtcgggtctttgt

SEQ ID NO: 95449 - DNA, 25 bp, Mus musculus
acacatcttaggctaatcaggaatc

SEQ ID NO: 95450 - DNA, 25 bp, Mus musculus
acacatcttagggtaatcaggaatc

SEQ ID NO: 95451 - DNA, 25 bp, Mus musculus
acacatcttcttcttgcagctgcat

SEQ ID NO: 95452 - DNA, 25 bp, Mus musculus
acacatcttcttgttgcagctgcat

SEQ ID NO: 95453 - DNA, 25 bp, Mus musculus
acacatcttgaactagacctcggag

SEQ ID NO: 95454 - DNA, 25 bp, Mus musculus
acacatcttgaagtagacctcggag

SEQ ID NO: 95455 - DNA, 25 bp, Mus musculus
acacatctttctacctaacgtcgta

SEQ ID NO: 95456 - DNA, 25 bp, Mus musculus
acacatctttcttcctaacgtcgta

SEQ ID NO: 95457 - DNA, 25 bp, Mus musculus
acacatgaacacattagggctggcc

SEQ ID NO: 95458 - DNA, 25 bp, Mus musculus
acacatgaacactttagggctggcc

SEQ ID NO: 95459 - DNA, 25 bp, Mus musculus
acacatgacacaccagatggctcca

SEQ ID NO: 95460 - DNA, 25 bp, Mus musculus
acacatgacacagcagatggctcca

SEQ ID NO: 95461 - DNA, 25 bp, Mus musculus
acacatgaccgtcggccaagctgga

SEQ ID NO: 95462 - DNA, 25 bp, Mus musculus
acacatgaccgtgggccaagctgga

SEQ ID NO: 95463 - DNA, 25 bp, Mus musculus
acacatgagagacgtggcagccaca

SEQ ID NO: 95464 - DNA, 25 bp, Mus musculus
acacatgagagaggtggcagccaca

SEQ ID NO: 95465 - DNA, 25 bp, Mus musculus
acacatgatcatattagctcagcaa

SEQ ID NO: 95466 - DNA, 25 bp, Mus musculus
acacatgatcattttagctcagcaa

SEQ ID NO: 95467 - DNA, 25 bp, Mus musculus
acacatgatgccattgaatgtcata

SEQ ID NO: 95468 - DNA, 25 bp, Mus musculus
acacatgatgcctttgaatgtcata

SEQ ID NO: 95469 - DNA, 25 bp, Mus musculus
acacatgattctcaggtaggaccac

SEQ ID NO: 95470 - DNA, 25 bp, Mus musculus
acacatgattctgaggtaggaccac

SEQ ID NO: 95471 - DNA, 25 bp, Mus musculus
acacatgcacagctatagacacata

SEQ ID NO: 95472 - DNA, 25 bp, Mus musculus
acacatgcacaggtatagacacata

SEQ ID NO: 95473 - DNA, 25 bp, Mus musculus
acacatgccgtcagtagtaaccgct

SEQ ID NO: 95474 - DNA, 25 bp, Mus musculus
acacatgccgtctgtagtaaccgct

SEQ ID NO: 95475 - DNA, 25 bp, Mus musculus
acacatgcctgaccaccgtagggtg

SEQ ID NO: 95476 - DNA, 25 bp, Mus musculus
acacatgcctgagcaccgtagggtg

SEQ ID NO: 95477 - DNA, 25 bp, Mus musculus
acacatgcctgtatgttacatatca

SEQ ID NO: 95478 - DNA, 25 bp, Mus musculus
acacatgcctgtttgttacatatca

SEQ ID NO: 95479 - DNA, 25 bp, Mus musculus
acacatgcgtagagtcccagggttg

SEQ ID NO: 95480 - DNA, 25 bp, Mus musculus
acacatgcgtagtgtcccagggttg

SEQ ID NO: 95481 - DNA, 25 bp, Mus musculus
acacatgcgttgaccgttcattttc

SEQ ID NO: 95482 - DNA, 25 bp, Mus musculus
acacatgcgttgtccgttcattttc

SEQ ID NO: 95483 - DNA, 25 bp, Mus musculus
acacatgctcgaaggcaggttcatt

SEQ ID NO: 95484 - DNA, 25 bp, Mus musculus
acacatgctcgatggcaggttcatt

SEQ ID NO: 95485 - DNA, 25 bp, Mus musculus
acacatgctgttcatagggtctctc

SEQ ID NO: 95486 - DNA, 25 bp, Mus musculus
acacatgctgttgatagggtctctc

SEQ ID NO: 95487 - DNA, 25 bp, Mus musculus
acacatgcttgtcgcaggcaacata

SEQ ID NO: 95488 - DNA, 25 bp, Mus musculus
acacatgcttgtggcaggcaacata

SEQ ID NO: 95489 - DNA, 25 bp, Mus musculus
acacatgctttcatttgtctatctg

SEQ ID NO: 95490 - DNA, 25 bp, Mus musculus
acacatgctttcttttgtctatctg

SEQ ID NO: 95491 - DNA, 25 bp, Mus musculus
acacatgcttttacagtcttcactt

SEQ ID NO: 95492 - DNA, 25 bp, Mus musculus
acacatgctttttcagtcttcactt

SEQ ID NO: 95493 - DNA, 25 bp, Mus musculus
acacatggaaaacacctggactttg

SEQ ID NO: 95494 - DNA, 25 bp, Mus musculus
acacatggaaaagacctggactttg

SEQ ID NO: 95495 - DNA, 25 bp, Mus musculus
acacatggaaataggttctccttcc

SEQ ID NO: 95496 - DNA, 25 bp, Mus musculus
acacatggaaattggttctccttcc

SEQ ID NO: 95497 - DNA, 25 bp, Mus musculus
acacatggacaaagggcacaaaccc

SEQ ID NO: 95498 - DNA, 25 bp, Mus musculus
acacatggacaatgggcacaaaccc

SEQ ID NO: 95499 - DNA, 25 bp, Mus musculus
acacatggacccattgctgttgcaa

SEQ ID NO: 95500 - DNA, 25 bp, Mus musculus
acacatggaccctttgctgttgcaa

SEQ ID NO: 95501 - DNA, 25 bp, Mus musculus
acacatggactaaaaattcaggttg

SEQ ID NO: 95502 - DNA, 25 bp, Mus musculus
acacatggactataaattcaggttg

SEQ ID NO: 95503 - DNA, 25 bp, Mus musculus
acacatggagacaggccgggctttc

SEQ ID NO: 95504 - DNA, 25 bp, Mus musculus
acacatggagactggccgggctttc

SEQ ID NO: 95505 - DNA, 25 bp, Mus musculus
acacatggagccacgtcgggagaat

SEQ ID NO: 95506 - DNA, 25 bp, Mus musculus
acacatggagcctcgtcgggagaat

SEQ ID NO: 95507 - DNA, 25 bp, Mus musculus
acacatggagggacctatagctcta

SEQ ID NO: 95508 - DNA, 25 bp, Mus musculus
acacatggagggtcctatagctcta

SEQ ID NO: 95509 - DNA, 25 bp, Mus musculus
acacatggagtcaagagcttgtctt

SEQ ID NO: 95510 - DNA, 25 bp, Mus musculus
acacatggagtctagagcttgtctt

SEQ ID NO: 95511 - DNA, 25 bp, Mus musculus
acacatggcagacctggtgagcaaa

SEQ ID NO: 95512 - DNA, 25 bp, Mus musculus
acacatggcagagctggtgagcaaa

SEQ ID NO: 95513 - DNA, 25 bp, Mus musculus
acacatggcggtcacagtcaggctt

SEQ ID NO: 95514 - DNA, 25 bp, Mus musculus
acacatggcggtgacagtcaggctt

SEQ ID NO: 95515 - DNA, 25 bp, Mus musculus
acacatggcttcaaaatagggaaaa

SEQ ID NO: 95516 - DNA, 25 bp, Mus musculus
acacatggcttctaaatagggaaaa

SEQ ID NO: 95517 - DNA, 25 bp, Mus musculus
acacatgggatgatggtctgtgaag

SEQ ID NO: 95518 - DNA, 25 bp, Mus musculus
acacatgggatgttggtctgtgaag

SEQ ID NO: 95519 - DNA, 25 bp, Mus musculus
acacatgggcttagtggccacatca

SEQ ID NO: 95520 - DNA, 25 bp, Mus musculus
acacatgggctttgtggccacatca

SEQ ID NO: 95521 - DNA, 25 bp, Mus musculus
acacatggtttgatcaagcacactt

SEQ ID NO: 95522 - DNA, 25 bp, Mus musculus
acacatggtttgttcaagcacactt

SEQ ID NO: 95523 - DNA, 25 bp, Mus musculus
acacatgtaaagattctggttgacc

SEQ ID NO: 95524 - DNA, 25 bp, Mus musculus
acacatgtaaagtttctggttgacc

SEQ ID NO: 95525 - DNA, 25 bp, Mus musculus
acacatgtacaaagcctaaggaagc

SEQ ID NO: 95526 - DNA, 25 bp, Mus musculus
acacatgtacaatgcctaaggaagc

SEQ ID NO: 95527 - DNA, 25 bp, Mus musculus
acacatgtacagacacggccacaaa

SEQ ID NO: 95528 - DNA, 25 bp, Mus musculus
acacatgtacagtcacggccacaaa

SEQ ID NO: 95529 - DNA, 25 bp, Mus musculus
acacatgtagccagggtcgactcgg

SEQ ID NO: 95530 - DNA, 25 bp, Mus musculus
acacatgtagcctgggtcgactcgg

SEQ ID NO: 95531 - DNA, 25 bp, Mus musculus
acacatgtattcaccaatgtgaagg

SEQ ID NO: 95532 - DNA, 25 bp, Mus musculus
acacatgtattctccaatgtgaagg

SEQ ID NO: 95533 - DNA, 25 bp, Mus musculus
acacatgtccctactcaacaaggaa

SEQ ID NO: 95534 - DNA, 25 bp, Mus musculus
acacatgtcccttctcaacaaggaa

SEQ ID NO: 95535 - DNA, 25 bp, Mus musculus
acacatgtcctgagggaggtgaagc

SEQ ID NO: 95536 - DNA, 25 bp, Mus musculus
acacatgtcctgtgggaggtgaagc

SEQ ID NO: 95537 - DNA, 25 bp, Mus musculus
acacatgtggagaccctgcaggatg

SEQ ID NO: 95538 - DNA, 25 bp, Mus musculus
acacatgtggagtccctgcaggatg

SEQ ID NO: 95539 - DNA, 25 bp, Mus musculus
acacatgtggcccatggctggactc

SEQ ID NO: 95540 - DNA, 25 bp, Mus musculus
acacatgtggccgatggctggactc

SEQ ID NO: 95541 - DNA, 25 bp, Mus musculus
acacatgtgtgtccttgatatgtta

SEQ ID NO: 95542 - DNA, 25 bp, Mus musculus
acacatgtgtgtgcttgatatgtta

SEQ ID NO: 95543 - DNA, 25 bp, Mus musculus
acacatgtgttcatatatcagttca

SEQ ID NO: 95544 - DNA, 25 bp, Mus musculus
acacatgtgttcttatatcagttca

SEQ ID NO: 95545 - DNA, 25 bp, Mus musculus
acacatgttcctagaagagggctga

SEQ ID NO: 95546 - DNA, 25 bp, Mus musculus
acacatgttccttgaagagggctga

SEQ ID NO: 95547 - DNA, 25 bp, Mus musculus
acacatgttggaacttatggctcta

SEQ ID NO: 95548 - DNA, 25 bp, Mus musculus
acacatgttggatcttatggctcta

SEQ ID NO: 95549 - DNA, 25 bp, Mus musculus
acacatgtttgtagatgctgcaatt

SEQ ID NO: 95550 - DNA, 25 bp, Mus musculus
acacatgtttgttgatgctgcaatt

SEQ ID NO: 95551 - DNA, 25 bp, Mus musculus
acacattaacgtatctagctacaag

SEQ ID NO: 95552 - DNA, 25 bp, Mus musculus
acacattaacgtttctagctacaag

SEQ ID NO: 95553 - DNA, 25 bp, Mus musculus
acacattacaatcccactgctactg

SEQ ID NO: 95554 - DNA, 25 bp, Mus musculus
acacattacaatgccactgctactg

SEQ ID NO: 95555 - DNA, 25 bp, Mus musculus
acacattacccgcatgcttttgttc

SEQ ID NO: 95556 - DNA, 25 bp, Mus musculus
acacattacccggatgcttttgttc

SEQ ID NO: 95557 - DNA, 25 bp, Mus musculus
acacattaccttagggaagcgcggg

SEQ ID NO: 95558 - DNA, 25 bp, Mus musculus
acacattacctttgggaagcgcggg

SEQ ID NO: 95559 - DNA, 25 bp, Mus musculus
acacattaggctccatcctgaatct

SEQ ID NO: 95560 - DNA, 25 bp, Mus musculus
acacattaggctgcatcctgaatct

SEQ ID NO: 95561 - DNA, 25 bp, Mus musculus
acacattagtgaagggctgatggcg

SEQ ID NO: 95562 - DNA, 25 bp, Mus musculus
acacattagtgatgggctgatggcg

SEQ ID NO: 95563 - DNA, 25 bp, Mus musculus
acacattagtgtcgtcctggctttc

SEQ ID NO: 95564 - DNA, 25 bp, Mus musculus
acacattagtgtggtcctggctttc

SEQ ID NO: 95565 - DNA, 25 bp, Mus musculus
acacattatcataccattttttcat

SEQ ID NO: 95566 - DNA, 25 bp, Mus musculus
acacattatcattccattttttcat

SEQ ID NO: 95567 - DNA, 25 bp, Mus musculus
acacattatctcctaatcctagcat

SEQ ID NO: 95568 - DNA, 25 bp, Mus musculus
acacattatctcgtaatcctagcat

SEQ ID NO: 95569 - DNA, 25 bp, Mus musculus
acacattatgctcatgttgatgaca

SEQ ID NO: 95570 - DNA, 25 bp, Mus musculus
acacattatgctgatgttgatgaca

SEQ ID NO: 95571 - DNA, 25 bp, Mus musculus
acacattattccagtcgagtcgaag

SEQ ID NO: 95572 - DNA, 25 bp, Mus musculus
acacattattcctgtcgagtcgaag

SEQ ID NO: 95573 - DNA, 25 bp, Mus musculus
acacattcaggcctcaggtagaaaa

SEQ ID NO: 95574 - DNA, 25 bp, Mus musculus
acacattcaggcgtcaggtagaaaa

SEQ ID NO: 95575 - DNA, 25 bp, Mus musculus
acacattcattaactcgtctttctc

SEQ ID NO: 95576 - DNA, 25 bp, Mus musculus
acacattcattatctcgtctttctc

SEQ ID NO: 95577 - DNA, 25 bp, Mus musculus
acacattccaaaataattctgagat

SEQ ID NO: 95578 - DNA, 25 bp, Mus musculus
acacattccaaattaattctgagat

SEQ ID NO: 95579 - DNA, 25 bp, Mus musculus
acacattccactaggccttttcatt

SEQ ID NO: 95580 - DNA, 25 bp, Mus musculus
acacattccacttggccttttcatt

SEQ ID NO: 95581 - DNA, 25 bp, Mus musculus
acacattctaatcggtggatcggaa

SEQ ID NO: 95582 - DNA, 25 bp, Mus musculus
acacattctaatgggtggatcggaa

SEQ ID NO: 95583 - DNA, 25 bp, Mus musculus
acacattctagtacaagctattatg

SEQ ID NO: 95584 - DNA, 25 bp, Mus musculus
acacattctagttcaagctattatg

SEQ ID NO: 95585 - DNA, 25 bp, Mus musculus
acacattctgaaccctcctgtgttg

SEQ ID NO: 95586 - DNA, 25 bp, Mus musculus
acacattctgaagcctcctgtgttg

SEQ ID NO: 95587 - DNA, 25 bp, Mus musculus
acacattgaagcctgagtttcccca

SEQ ID NO: 95588 - DNA, 25 bp, Mus musculus
acacattgaagcgtgagtttcccca

SEQ ID NO: 95589 - DNA, 25 bp, Mus musculus
acacattgaattatcgccctgggca

SEQ ID NO: 95590 - DNA, 25 bp, Mus musculus
acacattgaattttcgccctgggca

SEQ ID NO: 95591 - DNA, 25 bp, Mus musculus
acacattgatccattttgtttaaat

SEQ ID NO: 95592 - DNA, 25 bp, Mus musculus
acacattgatcctttttgtttaaat

SEQ ID NO: 95593 - DNA, 25 bp, Mus musculus
acacattgcatgcatggtgcccaca

SEQ ID NO: 95594 - DNA, 25 bp, Mus musculus
acacattgcatggatggtgcccaca

SEQ ID NO: 95595 - DNA, 25 bp, Mus musculus
acacattgccagagccagactttac

SEQ ID NO: 95596 - DNA, 25 bp, Mus musculus
acacattgccagtgccagactttac

SEQ ID NO: 95597 - DNA, 25 bp, Mus musculus
acacattgcttgacattccttgttg

SEQ ID NO: 95598 - DNA, 25 bp, Mus musculus
acacattgcttgtcattccttgttg

SEQ ID NO: 95599 - DNA, 25 bp, Mus musculus
acacattggtgtcgctctcctgaag

SEQ ID NO: 95600 - DNA, 25 bp, Mus musculus
acacattggtgtggctctcctgaag

SEQ ID NO: 95601 - DNA, 25 bp, Mus musculus
acacattggttgcttattcccacag

SEQ ID NO: 95602 - DNA, 25 bp, Mus musculus
acacattggttggttattcccacag

SEQ ID NO: 95603 - DNA, 25 bp, Mus musculus
acacattgtgacctgcccgaatcaa

SEQ ID NO: 95604 - DNA, 25 bp, Mus musculus
acacattgtgacgtgcccgaatcaa

SEQ ID NO: 95605 - DNA, 25 bp, Mus musculus
acacattgtgtgctaccttatcaag

SEQ ID NO: 95606 - DNA, 25 bp, Mus musculus
acacattgtgtggtaccttatcaag

SEQ ID NO: 95607 - DNA, 25 bp, Mus musculus
acacattgtgttccttctacaagta

SEQ ID NO: 95608 - DNA, 25 bp, Mus musculus
acacattgtgttgcttctacaagta

SEQ ID NO: 95609 - DNA, 25 bp, Mus musculus
acacattgtttcagcaccagtgcac

SEQ ID NO: 95610 - DNA, 25 bp, Mus musculus
acacattgtttctgcaccagtgcac

SEQ ID NO: 95611 - DNA, 25 bp, Mus musculus
acacatttaatgaaagcactcagaa

SEQ ID NO: 95612 - DNA, 25 bp, Mus musculus
acacatttaatgaccgtgaccctgt

SEQ ID NO: 95613 - DNA, 25 bp, Mus musculus
acacatttaatgtaagcactcagaa

SEQ ID NO: 95614 - DNA, 25 bp, Mus musculus
acacatttaatgtccgtgaccctgt

SEQ ID NO: 95615 - DNA, 25 bp, Mus musculus
acacatttctgcattcaccttattt

SEQ ID NO: 95616 - DNA, 25 bp, Mus musculus
acacatttctgccagtgacggtttg

SEQ ID NO: 95617 - DNA, 25 bp, Mus musculus
acacatttctgcgagtgacggtttg

SEQ ID NO: 95618 - DNA, 25 bp, Mus musculus
acacatttctgctttcaccttattt

SEQ ID NO: 95619 - DNA, 25 bp, Mus musculus
acacatttggccaagctgtacgata

SEQ ID NO: 95620 - DNA, 25 bp, Mus musculus
acacatttggcctagctgtacgata

SEQ ID NO: 95621 - DNA, 25 bp, Mus musculus
acacatttgtcacacgccaggctgt

SEQ ID NO: 95622 - DNA, 25 bp, Mus musculus
acacatttgtcactggttggctttg

SEQ ID NO: 95623 - DNA, 25 bp, Mus musculus
acacatttgtcagacgccaggctgt

SEQ ID NO: 95624 - DNA, 25 bp, Mus musculus
acacatttgtcagtggttggctttg

SEQ ID NO: 95625 - DNA, 25 bp, Mus musculus
acacatttgttgagcatgtagttgc

SEQ ID NO: 95626 - DNA, 25 bp, Mus musculus
acacatttgttgtgcatgtagttgc

SEQ ID NO: 95627 - DNA, 25 bp, Mus musculus
acacattttaccctgtgccttaatg

SEQ ID NO: 95628 - DNA, 25 bp, Mus musculus
acacattttaccgtgtgccttaatg

SEQ ID NO: 95629 - DNA, 25 bp, Mus musculus
acacattttctaaatctaaattcat

SEQ ID NO: 95630 - DNA, 25 bp, Mus musculus
acacattttctatatctaaattcat

SEQ ID NO: 95631 - DNA, 25 bp, Mus musculus
acaccaaaaggcacctgagcgattt

SEQ ID NO: 95632 - DNA, 25 bp, Mus musculus
acaccaaaaggctcctgagcgattt

SEQ ID NO: 95633 - DNA, 25 bp, Mus musculus
acaccaaaattgataggcgacaggc

SEQ ID NO: 95634 - DNA, 25 bp, Mus musculus
acaccaaaattgttaggcgacaggc

SEQ ID NO: 95635 - DNA, 25 bp, Mus musculus
acaccaaactatatgctgttcagaa

SEQ ID NO: 95636 - DNA, 25 bp, Mus musculus
acaccaaactatttgctgttcagaa

SEQ ID NO: 95637 - DNA, 25 bp, Mus musculus
acaccaaagaggaggcccagcgcat

SEQ ID NO: 95638 - DNA, 25 bp, Mus musculus
acaccaaagaggtggcccagcgcat

SEQ ID NO: 95639 - DNA, 25 bp, Mus musculus
acaccaaagcccactatgcttttat

SEQ ID NO: 95640 - DNA, 25 bp, Mus musculus
acaccaaagccctctatgcttttat

SEQ ID NO: 95641 - DNA, 25 bp, Mus musculus
acaccaaaggcgacctggcgagaat

SEQ ID NO: 95642 - DNA, 25 bp, Mus musculus
acaccaaaggcgtcctggcgagaat

SEQ ID NO: 95643 - DNA, 25 bp, Mus musculus
acaccaacaactctgtttcttccta

SEQ ID NO: 95644 - DNA, 25 bp, Mus musculus
acaccaacaactgtgtttcttccta

SEQ ID NO: 95645 - DNA, 25 bp, Mus musculus
acaccaacagctcatgagagacatt

SEQ ID NO: 95646 - DNA, 25 bp, Mus musculus
acaccaacagctgatgagagacatt

SEQ ID NO: 95647 - DNA, 25 bp, Mus musculus
acaccaacaggtatatgtccccata

SEQ ID NO: 95648 - DNA, 25 bp, Mus musculus
acaccaacaggtttatgtccccata

SEQ ID NO: 95649 - DNA, 25 bp, Mus musculus
acaccaacatcgatgggcggcggaa

SEQ ID NO: 95650 - DNA, 25 bp, Mus musculus
acaccaacatcgttgggcggcggaa

SEQ ID NO: 95651 - DNA, 25 bp, Mus musculus
acaccaaccacgactctaagagatt

SEQ ID NO: 95652 - DNA, 25 bp, Mus musculus
acaccaaccacgtctctaagagatt

SEQ ID NO: 95653 - DNA, 25 bp, Mus musculus
acaccaaccatgatggctctgtcag

SEQ ID NO: 95654 - DNA, 25 bp, Mus musculus
acaccaaccatgttggctctgtcag

SEQ ID NO: 95655 - DNA, 25 bp, Mus musculus
acaccaacccctcctaataattaat

SEQ ID NO: 95656 - DNA, 25 bp, Mus musculus
acaccaacccctgctaataattaat

SEQ ID NO: 95657 - DNA, 25 bp, Mus musculus
acaccaaccttgcaagatatttgtt

SEQ ID NO: 95658 - DNA, 25 bp, Mus musculus
acaccaaccttggaagatatttgtt

SEQ ID NO: 95659 - DNA, 25 bp, Mus musculus
acaccaacgctgacacattaagacg

SEQ ID NO: 95660 - DNA, 25 bp, Mus musculus
acaccaacgctgtcacattaagacg

SEQ ID NO: 95661 - DNA, 25 bp, Mus musculus
acaccaacgggaagtgctatagtcc

SEQ ID NO: 95662 - DNA, 25 bp, Mus musculus
acaccaacgggatgtgctatagtcc

SEQ ID NO: 95663 - DNA, 25 bp, Mus musculus
acaccaacgtcaccaatgctgtgaa

SEQ ID NO: 95664 - DNA, 25 bp, Mus musculus
acaccaacgtcagcaatgctgtgaa

SEQ ID NO: 95665 - DNA, 25 bp, Mus musculus
acaccaactccaacagttctaacgg

SEQ ID NO: 95666 - DNA, 25 bp, Mus musculus
acaccaactccatcagttctaacgg

SEQ ID NO: 95667 - DNA, 25 bp, Mus musculus
acaccaagaagccaggacctgcatc

SEQ ID NO: 95668 - DNA, 25 bp, Mus musculus
acaccaagaagcgaggacctgcatc

SEQ ID NO: 95669 - DNA, 25 bp, Mus musculus
acaccaagaaggaaacacttagccg

SEQ ID NO: 95670 - DNA, 25 bp, Mus musculus
acaccaagaaggtaacacttagccg

SEQ ID NO: 95671 - DNA, 25 bp, Mus musculus
acaccaagaccactggccgcagggg

SEQ ID NO: 95672 - DNA, 25 bp, Mus musculus
acaccaagaccagtggccgcagggg

SEQ ID NO: 95673 - DNA, 25 bp, Mus musculus
acaccaagagaactatctgcccaat

SEQ ID NO: 95674 - DNA, 25 bp, Mus musculus
acaccaagagaagtatctgcccaat

SEQ ID NO: 95675 - DNA, 25 bp, Mus musculus
acaccaagaggaaagggcgcgttat

SEQ ID NO: 95676 - DNA, 25 bp, Mus musculus
acaccaagaggatagggcgcgttat

SEQ ID NO: 95677 - DNA, 25 bp, Mus musculus
acaccaagcgtgatgtgacccttga

SEQ ID NO: 95678 - DNA, 25 bp, Mus musculus
acaccaagcgtgttgtgacccttga

SEQ ID NO: 95679 - DNA, 25 bp, Mus musculus
acaccaaggaggctgcccatacctt

SEQ ID NO: 95680 - DNA, 25 bp, Mus musculus
acaccaaggagggtgcccatacctt

SEQ ID NO: 95681 - DNA, 25 bp, Mus musculus
acaccaagggaccaatgttccagga

SEQ ID NO: 95682 - DNA, 25 bp, Mus musculus
acaccaagggacgaatgttccagga

SEQ ID NO: 95683 - DNA, 25 bp, Mus musculus
acaccaataaaacatacttcccact

SEQ ID NO: 95684 - DNA, 25 bp, Mus musculus
acaccaataaaagatacttcccact

SEQ ID NO: 95685 - DNA, 25 bp, Mus musculus
acaccaatattaacctatagtgaag

SEQ ID NO: 95686 - DNA, 25 bp, Mus musculus
acaccaatattatcctatagtgaag

SEQ ID NO: 95687 - DNA, 25 bp, Mus musculus
acaccaatcacacggtaagatgtcc

SEQ ID NO: 95688 - DNA, 25 bp, Mus musculus
acaccaatcacagggtaagatgtcc

SEQ ID NO: 95689 - DNA, 25 bp, Mus musculus
acaccaatgatgcatgcactgtccc

SEQ ID NO: 95690 - DNA, 25 bp, Mus musculus
acaccaatgatggatgcactgtccc

SEQ ID NO: 95691 - DNA, 25 bp, Mus musculus
acaccaatgcttagacctttgtcat

SEQ ID NO: 95692 - DNA, 25 bp, Mus musculus
acaccaatgctttgacctttgtcat

SEQ ID NO: 95693 - DNA, 25 bp, Mus musculus
acaccaatggacagcgcgctgcaag

SEQ ID NO: 95694 - DNA, 25 bp, Mus musculus
acaccaatggactgcgcgctgcaag

SEQ ID NO: 95695 - DNA, 25 bp, Mus musculus
acaccaattgctatgaggtcacagt

SEQ ID NO: 95696 - DNA, 25 bp, Mus musculus
acaccaattgctttgaggtcacagt

SEQ ID NO: 95697 - DNA, 25 bp, Mus musculus
acaccaattttcaagtataatccat

SEQ ID NO: 95698 - DNA, 25 bp, Mus musculus
acaccaattttctagtataatccat

SEQ ID NO: 95699 - DNA, 25 bp, Mus musculus
acaccacaaaacctctcaaagcagt

SEQ ID NO: 95700 - DNA, 25 bp, Mus musculus
acaccacaaaacgtctcaaagcagt

SEQ ID NO: 95701 - DNA, 25 bp, Mus musculus
acaccacacacaactgtagcgagat

SEQ ID NO: 95702 - DNA, 25 bp, Mus musculus
acaccacacacatctgtagcgagat

SEQ ID NO: 95703 - DNA, 25 bp, Mus musculus
acaccacaccatcatttggcttttg

SEQ ID NO: 95704 - DNA, 25 bp, Mus musculus
acaccacaccatgatttggcttttg

SEQ ID NO: 95705 - DNA, 25 bp, Mus musculus
acaccacaccctcagaaaacggaga

SEQ ID NO: 95706 - DNA, 25 bp, Mus musculus
acaccacaccctgagaaaacggaga

SEQ ID NO: 95707 - DNA, 25 bp, Mus musculus
acaccacacggacctttacatgaat

SEQ ID NO: 95708 - DNA, 25 bp, Mus musculus
acaccacacggagctttacatgaat

SEQ ID NO: 95709 - DNA, 25 bp, Mus musculus
acaccacacgttaatacggatttcg

SEQ ID NO: 95710 - DNA, 25 bp, Mus musculus
acaccacacgtttatacggatttcg

SEQ ID NO: 95711 - DNA, 25 bp, Mus musculus
acaccacactctcgctttaaactgt

SEQ ID NO: 95712 - DNA, 25 bp, Mus musculus
acaccacactctggctttaaactgt

SEQ ID NO: 95713 - DNA, 25 bp, Mus musculus
acaccacactgtaccttaatcattt

SEQ ID NO: 95714 - DNA, 25 bp, Mus musculus
acaccacactgtcactctgagtttt

SEQ ID NO: 95715 - DNA, 25 bp, Mus musculus
acaccacactgtgactctgagtttt

SEQ ID NO: 95716 - DNA, 25 bp, Mus musculus
acaccacactgttccttaatcattt

SEQ ID NO: 95717 - DNA, 25 bp, Mus musculus
acaccacagacactgctgttcggat

SEQ ID NO: 95718 - DNA, 25 bp, Mus musculus
acaccacagacagtgctgttcggat

SEQ ID NO: 95719 - DNA, 25 bp, Mus musculus
acaccacagactaccaggagagctt

SEQ ID NO: 95720 - DNA, 25 bp, Mus musculus
acaccacagacttccaggagagctt

SEQ ID NO: 95721 - DNA, 25 bp, Mus musculus
acaccacagcagaccagaatgggtt

SEQ ID NO: 95722 - DNA, 25 bp, Mus musculus
acaccacagcagtccagaatgggtt

SEQ ID NO: 95723 - DNA, 25 bp, Mus musculus
acaccacagcgaagtcaacttttca

SEQ ID NO: 95724 - DNA, 25 bp, Mus musculus
acaccacagcgatgtcaacttttca

SEQ ID NO: 95725 - DNA, 25 bp, Mus musculus
acaccacaggcacgttgcttcttgt

SEQ ID NO: 95726 - DNA, 25 bp, Mus musculus
acaccacaggcaggttgcttcttgt

SEQ ID NO: 95727 - DNA, 25 bp, Mus musculus
acaccacaggccctttgccagagag

SEQ ID NO: 95728 - DNA, 25 bp, Mus musculus
acaccacaggccgtttgccagagag

SEQ ID NO: 95729 - DNA, 25 bp, Mus musculus
acaccacaggctatgctactggagc

SEQ ID NO: 95730 - DNA, 25 bp, Mus musculus
acaccacaggctttgctactggagc

SEQ ID NO: 95731 - DNA, 25 bp, Mus musculus
acaccacagggtcagcatccggatg

SEQ ID NO: 95732 - DNA, 25 bp, Mus musculus
acaccacagggtgagcatccggatg

SEQ ID NO: 95733 - DNA, 25 bp, Mus musculus
acaccacaggtgaacatagacgctt

SEQ ID NO: 95734 - DNA, 25 bp, Mus musculus
acaccacaggtgtacatagacgctt

SEQ ID NO: 95735 - DNA, 25 bp, Mus musculus
acaccacagtcccagtttcaagaat

SEQ ID NO: 95736 - DNA, 25 bp, Mus musculus
acaccacagtccgagtttcaagaat

SEQ ID NO: 95737 - DNA, 25 bp, Mus musculus
acaccacataaaattcctttagatg

SEQ ID NO: 95738 - DNA, 25 bp, Mus musculus
acaccacataaatttcctttagatg

SEQ ID NO: 95739 - DNA, 25 bp, Mus musculus
acaccacattttcaccttgtagggg

SEQ ID NO: 95740 - DNA, 25 bp, Mus musculus
acaccacattttgaccttgtagggg

SEQ ID NO: 95741 - DNA, 25 bp, Mus musculus
acaccaccagaacctacgtcaaaaa

SEQ ID NO: 95742 - DNA, 25 bp, Mus musculus
acaccaccagaagctacgtcaaaaa

SEQ ID NO: 95743 - DNA, 25 bp, Mus musculus
acaccacccccaaggggaggcacat

SEQ ID NO: 95744 - DNA, 25 bp, Mus musculus
acaccacccccatggggaggcacat

SEQ ID NO: 95745 - DNA, 25 bp, Mus musculus
acaccaccctgcatgacttaagagt

SEQ ID NO: 95746 - DNA, 25 bp, Mus musculus
acaccaccctgcttgacttaagagt

SEQ ID NO: 95747 - DNA, 25 bp, Mus musculus
acaccaccctggccgaggaacaggt

SEQ ID NO: 95748 - DNA, 25 bp, Mus musculus
acaccaccctgggcgaggaacaggt

SEQ ID NO: 95749 - DNA, 25 bp, Mus musculus
acaccacccttgcatttcttctgtg

SEQ ID NO: 95750 - DNA, 25 bp, Mus musculus
acaccacccttggatttcttctgtg

SEQ ID NO: 95751 - DNA, 25 bp, Mus musculus
acaccaccgcaacttttttagtcag

SEQ ID NO: 95752 - DNA, 25 bp, Mus musculus
acaccaccgcaagttttttagtcag

SEQ ID NO: 95753 - DNA, 25 bp, Mus musculus
acaccacctcacactaatgtattgt

SEQ ID NO: 95754 - DNA, 25 bp, Mus musculus
acaccacctcactctaatgtattgt

SEQ ID NO: 95755 - DNA, 25 bp, Mus musculus
acaccacctggcagagctcaaaaga

SEQ ID NO: 95756 - DNA, 25 bp, Mus musculus
acaccacctggctgagctcaaaaga

SEQ ID NO: 95757 - DNA, 25 bp, Mus musculus
acaccacctgtgcatcatcatcggg

SEQ ID NO: 95758 - DNA, 25 bp, Mus musculus
acaccacctgtggatcatcatcggg

SEQ ID NO: 95759 - DNA, 25 bp, Mus musculus
acaccacgagtcagcagtattaggg

SEQ ID NO: 95760 - DNA, 25 bp, Mus musculus
acaccacgagtctgcagtattaggg

SEQ ID NO: 95761 - DNA, 25 bp, Mus musculus
acaccacgtacccagaaggacttga

SEQ ID NO: 95762 - DNA, 25 bp, Mus musculus
acaccacgtaccgagaaggacttga

SEQ ID NO: 95763 - DNA, 25 bp, Mus musculus
acaccacgtttcatgtgccgtatga

SEQ ID NO: 95764 - DNA, 25 bp, Mus musculus
acaccacgtttcttgtgccgtatga

SEQ ID NO: 95765 - DNA, 25 bp, Mus musculus
acaccactatccactttgaatcctg

SEQ ID NO: 95766 - DNA, 25 bp, Mus musculus
acaccactatcctctttgaatcctg

SEQ ID NO: 95767 - DNA, 25 bp, Mus musculus
acaccactcactagttactcttaaa

SEQ ID NO: 95768 - DNA, 25 bp, Mus musculus
acaccactcacttgttactcttaaa

SEQ ID NO: 95769 - DNA, 25 bp, Mus musculus
acaccactcctgagcatcagggatt

SEQ ID NO: 95770 - DNA, 25 bp, Mus musculus
acaccactcctgtgcatcagggatt

SEQ ID NO: 95771 - DNA, 25 bp, Mus musculus
acaccactctgaccttgctgacaaa

SEQ ID NO: 95772 - DNA, 25 bp, Mus musculus
acaccactctgacttgactctttgt

SEQ ID NO: 95773 - DNA, 25 bp, Mus musculus
acaccactctgagcttgctgacaaa

SEQ ID NO: 95774 - DNA, 25 bp, Mus musculus
acaccactctgagttgactctttgt

SEQ ID NO: 95775 - DNA, 25 bp, Mus musculus
acaccactgaccatgatgccagtaa

SEQ ID NO: 95776 - DNA, 25 bp, Mus musculus
acaccactgaccttgatgccagtaa

SEQ ID NO: 95777 - DNA, 25 bp, Mus musculus
acaccactgattatcaacgggctga

SEQ ID NO: 95778 - DNA, 25 bp, Mus musculus
acaccactgattttcaacgggctga

SEQ ID NO: 95779 - DNA, 25 bp, Mus musculus
acaccactgccgagcttgcggacag

SEQ ID NO: 95780 - DNA, 25 bp, Mus musculus
acaccactgccgtgcttgcggacag

SEQ ID NO: 95781 - DNA, 25 bp, Mus musculus
acaccactgggtcatgccgctgaga

SEQ ID NO: 95782 - DNA, 25 bp, Mus musculus
acaccactgggtgatgccgctgaga

SEQ ID NO: 95783 - DNA, 25 bp, Mus musculus
acaccactggtgactccaaaatgct

SEQ ID NO: 95784 - DNA, 25 bp, Mus musculus
acaccactggtgtctccaaaatgct

SEQ ID NO: 95785 - DNA, 25 bp, Mus musculus
acaccacttccgattgatttgaatg

SEQ ID NO: 95786 - DNA, 25 bp, Mus musculus
acaccacttccgtttgatttgaatg

SEQ ID NO: 95787 - DNA, 25 bp, Mus musculus
acaccactttgacacagttcctaat

SEQ ID NO: 95788 - DNA, 25 bp, Mus musculus
acaccactttgagacagttcctaat

SEQ ID NO: 95789 - DNA, 25 bp, Mus musculus
acaccagaacaccacagcatcatta

SEQ ID NO: 95790 - DNA, 25 bp, Mus musculus
acaccagaacacgacagcatcatta

SEQ ID NO: 95791 - DNA, 25 bp, Mus musculus
acaccagaactcatccttttgtttt

SEQ ID NO: 95792 - DNA, 25 bp, Mus musculus
acaccagaactcttccttttgtttt

SEQ ID NO: 95793 - DNA, 25 bp, Mus musculus
acaccagacacacagcttttacatg

SEQ ID NO: 95794 - DNA, 25 bp, Mus musculus
acaccagacacagagcttttacatg

SEQ ID NO: 95795 - DNA, 25 bp, Mus musculus
acaccagacattattgatgcccaag

SEQ ID NO: 95796 - DNA, 25 bp, Mus musculus
acaccagacatttttgatgcccaag

SEQ ID NO: 95797 - DNA, 25 bp, Mus musculus
acaccagacccaattcccattgttt

SEQ ID NO: 95798 - DNA, 25 bp, Mus musculus
acaccagacccatttcccattgttt

SEQ ID NO: 95799 - DNA, 25 bp, Mus musculus
acaccagaccgactgactgaattct

SEQ ID NO: 95800 - DNA, 25 bp, Mus musculus
acaccagaccgagtgactgaattct

SEQ ID NO: 95801 - DNA, 25 bp, Mus musculus
acaccagagttaatggatgtgactg

SEQ ID NO: 95802 - DNA, 25 bp, Mus musculus
acaccagagttattggatgtgactg

SEQ ID NO: 95803 - DNA, 25 bp, Mus musculus
acaccagagttcctgataatcctcc

SEQ ID NO: 95804 - DNA, 25 bp, Mus musculus
acaccagagttcgtgataatcctcc

SEQ ID NO: 95805 - DNA, 25 bp, Mus musculus
acaccagcaaggacatcttctgacc

SEQ ID NO: 95806 - DNA, 25 bp, Mus musculus
acaccagcaaggtcatcttctgacc

SEQ ID NO: 95807 - DNA, 25 bp, Mus musculus
acaccagcacacatcttacgagatg

SEQ ID NO: 95808 - DNA, 25 bp, Mus musculus
acaccagcacacttcttacgagatg

SEQ ID NO: 95809 - DNA, 25 bp, Mus musculus
acaccagcaggtcccaaacagaagg

SEQ ID NO: 95810 - DNA, 25 bp, Mus musculus
acaccagcaggtgccaaacagaagg

SEQ ID NO: 95811 - DNA, 25 bp, Mus musculus
acaccagcagtgaggttctcgcggt

SEQ ID NO: 95812 - DNA, 25 bp, Mus musculus
acaccagcagtgtggttctcgcggt

SEQ ID NO: 95813 - DNA, 25 bp, Mus musculus
acaccagcatcgcttgtggtcacat

SEQ ID NO: 95814 - DNA, 25 bp, Mus musculus
acaccagcatcggttgtggtcacat

SEQ ID NO: 95815 - DNA, 25 bp, Mus musculus
acaccagcatgcacttcaggatcat

SEQ ID NO: 95816 - DNA, 25 bp, Mus musculus
acaccagcatgctcttcaggatcat

SEQ ID NO: 95817 - DNA, 25 bp, Mus musculus
acaccagccaagcagattgtgcacc

SEQ ID NO: 95818 - DNA, 25 bp, Mus musculus
acaccagccaaggagattgtgcacc

SEQ ID NO: 95819 - DNA, 25 bp, Mus musculus
acaccagccgggaggcgagacttcc

SEQ ID NO: 95820 - DNA, 25 bp, Mus musculus
acaccagccgggtggcgagacttcc

SEQ ID NO: 95821 - DNA, 25 bp, Mus musculus
acaccagccttgagttcgctgatga

SEQ ID NO: 95822 - DNA, 25 bp, Mus musculus
acaccagccttgtgttcgctgatga

SEQ ID NO: 95823 - DNA, 25 bp, Mus musculus
acaccagcgaacagaatctctcctg

SEQ ID NO: 95824 - DNA, 25 bp, Mus musculus
acaccagcgaactgaatctctcctg

SEQ ID NO: 95825 - DNA, 25 bp, Mus musculus
acaccagctagcaatcagcctaaga

SEQ ID NO: 95826 - DNA, 25 bp, Mus musculus
acaccagctagctatcagcctaaga

SEQ ID NO: 95827 - DNA, 25 bp, Mus musculus
acaccagcttcacgatgtcttaatc

SEQ ID NO: 95828 - DNA, 25 bp, Mus musculus
acaccagcttcaggatgtcttaatc

SEQ ID NO: 95829 - DNA, 25 bp, Mus musculus
acaccagcttccagaaaatgtccat

SEQ ID NO: 95830 - DNA, 25 bp, Mus musculus
acaccagcttcctgaaaatgtccat

SEQ ID NO: 95831 - DNA, 25 bp, Mus musculus
acaccagcttctctcaggtacttta

SEQ ID NO: 95832 - DNA, 25 bp, Mus musculus
acaccagcttctgtcaggtacttta

SEQ ID NO: 95833 - DNA, 25 bp, Mus musculus
acaccaggacagatggtttctgaaa

SEQ ID NO: 95834 - DNA, 25 bp, Mus musculus
acaccaggacagttggtttctgaaa

SEQ ID NO: 95835 - DNA, 25 bp, Mus musculus
acaccaggacttcctagcaccggtg

SEQ ID NO: 95836 - DNA, 25 bp, Mus musculus
acaccaggacttgctagcaccggtg

SEQ ID NO: 95837 - DNA, 25 bp, Mus musculus
acaccaggagctcttttttgcagtc

SEQ ID NO: 95838 - DNA, 25 bp, Mus musculus
acaccaggagctgttttttgcagtc

SEQ ID NO: 95839 - DNA, 25 bp, Mus musculus
acaccaggattcatccatgcggaaa

SEQ ID NO: 95840 - DNA, 25 bp, Mus musculus
acaccaggattcttccatgcggaaa

SEQ ID NO: 95841 - DNA, 25 bp, Mus musculus
acaccaggcaaaatctctgccacaa

SEQ ID NO: 95842 - DNA, 25 bp, Mus musculus
acaccaggcaaattctctgccacaa

SEQ ID NO: 95843 - DNA, 25 bp, Mus musculus
acaccaggcagaatctcgatcggta

SEQ ID NO: 95844 - DNA, 25 bp, Mus musculus
acaccaggcagattctcgatcggta

SEQ ID NO: 95845 - DNA, 25 bp, Mus musculus
acaccaggcagtaggctgctcagtg

SEQ ID NO: 95846 - DNA, 25 bp, Mus musculus
acaccaggcagttggctgctcagtg

SEQ ID NO: 95847 - DNA, 25 bp, Mus musculus
acaccaggccaacagctttggcaga

SEQ ID NO: 95848 - DNA, 25 bp, Mus musculus
acaccaggccaagagctttggcaga

SEQ ID NO: 95849 - DNA, 25 bp, Mus musculus
acaccaggctggcaaacctcagagc

SEQ ID NO: 95850 - DNA, 25 bp, Mus musculus
acaccaggctgggaaacctcagagc

SEQ ID NO: 95851 - DNA, 25 bp, Mus musculus
acaccagggaggatctgccctacca

SEQ ID NO: 95852 - DNA, 25 bp, Mus musculus
acaccagggaggttctgccctacca

SEQ ID NO: 95853 - DNA, 25 bp, Mus musculus
acaccagggtctatcagattatagt

SEQ ID NO: 95854 - DNA, 25 bp, Mus musculus
acaccagggtctttcagattatagt

SEQ ID NO: 95855 - DNA, 25 bp, Mus musculus
acaccagggtttcccaagattacag

SEQ ID NO: 95856 - DNA, 25 bp, Mus musculus
acaccagggtttgccaagattacag

SEQ ID NO: 95857 - DNA, 25 bp, Mus musculus
acaccagtaaccaaaatgcctccag

SEQ ID NO: 95858 - DNA, 25 bp, Mus musculus
acaccagtaacctaaatgcctccag

SEQ ID NO: 95859 - DNA, 25 bp, Mus musculus
acaccagtaattccctgtttcagag

SEQ ID NO: 95860 - DNA, 25 bp, Mus musculus
acaccagtaattgcctgtttcagag

SEQ ID NO: 95861 - DNA, 25 bp, Mus musculus
acaccagtacccacatgtacaaaca

SEQ ID NO: 95862 - DNA, 25 bp, Mus musculus
acaccagtaccctcatgtacaaaca

SEQ ID NO: 95863 - DNA, 25 bp, Mus musculus
acaccagtaggtatctctttagagg

SEQ ID NO: 95864 - DNA, 25 bp, Mus musculus
acaccagtaggtttctctttagagg

SEQ ID NO: 95865 - DNA, 25 bp, Mus musculus
acaccagtcactcggctgtatggaa

SEQ ID NO: 95866 - DNA, 25 bp, Mus musculus
acaccagtcactgggctgtatggaa

SEQ ID NO: 95867 - DNA, 25 bp, Mus musculus
acaccagtctctacagaccatcttt

SEQ ID NO: 95868 - DNA, 25 bp, Mus musculus
acaccagtctcttcagaccatcttt

SEQ ID NO: 95869 - DNA, 25 bp, Mus musculus
acaccagtgactatgttaactacgg

SEQ ID NO: 95870 - DNA, 25 bp, Mus musculus
acaccagtgactttgttaactacgg

SEQ ID NO: 95871 - DNA, 25 bp, Mus musculus
acaccagtgagaagcggagtgagct

SEQ ID NO: 95872 - DNA, 25 bp, Mus musculus
acaccagtgagatgcggagtgagct

SEQ ID NO: 95873 - DNA, 25 bp, Mus musculus
acaccagtgattcagtctcctagta

SEQ ID NO: 95874 - DNA, 25 bp, Mus musculus
acaccagtgattgagtctcctagta

SEQ ID NO: 95875 - DNA, 25 bp, Mus musculus
acaccagtgcccacagcacaagaag

SEQ ID NO: 95876 - DNA, 25 bp, Mus musculus
acaccagtgccctcagcacaagaag

SEQ ID NO: 95877 - DNA, 25 bp, Mus musculus
acaccagtgggacggcagtcctcta

SEQ ID NO: 95878 - DNA, 25 bp, Mus musculus
acaccagtgggagggcagtcctcta

SEQ ID NO: 95879 - DNA, 25 bp, Mus musculus
acaccagtgggcatttgttcctagc

SEQ ID NO: 95880 - DNA, 25 bp, Mus musculus
acaccagtgggcctgtgcgtaagca

SEQ ID NO: 95881 - DNA, 25 bp, Mus musculus
acaccagtgggcgtgtgcgtaagca

SEQ ID NO: 95882 - DNA, 25 bp, Mus musculus
acaccagtgggcttttgttcctagc

SEQ ID NO: 95883 - DNA, 25 bp, Mus musculus
acaccagtgtatatcagtgctgtcg

SEQ ID NO: 95884 - DNA, 25 bp, Mus musculus
acaccagtgtatttcagtgctgtcg

SEQ ID NO: 95885 - DNA, 25 bp, Mus musculus
acaccagtgtcacatattgagattt

SEQ ID NO: 95886 - DNA, 25 bp, Mus musculus
acaccagtgtcagatattgagattt

SEQ ID NO: 95887 - DNA, 25 bp, Mus musculus
acaccagtgtctccagagggaggtc

SEQ ID NO: 95888 - DNA, 25 bp, Mus musculus
acaccagtgtctgcagagggaggtc

SEQ ID NO: 95889 - DNA, 25 bp, Mus musculus
acaccagttcctaccatggagtcaa

SEQ ID NO: 95890 - DNA, 25 bp, Mus musculus
acaccagttccttccatggagtcaa

SEQ ID NO: 95891 - DNA, 25 bp, Mus musculus
acaccagttgccattgctcattgct

SEQ ID NO: 95892 - DNA, 25 bp, Mus musculus
acaccagttgcctttgctcattgct

SEQ ID NO: 95893 - DNA, 25 bp, Mus musculus
acaccagttggcagagtctgtccag

SEQ ID NO: 95894 - DNA, 25 bp, Mus musculus
acaccagttggctgagtctgtccag

SEQ ID NO: 95895 - DNA, 25 bp, Mus musculus
acaccagttgggaccgaagccttct

SEQ ID NO: 95896 - DNA, 25 bp, Mus musculus
acaccagttgggtccgaagccttct

SEQ ID NO: 95897 - DNA, 25 bp, Mus musculus
acaccagttgtgattgtcttggact

SEQ ID NO: 95898 - DNA, 25 bp, Mus musculus
acaccagttgtgtttgtcttggact

SEQ ID NO: 95899 - DNA, 25 bp, Mus musculus
acaccataagagagcacagtgccat

SEQ ID NO: 95900 - DNA, 25 bp, Mus musculus
acaccataagagtgcacagtgccat

SEQ ID NO: 95901 - DNA, 25 bp, Mus musculus
acaccatacatgagaggtctcctca

SEQ ID NO: 95902 - DNA, 25 bp, Mus musculus
acaccatacatgtgaggtctcctca

SEQ ID NO: 95903 - DNA, 25 bp, Mus musculus
acaccatactatcatgcgcagtggc

SEQ ID NO: 95904 - DNA, 25 bp, Mus musculus
acaccatactatgatgcgcagtggc

SEQ ID NO: 95905 - DNA, 25 bp, Mus musculus
acaccataggacacagcggcggcgg

SEQ ID NO: 95906 - DNA, 25 bp, Mus musculus
acaccataggactcagcggcggcgg

SEQ ID NO: 95907 - DNA, 25 bp, Mus musculus
acaccatattgcagctgtttctaaa

SEQ ID NO: 95908 - DNA, 25 bp, Mus musculus
acaccatattgctgctgtttctaaa

SEQ ID NO: 95909 - DNA, 25 bp, Mus musculus
acaccatcaaaactggcaacttgaa

SEQ ID NO: 95910 - DNA, 25 bp, Mus musculus
acaccatcaaaagtggcaacttgaa

SEQ ID NO: 95911 - DNA, 25 bp, Mus musculus
acaccatcaccaattaacatacctt

SEQ ID NO: 95912 - DNA, 25 bp, Mus musculus
acaccatcaccatttaacatacctt

SEQ ID NO: 95913 - DNA, 25 bp, Mus musculus
acaccatcactaatctaagatcagg

SEQ ID NO: 95914 - DNA, 25 bp, Mus musculus
acaccatcactattctaagatcagg

SEQ ID NO: 95915 - DNA, 25 bp, Mus musculus
acaccatccacactatcctttgaat

SEQ ID NO: 95916 - DNA, 25 bp, Mus musculus
acaccatccacagtatcctttgaat

SEQ ID NO: 95917 - DNA, 25 bp, Mus musculus
acaccatctaatacctggctcaaga

SEQ ID NO: 95918 - DNA, 25 bp, Mus musculus
acaccatctaattcctggctcaaga

SEQ ID NO: 95919 - DNA, 25 bp, Mus musculus
acaccatctcctctagagtttcaaa

SEQ ID NO: 95920 - DNA, 25 bp, Mus musculus
acaccatctcctgtagagtttcaaa

SEQ ID NO: 95921 - DNA, 25 bp, Mus musculus
acaccatcttgaattcctatttcca

SEQ ID NO: 95922 - DNA, 25 bp, Mus musculus
acaccatcttgatttcctatttcca

SEQ ID NO: 95923 - DNA, 25 bp, Mus musculus
acaccatgacttatactatgttaga

SEQ ID NO: 95924 - DNA, 25 bp, Mus musculus
acaccatgacttttactatgttaga

SEQ ID NO: 95925 - DNA, 25 bp, Mus musculus
acaccatgatggctctcaggctcag

SEQ ID NO: 95926 - DNA, 25 bp, Mus musculus
acaccatgatgggtctcaggctcag

SEQ ID NO: 95927 - DNA, 25 bp, Mus musculus
acaccatgcaccatgagtggagaga

SEQ ID NO: 95928 - DNA, 25 bp, Mus musculus
acaccatgcaccttgagtggagaga

SEQ ID NO: 95929 - DNA, 25 bp, Mus musculus
acaccatgctggaatagttccaaat

SEQ ID NO: 95930 - DNA, 25 bp, Mus musculus
acaccatgctggtatagttccaaat

SEQ ID NO: 95931 - DNA, 25 bp, Mus musculus
acaccatggagtatatttggacaac

SEQ ID NO: 95932 - DNA, 25 bp, Mus musculus
acaccatggagtctgtgctggagct

SEQ ID NO: 95933 - DNA, 25 bp, Mus musculus
acaccatggagtgtgtgctggagct

SEQ ID NO: 95934 - DNA, 25 bp, Mus musculus
acaccatggagtttatttggacaac

SEQ ID NO: 95935 - DNA, 25 bp, Mus musculus
acaccatgggagaaccctgccgtga

SEQ ID NO: 95936 - DNA, 25 bp, Mus musculus
acaccatgggagtaccctgccgtga

SEQ ID NO: 95937 - DNA, 25 bp, Mus musculus
acaccatgggccctgagcgtatctt

SEQ ID NO: 95938 - DNA, 25 bp, Mus musculus
acaccatgggccgtgagcgtatctt

SEQ ID NO: 95939 - DNA, 25 bp, Mus musculus
acaccatggtgaccaagtatgtgga

SEQ ID NO: 95940 - DNA, 25 bp, Mus musculus
acaccatggtgagcaagtatgtgga

SEQ ID NO: 95941 - DNA, 25 bp, Mus musculus
acaccatggtttatgacggcttcgg

SEQ ID NO: 95942 - DNA, 25 bp, Mus musculus
acaccatggtttttgacggcttcgg

SEQ ID NO: 95943 - DNA, 25 bp, Mus musculus
acaccatgtcacagcttcaagatac

SEQ ID NO: 95944 - DNA, 25 bp, Mus musculus
acaccatgtcactgcttcaagatac

SEQ ID NO: 95945 - DNA, 25 bp, Mus musculus
acaccatgtctgatactagggagaa

SEQ ID NO: 95946 - DNA, 25 bp, Mus musculus
acaccatgtctgttactagggagaa

SEQ ID NO: 95947 - DNA, 25 bp, Mus musculus
acaccatgtgaacctgagtgctgtt

SEQ ID NO: 95948 - DNA, 25 bp, Mus musculus
acaccatgtgaagctgagtgctgtt

SEQ ID NO: 95949 - DNA, 25 bp, Mus musculus
acaccatgtgctctgaccctgggct

SEQ ID NO: 95950 - DNA, 25 bp, Mus musculus
acaccatgtgctgtgaccctgggct

SEQ ID NO: 95951 - DNA, 25 bp, Mus musculus
acaccatgtgtgaccaaaagcgaca

SEQ ID NO: 95952 - DNA, 25 bp, Mus musculus
acaccatgtgtgcttaagtttggct

SEQ ID NO: 95953 - DNA, 25 bp, Mus musculus
acaccatgtgtggttaagtttggct

SEQ ID NO: 95954 - DNA, 25 bp, Mus musculus
acaccatgtgtgtccaaaagcgaca

SEQ ID NO: 95955 - DNA, 25 bp, Mus musculus
acaccatgtgttcattgttgtcttt

SEQ ID NO: 95956 - DNA, 25 bp, Mus musculus
acaccatgtgttgattgttgtcttt

SEQ ID NO: 95957 - DNA, 25 bp, Mus musculus
acaccattcagtacagttcactgat

SEQ ID NO: 95958 - DNA, 25 bp, Mus musculus
acaccattcagttcagttcactgat

SEQ ID NO: 95959 - DNA, 25 bp, Mus musculus
acaccattccggaagaactgcagct

SEQ ID NO: 95960 - DNA, 25 bp, Mus musculus
acaccattccggtagaactgcagct

SEQ ID NO: 95961 - DNA, 25 bp, Mus musculus
acaccattgagcagtgtcggcgaga

SEQ ID NO: 95962 - DNA, 25 bp, Mus musculus
acaccattgagctgtgtcggcgaga

SEQ ID NO: 95963 - DNA, 25 bp, Mus musculus
acaccattgatgattgatcggatga

SEQ ID NO: 95964 - DNA, 25 bp, Mus musculus
acaccattgatgtttgatcggatga

SEQ ID NO: 95965 - DNA, 25 bp, Mus musculus
acaccattggtgacttcttttccag

SEQ ID NO: 95966 - DNA, 25 bp, Mus musculus
acaccattggtgtcttcttttccag

SEQ ID NO: 95967 - DNA, 25 bp, Mus musculus
acaccattgtgtatccgagaggttt

SEQ ID NO: 95968 - DNA, 25 bp, Mus musculus
acaccattgtgtatgaccgcgttcc

SEQ ID NO: 95969 - DNA, 25 bp, Mus musculus
acaccattgtgtttccgagaggttt

SEQ ID NO: 95970 - DNA, 25 bp, Mus musculus
acaccattgtgtttgaccgcgttcc

SEQ ID NO: 95971 - DNA, 25 bp, Mus musculus
acacccaaacatattcatgcacgct

SEQ ID NO: 95972 - DNA, 25 bp, Mus musculus
acacccaaacattttcatgcacgct

SEQ ID NO: 95973 - DNA, 25 bp, Mus musculus
acacccaacagtccactatgaagtc

SEQ ID NO: 95974 - DNA, 25 bp, Mus musculus
acacccaacagtgcactatgaagtc

SEQ ID NO: 95975 - DNA, 25 bp, Mus musculus
acacccaaccttactgggatgtgct

SEQ ID NO: 95976 - DNA, 25 bp, Mus musculus
acacccaacctttctgggatgtgct

SEQ ID NO: 95977 - DNA, 25 bp, Mus musculus
acacccaacggtcttgtttatatgt

SEQ ID NO: 95978 - DNA, 25 bp, Mus musculus
acacccaacggtgttgtttatatgt

SEQ ID NO: 95979 - DNA, 25 bp, Mus musculus
acacccaaggacctggacatttgct

SEQ ID NO: 95980 - DNA, 25 bp, Mus musculus
acacccaaggacgtggacatttgct

SEQ ID NO: 95981 - DNA, 25 bp, Mus musculus
acacccaaggcaaccatagctgtgg

SEQ ID NO: 95982 - DNA, 25 bp, Mus musculus
acacccaaggcatccatagctgtgg

SEQ ID NO: 95983 - DNA, 25 bp, Mus musculus
acacccaataatccacaggcttaag

SEQ ID NO: 95984 - DNA, 25 bp, Mus musculus
acacccaataatgcacaggcttaag

SEQ ID NO: 95985 - DNA, 25 bp, Mus musculus
acacccaatatcataccattccttg

SEQ ID NO: 95986 - DNA, 25 bp, Mus musculus
acacccaatatcttaccattccttg

SEQ ID NO: 95987 - DNA, 25 bp, Mus musculus
acacccaccaagatagactttctca

SEQ ID NO: 95988 - DNA, 25 bp, Mus musculus
acacccaccaagttagactttctca

SEQ ID NO: 95989 - DNA, 25 bp, Mus musculus
acacccaccatgagtattgtttcct

SEQ ID NO: 95990 - DNA, 25 bp, Mus musculus
acacccaccatgtgtattgtttcct

SEQ ID NO: 95991 - DNA, 25 bp, Mus musculus
acacccacctacagatccctatttc

SEQ ID NO: 95992 - DNA, 25 bp, Mus musculus
acacccacctactgatccctatttc

SEQ ID NO: 95993 - DNA, 25 bp, Mus musculus
acacccacctatatacttcgcacag

SEQ ID NO: 95994 - DNA, 25 bp, Mus musculus
acacccacctatttacttcgcacag

SEQ ID NO: 95995 - DNA, 25 bp, Mus musculus
acacccacggttagaacagcctttg

SEQ ID NO: 95996 - DNA, 25 bp, Mus musculus
acacccacggtttgaacagcctttg

SEQ ID NO: 95997 - DNA, 25 bp, Mus musculus
acacccacgtctatcgaagctggtg

SEQ ID NO: 95998 - DNA, 25 bp, Mus musculus
acacccacgtctttcgaagctggtg

SEQ ID NO: 95999 - DNA, 25 bp, Mus musculus
acacccactcacacgggaaagtatg

SEQ ID NO: 96000 - DNA, 25 bp, Mus musculus
acacccactcactcgggaaagtatg

SEQ ID NO: 96001 - DNA, 25 bp, Mus musculus
acacccactggtaggacactagatc

SEQ ID NO: 96002 - DNA, 25 bp, Mus musculus
acacccactggttggacactagatc

SEQ ID NO: 96003 - DNA, 25 bp, Mus musculus
acacccactgtgagatttacgtcaa

SEQ ID NO: 96004 - DNA, 25 bp, Mus musculus
acacccactgtgtgatttacgtcaa

SEQ ID NO: 96005 - DNA, 25 bp, Mus musculus
acacccactgttagagcgtgtgctt

SEQ ID NO: 96006 - DNA, 25 bp, Mus musculus
acacccactgtttgagcgtgtgctt

SEQ ID NO: 96007 - DNA, 25 bp, Mus musculus
acacccagactcaagtaacctactt

SEQ ID NO: 96008 - DNA, 25 bp, Mus musculus
acacccagactctagtaacctactt

SEQ ID NO: 96009 - DNA, 25 bp, Mus musculus
acacccagcaatcgatacaggacat

SEQ ID NO: 96010 - DNA, 25 bp, Mus musculus
acacccagcaatggatacaggacat

SEQ ID NO: 96011 - DNA, 25 bp, Mus musculus
acacccagcatgattgcaacactga

SEQ ID NO: 96012 - DNA, 25 bp, Mus musculus
acacccagcatgtttgcaacactga

SEQ ID NO: 96013 - DNA, 25 bp, Mus musculus
acacccagcattcccgtggttgttg

SEQ ID NO: 96014 - DNA, 25 bp, Mus musculus
acacccagcattgccgtggttgttg

SEQ ID NO: 96015 - DNA, 25 bp, Mus musculus
acacccagcctccttgtagcttgtg

SEQ ID NO: 96016 - DNA, 25 bp, Mus musculus
acacccagcctcgttgtagcttgtg

SEQ ID NO: 96017 - DNA, 25 bp, Mus musculus
acacccagcgtgaatcagtactaag

SEQ ID NO: 96018 - DNA, 25 bp, Mus musculus
acacccagcgtgtatcagtactaag

SEQ ID NO: 96019 - DNA, 25 bp, Mus musculus
acacccagctatatgagtttccaag

SEQ ID NO: 96020 - DNA, 25 bp, Mus musculus
acacccagctatctacgtgtgggat

SEQ ID NO: 96021 - DNA, 25 bp, Mus musculus
acacccagctatgtacgtgtgggat

SEQ ID NO: 96022 - DNA, 25 bp, Mus musculus
acacccagctatttgagtttccaag

SEQ ID NO: 96023 - DNA, 25 bp, Mus musculus
acacccagctttccaaggattttgg

SEQ ID NO: 96024 - DNA, 25 bp, Mus musculus
acacccagctttcgtcttgacattt

SEQ ID NO: 96025 - DNA, 25 bp, Mus musculus
acacccagctttgcaaggattttgg

SEQ ID NO: 96026 - DNA, 25 bp, Mus musculus
acacccagctttggtcttgacattt

SEQ ID NO: 96027 - DNA, 25 bp, Mus musculus
acacccaggacacatgcagagctct

SEQ ID NO: 96028 - DNA, 25 bp, Mus musculus
acacccaggacagatgcagagctct

SEQ ID NO: 96029 - DNA, 25 bp, Mus musculus
acacccaggcaaattactatccatg

SEQ ID NO: 96030 - DNA, 25 bp, Mus musculus
acacccaggcaatttactatccatg

SEQ ID NO: 96031 - DNA, 25 bp, Mus musculus
acacccaggtaaaggaatgtccgta

SEQ ID NO: 96032 - DNA, 25 bp, Mus musculus
acacccaggtaatggaatgtccgta

SEQ ID NO: 96033 - DNA, 25 bp, Mus musculus
acacccaggtcaatgatggcttttt

SEQ ID NO: 96034 - DNA, 25 bp, Mus musculus
acacccaggtcattgatggcttttt

SEQ ID NO: 96035 - DNA, 25 bp, Mus musculus
acacccagtcctacattataagttt

SEQ ID NO: 96036 - DNA, 25 bp, Mus musculus
acacccagtccttcattataagttt

SEQ ID NO: 96037 - DNA, 25 bp, Mus musculus
acacccagttgcagtgccaaggagc

SEQ ID NO: 96038 - DNA, 25 bp, Mus musculus
acacccagttgctgtgccaaggagc

SEQ ID NO: 96039 - DNA, 25 bp, Mus musculus
acacccatcctgcaggacagtggat

SEQ ID NO: 96040 - DNA, 25 bp, Mus musculus
acacccatcctggaggacagtggat

SEQ ID NO: 96041 - DNA, 25 bp, Mus musculus
acacccatgagtacagcctgcagat

SEQ ID NO: 96042 - DNA, 25 bp, Mus musculus
acacccatgagttcagcctgcagat

SEQ ID NO: 96043 - DNA, 25 bp, Mus musculus
acacccatgctgcttagaagcctaa

SEQ ID NO: 96044 - DNA, 25 bp, Mus musculus
acacccatgctggttagaagcctaa

SEQ ID NO: 96045 - DNA, 25 bp, Mus musculus
acacccatgggaatttgccactctg

SEQ ID NO: 96046 - DNA, 25 bp, Mus musculus
acacccatgggattttgccactctg

SEQ ID NO: 96047 - DNA, 25 bp, Mus musculus
acacccatgggcactgtggctttct

SEQ ID NO: 96048 - DNA, 25 bp, Mus musculus
acacccatgggctctgtggctttct

SEQ ID NO: 96049 - DNA, 25 bp, Mus musculus
acacccatgttcacagacaacacgt

SEQ ID NO: 96050 - DNA, 25 bp, Mus musculus
acacccatgttctcagacaacacgt

SEQ ID NO: 96051 - DNA, 25 bp, Mus musculus
acacccatgtttacttggatttcaa

SEQ ID NO: 96052 - DNA, 25 bp, Mus musculus
acacccatgttttcttggatttcaa

SEQ ID NO: 96053 - DNA, 25 bp, Mus musculus
acacccattagaatcatgcactttt

SEQ ID NO: 96054 - DNA, 25 bp, Mus musculus
acacccattagattcatgcactttt

SEQ ID NO: 96055 - DNA, 25 bp, Mus musculus
acacccattcacaaacaagtattta

SEQ ID NO: 96056 - DNA, 25 bp, Mus musculus
acacccattcactaacaagtattta

SEQ ID NO: 96057 - DNA, 25 bp, Mus musculus
acacccattgagaatccgaaacctg

SEQ ID NO: 96058 - DNA, 25 bp, Mus musculus
acacccattgagtatccgaaacctg

SEQ ID NO: 96059 - DNA, 25 bp, Mus musculus
acacccatttggaggtggctcccaa

SEQ ID NO: 96060 - DNA, 25 bp, Mus musculus
acacccatttggtggtggctcccaa

SEQ ID NO: 96061 - DNA, 25 bp, Mus musculus
acacccattttgattgatctttaat

SEQ ID NO: 96062 - DNA, 25 bp, Mus musculus
acacccattttgtttgatctttaat

SEQ ID NO: 96063 - DNA, 25 bp, Mus musculus
acaccccactagatgtttgatgcaa

SEQ ID NO: 96064 - DNA, 25 bp, Mus musculus
acaccccactagttgtttgatgcaa

SEQ ID NO: 96065 - DNA, 25 bp, Mus musculus
acaccccatggaaacactattcctg

SEQ ID NO: 96066 - DNA, 25 bp, Mus musculus
acaccccatggatacactattcctg

SEQ ID NO: 96067 - DNA, 25 bp, Mus musculus
acaccccatgggaacatcttagaga

SEQ ID NO: 96068 - DNA, 25 bp, Mus musculus
acaccccatgggtacatcttagaga

SEQ ID NO: 96069 - DNA, 25 bp, Mus musculus
acaccccgaaatacatcttatgctg

SEQ ID NO: 96070 - DNA, 25 bp, Mus musculus
acaccccgaaattcatcttatgctg

SEQ ID NO: 96071 - DNA, 25 bp, Mus musculus
acaccccgcagaagatgaacttctt

SEQ ID NO: 96072 - DNA, 25 bp, Mus musculus
acaccccgcagatgatgaacttctt

SEQ ID NO: 96073 - DNA, 25 bp, Mus musculus
acaccccgcttgctagaatgttagc

SEQ ID NO: 96074 - DNA, 25 bp, Mus musculus
acaccccgcttggtagaatgttagc

SEQ ID NO: 96075 - DNA, 25 bp, Mus musculus
acacccctagctcagagactattgg

SEQ ID NO: 96076 - DNA, 25 bp, Mus musculus
acacccctagctgagagactattgg

SEQ ID NO: 96077 - DNA, 25 bp, Mus musculus
acacccctatgtaatgctgagtcag

SEQ ID NO: 96078 - DNA, 25 bp, Mus musculus
acacccctatgttatgctgagtcag

SEQ ID NO: 96079 - DNA, 25 bp, Mus musculus
acacccctccatcggtatggagttc

SEQ ID NO: 96080 - DNA, 25 bp, Mus musculus
acacccctccatgggtatggagttc

SEQ ID NO: 96081 - DNA, 25 bp, Mus musculus
acacccctgcagatgcagttaagat

SEQ ID NO: 96082 - DNA, 25 bp, Mus musculus
acacccctgcagttgcagttaagat

SEQ ID NO: 96083 - DNA, 25 bp, Mus musculus
acacccctggtcagctgggaggcaa

SEQ ID NO: 96084 - DNA, 25 bp, Mus musculus
acacccctggtctgctgggaggcaa

SEQ ID NO: 96085 - DNA, 25 bp, Mus musculus
acacccctggttagagcaaatcggc

SEQ ID NO: 96086 - DNA, 25 bp, Mus musculus
acacccctggtttgagcaaatcggc

SEQ ID NO: 96087 - DNA, 25 bp, Mus musculus
acacccctgttcagtaacattagcg

SEQ ID NO: 96088 - DNA, 25 bp, Mus musculus
acacccctgttctgtaacattagcg

SEQ ID NO: 96089 - DNA, 25 bp, Mus musculus
acacccctttggcatagctctgtgc

SEQ ID NO: 96090 - DNA, 25 bp, Mus musculus
acacccctttgggatagctctgtgc

SEQ ID NO: 96091 - DNA, 25 bp, Mus musculus
acacccgaaaagctagactcggatt

SEQ ID NO: 96092 - DNA, 25 bp, Mus musculus
acacccgaaaaggtagactcggatt

SEQ ID NO: 96093 - DNA, 25 bp, Mus musculus
acacccgaatacacagctgttctgc

SEQ ID NO: 96094 - DNA, 25 bp, Mus musculus
acacccgaatactcagctgttctgc

SEQ ID NO: 96095 - DNA, 25 bp, Mus musculus
acacccgaggttcctacagctatgt

SEQ ID NO: 96096 - DNA, 25 bp, Mus musculus
acacccgaggttgctacagctatgt

SEQ ID NO: 96097 - DNA, 25 bp, Mus musculus
acacccgagtttactgcagcacttg

SEQ ID NO: 96098 - DNA, 25 bp, Mus musculus
acacccgagttttctgcagcacttg

SEQ ID NO: 96099 - DNA, 25 bp, Mus musculus
acacccgcaaacaccggctgatggt

SEQ ID NO: 96100 - DNA, 25 bp, Mus musculus
acacccgcaaactccggctgatggt

SEQ ID NO: 96101 - DNA, 25 bp, Mus musculus
acacccgcagtcctagctattagag

SEQ ID NO: 96102 - DNA, 25 bp, Mus musculus
acacccgcagtcgtagctattagag

SEQ ID NO: 96103 - DNA, 25 bp, Mus musculus
acacccgcatccagtctatatagag

SEQ ID NO: 96104 - DNA, 25 bp, Mus musculus
acacccgcatccatggaataaattc

SEQ ID NO: 96105 - DNA, 25 bp, Mus musculus
acacccgcatcctgtctatatagag

SEQ ID NO: 96106 - DNA, 25 bp, Mus musculus
acacccgcatccttggaataaattc

SEQ ID NO: 96107 - DNA, 25 bp, Mus musculus
acacccgcatggcaccttggaggtg

SEQ ID NO: 96108 - DNA, 25 bp, Mus musculus
acacccgcatgggaccttggaggtg

SEQ ID NO: 96109 - DNA, 25 bp, Mus musculus
acacccgcttctctgggaagagaac

SEQ ID NO: 96110 - DNA, 25 bp, Mus musculus
acacccgcttctgtgggaagagaac

SEQ ID NO: 96111 - DNA, 25 bp, Mus musculus
acacccggctgaaacactgtgtggc

SEQ ID NO: 96112 - DNA, 25 bp, Mus musculus
acacccggctgatacactgtgtggc

SEQ ID NO: 96113 - DNA, 25 bp, Mus musculus
acacccggctgtaatgtgctttttc

SEQ ID NO: 96114 - DNA, 25 bp, Mus musculus
acacccggctgttatgtgctttttc

SEQ ID NO: 96115 - DNA, 25 bp, Mus musculus
acacccgggatccacatggccagag

SEQ ID NO: 96116 - DNA, 25 bp, Mus musculus
acacccgggatcgacatggccagag

SEQ ID NO: 96117 - DNA, 25 bp, Mus musculus
acacccgggccaagagctggtgaga

SEQ ID NO: 96118 - DNA, 25 bp, Mus musculus
acacccgggccatgagctggtgaga

SEQ ID NO: 96119 - DNA, 25 bp, Mus musculus
acacccgtaaggcacactagacagc

SEQ ID NO: 96120 - DNA, 25 bp, Mus musculus
acacccgtaagggacactagacagc

SEQ ID NO: 96121 - DNA, 25 bp, Mus musculus
acacccgtactgagtttctgagcaa

SEQ ID NO: 96122 - DNA, 25 bp, Mus musculus
acacccgtactgtgtttctgagcaa

SEQ ID NO: 96123 - DNA, 25 bp, Mus musculus
acacccgtcaaaaatgaatacccag

SEQ ID NO: 96124 - DNA, 25 bp, Mus musculus
acacccgtcaaatatgaatacccag

SEQ ID NO: 96125 - DNA, 25 bp, Mus musculus
acacccgtcatgctggtgggcacag

SEQ ID NO: 96126 - DNA, 25 bp, Mus musculus
acacccgtcatggtggtgggcacag

SEQ ID NO: 96127 - DNA, 25 bp, Mus musculus
acacccgtcttacgtttgttgcaat

SEQ ID NO: 96128 - DNA, 25 bp, Mus musculus
acacccgtcttaggtttgttgcaat

SEQ ID NO: 96129 - DNA, 25 bp, Mus musculus
acacccgtgcagctgtagtcacagt

SEQ ID NO: 96130 - DNA, 25 bp, Mus musculus
acacccgtgcaggtgtagtcacagt

SEQ ID NO: 96131 - DNA, 25 bp, Mus musculus
acacccgtggagattgtggctcaca

SEQ ID NO: 96132 - DNA, 25 bp, Mus musculus
acacccgtggagtttgtggctcaca

SEQ ID NO: 96133 - DNA, 25 bp, Mus musculus
acacccgtgggtctcaaactgacac

SEQ ID NO: 96134 - DNA, 25 bp, Mus musculus
acacccgtgggtgtcaaactgacac

SEQ ID NO: 96135 - DNA, 25 bp, Mus musculus
acacccgtgtgacgtaatcgcattg

SEQ ID NO: 96136 - DNA, 25 bp, Mus musculus
acacccgtgtgaggtaatcgcattg

SEQ ID NO: 96137 - DNA, 25 bp, Mus musculus
acacccgtgttacgctttgacaact

SEQ ID NO: 96138 - DNA, 25 bp, Mus musculus
acacccgtgttaggctttgacaact

SEQ ID NO: 96139 - DNA, 25 bp, Mus musculus
acaccctaagtgaggcctgcatgct

SEQ ID NO: 96140 - DNA, 25 bp, Mus musculus
acaccctaagtgtggcctgcatgct

SEQ ID NO: 96141 - DNA, 25 bp, Mus musculus
acaccctacccgacgtggctgaagt

SEQ ID NO: 96142 - DNA, 25 bp, Mus musculus
acaccctacccgtcgtggctgaagt

SEQ ID NO: 96143 - DNA, 25 bp, Mus musculus
acaccctagcttatttcgatgtgaa

SEQ ID NO: 96144 - DNA, 25 bp, Mus musculus
acaccctagcttttttcgatgtgaa

SEQ ID NO: 96145 - DNA, 25 bp, Mus musculus
acaccctaggtgcagacacaggctc

SEQ ID NO: 96146 - DNA, 25 bp, Mus musculus
acaccctaggtggagacacaggctc

SEQ ID NO: 96147 - DNA, 25 bp, Mus musculus
acaccctatcacatagacttgcaaa

SEQ ID NO: 96148 - DNA, 25 bp, Mus musculus
acaccctatcacttagacttgcaaa

SEQ ID NO: 96149 - DNA, 25 bp, Mus musculus
acaccctatcagattccagacatat

SEQ ID NO: 96150 - DNA, 25 bp, Mus musculus
acaccctatcagtttccagacatat

SEQ ID NO: 96151 - DNA, 25 bp, Mus musculus
acaccctatggcaagcttgggatac

SEQ ID NO: 96152 - DNA, 25 bp, Mus musculus
acaccctatggctagcttgggatac

SEQ ID NO: 96153 - DNA, 25 bp, Mus musculus
acaccctattgccttatttattctg

SEQ ID NO: 96154 - DNA, 25 bp, Mus musculus
acaccctattgcgttatttattctg

SEQ ID NO: 96155 - DNA, 25 bp, Mus musculus
acaccctcaaacaggaacttatcac

SEQ ID NO: 96156 - DNA, 25 bp, Mus musculus
acaccctcaaactggaacttatcac

SEQ ID NO: 96157 - DNA, 25 bp, Mus musculus
acaccctcaactatcagatcagcga

SEQ ID NO: 96158 - DNA, 25 bp, Mus musculus
acaccctcaactttcagatcagcga

SEQ ID NO: 96159 - DNA, 25 bp, Mus musculus
acaccctcagatccaagcactatat

SEQ ID NO: 96160 - DNA, 25 bp, Mus musculus
acaccctcagatgcaagcactatat

SEQ ID NO: 96161 - DNA, 25 bp, Mus musculus
acaccctcataccatatacatcaat

SEQ ID NO: 96162 - DNA, 25 bp, Mus musculus
acaccctcatacgatatacatcaat

SEQ ID NO: 96163 - DNA, 25 bp, Mus musculus
acaccctccgtgcatcgagtatgtt

SEQ ID NO: 96164 - DNA, 25 bp, Mus musculus
acaccctccgtggatcgagtatgtt

SEQ ID NO: 96165 - DNA, 25 bp, Mus musculus
acaccctcctgcagaaaacttatag

SEQ ID NO: 96166 - DNA, 25 bp, Mus musculus
acaccctcctgccaggatatagtag

SEQ ID NO: 96167 - DNA, 25 bp, Mus musculus
acaccctcctgcgaggatatagtag

SEQ ID NO: 96168 - DNA, 25 bp, Mus musculus
acaccctcctgctgaaaacttatag

SEQ ID NO: 96169 - DNA, 25 bp, Mus musculus
acaccctgagatcaagcactggcct

SEQ ID NO: 96170 - DNA, 25 bp, Mus musculus
acaccctgagatgaagcactggcct

SEQ ID NO: 96171 - DNA, 25 bp, Mus musculus
acaccctgaggaagcccacagtgtt

SEQ ID NO: 96172 - DNA, 25 bp, Mus musculus
acaccctgaggatgcccacagtgtt

SEQ ID NO: 96173 - DNA, 25 bp, Mus musculus
acaccctgagtgctgatttctgcta

SEQ ID NO: 96174 - DNA, 25 bp, Mus musculus
acaccctgagtggtgatttctgcta

SEQ ID NO: 96175 - DNA, 25 bp, Mus musculus
acaccctgatgtaagccttttgttc

SEQ ID NO: 96176 - DNA, 25 bp, Mus musculus
acaccctgatgttagccttttgttc

SEQ ID NO: 96177 - DNA, 25 bp, Mus musculus
acaccctgattgcacgtgcagctca

SEQ ID NO: 96178 - DNA, 25 bp, Mus musculus
acaccctgattggacgtgcagctca

SEQ ID NO: 96179 - DNA, 25 bp, Mus musculus
acaccctgccatacacaatgagaaa

SEQ ID NO: 96180 - DNA, 25 bp, Mus musculus
acaccctgccattcacaatgagaaa

SEQ ID NO: 96181 - DNA, 25 bp, Mus musculus
acaccctgcctgctttcactatgta

SEQ ID NO: 96182 - DNA, 25 bp, Mus musculus
acaccctgcctggtttcactatgta

SEQ ID NO: 96183 - DNA, 25 bp, Mus musculus
acaccctgctacaaacctgaaatgc

SEQ ID NO: 96184 - DNA, 25 bp, Mus musculus
acaccctgctactaacctgaaatgc

SEQ ID NO: 96185 - DNA, 25 bp, Mus musculus
acaccctggagcctatgaaagatat

SEQ ID NO: 96186 - DNA, 25 bp, Mus musculus
acaccctggagcgtatgaaagatat

SEQ ID NO: 96187 - DNA, 25 bp, Mus musculus
acaccctggccaatgatgtactgga

SEQ ID NO: 96188 - DNA, 25 bp, Mus musculus
acaccctggccattgatgtactgga

SEQ ID NO: 96189 - DNA, 25 bp, Mus musculus
acaccctggcctcgctagagatggc

SEQ ID NO: 96190 - DNA, 25 bp, Mus musculus
acaccctggcctggctagagatggc

SEQ ID NO: 96191 - DNA, 25 bp, Mus musculus
acaccctgggctcttatctggaatt

SEQ ID NO: 96192 - DNA, 25 bp, Mus musculus
acaccctgggctgttatctggaatt

SEQ ID NO: 96193 - DNA, 25 bp, Mus musculus
acaccctggtggaatttggatcatt

SEQ ID NO: 96194 - DNA, 25 bp, Mus musculus
acaccctggtggtatttggatcatt

SEQ ID NO: 96195 - DNA, 25 bp, Mus musculus
acaccctggtgtaggatggccgaca

SEQ ID NO: 96196 - DNA, 25 bp, Mus musculus
acaccctggtgttggatggccgaca

SEQ ID NO: 96197 - DNA, 25 bp, Mus musculus
acaccctggttaacacagacaagga

SEQ ID NO: 96198 - DNA, 25 bp, Mus musculus
acaccctggttatcacagacaagga

SEQ ID NO: 96199 - DNA, 25 bp, Mus musculus
acaccctgtatgactacaccacagt

SEQ ID NO: 96200 - DNA, 25 bp, Mus musculus
acaccctgtatgtctacaccacagt

SEQ ID NO: 96201 - DNA, 25 bp, Mus musculus
acaccctgtcttaacatagaatcaa

SEQ ID NO: 96202 - DNA, 25 bp, Mus musculus
acaccctgtctttacatagaatcaa

SEQ ID NO: 96203 - DNA, 25 bp, Mus musculus
acaccctgtggactgaagtgagcca

SEQ ID NO: 96204 - DNA, 25 bp, Mus musculus
acaccctgtggagtgaagtgagcca

SEQ ID NO: 96205 - DNA, 25 bp, Mus musculus
acaccctgtgttcttgtcttgcaga

SEQ ID NO: 96206 - DNA, 25 bp, Mus musculus
acaccctgtgttgttgtcttgcaga

SEQ ID NO: 96207 - DNA, 25 bp, Mus musculus
acaccctgttggaacagtatgcccg

SEQ ID NO: 96208 - DNA, 25 bp, Mus musculus
acaccctgttggtacagtatgcccg

SEQ ID NO: 96209 - DNA, 25 bp, Mus musculus
acacccttacacagtcttgaaactg

SEQ ID NO: 96210 - DNA, 25 bp, Mus musculus
acacccttacactgtcttgaaactg

SEQ ID NO: 96211 - DNA, 25 bp, Mus musculus
acacccttacagactgtctttttag

SEQ ID NO: 96212 - DNA, 25 bp, Mus musculus
acacccttacagtctgtctttttag

SEQ ID NO: 96213 - DNA, 25 bp, Mus musculus
acacccttcaggcagtgtgacctga

SEQ ID NO: 96214 - DNA, 25 bp, Mus musculus
acacccttcagggagtgtgacctga

SEQ ID NO: 96215 - DNA, 25 bp, Mus musculus
acacccttcatccgactttcttggt

SEQ ID NO: 96216 - DNA, 25 bp, Mus musculus
acacccttcatcggactttcttggt

SEQ ID NO: 96217 - DNA, 25 bp, Mus musculus
acacccttccatcattaaacattgt

SEQ ID NO: 96218 - DNA, 25 bp, Mus musculus
acacccttccatgattaaacattgt

SEQ ID NO: 96219 - DNA, 25 bp, Mus musculus
acacccttccgtcggtgagtggagc

SEQ ID NO: 96220 - DNA, 25 bp, Mus musculus
acacccttccgtgggtgagtggagc

SEQ ID NO: 96221 - DNA, 25 bp, Mus musculus
acacccttcctaacacagtaggatg

SEQ ID NO: 96222 - DNA, 25 bp, Mus musculus
acacccttcctatcacagtaggatg

SEQ ID NO: 96223 - DNA, 25 bp, Mus musculus
acacccttcgtgctttgctgcaaat

SEQ ID NO: 96224 - DNA, 25 bp, Mus musculus
acacccttcgtggtttgctgcaaat

SEQ ID NO: 96225 - DNA, 25 bp, Mus musculus
acacccttctaaagccttctgtgga

SEQ ID NO: 96226 - DNA, 25 bp, Mus musculus
acacccttctaatgccttctgtgga

SEQ ID NO: 96227 - DNA, 25 bp, Mus musculus
acacccttgcctcgtggtgagcagg

SEQ ID NO: 96228 - DNA, 25 bp, Mus musculus
acacccttgcctggtggtgagcagg

SEQ ID NO: 96229 - DNA, 25 bp, Mus musculus
acacccttgctcagcaaatgttttt

SEQ ID NO: 96230 - DNA, 25 bp, Mus musculus
acacccttgctctgcaaatgttttt

SEQ ID NO: 96231 - DNA, 25 bp, Mus musculus
acacccttggtgacttacgactaca

SEQ ID NO: 96232 - DNA, 25 bp, Mus musculus
acacccttggtgtcttacgactaca

SEQ ID NO: 96233 - DNA, 25 bp, Mus musculus
acacccttggttctcgatgtggaat

SEQ ID NO: 96234 - DNA, 25 bp, Mus musculus
acacccttggttgtcgatgtggaat

SEQ ID NO: 96235 - DNA, 25 bp, Mus musculus
acacccttgtgcaagaattctccag

SEQ ID NO: 96236 - DNA, 25 bp, Mus musculus
acacccttgtgctagaattctccag

SEQ ID NO: 96237 - DNA, 25 bp, Mus musculus
acaccgaaccctaacaactgaattg

SEQ ID NO: 96238 - DNA, 25 bp, Mus musculus
acaccgaacccttacaactgaattg

SEQ ID NO: 96239 - DNA, 25 bp, Mus musculus
acaccgaactgtatctgagctagga

SEQ ID NO: 96240 - DNA, 25 bp, Mus musculus
acaccgaactgtttctgagctagga

SEQ ID NO: 96241 - DNA, 25 bp, Mus musculus
acaccgactcctcttgggaccagat

SEQ ID NO: 96242 - DNA, 25 bp, Mus musculus
acaccgactcctgttgggaccagat

SEQ ID NO: 96243 - DNA, 25 bp, Mus musculus
acaccgacttgaagacaagggacag

SEQ ID NO: 96244 - DNA, 25 bp, Mus musculus
acaccgacttgatgacaagggacag

SEQ ID NO: 96245 - DNA, 25 bp, Mus musculus
acaccgagacgacaggagccccaga

SEQ ID NO: 96246 - DNA, 25 bp, Mus musculus
acaccgagacgagaggagccccaga

SEQ ID NO: 96247 - DNA, 25 bp, Mus musculus
acaccgagctgtaccggcacgcggg

SEQ ID NO: 96248 - DNA, 25 bp, Mus musculus
acaccgagctgttccggcacgcggg

SEQ ID NO: 96249 - DNA, 25 bp, Mus musculus
acaccgaggaccatcgcatcttgta

SEQ ID NO: 96250 - DNA, 25 bp, Mus musculus
acaccgaggaccttcgcatcttgta

SEQ ID NO: 96251 - DNA, 25 bp, Mus musculus
acaccgagtaagaggctgggcgata

SEQ ID NO: 96252 - DNA, 25 bp, Mus musculus
acaccgagtaagtggctgggcgata

SEQ ID NO: 96253 - DNA, 25 bp, Mus musculus
acaccgagtgtgaatctgggtcctg

SEQ ID NO: 96254 - DNA, 25 bp, Mus musculus
acaccgagtgtgtatctgggtcctg

SEQ ID NO: 96255 - DNA, 25 bp, Mus musculus
acaccgatgcaaaccacagaggtcg

SEQ ID NO: 96256 - DNA, 25 bp, Mus musculus
acaccgatgcaatccacagaggtcg

SEQ ID NO: 96257 - DNA, 25 bp, Mus musculus
acaccgcaacctacaaagctgtttg

SEQ ID NO: 96258 - DNA, 25 bp, Mus musculus
acaccgcaaccttcaaagctgtttg

SEQ ID NO: 96259 - DNA, 25 bp, Mus musculus
acaccgcatgcccaagtggctggat

SEQ ID NO: 96260 - DNA, 25 bp, Mus musculus
acaccgcatgccgaagtggctggat

SEQ ID NO: 96261 - DNA, 25 bp, Mus musculus
acaccgccctcgagtcagaggctga

SEQ ID NO: 96262 - DNA, 25 bp, Mus musculus
acaccgccctcgtgtcagaggctga

SEQ ID NO: 96263 - DNA, 25 bp, Mus musculus
acaccgcttcgtctcaattgtgact

SEQ ID NO: 96264 - DNA, 25 bp, Mus musculus
acaccgcttcgtgtcaattgtgact

SEQ ID NO: 96265 - DNA, 25 bp, Mus musculus
acaccggagagaaattcgcctgcga

SEQ ID NO: 96266 - DNA, 25 bp, Mus musculus
acaccggagagatattcgcctgcga

SEQ ID NO: 96267 - DNA, 25 bp, Mus musculus
acaccggagtgtcatccttctggcg

SEQ ID NO: 96268 - DNA, 25 bp, Mus musculus
acaccggagtgtgatccttctggcg

SEQ ID NO: 96269 - DNA, 25 bp, Mus musculus
acaccggcaattactgatgacacca

SEQ ID NO: 96270 - DNA, 25 bp, Mus musculus
acaccggcaatttctgatgacacca

SEQ ID NO: 96271 - DNA, 25 bp, Mus musculus
acaccggccaaaatcactggcaagg

SEQ ID NO: 96272 - DNA, 25 bp, Mus musculus
acaccggccaaattcactggcaagg

SEQ ID NO: 96273 - DNA, 25 bp, Mus musculus
acaccggcggcaaagacttggcttt

SEQ ID NO: 96274 - DNA, 25 bp, Mus musculus
acaccggcggcatagacttggcttt

SEQ ID NO: 96275 - DNA, 25 bp, Mus musculus
acaccgggtcatctccatctgttgc

SEQ ID NO: 96276 - DNA, 25 bp, Mus musculus
acaccgggtcatgtccatctgttgc

SEQ ID NO: 96277 - DNA, 25 bp, Mus musculus
acaccggttaccattatttcatgcg

SEQ ID NO: 96278 - DNA, 25 bp, Mus musculus
acaccggttacctttatttcatgcg

SEQ ID NO: 96279 - DNA, 25 bp, Mus musculus
acaccggttgtgcattttggaacag

SEQ ID NO: 96280 - DNA, 25 bp, Mus musculus
acaccggttgtggattttggaacag

SEQ ID NO: 96281 - DNA, 25 bp, Mus musculus
acaccggtttccagtaactagcatt

SEQ ID NO: 96282 - DNA, 25 bp, Mus musculus
acaccggtttcctgtaactagcatt

SEQ ID NO: 96283 - DNA, 25 bp, Mus musculus
acaccgtaacatatgggcctgcata

SEQ ID NO: 96284 - DNA, 25 bp, Mus musculus
acaccgtaacatttgggcctgcata

SEQ ID NO: 96285 - DNA, 25 bp, Mus musculus
acaccgtattaaaccaggctccata

SEQ ID NO: 96286 - DNA, 25 bp, Mus musculus
acaccgtattaatccaggctccata

SEQ ID NO: 96287 - DNA, 25 bp, Mus musculus
acaccgtcactgactttagacagat

SEQ ID NO: 96288 - DNA, 25 bp, Mus musculus
acaccgtcactgtctttagacagat

SEQ ID NO: 96289 - DNA, 25 bp, Mus musculus
acaccgtcctacatcttaatgtatt

SEQ ID NO: 96290 - DNA, 25 bp, Mus musculus
acaccgtcctacttcttaatgtatt

SEQ ID NO: 96291 - DNA, 25 bp, Mus musculus
acaccgtgaatgaccgaagtgacat

SEQ ID NO: 96292 - DNA, 25 bp, Mus musculus
acaccgtgaatgtccgaagtgacat

SEQ ID NO: 96293 - DNA, 25 bp, Mus musculus
acaccgtgcgtcattctcgttatta

SEQ ID NO: 96294 - DNA, 25 bp, Mus musculus
acaccgtgcgtctttctcgttatta

SEQ ID NO: 96295 - DNA, 25 bp, Mus musculus
acaccgtggcgacccaagtatttca

SEQ ID NO: 96296 - DNA, 25 bp, Mus musculus
acaccgtggcgagccaagtatttca

SEQ ID NO: 96297 - DNA, 25 bp, Mus musculus
acaccgtgtacacacttccagggaa

SEQ ID NO: 96298 - DNA, 25 bp, Mus musculus
acaccgtgtacagacttccagggaa

SEQ ID NO: 96299 - DNA, 25 bp, Mus musculus
acaccgtgtactccatcgctaagca

SEQ ID NO: 96300 - DNA, 25 bp, Mus musculus
acaccgtgtactgcatcgctaagca

SEQ ID NO: 96301 - DNA, 25 bp, Mus musculus
acaccgtgtgggactgcatcagaga

SEQ ID NO: 96302 - DNA, 25 bp, Mus musculus
acaccgtgtgggtctgcatcagaga

SEQ ID NO: 96303 - DNA, 25 bp, Mus musculus
acaccgtgtgttcactcaacctagt

SEQ ID NO: 96304 - DNA, 25 bp, Mus musculus
acaccgtgtgttgactcaacctagt

SEQ ID NO: 96305 - DNA, 25 bp, Mus musculus
acaccgttaaacatctggatctcgt

SEQ ID NO: 96306 - DNA, 25 bp, Mus musculus
acaccgttaaacttctggatctcgt

SEQ ID NO: 96307 - DNA, 25 bp, Mus musculus
acaccgttgggtacttgagcaccta

SEQ ID NO: 96308 - DNA, 25 bp, Mus musculus
acaccgttgggttcttgagcaccta

SEQ ID NO: 96309 - DNA, 25 bp, Mus musculus
acaccgtttctcagagtggaatgag

SEQ ID NO: 96310 - DNA, 25 bp, Mus musculus
acaccgtttctctgagtggaatgag

SEQ ID NO: 96311 - DNA, 25 bp, Mus musculus
acacctaaatttatgcttcaccttg

SEQ ID NO: 96312 - DNA, 25 bp, Mus musculus
acacctaaatttttgcttcaccttg

SEQ ID NO: 96313 - DNA, 25 bp, Mus musculus
acacctaacactcgatatgtggcag

SEQ ID NO: 96314 - DNA, 25 bp, Mus musculus
acacctaacactggatatgtggcag

SEQ ID NO: 96315 - DNA, 25 bp, Mus musculus
acacctaactgactgactgtcacag

SEQ ID NO: 96316 - DNA, 25 bp, Mus musculus
acacctaactgagtgactgtcacag

SEQ ID NO: 96317 - DNA, 25 bp, Mus musculus
acacctaagaacagtgtccctttag

SEQ ID NO: 96318 - DNA, 25 bp, Mus musculus
acacctaagaactgtgtccctttag

SEQ ID NO: 96319 - DNA, 25 bp, Mus musculus
acacctaagatcactgcaacctgga

SEQ ID NO: 96320 - DNA, 25 bp, Mus musculus
acacctaagatctctgcaacctgga

SEQ ID NO: 96321 - DNA, 25 bp, Mus musculus
acacctaatcccaacagaagtcaaa

SEQ ID NO: 96322 - DNA, 25 bp, Mus musculus
acacctaatccctacagaagtcaaa

SEQ ID NO: 96323 - DNA, 25 bp, Mus musculus
acacctaatgctatgtcttgtttca

SEQ ID NO: 96324 - DNA, 25 bp, Mus musculus
acacctaatgctttgtcttgtttca

SEQ ID NO: 96325 - DNA, 25 bp, Mus musculus
acacctacacttctccaactgaaga

SEQ ID NO: 96326 - DNA, 25 bp, Mus musculus
acacctacacttgtccaactgaaga

SEQ ID NO: 96327 - DNA, 25 bp, Mus musculus
acacctacaggaacccatactgtga

SEQ ID NO: 96328 - DNA, 25 bp, Mus musculus
acacctacaggatcccatactgtga

SEQ ID NO: 96329 - DNA, 25 bp, Mus musculus
acacctacatgtatgcactctggaa

SEQ ID NO: 96330 - DNA, 25 bp, Mus musculus
acacctacatgtttgcactctggaa

SEQ ID NO: 96331 - DNA, 25 bp, Mus musculus
acacctaccacgaagccattgctaa

SEQ ID NO: 96332 - DNA, 25 bp, Mus musculus
acacctaccacgtagccattgctaa

SEQ ID NO: 96333 - DNA, 25 bp, Mus musculus
acacctagctcacctttcatttttt

SEQ ID NO: 96334 - DNA, 25 bp, Mus musculus
acacctagctcagctttcatttttt

SEQ ID NO: 96335 - DNA, 25 bp, Mus musculus
acacctagctgacacccaaaaagaa

SEQ ID NO: 96336 - DNA, 25 bp, Mus musculus
acacctagctgagacccaaaaagaa

SEQ ID NO: 96337 - DNA, 25 bp, Mus musculus
acacctaggatgagctttgcctctg

SEQ ID NO: 96338 - DNA, 25 bp, Mus musculus
acacctaggatgtgctttgcctctg

SEQ ID NO: 96339 - DNA, 25 bp, Mus musculus
acacctaggctgatgttagtggagg

SEQ ID NO: 96340 - DNA, 25 bp, Mus musculus
acacctaggctgttgttagtggagg

SEQ ID NO: 96341 - DNA, 25 bp, Mus musculus
acacctatatctctagtatttcttg

SEQ ID NO: 96342 - DNA, 25 bp, Mus musculus
acacctatatctgtagtatttcttg

SEQ ID NO: 96343 - DNA, 25 bp, Mus musculus
acacctatccccacatgtggacatg

SEQ ID NO: 96344 - DNA, 25 bp, Mus musculus
acacctatcccctcatgtggacatg

SEQ ID NO: 96345 - DNA, 25 bp, Mus musculus
acacctatgaagctccattatgcca

SEQ ID NO: 96346 - DNA, 25 bp, Mus musculus
acacctatgaaggtccattatgcca

SEQ ID NO: 96347 - DNA, 25 bp, Mus musculus
acacctatgaataagatcaggccca

SEQ ID NO: 96348 - DNA, 25 bp, Mus musculus
acacctatgaattagatcaggccca

SEQ ID NO: 96349 - DNA, 25 bp, Mus musculus
acacctatgagactctgttctgtcc

SEQ ID NO: 96350 - DNA, 25 bp, Mus musculus
acacctatgagagtctgttctgtcc

SEQ ID NO: 96351 - DNA, 25 bp, Mus musculus
acacctatgcctatacaacctaagt

SEQ ID NO: 96352 - DNA, 25 bp, Mus musculus
acacctatgcctttacaacctaagt

SEQ ID NO: 96353 - DNA, 25 bp, Mus musculus
acacctatgggtcctggctagtgac

SEQ ID NO: 96354 - DNA, 25 bp, Mus musculus
acacctatgggtgctggctagtgac

SEQ ID NO: 96355 - DNA, 25 bp, Mus musculus
acacctattgtacgatccaaaataa

SEQ ID NO: 96356 - DNA, 25 bp, Mus musculus
acacctattgtaggatccaaaataa

SEQ ID NO: 96357 - DNA, 25 bp, Mus musculus
acacctcaaattccaaccacatttt

SEQ ID NO: 96358 - DNA, 25 bp, Mus musculus
acacctcaaattgcaaccacatttt

SEQ ID NO: 96359 - DNA, 25 bp, Mus musculus
acacctcacaggcatgggcggctta

SEQ ID NO: 96360 - DNA, 25 bp, Mus musculus
acacctcacagggatgggcggctta

SEQ ID NO: 96361 - DNA, 25 bp, Mus musculus
acacctcacattatctatcctttta

SEQ ID NO: 96362 - DNA, 25 bp, Mus musculus
acacctcacattttctatcctttta

SEQ ID NO: 96363 - DNA, 25 bp, Mus musculus
acacctcacggtctcagtgctggga

SEQ ID NO: 96364 - DNA, 25 bp, Mus musculus
acacctcacggtgtcagtgctggga

SEQ ID NO: 96365 - DNA, 25 bp, Mus musculus
acacctcactgtatctgggattctg

SEQ ID NO: 96366 - DNA, 25 bp, Mus musculus
acacctcactgtttctgggattctg

SEQ ID NO: 96367 - DNA, 25 bp, Mus musculus
acacctcagagaacacatcaatttt

SEQ ID NO: 96368 - DNA, 25 bp, Mus musculus
acacctcagagacattgtttccatt

SEQ ID NO: 96369 - DNA, 25 bp, Mus musculus
acacctcagagagattgtttccatt

SEQ ID NO: 96370 - DNA, 25 bp, Mus musculus
acacctcagagatcacatcaatttt

SEQ ID NO: 96371 - DNA, 25 bp, Mus musculus
acacctcagccaacagtgtgggcaa

SEQ ID NO: 96372 - DNA, 25 bp, Mus musculus
acacctcagccatcagtgtgggcaa

SEQ ID NO: 96373 - DNA, 25 bp, Mus musculus
acacctcagggtcaatctacttcgt

SEQ ID NO: 96374 - DNA, 25 bp, Mus musculus
acacctcagggtgaatctacttcgt

SEQ ID NO: 96375 - DNA, 25 bp, Mus musculus
acacctcagtagagctgtctgcatg

SEQ ID NO: 96376 - DNA, 25 bp, Mus musculus
acacctcagtagtgctgtctgcatg

SEQ ID NO: 96377 - DNA, 25 bp, Mus musculus
acacctcataggaatggaatttttt

SEQ ID NO: 96378 - DNA, 25 bp, Mus musculus
acacctcataggtatggaatttttt

SEQ ID NO: 96379 - DNA, 25 bp, Mus musculus
acacctcatcctattctggtgagac

SEQ ID NO: 96380 - DNA, 25 bp, Mus musculus
acacctcatccttttctggtgagac

SEQ ID NO: 96381 - DNA, 25 bp, Mus musculus
acacctcatcgtcgtgctggacaag

SEQ ID NO: 96382 - DNA, 25 bp, Mus musculus
acacctcatcgtggtgctggacaag

SEQ ID NO: 96383 - DNA, 25 bp, Mus musculus
acacctccacacagaacgaacgtag

SEQ ID NO: 96384 - DNA, 25 bp, Mus musculus
acacctccacactgaacgaacgtag

SEQ ID NO: 96385 - DNA, 25 bp, Mus musculus
acacctccacagaatgttttgccaa

SEQ ID NO: 96386 - DNA, 25 bp, Mus musculus
acacctccacagtatgttttgccaa

SEQ ID NO: 96387 - DNA, 25 bp, Mus musculus
acacctccccgaacgagattgaagg

SEQ ID NO: 96388 - DNA, 25 bp, Mus musculus
acacctccccgatcgagattgaagg

SEQ ID NO: 96389 - DNA, 25 bp, Mus musculus
acacctccctggatgatccaagagg

SEQ ID NO: 96390 - DNA, 25 bp, Mus musculus
acacctccctggttgatccaagagg

SEQ ID NO: 96391 - DNA, 25 bp, Mus musculus
acacctccgattactctgggaaggg

SEQ ID NO: 96392 - DNA, 25 bp, Mus musculus
acacctccgatttctctgggaaggg

SEQ ID NO: 96393 - DNA, 25 bp, Mus musculus
acacctcctaccagttcctgtgagt

SEQ ID NO: 96394 - DNA, 25 bp, Mus musculus
acacctcctacctgttcctgtgagt

SEQ ID NO: 96395 - DNA, 25 bp, Mus musculus
acacctcctgacctaaatagtccaa

SEQ ID NO: 96396 - DNA, 25 bp, Mus musculus
acacctcctgacgtaaatagtccaa

SEQ ID NO: 96397 - DNA, 25 bp, Mus musculus
acacctccttgaagtttactctaat

SEQ ID NO: 96398 - DNA, 25 bp, Mus musculus
acacctccttgatgtttactctaat

SEQ ID NO: 96399 - DNA, 25 bp, Mus musculus
acacctcgagggagcccattttttg

SEQ ID NO: 96400 - DNA, 25 bp, Mus musculus
acacctcgagggtgcccattttttg

SEQ ID NO: 96401 - DNA, 25 bp, Mus musculus
acacctcgggcgagaggagaccagt

SEQ ID NO: 96402 - DNA, 25 bp, Mus musculus
acacctcgggcgtgaggagaccagt

SEQ ID NO: 96403 - DNA, 25 bp, Mus musculus
acacctctaaccattgacccataag

SEQ ID NO: 96404 - DNA, 25 bp, Mus musculus
acacctctaacctttgacccataag

SEQ ID NO: 96405 - DNA, 25 bp, Mus musculus
acacctctaatccaagcactgcaga

SEQ ID NO: 96406 - DNA, 25 bp, Mus musculus
acacctctaatcgaagcactgcaga

SEQ ID NO: 96407 - DNA, 25 bp, Mus musculus
acacctctaattccagcacttgggt

SEQ ID NO: 96408 - DNA, 25 bp, Mus musculus
acacctctaattgcagcacttgggt

SEQ ID NO: 96409 - DNA, 25 bp, Mus musculus
acacctctagtgaacatctctgtaa

SEQ ID NO: 96410 - DNA, 25 bp, Mus musculus
acacctctagtgcacttcttgatgc

SEQ ID NO: 96411 - DNA, 25 bp, Mus musculus
acacctctagtggacttcttgatgc

SEQ ID NO: 96412 - DNA, 25 bp, Mus musculus
acacctctagtgtacatctctgtaa

SEQ ID NO: 96413 - DNA, 25 bp, Mus musculus
acacctctcggcatagtcttaagag

SEQ ID NO: 96414 - DNA, 25 bp, Mus musculus
acacctctcggcttagtcttaagag

SEQ ID NO: 96415 - DNA, 25 bp, Mus musculus
acacctctcgtgatcagttctatta

SEQ ID NO: 96416 - DNA, 25 bp, Mus musculus
acacctctcgtgttcagttctatta

SEQ ID NO: 96417 - DNA, 25 bp, Mus musculus
acacctctctttcagtacctgtggg

SEQ ID NO: 96418 - DNA, 25 bp, Mus musculus
acacctctctttctttcctgtgaca

SEQ ID NO: 96419 - DNA, 25 bp, Mus musculus
acacctctctttgagtacctgtggg

SEQ ID NO: 96420 - DNA, 25 bp, Mus musculus
acacctctctttgtttcctgtgaca

SEQ ID NO: 96421 - DNA, 25 bp, Mus musculus
acacctctgactctctttggtatat

SEQ ID NO: 96422 - DNA, 25 bp, Mus musculus
acacctctgactgtctttggtatat

SEQ ID NO: 96423 - DNA, 25 bp, Mus musculus
acacctctgagcaagatggcacaca

SEQ ID NO: 96424 - DNA, 25 bp, Mus musculus
acacctctgagctagatggcacaca

SEQ ID NO: 96425 - DNA, 25 bp, Mus musculus
acacctctgaggcaccggtgaatgg

SEQ ID NO: 96426 - DNA, 25 bp, Mus musculus
acacctctgagggaccggtgaatgg

SEQ ID NO: 96427 - DNA, 25 bp, Mus musculus
acacctctgcttcagaaaaccttag

SEQ ID NO: 96428 - DNA, 25 bp, Mus musculus
acacctctgcttgagaaaaccttag

SEQ ID NO: 96429 - DNA, 25 bp, Mus musculus
acacctctggacctggctaagacaa

SEQ ID NO: 96430 - DNA, 25 bp, Mus musculus
acacctctggacgtggctaagacaa

SEQ ID NO: 96431 - DNA, 25 bp, Mus musculus
acacctctggctagagtgcatctat

SEQ ID NO: 96432 - DNA, 25 bp, Mus musculus
acacctctggcttgagtgcatctat

SEQ ID NO: 96433 - DNA, 25 bp, Mus musculus
acacctctgggaagatcatgtagaa

SEQ ID NO: 96434 - DNA, 25 bp, Mus musculus
acacctctgggatgatcatgtagaa

SEQ ID NO: 96435 - DNA, 25 bp, Mus musculus
acacctctggttctttcaaagtttg

SEQ ID NO: 96436 - DNA, 25 bp, Mus musculus
acacctctggttgtttcaaagtttg

SEQ ID NO: 96437 - DNA, 25 bp, Mus musculus
acacctctgtccctcgggaagatgg

SEQ ID NO: 96438 - DNA, 25 bp, Mus musculus
acacctctgtccgtcgggaagatgg

SEQ ID NO: 96439 - DNA, 25 bp, Mus musculus
acacctctgtttatctaagatctct

SEQ ID NO: 96440 - DNA, 25 bp, Mus musculus
acacctctgtttttctaagatctct

SEQ ID NO: 96441 - DNA, 25 bp, Mus musculus
acacctcttattcacctgccgaagc

SEQ ID NO: 96442 - DNA, 25 bp, Mus musculus
acacctcttattgacctgccgaagc

SEQ ID NO: 96443 - DNA, 25 bp, Mus musculus
acacctcttcctatgaggccataaa

SEQ ID NO: 96444 - DNA, 25 bp, Mus musculus
acacctcttcctttgaggccataaa

SEQ ID NO: 96445 - DNA, 25 bp, Mus musculus
acacctgaaacacatcactgaggat

SEQ ID NO: 96446 - DNA, 25 bp, Mus musculus
acacctgaaacagatcactgaggat

SEQ ID NO: 96447 - DNA, 25 bp, Mus musculus
acacctgaacatagacacatacaca

SEQ ID NO: 96448 - DNA, 25 bp, Mus musculus
acacctgaacattgacacatacaca

SEQ ID NO: 96449 - DNA, 25 bp, Mus musculus
acacctgaactgattttcccatggt

SEQ ID NO: 96450 - DNA, 25 bp, Mus musculus
acacctgaactgtttttcccatggt

SEQ ID NO: 96451 - DNA, 25 bp, Mus musculus
acacctgaagggactgctctgactg

SEQ ID NO: 96452 - DNA, 25 bp, Mus musculus
acacctgaagggtctgctctgactg

SEQ ID NO: 96453 - DNA, 25 bp, Mus musculus
acacctgaatcaatacccacaaaca

SEQ ID NO: 96454 - DNA, 25 bp, Mus musculus
acacctgaatcattacccacaaaca

SEQ ID NO: 96455 - DNA, 25 bp, Mus musculus
acacctgacctgaggaagcttggtt

SEQ ID NO: 96456 - DNA, 25 bp, Mus musculus
acacctgacctgtggaagcttggtt

SEQ ID NO: 96457 - DNA, 25 bp, Mus musculus
acacctgactcaacctggcagagga

SEQ ID NO: 96458 - DNA, 25 bp, Mus musculus
acacctgactcatcctggcagagga

SEQ ID NO: 96459 - DNA, 25 bp, Mus musculus
acacctgacttgagaggctttcatt

SEQ ID NO: 96460 - DNA, 25 bp, Mus musculus
acacctgacttgtgaggctttcatt

SEQ ID NO: 96461 - DNA, 25 bp, Mus musculus
acacctgagctgaggttttgatact

SEQ ID NO: 96462 - DNA, 25 bp, Mus musculus
acacctgagctgtggttttgatact

SEQ ID NO: 96463 - DNA, 25 bp, Mus musculus
acacctgaggatatcttttgatttc

SEQ ID NO: 96464 - DNA, 25 bp, Mus musculus
acacctgaggatcatggctttccct

SEQ ID NO: 96465 - DNA, 25 bp, Mus musculus
acacctgaggatgatggctttccct

SEQ ID NO: 96466 - DNA, 25 bp, Mus musculus
acacctgaggatttcttttgatttc

SEQ ID NO: 96467 - DNA, 25 bp, Mus musculus
acacctgaggtaatagtggccgact

SEQ ID NO: 96468 - DNA, 25 bp, Mus musculus
acacctgaggtattagtggccgact

SEQ ID NO: 96469 - DNA, 25 bp, Mus musculus
acacctgagtataggctccttctgg

SEQ ID NO: 96470 - DNA, 25 bp, Mus musculus
acacctgagtattggctccttctgg

SEQ ID NO: 96471 - DNA, 25 bp, Mus musculus
acacctgcaacaagaatagtaagac

SEQ ID NO: 96472 - DNA, 25 bp, Mus musculus
acacctgcaacatgaatagtaagac

SEQ ID NO: 96473 - DNA, 25 bp, Mus musculus
acacctgcaaggactgtgggactcg

SEQ ID NO: 96474 - DNA, 25 bp, Mus musculus
acacctgcaaggtctgtgggactcg

SEQ ID NO: 96475 - DNA, 25 bp, Mus musculus
acacctgcactgacgggagctccgg

SEQ ID NO: 96476 - DNA, 25 bp, Mus musculus
acacctgcactgtcgggagctccgg

SEQ ID NO: 96477 - DNA, 25 bp, Mus musculus
acacctgcagatcttgagtaacaac

SEQ ID NO: 96478 - DNA, 25 bp, Mus musculus
acacctgcagatgttgagtaacaac

SEQ ID NO: 96479 - DNA, 25 bp, Mus musculus
acacctgcagggattatcaggcaca

SEQ ID NO: 96480 - DNA, 25 bp, Mus musculus
acacctgcagggtttatcaggcaca

SEQ ID NO: 96481 - DNA, 25 bp, Mus musculus
acacctgcaggtacaacaatttaaa

SEQ ID NO: 96482 - DNA, 25 bp, Mus musculus
acacctgcaggttcaacaatttaaa

SEQ ID NO: 96483 - DNA, 25 bp, Mus musculus
acacctgcatttagtgcgtctatgc

SEQ ID NO: 96484 - DNA, 25 bp, Mus musculus
acacctgcattttgtgcgtctatgc

SEQ ID NO: 96485 - DNA, 25 bp, Mus musculus
acacctgcccaccagtattatttat

SEQ ID NO: 96486 - DNA, 25 bp, Mus musculus
acacctgcccacgagtattatttat

SEQ ID NO: 96487 - DNA, 25 bp, Mus musculus
acacctgcccttatgttaatacata

SEQ ID NO: 96488 - DNA, 25 bp, Mus musculus
acacctgcccttttgttaatacata

SEQ ID NO: 96489 - DNA, 25 bp, Mus musculus
acacctgctaacaaacgaatggaag

SEQ ID NO: 96490 - DNA, 25 bp, Mus musculus
acacctgctaactaacgaatggaag

SEQ ID NO: 96491 - DNA, 25 bp, Mus musculus
acacctgctggacccggacgctgag

SEQ ID NO: 96492 - DNA, 25 bp, Mus musculus
acacctgctggagccggacgctgag

SEQ ID NO: 96493 - DNA, 25 bp, Mus musculus
acacctgcttctctttggtgtcaaa

SEQ ID NO: 96494 - DNA, 25 bp, Mus musculus
acacctgcttctgtttggtgtcaaa

SEQ ID NO: 96495 - DNA, 25 bp, Mus musculus
acacctgcttgccttttagcttatt

SEQ ID NO: 96496 - DNA, 25 bp, Mus musculus
acacctgcttgcgttttagcttatt

SEQ ID NO: 96497 - DNA, 25 bp, Mus musculus
acacctggaacaccactgccatata

SEQ ID NO: 96498 - DNA, 25 bp, Mus musculus
acacctggaacagcactgccatata

SEQ ID NO: 96499 - DNA, 25 bp, Mus musculus
acacctggaaccaggttactccact

SEQ ID NO: 96500 - DNA, 25 bp, Mus musculus
acacctggaacctggttactccact

SEQ ID NO: 96501 - DNA, 25 bp, Mus musculus
acacctggagtgaacctgagattat

SEQ ID NO: 96502 - DNA, 25 bp, Mus musculus
acacctggagtgtacctgagattat

SEQ ID NO: 96503 - DNA, 25 bp, Mus musculus
acacctggattgatatgagcttatt

SEQ ID NO: 96504 - DNA, 25 bp, Mus musculus
acacctggattgttatgagcttatt

SEQ ID NO: 96505 - DNA, 25 bp, Mus musculus
acacctggcagaaatgacacctgaa

SEQ ID NO: 96506 - DNA, 25 bp, Mus musculus
acacctggcagatatgacacctgaa

SEQ ID NO: 96507 - DNA, 25 bp, Mus musculus
acacctggcattaggttttgtaaat

SEQ ID NO: 96508 - DNA, 25 bp, Mus musculus
acacctggcatttggttttgtaaat

SEQ ID NO: 96509 - DNA, 25 bp, Mus musculus
acacctggcccaaattgaagctttt

SEQ ID NO: 96510 - DNA, 25 bp, Mus musculus
acacctggcccatattgaagctttt

SEQ ID NO: 96511 - DNA, 25 bp, Mus musculus
acacctggctacatctgttttttca

SEQ ID NO: 96512 - DNA, 25 bp, Mus musculus
acacctggctacttctgttttttca

SEQ ID NO: 96513 - DNA, 25 bp, Mus musculus
acacctggctctcaggtttgttcag

SEQ ID NO: 96514 - DNA, 25 bp, Mus musculus
acacctggctctcgtaaagaccttc

SEQ ID NO: 96515 - DNA, 25 bp, Mus musculus
acacctggctctgaggtttgttcag

SEQ ID NO: 96516 - DNA, 25 bp, Mus musculus
acacctggctctggtaaagaccttc

SEQ ID NO: 96517 - DNA, 25 bp, Mus musculus
acacctggcttaatgtctgtccttt

SEQ ID NO: 96518 - DNA, 25 bp, Mus musculus
acacctggcttacggtggcgtacct

SEQ ID NO: 96519 - DNA, 25 bp, Mus musculus
acacctggcttagggtggcgtacct

SEQ ID NO: 96520 - DNA, 25 bp, Mus musculus
acacctggcttattgtctgtccttt

SEQ ID NO: 96521 - DNA, 25 bp, Mus musculus
acacctgggcccaatttattgataa

SEQ ID NO: 96522 - DNA, 25 bp, Mus musculus
acacctgggccctatttattgataa

SEQ ID NO: 96523 - DNA, 25 bp, Mus musculus
acacctgggctaatctcttgtcacg

SEQ ID NO: 96524 - DNA, 25 bp, Mus musculus
acacctgggctattctcttgtcacg

SEQ ID NO: 96525 - DNA, 25 bp, Mus musculus
acacctgggcttacaagtatgagag

SEQ ID NO: 96526 - DNA, 25 bp, Mus musculus
acacctgggctttcaagtatgagag

SEQ ID NO: 96527 - DNA, 25 bp, Mus musculus
acacctggtatccttctggttagaa

SEQ ID NO: 96528 - DNA, 25 bp, Mus musculus
acacctggtatcgttctggttagaa

SEQ ID NO: 96529 - DNA, 25 bp, Mus musculus
acacctggtgcacatggttcttcag

SEQ ID NO: 96530 - DNA, 25 bp, Mus musculus
acacctggtgcagatggttcttcag

SEQ ID NO: 96531 - DNA, 25 bp, Mus musculus
acacctggtggccactgagcctggt

SEQ ID NO: 96532 - DNA, 25 bp, Mus musculus
acacctggtggcgactgagcctggt

SEQ ID NO: 96533 - DNA, 25 bp, Mus musculus
acacctggtggtagcataagcgagt

SEQ ID NO: 96534 - DNA, 25 bp, Mus musculus
acacctggtggttgcataagcgagt

SEQ ID NO: 96535 - DNA, 25 bp, Mus musculus
acacctggttgaaacatcactgtat

SEQ ID NO: 96536 - DNA, 25 bp, Mus musculus
acacctggttgatacatcactgtat

SEQ ID NO: 96537 - DNA, 25 bp, Mus musculus
acacctgtaaaaatggttgcacatc

SEQ ID NO: 96538 - DNA, 25 bp, Mus musculus
acacctgtaaaattggttgcacatc

SEQ ID NO: 96539 - DNA, 25 bp, Mus musculus
acacctgtaaccaggcacttgaaaa

SEQ ID NO: 96540 - DNA, 25 bp, Mus musculus
acacctgtaacctggcacttgaaaa

SEQ ID NO: 96541 - DNA, 25 bp, Mus musculus
acacctgtaatactaccacttgaga

SEQ ID NO: 96542 - DNA, 25 bp, Mus musculus
acacctgtaatagtaccacttgaga

SEQ ID NO: 96543 - DNA, 25 bp, Mus musculus
acacctgtacctcagatctgttcat

SEQ ID NO: 96544 - DNA, 25 bp, Mus musculus
acacctgtacctgagatctgttcat

SEQ ID NO: 96545 - DNA, 25 bp, Mus musculus
acacctgtactcatacaaacacaca

SEQ ID NO: 96546 - DNA, 25 bp, Mus musculus
acacctgtactcttacaaacacaca

SEQ ID NO: 96547 - DNA, 25 bp, Mus musculus
acacctgtagaacgaagcctaacat

SEQ ID NO: 96548 - DNA, 25 bp, Mus musculus
acacctgtagaaggaagcctaacat

SEQ ID NO: 96549 - DNA, 25 bp, Mus musculus
acacctgtaggtccactgtgggctt

SEQ ID NO: 96550 - DNA, 25 bp, Mus musculus
acacctgtaggtgcactgtgggctt

SEQ ID NO: 96551 - DNA, 25 bp, Mus musculus
acacctgtccggacctgtgggtaga

SEQ ID NO: 96552 - DNA, 25 bp, Mus musculus
acacctgtccggtcctgtgggtaga

SEQ ID NO: 96553 - DNA, 25 bp, Mus musculus
acacctgtcctgacccgggaagtga

SEQ ID NO: 96554 - DNA, 25 bp, Mus musculus
acacctgtcctgagggaaaagcctt

SEQ ID NO: 96555 - DNA, 25 bp, Mus musculus
acacctgtcctgtcccgggaagtga

SEQ ID NO: 96556 - DNA, 25 bp, Mus musculus
acacctgtcctgtgggaaaagcctt

SEQ ID NO: 96557 - DNA, 25 bp, Mus musculus
acacctgtcgtcagaactgtgcaga

SEQ ID NO: 96558 - DNA, 25 bp, Mus musculus
acacctgtcgtctgaactgtgcaga

SEQ ID NO: 96559 - DNA, 25 bp, Mus musculus
acacctgtctttcggtccctgtttg

SEQ ID NO: 96560 - DNA, 25 bp, Mus musculus
acacctgtctttgggtccctgtttg

SEQ ID NO: 96561 - DNA, 25 bp, Mus musculus
acacctgtgaagagttgcagctcat

SEQ ID NO: 96562 - DNA, 25 bp, Mus musculus
acacctgtgaagtgttgcagctcat

SEQ ID NO: 96563 - DNA, 25 bp, Mus musculus
acacctgtgatgaacttttctctct

SEQ ID NO: 96564 - DNA, 25 bp, Mus musculus
acacctgtgatgtacttttctctct

SEQ ID NO: 96565 - DNA, 25 bp, Mus musculus
acacctgtgattaggcaactggtca

SEQ ID NO: 96566 - DNA, 25 bp, Mus musculus
acacctgtgatttggcaactggtca

SEQ ID NO: 96567 - DNA, 25 bp, Mus musculus
acacctgtgctccttgaaagacatc

SEQ ID NO: 96568 - DNA, 25 bp, Mus musculus
acacctgtgctcgttgaaagacatc

SEQ ID NO: 96569 - DNA, 25 bp, Mus musculus
acacctgtgtccagaagccttcgta

SEQ ID NO: 96570 - DNA, 25 bp, Mus musculus
acacctgtgtcctgaagccttcgta

SEQ ID NO: 96571 - DNA, 25 bp, Mus musculus
acacctgtgtctatggctggctggc

SEQ ID NO: 96572 - DNA, 25 bp, Mus musculus
acacctgtgtctttggctggctggc

SEQ ID NO: 96573 - DNA, 25 bp, Mus musculus
acacctgtgtgtcagactgggagct

SEQ ID NO: 96574 - DNA, 25 bp, Mus musculus
acacctgtgtgtgagactgggagct

SEQ ID NO: 96575 - DNA, 25 bp, Mus musculus
acacctgtgttaatctctgacctga

SEQ ID NO: 96576 - DNA, 25 bp, Mus musculus
acacctgtgttattctctgacctga

SEQ ID NO: 96577 - DNA, 25 bp, Mus musculus
acacctgttcctctctgtgaggctg

SEQ ID NO: 96578 - DNA, 25 bp, Mus musculus
acacctgttcctgtctgtgaggctg

SEQ ID NO: 96579 - DNA, 25 bp, Mus musculus
acacctgttgggacctatttgaagc

SEQ ID NO: 96580 - DNA, 25 bp, Mus musculus
acacctgttgggtcctatttgaagc

SEQ ID NO: 96581 - DNA, 25 bp, Mus musculus
acacctgttgtgcaccccatcgggt

SEQ ID NO: 96582 - DNA, 25 bp, Mus musculus
acacctgttgtggaccccatcgggt

SEQ ID NO: 96583 - DNA, 25 bp, Mus musculus
acacctgtttccaaatgatgggaca

SEQ ID NO: 96584 - DNA, 25 bp, Mus musculus
acacctgtttcctaatgatgggaca

SEQ ID NO: 96585 - DNA, 25 bp, Mus musculus
acaccttaccttagcctgaaggatt

SEQ ID NO: 96586 - DNA, 25 bp, Mus musculus
acaccttacctttgcctgaaggatt

SEQ ID NO: 96587 - DNA, 25 bp, Mus musculus
acaccttagggaccgcttcctgggt

SEQ ID NO: 96588 - DNA, 25 bp, Mus musculus
acaccttagggagcgcttcctgggt

SEQ ID NO: 96589 - DNA, 25 bp, Mus musculus
acaccttagtcaactacttggatct

SEQ ID NO: 96590 - DNA, 25 bp, Mus musculus
acaccttagtcatctacttggatct

SEQ ID NO: 96591 - DNA, 25 bp, Mus musculus
acaccttatcctagtccacatggag

SEQ ID NO: 96592 - DNA, 25 bp, Mus musculus
acaccttatccttgtccacatggag

SEQ ID NO: 96593 - DNA, 25 bp, Mus musculus
acaccttatctaacaaaatctggct

SEQ ID NO: 96594 - DNA, 25 bp, Mus musculus
acaccttatctatcaaaatctggct

SEQ ID NO: 96595 - DNA, 25 bp, Mus musculus
acaccttatctgagctatattagta

SEQ ID NO: 96596 - DNA, 25 bp, Mus musculus
acaccttatctgtgctatattagta

SEQ ID NO: 96597 - DNA, 25 bp, Mus musculus
acaccttcagttaccacagatcttg

SEQ ID NO: 96598 - DNA, 25 bp, Mus musculus
acaccttcagtttccacagatcttg

SEQ ID NO: 96599 - DNA, 25 bp, Mus musculus
acaccttcattcaggtagagcacct

SEQ ID NO: 96600 - DNA, 25 bp, Mus musculus
acaccttcattcagtgtctgtgcca

SEQ ID NO: 96601 - DNA, 25 bp, Mus musculus
acaccttcattctggtagagcacct

SEQ ID NO: 96602 - DNA, 25 bp, Mus musculus
acaccttcattctgtgtctgtgcca

SEQ ID NO: 96603 - DNA, 25 bp, Mus musculus
acaccttccaaacctgctttgtcaa

SEQ ID NO: 96604 - DNA, 25 bp, Mus musculus
acaccttccaaagctgctttgtcaa

SEQ ID NO: 96605 - DNA, 25 bp, Mus musculus
acaccttccatcagggatttgcagg

SEQ ID NO: 96606 - DNA, 25 bp, Mus musculus
acaccttccatctgggatttgcagg

SEQ ID NO: 96607 - DNA, 25 bp, Mus musculus
acaccttcccgcaggaaaagcgcgt

SEQ ID NO: 96608 - DNA, 25 bp, Mus musculus
acaccttcccgctggaaaagcgcgt

SEQ ID NO: 96609 - DNA, 25 bp, Mus musculus
acaccttcctgaatcgagcagagaa

SEQ ID NO: 96610 - DNA, 25 bp, Mus musculus
acaccttcctgattcgagcagagaa

SEQ ID NO: 96611 - DNA, 25 bp, Mus musculus
acaccttcggccagtggcctttgca

SEQ ID NO: 96612 - DNA, 25 bp, Mus musculus
acaccttcggcctgtggcctttgca

SEQ ID NO: 96613 - DNA, 25 bp, Mus musculus
acaccttctgcaagtactccgagga

SEQ ID NO: 96614 - DNA, 25 bp, Mus musculus
acaccttctgcatgtactccgagga

SEQ ID NO: 96615 - DNA, 25 bp, Mus musculus
acaccttctggcctgcactaaaaga

SEQ ID NO: 96616 - DNA, 25 bp, Mus musculus
acaccttctggcgtgcactaaaaga

SEQ ID NO: 96617 - DNA, 25 bp, Mus musculus
acaccttgagccagccactgttgtt

SEQ ID NO: 96618 - DNA, 25 bp, Mus musculus
acaccttgagcctgccactgttgtt

SEQ ID NO: 96619 - DNA, 25 bp, Mus musculus
acaccttgagtcacactgagagctg

SEQ ID NO: 96620 - DNA, 25 bp, Mus musculus
acaccttgagtctcactgagagctg

SEQ ID NO: 96621 - DNA, 25 bp, Mus musculus
acaccttgatccaaagcagtgctcc

SEQ ID NO: 96622 - DNA, 25 bp, Mus musculus
acaccttgatcctaagcagtgctcc

SEQ ID NO: 96623 - DNA, 25 bp, Mus musculus
acaccttgggttcatttcaatggct

SEQ ID NO: 96624 - DNA, 25 bp, Mus musculus
acaccttgggttgatttcaatggct

SEQ ID NO: 96625 - DNA, 25 bp, Mus musculus
acaccttggtgcaatccttttgaaa

SEQ ID NO: 96626 - DNA, 25 bp, Mus musculus
acaccttggtgctatccttttgaaa

SEQ ID NO: 96627 - DNA, 25 bp, Mus musculus
acaccttgtttaatgtcttctcaga

SEQ ID NO: 96628 - DNA, 25 bp, Mus musculus
acaccttgtttattgtcttctcaga

SEQ ID NO: 96629 - DNA, 25 bp, Mus musculus
acacctttaaatccctgagctgaag

SEQ ID NO: 96630 - DNA, 25 bp, Mus musculus
acacctttaaatgcctgagctgaag

SEQ ID NO: 96631 - DNA, 25 bp, Mus musculus
acacctttatagaaccagaaacgtg

SEQ ID NO: 96632 - DNA, 25 bp, Mus musculus
acacctttatagtaccagaaacgtg

SEQ ID NO: 96633 - DNA, 25 bp, Mus musculus
acacctttcactcaaccatttggga

SEQ ID NO: 96634 - DNA, 25 bp, Mus musculus
acacctttcactgaaccatttggga

SEQ ID NO: 96635 - DNA, 25 bp, Mus musculus
acacctttcaggactttgatgagtc

SEQ ID NO: 96636 - DNA, 25 bp, Mus musculus
acacctttcaggtctttgatgagtc

SEQ ID NO: 96637 - DNA, 25 bp, Mus musculus
acacctttcatcacaacactggaga

SEQ ID NO: 96638 - DNA, 25 bp, Mus musculus
acacctttcatctcaacactggaga

SEQ ID NO: 96639 - DNA, 25 bp, Mus musculus
acacctttcatgatgatttactgct

SEQ ID NO: 96640 - DNA, 25 bp, Mus musculus
acacctttcatgttgatttactgct

SEQ ID NO: 96641 - DNA, 25 bp, Mus musculus
acacctttccaaatcttcgatgtct

SEQ ID NO: 96642 - DNA, 25 bp, Mus musculus
acacctttccaattcttcgatgtct

SEQ ID NO: 96643 - DNA, 25 bp, Mus musculus
acacctttccctaataacacacagg

SEQ ID NO: 96644 - DNA, 25 bp, Mus musculus
acacctttcccttataacacacagg

SEQ ID NO: 96645 - DNA, 25 bp, Mus musculus
acacctttcctcattattatacatg

SEQ ID NO: 96646 - DNA, 25 bp, Mus musculus
acacctttcctctttattatacatg

SEQ ID NO: 96647 - DNA, 25 bp, Mus musculus
acacctttctgtctctgattcaaaa

SEQ ID NO: 96648 - DNA, 25 bp, Mus musculus
acacctttctgtgtctgattcaaaa

SEQ ID NO: 96649 - DNA, 25 bp, Mus musculus
acacctttcttgcatgatgaactga

SEQ ID NO: 96650 - DNA, 25 bp, Mus musculus
acacctttcttggatgatgaactga

SEQ ID NO: 96651 - DNA, 25 bp, Mus musculus
acacctttgacaccaacggcgacag

SEQ ID NO: 96652 - DNA, 25 bp, Mus musculus
acacctttgacagcaacggcgacag

SEQ ID NO: 96653 - DNA, 25 bp, Mus musculus
acacctttgctccatatatgagtta

SEQ ID NO: 96654 - DNA, 25 bp, Mus musculus
acacctttgctcgatatatgagtta

SEQ ID NO: 96655 - DNA, 25 bp, Mus musculus
acacgaactataaaaaagggtcata

SEQ ID NO: 96656 - DNA, 25 bp, Mus musculus
acacgaactatataaaagggtcata

SEQ ID NO: 96657 - DNA, 25 bp, Mus musculus
acacgaagatctccttcaaattggg

SEQ ID NO: 96658 - DNA, 25 bp, Mus musculus
acacgaagatctgcttcaaattggg

SEQ ID NO: 96659 - DNA, 25 bp, Mus musculus
acacgaatattcaggtgattccttc

SEQ ID NO: 96660 - DNA, 25 bp, Mus musculus
acacgaatattctggtgattccttc

SEQ ID NO: 96661 - DNA, 25 bp, Mus musculus
acacgaattggaccctgagaaggac

SEQ ID NO: 96662 - DNA, 25 bp, Mus musculus
acacgaattggagcctgagaaggac

SEQ ID NO: 96663 - DNA, 25 bp, Mus musculus
acacgacaaacaatagcacttcatc

SEQ ID NO: 96664 - DNA, 25 bp, Mus musculus
acacgacaaacattagcacttcatc

SEQ ID NO: 96665 - DNA, 25 bp, Mus musculus
acacgacctcgaagtggaccttgca

SEQ ID NO: 96666 - DNA, 25 bp, Mus musculus
acacgacctcgatgtggaccttgca

SEQ ID NO: 96667 - DNA, 25 bp, Mus musculus
acacgacctttgaattgtgcctact

SEQ ID NO: 96668 - DNA, 25 bp, Mus musculus
acacgacctttgtattgtgcctact

SEQ ID NO: 96669 - DNA, 25 bp, Mus musculus
acacgacgaataccattatctgaat

SEQ ID NO: 96670 - DNA, 25 bp, Mus musculus
acacgacgaatagcattatctgaat

SEQ ID NO: 96671 - DNA, 25 bp, Mus musculus
acacgacgtgtaccagtgactgcca

SEQ ID NO: 96672 - DNA, 25 bp, Mus musculus
acacgacgtgtagcagtgactgcca

SEQ ID NO: 96673 - DNA, 25 bp, Mus musculus
acacgactctgtacactgcaattaa

SEQ ID NO: 96674 - DNA, 25 bp, Mus musculus
acacgactctgttcactgcaattaa

SEQ ID NO: 96675 - DNA, 25 bp, Mus musculus
acacgactgggcatggtggcctgaa

SEQ ID NO: 96676 - DNA, 25 bp, Mus musculus
acacgactgggcttggtggcctgaa

SEQ ID NO: 96677 - DNA, 25 bp, Mus musculus
acacgagaggccaggcttgccttgc

SEQ ID NO: 96678 - DNA, 25 bp, Mus musculus
acacgagaggcctggcttgccttgc

SEQ ID NO: 96679 - DNA, 25 bp, Mus musculus
acacgagcacttctctgctttacta

SEQ ID NO: 96680 - DNA, 25 bp, Mus musculus
acacgagcacttgtctgctttacta

SEQ ID NO: 96681 - DNA, 25 bp, Mus musculus
acacgagcccatagggcacatttca

SEQ ID NO: 96682 - DNA, 25 bp, Mus musculus
acacgagcccattgggcacatttca

SEQ ID NO: 96683 - DNA, 25 bp, Mus musculus
acacgagcctttctgggactcctat

SEQ ID NO: 96684 - DNA, 25 bp, Mus musculus
acacgagcctttgtgggactcctat

SEQ ID NO: 96685 - DNA, 25 bp, Mus musculus
acacgaggacaccatggctgaccag

SEQ ID NO: 96686 - DNA, 25 bp, Mus musculus
acacgaggacacgatggctgaccag

SEQ ID NO: 96687 - DNA, 25 bp, Mus musculus
acacgaggatggagctggagttcaa

SEQ ID NO: 96688 - DNA, 25 bp, Mus musculus
acacgaggatggctgctgtctgcaa

SEQ ID NO: 96689 - DNA, 25 bp, Mus musculus
acacgaggatgggtgctgtctgcaa

SEQ ID NO: 96690 - DNA, 25 bp, Mus musculus
acacgaggatggtgctggagttcaa

SEQ ID NO: 96691 - DNA, 25 bp, Mus musculus
acacgaggcaggcagtcctaggaca

SEQ ID NO: 96692 - DNA, 25 bp, Mus musculus
acacgaggcagggagtcctaggaca

SEQ ID NO: 96693 - DNA, 25 bp, Mus musculus
acacgaggctcgcagtttgtattta

SEQ ID NO: 96694 - DNA, 25 bp, Mus musculus
acacgaggctcggagtttgtattta

SEQ ID NO: 96695 - DNA, 25 bp, Mus musculus
acacgaggtcggcatgcagctcaca

SEQ ID NO: 96696 - DNA, 25 bp, Mus musculus
acacgaggtcgggatgcagctcaca

SEQ ID NO: 96697 - DNA, 25 bp, Mus musculus
acacgaggttttacagtgctgcact

SEQ ID NO: 96698 - DNA, 25 bp, Mus musculus
acacgaggtttttcagtgctgcact

SEQ ID NO: 96699 - DNA, 25 bp, Mus musculus
acacgagtaaggcacctgtgagtac

SEQ ID NO: 96700 - DNA, 25 bp, Mus musculus
acacgagtaagggacctgtgagtac

SEQ ID NO: 96701 - DNA, 25 bp, Mus musculus
acacgagtacatctcttacattaga

SEQ ID NO: 96702 - DNA, 25 bp, Mus musculus
acacgagtacatgtcttacattaga

SEQ ID NO: 96703 - DNA, 25 bp, Mus musculus
acacgagtaccacatcttgctttaa

SEQ ID NO: 96704 - DNA, 25 bp, Mus musculus
acacgagtaccagatcttgctttaa

SEQ ID NO: 96705 - DNA, 25 bp, Mus musculus
acacgagtcccaaccctatttgatg

SEQ ID NO: 96706 - DNA, 25 bp, Mus musculus
acacgagtcccatccctatttgatg

SEQ ID NO: 96707 - DNA, 25 bp, Mus musculus
acacgagttgatcatgctaaggcac

SEQ ID NO: 96708 - DNA, 25 bp, Mus musculus
acacgagttgatgatgctaaggcac

SEQ ID NO: 96709 - DNA, 25 bp, Mus musculus
acacgatccagtattcgaagcaccc

SEQ ID NO: 96710 - DNA, 25 bp, Mus musculus
acacgatccagttttcgaagcaccc

SEQ ID NO: 96711 - DNA, 25 bp, Mus musculus
acacgatccctccaattaaagtcta

SEQ ID NO: 96712 - DNA, 25 bp, Mus musculus
acacgatccctcgaattaaagtcta

SEQ ID NO: 96713 - DNA, 25 bp, Mus musculus
acacgatcttccatggccaggcaga

SEQ ID NO: 96714 - DNA, 25 bp, Mus musculus
acacgatcttccttggccaggcaga

SEQ ID NO: 96715 - DNA, 25 bp, Mus musculus
acacgatgactgattctacacacga

SEQ ID NO: 96716 - DNA, 25 bp, Mus musculus
acacgatgactgtttctacacacga

SEQ ID NO: 96717 - DNA, 25 bp, Mus musculus
acacgatgcagcactgggcccggcg

SEQ ID NO: 96718 - DNA, 25 bp, Mus musculus
acacgatgcagctctgggcccggcg

SEQ ID NO: 96719 - DNA, 25 bp, Mus musculus
acacgatggcatcacagtggctgtg

SEQ ID NO: 96720 - DNA, 25 bp, Mus musculus
acacgatggcatcgtggccgactga

SEQ ID NO: 96721 - DNA, 25 bp, Mus musculus
acacgatggcatgacagtggctgtg

SEQ ID NO: 96722 - DNA, 25 bp, Mus musculus
acacgatggcatggtggccgactga

SEQ ID NO: 96723 - DNA, 25 bp, Mus musculus
acacgatggtacacaaaactggaac

SEQ ID NO: 96724 - DNA, 25 bp, Mus musculus
acacgatggtactcaaaactggaac

SEQ ID NO: 96725 - DNA, 25 bp, Mus musculus
acacgattatgtccgcgtcaacagg

SEQ ID NO: 96726 - DNA, 25 bp, Mus musculus
acacgattatgtgcgcgtcaacagg

SEQ ID NO: 96727 - DNA, 25 bp, Mus musculus
acacgattgaggacttctggcgaat

SEQ ID NO: 96728 - DNA, 25 bp, Mus musculus
acacgattgaggtcttctggcgaat

SEQ ID NO: 96729 - DNA, 25 bp, Mus musculus
acacgattggtgattgtctctcagt

SEQ ID NO: 96730 - DNA, 25 bp, Mus musculus
acacgattggtgtttgtctctcagt

SEQ ID NO: 96731 - DNA, 25 bp, Mus musculus
acacgattgtaaatcaccacaggct

SEQ ID NO: 96732 - DNA, 25 bp, Mus musculus
acacgattgtaattcaccacaggct

SEQ ID NO: 96733 - DNA, 25 bp, Mus musculus
acacgatttggtagcatgtgataaa

SEQ ID NO: 96734 - DNA, 25 bp, Mus musculus
acacgatttggttgcatgtgataaa

SEQ ID NO: 96735 - DNA, 25 bp, Mus musculus
acacgcaaaactcctagcttgattt

SEQ ID NO: 96736 - DNA, 25 bp, Mus musculus
acacgcaaaactgctagcttgattt

SEQ ID NO: 96737 - DNA, 25 bp, Mus musculus
acacgcaacctaagtgaatgttagt

SEQ ID NO: 96738 - DNA, 25 bp, Mus musculus
acacgcaacctatgtgaatgttagt

SEQ ID NO: 96739 - DNA, 25 bp, Mus musculus
acacgcacagaacccactggtgttt

SEQ ID NO: 96740 - DNA, 25 bp, Mus musculus
acacgcacagaagccactggtgttt

SEQ ID NO: 96741 - DNA, 25 bp, Mus musculus
acacgcacatcacccattttgataa

SEQ ID NO: 96742 - DNA, 25 bp, Mus musculus
acacgcacatcagccattttgataa

SEQ ID NO: 96743 - DNA, 25 bp, Mus musculus
acacgcacattacacttactgaaag

SEQ ID NO: 96744 - DNA, 25 bp, Mus musculus
acacgcacattagacttactgaaag

SEQ ID NO: 96745 - DNA, 25 bp, Mus musculus
acacgcaccattatcctttagtata

SEQ ID NO: 96746 - DNA, 25 bp, Mus musculus
acacgcaccattttcctttagtata

SEQ ID NO: 96747 - DNA, 25 bp, Mus musculus
acacgcacctgcaatcttgcaaagg

SEQ ID NO: 96748 - DNA, 25 bp, Mus musculus
acacgcacctgctatcttgcaaagg

SEQ ID NO: 96749 - DNA, 25 bp, Mus musculus
acacgcacgtgaacggctgggccaa

SEQ ID NO: 96750 - DNA, 25 bp, Mus musculus
acacgcacgtgatcggctgggccaa

SEQ ID NO: 96751 - DNA, 25 bp, Mus musculus
acacgcagaggtcactttcataatt

SEQ ID NO: 96752 - DNA, 25 bp, Mus musculus
acacgcagaggtgactttcataatt

SEQ ID NO: 96753 - DNA, 25 bp, Mus musculus
acacgcagctttaggaatgttccag

SEQ ID NO: 96754 - DNA, 25 bp, Mus musculus
acacgcagcttttggaatgttccag

SEQ ID NO: 96755 - DNA, 25 bp, Mus musculus
acacgcatgatgctgaggccaatgg

SEQ ID NO: 96756 - DNA, 25 bp, Mus musculus
acacgcatgatggtgaggccaatgg

SEQ ID NO: 96757 - DNA, 25 bp, Mus musculus
acacgcatggtcacttcactgctgc

SEQ ID NO: 96758 - DNA, 25 bp, Mus musculus
acacgcatggtctcttcactgctgc

SEQ ID NO: 96759 - DNA, 25 bp, Mus musculus
acacgcattgctcttatttgtcggc

SEQ ID NO: 96760 - DNA, 25 bp, Mus musculus
acacgcattgctgttatttgtcggc

SEQ ID NO: 96761 - DNA, 25 bp, Mus musculus
acacgcatttagcagaccacagcac

SEQ ID NO: 96762 - DNA, 25 bp, Mus musculus
acacgcatttaggagaccacagcac

SEQ ID NO: 96763 - DNA, 25 bp, Mus musculus
acacgcatttctccctgagacaatc

SEQ ID NO: 96764 - DNA, 25 bp, Mus musculus
acacgcatttctgcctgagacaatc

SEQ ID NO: 96765 - DNA, 25 bp, Mus musculus
acacgccaacttagtgacaactcgt

SEQ ID NO: 96766 - DNA, 25 bp, Mus musculus
acacgccaactttgtgacaactcgt

SEQ ID NO: 96767 - DNA, 25 bp, Mus musculus
acacgccaagtgcttccaggccaga

SEQ ID NO: 96768 - DNA, 25 bp, Mus musculus
acacgccaagtggttccaggccaga

SEQ ID NO: 96769 - DNA, 25 bp, Mus musculus
acacgccagaggcttttggaccagg

SEQ ID NO: 96770 - DNA, 25 bp, Mus musculus
acacgccagagggttttggaccagg

SEQ ID NO: 96771 - DNA, 25 bp, Mus musculus
acacgccagtggcttcttctgtgac

SEQ ID NO: 96772 - DNA, 25 bp, Mus musculus
acacgccagtgggttcttctgtgac

SEQ ID NO: 96773 - DNA, 25 bp, Mus musculus
acacgccatcttcgagcagtagcag

SEQ ID NO: 96774 - DNA, 25 bp, Mus musculus
acacgccatcttggagcagtagcag

SEQ ID NO: 96775 - DNA, 25 bp, Mus musculus
acacgcccacggctaatctgggagt

SEQ ID NO: 96776 - DNA, 25 bp, Mus musculus
acacgcccacgggtaatctgggagt

SEQ ID NO: 96777 - DNA, 25 bp, Mus musculus
acacgcccagccaaagaagattcag

SEQ ID NO: 96778 - DNA, 25 bp, Mus musculus
acacgcccagcctaagaagattcag

SEQ ID NO: 96779 - DNA, 25 bp, Mus musculus
acacgccccagtatgatttcagaaa

SEQ ID NO: 96780 - DNA, 25 bp, Mus musculus
acacgccccagtttgatttcagaaa

SEQ ID NO: 96781 - DNA, 25 bp, Mus musculus
acacgcccgctgacgtgggtggaat

SEQ ID NO: 96782 - DNA, 25 bp, Mus musculus
acacgcccgctgtcgtgggtggaat

SEQ ID NO: 96783 - DNA, 25 bp, Mus musculus
acacgcccttcactgatcatataag

SEQ ID NO: 96784 - DNA, 25 bp, Mus musculus
acacgcccttcagtgatcatataag

SEQ ID NO: 96785 - DNA, 25 bp, Mus musculus
acacgccgtggcagatcgcagacct

SEQ ID NO: 96786 - DNA, 25 bp, Mus musculus
acacgccgtggctgatcgcagacct

SEQ ID NO: 96787 - DNA, 25 bp, Mus musculus
acacgcctgggcactatgtggagag

SEQ ID NO: 96788 - DNA, 25 bp, Mus musculus
acacgcctgggctctatgtggagag

SEQ ID NO: 96789 - DNA, 25 bp, Mus musculus
acacgcctgtacaccagagttctaa

SEQ ID NO: 96790 - DNA, 25 bp, Mus musculus
acacgcctgtactccagagttctaa

SEQ ID NO: 96791 - DNA, 25 bp, Mus musculus
acacgcctgtttcttacaattacca

SEQ ID NO: 96792 - DNA, 25 bp, Mus musculus
acacgcctgtttgttacaattacca

SEQ ID NO: 96793 - DNA, 25 bp, Mus musculus
acacgcctttatccagacacaccct

SEQ ID NO: 96794 - DNA, 25 bp, Mus musculus
acacgcctttatgcagacacaccct

SEQ ID NO: 96795 - DNA, 25 bp, Mus musculus
acacgcgagacgctcagggtttgaa

SEQ ID NO: 96796 - DNA, 25 bp, Mus musculus
acacgcgagacggtcagggtttgaa

SEQ ID NO: 96797 - DNA, 25 bp, Mus musculus
acacgcgattgcccaatgccataaa

SEQ ID NO: 96798 - DNA, 25 bp, Mus musculus
acacgcgattgcgcaatgccataaa

SEQ ID NO: 96799 - DNA, 25 bp, Mus musculus
acacgcgtgctcacattaatgacag

SEQ ID NO: 96800 - DNA, 25 bp, Mus musculus
acacgcgtgctctcattaatgacag

SEQ ID NO: 96801 - DNA, 25 bp, Mus musculus
acacgcgtgttcatgcatgcacatt

SEQ ID NO: 96802 - DNA, 25 bp, Mus musculus
acacgcgtgttcttgcatgcacatt

SEQ ID NO: 96803 - DNA, 25 bp, Mus musculus
acacgctcttacagtcgatggactt

SEQ ID NO: 96804 - DNA, 25 bp, Mus musculus
acacgctcttactgtcgatggactt

SEQ ID NO: 96805 - DNA, 25 bp, Mus musculus
acacgctgacagaccgtgaactgga

SEQ ID NO: 96806 - DNA, 25 bp, Mus musculus
acacgctgacagtccgtgaactgga

SEQ ID NO: 96807 - DNA, 25 bp, Mus musculus
acacgctgactcactttcaggcaaa

SEQ ID NO: 96808 - DNA, 25 bp, Mus musculus
acacgctgactctctttcaggcaaa

SEQ ID NO: 96809 - DNA, 25 bp, Mus musculus
acacgctgcaagagctgtcggcgcg

SEQ ID NO: 96810 - DNA, 25 bp, Mus musculus
acacgctgcaagtgctgtcggcgcg

SEQ ID NO: 96811 - DNA, 25 bp, Mus musculus
acacgctgctcaacatcatccacac

SEQ ID NO: 96812 - DNA, 25 bp, Mus musculus
acacgctgctcatcatcatccacac

SEQ ID NO: 96813 - DNA, 25 bp, Mus musculus
acacgctgctcgaacaatcaaaagc

SEQ ID NO: 96814 - DNA, 25 bp, Mus musculus
acacgctgctcgtacaatcaaaagc

SEQ ID NO: 96815 - DNA, 25 bp, Mus musculus
acacgctgctgcaagctggagtatt

SEQ ID NO: 96816 - DNA, 25 bp, Mus musculus
acacgctgctgctagctggagtatt

SEQ ID NO: 96817 - DNA, 25 bp, Mus musculus
acacgctggtaacttacgtgcctgt

SEQ ID NO: 96818 - DNA, 25 bp, Mus musculus
acacgctggtaagttacgtgcctgt

SEQ ID NO: 96819 - DNA, 25 bp, Mus musculus
acacgctgtagcatttctatgcatg

SEQ ID NO: 96820 - DNA, 25 bp, Mus musculus
acacgctgtagcttttctatgcatg

SEQ ID NO: 96821 - DNA, 25 bp, Mus musculus
acacgctgtcgcctttacttgagct

SEQ ID NO: 96822 - DNA, 25 bp, Mus musculus
acacgctgtcgcgtttacttgagct

SEQ ID NO: 96823 - DNA, 25 bp, Mus musculus
acacgctgttcaccaagtacaagga

SEQ ID NO: 96824 - DNA, 25 bp, Mus musculus
acacgctgttcagcaagtacaagga

SEQ ID NO: 96825 - DNA, 25 bp, Mus musculus
acacgctgttgtctgttgatgctgc

SEQ ID NO: 96826 - DNA, 25 bp, Mus musculus
acacgctgttgtgtgttgatgctgc

SEQ ID NO: 96827 - DNA, 25 bp, Mus musculus
acacgcttcagcagtacctggctct

SEQ ID NO: 96828 - DNA, 25 bp, Mus musculus
acacgcttcagcagtgagttcccat

SEQ ID NO: 96829 - DNA, 25 bp, Mus musculus
acacgcttcagctgtacctggctct

SEQ ID NO: 96830 - DNA, 25 bp, Mus musculus
acacgcttcagctgtgagttcccat

SEQ ID NO: 96831 - DNA, 25 bp, Mus musculus
acacgcttcattagccagaccagaa

SEQ ID NO: 96832 - DNA, 25 bp, Mus musculus
acacgcttcatttgccagaccagaa

SEQ ID NO: 96833 - DNA, 25 bp, Mus musculus
acacgcttccagatgtcactaacag

SEQ ID NO: 96834 - DNA, 25 bp, Mus musculus
acacgcttccagttgtcactaacag

SEQ ID NO: 96835 - DNA, 25 bp, Mus musculus
acacgcttctgcagctaggaatgat

SEQ ID NO: 96836 - DNA, 25 bp, Mus musculus
acacgcttctgctgctaggaatgat

SEQ ID NO: 96837 - DNA, 25 bp, Mus musculus
acacgcttggccaagacgagggagc

SEQ ID NO: 96838 - DNA, 25 bp, Mus musculus
acacgcttggcctagacgagggagc

SEQ ID NO: 96839 - DNA, 25 bp, Mus musculus
acacgcttggcgaggatggcgcaca

SEQ ID NO: 96840 - DNA, 25 bp, Mus musculus
acacgcttggcgtggatggcgcaca

SEQ ID NO: 96841 - DNA, 25 bp, Mus musculus
acacgctttagcaattacccgatgt

SEQ ID NO: 96842 - DNA, 25 bp, Mus musculus
acacgctttagctattacccgatgt

SEQ ID NO: 96843 - DNA, 25 bp, Mus musculus
acacggaaaactatgttccatgcaa

SEQ ID NO: 96844 - DNA, 25 bp, Mus musculus
acacggaaaactttgttccatgcaa

SEQ ID NO: 96845 - DNA, 25 bp, Mus musculus
acacggaaggtgaacttgatctgcc

SEQ ID NO: 96846 - DNA, 25 bp, Mus musculus
acacggaaggtgtacttgatctgcc

SEQ ID NO: 96847 - DNA, 25 bp, Mus musculus
acacggaatccgacaacatgtattg

SEQ ID NO: 96848 - DNA, 25 bp, Mus musculus
acacggaatccgtcaacatgtattg

SEQ ID NO: 96849 - DNA, 25 bp, Mus musculus
acacggacacataggcctttgatat

SEQ ID NO: 96850 - DNA, 25 bp, Mus musculus
acacggacacattggcctttgatat

SEQ ID NO: 96851 - DNA, 25 bp, Mus musculus
acacggacaggaccttcagggacag

SEQ ID NO: 96852 - DNA, 25 bp, Mus musculus
acacggacaggagcttcagggacag

SEQ ID NO: 96853 - DNA, 25 bp, Mus musculus
acacggaccatcagaagatttcttc

SEQ ID NO: 96854 - DNA, 25 bp, Mus musculus
acacggaccatctgaagatttcttc

SEQ ID NO: 96855 - DNA, 25 bp, Mus musculus
acacggagatctctttcaagttggg

SEQ ID NO: 96856 - DNA, 25 bp, Mus musculus
acacggagatctgtttcaagttggg

SEQ ID NO: 96857 - DNA, 25 bp, Mus musculus
acacggaggaatcctggtgctttct

SEQ ID NO: 96858 - DNA, 25 bp, Mus musculus
acacggaggaatgctggtgctttct

SEQ ID NO: 96859 - DNA, 25 bp, Mus musculus
acacggaggagaattccaattttag

SEQ ID NO: 96860 - DNA, 25 bp, Mus musculus
acacggaggagatttccaattttag

SEQ ID NO: 96861 - DNA, 25 bp, Mus musculus
acacggatagtaacctgcagctcag

SEQ ID NO: 96862 - DNA, 25 bp, Mus musculus
acacggatagtatcctgcagctcag

SEQ ID NO: 96863 - DNA, 25 bp, Mus musculus
acacggatgagtaacctgttggttt

SEQ ID NO: 96864 - DNA, 25 bp, Mus musculus
acacggatgagttacctgttggttt

SEQ ID NO: 96865 - DNA, 25 bp, Mus musculus
acacggatgcttatgtggcgtattt

SEQ ID NO: 96866 - DNA, 25 bp, Mus musculus
acacggatgcttttgtggcgtattt

SEQ ID NO: 96867 - DNA, 25 bp, Mus musculus
acacggatttccacagatgacccag

SEQ ID NO: 96868 - DNA, 25 bp, Mus musculus
acacggatttcctcagatgacccag

SEQ ID NO: 96869 - DNA, 25 bp, Mus musculus
acacggatttttcgtcccaacagtg

SEQ ID NO: 96870 - DNA, 25 bp, Mus musculus
acacggatttttggtcccaacagtg

SEQ ID NO: 96871 - DNA, 25 bp, Mus musculus
acacggcaagatcccacggagagaa

SEQ ID NO: 96872 - DNA, 25 bp, Mus musculus
acacggcaagatgccacggagagaa

SEQ ID NO: 96873 - DNA, 25 bp, Mus musculus
acacggcacgggaagcagaaccgtc

SEQ ID NO: 96874 - DNA, 25 bp, Mus musculus
acacggcacgggtagcagaaccgtc

SEQ ID NO: 96875 - DNA, 25 bp, Mus musculus
acacggcaggccacagatcgaaaac

SEQ ID NO: 96876 - DNA, 25 bp, Mus musculus
acacggcaggccagcccaagaagat

SEQ ID NO: 96877 - DNA, 25 bp, Mus musculus
acacggcaggcctcagatcgaaaac

SEQ ID NO: 96878 - DNA, 25 bp, Mus musculus
acacggcaggcctgcccaagaagat

SEQ ID NO: 96879 - DNA, 25 bp, Mus musculus
acacggcagtggctttaaccttggc

SEQ ID NO: 96880 - DNA, 25 bp, Mus musculus
acacggcagtgggtttaaccttggc

SEQ ID NO: 96881 - DNA, 25 bp, Mus musculus
acacggcatttgaagttgctggcac

SEQ ID NO: 96882 - DNA, 25 bp, Mus musculus
acacggcatttgtagttgctggcac

SEQ ID NO: 96883 - DNA, 25 bp, Mus musculus
acacggccacagctgcattctggga

SEQ ID NO: 96884 - DNA, 25 bp, Mus musculus
acacggccacaggtgcattctggga

SEQ ID NO: 96885 - DNA, 25 bp, Mus musculus
acacggccagacaatatctcctggg

SEQ ID NO: 96886 - DNA, 25 bp, Mus musculus
acacggccagactatatctcctggg

SEQ ID NO: 96887 - DNA, 25 bp, Mus musculus
acacggcccgtgctggaggcccagg

SEQ ID NO: 96888 - DNA, 25 bp, Mus musculus
acacggcccgtggtggaggcccagg

SEQ ID NO: 96889 - DNA, 25 bp, Mus musculus
acacggccctcacgaagcactgaaa

SEQ ID NO: 96890 - DNA, 25 bp, Mus musculus
acacggccctcaggaagcactgaaa

SEQ ID NO: 96891 - DNA, 25 bp, Mus musculus
acacggcggaagaggacgcccctga

SEQ ID NO: 96892 - DNA, 25 bp, Mus musculus
acacggcggaagtggacgcccctga

SEQ ID NO: 96893 - DNA, 25 bp, Mus musculus
acacggctaagcactatggaaacag

SEQ ID NO: 96894 - DNA, 25 bp, Mus musculus
acacggctaagctctatggaaacag

SEQ ID NO: 96895 - DNA, 25 bp, Mus musculus
acacggctcccactgatgcgatggt

SEQ ID NO: 96896 - DNA, 25 bp, Mus musculus
acacggctcccagtgatgcgatggt

SEQ ID NO: 96897 - DNA, 25 bp, Mus musculus
acacggcttcccaaggtgtgtaggg

SEQ ID NO: 96898 - DNA, 25 bp, Mus musculus
acacggcttccctaggtgtgtaggg

SEQ ID NO: 96899 - DNA, 25 bp, Mus musculus
acacggcttcgtcatcaagtggagc

SEQ ID NO: 96900 - DNA, 25 bp, Mus musculus
acacggcttcgtgatcaagtggagc

SEQ ID NO: 96901 - DNA, 25 bp, Mus musculus
acacggctttctcgaggcacacgct

SEQ ID NO: 96902 - DNA, 25 bp, Mus musculus
acacggctttctggaggcacacgct

SEQ ID NO: 96903 - DNA, 25 bp, Mus musculus
acacgggacaagcaataaagttcag

SEQ ID NO: 96904 - DNA, 25 bp, Mus musculus
acacgggacaaggaataaagttcag

SEQ ID NO: 96905 - DNA, 25 bp, Mus musculus
acacgggactgaacctgtcagcagc

SEQ ID NO: 96906 - DNA, 25 bp, Mus musculus
acacgggactgatcctgtcagcagc

SEQ ID NO: 96907 - DNA, 25 bp, Mus musculus
acacgggatatcatttttaactcgg

SEQ ID NO: 96908 - DNA, 25 bp, Mus musculus
acacgggatatcttttttaactcgg

SEQ ID NO: 96909 - DNA, 25 bp, Mus musculus
acacgggatcagatcagggaccaag

SEQ ID NO: 96910 - DNA, 25 bp, Mus musculus
acacgggatcagttcagggaccaag

SEQ ID NO: 96911 - DNA, 25 bp, Mus musculus
acacgggatgcacggtaaaagcttc

SEQ ID NO: 96912 - DNA, 25 bp, Mus musculus
acacgggatgcagggtaaaagcttc

SEQ ID NO: 96913 - DNA, 25 bp, Mus musculus
acacgggcagaaccgaggcagacat

SEQ ID NO: 96914 - DNA, 25 bp, Mus musculus
acacgggcagaagcgaggcagacat

SEQ ID NO: 96915 - DNA, 25 bp, Mus musculus
acacgggcagcaacaacagcacaga

SEQ ID NO: 96916 - DNA, 25 bp, Mus musculus
acacgggcagcatcaacagcacaga

SEQ ID NO: 96917 - DNA, 25 bp, Mus musculus
acacgggcccagagatttggaacat

SEQ ID NO: 96918 - DNA, 25 bp, Mus musculus
acacgggcccagtgatttggaacat

SEQ ID NO: 96919 - DNA, 25 bp, Mus musculus
acacgggcctcaccgactgttgcaa

SEQ ID NO: 96920 - DNA, 25 bp, Mus musculus
acacgggcctcagcgactgttgcaa

SEQ ID NO: 96921 - DNA, 25 bp, Mus musculus
acacgggccttcacatgggtgggcc

SEQ ID NO: 96922 - DNA, 25 bp, Mus musculus
acacgggccttctcatgggtgggcc

SEQ ID NO: 96923 - DNA, 25 bp, Mus musculus
acacgggcgtgtatgtatgcctggt

SEQ ID NO: 96924 - DNA, 25 bp, Mus musculus
acacgggcgtgtttgtatgcctggt

SEQ ID NO: 96925 - DNA, 25 bp, Mus musculus
acacgggcttgtacatggccctgga

SEQ ID NO: 96926 - DNA, 25 bp, Mus musculus
acacgggcttgttcatggccctgga

SEQ ID NO: 96927 - DNA, 25 bp, Mus musculus
acacgggtagaaagcagcggcattt

SEQ ID NO: 96928 - DNA, 25 bp, Mus musculus
acacgggtagaatgcagcggcattt

SEQ ID NO: 96929 - DNA, 25 bp, Mus musculus
acacgggtatccagccaagttcaac

SEQ ID NO: 96930 - DNA, 25 bp, Mus musculus
acacgggtatcctgccaagttcaac

SEQ ID NO: 96931 - DNA, 25 bp, Mus musculus
acacggtaaccaatctcctcagata

SEQ ID NO: 96932 - DNA, 25 bp, Mus musculus
acacggtaaccattctcctcagata

SEQ ID NO: 96933 - DNA, 25 bp, Mus musculus
acacggtacaaccttcatccctgga

SEQ ID NO: 96934 - DNA, 25 bp, Mus musculus
acacggtacaacgttcatccctgga

SEQ ID NO: 96935 - DNA, 25 bp, Mus musculus
acacggtagaggactcgcgtggtca

SEQ ID NO: 96936 - DNA, 25 bp, Mus musculus
acacggtagaggtctcgcgtggtca

SEQ ID NO: 96937 - DNA, 25 bp, Mus musculus
acacggtagatgatacttcatggca

SEQ ID NO: 96938 - DNA, 25 bp, Mus musculus
acacggtagatgttacttcatggca

SEQ ID NO: 96939 - DNA, 25 bp, Mus musculus
acacggtcctggattgcagcttgga

SEQ ID NO: 96940 - DNA, 25 bp, Mus musculus
acacggtcctggtttgcagcttgga

SEQ ID NO: 96941 - DNA, 25 bp, Mus musculus
acacggtcgatgaagtgtgccaggc

SEQ ID NO: 96942 - DNA, 25 bp, Mus musculus
acacggtcgatgtagtgtgccaggc

SEQ ID NO: 96943 - DNA, 25 bp, Mus musculus
acacggtcttccacatagcgcggta

SEQ ID NO: 96944 - DNA, 25 bp, Mus musculus
acacggtcttcctcatagcgcggta

SEQ ID NO: 96945 - DNA, 25 bp, Mus musculus
acacggtgagtaactccagagaata

SEQ ID NO: 96946 - DNA, 25 bp, Mus musculus
acacggtgagtatctccagagaata

SEQ ID NO: 96947 - DNA, 25 bp, Mus musculus
acacggtgcaccaggttgacttgaa

SEQ ID NO: 96948 - DNA, 25 bp, Mus musculus
acacggtgcacctggttgacttgaa

SEQ ID NO: 96949 - DNA, 25 bp, Mus musculus
acacggtggcatcgagaactgtctc

SEQ ID NO: 96950 - DNA, 25 bp, Mus musculus
acacggtggcatggagaactgtctc

SEQ ID NO: 96951 - DNA, 25 bp, Mus musculus
acacggtgtgggagacccctgagct

SEQ ID NO: 96952 - DNA, 25 bp, Mus musculus
acacggtgtgggtgacccctgagct

SEQ ID NO: 96953 - DNA, 25 bp, Mus musculus
acacggtgttgaatgaaggcttctt

SEQ ID NO: 96954 - DNA, 25 bp, Mus musculus
acacggtgttgattgaaggcttctt

SEQ ID NO: 96955 - DNA, 25 bp, Mus musculus
acacggttactgaattttgctgata

SEQ ID NO: 96956 - DNA, 25 bp, Mus musculus
acacggttactgtattttgctgata

SEQ ID NO: 96957 - DNA, 25 bp, Mus musculus
acacggttcgccctcgtatgatgat

SEQ ID NO: 96958 - DNA, 25 bp, Mus musculus
acacggttcgccgtcgtatgatgat

SEQ ID NO: 96959 - DNA, 25 bp, Mus musculus
acacggttcgtgatgcttatagctc

SEQ ID NO: 96960 - DNA, 25 bp, Mus musculus
acacggttcgtgttgcttatagctc

SEQ ID NO: 96961 - DNA, 25 bp, Mus musculus
acacggttgaaactgcaactccact

SEQ ID NO: 96962 - DNA, 25 bp, Mus musculus
acacggttgaaagtgcaactccact

SEQ ID NO: 96963 - DNA, 25 bp, Mus musculus
acacgtacacgcacgtgaacggctg

SEQ ID NO: 96964 - DNA, 25 bp, Mus musculus
acacgtacacgctcgtgaacggctg

SEQ ID NO: 96965 - DNA, 25 bp, Mus musculus
acacgtacgtacaagcagatggtca

SEQ ID NO: 96966 - DNA, 25 bp, Mus musculus
acacgtacgtactagcagatggtca

SEQ ID NO: 96967 - DNA, 25 bp, Mus musculus
acacgtagactcactgcgcacacag

SEQ ID NO: 96968 - DNA, 25 bp, Mus musculus
acacgtagactctctgcgcacacag

SEQ ID NO: 96969 - DNA, 25 bp, Mus musculus
acacgtagatctatgtacagttgac

SEQ ID NO: 96970 - DNA, 25 bp, Mus musculus
acacgtagatctttgtacagttgac

SEQ ID NO: 96971 - DNA, 25 bp, Mus musculus
acacgtagatttatgtaactgatct

SEQ ID NO: 96972 - DNA, 25 bp, Mus musculus
acacgtagatttttgtaactgatct

SEQ ID NO: 96973 - DNA, 25 bp, Mus musculus
acacgtaggccaaaagattccctcc

SEQ ID NO: 96974 - DNA, 25 bp, Mus musculus
acacgtaggccataagattccctcc

SEQ ID NO: 96975 - DNA, 25 bp, Mus musculus
acacgtaggcctacaatatgcgtcc

SEQ ID NO: 96976 - DNA, 25 bp, Mus musculus
acacgtaggccttcaatatgcgtcc

SEQ ID NO: 96977 - DNA, 25 bp, Mus musculus
acacgtagtggtatgtctctggcac

SEQ ID NO: 96978 - DNA, 25 bp, Mus musculus
acacgtagtggtttgtctctggcac

SEQ ID NO: 96979 - DNA, 25 bp, Mus musculus
acacgtatacaacgacaagccctgc

SEQ ID NO: 96980 - DNA, 25 bp, Mus musculus
acacgtatacaaggacaagccctgc

SEQ ID NO: 96981 - DNA, 25 bp, Mus musculus
acacgtatgctgaatgttgatgcct

SEQ ID NO: 96982 - DNA, 25 bp, Mus musculus
acacgtatgctgtatgttgatgcct

SEQ ID NO: 96983 - DNA, 25 bp, Mus musculus
acacgtattagtctgtgcacacccc

SEQ ID NO: 96984 - DNA, 25 bp, Mus musculus
acacgtattagtgtgtgcacacccc

SEQ ID NO: 96985 - DNA, 25 bp, Mus musculus
acacgtcactgcataggttctgaga

SEQ ID NO: 96986 - DNA, 25 bp, Mus musculus
acacgtcactgcttaggttctgaga

SEQ ID NO: 96987 - DNA, 25 bp, Mus musculus
acacgtcagtgcataccttacctca

SEQ ID NO: 96988 - DNA, 25 bp, Mus musculus
acacgtcagtgcttaccttacctca

SEQ ID NO: 96989 - DNA, 25 bp, Mus musculus
acacgtccaaagaagtccctctcag

SEQ ID NO: 96990 - DNA, 25 bp, Mus musculus
acacgtccaaagtagtccctctcag

SEQ ID NO: 96991 - DNA, 25 bp, Mus musculus
acacgtccctgaaaactttgagcat

SEQ ID NO: 96992 - DNA, 25 bp, Mus musculus
acacgtccctgataactttgagcat

SEQ ID NO: 96993 - DNA, 25 bp, Mus musculus
acacgtcctgtacatcgcctatggg

SEQ ID NO: 96994 - DNA, 25 bp, Mus musculus
acacgtcctgtagatcgcctatggg

SEQ ID NO: 96995 - DNA, 25 bp, Mus musculus
acacgtctccacacagaactatgtg

SEQ ID NO: 96996 - DNA, 25 bp, Mus musculus
acacgtctccactcagaactatgtg

SEQ ID NO: 96997 - DNA, 25 bp, Mus musculus
acacgtctgctccagagggaagaga

SEQ ID NO: 96998 - DNA, 25 bp, Mus musculus
acacgtctgctcgagagggaagaga

SEQ ID NO: 96999 - DNA, 25 bp, Mus musculus
acacgtcttgaccaaggtttacgct

SEQ ID NO: 97000 - DNA, 25 bp, Mus musculus
acacgtcttgacgaaggtttacgct

SEQ ID NO: 97001 - DNA, 25 bp, Mus musculus
acacgtgaaagtagcatgtttccta

SEQ ID NO: 97002 - DNA, 25 bp, Mus musculus
acacgtgaaagttgcatgtttccta

SEQ ID NO: 97003 - DNA, 25 bp, Mus musculus
acacgtgaactgcaccttagggcaa

SEQ ID NO: 97004 - DNA, 25 bp, Mus musculus
acacgtgaactggaccttagggcaa

SEQ ID NO: 97005 - DNA, 25 bp, Mus musculus
acacgtgacccaaggctagggctgt

SEQ ID NO: 97006 - DNA, 25 bp, Mus musculus
acacgtgacccactaaggaccaggc

SEQ ID NO: 97007 - DNA, 25 bp, Mus musculus
acacgtgacccagtaaggaccaggc

SEQ ID NO: 97008 - DNA, 25 bp, Mus musculus
acacgtgacccatggctagggctgt

SEQ ID NO: 97009 - DNA, 25 bp, Mus musculus
acacgtgacctgctttttgatttct

SEQ ID NO: 97010 - DNA, 25 bp, Mus musculus
acacgtgacctggtttttgatttct

SEQ ID NO: 97011 - DNA, 25 bp, Mus musculus
acacgtgacggaatggaatcctcct

SEQ ID NO: 97012 - DNA, 25 bp, Mus musculus
acacgtgacggattggaatcctcct

SEQ ID NO: 97013 - DNA, 25 bp, Mus musculus
acacgtgactcaaatcacctgagaa

SEQ ID NO: 97014 - DNA, 25 bp, Mus musculus
acacgtgactcatatcacctgagaa

SEQ ID NO: 97015 - DNA, 25 bp, Mus musculus
acacgtgactgtattaatgctgcaa

SEQ ID NO: 97016 - DNA, 25 bp, Mus musculus
acacgtgactgttttaatgctgcaa

SEQ ID NO: 97017 - DNA, 25 bp, Mus musculus
acacgtgagtttctgttgctggctg

SEQ ID NO: 97018 - DNA, 25 bp, Mus musculus
acacgtgagtttgtgttgctggctg

SEQ ID NO: 97019 - DNA, 25 bp, Mus musculus
acacgtgatcaaccctaggatttca

SEQ ID NO: 97020 - DNA, 25 bp, Mus musculus
acacgtgatcaagcctaggatttca

SEQ ID NO: 97021 - DNA, 25 bp, Mus musculus
acacgtgatgatctgaagtgcctca

SEQ ID NO: 97022 - DNA, 25 bp, Mus musculus
acacgtgatgatgtgaagtgcctca

SEQ ID NO: 97023 - DNA, 25 bp, Mus musculus
acacgtgatttaacctatgagctat

SEQ ID NO: 97024 - DNA, 25 bp, Mus musculus
acacgtgatttatcctatgagctat

SEQ ID NO: 97025 - DNA, 25 bp, Mus musculus
acacgtgcacacatgagttccaatt

SEQ ID NO: 97026 - DNA, 25 bp, Mus musculus
acacgtgcacacttgagttccaatt

SEQ ID NO: 97027 - DNA, 25 bp, Mus musculus
acacgtgcatttctgtgcgtcctgg

SEQ ID NO: 97028 - DNA, 25 bp, Mus musculus
acacgtgcatttgtgtgcgtcctgg

SEQ ID NO: 97029 - DNA, 25 bp, Mus musculus
acacgtgccgagagctcctgaaatg

SEQ ID NO: 97030 - DNA, 25 bp, Mus musculus
acacgtgccgagtgctcctgaaatg

SEQ ID NO: 97031 - DNA, 25 bp, Mus musculus
acacgtgcctgcagctgatagggct

SEQ ID NO: 97032 - DNA, 25 bp, Mus musculus
acacgtgcctgctgctgatagggct

SEQ ID NO: 97033 - DNA, 25 bp, Mus musculus
acacgtgcctttccgatggattaaa

SEQ ID NO: 97034 - DNA, 25 bp, Mus musculus
acacgtgcctttgcgatggattaaa

SEQ ID NO: 97035 - DNA, 25 bp, Mus musculus
acacgtgctggtcgtctgggcatca

SEQ ID NO: 97036 - DNA, 25 bp, Mus musculus
acacgtgctggtggtctgggcatca

SEQ ID NO: 97037 - DNA, 25 bp, Mus musculus
acacgtgctgtcatgtcctgataca

SEQ ID NO: 97038 - DNA, 25 bp, Mus musculus
acacgtgctgtcttgtcctgataca

SEQ ID NO: 97039 - DNA, 25 bp, Mus musculus
acacgtgctgtgacttggttgtaaa

SEQ ID NO: 97040 - DNA, 25 bp, Mus musculus
acacgtgctgtgtcttggttgtaaa

SEQ ID NO: 97041 - DNA, 25 bp, Mus musculus
acacgtggaacaagtctaagggcac

SEQ ID NO: 97042 - DNA, 25 bp, Mus musculus
acacgtggaacatgtctaagggcac

SEQ ID NO: 97043 - DNA, 25 bp, Mus musculus
acacgtggcagaacacatatgccta

SEQ ID NO: 97044 - DNA, 25 bp, Mus musculus
acacgtggcagatcacatatgccta

SEQ ID NO: 97045 - DNA, 25 bp, Mus musculus
acacgtggcaggctcttgctgttgt

SEQ ID NO: 97046 - DNA, 25 bp, Mus musculus
acacgtggcagggtcttgctgttgt

SEQ ID NO: 97047 - DNA, 25 bp, Mus musculus
acacgtggcgatcttttagtgacca

SEQ ID NO: 97048 - DNA, 25 bp, Mus musculus
acacgtggcgatgttttagtgacca

SEQ ID NO: 97049 - DNA, 25 bp, Mus musculus
acacgtgggacacagcccgaactca

SEQ ID NO: 97050 - DNA, 25 bp, Mus musculus
acacgtgggacagagcccgaactca

SEQ ID NO: 97051 - DNA, 25 bp, Mus musculus
acacgtggtttaattggcaagactg

SEQ ID NO: 97052 - DNA, 25 bp, Mus musculus
acacgtggtttatttggcaagactg

SEQ ID NO: 97053 - DNA, 25 bp, Mus musculus
acacgtgtaactctctagccgggcc

SEQ ID NO: 97054 - DNA, 25 bp, Mus musculus
acacgtgtaactgtctagccgggcc

SEQ ID NO: 97055 - DNA, 25 bp, Mus musculus
acacgtgtacacacagatcattaat

SEQ ID NO: 97056 - DNA, 25 bp, Mus musculus
acacgtgtacactcagatcattaat

SEQ ID NO: 97057 - DNA, 25 bp, Mus musculus
acacgtgtagttatggttcttacca

SEQ ID NO: 97058 - DNA, 25 bp, Mus musculus
acacgtgtagttttggttcttacca

SEQ ID NO: 97059 - DNA, 25 bp, Mus musculus
acacgtgtcacgaggtactttatat

SEQ ID NO: 97060 - DNA, 25 bp, Mus musculus
acacgtgtcacgtggtactttatat

SEQ ID NO: 97061 - DNA, 25 bp, Mus musculus
acacgtgtccctagcagtaactgaa

SEQ ID NO: 97062 - DNA, 25 bp, Mus musculus
acacgtgtcccttgcagtaactgaa

SEQ ID NO: 97063 - DNA, 25 bp, Mus musculus
acacgtgtcgttcttggtgacctgg

SEQ ID NO: 97064 - DNA, 25 bp, Mus musculus
acacgtgtcgttgttggtgacctgg

SEQ ID NO: 97065 - DNA, 25 bp, Mus musculus
acacgtgtctctctctaaatgctaa

SEQ ID NO: 97066 - DNA, 25 bp, Mus musculus
acacgtgtctctgtctaaatgctaa

SEQ ID NO: 97067 - DNA, 25 bp, Mus musculus
acacgtgtgaccagtgaggacataa

SEQ ID NO: 97068 - DNA, 25 bp, Mus musculus
acacgtgtgacctgtgaggacataa

SEQ ID NO: 97069 - DNA, 25 bp, Mus musculus
acacgtgtgcgcctcacagatcagg

SEQ ID NO: 97070 - DNA, 25 bp, Mus musculus
acacgtgtgcgcgtcacagatcagg

SEQ ID NO: 97071 - DNA, 25 bp, Mus musculus
acacgtgtgtttcctgctgtgatta

SEQ ID NO: 97072 - DNA, 25 bp, Mus musculus
acacgtgtgtttgctgctgtgatta

SEQ ID NO: 97073 - DNA, 25 bp, Mus musculus
acacgtgttcgtcgagactgtcccc

SEQ ID NO: 97074 - DNA, 25 bp, Mus musculus
acacgtgttcgtggagactgtcccc

SEQ ID NO: 97075 - DNA, 25 bp, Mus musculus
acacgtgttgctcctagtcatgaaa

SEQ ID NO: 97076 - DNA, 25 bp, Mus musculus
acacgtgttgctgctagtcatgaaa

SEQ ID NO: 97077 - DNA, 25 bp, Mus musculus
acacgtgttgtacatgtggccctta

SEQ ID NO: 97078 - DNA, 25 bp, Mus musculus
acacgtgttgtagatgtggccctta

SEQ ID NO: 97079 - DNA, 25 bp, Mus musculus
acacgttcatggaccttatcgagca

SEQ ID NO: 97080 - DNA, 25 bp, Mus musculus
acacgttcatggtccttatcgagca

SEQ ID NO: 97081 - DNA, 25 bp, Mus musculus
acacgttccattactcgggaggcag

SEQ ID NO: 97082 - DNA, 25 bp, Mus musculus
acacgttccatttctcgggaggcag

SEQ ID NO: 97083 - DNA, 25 bp, Mus musculus
acacgttccgccaggtacggctgaa

SEQ ID NO: 97084 - DNA, 25 bp, Mus musculus
acacgttccgcctggtacggctgaa

SEQ ID NO: 97085 - DNA, 25 bp, Mus musculus
acacgttcctagaatgtcctgttct

SEQ ID NO: 97086 - DNA, 25 bp, Mus musculus
acacgttcctagtatgtcctgttct

SEQ ID NO: 97087 - DNA, 25 bp, Mus musculus
acacgttctaggactgttgtttatc

SEQ ID NO: 97088 - DNA, 25 bp, Mus musculus
acacgttctaggtctgttgtttatc

SEQ ID NO: 97089 - DNA, 25 bp, Mus musculus
acacgttgtttgaattgcttctcca

SEQ ID NO: 97090 - DNA, 25 bp, Mus musculus
acacgttgtttgtattgcttctcca

SEQ ID NO: 97091 - DNA, 25 bp, Mus musculus
acacgtttgagtcacatttgccaac

SEQ ID NO: 97092 - DNA, 25 bp, Mus musculus
acacgtttgagtgacatttgccaac

SEQ ID NO: 97093 - DNA, 25 bp, Mus musculus
acacgtttgataacctgcttcacct

SEQ ID NO: 97094 - DNA, 25 bp, Mus musculus
acacgtttgatatcctgcttcacct

SEQ ID NO: 97095 - DNA, 25 bp, Mus musculus
acacgtttgattagtcagttgacta

SEQ ID NO: 97096 - DNA, 25 bp, Mus musculus
acacgtttgatttgtcagttgacta

SEQ ID NO: 97097 - DNA, 25 bp, Mus musculus
acacgtttgcttaacacctttcgat

SEQ ID NO: 97098 - DNA, 25 bp, Mus musculus
acacgtttgctttacacctttcgat

SEQ ID NO: 97099 - DNA, 25 bp, Mus musculus
acacgtttgggcagtgggtctcatc

SEQ ID NO: 97100 - DNA, 25 bp, Mus musculus
acacgtttgggctgtgggtctcatc

SEQ ID NO: 97101 - DNA, 25 bp, Mus musculus
acacgtttgtgcctagttatctaat

SEQ ID NO: 97102 - DNA, 25 bp, Mus musculus
acacgtttgtgcgtagttatctaat

SEQ ID NO: 97103 - DNA, 25 bp, Mus musculus
acactaaagagtagcagggccgggc

SEQ ID NO: 97104 - DNA, 25 bp, Mus musculus
acactaaagagttgcagggccgggc

SEQ ID NO: 97105 - DNA, 25 bp, Mus musculus
acactaaagctccagatctcctact

SEQ ID NO: 97106 - DNA, 25 bp, Mus musculus
acactaaagctcgagatctcctact

SEQ ID NO: 97107 - DNA, 25 bp, Mus musculus
acactaacgccaaagagtccccttg

SEQ ID NO: 97108 - DNA, 25 bp, Mus musculus
acactaacgccatagagtccccttg

SEQ ID NO: 97109 - DNA, 25 bp, Mus musculus
acactaacgtggcaaggacaggagt

SEQ ID NO: 97110 - DNA, 25 bp, Mus musculus
acactaacgtgggaaggacaggagt

SEQ ID NO: 97111 - DNA, 25 bp, Mus musculus
acactaactcacagagactctgcag

SEQ ID NO: 97112 - DNA, 25 bp, Mus musculus
acactaactcacattgttccgatct

SEQ ID NO: 97113 - DNA, 25 bp, Mus musculus
acactaactcactgagactctgcag

SEQ ID NO: 97114 - DNA, 25 bp, Mus musculus
acactaactcactttgttccgatct

SEQ ID NO: 97115 - DNA, 25 bp, Mus musculus
acactaactcggcagcttggcctca

SEQ ID NO: 97116 - DNA, 25 bp, Mus musculus
acactaactcgggagcttggcctca

SEQ ID NO: 97117 - DNA, 25 bp, Mus musculus
acactaactctgctggaagacacca

SEQ ID NO: 97118 - DNA, 25 bp, Mus musculus
acactaactctggtggaagacacca

SEQ ID NO: 97119 - DNA, 25 bp, Mus musculus
acactaaggcgcaagggcctctcct

SEQ ID NO: 97120 - DNA, 25 bp, Mus musculus
acactaaggcgctagggcctctcct

SEQ ID NO: 97121 - DNA, 25 bp, Mus musculus
acactaaggtgtagatcatgtatct

SEQ ID NO: 97122 - DNA, 25 bp, Mus musculus
acactaaggtgttgatcatgtatct

SEQ ID NO: 97123 - DNA, 25 bp, Mus musculus
acactaatatggaggccctcaacca

SEQ ID NO: 97124 - DNA, 25 bp, Mus musculus
acactaatatggtggccctcaacca

SEQ ID NO: 97125 - DNA, 25 bp, Mus musculus
acactaatcctgacaccacgatggg

SEQ ID NO: 97126 - DNA, 25 bp, Mus musculus
acactaatcctgtcaccacgatggg

SEQ ID NO: 97127 - DNA, 25 bp, Mus musculus
acactaatctctaggacttcttcag

SEQ ID NO: 97128 - DNA, 25 bp, Mus musculus
acactaatctcttggacttcttcag

SEQ ID NO: 97129 - DNA, 25 bp, Mus musculus
acactaattccactcatggtaggca

SEQ ID NO: 97130 - DNA, 25 bp, Mus musculus
acactaattccagtcatggtaggca

SEQ ID NO: 97131 - DNA, 25 bp, Mus musculus
acactaattctacgtggctgcccca

SEQ ID NO: 97132 - DNA, 25 bp, Mus musculus
acactaattctaggtggctgcccca

SEQ ID NO: 97133 - DNA, 25 bp, Mus musculus
acactacaacacacttctatgaacc

SEQ ID NO: 97134 - DNA, 25 bp, Mus musculus
acactacaacactcttctatgaacc

SEQ ID NO: 97135 - DNA, 25 bp, Mus musculus
acactacactggacacctgttcaaa

SEQ ID NO: 97136 - DNA, 25 bp, Mus musculus
acactacactggtcacctgttcaaa

SEQ ID NO: 97137 - DNA, 25 bp, Mus musculus
acactacagaagaacgccgcggctg

SEQ ID NO: 97138 - DNA, 25 bp, Mus musculus
acactacagaagtacgccgcggctg

SEQ ID NO: 97139 - DNA, 25 bp, Mus musculus
acactacagaccctggacagaagga

SEQ ID NO: 97140 - DNA, 25 bp, Mus musculus
acactacagaccgtggacagaagga

SEQ ID NO: 97141 - DNA, 25 bp, Mus musculus
acactacagccgagaatgtcctgga

SEQ ID NO: 97142 - DNA, 25 bp, Mus musculus
acactacagccgtgaatgtcctgga

SEQ ID NO: 97143 - DNA, 25 bp, Mus musculus
acactacagtatcttcttacgaaat

SEQ ID NO: 97144 - DNA, 25 bp, Mus musculus
acactacagtatgttcttacgaaat

SEQ ID NO: 97145 - DNA, 25 bp, Mus musculus
acactacagtgcagctgtctgtgct

SEQ ID NO: 97146 - DNA, 25 bp, Mus musculus
acactacagtgctgctgtctgtgct

SEQ ID NO: 97147 - DNA, 25 bp, Mus musculus
acactacatgcacgatcttctcttg

SEQ ID NO: 97148 - DNA, 25 bp, Mus musculus
acactacatgcaggatcttctcttg

SEQ ID NO: 97149 - DNA, 25 bp, Mus musculus
acactacatgttcctgatgctgaca

SEQ ID NO: 97150 - DNA, 25 bp, Mus musculus
acactacatgttgctgatgctgaca

SEQ ID NO: 97151 - DNA, 25 bp, Mus musculus
acactaccaaaccaccaagcagaac

SEQ ID NO: 97152 - DNA, 25 bp, Mus musculus
acactaccaaacgaccaagcagaac

SEQ ID NO: 97153 - DNA, 25 bp, Mus musculus
acactaccaatccatggccttgtgt

SEQ ID NO: 97154 - DNA, 25 bp, Mus musculus
acactaccaatcgatggccttgtgt

SEQ ID NO: 97155 - DNA, 25 bp, Mus musculus
acactaccaccacatctgcatttaa

SEQ ID NO: 97156 - DNA, 25 bp, Mus musculus
acactaccaccagatctgcatttaa

SEQ ID NO: 97157 - DNA, 25 bp, Mus musculus
acactaccagcaatagacagttttt

SEQ ID NO: 97158 - DNA, 25 bp, Mus musculus
acactaccagcattagacagttttt

SEQ ID NO: 97159 - DNA, 25 bp, Mus musculus
acactacccacaccactttgtattt

SEQ ID NO: 97160 - DNA, 25 bp, Mus musculus
acactacccacagcactttgtattt

SEQ ID NO: 97161 - DNA, 25 bp, Mus musculus
acactaccctctagacacttttcca

SEQ ID NO: 97162 - DNA, 25 bp, Mus musculus
acactaccctcttgacacttttcca

SEQ ID NO: 97163 - DNA, 25 bp, Mus musculus
acactaccgtttcgaattgagggct

SEQ ID NO: 97164 - DNA, 25 bp, Mus musculus
acactaccgtttggaattgagggct

SEQ ID NO: 97165 - DNA, 25 bp, Mus musculus
acactacgatgcatgtggtttgcta

SEQ ID NO: 97166 - DNA, 25 bp, Mus musculus
acactacgatgcttgtggtttgcta

SEQ ID NO: 97167 - DNA, 25 bp, Mus musculus
acactacgctgtcatttttatcttt

SEQ ID NO: 97168 - DNA, 25 bp, Mus musculus
acactacgctgtgatttttatcttt

SEQ ID NO: 97169 - DNA, 25 bp, Mus musculus
acactactaagtatccagatccaat

SEQ ID NO: 97170 - DNA, 25 bp, Mus musculus
acactactaagtttccagatccaat

SEQ ID NO: 97171 - DNA, 25 bp, Mus musculus
acactactactccatgagggacttc

SEQ ID NO: 97172 - DNA, 25 bp, Mus musculus
acactactactcgatgagggacttc

SEQ ID NO: 97173 - DNA, 25 bp, Mus musculus
acactactgaaaatactggatgctt

SEQ ID NO: 97174 - DNA, 25 bp, Mus musculus
acactactgaaattactggatgctt

SEQ ID NO: 97175 - DNA, 25 bp, Mus musculus
acactactggcacctgattctattg

SEQ ID NO: 97176 - DNA, 25 bp, Mus musculus
acactactggcagctgattctattg

SEQ ID NO: 97177 - DNA, 25 bp, Mus musculus
acactactgtaactacctactaaat

SEQ ID NO: 97178 - DNA, 25 bp, Mus musculus
acactactgtaagtacctactaaat

SEQ ID NO: 97179 - DNA, 25 bp, Mus musculus
acactactgtttctttcctagctag

SEQ ID NO: 97180 - DNA, 25 bp, Mus musculus
acactactgtttgtttcctagctag

SEQ ID NO: 97181 - DNA, 25 bp, Mus musculus
acactacttactctctctgtggagc

SEQ ID NO: 97182 - DNA, 25 bp, Mus musculus
acactacttactgtctctgtggagc

SEQ ID NO: 97183 - DNA, 25 bp, Mus musculus
acactacttgtgcatgttgaaccta

SEQ ID NO: 97184 - DNA, 25 bp, Mus musculus
acactacttgtggatgttgaaccta

SEQ ID NO: 97185 - DNA, 25 bp, Mus musculus
acactagaacatccctctgtctggg

SEQ ID NO: 97186 - DNA, 25 bp, Mus musculus
acactagaacatgcctctgtctggg

SEQ ID NO: 97187 - DNA, 25 bp, Mus musculus
acactagaaccacggcagtgcccaa

SEQ ID NO: 97188 - DNA, 25 bp, Mus musculus
acactagaaccagggcagtgcccaa

SEQ ID NO: 97189 - DNA, 25 bp, Mus musculus
acactagaagccctggttcacatga

SEQ ID NO: 97190 - DNA, 25 bp, Mus musculus
acactagaagccgtggttcacatga

SEQ ID NO: 97191 - DNA, 25 bp, Mus musculus
acactagatgggattcaccagtctg

SEQ ID NO: 97192 - DNA, 25 bp, Mus musculus
acactagatgggtttcaccagtctg

SEQ ID NO: 97193 - DNA, 25 bp, Mus musculus
acactagatttgcagaccgaaccca

SEQ ID NO: 97194 - DNA, 25 bp, Mus musculus
acactagatttggagaccgaaccca

SEQ ID NO: 97195 - DNA, 25 bp, Mus musculus
acactagcaccgcttgatttcttct

SEQ ID NO: 97196 - DNA, 25 bp, Mus musculus
acactagcaccggttgatttcttct

SEQ ID NO: 97197 - DNA, 25 bp, Mus musculus
acactagcatctatcttcgtcagat

SEQ ID NO: 97198 - DNA, 25 bp, Mus musculus
acactagcatctttcttcgtcagat

SEQ ID NO: 97199 - DNA, 25 bp, Mus musculus
acactagcctcaataatgaccaaga

SEQ ID NO: 97200 - DNA, 25 bp, Mus musculus
acactagcctcattaatgaccaaga

SEQ ID NO: 97201 - DNA, 25 bp, Mus musculus
acactagcctgtcctagcagcagtc

SEQ ID NO: 97202 - DNA, 25 bp, Mus musculus
acactagcctgtgctagcagcagtc

SEQ ID NO: 97203 - DNA, 25 bp, Mus musculus
acactagctagtacttgtctttcca

SEQ ID NO: 97204 - DNA, 25 bp, Mus musculus
acactagctagttcttgtctttcca

SEQ ID NO: 97205 - DNA, 25 bp, Mus musculus
acactagctgggaagcatctctcag

SEQ ID NO: 97206 - DNA, 25 bp, Mus musculus
acactagctgggtagcatctctcag

SEQ ID NO: 97207 - DNA, 25 bp, Mus musculus
acactagctggtctcagtgacttaa

SEQ ID NO: 97208 - DNA, 25 bp, Mus musculus
acactagctggtgtcagtgacttaa

SEQ ID NO: 97209 - DNA, 25 bp, Mus musculus
acactagctgtgaaccccggaaaga

SEQ ID NO: 97210 - DNA, 25 bp, Mus musculus
acactagctgtgtaccccggaaaga

SEQ ID NO: 97211 - DNA, 25 bp, Mus musculus
acactaggccctacctatgagaggt

SEQ ID NO: 97212 - DNA, 25 bp, Mus musculus
acactaggcccttcctatgagaggt

SEQ ID NO: 97213 - DNA, 25 bp, Mus musculus
acactagggatcacaactgactcct

SEQ ID NO: 97214 - DNA, 25 bp, Mus musculus
acactagggatctcaactgactcct

SEQ ID NO: 97215 - DNA, 25 bp, Mus musculus
acactaggggctccacagatccaat

SEQ ID NO: 97216 - DNA, 25 bp, Mus musculus
acactaggggctgcacagatccaat

SEQ ID NO: 97217 - DNA, 25 bp, Mus musculus
acactagggttaatttgatcgttga

SEQ ID NO: 97218 - DNA, 25 bp, Mus musculus
acactagggttattttgatcgttga

SEQ ID NO: 97219 - DNA, 25 bp, Mus musculus
acactaggtagccagtttgcttcat

SEQ ID NO: 97220 - DNA, 25 bp, Mus musculus
acactaggtagcgagtttgcttcat

SEQ ID NO: 97221 - DNA, 25 bp, Mus musculus
acactaggtctacgttatggtgaag

SEQ ID NO: 97222 - DNA, 25 bp, Mus musculus
acactaggtctaggttatggtgaag

SEQ ID NO: 97223 - DNA, 25 bp, Mus musculus
acactaggtgccagggtagaagccg

SEQ ID NO: 97224 - DNA, 25 bp, Mus musculus
acactaggtgcctgggtagaagccg

SEQ ID NO: 97225 - DNA, 25 bp, Mus musculus
acactaggttttctctcgaccaatt

SEQ ID NO: 97226 - DNA, 25 bp, Mus musculus
acactaggttttgtctcgaccaatt

SEQ ID NO: 97227 - DNA, 25 bp, Mus musculus
acactagtacacattaaacattttt

SEQ ID NO: 97228 - DNA, 25 bp, Mus musculus
acactagtacactttaaacattttt

SEQ ID NO: 97229 - DNA, 25 bp, Mus musculus
acactagtcaagatgctggttcaca

SEQ ID NO: 97230 - DNA, 25 bp, Mus musculus
acactagtcaagttgctggttcaca

SEQ ID NO: 97231 - DNA, 25 bp, Mus musculus
acactagtcacactctcgacaggtt

SEQ ID NO: 97232 - DNA, 25 bp, Mus musculus
acactagtcacagtctcgacaggtt

SEQ ID NO: 97233 - DNA, 25 bp, Mus musculus
acactagtctacaggggttgcagca

SEQ ID NO: 97234 - DNA, 25 bp, Mus musculus
acactagtctactggggttgcagca

SEQ ID NO: 97235 - DNA, 25 bp, Mus musculus
acactagtgaagatgcttgttagag

SEQ ID NO: 97236 - DNA, 25 bp, Mus musculus
acactagtgaagttgcttgttagag

SEQ ID NO: 97237 - DNA, 25 bp, Mus musculus
acactagtgaatcattaggtgaatg

SEQ ID NO: 97238 - DNA, 25 bp, Mus musculus
acactagtgaatgattaggtgaatg

SEQ ID NO: 97239 - DNA, 25 bp, Mus musculus
acactagtgacacgctctgtgagac

SEQ ID NO: 97240 - DNA, 25 bp, Mus musculus
acactagtgacaggctctgtgagac

SEQ ID NO: 97241 - DNA, 25 bp, Mus musculus
acactagtgaccaaatatctcgata

SEQ ID NO: 97242 - DNA, 25 bp, Mus musculus
acactagtgacctaatatctcgata

SEQ ID NO: 97243 - DNA, 25 bp, Mus musculus
acactagtggcaccacttgttctta

SEQ ID NO: 97244 - DNA, 25 bp, Mus musculus
acactagtggcagcacttgttctta

SEQ ID NO: 97245 - DNA, 25 bp, Mus musculus
acactagtgtctatggtagggctga

SEQ ID NO: 97246 - DNA, 25 bp, Mus musculus
acactagtgtctttggtagggctga

SEQ ID NO: 97247 - DNA, 25 bp, Mus musculus
acactagttccgcagaatctaccac

SEQ ID NO: 97248 - DNA, 25 bp, Mus musculus
acactagttccggagaatctaccac

SEQ ID NO: 97249 - DNA, 25 bp, Mus musculus
acactagttcttcccaacatctgtc

SEQ ID NO: 97250 - DNA, 25 bp, Mus musculus
acactagttcttgccaacatctgtc

SEQ ID NO: 97251 - DNA, 25 bp, Mus musculus
acactataccctatgctttctagaa

SEQ ID NO: 97252 - DNA, 25 bp, Mus musculus
acactataccctttgctttctagaa

SEQ ID NO: 97253 - DNA, 25 bp, Mus musculus
acactatagtaaattctccctcaca

SEQ ID NO: 97254 - DNA, 25 bp, Mus musculus
acactatagtaatttctccctcaca

SEQ ID NO: 97255 - DNA, 25 bp, Mus musculus
acactatatctcactcatctcagaa

SEQ ID NO: 97256 - DNA, 25 bp, Mus musculus
acactatatctctctcatctcagaa

SEQ ID NO: 97257 - DNA, 25 bp, Mus musculus
acactatatctgctacacgggctga

SEQ ID NO: 97258 - DNA, 25 bp, Mus musculus
acactatatctggtacacgggctga

SEQ ID NO: 97259 - DNA, 25 bp, Mus musculus
acactatcaagtatcctgtacccaa

SEQ ID NO: 97260 - DNA, 25 bp, Mus musculus
acactatcaagtttcctgtacccaa

SEQ ID NO: 97261 - DNA, 25 bp, Mus musculus
acactatcatatcgctgtctcgctc

SEQ ID NO: 97262 - DNA, 25 bp, Mus musculus
acactatcatatggctgtctcgctc

SEQ ID NO: 97263 - DNA, 25 bp, Mus musculus
acactatccttcatgtcatgctgat

SEQ ID NO: 97264 - DNA, 25 bp, Mus musculus
acactatccttcttgtcatgctgat

SEQ ID NO: 97265 - DNA, 25 bp, Mus musculus
acactatctgtgatgtaatcggtca

SEQ ID NO: 97266 - DNA, 25 bp, Mus musculus
acactatctgtgttgtaatcggtca

SEQ ID NO: 97267 - DNA, 25 bp, Mus musculus
acactatgaatccttccctggtgat

SEQ ID NO: 97268 - DNA, 25 bp, Mus musculus
acactatgaatcgttccctggtgat

SEQ ID NO: 97269 - DNA, 25 bp, Mus musculus
acactatgacacattggccgtgctg

SEQ ID NO: 97270 - DNA, 25 bp, Mus musculus
acactatgacactttggccgtgctg

SEQ ID NO: 97271 - DNA, 25 bp, Mus musculus
acactatgattcacccagcgtttaa

SEQ ID NO: 97272 - DNA, 25 bp, Mus musculus
acactatgattctcccagcgtttaa

SEQ ID NO: 97273 - DNA, 25 bp, Mus musculus
acactatgcacgaacgtattccacc

SEQ ID NO: 97274 - DNA, 25 bp, Mus musculus
acactatgcacgtacgtattccacc

SEQ ID NO: 97275 - DNA, 25 bp, Mus musculus
acactatgcatgcatcctcacaatc

SEQ ID NO: 97276 - DNA, 25 bp, Mus musculus
acactatgcatggatcctcacaatc

SEQ ID NO: 97277 - DNA, 25 bp, Mus musculus
acactatgccccagctcggcaggat

SEQ ID NO: 97278 - DNA, 25 bp, Mus musculus
acactatgcccctgctcggcaggat

SEQ ID NO: 97279 - DNA, 25 bp, Mus musculus
acactatgttaaaagcctttgacta

SEQ ID NO: 97280 - DNA, 25 bp, Mus musculus
acactatgttaatagcctttgacta

SEQ ID NO: 97281 - DNA, 25 bp, Mus musculus
acactattaaggacccatgggcact

SEQ ID NO: 97282 - DNA, 25 bp, Mus musculus
acactattaaggtcccatgggcact

SEQ ID NO: 97283 - DNA, 25 bp, Mus musculus
acactattaatcaaccactgtctgg

SEQ ID NO: 97284 - DNA, 25 bp, Mus musculus
acactattaatctaccactgtctgg

SEQ ID NO: 97285 - DNA, 25 bp, Mus musculus
acactattcaccacttgcacaaaat

SEQ ID NO: 97286 - DNA, 25 bp, Mus musculus
acactattcacctcttgcacaaaat

SEQ ID NO: 97287 - DNA, 25 bp, Mus musculus
acactattcagaactgctgtcagga

SEQ ID NO: 97288 - DNA, 25 bp, Mus musculus
acactattcagatctgctgtcagga

SEQ ID NO: 97289 - DNA, 25 bp, Mus musculus
acactattctagcagttttcacttc

SEQ ID NO: 97290 - DNA, 25 bp, Mus musculus
acactattctaggagttttcacttc

SEQ ID NO: 97291 - DNA, 25 bp, Mus musculus
acactattgctgaccattgctgctg

SEQ ID NO: 97292 - DNA, 25 bp, Mus musculus
acactattgctgtccattgctgctg

SEQ ID NO: 97293 - DNA, 25 bp, Mus musculus
acactattggctatctgcccagaat

SEQ ID NO: 97294 - DNA, 25 bp, Mus musculus
acactattggctttctgcccagaat

SEQ ID NO: 97295 - DNA, 25 bp, Mus musculus
acactatttattactattttcattg

SEQ ID NO: 97296 - DNA, 25 bp, Mus musculus
acactatttatttctattttcattg

SEQ ID NO: 97297 - DNA, 25 bp, Mus musculus
acactatttcacactgtatattaga

SEQ ID NO: 97298 - DNA, 25 bp, Mus musculus
acactatttcactctgtatattaga

SEQ ID NO: 97299 - DNA, 25 bp, Mus musculus
acactcaaacaacctgtgagggagg

SEQ ID NO: 97300 - DNA, 25 bp, Mus musculus
acactcaaacaagctgtgagggagg

SEQ ID NO: 97301 - DNA, 25 bp, Mus musculus
acactcaacagtccatctaagcaac

SEQ ID NO: 97302 - DNA, 25 bp, Mus musculus
acactcaacagtgcatctaagcaac

SEQ ID NO: 97303 - DNA, 25 bp, Mus musculus
acactcaagacccaggacctgttgg

SEQ ID NO: 97304 - DNA, 25 bp, Mus musculus
acactcaagaccgaggacctgttgg

SEQ ID NO: 97305 - DNA, 25 bp, Mus musculus
acactcaagagcctcgagctcagaa

SEQ ID NO: 97306 - DNA, 25 bp, Mus musculus
acactcaagagcgtcgagctcagaa

SEQ ID NO: 97307 - DNA, 25 bp, Mus musculus
acactcaaggctatttcacccaaag

SEQ ID NO: 97308 - DNA, 25 bp, Mus musculus
acactcaaggctttttcacccaaag

SEQ ID NO: 97309 - DNA, 25 bp, Mus musculus
acactcaagtaaaagtctctcctcc

SEQ ID NO: 97310 - DNA, 25 bp, Mus musculus
acactcaagtaatagtctctcctcc

SEQ ID NO: 97311 - DNA, 25 bp, Mus musculus
acactcacacacacgtacattagag

SEQ ID NO: 97312 - DNA, 25 bp, Mus musculus
acactcacacactcgtacattagag

SEQ ID NO: 97313 - DNA, 25 bp, Mus musculus
acactcacacggctcctgaaagaaa

SEQ ID NO: 97314 - DNA, 25 bp, Mus musculus
acactcacacgggtcctgaaagaaa

SEQ ID NO: 97315 - DNA, 25 bp, Mus musculus
acactcacacgtatatgtatgctac

SEQ ID NO: 97316 - DNA, 25 bp, Mus musculus
acactcacacgtttatgtatgctac

SEQ ID NO: 97317 - DNA, 25 bp, Mus musculus
acactcacatgacctttctggtttg

SEQ ID NO: 97318 - DNA, 25 bp, Mus musculus
acactcacatgagctttctggtttg

SEQ ID NO: 97319 - DNA, 25 bp, Mus musculus
acactcacatgcagtgtgcacatgc

SEQ ID NO: 97320 - DNA, 25 bp, Mus musculus
acactcacatgctgtgtgcacatgc

SEQ ID NO: 97321 - DNA, 25 bp, Mus musculus
acactcacctttcacttttgcgaat

SEQ ID NO: 97322 - DNA, 25 bp, Mus musculus
acactcacctttgacttttgcgaat

SEQ ID NO: 97323 - DNA, 25 bp, Mus musculus
acactcacgcaacacacattctaag

SEQ ID NO: 97324 - DNA, 25 bp, Mus musculus
acactcacgcaagacacattctaag

SEQ ID NO: 97325 - DNA, 25 bp, Mus musculus
acactcacgttgcagagacagctgg

SEQ ID NO: 97326 - DNA, 25 bp, Mus musculus
acactcacgttggagagacagctgg

SEQ ID NO: 97327 - DNA, 25 bp, Mus musculus
acactcactactacagctgcacaat

SEQ ID NO: 97328 - DNA, 25 bp, Mus musculus
acactcactacttcagctgcacaat

SEQ ID NO: 97329 - DNA, 25 bp, Mus musculus
acactcactcgcctagagcacaaaa

SEQ ID NO: 97330 - DNA, 25 bp, Mus musculus
acactcactcgcgtagagcacaaaa

SEQ ID NO: 97331 - DNA, 25 bp, Mus musculus
acactcactgagaagtagaggtcct

SEQ ID NO: 97332 - DNA, 25 bp, Mus musculus
acactcactgagtagtagaggtcct

SEQ ID NO: 97333 - DNA, 25 bp, Mus musculus
acactcactggtcgttgccataaac

SEQ ID NO: 97334 - DNA, 25 bp, Mus musculus
acactcactggtggttgccataaac

SEQ ID NO: 97335 - DNA, 25 bp, Mus musculus
acactcacttggcagacttttattt

SEQ ID NO: 97336 - DNA, 25 bp, Mus musculus
acactcacttgggagacttttattt

SEQ ID NO: 97337 - DNA, 25 bp, Mus musculus
acactcagaccacacatattcacag

SEQ ID NO: 97338 - DNA, 25 bp, Mus musculus
acactcagaccagacatattcacag

SEQ ID NO: 97339 - DNA, 25 bp, Mus musculus
acactcagaggcaccacatgggctg

SEQ ID NO: 97340 - DNA, 25 bp, Mus musculus
acactcagaggctccacatgggctg

SEQ ID NO: 97341 - DNA, 25 bp, Mus musculus
acactcagagttcccctgacagagc

SEQ ID NO: 97342 - DNA, 25 bp, Mus musculus
acactcagagttgccctgacagagc

SEQ ID NO: 97343 - DNA, 25 bp, Mus musculus
acactcagcaggcatacatttttat

SEQ ID NO: 97344 - DNA, 25 bp, Mus musculus
acactcagcagggatacatttttat

SEQ ID NO: 97345 - DNA, 25 bp, Mus musculus
acactcagcctgcttttaagggact

SEQ ID NO: 97346 - DNA, 25 bp, Mus musculus
acactcagcctggttttaagggact

SEQ ID NO: 97347 - DNA, 25 bp, Mus musculus
acactcagcggtcatgtctggacat

SEQ ID NO: 97348 - DNA, 25 bp, Mus musculus
acactcagcggtgatgtctggacat

SEQ ID NO: 97349 - DNA, 25 bp, Mus musculus
acactcaggctcaggcgcaagactg

SEQ ID NO: 97350 - DNA, 25 bp, Mus musculus
acactcaggctctggcgcaagactg

SEQ ID NO: 97351 - DNA, 25 bp, Mus musculus
acactcagggagacgctggctctag

SEQ ID NO: 97352 - DNA, 25 bp, Mus musculus
acactcagggagtcgctggctctag

SEQ ID NO: 97353 - DNA, 25 bp, Mus musculus
acactcaggtctactttaaaattag

SEQ ID NO: 97354 - DNA, 25 bp, Mus musculus
acactcaggtcttctttaaaattag

SEQ ID NO: 97355 - DNA, 25 bp, Mus musculus
acactcagtggtcggcgtaattcca

SEQ ID NO: 97356 - DNA, 25 bp, Mus musculus
acactcagtggtgggcgtaattcca

SEQ ID NO: 97357 - DNA, 25 bp, Mus musculus
acactcagtgttattcctgcttttt

SEQ ID NO: 97358 - DNA, 25 bp, Mus musculus
acactcagtgtttttcctgcttttt

SEQ ID NO: 97359 - DNA, 25 bp, Mus musculus
acactcagttctcgatgtggtgctg

SEQ ID NO: 97360 - DNA, 25 bp, Mus musculus
acactcagttctggatgtggtgctg

SEQ ID NO: 97361 - DNA, 25 bp, Mus musculus
acactcagtttaacttggcgcagcc

SEQ ID NO: 97362 - DNA, 25 bp, Mus musculus
acactcagtttatcttggcgcagcc

SEQ ID NO: 97363 - DNA, 25 bp, Mus musculus
acactcagtttcaactttcttaagc

SEQ ID NO: 97364 - DNA, 25 bp, Mus musculus
acactcagtttctactttcttaagc

SEQ ID NO: 97365 - DNA, 25 bp, Mus musculus
acactcataactcatgccattctgg

SEQ ID NO: 97366 - DNA, 25 bp, Mus musculus
acactcataactgatgccattctgg

SEQ ID NO: 97367 - DNA, 25 bp, Mus musculus
acactcatacttcgtctgctggttc

SEQ ID NO: 97368 - DNA, 25 bp, Mus musculus
acactcatacttggtctgctggttc

SEQ ID NO: 97369 - DNA, 25 bp, Mus musculus
acactcatcattctgtctctctggt

SEQ ID NO: 97370 - DNA, 25 bp, Mus musculus
acactcatcattgtgtctctctggt

SEQ ID NO: 97371 - DNA, 25 bp, Mus musculus
acactcatctacagatgctgcggag

SEQ ID NO: 97372 - DNA, 25 bp, Mus musculus
acactcatctactgatgctgcggag

SEQ ID NO: 97373 - DNA, 25 bp, Mus musculus
acactcatgatcacagcacaggcag

SEQ ID NO: 97374 - DNA, 25 bp, Mus musculus
acactcatgatctcagcacaggcag

SEQ ID NO: 97375 - DNA, 25 bp, Mus musculus
acactcatgcatacactctattgac

SEQ ID NO: 97376 - DNA, 25 bp, Mus musculus
acactcatgcattcactctattgac

SEQ ID NO: 97377 - DNA, 25 bp, Mus musculus
acactcatggcgagttctcatttga

SEQ ID NO: 97378 - DNA, 25 bp, Mus musculus
acactcatggcgtgttctcatttga

SEQ ID NO: 97379 - DNA, 25 bp, Mus musculus
acactcattccaagtagagggtgac

SEQ ID NO: 97380 - DNA, 25 bp, Mus musculus
acactcattccatgtagagggtgac

SEQ ID NO: 97381 - DNA, 25 bp, Mus musculus
acactcattccgactgggtagggta

SEQ ID NO: 97382 - DNA, 25 bp, Mus musculus
acactcattccgtctgggtagggta

SEQ ID NO: 97383 - DNA, 25 bp, Mus musculus
acactcattctccaaggccaaaggg

SEQ ID NO: 97384 - DNA, 25 bp, Mus musculus
acactcattctcgaaggccaaaggg

SEQ ID NO: 97385 - DNA, 25 bp, Mus musculus
acactcattgagattttgcacccaa

SEQ ID NO: 97386 - DNA, 25 bp, Mus musculus
acactcattgagtttttgcacccaa

SEQ ID NO: 97387 - DNA, 25 bp, Mus musculus
acactcatttcccagaacgccgttt

SEQ ID NO: 97388 - DNA, 25 bp, Mus musculus
acactcatttccgagaacgccgttt

SEQ ID NO: 97389 - DNA, 25 bp, Mus musculus
acactcatttgacgtcccaggtgaa

SEQ ID NO: 97390 - DNA, 25 bp, Mus musculus
acactcatttgaggtcccaggtgaa

SEQ ID NO: 97391 - DNA, 25 bp, Mus musculus
acactccaaagcaccactgaatgaa

SEQ ID NO: 97392 - DNA, 25 bp, Mus musculus
acactccaaagctccactgaatgaa

SEQ ID NO: 97393 - DNA, 25 bp, Mus musculus
acactccaaggaattgctctgatga

SEQ ID NO: 97394 - DNA, 25 bp, Mus musculus
acactccaaggatttgctctgatga

SEQ ID NO: 97395 - DNA, 25 bp, Mus musculus
acactccaccagaagataactttag

SEQ ID NO: 97396 - DNA, 25 bp, Mus musculus
acactccaccagtagataactttag

SEQ ID NO: 97397 - DNA, 25 bp, Mus musculus
acactccacgcacatgtgtgcaggc

SEQ ID NO: 97398 - DNA, 25 bp, Mus musculus
acactccacgcagatgtgtgcaggc

SEQ ID NO: 97399 - DNA, 25 bp, Mus musculus
acactccacgtgcaaattcggctgt

SEQ ID NO: 97400 - DNA, 25 bp, Mus musculus
acactccacgtggaaattcggctgt

SEQ ID NO: 97401 - DNA, 25 bp, Mus musculus
acactccaggatctccagcatcgga

SEQ ID NO: 97402 - DNA, 25 bp, Mus musculus
acactccaggatgtccagcatcgga

SEQ ID NO: 97403 - DNA, 25 bp, Mus musculus
acactccagttcagtgcttttgtgt

SEQ ID NO: 97404 - DNA, 25 bp, Mus musculus
acactccagttctgtgcttttgtgt

SEQ ID NO: 97405 - DNA, 25 bp, Mus musculus
acactccatacaaagcacgcgttag

SEQ ID NO: 97406 - DNA, 25 bp, Mus musculus
acactccatacatagcacgcgttag

SEQ ID NO: 97407 - DNA, 25 bp, Mus musculus
acactcccagagataccctgagata

SEQ ID NO: 97408 - DNA, 25 bp, Mus musculus
acactcccagagttaccctgagata

SEQ ID NO: 97409 - DNA, 25 bp, Mus musculus
acactcccgaaacttggccaatgag

SEQ ID NO: 97410 - DNA, 25 bp, Mus musculus
acactcccgaaagttggccaatgag

SEQ ID NO: 97411 - DNA, 25 bp, Mus musculus
acactcccgagcctggacatggtgg

SEQ ID NO: 97412 - DNA, 25 bp, Mus musculus
acactcccgagcgtggacatggtgg

SEQ ID NO: 97413 - DNA, 25 bp, Mus musculus
acactcccgcgcagatatacacatg

SEQ ID NO: 97414 - DNA, 25 bp, Mus musculus
acactcccgcgctgatatacacatg

SEQ ID NO: 97415 - DNA, 25 bp, Mus musculus
acactccctactcatttaacttgaa

SEQ ID NO: 97416 - DNA, 25 bp, Mus musculus
acactccctactgatttaacttgaa

SEQ ID NO: 97417 - DNA, 25 bp, Mus musculus
acactccctgaccttataatcttat

SEQ ID NO: 97418 - DNA, 25 bp, Mus musculus
acactccctgacgttataatcttat

SEQ ID NO: 97419 - DNA, 25 bp, Mus musculus
acactccctgtgaggaactcatttt

SEQ ID NO: 97420 - DNA, 25 bp, Mus musculus
acactccctgtgtggaactcatttt

SEQ ID NO: 97421 - DNA, 25 bp, Mus musculus
acactccctgttaatctagtctctc

SEQ ID NO: 97422 - DNA, 25 bp, Mus musculus
acactccctgtttatctagtctctc

SEQ ID NO: 97423 - DNA, 25 bp, Mus musculus
acactccgaagaactgtctctcaga

SEQ ID NO: 97424 - DNA, 25 bp, Mus musculus
acactccgaagatctgtctctcaga

SEQ ID NO: 97425 - DNA, 25 bp, Mus musculus
acactccgcaatcggcatttcaaca

SEQ ID NO: 97426 - DNA, 25 bp, Mus musculus
acactccgcaatgggcatttcaaca

SEQ ID NO: 97427 - DNA, 25 bp, Mus musculus
acactccgggcacgcgacagagtat

SEQ ID NO: 97428 - DNA, 25 bp, Mus musculus
acactccgggcaggcgacagagtat

SEQ ID NO: 97429 - DNA, 25 bp, Mus musculus
acactcctaattatcagccacaaag

SEQ ID NO: 97430 - DNA, 25 bp, Mus musculus
acactcctaattttcagccacaaag

SEQ ID NO: 97431 - DNA, 25 bp, Mus musculus
acactcctacacaatgactgcattc

SEQ ID NO: 97432 - DNA, 25 bp, Mus musculus
acactcctacactatgactgcattc

SEQ ID NO: 97433 - DNA, 25 bp, Mus musculus
acactcctattaaacgctgtctgca

SEQ ID NO: 97434 - DNA, 25 bp, Mus musculus
acactcctattatacgctgtctgca

SEQ ID NO: 97435 - DNA, 25 bp, Mus musculus
acactcctcaggactcaagcagggt

SEQ ID NO: 97436 - DNA, 25 bp, Mus musculus
acactcctcaggtctcaagcagggt

SEQ ID NO: 97437 - DNA, 25 bp, Mus musculus
acactcctcctaatttccagaagtg

SEQ ID NO: 97438 - DNA, 25 bp, Mus musculus
acactcctcctattttccagaagtg

SEQ ID NO: 97439 - DNA, 25 bp, Mus musculus
acactcctcgtgaggctggatctca

SEQ ID NO: 97440 - DNA, 25 bp, Mus musculus
acactcctcgtgtggctggatctca

SEQ ID NO: 97441 - DNA, 25 bp, Mus musculus
acactcctctaccacattgtgtttt

SEQ ID NO: 97442 - DNA, 25 bp, Mus musculus
acactcctctacgacattgtgtttt

SEQ ID NO: 97443 - DNA, 25 bp, Mus musculus
acactcctgagtacggtgggaacct

SEQ ID NO: 97444 - DNA, 25 bp, Mus musculus
acactcctgagttcggtgggaacct

SEQ ID NO: 97445 - DNA, 25 bp, Mus musculus
acactcctgcctctcattgggcggt

SEQ ID NO: 97446 - DNA, 25 bp, Mus musculus
acactcctgcctgtcattgggcggt

SEQ ID NO: 97447 - DNA, 25 bp, Mus musculus
acactcctgcgacggctgtgggaat

SEQ ID NO: 97448 - DNA, 25 bp, Mus musculus
acactcctgcgagggctgtgggaat

SEQ ID NO: 97449 - DNA, 25 bp, Mus musculus
acactcctggagaagtctattttct

SEQ ID NO: 97450 - DNA, 25 bp, Mus musculus
acactcctggagtagtctattttct

SEQ ID NO: 97451 - DNA, 25 bp, Mus musculus
acactcctggccaagtttctaagtt

SEQ ID NO: 97452 - DNA, 25 bp, Mus musculus
acactcctggcctagtttctaagtt

SEQ ID NO: 97453 - DNA, 25 bp, Mus musculus
acactcctgggtactcttactgcat

SEQ ID NO: 97454 - DNA, 25 bp, Mus musculus
acactcctgggttctcttactgcat

SEQ ID NO: 97455 - DNA, 25 bp, Mus musculus
acactcctgtgtactgcatcttgga

SEQ ID NO: 97456 - DNA, 25 bp, Mus musculus
acactcctgtgttctgcatcttgga

SEQ ID NO: 97457 - DNA, 25 bp, Mus musculus
acactcctgttactcggacactgaa

SEQ ID NO: 97458 - DNA, 25 bp, Mus musculus
acactcctgttagtcggacactgaa

SEQ ID NO: 97459 - DNA, 25 bp, Mus musculus
acactccttaccactggagggatac

SEQ ID NO: 97460 - DNA, 25 bp, Mus musculus
acactccttacctctggagggatac

SEQ ID NO: 97461 - DNA, 25 bp, Mus musculus
acactccttcccattctatatggat

SEQ ID NO: 97462 - DNA, 25 bp, Mus musculus
acactccttccctttctatatggat

SEQ ID NO: 97463 - DNA, 25 bp, Mus musculus
acactccttgaaccccaagatgtag

SEQ ID NO: 97464 - DNA, 25 bp, Mus musculus
acactccttgaagcccaagatgtag

SEQ ID NO: 97465 - DNA, 25 bp, Mus musculus
acactcgaatcgctacattgctttt

SEQ ID NO: 97466 - DNA, 25 bp, Mus musculus
acactcgaatcggtacattgctttt

SEQ ID NO: 97467 - DNA, 25 bp, Mus musculus
acactcgagagcaggccaggattga

SEQ ID NO: 97468 - DNA, 25 bp, Mus musculus
acactcgagagctggccaggattga

SEQ ID NO: 97469 - DNA, 25 bp, Mus musculus
acactcgccattcaattttatgttc

SEQ ID NO: 97470 - DNA, 25 bp, Mus musculus
acactcgccattgaattttatgttc

SEQ ID NO: 97471 - DNA, 25 bp, Mus musculus
acactcgccctcacagtgaatgttc

SEQ ID NO: 97472 - DNA, 25 bp, Mus musculus
acactcgccctctcagtgaatgttc

SEQ ID NO: 97473 - DNA, 25 bp, Mus musculus
acactcgctgtgcttcgttgaagcg

SEQ ID NO: 97474 - DNA, 25 bp, Mus musculus
acactcgctgtggttcgttgaagcg

SEQ ID NO: 97475 - DNA, 25 bp, Mus musculus
acactcggctcaacgtgttcgaaaa

SEQ ID NO: 97476 - DNA, 25 bp, Mus musculus
acactcggctcatcgtgttcgaaaa

SEQ ID NO: 97477 - DNA, 25 bp, Mus musculus
acactcgggtcaacaaactcacatt

SEQ ID NO: 97478 - DNA, 25 bp, Mus musculus
acactcgggtcatcaaactcacatt

SEQ ID NO: 97479 - DNA, 25 bp, Mus musculus
acactcggtgggcatttctcctggg

SEQ ID NO: 97480 - DNA, 25 bp, Mus musculus
acactcggtggggatttctcctggg

SEQ ID NO: 97481 - DNA, 25 bp, Mus musculus
acactcggttctaacactggatcat

SEQ ID NO: 97482 - DNA, 25 bp, Mus musculus
acactcggttcttacactggatcat

SEQ ID NO: 97483 - DNA, 25 bp, Mus musculus
acactcggttgtatgttgttctcac

SEQ ID NO: 97484 - DNA, 25 bp, Mus musculus
acactcggttgtttgttgttctcac

SEQ ID NO: 97485 - DNA, 25 bp, Mus musculus
acactcgtgcgaaggttgggtactg

SEQ ID NO: 97486 - DNA, 25 bp, Mus musculus
acactcgtgcgatggttgggtactg

SEQ ID NO: 97487 - DNA, 25 bp, Mus musculus
acactcgttggaatctttcccaggc

SEQ ID NO: 97488 - DNA, 25 bp, Mus musculus
acactcgttggattctttcccaggc

SEQ ID NO: 97489 - DNA, 25 bp, Mus musculus
acactctaaaagatttggctgaaag

SEQ ID NO: 97490 - DNA, 25 bp, Mus musculus
acactctaaaagttttggctgaaag

SEQ ID NO: 97491 - DNA, 25 bp, Mus musculus
acactctaccaactttgtcattgca

SEQ ID NO: 97492 - DNA, 25 bp, Mus musculus
acactctaccaagtttgtcattgca

SEQ ID NO: 97493 - DNA, 25 bp, Mus musculus
acactctaggccatctattaaaagc

SEQ ID NO: 97494 - DNA, 25 bp, Mus musculus
acactctaggccttctattaaaagc

SEQ ID NO: 97495 - DNA, 25 bp, Mus musculus
acactctagtagagcttgcctgtcc

SEQ ID NO: 97496 - DNA, 25 bp, Mus musculus
acactctagtagtgcttgcctgtcc

SEQ ID NO: 97497 - DNA, 25 bp, Mus musculus
acactctcaaacctaaggctctggg

SEQ ID NO: 97498 - DNA, 25 bp, Mus musculus
acactctcaaacgtaaggctctggg

SEQ ID NO: 97499 - DNA, 25 bp, Mus musculus
acactctcacttcttggtagcttct

SEQ ID NO: 97500 - DNA, 25 bp, Mus musculus
acactctcacttgttggtagcttct

SEQ ID NO: 97501 - DNA, 25 bp, Mus musculus
acactctcattcactatccacagtt

SEQ ID NO: 97502 - DNA, 25 bp, Mus musculus
acactctcattctctatccacagtt

SEQ ID NO: 97503 - DNA, 25 bp, Mus musculus
acactctcattgattgtaagggaag

SEQ ID NO: 97504 - DNA, 25 bp, Mus musculus
acactctcattgtttgtaagggaag

SEQ ID NO: 97505 - DNA, 25 bp, Mus musculus
acactctccataaaattgctcctat

SEQ ID NO: 97506 - DNA, 25 bp, Mus musculus
acactctccatataattgctcctat

SEQ ID NO: 97507 - DNA, 25 bp, Mus musculus
acactctcgtgcaggtatttcttta

SEQ ID NO: 97508 - DNA, 25 bp, Mus musculus
acactctcgtgctggtatttcttta

SEQ ID NO: 97509 - DNA, 25 bp, Mus musculus
acactctctataaacacatgctatg

SEQ ID NO: 97510 - DNA, 25 bp, Mus musculus
acactctctatatacacatgctatg

SEQ ID NO: 97511 - DNA, 25 bp, Mus musculus
acactctctcaaattgcctatcaga

SEQ ID NO: 97512 - DNA, 25 bp, Mus musculus
acactctctcaatttgcctatcaga

SEQ ID NO: 97513 - DNA, 25 bp, Mus musculus
acactctctctgaaaagcccgaatc

SEQ ID NO: 97514 - DNA, 25 bp, Mus musculus
acactctctctgtaaagcccgaatc

SEQ ID NO: 97515 - DNA, 25 bp, Mus musculus
acactctctgtgacgagcactaggt

SEQ ID NO: 97516 - DNA, 25 bp, Mus musculus
acactctctgtgtcgagcactaggt

SEQ ID NO: 97517 - DNA, 25 bp, Mus musculus
acactctgaagaaagccggaatgct

SEQ ID NO: 97518 - DNA, 25 bp, Mus musculus
acactctgaagatagccggaatgct

SEQ ID NO: 97519 - DNA, 25 bp, Mus musculus
acactctgagctagctctcatttta

SEQ ID NO: 97520 - DNA, 25 bp, Mus musculus
acactctgagcttgctctcatttta

SEQ ID NO: 97521 - DNA, 25 bp, Mus musculus
acactctgaggtcagggctgaagcc

SEQ ID NO: 97522 - DNA, 25 bp, Mus musculus
acactctgaggtgagggctgaagcc

SEQ ID NO: 97523 - DNA, 25 bp, Mus musculus
acactctgcagacatcttgcttctc

SEQ ID NO: 97524 - DNA, 25 bp, Mus musculus
acactctgcagagatcttgcttctc

SEQ ID NO: 97525 - DNA, 25 bp, Mus musculus
acactctgccttctcttttgagtat

SEQ ID NO: 97526 - DNA, 25 bp, Mus musculus
acactctgccttgtcttttgagtat

SEQ ID NO: 97527 - DNA, 25 bp, Mus musculus
acactctgctcacagctatcagaaa

SEQ ID NO: 97528 - DNA, 25 bp, Mus musculus
acactctgctcagagctatcagaaa

SEQ ID NO: 97529 - DNA, 25 bp, Mus musculus
acactctgctctacacgttataatt

SEQ ID NO: 97530 - DNA, 25 bp, Mus musculus
acactctgctcttcacgttataatt

SEQ ID NO: 97531 - DNA, 25 bp, Mus musculus
acactctggactactactgtcagga

SEQ ID NO: 97532 - DNA, 25 bp, Mus musculus
acactctggacttctactgtcagga

SEQ ID NO: 97533 - DNA, 25 bp, Mus musculus
acactctgggtgatttgttgtgcaa

SEQ ID NO: 97534 - DNA, 25 bp, Mus musculus
acactctgggtgttttgttgtgcaa

SEQ ID NO: 97535 - DNA, 25 bp, Mus musculus
acactctggtctccttcggtgacag

SEQ ID NO: 97536 - DNA, 25 bp, Mus musculus
acactctggtctgcttcggtgacag

SEQ ID NO: 97537 - DNA, 25 bp, Mus musculus
acactctgtatacctgacgtattca

SEQ ID NO: 97538 - DNA, 25 bp, Mus musculus
acactctgtatagctgacgtattca

SEQ ID NO: 97539 - DNA, 25 bp, Mus musculus
acactctgtcagatctccgagagaa

SEQ ID NO: 97540 - DNA, 25 bp, Mus musculus
acactctgtcagttctccgagagaa

SEQ ID NO: 97541 - DNA, 25 bp, Mus musculus
acactctgtcatccacacgggaaga

SEQ ID NO: 97542 - DNA, 25 bp, Mus musculus
acactctgtcatgcacacgggaaga

SEQ ID NO: 97543 - DNA, 25 bp, Mus musculus
acactctgtggacatggagcttcag

SEQ ID NO: 97544 - DNA, 25 bp, Mus musculus
acactctgtggagatggagcttcag

SEQ ID NO: 97545 - DNA, 25 bp, Mus musculus
acactcttaacgactatgggctgaa

SEQ ID NO: 97546 - DNA, 25 bp, Mus musculus
acactcttaacgtctatgggctgaa

SEQ ID NO: 97547 - DNA, 25 bp, Mus musculus
acactcttaagtcttaccacttcag

SEQ ID NO: 97548 - DNA, 25 bp, Mus musculus
acactcttaagtgttaccacttcag

SEQ ID NO: 97549 - DNA, 25 bp, Mus musculus
acactcttagtaaagcatttaccat

SEQ ID NO: 97550 - DNA, 25 bp, Mus musculus
acactcttagtatagcatttaccat

SEQ ID NO: 97551 - DNA, 25 bp, Mus musculus
acactcttagttacttggttcaggc

SEQ ID NO: 97552 - DNA, 25 bp, Mus musculus
acactcttagtttcttggttcaggc

SEQ ID NO: 97553 - DNA, 25 bp, Mus musculus
acactcttcaggcacaaaggtcaat

SEQ ID NO: 97554 - DNA, 25 bp, Mus musculus
acactcttcagggacaaaggtcaat

SEQ ID NO: 97555 - DNA, 25 bp, Mus musculus
acactcttccctctttgaataatgc

SEQ ID NO: 97556 - DNA, 25 bp, Mus musculus
acactcttccctgtttgaataatgc

SEQ ID NO: 97557 - DNA, 25 bp, Mus musculus
acactcttccttagcctaagcttta

SEQ ID NO: 97558 - DNA, 25 bp, Mus musculus
acactcttcctttgcctaagcttta

SEQ ID NO: 97559 - DNA, 25 bp, Mus musculus
acactcttctccatagagcattggt

SEQ ID NO: 97560 - DNA, 25 bp, Mus musculus
acactcttctccttagagcattggt

SEQ ID NO: 97561 - DNA, 25 bp, Mus musculus
acactcttgagaagacgacaggcca

SEQ ID NO: 97562 - DNA, 25 bp, Mus musculus
acactcttgagatgacgacaggcca

SEQ ID NO: 97563 - DNA, 25 bp, Mus musculus
acactcttgtggatggcactgactt

SEQ ID NO: 97564 - DNA, 25 bp, Mus musculus
acactcttgtggcacgtgtcatata

SEQ ID NO: 97565 - DNA, 25 bp, Mus musculus
acactcttgtgggacgtgtcatata

SEQ ID NO: 97566 - DNA, 25 bp, Mus musculus
acactcttgtggttggcactgactt

SEQ ID NO: 97567 - DNA, 25 bp, Mus musculus
acactcttgttcaccgggcgaggtg

SEQ ID NO: 97568 - DNA, 25 bp, Mus musculus
acactcttgttctccgggcgaggtg

SEQ ID NO: 97569 - DNA, 25 bp, Mus musculus
acactctttagccaggatcaggcac

SEQ ID NO: 97570 - DNA, 25 bp, Mus musculus
acactctttagcgaggatcaggcac

SEQ ID NO: 97571 - DNA, 25 bp, Mus musculus
acactctttagtccttagttgactt

SEQ ID NO: 97572 - DNA, 25 bp, Mus musculus
acactctttagtgcttagttgactt

SEQ ID NO: 97573 - DNA, 25 bp, Mus musculus
acactctttattcacctccatgtat

SEQ ID NO: 97574 - DNA, 25 bp, Mus musculus
acactctttattgacctccatgtat

SEQ ID NO: 97575 - DNA, 25 bp, Mus musculus
acactctttcctcaactgtcgtagt

SEQ ID NO: 97576 - DNA, 25 bp, Mus musculus
acactctttcctgaactgtcgtagt

SEQ ID NO: 97577 - DNA, 25 bp, Mus musculus
acactcttttcacgtacttctagta

SEQ ID NO: 97578 - DNA, 25 bp, Mus musculus
acactcttttcaggtacttctagta

SEQ ID NO: 97579 - DNA, 25 bp, Mus musculus
acactgaaaatgaccactttgttag

SEQ ID NO: 97580 - DNA, 25 bp, Mus musculus
acactgaaaatgtccactttgttag

SEQ ID NO: 97581 - DNA, 25 bp, Mus musculus
acactgaaaccccaactatctgaag

SEQ ID NO: 97582 - DNA, 25 bp, Mus musculus
acactgaaacccgaactatctgaag

SEQ ID NO: 97583 - DNA, 25 bp, Mus musculus
acactgaaactcctatagatgctga

SEQ ID NO: 97584 - DNA, 25 bp, Mus musculus
acactgaaactcgtatagatgctga

SEQ ID NO: 97585 - DNA, 25 bp, Mus musculus
acactgaaatgcatactgtatctga

SEQ ID NO: 97586 - DNA, 25 bp, Mus musculus
acactgaaatgcttactgtatctga

SEQ ID NO: 97587 - DNA, 25 bp, Mus musculus
acactgaaccggcacatggcttctt

SEQ ID NO: 97588 - DNA, 25 bp, Mus musculus
acactgaaccgggacatggcttctt

SEQ ID NO: 97589 - DNA, 25 bp, Mus musculus
acactgaagcacctctatcgtccat

SEQ ID NO: 97590 - DNA, 25 bp, Mus musculus
acactgaagcacgtctatcgtccat

SEQ ID NO: 97591 - DNA, 25 bp, Mus musculus
acactgaaggaacctgccgggtgct

SEQ ID NO: 97592 - DNA, 25 bp, Mus musculus
acactgaaggaacgagccagcttta

SEQ ID NO: 97593 - DNA, 25 bp, Mus musculus
acactgaaggaagctgccgggtgct

SEQ ID NO: 97594 - DNA, 25 bp, Mus musculus
acactgaaggaaggagccagcttta

SEQ ID NO: 97595 - DNA, 25 bp, Mus musculus
acactgaagtagctgtctgcctgga

SEQ ID NO: 97596 - DNA, 25 bp, Mus musculus
acactgaagtaggtgtctgcctgga

SEQ ID NO: 97597 - DNA, 25 bp, Mus musculus
acactgaatataccaacttggttct

SEQ ID NO: 97598 - DNA, 25 bp, Mus musculus
acactgaatatagcaacttggttct

SEQ ID NO: 97599 - DNA, 25 bp, Mus musculus
acactgaatctgagttcccgattca

SEQ ID NO: 97600 - DNA, 25 bp, Mus musculus
acactgaatctgtgttcccgattca

SEQ ID NO: 97601 - DNA, 25 bp, Mus musculus
acactgaatcttagagcaacttcga

SEQ ID NO: 97602 - DNA, 25 bp, Mus musculus
acactgaatctttgagcaacttcga

SEQ ID NO: 97603 - DNA, 25 bp, Mus musculus
acactgacacttcttcctatgtggg

SEQ ID NO: 97604 - DNA, 25 bp, Mus musculus
acactgacacttgttcctatgtggg

SEQ ID NO: 97605 - DNA, 25 bp, Mus musculus
acactgacatccattctggactgaa

SEQ ID NO: 97606 - DNA, 25 bp, Mus musculus
acactgacatcctttctggactgaa

SEQ ID NO: 97607 - DNA, 25 bp, Mus musculus
acactgacatcgagacttggtgctg

SEQ ID NO: 97608 - DNA, 25 bp, Mus musculus
acactgacatcgtgacttggtgctg

SEQ ID NO: 97609 - DNA, 25 bp, Mus musculus
acactgaccaagatctttgaggcat

SEQ ID NO: 97610 - DNA, 25 bp, Mus musculus
acactgaccaagttctttgaggcat

SEQ ID NO: 97611 - DNA, 25 bp, Mus musculus
acactgaccaataacttgtttccat

SEQ ID NO: 97612 - DNA, 25 bp, Mus musculus
acactgaccaattacttgtttccat

SEQ ID NO: 97613 - DNA, 25 bp, Mus musculus
acactgaccaccatattgctgagta

SEQ ID NO: 97614 - DNA, 25 bp, Mus musculus
acactgaccaccttattgctgagta

SEQ ID NO: 97615 - DNA, 25 bp, Mus musculus
acactgaccatgaaatgccacctat

SEQ ID NO: 97616 - DNA, 25 bp, Mus musculus
acactgaccatgtaatgccacctat

SEQ ID NO: 97617 - DNA, 25 bp, Mus musculus
acactgacccacctgaatcactgtt

SEQ ID NO: 97618 - DNA, 25 bp, Mus musculus
acactgacccacgtgaatcactgtt

SEQ ID NO: 97619 - DNA, 25 bp, Mus musculus
acactgacccagaagcttaaagaac

SEQ ID NO: 97620 - DNA, 25 bp, Mus musculus
acactgacccagtagcttaaagaac

SEQ ID NO: 97621 - DNA, 25 bp, Mus musculus
acactgacgaatcgtcagcgctcct

SEQ ID NO: 97622 - DNA, 25 bp, Mus musculus
acactgacgaatggtcagcgctcct

SEQ ID NO: 97623 - DNA, 25 bp, Mus musculus
acactgacgtctcccaaagcgaata

SEQ ID NO: 97624 - DNA, 25 bp, Mus musculus
acactgacgtctgccaaagcgaata

SEQ ID NO: 97625 - DNA, 25 bp, Mus musculus
acactgactcctattgttttcattg

SEQ ID NO: 97626 - DNA, 25 bp, Mus musculus
acactgactccttttgttttcattg

SEQ ID NO: 97627 - DNA, 25 bp, Mus musculus
acactgactctaagggtcccaccgg

SEQ ID NO: 97628 - DNA, 25 bp, Mus musculus
acactgactctatgggtcccaccgg

SEQ ID NO: 97629 - DNA, 25 bp, Mus musculus
acactgactgatcttgaaaacctgt

SEQ ID NO: 97630 - DNA, 25 bp, Mus musculus
acactgactgatgttgaaaacctgt

SEQ ID NO: 97631 - DNA, 25 bp, Mus musculus
acactgactggtccattgactgctt

SEQ ID NO: 97632 - DNA, 25 bp, Mus musculus
acactgactggtgcattgactgctt

SEQ ID NO: 97633 - DNA, 25 bp, Mus musculus
acactgagaaagaaataatccattt

SEQ ID NO: 97634 - DNA, 25 bp, Mus musculus
acactgagaaagtaataatccattt

SEQ ID NO: 97635 - DNA, 25 bp, Mus musculus
acactgagaacaaccgccgtgtctt

SEQ ID NO: 97636 - DNA, 25 bp, Mus musculus
acactgagaacatccgccgtgtctt

SEQ ID NO: 97637 - DNA, 25 bp, Mus musculus
acactgagaaccaggactgggtgta

SEQ ID NO: 97638 - DNA, 25 bp, Mus musculus
acactgagaacctggactgggtgta

SEQ ID NO: 97639 - DNA, 25 bp, Mus musculus
acactgagaatcagtaggctcttgt

SEQ ID NO: 97640 - DNA, 25 bp, Mus musculus
acactgagaatctgtaggctcttgt

SEQ ID NO: 97641 - DNA, 25 bp, Mus musculus
acactgagctaacagactcttgtct

SEQ ID NO: 97642 - DNA, 25 bp, Mus musculus
acactgagctaagagactcttgtct

SEQ ID NO: 97643 - DNA, 25 bp, Mus musculus
acactgagctatcacccactgaccc

SEQ ID NO: 97644 - DNA, 25 bp, Mus musculus
acactgagctatgacccactgaccc

SEQ ID NO: 97645 - DNA, 25 bp, Mus musculus
acactgagcttcagtccacgtattt

SEQ ID NO: 97646 - DNA, 25 bp, Mus musculus
acactgagcttctgtccacgtattt

SEQ ID NO: 97647 - DNA, 25 bp, Mus musculus
acactgaggattcagcccacggtca

SEQ ID NO: 97648 - DNA, 25 bp, Mus musculus
acactgaggattgagcccacggtca

SEQ ID NO: 97649 - DNA, 25 bp, Mus musculus
acactgagggcgctgcttcaatgag

SEQ ID NO: 97650 - DNA, 25 bp, Mus musculus
acactgagggcggtgcttcaatgag

SEQ ID NO: 97651 - DNA, 25 bp, Mus musculus
acactgagggctccccagcctcaga

SEQ ID NO: 97652 - DNA, 25 bp, Mus musculus
acactgagggctgcccagcctcaga

SEQ ID NO: 97653 - DNA, 25 bp, Mus musculus
acactgagttcgaggccgacctgag

SEQ ID NO: 97654 - DNA, 25 bp, Mus musculus
acactgagttcgtggccgacctgag

SEQ ID NO: 97655 - DNA, 25 bp, Mus musculus
acactgagttgcagggctgcgctaa

SEQ ID NO: 97656 - DNA, 25 bp, Mus musculus
acactgagttgctgggctgcgctaa

SEQ ID NO: 97657 - DNA, 25 bp, Mus musculus
acactgatacctacatggccaggta

SEQ ID NO: 97658 - DNA, 25 bp, Mus musculus
acactgataccttcatggccaggta

SEQ ID NO: 97659 - DNA, 25 bp, Mus musculus
acactgatatgcacctcgactagag

SEQ ID NO: 97660 - DNA, 25 bp, Mus musculus
acactgatatgctcctcgactagag

SEQ ID NO: 97661 - DNA, 25 bp, Mus musculus
acactgatcctgctcctggctggaa

SEQ ID NO: 97662 - DNA, 25 bp, Mus musculus
acactgatcctggtcctggctggaa

SEQ ID NO: 97663 - DNA, 25 bp, Mus musculus
acactgatctacatttggtctcttc

SEQ ID NO: 97664 - DNA, 25 bp, Mus musculus
acactgatctacttttggtctcttc

SEQ ID NO: 97665 - DNA, 25 bp, Mus musculus
acactgatctctagacctttctagc

SEQ ID NO: 97666 - DNA, 25 bp, Mus musculus
acactgatctcttgacctttctagc

SEQ ID NO: 97667 - DNA, 25 bp, Mus musculus
acactgatcttgcaaaatgtgaaca

SEQ ID NO: 97668 - DNA, 25 bp, Mus musculus
acactgatcttggaaaatgtgaaca

SEQ ID NO: 97669 - DNA, 25 bp, Mus musculus
acactgatgcctcgctgattcctgg

SEQ ID NO: 97670 - DNA, 25 bp, Mus musculus
acactgatgcctggctgattcctgg

SEQ ID NO: 97671 - DNA, 25 bp, Mus musculus
acactgatggaacaatcggccgagc

SEQ ID NO: 97672 - DNA, 25 bp, Mus musculus
acactgatggaagaatcggccgagc

SEQ ID NO: 97673 - DNA, 25 bp, Mus musculus
acactgatggatcgagctgcatttg

SEQ ID NO: 97674 - DNA, 25 bp, Mus musculus
acactgatggatggagctgcatttg

SEQ ID NO: 97675 - DNA, 25 bp, Mus musculus
acactgatggcaatttacctacaat

SEQ ID NO: 97676 - DNA, 25 bp, Mus musculus
acactgatggcattttacctacaat

SEQ ID NO: 97677 - DNA, 25 bp, Mus musculus
acactgatgtggctatctttttaat

SEQ ID NO: 97678 - DNA, 25 bp, Mus musculus
acactgatgtgggtatctttttaat

SEQ ID NO: 97679 - DNA, 25 bp, Mus musculus
acactgatgttacctacctctgaag

SEQ ID NO: 97680 - DNA, 25 bp, Mus musculus
acactgatgttagctacctctgaag

SEQ ID NO: 97681 - DNA, 25 bp, Mus musculus
acactgatgtttatgttcctgttgt

SEQ ID NO: 97682 - DNA, 25 bp, Mus musculus
acactgatgtttttgttcctgttgt

SEQ ID NO: 97683 - DNA, 25 bp, Mus musculus
acactgattgtcacatggttggaat

SEQ ID NO: 97684 - DNA, 25 bp, Mus musculus
acactgattgtctcatggttggaat

SEQ ID NO: 97685 - DNA, 25 bp, Mus musculus
acactgatttagacaatccctttga

SEQ ID NO: 97686 - DNA, 25 bp, Mus musculus
acactgatttagtcaatccctttga

SEQ ID NO: 97687 - DNA, 25 bp, Mus musculus
acactgatttctcctcactttgcaa

SEQ ID NO: 97688 - DNA, 25 bp, Mus musculus
acactgatttctgctcactttgcaa

SEQ ID NO: 97689 - DNA, 25 bp, Mus musculus
acactgattttgattagccggaagt

SEQ ID NO: 97690 - DNA, 25 bp, Mus musculus
acactgattttgtttagccggaagt

SEQ ID NO: 97691 - DNA, 25 bp, Mus musculus
acactgcaaacacggacttccagaa

SEQ ID NO: 97692 - DNA, 25 bp, Mus musculus
acactgcaaacagggacttccagaa

SEQ ID NO: 97693 - DNA, 25 bp, Mus musculus
acactgcaagcccagtatagccata

SEQ ID NO: 97694 - DNA, 25 bp, Mus musculus
acactgcaagccgagtatagccata

SEQ ID NO: 97695 - DNA, 25 bp, Mus musculus
acactgcactgtactcgaagcttaa

SEQ ID NO: 97696 - DNA, 25 bp, Mus musculus
acactgcactgttctcgaagcttaa

SEQ ID NO: 97697 - DNA, 25 bp, Mus musculus
acactgcacttccttcttagggatt

SEQ ID NO: 97698 - DNA, 25 bp, Mus musculus
acactgcacttcgttcttagggatt

SEQ ID NO: 97699 - DNA, 25 bp, Mus musculus
acactgcagccaaccaatatggaga

SEQ ID NO: 97700 - DNA, 25 bp, Mus musculus
acactgcagccatccaatatggaga

SEQ ID NO: 97701 - DNA, 25 bp, Mus musculus
acactgcagtatctcaacctcatca

SEQ ID NO: 97702 - DNA, 25 bp, Mus musculus
acactgcagtatgtcaacctcatca

SEQ ID NO: 97703 - DNA, 25 bp, Mus musculus
acactgcagtttaatctttaggctt

SEQ ID NO: 97704 - DNA, 25 bp, Mus musculus
acactgcagttttatctttaggctt

SEQ ID NO: 97705 - DNA, 25 bp, Mus musculus
acactgcataacacgcttctttgag

SEQ ID NO: 97706 - DNA, 25 bp, Mus musculus
acactgcataactcgcttctttgag

SEQ ID NO: 97707 - DNA, 25 bp, Mus musculus
acactgcatcctcccttgggataga

SEQ ID NO: 97708 - DNA, 25 bp, Mus musculus
acactgcatcctgccttgggataga

SEQ ID NO: 97709 - DNA, 25 bp, Mus musculus
acactgcatctaatttgctggcaat

SEQ ID NO: 97710 - DNA, 25 bp, Mus musculus
acactgcatctattttgctggcaat

SEQ ID NO: 97711 - DNA, 25 bp, Mus musculus
acactgccaattaaaggccggcctg

SEQ ID NO: 97712 - DNA, 25 bp, Mus musculus
acactgccaatttaaggccggcctg

SEQ ID NO: 97713 - DNA, 25 bp, Mus musculus
acactgccatacactgggttttaca

SEQ ID NO: 97714 - DNA, 25 bp, Mus musculus
acactgccatactctgggttttaca

SEQ ID NO: 97715 - DNA, 25 bp, Mus musculus
acactgccatttattactgtacccc

SEQ ID NO: 97716 - DNA, 25 bp, Mus musculus
acactgccattttttactgtacccc

SEQ ID NO: 97717 - DNA, 25 bp, Mus musculus
acactgcccttgactgatcataatc

SEQ ID NO: 97718 - DNA, 25 bp, Mus musculus
acactgcccttgtctgatcataatc

SEQ ID NO: 97719 - DNA, 25 bp, Mus musculus
acactgccgtgaacgttatatgacg

SEQ ID NO: 97720 - DNA, 25 bp, Mus musculus
acactgccgtgatcgttatatgacg

SEQ ID NO: 97721 - DNA, 25 bp, Mus musculus
acactgcctactagcttgttcttaa

SEQ ID NO: 97722 - DNA, 25 bp, Mus musculus
acactgcctacttgcttgttcttaa

SEQ ID NO: 97723 - DNA, 25 bp, Mus musculus
acactgcctcccaagtattagttgt

SEQ ID NO: 97724 - DNA, 25 bp, Mus musculus
acactgcctccctagtattagttgt

SEQ ID NO: 97725 - DNA, 25 bp, Mus musculus
acactgcctgcactgtaacattgga

SEQ ID NO: 97726 - DNA, 25 bp, Mus musculus
acactgcctgcagtgtaacattgga

SEQ ID NO: 97727 - DNA, 25 bp, Mus musculus
acactgcctgtcatcttgcatggac

SEQ ID NO: 97728 - DNA, 25 bp, Mus musculus
acactgcctgtcttcttgcatggac

SEQ ID NO: 97729 - DNA, 25 bp, Mus musculus
acactgcctgtgatagctactctga

SEQ ID NO: 97730 - DNA, 25 bp, Mus musculus
acactgcctgtgcacttgtgtggtg

SEQ ID NO: 97731 - DNA, 25 bp, Mus musculus
acactgcctgtggacttgtgtggtg

SEQ ID NO: 97732 - DNA, 25 bp, Mus musculus
acactgcctgtgttagctactctga

SEQ ID NO: 97733 - DNA, 25 bp, Mus musculus
acactgcggagcaggtgtcaacact

SEQ ID NO: 97734 - DNA, 25 bp, Mus musculus
acactgcggagctggtgtcaacact

SEQ ID NO: 97735 - DNA, 25 bp, Mus musculus
acactgcggccaccaatggaggtta

SEQ ID NO: 97736 - DNA, 25 bp, Mus musculus
acactgcggccagcaatggaggtta

SEQ ID NO: 97737 - DNA, 25 bp, Mus musculus
acactgcgtctaagtgcttcaggtt

SEQ ID NO: 97738 - DNA, 25 bp, Mus musculus
acactgcgtctatgtgcttcaggtt

SEQ ID NO: 97739 - DNA, 25 bp, Mus musculus
acactgcgtggtcttcagctggaca

SEQ ID NO: 97740 - DNA, 25 bp, Mus musculus
acactgcgtggtgttcagctggaca

SEQ ID NO: 97741 - DNA, 25 bp, Mus musculus
acactgctactacagccctgtttgt

SEQ ID NO: 97742 - DNA, 25 bp, Mus musculus
acactgctactagagccctgtttgt

SEQ ID NO: 97743 - DNA, 25 bp, Mus musculus
acactgctactgactctgtgagttc

SEQ ID NO: 97744 - DNA, 25 bp, Mus musculus
acactgctactgtctctgtgagttc

SEQ ID NO: 97745 - DNA, 25 bp, Mus musculus
acactgctatacacacctctgtttt

SEQ ID NO: 97746 - DNA, 25 bp, Mus musculus
acactgctatactcacctctgtttt

SEQ ID NO: 97747 - DNA, 25 bp, Mus musculus
acactgctattgatgtgaccccgtt

SEQ ID NO: 97748 - DNA, 25 bp, Mus musculus
acactgctattgttgtgaccccgtt

SEQ ID NO: 97749 - DNA, 25 bp, Mus musculus
acactgctcccgagaagtacaccta

SEQ ID NO: 97750 - DNA, 25 bp, Mus musculus
acactgctcccgtgaagtacaccta

SEQ ID NO: 97751 - DNA, 25 bp, Mus musculus
acactgctcgaacctggactggcaa

SEQ ID NO: 97752 - DNA, 25 bp, Mus musculus
acactgctcgaagctggactggcaa

SEQ ID NO: 97753 - DNA, 25 bp, Mus musculus
acactgctctgcatactattggtag

SEQ ID NO: 97754 - DNA, 25 bp, Mus musculus
acactgctctgcttactattggtag

SEQ ID NO: 97755 - DNA, 25 bp, Mus musculus
acactgctcttgaaactgctatctt

SEQ ID NO: 97756 - DNA, 25 bp, Mus musculus
acactgctcttgtaactgctatctt

SEQ ID NO: 97757 - DNA, 25 bp, Mus musculus
acactgctgaaacacactgtctcaa

SEQ ID NO: 97758 - DNA, 25 bp, Mus musculus
acactgctgaaagacactgtctcaa

SEQ ID NO: 97759 - DNA, 25 bp, Mus musculus
acactgctgaacatgctgaacatct

SEQ ID NO: 97760 - DNA, 25 bp, Mus musculus
acactgctgaacttgctgaacatct

SEQ ID NO: 97761 - DNA, 25 bp, Mus musculus
acactgctgaatccccgaatgattg

SEQ ID NO: 97762 - DNA, 25 bp, Mus musculus
acactgctgaatgcccgaatgattg

SEQ ID NO: 97763 - DNA, 25 bp, Mus musculus
acactgctgattctggtctccatgc

SEQ ID NO: 97764 - DNA, 25 bp, Mus musculus
acactgctgattgtggtctccatgc

SEQ ID NO: 97765 - DNA, 25 bp, Mus musculus
acactgctgctcagggtaaccaagg

SEQ ID NO: 97766 - DNA, 25 bp, Mus musculus
acactgctgctctgggtaaccaagg

SEQ ID NO: 97767 - DNA, 25 bp, Mus musculus
acactgctgcttcgtgctgtgaagg

SEQ ID NO: 97768 - DNA, 25 bp, Mus musculus
acactgctgcttggtgctgtgaagg

SEQ ID NO: 97769 - DNA, 25 bp, Mus musculus
acactgctggacactagtctcgagg

SEQ ID NO: 97770 - DNA, 25 bp, Mus musculus
acactgctggactctagtctcgagg

SEQ ID NO: 97771 - DNA, 25 bp, Mus musculus
acactgctggcaatgatggtccttg

SEQ ID NO: 97772 - DNA, 25 bp, Mus musculus
acactgctggcattgatggtccttg

SEQ ID NO: 97773 - DNA, 25 bp, Mus musculus
acactgctgtcactggttcttagga

SEQ ID NO: 97774 - DNA, 25 bp, Mus musculus
acactgctgtcagtggttcttagga

SEQ ID NO: 97775 - DNA, 25 bp, Mus musculus
acactgctgtttctcctgaatgtaa

SEQ ID NO: 97776 - DNA, 25 bp, Mus musculus
acactgctgtttgtcctgaatgtaa

SEQ ID NO: 97777 - DNA, 25 bp, Mus musculus
acactgcttacgcttacactttctg

SEQ ID NO: 97778 - DNA, 25 bp, Mus musculus
acactgcttacggttacactttctg

SEQ ID NO: 97779 - DNA, 25 bp, Mus musculus
acactgcttcaaaccacgagtctct

SEQ ID NO: 97780 - DNA, 25 bp, Mus musculus
acactgcttcaatccacgagtctct

SEQ ID NO: 97781 - DNA, 25 bp, Mus musculus
acactgctttagatggtcagcccga

SEQ ID NO: 97782 - DNA, 25 bp, Mus musculus
acactgctttagttggtcagcccga

SEQ ID NO: 97783 - DNA, 25 bp, Mus musculus
acactgctttcaatttgttgccatc

SEQ ID NO: 97784 - DNA, 25 bp, Mus musculus
acactgctttcattttgttgccatc

SEQ ID NO: 97785 - DNA, 25 bp, Mus musculus
acactgctttgaaaaggtctgccat

SEQ ID NO: 97786 - DNA, 25 bp, Mus musculus
acactgctttgataaggtctgccat

SEQ ID NO: 97787 - DNA, 25 bp, Mus musculus
acactgctttgcaatgaagattcat

SEQ ID NO: 97788 - DNA, 25 bp, Mus musculus
acactgctttgctatgaagattcat

SEQ ID NO: 97789 - DNA, 25 bp, Mus musculus
acactggaacttctccatcaggaaa

SEQ ID NO: 97790 - DNA, 25 bp, Mus musculus
acactggaacttgtccatcaggaaa

SEQ ID NO: 97791 - DNA, 25 bp, Mus musculus
acactggaagacactggatgacctc

SEQ ID NO: 97792 - DNA, 25 bp, Mus musculus
acactggaagactctggatgacctc

SEQ ID NO: 97793 - DNA, 25 bp, Mus musculus
acactggaaggacatgatcgctcgt

SEQ ID NO: 97794 - DNA, 25 bp, Mus musculus
acactggaaggagatgatcgctcgt

SEQ ID NO: 97795 - DNA, 25 bp, Mus musculus
acactggaatggacactgaagttgg

SEQ ID NO: 97796 - DNA, 25 bp, Mus musculus
acactggaatggtcactgaagttgg

SEQ ID NO: 97797 - DNA, 25 bp, Mus musculus
acactggacagtcactctgtgccag

SEQ ID NO: 97798 - DNA, 25 bp, Mus musculus
acactggacagtgactctgtgccag

SEQ ID NO: 97799 - DNA, 25 bp, Mus musculus
acactggacattcggcctcgggcta

SEQ ID NO: 97800 - DNA, 25 bp, Mus musculus
acactggacattgggcctcgggcta

SEQ ID NO: 97801 - DNA, 25 bp, Mus musculus
acactggacccaaacaggttcttta

SEQ ID NO: 97802 - DNA, 25 bp, Mus musculus
acactggacccatacaggttcttta

SEQ ID NO: 97803 - DNA, 25 bp, Mus musculus
acactggaccttctgcagagggcct

SEQ ID NO: 97804 - DNA, 25 bp, Mus musculus
acactggaccttgtgcagagggcct

SEQ ID NO: 97805 - DNA, 25 bp, Mus musculus
acactggactttcagcttccctgag

SEQ ID NO: 97806 - DNA, 25 bp, Mus musculus
acactggactttgagcttccctgag

SEQ ID NO: 97807 - DNA, 25 bp, Mus musculus
acactggaggcaagtatgttggact

SEQ ID NO: 97808 - DNA, 25 bp, Mus musculus
acactggaggcatgtatgttggact

SEQ ID NO: 97809 - DNA, 25 bp, Mus musculus
acactggatcccatcaactttgaga

SEQ ID NO: 97810 - DNA, 25 bp, Mus musculus
acactggatcccttcaactttgaga

SEQ ID NO: 97811 - DNA, 25 bp, Mus musculus
acactggcaaggctgtacatcatgc

SEQ ID NO: 97812 - DNA, 25 bp, Mus musculus
acactggcaagggtgtacatcatgc

SEQ ID NO: 97813 - DNA, 25 bp, Mus musculus
acactggcacgtacgaggacttcgt

SEQ ID NO: 97814 - DNA, 25 bp, Mus musculus
acactggcacgttcgaggacttcgt

SEQ ID NO: 97815 - DNA, 25 bp, Mus musculus
acactggcagaaagtccacccacag

SEQ ID NO: 97816 - DNA, 25 bp, Mus musculus
acactggcagaatgtccacccacag

SEQ ID NO: 97817 - DNA, 25 bp, Mus musculus
acactggcagcccaatttggaaaag

SEQ ID NO: 97818 - DNA, 25 bp, Mus musculus
acactggcagccgaatttggaaaag

SEQ ID NO: 97819 - DNA, 25 bp, Mus musculus
acactggcatgaattaacttctatt

SEQ ID NO: 97820 - DNA, 25 bp, Mus musculus
acactggcatgatttaacttctatt

SEQ ID NO: 97821 - DNA, 25 bp, Mus musculus
acactggccataccttgagcatacg

SEQ ID NO: 97822 - DNA, 25 bp, Mus musculus
acactggccatagcttgagcatacg

SEQ ID NO: 97823 - DNA, 25 bp, Mus musculus
acactggcccacatgtacacatcga

SEQ ID NO: 97824 - DNA, 25 bp, Mus musculus
acactggcccacttgtacacatcga

SEQ ID NO: 97825 - DNA, 25 bp, Mus musculus
acactggcctatctactgcaaatat

SEQ ID NO: 97826 - DNA, 25 bp, Mus musculus
acactggcctatgtactgcaaatat

SEQ ID NO: 97827 - DNA, 25 bp, Mus musculus
acactggcctgtcatgtcagtttcc

SEQ ID NO: 97828 - DNA, 25 bp, Mus musculus
acactggcctgtgatgtcagtttcc

SEQ ID NO: 97829 - DNA, 25 bp, Mus musculus
acactggcggctcttctgcactaga

SEQ ID NO: 97830 - DNA, 25 bp, Mus musculus
acactggcggctgttctgcactaga

SEQ ID NO: 97831 - DNA, 25 bp, Mus musculus
acactggctgaaccggacttttctc

SEQ ID NO: 97832 - DNA, 25 bp, Mus musculus
acactggctgaagcggacttttctc

SEQ ID NO: 97833 - DNA, 25 bp, Mus musculus
acactggctgctcttaaagaagaat

SEQ ID NO: 97834 - DNA, 25 bp, Mus musculus
acactggctgctgttaaagaagaat

SEQ ID NO: 97835 - DNA, 25 bp, Mus musculus
acactggctgtaccatacaataaag

SEQ ID NO: 97836 - DNA, 25 bp, Mus musculus
acactggctgtagcatacaataaag

SEQ ID NO: 97837 - DNA, 25 bp, Mus musculus
acactggcttgcaaccacacaaatg

SEQ ID NO: 97838 - DNA, 25 bp, Mus musculus
acactggcttgctaccacacaaatg

SEQ ID NO: 97839 - DNA, 25 bp, Mus musculus
acactggcttttcccgatagagcag

SEQ ID NO: 97840 - DNA, 25 bp, Mus musculus
acactggcttttgccgatagagcag

SEQ ID NO: 97841 - DNA, 25 bp, Mus musculus
acactgggaaagacttttaaagctg

SEQ ID NO: 97842 - DNA, 25 bp, Mus musculus
acactgggaaagtcttttaaagctg

SEQ ID NO: 97843 - DNA, 25 bp, Mus musculus
acactgggaaccacgctatagattt

SEQ ID NO: 97844 - DNA, 25 bp, Mus musculus
acactgggaacctcgctatagattt

SEQ ID NO: 97845 - DNA, 25 bp, Mus musculus
acactgggaatcaactaaagccttt

SEQ ID NO: 97846 - DNA, 25 bp, Mus musculus
acactgggaatctactaaagccttt

SEQ ID NO: 97847 - DNA, 25 bp, Mus musculus
acactgggactcatttgtggagacg

SEQ ID NO: 97848 - DNA, 25 bp, Mus musculus
acactgggactcttttgtggagacg

SEQ ID NO: 97849 - DNA, 25 bp, Mus musculus
acactgggaggcctagtacttctaa

SEQ ID NO: 97850 - DNA, 25 bp, Mus musculus
acactgggaggcgtagtacttctaa

SEQ ID NO: 97851 - DNA, 25 bp, Mus musculus
acactgggaggtaagagcgtgcccc

SEQ ID NO: 97852 - DNA, 25 bp, Mus musculus
acactgggaggttagagcgtgcccc

SEQ ID NO: 97853 - DNA, 25 bp, Mus musculus
acactgggatttacatgagggtcac

SEQ ID NO: 97854 - DNA, 25 bp, Mus musculus
acactgggattttcatgagggtcac

SEQ ID NO: 97855 - DNA, 25 bp, Mus musculus
acactgggccaacgtggtcatcctg

SEQ ID NO: 97856 - DNA, 25 bp, Mus musculus
acactgggccaaggtggtcatcctg

SEQ ID NO: 97857 - DNA, 25 bp, Mus musculus
acactgggccacctttgctttgatt

SEQ ID NO: 97858 - DNA, 25 bp, Mus musculus
acactgggccacgtttgctttgatt

SEQ ID NO: 97859 - DNA, 25 bp, Mus musculus
acactgggccagaaggagattgatc

SEQ ID NO: 97860 - DNA, 25 bp, Mus musculus
acactgggccagtaggagattgatc

SEQ ID NO: 97861 - DNA, 25 bp, Mus musculus
acactgggcggtaatcattggcgtc

SEQ ID NO: 97862 - DNA, 25 bp, Mus musculus
acactgggcggttatcattggcgtc

SEQ ID NO: 97863 - DNA, 25 bp, Mus musculus
acactgggtactatgtgggtctctt

SEQ ID NO: 97864 - DNA, 25 bp, Mus musculus
acactgggtactttgtgggtctctt

SEQ ID NO: 97865 - DNA, 25 bp, Mus musculus
acactgggtcagatgtgataagact

SEQ ID NO: 97866 - DNA, 25 bp, Mus musculus
acactgggtcagttgtgataagact

SEQ ID NO: 97867 - DNA, 25 bp, Mus musculus
acactgggtcgtattcctggacttg

SEQ ID NO: 97868 - DNA, 25 bp, Mus musculus
acactgggtcgttttcctggacttg

SEQ ID NO: 97869 - DNA, 25 bp, Mus musculus
acactgggtgcaccctatcatgtgc

SEQ ID NO: 97870 - DNA, 25 bp, Mus musculus
acactgggtgcagcctatcatgtgc

SEQ ID NO: 97871 - DNA, 25 bp, Mus musculus
acactgggtgtgagtcaagcccact

SEQ ID NO: 97872 - DNA, 25 bp, Mus musculus
acactgggtgtgtgtcaagcccact

SEQ ID NO: 97873 - DNA, 25 bp, Mus musculus
acactggtaactcggaagaggctct

SEQ ID NO: 97874 - DNA, 25 bp, Mus musculus
acactggtaactgggaagaggctct

SEQ ID NO: 97875 - DNA, 25 bp, Mus musculus
acactggtacccatataccttggag

SEQ ID NO: 97876 - DNA, 25 bp, Mus musculus
acactggtacccttataccttggag

SEQ ID NO: 97877 - DNA, 25 bp, Mus musculus
acactggtcacaagctgtaaggatt

SEQ ID NO: 97878 - DNA, 25 bp, Mus musculus
acactggtcacatgctgtaaggatt

SEQ ID NO: 97879 - DNA, 25 bp, Mus musculus
acactggtcaccctggcatgacaca

SEQ ID NO: 97880 - DNA, 25 bp, Mus musculus
acactggtcaccgtggcatgacaca

SEQ ID NO: 97881 - DNA, 25 bp, Mus musculus
acactggtccagcataacctcttct

SEQ ID NO: 97882 - DNA, 25 bp, Mus musculus
acactggtccaggataacctcttct

SEQ ID NO: 97883 - DNA, 25 bp, Mus musculus
acactggtgaccacttggagcaaaa

SEQ ID NO: 97884 - DNA, 25 bp, Mus musculus
acactggtgacctcttggagcaaaa

SEQ ID NO: 97885 - DNA, 25 bp, Mus musculus
acactggtgtaccttgctggcatgg

SEQ ID NO: 97886 - DNA, 25 bp, Mus musculus
acactggtgtacgttgctggcatgg

SEQ ID NO: 97887 - DNA, 25 bp, Mus musculus
acactggtgtgtctgatttccaact

SEQ ID NO: 97888 - DNA, 25 bp, Mus musculus
acactggtgtgtgtgatttccaact

SEQ ID NO: 97889 - DNA, 25 bp, Mus musculus
acactggttatgacattgaactgca

SEQ ID NO: 97890 - DNA, 25 bp, Mus musculus
acactggttatgtcattgaactgca

SEQ ID NO: 97891 - DNA, 25 bp, Mus musculus
acactggttccaacgttcattgtca

SEQ ID NO: 97892 - DNA, 25 bp, Mus musculus
acactggttccatcgttcattgtca

SEQ ID NO: 97893 - DNA, 25 bp, Mus musculus
acactggttcctctgcaagcttaca

SEQ ID NO: 97894 - DNA, 25 bp, Mus musculus
acactggttcctgtgcaagcttaca

SEQ ID NO: 97895 - DNA, 25 bp, Mus musculus
acactggttctgactccctagagag

SEQ ID NO: 97896 - DNA, 25 bp, Mus musculus
acactggttctgtctccctagagag

SEQ ID NO: 97897 - DNA, 25 bp, Mus musculus
acactggttgcaaacggctgccaaa

SEQ ID NO: 97898 - DNA, 25 bp, Mus musculus
acactggttgcatacggctgccaaa

SEQ ID NO: 97899 - DNA, 25 bp, Mus musculus
acactggtttctactctcagaactg

SEQ ID NO: 97900 - DNA, 25 bp, Mus musculus
acactggtttcttctctcagaactg

SEQ ID NO: 97901 - DNA, 25 bp, Mus musculus
acactggtttttcatgcctttgcac

SEQ ID NO: 97902 - DNA, 25 bp, Mus musculus
acactggtttttgatgcctttgcac

SEQ ID NO: 97903 - DNA, 25 bp, Mus musculus
acactgtaaacaactcttctgcctg

SEQ ID NO: 97904 - DNA, 25 bp, Mus musculus
acactgtaaacatctcttctgcctg

SEQ ID NO: 97905 - DNA, 25 bp, Mus musculus
acactgtaaattatcacctgaccct

SEQ ID NO: 97906 - DNA, 25 bp, Mus musculus
acactgtaaattttcacctgaccct

SEQ ID NO: 97907 - DNA, 25 bp, Mus musculus
acactgtacaggcacatttgggctg

SEQ ID NO: 97908 - DNA, 25 bp, Mus musculus
acactgtacagggacatttgggctg

SEQ ID NO: 97909 - DNA, 25 bp, Mus musculus
acactgtaccaacttttgcagattc

SEQ ID NO: 97910 - DNA, 25 bp, Mus musculus
acactgtaccaagttttgcagattc

SEQ ID NO: 97911 - DNA, 25 bp, Mus musculus
acactgtactatcttaaggccacat

SEQ ID NO: 97912 - DNA, 25 bp, Mus musculus
acactgtactatgttaaggccacat

SEQ ID NO: 97913 - DNA, 25 bp, Mus musculus
acactgtagacccattagaaggaag

SEQ ID NO: 97914 - DNA, 25 bp, Mus musculus
acactgtagaccgattagaaggaag

SEQ ID NO: 97915 - DNA, 25 bp, Mus musculus
acactgtagcagactcaatactctt

SEQ ID NO: 97916 - DNA, 25 bp, Mus musculus
acactgtagcagtctcaatactctt

SEQ ID NO: 97917 - DNA, 25 bp, Mus musculus
acactgtagtctcggtttctgggag

SEQ ID NO: 97918 - DNA, 25 bp, Mus musculus
acactgtagtctgggtttctgggag

SEQ ID NO: 97919 - DNA, 25 bp, Mus musculus
acactgtatacacctgactcttcca

SEQ ID NO: 97920 - DNA, 25 bp, Mus musculus
acactgtatacagctgactcttcca

SEQ ID NO: 97921 - DNA, 25 bp, Mus musculus
acactgtatctaaaccgaggctgct

SEQ ID NO: 97922 - DNA, 25 bp, Mus musculus
acactgtatctataccgaggctgct

SEQ ID NO: 97923 - DNA, 25 bp, Mus musculus
acactgtattggacttttatacttg

SEQ ID NO: 97924 - DNA, 25 bp, Mus musculus
acactgtattggtcttttatacttg

SEQ ID NO: 97925 - DNA, 25 bp, Mus musculus
acactgtcacagagcttgtgggatt

SEQ ID NO: 97926 - DNA, 25 bp, Mus musculus
acactgtcacagtgcttgtgggatt

SEQ ID NO: 97927 - DNA, 25 bp, Mus musculus
acactgtcaggaccttgtcactctt

SEQ ID NO: 97928 - DNA, 25 bp, Mus musculus
acactgtcaggagcttgtcactctt

SEQ ID NO: 97929 - DNA, 25 bp, Mus musculus
acactgtccaccagttttctatgga

SEQ ID NO: 97930 - DNA, 25 bp, Mus musculus
acactgtccacctgttttctatgga

SEQ ID NO: 97931 - DNA, 25 bp, Mus musculus
acactgtctagtcttgggcttcctc

SEQ ID NO: 97932 - DNA, 25 bp, Mus musculus
acactgtctagtgttgggcttcctc

SEQ ID NO: 97933 - DNA, 25 bp, Mus musculus
acactgtctcagaacttaataaggg

SEQ ID NO: 97934 - DNA, 25 bp, Mus musculus
acactgtctcagtacttaataaggg

SEQ ID NO: 97935 - DNA, 25 bp, Mus musculus
acactgtctgctcggcaagcacaga

SEQ ID NO: 97936 - DNA, 25 bp, Mus musculus
acactgtctgctgggcaagcacaga

SEQ ID NO: 97937 - DNA, 25 bp, Mus musculus
acactgtgacacctattcgggatga

SEQ ID NO: 97938 - DNA, 25 bp, Mus musculus
acactgtgacacgtattcgggatga

SEQ ID NO: 97939 - DNA, 25 bp, Mus musculus
acactgtgactgagcagcctctgag

SEQ ID NO: 97940 - DNA, 25 bp, Mus musculus
acactgtgactgtgcagcctctgag

SEQ ID NO: 97941 - DNA, 25 bp, Mus musculus
acactgtgcaggctatccatgggca

SEQ ID NO: 97942 - DNA, 25 bp, Mus musculus
acactgtgcagggtatccatgggca

SEQ ID NO: 97943 - DNA, 25 bp, Mus musculus
acactgtgcatcaggcgtgtgctta

SEQ ID NO: 97944 - DNA, 25 bp, Mus musculus
acactgtgcatctggcgtgtgctta

SEQ ID NO: 97945 - DNA, 25 bp, Mus musculus
acactgtgcctcatgagactctgct

SEQ ID NO: 97946 - DNA, 25 bp, Mus musculus
acactgtgcctcttgagactctgct

SEQ ID NO: 97947 - DNA, 25 bp, Mus musculus
acactgtgccttatgatgttgtcca

SEQ ID NO: 97948 - DNA, 25 bp, Mus musculus
acactgtgccttttgatgttgtcca

SEQ ID NO: 97949 - DNA, 25 bp, Mus musculus
acactgtgctctcaaggacgtccct

SEQ ID NO: 97950 - DNA, 25 bp, Mus musculus
acactgtgctctgaaggacgtccct

SEQ ID NO: 97951 - DNA, 25 bp, Mus musculus
acactgtggaccagcggcttctgaa

SEQ ID NO: 97952 - DNA, 25 bp, Mus musculus
acactgtggacctgcggcttctgaa

SEQ ID NO: 97953 - DNA, 25 bp, Mus musculus
acactgtggagccaggaataatggt

SEQ ID NO: 97954 - DNA, 25 bp, Mus musculus
acactgtggagcgaggaataatggt

SEQ ID NO: 97955 - DNA, 25 bp, Mus musculus
acactgtggatcagtctcgggagca

SEQ ID NO: 97956 - DNA, 25 bp, Mus musculus
acactgtggatctgtctcgggagca

SEQ ID NO: 97957 - DNA, 25 bp, Mus musculus
acactgtggttgatatgagattttt

SEQ ID NO: 97958 - DNA, 25 bp, Mus musculus
acactgtggttgttatgagattttt

SEQ ID NO: 97959 - DNA, 25 bp, Mus musculus
acactgtgtagcattccctgctgcc

SEQ ID NO: 97960 - DNA, 25 bp, Mus musculus
acactgtgtagctttccctgctgcc

SEQ ID NO: 97961 - DNA, 25 bp, Mus musculus
acactgtgtatgactctagagccca

SEQ ID NO: 97962 - DNA, 25 bp, Mus musculus
acactgtgtatgtctctagagccca

SEQ ID NO: 97963 - DNA, 25 bp, Mus musculus
acactgtgtccaagtttgagatgat

SEQ ID NO: 97964 - DNA, 25 bp, Mus musculus
acactgtgtccatgtttgagatgat

SEQ ID NO: 97965 - DNA, 25 bp, Mus musculus
acactgtgtgcacttaccacgctag

SEQ ID NO: 97966 - DNA, 25 bp, Mus musculus
acactgtgtgcagttaccacgctag

SEQ ID NO: 97967 - DNA, 25 bp, Mus musculus
acactgtgtgtgatggcgatacttc

SEQ ID NO: 97968 - DNA, 25 bp, Mus musculus
acactgtgtgtgctagctacttcta

SEQ ID NO: 97969 - DNA, 25 bp, Mus musculus
acactgtgtgtgctggcacatgctt

SEQ ID NO: 97970 - DNA, 25 bp, Mus musculus
acactgtgtgtggtagctacttcta

SEQ ID NO: 97971 - DNA, 25 bp, Mus musculus
acactgtgtgtggtggcacatgctt

SEQ ID NO: 97972 - DNA, 25 bp, Mus musculus
acactgtgtgtgttggcgatacttc

SEQ ID NO: 97973 - DNA, 25 bp, Mus musculus
acactgtgttctaagcacccaggag

SEQ ID NO: 97974 - DNA, 25 bp, Mus musculus
acactgtgttcttagcacccaggag

SEQ ID NO: 97975 - DNA, 25 bp, Mus musculus
acactgtgttgtactgggctctgaa

SEQ ID NO: 97976 - DNA, 25 bp, Mus musculus
acactgtgttgttctgggctctgaa

SEQ ID NO: 97977 - DNA, 25 bp, Mus musculus
acactgttacagacttaccggctca

SEQ ID NO: 97978 - DNA, 25 bp, Mus musculus
acactgttacagtcttaccggctca

SEQ ID NO: 97979 - DNA, 25 bp, Mus musculus
acactgttatacacctgttttatga

SEQ ID NO: 97980 - DNA, 25 bp, Mus musculus
acactgttatactcctgttttatga

SEQ ID NO: 97981 - DNA, 25 bp, Mus musculus
acactgttcacacacttgcctgcaa

SEQ ID NO: 97982 - DNA, 25 bp, Mus musculus
acactgttcacagacttgcctgcaa

SEQ ID NO: 97983 - DNA, 25 bp, Mus musculus
acactgttccctagacatgggctgt

SEQ ID NO: 97984 - DNA, 25 bp, Mus musculus
acactgttcccttgacatgggctgt

SEQ ID NO: 97985 - DNA, 25 bp, Mus musculus
acactgttccttaacactcattgat

SEQ ID NO: 97986 - DNA, 25 bp, Mus musculus
acactgttcctttacactcattgat

SEQ ID NO: 97987 - DNA, 25 bp, Mus musculus
acactgttcgtcctaggatgatgat

SEQ ID NO: 97988 - DNA, 25 bp, Mus musculus
acactgttcgtcgtaggatgatgat

SEQ ID NO: 97989 - DNA, 25 bp, Mus musculus
acactgttcttgatctagagcccca

SEQ ID NO: 97990 - DNA, 25 bp, Mus musculus
acactgttcttgttctagagcccca

SEQ ID NO: 97991 - DNA, 25 bp, Mus musculus
acactgttgcccagtttgtcgttgg

SEQ ID NO: 97992 - DNA, 25 bp, Mus musculus
acactgttgccctgtttgtcgttgg

SEQ ID NO: 97993 - DNA, 25 bp, Mus musculus
acactgttgtatcgcattggttcac

SEQ ID NO: 97994 - DNA, 25 bp, Mus musculus
acactgttgtatggcattggttcac

SEQ ID NO: 97995 - DNA, 25 bp, Mus musculus
acactgtttcctccattgtacaagg

SEQ ID NO: 97996 - DNA, 25 bp, Mus musculus
acactgtttcctgcattgtacaagg

SEQ ID NO: 97997 - DNA, 25 bp, Mus musculus
acactgtttctgctcctgtttttat

SEQ ID NO: 97998 - DNA, 25 bp, Mus musculus
acactgtttctggtcctgtttttat

SEQ ID NO: 97999 - DNA, 25 bp, Mus musculus
acactgtttggcaatgctgctgtaa

SEQ ID NO: 98000 - DNA, 25 bp, Mus musculus
acactgtttggcctctttcacggag

SEQ ID NO: 98001 - DNA, 25 bp, Mus musculus
acactgtttggcgtctttcacggag

SEQ ID NO: 98002 - DNA, 25 bp, Mus musculus
acactgtttggctatgctgctgtaa

SEQ ID NO: 98003 - DNA, 25 bp, Mus musculus
acactgtttgtgagccttgttcacc

SEQ ID NO: 98004 - DNA, 25 bp, Mus musculus
acactgtttgtgtgccttgttcacc

SEQ ID NO: 98005 - DNA, 25 bp, Mus musculus
acacttaaattcaaccccacacttg

SEQ ID NO: 98006 - DNA, 25 bp, Mus musculus
acacttaaattctaccccacacttg

SEQ ID NO: 98007 - DNA, 25 bp, Mus musculus
acacttaagttaagcctgtcctaaa

SEQ ID NO: 98008 - DNA, 25 bp, Mus musculus
acacttaagttatgcctgtcctaaa

SEQ ID NO: 98009 - DNA, 25 bp, Mus musculus
acacttaatgctaactccaattgga

SEQ ID NO: 98010 - DNA, 25 bp, Mus musculus
acacttaatgcttactccaattgga

SEQ ID NO: 98011 - DNA, 25 bp, Mus musculus
acacttaccgtgctgtgctaatgga

SEQ ID NO: 98012 - DNA, 25 bp, Mus musculus
acacttaccgtggtgtgctaatgga

SEQ ID NO: 98013 - DNA, 25 bp, Mus musculus
acacttacctagctatttccagaga

SEQ ID NO: 98014 - DNA, 25 bp, Mus musculus
acacttacctaggtatttccagaga

SEQ ID NO: 98015 - DNA, 25 bp, Mus musculus
acacttacctcaaaatcttgcacca

SEQ ID NO: 98016 - DNA, 25 bp, Mus musculus
acacttacctcataatcttgcacca

SEQ ID NO: 98017 - DNA, 25 bp, Mus musculus
acacttactgtaacttgccactgac

SEQ ID NO: 98018 - DNA, 25 bp, Mus musculus
acacttactgtatcttgccactgac

SEQ ID NO: 98019 - DNA, 25 bp, Mus musculus
acacttactgtgatcctatggaaac

SEQ ID NO: 98020 - DNA, 25 bp, Mus musculus
acacttactgtgttcctatggaaac

SEQ ID NO: 98021 - DNA, 25 bp, Mus musculus
acacttagacacatcagcagtcctt

SEQ ID NO: 98022 - DNA, 25 bp, Mus musculus
acacttagacacttcagcagtcctt

SEQ ID NO: 98023 - DNA, 25 bp, Mus musculus
acacttagacctcaaagtcccagat

SEQ ID NO: 98024 - DNA, 25 bp, Mus musculus
acacttagacctgaaagtcccagat

SEQ ID NO: 98025 - DNA, 25 bp, Mus musculus
acacttagcgtgactttcttttcag

SEQ ID NO: 98026 - DNA, 25 bp, Mus musculus
acacttagcgtgtctttcttttcag

SEQ ID NO: 98027 - DNA, 25 bp, Mus musculus
acacttagctagagatattcctgtc

SEQ ID NO: 98028 - DNA, 25 bp, Mus musculus
acacttagctagtgatattcctgtc

SEQ ID NO: 98029 - DNA, 25 bp, Mus musculus
acacttagggtacaagcggtcctga

SEQ ID NO: 98030 - DNA, 25 bp, Mus musculus
acacttagggtagaagcggtcctga

SEQ ID NO: 98031 - DNA, 25 bp, Mus musculus
acacttagtgtccagtttattctat

SEQ ID NO: 98032 - DNA, 25 bp, Mus musculus
acacttagtgtcgagtttattctat

SEQ ID NO: 98033 - DNA, 25 bp, Mus musculus
acacttatctttcaagctataacat

SEQ ID NO: 98034 - DNA, 25 bp, Mus musculus
acacttatctttgaagctataacat

SEQ ID NO: 98035 - DNA, 25 bp, Mus musculus
acacttatgctgctcgtgtgggcac

SEQ ID NO: 98036 - DNA, 25 bp, Mus musculus
acacttatgctggtcgtgtgggcac

SEQ ID NO: 98037 - DNA, 25 bp, Mus musculus
acacttatggtcaatttaactttat

SEQ ID NO: 98038 - DNA, 25 bp, Mus musculus
acacttatggtctatttaactttat

SEQ ID NO: 98039 - DNA, 25 bp, Mus musculus
acacttattggcattgagtccctgc

SEQ ID NO: 98040 - DNA, 25 bp, Mus musculus
acacttattggctttgagtccctgc

SEQ ID NO: 98041 - DNA, 25 bp, Mus musculus
acacttatttagctggtcggccatt

SEQ ID NO: 98042 - DNA, 25 bp, Mus musculus
acacttatttaggtggtcggccatt

SEQ ID NO: 98043 - DNA, 25 bp, Mus musculus
acacttcaacatacatgggctgcac

SEQ ID NO: 98044 - DNA, 25 bp, Mus musculus
acacttcaacattcatgggctgcac

SEQ ID NO: 98045 - DNA, 25 bp, Mus musculus
acacttcacacactttaactcacaa

SEQ ID NO: 98046 - DNA, 25 bp, Mus musculus
acacttcacacagtttaactcacaa

SEQ ID NO: 98047 - DNA, 25 bp, Mus musculus
acacttcacatactgcaggtctaac

SEQ ID NO: 98048 - DNA, 25 bp, Mus musculus
acacttcacatagtgcaggtctaac

SEQ ID NO: 98049 - DNA, 25 bp, Mus musculus
acacttcaggccacaagggagcagt

SEQ ID NO: 98050 - DNA, 25 bp, Mus musculus
acacttcaggcctcaagggagcagt

SEQ ID NO: 98051 - DNA, 25 bp, Mus musculus
acacttcaggttaatcggcacacaa

SEQ ID NO: 98052 - DNA, 25 bp, Mus musculus
acacttcaggtttatcggcacacaa

SEQ ID NO: 98053 - DNA, 25 bp, Mus musculus
acacttcagttcatcctaaaggttg

SEQ ID NO: 98054 - DNA, 25 bp, Mus musculus
acacttcagttcattatacctctac

SEQ ID NO: 98055 - DNA, 25 bp, Mus musculus
acacttcagttcttcctaaaggttg

SEQ ID NO: 98056 - DNA, 25 bp, Mus musculus
acacttcagttctttatacctctac

SEQ ID NO: 98057 - DNA, 25 bp, Mus musculus
acacttcagtttctcgcagatatat

SEQ ID NO: 98058 - DNA, 25 bp, Mus musculus
acacttcagtttgtcgcagatatat

SEQ ID NO: 98059 - DNA, 25 bp, Mus musculus
acacttcatgttagctgctccaact

SEQ ID NO: 98060 - DNA, 25 bp, Mus musculus
acacttcatgtttgctgctccaact

SEQ ID NO: 98061 - DNA, 25 bp, Mus musculus
acacttcattgaacaggctggcatc

SEQ ID NO: 98062 - DNA, 25 bp, Mus musculus
acacttcattgatcaggctggcatc

SEQ ID NO: 98063 - DNA, 25 bp, Mus musculus
acacttcattttaaacactacacta

SEQ ID NO: 98064 - DNA, 25 bp, Mus musculus
acacttcatttttaacactacacta

SEQ ID NO: 98065 - DNA, 25 bp, Mus musculus
acacttccactacctggtgcagatg

SEQ ID NO: 98066 - DNA, 25 bp, Mus musculus
acacttccactagctggtgcagatg

SEQ ID NO: 98067 - DNA, 25 bp, Mus musculus
acacttccagctagcagtagctcta

SEQ ID NO: 98068 - DNA, 25 bp, Mus musculus
acacttccagcttgcagtagctcta

SEQ ID NO: 98069 - DNA, 25 bp, Mus musculus
acacttcccgtgatatttgatttta

SEQ ID NO: 98070 - DNA, 25 bp, Mus musculus
acacttcccgtgttatttgatttta

SEQ ID NO: 98071 - DNA, 25 bp, Mus musculus
acacttcccttactggtgtgtgtgg

SEQ ID NO: 98072 - DNA, 25 bp, Mus musculus
acacttcccttagtggtgtgtgtgg

SEQ ID NO: 98073 - DNA, 25 bp, Mus musculus
acacttcctacaaggccatcatgag

SEQ ID NO: 98074 - DNA, 25 bp, Mus musculus
acacttcctacatggccatcatgag

SEQ ID NO: 98075 - DNA, 25 bp, Mus musculus
acacttcctcttatgtactgtgtcg

SEQ ID NO: 98076 - DNA, 25 bp, Mus musculus
acacttcctcttttgtactgtgtcg

SEQ ID NO: 98077 - DNA, 25 bp, Mus musculus
acacttcctggtaggagcctgttga

SEQ ID NO: 98078 - DNA, 25 bp, Mus musculus
acacttcctggttggagcctgttga

SEQ ID NO: 98079 - DNA, 25 bp, Mus musculus
acacttcctgtcaaggtggttgcga

SEQ ID NO: 98080 - DNA, 25 bp, Mus musculus
acacttcctgtctaggtggttgcga

SEQ ID NO: 98081 - DNA, 25 bp, Mus musculus
acacttccttcccaggtgcgggagg

SEQ ID NO: 98082 - DNA, 25 bp, Mus musculus
acacttccttccgaggtgcgggagg

SEQ ID NO: 98083 - DNA, 25 bp, Mus musculus
acacttcgaatccatatagcagctt

SEQ ID NO: 98084 - DNA, 25 bp, Mus musculus
acacttcgaatcgatatagcagctt

SEQ ID NO: 98085 - DNA, 25 bp, Mus musculus
acacttcggtacatggtgatcttaa

SEQ ID NO: 98086 - DNA, 25 bp, Mus musculus
acacttcggtacttggtgatcttaa

SEQ ID NO: 98087 - DNA, 25 bp, Mus musculus
acacttcgtatgcatcacatgctgc

SEQ ID NO: 98088 - DNA, 25 bp, Mus musculus
acacttcgtatggatcacatgctgc

SEQ ID NO: 98089 - DNA, 25 bp, Mus musculus
acacttctaattcctacagtaattt

SEQ ID NO: 98090 - DNA, 25 bp, Mus musculus
acacttctaattgctacagtaattt

SEQ ID NO: 98091 - DNA, 25 bp, Mus musculus
acacttctaggtcatccaactctct

SEQ ID NO: 98092 - DNA, 25 bp, Mus musculus
acacttctaggtgatccaactctct

SEQ ID NO: 98093 - DNA, 25 bp, Mus musculus
acacttctcccaccttctgaagatt

SEQ ID NO: 98094 - DNA, 25 bp, Mus musculus
acacttctcccagcttctgaagatt

SEQ ID NO: 98095 - DNA, 25 bp, Mus musculus
acacttctctgcaggatcaggacga

SEQ ID NO: 98096 - DNA, 25 bp, Mus musculus
acacttctctgctggatcaggacga

SEQ ID NO: 98097 - DNA, 25 bp, Mus musculus
acacttctctggacatgtaggctct

SEQ ID NO: 98098 - DNA, 25 bp, Mus musculus
acacttctctggtcatgtaggctct

SEQ ID NO: 98099 - DNA, 25 bp, Mus musculus
acacttctctgtatttccctaggaa

SEQ ID NO: 98100 - DNA, 25 bp, Mus musculus
acacttctctgtttttccctaggaa

SEQ ID NO: 98101 - DNA, 25 bp, Mus musculus
acacttctcttcaccgaattctata

SEQ ID NO: 98102 - DNA, 25 bp, Mus musculus
acacttctcttctccgaattctata

SEQ ID NO: 98103 - DNA, 25 bp, Mus musculus
acacttctctttcgatgtcacatct

SEQ ID NO: 98104 - DNA, 25 bp, Mus musculus
acacttctctttggatgtcacatct

SEQ ID NO: 98105 - DNA, 25 bp, Mus musculus
acacttctgaagactaaactgggaa

SEQ ID NO: 98106 - DNA, 25 bp, Mus musculus
acacttctgaagtctaaactgggaa

SEQ ID NO: 98107 - DNA, 25 bp, Mus musculus
acacttctggtactgagctctcggg

SEQ ID NO: 98108 - DNA, 25 bp, Mus musculus
acacttctggtagtgagctctcggg

SEQ ID NO: 98109 - DNA, 25 bp, Mus musculus
acacttctgtgactggtagctgagg

SEQ ID NO: 98110 - DNA, 25 bp, Mus musculus
acacttctgtgagtggtagctgagg

SEQ ID NO: 98111 - DNA, 25 bp, Mus musculus
acacttctgttcactgcttccagga

SEQ ID NO: 98112 - DNA, 25 bp, Mus musculus
acacttctgttctctgcttccagga

SEQ ID NO: 98113 - DNA, 25 bp, Mus musculus
acacttcttacaacatggtcctggg

SEQ ID NO: 98114 - DNA, 25 bp, Mus musculus
acacttcttacatcatggtcctggg

SEQ ID NO: 98115 - DNA, 25 bp, Mus musculus
acacttcttctcaagcttcagtcag

SEQ ID NO: 98116 - DNA, 25 bp, Mus musculus
acacttcttctctagcttcagtcag

SEQ ID NO: 98117 - DNA, 25 bp, Mus musculus
acacttcttcttagcatgtgctata

SEQ ID NO: 98118 - DNA, 25 bp, Mus musculus
acacttcttctttgcatgtgctata

SEQ ID NO: 98119 - DNA, 25 bp, Mus musculus
acacttcttgaaaaatttactagca

SEQ ID NO: 98120 - DNA, 25 bp, Mus musculus
acacttcttgaataatttactagca

SEQ ID NO: 98121 - DNA, 25 bp, Mus musculus
acacttcttttcactgggtttgaat

SEQ ID NO: 98122 - DNA, 25 bp, Mus musculus
acacttcttttctctgggtttgaat

SEQ ID NO: 98123 - DNA, 25 bp, Mus musculus
acacttgaatcacatctttctggaa

SEQ ID NO: 98124 - DNA, 25 bp, Mus musculus
acacttgaatcagatctttctggaa

SEQ ID NO: 98125 - DNA, 25 bp, Mus musculus
acacttgaatttcaggcataccctt

SEQ ID NO: 98126 - DNA, 25 bp, Mus musculus
acacttgaatttgaggcataccctt

SEQ ID NO: 98127 - DNA, 25 bp, Mus musculus
acacttgacactcttaacactactc

SEQ ID NO: 98128 - DNA, 25 bp, Mus musculus
acacttgacactgttaacactactc

SEQ ID NO: 98129 - DNA, 25 bp, Mus musculus
acacttgactcaacctggagggcag

SEQ ID NO: 98130 - DNA, 25 bp, Mus musculus
acacttgactcatcctggagggcag

SEQ ID NO: 98131 - DNA, 25 bp, Mus musculus
acacttgacttgattcttttctaat

SEQ ID NO: 98132 - DNA, 25 bp, Mus musculus
acacttgacttgtttcttttctaat

SEQ ID NO: 98133 - DNA, 25 bp, Mus musculus
acacttgagcagaacggatacaaca

SEQ ID NO: 98134 - DNA, 25 bp, Mus musculus
acacttgagcagtacggatacaaca

SEQ ID NO: 98135 - DNA, 25 bp, Mus musculus
acacttgagtgtcaccatggagacc

SEQ ID NO: 98136 - DNA, 25 bp, Mus musculus
acacttgagtgtgaccatggagacc

SEQ ID NO: 98137 - DNA, 25 bp, Mus musculus
acacttgatattactataggacctt

SEQ ID NO: 98138 - DNA, 25 bp, Mus musculus
acacttgatatttctataggacctt

SEQ ID NO: 98139 - DNA, 25 bp, Mus musculus
acacttgatccccagctggtagaaa

SEQ ID NO: 98140 - DNA, 25 bp, Mus musculus
acacttgatcccgagctggtagaaa

SEQ ID NO: 98141 - DNA, 25 bp, Mus musculus
acacttgatcgtagggagtcagccc

SEQ ID NO: 98142 - DNA, 25 bp, Mus musculus
acacttgatcgttgggagtcagccc

SEQ ID NO: 98143 - DNA, 25 bp, Mus musculus
acacttgatgcacgtggatagccaa

SEQ ID NO: 98144 - DNA, 25 bp, Mus musculus
acacttgatgcaggtggatagccaa

SEQ ID NO: 98145 - DNA, 25 bp, Mus musculus
acacttgatgccaagacacagggag

SEQ ID NO: 98146 - DNA, 25 bp, Mus musculus
acacttgatgcctagacacagggag

SEQ ID NO: 98147 - DNA, 25 bp, Mus musculus
acacttgcacatcattcctccagag

SEQ ID NO: 98148 - DNA, 25 bp, Mus musculus
acacttgcacatgattcctccagag

SEQ ID NO: 98149 - DNA, 25 bp, Mus musculus
acacttgcaggaagccccatggctg

SEQ ID NO: 98150 - DNA, 25 bp, Mus musculus
acacttgcaggatgccccatggctg

SEQ ID NO: 98151 - DNA, 25 bp, Mus musculus
acacttgcatatctgattccacttt

SEQ ID NO: 98152 - DNA, 25 bp, Mus musculus
acacttgcatatgtgattccacttt

SEQ ID NO: 98153 - DNA, 25 bp, Mus musculus
acacttgcatggctcacagatcaat

SEQ ID NO: 98154 - DNA, 25 bp, Mus musculus
acacttgcatgggtcacagatcaat

SEQ ID NO: 98155 - DNA, 25 bp, Mus musculus
acacttgccaagctggatgtactga

SEQ ID NO: 98156 - DNA, 25 bp, Mus musculus
acacttgccaaggtggatgtactga

SEQ ID NO: 98157 - DNA, 25 bp, Mus musculus
acacttgcccctacgtccataatat

SEQ ID NO: 98158 - DNA, 25 bp, Mus musculus
acacttgccccttcgtccataatat

SEQ ID NO: 98159 - DNA, 25 bp, Mus musculus
acacttgcccgaccttttgtacggc

SEQ ID NO: 98160 - DNA, 25 bp, Mus musculus
acacttgcccgagcttttgtacggc

SEQ ID NO: 98161 - DNA, 25 bp, Mus musculus
acacttgcccgtcaggatgcctgtg

SEQ ID NO: 98162 - DNA, 25 bp, Mus musculus
acacttgcccgtgaggatgcctgtg

SEQ ID NO: 98163 - DNA, 25 bp, Mus musculus
acacttgcctccaagcttagtgacc

SEQ ID NO: 98164 - DNA, 25 bp, Mus musculus
acacttgcctcctagcttagtgacc

SEQ ID NO: 98165 - DNA, 25 bp, Mus musculus
acacttgcctgacatttatgtggct

SEQ ID NO: 98166 - DNA, 25 bp, Mus musculus
acacttgcctgagatttatgtggct

SEQ ID NO: 98167 - DNA, 25 bp, Mus musculus
acacttgccttccaatgctgctgga

SEQ ID NO: 98168 - DNA, 25 bp, Mus musculus
acacttgccttcgaatgctgctgga

SEQ ID NO: 98169 - DNA, 25 bp, Mus musculus
acacttgctccactgtaggacacag

SEQ ID NO: 98170 - DNA, 25 bp, Mus musculus
acacttgctccagtgtaggacacag

SEQ ID NO: 98171 - DNA, 25 bp, Mus musculus
acacttgctgaaaggcaagccctgg

SEQ ID NO: 98172 - DNA, 25 bp, Mus musculus
acacttgctgaatggcaagccctgg

SEQ ID NO: 98173 - DNA, 25 bp, Mus musculus
acacttgctgagctcccagacagga

SEQ ID NO: 98174 - DNA, 25 bp, Mus musculus
acacttgctgaggtcccagacagga

SEQ ID NO: 98175 - DNA, 25 bp, Mus musculus
acacttgctgtcagtttcttgcagc

SEQ ID NO: 98176 - DNA, 25 bp, Mus musculus
acacttgctgtctgtttcttgcagc

SEQ ID NO: 98177 - DNA, 25 bp, Mus musculus
acacttgcttgcattctgtgcctgc

SEQ ID NO: 98178 - DNA, 25 bp, Mus musculus
acacttgcttgctttctgtgcctgc

SEQ ID NO: 98179 - DNA, 25 bp, Mus musculus
acacttgctttgaaatgtggctgtt

SEQ ID NO: 98180 - DNA, 25 bp, Mus musculus
acacttgctttgtaatgtggctgtt

SEQ ID NO: 98181 - DNA, 25 bp, Mus musculus
acacttggaactaaggatgtaccta

SEQ ID NO: 98182 - DNA, 25 bp, Mus musculus
acacttggaacttaggatgtaccta

SEQ ID NO: 98183 - DNA, 25 bp, Mus musculus
acacttggaagtcactgtttgttct

SEQ ID NO: 98184 - DNA, 25 bp, Mus musculus
acacttggaagtgactgtttgttct

SEQ ID NO: 98185 - DNA, 25 bp, Mus musculus
acacttggaccacagggagaatcct

SEQ ID NO: 98186 - DNA, 25 bp, Mus musculus
acacttggaccagagggagaatcct

SEQ ID NO: 98187 - DNA, 25 bp, Mus musculus
acacttggactgaccctgcaggttg

SEQ ID NO: 98188 - DNA, 25 bp, Mus musculus
acacttggactgtccctgcaggttg

SEQ ID NO: 98189 - DNA, 25 bp, Mus musculus
acacttggagccacacctttgttag

SEQ ID NO: 98190 - DNA, 25 bp, Mus musculus
acacttggagcctcacctttgttag

SEQ ID NO: 98191 - DNA, 25 bp, Mus musculus
acacttggagtcaaagcaggacatg

SEQ ID NO: 98192 - DNA, 25 bp, Mus musculus
acacttggagtctaagcaggacatg

SEQ ID NO: 98193 - DNA, 25 bp, Mus musculus
acacttggatgtccccattgttcac

SEQ ID NO: 98194 - DNA, 25 bp, Mus musculus
acacttggatgtgcccattgttcac

SEQ ID NO: 98195 - DNA, 25 bp, Mus musculus
acacttggcaagcatgcaatcccca

SEQ ID NO: 98196 - DNA, 25 bp, Mus musculus
acacttggcaaggatgcaatcccca

SEQ ID NO: 98197 - DNA, 25 bp, Mus musculus
acacttggcatacaaacgtgcttat

SEQ ID NO: 98198 - DNA, 25 bp, Mus musculus
acacttggcatagaaacgtgcttat

SEQ ID NO: 98199 - DNA, 25 bp, Mus musculus
acacttggccagctagacagaagat

SEQ ID NO: 98200 - DNA, 25 bp, Mus musculus
acacttggccaggtagacagaagat

SEQ ID NO: 98201 - DNA, 25 bp, Mus musculus
acacttggctgactttctacctggg

SEQ ID NO: 98202 - DNA, 25 bp, Mus musculus
acacttggctgagtttctacctggg

SEQ ID NO: 98203 - DNA, 25 bp, Mus musculus
acacttggctgtatttattctactc

SEQ ID NO: 98204 - DNA, 25 bp, Mus musculus
acacttggctgtttttattctactc

SEQ ID NO: 98205 - DNA, 25 bp, Mus musculus
acacttgggtggctttactctctgt

SEQ ID NO: 98206 - DNA, 25 bp, Mus musculus
acacttgggtgggtttactctctgt

SEQ ID NO: 98207 - DNA, 25 bp, Mus musculus
acacttgggtttattaatgctgcac

SEQ ID NO: 98208 - DNA, 25 bp, Mus musculus
acacttgggttttttaatgctgcac

SEQ ID NO: 98209 - DNA, 25 bp, Mus musculus
acacttggtaaacagacatgcatgc

SEQ ID NO: 98210 - DNA, 25 bp, Mus musculus
acacttggtaaagagacatgcatgc

SEQ ID NO: 98211 - DNA, 25 bp, Mus musculus
acacttggtaatcaaggctgcttct

SEQ ID NO: 98212 - DNA, 25 bp, Mus musculus
acacttggtaatgaaggctgcttct

SEQ ID NO: 98213 - DNA, 25 bp, Mus musculus
acacttggtccaaaattttcgtaga

SEQ ID NO: 98214 - DNA, 25 bp, Mus musculus
acacttggtccataattttcgtaga

SEQ ID NO: 98215 - DNA, 25 bp, Mus musculus
acacttggtcgaatacttccctgag

SEQ ID NO: 98216 - DNA, 25 bp, Mus musculus
acacttggtcgattacttccctgag

SEQ ID NO: 98217 - DNA, 25 bp, Mus musculus
acacttggtctactgtgtggatttc

SEQ ID NO: 98218 - DNA, 25 bp, Mus musculus
acacttggtctagtgtgtggatttc

SEQ ID NO: 98219 - DNA, 25 bp, Mus musculus
acacttggttttcggtatcaggcac

SEQ ID NO: 98220 - DNA, 25 bp, Mus musculus
acacttggttttgggtatcaggcac

SEQ ID NO: 98221 - DNA, 25 bp, Mus musculus
acacttgtaatcatactgctcacct

SEQ ID NO: 98222 - DNA, 25 bp, Mus musculus
acacttgtaatcttactgctcacct

SEQ ID NO: 98223 - DNA, 25 bp, Mus musculus
acacttgtcacaacactactaggtt

SEQ ID NO: 98224 - DNA, 25 bp, Mus musculus
acacttgtcacatcactactaggtt

SEQ ID NO: 98225 - DNA, 25 bp, Mus musculus
acacttgtcactacaccaagacatg

SEQ ID NO: 98226 - DNA, 25 bp, Mus musculus
acacttgtcacttcaccaagacatg

SEQ ID NO: 98227 - DNA, 25 bp, Mus musculus
acacttgtcagtctaagtctatgct

SEQ ID NO: 98228 - DNA, 25 bp, Mus musculus
acacttgtcagtgtaagtctatgct

SEQ ID NO: 98229 - DNA, 25 bp, Mus musculus
acacttgtctgaacctcatcactaa

SEQ ID NO: 98230 - DNA, 25 bp, Mus musculus
acacttgtctgatcctcatcactaa

SEQ ID NO: 98231 - DNA, 25 bp, Mus musculus
acacttgtctgtatttccatgatgg

SEQ ID NO: 98232 - DNA, 25 bp, Mus musculus
acacttgtctgtcaaaaggtctagt

SEQ ID NO: 98233 - DNA, 25 bp, Mus musculus
acacttgtctgtgaaaaggtctagt

SEQ ID NO: 98234 - DNA, 25 bp, Mus musculus
acacttgtctgtttttccatgatgg

SEQ ID NO: 98235 - DNA, 25 bp, Mus musculus
acacttgtgactagggtttgtgaca

SEQ ID NO: 98236 - DNA, 25 bp, Mus musculus
acacttgtgacttgggtttgtgaca

SEQ ID NO: 98237 - DNA, 25 bp, Mus musculus
acacttgtgatgacacctcttggat

SEQ ID NO: 98238 - DNA, 25 bp, Mus musculus
acacttgtgatgtcacctcttggat

SEQ ID NO: 98239 - DNA, 25 bp, Mus musculus
acacttgtgcacagtcttgggcaga

SEQ ID NO: 98240 - DNA, 25 bp, Mus musculus
acacttgtgcactgtcttgggcaga

SEQ ID NO: 98241 - DNA, 25 bp, Mus musculus
acacttgtggcactagagcgacccc

SEQ ID NO: 98242 - DNA, 25 bp, Mus musculus
acacttgtggcagtagagcgacccc

SEQ ID NO: 98243 - DNA, 25 bp, Mus musculus
acacttgtgggtcctgcatctcgtc

SEQ ID NO: 98244 - DNA, 25 bp, Mus musculus
acacttgtgggtgctgcatctcgtc

SEQ ID NO: 98245 - DNA, 25 bp, Mus musculus
acacttgtggtcctagcactcggga

SEQ ID NO: 98246 - DNA, 25 bp, Mus musculus
acacttgtggtcgtagcactcggga

SEQ ID NO: 98247 - DNA, 25 bp, Mus musculus
acacttgtggttcataaacttcata

SEQ ID NO: 98248 - DNA, 25 bp, Mus musculus
acacttgtggttgataaacttcata

SEQ ID NO: 98249 - DNA, 25 bp, Mus musculus
acacttgtgtgaaccgtgaccatct

SEQ ID NO: 98250 - DNA, 25 bp, Mus musculus
acacttgtgtgatccgtgaccatct

SEQ ID NO: 98251 - DNA, 25 bp, Mus musculus
acacttgtgtggaggcagcttccct

SEQ ID NO: 98252 - DNA, 25 bp, Mus musculus
acacttgtgtggtggcagcttccct

SEQ ID NO: 98253 - DNA, 25 bp, Mus musculus
acacttgtgtgtctccgtgcgaaca

SEQ ID NO: 98254 - DNA, 25 bp, Mus musculus
acacttgtgtgtgtccgtgcgaaca

SEQ ID NO: 98255 - DNA, 25 bp, Mus musculus
acacttgttctgctgtgctgtaaca

SEQ ID NO: 98256 - DNA, 25 bp, Mus musculus
acacttgttctggtgtgctgtaaca

SEQ ID NO: 98257 - DNA, 25 bp, Mus musculus
acacttgttggcaatgatctggttc

SEQ ID NO: 98258 - DNA, 25 bp, Mus musculus
acacttgttggctatgatctggttc

SEQ ID NO: 98259 - DNA, 25 bp, Mus musculus
acacttgttttgctggctgtcctgt

SEQ ID NO: 98260 - DNA, 25 bp, Mus musculus
acacttgttttggtggctgtcctgt

SEQ ID NO: 98261 - DNA, 25 bp, Mus musculus
acactttaaagtccttaccctgcca

SEQ ID NO: 98262 - DNA, 25 bp, Mus musculus
acactttaaagtgcttaccctgcca

SEQ ID NO: 98263 - DNA, 25 bp, Mus musculus
acactttaacagctgttcccgaaag

SEQ ID NO: 98264 - DNA, 25 bp, Mus musculus
acactttaacaggtgttcccgaaag

SEQ ID NO: 98265 - DNA, 25 bp, Mus musculus
acactttacatgcaccttcatgtca

SEQ ID NO: 98266 - DNA, 25 bp, Mus musculus
acactttacatggaccttcatgtca

SEQ ID NO: 98267 - DNA, 25 bp, Mus musculus
acactttagacaaaccattcaggag

SEQ ID NO: 98268 - DNA, 25 bp, Mus musculus
acactttagacataccattcaggag

SEQ ID NO: 98269 - DNA, 25 bp, Mus musculus
acactttagactaccattcaggagg

SEQ ID NO: 98270 - DNA, 25 bp, Mus musculus
acactttagacttccattcaggagg

SEQ ID NO: 98271 - DNA, 25 bp, Mus musculus
acactttaggtaccctggtgtgcag

SEQ ID NO: 98272 - DNA, 25 bp, Mus musculus
acactttaggtagcctggtgtgcag

SEQ ID NO: 98273 - DNA, 25 bp, Mus musculus
acactttatcctacttggaggatgg

SEQ ID NO: 98274 - DNA, 25 bp, Mus musculus
acactttatccttcttggaggatgg

SEQ ID NO: 98275 - DNA, 25 bp, Mus musculus
acactttatcttcggtttctcagcc

SEQ ID NO: 98276 - DNA, 25 bp, Mus musculus
acactttatcttgggtttctcagcc

SEQ ID NO: 98277 - DNA, 25 bp, Mus musculus
acactttattatctactgttcctaa

SEQ ID NO: 98278 - DNA, 25 bp, Mus musculus
acactttattatgtactgttcctaa

SEQ ID NO: 98279 - DNA, 25 bp, Mus musculus
acactttattcactactggatccag

SEQ ID NO: 98280 - DNA, 25 bp, Mus musculus
acactttattcagtactggatccag

SEQ ID NO: 98281 - DNA, 25 bp, Mus musculus
acactttattccctgttaaagagct

SEQ ID NO: 98282 - DNA, 25 bp, Mus musculus
acactttattccgtgttaaagagct

SEQ ID NO: 98283 - DNA, 25 bp, Mus musculus
acactttcactgacaaatagctttg

SEQ ID NO: 98284 - DNA, 25 bp, Mus musculus
acactttcactgagactcactgtgg

SEQ ID NO: 98285 - DNA, 25 bp, Mus musculus
acactttcactgatgcggtctttga

SEQ ID NO: 98286 - DNA, 25 bp, Mus musculus
acactttcactgtcaaatagctttg

SEQ ID NO: 98287 - DNA, 25 bp, Mus musculus
acactttcactgtgactcactgtgg

SEQ ID NO: 98288 - DNA, 25 bp, Mus musculus
acactttcactgttgcggtctttga

SEQ ID NO: 98289 - DNA, 25 bp, Mus musculus
acactttcaggtacagtttcttctt

SEQ ID NO: 98290 - DNA, 25 bp, Mus musculus
acactttcaggttcagtttcttctt

SEQ ID NO: 98291 - DNA, 25 bp, Mus musculus
acactttcatctcttggcctgtctg

SEQ ID NO: 98292 - DNA, 25 bp, Mus musculus
acactttcatctgttggcctgtctg

SEQ ID NO: 98293 - DNA, 25 bp, Mus musculus
acactttccatgagtcatctcgtac

SEQ ID NO: 98294 - DNA, 25 bp, Mus musculus
acactttccatgtgtcatctcgtac

SEQ ID NO: 98295 - DNA, 25 bp, Mus musculus
acactttccctgatttctgttgaca

SEQ ID NO: 98296 - DNA, 25 bp, Mus musculus
acactttccctgttttctgttgaca

SEQ ID NO: 98297 - DNA, 25 bp, Mus musculus
acactttcctcacatcaccatagat

SEQ ID NO: 98298 - DNA, 25 bp, Mus musculus
acactttcctcagatcaccatagat

SEQ ID NO: 98299 - DNA, 25 bp, Mus musculus
acactttcgttcaggcaaaccggtg

SEQ ID NO: 98300 - DNA, 25 bp, Mus musculus
acactttcgttctggcaaaccggtg

SEQ ID NO: 98301 - DNA, 25 bp, Mus musculus
acactttctcacatagcggataaga

SEQ ID NO: 98302 - DNA, 25 bp, Mus musculus
acactttctcacttagcggataaga

SEQ ID NO: 98303 - DNA, 25 bp, Mus musculus
acactttctcttagtacatattcgt

SEQ ID NO: 98304 - DNA, 25 bp, Mus musculus
acactttctctttgtacatattcgt

SEQ ID NO: 98305 - DNA, 25 bp, Mus musculus
acactttctgtgctactactattat

SEQ ID NO: 98306 - DNA, 25 bp, Mus musculus
acactttctgtggtactactattat

SEQ ID NO: 98307 - DNA, 25 bp, Mus musculus
acactttcttgcactgtgctgtggc

SEQ ID NO: 98308 - DNA, 25 bp, Mus musculus
acactttcttgctctgtgctgtggc

SEQ ID NO: 98309 - DNA, 25 bp, Mus musculus
acactttcttggaaaaactgtagat

SEQ ID NO: 98310 - DNA, 25 bp, Mus musculus
acactttcttggtaaaactgtagat

SEQ ID NO: 98311 - DNA, 25 bp, Mus musculus
acactttgaagtccccaagcttgaa

SEQ ID NO: 98312 - DNA, 25 bp, Mus musculus
acactttgaagtgcccaagcttgaa

SEQ ID NO: 98313 - DNA, 25 bp, Mus musculus
acactttgagtcaaggtggtgcaca

SEQ ID NO: 98314 - DNA, 25 bp, Mus musculus
acactttgagtctaggtggtgcaca

SEQ ID NO: 98315 - DNA, 25 bp, Mus musculus
acactttgagtgctatctagactat

SEQ ID NO: 98316 - DNA, 25 bp, Mus musculus
acactttgagtggtatctagactat

SEQ ID NO: 98317 - DNA, 25 bp, Mus musculus
acactttgccaacgtgtgggtgcac

SEQ ID NO: 98318 - DNA, 25 bp, Mus musculus
acactttgccaaggtgtgggtgcac

SEQ ID NO: 98319 - DNA, 25 bp, Mus musculus
acactttgccacacaaatcaccaaa

SEQ ID NO: 98320 - DNA, 25 bp, Mus musculus
acactttgccactcaaatcaccaaa

SEQ ID NO: 98321 - DNA, 25 bp, Mus musculus
acactttgcgtaatgttagttctca

SEQ ID NO: 98322 - DNA, 25 bp, Mus musculus
acactttgcgtattgttagttctca

SEQ ID NO: 98323 - DNA, 25 bp, Mus musculus
acactttgctctagtgtcaaacaca

SEQ ID NO: 98324 - DNA, 25 bp, Mus musculus
acactttgctcttgtgtcaaacaca

SEQ ID NO: 98325 - DNA, 25 bp, Mus musculus
acactttggaatactttttcatgcc

SEQ ID NO: 98326 - DNA, 25 bp, Mus musculus
acactttggaattctttttcatgcc

SEQ ID NO: 98327 - DNA, 25 bp, Mus musculus
acactttggagcatttactctaggg

SEQ ID NO: 98328 - DNA, 25 bp, Mus musculus
acactttggagcttttactctaggg

SEQ ID NO: 98329 - DNA, 25 bp, Mus musculus
acactttggaggcaacgttctgaaa

SEQ ID NO: 98330 - DNA, 25 bp, Mus musculus
acactttggagggaacgttctgaaa

SEQ ID NO: 98331 - DNA, 25 bp, Mus musculus
acactttggatcctgagctgagaca

SEQ ID NO: 98332 - DNA, 25 bp, Mus musculus
acactttggatcgtgagctgagaca

SEQ ID NO: 98333 - DNA, 25 bp, Mus musculus
acactttggctcatcccagcaaggg

SEQ ID NO: 98334 - DNA, 25 bp, Mus musculus
acactttggctcttcccagcaaggg

SEQ ID NO: 98335 - DNA, 25 bp, Mus musculus
acactttgggtgctattgatggagc

SEQ ID NO: 98336 - DNA, 25 bp, Mus musculus
acactttgggtggtattgatggagc

SEQ ID NO: 98337 - DNA, 25 bp, Mus musculus
acactttgtaccagcgcctctgaac

SEQ ID NO: 98338 - DNA, 25 bp, Mus musculus
acactttgtacctgcgcctctgaac

SEQ ID NO: 98339 - DNA, 25 bp, Mus musculus
acactttgtctgagatgccatgagt

SEQ ID NO: 98340 - DNA, 25 bp, Mus musculus
acactttgtctgtgatgccatgagt

SEQ ID NO: 98341 - DNA, 25 bp, Mus musculus
acactttgtcttaggcctgtagtct

SEQ ID NO: 98342 - DNA, 25 bp, Mus musculus
acactttgtctttggcctgtagtct

SEQ ID NO: 98343 - DNA, 25 bp, Mus musculus
acactttgtgagcactaatggaaaa

SEQ ID NO: 98344 - DNA, 25 bp, Mus musculus
acactttgtgaggactaatggaaaa

SEQ ID NO: 98345 - DNA, 25 bp, Mus musculus
acactttgtgctaggataatcttgg

SEQ ID NO: 98346 - DNA, 25 bp, Mus musculus
acactttgtgcttggataatcttgg

SEQ ID NO: 98347 - DNA, 25 bp, Mus musculus
acactttgtgtgctttaatgttgtt

SEQ ID NO: 98348 - DNA, 25 bp, Mus musculus
acactttgtgtggtttaatgttgtt

SEQ ID NO: 98349 - DNA, 25 bp, Mus musculus
acacttttaagtacagcagctgaca

SEQ ID NO: 98350 - DNA, 25 bp, Mus musculus
acacttttaagttcagcagctgaca

SEQ ID NO: 98351 - DNA, 25 bp, Mus musculus
acacttttactccacgcaactgttg

SEQ ID NO: 98352 - DNA, 25 bp, Mus musculus
acacttttactcgacgcaactgttg

SEQ ID NO: 98353 - DNA, 25 bp, Mus musculus
acacttttacttctttccctgacag

SEQ ID NO: 98354 - DNA, 25 bp, Mus musculus
acacttttacttgtttccctgacag

SEQ ID NO: 98355 - DNA, 25 bp, Mus musculus
acacttttatggcaacatggagcag

SEQ ID NO: 98356 - DNA, 25 bp, Mus musculus
acacttttatgggaacatggagcag

SEQ ID NO: 98357 - DNA, 25 bp, Mus musculus
acacttttcactacagggctggact

SEQ ID NO: 98358 - DNA, 25 bp, Mus musculus
acacttttcacttcagggctggact

SEQ ID NO: 98359 - DNA, 25 bp, Mus musculus
acacttttcataccctgagctattc

SEQ ID NO: 98360 - DNA, 25 bp, Mus musculus
acacttttcatagcctgagctattc

SEQ ID NO: 98361 - DNA, 25 bp, Mus musculus
acacttttcttacaagcttcttctg

SEQ ID NO: 98362 - DNA, 25 bp, Mus musculus
acacttttcttagaagcttcttctg

SEQ ID NO: 98363 - DNA, 25 bp, Mus musculus
acacttttgcaaaagaaggcacttt

SEQ ID NO: 98364 - DNA, 25 bp, Mus musculus
acacttttgcaatagaaggcacttt

SEQ ID NO: 98365 - DNA, 25 bp, Mus musculus
acacttttgcatagtttggaaacgg

SEQ ID NO: 98366 - DNA, 25 bp, Mus musculus
acacttttgcattgtttggaaacgg

SEQ ID NO: 98367 - DNA, 25 bp, Mus musculus
acacttttgccccttgcttctttca

SEQ ID NO: 98368 - DNA, 25 bp, Mus musculus
acacttttgcccgttgcttctttca

SEQ ID NO: 98369 - DNA, 25 bp, Mus musculus
acacttttggctactgaggcccttg

SEQ ID NO: 98370 - DNA, 25 bp, Mus musculus
acacttttggcttctgaggcccttg

SEQ ID NO: 98371 - DNA, 25 bp, Mus musculus
acacttttgtgtccttagcatggca

SEQ ID NO: 98372 - DNA, 25 bp, Mus musculus
acacttttgtgtgcttagcatggca

SEQ ID NO: 98373 - DNA, 25 bp, Mus musculus
acagaaaacatacccgaagcattag

SEQ ID NO: 98374 - DNA, 25 bp, Mus musculus
acagaaaacatagccgaagcattag

SEQ ID NO: 98375 - DNA, 25 bp, Mus musculus
acagaaaacccaagcctccggaatg

SEQ ID NO: 98376 - DNA, 25 bp, Mus musculus
acagaaaacccatgcctccggaatg

SEQ ID NO: 98377 - DNA, 25 bp, Mus musculus
acagaaaacgatctctttggttggg

SEQ ID NO: 98378 - DNA, 25 bp, Mus musculus
acagaaaacgatgtctttggttggg

SEQ ID NO: 98379 - DNA, 25 bp, Mus musculus
acagaaaacgtcaatgctggtgctg

SEQ ID NO: 98380 - DNA, 25 bp, Mus musculus
acagaaaacgtctatgctggtgctg

SEQ ID NO: 98381 - DNA, 25 bp, Mus musculus
acagaaaactttcagggaatcctat

SEQ ID NO: 98382 - DNA, 25 bp, Mus musculus
acagaaaactttgagggaatcctat

SEQ ID NO: 98383 - DNA, 25 bp, Mus musculus
acagaaaattttctccctcacgcat

SEQ ID NO: 98384 - DNA, 25 bp, Mus musculus
acagaaaattttgtccctcacgcat

SEQ ID NO: 98385 - DNA, 25 bp, Mus musculus
acagaaacaaacagccaggaatccc

SEQ ID NO: 98386 - DNA, 25 bp, Mus musculus
acagaaacaaactgccaggaatccc

SEQ ID NO: 98387 - DNA, 25 bp, Mus musculus
acagaaacacagatgcccggcaggt

SEQ ID NO: 98388 - DNA, 25 bp, Mus musculus
acagaaacacagttgcccggcaggt

SEQ ID NO: 98389 - DNA, 25 bp, Mus musculus
acagaaacagaactgaccctgtgaa

SEQ ID NO: 98390 - DNA, 25 bp, Mus musculus
acagaaacagaagtgaccctgtgaa

SEQ ID NO: 98391 - DNA, 25 bp, Mus musculus
acagaaacagacactcaccggctgg

SEQ ID NO: 98392 - DNA, 25 bp, Mus musculus
acagaaacagactctcaccggctgg

SEQ ID NO: 98393 - DNA, 25 bp, Mus musculus
acagaaaccaccatggcaagcttga

SEQ ID NO: 98394 - DNA, 25 bp, Mus musculus
acagaaaccaccttggcaagcttga

SEQ ID NO: 98395 - DNA, 25 bp, Mus musculus
acagaaaccccaatccgcattttcg

SEQ ID NO: 98396 - DNA, 25 bp, Mus musculus
acagaaaccccattccgcattttcg

SEQ ID NO: 98397 - DNA, 25 bp, Mus musculus
acagaaaccgctaaatatgtgcttt

SEQ ID NO: 98398 - DNA, 25 bp, Mus musculus
acagaaaccgcttaatatgtgcttt

SEQ ID NO: 98399 - DNA, 25 bp, Mus musculus
acagaaacctagatgggcagccagc

SEQ ID NO: 98400 - DNA, 25 bp, Mus musculus
acagaaacctagttgggcagccagc

SEQ ID NO: 98401 - DNA, 25 bp, Mus musculus
acagaaacctgcagacactaccaaa

SEQ ID NO: 98402 - DNA, 25 bp, Mus musculus
acagaaacctgctgacactaccaaa

SEQ ID NO: 98403 - DNA, 25 bp, Mus musculus
acagaaacttacctttgttgattgt

SEQ ID NO: 98404 - DNA, 25 bp, Mus musculus
acagaaacttacgtttgttgattgt

SEQ ID NO: 98405 - DNA, 25 bp, Mus musculus
acagaaacttcgctggtcagcagta

SEQ ID NO: 98406 - DNA, 25 bp, Mus musculus
acagaaacttcggtggtcagcagta

SEQ ID NO: 98407 - DNA, 25 bp, Mus musculus
acagaaacttctacccacagtgcag

SEQ ID NO: 98408 - DNA, 25 bp, Mus musculus
acagaaacttcttcccacagtgcag

SEQ ID NO: 98409 - DNA, 25 bp, Mus musculus
acagaaactttgacttcctactctt

SEQ ID NO: 98410 - DNA, 25 bp, Mus musculus
acagaaactttgtcttcctactctt

SEQ ID NO: 98411 - DNA, 25 bp, Mus musculus
acagaaacttttcagcagtgcatgt

SEQ ID NO: 98412 - DNA, 25 bp, Mus musculus
acagaaacttttgagcagtgcatgt

SEQ ID NO: 98413 - DNA, 25 bp, Mus musculus
acagaaagacttaaggcccgcgcct

SEQ ID NO: 98414 - DNA, 25 bp, Mus musculus
acagaaagactttaggcccgcgcct

SEQ ID NO: 98415 - DNA, 25 bp, Mus musculus
acagaaagattacagaggtaaggct

SEQ ID NO: 98416 - DNA, 25 bp, Mus musculus
acagaaagattagagaggtaaggct

SEQ ID NO: 98417 - DNA, 25 bp, Mus musculus
acagaaagccctaggatggagccaa

SEQ ID NO: 98418 - DNA, 25 bp, Mus musculus
acagaaagcccttggatggagccaa

SEQ ID NO: 98419 - DNA, 25 bp, Mus musculus
acagaaagctctcctgcatccggta

SEQ ID NO: 98420 - DNA, 25 bp, Mus musculus
acagaaagctctgctgcatccggta

SEQ ID NO: 98421 - DNA, 25 bp, Mus musculus
acagaaaggctgaccgacgactact

SEQ ID NO: 98422 - DNA, 25 bp, Mus musculus
acagaaaggctgtccgacgactact

SEQ ID NO: 98423 - DNA, 25 bp, Mus musculus
acagaaaggcttctctctcagaaaa

SEQ ID NO: 98424 - DNA, 25 bp, Mus musculus
acagaaaggcttgtctctcagaaaa

SEQ ID NO: 98425 - DNA, 25 bp, Mus musculus
acagaaagggctcagtcacttccca

SEQ ID NO: 98426 - DNA, 25 bp, Mus musculus
acagaaagggctgagtcacttccca

SEQ ID NO: 98427 - DNA, 25 bp, Mus musculus
acagaaaggtctccagggtcctggc

SEQ ID NO: 98428 - DNA, 25 bp, Mus musculus
acagaaaggtctctaaggccgaaga

SEQ ID NO: 98429 - DNA, 25 bp, Mus musculus
acagaaaggtctgcagggtcctggc

SEQ ID NO: 98430 - DNA, 25 bp, Mus musculus
acagaaaggtctgtaaggccgaaga

SEQ ID NO: 98431 - DNA, 25 bp, Mus musculus
acagaaatagacatcggcaccgact

SEQ ID NO: 98432 - DNA, 25 bp, Mus musculus
acagaaatagacttcggcaccgact

SEQ ID NO: 98433 - DNA, 25 bp, Mus musculus
acagaaatagggactggctgccaca

SEQ ID NO: 98434 - DNA, 25 bp, Mus musculus
acagaaatagggtctggctgccaca

SEQ ID NO: 98435 - DNA, 25 bp, Mus musculus
acagaaatagttagagtcattatta

SEQ ID NO: 98436 - DNA, 25 bp, Mus musculus
acagaaatagtttgagtcattatta

SEQ ID NO: 98437 - DNA, 25 bp, Mus musculus
acagaaatccccagggtggtcttag

SEQ ID NO: 98438 - DNA, 25 bp, Mus musculus
acagaaatcccctgggtggtcttag

SEQ ID NO: 98439 - DNA, 25 bp, Mus musculus
acagaaatcgaaacgcccatgacta

SEQ ID NO: 98440 - DNA, 25 bp, Mus musculus
acagaaatcgaatcgcccatgacta

SEQ ID NO: 98441 - DNA, 25 bp, Mus musculus
acagaaatgaacatagctcagatta

SEQ ID NO: 98442 - DNA, 25 bp, Mus musculus
acagaaatgaacttagctcagatta

SEQ ID NO: 98443 - DNA, 25 bp, Mus musculus
acagaaatgctgctttgtgtcacct

SEQ ID NO: 98444 - DNA, 25 bp, Mus musculus
acagaaatgctggtttgtgtcacct

SEQ ID NO: 98445 - DNA, 25 bp, Mus musculus
acagaaatgtccacgtggctctcat

SEQ ID NO: 98446 - DNA, 25 bp, Mus musculus
acagaaatgtcctcgtggctctcat

SEQ ID NO: 98447 - DNA, 25 bp, Mus musculus
acagaaatgtgcaagcctcagacca

SEQ ID NO: 98448 - DNA, 25 bp, Mus musculus
acagaaatgtgctagcctcagacca

SEQ ID NO: 98449 - DNA, 25 bp, Mus musculus
acagaaattctgatgcaccgctata

SEQ ID NO: 98450 - DNA, 25 bp, Mus musculus
acagaaattctgttgcaccgctata

SEQ ID NO: 98451 - DNA, 25 bp, Mus musculus
acagaaattggtcgagaaagtggca

SEQ ID NO: 98452 - DNA, 25 bp, Mus musculus
acagaaattggtggagaaagtggca

SEQ ID NO: 98453 - DNA, 25 bp, Mus musculus
acagaacaacataggcatggtggtc

SEQ ID NO: 98454 - DNA, 25 bp, Mus musculus
acagaacaacattggcatggtggtc

SEQ ID NO: 98455 - DNA, 25 bp, Mus musculus
acagaacaacctagggtgtccacca

SEQ ID NO: 98456 - DNA, 25 bp, Mus musculus
acagaacaaccttgggtgtccacca

SEQ ID NO: 98457 - DNA, 25 bp, Mus musculus
acagaacaacttatctcccacagtc

SEQ ID NO: 98458 - DNA, 25 bp, Mus musculus
acagaacaacttttctcccacagtc

SEQ ID NO: 98459 - DNA, 25 bp, Mus musculus
acagaacaatgcaaagaagccttta

SEQ ID NO: 98460 - DNA, 25 bp, Mus musculus
acagaacaatgctaagaagccttta

SEQ ID NO: 98461 - DNA, 25 bp, Mus musculus
acagaacacaccattgtctgtgcct

SEQ ID NO: 98462 - DNA, 25 bp, Mus musculus
acagaacacacctttgtctgtgcct

SEQ ID NO: 98463 - DNA, 25 bp, Mus musculus
acagaacaccctaagggactggaga

SEQ ID NO: 98464 - DNA, 25 bp, Mus musculus
acagaacacccttagggactggaga

SEQ ID NO: 98465 - DNA, 25 bp, Mus musculus
acagaacactgtacagccgagtcag

SEQ ID NO: 98466 - DNA, 25 bp, Mus musculus
acagaacactgttcagccgagtcag

SEQ ID NO: 98467 - DNA, 25 bp, Mus musculus
acagaacactttcctacttgcttag

SEQ ID NO: 98468 - DNA, 25 bp, Mus musculus
acagaacactttgctacttgcttag

SEQ ID NO: 98469 - DNA, 25 bp, Mus musculus
acagaacagagcagccggcaacggc

SEQ ID NO: 98470 - DNA, 25 bp, Mus musculus
acagaacagagctgccggcaacggc

SEQ ID NO: 98471 - DNA, 25 bp, Mus musculus
acagaacatgatatggcgattttta

SEQ ID NO: 98472 - DNA, 25 bp, Mus musculus
acagaacatgatttggcgattttta

SEQ ID NO: 98473 - DNA, 25 bp, Mus musculus
acagaacatgctcgtgcaatgtcca

SEQ ID NO: 98474 - DNA, 25 bp, Mus musculus
acagaacatgctggtgcaatgtcca

SEQ ID NO: 98475 - DNA, 25 bp, Mus musculus
acagaacatgtgactctgttgctgc

SEQ ID NO: 98476 - DNA, 25 bp, Mus musculus
acagaacatgtgtctctgttgctgc

SEQ ID NO: 98477 - DNA, 25 bp, Mus musculus
acagaacattttcccacctttgcta

SEQ ID NO: 98478 - DNA, 25 bp, Mus musculus
acagaacattttgccacctttgcta

SEQ ID NO: 98479 - DNA, 25 bp, Mus musculus
acagaaccaccacagcactttattt

SEQ ID NO: 98480 - DNA, 25 bp, Mus musculus
acagaaccaccagagcactttattt

SEQ ID NO: 98481 - DNA, 25 bp, Mus musculus
acagaaccattgatacgctttgtaa

SEQ ID NO: 98482 - DNA, 25 bp, Mus musculus
acagaaccattgttacgctttgtaa

SEQ ID NO: 98483 - DNA, 25 bp, Mus musculus
acagaaccccagattagtcccagca

SEQ ID NO: 98484 - DNA, 25 bp, Mus musculus
acagaaccccagcaaggccatagtt

SEQ ID NO: 98485 - DNA, 25 bp, Mus musculus
acagaaccccaggaaggccatagtt

SEQ ID NO: 98486 - DNA, 25 bp, Mus musculus
acagaaccccagtttagtcccagca

SEQ ID NO: 98487 - DNA, 25 bp, Mus musculus
acagaacccttaatgttcctcagtc

SEQ ID NO: 98488 - DNA, 25 bp, Mus musculus
acagaacccttattgttcctcagtc

SEQ ID NO: 98489 - DNA, 25 bp, Mus musculus
acagaacctatcctgaactctagca

SEQ ID NO: 98490 - DNA, 25 bp, Mus musculus
acagaacctatcgtgaactctagca

SEQ ID NO: 98491 - DNA, 25 bp, Mus musculus
acagaacctctgagagatctaggat

SEQ ID NO: 98492 - DNA, 25 bp, Mus musculus
acagaacctctgtgagatctaggat

SEQ ID NO: 98493 - DNA, 25 bp, Mus musculus
acagaacctgtcagcctgataggca

SEQ ID NO: 98494 - DNA, 25 bp, Mus musculus
acagaacctgtctgcctgataggca

SEQ ID NO: 98495 - DNA, 25 bp, Mus musculus
acagaacctttgatagccatttcag

SEQ ID NO: 98496 - DNA, 25 bp, Mus musculus
acagaacctttgttagccatttcag

SEQ ID NO: 98497 - DNA, 25 bp, Mus musculus
acagaacgctttcgatgccctgttc

SEQ ID NO: 98498 - DNA, 25 bp, Mus musculus
acagaacgctttggatgccctgttc

SEQ ID NO: 98499 - DNA, 25 bp, Mus musculus
acagaacgttgcatatggacagtca

SEQ ID NO: 98500 - DNA, 25 bp, Mus musculus
acagaacgttgcttatggacagtca

SEQ ID NO: 98501 - DNA, 25 bp, Mus musculus
acagaactagttctctcttgccaag

SEQ ID NO: 98502 - DNA, 25 bp, Mus musculus
acagaactagttctggatttgcccc

SEQ ID NO: 98503 - DNA, 25 bp, Mus musculus
acagaactagttgtctcttgccaag

SEQ ID NO: 98504 - DNA, 25 bp, Mus musculus
acagaactagttgtggatttgcccc

SEQ ID NO: 98505 - DNA, 25 bp, Mus musculus
acagaactggcaattggcaaagctt

SEQ ID NO: 98506 - DNA, 25 bp, Mus musculus
acagaactggcatttggcaaagctt

SEQ ID NO: 98507 - DNA, 25 bp, Mus musculus
acagaactgggcagactcttcagat

SEQ ID NO: 98508 - DNA, 25 bp, Mus musculus
acagaactgggctgactcttcagat

SEQ ID NO: 98509 - DNA, 25 bp, Mus musculus
acagaactgtaaaggctcatgctct

SEQ ID NO: 98510 - DNA, 25 bp, Mus musculus
acagaactgtaatggctcatgctct

SEQ ID NO: 98511 - DNA, 25 bp, Mus musculus
acagaactgtgtatccagcgctgtg

SEQ ID NO: 98512 - DNA, 25 bp, Mus musculus
acagaactgtgtttccagcgctgtg

SEQ ID NO: 98513 - DNA, 25 bp, Mus musculus
acagaacttaccaggaatgtgctca

SEQ ID NO: 98514 - DNA, 25 bp, Mus musculus
acagaacttaccattttgcacagag

SEQ ID NO: 98515 - DNA, 25 bp, Mus musculus
acagaacttacctggaatgtgctca

SEQ ID NO: 98516 - DNA, 25 bp, Mus musculus
acagaacttacctttttgcacagag

SEQ ID NO: 98517 - DNA, 25 bp, Mus musculus
acagaagaaagcaacctgcccaggg

SEQ ID NO: 98518 - DNA, 25 bp, Mus musculus
acagaagaaagctacctgcccaggg

SEQ ID NO: 98519 - DNA, 25 bp, Mus musculus
acagaagaacccagagatgtgtcaa

SEQ ID NO: 98520 - DNA, 25 bp, Mus musculus
acagaagaaccctgagatgtgtcaa

SEQ ID NO: 98521 - DNA, 25 bp, Mus musculus
acagaagaaccgctcgccgaaattg

SEQ ID NO: 98522 - DNA, 25 bp, Mus musculus
acagaagaaccggtcgccgaaattg

SEQ ID NO: 98523 - DNA, 25 bp, Mus musculus
acagaagacagacggccactgatga

SEQ ID NO: 98524 - DNA, 25 bp, Mus musculus
acagaagacagagggccactgatga

SEQ ID NO: 98525 - DNA, 25 bp, Mus musculus
acagaagacatcagccctgcagagg

SEQ ID NO: 98526 - DNA, 25 bp, Mus musculus
acagaagacatctgccctgcagagg

SEQ ID NO: 98527 - DNA, 25 bp, Mus musculus
acagaagacgccaatgactcaagaa

SEQ ID NO: 98528 - DNA, 25 bp, Mus musculus
acagaagacgcctatgactcaagaa

SEQ ID NO: 98529 - DNA, 25 bp, Mus musculus
acagaagactatcactcacttccgc

SEQ ID NO: 98530 - DNA, 25 bp, Mus musculus
acagaagactatgactcacttccgc

SEQ ID NO: 98531 - DNA, 25 bp, Mus musculus
acagaagacttactttcttccctcg

SEQ ID NO: 98532 - DNA, 25 bp, Mus musculus
acagaagacttagtttcttccctcg

SEQ ID NO: 98533 - DNA, 25 bp, Mus musculus
acagaagagacacctttctactccc

SEQ ID NO: 98534 - DNA, 25 bp, Mus musculus
acagaagagacagctttctactccc

SEQ ID NO: 98535 - DNA, 25 bp, Mus musculus
acagaagagaccctcgtccaccaag

SEQ ID NO: 98536 - DNA, 25 bp, Mus musculus
acagaagagaccgtcgtccaccaag

SEQ ID NO: 98537 - DNA, 25 bp, Mus musculus
acagaagagccactcgggagcctac

SEQ ID NO: 98538 - DNA, 25 bp, Mus musculus
acagaagagccagtcgggagcctac

SEQ ID NO: 98539 - DNA, 25 bp, Mus musculus
acagaagagcttctaccagccaata

SEQ ID NO: 98540 - DNA, 25 bp, Mus musculus
acagaagagcttgtaccagccaata

SEQ ID NO: 98541 - DNA, 25 bp, Mus musculus
acagaagaggaacttcgtttgttga

SEQ ID NO: 98542 - DNA, 25 bp, Mus musculus
acagaagaggaagttcgtttgttga

SEQ ID NO: 98543 - DNA, 25 bp, Mus musculus
acagaagatcatacatgttgccatg

SEQ ID NO: 98544 - DNA, 25 bp, Mus musculus
acagaagatcattcatgttgccatg

SEQ ID NO: 98545 - DNA, 25 bp, Mus musculus
acagaagatctaagttcaagtccca

SEQ ID NO: 98546 - DNA, 25 bp, Mus musculus
acagaagatctatgttcaagtccca

SEQ ID NO: 98547 - DNA, 25 bp, Mus musculus
acagaagatgtcatttgtctcctcc

SEQ ID NO: 98548 - DNA, 25 bp, Mus musculus
acagaagatgtcttttgtctcctcc

SEQ ID NO: 98549 - DNA, 25 bp, Mus musculus
acagaagattcaatctcctttcact

SEQ ID NO: 98550 - DNA, 25 bp, Mus musculus
acagaagattcattctcctttcact

SEQ ID NO: 98551 - DNA, 25 bp, Mus musculus
acagaagattctagacaagtgcaat

SEQ ID NO: 98552 - DNA, 25 bp, Mus musculus
acagaagattcttgacaagtgcaat

SEQ ID NO: 98553 - DNA, 25 bp, Mus musculus
acagaagcaaacatccggtgcccat

SEQ ID NO: 98554 - DNA, 25 bp, Mus musculus
acagaagcaaacttccggtgcccat

SEQ ID NO: 98555 - DNA, 25 bp, Mus musculus
acagaagcaacgactggccattgcc

SEQ ID NO: 98556 - DNA, 25 bp, Mus musculus
acagaagcaacgtctggccattgcc

SEQ ID NO: 98557 - DNA, 25 bp, Mus musculus
acagaagcaatgagctgaatgactg

SEQ ID NO: 98558 - DNA, 25 bp, Mus musculus
acagaagcaatgtgctgaatgactg

SEQ ID NO: 98559 - DNA, 25 bp, Mus musculus
acagaagcacgtcagcagggcctat

SEQ ID NO: 98560 - DNA, 25 bp, Mus musculus
acagaagcacgtgagcagggcctat

SEQ ID NO: 98561 - DNA, 25 bp, Mus musculus
acagaagcagccaaggcagcccttc

SEQ ID NO: 98562 - DNA, 25 bp, Mus musculus
acagaagcagcctaggcagcccttc

SEQ ID NO: 98563 - DNA, 25 bp, Mus musculus
acagaagccaagctcctctggacaa

SEQ ID NO: 98564 - DNA, 25 bp, Mus musculus
acagaagccaaggtcctctggacaa

SEQ ID NO: 98565 - DNA, 25 bp, Mus musculus
acagaagccattctgcatatgcctt

SEQ ID NO: 98566 - DNA, 25 bp, Mus musculus
acagaagccattgtgcatatgcctt

SEQ ID NO: 98567 - DNA, 25 bp, Mus musculus
acagaagcccttatcgctttctaaa

SEQ ID NO: 98568 - DNA, 25 bp, Mus musculus
acagaagcccttttcgctttctaaa

SEQ ID NO: 98569 - DNA, 25 bp, Mus musculus
acagaagcctggacacccctggtgg

SEQ ID NO: 98570 - DNA, 25 bp, Mus musculus
acagaagcctggtcacccctggtgg

SEQ ID NO: 98571 - DNA, 25 bp, Mus musculus
acagaagcgagcagcagcacggcat

SEQ ID NO: 98572 - DNA, 25 bp, Mus musculus
acagaagcgagctgcagcacggcat

SEQ ID NO: 98573 - DNA, 25 bp, Mus musculus
acagaagctacacttggcagagaat

SEQ ID NO: 98574 - DNA, 25 bp, Mus musculus
acagaagctacagttggcagagaat

SEQ ID NO: 98575 - DNA, 25 bp, Mus musculus
acagaagctatgaggcctctgatcc

SEQ ID NO: 98576 - DNA, 25 bp, Mus musculus
acagaagctatgtggcctctgatcc

SEQ ID NO: 98577 - DNA, 25 bp, Mus musculus
acagaagctgataacccacgtctca

SEQ ID NO: 98578 - DNA, 25 bp, Mus musculus
acagaagctgattacccacgtctca

SEQ ID NO: 98579 - DNA, 25 bp, Mus musculus
acagaagctgtcactgcttttggca

SEQ ID NO: 98580 - DNA, 25 bp, Mus musculus
acagaagctgtcatcgagcccagaa

SEQ ID NO: 98581 - DNA, 25 bp, Mus musculus
acagaagctgtctctgcttttggca

SEQ ID NO: 98582 - DNA, 25 bp, Mus musculus
acagaagctgtcttcgagcccagaa

SEQ ID NO: 98583 - DNA, 25 bp, Mus musculus
acagaaggagcaatgcactcaccac

SEQ ID NO: 98584 - DNA, 25 bp, Mus musculus
acagaaggagcattgcactcaccac

SEQ ID NO: 98585 - DNA, 25 bp, Mus musculus
acagaaggcacaactccaaggcaat

SEQ ID NO: 98586 - DNA, 25 bp, Mus musculus
acagaaggcacatctccaaggcaat

SEQ ID NO: 98587 - DNA, 25 bp, Mus musculus
acagaaggccaaagcccatggcttc

SEQ ID NO: 98588 - DNA, 25 bp, Mus musculus
acagaaggccaatgcccatggcttc

SEQ ID NO: 98589 - DNA, 25 bp, Mus musculus
acagaaggccatccaggctcaggga

SEQ ID NO: 98590 - DNA, 25 bp, Mus musculus
acagaaggccatcgaccggctccag

SEQ ID NO: 98591 - DNA, 25 bp, Mus musculus
acagaaggccatgcaggctcaggga

SEQ ID NO: 98592 - DNA, 25 bp, Mus musculus
acagaaggccatggaccggctccag

SEQ ID NO: 98593 - DNA, 25 bp, Mus musculus
acagaaggccctcagttttccaaca

SEQ ID NO: 98594 - DNA, 25 bp, Mus musculus
acagaaggccctgagttttccaaca

SEQ ID NO: 98595 - DNA, 25 bp, Mus musculus
acagaaggcggcctcaatctcacct

SEQ ID NO: 98596 - DNA, 25 bp, Mus musculus
acagaaggcggcgtcaatctcacct

SEQ ID NO: 98597 - DNA, 25 bp, Mus musculus
acagaaggctgtccttgcacacaga

SEQ ID NO: 98598 - DNA, 25 bp, Mus musculus
acagaaggctgtgcttgcacacaga

SEQ ID NO: 98599 - DNA, 25 bp, Mus musculus
acagaaggcttgctggactcctttt

SEQ ID NO: 98600 - DNA, 25 bp, Mus musculus
acagaaggcttggtggactcctttt

SEQ ID NO: 98601 - DNA, 25 bp, Mus musculus
acagaagggactagggctcttgcca

SEQ ID NO: 98602 - DNA, 25 bp, Mus musculus
acagaagggactcgtattacatcat

SEQ ID NO: 98603 - DNA, 25 bp, Mus musculus
acagaagggactggtattacatcat

SEQ ID NO: 98604 - DNA, 25 bp, Mus musculus
acagaagggacttgggctcttgcca

SEQ ID NO: 98605 - DNA, 25 bp, Mus musculus
acagaagggcacctatggcccgtct

SEQ ID NO: 98606 - DNA, 25 bp, Mus musculus
acagaagggcacgtatggcccgtct

SEQ ID NO: 98607 - DNA, 25 bp, Mus musculus
acagaagggctgatgccgataatca

SEQ ID NO: 98608 - DNA, 25 bp, Mus musculus
acagaagggctgttgccgataatca

SEQ ID NO: 98609 - DNA, 25 bp, Mus musculus
acagaaggtcgcacttgtgggtaaa

SEQ ID NO: 98610 - DNA, 25 bp, Mus musculus
acagaaggtcgctcttgtgggtaaa

SEQ ID NO: 98611 - DNA, 25 bp, Mus musculus
acagaaggtctgactttcaaggaaa

SEQ ID NO: 98612 - DNA, 25 bp, Mus musculus
acagaaggtctgtctttcaaggaaa

SEQ ID NO: 98613 - DNA, 25 bp, Mus musculus
acagaaggtggcaggcccgttacaa

SEQ ID NO: 98614 - DNA, 25 bp, Mus musculus
acagaaggtggctggcccgttacaa

SEQ ID NO: 98615 - DNA, 25 bp, Mus musculus
acagaaggtgggacagtcaacttat

SEQ ID NO: 98616 - DNA, 25 bp, Mus musculus
acagaaggtgggtcagtcaacttat

SEQ ID NO: 98617 - DNA, 25 bp, Mus musculus
acagaaggttggactgcacctctat

SEQ ID NO: 98618 - DNA, 25 bp, Mus musculus
acagaaggttggtctgcacctctat

SEQ ID NO: 98619 - DNA, 25 bp, Mus musculus
acagaagtatctacctggcttctcc

SEQ ID NO: 98620 - DNA, 25 bp, Mus musculus
acagaagtatcttcctggcttctcc

SEQ ID NO: 98621 - DNA, 25 bp, Mus musculus
acagaagtccttatcctgtaggaag

SEQ ID NO: 98622 - DNA, 25 bp, Mus musculus
acagaagtccttccgataccaagct

SEQ ID NO: 98623 - DNA, 25 bp, Mus musculus
acagaagtccttgcgataccaagct

SEQ ID NO: 98624 - DNA, 25 bp, Mus musculus
acagaagtccttttcctgtaggaag

SEQ ID NO: 98625 - DNA, 25 bp, Mus musculus
acagaagtctttctactgccttaca

SEQ ID NO: 98626 - DNA, 25 bp, Mus musculus
acagaagtctttgtactgccttaca

SEQ ID NO: 98627 - DNA, 25 bp, Mus musculus
acagaagtgagcaacaacaatgtct

SEQ ID NO: 98628 - DNA, 25 bp, Mus musculus
acagaagtgagctacaacaatgtct

SEQ ID NO: 98629 - DNA, 25 bp, Mus musculus
acagaagtggttagtgtccagccaa

SEQ ID NO: 98630 - DNA, 25 bp, Mus musculus
acagaagtggtttgtgtccagccaa

SEQ ID NO: 98631 - DNA, 25 bp, Mus musculus
acagaagttgtaagtttcaatgaga

SEQ ID NO: 98632 - DNA, 25 bp, Mus musculus
acagaagttgtatgtttcaatgaga

SEQ ID NO: 98633 - DNA, 25 bp, Mus musculus
acagaagtttgacccttattggatc

SEQ ID NO: 98634 - DNA, 25 bp, Mus musculus
acagaagtttgagccttattggatc

SEQ ID NO: 98635 - DNA, 25 bp, Mus musculus
acagaataccaaagtctcaggctct

SEQ ID NO: 98636 - DNA, 25 bp, Mus musculus
acagaataccaatgtctcaggctct

SEQ ID NO: 98637 - DNA, 25 bp, Mus musculus
acagaataccacagctccttattac

SEQ ID NO: 98638 - DNA, 25 bp, Mus musculus
acagaataccactgctccttattac

SEQ ID NO: 98639 - DNA, 25 bp, Mus musculus
acagaatagccaacatactttttat

SEQ ID NO: 98640 - DNA, 25 bp, Mus musculus
acagaatagccatcatactttttat

SEQ ID NO: 98641 - DNA, 25 bp, Mus musculus
acagaatagccccagcgttcgttcg

SEQ ID NO: 98642 - DNA, 25 bp, Mus musculus
acagaatagcccgagcgttcgttcg

SEQ ID NO: 98643 - DNA, 25 bp, Mus musculus
acagaatccacgacaggtagcgcaa

SEQ ID NO: 98644 - DNA, 25 bp, Mus musculus
acagaatccacgtcaggtagcgcaa

SEQ ID NO: 98645 - DNA, 25 bp, Mus musculus
acagaatccattcctatgctcattt

SEQ ID NO: 98646 - DNA, 25 bp, Mus musculus
acagaatccattgctatgctcattt

SEQ ID NO: 98647 - DNA, 25 bp, Mus musculus
acagaatcctacattccacgtgtta

SEQ ID NO: 98648 - DNA, 25 bp, Mus musculus
acagaatcctactttccacgtgtta

SEQ ID NO: 98649 - DNA, 25 bp, Mus musculus
acagaatcctgtccggtacaagacg

SEQ ID NO: 98650 - DNA, 25 bp, Mus musculus
acagaatcctgtgcggtacaagacg

SEQ ID NO: 98651 - DNA, 25 bp, Mus musculus
acagaatctagaagtcccatgcagt

SEQ ID NO: 98652 - DNA, 25 bp, Mus musculus
acagaatctagatgtcccatgcagt

SEQ ID NO: 98653 - DNA, 25 bp, Mus musculus
acagaatctgtccttttcctattat

SEQ ID NO: 98654 - DNA, 25 bp, Mus musculus
acagaatctgtcgttttcctattat

SEQ ID NO: 98655 - DNA, 25 bp, Mus musculus
acagaatgaatgactggaccggcaa

SEQ ID NO: 98656 - DNA, 25 bp, Mus musculus
acagaatgaatgtctggaccggcaa

SEQ ID NO: 98657 - DNA, 25 bp, Mus musculus
acagaatgacaacctagccaagagt

SEQ ID NO: 98658 - DNA, 25 bp, Mus musculus
acagaatgacaagctagccaagagt

SEQ ID NO: 98659 - DNA, 25 bp, Mus musculus
acagaatgaggtatgtctttgtcct

SEQ ID NO: 98660 - DNA, 25 bp, Mus musculus
acagaatgaggtttgtctttgtcct

SEQ ID NO: 98661 - DNA, 25 bp, Mus musculus
acagaatgatttcgtcttccccgtg

SEQ ID NO: 98662 - DNA, 25 bp, Mus musculus
acagaatgatttggtcttccccgtg

SEQ ID NO: 98663 - DNA, 25 bp, Mus musculus
acagaatgcagtacctcagtggatc

SEQ ID NO: 98664 - DNA, 25 bp, Mus musculus
acagaatgcagttcctcagtggatc

SEQ ID NO: 98665 - DNA, 25 bp, Mus musculus
acagaatgccacagagtacactttt

SEQ ID NO: 98666 - DNA, 25 bp, Mus musculus
acagaatgccactgagtacactttt

SEQ ID NO: 98667 - DNA, 25 bp, Mus musculus
acagaatgcctgactctaggaagca

SEQ ID NO: 98668 - DNA, 25 bp, Mus musculus
acagaatgcctgtctctaggaagca

SEQ ID NO: 98669 - DNA, 25 bp, Mus musculus
acagaatgcttcagcaggctcccgg

SEQ ID NO: 98670 - DNA, 25 bp, Mus musculus
acagaatgcttctgcaggctcccgg

SEQ ID NO: 98671 - DNA, 25 bp, Mus musculus
acagaatggcgtagatacagtggaa

SEQ ID NO: 98672 - DNA, 25 bp, Mus musculus
acagaatggcgttgatacagtggaa

SEQ ID NO: 98673 - DNA, 25 bp, Mus musculus
acagaatgggcaaccataccctctc

SEQ ID NO: 98674 - DNA, 25 bp, Mus musculus
acagaatgggcatccataccctctc

SEQ ID NO: 98675 - DNA, 25 bp, Mus musculus
acagaatgtggactgcctgagcccc

SEQ ID NO: 98676 - DNA, 25 bp, Mus musculus
acagaatgtggagtgcctgagcccc

SEQ ID NO: 98677 - DNA, 25 bp, Mus musculus
acagaatgtttccaatttccctcct

SEQ ID NO: 98678 - DNA, 25 bp, Mus musculus
acagaatgtttcgaatttccctcct

SEQ ID NO: 98679 - DNA, 25 bp, Mus musculus
acagaattaagtcccttcggcaggt

SEQ ID NO: 98680 - DNA, 25 bp, Mus musculus
acagaattaagtgccttcggcaggt

SEQ ID NO: 98681 - DNA, 25 bp, Mus musculus
acagaattctgacttctctactgat

SEQ ID NO: 98682 - DNA, 25 bp, Mus musculus
acagaattctgagttctctactgat

SEQ ID NO: 98683 - DNA, 25 bp, Mus musculus
acagaattgagaatatagtgcccat

SEQ ID NO: 98684 - DNA, 25 bp, Mus musculus
acagaattgagattatagtgcccat

SEQ ID NO: 98685 - DNA, 25 bp, Mus musculus
acagaattgagtacatgcctttctg

SEQ ID NO: 98686 - DNA, 25 bp, Mus musculus
acagaattgagttcatgcctttctg

SEQ ID NO: 98687 - DNA, 25 bp, Mus musculus
acagaattgcagacatcgtagttta

SEQ ID NO: 98688 - DNA, 25 bp, Mus musculus
acagaattgcagtcatcgtagttta

SEQ ID NO: 98689 - DNA, 25 bp, Mus musculus
acagaattggccctgtggactccaa

SEQ ID NO: 98690 - DNA, 25 bp, Mus musculus
acagaattggccgtgtggactccaa

SEQ ID NO: 98691 - DNA, 25 bp, Mus musculus
acagaatttactaggcattgttaca

SEQ ID NO: 98692 - DNA, 25 bp, Mus musculus
acagaatttacttggcattgttaca

SEQ ID NO: 98693 - DNA, 25 bp, Mus musculus
acagaattttgaagatttgcccctc

SEQ ID NO: 98694 - DNA, 25 bp, Mus musculus
acagaattttgatgatttgcccctc

SEQ ID NO: 98695 - DNA, 25 bp, Mus musculus
acagacaaatgtagccctgcttggc

SEQ ID NO: 98696 - DNA, 25 bp, Mus musculus
acagacaaatgttgccctgcttggc

SEQ ID NO: 98697 - DNA, 25 bp, Mus musculus
acagacaaggtgcagcgaatcaagg

SEQ ID NO: 98698 - DNA, 25 bp, Mus musculus
acagacaaggtggagcgaatcaagg

SEQ ID NO: 98699 - DNA, 25 bp, Mus musculus
acagacaagtttcccagtcctctag

SEQ ID NO: 98700 - DNA, 25 bp, Mus musculus
acagacaagtttgccagtcctctag

SEQ ID NO: 98701 - DNA, 25 bp, Mus musculus
acagacacacagacgcgcaaacacg

SEQ ID NO: 98702 - DNA, 25 bp, Mus musculus
acagacacacagtcgcgcaaacacg

SEQ ID NO: 98703 - DNA, 25 bp, Mus musculus
acagacacagccctcaagaggatag

SEQ ID NO: 98704 - DNA, 25 bp, Mus musculus
acagacacagccgtcaagaggatag

SEQ ID NO: 98705 - DNA, 25 bp, Mus musculus
acagacacagtcatgggtaccactc

SEQ ID NO: 98706 - DNA, 25 bp, Mus musculus
acagacacagtcttgggtaccactc

SEQ ID NO: 98707 - DNA, 25 bp, Mus musculus
acagacacccagagacttggtctct

SEQ ID NO: 98708 - DNA, 25 bp, Mus musculus
acagacacccagtgacttggtctct

SEQ ID NO: 98709 - DNA, 25 bp, Mus musculus
acagacaccctccaactaaattaga

SEQ ID NO: 98710 - DNA, 25 bp, Mus musculus
acagacaccctcgaactaaattaga

SEQ ID NO: 98711 - DNA, 25 bp, Mus musculus
acagacacccttattgtgcttgagt

SEQ ID NO: 98712 - DNA, 25 bp, Mus musculus
acagacaccctttttgtgcttgagt

SEQ ID NO: 98713 - DNA, 25 bp, Mus musculus
acagacacctgtccctagcaatatt

SEQ ID NO: 98714 - DNA, 25 bp, Mus musculus
acagacacctgtgcctagcaatatt

SEQ ID NO: 98715 - DNA, 25 bp, Mus musculus
acagacaccttgagtgtgggccctg

SEQ ID NO: 98716 - DNA, 25 bp, Mus musculus
acagacaccttgtgtgtgggccctg

SEQ ID NO: 98717 - DNA, 25 bp, Mus musculus
acagacacggtcagcgaggagcaat

SEQ ID NO: 98718 - DNA, 25 bp, Mus musculus
acagacacggtctgcgaggagcaat

SEQ ID NO: 98719 - DNA, 25 bp, Mus musculus
acagacactaacatccgcctggtag

SEQ ID NO: 98720 - DNA, 25 bp, Mus musculus
acagacactaacttccgcctggtag

SEQ ID NO: 98721 - DNA, 25 bp, Mus musculus
acagacactggcatggccacagttt

SEQ ID NO: 98722 - DNA, 25 bp, Mus musculus
acagacactggcttggccacagttt

SEQ ID NO: 98723 - DNA, 25 bp, Mus musculus
acagacactgtaacttagccacaaa

SEQ ID NO: 98724 - DNA, 25 bp, Mus musculus
acagacactgtatcttagccacaaa

SEQ ID NO: 98725 - DNA, 25 bp, Mus musculus
acagacactgttacccttggtctat

SEQ ID NO: 98726 - DNA, 25 bp, Mus musculus
acagacactgtttcccttggtctat

SEQ ID NO: 98727 - DNA, 25 bp, Mus musculus
acagacagacaaacggaacccagca

SEQ ID NO: 98728 - DNA, 25 bp, Mus musculus
acagacagacaatcggaacccagca

SEQ ID NO: 98729 - DNA, 25 bp, Mus musculus
acagacagactccacacaagggact

SEQ ID NO: 98730 - DNA, 25 bp, Mus musculus
acagacagactcgacacaagggact

SEQ ID NO: 98731 - DNA, 25 bp, Mus musculus
acagacagaggacgcatttcctgca

SEQ ID NO: 98732 - DNA, 25 bp, Mus musculus
acagacagaggaggcatttcctgca

SEQ ID NO: 98733 - DNA, 25 bp, Mus musculus
acagacagatacacttatccactga

SEQ ID NO: 98734 - DNA, 25 bp, Mus musculus
acagacagatactcttatccactga

SEQ ID NO: 98735 - DNA, 25 bp, Mus musculus
acagacagcttcacccttccttgag

SEQ ID NO: 98736 - DNA, 25 bp, Mus musculus
acagacagcttctcccttccttgag

SEQ ID NO: 98737 - DNA, 25 bp, Mus musculus
acagacaggcacagctctccaggag

SEQ ID NO: 98738 - DNA, 25 bp, Mus musculus
acagacaggcactgctctccaggag

SEQ ID NO: 98739 - DNA, 25 bp, Mus musculus
acagacaggtacataaacggcggct

SEQ ID NO: 98740 - DNA, 25 bp, Mus musculus
acagacaggtacttaaacggcggct

SEQ ID NO: 98741 - DNA, 25 bp, Mus musculus
acagacaggttcatggacccaggca

SEQ ID NO: 98742 - DNA, 25 bp, Mus musculus
acagacaggttcttggacccaggca

SEQ ID NO: 98743 - DNA, 25 bp, Mus musculus
acagacagtgtaaacctttgacctc

SEQ ID NO: 98744 - DNA, 25 bp, Mus musculus
acagacagtgtatacctttgacctc

SEQ ID NO: 98745 - DNA, 25 bp, Mus musculus
acagacagtgttaacgtgcctttac

SEQ ID NO: 98746 - DNA, 25 bp, Mus musculus
acagacagtgtttacgtgcctttac

SEQ ID NO: 98747 - DNA, 25 bp, Mus musculus
acagacataactcatcattccccag

SEQ ID NO: 98748 - DNA, 25 bp, Mus musculus
acagacataactgatcattccccag

SEQ ID NO: 98749 - DNA, 25 bp, Mus musculus
acagacataatgctacactccagta

SEQ ID NO: 98750 - DNA, 25 bp, Mus musculus
acagacataatggtacactccagta

SEQ ID NO: 98751 - DNA, 25 bp, Mus musculus
acagacataggcattgatttccaaa

SEQ ID NO: 98752 - DNA, 25 bp, Mus musculus
acagacataggctttgatttccaaa

SEQ ID NO: 98753 - DNA, 25 bp, Mus musculus
acagacatatagacagaacacccat

SEQ ID NO: 98754 - DNA, 25 bp, Mus musculus
acagacatatagtcagaacacccat

SEQ ID NO: 98755 - DNA, 25 bp, Mus musculus
acagacatatctattctccagggaa

SEQ ID NO: 98756 - DNA, 25 bp, Mus musculus
acagacatatcttttctccagggaa

SEQ ID NO: 98757 - DNA, 25 bp, Mus musculus
acagacatatgcacctactggacct

SEQ ID NO: 98758 - DNA, 25 bp, Mus musculus
acagacatatgctcctactggacct

SEQ ID NO: 98759 - DNA, 25 bp, Mus musculus
acagacatattcacctggcctgaag

SEQ ID NO: 98760 - DNA, 25 bp, Mus musculus
acagacatattctcctggcctgaag

SEQ ID NO: 98761 - DNA, 25 bp, Mus musculus
acagacatatttacctccacatttg

SEQ ID NO: 98762 - DNA, 25 bp, Mus musculus
acagacatattttcctccacatttg

SEQ ID NO: 98763 - DNA, 25 bp, Mus musculus
acagacatcaatcctgtggcccgct

SEQ ID NO: 98764 - DNA, 25 bp, Mus musculus
acagacatcaatgctgtggcccgct

SEQ ID NO: 98765 - DNA, 25 bp, Mus musculus
acagacatcaccacattcttatcag

SEQ ID NO: 98766 - DNA, 25 bp, Mus musculus
acagacatcacctcattcttatcag

SEQ ID NO: 98767 - DNA, 25 bp, Mus musculus
acagacatcactacctatcttaggt

SEQ ID NO: 98768 - DNA, 25 bp, Mus musculus
acagacatcacttcctatcttaggt

SEQ ID NO: 98769 - DNA, 25 bp, Mus musculus
acagacatccacatccaaacagtag

SEQ ID NO: 98770 - DNA, 25 bp, Mus musculus
acagacatccacttccaaacagtag

SEQ ID NO: 98771 - DNA, 25 bp, Mus musculus
acagacatctagatttggatatcaa

SEQ ID NO: 98772 - DNA, 25 bp, Mus musculus
acagacatctagttttggatatcaa

SEQ ID NO: 98773 - DNA, 25 bp, Mus musculus
acagacatctatcatgtactgggtc

SEQ ID NO: 98774 - DNA, 25 bp, Mus musculus
acagacatctatgatgtactgggtc

SEQ ID NO: 98775 - DNA, 25 bp, Mus musculus
acagacatcttgaccgcggcgggcg

SEQ ID NO: 98776 - DNA, 25 bp, Mus musculus
acagacatcttgtccgcggcgggcg

SEQ ID NO: 98777 - DNA, 25 bp, Mus musculus
acagacatgccaaacaggtactttg

SEQ ID NO: 98778 - DNA, 25 bp, Mus musculus
acagacatgccatacaggtactttg

SEQ ID NO: 98779 - DNA, 25 bp, Mus musculus
acagacatgtatcacatctttccaa

SEQ ID NO: 98780 - DNA, 25 bp, Mus musculus
acagacatgtatgacatctttccaa

SEQ ID NO: 98781 - DNA, 25 bp, Mus musculus
acagacatgtctcagtgaccctcct

SEQ ID NO: 98782 - DNA, 25 bp, Mus musculus
acagacatgtctccactcactttct

SEQ ID NO: 98783 - DNA, 25 bp, Mus musculus
acagacatgtctgagtgaccctcct

SEQ ID NO: 98784 - DNA, 25 bp, Mus musculus
acagacatgtctgcactcactttct

SEQ ID NO: 98785 - DNA, 25 bp, Mus musculus
acagacatgtgcctatcccaaacct

SEQ ID NO: 98786 - DNA, 25 bp, Mus musculus
acagacatgtgcgtatcccaaacct

SEQ ID NO: 98787 - DNA, 25 bp, Mus musculus
acagacattcccacccatatatgaa

SEQ ID NO: 98788 - DNA, 25 bp, Mus musculus
acagacattccctcccatatatgaa

SEQ ID NO: 98789 - DNA, 25 bp, Mus musculus
acagacattctccttctaaacatct

SEQ ID NO: 98790 - DNA, 25 bp, Mus musculus
acagacattctcgttctaaacatct

SEQ ID NO: 98791 - DNA, 25 bp, Mus musculus
acagacattgagacagtggcttctc

SEQ ID NO: 98792 - DNA, 25 bp, Mus musculus
acagacattgagtcagtggcttctc

SEQ ID NO: 98793 - DNA, 25 bp, Mus musculus
acagacattgcacggatggtcaaaa

SEQ ID NO: 98794 - DNA, 25 bp, Mus musculus
acagacattgcagggatggtcaaaa

SEQ ID NO: 98795 - DNA, 25 bp, Mus musculus
acagacattgccctcaaagcacttc

SEQ ID NO: 98796 - DNA, 25 bp, Mus musculus
acagacattgccgtcaaagcacttc

SEQ ID NO: 98797 - DNA, 25 bp, Mus musculus
acagacatttcacttgcttacctcc

SEQ ID NO: 98798 - DNA, 25 bp, Mus musculus
acagacatttcagttgcttacctcc

SEQ ID NO: 98799 - DNA, 25 bp, Mus musculus
acagacatttggaacaccaagagat

SEQ ID NO: 98800 - DNA, 25 bp, Mus musculus
acagacatttggtacaccaagagat

SEQ ID NO: 98801 - DNA, 25 bp, Mus musculus
acagacatttgtatgcatgacacac

SEQ ID NO: 98802 - DNA, 25 bp, Mus musculus
acagacatttgtttgcatgacacac

SEQ ID NO: 98803 - DNA, 25 bp, Mus musculus
acagaccaaagacgccatcgtcagt

SEQ ID NO: 98804 - DNA, 25 bp, Mus musculus
acagaccaaagaggccatcgtcagt

SEQ ID NO: 98805 - DNA, 25 bp, Mus musculus
acagaccaagacaccggcaagtgtg

SEQ ID NO: 98806 - DNA, 25 bp, Mus musculus
acagaccaagactccggcaagtgtg

SEQ ID NO: 98807 - DNA, 25 bp, Mus musculus
acagaccaagcgcaagacgtaaaga

SEQ ID NO: 98808 - DNA, 25 bp, Mus musculus
acagaccaagcggaagacgtaaaga

SEQ ID NO: 98809 - DNA, 25 bp, Mus musculus
acagaccaatgcactcgtttgcaaa

SEQ ID NO: 98810 - DNA, 25 bp, Mus musculus
acagaccaatgctctcgtttgcaaa

SEQ ID NO: 98811 - DNA, 25 bp, Mus musculus
acagaccacacgaggccatttaaat

SEQ ID NO: 98812 - DNA, 25 bp, Mus musculus
acagaccacacgtggccatttaaat

SEQ ID NO: 98813 - DNA, 25 bp, Mus musculus
acagaccacagactattcagccatg

SEQ ID NO: 98814 - DNA, 25 bp, Mus musculus
acagaccacagagtattcagccatg

SEQ ID NO: 98815 - DNA, 25 bp, Mus musculus
acagaccacctcactattctagatg

SEQ ID NO: 98816 - DNA, 25 bp, Mus musculus
acagaccacctctctattctagatg

SEQ ID NO: 98817 - DNA, 25 bp, Mus musculus
acagaccactgaaggacagcagatt

SEQ ID NO: 98818 - DNA, 25 bp, Mus musculus
acagaccactgatggacagcagatt

SEQ ID NO: 98819 - DNA, 25 bp, Mus musculus
acagaccagaagaagcctagcccgg

SEQ ID NO: 98820 - DNA, 25 bp, Mus musculus
acagaccagaagtagcctagcccgg

SEQ ID NO: 98821 - DNA, 25 bp, Mus musculus
acagaccagactcaggcccattcct

SEQ ID NO: 98822 - DNA, 25 bp, Mus musculus
acagaccagactgaggcccattcct

SEQ ID NO: 98823 - DNA, 25 bp, Mus musculus
acagaccagcagcactagggacaga

SEQ ID NO: 98824 - DNA, 25 bp, Mus musculus
acagaccagcaggactagggacaga

SEQ ID NO: 98825 - DNA, 25 bp, Mus musculus
acagaccagccaagcttgtcacttt

SEQ ID NO: 98826 - DNA, 25 bp, Mus musculus
acagaccagccatgcttgtcacttt

SEQ ID NO: 98827 - DNA, 25 bp, Mus musculus
acagaccagcgcagttgacatctca

SEQ ID NO: 98828 - DNA, 25 bp, Mus musculus
acagaccagcgctgttgacatctca

SEQ ID NO: 98829 - DNA, 25 bp, Mus musculus
acagaccaggttaattctttcagga

SEQ ID NO: 98830 - DNA, 25 bp, Mus musculus
acagaccaggtttattctttcagga

SEQ ID NO: 98831 - DNA, 25 bp, Mus musculus
acagaccatatccaggcttctaggg

SEQ ID NO: 98832 - DNA, 25 bp, Mus musculus
acagaccatatcgaggcttctaggg

SEQ ID NO: 98833 - DNA, 25 bp, Mus musculus
acagaccatcatattaagtacttag

SEQ ID NO: 98834 - DNA, 25 bp, Mus musculus
acagaccatcattttaagtacttag

SEQ ID NO: 98835 - DNA, 25 bp, Mus musculus
acagaccatcctcaaggagtactga

SEQ ID NO: 98836 - DNA, 25 bp, Mus musculus
acagaccatcctgaaggagtactga

SEQ ID NO: 98837 - DNA, 25 bp, Mus musculus
acagaccatgcaacagatggctgct

SEQ ID NO: 98838 - DNA, 25 bp, Mus musculus
acagaccatgcatcagatggctgct

SEQ ID NO: 98839 - DNA, 25 bp, Mus musculus
acagaccatgtgcaattcccaggta

SEQ ID NO: 98840 - DNA, 25 bp, Mus musculus
acagaccatgtggaattcccaggta

SEQ ID NO: 98841 - DNA, 25 bp, Mus musculus
acagaccatttcacactcaaactct

SEQ ID NO: 98842 - DNA, 25 bp, Mus musculus
acagaccatttctcactcaaactct

SEQ ID NO: 98843 - DNA, 25 bp, Mus musculus
acagacccactcctgagtcgggaaa

SEQ ID NO: 98844 - DNA, 25 bp, Mus musculus
acagacccactcgtgagtcgggaaa

SEQ ID NO: 98845 - DNA, 25 bp, Mus musculus
acagacccacttagacacacatata

SEQ ID NO: 98846 - DNA, 25 bp, Mus musculus
acagacccacttctagaatctgctt

SEQ ID NO: 98847 - DNA, 25 bp, Mus musculus
acagacccacttgtagaatctgctt

SEQ ID NO: 98848 - DNA, 25 bp, Mus musculus
acagacccactttgacacacatata

SEQ ID NO: 98849 - DNA, 25 bp, Mus musculus
acagaccccaaaactcgtacatttg

SEQ ID NO: 98850 - DNA, 25 bp, Mus musculus
acagaccccaaatctcgtacatttg

SEQ ID NO: 98851 - DNA, 25 bp, Mus musculus
acagaccccagcacagtcagcatgg

SEQ ID NO: 98852 - DNA, 25 bp, Mus musculus
acagaccccagctcagtcagcatgg

SEQ ID NO: 98853 - DNA, 25 bp, Mus musculus
acagaccccatccattagagtaata

SEQ ID NO: 98854 - DNA, 25 bp, Mus musculus
acagaccccatcgattagagtaata

SEQ ID NO: 98855 - DNA, 25 bp, Mus musculus
acagacccccagaatttcctggaca

SEQ ID NO: 98856 - DNA, 25 bp, Mus musculus
acagacccccagtatttcctggaca

SEQ ID NO: 98857 - DNA, 25 bp, Mus musculus
acagacccgaagcactcatggccta

SEQ ID NO: 98858 - DNA, 25 bp, Mus musculus
acagacccgaaggactcatggccta

SEQ ID NO: 98859 - DNA, 25 bp, Mus musculus
acagaccctgacacgggcttcaatg

SEQ ID NO: 98860 - DNA, 25 bp, Mus musculus
acagaccctgactcgggcttcaatg

SEQ ID NO: 98861 - DNA, 25 bp, Mus musculus
acagaccctgggacttgtttctagc

SEQ ID NO: 98862 - DNA, 25 bp, Mus musculus
acagaccctgggtcttgtttctagc

SEQ ID NO: 98863 - DNA, 25 bp, Mus musculus
acagaccctgtaagagctgatgctc

SEQ ID NO: 98864 - DNA, 25 bp, Mus musculus
acagaccctgtatgagctgatgctc

SEQ ID NO: 98865 - DNA, 25 bp, Mus musculus
acagaccgcgggagctgggatccat

SEQ ID NO: 98866 - DNA, 25 bp, Mus musculus
acagaccgcgggtgctgggatccat

SEQ ID NO: 98867 - DNA, 25 bp, Mus musculus
acagaccgtggacggctgcggacac

SEQ ID NO: 98868 - DNA, 25 bp, Mus musculus
acagaccgtggagggctgcggacac

SEQ ID NO: 98869 - DNA, 25 bp, Mus musculus
acagacctactaatgagctttccct

SEQ ID NO: 98870 - DNA, 25 bp, Mus musculus
acagacctactattgagctttccct

SEQ ID NO: 98871 - DNA, 25 bp, Mus musculus
acagacctatgcatggatgcagaga

SEQ ID NO: 98872 - DNA, 25 bp, Mus musculus
acagacctatgcttggatgcagaga

SEQ ID NO: 98873 - DNA, 25 bp, Mus musculus
acagacctcagaatctcagacctat

SEQ ID NO: 98874 - DNA, 25 bp, Mus musculus
acagacctcagattctcagacctat

SEQ ID NO: 98875 - DNA, 25 bp, Mus musculus
acagacctctcaagccctatcgagg

SEQ ID NO: 98876 - DNA, 25 bp, Mus musculus
acagacctctcatgccctatcgagg

SEQ ID NO: 98877 - DNA, 25 bp, Mus musculus
acagacctctgtacaataaattatt

SEQ ID NO: 98878 - DNA, 25 bp, Mus musculus
acagacctctgttcaataaattatt

SEQ ID NO: 98879 - DNA, 25 bp, Mus musculus
acagacctgaagaattgtttgcaat

SEQ ID NO: 98880 - DNA, 25 bp, Mus musculus
acagacctgaagtattgtttgcaat

SEQ ID NO: 98881 - DNA, 25 bp, Mus musculus
acagacctgactccatagggttgtt

SEQ ID NO: 98882 - DNA, 25 bp, Mus musculus
acagacctgactgcatagggttgtt

SEQ ID NO: 98883 - DNA, 25 bp, Mus musculus
acagacctgcttatggcttcaggaa

SEQ ID NO: 98884 - DNA, 25 bp, Mus musculus
acagacctgcttttggcttcaggaa

SEQ ID NO: 98885 - DNA, 25 bp, Mus musculus
acagacctgggcatgagaaagtagt

SEQ ID NO: 98886 - DNA, 25 bp, Mus musculus
acagacctgggcttgagaaagtagt

SEQ ID NO: 98887 - DNA, 25 bp, Mus musculus
acagacctgttgcttcaatcaatag

SEQ ID NO: 98888 - DNA, 25 bp, Mus musculus
acagacctgttggttcaatcaatag

SEQ ID NO: 98889 - DNA, 25 bp, Mus musculus
acagaccttagccattttccataaa

SEQ ID NO: 98890 - DNA, 25 bp, Mus musculus
acagaccttagcgattttccataaa

SEQ ID NO: 98891 - DNA, 25 bp, Mus musculus
acagaccttcagagcttcattcaag

SEQ ID NO: 98892 - DNA, 25 bp, Mus musculus
acagaccttcagtgcttcattcaag

SEQ ID NO: 98893 - DNA, 25 bp, Mus musculus
acagaccttggactttcctgatttc

SEQ ID NO: 98894 - DNA, 25 bp, Mus musculus
acagaccttggagtttcctgatttc

SEQ ID NO: 98895 - DNA, 25 bp, Mus musculus
acagacctttccaaggccagaagag

SEQ ID NO: 98896 - DNA, 25 bp, Mus musculus
acagacctttcctaggccagaagag

SEQ ID NO: 98897 - DNA, 25 bp, Mus musculus
acagacgaacaacccaaactcaatt

SEQ ID NO: 98898 - DNA, 25 bp, Mus musculus
acagacgaacaagccaaactcaatt

SEQ ID NO: 98899 - DNA, 25 bp, Mus musculus
acagacgaaggtagccagtcacaag

SEQ ID NO: 98900 - DNA, 25 bp, Mus musculus
acagacgaaggttgccagtcacaag

SEQ ID NO: 98901 - DNA, 25 bp, Mus musculus
acagacgactctcgctgagttatca

SEQ ID NO: 98902 - DNA, 25 bp, Mus musculus
acagacgactctggctgagttatca

SEQ ID NO: 98903 - DNA, 25 bp, Mus musculus
acagacgagacgaagggtatcccta

SEQ ID NO: 98904 - DNA, 25 bp, Mus musculus
acagacgagacgtagggtatcccta

SEQ ID NO: 98905 - DNA, 25 bp, Mus musculus
acagacgcaccaacgaagttaaccg

SEQ ID NO: 98906 - DNA, 25 bp, Mus musculus
acagacgcaccatcgaagttaaccg

SEQ ID NO: 98907 - DNA, 25 bp, Mus musculus
acagacgcattgctgttcacacgca

SEQ ID NO: 98908 - DNA, 25 bp, Mus musculus
acagacgcattggtgttcacacgca

SEQ ID NO: 98909 - DNA, 25 bp, Mus musculus
acagacgccataaacatctctaaaa

SEQ ID NO: 98910 - DNA, 25 bp, Mus musculus
acagacgccatatacatctctaaaa

SEQ ID NO: 98911 - DNA, 25 bp, Mus musculus
acagacgctcatcacatttggtgtt

SEQ ID NO: 98912 - DNA, 25 bp, Mus musculus
acagacgctcatgacatttggtgtt

SEQ ID NO: 98913 - DNA, 25 bp, Mus musculus
acagacggactgctgtgacacacct

SEQ ID NO: 98914 - DNA, 25 bp, Mus musculus
acagacggactggtgtgacacacct

SEQ ID NO: 98915 - DNA, 25 bp, Mus musculus
acagacggcttacgcgtgcagcctt

SEQ ID NO: 98916 - DNA, 25 bp, Mus musculus
acagacggcttaggcgtgcagcctt

SEQ ID NO: 98917 - DNA, 25 bp, Mus musculus
acagacgggttcatacatatattcc

SEQ ID NO: 98918 - DNA, 25 bp, Mus musculus
acagacgggttcttacatatattcc

SEQ ID NO: 98919 - DNA, 25 bp, Mus musculus
acagacggtgctacacggatcctac

SEQ ID NO: 98920 - DNA, 25 bp, Mus musculus
acagacggtgcttcacggatcctac

SEQ ID NO: 98921 - DNA, 25 bp, Mus musculus
acagacggttatatatgcgctacta

SEQ ID NO: 98922 - DNA, 25 bp, Mus musculus
acagacggttatttatgcgctacta

SEQ ID NO: 98923 - DNA, 25 bp, Mus musculus
acagacgtatggacgctcggtgagc

SEQ ID NO: 98924 - DNA, 25 bp, Mus musculus
acagacgtatggtcgctcggtgagc

SEQ ID NO: 98925 - DNA, 25 bp, Mus musculus
acagacgtcacaagggctctttggg

SEQ ID NO: 98926 - DNA, 25 bp, Mus musculus
acagacgtcacatgggctctttggg

SEQ ID NO: 98927 - DNA, 25 bp, Mus musculus
acagacgtcatgcaccactattggg

SEQ ID NO: 98928 - DNA, 25 bp, Mus musculus
acagacgtcatggaccactattggg

SEQ ID NO: 98929 - DNA, 25 bp, Mus musculus
acagacgtccagctgactcttttat

SEQ ID NO: 98930 - DNA, 25 bp, Mus musculus
acagacgtccaggtgactcttttat

SEQ ID NO: 98931 - DNA, 25 bp, Mus musculus
acagacgtctgcagagttccgtaca

SEQ ID NO: 98932 - DNA, 25 bp, Mus musculus
acagacgtctgctgagttccgtaca

SEQ ID NO: 98933 - DNA, 25 bp, Mus musculus
acagacgtgcggcatgttgacctgt

SEQ ID NO: 98934 - DNA, 25 bp, Mus musculus
acagacgtgcgggatgttgacctgt

SEQ ID NO: 98935 - DNA, 25 bp, Mus musculus
acagacgttcctcaaaggtagccga

SEQ ID NO: 98936 - DNA, 25 bp, Mus musculus
acagacgttcctgaaaggtagccga

SEQ ID NO: 98937 - DNA, 25 bp, Mus musculus
acagactaatgtctgcaggttataa

SEQ ID NO: 98938 - DNA, 25 bp, Mus musculus
acagactaatgtgtgcaggttataa

SEQ ID NO: 98939 - DNA, 25 bp, Mus musculus
acagactacacgaatcaaggagact

SEQ ID NO: 98940 - DNA, 25 bp, Mus musculus
acagactacacgtatcaaggagact

SEQ ID NO: 98941 - DNA, 25 bp, Mus musculus
acagactacgagacaggcttccaga

SEQ ID NO: 98942 - DNA, 25 bp, Mus musculus
acagactacgagtcaggcttccaga

SEQ ID NO: 98943 - DNA, 25 bp, Mus musculus
acagactagtacaccgactgacttt

SEQ ID NO: 98944 - DNA, 25 bp, Mus musculus
acagactagtactccgactgacttt

SEQ ID NO: 98945 - DNA, 25 bp, Mus musculus
acagactatgcaatagttcccctcc

SEQ ID NO: 98946 - DNA, 25 bp, Mus musculus
acagactatgcattagttcccctcc

SEQ ID NO: 98947 - DNA, 25 bp, Mus musculus
acagactatttcatgcctggcttcc

SEQ ID NO: 98948 - DNA, 25 bp, Mus musculus
acagactatttcttgcctggcttcc

SEQ ID NO: 98949 - DNA, 25 bp, Mus musculus
acagactcaggtatctttggaccaa

SEQ ID NO: 98950 - DNA, 25 bp, Mus musculus
acagactcaggtttctttggaccaa

SEQ ID NO: 98951 - DNA, 25 bp, Mus musculus
acagactccagcctactttacagaa

SEQ ID NO: 98952 - DNA, 25 bp, Mus musculus
acagactccagcgtactttacagaa

SEQ ID NO: 98953 - DNA, 25 bp, Mus musculus
acagactccattcccatcttattaa

SEQ ID NO: 98954 - DNA, 25 bp, Mus musculus
acagactccattgccatcttattaa

SEQ ID NO: 98955 - DNA, 25 bp, Mus musculus
acagactccgcactgtgagatgctt

SEQ ID NO: 98956 - DNA, 25 bp, Mus musculus
acagactccgcagtgtgagatgctt

SEQ ID NO: 98957 - DNA, 25 bp, Mus musculus
acagactcctcaaatgacaacacca

SEQ ID NO: 98958 - DNA, 25 bp, Mus musculus
acagactcctcatatgacaacacca

SEQ ID NO: 98959 - DNA, 25 bp, Mus musculus
acagactccttgcattttaaaattc

SEQ ID NO: 98960 - DNA, 25 bp, Mus musculus
acagactccttggattttaaaattc

SEQ ID NO: 98961 - DNA, 25 bp, Mus musculus
acagactcggacacacagctgcagt

SEQ ID NO: 98962 - DNA, 25 bp, Mus musculus
acagactcggactcacagctgcagt

SEQ ID NO: 98963 - DNA, 25 bp, Mus musculus
acagactctacaacctcacagagag

SEQ ID NO: 98964 - DNA, 25 bp, Mus musculus
acagactctacatcctcacagagag

SEQ ID NO: 98965 - DNA, 25 bp, Mus musculus
acagactctctcagccgtggatggc

SEQ ID NO: 98966 - DNA, 25 bp, Mus musculus
acagactctctctgccgtggatggc

SEQ ID NO: 98967 - DNA, 25 bp, Mus musculus
acagactctgtgcagcctgagatac

SEQ ID NO: 98968 - DNA, 25 bp, Mus musculus
acagactctgtggagcctgagatac

SEQ ID NO: 98969 - DNA, 25 bp, Mus musculus
acagactcttgtaatgatgttcccc

SEQ ID NO: 98970 - DNA, 25 bp, Mus musculus
acagactcttgttatgatgttcccc

SEQ ID NO: 98971 - DNA, 25 bp, Mus musculus
acagactgaagccatcgacctcaaa

SEQ ID NO: 98972 - DNA, 25 bp, Mus musculus
acagactgaagcgatcgacctcaaa

SEQ ID NO: 98973 - DNA, 25 bp, Mus musculus
acagactgactaagctgcagctgaa

SEQ ID NO: 98974 - DNA, 25 bp, Mus musculus
acagactgactatgctgcagctgaa

SEQ ID NO: 98975 - DNA, 25 bp, Mus musculus
acagactgatccacacatacaaaca

SEQ ID NO: 98976 - DNA, 25 bp, Mus musculus
acagactgatcctcacatacaaaca

SEQ ID NO: 98977 - DNA, 25 bp, Mus musculus
acagactgatttctttagatattaa

SEQ ID NO: 98978 - DNA, 25 bp, Mus musculus
acagactgatttgtttagatattaa

SEQ ID NO: 98979 - DNA, 25 bp, Mus musculus
acagactgcactaaaaacaccggag

SEQ ID NO: 98980 - DNA, 25 bp, Mus musculus
acagactgcacttaaaacaccggag

SEQ ID NO: 98981 - DNA, 25 bp, Mus musculus
acagactgcattcaaagtgacctga

SEQ ID NO: 98982 - DNA, 25 bp, Mus musculus
acagactgcattgaaagtgacctga

SEQ ID NO: 98983 - DNA, 25 bp, Mus musculus
acagactgcctcacccactgtgtga

SEQ ID NO: 98984 - DNA, 25 bp, Mus musculus
acagactgcctcctaattgtcaggg

SEQ ID NO: 98985 - DNA, 25 bp, Mus musculus
acagactgcctcgtaattgtcaggg

SEQ ID NO: 98986 - DNA, 25 bp, Mus musculus
acagactgcctctcccactgtgtga

SEQ ID NO: 98987 - DNA, 25 bp, Mus musculus
acagactgcctgatgctagagcctc

SEQ ID NO: 98988 - DNA, 25 bp, Mus musculus
acagactgcctgttgctagagcctc

SEQ ID NO: 98989 - DNA, 25 bp, Mus musculus
acagactggcaaactttcactcaac

SEQ ID NO: 98990 - DNA, 25 bp, Mus musculus
acagactggcaatctttcactcaac

SEQ ID NO: 98991 - DNA, 25 bp, Mus musculus
acagactgtactccaggtctactga

SEQ ID NO: 98992 - DNA, 25 bp, Mus musculus
acagactgtactgcaggtctactga

SEQ ID NO: 98993 - DNA, 25 bp, Mus musculus
acagactgtattccaggagtgggct

SEQ ID NO: 98994 - DNA, 25 bp, Mus musculus
acagactgtattgcaggagtgggct

SEQ ID NO: 98995 - DNA, 25 bp, Mus musculus
acagactgtctgcagatcctggaat

SEQ ID NO: 98996 - DNA, 25 bp, Mus musculus
acagactgtctggagatcctggaat

SEQ ID NO: 98997 - DNA, 25 bp, Mus musculus
acagactgtgtgcactcagctcaca

SEQ ID NO: 98998 - DNA, 25 bp, Mus musculus
acagactgtgtggactcagctcaca

SEQ ID NO: 98999 - DNA, 25 bp, Mus musculus
acagacttaagtatccttgtattga

SEQ ID NO: 99000 - DNA, 25 bp, Mus musculus
acagacttaagtttccttgtattga

SEQ ID NO: 99001 - DNA, 25 bp, Mus musculus
acagacttacctcaaatgctcacat

SEQ ID NO: 99002 - DNA, 25 bp, Mus musculus
acagacttacctgaaatgctcacat

SEQ ID NO: 99003 - DNA, 25 bp, Mus musculus
acagacttctgcaagtatatgcctt

SEQ ID NO: 99004 - DNA, 25 bp, Mus musculus
acagacttctgctagtatatgcctt

SEQ ID NO: 99005 - DNA, 25 bp, Mus musculus
acagacttctttcgaacattgcccc

SEQ ID NO: 99006 - DNA, 25 bp, Mus musculus
acagacttctttggaacattgcccc

SEQ ID NO: 99007 - DNA, 25 bp, Mus musculus
acagacttgaaaagcgggccgcgtt

SEQ ID NO: 99008 - DNA, 25 bp, Mus musculus
acagacttgaaatgcgggccgcgtt

SEQ ID NO: 99009 - DNA, 25 bp, Mus musculus
acagacttgcctatcaaaactgcta

SEQ ID NO: 99010 - DNA, 25 bp, Mus musculus
acagacttgcctcgcagaatgctca

SEQ ID NO: 99011 - DNA, 25 bp, Mus musculus
acagacttgcctggcagaatgctca

SEQ ID NO: 99012 - DNA, 25 bp, Mus musculus
acagacttgcctttcaaaactgcta

SEQ ID NO: 99013 - DNA, 25 bp, Mus musculus
acagacttgtgtcccaatgaaggaa

SEQ ID NO: 99014 - DNA, 25 bp, Mus musculus
acagacttgtgtgccaatgaaggaa

SEQ ID NO: 99015 - DNA, 25 bp, Mus musculus
acagacttgttaccaggtctctctg

SEQ ID NO: 99016 - DNA, 25 bp, Mus musculus
acagacttgttagcaggtctctctg

SEQ ID NO: 99017 - DNA, 25 bp, Mus musculus
acagactttatcattttatgttcat

SEQ ID NO: 99018 - DNA, 25 bp, Mus musculus
acagactttatctttttatgttcat

SEQ ID NO: 99019 - DNA, 25 bp, Mus musculus
acagactttctgcagaccccagcaa

SEQ ID NO: 99020 - DNA, 25 bp, Mus musculus
acagactttctggagaccccagcaa

SEQ ID NO: 99021 - DNA, 25 bp, Mus musculus
acagactttgtcaacagccggactg

SEQ ID NO: 99022 - DNA, 25 bp, Mus musculus
acagactttgtcacttatttgtgaa

SEQ ID NO: 99023 - DNA, 25 bp, Mus musculus
acagactttgtctacagccggactg

SEQ ID NO: 99024 - DNA, 25 bp, Mus musculus
acagactttgtctcttatttgtgaa

SEQ ID NO: 99025 - DNA, 25 bp, Mus musculus
acagagaaaccgagggccagccgtg

SEQ ID NO: 99026 - DNA, 25 bp, Mus musculus
acagagaaaccgtgggccagccgtg

SEQ ID NO: 99027 - DNA, 25 bp, Mus musculus
acagagaaacgaacgctacttatca

SEQ ID NO: 99028 - DNA, 25 bp, Mus musculus
acagagaaacgatcgctacttatca

SEQ ID NO: 99029 - DNA, 25 bp, Mus musculus
acagagaaactcaagaaggtcaaga

SEQ ID NO: 99030 - DNA, 25 bp, Mus musculus
acagagaaactctagaaggtcaaga

SEQ ID NO: 99031 - DNA, 25 bp, Mus musculus
acagagaaagcacgacgggatactt

SEQ ID NO: 99032 - DNA, 25 bp, Mus musculus
acagagaaagcaggacgggatactt

SEQ ID NO: 99033 - DNA, 25 bp, Mus musculus
acagagaaaggaagagaccggtgca

SEQ ID NO: 99034 - DNA, 25 bp, Mus musculus
acagagaaaggatgagaccggtgca

SEQ ID NO: 99035 - DNA, 25 bp, Mus musculus
acagagaaatgtccccagcggtggt

SEQ ID NO: 99036 - DNA, 25 bp, Mus musculus
acagagaaatgtgcccagcggtggt

SEQ ID NO: 99037 - DNA, 25 bp, Mus musculus
acagagaacaccaagcaggaatgtt

SEQ ID NO: 99038 - DNA, 25 bp, Mus musculus
acagagaacacctagcaggaatgtt

SEQ ID NO: 99039 - DNA, 25 bp, Mus musculus
acagagaactcgctcttgggtccgc

SEQ ID NO: 99040 - DNA, 25 bp, Mus musculus
acagagaactcggtcttgggtccgc

SEQ ID NO: 99041 - DNA, 25 bp, Mus musculus
acagagaagagtccgcacgaacccg

SEQ ID NO: 99042 - DNA, 25 bp, Mus musculus
acagagaagagtgcgcacgaacccg

SEQ ID NO: 99043 - DNA, 25 bp, Mus musculus
acagagaagggtcttggtctcctcc

SEQ ID NO: 99044 - DNA, 25 bp, Mus musculus
acagagaagggtgttggtctcctcc

SEQ ID NO: 99045 - DNA, 25 bp, Mus musculus
acagagaatcagattgcctcccgga

SEQ ID NO: 99046 - DNA, 25 bp, Mus musculus
acagagaatcagtttgcctcccgga

SEQ ID NO: 99047 - DNA, 25 bp, Mus musculus
acagagacacacagaaggccttgct

SEQ ID NO: 99048 - DNA, 25 bp, Mus musculus
acagagacacactgaaggccttgct

SEQ ID NO: 99049 - DNA, 25 bp, Mus musculus
acagagacagccaagtcactgccgg

SEQ ID NO: 99050 - DNA, 25 bp, Mus musculus
acagagacagccatggatgaaatta

SEQ ID NO: 99051 - DNA, 25 bp, Mus musculus
acagagacagcctagtcactgccgg

SEQ ID NO: 99052 - DNA, 25 bp, Mus musculus
acagagacagccttggatgaaatta

SEQ ID NO: 99053 - DNA, 25 bp, Mus musculus
acagagacatgcaaggattaagggt

SEQ ID NO: 99054 - DNA, 25 bp, Mus musculus
acagagacatgctaggattaagggt

SEQ ID NO: 99055 - DNA, 25 bp, Mus musculus
acagagacatggaccgcaccgggaa

SEQ ID NO: 99056 - DNA, 25 bp, Mus musculus
acagagacatggtccgcaccgggaa

SEQ ID NO: 99057 - DNA, 25 bp, Mus musculus
acagagacccacagcaagcttttcg

SEQ ID NO: 99058 - DNA, 25 bp, Mus musculus
acagagacccactgcaagcttttcg

SEQ ID NO: 99059 - DNA, 25 bp, Mus musculus
acagagacccggcatatcttgccac

SEQ ID NO: 99060 - DNA, 25 bp, Mus musculus
acagagacccgggatatcttgccac

SEQ ID NO: 99061 - DNA, 25 bp, Mus musculus
acagagacctggctatgtccattgt

SEQ ID NO: 99062 - DNA, 25 bp, Mus musculus
acagagacctgggtatgtccattgt

SEQ ID NO: 99063 - DNA, 25 bp, Mus musculus
acagagactcttcgccctcagatac

SEQ ID NO: 99064 - DNA, 25 bp, Mus musculus
acagagactcttggccctcagatac

SEQ ID NO: 99065 - DNA, 25 bp, Mus musculus
acagagactgaactggctgtctttt

SEQ ID NO: 99066 - DNA, 25 bp, Mus musculus
acagagactgaagtggctgtctttt

SEQ ID NO: 99067 - DNA, 25 bp, Mus musculus
acagagactgtaatcatcgtggaga

SEQ ID NO: 99068 - DNA, 25 bp, Mus musculus
acagagactgtactggaggtgtcca

SEQ ID NO: 99069 - DNA, 25 bp, Mus musculus
acagagactgtagtggaggtgtcca

SEQ ID NO: 99070 - DNA, 25 bp, Mus musculus
acagagactgtattcatcgtggaga

SEQ ID NO: 99071 - DNA, 25 bp, Mus musculus
acagagagacaacgaccgcgaaccc

SEQ ID NO: 99072 - DNA, 25 bp, Mus musculus
acagagagacaaggaccgcgaaccc

SEQ ID NO: 99073 - DNA, 25 bp, Mus musculus
acagagagaccaagtatcagaaaac

SEQ ID NO: 99074 - DNA, 25 bp, Mus musculus
acagagagaccatgtatcagaaaac

SEQ ID NO: 99075 - DNA, 25 bp, Mus musculus
acagagagacttcactggacctggg

SEQ ID NO: 99076 - DNA, 25 bp, Mus musculus
acagagagacttgactggacctggg

SEQ ID NO: 99077 - DNA, 25 bp, Mus musculus
acagagagccccagggaagctggaa

SEQ ID NO: 99078 - DNA, 25 bp, Mus musculus
acagagagcccctgggaagctggaa

SEQ ID NO: 99079 - DNA, 25 bp, Mus musculus
acagagagccctcgcatatgtggcc

SEQ ID NO: 99080 - DNA, 25 bp, Mus musculus
acagagagccctggcatatgtggcc

SEQ ID NO: 99081 - DNA, 25 bp, Mus musculus
acagagagctctacatcccaggacc

SEQ ID NO: 99082 - DNA, 25 bp, Mus musculus
acagagagctcttcatcccaggacc

SEQ ID NO: 99083 - DNA, 25 bp, Mus musculus
acagagagctgtaccaggtggcttt

SEQ ID NO: 99084 - DNA, 25 bp, Mus musculus
acagagagctgtcctgtagctcagt

SEQ ID NO: 99085 - DNA, 25 bp, Mus musculus
acagagagctgtgctgtagctcagt

SEQ ID NO: 99086 - DNA, 25 bp, Mus musculus
acagagagctgttccaggtggcttt

SEQ ID NO: 99087 - DNA, 25 bp, Mus musculus
acagagaggccacccttttcaggac

SEQ ID NO: 99088 - DNA, 25 bp, Mus musculus
acagagaggccagccttttcaggac

SEQ ID NO: 99089 - DNA, 25 bp, Mus musculus
acagagagtgcgagcaatgagacta

SEQ ID NO: 99090 - DNA, 25 bp, Mus musculus
acagagagtgcgtgcaatgagacta

SEQ ID NO: 99091 - DNA, 25 bp, Mus musculus
acagagagtgtcagtggcaccctca

SEQ ID NO: 99092 - DNA, 25 bp, Mus musculus
acagagagtgtctgtggcaccctca

SEQ ID NO: 99093 - DNA, 25 bp, Mus musculus
acagagatagccactgtgtctgctt

SEQ ID NO: 99094 - DNA, 25 bp, Mus musculus
acagagatagcctctgtgtctgctt

SEQ ID NO: 99095 - DNA, 25 bp, Mus musculus
acagagatcgagagagcctggatgc

SEQ ID NO: 99096 - DNA, 25 bp, Mus musculus
acagagatcgagtgagcctggatgc

SEQ ID NO: 99097 - DNA, 25 bp, Mus musculus
acagagatcgttaatatttccttat

SEQ ID NO: 99098 - DNA, 25 bp, Mus musculus
acagagatcgtttatatttccttat

SEQ ID NO: 99099 - DNA, 25 bp, Mus musculus
acagagatctaaccatgaaggttaa

SEQ ID NO: 99100 - DNA, 25 bp, Mus musculus
acagagatctaagcatgaaggttaa

SEQ ID NO: 99101 - DNA, 25 bp, Mus musculus
acagagatgaccaaggtgcacccac

SEQ ID NO: 99102 - DNA, 25 bp, Mus musculus
acagagatgacctaggtgcacccac

SEQ ID NO: 99103 - DNA, 25 bp, Mus musculus
acagagatgcctcgtttggagaatc

SEQ ID NO: 99104 - DNA, 25 bp, Mus musculus
acagagatgcctggtttggagaatc

SEQ ID NO: 99105 - DNA, 25 bp, Mus musculus
acagagatgcttataagtgctcccc

SEQ ID NO: 99106 - DNA, 25 bp, Mus musculus
acagagatgcttttaagtgctcccc

SEQ ID NO: 99107 - DNA, 25 bp, Mus musculus
acagagatgtccaggtaccgggtct

SEQ ID NO: 99108 - DNA, 25 bp, Mus musculus
acagagatgtcccttgatgtcaatg

SEQ ID NO: 99109 - DNA, 25 bp, Mus musculus
acagagatgtccgttgatgtcaatg

SEQ ID NO: 99110 - DNA, 25 bp, Mus musculus
acagagatgtcctggtaccgggtct

SEQ ID NO: 99111 - DNA, 25 bp, Mus musculus
acagagatgtgtatctcttctgtgg

SEQ ID NO: 99112 - DNA, 25 bp, Mus musculus
acagagatgtgtttctcttctgtgg

SEQ ID NO: 99113 - DNA, 25 bp, Mus musculus
acagagattgctacagtaagattta

SEQ ID NO: 99114 - DNA, 25 bp, Mus musculus
acagagattgcttcagtaagattta

SEQ ID NO: 99115 - DNA, 25 bp, Mus musculus
acagagatttctagtggctcggagc

SEQ ID NO: 99116 - DNA, 25 bp, Mus musculus
acagagatttcttgtggctcggagc

SEQ ID NO: 99117 - DNA, 25 bp, Mus musculus
acagagatttgacttccatctgtcc

SEQ ID NO: 99118 - DNA, 25 bp, Mus musculus
acagagatttgagttccatctgtcc

SEQ ID NO: 99119 - DNA, 25 bp, Mus musculus
acagagcaaatgcaaatgggtcccg

SEQ ID NO: 99120 - DNA, 25 bp, Mus musculus
acagagcaaatggaaatgggtcccg

SEQ ID NO: 99121 - DNA, 25 bp, Mus musculus
acagagcaaggcagccaagaattgc

SEQ ID NO: 99122 - DNA, 25 bp, Mus musculus
acagagcaaggctgccaagaattgc

SEQ ID NO: 99123 - DNA, 25 bp, Mus musculus
acagagcacccgaggtcacagagaa

SEQ ID NO: 99124 - DNA, 25 bp, Mus musculus
acagagcacccgtggtcacagagaa

SEQ ID NO: 99125 - DNA, 25 bp, Mus musculus
acagagcacgctagtttggacggtt

SEQ ID NO: 99126 - DNA, 25 bp, Mus musculus
acagagcacgcttgtttggacggtt

SEQ ID NO: 99127 - DNA, 25 bp, Mus musculus
acagagcactttaatctcctcttcc

SEQ ID NO: 99128 - DNA, 25 bp, Mus musculus
acagagcacttttatctcctcttcc

SEQ ID NO: 99129 - DNA, 25 bp, Mus musculus
acagagcagaggaccccgaggtgaa

SEQ ID NO: 99130 - DNA, 25 bp, Mus musculus
acagagcagaggtccccgaggtgaa

SEQ ID NO: 99131 - DNA, 25 bp, Mus musculus
acagagcagcacagcaatgagcagt

SEQ ID NO: 99132 - DNA, 25 bp, Mus musculus
acagagcagcactgcaatgagcagt

SEQ ID NO: 99133 - DNA, 25 bp, Mus musculus
acagagcagctcaatatttgtgata

SEQ ID NO: 99134 - DNA, 25 bp, Mus musculus
acagagcagctcatggtgtgttgct

SEQ ID NO: 99135 - DNA, 25 bp, Mus musculus
acagagcagctctatatttgtgata

SEQ ID NO: 99136 - DNA, 25 bp, Mus musculus
acagagcagctcttggtgtgttgct

SEQ ID NO: 99137 - DNA, 25 bp, Mus musculus
acagagcagcttcatcttacacggt

SEQ ID NO: 99138 - DNA, 25 bp, Mus musculus
acagagcagcttgatcttacacggt

SEQ ID NO: 99139 - DNA, 25 bp, Mus musculus
acagagcaggacatgttcgaggact

SEQ ID NO: 99140 - DNA, 25 bp, Mus musculus
acagagcaggaccagttctccttca

SEQ ID NO: 99141 - DNA, 25 bp, Mus musculus
acagagcaggacgagttctccttca

SEQ ID NO: 99142 - DNA, 25 bp, Mus musculus
acagagcaggacttgttcgaggact

SEQ ID NO: 99143 - DNA, 25 bp, Mus musculus
acagagcaggccactcaactttgag

SEQ ID NO: 99144 - DNA, 25 bp, Mus musculus
acagagcaggcctctcaactttgag

SEQ ID NO: 99145 - DNA, 25 bp, Mus musculus
acagagcagggtatttgtgggtcta

SEQ ID NO: 99146 - DNA, 25 bp, Mus musculus
acagagcagggtttttgtgggtcta

SEQ ID NO: 99147 - DNA, 25 bp, Mus musculus
acagagcagtatcttttatttcttc

SEQ ID NO: 99148 - DNA, 25 bp, Mus musculus
acagagcagtatgttttatttcttc

SEQ ID NO: 99149 - DNA, 25 bp, Mus musculus
acagagcatctgaccacacgagtgt

SEQ ID NO: 99150 - DNA, 25 bp, Mus musculus
acagagcatctgtccacacgagtgt

SEQ ID NO: 99151 - DNA, 25 bp, Mus musculus
acagagcatgagactacggtggcat

SEQ ID NO: 99152 - DNA, 25 bp, Mus musculus
acagagcatgagtctacggtggcat

SEQ ID NO: 99153 - DNA, 25 bp, Mus musculus
acagagcatgctaatacatttttaa

SEQ ID NO: 99154 - DNA, 25 bp, Mus musculus
acagagcatgcttatacatttttaa

SEQ ID NO: 99155 - DNA, 25 bp, Mus musculus
acagagcatggcatttctttggcat

SEQ ID NO: 99156 - DNA, 25 bp, Mus musculus
acagagcatggcttttctttggcat

SEQ ID NO: 99157 - DNA, 25 bp, Mus musculus
acagagcattggctgccctggagct

SEQ ID NO: 99158 - DNA, 25 bp, Mus musculus
acagagcattgggtgccctggagct

SEQ ID NO: 99159 - DNA, 25 bp, Mus musculus
acagagccagcacagacttgaggat

SEQ ID NO: 99160 - DNA, 25 bp, Mus musculus
acagagccagcagagacttgaggat

SEQ ID NO: 99161 - DNA, 25 bp, Mus musculus
acagagccagccaatatgtcccgca

SEQ ID NO: 99162 - DNA, 25 bp, Mus musculus
acagagccagcctatatgtcccgca

SEQ ID NO: 99163 - DNA, 25 bp, Mus musculus
acagagccaggtcgacctcgggcca

SEQ ID NO: 99164 - DNA, 25 bp, Mus musculus
acagagccaggtggacctcgggcca

SEQ ID NO: 99165 - DNA, 25 bp, Mus musculus
acagagccatctcagacagcgccat

SEQ ID NO: 99166 - DNA, 25 bp, Mus musculus
acagagccatctgagacagcgccat

SEQ ID NO: 99167 - DNA, 25 bp, Mus musculus
acagagccatgaacagtaagtgcag

SEQ ID NO: 99168 - DNA, 25 bp, Mus musculus
acagagccatgatcagtaagtgcag

SEQ ID NO: 99169 - DNA, 25 bp, Mus musculus
acagagcccacgcagtgtctggaga

SEQ ID NO: 99170 - DNA, 25 bp, Mus musculus
acagagcccacggagtgtctggaga

SEQ ID NO: 99171 - DNA, 25 bp, Mus musculus
acagagccccagaacaactattgag

SEQ ID NO: 99172 - DNA, 25 bp, Mus musculus
acagagccccagtacaactattgag

SEQ ID NO: 99173 - DNA, 25 bp, Mus musculus
acagagcccctcagaggctctggat

SEQ ID NO: 99174 - DNA, 25 bp, Mus musculus
acagagcccctctgaggctctggat

SEQ ID NO: 99175 - DNA, 25 bp, Mus musculus
acagagcccctgaagtggattagaa

SEQ ID NO: 99176 - DNA, 25 bp, Mus musculus
acagagcccctgaggccaattgaaa

SEQ ID NO: 99177 - DNA, 25 bp, Mus musculus
acagagcccctgtagtggattagaa

SEQ ID NO: 99178 - DNA, 25 bp, Mus musculus
acagagcccctgtggccaattgaaa

SEQ ID NO: 99179 - DNA, 25 bp, Mus musculus
acagagccctatagagccccagcgg

SEQ ID NO: 99180 - DNA, 25 bp, Mus musculus
acagagccctattgagccccagcgg

SEQ ID NO: 99181 - DNA, 25 bp, Mus musculus
acagagccctgaagtctgacaacct

SEQ ID NO: 99182 - DNA, 25 bp, Mus musculus
acagagccctgatgtctgacaacct

SEQ ID NO: 99183 - DNA, 25 bp, Mus musculus
acagagccctgtccaaaatgagttt

SEQ ID NO: 99184 - DNA, 25 bp, Mus musculus
acagagccctgtgcaaaatgagttt

SEQ ID NO: 99185 - DNA, 25 bp, Mus musculus
acagagccctttaacatgacgtgtt

SEQ ID NO: 99186 - DNA, 25 bp, Mus musculus
acagagcccttttacatgacgtgtt

SEQ ID NO: 99187 - DNA, 25 bp, Mus musculus
acagagccgaaacagtccttcacag

SEQ ID NO: 99188 - DNA, 25 bp, Mus musculus
acagagccgaaagagtccttcacag

SEQ ID NO: 99189 - DNA, 25 bp, Mus musculus
acagagccgagcaccagcaagggac

SEQ ID NO: 99190 - DNA, 25 bp, Mus musculus
acagagccgagctccagcaagggac

SEQ ID NO: 99191 - DNA, 25 bp, Mus musculus
acagagccgggaccatcggcagcct

SEQ ID NO: 99192 - DNA, 25 bp, Mus musculus
acagagccgggagcatcggcagcct

SEQ ID NO: 99193 - DNA, 25 bp, Mus musculus
acagagcctacacggtgacctgctt

SEQ ID NO: 99194 - DNA, 25 bp, Mus musculus
acagagcctacagggtgacctgctt

SEQ ID NO: 99195 - DNA, 25 bp, Mus musculus
acagagcctccaatttgcagtaaca

SEQ ID NO: 99196 - DNA, 25 bp, Mus musculus
acagagcctccattttgcagtaaca

SEQ ID NO: 99197 - DNA, 25 bp, Mus musculus
acagagcctgcaagagtctgggctt

SEQ ID NO: 99198 - DNA, 25 bp, Mus musculus
acagagcctgcaccgaagagggcat

SEQ ID NO: 99199 - DNA, 25 bp, Mus musculus
acagagcctgcagcgaagagggcat

SEQ ID NO: 99200 - DNA, 25 bp, Mus musculus
acagagcctgcatgagtctgggctt

SEQ ID NO: 99201 - DNA, 25 bp, Mus musculus
acagagcctggccatcgagagtgac

SEQ ID NO: 99202 - DNA, 25 bp, Mus musculus
acagagcctggcgatcgagagtgac

SEQ ID NO: 99203 - DNA, 25 bp, Mus musculus
acagagccttctaccacggtggaga

SEQ ID NO: 99204 - DNA, 25 bp, Mus musculus
acagagccttcttccacggtggaga

SEQ ID NO: 99205 - DNA, 25 bp, Mus musculus
acagagccttgtccattaaaatctt

SEQ ID NO: 99206 - DNA, 25 bp, Mus musculus
acagagccttgtgcattaaaatctt

SEQ ID NO: 99207 - DNA, 25 bp, Mus musculus
acagagcctttgcaccttgttcaag

SEQ ID NO: 99208 - DNA, 25 bp, Mus musculus
acagagcctttggaccttgttcaag

SEQ ID NO: 99209 - DNA, 25 bp, Mus musculus
acagagcgtttcagcctgtggagga

SEQ ID NO: 99210 - DNA, 25 bp, Mus musculus
acagagcgtttctgcctgtggagga

SEQ ID NO: 99211 - DNA, 25 bp, Mus musculus
acagagctaaagacgccaagaggga

SEQ ID NO: 99212 - DNA, 25 bp, Mus musculus
acagagctaaagtcgccaagaggga

SEQ ID NO: 99213 - DNA, 25 bp, Mus musculus
acagagctaccgctaagccacatta

SEQ ID NO: 99214 - DNA, 25 bp, Mus musculus
acagagctaccggtaagccacatta

SEQ ID NO: 99215 - DNA, 25 bp, Mus musculus
acagagctacttcctacatgacaca

SEQ ID NO: 99216 - DNA, 25 bp, Mus musculus
acagagctacttgctacatgacaca

SEQ ID NO: 99217 - DNA, 25 bp, Mus musculus
acagagctagggaccaggctggctt

SEQ ID NO: 99218 - DNA, 25 bp, Mus musculus
acagagctagggtccaggctggctt

SEQ ID NO: 99219 - DNA, 25 bp, Mus musculus
acagagctagtacacacttcccgca

SEQ ID NO: 99220 - DNA, 25 bp, Mus musculus
acagagctagtagacacttcccgca

SEQ ID NO: 99221 - DNA, 25 bp, Mus musculus
acagagctcagtcgccagaggcttt

SEQ ID NO: 99222 - DNA, 25 bp, Mus musculus
acagagctcagtggccagaggcttt

SEQ ID NO: 99223 - DNA, 25 bp, Mus musculus
acagagctccaaaaagacagcagaa

SEQ ID NO: 99224 - DNA, 25 bp, Mus musculus
acagagctccaataagacagcagaa

SEQ ID NO: 99225 - DNA, 25 bp, Mus musculus
acagagctctcaactatgcaggcaa

SEQ ID NO: 99226 - DNA, 25 bp, Mus musculus
acagagctctcatctatgcaggcaa

SEQ ID NO: 99227 - DNA, 25 bp, Mus musculus
acagagctgagcatgggacaccaga

SEQ ID NO: 99228 - DNA, 25 bp, Mus musculus
acagagctgagcttgggacaccaga

SEQ ID NO: 99229 - DNA, 25 bp, Mus musculus
acagagctgcacacagtaatgaagt

SEQ ID NO: 99230 - DNA, 25 bp, Mus musculus
acagagctgcactcagtaatgaagt

SEQ ID NO: 99231 - DNA, 25 bp, Mus musculus
acagagctgctgatcttgcggcggc

SEQ ID NO: 99232 - DNA, 25 bp, Mus musculus
acagagctgctgttcttgcggcggc

SEQ ID NO: 99233 - DNA, 25 bp, Mus musculus
acagagctgggtatccgcacagtgg

SEQ ID NO: 99234 - DNA, 25 bp, Mus musculus
acagagctgggtttccgcacagtgg

SEQ ID NO: 99235 - DNA, 25 bp, Mus musculus
acagagctggttattgcaatcctag

SEQ ID NO: 99236 - DNA, 25 bp, Mus musculus
acagagctggtttttgcaatcctag

SEQ ID NO: 99237 - DNA, 25 bp, Mus musculus
acagagctgtagagtcttggtcgtc

SEQ ID NO: 99238 - DNA, 25 bp, Mus musculus
acagagctgtagtgtcttggtcgtc

SEQ ID NO: 99239 - DNA, 25 bp, Mus musculus
acagagctgtccagtgctttggttc

SEQ ID NO: 99240 - DNA, 25 bp, Mus musculus
acagagctgtcctgtgctttggttc

SEQ ID NO: 99241 - DNA, 25 bp, Mus musculus
acagagctgtggctcccattagttc

SEQ ID NO: 99242 - DNA, 25 bp, Mus musculus
acagagctgtgggtcccattagttc

SEQ ID NO: 99243 - DNA, 25 bp, Mus musculus
acagagcttctgaatcctggctgtc

SEQ ID NO: 99244 - DNA, 25 bp, Mus musculus
acagagcttctgtatcctggctgtc

SEQ ID NO: 99245 - DNA, 25 bp, Mus musculus
acagaggaacatcgaagcacccaat

SEQ ID NO: 99246 - DNA, 25 bp, Mus musculus
acagaggaacatggaagcacccaat

SEQ ID NO: 99247 - DNA, 25 bp, Mus musculus
acagaggaatacaaggtgacacaga

SEQ ID NO: 99248 - DNA, 25 bp, Mus musculus
acagaggaatactaggtgacacaga

SEQ ID NO: 99249 - DNA, 25 bp, Mus musculus
acagaggaccctatcttgagaagaa

SEQ ID NO: 99250 - DNA, 25 bp, Mus musculus
acagaggaccctttcttgagaagaa

SEQ ID NO: 99251 - DNA, 25 bp, Mus musculus
acagaggacctcatggttgctttat

SEQ ID NO: 99252 - DNA, 25 bp, Mus musculus
acagaggacctcttggttgctttat

SEQ ID NO: 99253 - DNA, 25 bp, Mus musculus
acagaggacggaactgtcactccta

SEQ ID NO: 99254 - DNA, 25 bp, Mus musculus
acagaggacggatctgtcactccta

SEQ ID NO: 99255 - DNA, 25 bp, Mus musculus
acagaggagaatatgcagctgccct

SEQ ID NO: 99256 - DNA, 25 bp, Mus musculus
acagaggagaatttgcagctgccct

SEQ ID NO: 99257 - DNA, 25 bp, Mus musculus
acagaggagccaaggccgctggact

SEQ ID NO: 99258 - DNA, 25 bp, Mus musculus
acagaggagccatggccgctggact

SEQ ID NO: 99259 - DNA, 25 bp, Mus musculus
acagaggagccgacgtctaacgaca

SEQ ID NO: 99260 - DNA, 25 bp, Mus musculus
acagaggagccgtcgtctaacgaca

SEQ ID NO: 99261 - DNA, 25 bp, Mus musculus
acagaggaggcaattcctgcagagg

SEQ ID NO: 99262 - DNA, 25 bp, Mus musculus
acagaggaggcatttcctgcagagg

SEQ ID NO: 99263 - DNA, 25 bp, Mus musculus
acagaggatagacacctagatcaat

SEQ ID NO: 99264 - DNA, 25 bp, Mus musculus
acagaggatagagacctagatcaat

SEQ ID NO: 99265 - DNA, 25 bp, Mus musculus
acagaggatgagctgccctatgatg

SEQ ID NO: 99266 - DNA, 25 bp, Mus musculus
acagaggatgaggtgccctatgatg

SEQ ID NO: 99267 - DNA, 25 bp, Mus musculus
acagaggattatcggccgcgttcat

SEQ ID NO: 99268 - DNA, 25 bp, Mus musculus
acagaggattatgggccgcgttcat

SEQ ID NO: 99269 - DNA, 25 bp, Mus musculus
acagaggcactgagctttcctgaca

SEQ ID NO: 99270 - DNA, 25 bp, Mus musculus
acagaggcactgtgctttcctgaca

SEQ ID NO: 99271 - DNA, 25 bp, Mus musculus
acagaggcacttctcgggatcatgc

SEQ ID NO: 99272 - DNA, 25 bp, Mus musculus
acagaggcacttgtcgggatcatgc

SEQ ID NO: 99273 - DNA, 25 bp, Mus musculus
acagaggcagagatgccatgagctc

SEQ ID NO: 99274 - DNA, 25 bp, Mus musculus
acagaggcagagttgccatgagctc

SEQ ID NO: 99275 - DNA, 25 bp, Mus musculus
acagaggcagctcctcacttggtgg

SEQ ID NO: 99276 - DNA, 25 bp, Mus musculus
acagaggcagctgctcacttggtgg

SEQ ID NO: 99277 - DNA, 25 bp, Mus musculus
acagaggcaggcaaacgggctttaa

SEQ ID NO: 99278 - DNA, 25 bp, Mus musculus
acagaggcaggctaacgggctttaa

SEQ ID NO: 99279 - DNA, 25 bp, Mus musculus
acagaggcatggagcgtatcccggt

SEQ ID NO: 99280 - DNA, 25 bp, Mus musculus
acagaggcatggctcctctacttgg

SEQ ID NO: 99281 - DNA, 25 bp, Mus musculus
acagaggcatgggtcctctacttgg

SEQ ID NO: 99282 - DNA, 25 bp, Mus musculus
acagaggcatggtgcgtatcccggt

SEQ ID NO: 99283 - DNA, 25 bp, Mus musculus
acagaggccaagcaccatgcgtatt

SEQ ID NO: 99284 - DNA, 25 bp, Mus musculus
acagaggccaaggaccatgcgtatt

SEQ ID NO: 99285 - DNA, 25 bp, Mus musculus
acagaggcccacaactgtgttccag

SEQ ID NO: 99286 - DNA, 25 bp, Mus musculus
acagaggcccactactgtgttccag

SEQ ID NO: 99287 - DNA, 25 bp, Mus musculus
acagaggccgagacagcaacttgct

SEQ ID NO: 99288 - DNA, 25 bp, Mus musculus
acagaggccgagtcagcaacttgct

SEQ ID NO: 99289 - DNA, 25 bp, Mus musculus
acagaggcctccagtgatggaccag

SEQ ID NO: 99290 - DNA, 25 bp, Mus musculus
acagaggcctcctgtgatggaccag

SEQ ID NO: 99291 - DNA, 25 bp, Mus musculus
acagaggcggccatctgcatcatcc

SEQ ID NO: 99292 - DNA, 25 bp, Mus musculus
acagaggcggccttctgcatcatcc

SEQ ID NO: 99293 - DNA, 25 bp, Mus musculus
acagaggcgttcattcgggatgagc

SEQ ID NO: 99294 - DNA, 25 bp, Mus musculus
acagaggcgttctttcgggatgagc

SEQ ID NO: 99295 - DNA, 25 bp, Mus musculus
acagaggcttataccaccctcagct

SEQ ID NO: 99296 - DNA, 25 bp, Mus musculus
acagaggcttattccaccctcagct

SEQ ID NO: 99297 - DNA, 25 bp, Mus musculus
acagagggactactccttctccagc

SEQ ID NO: 99298 - DNA, 25 bp, Mus musculus
acagagggactagtccttctccagc

SEQ ID NO: 99299 - DNA, 25 bp, Mus musculus
acagagggacttcttttgctgctca

SEQ ID NO: 99300 - DNA, 25 bp, Mus musculus
acagagggacttgttttgctgctca

SEQ ID NO: 99301 - DNA, 25 bp, Mus musculus
acagagggatccacggcgggtatct

SEQ ID NO: 99302 - DNA, 25 bp, Mus musculus
acagagggatcctcggcgggtatct

SEQ ID NO: 99303 - DNA, 25 bp, Mus musculus
acagagggatgcacaggccgcacgc

SEQ ID NO: 99304 - DNA, 25 bp, Mus musculus
acagagggatgctcaggccgcacgc

SEQ ID NO: 99305 - DNA, 25 bp, Mus musculus
acagagggcaagatcacttacccca

SEQ ID NO: 99306 - DNA, 25 bp, Mus musculus
acagagggcaagttcacttacccca

SEQ ID NO: 99307 - DNA, 25 bp, Mus musculus
acagagggcacgaaagaggcacagt

SEQ ID NO: 99308 - DNA, 25 bp, Mus musculus
acagagggcacgtaagaggcacagt

SEQ ID NO: 99309 - DNA, 25 bp, Mus musculus
acagagggcctgatggtcatgacct

SEQ ID NO: 99310 - DNA, 25 bp, Mus musculus
acagagggcctgttggtcatgacct

SEQ ID NO: 99311 - DNA, 25 bp, Mus musculus
acagagggccttcttcaatactgct

SEQ ID NO: 99312 - DNA, 25 bp, Mus musculus
acagagggccttgttcaatactgct

SEQ ID NO: 99313 - DNA, 25 bp, Mus musculus
acagagggctctatgaattggtaaa

SEQ ID NO: 99314 - DNA, 25 bp, Mus musculus
acagagggctctttgaattggtaaa

SEQ ID NO: 99315 - DNA, 25 bp, Mus musculus
acagagggtccactggagactaccg

SEQ ID NO: 99316 - DNA, 25 bp, Mus musculus
acagagggtccagtggagactaccg

SEQ ID NO: 99317 - DNA, 25 bp, Mus musculus
acagagggtctaattcgaagagcat

SEQ ID NO: 99318 - DNA, 25 bp, Mus musculus
acagagggtctatttcgaagagcat

SEQ ID NO: 99319 - DNA, 25 bp, Mus musculus
acagagggtgaaatgtggctgacca

SEQ ID NO: 99320 - DNA, 25 bp, Mus musculus
acagagggtgaattgtggctgacca

SEQ ID NO: 99321 - DNA, 25 bp, Mus musculus
acagagggtgggactcccccttcag

SEQ ID NO: 99322 - DNA, 25 bp, Mus musculus
acagagggtgggtctcccccttcag

SEQ ID NO: 99323 - DNA, 25 bp, Mus musculus
acagagggttgacaccttcagcccc

SEQ ID NO: 99324 - DNA, 25 bp, Mus musculus
acagagggttgagaccttcagcccc

SEQ ID NO: 99325 - DNA, 25 bp, Mus musculus
acagagggttttatggtgcctgagt

SEQ ID NO: 99326 - DNA, 25 bp, Mus musculus
acagagggttttttggtgcctgagt

SEQ ID NO: 99327 - DNA, 25 bp, Mus musculus
acagaggtacagatgtgcagacaga

SEQ ID NO: 99328 - DNA, 25 bp, Mus musculus
acagaggtacagttgtgcagacaga

SEQ ID NO: 99329 - DNA, 25 bp, Mus musculus
acagaggtactcagttccctggagc

SEQ ID NO: 99330 - DNA, 25 bp, Mus musculus
acagaggtactctgttccctggagc

SEQ ID NO: 99331 - DNA, 25 bp, Mus musculus
acagaggtactgcacttcccaactg

SEQ ID NO: 99332 - DNA, 25 bp, Mus musculus
acagaggtactggacttcccaactg

SEQ ID NO: 99333 - DNA, 25 bp, Mus musculus
acagaggtaggcatgtcaggcctgt

SEQ ID NO: 99334 - DNA, 25 bp, Mus musculus
acagaggtaggcttgtcaggcctgt

SEQ ID NO: 99335 - DNA, 25 bp, Mus musculus
acagaggtcactcctgtgacgctca

SEQ ID NO: 99336 - DNA, 25 bp, Mus musculus
acagaggtcactgctgtgacgctca

SEQ ID NO: 99337 - DNA, 25 bp, Mus musculus
acagaggtcatcacttttacccact

SEQ ID NO: 99338 - DNA, 25 bp, Mus musculus
acagaggtcatctcttttacccact

SEQ ID NO: 99339 - DNA, 25 bp, Mus musculus
acagaggtcatgactttggcagctt

SEQ ID NO: 99340 - DNA, 25 bp, Mus musculus
acagaggtcatgtctttggcagctt

SEQ ID NO: 99341 - DNA, 25 bp, Mus musculus
acagaggtctggagtcagttgccaa

SEQ ID NO: 99342 - DNA, 25 bp, Mus musculus
acagaggtctggtgtcagttgccaa

SEQ ID NO: 99343 - DNA, 25 bp, Mus musculus
acagaggtgattaatacaaaccaga

SEQ ID NO: 99344 - DNA, 25 bp, Mus musculus
acagaggtgatttatacaaaccaga

SEQ ID NO: 99345 - DNA, 25 bp, Mus musculus
acagaggtgcagcacctgctgtcat

SEQ ID NO: 99346 - DNA, 25 bp, Mus musculus
acagaggtgcaggacctgctgtcat

SEQ ID NO: 99347 - DNA, 25 bp, Mus musculus
acagaggtgctgcatgctaccgaga

SEQ ID NO: 99348 - DNA, 25 bp, Mus musculus
acagaggtgctggatgctaccgaga

SEQ ID NO: 99349 - DNA, 25 bp, Mus musculus
acagaggtggacacgtgccagccaa

SEQ ID NO: 99350 - DNA, 25 bp, Mus musculus
acagaggtggactcgtgccagccaa

SEQ ID NO: 99351 - DNA, 25 bp, Mus musculus
acagaggtggccaatcttttccgtg

SEQ ID NO: 99352 - DNA, 25 bp, Mus musculus
acagaggtggcctatcttttccgtg

SEQ ID NO: 99353 - DNA, 25 bp, Mus musculus
acagaggtgtcaccccatgtggtca

SEQ ID NO: 99354 - DNA, 25 bp, Mus musculus
acagaggtgtcagcccatgtggtca

SEQ ID NO: 99355 - DNA, 25 bp, Mus musculus
acagaggtgtccaagcagactgagt

SEQ ID NO: 99356 - DNA, 25 bp, Mus musculus
acagaggtgtcctagcagactgagt

SEQ ID NO: 99357 - DNA, 25 bp, Mus musculus
acagaggttaccacccactttgtga

SEQ ID NO: 99358 - DNA, 25 bp, Mus musculus
acagaggttacctcccactttgtga

SEQ ID NO: 99359 - DNA, 25 bp, Mus musculus
acagaggttgcaaggtcacacagat

SEQ ID NO: 99360 - DNA, 25 bp, Mus musculus
acagaggttgcatggtcacacagat

SEQ ID NO: 99361 - DNA, 25 bp, Mus musculus
acagaggttggtatcccatggcacc

SEQ ID NO: 99362 - DNA, 25 bp, Mus musculus
acagaggttggtttcccatggcacc

SEQ ID NO: 99363 - DNA, 25 bp, Mus musculus
acagaggttgttccagcctggcctg

SEQ ID NO: 99364 - DNA, 25 bp, Mus musculus
acagaggttgttgcagcctggcctg

SEQ ID NO: 99365 - DNA, 25 bp, Mus musculus
acagaggtttttcatgtcaaggtcc

SEQ ID NO: 99366 - DNA, 25 bp, Mus musculus
acagaggtttttgatgtcaaggtcc

SEQ ID NO: 99367 - DNA, 25 bp, Mus musculus
acagagtaacatcatctacagatct

SEQ ID NO: 99368 - DNA, 25 bp, Mus musculus
acagagtaacatgatctacagatct

SEQ ID NO: 99369 - DNA, 25 bp, Mus musculus
acagagtaagccaccagacctatat

SEQ ID NO: 99370 - DNA, 25 bp, Mus musculus
acagagtaagcctccagacctatat

SEQ ID NO: 99371 - DNA, 25 bp, Mus musculus
acagagtaagttcggcttgccacaa

SEQ ID NO: 99372 - DNA, 25 bp, Mus musculus
acagagtaagttgggcttgccacaa

SEQ ID NO: 99373 - DNA, 25 bp, Mus musculus
acagagtacatcacctgagctgtct

SEQ ID NO: 99374 - DNA, 25 bp, Mus musculus
acagagtacatctcctgagctgtct

SEQ ID NO: 99375 - DNA, 25 bp, Mus musculus
acagagtagaggctgcacgctcaca

SEQ ID NO: 99376 - DNA, 25 bp, Mus musculus
acagagtagagggtgcacgctcaca

SEQ ID NO: 99377 - DNA, 25 bp, Mus musculus
acagagtagctgattcaagttcagt

SEQ ID NO: 99378 - DNA, 25 bp, Mus musculus
acagagtagctgtttcaagttcagt

SEQ ID NO: 99379 - DNA, 25 bp, Mus musculus
acagagtatgttacaccaagaccaa

SEQ ID NO: 99380 - DNA, 25 bp, Mus musculus
acagagtatgtttcaccaagaccaa

SEQ ID NO: 99381 - DNA, 25 bp, Mus musculus
acagagtcacgtacatttcccagat

SEQ ID NO: 99382 - DNA, 25 bp, Mus musculus
acagagtcacgttcatttcccagat

SEQ ID NO: 99383 - DNA, 25 bp, Mus musculus
acagagtcacttcctgacctgcaga

SEQ ID NO: 99384 - DNA, 25 bp, Mus musculus
acagagtcacttgctgacctgcaga

SEQ ID NO: 99385 - DNA, 25 bp, Mus musculus
acagagtcagagaattcctcctcag

SEQ ID NO: 99386 - DNA, 25 bp, Mus musculus
acagagtcagagtattcctcctcag

SEQ ID NO: 99387 - DNA, 25 bp, Mus musculus
acagagtcaggtcaatttttatgag

SEQ ID NO: 99388 - DNA, 25 bp, Mus musculus
acagagtcaggtgaatttttatgag

SEQ ID NO: 99389 - DNA, 25 bp, Mus musculus
acagagtcattcacagcagccagag

SEQ ID NO: 99390 - DNA, 25 bp, Mus musculus
acagagtcattctcagcagccagag

SEQ ID NO: 99391 - DNA, 25 bp, Mus musculus
acagagtcccttcgttacttcctgc

SEQ ID NO: 99392 - DNA, 25 bp, Mus musculus
acagagtcccttggttacttcctgc

SEQ ID NO: 99393 - DNA, 25 bp, Mus musculus
acagagtcctcaagcctgttgtgta

SEQ ID NO: 99394 - DNA, 25 bp, Mus musculus
acagagtcctcatgcctgttgtgta

SEQ ID NO: 99395 - DNA, 25 bp, Mus musculus
acagagtcctctctaccggagggta

SEQ ID NO: 99396 - DNA, 25 bp, Mus musculus
acagagtcctctgtaccggagggta

SEQ ID NO: 99397 - DNA, 25 bp, Mus musculus
acagagtctactcctttctctaaaa

SEQ ID NO: 99398 - DNA, 25 bp, Mus musculus
acagagtctactgctttctctaaaa

SEQ ID NO: 99399 - DNA, 25 bp, Mus musculus
acagagtctccaacatgctaggcaa

SEQ ID NO: 99400 - DNA, 25 bp, Mus musculus
acagagtctccatcatgctaggcaa

SEQ ID NO: 99401 - DNA, 25 bp, Mus musculus
acagagtctctcacccaggtcttat

SEQ ID NO: 99402 - DNA, 25 bp, Mus musculus
acagagtctctctcccaggtcttat

SEQ ID NO: 99403 - DNA, 25 bp, Mus musculus
acagagtctgctcccagggagtcct

SEQ ID NO: 99404 - DNA, 25 bp, Mus musculus
acagagtctgctgccagggagtcct

SEQ ID NO: 99405 - DNA, 25 bp, Mus musculus
acagagtctggcaatgtcaagtcta

SEQ ID NO: 99406 - DNA, 25 bp, Mus musculus
acagagtctggctatgtcaagtcta

SEQ ID NO: 99407 - DNA, 25 bp, Mus musculus
acagagtgaaatagggactacctga

SEQ ID NO: 99408 - DNA, 25 bp, Mus musculus
acagagtgaaattgggactacctga

SEQ ID NO: 99409 - DNA, 25 bp, Mus musculus
acagagtgagggaacctgcaaaacc

SEQ ID NO: 99410 - DNA, 25 bp, Mus musculus
acagagtgagggtacctgcaaaacc

SEQ ID NO: 99411 - DNA, 25 bp, Mus musculus
acagagtgaggtaccagacaggcat

SEQ ID NO: 99412 - DNA, 25 bp, Mus musculus
acagagtgaggttccagacaggcat

SEQ ID NO: 99413 - DNA, 25 bp, Mus musculus
acagagtgctggatcatcacgttct

SEQ ID NO: 99414 - DNA, 25 bp, Mus musculus
acagagtgctggttcatcacgttct

SEQ ID NO: 99415 - DNA, 25 bp, Mus musculus
acagagtggacacagacaacctcct

SEQ ID NO: 99416 - DNA, 25 bp, Mus musculus
acagagtggacagagacaacctcct

SEQ ID NO: 99417 - DNA, 25 bp, Mus musculus
acagagtgggttatttcccagccct

SEQ ID NO: 99418 - DNA, 25 bp, Mus musculus
acagagtgggttttttcccagccct

SEQ ID NO: 99419 - DNA, 25 bp, Mus musculus
acagagtgtcacagcatctatgaag

SEQ ID NO: 99420 - DNA, 25 bp, Mus musculus
acagagtgtcactgcatctatgaag

SEQ ID NO: 99421 - DNA, 25 bp, Mus musculus
acagagtgtgaacgctcaaggctat

SEQ ID NO: 99422 - DNA, 25 bp, Mus musculus
acagagtgtgaaggctcaaggctat

SEQ ID NO: 99423 - DNA, 25 bp, Mus musculus
acagagtgtttcctgtgctcttgct

SEQ ID NO: 99424 - DNA, 25 bp, Mus musculus
acagagtgtttcgtgtgctcttgct

SEQ ID NO: 99425 - DNA, 25 bp, Mus musculus
acagagttaacacctgtctcaggaa

SEQ ID NO: 99426 - DNA, 25 bp, Mus musculus
acagagttaacagctgtctcaggaa

SEQ ID NO: 99427 - DNA, 25 bp, Mus musculus
acagagttatgacctaggtaccaaa

SEQ ID NO: 99428 - DNA, 25 bp, Mus musculus
acagagttatgagctaggtaccaaa

SEQ ID NO: 99429 - DNA, 25 bp, Mus musculus
acagagttcattcttagtcacagga

SEQ ID NO: 99430 - DNA, 25 bp, Mus musculus
acagagttcattgttagtcacagga

SEQ ID NO: 99431 - DNA, 25 bp, Mus musculus
acagagttccagatgcggctcctct

SEQ ID NO: 99432 - DNA, 25 bp, Mus musculus
acagagttccagttgcggctcctct

SEQ ID NO: 99433 - DNA, 25 bp, Mus musculus
acagagttctgaattcccctcaggt

SEQ ID NO: 99434 - DNA, 25 bp, Mus musculus
acagagttctgatttcccctcaggt

SEQ ID NO: 99435 - DNA, 25 bp, Mus musculus
acagagttgacccttggagcgttta

SEQ ID NO: 99436 - DNA, 25 bp, Mus musculus
acagagttgaccgttggagcgttta

SEQ ID NO: 99437 - DNA, 25 bp, Mus musculus
acagagttggagacgaaggtctttc

SEQ ID NO: 99438 - DNA, 25 bp, Mus musculus
acagagttggagtcgaaggtctttc

SEQ ID NO: 99439 - DNA, 25 bp, Mus musculus
acagagttggttcttcaggcgtccc

SEQ ID NO: 99440 - DNA, 25 bp, Mus musculus
acagagttggttgttcaggcgtccc

SEQ ID NO: 99441 - DNA, 25 bp, Mus musculus
acagagttgtcgagttccctggcca

SEQ ID NO: 99442 - DNA, 25 bp, Mus musculus
acagagttgtcgtgttccctggcca

SEQ ID NO: 99443 - DNA, 25 bp, Mus musculus
acagagttgtttctttcctctttga

SEQ ID NO: 99444 - DNA, 25 bp, Mus musculus
acagagttgtttgtttcctctttga

SEQ ID NO: 99445 - DNA, 25 bp, Mus musculus
acagataaatgacctgccgggcagt

SEQ ID NO: 99446 - DNA, 25 bp, Mus musculus
acagataaatgagctgccgggcagt

SEQ ID NO: 99447 - DNA, 25 bp, Mus musculus
acagataatcgtcggctttggtcag

SEQ ID NO: 99448 - DNA, 25 bp, Mus musculus
acagataatcgtgggctttggtcag

SEQ ID NO: 99449 - DNA, 25 bp, Mus musculus
acagataatgtaccccaccaacctt

SEQ ID NO: 99450 - DNA, 25 bp, Mus musculus
acagataatgtagcccaccaacctt

SEQ ID NO: 99451 - DNA, 25 bp, Mus musculus
acagataattttccatagctatgac

SEQ ID NO: 99452 - DNA, 25 bp, Mus musculus
acagataattttgcatagctatgac

SEQ ID NO: 99453 - DNA, 25 bp, Mus musculus
acagatacacacacaagtccataca

SEQ ID NO: 99454 - DNA, 25 bp, Mus musculus
acagatacacactcaagtccataca

SEQ ID NO: 99455 - DNA, 25 bp, Mus musculus
acagatacacgaccagttcataaag

SEQ ID NO: 99456 - DNA, 25 bp, Mus musculus
acagatacacgagcagttcataaag

SEQ ID NO: 99457 - DNA, 25 bp, Mus musculus
acagatacagtaagattggttagaa

SEQ ID NO: 99458 - DNA, 25 bp, Mus musculus
acagatacagtatgattggttagaa

SEQ ID NO: 99459 - DNA, 25 bp, Mus musculus
acagatacagttagccctcagtgta

SEQ ID NO: 99460 - DNA, 25 bp, Mus musculus
acagatacagtttgccctcagtgta

SEQ ID NO: 99461 - DNA, 25 bp, Mus musculus
acagataccaccattaaagcaattc

SEQ ID NO: 99462 - DNA, 25 bp, Mus musculus
acagataccacctttaaagcaattc

SEQ ID NO: 99463 - DNA, 25 bp, Mus musculus
acagataccacgctcagcagacttc

SEQ ID NO: 99464 - DNA, 25 bp, Mus musculus
acagataccacggtcagcagacttc

SEQ ID NO: 99465 - DNA, 25 bp, Mus musculus
acagataccggaatctgaccagata

SEQ ID NO: 99466 - DNA, 25 bp, Mus musculus
acagataccggattctgaccagata

SEQ ID NO: 99467 - DNA, 25 bp, Mus musculus
acagatacctccatactgttttcag

SEQ ID NO: 99468 - DNA, 25 bp, Mus musculus
acagatacctccttactgttttcag

SEQ ID NO: 99469 - DNA, 25 bp, Mus musculus
acagatacctgtacgtcagcatcgc

SEQ ID NO: 99470 - DNA, 25 bp, Mus musculus
acagatacctgttcgtcagcatcgc

SEQ ID NO: 99471 - DNA, 25 bp, Mus musculus
acagatacgggaaccaggcttcaaa

SEQ ID NO: 99472 - DNA, 25 bp, Mus musculus
acagatacgggatccaggcttcaaa

SEQ ID NO: 99473 - DNA, 25 bp, Mus musculus
acagatactaacagcaggttacggg

SEQ ID NO: 99474 - DNA, 25 bp, Mus musculus
acagatactaactgcaggttacggg

SEQ ID NO: 99475 - DNA, 25 bp, Mus musculus
acagatactctgaatttgttacttt

SEQ ID NO: 99476 - DNA, 25 bp, Mus musculus
acagatactctgacaaagggtgaaa

SEQ ID NO: 99477 - DNA, 25 bp, Mus musculus
acagatactctgtatttgttacttt

SEQ ID NO: 99478 - DNA, 25 bp, Mus musculus
acagatactctgtcaaagggtgaaa

SEQ ID NO: 99479 - DNA, 25 bp, Mus musculus
acagatactcttcgccatgactttc

SEQ ID NO: 99480 - DNA, 25 bp, Mus musculus
acagatactcttctttccatggtac

SEQ ID NO: 99481 - DNA, 25 bp, Mus musculus
acagatactcttggccatgactttc

SEQ ID NO: 99482 - DNA, 25 bp, Mus musculus
acagatactcttgtttccatggtac

SEQ ID NO: 99483 - DNA, 25 bp, Mus musculus
acagatacttaaaagaacagccaag

SEQ ID NO: 99484 - DNA, 25 bp, Mus musculus
acagatacttaatagaacagccaag

SEQ ID NO: 99485 - DNA, 25 bp, Mus musculus
acagatacttgaccataatgccaga

SEQ ID NO: 99486 - DNA, 25 bp, Mus musculus
acagatacttgagcataatgccaga

SEQ ID NO: 99487 - DNA, 25 bp, Mus musculus
acagatagacacctgtgcccacgca

SEQ ID NO: 99488 - DNA, 25 bp, Mus musculus
acagatagacacgtgtgcccacgca

SEQ ID NO: 99489 - DNA, 25 bp, Mus musculus
acagatagagccacgcacacaccat

SEQ ID NO: 99490 - DNA, 25 bp, Mus musculus
acagatagagcctcgcacacaccat

SEQ ID NO: 99491 - DNA, 25 bp, Mus musculus
acagatagagttagtgtctttcatg

SEQ ID NO: 99492 - DNA, 25 bp, Mus musculus
acagatagagtttgtgtctttcatg

SEQ ID NO: 99493 - DNA, 25 bp, Mus musculus
acagatagcaatccggctgccactg

SEQ ID NO: 99494 - DNA, 25 bp, Mus musculus
acagatagcaatgcggctgccactg

SEQ ID NO: 99495 - DNA, 25 bp, Mus musculus
acagatagctccaccaagaagacaa

SEQ ID NO: 99496 - DNA, 25 bp, Mus musculus
acagatagctcctccaagaagacaa

SEQ ID NO: 99497 - DNA, 25 bp, Mus musculus
acagatatccttcttcaggtagcat

SEQ ID NO: 99498 - DNA, 25 bp, Mus musculus
acagatatccttgttcaggtagcat

SEQ ID NO: 99499 - DNA, 25 bp, Mus musculus
acagatatgcagattcctccaaatg

SEQ ID NO: 99500 - DNA, 25 bp, Mus musculus
acagatatgcagtttcctccaaatg

SEQ ID NO: 99501 - DNA, 25 bp, Mus musculus
acagatatgcctatgattttgcaag

SEQ ID NO: 99502 - DNA, 25 bp, Mus musculus
acagatatgcctttgattttgcaag

SEQ ID NO: 99503 - DNA, 25 bp, Mus musculus
acagatatggcaacttgctcctcca

SEQ ID NO: 99504 - DNA, 25 bp, Mus musculus
acagatatggcatcttgctcctcca

SEQ ID NO: 99505 - DNA, 25 bp, Mus musculus
acagatatgggcactgtcatactct

SEQ ID NO: 99506 - DNA, 25 bp, Mus musculus
acagatatgggctctgtcatactct

SEQ ID NO: 99507 - DNA, 25 bp, Mus musculus
acagatattatcatgacggctttgt

SEQ ID NO: 99508 - DNA, 25 bp, Mus musculus
acagatattatcttgacggctttgt

SEQ ID NO: 99509 - DNA, 25 bp, Mus musculus
acagatcaacatccgtgtccaggaa

SEQ ID NO: 99510 - DNA, 25 bp, Mus musculus
acagatcaacatgcgtgtccaggaa

SEQ ID NO: 99511 - DNA, 25 bp, Mus musculus
acagatcaagatatacccggctagg

SEQ ID NO: 99512 - DNA, 25 bp, Mus musculus
acagatcaagatttacccggctagg

SEQ ID NO: 99513 - DNA, 25 bp, Mus musculus
acagatcacatcaaacgctttcatt

SEQ ID NO: 99514 - DNA, 25 bp, Mus musculus
acagatcacatctaacgctttcatt

SEQ ID NO: 99515 - DNA, 25 bp, Mus musculus
acagatcaccccatcttactataca

SEQ ID NO: 99516 - DNA, 25 bp, Mus musculus
acagatcaccccttcttactataca

SEQ ID NO: 99517 - DNA, 25 bp, Mus musculus
acagatcaccgtacagtagacttac

SEQ ID NO: 99518 - DNA, 25 bp, Mus musculus
acagatcaccgttcagtagacttac

SEQ ID NO: 99519 - DNA, 25 bp, Mus musculus
acagatcaggatccttgcactttaa

SEQ ID NO: 99520 - DNA, 25 bp, Mus musculus
acagatcaggatgcttgcactttaa

SEQ ID NO: 99521 - DNA, 25 bp, Mus musculus
acagatcagggcatgtcagttgtga

SEQ ID NO: 99522 - DNA, 25 bp, Mus musculus
acagatcagggcttgtcagttgtga

SEQ ID NO: 99523 - DNA, 25 bp, Mus musculus
acagatcatgcgctatgtccctatt

SEQ ID NO: 99524 - DNA, 25 bp, Mus musculus
acagatcatgcggtatgtccctatt

SEQ ID NO: 99525 - DNA, 25 bp, Mus musculus
acagatccaaacaaccagacgctga

SEQ ID NO: 99526 - DNA, 25 bp, Mus musculus
acagatccaaactaccagacgctga

SEQ ID NO: 99527 - DNA, 25 bp, Mus musculus
acagatccaaagatctcacaagccc

SEQ ID NO: 99528 - DNA, 25 bp, Mus musculus
acagatccaaagttctcacaagccc

SEQ ID NO: 99529 - DNA, 25 bp, Mus musculus
acagatccagctctttggaccagag

SEQ ID NO: 99530 - DNA, 25 bp, Mus musculus
acagatccagctgtttggaccagag

SEQ ID NO: 99531 - DNA, 25 bp, Mus musculus
acagatccagtaattaaaacataaa

SEQ ID NO: 99532 - DNA, 25 bp, Mus musculus
acagatccagtatttaaaacataaa

SEQ ID NO: 99533 - DNA, 25 bp, Mus musculus
acagatcccaagacagaagtaggta

SEQ ID NO: 99534 - DNA, 25 bp, Mus musculus
acagatcccaagtcagaagtaggta

SEQ ID NO: 99535 - DNA, 25 bp, Mus musculus
acagatcccacacttaagacttcag

SEQ ID NO: 99536 - DNA, 25 bp, Mus musculus
acagatcccacagttaagacttcag

SEQ ID NO: 99537 - DNA, 25 bp, Mus musculus
acagatcccagcagagcacttggcc

SEQ ID NO: 99538 - DNA, 25 bp, Mus musculus
acagatcccagctgagcacttggcc

SEQ ID NO: 99539 - DNA, 25 bp, Mus musculus
acagatcccattagtgtgacacagg

SEQ ID NO: 99540 - DNA, 25 bp, Mus musculus
acagatcccatttgtgtgacacagg

SEQ ID NO: 99541 - DNA, 25 bp, Mus musculus
acagatccctttacaccacttggag

SEQ ID NO: 99542 - DNA, 25 bp, Mus musculus
acagatcccttttcaccacttggag

SEQ ID NO: 99543 - DNA, 25 bp, Mus musculus
acagatccggttcggtcaggagcct

SEQ ID NO: 99544 - DNA, 25 bp, Mus musculus
acagatccggttgggtcaggagcct

SEQ ID NO: 99545 - DNA, 25 bp, Mus musculus
acagatcctatcaggttgtgcagaa

SEQ ID NO: 99546 - DNA, 25 bp, Mus musculus
acagatcctatctggttgtgcagaa

SEQ ID NO: 99547 - DNA, 25 bp, Mus musculus
acagatcctatgagttggccattgt

SEQ ID NO: 99548 - DNA, 25 bp, Mus musculus
acagatcctatgtgttggccattgt

SEQ ID NO: 99549 - DNA, 25 bp, Mus musculus
acagatcctgtcattttcatgtgac

SEQ ID NO: 99550 - DNA, 25 bp, Mus musculus
acagatcctgtctttttcatgtgac

SEQ ID NO: 99551 - DNA, 25 bp, Mus musculus
acagatcgcagcctagatcctaggg

SEQ ID NO: 99552 - DNA, 25 bp, Mus musculus
acagatcgcagcgtagatcctaggg

SEQ ID NO: 99553 - DNA, 25 bp, Mus musculus
acagatcgcctcacagtgctggttg

SEQ ID NO: 99554 - DNA, 25 bp, Mus musculus
acagatcgcctctcagtgctggttg

SEQ ID NO: 99555 - DNA, 25 bp, Mus musculus
acagatcgctggcagttctctttac

SEQ ID NO: 99556 - DNA, 25 bp, Mus musculus
acagatcgctgggagttctctttac

SEQ ID NO: 99557 - DNA, 25 bp, Mus musculus
acagatcgtcgaaggcattaaacaa

SEQ ID NO: 99558 - DNA, 25 bp, Mus musculus
acagatcgtcgatggcattaaacaa

SEQ ID NO: 99559 - DNA, 25 bp, Mus musculus
acagatctagggattacaactttgt

SEQ ID NO: 99560 - DNA, 25 bp, Mus musculus
acagatctagggtttacaactttgt

SEQ ID NO: 99561 - DNA, 25 bp, Mus musculus
acagatctcaaactcttacttccag

SEQ ID NO: 99562 - DNA, 25 bp, Mus musculus
acagatctcaaagtcttacttccag

SEQ ID NO: 99563 - DNA, 25 bp, Mus musculus
acagatctctacacccaggagatat

SEQ ID NO: 99564 - DNA, 25 bp, Mus musculus
acagatctctactcccaggagatat

SEQ ID NO: 99565 - DNA, 25 bp, Mus musculus
acagatctcttgctctccagatggg

SEQ ID NO: 99566 - DNA, 25 bp, Mus musculus
acagatctcttggtctccagatggg

SEQ ID NO: 99567 - DNA, 25 bp, Mus musculus
acagatctgaaacgtgtgtatggca

SEQ ID NO: 99568 - DNA, 25 bp, Mus musculus
acagatctgaaaggtgtgtatggca

SEQ ID NO: 99569 - DNA, 25 bp, Mus musculus
acagatctgagtcgtttttgagccc

SEQ ID NO: 99570 - DNA, 25 bp, Mus musculus
acagatctgagtggtttttgagccc

SEQ ID NO: 99571 - DNA, 25 bp, Mus musculus
acagatctgcaactcgtttcctttg

SEQ ID NO: 99572 - DNA, 25 bp, Mus musculus
acagatctgcaagtcgtttcctttg

SEQ ID NO: 99573 - DNA, 25 bp, Mus musculus
acagatctgcctctcctggacttgt

SEQ ID NO: 99574 - DNA, 25 bp, Mus musculus
acagatctgcctgtcctggacttgt

SEQ ID NO: 99575 - DNA, 25 bp, Mus musculus
acagatctgcttcggcctgtgcaaa

SEQ ID NO: 99576 - DNA, 25 bp, Mus musculus
acagatctgcttgggcctgtgcaaa

SEQ ID NO: 99577 - DNA, 25 bp, Mus musculus
acagatctggcaaccttacaggcaa

SEQ ID NO: 99578 - DNA, 25 bp, Mus musculus
acagatctggcatccttacaggcaa

SEQ ID NO: 99579 - DNA, 25 bp, Mus musculus
acagatctggctatcgttattgcga

SEQ ID NO: 99580 - DNA, 25 bp, Mus musculus
acagatctggctttcgttattgcga

SEQ ID NO: 99581 - DNA, 25 bp, Mus musculus
acagatctgttcatttcattcccac

SEQ ID NO: 99582 - DNA, 25 bp, Mus musculus
acagatctgttcttttcattcccac

SEQ ID NO: 99583 - DNA, 25 bp, Mus musculus
acagatcttaaacgtggagcctctc

SEQ ID NO: 99584 - DNA, 25 bp, Mus musculus
acagatcttaaaggtggagcctctc

SEQ ID NO: 99585 - DNA, 25 bp, Mus musculus
acagatcttagaaacggccttacag

SEQ ID NO: 99586 - DNA, 25 bp, Mus musculus
acagatcttagatacggccttacag

SEQ ID NO: 99587 - DNA, 25 bp, Mus musculus
acagatcttataatgtgtcagttga

SEQ ID NO: 99588 - DNA, 25 bp, Mus musculus
acagatcttatattgtgtcagttga

SEQ ID NO: 99589 - DNA, 25 bp, Mus musculus
acagatcttcataccgcttcctaag

SEQ ID NO: 99590 - DNA, 25 bp, Mus musculus
acagatcttcattccgcttcctaag

SEQ ID NO: 99591 - DNA, 25 bp, Mus musculus
acagatcttcggagagcaagtggct

SEQ ID NO: 99592 - DNA, 25 bp, Mus musculus
acagatcttcggtgagcaagtggct

SEQ ID NO: 99593 - DNA, 25 bp, Mus musculus
acagatcttgaaaccttgctaataa

SEQ ID NO: 99594 - DNA, 25 bp, Mus musculus
acagatcttgaatccttgctaataa

SEQ ID NO: 99595 - DNA, 25 bp, Mus musculus
acagatcttgagctgtcctgagtcc

SEQ ID NO: 99596 - DNA, 25 bp, Mus musculus
acagatcttgaggtgtcctgagtcc

SEQ ID NO: 99597 - DNA, 25 bp, Mus musculus
acagatctttctcttgtcaaaactc

SEQ ID NO: 99598 - DNA, 25 bp, Mus musculus
acagatctttctgttgtcaaaactc

SEQ ID NO: 99599 - DNA, 25 bp, Mus musculus
acagatgaacagacagccttgggtt

SEQ ID NO: 99600 - DNA, 25 bp, Mus musculus
acagatgaacagtcagccttgggtt

SEQ ID NO: 99601 - DNA, 25 bp, Mus musculus
acagatgaagatattttaccacaga

SEQ ID NO: 99602 - DNA, 25 bp, Mus musculus
acagatgaagattttttaccacaga

SEQ ID NO: 99603 - DNA, 25 bp, Mus musculus
acagatgacacaattcctgctccct

SEQ ID NO: 99604 - DNA, 25 bp, Mus musculus
acagatgacacatttcctgctccct

SEQ ID NO: 99605 - DNA, 25 bp, Mus musculus
acagatgacatcaggaattttccag

SEQ ID NO: 99606 - DNA, 25 bp, Mus musculus
acagatgacatccttgtggcctcgg

SEQ ID NO: 99607 - DNA, 25 bp, Mus musculus
acagatgacatcgttgtggcctcgg

SEQ ID NO: 99608 - DNA, 25 bp, Mus musculus
acagatgacatctggaattttccag

SEQ ID NO: 99609 - DNA, 25 bp, Mus musculus
acagatgacattataggaactccta

SEQ ID NO: 99610 - DNA, 25 bp, Mus musculus
acagatgacattttaggaactccta

SEQ ID NO: 99611 - DNA, 25 bp, Mus musculus
acagatgacctgaggaacacctcca

SEQ ID NO: 99612 - DNA, 25 bp, Mus musculus
acagatgacctgtggaacacctcca

SEQ ID NO: 99613 - DNA, 25 bp, Mus musculus
acagatgacttgctggactccctag

SEQ ID NO: 99614 - DNA, 25 bp, Mus musculus
acagatgacttggtggactccctag

SEQ ID NO: 99615 - DNA, 25 bp, Mus musculus
acagatgagaacctaggcacccaca

SEQ ID NO: 99616 - DNA, 25 bp, Mus musculus
acagatgagaacgtaggcacccaca

SEQ ID NO: 99617 - DNA, 25 bp, Mus musculus
acagatgagcttcgtgtgttgccct

SEQ ID NO: 99618 - DNA, 25 bp, Mus musculus
acagatgagcttggtgtgttgccct

SEQ ID NO: 99619 - DNA, 25 bp, Mus musculus
acagatgagtgtccatctccctacc

SEQ ID NO: 99620 - DNA, 25 bp, Mus musculus
acagatgagtgtgcatctccctacc

SEQ ID NO: 99621 - DNA, 25 bp, Mus musculus
acagatgatctcaactgtgtgaacc

SEQ ID NO: 99622 - DNA, 25 bp, Mus musculus
acagatgatctctactgtgtgaacc

SEQ ID NO: 99623 - DNA, 25 bp, Mus musculus
acagatgattaacgatttagccaaa

SEQ ID NO: 99624 - DNA, 25 bp, Mus musculus
acagatgattaaggatttagccaaa

SEQ ID NO: 99625 - DNA, 25 bp, Mus musculus
acagatgattctagagactggttga

SEQ ID NO: 99626 - DNA, 25 bp, Mus musculus
acagatgattcttgagactggttga

SEQ ID NO: 99627 - DNA, 25 bp, Mus musculus
acagatgcagatcacccggagactc

SEQ ID NO: 99628 - DNA, 25 bp, Mus musculus
acagatgcagatgacccggagactc

SEQ ID NO: 99629 - DNA, 25 bp, Mus musculus
acagatgcagccacagtttcagttg

SEQ ID NO: 99630 - DNA, 25 bp, Mus musculus
acagatgcagcctcagtttcagttg

SEQ ID NO: 99631 - DNA, 25 bp, Mus musculus
acagatgcatccaggcacacacaga

SEQ ID NO: 99632 - DNA, 25 bp, Mus musculus
acagatgcatcctggcacacacaga

SEQ ID NO: 99633 - DNA, 25 bp, Mus musculus
acagatgcattaccgtcagcgtcaa

SEQ ID NO: 99634 - DNA, 25 bp, Mus musculus
acagatgcattagcgtcagcgtcaa

SEQ ID NO: 99635 - DNA, 25 bp, Mus musculus
acagatgcccagagcagggcctgta

SEQ ID NO: 99636 - DNA, 25 bp, Mus musculus
acagatgcccagtgcagggcctgta

SEQ ID NO: 99637 - DNA, 25 bp, Mus musculus
acagatgccccaacagagttcggga

SEQ ID NO: 99638 - DNA, 25 bp, Mus musculus
acagatgccccatcagagttcggga

SEQ ID NO: 99639 - DNA, 25 bp, Mus musculus
acagatgccctgaggactgtgtcct

SEQ ID NO: 99640 - DNA, 25 bp, Mus musculus
acagatgccctgtggactgtgtcct

SEQ ID NO: 99641 - DNA, 25 bp, Mus musculus
acagatgcccttattcagcttgaag

SEQ ID NO: 99642 - DNA, 25 bp, Mus musculus
acagatgccctttttcagcttgaag

SEQ ID NO: 99643 - DNA, 25 bp, Mus musculus
acagatgccttaagcctcacatttt

SEQ ID NO: 99644 - DNA, 25 bp, Mus musculus
acagatgccttatgcctcacatttt

SEQ ID NO: 99645 - DNA, 25 bp, Mus musculus
acagatgccttcaaaccacccagaa

SEQ ID NO: 99646 - DNA, 25 bp, Mus musculus
acagatgccttctaaccacccagaa

SEQ ID NO: 99647 - DNA, 25 bp, Mus musculus
acagatgccttgctgctgcagtcct

SEQ ID NO: 99648 - DNA, 25 bp, Mus musculus
acagatgccttggtgctgcagtcct

SEQ ID NO: 99649 - DNA, 25 bp, Mus musculus
acagatgctaaaatgactggcaagc

SEQ ID NO: 99650 - DNA, 25 bp, Mus musculus
acagatgctaaattgactggcaagc

SEQ ID NO: 99651 - DNA, 25 bp, Mus musculus
acagatgctcacaataagattcagg

SEQ ID NO: 99652 - DNA, 25 bp, Mus musculus
acagatgctcactataagattcagg

SEQ ID NO: 99653 - DNA, 25 bp, Mus musculus
acagatgctcttcaagcttgttgaa

SEQ ID NO: 99654 - DNA, 25 bp, Mus musculus
acagatgctcttgaagcttgttgaa

SEQ ID NO: 99655 - DNA, 25 bp, Mus musculus
acagatgctttgaactgccttcctt

SEQ ID NO: 99656 - DNA, 25 bp, Mus musculus
acagatgctttgattccagtcgggc

SEQ ID NO: 99657 - DNA, 25 bp, Mus musculus
acagatgctttgtactgccttcctt

SEQ ID NO: 99658 - DNA, 25 bp, Mus musculus
acagatgctttgtttccagtcgggc

SEQ ID NO: 99659 - DNA, 25 bp, Mus musculus
acagatggaaggaacaccggccccg

SEQ ID NO: 99660 - DNA, 25 bp, Mus musculus
acagatggaaggtacaccggccccg

SEQ ID NO: 99661 - DNA, 25 bp, Mus musculus
acagatggacggcatccctccatgc

SEQ ID NO: 99662 - DNA, 25 bp, Mus musculus
acagatggacgggatccctccatgc

SEQ ID NO: 99663 - DNA, 25 bp, Mus musculus
acagatggccgtctattcccacagc

SEQ ID NO: 99664 - DNA, 25 bp, Mus musculus
acagatggccgtgtattcccacagc

SEQ ID NO: 99665 - DNA, 25 bp, Mus musculus
acagatgggcctcaggagcttctcg

SEQ ID NO: 99666 - DNA, 25 bp, Mus musculus
acagatgggcctgaggagcttctcg

SEQ ID NO: 99667 - DNA, 25 bp, Mus musculus
acagatgggctcaggcgatgcctat

SEQ ID NO: 99668 - DNA, 25 bp, Mus musculus
acagatgggctctggcgatgcctat

SEQ ID NO: 99669 - DNA, 25 bp, Mus musculus
acagatggtcatagatgtccttcat

SEQ ID NO: 99670 - DNA, 25 bp, Mus musculus
acagatggtcattgatgtccttcat

SEQ ID NO: 99671 - DNA, 25 bp, Mus musculus
acagatggtgtcatctctatttcct

SEQ ID NO: 99672 - DNA, 25 bp, Mus musculus
acagatggtgtcttctctatttcct

SEQ ID NO: 99673 - DNA, 25 bp, Mus musculus
acagatggtgtgctcagctttgctt

SEQ ID NO: 99674 - DNA, 25 bp, Mus musculus
acagatggtgtggtcagctttgctt

SEQ ID NO: 99675 - DNA, 25 bp, Mus musculus
acagatgtacgtcggtttttgagaa

SEQ ID NO: 99676 - DNA, 25 bp, Mus musculus
acagatgtacgtgggtttttgagaa

SEQ ID NO: 99677 - DNA, 25 bp, Mus musculus
acagatgtagctctcccagtgttag

SEQ ID NO: 99678 - DNA, 25 bp, Mus musculus
acagatgtagctgtcccagtgttag

SEQ ID NO: 99679 - DNA, 25 bp, Mus musculus
acagatgtcagtactagcctggttc

SEQ ID NO: 99680 - DNA, 25 bp, Mus musculus
acagatgtcagttctagcctggttc

SEQ ID NO: 99681 - DNA, 25 bp, Mus musculus
acagatgtccgtacagagtagtcga

SEQ ID NO: 99682 - DNA, 25 bp, Mus musculus
acagatgtccgtcctagctgaagaa

SEQ ID NO: 99683 - DNA, 25 bp, Mus musculus
acagatgtccgtgctagctgaagaa

SEQ ID NO: 99684 - DNA, 25 bp, Mus musculus
acagatgtccgttcagagtagtcga

SEQ ID NO: 99685 - DNA, 25 bp, Mus musculus
acagatgtccttcagcactttcaaa

SEQ ID NO: 99686 - DNA, 25 bp, Mus musculus
acagatgtccttgagcactttcaaa

SEQ ID NO: 99687 - DNA, 25 bp, Mus musculus
acagatgtctggagcgaagccccag

SEQ ID NO: 99688 - DNA, 25 bp, Mus musculus
acagatgtctggaggttcccagcag

SEQ ID NO: 99689 - DNA, 25 bp, Mus musculus
acagatgtctggtgcgaagccccag

SEQ ID NO: 99690 - DNA, 25 bp, Mus musculus
acagatgtctggtggttcccagcag

SEQ ID NO: 99691 - DNA, 25 bp, Mus musculus
acagatgtctgtctgttcgcagcac

SEQ ID NO: 99692 - DNA, 25 bp, Mus musculus
acagatgtctgtgtgttcgcagcac

SEQ ID NO: 99693 - DNA, 25 bp, Mus musculus
acagatgtgatgagcaaccccttct

SEQ ID NO: 99694 - DNA, 25 bp, Mus musculus
acagatgtgatgtgcaaccccttct

SEQ ID NO: 99695 - DNA, 25 bp, Mus musculus
acagatgtgcggcagtcctccgaac

SEQ ID NO: 99696 - DNA, 25 bp, Mus musculus
acagatgtgcgggagtcctccgaac

SEQ ID NO: 99697 - DNA, 25 bp, Mus musculus
acagatgtgctcacaccagctggaa

SEQ ID NO: 99698 - DNA, 25 bp, Mus musculus
acagatgtgctctcaccagctggaa

SEQ ID NO: 99699 - DNA, 25 bp, Mus musculus
acagatgtgcttcgaggcttgtctc

SEQ ID NO: 99700 - DNA, 25 bp, Mus musculus
acagatgtgcttggaggcttgtctc

SEQ ID NO: 99701 - DNA, 25 bp, Mus musculus
acagatgtgtttccccacctgacac

SEQ ID NO: 99702 - DNA, 25 bp, Mus musculus
acagatgtgtttgcccacctgacac

SEQ ID NO: 99703 - DNA, 25 bp, Mus musculus
acagatgttcatcgagcttgtgaga

SEQ ID NO: 99704 - DNA, 25 bp, Mus musculus
acagatgttcatggagcttgtgaga

SEQ ID NO: 99705 - DNA, 25 bp, Mus musculus
acagatgtttccattctcatgctga

SEQ ID NO: 99706 - DNA, 25 bp, Mus musculus
acagatgtttcctttctcatgctga

SEQ ID NO: 99707 - DNA, 25 bp, Mus musculus
acagatgtttgccattaaacctcaa

SEQ ID NO: 99708 - DNA, 25 bp, Mus musculus
acagatgtttgcgattaaacctcaa

SEQ ID NO: 99709 - DNA, 25 bp, Mus musculus
acagattaaattctactcccaccag

SEQ ID NO: 99710 - DNA, 25 bp, Mus musculus
acagattaaattgtactcccaccag

SEQ ID NO: 99711 - DNA, 25 bp, Mus musculus
acagattaagttacattgtctttgg

SEQ ID NO: 99712 - DNA, 25 bp, Mus musculus
acagattaagtttcattgtctttgg

SEQ ID NO: 99713 - DNA, 25 bp, Mus musculus
acagattaggtcacagagggaagaa

SEQ ID NO: 99714 - DNA, 25 bp, Mus musculus
acagattaggtctcagagggaagaa

SEQ ID NO: 99715 - DNA, 25 bp, Mus musculus
acagattattctctatcccagcttt

SEQ ID NO: 99716 - DNA, 25 bp, Mus musculus
acagattattctgtatcccagcttt

SEQ ID NO: 99717 - DNA, 25 bp, Mus musculus
acagattcacaactcactgtgtagt

SEQ ID NO: 99718 - DNA, 25 bp, Mus musculus
acagattcacaagtcactgtgtagt

SEQ ID NO: 99719 - DNA, 25 bp, Mus musculus
acagattcagagctcaaaaggcgaa

SEQ ID NO: 99720 - DNA, 25 bp, Mus musculus
acagattcagaggtcaaaaggcgaa

SEQ ID NO: 99721 - DNA, 25 bp, Mus musculus
acagattcatgtagcagttcctcaa

SEQ ID NO: 99722 - DNA, 25 bp, Mus musculus
acagattcatgttgcagttcctcaa

SEQ ID NO: 99723 - DNA, 25 bp, Mus musculus
acagattccaacaccttaacctatg

SEQ ID NO: 99724 - DNA, 25 bp, Mus musculus
acagattccaactccttaacctatg

SEQ ID NO: 99725 - DNA, 25 bp, Mus musculus
acagattcctgaacgttccattgct

SEQ ID NO: 99726 - DNA, 25 bp, Mus musculus
acagattcctgatcgttccattgct

SEQ ID NO: 99727 - DNA, 25 bp, Mus musculus
acagattccttcacatgcaacgtga

SEQ ID NO: 99728 - DNA, 25 bp, Mus musculus
acagattccttctcatgcaacgtga

SEQ ID NO: 99729 - DNA, 25 bp, Mus musculus
acagattcgccccatgagttgaaaa

SEQ ID NO: 99730 - DNA, 25 bp, Mus musculus
acagattcgcccgatgagttgaaaa

SEQ ID NO: 99731 - DNA, 25 bp, Mus musculus
acagattcgtgtatgtgtggctaat

SEQ ID NO: 99732 - DNA, 25 bp, Mus musculus
acagattcgtgtttgtgtggctaat

SEQ ID NO: 99733 - DNA, 25 bp, Mus musculus
acagattctcaacctactgccggaa

SEQ ID NO: 99734 - DNA, 25 bp, Mus musculus
acagattctcaagctactgccggaa

SEQ ID NO: 99735 - DNA, 25 bp, Mus musculus
acagattctcacatgctagctggac

SEQ ID NO: 99736 - DNA, 25 bp, Mus musculus
acagattctcacttgctagctggac

SEQ ID NO: 99737 - DNA, 25 bp, Mus musculus
acagattcttacacactccctagta

SEQ ID NO: 99738 - DNA, 25 bp, Mus musculus
acagattcttactcactccctagta

SEQ ID NO: 99739 - DNA, 25 bp, Mus musculus
acagattgaattctgtcccctatcc

SEQ ID NO: 99740 - DNA, 25 bp, Mus musculus
acagattgaattgtgtcccctatcc

SEQ ID NO: 99741 - DNA, 25 bp, Mus musculus
acagattgccttatccatcatcata

SEQ ID NO: 99742 - DNA, 25 bp, Mus musculus
acagattgccttttccatcatcata

SEQ ID NO: 99743 - DNA, 25 bp, Mus musculus
acagattgctctctcagcgctgttc

SEQ ID NO: 99744 - DNA, 25 bp, Mus musculus
acagattgctctgtcagcgctgttc

SEQ ID NO: 99745 - DNA, 25 bp, Mus musculus
acagattgcttcaagcatgggctgt

SEQ ID NO: 99746 - DNA, 25 bp, Mus musculus
acagattgcttctagcatgggctgt

SEQ ID NO: 99747 - DNA, 25 bp, Mus musculus
acagattgtagtcaaccgtaggctt

SEQ ID NO: 99748 - DNA, 25 bp, Mus musculus
acagattgtagtgaaccgtaggctt

SEQ ID NO: 99749 - DNA, 25 bp, Mus musculus
acagattgtgccaggcctgttggat

SEQ ID NO: 99750 - DNA, 25 bp, Mus musculus
acagattgtgcctggcctgttggat

SEQ ID NO: 99751 - DNA, 25 bp, Mus musculus
acagatttacccctggatgaccaaa

SEQ ID NO: 99752 - DNA, 25 bp, Mus musculus
acagatttacccgtggatgaccaaa

SEQ ID NO: 99753 - DNA, 25 bp, Mus musculus
acagatttatcaagggtaaccagct

SEQ ID NO: 99754 - DNA, 25 bp, Mus musculus
acagatttatcatgggtaaccagct

SEQ ID NO: 99755 - DNA, 25 bp, Mus musculus
acagatttatgtcaccatcccctcc

SEQ ID NO: 99756 - DNA, 25 bp, Mus musculus
acagatttatgtgaccatcccctcc

SEQ ID NO: 99757 - DNA, 25 bp, Mus musculus
acagatttccatccgataccttgat

SEQ ID NO: 99758 - DNA, 25 bp, Mus musculus
acagatttccatgcgataccttgat

SEQ ID NO: 99759 - DNA, 25 bp, Mus musculus
acagatttcgggatcaggtatgata

SEQ ID NO: 99760 - DNA, 25 bp, Mus musculus
acagatttcgggttcaggtatgata

SEQ ID NO: 99761 - DNA, 25 bp, Mus musculus
acagatttctggaattctgggtttc

SEQ ID NO: 99762 - DNA, 25 bp, Mus musculus
acagatttctggtattctgggtttc

SEQ ID NO: 99763 - DNA, 25 bp, Mus musculus
acagatttgaagaaacgttcttatt

SEQ ID NO: 99764 - DNA, 25 bp, Mus musculus
acagatttgaagtaacgttcttatt

SEQ ID NO: 99765 - DNA, 25 bp, Mus musculus
acagatttgtgaactcagccaagca

SEQ ID NO: 99766 - DNA, 25 bp, Mus musculus
acagatttgtgatctcagccaagca

SEQ ID NO: 99767 - DNA, 25 bp, Mus musculus
acagattttccccaaaggatgccac

SEQ ID NO: 99768 - DNA, 25 bp, Mus musculus
acagattttcccgaaaggatgccac

SEQ ID NO: 99769 - DNA, 25 bp, Mus musculus
acagatttttcaaggtagcttttga

SEQ ID NO: 99770 - DNA, 25 bp, Mus musculus
acagatttttcatggtagcttttga

SEQ ID NO: 99771 - DNA, 25 bp, Mus musculus
acagatttttgtaatgcatccaaca

SEQ ID NO: 99772 - DNA, 25 bp, Mus musculus
acagatttttgttatgcatccaaca

SEQ ID NO: 99773 - DNA, 25 bp, Mus musculus
acagcaaaagccagctcggcccatg

SEQ ID NO: 99774 - DNA, 25 bp, Mus musculus
acagcaaaagcctgctcggcccatg

SEQ ID NO: 99775 - DNA, 25 bp, Mus musculus
acagcaaaagctcggcggccatgag

SEQ ID NO: 99776 - DNA, 25 bp, Mus musculus
acagcaaaagctgggcggccatgag

SEQ ID NO: 99777 - DNA, 25 bp, Mus musculus
acagcaaactcgagtctgtctgttc

SEQ ID NO: 99778 - DNA, 25 bp, Mus musculus
acagcaaactcgtgtctgtctgttc

SEQ ID NO: 99779 - DNA, 25 bp, Mus musculus
acagcaaagtagaggcctggaagaa

SEQ ID NO: 99780 - DNA, 25 bp, Mus musculus
acagcaaagtagtggcctggaagaa

SEQ ID NO: 99781 - DNA, 25 bp, Mus musculus
acagcaaataccctaagccaagttt

SEQ ID NO: 99782 - DNA, 25 bp, Mus musculus
acagcaaataccgtaagccaagttt

SEQ ID NO: 99783 - DNA, 25 bp, Mus musculus
acagcaaatcgcatctccggtggat

SEQ ID NO: 99784 - DNA, 25 bp, Mus musculus
acagcaaatcgcttctccggtggat

SEQ ID NO: 99785 - DNA, 25 bp, Mus musculus
acagcaaatctgacctatggagaat

SEQ ID NO: 99786 - DNA, 25 bp, Mus musculus
acagcaaatctgtcctatggagaat

SEQ ID NO: 99787 - DNA, 25 bp, Mus musculus
acagcaaatggaattctgtatttat

SEQ ID NO: 99788 - DNA, 25 bp, Mus musculus
acagcaaatggatttctgtatttat

SEQ ID NO: 99789 - DNA, 25 bp, Mus musculus
acagcaaatggtcctttagttttgt

SEQ ID NO: 99790 - DNA, 25 bp, Mus musculus
acagcaaatggtgctttagttttgt

SEQ ID NO: 99791 - DNA, 25 bp, Mus musculus
acagcaacagctccaagattatcag

SEQ ID NO: 99792 - DNA, 25 bp, Mus musculus
acagcaacagctgcaagattatcag

SEQ ID NO: 99793 - DNA, 25 bp, Mus musculus
acagcaacatgtccacacgcatgca

SEQ ID NO: 99794 - DNA, 25 bp, Mus musculus
acagcaacatgtgcacacgcatgca

SEQ ID NO: 99795 - DNA, 25 bp, Mus musculus
acagcaaccgcccattgaggacttt

SEQ ID NO: 99796 - DNA, 25 bp, Mus musculus
acagcaaccgccgattgaggacttt

SEQ ID NO: 99797 - DNA, 25 bp, Mus musculus
acagcaacctcacctattggcggaa

SEQ ID NO: 99798 - DNA, 25 bp, Mus musculus
acagcaacctcagctattggcggaa

SEQ ID NO: 99799 - DNA, 25 bp, Mus musculus
acagcaacctccaacatgtcaggaa

SEQ ID NO: 99800 - DNA, 25 bp, Mus musculus
acagcaacctcctacatgtcaggaa

SEQ ID NO: 99801 - DNA, 25 bp, Mus musculus
acagcaacgagcaggagactggaag

SEQ ID NO: 99802 - DNA, 25 bp, Mus musculus
acagcaacgagctggagactggaag

SEQ ID NO: 99803 - DNA, 25 bp, Mus musculus
acagcaacgtctagaacaggcgctg

SEQ ID NO: 99804 - DNA, 25 bp, Mus musculus
acagcaacgtcttgaacaggcgctg

SEQ ID NO: 99805 - DNA, 25 bp, Mus musculus
acagcaacgtgcacatccagaccat

SEQ ID NO: 99806 - DNA, 25 bp, Mus musculus
acagcaacgtgctcatccagaccat

SEQ ID NO: 99807 - DNA, 25 bp, Mus musculus
acagcaactccgcaaaaagcagcag

SEQ ID NO: 99808 - DNA, 25 bp, Mus musculus
acagcaactccggaaaaagcagcag

SEQ ID NO: 99809 - DNA, 25 bp, Mus musculus
acagcaactggcctggtttattact

SEQ ID NO: 99810 - DNA, 25 bp, Mus musculus
acagcaactggcgtggtttattact

SEQ ID NO: 99811 - DNA, 25 bp, Mus musculus
acagcaactggtctgggtgcttttt

SEQ ID NO: 99812 - DNA, 25 bp, Mus musculus
acagcaactggtgtgggtgcttttt

SEQ ID NO: 99813 - DNA, 25 bp, Mus musculus
acagcaacttccaaaattgtagaga

SEQ ID NO: 99814 - DNA, 25 bp, Mus musculus
acagcaacttcctaaattgtagaga

SEQ ID NO: 99815 - DNA, 25 bp, Mus musculus
acagcaagaaagagtgtctgggcct

SEQ ID NO: 99816 - DNA, 25 bp, Mus musculus
acagcaagaaagtgtgtctgggcct

SEQ ID NO: 99817 - DNA, 25 bp, Mus musculus
acagcaagaagacctttcattcaat

SEQ ID NO: 99818 - DNA, 25 bp, Mus musculus
acagcaagaagagctttcattcaat

SEQ ID NO: 99819 - DNA, 25 bp, Mus musculus
acagcaagaatgatgggatttctat

SEQ ID NO: 99820 - DNA, 25 bp, Mus musculus
acagcaagaatgttgggatttctat

SEQ ID NO: 99821 - DNA, 25 bp, Mus musculus
acagcaagacttctgccaggagtgg

SEQ ID NO: 99822 - DNA, 25 bp, Mus musculus
acagcaagacttgtgccaggagtgg

SEQ ID NO: 99823 - DNA, 25 bp, Mus musculus
acagcaagagctaaggcagtcaaaa

SEQ ID NO: 99824 - DNA, 25 bp, Mus musculus
acagcaagagcttaggcagtcaaaa

SEQ ID NO: 99825 - DNA, 25 bp, Mus musculus
acagcaagcacactgtggcctcgat

SEQ ID NO: 99826 - DNA, 25 bp, Mus musculus
acagcaagcacagtgtggcctcgat

SEQ ID NO: 99827 - DNA, 25 bp, Mus musculus
acagcaagcaggcaccgagcgcaca

SEQ ID NO: 99828 - DNA, 25 bp, Mus musculus
acagcaagcagggaccgagcgcaca

SEQ ID NO: 99829 - DNA, 25 bp, Mus musculus
acagcaagcagtatgcccagacctg

SEQ ID NO: 99830 - DNA, 25 bp, Mus musculus
acagcaagcagtctgaaggccagct

SEQ ID NO: 99831 - DNA, 25 bp, Mus musculus
acagcaagcagtgtgaaggccagct

SEQ ID NO: 99832 - DNA, 25 bp, Mus musculus
acagcaagcagtttgcccagacctg

SEQ ID NO: 99833 - DNA, 25 bp, Mus musculus
acagcaagcatgaatgccacccttg

SEQ ID NO: 99834 - DNA, 25 bp, Mus musculus
acagcaagcatgtatgccacccttg

SEQ ID NO: 99835 - DNA, 25 bp, Mus musculus
acagcaagccatcagatgggtgtgt

SEQ ID NO: 99836 - DNA, 25 bp, Mus musculus
acagcaagccatgagatgggtgtgt

SEQ ID NO: 99837 - DNA, 25 bp, Mus musculus
acagcaagcgcccttatgcactaag

SEQ ID NO: 99838 - DNA, 25 bp, Mus musculus
acagcaagcgccgttatgcactaag

SEQ ID NO: 99839 - DNA, 25 bp, Mus musculus
acagcaagctcaatgtgcagaagag

SEQ ID NO: 99840 - DNA, 25 bp, Mus musculus
acagcaagctcattgtgcagaagag

SEQ ID NO: 99841 - DNA, 25 bp, Mus musculus
acagcaaggcccattatctgtggca

SEQ ID NO: 99842 - DNA, 25 bp, Mus musculus
acagcaaggccctttatctgtggca

SEQ ID NO: 99843 - DNA, 25 bp, Mus musculus
acagcaagggtgacttcgccaagca

SEQ ID NO: 99844 - DNA, 25 bp, Mus musculus
acagcaagggtgtcttcgccaagca

SEQ ID NO: 99845 - DNA, 25 bp, Mus musculus
acagcaagtgacaccaggtgatgtt

SEQ ID NO: 99846 - DNA, 25 bp, Mus musculus
acagcaagtgactccaggtgatgtt

SEQ ID NO: 99847 - DNA, 25 bp, Mus musculus
acagcaagtggccttatgtcttttg

SEQ ID NO: 99848 - DNA, 25 bp, Mus musculus
acagcaagtggcgttatgtcttttg

SEQ ID NO: 99849 - DNA, 25 bp, Mus musculus
acagcaagttgtcggtttaagcgtc

SEQ ID NO: 99850 - DNA, 25 bp, Mus musculus
acagcaagttgtgggtttaagcgtc

SEQ ID NO: 99851 - DNA, 25 bp, Mus musculus
acagcaatactgagttcctcattag

SEQ ID NO: 99852 - DNA, 25 bp, Mus musculus
acagcaatactgtgttcctcattag

SEQ ID NO: 99853 - DNA, 25 bp, Mus musculus
acagcaatataaactggcccttcct

SEQ ID NO: 99854 - DNA, 25 bp, Mus musculus
acagcaatataatctggcccttcct

SEQ ID NO: 99855 - DNA, 25 bp, Mus musculus
acagcaatcaccatagctacgagat

SEQ ID NO: 99856 - DNA, 25 bp, Mus musculus
acagcaatcaccttagctacgagat

SEQ ID NO: 99857 - DNA, 25 bp, Mus musculus
acagcaatcctccttgctttgagtt

SEQ ID NO: 99858 - DNA, 25 bp, Mus musculus
acagcaatcctcgttgctttgagtt

SEQ ID NO: 99859 - DNA, 25 bp, Mus musculus
acagcaatctgcagtgtgacctcct

SEQ ID NO: 99860 - DNA, 25 bp, Mus musculus
acagcaatctgctgtgtgacctcct

SEQ ID NO: 99861 - DNA, 25 bp, Mus musculus
acagcaatgatacgcccagttttct

SEQ ID NO: 99862 - DNA, 25 bp, Mus musculus
acagcaatgataggcccagttttct

SEQ ID NO: 99863 - DNA, 25 bp, Mus musculus
acagcaatggttagatgccactgga

SEQ ID NO: 99864 - DNA, 25 bp, Mus musculus
acagcaatggtttgatgccactgga

SEQ ID NO: 99865 - DNA, 25 bp, Mus musculus
acagcaatgtccattctgcagtttc

SEQ ID NO: 99866 - DNA, 25 bp, Mus musculus
acagcaatgtcctttctgcagtttc

SEQ ID NO: 99867 - DNA, 25 bp, Mus musculus
acagcaatgtggactctaacggaga

SEQ ID NO: 99868 - DNA, 25 bp, Mus musculus
acagcaatgtggctttctcgcctgt

SEQ ID NO: 99869 - DNA, 25 bp, Mus musculus
acagcaatgtgggtttctcgcctgt

SEQ ID NO: 99870 - DNA, 25 bp, Mus musculus
acagcaatgtggtctctaacggaga

SEQ ID NO: 99871 - DNA, 25 bp, Mus musculus
acagcaatgttgctcaggcctgtgt

SEQ ID NO: 99872 - DNA, 25 bp, Mus musculus
acagcaatgttggtcaggcctgtgt

SEQ ID NO: 99873 - DNA, 25 bp, Mus musculus
acagcaattatactccagttccagg

SEQ ID NO: 99874 - DNA, 25 bp, Mus musculus
acagcaattatagtccagttccagg

SEQ ID NO: 99875 - DNA, 25 bp, Mus musculus
acagcaattcctatcgatccaacta

SEQ ID NO: 99876 - DNA, 25 bp, Mus musculus
acagcaattcctttcgatccaacta

SEQ ID NO: 99877 - DNA, 25 bp, Mus musculus
acagcacaagatccgcacattggaa

SEQ ID NO: 99878 - DNA, 25 bp, Mus musculus
acagcacaagatgcgcacattggaa

SEQ ID NO: 99879 - DNA, 25 bp, Mus musculus
acagcacaagcgactgcaagtattg

SEQ ID NO: 99880 - DNA, 25 bp, Mus musculus
acagcacaagcgtctgcaagtattg

SEQ ID NO: 99881 - DNA, 25 bp, Mus musculus
acagcacaatctctgcattaccgag

SEQ ID NO: 99882 - DNA, 25 bp, Mus musculus
acagcacaatctgtgcattaccgag

SEQ ID NO: 99883 - DNA, 25 bp, Mus musculus
acagcacacaggacacacgcgggcc

SEQ ID NO: 99884 - DNA, 25 bp, Mus musculus
acagcacacaggtcacacgcgggcc

SEQ ID NO: 99885 - DNA, 25 bp, Mus musculus
acagcacacagtattacctcgtcag

SEQ ID NO: 99886 - DNA, 25 bp, Mus musculus
acagcacacagttttacctcgtcag

SEQ ID NO: 99887 - DNA, 25 bp, Mus musculus
acagcacacataactgcatacgcat

SEQ ID NO: 99888 - DNA, 25 bp, Mus musculus
acagcacacatatctgcatacgcat

SEQ ID NO: 99889 - DNA, 25 bp, Mus musculus
acagcacacattattcaggcaatga

SEQ ID NO: 99890 - DNA, 25 bp, Mus musculus
acagcacacatttttcaggcaatga

SEQ ID NO: 99891 - DNA, 25 bp, Mus musculus
acagcacacctgaagttgttctgtg

SEQ ID NO: 99892 - DNA, 25 bp, Mus musculus
acagcacacctgtagttgttctgtg

SEQ ID NO: 99893 - DNA, 25 bp, Mus musculus
acagcacaccttattatgctcagga

SEQ ID NO: 99894 - DNA, 25 bp, Mus musculus
acagcacacctttttatgctcagga

SEQ ID NO: 99895 - DNA, 25 bp, Mus musculus
acagcacactgtcgtgccttatgtg

SEQ ID NO: 99896 - DNA, 25 bp, Mus musculus
acagcacactgtggtgccttatgtg

SEQ ID NO: 99897 - DNA, 25 bp, Mus musculus
acagcacagcccaatgcaacctggg

SEQ ID NO: 99898 - DNA, 25 bp, Mus musculus
acagcacagccctatgcaacctggg

SEQ ID NO: 99899 - DNA, 25 bp, Mus musculus
acagcacagcctagagaagtcggag

SEQ ID NO: 99900 - DNA, 25 bp, Mus musculus
acagcacagccttgagaagtcggag

SEQ ID NO: 99901 - DNA, 25 bp, Mus musculus
acagcacagctaacactttacagtc

SEQ ID NO: 99902 - DNA, 25 bp, Mus musculus
acagcacagctatcactttacagtc

SEQ ID NO: 99903 - DNA, 25 bp, Mus musculus
acagcacagtgccttgtactagtgt

SEQ ID NO: 99904 - DNA, 25 bp, Mus musculus
acagcacagtgcgttgtactagtgt

SEQ ID NO: 99905 - DNA, 25 bp, Mus musculus
acagcacatcacagatactctgaag

SEQ ID NO: 99906 - DNA, 25 bp, Mus musculus
acagcacatcactgatactctgaag

SEQ ID NO: 99907 - DNA, 25 bp, Mus musculus
acagcacatcgcattactaacacat

SEQ ID NO: 99908 - DNA, 25 bp, Mus musculus
acagcacatcgctttactaacacat

SEQ ID NO: 99909 - DNA, 25 bp, Mus musculus
acagcacatgccatatattagtaag

SEQ ID NO: 99910 - DNA, 25 bp, Mus musculus
acagcacatgccttatattagtaag

SEQ ID NO: 99911 - DNA, 25 bp, Mus musculus
acagcacatgcgaacattcttcatc

SEQ ID NO: 99912 - DNA, 25 bp, Mus musculus
acagcacatgcgtacattcttcatc

SEQ ID NO: 99913 - DNA, 25 bp, Mus musculus
acagcaccaaaacgagaccccgagg

SEQ ID NO: 99914 - DNA, 25 bp, Mus musculus
acagcaccaaaaggagaccccgagg

SEQ ID NO: 99915 - DNA, 25 bp, Mus musculus
acagcaccagctacttcatcaggga

SEQ ID NO: 99916 - DNA, 25 bp, Mus musculus
acagcaccagcttcttcatcaggga

SEQ ID NO: 99917 - DNA, 25 bp, Mus musculus
acagcaccaggtaccaaatcatcag

SEQ ID NO: 99918 - DNA, 25 bp, Mus musculus
acagcaccaggttccaaatcatcag

SEQ ID NO: 99919 - DNA, 25 bp, Mus musculus
acagcaccatcaacttccaagtgtt

SEQ ID NO: 99920 - DNA, 25 bp, Mus musculus
acagcaccatcatcttccaagtgtt

SEQ ID NO: 99921 - DNA, 25 bp, Mus musculus
acagcaccatcgcgtgcatagtggg

SEQ ID NO: 99922 - DNA, 25 bp, Mus musculus
acagcaccatcgggtgcatagtggg

SEQ ID NO: 99923 - DNA, 25 bp, Mus musculus
acagcaccatgtaagagtcggacct

SEQ ID NO: 99924 - DNA, 25 bp, Mus musculus
acagcaccatgttagagtcggacct

SEQ ID NO: 99925 - DNA, 25 bp, Mus musculus
acagcacccagaactcttctgagaa

SEQ ID NO: 99926 - DNA, 25 bp, Mus musculus
acagcacccagatctcttctgagaa

SEQ ID NO: 99927 - DNA, 25 bp, Mus musculus
acagcaccccaacaattctggagga

SEQ ID NO: 99928 - DNA, 25 bp, Mus musculus
acagcaccccaagaattctggagga

SEQ ID NO: 99929 - DNA, 25 bp, Mus musculus
acagcacccctgagactacattgat

SEQ ID NO: 99930 - DNA, 25 bp, Mus musculus
acagcacccctgtgactacattgat

SEQ ID NO: 99931 - DNA, 25 bp, Mus musculus
acagcacccgggattgttcactggt

SEQ ID NO: 99932 - DNA, 25 bp, Mus musculus
acagcacccgggtttgttcactggt

SEQ ID NO: 99933 - DNA, 25 bp, Mus musculus
acagcaccctgcatagtggtaataa

SEQ ID NO: 99934 - DNA, 25 bp, Mus musculus
acagcaccctgcttagtggtaataa

SEQ ID NO: 99935 - DNA, 25 bp, Mus musculus
acagcaccctggcacgtgagtcttg

SEQ ID NO: 99936 - DNA, 25 bp, Mus musculus
acagcaccctgggacgtgagtcttg

SEQ ID NO: 99937 - DNA, 25 bp, Mus musculus
acagcaccgataccaagtctgtggt

SEQ ID NO: 99938 - DNA, 25 bp, Mus musculus
acagcaccgatagcaagtctgtggt

SEQ ID NO: 99939 - DNA, 25 bp, Mus musculus
acagcaccgattctgatgtggccca

SEQ ID NO: 99940 - DNA, 25 bp, Mus musculus
acagcaccgattgtgatgtggccca

SEQ ID NO: 99941 - DNA, 25 bp, Mus musculus
acagcacctactaggccctgagata

SEQ ID NO: 99942 - DNA, 25 bp, Mus musculus
acagcacctacttggccctgagata

SEQ ID NO: 99943 - DNA, 25 bp, Mus musculus
acagcacctcctcccatgattagac

SEQ ID NO: 99944 - DNA, 25 bp, Mus musculus
acagcacctcctgccatgattagac

SEQ ID NO: 99945 - DNA, 25 bp, Mus musculus
acagcacctctgaaagccactggtt

SEQ ID NO: 99946 - DNA, 25 bp, Mus musculus
acagcacctctgatgacattggact

SEQ ID NO: 99947 - DNA, 25 bp, Mus musculus
acagcacctctgtaagccactggtt

SEQ ID NO: 99948 - DNA, 25 bp, Mus musculus
acagcacctctgttgacattggact

SEQ ID NO: 99949 - DNA, 25 bp, Mus musculus
acagcacctggcacgctatgtggag

SEQ ID NO: 99950 - DNA, 25 bp, Mus musculus
acagcacctggctcgctatgtggag

SEQ ID NO: 99951 - DNA, 25 bp, Mus musculus
acagcacgactgagagtcatggaca

SEQ ID NO: 99952 - DNA, 25 bp, Mus musculus
acagcacgactgtgagtcatggaca

SEQ ID NO: 99953 - DNA, 25 bp, Mus musculus
acagcacgctgtattcatgtgtcat

SEQ ID NO: 99954 - DNA, 25 bp, Mus musculus
acagcacgctgttttcatgtgtcat

SEQ ID NO: 99955 - DNA, 25 bp, Mus musculus
acagcacggctaaggtttcccgata

SEQ ID NO: 99956 - DNA, 25 bp, Mus musculus
acagcacggctatggtttcccgata

SEQ ID NO: 99957 - DNA, 25 bp, Mus musculus
acagcacgggaaccaacagctcctt

SEQ ID NO: 99958 - DNA, 25 bp, Mus musculus
acagcacgggaagcaacagctcctt

SEQ ID NO: 99959 - DNA, 25 bp, Mus musculus
acagcacggtagagggacagctcct

SEQ ID NO: 99960 - DNA, 25 bp, Mus musculus
acagcacggtagtgggacagctcct

SEQ ID NO: 99961 - DNA, 25 bp, Mus musculus
acagcacgtgatattgatcattgca

SEQ ID NO: 99962 - DNA, 25 bp, Mus musculus
acagcacgtgattttgatcattgca

SEQ ID NO: 99963 - DNA, 25 bp, Mus musculus
acagcacgtggaatctgtgggcaca

SEQ ID NO: 99964 - DNA, 25 bp, Mus musculus
acagcacgtggattctgtgggcaca

SEQ ID NO: 99965 - DNA, 25 bp, Mus musculus
acagcactaattcctcagccctata

SEQ ID NO: 99966 - DNA, 25 bp, Mus musculus
acagcactaattgctcagccctata

SEQ ID NO: 99967 - DNA, 25 bp, Mus musculus
acagcactaccacgcgtctctctga

SEQ ID NO: 99968 - DNA, 25 bp, Mus musculus
acagcactaccaggcgtctctctga

SEQ ID NO: 99969 - DNA, 25 bp, Mus musculus
acagcactatacaagaaagcctttc

SEQ ID NO: 99970 - DNA, 25 bp, Mus musculus
acagcactatactagaaagcctttc

SEQ ID NO: 99971 - DNA, 25 bp, Mus musculus
acagcactcctcaggacagtcctat

SEQ ID NO: 99972 - DNA, 25 bp, Mus musculus
acagcactcctcatgtgttggcaaa

SEQ ID NO: 99973 - DNA, 25 bp, Mus musculus
acagcactcctctggacagtcctat

SEQ ID NO: 99974 - DNA, 25 bp, Mus musculus
acagcactcctcttgtgttggcaaa

SEQ ID NO: 99975 - DNA, 25 bp, Mus musculus
acagcactccttatcttcatatttg

SEQ ID NO: 99976 - DNA, 25 bp, Mus musculus
acagcactccttttcttcatatttg

SEQ ID NO: 99977 - DNA, 25 bp, Mus musculus
acagcactgagactgatggtcactg

SEQ ID NO: 99978 - DNA, 25 bp, Mus musculus
acagcactgagagtgatggtcactg

SEQ ID NO: 99979 - DNA, 25 bp, Mus musculus
acagcactgaggactcaccaaattt

SEQ ID NO: 99980 - DNA, 25 bp, Mus musculus
acagcactgaggtctcaccaaattt

SEQ ID NO: 99981 - DNA, 25 bp, Mus musculus
acagcactgagtctaaaacccacgt

SEQ ID NO: 99982 - DNA, 25 bp, Mus musculus
acagcactgagtgtaaaacccacgt

SEQ ID NO: 99983 - DNA, 25 bp, Mus musculus
acagcactgatgacatgttggcaat

SEQ ID NO: 99984 - DNA, 25 bp, Mus musculus
acagcactgatgtcatgttggcaat

SEQ ID NO: 99985 - DNA, 25 bp, Mus musculus
acagcactgattataccttgctaag

SEQ ID NO: 99986 - DNA, 25 bp, Mus musculus
acagcactgattttaccttgctaag

SEQ ID NO: 99987 - DNA, 25 bp, Mus musculus
acagcactgctaaaaaggccaggtg

SEQ ID NO: 99988 - DNA, 25 bp, Mus musculus
acagcactgctataaaggccaggtg

SEQ ID NO: 99989 - DNA, 25 bp, Mus musculus
acagcactgctgacttggtcttatc

SEQ ID NO: 99990 - DNA, 25 bp, Mus musculus
acagcactgctgtcttggtcttatc

SEQ ID NO: 99991 - DNA, 25 bp, Mus musculus
acagcactggttcgtgttcccttga

SEQ ID NO: 99992 - DNA, 25 bp, Mus musculus
acagcactggttggtgttcccttga

SEQ ID NO: 99993 - DNA, 25 bp, Mus musculus
acagcactgtggctgctggctccca

SEQ ID NO: 99994 - DNA, 25 bp, Mus musculus
acagcactgtgggtgctggctccca

SEQ ID NO: 99995 - DNA, 25 bp, Mus musculus
acagcactgtgtacatcatggccat

SEQ ID NO: 99996 - DNA, 25 bp, Mus musculus
acagcactgtgtacccagatggtgg

SEQ ID NO: 99997 - DNA, 25 bp, Mus musculus
acagcactgtgttcatcatggccat

SEQ ID NO: 99998 - DNA, 25 bp, Mus musculus
acagcactgtgttcccagatggtgg

SEQ ID NO: 99999 - DNA, 25 bp, Mus musculus
acagcactgttaatctgaacactag

SEQ ID NO: 100000 - DNA, 25 bp, Mus musculus
acagcactgttattctgaacactag

SEQ ID NO: 100001 - DNA, 25 bp, Mus musculus
acagcactgttgaagcttctggcag

SEQ ID NO: 100002 - DNA, 25 bp, Mus musculus
acagcactgttgctcaggaaatcag

SEQ ID NO: 100003 - DNA, 25 bp, Mus musculus
acagcactgttggtcaggaaatcag

SEQ ID NO: 100004 - DNA, 25 bp, Mus musculus
acagcactgttgtagcttctggcag

SEQ ID NO: 100005 - DNA, 25 bp, Mus musculus
acagcacttatacaatgcttctctc

SEQ ID NO: 100006 - DNA, 25 bp, Mus musculus
acagcacttatagaatgcttctctc

SEQ ID NO: 100007 - DNA, 25 bp, Mus musculus
acagcacttcgcacagagtggttgg

SEQ ID NO: 100008 - DNA, 25 bp, Mus musculus
acagcacttcgctcagagtggttgg

SEQ ID NO: 100009 - DNA, 25 bp, Mus musculus
acagcacttgcccagtcctttgtat

SEQ ID NO: 100010 - DNA, 25 bp, Mus musculus
acagcacttgccgagtcctttgtat

SEQ ID NO: 100011 - DNA, 25 bp, Mus musculus
acagcactttgaaagcattctcttc

SEQ ID NO: 100012 - DNA, 25 bp, Mus musculus
acagcactttgatagcattctcttc

SEQ ID NO: 100013 - DNA, 25 bp, Mus musculus
acagcagaacaacgtggaacacaag

SEQ ID NO: 100014 - DNA, 25 bp, Mus musculus
acagcagaacaaggtggaacacaag

SEQ ID NO: 100015 - DNA, 25 bp, Mus musculus
acagcagaagagctcactagatccc

SEQ ID NO: 100016 - DNA, 25 bp, Mus musculus
acagcagaagaggtcactagatccc

SEQ ID NO: 100017 - DNA, 25 bp, Mus musculus
acagcagacaggatctagctgacct

SEQ ID NO: 100018 - DNA, 25 bp, Mus musculus
acagcagacaggttctagctgacct

SEQ ID NO: 100019 - DNA, 25 bp, Mus musculus
acagcagaccctatcagtcatttca

SEQ ID NO: 100020 - DNA, 25 bp, Mus musculus
acagcagaccctttcagtcatttca

SEQ ID NO: 100021 - DNA, 25 bp, Mus musculus
acagcagactttattccagcatttc

SEQ ID NO: 100022 - DNA, 25 bp, Mus musculus
acagcagacttttttccagcatttc

SEQ ID NO: 100023 - DNA, 25 bp, Mus musculus
acagcagagaccaaacatttttcga

SEQ ID NO: 100024 - DNA, 25 bp, Mus musculus
acagcagagacctaacatttttcga

SEQ ID NO: 100025 - DNA, 25 bp, Mus musculus
acagcagagatcatttccacactct

SEQ ID NO: 100026 - DNA, 25 bp, Mus musculus
acagcagagatcttttccacactct

SEQ ID NO: 100027 - DNA, 25 bp, Mus musculus
acagcagagcccagcagactgctta

SEQ ID NO: 100028 - DNA, 25 bp, Mus musculus
acagcagagccctgcagactgctta

SEQ ID NO: 100029 - DNA, 25 bp, Mus musculus
acagcagagcctctggatgcctgta

SEQ ID NO: 100030 - DNA, 25 bp, Mus musculus
acagcagagcctgtggatgcctgta

SEQ ID NO: 100031 - DNA, 25 bp, Mus musculus
acagcagagctacagagagtccaca

SEQ ID NO: 100032 - DNA, 25 bp, Mus musculus
acagcagagctagagagagtccaca

SEQ ID NO: 100033 - DNA, 25 bp, Mus musculus
acagcagagctgctgcttgttaatc

SEQ ID NO: 100034 - DNA, 25 bp, Mus musculus
acagcagagctggtgcttgttaatc

SEQ ID NO: 100035 - DNA, 25 bp, Mus musculus
acagcagaggagagcccctgacatc

SEQ ID NO: 100036 - DNA, 25 bp, Mus musculus
acagcagaggagtgcccctgacatc

SEQ ID NO: 100037 - DNA, 25 bp, Mus musculus
acagcagaggttcaaattcctgttt

SEQ ID NO: 100038 - DNA, 25 bp, Mus musculus
acagcagaggttgaaattcctgttt

SEQ ID NO: 100039 - DNA, 25 bp, Mus musculus
acagcagatcccatagttcctaata

SEQ ID NO: 100040 - DNA, 25 bp, Mus musculus
acagcagatcccttagttcctaata

SEQ ID NO: 100041 - DNA, 25 bp, Mus musculus
acagcagatccgcactcgaagtttc

SEQ ID NO: 100042 - DNA, 25 bp, Mus musculus
acagcagatccggactcgaagtttc

SEQ ID NO: 100043 - DNA, 25 bp, Mus musculus
acagcagatcttaagcagcacaata

SEQ ID NO: 100044 - DNA, 25 bp, Mus musculus
acagcagatctttagcagcacaata

SEQ ID NO: 100045 - DNA, 25 bp, Mus musculus
acagcagatgaccttgtgtgcacca

SEQ ID NO: 100046 - DNA, 25 bp, Mus musculus
acagcagatgacgttgtgtgcacca

SEQ ID NO: 100047 - DNA, 25 bp, Mus musculus
acagcagcaaagaccagaccctggc

SEQ ID NO: 100048 - DNA, 25 bp, Mus musculus
acagcagcaaagtccagaccctggc

SEQ ID NO: 100049 - DNA, 25 bp, Mus musculus
acagcagcaagtatggcatggtgac

SEQ ID NO: 100050 - DNA, 25 bp, Mus musculus
acagcagcaagtttggcatggtgac

SEQ ID NO: 100051 - DNA, 25 bp, Mus musculus
acagcagcactgattctgagggttg

SEQ ID NO: 100052 - DNA, 25 bp, Mus musculus
acagcagcactgtttctgagggttg

SEQ ID NO: 100053 - DNA, 25 bp, Mus musculus
acagcagcagcaacttagtcacagt

SEQ ID NO: 100054 - DNA, 25 bp, Mus musculus
acagcagcagcatcttagtcacagt

SEQ ID NO: 100055 - DNA, 25 bp, Mus musculus
acagcagcagctcgttctgtgacct

SEQ ID NO: 100056 - DNA, 25 bp, Mus musculus
acagcagcagctggttctgtgacct

SEQ ID NO: 100057 - DNA, 25 bp, Mus musculus
acagcagcaggcaaccagcacagtt

SEQ ID NO: 100058 - DNA, 25 bp, Mus musculus
acagcagcaggctaccagcacagtt

SEQ ID NO: 100059 - DNA, 25 bp, Mus musculus
acagcagcatccacagcagagatct

SEQ ID NO: 100060 - DNA, 25 bp, Mus musculus
acagcagcatcctcagcagagatct

SEQ ID NO: 100061 - DNA, 25 bp, Mus musculus
acagcagccaaaatcatcctcaccc

SEQ ID NO: 100062 - DNA, 25 bp, Mus musculus
acagcagccaaattcatcctcaccc

SEQ ID NO: 100063 - DNA, 25 bp, Mus musculus
acagcagcccctagacacctgtgtt

SEQ ID NO: 100064 - DNA, 25 bp, Mus musculus
acagcagccccttgacacctgtgtt

SEQ ID NO: 100065 - DNA, 25 bp, Mus musculus
acagcagccctaaactttggtacca

SEQ ID NO: 100066 - DNA, 25 bp, Mus musculus
acagcagccctatactttggtacca

SEQ ID NO: 100067 - DNA, 25 bp, Mus musculus
acagcagccgtacccacactgaggg

SEQ ID NO: 100068 - DNA, 25 bp, Mus musculus
acagcagccgtagccacactgaggg

SEQ ID NO: 100069 - DNA, 25 bp, Mus musculus
acagcagcctctcgtggcccgagag

SEQ ID NO: 100070 - DNA, 25 bp, Mus musculus
acagcagcctctggtggcccgagag

SEQ ID NO: 100071 - DNA, 25 bp, Mus musculus
acagcagccttaaactacttttagt

SEQ ID NO: 100072 - DNA, 25 bp, Mus musculus
acagcagccttaccataccatggag

SEQ ID NO: 100073 - DNA, 25 bp, Mus musculus
acagcagccttagcataccatggag

SEQ ID NO: 100074 - DNA, 25 bp, Mus musculus
acagcagccttatactacttttagt

SEQ ID NO: 100075 - DNA, 25 bp, Mus musculus
acagcagcgagacgttcaagctcct

SEQ ID NO: 100076 - DNA, 25 bp, Mus musculus
acagcagcgagaggttcaagctcct

SEQ ID NO: 100077 - DNA, 25 bp, Mus musculus
acagcagcgccgcaatgtaattcaa

SEQ ID NO: 100078 - DNA, 25 bp, Mus musculus
acagcagcgccggaatgtaattcaa

SEQ ID NO: 100079 - DNA, 25 bp, Mus musculus
acagcagcggccagtggtgacagta

SEQ ID NO: 100080 - DNA, 25 bp, Mus musculus
acagcagcggcctgtggtgacagta

SEQ ID NO: 100081 - DNA, 25 bp, Mus musculus
acagcagcggtaacaacaacatgat

SEQ ID NO: 100082 - DNA, 25 bp, Mus musculus
acagcagcggtatcaacaacatgat

SEQ ID NO: 100083 - DNA, 25 bp, Mus musculus
acagcagcggttcgtccatcttggg

SEQ ID NO: 100084 - DNA, 25 bp, Mus musculus
acagcagcggttggtccatcttggg

SEQ ID NO: 100085 - DNA, 25 bp, Mus musculus
acagcagcgtggacctagcttcagt

SEQ ID NO: 100086 - DNA, 25 bp, Mus musculus
acagcagcgtggtcctagcttcagt

SEQ ID NO: 100087 - DNA, 25 bp, Mus musculus
acagcagcgtgtacagccaaggact

SEQ ID NO: 100088 - DNA, 25 bp, Mus musculus
acagcagcgtgttcagccaaggact

SEQ ID NO: 100089 - DNA, 25 bp, Mus musculus
acagcagctaccaggccaaggctga

SEQ ID NO: 100090 - DNA, 25 bp, Mus musculus
acagcagctacctggccaaggctga

SEQ ID NO: 100091 - DNA, 25 bp, Mus musculus
acagcagctagaccacagtgataat

SEQ ID NO: 100092 - DNA, 25 bp, Mus musculus
acagcagctagagcacagtgataat

SEQ ID NO: 100093 - DNA, 25 bp, Mus musculus
acagcagctccaattctggtgtttg

SEQ ID NO: 100094 - DNA, 25 bp, Mus musculus
acagcagctccatttctggtgtttg

SEQ ID NO: 100095 - DNA, 25 bp, Mus musculus
acagcagctcgaaacgctaccatat

SEQ ID NO: 100096 - DNA, 25 bp, Mus musculus
acagcagctcgatacgctaccatat

SEQ ID NO: 100097 - DNA, 25 bp, Mus musculus
acagcagctcgcaggagattcgcac

SEQ ID NO: 100098 - DNA, 25 bp, Mus musculus
acagcagctcgctggagattcgcac

SEQ ID NO: 100099 - DNA, 25 bp, Mus musculus
acagcagctctgagactagacggaa

SEQ ID NO: 100100 - DNA, 25 bp, Mus musculus
acagcagctctgcttgtctgcataa

SEQ ID NO: 100101 - DNA, 25 bp, Mus musculus
acagcagctctggttgtctgcataa

SEQ ID NO: 100102 - DNA, 25 bp, Mus musculus
acagcagctctgtgactagacggaa

SEQ ID NO: 100103 - DNA, 25 bp, Mus musculus
acagcagctgacagtacacgcctga

SEQ ID NO: 100104 - DNA, 25 bp, Mus musculus
acagcagctgactgtacacgcctga

SEQ ID NO: 100105 - DNA, 25 bp, Mus musculus
acagcagctgcactagacggagcgt

SEQ ID NO: 100106 - DNA, 25 bp, Mus musculus
acagcagctgcagtagacggagcgt

SEQ ID NO: 100107 - DNA, 25 bp, Mus musculus
acagcagctggacgcctctgaaaca

SEQ ID NO: 100108 - DNA, 25 bp, Mus musculus
acagcagctggaggcctctgaaaca

SEQ ID NO: 100109 - DNA, 25 bp, Mus musculus
acagcagctgggagcctattgagta

SEQ ID NO: 100110 - DNA, 25 bp, Mus musculus
acagcagctgggtgcctattgagta

SEQ ID NO: 100111 - DNA, 25 bp, Mus musculus
acagcagctgtaacgtgaggtccca

SEQ ID NO: 100112 - DNA, 25 bp, Mus musculus
acagcagctgtacttagtcgcacaa

SEQ ID NO: 100113 - DNA, 25 bp, Mus musculus
acagcagctgtagttagtcgcacaa

SEQ ID NO: 100114 - DNA, 25 bp, Mus musculus
acagcagctgtatcgtgaggtccca

SEQ ID NO: 100115 - DNA, 25 bp, Mus musculus
acagcagcttcacttgtgtgccaac

SEQ ID NO: 100116 - DNA, 25 bp, Mus musculus
acagcagcttcagttgtgtgccaac

SEQ ID NO: 100117 - DNA, 25 bp, Mus musculus
acagcagcttgcaatgttgtatgaa

SEQ ID NO: 100118 - DNA, 25 bp, Mus musculus
acagcagcttgctatgttgtatgaa

SEQ ID NO: 100119 - DNA, 25 bp, Mus musculus
acagcagctttgaatgagtgaacta

SEQ ID NO: 100120 - DNA, 25 bp, Mus musculus
acagcagctttgaccttggctacaa

SEQ ID NO: 100121 - DNA, 25 bp, Mus musculus
acagcagctttgtatgagtgaacta

SEQ ID NO: 100122 - DNA, 25 bp, Mus musculus
acagcagctttgtccttggctacaa

SEQ ID NO: 100123 - DNA, 25 bp, Mus musculus
acagcaggacccagagtcagcttct

SEQ ID NO: 100124 - DNA, 25 bp, Mus musculus
acagcaggaccctgagtcagcttct

SEQ ID NO: 100125 - DNA, 25 bp, Mus musculus
acagcaggactcatcaacggcaggc

SEQ ID NO: 100126 - DNA, 25 bp, Mus musculus
acagcaggactcttcaacggcaggc

SEQ ID NO: 100127 - DNA, 25 bp, Mus musculus
acagcaggaggcatcccatcacagc

SEQ ID NO: 100128 - DNA, 25 bp, Mus musculus
acagcaggaggcttcccatcacagc

SEQ ID NO: 100129 - DNA, 25 bp, Mus musculus
acagcaggagggaccagaggcacct

SEQ ID NO: 100130 - DNA, 25 bp, Mus musculus
acagcaggagggtccagaggcacct

SEQ ID NO: 100131 - DNA, 25 bp, Mus musculus
acagcaggaggtatgcccagaaagt

SEQ ID NO: 100132 - DNA, 25 bp, Mus musculus
acagcaggaggtttgcccagaaagt

SEQ ID NO: 100133 - DNA, 25 bp, Mus musculus
acagcaggatgcatgctcaatctgc

SEQ ID NO: 100134 - DNA, 25 bp, Mus musculus
acagcaggatgcttgctcaatctgc

SEQ ID NO: 100135 - DNA, 25 bp, Mus musculus
acagcaggcaccactgatgcaggag

SEQ ID NO: 100136 - DNA, 25 bp, Mus musculus
acagcaggcacctctgatgcaggag

SEQ ID NO: 100137 - DNA, 25 bp, Mus musculus
acagcaggcactcactactcaggag

SEQ ID NO: 100138 - DNA, 25 bp, Mus musculus
acagcaggcactcgttcagaagcgc

SEQ ID NO: 100139 - DNA, 25 bp, Mus musculus
acagcaggcactgactactcaggag

SEQ ID NO: 100140 - DNA, 25 bp, Mus musculus
acagcaggcactggttcagaagcgc

SEQ ID NO: 100141 - DNA, 25 bp, Mus musculus
acagcaggctaaacaggaggcccga

SEQ ID NO: 100142 - DNA, 25 bp, Mus musculus
acagcaggctaatcaggaggcccga

SEQ ID NO: 100143 - DNA, 25 bp, Mus musculus
acagcaggctccaactctatcttgg

SEQ ID NO: 100144 - DNA, 25 bp, Mus musculus
acagcaggctcctactctatcttgg

SEQ ID NO: 100145 - DNA, 25 bp, Mus musculus
acagcagggactaccccaattcagt

SEQ ID NO: 100146 - DNA, 25 bp, Mus musculus
acagcagggactcagacctttctct

SEQ ID NO: 100147 - DNA, 25 bp, Mus musculus
acagcagggactgagacctttctct

SEQ ID NO: 100148 - DNA, 25 bp, Mus musculus
acagcagggacttccccaattcagt

SEQ ID NO: 100149 - DNA, 25 bp, Mus musculus
acagcagggcggcactacggactac

SEQ ID NO: 100150 - DNA, 25 bp, Mus musculus
acagcagggcggctaggacctccac

SEQ ID NO: 100151 - DNA, 25 bp, Mus musculus
acagcagggcgggactacggactac

SEQ ID NO: 100152 - DNA, 25 bp, Mus musculus
acagcagggcgggtaggacctccac

SEQ ID NO: 100153 - DNA, 25 bp, Mus musculus
acagcagggtacatcccaggtatat

SEQ ID NO: 100154 - DNA, 25 bp, Mus musculus
acagcagggtacttcccaggtatat

SEQ ID NO: 100155 - DNA, 25 bp, Mus musculus
acagcagggtatacctgactctctc

SEQ ID NO: 100156 - DNA, 25 bp, Mus musculus
acagcagggtattcctgactctctc

SEQ ID NO: 100157 - DNA, 25 bp, Mus musculus
acagcagggtggactggaagctcat

SEQ ID NO: 100158 - DNA, 25 bp, Mus musculus
acagcagggtggtctggaagctcat

SEQ ID NO: 100159 - DNA, 25 bp, Mus musculus
acagcaggtaagagagctgcagctg

SEQ ID NO: 100160 - DNA, 25 bp, Mus musculus
acagcaggtaagtgagctgcagctg

SEQ ID NO: 100161 - DNA, 25 bp, Mus musculus
acagcaggtatgatgcaagatctca

SEQ ID NO: 100162 - DNA, 25 bp, Mus musculus
acagcaggtatgttgcaagatctca

SEQ ID NO: 100163 - DNA, 25 bp, Mus musculus
acagcaggtccgcatagtcctagtt

SEQ ID NO: 100164 - DNA, 25 bp, Mus musculus
acagcaggtccggatagtcctagtt

SEQ ID NO: 100165 - DNA, 25 bp, Mus musculus
acagcaggtctcatggccctgaaaa

SEQ ID NO: 100166 - DNA, 25 bp, Mus musculus
acagcaggtctcttggccctgaaaa

SEQ ID NO: 100167 - DNA, 25 bp, Mus musculus
acagcaggtgatctaccactatgat

SEQ ID NO: 100168 - DNA, 25 bp, Mus musculus
acagcaggtgatgtaccactatgat

SEQ ID NO: 100169 - DNA, 25 bp, Mus musculus
acagcagtaccgctaagtctcccaa

SEQ ID NO: 100170 - DNA, 25 bp, Mus musculus
acagcagtaccggtaagtctcccaa

SEQ ID NO: 100171 - DNA, 25 bp, Mus musculus
acagcagtcataccaacaggagtct

SEQ ID NO: 100172 - DNA, 25 bp, Mus musculus
acagcagtcatagcaacaggagtct

SEQ ID NO: 100173 - DNA, 25 bp, Mus musculus
acagcagtcatgacgggccgcacag

SEQ ID NO: 100174 - DNA, 25 bp, Mus musculus
acagcagtcatgtcgggccgcacag

SEQ ID NO: 100175 - DNA, 25 bp, Mus musculus
acagcagtccccaagtatgtgagac

SEQ ID NO: 100176 - DNA, 25 bp, Mus musculus
acagcagtcccctagtatgtgagac

SEQ ID NO: 100177 - DNA, 25 bp, Mus musculus
acagcagtcctacaagtccttggtg

SEQ ID NO: 100178 - DNA, 25 bp, Mus musculus
acagcagtcctagaagtccttggtg

SEQ ID NO: 100179 - DNA, 25 bp, Mus musculus
acagcagtctgacattgacttgcca

SEQ ID NO: 100180 - DNA, 25 bp, Mus musculus
acagcagtctgagattgacttgcca

SEQ ID NO: 100181 - DNA, 25 bp, Mus musculus
acagcagtgctgagaggaggactta

SEQ ID NO: 100182 - DNA, 25 bp, Mus musculus
acagcagtgctgaggacctggactc

SEQ ID NO: 100183 - DNA, 25 bp, Mus musculus
acagcagtgctgtgaggaggactta

SEQ ID NO: 100184 - DNA, 25 bp, Mus musculus
acagcagtgctgtggacctggactc

SEQ ID NO: 100185 - DNA, 25 bp, Mus musculus
acagcagtgcttataatctcttccc

SEQ ID NO: 100186 - DNA, 25 bp, Mus musculus
acagcagtgcttcacatactagtat

SEQ ID NO: 100187 - DNA, 25 bp, Mus musculus
acagcagtgcttgacatactagtat

SEQ ID NO: 100188 - DNA, 25 bp, Mus musculus
acagcagtgcttttaatctcttccc

SEQ ID NO: 100189 - DNA, 25 bp, Mus musculus
acagcagtggtgatgtgacctagca

SEQ ID NO: 100190 - DNA, 25 bp, Mus musculus
acagcagtggtgttgtgacctagca

SEQ ID NO: 100191 - DNA, 25 bp, Mus musculus
acagcagtgtctatgactcaatcag

SEQ ID NO: 100192 - DNA, 25 bp, Mus musculus
acagcagtgtctttgactcaatcag

SEQ ID NO: 100193 - DNA, 25 bp, Mus musculus
acagcagtgttgagtcccttgccca

SEQ ID NO: 100194 - DNA, 25 bp, Mus musculus
acagcagtgttgtgtcccttgccca

SEQ ID NO: 100195 - DNA, 25 bp, Mus musculus
acagcagttagtatccttgttatga

SEQ ID NO: 100196 - DNA, 25 bp, Mus musculus
acagcagttagtttccttgttatga

SEQ ID NO: 100197 - DNA, 25 bp, Mus musculus
acagcagttcacactgaggctcact

SEQ ID NO: 100198 - DNA, 25 bp, Mus musculus
acagcagttcactctgaggctcact

SEQ ID NO: 100199 - DNA, 25 bp, Mus musculus
acagcagttgcactacagacagtct

SEQ ID NO: 100200 - DNA, 25 bp, Mus musculus
acagcagttgcagtacagacagtct

SEQ ID NO: 100201 - DNA, 25 bp, Mus musculus
acagcagttgttcgacctgttttca

SEQ ID NO: 100202 - DNA, 25 bp, Mus musculus
acagcagttgttggacctgttttca

SEQ ID NO: 100203 - DNA, 25 bp, Mus musculus
acagcagttttccagtcttattact

SEQ ID NO: 100204 - DNA, 25 bp, Mus musculus
acagcagttttcgagtcttattact

SEQ ID NO: 100205 - DNA, 25 bp, Mus musculus
acagcatacccgaagccaaggcttt

SEQ ID NO: 100206 - DNA, 25 bp, Mus musculus
acagcatacccgtagccaaggcttt

SEQ ID NO: 100207 - DNA, 25 bp, Mus musculus
acagcatacctgactagaccttagt

SEQ ID NO: 100208 - DNA, 25 bp, Mus musculus
acagcatacctgtctagaccttagt

SEQ ID NO: 100209 - DNA, 25 bp, Mus musculus
acagcataccttcttcctctatgtg

SEQ ID NO: 100210 - DNA, 25 bp, Mus musculus
acagcataccttgttcctctatgtg

SEQ ID NO: 100211 - DNA, 25 bp, Mus musculus
acagcatagtacagctatctgagct

SEQ ID NO: 100212 - DNA, 25 bp, Mus musculus
acagcatagtactgctatctgagct

SEQ ID NO: 100213 - DNA, 25 bp, Mus musculus
acagcatagtataggcagggctcta

SEQ ID NO: 100214 - DNA, 25 bp, Mus musculus
acagcatagtatcgttctcatgaaa

SEQ ID NO: 100215 - DNA, 25 bp, Mus musculus
acagcatagtatggttctcatgaaa

SEQ ID NO: 100216 - DNA, 25 bp, Mus musculus
acagcatagtattggcagggctcta

SEQ ID NO: 100217 - DNA, 25 bp, Mus musculus
acagcatagtgcaagtctcctttat

SEQ ID NO: 100218 - DNA, 25 bp, Mus musculus
acagcatagtgctagtctcctttat

SEQ ID NO: 100219 - DNA, 25 bp, Mus musculus
acagcatatcagaccacttgacagg

SEQ ID NO: 100220 - DNA, 25 bp, Mus musculus
acagcatatcagtccacttgacagg

SEQ ID NO: 100221 - DNA, 25 bp, Mus musculus
acagcatcaaagagggcttctcctt

SEQ ID NO: 100222 - DNA, 25 bp, Mus musculus
acagcatcaaagtgggcttctcctt

SEQ ID NO: 100223 - DNA, 25 bp, Mus musculus
acagcatcacaactccctactgggt

SEQ ID NO: 100224 - DNA, 25 bp, Mus musculus
acagcatcacaagtccctactgggt

SEQ ID NO: 100225 - DNA, 25 bp, Mus musculus
acagcatcacagcttcacagagtga

SEQ ID NO: 100226 - DNA, 25 bp, Mus musculus
acagcatcacagcttgttttggact

SEQ ID NO: 100227 - DNA, 25 bp, Mus musculus
acagcatcacaggttcacagagtga

SEQ ID NO: 100228 - DNA, 25 bp, Mus musculus
acagcatcacaggttgttttggact

SEQ ID NO: 100229 - DNA, 25 bp, Mus musculus
acagcatcaccactgacgttcttca

SEQ ID NO: 100230 - DNA, 25 bp, Mus musculus
acagcatcaccagtgacgttcttca

SEQ ID NO: 100231 - DNA, 25 bp, Mus musculus
acagcatcagacagtttagtcgttt

SEQ ID NO: 100232 - DNA, 25 bp, Mus musculus
acagcatcagactgtttagtcgttt

SEQ ID NO: 100233 - DNA, 25 bp, Mus musculus
acagcatcagatccctattcacttt

SEQ ID NO: 100234 - DNA, 25 bp, Mus musculus
acagcatcagatgcctattcacttt

SEQ ID NO: 100235 - DNA, 25 bp, Mus musculus
acagcatcatgcagtcctgctggga

SEQ ID NO: 100236 - DNA, 25 bp, Mus musculus
acagcatcatgctgtcctgctggga

SEQ ID NO: 100237 - DNA, 25 bp, Mus musculus
acagcatcattacgaacctccttta

SEQ ID NO: 100238 - DNA, 25 bp, Mus musculus
acagcatcattaggaacctccttta

SEQ ID NO: 100239 - DNA, 25 bp, Mus musculus
acagcatcatttactgattatgtag

SEQ ID NO: 100240 - DNA, 25 bp, Mus musculus
acagcatcattttctgattatgtag

SEQ ID NO: 100241 - DNA, 25 bp, Mus musculus
acagcatccaacatacaatatctcc

SEQ ID NO: 100242 - DNA, 25 bp, Mus musculus
acagcatccaacttacaatatctcc

SEQ ID NO: 100243 - DNA, 25 bp, Mus musculus
acagcatccaatcaaactcaatcac

SEQ ID NO: 100244 - DNA, 25 bp, Mus musculus
acagcatccaatgaaactcaatcac

SEQ ID NO: 100245 - DNA, 25 bp, Mus musculus
acagcatcccctcctgacggatggg

SEQ ID NO: 100246 - DNA, 25 bp, Mus musculus
acagcatcccctgctgacggatggg

SEQ ID NO: 100247 - DNA, 25 bp, Mus musculus
acagcatcctccacaggttttagaa

SEQ ID NO: 100248 - DNA, 25 bp, Mus musculus
acagcatcctcctcaggttttagaa

SEQ ID NO: 100249 - DNA, 25 bp, Mus musculus
acagcatctcacagcatagtgcaag

SEQ ID NO: 100250 - DNA, 25 bp, Mus musculus
acagcatctcactgcatagtgcaag

SEQ ID NO: 100251 - DNA, 25 bp, Mus musculus
acagcatctctcactagtagccgag

SEQ ID NO: 100252 - DNA, 25 bp, Mus musculus
acagcatctctctctagtagccgag

SEQ ID NO: 100253 - DNA, 25 bp, Mus musculus
acagcatctctgacctatgtgaagc

SEQ ID NO: 100254 - DNA, 25 bp, Mus musculus
acagcatctctgtcctatgtgaagc

SEQ ID NO: 100255 - DNA, 25 bp, Mus musculus
acagcatctgaacacaccgggtagt

SEQ ID NO: 100256 - DNA, 25 bp, Mus musculus
acagcatctgaagacaccgggtagt

SEQ ID NO: 100257 - DNA, 25 bp, Mus musculus
acagcatctgctcaaagtccaagag

SEQ ID NO: 100258 - DNA, 25 bp, Mus musculus
acagcatctgctgaaagtccaagag

SEQ ID NO: 100259 - DNA, 25 bp, Mus musculus
acagcatgcacacagtccttgtcat

SEQ ID NO: 100260 - DNA, 25 bp, Mus musculus
acagcatgcacagagtccttgtcat

SEQ ID NO: 100261 - DNA, 25 bp, Mus musculus
acagcatgcatgagtactactacat

SEQ ID NO: 100262 - DNA, 25 bp, Mus musculus
acagcatgcatgtgtactactacat

SEQ ID NO: 100263 - DNA, 25 bp, Mus musculus
acagcatgcggacctacaagcacga

SEQ ID NO: 100264 - DNA, 25 bp, Mus musculus
acagcatgcggagctacaagcacga

SEQ ID NO: 100265 - DNA, 25 bp, Mus musculus
acagcatgctcaaaggacctacagg

SEQ ID NO: 100266 - DNA, 25 bp, Mus musculus
acagcatgctcataggacctacagg

SEQ ID NO: 100267 - DNA, 25 bp, Mus musculus
acagcatgcttgatcctgtaactac

SEQ ID NO: 100268 - DNA, 25 bp, Mus musculus
acagcatgcttgttcctgtaactac

SEQ ID NO: 100269 - DNA, 25 bp, Mus musculus
acagcatggactatctttcttgctc

SEQ ID NO: 100270 - DNA, 25 bp, Mus musculus
acagcatggactttctttcttgctc

SEQ ID NO: 100271 - DNA, 25 bp, Mus musculus
acagcatggcccctggaaatcaaag

SEQ ID NO: 100272 - DNA, 25 bp, Mus musculus
acagcatggcccgtggaaatcaaag

SEQ ID NO: 100273 - DNA, 25 bp, Mus musculus
acagcatggctcacagtcacatctc

SEQ ID NO: 100274 - DNA, 25 bp, Mus musculus
acagcatggctctcagtcacatctc

SEQ ID NO: 100275 - DNA, 25 bp, Mus musculus
acagcatggcttcggttgtggacct

SEQ ID NO: 100276 - DNA, 25 bp, Mus musculus
acagcatggcttgggttgtggacct

SEQ ID NO: 100277 - DNA, 25 bp, Mus musculus
acagcatgggtgagcgactgcccga

SEQ ID NO: 100278 - DNA, 25 bp, Mus musculus
acagcatgggtgtgcgactgcccga

SEQ ID NO: 100279 - DNA, 25 bp, Mus musculus
acagcatgtaacaccagttctcagg

SEQ ID NO: 100280 - DNA, 25 bp, Mus musculus
acagcatgtaactccagttctcagg

SEQ ID NO: 100281 - DNA, 25 bp, Mus musculus
acagcatgtatcacactgcagacaa

SEQ ID NO: 100282 - DNA, 25 bp, Mus musculus
acagcatgtatctcactgcagacaa

SEQ ID NO: 100283 - DNA, 25 bp, Mus musculus
acagcatgtctgagggcaacttgga

SEQ ID NO: 100284 - DNA, 25 bp, Mus musculus
acagcatgtctgtgggcaacttgga

SEQ ID NO: 100285 - DNA, 25 bp, Mus musculus
acagcatgtgccagcctcttgagac

SEQ ID NO: 100286 - DNA, 25 bp, Mus musculus
acagcatgtgcctgcctcttgagac

SEQ ID NO: 100287 - DNA, 25 bp, Mus musculus
acagcatgttcactacactgaccgc

SEQ ID NO: 100288 - DNA, 25 bp, Mus musculus
acagcatgttcagtacactgaccgc

SEQ ID NO: 100289 - DNA, 25 bp, Mus musculus
acagcatgttggcttttcaacctcc

SEQ ID NO: 100290 - DNA, 25 bp, Mus musculus
acagcatgttgggttttcaacctcc

SEQ ID NO: 100291 - DNA, 25 bp, Mus musculus
acagcattactgatgtcaccagttg

SEQ ID NO: 100292 - DNA, 25 bp, Mus musculus
acagcattactgttgtcaccagttg

SEQ ID NO: 100293 - DNA, 25 bp, Mus musculus
acagcattatctcttctttcttcaa

SEQ ID NO: 100294 - DNA, 25 bp, Mus musculus
acagcattatctgttctttcttcaa

SEQ ID NO: 100295 - DNA, 25 bp, Mus musculus
acagcattatggcagcagctaggtg

SEQ ID NO: 100296 - DNA, 25 bp, Mus musculus
acagcattatgggagcagctaggtg

SEQ ID NO: 100297 - DNA, 25 bp, Mus musculus
acagcattccagctatgatcatgtt

SEQ ID NO: 100298 - DNA, 25 bp, Mus musculus
acagcattccaggtatgatcatgtt

SEQ ID NO: 100299 - DNA, 25 bp, Mus musculus
acagcattcgcacgcctctacgtgg

SEQ ID NO: 100300 - DNA, 25 bp, Mus musculus
acagcattcgcaggcctctacgtgg

SEQ ID NO: 100301 - DNA, 25 bp, Mus musculus
acagcattcggccaagaagcaatcc

SEQ ID NO: 100302 - DNA, 25 bp, Mus musculus
acagcattcggcgaagaagcaatcc

SEQ ID NO: 100303 - DNA, 25 bp, Mus musculus
acagcattctgcacgggatcatggg

SEQ ID NO: 100304 - DNA, 25 bp, Mus musculus
acagcattctgctcgggatcatggg

SEQ ID NO: 100305 - DNA, 25 bp, Mus musculus
acagcattgatcacttacctgacaa

SEQ ID NO: 100306 - DNA, 25 bp, Mus musculus
acagcattgatctcttacctgacaa

SEQ ID NO: 100307 - DNA, 25 bp, Mus musculus
acagcattgctgacacacaggacta

SEQ ID NO: 100308 - DNA, 25 bp, Mus musculus
acagcattgctgtcacacaggacta

SEQ ID NO: 100309 - DNA, 25 bp, Mus musculus
acagcattgcttcttgtcacagaag

SEQ ID NO: 100310 - DNA, 25 bp, Mus musculus
acagcattgcttgttgtcacagaag

SEQ ID NO: 100311 - DNA, 25 bp, Mus musculus
acagcattggtgacggatgggcctt

SEQ ID NO: 100312 - DNA, 25 bp, Mus musculus
acagcattggtgtcggatgggcctt

SEQ ID NO: 100313 - DNA, 25 bp, Mus musculus
acagcattgtgtaagttaatgtggc

SEQ ID NO: 100314 - DNA, 25 bp, Mus musculus
acagcattgtgttagttaatgtggc

SEQ ID NO: 100315 - DNA, 25 bp, Mus musculus
acagcattgttgaggtcgtggcctg

SEQ ID NO: 100316 - DNA, 25 bp, Mus musculus
acagcattgttgtggtcgtggcctg

SEQ ID NO: 100317 - DNA, 25 bp, Mus musculus
acagcatttactcctttttcagagg

SEQ ID NO: 100318 - DNA, 25 bp, Mus musculus
acagcatttactgctttttcagagg

SEQ ID NO: 100319 - DNA, 25 bp, Mus musculus
acagcatttagcaccctgagccggt

SEQ ID NO: 100320 - DNA, 25 bp, Mus musculus
acagcatttagctccctgagccggt

SEQ ID NO: 100321 - DNA, 25 bp, Mus musculus
acagcatttcggatggatcagcaca

SEQ ID NO: 100322 - DNA, 25 bp, Mus musculus
acagcatttcggttggatcagcaca

SEQ ID NO: 100323 - DNA, 25 bp, Mus musculus
acagcatttgagaaccaacagcatc

SEQ ID NO: 100324 - DNA, 25 bp, Mus musculus
acagcatttgagtaccaacagcatc

SEQ ID NO: 100325 - DNA, 25 bp, Mus musculus
acagcatttgttctcctggatgtct

SEQ ID NO: 100326 - DNA, 25 bp, Mus musculus
acagcatttgttgtcctggatgtct

SEQ ID NO: 100327 - DNA, 25 bp, Mus musculus
acagcatttttcagagtccacctag

SEQ ID NO: 100328 - DNA, 25 bp, Mus musculus
acagcatttttctgagtccacctag

SEQ ID NO: 100329 - DNA, 25 bp, Mus musculus
acagccaaacttccgtgtatttcgt

SEQ ID NO: 100330 - DNA, 25 bp, Mus musculus
acagccaaacttgcgtgtatttcgt

SEQ ID NO: 100331 - DNA, 25 bp, Mus musculus
acagccaaagtcacaggcacaggca

SEQ ID NO: 100332 - DNA, 25 bp, Mus musculus
acagccaaagtctcaggcacaggca

SEQ ID NO: 100333 - DNA, 25 bp, Mus musculus
acagccaaagttcttacatcgtgtt

SEQ ID NO: 100334 - DNA, 25 bp, Mus musculus
acagccaaagttgttacatcgtgtt

SEQ ID NO: 100335 - DNA, 25 bp, Mus musculus
acagccaaatccaaatctccttaaa

SEQ ID NO: 100336 - DNA, 25 bp, Mus musculus
acagccaaatcctaatctccttaaa

SEQ ID NO: 100337 - DNA, 25 bp, Mus musculus
acagccaacaaactttcagaggttt

SEQ ID NO: 100338 - DNA, 25 bp, Mus musculus
acagccaacaaagtttcagaggttt

SEQ ID NO: 100339 - DNA, 25 bp, Mus musculus
acagccaaccagatttacctctgat

SEQ ID NO: 100340 - DNA, 25 bp, Mus musculus
acagccaaccagttttacctctgat

SEQ ID NO: 100341 - DNA, 25 bp, Mus musculus
acagccaacctcctggatgacgtgg

SEQ ID NO: 100342 - DNA, 25 bp, Mus musculus
acagccaacctcgtggatgacgtgg

SEQ ID NO: 100343 - DNA, 25 bp, Mus musculus
acagccaactcacgacactattcat

SEQ ID NO: 100344 - DNA, 25 bp, Mus musculus
acagccaactcaggacactattcat

SEQ ID NO: 100345 - DNA, 25 bp, Mus musculus
acagccaactgtaaggttttgttgc

SEQ ID NO: 100346 - DNA, 25 bp, Mus musculus
acagccaactgttaggttttgttgc

SEQ ID NO: 100347 - DNA, 25 bp, Mus musculus
acagccaagaacatctcctgacact

SEQ ID NO: 100348 - DNA, 25 bp, Mus musculus
acagccaagaacttctcctgacact

SEQ ID NO: 100349 - DNA, 25 bp, Mus musculus
acagccaagaccacggagagctttt

SEQ ID NO: 100350 - DNA, 25 bp, Mus musculus
acagccaagacctcggagagctttt

SEQ ID NO: 100351 - DNA, 25 bp, Mus musculus
acagccaagctcattgtcgactttt

SEQ ID NO: 100352 - DNA, 25 bp, Mus musculus
acagccaagctctttgtcgactttt

SEQ ID NO: 100353 - DNA, 25 bp, Mus musculus
acagccaagcttactgcatgtgcat

SEQ ID NO: 100354 - DNA, 25 bp, Mus musculus
acagccaagctttctgcatgtgcat

SEQ ID NO: 100355 - DNA, 25 bp, Mus musculus
acagccaaggacagctggccacagg

SEQ ID NO: 100356 - DNA, 25 bp, Mus musculus
acagccaaggactgctggccacagg

SEQ ID NO: 100357 - DNA, 25 bp, Mus musculus
acagccaagtatcgctaatgcctat

SEQ ID NO: 100358 - DNA, 25 bp, Mus musculus
acagccaagtatggctaatgcctat

SEQ ID NO: 100359 - DNA, 25 bp, Mus musculus
acagccaagtcgacctgggccaggt

SEQ ID NO: 100360 - DNA, 25 bp, Mus musculus
acagccaagtcgtcctgggccaggt

SEQ ID NO: 100361 - DNA, 25 bp, Mus musculus
acagccaagtctcctcatctgagtt

SEQ ID NO: 100362 - DNA, 25 bp, Mus musculus
acagccaagtctgctcatctgagtt

SEQ ID NO: 100363 - DNA, 25 bp, Mus musculus
acagccaagtggatatgggtctcat

SEQ ID NO: 100364 - DNA, 25 bp, Mus musculus
acagccaagtggttatgggtctcat

SEQ ID NO: 100365 - DNA, 25 bp, Mus musculus
acagccaatcacagtccggagttag

SEQ ID NO: 100366 - DNA, 25 bp, Mus musculus
acagccaatcactgtccggagttag

SEQ ID NO: 100367 - DNA, 25 bp, Mus musculus
acagccaatcctaggaacaccatcg

SEQ ID NO: 100368 - DNA, 25 bp, Mus musculus
acagccaatccttggaacaccatcg

SEQ ID NO: 100369 - DNA, 25 bp, Mus musculus
acagccaatgagacagaaattcgag

SEQ ID NO: 100370 - DNA, 25 bp, Mus musculus
acagccaatgagagtccatgtgatt

SEQ ID NO: 100371 - DNA, 25 bp, Mus musculus
acagccaatgagtcagaaattcgag

SEQ ID NO: 100372 - DNA, 25 bp, Mus musculus
acagccaatgagtgtccatgtgatt

SEQ ID NO: 100373 - DNA, 25 bp, Mus musculus
acagccacagcacccgagatgcaaa

SEQ ID NO: 100374 - DNA, 25 bp, Mus musculus
acagccacagcagccgagatgcaaa

SEQ ID NO: 100375 - DNA, 25 bp, Mus musculus
acagccacaggcacaggtacaggca

SEQ ID NO: 100376 - DNA, 25 bp, Mus musculus
acagccacaggctcaggtacaggca

SEQ ID NO: 100377 - DNA, 25 bp, Mus musculus
acagccacagggaattctcttcatg

SEQ ID NO: 100378 - DNA, 25 bp, Mus musculus
acagccacagggtattctcttcatg

SEQ ID NO: 100379 - DNA, 25 bp, Mus musculus
acagccacagtaattgccaggtttg

SEQ ID NO: 100380 - DNA, 25 bp, Mus musculus
acagccacagtatttgccaggtttg

SEQ ID NO: 100381 - DNA, 25 bp, Mus musculus
acagccacatagatttcttgagcaa

SEQ ID NO: 100382 - DNA, 25 bp, Mus musculus
acagccacatagttttcttgagcaa

SEQ ID NO: 100383 - DNA, 25 bp, Mus musculus
acagccacattgactggctcacaca

SEQ ID NO: 100384 - DNA, 25 bp, Mus musculus
acagccacattgtctggctcacaca

SEQ ID NO: 100385 - DNA, 25 bp, Mus musculus
acagccaccacacatgacttggact

SEQ ID NO: 100386 - DNA, 25 bp, Mus musculus
acagccaccacagatgacttggact

SEQ ID NO: 100387 - DNA, 25 bp, Mus musculus
acagccaccactattgctatggtag

SEQ ID NO: 100388 - DNA, 25 bp, Mus musculus
acagccaccacttttgctatggtag

SEQ ID NO: 100389 - DNA, 25 bp, Mus musculus
acagccaccatgagcctttgtaaca

SEQ ID NO: 100390 - DNA, 25 bp, Mus musculus
acagccaccatgtgcctttgtaaca

SEQ ID NO: 100391 - DNA, 25 bp, Mus musculus
acagccacctggctaagcggctaga

SEQ ID NO: 100392 - DNA, 25 bp, Mus musculus
acagccacctgggtaagcggctaga

SEQ ID NO: 100393 - DNA, 25 bp, Mus musculus
acagccacctgtaagttcagctcca

SEQ ID NO: 100394 - DNA, 25 bp, Mus musculus
acagccacctgtcccatgagaagtg

SEQ ID NO: 100395 - DNA, 25 bp, Mus musculus
acagccacctgtgccatgagaagtg

SEQ ID NO: 100396 - DNA, 25 bp, Mus musculus
acagccacctgttagttcagctcca

SEQ ID NO: 100397 - DNA, 25 bp, Mus musculus
acagccacgtccagaagtcgagaca

SEQ ID NO: 100398 - DNA, 25 bp, Mus musculus
acagccacgtcctgaagtcgagaca

SEQ ID NO: 100399 - DNA, 25 bp, Mus musculus
acagccactctgcaggagaaacgga

SEQ ID NO: 100400 - DNA, 25 bp, Mus musculus
acagccactctggaggagaaacgga

SEQ ID NO: 100401 - DNA, 25 bp, Mus musculus
acagccactgtgacttttcaggagt

SEQ ID NO: 100402 - DNA, 25 bp, Mus musculus
acagccactgtgtcttttcaggagt

SEQ ID NO: 100403 - DNA, 25 bp, Mus musculus
acagccagactcacaagtgcctttg

SEQ ID NO: 100404 - DNA, 25 bp, Mus musculus
acagccagactctcaagtgcctttg

SEQ ID NO: 100405 - DNA, 25 bp, Mus musculus
acagccagacttcattgagagccat

SEQ ID NO: 100406 - DNA, 25 bp, Mus musculus
acagccagacttgattgagagccat

SEQ ID NO: 100407 - DNA, 25 bp, Mus musculus
acagccagagaaagtcaccccagag

SEQ ID NO: 100408 - DNA, 25 bp, Mus musculus
acagccagagaatgtcaccccagag

SEQ ID NO: 100409 - DNA, 25 bp, Mus musculus
acagccagagttaaaggcgttggat

SEQ ID NO: 100410 - DNA, 25 bp, Mus musculus
acagccagagttcggcctgatgcct

SEQ ID NO: 100411 - DNA, 25 bp, Mus musculus
acagccagagttgggcctgatgcct

SEQ ID NO: 100412 - DNA, 25 bp, Mus musculus
acagccagagtttaaggcgttggat

SEQ ID NO: 100413 - DNA, 25 bp, Mus musculus
acagccagcaagcaccgaaccaaat

SEQ ID NO: 100414 - DNA, 25 bp, Mus musculus
acagccagcaaggaccgaaccaaat

SEQ ID NO: 100415 - DNA, 25 bp, Mus musculus
acagccagcaatccttcagagtctg

SEQ ID NO: 100416 - DNA, 25 bp, Mus musculus
acagccagcaatgcttcagagtctg

SEQ ID NO: 100417 - DNA, 25 bp, Mus musculus
acagccagcaggcatgtgctttctt

SEQ ID NO: 100418 - DNA, 25 bp, Mus musculus
acagccagcagggatgtgctttctt

SEQ ID NO: 100419 - DNA, 25 bp, Mus musculus
acagccagccacagaggattggtca

SEQ ID NO: 100420 - DNA, 25 bp, Mus musculus
acagccagccactgaggattggtca

SEQ ID NO: 100421 - DNA, 25 bp, Mus musculus
acagccagcccacaagtgatgtttt

SEQ ID NO: 100422 - DNA, 25 bp, Mus musculus
acagccagcccagaagtgatgtttt

SEQ ID NO: 100423 - DNA, 25 bp, Mus musculus
acagccagccctcttagccaatgag

SEQ ID NO: 100424 - DNA, 25 bp, Mus musculus
acagccagccctgttagccaatgag

SEQ ID NO: 100425 - DNA, 25 bp, Mus musculus
acagccagcctccaggactgagcaa

SEQ ID NO: 100426 - DNA, 25 bp, Mus musculus
acagccagcctcgaggactgagcaa

SEQ ID NO: 100427 - DNA, 25 bp, Mus musculus
acagccagctaactgctactaaaat

SEQ ID NO: 100428 - DNA, 25 bp, Mus musculus
acagccagctaagtgctactaaaat

SEQ ID NO: 100429 - DNA, 25 bp, Mus musculus
acagccagctctcttgtgggcggaa

SEQ ID NO: 100430 - DNA, 25 bp, Mus musculus
acagccagctctgttgtgggcggaa

SEQ ID NO: 100431 - DNA, 25 bp, Mus musculus
acagccagctgcatgtttacaaagg

SEQ ID NO: 100432 - DNA, 25 bp, Mus musculus
acagccagctgcttgtttacaaagg

SEQ ID NO: 100433 - DNA, 25 bp, Mus musculus
acagccagctggctgatgatgacct

SEQ ID NO: 100434 - DNA, 25 bp, Mus musculus
acagccagctgggtgatgatgacct

SEQ ID NO: 100435 - DNA, 25 bp, Mus musculus
acagccagcttcacgctggcagaag

SEQ ID NO: 100436 - DNA, 25 bp, Mus musculus
acagccagcttctcgctggcagaag

SEQ ID NO: 100437 - DNA, 25 bp, Mus musculus
acagccagggtaaggaccagagtga

SEQ ID NO: 100438 - DNA, 25 bp, Mus musculus
acagccagggtatggaccagagtga

SEQ ID NO: 100439 - DNA, 25 bp, Mus musculus
acagccagtaccaatctgcagagga

SEQ ID NO: 100440 - DNA, 25 bp, Mus musculus
acagccagtacctatctgcagagga

SEQ ID NO: 100441 - DNA, 25 bp, Mus musculus
acagccagtatgctatcggtcctgc

SEQ ID NO: 100442 - DNA, 25 bp, Mus musculus
acagccagtatggtatcggtcctgc

SEQ ID NO: 100443 - DNA, 25 bp, Mus musculus
acagccagtgagagatgtcctcatc

SEQ ID NO: 100444 - DNA, 25 bp, Mus musculus
acagccagtgagtgatgtcctcatc

SEQ ID NO: 100445 - DNA, 25 bp, Mus musculus
acagccagtgctaataaccaccgag

SEQ ID NO: 100446 - DNA, 25 bp, Mus musculus
acagccagtgcttataaccaccgag

SEQ ID NO: 100447 - DNA, 25 bp, Mus musculus
acagccagtggtacagacaggtttg

SEQ ID NO: 100448 - DNA, 25 bp, Mus musculus
acagccagtggttcagacaggtttg

SEQ ID NO: 100449 - DNA, 25 bp, Mus musculus
acagccagtgttagtcttcatgcgt

SEQ ID NO: 100450 - DNA, 25 bp, Mus musculus
acagccagtgtttgtcttcatgcgt

SEQ ID NO: 100451 - DNA, 25 bp, Mus musculus
acagccagttagactacagcagcat

SEQ ID NO: 100452 - DNA, 25 bp, Mus musculus
acagccagttagtctacagcagcat

SEQ ID NO: 100453 - DNA, 25 bp, Mus musculus
acagccataaaacacccaaatggca

SEQ ID NO: 100454 - DNA, 25 bp, Mus musculus
acagccataaaagacccaaatggca

SEQ ID NO: 100455 - DNA, 25 bp, Mus musculus
acagccataaccatagccaccatag

SEQ ID NO: 100456 - DNA, 25 bp, Mus musculus
acagccataaccattacttgccatt

SEQ ID NO: 100457 - DNA, 25 bp, Mus musculus
acagccataaccttagccaccatag

SEQ ID NO: 100458 - DNA, 25 bp, Mus musculus
acagccataacctttacttgccatt

SEQ ID NO: 100459 - DNA, 25 bp, Mus musculus
acagccatacatacggaaagatgag

SEQ ID NO: 100460 - DNA, 25 bp, Mus musculus
acagccatacattcggaaagatgag

SEQ ID NO: 100461 - DNA, 25 bp, Mus musculus
acagccatcttaaaacagttgtgca

SEQ ID NO: 100462 - DNA, 25 bp, Mus musculus
acagccatcttataacagttgtgca

SEQ ID NO: 100463 - DNA, 25 bp, Mus musculus
acagccatcttcctgatcttagtgt

SEQ ID NO: 100464 - DNA, 25 bp, Mus musculus
acagccatcttcgtgatcttagtgt

SEQ ID NO: 100465 - DNA, 25 bp, Mus musculus
acagccatcttgactgtaagcacat

SEQ ID NO: 100466 - DNA, 25 bp, Mus musculus
acagccatcttgtctgtaagcacat

SEQ ID NO: 100467 - DNA, 25 bp, Mus musculus
acagccatctttcgctgtctgtacg

SEQ ID NO: 100468 - DNA, 25 bp, Mus musculus
acagccatctttggctgtctgtacg

SEQ ID NO: 100469 - DNA, 25 bp, Mus musculus
acagccatgattacaacttccacat

SEQ ID NO: 100470 - DNA, 25 bp, Mus musculus
acagccatgatttcaacttccacat

SEQ ID NO: 100471 - DNA, 25 bp, Mus musculus
acagccatgttgaggaagtcggtcc

SEQ ID NO: 100472 - DNA, 25 bp, Mus musculus
acagccatgttgtggaagtcggtcc

SEQ ID NO: 100473 - DNA, 25 bp, Mus musculus
acagccattactcagggccaagtct

SEQ ID NO: 100474 - DNA, 25 bp, Mus musculus
acagccattactgagggccaagtct

SEQ ID NO: 100475 - DNA, 25 bp, Mus musculus
acagccattccacatagacgtccag

SEQ ID NO: 100476 - DNA, 25 bp, Mus musculus
acagccattccagatagacgtccag

SEQ ID NO: 100477 - DNA, 25 bp, Mus musculus
acagccattgaaatcccctacacaa

SEQ ID NO: 100478 - DNA, 25 bp, Mus musculus
acagccattgaattcccctacacaa

SEQ ID NO: 100479 - DNA, 25 bp, Mus musculus
acagccattgttctagagctgctgc

SEQ ID NO: 100480 - DNA, 25 bp, Mus musculus
acagccattgttgtagagctgctgc

SEQ ID NO: 100481 - DNA, 25 bp, Mus musculus
acagcccaaacaaaggtggcgctct

SEQ ID NO: 100482 - DNA, 25 bp, Mus musculus
acagcccaaacataggtggcgctct

SEQ ID NO: 100483 - DNA, 25 bp, Mus musculus
acagcccaagacatagtctcattat

SEQ ID NO: 100484 - DNA, 25 bp, Mus musculus
acagcccaagacttagtctcattat

SEQ ID NO: 100485 - DNA, 25 bp, Mus musculus
acagcccaagctcccagtgataatc

SEQ ID NO: 100486 - DNA, 25 bp, Mus musculus
acagcccaagctgccagtgataatc

SEQ ID NO: 100487 - DNA, 25 bp, Mus musculus
acagcccaaggaaattgcctttgtt

SEQ ID NO: 100488 - DNA, 25 bp, Mus musculus
acagcccaaggatattgcctttgtt

SEQ ID NO: 100489 - DNA, 25 bp, Mus musculus
acagcccacaagactatcagttcag

SEQ ID NO: 100490 - DNA, 25 bp, Mus musculus
acagcccacaagtctatcagttcag

SEQ ID NO: 100491 - DNA, 25 bp, Mus musculus
acagcccacataccatgcaagtttg

SEQ ID NO: 100492 - DNA, 25 bp, Mus musculus
acagcccacatagcatgcaagtttg

SEQ ID NO: 100493 - DNA, 25 bp, Mus musculus
acagcccactagaataatatgagca

SEQ ID NO: 100494 - DNA, 25 bp, Mus musculus
acagcccactagtataatatgagca

SEQ ID NO: 100495 - DNA, 25 bp, Mus musculus
acagcccactcaccgggttagcggg

SEQ ID NO: 100496 - DNA, 25 bp, Mus musculus
acagcccactcagcgggttagcggg

SEQ ID NO: 100497 - DNA, 25 bp, Mus musculus
acagcccagatcagtctcagtggga

SEQ ID NO: 100498 - DNA, 25 bp, Mus musculus
acagcccagatctgtctcagtggga

SEQ ID NO: 100499 - DNA, 25 bp, Mus musculus
acagcccagcaccaacatatttgga

SEQ ID NO: 100500 - DNA, 25 bp, Mus musculus
acagcccagcacgaacatatttgga

SEQ ID NO: 100501 - DNA, 25 bp, Mus musculus
acagcccaggccaattcataattaa

SEQ ID NO: 100502 - DNA, 25 bp, Mus musculus
acagcccaggcctattcataattaa

SEQ ID NO: 100503 - DNA, 25 bp, Mus musculus
acagcccaggctctacagttgtctc

SEQ ID NO: 100504 - DNA, 25 bp, Mus musculus
acagcccaggctgtacagttgtctc

SEQ ID NO: 100505 - DNA, 25 bp, Mus musculus
acagcccaggttagtggtctacagc

SEQ ID NO: 100506 - DNA, 25 bp, Mus musculus
acagcccaggtttgtggtctacagc

SEQ ID NO: 100507 - DNA, 25 bp, Mus musculus
acagcccagtctaacttgtttctct

SEQ ID NO: 100508 - DNA, 25 bp, Mus musculus
acagcccagtcttacttgtttctct

SEQ ID NO: 100509 - DNA, 25 bp, Mus musculus
acagcccagtgtagcctaaggcatg

SEQ ID NO: 100510 - DNA, 25 bp, Mus musculus
acagcccagtgttgcctaaggcatg

SEQ ID NO: 100511 - DNA, 25 bp, Mus musculus
acagcccatggcagagacacataac

SEQ ID NO: 100512 - DNA, 25 bp, Mus musculus
acagcccatggctgagacacataac

SEQ ID NO: 100513 - DNA, 25 bp, Mus musculus
acagccccaaggaccatgttatttt

SEQ ID NO: 100514 - DNA, 25 bp, Mus musculus
acagccccaaggtccatgttatttt

SEQ ID NO: 100515 - DNA, 25 bp, Mus musculus
acagccccaccactagtgtgtgagg

SEQ ID NO: 100516 - DNA, 25 bp, Mus musculus
acagccccaccagtagtgtgtgagg

SEQ ID NO: 100517 - DNA, 25 bp, Mus musculus
acagccccagaaagaaggttacaca

SEQ ID NO: 100518 - DNA, 25 bp, Mus musculus
acagccccagaatgaaggttacaca

SEQ ID NO: 100519 - DNA, 25 bp, Mus musculus
acagccccgaagaatgtcttttgtc

SEQ ID NO: 100520 - DNA, 25 bp, Mus musculus
acagccccgaagtatgtcttttgtc

SEQ ID NO: 100521 - DNA, 25 bp, Mus musculus
acagccccgagaagtcacagtcaat

SEQ ID NO: 100522 - DNA, 25 bp, Mus musculus
acagccccgagatgtcacagtcaat

SEQ ID NO: 100523 - DNA, 25 bp, Mus musculus
acagcccctactcgagaacagttga

SEQ ID NO: 100524 - DNA, 25 bp, Mus musculus
acagcccctactggagaacagttga

SEQ ID NO: 100525 - DNA, 25 bp, Mus musculus
acagcccctctacaggtctggtcta

SEQ ID NO: 100526 - DNA, 25 bp, Mus musculus
acagcccctctagaggtctggtcta

SEQ ID NO: 100527 - DNA, 25 bp, Mus musculus
acagcccctgagatgcgccatgcag

SEQ ID NO: 100528 - DNA, 25 bp, Mus musculus
acagcccctgagttgcgccatgcag

SEQ ID NO: 100529 - DNA, 25 bp, Mus musculus
acagcccctgatcgtgactactgga

SEQ ID NO: 100530 - DNA, 25 bp, Mus musculus
acagcccctgatggtgactactgga

SEQ ID NO: 100531 - DNA, 25 bp, Mus musculus
acagcccggcacaaacaaactgagg

SEQ ID NO: 100532 - DNA, 25 bp, Mus musculus
acagcccggcactaacaaactgagg

SEQ ID NO: 100533 - DNA, 25 bp, Mus musculus
acagcccggcggaaggatgccaagt

SEQ ID NO: 100534 - DNA, 25 bp, Mus musculus
acagcccggcggtaggatgccaagt

SEQ ID NO: 100535 - DNA, 25 bp, Mus musculus
acagcccgggagagtcttatcaagt

SEQ ID NO: 100536 - DNA, 25 bp, Mus musculus
acagcccgggagtgtcttatcaagt

SEQ ID NO: 100537 - DNA, 25 bp, Mus musculus
acagcccgggccagaacagaggttg

SEQ ID NO: 100538 - DNA, 25 bp, Mus musculus
acagcccgggcctgaacagaggttg

SEQ ID NO: 100539 - DNA, 25 bp, Mus musculus
acagcccgtgttatcacagtgatcg

SEQ ID NO: 100540 - DNA, 25 bp, Mus musculus
acagcccgtgttttcacagtgatcg

SEQ ID NO: 100541 - DNA, 25 bp, Mus musculus
acagcccgtttcagcgaactgaggt

SEQ ID NO: 100542 - DNA, 25 bp, Mus musculus
acagcccgtttctgcgaactgaggt

SEQ ID NO: 100543 - DNA, 25 bp, Mus musculus
acagcccgttttctgcgaagtgagg

SEQ ID NO: 100544 - DNA, 25 bp, Mus musculus
acagcccgttttgtgcgaagtgagg

SEQ ID NO: 100545 - DNA, 25 bp, Mus musculus
acagccctaggaaccaaaccaggaa

SEQ ID NO: 100546 - DNA, 25 bp, Mus musculus
acagccctaggatccaaaccaggaa

SEQ ID NO: 100547 - DNA, 25 bp, Mus musculus
acagccctagggaggaaactccttg

SEQ ID NO: 100548 - DNA, 25 bp, Mus musculus
acagccctagggtggaaactccttg

SEQ ID NO: 100549 - DNA, 25 bp, Mus musculus
acagccctatcactcaacagcagtg

SEQ ID NO: 100550 - DNA, 25 bp, Mus musculus
acagccctatcagtcaacagcagtg

SEQ ID NO: 100551 - DNA, 25 bp, Mus musculus
acagccctcaggatgcagggtgctg

SEQ ID NO: 100552 - DNA, 25 bp, Mus musculus
acagccctcaggttgcagggtgctg

SEQ ID NO: 100553 - DNA, 25 bp, Mus musculus
acagccctctgcatcgaaatgtcac

SEQ ID NO: 100554 - DNA, 25 bp, Mus musculus
acagccctctgcttcgaaatgtcac

SEQ ID NO: 100555 - DNA, 25 bp, Mus musculus
acagccctgaagctagtccagtgcc

SEQ ID NO: 100556 - DNA, 25 bp, Mus musculus
acagccctgaaggtagtccagtgcc

SEQ ID NO: 100557 - DNA, 25 bp, Mus musculus
acagccctgaatccaggtgcagttt

SEQ ID NO: 100558 - DNA, 25 bp, Mus musculus
acagccctgaatgcaggtgcagttt

SEQ ID NO: 100559 - DNA, 25 bp, Mus musculus
acagccctgcctatattaagcacaa

SEQ ID NO: 100560 - DNA, 25 bp, Mus musculus
acagccctgcctttattaagcacaa

SEQ ID NO: 100561 - DNA, 25 bp, Mus musculus
acagccctgctgaatcactgggaaa

SEQ ID NO: 100562 - DNA, 25 bp, Mus musculus
acagccctgctgcagattagttatc

SEQ ID NO: 100563 - DNA, 25 bp, Mus musculus
acagccctgctggagattagttatc

SEQ ID NO: 100564 - DNA, 25 bp, Mus musculus
acagccctgctgtatcactgggaaa

SEQ ID NO: 100565 - DNA, 25 bp, Mus musculus
acagccctgcttatactcagatgag

SEQ ID NO: 100566 - DNA, 25 bp, Mus musculus
acagccctgcttttactcagatgag

SEQ ID NO: 100567 - DNA, 25 bp, Mus musculus
acagccctggaaattgaagttttgg

SEQ ID NO: 100568 - DNA, 25 bp, Mus musculus
acagccctggaatttgaagttttgg

SEQ ID NO: 100569 - DNA, 25 bp, Mus musculus
acagccctggcaatggcccgaggat

SEQ ID NO: 100570 - DNA, 25 bp, Mus musculus
acagccctggcattggcccgaggat

SEQ ID NO: 100571 - DNA, 25 bp, Mus musculus
acagccctgtaaatggcttgctgaa

SEQ ID NO: 100572 - DNA, 25 bp, Mus musculus
acagccctgtaattggcttgctgaa

SEQ ID NO: 100573 - DNA, 25 bp, Mus musculus
acagccctgtccaggcaactggaag

SEQ ID NO: 100574 - DNA, 25 bp, Mus musculus
acagccctgtccattggtcagttgg

SEQ ID NO: 100575 - DNA, 25 bp, Mus musculus
acagccctgtcctggcaactggaag

SEQ ID NO: 100576 - DNA, 25 bp, Mus musculus
acagccctgtcctttggtcagttgg

SEQ ID NO: 100577 - DNA, 25 bp, Mus musculus
acagccctgtgaatcttacatggaa

SEQ ID NO: 100578 - DNA, 25 bp, Mus musculus
acagccctgtgattcttacatggaa

SEQ ID NO: 100579 - DNA, 25 bp, Mus musculus
acagcccttcatcagagtcacagac

SEQ ID NO: 100580 - DNA, 25 bp, Mus musculus
acagcccttcatgagagtcacagac

SEQ ID NO: 100581 - DNA, 25 bp, Mus musculus
acagcccttgatcaggccctgaagt

SEQ ID NO: 100582 - DNA, 25 bp, Mus musculus
acagcccttgatgaggccctgaagt

SEQ ID NO: 100583 - DNA, 25 bp, Mus musculus
acagcccttgcaccttgattttaca

SEQ ID NO: 100584 - DNA, 25 bp, Mus musculus
acagcccttgcagcttgattttaca

SEQ ID NO: 100585 - DNA, 25 bp, Mus musculus
acagcccttggcctagcaatgcaca

SEQ ID NO: 100586 - DNA, 25 bp, Mus musculus
acagcccttggcgtagcaatgcaca

SEQ ID NO: 100587 - DNA, 25 bp, Mus musculus
acagcccttttcagcaatctgaggt

SEQ ID NO: 100588 - DNA, 25 bp, Mus musculus
acagcccttttctgcaatctgaggt

SEQ ID NO: 100589 - DNA, 25 bp, Mus musculus
acagccgaaagcatgcaggccagca

SEQ ID NO: 100590 - DNA, 25 bp, Mus musculus
acagccgaaagcttgcaggccagca

SEQ ID NO: 100591 - DNA, 25 bp, Mus musculus
acagccgaagcaaatcccagtctca

SEQ ID NO: 100592 - DNA, 25 bp, Mus musculus
acagccgaagcatatcccagtctca

SEQ ID NO: 100593 - DNA, 25 bp, Mus musculus
acagccgaatcaccccagtaaaatg

SEQ ID NO: 100594 - DNA, 25 bp, Mus musculus
acagccgaatcagcccagtaaaatg

SEQ ID NO: 100595 - DNA, 25 bp, Mus musculus
acagccgacagaacctgtcacatga

SEQ ID NO: 100596 - DNA, 25 bp, Mus musculus
acagccgacagatcctgtcacatga

SEQ ID NO: 100597 - DNA, 25 bp, Mus musculus
acagccgactggataaatacatgag

SEQ ID NO: 100598 - DNA, 25 bp, Mus musculus
acagccgactggttaaatacatgag

SEQ ID NO: 100599 - DNA, 25 bp, Mus musculus
acagccgaggtcagcgtgtcaacag

SEQ ID NO: 100600 - DNA, 25 bp, Mus musculus
acagccgaggtctgcgtgtcaacag

SEQ ID NO: 100601 - DNA, 25 bp, Mus musculus
acagccgaggtgcagtacaacttca

SEQ ID NO: 100602 - DNA, 25 bp, Mus musculus
acagccgaggtggagtacaacttca

SEQ ID NO: 100603 - DNA, 25 bp, Mus musculus
acagccgcagccaggttcctgaagt

SEQ ID NO: 100604 - DNA, 25 bp, Mus musculus
acagccgcagcctggttcctgaagt

SEQ ID NO: 100605 - DNA, 25 bp, Mus musculus
acagccgcagcgaagatcttgcaga

SEQ ID NO: 100606 - DNA, 25 bp, Mus musculus
acagccgcagcgtagatcttgcaga

SEQ ID NO: 100607 - DNA, 25 bp, Mus musculus
acagccgcatataatgtgactttct

SEQ ID NO: 100608 - DNA, 25 bp, Mus musculus
acagccgcatattatgtgactttct

SEQ ID NO: 100609 - DNA, 25 bp, Mus musculus
acagccgccgaaacctgaagtgaga

SEQ ID NO: 100610 - DNA, 25 bp, Mus musculus
acagccgccgaatcctgaagtgaga

SEQ ID NO: 100611 - DNA, 25 bp, Mus musculus
acagccggctccagagtctgtagac

SEQ ID NO: 100612 - DNA, 25 bp, Mus musculus
acagccggctcctgagtctgtagac

SEQ ID NO: 100613 - DNA, 25 bp, Mus musculus
acagccggtacaaggagcacttaga

SEQ ID NO: 100614 - DNA, 25 bp, Mus musculus
acagccggtacatggagcacttaga

SEQ ID NO: 100615 - DNA, 25 bp, Mus musculus
acagccggttccaggactgtaactg

SEQ ID NO: 100616 - DNA, 25 bp, Mus musculus
acagccggttcctggactgtaactg

SEQ ID NO: 100617 - DNA, 25 bp, Mus musculus
acagccgtagtcatggcggcgccgc

SEQ ID NO: 100618 - DNA, 25 bp, Mus musculus
acagccgtagtcttggcggcgccgc

SEQ ID NO: 100619 - DNA, 25 bp, Mus musculus
acagccgtccagagcttgttgaaga

SEQ ID NO: 100620 - DNA, 25 bp, Mus musculus
acagccgtccagtgcttgttgaaga

SEQ ID NO: 100621 - DNA, 25 bp, Mus musculus
acagccgtcctgaatagtgtaccct

SEQ ID NO: 100622 - DNA, 25 bp, Mus musculus
acagccgtcctgtatagtgtaccct

SEQ ID NO: 100623 - DNA, 25 bp, Mus musculus
acagccgtcgttagttttccatgga

SEQ ID NO: 100624 - DNA, 25 bp, Mus musculus
acagccgtcgtttgttttccatgga

SEQ ID NO: 100625 - DNA, 25 bp, Mus musculus
acagccgtctggattgtatgggtga

SEQ ID NO: 100626 - DNA, 25 bp, Mus musculus
acagccgtctggtttgtatgggtga

SEQ ID NO: 100627 - DNA, 25 bp, Mus musculus
acagccgttggcatcaggcaagcta

SEQ ID NO: 100628 - DNA, 25 bp, Mus musculus
acagccgttggcttcaggcaagcta

SEQ ID NO: 100629 - DNA, 25 bp, Mus musculus
acagccgttgtcaaatgatgttcca

SEQ ID NO: 100630 - DNA, 25 bp, Mus musculus
acagccgttgtctaatgatgttcca

SEQ ID NO: 100631 - DNA, 25 bp, Mus musculus
acagcctacaacagcttatgactgg

SEQ ID NO: 100632 - DNA, 25 bp, Mus musculus
acagcctacaactgcttatgactgg

SEQ ID NO: 100633 - DNA, 25 bp, Mus musculus
acagcctacacgcaagcatttgtat

SEQ ID NO: 100634 - DNA, 25 bp, Mus musculus
acagcctacacggaagcatttgtat

SEQ ID NO: 100635 - DNA, 25 bp, Mus musculus
acagcctacattctgagctcgagtc

SEQ ID NO: 100636 - DNA, 25 bp, Mus musculus
acagcctacattgtgagctcgagtc

SEQ ID NO: 100637 - DNA, 25 bp, Mus musculus
acagcctactcacataattaaagac

SEQ ID NO: 100638 - DNA, 25 bp, Mus musculus
acagcctactcagataattaaagac

SEQ ID NO: 100639 - DNA, 25 bp, Mus musculus
acagcctataggaacttgcctgtgt

SEQ ID NO: 100640 - DNA, 25 bp, Mus musculus
acagcctataggtacttgcctgtgt

SEQ ID NO: 100641 - DNA, 25 bp, Mus musculus
acagcctatgcgagcttcttggcaa

SEQ ID NO: 100642 - DNA, 25 bp, Mus musculus
acagcctatgcgtgcttcttggcaa

SEQ ID NO: 100643 - DNA, 25 bp, Mus musculus
acagcctcacctaggttcactgtta

SEQ ID NO: 100644 - DNA, 25 bp, Mus musculus
acagcctcaccttggttcactgtta

SEQ ID NO: 100645 - DNA, 25 bp, Mus musculus
acagcctcagagacttagcaatggt

SEQ ID NO: 100646 - DNA, 25 bp, Mus musculus
acagcctcagagtcttagcaatggt

SEQ ID NO: 100647 - DNA, 25 bp, Mus musculus
acagcctcagctctgtagaagcttt

SEQ ID NO: 100648 - DNA, 25 bp, Mus musculus
acagcctcagctgtgtagaagcttt

SEQ ID NO: 100649 - DNA, 25 bp, Mus musculus
acagcctcattgaagctccggaaga

SEQ ID NO: 100650 - DNA, 25 bp, Mus musculus
acagcctcattgtagctccggaaga

SEQ ID NO: 100651 - DNA, 25 bp, Mus musculus
acagcctccaagcaatcgacaagtt

SEQ ID NO: 100652 - DNA, 25 bp, Mus musculus
acagcctccaaggaatcgacaagtt

SEQ ID NO: 100653 - DNA, 25 bp, Mus musculus
acagcctccagaagatggtccattc

SEQ ID NO: 100654 - DNA, 25 bp, Mus musculus
acagcctccagaatgccaagacatg

SEQ ID NO: 100655 - DNA, 25 bp, Mus musculus
acagcctccagatgatggtccattc

SEQ ID NO: 100656 - DNA, 25 bp, Mus musculus
acagcctccagattgccaagacatg

SEQ ID NO: 100657 - DNA, 25 bp, Mus musculus
acagcctccattcgtacgagaaacg

SEQ ID NO: 100658 - DNA, 25 bp, Mus musculus
acagcctccattggtacgagaaacg

SEQ ID NO: 100659 - DNA, 25 bp, Mus musculus
acagcctccgatactctagagaaac

SEQ ID NO: 100660 - DNA, 25 bp, Mus musculus
acagcctccgattctctagagaaac

SEQ ID NO: 100661 - DNA, 25 bp, Mus musculus
acagcctccgcccagtgtatgtggt

SEQ ID NO: 100662 - DNA, 25 bp, Mus musculus
acagcctccgccgagtgtatgtggt

SEQ ID NO: 100663 - DNA, 25 bp, Mus musculus
acagcctcctcaagcgttgaaataa

SEQ ID NO: 100664 - DNA, 25 bp, Mus musculus
acagcctcctcatgcgttgaaataa

SEQ ID NO: 100665 - DNA, 25 bp, Mus musculus
acagcctcctgcattctttaaagca

SEQ ID NO: 100666 - DNA, 25 bp, Mus musculus
acagcctcctgctttctttaaagca

SEQ ID NO: 100667 - DNA, 25 bp, Mus musculus
acagcctcgcggagagactgaacat

SEQ ID NO: 100668 - DNA, 25 bp, Mus musculus
acagcctcgcggtgagactgaacat

SEQ ID NO: 100669 - DNA, 25 bp, Mus musculus
acagcctctacaattgttacgtaat

SEQ ID NO: 100670 - DNA, 25 bp, Mus musculus
acagcctctacatttgttacgtaat

SEQ ID NO: 100671 - DNA, 25 bp, Mus musculus
acagcctctctgagaatgacagcag

SEQ ID NO: 100672 - DNA, 25 bp, Mus musculus
acagcctctctgtgaatgacagcag

SEQ ID NO: 100673 - DNA, 25 bp, Mus musculus
acagcctctgacacagtggattcgg

SEQ ID NO: 100674 - DNA, 25 bp, Mus musculus
acagcctctgaccttgtgtttggta

SEQ ID NO: 100675 - DNA, 25 bp, Mus musculus
acagcctctgacgttgtgtttggta

SEQ ID NO: 100676 - DNA, 25 bp, Mus musculus
acagcctctgactcagtggattcgg

SEQ ID NO: 100677 - DNA, 25 bp, Mus musculus
acagcctctggacttctgcagttat

SEQ ID NO: 100678 - DNA, 25 bp, Mus musculus
acagcctctggagttctgcagttat

SEQ ID NO: 100679 - DNA, 25 bp, Mus musculus
acagcctctgtgcaaagctcctagt

SEQ ID NO: 100680 - DNA, 25 bp, Mus musculus
acagcctctgtggaaagctcctagt

SEQ ID NO: 100681 - DNA, 25 bp, Mus musculus
acagcctctgttatggagccaggaa

SEQ ID NO: 100682 - DNA, 25 bp, Mus musculus
acagcctctgttttggagccaggaa

SEQ ID NO: 100683 - DNA, 25 bp, Mus musculus
acagcctcttctaatgggctctcgg

SEQ ID NO: 100684 - DNA, 25 bp, Mus musculus
acagcctcttcttatgggctctcgg

SEQ ID NO: 100685 - DNA, 25 bp, Mus musculus
acagcctcttgtatgatacctacag

SEQ ID NO: 100686 - DNA, 25 bp, Mus musculus
acagcctcttgtttgatacctacag

SEQ ID NO: 100687 - DNA, 25 bp, Mus musculus
acagcctctttaactttgcaactct

SEQ ID NO: 100688 - DNA, 25 bp, Mus musculus
acagcctctttatctttgcaactct

SEQ ID NO: 100689 - DNA, 25 bp, Mus musculus
acagcctgacacagcagtgatttca

SEQ ID NO: 100690 - DNA, 25 bp, Mus musculus
acagcctgacactgcagtgatttca

SEQ ID NO: 100691 - DNA, 25 bp, Mus musculus
acagcctgacctagaccgagtgaag

SEQ ID NO: 100692 - DNA, 25 bp, Mus musculus
acagcctgaccttgaccgagtgaag

SEQ ID NO: 100693 - DNA, 25 bp, Mus musculus
acagcctgacttctagctattgcag

SEQ ID NO: 100694 - DNA, 25 bp, Mus musculus
acagcctgacttctgtagtctggca

SEQ ID NO: 100695 - DNA, 25 bp, Mus musculus
acagcctgacttgtagctattgcag

SEQ ID NO: 100696 - DNA, 25 bp, Mus musculus
acagcctgacttgtgtagtctggca

SEQ ID NO: 100697 - DNA, 25 bp, Mus musculus
acagcctgagctatgaggacttcct

SEQ ID NO: 100698 - DNA, 25 bp, Mus musculus
acagcctgagctttgaggacttcct

SEQ ID NO: 100699 - DNA, 25 bp, Mus musculus
acagcctgaggaagcgccggaccag

SEQ ID NO: 100700 - DNA, 25 bp, Mus musculus
acagcctgaggatgcgccggaccag

SEQ ID NO: 100701 - DNA, 25 bp, Mus musculus
acagcctgatccatgcgttctctgc

SEQ ID NO: 100702 - DNA, 25 bp, Mus musculus
acagcctgatccttgcgttctctgc

SEQ ID NO: 100703 - DNA, 25 bp, Mus musculus
acagcctgcaaacaacaggcagttg

SEQ ID NO: 100704 - DNA, 25 bp, Mus musculus
acagcctgcaaagaacaggcagttg

SEQ ID NO: 100705 - DNA, 25 bp, Mus musculus
acagcctgcactcatgttggtgtcc

SEQ ID NO: 100706 - DNA, 25 bp, Mus musculus
acagcctgcactgatgttggtgtcc

SEQ ID NO: 100707 - DNA, 25 bp, Mus musculus
acagcctgcatcattggttgtgctt

SEQ ID NO: 100708 - DNA, 25 bp, Mus musculus
acagcctgcatctttggttgtgctt

SEQ ID NO: 100709 - DNA, 25 bp, Mus musculus
acagcctgccagacttatgcggtgg

SEQ ID NO: 100710 - DNA, 25 bp, Mus musculus
acagcctgccagagtgtcgtaaggt

SEQ ID NO: 100711 - DNA, 25 bp, Mus musculus
acagcctgccagtcttatgcggtgg

SEQ ID NO: 100712 - DNA, 25 bp, Mus musculus
acagcctgccagtgtgtcgtaaggt

SEQ ID NO: 100713 - DNA, 25 bp, Mus musculus
acagcctgctcaaagctactgcagc

SEQ ID NO: 100714 - DNA, 25 bp, Mus musculus
acagcctgctcatagctactgcagc

SEQ ID NO: 100715 - DNA, 25 bp, Mus musculus
acagcctgctccctgcacagtggga

SEQ ID NO: 100716 - DNA, 25 bp, Mus musculus
acagcctgctccgtgcacagtggga

SEQ ID NO: 100717 - DNA, 25 bp, Mus musculus
acagcctgcttcctgtagcagatgt

SEQ ID NO: 100718 - DNA, 25 bp, Mus musculus
acagcctgcttcgtgtagcagatgt

SEQ ID NO: 100719 - DNA, 25 bp, Mus musculus
acagcctgcttgcttccacatgtca

SEQ ID NO: 100720 - DNA, 25 bp, Mus musculus
acagcctgcttggttccacatgtca

SEQ ID NO: 100721 - DNA, 25 bp, Mus musculus
acagcctggcataccaatcttgtga

SEQ ID NO: 100722 - DNA, 25 bp, Mus musculus
acagcctggcattccaatcttgtga

SEQ ID NO: 100723 - DNA, 25 bp, Mus musculus
acagcctggcctaggtttacaatgc

SEQ ID NO: 100724 - DNA, 25 bp, Mus musculus
acagcctggcctcaccatggagtac

SEQ ID NO: 100725 - DNA, 25 bp, Mus musculus
acagcctggcctgaccatggagtac

SEQ ID NO: 100726 - DNA, 25 bp, Mus musculus
acagcctggccttggtttacaatgc

SEQ ID NO: 100727 - DNA, 25 bp, Mus musculus
acagcctggcgtcgaacaacatgat

SEQ ID NO: 100728 - DNA, 25 bp, Mus musculus
acagcctggcgtggaacaacatgat

SEQ ID NO: 100729 - DNA, 25 bp, Mus musculus
acagcctgggatcttcatgctggat

SEQ ID NO: 100730 - DNA, 25 bp, Mus musculus
acagcctgggatgttcatgctggat

SEQ ID NO: 100731 - DNA, 25 bp, Mus musculus
acagcctgtaacagcctctgtgagt

SEQ ID NO: 100732 - DNA, 25 bp, Mus musculus
acagcctgtaactgcctctgtgagt

SEQ ID NO: 100733 - DNA, 25 bp, Mus musculus
acagcctgtacaccttcatcacggg

SEQ ID NO: 100734 - DNA, 25 bp, Mus musculus
acagcctgtacagcttcatcacggg

SEQ ID NO: 100735 - DNA, 25 bp, Mus musculus
acagcctgtgtcaagccagacttgc

SEQ ID NO: 100736 - DNA, 25 bp, Mus musculus
acagcctgtgtctagccagacttgc

SEQ ID NO: 100737 - DNA, 25 bp, Mus musculus
acagcctgtgtgaccggaagtacca

SEQ ID NO: 100738 - DNA, 25 bp, Mus musculus
acagcctgtgtgtccggaagtacca

SEQ ID NO: 100739 - DNA, 25 bp, Mus musculus
acagcctgttagagggagcttgccc

SEQ ID NO: 100740 - DNA, 25 bp, Mus musculus
acagcctgttagtgggagcttgccc

SEQ ID NO: 100741 - DNA, 25 bp, Mus musculus
acagcctgtttcactatacttataa

SEQ ID NO: 100742 - DNA, 25 bp, Mus musculus
acagcctgtttctctatacttataa

SEQ ID NO: 100743 - DNA, 25 bp, Mus musculus
acagccttaagtcagactttagatg

SEQ ID NO: 100744 - DNA, 25 bp, Mus musculus
acagccttaagtgagactttagatg

SEQ ID NO: 100745 - DNA, 25 bp, Mus musculus
acagccttacttacgagagccttac

SEQ ID NO: 100746 - DNA, 25 bp, Mus musculus
acagccttactttcgagagccttac

SEQ ID NO: 100747 - DNA, 25 bp, Mus musculus
acagccttaggacaaccatcttggt

SEQ ID NO: 100748 - DNA, 25 bp, Mus musculus
acagccttaggagaaccatcttggt

SEQ ID NO: 100749 - DNA, 25 bp, Mus musculus
acagccttaggcaaacagttgaacc

SEQ ID NO: 100750 - DNA, 25 bp, Mus musculus
acagccttaggctaacagttgaacc

SEQ ID NO: 100751 - DNA, 25 bp, Mus musculus
acagccttattcaagttctggcaag

SEQ ID NO: 100752 - DNA, 25 bp, Mus musculus
acagccttattctagttctggcaag

SEQ ID NO: 100753 - DNA, 25 bp, Mus musculus
acagccttcatactgtccttcatac

SEQ ID NO: 100754 - DNA, 25 bp, Mus musculus
acagccttcatagtgtccttcatac

SEQ ID NO: 100755 - DNA, 25 bp, Mus musculus
acagccttcatgcatctcaacagcc

SEQ ID NO: 100756 - DNA, 25 bp, Mus musculus
acagccttcatggatctcaacagcc

SEQ ID NO: 100757 - DNA, 25 bp, Mus musculus
acagccttccacatttaaactccag

SEQ ID NO: 100758 - DNA, 25 bp, Mus musculus
acagccttccacttttaaactccag

SEQ ID NO: 100759 - DNA, 25 bp, Mus musculus
acagccttccatcttcatctgtcta

SEQ ID NO: 100760 - DNA, 25 bp, Mus musculus
acagccttccatgttcatctgtcta

SEQ ID NO: 100761 - DNA, 25 bp, Mus musculus
acagccttccgtctgggatctgcca

SEQ ID NO: 100762 - DNA, 25 bp, Mus musculus
acagccttccgtgtgggatctgcca

SEQ ID NO: 100763 - DNA, 25 bp, Mus musculus
acagccttcttgcttcgttcgttca

SEQ ID NO: 100764 - DNA, 25 bp, Mus musculus
acagccttcttggttcgttcgttca

SEQ ID NO: 100765 - DNA, 25 bp, Mus musculus
acagccttgactcggaagaatatca

SEQ ID NO: 100766 - DNA, 25 bp, Mus musculus
acagccttgactgggaagaatatca

SEQ ID NO: 100767 - DNA, 25 bp, Mus musculus
acagccttgagaagtcggagactcg

SEQ ID NO: 100768 - DNA, 25 bp, Mus musculus
acagccttgagatgtcggagactcg

SEQ ID NO: 100769 - DNA, 25 bp, Mus musculus
acagccttgccacgagtccaccaca

SEQ ID NO: 100770 - DNA, 25 bp, Mus musculus
acagccttgccaggagtccaccaca

SEQ ID NO: 100771 - DNA, 25 bp, Mus musculus
acagccttggaaacactgcaccaga

SEQ ID NO: 100772 - DNA, 25 bp, Mus musculus
acagccttggaatcactgcaccaga

SEQ ID NO: 100773 - DNA, 25 bp, Mus musculus
acagccttggctcacaagtaccact

SEQ ID NO: 100774 - DNA, 25 bp, Mus musculus
acagccttggctgacaagtaccact

SEQ ID NO: 100775 - DNA, 25 bp, Mus musculus
acagccttgggcattcttgtatctc

SEQ ID NO: 100776 - DNA, 25 bp, Mus musculus
acagccttgggctttcttgtatctc

SEQ ID NO: 100777 - DNA, 25 bp, Mus musculus
acagccttgtggattacaactcgga

SEQ ID NO: 100778 - DNA, 25 bp, Mus musculus
acagccttgtggctaccttcagtaa

SEQ ID NO: 100779 - DNA, 25 bp, Mus musculus
acagccttgtgggtaccttcagtaa

SEQ ID NO: 100780 - DNA, 25 bp, Mus musculus
acagccttgtggtttacaactcgga

SEQ ID NO: 100781 - DNA, 25 bp, Mus musculus
acagccttgtgtcactcgtggtgac

SEQ ID NO: 100782 - DNA, 25 bp, Mus musculus
acagccttgtgtcctgagacccaga

SEQ ID NO: 100783 - DNA, 25 bp, Mus musculus
acagccttgtgtctttcaactatta

SEQ ID NO: 100784 - DNA, 25 bp, Mus musculus
acagccttgtgtgactcgtggtgac

SEQ ID NO: 100785 - DNA, 25 bp, Mus musculus
acagccttgtgtgctgagacccaga

SEQ ID NO: 100786 - DNA, 25 bp, Mus musculus
acagccttgtgtgtttcaactatta

SEQ ID NO: 100787 - DNA, 25 bp, Mus musculus
acagcctttgccaccgctttgtgtg

SEQ ID NO: 100788 - DNA, 25 bp, Mus musculus
acagcctttgcctccgctttgtgtg

SEQ ID NO: 100789 - DNA, 25 bp, Mus musculus
acagcctttggcatattgatatcag

SEQ ID NO: 100790 - DNA, 25 bp, Mus musculus
acagcctttggcttattgatatcag

SEQ ID NO: 100791 - DNA, 25 bp, Mus musculus
acagccttttctctggtgtctgggc

SEQ ID NO: 100792 - DNA, 25 bp, Mus musculus
acagccttttctgtggtgtctgggc

SEQ ID NO: 100793 - DNA, 25 bp, Mus musculus
acagcctttttcatcatgttactcc

SEQ ID NO: 100794 - DNA, 25 bp, Mus musculus
acagcctttttcttcatgttactcc

SEQ ID NO: 100795 - DNA, 25 bp, Mus musculus
acagcgaaccaaccctatctcaaaa

SEQ ID NO: 100796 - DNA, 25 bp, Mus musculus
acagcgaaccaagcctatctcaaaa

SEQ ID NO: 100797 - DNA, 25 bp, Mus musculus
acagcgaagtctccagcgttatgat

SEQ ID NO: 100798 - DNA, 25 bp, Mus musculus
acagcgaagtctgcagcgttatgat

SEQ ID NO: 100799 - DNA, 25 bp, Mus musculus
acagcgaattttaaggcattgtcca

SEQ ID NO: 100800 - DNA, 25 bp, Mus musculus
acagcgaatttttaggcattgtcca

SEQ ID NO: 100801 - DNA, 25 bp, Mus musculus
acagcgacagatctcactgggagcg

SEQ ID NO: 100802 - DNA, 25 bp, Mus musculus
acagcgacagatgtcactgggagcg

SEQ ID NO: 100803 - DNA, 25 bp, Mus musculus
acagcgaccaggaggtggcaacaga

SEQ ID NO: 100804 - DNA, 25 bp, Mus musculus
acagcgaccaggtggtggcaacaga

SEQ ID NO: 100805 - DNA, 25 bp, Mus musculus
acagcgacctctacaaattcaacaa

SEQ ID NO: 100806 - DNA, 25 bp, Mus musculus
acagcgacctcttcaaattcaacaa

SEQ ID NO: 100807 - DNA, 25 bp, Mus musculus
acagcgagcgctcgaaagccatcaa

SEQ ID NO: 100808 - DNA, 25 bp, Mus musculus
acagcgagcgctggaaagccatcaa

SEQ ID NO: 100809 - DNA, 25 bp, Mus musculus
acagcgagctatatctggggcccaa

SEQ ID NO: 100810 - DNA, 25 bp, Mus musculus
acagcgagctatttctggggcccaa

SEQ ID NO: 100811 - DNA, 25 bp, Mus musculus
acagcgagtactattattccaacac

SEQ ID NO: 100812 - DNA, 25 bp, Mus musculus
acagcgagtacttttattccaacac

SEQ ID NO: 100813 - DNA, 25 bp, Mus musculus
acagcgagtctgcttgcacaactgc

SEQ ID NO: 100814 - DNA, 25 bp, Mus musculus
acagcgagtctggttgcacaactgc

SEQ ID NO: 100815 - DNA, 25 bp, Mus musculus
acagcgagtgcgcagcagagactcc

SEQ ID NO: 100816 - DNA, 25 bp, Mus musculus
acagcgagtgcggagcagagactcc

SEQ ID NO: 100817 - DNA, 25 bp, Mus musculus
acagcgatcaggaaaccggaggcaa

SEQ ID NO: 100818 - DNA, 25 bp, Mus musculus
acagcgatcaggtaaccggaggcaa

SEQ ID NO: 100819 - DNA, 25 bp, Mus musculus
acagcgatgcttctgatcttcacaa

SEQ ID NO: 100820 - DNA, 25 bp, Mus musculus
acagcgatgcttgtgatcttcacaa

SEQ ID NO: 100821 - DNA, 25 bp, Mus musculus
acagcgatggctatgttgacaccct

SEQ ID NO: 100822 - DNA, 25 bp, Mus musculus
acagcgatggctcggcatcctggaa

SEQ ID NO: 100823 - DNA, 25 bp, Mus musculus
acagcgatggctgggcatcctggaa

SEQ ID NO: 100824 - DNA, 25 bp, Mus musculus
acagcgatggctttgttgacaccct

SEQ ID NO: 100825 - DNA, 25 bp, Mus musculus
acagcgcactgtatgattgccgaga

SEQ ID NO: 100826 - DNA, 25 bp, Mus musculus
acagcgcactgtttgattgccgaga

SEQ ID NO: 100827 - DNA, 25 bp, Mus musculus
acagcgcagcgtacagcaccgagga

SEQ ID NO: 100828 - DNA, 25 bp, Mus musculus
acagcgcagcgttcagcaccgagga

SEQ ID NO: 100829 - DNA, 25 bp, Mus musculus
acagcgcagggaccattcagtcagc

SEQ ID NO: 100830 - DNA, 25 bp, Mus musculus
acagcgcagggagcattcagtcagc

SEQ ID NO: 100831 - DNA, 25 bp, Mus musculus
acagcgcattatcttgccggtcaat

SEQ ID NO: 100832 - DNA, 25 bp, Mus musculus
acagcgcattatgttgccggtcaat

SEQ ID NO: 100833 - DNA, 25 bp, Mus musculus
acagcgccgaccagtgtccagtgtg

SEQ ID NO: 100834 - DNA, 25 bp, Mus musculus
acagcgccgacctgtgtccagtgtg

SEQ ID NO: 100835 - DNA, 25 bp, Mus musculus
acagcgcctagacccaggcatttta

SEQ ID NO: 100836 - DNA, 25 bp, Mus musculus
acagcgcctagagccaggcatttta

SEQ ID NO: 100837 - DNA, 25 bp, Mus musculus
acagcgcgtgaaccgtctgctgatc

SEQ ID NO: 100838 - DNA, 25 bp, Mus musculus
acagcgcgtgaagcgtctgctgatc

SEQ ID NO: 100839 - DNA, 25 bp, Mus musculus
acagcgcgtgagacagaatttccga

SEQ ID NO: 100840 - DNA, 25 bp, Mus musculus
acagcgcgtgagtcagaatttccga

SEQ ID NO: 100841 - DNA, 25 bp, Mus musculus
acagcgctcatgaaaagtgtcacta

SEQ ID NO: 100842 - DNA, 25 bp, Mus musculus
acagcgctcatgtaaagtgtcacta

SEQ ID NO: 100843 - DNA, 25 bp, Mus musculus
acagcgctgcatatctcgtggcttc

SEQ ID NO: 100844 - DNA, 25 bp, Mus musculus
acagcgctgcatttctcgtggcttc

SEQ ID NO: 100845 - DNA, 25 bp, Mus musculus
acagcgcttggcccgtggcatccaa

SEQ ID NO: 100846 - DNA, 25 bp, Mus musculus
acagcgcttggcgcgtggcatccaa

SEQ ID NO: 100847 - DNA, 25 bp, Mus musculus
acagcgctttgtagagtcttaataa

SEQ ID NO: 100848 - DNA, 25 bp, Mus musculus
acagcgctttgttgagtcttaataa

SEQ ID NO: 100849 - DNA, 25 bp, Mus musculus
acagcggaagttcctttccaggagc

SEQ ID NO: 100850 - DNA, 25 bp, Mus musculus
acagcggaagttgctttccaggagc

SEQ ID NO: 100851 - DNA, 25 bp, Mus musculus
acagcggagcagaaccttctctgtg

SEQ ID NO: 100852 - DNA, 25 bp, Mus musculus
acagcggagcagtaccttctctgtg

SEQ ID NO: 100853 - DNA, 25 bp, Mus musculus
acagcggcactgatgaatgatttta

SEQ ID NO: 100854 - DNA, 25 bp, Mus musculus
acagcggcactgttgaatgatttta

SEQ ID NO: 100855 - DNA, 25 bp, Mus musculus
acagcggccatgaccagacagacct

SEQ ID NO: 100856 - DNA, 25 bp, Mus musculus
acagcggccatgtccagacagacct

SEQ ID NO: 100857 - DNA, 25 bp, Mus musculus
acagcggccttcatggtggttttgg

SEQ ID NO: 100858 - DNA, 25 bp, Mus musculus
acagcggccttcttggtggttttgg

SEQ ID NO: 100859 - DNA, 25 bp, Mus musculus
acagcggctcctatgtaagcttcag

SEQ ID NO: 100860 - DNA, 25 bp, Mus musculus
acagcggctcctttgtaagcttcag

SEQ ID NO: 100861 - DNA, 25 bp, Mus musculus
acagcggctttgatcaacttgtatt

SEQ ID NO: 100862 - DNA, 25 bp, Mus musculus
acagcggctttgttcaacttgtatt

SEQ ID NO: 100863 - DNA, 25 bp, Mus musculus
acagcgggactccagttggtcagtt

SEQ ID NO: 100864 - DNA, 25 bp, Mus musculus
acagcgggactcgagttggtcagtt

SEQ ID NO: 100865 - DNA, 25 bp, Mus musculus
acagcgggagctactggagcgtcac

SEQ ID NO: 100866 - DNA, 25 bp, Mus musculus
acagcgggagcttctggagcgtcac

SEQ ID NO: 100867 - DNA, 25 bp, Mus musculus
acagcgggcaacctggtgattgaca

SEQ ID NO: 100868 - DNA, 25 bp, Mus musculus
acagcgggcaacgtggtgattgaca

SEQ ID NO: 100869 - DNA, 25 bp, Mus musculus
acagcgggcggtaacttccgacagt

SEQ ID NO: 100870 - DNA, 25 bp, Mus musculus
acagcgggcggttacttccgacagt

SEQ ID NO: 100871 - DNA, 25 bp, Mus musculus
acagcggtaacacaagtgcctgaca

SEQ ID NO: 100872 - DNA, 25 bp, Mus musculus
acagcggtaacagaagtgcctgaca

SEQ ID NO: 100873 - DNA, 25 bp, Mus musculus
acagcggtaagaacgtgatcaacgt

SEQ ID NO: 100874 - DNA, 25 bp, Mus musculus
acagcggtaagatcgtgatcaacgt

SEQ ID NO: 100875 - DNA, 25 bp, Mus musculus
acagcggtcccacttgtgttcagat

SEQ ID NO: 100876 - DNA, 25 bp, Mus musculus
acagcggtcccagttgtgttcagat

SEQ ID NO: 100877 - DNA, 25 bp, Mus musculus
acagcggtgcttagaagcaggaatc

SEQ ID NO: 100878 - DNA, 25 bp, Mus musculus
acagcggtgctttgaagcaggaatc

SEQ ID NO: 100879 - DNA, 25 bp, Mus musculus
acagcggtgtaaaccatgcggccat

SEQ ID NO: 100880 - DNA, 25 bp, Mus musculus
acagcggtgtaatccatgcggccat

SEQ ID NO: 100881 - DNA, 25 bp, Mus musculus
acagcgtaacctccaaagtcttagc

SEQ ID NO: 100882 - DNA, 25 bp, Mus musculus
acagcgtaacctgcaaagtcttagc

SEQ ID NO: 100883 - DNA, 25 bp, Mus musculus
acagcgtaacttatgttcccattgt

SEQ ID NO: 100884 - DNA, 25 bp, Mus musculus
acagcgtaacttttgttcccattgt

SEQ ID NO: 100885 - DNA, 25 bp, Mus musculus
acagcgtcacacagagatacctctc

SEQ ID NO: 100886 - DNA, 25 bp, Mus musculus
acagcgtcacactgagatacctctc

SEQ ID NO: 100887 - DNA, 25 bp, Mus musculus
acagcgtcgcctattccttctgtga

SEQ ID NO: 100888 - DNA, 25 bp, Mus musculus
acagcgtcgccttttccttctgtga

SEQ ID NO: 100889 - DNA, 25 bp, Mus musculus
acagcgtctacacgcggtgtctcta

SEQ ID NO: 100890 - DNA, 25 bp, Mus musculus
acagcgtctacaggcggtgtctcta

SEQ ID NO: 100891 - DNA, 25 bp, Mus musculus
acagcgtcttttagaccagagtgcc

SEQ ID NO: 100892 - DNA, 25 bp, Mus musculus
acagcgtctttttgaccagagtgcc

SEQ ID NO: 100893 - DNA, 25 bp, Mus musculus
acagcgtgccaccttgcgaaaagaa

SEQ ID NO: 100894 - DNA, 25 bp, Mus musculus
acagcgtgccacgttgcgaaaagaa

SEQ ID NO: 100895 - DNA, 25 bp, Mus musculus
acagcgtgggcaacgatgcgaacat

SEQ ID NO: 100896 - DNA, 25 bp, Mus musculus
acagcgtgggcatcgatgcgaacat

SEQ ID NO: 100897 - DNA, 25 bp, Mus musculus
acagcgtgggctcagcaagctcctg

SEQ ID NO: 100898 - DNA, 25 bp, Mus musculus
acagcgtgggctgagcaagctcctg

SEQ ID NO: 100899 - DNA, 25 bp, Mus musculus
acagcgtggtggaaccttatgagcc

SEQ ID NO: 100900 - DNA, 25 bp, Mus musculus
acagcgtggtggtaccttatgagcc

SEQ ID NO: 100901 - DNA, 25 bp, Mus musculus
acagcgtgtagcattcattttctaa

SEQ ID NO: 100902 - DNA, 25 bp, Mus musculus
acagcgtgtagctttcattttctaa

SEQ ID NO: 100903 - DNA, 25 bp, Mus musculus
acagcgtgtcagctgggcacacact

SEQ ID NO: 100904 - DNA, 25 bp, Mus musculus
acagcgtgtcaggtgggcacacact

SEQ ID NO: 100905 - DNA, 25 bp, Mus musculus
acagcgtgttggctttctggaaaca

SEQ ID NO: 100906 - DNA, 25 bp, Mus musculus
acagcgtgttgggtttctggaaaca

SEQ ID NO: 100907 - DNA, 25 bp, Mus musculus
acagcgttaagcctagtcacggagc

SEQ ID NO: 100908 - DNA, 25 bp, Mus musculus
acagcgttaagcgtagtcacggagc

SEQ ID NO: 100909 - DNA, 25 bp, Mus musculus
acagcgttacccatgaggcccaact

SEQ ID NO: 100910 - DNA, 25 bp, Mus musculus
acagcgttacccttgaggcccaact

SEQ ID NO: 100911 - DNA, 25 bp, Mus musculus
acagcgttacgtcagcatcatgaac

SEQ ID NO: 100912 - DNA, 25 bp, Mus musculus
acagcgttacgtgagcatcatgaac

SEQ ID NO: 100913 - DNA, 25 bp, Mus musculus
acagcgttcaacctgggctcagaaa

SEQ ID NO: 100914 - DNA, 25 bp, Mus musculus
acagcgttcaacgtgggctcagaaa

SEQ ID NO: 100915 - DNA, 25 bp, Mus musculus
acagcgttccacatgtctgaagatc

SEQ ID NO: 100916 - DNA, 25 bp, Mus musculus
acagcgttccacttgtctgaagatc

SEQ ID NO: 100917 - DNA, 25 bp, Mus musculus
acagcgttgtgcaggctggacctaa

SEQ ID NO: 100918 - DNA, 25 bp, Mus musculus
acagcgttgtgctggctggacctaa

SEQ ID NO: 100919 - DNA, 25 bp, Mus musculus
acagctaaccttatgccccatgaca

SEQ ID NO: 100920 - DNA, 25 bp, Mus musculus
acagctaaccttttgccccatgaca

SEQ ID NO: 100921 - DNA, 25 bp, Mus musculus
acagctaactagctcaggatccagg

SEQ ID NO: 100922 - DNA, 25 bp, Mus musculus
acagctaactaggtcaggatccagg

SEQ ID NO: 100923 - DNA, 25 bp, Mus musculus
acagctaactccaaaggtggcttca

SEQ ID NO: 100924 - DNA, 25 bp, Mus musculus
acagctaactcctaaggtggcttca

SEQ ID NO: 100925 - DNA, 25 bp, Mus musculus
acagctaagaatatggctcctttgt

SEQ ID NO: 100926 - DNA, 25 bp, Mus musculus
acagctaagaatttggctcctttgt

SEQ ID NO: 100927 - DNA, 25 bp, Mus musculus
acagctaagtgactagttgtattat

SEQ ID NO: 100928 - DNA, 25 bp, Mus musculus
acagctaagtgagtagttgtattat

SEQ ID NO: 100929 - DNA, 25 bp, Mus musculus
acagctaagtttccagtgatgtctt

SEQ ID NO: 100930 - DNA, 25 bp, Mus musculus
acagctaagtttgcagtgatgtctt

SEQ ID NO: 100931 - DNA, 25 bp, Mus musculus
acagctaatatgatcttctttggca

SEQ ID NO: 100932 - DNA, 25 bp, Mus musculus
acagctaatatgttcttctttggca

SEQ ID NO: 100933 - DNA, 25 bp, Mus musculus
acagctaatcacatgtagacttatg

SEQ ID NO: 100934 - DNA, 25 bp, Mus musculus
acagctaatcacttgtagacttatg

SEQ ID NO: 100935 - DNA, 25 bp, Mus musculus
acagctaatcggattctggccttga

SEQ ID NO: 100936 - DNA, 25 bp, Mus musculus
acagctaatcggtttctggccttga

SEQ ID NO: 100937 - DNA, 25 bp, Mus musculus
acagctaattttcactcatttcctc

SEQ ID NO: 100938 - DNA, 25 bp, Mus musculus
acagctaattttgactcatttcctc

SEQ ID NO: 100939 - DNA, 25 bp, Mus musculus
acagctacagctcccatgagttgat

SEQ ID NO: 100940 - DNA, 25 bp, Mus musculus
acagctacagctgccatgagttgat

SEQ ID NO: 100941 - DNA, 25 bp, Mus musculus
acagctacagtgaacttacatataa

SEQ ID NO: 100942 - DNA, 25 bp, Mus musculus
acagctacagtgaatcgggtgccag

SEQ ID NO: 100943 - DNA, 25 bp, Mus musculus
acagctacagtgtacttacatataa

SEQ ID NO: 100944 - DNA, 25 bp, Mus musculus
acagctacagtgtatcgggtgccag

SEQ ID NO: 100945 - DNA, 25 bp, Mus musculus
acagctacagttatcatttcaaaga

SEQ ID NO: 100946 - DNA, 25 bp, Mus musculus
acagctacagttttcatttcaaaga

SEQ ID NO: 100947 - DNA, 25 bp, Mus musculus
acagctacatatattgtaaagggct

SEQ ID NO: 100948 - DNA, 25 bp, Mus musculus
acagctacatattttgtaaagggct

SEQ ID NO: 100949 - DNA, 25 bp, Mus musculus
acagctacatgtcgagcctcagtat

SEQ ID NO: 100950 - DNA, 25 bp, Mus musculus
acagctacatgtggagcctcagtat

SEQ ID NO: 100951 - DNA, 25 bp, Mus musculus
acagctaccactagtgcttttgtgt

SEQ ID NO: 100952 - DNA, 25 bp, Mus musculus
acagctaccacttgtgcttttgtgt

SEQ ID NO: 100953 - DNA, 25 bp, Mus musculus
acagctaccaggaacacctagtagt

SEQ ID NO: 100954 - DNA, 25 bp, Mus musculus
acagctaccaggtacacctagtagt

SEQ ID NO: 100955 - DNA, 25 bp, Mus musculus
acagctacccacagtgctggtattt

SEQ ID NO: 100956 - DNA, 25 bp, Mus musculus
acagctacccactgtgctggtattt

SEQ ID NO: 100957 - DNA, 25 bp, Mus musculus
acagctaccgtgcatttttctgcag

SEQ ID NO: 100958 - DNA, 25 bp, Mus musculus
acagctaccgtggatttttctgcag

SEQ ID NO: 100959 - DNA, 25 bp, Mus musculus
acagctacctctctatatccagtca

SEQ ID NO: 100960 - DNA, 25 bp, Mus musculus
acagctacctctgtatatccagtca

SEQ ID NO: 100961 - DNA, 25 bp, Mus musculus
acagctacgcgtcgcctttgatggg

SEQ ID NO: 100962 - DNA, 25 bp, Mus musculus
acagctacgcgtggcctttgatggg

SEQ ID NO: 100963 - DNA, 25 bp, Mus musculus
acagctactacgagaggtttttgaa

SEQ ID NO: 100964 - DNA, 25 bp, Mus musculus
acagctactacgtgaggtttttgaa

SEQ ID NO: 100965 - DNA, 25 bp, Mus musculus
acagctactcagagagccgcgtgga

SEQ ID NO: 100966 - DNA, 25 bp, Mus musculus
acagctactcagtgagccgcgtgga

SEQ ID NO: 100967 - DNA, 25 bp, Mus musculus
acagctactccacagaactttaaag

SEQ ID NO: 100968 - DNA, 25 bp, Mus musculus
acagctactccagagaactttaaag

SEQ ID NO: 100969 - DNA, 25 bp, Mus musculus
acagctactctcagatggtcatgta

SEQ ID NO: 100970 - DNA, 25 bp, Mus musculus
acagctactctctgatggtcatgta

SEQ ID NO: 100971 - DNA, 25 bp, Mus musculus
acagctactctgatcacaattggta

SEQ ID NO: 100972 - DNA, 25 bp, Mus musculus
acagctactctgttcacaattggta

SEQ ID NO: 100973 - DNA, 25 bp, Mus musculus
acagctactgccaaccagagaaaca

SEQ ID NO: 100974 - DNA, 25 bp, Mus musculus
acagctactgcctaccagagaaaca

SEQ ID NO: 100975 - DNA, 25 bp, Mus musculus
acagctactggcatgtcatatgtat

SEQ ID NO: 100976 - DNA, 25 bp, Mus musculus
acagctactggcttgtcatatgtat

SEQ ID NO: 100977 - DNA, 25 bp, Mus musculus
acagctacttctacgtgactttaat

SEQ ID NO: 100978 - DNA, 25 bp, Mus musculus
acagctacttcttcgtgactttaat

SEQ ID NO: 100979 - DNA, 25 bp, Mus musculus
acagctagacaacggtacaggtaca

SEQ ID NO: 100980 - DNA, 25 bp, Mus musculus
acagctagacaagggtacaggtaca

SEQ ID NO: 100981 - DNA, 25 bp, Mus musculus
acagctagactgacagctctcatct

SEQ ID NO: 100982 - DNA, 25 bp, Mus musculus
acagctagactgtcagctctcatct

SEQ ID NO: 100983 - DNA, 25 bp, Mus musculus
acagctagagccatctaccacaaaa

SEQ ID NO: 100984 - DNA, 25 bp, Mus musculus
acagctagagccttctaccacaaaa

SEQ ID NO: 100985 - DNA, 25 bp, Mus musculus
acagctagcattcgcctgtatctct

SEQ ID NO: 100986 - DNA, 25 bp, Mus musculus
acagctagcattggcctgtatctct

SEQ ID NO: 100987 - DNA, 25 bp, Mus musculus
acagctagccgcacagttcatgaat

SEQ ID NO: 100988 - DNA, 25 bp, Mus musculus
acagctagccgctcagttcatgaat

SEQ ID NO: 100989 - DNA, 25 bp, Mus musculus
acagctaggctgatttcagatgttt

SEQ ID NO: 100990 - DNA, 25 bp, Mus musculus
acagctaggctgttttcagatgttt

SEQ ID NO: 100991 - DNA, 25 bp, Mus musculus
acagctagggaccaaaaccctggag

SEQ ID NO: 100992 - DNA, 25 bp, Mus musculus
acagctagggacgaaaaccctggag

SEQ ID NO: 100993 - DNA, 25 bp, Mus musculus
acagctagggctctgtctgaaaaaa

SEQ ID NO: 100994 - DNA, 25 bp, Mus musculus
acagctagggctgtgtctgaaaaaa

SEQ ID NO: 100995 - DNA, 25 bp, Mus musculus
acagctaggtgcatgtgggtctcta

SEQ ID NO: 100996 - DNA, 25 bp, Mus musculus
acagctaggtgcttgtgggtctcta

SEQ ID NO: 100997 - DNA, 25 bp, Mus musculus
acagctaggtgtctggactgggaac

SEQ ID NO: 100998 - DNA, 25 bp, Mus musculus
acagctaggtgtgtggactgggaac

SEQ ID NO: 100999 - DNA, 25 bp, Mus musculus
acagctagtcttattcccagcaggg

SEQ ID NO: 101000 - DNA, 25 bp, Mus musculus
acagctagtctttttcccagcaggg

SEQ ID NO: 101001 - DNA, 25 bp, Mus musculus
acagctagtgttcttacatataata

SEQ ID NO: 101002 - DNA, 25 bp, Mus musculus
acagctagtgttgttacatataata

SEQ ID NO: 101003 - DNA, 25 bp, Mus musculus
acagctatcttgcaattctgctcca

SEQ ID NO: 101004 - DNA, 25 bp, Mus musculus
acagctatcttggaattctgctcca

SEQ ID NO: 101005 - DNA, 25 bp, Mus musculus
acagctatgaacctgcgtctttcat

SEQ ID NO: 101006 - DNA, 25 bp, Mus musculus
acagctatgaacgtgcgtctttcat

SEQ ID NO: 101007 - DNA, 25 bp, Mus musculus
acagctatgcatacttacagccatt

SEQ ID NO: 101008 - DNA, 25 bp, Mus musculus
acagctatgcattcttacagccatt

SEQ ID NO: 101009 - DNA, 25 bp, Mus musculus
acagctatgggcacttggtgatcta

SEQ ID NO: 101010 - DNA, 25 bp, Mus musculus
acagctatgggcattagaggcacct

SEQ ID NO: 101011 - DNA, 25 bp, Mus musculus
acagctatgggctcttggtgatcta

SEQ ID NO: 101012 - DNA, 25 bp, Mus musculus
acagctatgggctttagaggcacct

SEQ ID NO: 101013 - DNA, 25 bp, Mus musculus
acagctatgtaaagtattccagaga

SEQ ID NO: 101014 - DNA, 25 bp, Mus musculus
acagctatgtaatgtattccagaga

SEQ ID NO: 101015 - DNA, 25 bp, Mus musculus
acagctatgtgtagttgccttgccc

SEQ ID NO: 101016 - DNA, 25 bp, Mus musculus
acagctatgtgttgttgccttgccc

SEQ ID NO: 101017 - DNA, 25 bp, Mus musculus
acagctattttactcagtgcagtgc

SEQ ID NO: 101018 - DNA, 25 bp, Mus musculus
acagctattttagtcagtgcagtgc

SEQ ID NO: 101019 - DNA, 25 bp, Mus musculus
acagctcaaaccctggatgttgtga

SEQ ID NO: 101020 - DNA, 25 bp, Mus musculus
acagctcaaaccgtggatgttgtga

SEQ ID NO: 101021 - DNA, 25 bp, Mus musculus
acagctcaactgagggcacttgtcg

SEQ ID NO: 101022 - DNA, 25 bp, Mus musculus
acagctcaactgtgggcacttgtcg

SEQ ID NO: 101023 - DNA, 25 bp, Mus musculus
acagctcaagcccatggtctgatgc

SEQ ID NO: 101024 - DNA, 25 bp, Mus musculus
acagctcaagccgatggtctgatgc

SEQ ID NO: 101025 - DNA, 25 bp, Mus musculus
acagctcaagtgcactcaccagtaa

SEQ ID NO: 101026 - DNA, 25 bp, Mus musculus
acagctcaagtggactcaccagtaa

SEQ ID NO: 101027 - DNA, 25 bp, Mus musculus
acagctcacaccacggaaagtggaa

SEQ ID NO: 101028 - DNA, 25 bp, Mus musculus
acagctcacacctcggaaagtggaa

SEQ ID NO: 101029 - DNA, 25 bp, Mus musculus
acagctcacattatagtacaaacag

SEQ ID NO: 101030 - DNA, 25 bp, Mus musculus
acagctcacattttagtacaaacag

SEQ ID NO: 101031 - DNA, 25 bp, Mus musculus
acagctcactcaactagtcagaaag

SEQ ID NO: 101032 - DNA, 25 bp, Mus musculus
acagctcactcatctagtcagaaag

SEQ ID NO: 101033 - DNA, 25 bp, Mus musculus
acagctcagatcagccgtgcttagg

SEQ ID NO: 101034 - DNA, 25 bp, Mus musculus
acagctcagatctgccgtgcttagg

SEQ ID NO: 101035 - DNA, 25 bp, Mus musculus
acagctcaggagaggcagccattga

SEQ ID NO: 101036 - DNA, 25 bp, Mus musculus
acagctcaggagtggcagccattga

SEQ ID NO: 101037 - DNA, 25 bp, Mus musculus
acagctcagtgaagggatggcaaat

SEQ ID NO: 101038 - DNA, 25 bp, Mus musculus
acagctcagtgatgggatggcaaat

SEQ ID NO: 101039 - DNA, 25 bp, Mus musculus
acagctcatcaacgacctggccaaa

SEQ ID NO: 101040 - DNA, 25 bp, Mus musculus
acagctcatcaaggacctggccaaa

SEQ ID NO: 101041 - DNA, 25 bp, Mus musculus
acagctcatcctcggtagggtgtgt

SEQ ID NO: 101042 - DNA, 25 bp, Mus musculus
acagctcatcctgggtagggtgtgt

SEQ ID NO: 101043 - DNA, 25 bp, Mus musculus
acagctcatctgattaatccttatg

SEQ ID NO: 101044 - DNA, 25 bp, Mus musculus
acagctcatctgtttaatccttatg

SEQ ID NO: 101045 - DNA, 25 bp, Mus musculus
acagctcatggacgatggccagtcc

SEQ ID NO: 101046 - DNA, 25 bp, Mus musculus
acagctcatggaggatggccagtcc

SEQ ID NO: 101047 - DNA, 25 bp, Mus musculus
acagctcatgtgcaacctctgctag

SEQ ID NO: 101048 - DNA, 25 bp, Mus musculus
acagctcatgtggaacctctgctag

SEQ ID NO: 101049 - DNA, 25 bp, Mus musculus
acagctcatgttagtgtttgctgct

SEQ ID NO: 101050 - DNA, 25 bp, Mus musculus
acagctcatgtttgtgtttgctgct

SEQ ID NO: 101051 - DNA, 25 bp, Mus musculus
acagctcatttccacgcagggtgtt

SEQ ID NO: 101052 - DNA, 25 bp, Mus musculus
acagctcatttcgacgcagggtgtt

SEQ ID NO: 101053 - DNA, 25 bp, Mus musculus
acagctccaacaattgcggaagtgt

SEQ ID NO: 101054 - DNA, 25 bp, Mus musculus
acagctccaacatttgcggaagtgt

SEQ ID NO: 101055 - DNA, 25 bp, Mus musculus
acagctccaataaatgacccgcatg

SEQ ID NO: 101056 - DNA, 25 bp, Mus musculus
acagctccaatatatgacccgcatg

SEQ ID NO: 101057 - DNA, 25 bp, Mus musculus
acagctccagaacttgtctctagac

SEQ ID NO: 101058 - DNA, 25 bp, Mus musculus
acagctccagaagttgtctctagac

SEQ ID NO: 101059 - DNA, 25 bp, Mus musculus
acagctccagctacagagcctggca

SEQ ID NO: 101060 - DNA, 25 bp, Mus musculus
acagctccagcttcagagcctggca

SEQ ID NO: 101061 - DNA, 25 bp, Mus musculus
acagctccaggtattgtgtgccctc

SEQ ID NO: 101062 - DNA, 25 bp, Mus musculus
acagctccaggttttgtgtgccctc

SEQ ID NO: 101063 - DNA, 25 bp, Mus musculus
acagctccagtgcaaatggctctga

SEQ ID NO: 101064 - DNA, 25 bp, Mus musculus
acagctccagtggaaatggctctga

SEQ ID NO: 101065 - DNA, 25 bp, Mus musculus
acagctccagttcggaaaactggaa

SEQ ID NO: 101066 - DNA, 25 bp, Mus musculus
acagctccagttgggaaaactggaa

SEQ ID NO: 101067 - DNA, 25 bp, Mus musculus
acagctccatccacatggaagatat

SEQ ID NO: 101068 - DNA, 25 bp, Mus musculus
acagctccatcctcatggaagatat

SEQ ID NO: 101069 - DNA, 25 bp, Mus musculus
acagctccatgtatttattccatgc

SEQ ID NO: 101070 - DNA, 25 bp, Mus musculus
acagctccatgtttttattccatgc

SEQ ID NO: 101071 - DNA, 25 bp, Mus musculus
acagctcccaggaactcactggtca

SEQ ID NO: 101072 - DNA, 25 bp, Mus musculus
acagctcccaggtactcactggtca

SEQ ID NO: 101073 - DNA, 25 bp, Mus musculus
acagctcccatcaaaccaacgtgaa

SEQ ID NO: 101074 - DNA, 25 bp, Mus musculus
acagctcccatctaaccaacgtgaa

SEQ ID NO: 101075 - DNA, 25 bp, Mus musculus
acagctcccattaataattttgccc

SEQ ID NO: 101076 - DNA, 25 bp, Mus musculus
acagctcccatttataattttgccc

SEQ ID NO: 101077 - DNA, 25 bp, Mus musculus
acagctccccagatgatactcaggt

SEQ ID NO: 101078 - DNA, 25 bp, Mus musculus
acagctccccagttgatactcaggt

SEQ ID NO: 101079 - DNA, 25 bp, Mus musculus
acagctccccttcccaataaagtaa

SEQ ID NO: 101080 - DNA, 25 bp, Mus musculus
acagctccccttgccaataaagtaa

SEQ ID NO: 101081 - DNA, 25 bp, Mus musculus
acagctccctgtagtcaagttgatg

SEQ ID NO: 101082 - DNA, 25 bp, Mus musculus
acagctccctgtcgtagtccagatt

SEQ ID NO: 101083 - DNA, 25 bp, Mus musculus
acagctccctgtggtagtccagatt

SEQ ID NO: 101084 - DNA, 25 bp, Mus musculus
acagctccctgttgtcaagttgatg

SEQ ID NO: 101085 - DNA, 25 bp, Mus musculus
acagctccctttaaggaccaggaag

SEQ ID NO: 101086 - DNA, 25 bp, Mus musculus
acagctcccttttaggaccaggaag

SEQ ID NO: 101087 - DNA, 25 bp, Mus musculus
acagctccgcctcaatctggtagga

SEQ ID NO: 101088 - DNA, 25 bp, Mus musculus
acagctccgcctcagttaatggaaa

SEQ ID NO: 101089 - DNA, 25 bp, Mus musculus
acagctccgcctgaatctggtagga

SEQ ID NO: 101090 - DNA, 25 bp, Mus musculus
acagctccgcctgagttaatggaaa

SEQ ID NO: 101091 - DNA, 25 bp, Mus musculus
acagctccggtgatgtgtgtatttc

SEQ ID NO: 101092 - DNA, 25 bp, Mus musculus
acagctccggtgttgtgtgtatttc

SEQ ID NO: 101093 - DNA, 25 bp, Mus musculus
acagctcctggcatgcttgtgcaga

SEQ ID NO: 101094 - DNA, 25 bp, Mus musculus
acagctcctggcttgcttgtgcaga

SEQ ID NO: 101095 - DNA, 25 bp, Mus musculus
acagctcgcatgactataatgtaat

SEQ ID NO: 101096 - DNA, 25 bp, Mus musculus
acagctcgcatgtctataatgtaat

SEQ ID NO: 101097 - DNA, 25 bp, Mus musculus
acagctcgctgaaccctgttatcta

SEQ ID NO: 101098 - DNA, 25 bp, Mus musculus
acagctcgctgatccctgttatcta

SEQ ID NO: 101099 - DNA, 25 bp, Mus musculus
acagctcggtggctatttatttgcc

SEQ ID NO: 101100 - DNA, 25 bp, Mus musculus
acagctcggtgggtatttatttgcc

SEQ ID NO: 101101 - DNA, 25 bp, Mus musculus
acagctcggtgtctgttcagcccta

SEQ ID NO: 101102 - DNA, 25 bp, Mus musculus
acagctcggtgtgtgttcagcccta

SEQ ID NO: 101103 - DNA, 25 bp, Mus musculus
acagctcgtcttcaacactttatat

SEQ ID NO: 101104 - DNA, 25 bp, Mus musculus
acagctcgtcttgaacactttatat

SEQ ID NO: 101105 - DNA, 25 bp, Mus musculus
acagctctaacccatgtgttgtctt

SEQ ID NO: 101106 - DNA, 25 bp, Mus musculus
acagctctaaccgatgtgttgtctt

SEQ ID NO: 101107 - DNA, 25 bp, Mus musculus
acagctctaatcctcgcactaagga

SEQ ID NO: 101108 - DNA, 25 bp, Mus musculus
acagctctaatcgtcgcactaagga

SEQ ID NO: 101109 - DNA, 25 bp, Mus musculus
acagctctacctagggctgctttga

SEQ ID NO: 101110 - DNA, 25 bp, Mus musculus
acagctctaccttgggctgctttga

SEQ ID NO: 101111 - DNA, 25 bp, Mus musculus
acagctctatatattacaacctaca

SEQ ID NO: 101112 - DNA, 25 bp, Mus musculus
acagctctatattttacaacctaca

SEQ ID NO: 101113 - DNA, 25 bp, Mus musculus
acagctctcagcagttaggcacgtg

SEQ ID NO: 101114 - DNA, 25 bp, Mus musculus
acagctctcagctgttaggcacgtg

SEQ ID NO: 101115 - DNA, 25 bp, Mus musculus
acagctctcaggatggaccttctaa

SEQ ID NO: 101116 - DNA, 25 bp, Mus musculus
acagctctcaggttggaccttctaa

SEQ ID NO: 101117 - DNA, 25 bp, Mus musculus
acagctctccccaggtggtatgagg

SEQ ID NO: 101118 - DNA, 25 bp, Mus musculus
acagctctcccctggtggtatgagg

SEQ ID NO: 101119 - DNA, 25 bp, Mus musculus
acagctctcctacctggataagcta

SEQ ID NO: 101120 - DNA, 25 bp, Mus musculus
acagctctcctagctggataagcta

SEQ ID NO: 101121 - DNA, 25 bp, Mus musculus
acagctctcgttcggcttccaggtg

SEQ ID NO: 101122 - DNA, 25 bp, Mus musculus
acagctctcgttgggcttccaggtg

SEQ ID NO: 101123 - DNA, 25 bp, Mus musculus
acagctctctctcactcagtggaga

SEQ ID NO: 101124 - DNA, 25 bp, Mus musculus
acagctctctctgactcagtggaga

SEQ ID NO: 101125 - DNA, 25 bp, Mus musculus
acagctctctgtcctatcaggtggg

SEQ ID NO: 101126 - DNA, 25 bp, Mus musculus
acagctctctgtgctatcaggtggg

SEQ ID NO: 101127 - DNA, 25 bp, Mus musculus
acagctctcttgacttcttaagaac

SEQ ID NO: 101128 - DNA, 25 bp, Mus musculus
acagctctcttgtcttcttaagaac

SEQ ID NO: 101129 - DNA, 25 bp, Mus musculus
acagctctgaggaggctagagagcc

SEQ ID NO: 101130 - DNA, 25 bp, Mus musculus
acagctctgaggagtcactgggcaa

SEQ ID NO: 101131 - DNA, 25 bp, Mus musculus
acagctctgaggtggctagagagcc

SEQ ID NO: 101132 - DNA, 25 bp, Mus musculus
acagctctgaggtgtcactgggcaa

SEQ ID NO: 101133 - DNA, 25 bp, Mus musculus
acagctctgcagcttactatgctaa

SEQ ID NO: 101134 - DNA, 25 bp, Mus musculus
acagctctgcaggttactatgctaa

SEQ ID NO: 101135 - DNA, 25 bp, Mus musculus
acagctctgcccctcagttgaggga

SEQ ID NO: 101136 - DNA, 25 bp, Mus musculus
acagctctgcccgtcagttgaggga

SEQ ID NO: 101137 - DNA, 25 bp, Mus musculus
acagctctggctatgactgactcct

SEQ ID NO: 101138 - DNA, 25 bp, Mus musculus
acagctctggctattgcgggtcaaa

SEQ ID NO: 101139 - DNA, 25 bp, Mus musculus
acagctctggctttgactgactcct

SEQ ID NO: 101140 - DNA, 25 bp, Mus musculus
acagctctggcttttgcgggtcaaa

SEQ ID NO: 101141 - DNA, 25 bp, Mus musculus
acagctctgtcactacccaagctta

SEQ ID NO: 101142 - DNA, 25 bp, Mus musculus
acagctctgtcagtacccaagctta

SEQ ID NO: 101143 - DNA, 25 bp, Mus musculus
acagctctgtgcattgtttctgacc

SEQ ID NO: 101144 - DNA, 25 bp, Mus musculus
acagctctgtgctttgtttctgacc

SEQ ID NO: 101145 - DNA, 25 bp, Mus musculus
acagctctgtgtcgactgttccaag

SEQ ID NO: 101146 - DNA, 25 bp, Mus musculus
acagctctgtgtcggtctaatggaa

SEQ ID NO: 101147 - DNA, 25 bp, Mus musculus
acagctctgtgtggactgttccaag

SEQ ID NO: 101148 - DNA, 25 bp, Mus musculus
acagctctgtgtgggtctaatggaa

SEQ ID NO: 101149 - DNA, 25 bp, Mus musculus
acagctctgttgaacttctgcggct

SEQ ID NO: 101150 - DNA, 25 bp, Mus musculus
acagctctgttgtacttctgcggct

SEQ ID NO: 101151 - DNA, 25 bp, Mus musculus
acagctcttgcaagacaacctgaag

SEQ ID NO: 101152 - DNA, 25 bp, Mus musculus
acagctcttgcatgacaacctgaag

SEQ ID NO: 101153 - DNA, 25 bp, Mus musculus
acagctcttggaacaagcccaggac

SEQ ID NO: 101154 - DNA, 25 bp, Mus musculus
acagctcttggatcaagcccaggac

SEQ ID NO: 101155 - DNA, 25 bp, Mus musculus
acagctcttgtcaaaggacctgctt

SEQ ID NO: 101156 - DNA, 25 bp, Mus musculus
acagctcttgtcagggtgccctggt

SEQ ID NO: 101157 - DNA, 25 bp, Mus musculus
acagctcttgtctaaggacctgctt

SEQ ID NO: 101158 - DNA, 25 bp, Mus musculus
acagctcttgtctgggtgccctggt

SEQ ID NO: 101159 - DNA, 25 bp, Mus musculus
acagctgaaaggacacgttctgaga

SEQ ID NO: 101160 - DNA, 25 bp, Mus musculus
acagctgaaaggtcacgttctgaga

SEQ ID NO: 101161 - DNA, 25 bp, Mus musculus
acagctgaagaccagatgtatttct

SEQ ID NO: 101162 - DNA, 25 bp, Mus musculus
acagctgaagacgagatgtatttct

SEQ ID NO: 101163 - DNA, 25 bp, Mus musculus
acagctgaatccattcatgtatgag

SEQ ID NO: 101164 - DNA, 25 bp, Mus musculus
acagctgaatcctttcatgtatgag

SEQ ID NO: 101165 - DNA, 25 bp, Mus musculus
acagctgaatgcaggcatcgctctg

SEQ ID NO: 101166 - DNA, 25 bp, Mus musculus
acagctgaatgctggcatcgctctg

SEQ ID NO: 101167 - DNA, 25 bp, Mus musculus
acagctgacactcttgctgctgtca

SEQ ID NO: 101168 - DNA, 25 bp, Mus musculus
acagctgacactgttgctgctgtca

SEQ ID NO: 101169 - DNA, 25 bp, Mus musculus
acagctgaccacaagctcttaatga

SEQ ID NO: 101170 - DNA, 25 bp, Mus musculus
acagctgaccactagctcttaatga

SEQ ID NO: 101171 - DNA, 25 bp, Mus musculus
acagctgaccataagttgtgccagg

SEQ ID NO: 101172 - DNA, 25 bp, Mus musculus
acagctgaccatcgttcgggtagtt

SEQ ID NO: 101173 - DNA, 25 bp, Mus musculus
acagctgaccatggttcgggtagtt

SEQ ID NO: 101174 - DNA, 25 bp, Mus musculus
acagctgaccattagttgtgccagg

SEQ ID NO: 101175 - DNA, 25 bp, Mus musculus
acagctgacgagacggaagtactca

SEQ ID NO: 101176 - DNA, 25 bp, Mus musculus
acagctgacgagtcggaagtactca

SEQ ID NO: 101177 - DNA, 25 bp, Mus musculus
acagctgactgtaaggccttcttag

SEQ ID NO: 101178 - DNA, 25 bp, Mus musculus
acagctgactgttaggccttcttag

SEQ ID NO: 101179 - DNA, 25 bp, Mus musculus
acagctgagaagagctaccgggtca

SEQ ID NO: 101180 - DNA, 25 bp, Mus musculus
acagctgagaagtgctaccgggtca

SEQ ID NO: 101181 - DNA, 25 bp, Mus musculus
acagctgagatgcttcattacatca

SEQ ID NO: 101182 - DNA, 25 bp, Mus musculus
acagctgagatggttcattacatca

SEQ ID NO: 101183 - DNA, 25 bp, Mus musculus
acagctgagcacagggaccttcaaa

SEQ ID NO: 101184 - DNA, 25 bp, Mus musculus
acagctgagcactgggaccttcaaa

SEQ ID NO: 101185 - DNA, 25 bp, Mus musculus
acagctgagcgaatatttggtgcca

SEQ ID NO: 101186 - DNA, 25 bp, Mus musculus
acagctgagcgattatttggtgcca

SEQ ID NO: 101187 - DNA, 25 bp, Mus musculus
acagctgagcgcctagcatgcacgg

SEQ ID NO: 101188 - DNA, 25 bp, Mus musculus
acagctgagcgcgtagcatgcacgg

SEQ ID NO: 101189 - DNA, 25 bp, Mus musculus
acagctgagcttaggacgacgccca

SEQ ID NO: 101190 - DNA, 25 bp, Mus musculus
acagctgagctttggacgacgccca

SEQ ID NO: 101191 - DNA, 25 bp, Mus musculus
acagctgagggcaagtttcacagac

SEQ ID NO: 101192 - DNA, 25 bp, Mus musculus
acagctgagggctagtttcacagac

SEQ ID NO: 101193 - DNA, 25 bp, Mus musculus
acagctgaggtactgccacgctagg

SEQ ID NO: 101194 - DNA, 25 bp, Mus musculus
acagctgaggtagtgccacgctagg

SEQ ID NO: 101195 - DNA, 25 bp, Mus musculus
acagctgagtccaggtgccttggaa

SEQ ID NO: 101196 - DNA, 25 bp, Mus musculus
acagctgagtcctggtgccttggaa

SEQ ID NO: 101197 - DNA, 25 bp, Mus musculus
acagctgagtggcaacctgggaacc

SEQ ID NO: 101198 - DNA, 25 bp, Mus musculus
acagctgagtgggaacctgggaacc

SEQ ID NO: 101199 - DNA, 25 bp, Mus musculus
acagctgatcttcactcttacatga

SEQ ID NO: 101200 - DNA, 25 bp, Mus musculus
acagctgatcttgactcttacatga

SEQ ID NO: 101201 - DNA, 25 bp, Mus musculus
acagctgattatctgcctgagtggg

SEQ ID NO: 101202 - DNA, 25 bp, Mus musculus
acagctgattatgtgcctgagtggg

SEQ ID NO: 101203 - DNA, 25 bp, Mus musculus
acagctgcacaacatgctttaatca

SEQ ID NO: 101204 - DNA, 25 bp, Mus musculus
acagctgcacaagatgctttaatca

SEQ ID NO: 101205 - DNA, 25 bp, Mus musculus
acagctgcagatccaaatagacaat

SEQ ID NO: 101206 - DNA, 25 bp, Mus musculus
acagctgcagatgcaaatagacaat

SEQ ID NO: 101207 - DNA, 25 bp, Mus musculus
acagctgcagcaatccgaggttgga

SEQ ID NO: 101208 - DNA, 25 bp, Mus musculus
acagctgcagcattccgaggttgga

SEQ ID NO: 101209 - DNA, 25 bp, Mus musculus
acagctgcaggacccatgggagcct

SEQ ID NO: 101210 - DNA, 25 bp, Mus musculus
acagctgcaggagccatgggagcct

SEQ ID NO: 101211 - DNA, 25 bp, Mus musculus
acagctgcagtgagatgccgtcctt

SEQ ID NO: 101212 - DNA, 25 bp, Mus musculus
acagctgcagtgtgatgccgtcctt

SEQ ID NO: 101213 - DNA, 25 bp, Mus musculus
acagctgccaacacacagttcttcc

SEQ ID NO: 101214 - DNA, 25 bp, Mus musculus
acagctgccaactcacagttcttcc

SEQ ID NO: 101215 - DNA, 25 bp, Mus musculus
acagctgccatcaggcgacggtgtc

SEQ ID NO: 101216 - DNA, 25 bp, Mus musculus
acagctgccatcatgtttggtgaca

SEQ ID NO: 101217 - DNA, 25 bp, Mus musculus
acagctgccatctggcgacggtgtc

SEQ ID NO: 101218 - DNA, 25 bp, Mus musculus
acagctgccatcttgtttggtgaca

SEQ ID NO: 101219 - DNA, 25 bp, Mus musculus
acagctgccctcagtattaggagct

SEQ ID NO: 101220 - DNA, 25 bp, Mus musculus
acagctgccctctgtattaggagct

SEQ ID NO: 101221 - DNA, 25 bp, Mus musculus
acagctgccgttaccgtctgtagag

SEQ ID NO: 101222 - DNA, 25 bp, Mus musculus
acagctgccgtttccgtctgtagag

SEQ ID NO: 101223 - DNA, 25 bp, Mus musculus
acagctgcctacacatcttggaggg

SEQ ID NO: 101224 - DNA, 25 bp, Mus musculus
acagctgcctactcatcttggaggg

SEQ ID NO: 101225 - DNA, 25 bp, Mus musculus
acagctgcctgaagtcctagccaga

SEQ ID NO: 101226 - DNA, 25 bp, Mus musculus
acagctgcctgatgtcctagccaga

SEQ ID NO: 101227 - DNA, 25 bp, Mus musculus
acagctgccttcaatgccgagtttt

SEQ ID NO: 101228 - DNA, 25 bp, Mus musculus
acagctgccttctatgccgagtttt

SEQ ID NO: 101229 - DNA, 25 bp, Mus musculus
acagctgctctcaggtctcgtgcat

SEQ ID NO: 101230 - DNA, 25 bp, Mus musculus
acagctgctctctggtctcgtgcat

SEQ ID NO: 101231 - DNA, 25 bp, Mus musculus
acagctgctgcaacttgaggcacca

SEQ ID NO: 101232 - DNA, 25 bp, Mus musculus
acagctgctgcatcttgaggcacca

SEQ ID NO: 101233 - DNA, 25 bp, Mus musculus
acagctgctggcctatgggaccaag

SEQ ID NO: 101234 - DNA, 25 bp, Mus musculus
acagctgctggcgtatgggaccaag

SEQ ID NO: 101235 - DNA, 25 bp, Mus musculus
acagctgctggtctggaccatcgag

SEQ ID NO: 101236 - DNA, 25 bp, Mus musculus
acagctgctggtgtggaccatcgag

SEQ ID NO: 101237 - DNA, 25 bp, Mus musculus
acagctgctgtgctcatcaatggct

SEQ ID NO: 101238 - DNA, 25 bp, Mus musculus
acagctgctgtggtcatcaatggct

SEQ ID NO: 101239 - DNA, 25 bp, Mus musculus
acagctgctgttatgttgacactag

SEQ ID NO: 101240 - DNA, 25 bp, Mus musculus
acagctgctgttctatgtgaggaac

SEQ ID NO: 101241 - DNA, 25 bp, Mus musculus
acagctgctgttgtatgtgaggaac

SEQ ID NO: 101242 - DNA, 25 bp, Mus musculus
acagctgctgttttgttgacactag

SEQ ID NO: 101243 - DNA, 25 bp, Mus musculus
acagctgcttagaatgtgtgattgc

SEQ ID NO: 101244 - DNA, 25 bp, Mus musculus
acagctgcttagtatgtgtgattgc

SEQ ID NO: 101245 - DNA, 25 bp, Mus musculus
acagctgcttcaaaatttggtcgtt

SEQ ID NO: 101246 - DNA, 25 bp, Mus musculus
acagctgcttcataatttggtcgtt

SEQ ID NO: 101247 - DNA, 25 bp, Mus musculus
acagctgcttggcaatgtgttctag

SEQ ID NO: 101248 - DNA, 25 bp, Mus musculus
acagctgcttgggaatgtgttctag

SEQ ID NO: 101249 - DNA, 25 bp, Mus musculus
acagctgcttgtagtcatcattcca

SEQ ID NO: 101250 - DNA, 25 bp, Mus musculus
acagctgcttgttgtcatcattcca

SEQ ID NO: 101251 - DNA, 25 bp, Mus musculus
acagctggaagcatctgactcagga

SEQ ID NO: 101252 - DNA, 25 bp, Mus musculus
acagctggaagcttctgactcagga

SEQ ID NO: 101253 - DNA, 25 bp, Mus musculus
acagctggagagatgccctgtgcag

SEQ ID NO: 101254 - DNA, 25 bp, Mus musculus
acagctggagagttgccctgtgcag

SEQ ID NO: 101255 - DNA, 25 bp, Mus musculus
acagctggagcacaagccctgtttg

SEQ ID NO: 101256 - DNA, 25 bp, Mus musculus
acagctggagcagaagccctgtttg

SEQ ID NO: 101257 - DNA, 25 bp, Mus musculus
acagctggagctagaatctgacctc

SEQ ID NO: 101258 - DNA, 25 bp, Mus musculus
acagctggagcttgaatctgacctc

SEQ ID NO: 101259 - DNA, 25 bp, Mus musculus
acagctggaggcaatgcttctgcca

SEQ ID NO: 101260 - DNA, 25 bp, Mus musculus
acagctggaggctatgcttctgcca

SEQ ID NO: 101261 - DNA, 25 bp, Mus musculus
acagctggagtcaaagaagaccatc

SEQ ID NO: 101262 - DNA, 25 bp, Mus musculus
acagctggagtcagggctctcgtgc

SEQ ID NO: 101263 - DNA, 25 bp, Mus musculus
acagctggagtctaagaagaccatc

SEQ ID NO: 101264 - DNA, 25 bp, Mus musculus
acagctggagtctgggctctcgtgc

SEQ ID NO: 101265 - DNA, 25 bp, Mus musculus
acagctggatgtcgcttttgaacct

SEQ ID NO: 101266 - DNA, 25 bp, Mus musculus
acagctggatgtggcttttgaacct

SEQ ID NO: 101267 - DNA, 25 bp, Mus musculus
acagctggccgaaggcttttgtgaa

SEQ ID NO: 101268 - DNA, 25 bp, Mus musculus
acagctggccgatggcttttgtgaa

SEQ ID NO: 101269 - DNA, 25 bp, Mus musculus
acagctggcctaaccactcttgagt

SEQ ID NO: 101270 - DNA, 25 bp, Mus musculus
acagctggcctatccactcttgagt

SEQ ID NO: 101271 - DNA, 25 bp, Mus musculus
acagctggctctaaactgctccttg

SEQ ID NO: 101272 - DNA, 25 bp, Mus musculus
acagctggctcttaactgctccttg

SEQ ID NO: 101273 - DNA, 25 bp, Mus musculus
acagctggctgacctacaacagctg

SEQ ID NO: 101274 - DNA, 25 bp, Mus musculus
acagctggctgagctacaacagctg

SEQ ID NO: 101275 - DNA, 25 bp, Mus musculus
acagctggcttgctctcaaaatcta

SEQ ID NO: 101276 - DNA, 25 bp, Mus musculus
acagctggcttggtctcaaaatcta

SEQ ID NO: 101277 - DNA, 25 bp, Mus musculus
acagctggctttagcgttttgcaga

SEQ ID NO: 101278 - DNA, 25 bp, Mus musculus
acagctggcttttgcgttttgcaga

SEQ ID NO: 101279 - DNA, 25 bp, Mus musculus
acagctgggaagcagatgcagaact

SEQ ID NO: 101280 - DNA, 25 bp, Mus musculus
acagctgggaaggagatgcagaact

SEQ ID NO: 101281 - DNA, 25 bp, Mus musculus
acagctgggatgagccgcctggata

SEQ ID NO: 101282 - DNA, 25 bp, Mus musculus
acagctgggatgtgccgcctggata

SEQ ID NO: 101283 - DNA, 25 bp, Mus musculus
acagctggtccacagagagccgatt

SEQ ID NO: 101284 - DNA, 25 bp, Mus musculus
acagctggtccagagagagccgatt

SEQ ID NO: 101285 - DNA, 25 bp, Mus musculus
acagctggtcccagagcttgaagat

SEQ ID NO: 101286 - DNA, 25 bp, Mus musculus
acagctggtccctgagcttgaagat

SEQ ID NO: 101287 - DNA, 25 bp, Mus musculus
acagctggtgacatcccttgtagag

SEQ ID NO: 101288 - DNA, 25 bp, Mus musculus
acagctggtgacttcccttgtagag

SEQ ID NO: 101289 - DNA, 25 bp, Mus musculus
acagctggtggtagcaggtctccca

SEQ ID NO: 101290 - DNA, 25 bp, Mus musculus
acagctggtggttgcaggtctccca

SEQ ID NO: 101291 - DNA, 25 bp, Mus musculus
acagctggttgtagtggtacactct

SEQ ID NO: 101292 - DNA, 25 bp, Mus musculus
acagctggttgttgtggtacactct

SEQ ID NO: 101293 - DNA, 25 bp, Mus musculus
acagctgtaacaatggcaaccttat

SEQ ID NO: 101294 - DNA, 25 bp, Mus musculus
acagctgtaacattggcaaccttat

SEQ ID NO: 101295 - DNA, 25 bp, Mus musculus
acagctgtaaccatcagtcttccac

SEQ ID NO: 101296 - DNA, 25 bp, Mus musculus
acagctgtaaccatccatggatctt

SEQ ID NO: 101297 - DNA, 25 bp, Mus musculus
acagctgtaaccttcagtcttccac

SEQ ID NO: 101298 - DNA, 25 bp, Mus musculus
acagctgtaaccttccatggatctt

SEQ ID NO: 101299 - DNA, 25 bp, Mus musculus
acagctgtattaccatgtgaggtac

SEQ ID NO: 101300 - DNA, 25 bp, Mus musculus
acagctgtattagcatgtgaggtac

SEQ ID NO: 101301 - DNA, 25 bp, Mus musculus
acagctgtcaaaactcaaaagtgaa

SEQ ID NO: 101302 - DNA, 25 bp, Mus musculus
acagctgtcaaaagttacctccata

SEQ ID NO: 101303 - DNA, 25 bp, Mus musculus
acagctgtcaaatctcaaaagtgaa

SEQ ID NO: 101304 - DNA, 25 bp, Mus musculus
acagctgtcaaatgttacctccata

SEQ ID NO: 101305 - DNA, 25 bp, Mus musculus
acagctgtcagacctggtgtgcagc

SEQ ID NO: 101306 - DNA, 25 bp, Mus musculus
acagctgtcagagctggtgtgcagc

SEQ ID NO: 101307 - DNA, 25 bp, Mus musculus
acagctgtcattctagccatgtttt

SEQ ID NO: 101308 - DNA, 25 bp, Mus musculus
acagctgtcattgtagccatgtttt

SEQ ID NO: 101309 - DNA, 25 bp, Mus musculus
acagctgtccagagttggtgattcc

SEQ ID NO: 101310 - DNA, 25 bp, Mus musculus
acagctgtccagtgttggtgattcc

SEQ ID NO: 101311 - DNA, 25 bp, Mus musculus
acagctgtcctcagtatggagcact

SEQ ID NO: 101312 - DNA, 25 bp, Mus musculus
acagctgtcctctgtatggagcact

SEQ ID NO: 101313 - DNA, 25 bp, Mus musculus
acagctgtcctgagaatggtacttg

SEQ ID NO: 101314 - DNA, 25 bp, Mus musculus
acagctgtcctgtgaatggtacttg

SEQ ID NO: 101315 - DNA, 25 bp, Mus musculus
acagctgtccttagccatcagtgct

SEQ ID NO: 101316 - DNA, 25 bp, Mus musculus
acagctgtcctttgccatcagtgct

SEQ ID NO: 101317 - DNA, 25 bp, Mus musculus
acagctgtcgcacatgcccagaaga

SEQ ID NO: 101318 - DNA, 25 bp, Mus musculus
acagctgtcgcagatgcccagaaga

SEQ ID NO: 101319 - DNA, 25 bp, Mus musculus
acagctgtctctatgaagccatggc

SEQ ID NO: 101320 - DNA, 25 bp, Mus musculus
acagctgtctctttgaagccatggc

SEQ ID NO: 101321 - DNA, 25 bp, Mus musculus
acagctgtgactacttcctgaacac

SEQ ID NO: 101322 - DNA, 25 bp, Mus musculus
acagctgtgacttcttcctgaacac

SEQ ID NO: 101323 - DNA, 25 bp, Mus musculus
acagctgtgagcatctcagcatgga

SEQ ID NO: 101324 - DNA, 25 bp, Mus musculus
acagctgtgagcttctcagcatgga

SEQ ID NO: 101325 - DNA, 25 bp, Mus musculus
acagctgtgccaacccagggaaaag

SEQ ID NO: 101326 - DNA, 25 bp, Mus musculus
acagctgtgccacgacctgtggaca

SEQ ID NO: 101327 - DNA, 25 bp, Mus musculus
acagctgtgccaggacctgtggaca

SEQ ID NO: 101328 - DNA, 25 bp, Mus musculus
acagctgtgccatcccagggaaaag

SEQ ID NO: 101329 - DNA, 25 bp, Mus musculus
acagctgtgctgctatctcaggaga

SEQ ID NO: 101330 - DNA, 25 bp, Mus musculus
acagctgtgctggtatctcaggaga

SEQ ID NO: 101331 - DNA, 25 bp, Mus musculus
acagctgtggagaaggccgacacct

SEQ ID NO: 101332 - DNA, 25 bp, Mus musculus
acagctgtggagtaggccgacacct

SEQ ID NO: 101333 - DNA, 25 bp, Mus musculus
acagctgtggatagttgaactgctt

SEQ ID NO: 101334 - DNA, 25 bp, Mus musculus
acagctgtggattgttgaactgctt

SEQ ID NO: 101335 - DNA, 25 bp, Mus musculus
acagctgtggctctgagaaccttga

SEQ ID NO: 101336 - DNA, 25 bp, Mus musculus
acagctgtggctgtgagaaccttga

SEQ ID NO: 101337 - DNA, 25 bp, Mus musculus
acagctgtgtaccttatgattcata

SEQ ID NO: 101338 - DNA, 25 bp, Mus musculus
acagctgtgtacgttatgattcata

SEQ ID NO: 101339 - DNA, 25 bp, Mus musculus
acagctgtgtagaaaccccgtgttc

SEQ ID NO: 101340 - DNA, 25 bp, Mus musculus
acagctgtgtagtaaccccgtgttc

SEQ ID NO: 101341 - DNA, 25 bp, Mus musculus
acagctgttcacagggtttgcagca

SEQ ID NO: 101342 - DNA, 25 bp, Mus musculus
acagctgttcacctaatcctgacca

SEQ ID NO: 101343 - DNA, 25 bp, Mus musculus
acagctgttcacgtaatcctgacca

SEQ ID NO: 101344 - DNA, 25 bp, Mus musculus
acagctgttcactgggtttgcagca

SEQ ID NO: 101345 - DNA, 25 bp, Mus musculus
acagctgttcttatggttcactatt

SEQ ID NO: 101346 - DNA, 25 bp, Mus musculus
acagctgttcttttggttcactatt

SEQ ID NO: 101347 - DNA, 25 bp, Mus musculus
acagctgttggcatggaataccaca

SEQ ID NO: 101348 - DNA, 25 bp, Mus musculus
acagctgttggcttggaataccaca

SEQ ID NO: 101349 - DNA, 25 bp, Mus musculus
acagctgttgtaataatgacctatt

SEQ ID NO: 101350 - DNA, 25 bp, Mus musculus
acagctgttgtattaatgacctatt

SEQ ID NO: 101351 - DNA, 25 bp, Mus musculus
acagctgtttaccagactgcaggtc

SEQ ID NO: 101352 - DNA, 25 bp, Mus musculus
acagctgtttacgagactgcaggtc

SEQ ID NO: 101353 - DNA, 25 bp, Mus musculus
acagctgtttctcagagcgtccatc

SEQ ID NO: 101354 - DNA, 25 bp, Mus musculus
acagctgtttctgagagcgtccatc

SEQ ID NO: 101355 - DNA, 25 bp, Mus musculus
acagcttaactgattggactggaaa

SEQ ID NO: 101356 - DNA, 25 bp, Mus musculus
acagcttaactgtttggactggaaa

SEQ ID NO: 101357 - DNA, 25 bp, Mus musculus
acagcttactgaaagaggcccagca

SEQ ID NO: 101358 - DNA, 25 bp, Mus musculus
acagcttactgatagaggcccagca

SEQ ID NO: 101359 - DNA, 25 bp, Mus musculus
acagcttagcgtcttccgccggaga

SEQ ID NO: 101360 - DNA, 25 bp, Mus musculus
acagcttagcgtgttccgccggaga

SEQ ID NO: 101361 - DNA, 25 bp, Mus musculus
acagcttagctcagattcaaaagac

SEQ ID NO: 101362 - DNA, 25 bp, Mus musculus
acagcttagctctgattcaaaagac

SEQ ID NO: 101363 - DNA, 25 bp, Mus musculus
acagcttagtggcttgtcctttgag

SEQ ID NO: 101364 - DNA, 25 bp, Mus musculus
acagcttagtgggttgtcctttgag

SEQ ID NO: 101365 - DNA, 25 bp, Mus musculus
acagcttagtttagttgggccgtct

SEQ ID NO: 101366 - DNA, 25 bp, Mus musculus
acagcttagtttcgtttgagtcaca

SEQ ID NO: 101367 - DNA, 25 bp, Mus musculus
acagcttagtttggtttgagtcaca

SEQ ID NO: 101368 - DNA, 25 bp, Mus musculus
acagcttagttttgttgggccgtct

SEQ ID NO: 101369 - DNA, 25 bp, Mus musculus
acagcttattagaccctagttgcca

SEQ ID NO: 101370 - DNA, 25 bp, Mus musculus
acagcttattagtccctagttgcca

SEQ ID NO: 101371 - DNA, 25 bp, Mus musculus
acagcttcacccatccttgagctgt

SEQ ID NO: 101372 - DNA, 25 bp, Mus musculus
acagcttcacccttccttgagctgt

SEQ ID NO: 101373 - DNA, 25 bp, Mus musculus
acagcttcacgcacgggtggacaaa

SEQ ID NO: 101374 - DNA, 25 bp, Mus musculus
acagcttcacgctcgggtggacaaa

SEQ ID NO: 101375 - DNA, 25 bp, Mus musculus
acagcttcagctagtcatcttacac

SEQ ID NO: 101376 - DNA, 25 bp, Mus musculus
acagcttcagcttgtcatcttacac

SEQ ID NO: 101377 - DNA, 25 bp, Mus musculus
acagcttcaggtcttggtcctcagg

SEQ ID NO: 101378 - DNA, 25 bp, Mus musculus
acagcttcaggtgttggtcctcagg

SEQ ID NO: 101379 - DNA, 25 bp, Mus musculus
acagcttcagtaactccctgtagtt

SEQ ID NO: 101380 - DNA, 25 bp, Mus musculus
acagcttcagtatctccctgtagtt

SEQ ID NO: 101381 - DNA, 25 bp, Mus musculus
acagcttcagtgaccttggctctat

SEQ ID NO: 101382 - DNA, 25 bp, Mus musculus
acagcttcagtgtccttggctctat

SEQ ID NO: 101383 - DNA, 25 bp, Mus musculus
acagcttcatgtcgtttagttttca

SEQ ID NO: 101384 - DNA, 25 bp, Mus musculus
acagcttcatgtggtttagttttca

SEQ ID NO: 101385 - DNA, 25 bp, Mus musculus
acagcttccataaatagacctcctc

SEQ ID NO: 101386 - DNA, 25 bp, Mus musculus
acagcttccatatatagacctcctc

SEQ ID NO: 101387 - DNA, 25 bp, Mus musculus
acagcttcccaactcaagactcttc

SEQ ID NO: 101388 - DNA, 25 bp, Mus musculus
acagcttcccaagtcaagactcttc

SEQ ID NO: 101389 - DNA, 25 bp, Mus musculus
acagcttccccaaggttagcagcag

SEQ ID NO: 101390 - DNA, 25 bp, Mus musculus
acagcttccccatggttagcagcag

SEQ ID NO: 101391 - DNA, 25 bp, Mus musculus
acagcttccctgcatcgacattctt

SEQ ID NO: 101392 - DNA, 25 bp, Mus musculus
acagcttccctggatcgacattctt

SEQ ID NO: 101393 - DNA, 25 bp, Mus musculus
acagcttccggaaagtcaggaccat

SEQ ID NO: 101394 - DNA, 25 bp, Mus musculus
acagcttccggatagtcaggaccat

SEQ ID NO: 101395 - DNA, 25 bp, Mus musculus
acagcttcctacatgggaccatgat

SEQ ID NO: 101396 - DNA, 25 bp, Mus musculus
acagcttcctacttgggaccatgat

SEQ ID NO: 101397 - DNA, 25 bp, Mus musculus
acagcttcctagaaactcacatcaa

SEQ ID NO: 101398 - DNA, 25 bp, Mus musculus
acagcttcctagtaactcacatcaa

SEQ ID NO: 101399 - DNA, 25 bp, Mus musculus
acagcttcctcactgtgttgaacaa

SEQ ID NO: 101400 - DNA, 25 bp, Mus musculus
acagcttcctcagtgtgttgaacaa

SEQ ID NO: 101401 - DNA, 25 bp, Mus musculus
acagcttcctgacttttcccaagga

SEQ ID NO: 101402 - DNA, 25 bp, Mus musculus
acagcttcctgagttttcccaagga

SEQ ID NO: 101403 - DNA, 25 bp, Mus musculus
acagcttcctggaagcgggctcaga

SEQ ID NO: 101404 - DNA, 25 bp, Mus musculus
acagcttcctggctgactttgatta

SEQ ID NO: 101405 - DNA, 25 bp, Mus musculus
acagcttcctgggtgactttgatta

SEQ ID NO: 101406 - DNA, 25 bp, Mus musculus
acagcttcctggtagcgggctcaga

SEQ ID NO: 101407 - DNA, 25 bp, Mus musculus
acagcttccttgacaggacagactc

SEQ ID NO: 101408 - DNA, 25 bp, Mus musculus
acagcttccttgtcaggacagactc

SEQ ID NO: 101409 - DNA, 25 bp, Mus musculus
acagcttcgaggcatgcaccgcaag

SEQ ID NO: 101410 - DNA, 25 bp, Mus musculus
acagcttcgagggatgcaccgcaag

SEQ ID NO: 101411 - DNA, 25 bp, Mus musculus
acagcttcggagagtaccttaccct

SEQ ID NO: 101412 - DNA, 25 bp, Mus musculus
acagcttcggagtgtaccttaccct

SEQ ID NO: 101413 - DNA, 25 bp, Mus musculus
acagcttcgttccaagtcaccaagg

SEQ ID NO: 101414 - DNA, 25 bp, Mus musculus
acagcttcgttcgaagtcaccaagg

SEQ ID NO: 101415 - DNA, 25 bp, Mus musculus
acagcttctaggagatttcattcct

SEQ ID NO: 101416 - DNA, 25 bp, Mus musculus
acagcttctaggtgatttcattcct

SEQ ID NO: 101417 - DNA, 25 bp, Mus musculus
acagcttctcatcatggtgctctgc

SEQ ID NO: 101418 - DNA, 25 bp, Mus musculus
acagcttctcatgatggtgctctgc

SEQ ID NO: 101419 - DNA, 25 bp, Mus musculus
acagcttctcctaacaatgaaccga

SEQ ID NO: 101420 - DNA, 25 bp, Mus musculus
acagcttctccttacaatgaaccga

SEQ ID NO: 101421 - DNA, 25 bp, Mus musculus
acagcttctgtcatgtctctggaga

SEQ ID NO: 101422 - DNA, 25 bp, Mus musculus
acagcttctgtcttgtctctggaga

SEQ ID NO: 101423 - DNA, 25 bp, Mus musculus
acagcttcttcgatggaccagggac

SEQ ID NO: 101424 - DNA, 25 bp, Mus musculus
acagcttcttcgttggaccagggac

SEQ ID NO: 101425 - DNA, 25 bp, Mus musculus
acagcttcttctctaggttttgcct

SEQ ID NO: 101426 - DNA, 25 bp, Mus musculus
acagcttcttctgtaggttttgcct

SEQ ID NO: 101427 - DNA, 25 bp, Mus musculus
acagcttcttgaaccacttgtggtt

SEQ ID NO: 101428 - DNA, 25 bp, Mus musculus
acagcttcttgatccacttgtggtt

SEQ ID NO: 101429 - DNA, 25 bp, Mus musculus
acagcttctttgatccgtgttacga

SEQ ID NO: 101430 - DNA, 25 bp, Mus musculus
acagcttctttgttccgtgttacga

SEQ ID NO: 101431 - DNA, 25 bp, Mus musculus
acagcttgatggaaaggagaggttc

SEQ ID NO: 101432 - DNA, 25 bp, Mus musculus
acagcttgatggtaaggagaggttc

SEQ ID NO: 101433 - DNA, 25 bp, Mus musculus
acagcttgatgtcagccggctctga

SEQ ID NO: 101434 - DNA, 25 bp, Mus musculus
acagcttgatgtgagccggctctga

SEQ ID NO: 101435 - DNA, 25 bp, Mus musculus
acagcttgcaatccgcggtgatgaa

SEQ ID NO: 101436 - DNA, 25 bp, Mus musculus
acagcttgcaatgcgcggtgatgaa

SEQ ID NO: 101437 - DNA, 25 bp, Mus musculus
acagcttgctgcctaccaggaggaa

SEQ ID NO: 101438 - DNA, 25 bp, Mus musculus
acagcttgctgcgtaccaggaggaa

SEQ ID NO: 101439 - DNA, 25 bp, Mus musculus
acagcttgctggcatggtgttcgca

SEQ ID NO: 101440 - DNA, 25 bp, Mus musculus
acagcttgctgggatggtgttcgca

SEQ ID NO: 101441 - DNA, 25 bp, Mus musculus
acagcttggaccagtgggttctgca

SEQ ID NO: 101442 - DNA, 25 bp, Mus musculus
acagcttggacctgtgggttctgca

SEQ ID NO: 101443 - DNA, 25 bp, Mus musculus
acagcttggccaaatagtgtcttgc

SEQ ID NO: 101444 - DNA, 25 bp, Mus musculus
acagcttggccatatagtgtcttgc

SEQ ID NO: 101445 - DNA, 25 bp, Mus musculus
acagcttgggttccctgaaccttgg

SEQ ID NO: 101446 - DNA, 25 bp, Mus musculus
acagcttgggttgcctgaaccttgg

SEQ ID NO: 101447 - DNA, 25 bp, Mus musculus
acagcttggtggctagatgaactta

SEQ ID NO: 101448 - DNA, 25 bp, Mus musculus
acagcttggtgggtagatgaactta

SEQ ID NO: 101449 - DNA, 25 bp, Mus musculus
acagcttgtaatccagttccacggg

SEQ ID NO: 101450 - DNA, 25 bp, Mus musculus
acagcttgtaatctctctaatgtac

SEQ ID NO: 101451 - DNA, 25 bp, Mus musculus
acagcttgtaatgcagttccacggg

SEQ ID NO: 101452 - DNA, 25 bp, Mus musculus
acagcttgtaatgtctctaatgtac

SEQ ID NO: 101453 - DNA, 25 bp, Mus musculus
acagcttgtatgattcagactgctt

SEQ ID NO: 101454 - DNA, 25 bp, Mus musculus
acagcttgtatgtttcagactgctt

SEQ ID NO: 101455 - DNA, 25 bp, Mus musculus
acagcttgtcgccctttgagcagcg

SEQ ID NO: 101456 - DNA, 25 bp, Mus musculus
acagcttgtcgcgctttgagcagcg

SEQ ID NO: 101457 - DNA, 25 bp, Mus musculus
acagcttgtcttcaaggccacctgg

SEQ ID NO: 101458 - DNA, 25 bp, Mus musculus
acagcttgtcttgaaggccacctgg

SEQ ID NO: 101459 - DNA, 25 bp, Mus musculus
acagcttgtgttcatttgtcagagc

SEQ ID NO: 101460 - DNA, 25 bp, Mus musculus
acagcttgtgttgatttgtcagagc

SEQ ID NO: 101461 - DNA, 25 bp, Mus musculus
acagcttgtttaacggcagtgtcat

SEQ ID NO: 101462 - DNA, 25 bp, Mus musculus
acagcttgtttatcggcagtgtcat

SEQ ID NO: 101463 - DNA, 25 bp, Mus musculus
acagcttgttttcgactttgttaca

SEQ ID NO: 101464 - DNA, 25 bp, Mus musculus
acagcttgttttggactttgttaca

SEQ ID NO: 101465 - DNA, 25 bp, Mus musculus
acagctttaactaaggcaactttgg

SEQ ID NO: 101466 - DNA, 25 bp, Mus musculus
acagctttaactccttcattcatga

SEQ ID NO: 101467 - DNA, 25 bp, Mus musculus
acagctttaactgcttcattcatga

SEQ ID NO: 101468 - DNA, 25 bp, Mus musculus
acagctttaacttaggcaactttgg

SEQ ID NO: 101469 - DNA, 25 bp, Mus musculus
acagctttaatacccttagtggaaa

SEQ ID NO: 101470 - DNA, 25 bp, Mus musculus
acagctttaatagccttagtggaaa

SEQ ID NO: 101471 - DNA, 25 bp, Mus musculus
acagctttagaactgttgcctagtt

SEQ ID NO: 101472 - DNA, 25 bp, Mus musculus
acagctttagaagtgttgcctagtt

SEQ ID NO: 101473 - DNA, 25 bp, Mus musculus
acagctttatggacctccacttcag

SEQ ID NO: 101474 - DNA, 25 bp, Mus musculus
acagctttatggtcctccacttcag

SEQ ID NO: 101475 - DNA, 25 bp, Mus musculus
acagctttattacctcatgcgaact

SEQ ID NO: 101476 - DNA, 25 bp, Mus musculus
acagctttattagctcatgcgaact

SEQ ID NO: 101477 - DNA, 25 bp, Mus musculus
acagctttcaaacacacttccagtg

SEQ ID NO: 101478 - DNA, 25 bp, Mus musculus
acagctttcaaagacacttccagtg

SEQ ID NO: 101479 - DNA, 25 bp, Mus musculus
acagctttcagtagtcagctctttc

SEQ ID NO: 101480 - DNA, 25 bp, Mus musculus
acagctttcagttgtcagctctttc

SEQ ID NO: 101481 - DNA, 25 bp, Mus musculus
acagctttcctgaagtccataggtt

SEQ ID NO: 101482 - DNA, 25 bp, Mus musculus
acagctttcctgtagtccataggtt

SEQ ID NO: 101483 - DNA, 25 bp, Mus musculus
acagctttctacaccattgtctggg

SEQ ID NO: 101484 - DNA, 25 bp, Mus musculus
acagctttctactccattgtctggg

SEQ ID NO: 101485 - DNA, 25 bp, Mus musculus
acagctttcttaaacggccagggag

SEQ ID NO: 101486 - DNA, 25 bp, Mus musculus
acagctttcttaactgtggtgtgga

SEQ ID NO: 101487 - DNA, 25 bp, Mus musculus
acagctttcttatacggccagggag

SEQ ID NO: 101488 - DNA, 25 bp, Mus musculus
acagctttcttatctgtggtgtgga

SEQ ID NO: 101489 - DNA, 25 bp, Mus musculus
acagctttcttgcattccagcttca

SEQ ID NO: 101490 - DNA, 25 bp, Mus musculus
acagctttcttggattccagcttca

SEQ ID NO: 101491 - DNA, 25 bp, Mus musculus
acagctttgacacggaatagttctt

SEQ ID NO: 101492 - DNA, 25 bp, Mus musculus
acagctttgacagggaatagttctt

SEQ ID NO: 101493 - DNA, 25 bp, Mus musculus
acagctttgagcaatcttggtccag

SEQ ID NO: 101494 - DNA, 25 bp, Mus musculus
acagctttgagctatcttggtccag

SEQ ID NO: 101495 - DNA, 25 bp, Mus musculus
acagctttgaggagcgtgtggcttc

SEQ ID NO: 101496 - DNA, 25 bp, Mus musculus
acagctttgaggtgcgtgtggcttc

SEQ ID NO: 101497 - DNA, 25 bp, Mus musculus
acagctttgatgacacccgagtcag

SEQ ID NO: 101498 - DNA, 25 bp, Mus musculus
acagctttgatgtcacccgagtcag

SEQ ID NO: 101499 - DNA, 25 bp, Mus musculus
acagctttgcacactactttattat

SEQ ID NO: 101500 - DNA, 25 bp, Mus musculus
acagctttgcactctactttattat

SEQ ID NO: 101501 - DNA, 25 bp, Mus musculus
acagctttgctgatggcttttgtta

SEQ ID NO: 101502 - DNA, 25 bp, Mus musculus
acagctttgctgttggcttttgtta

SEQ ID NO: 101503 - DNA, 25 bp, Mus musculus
acagctttggagctcagctcttttt

SEQ ID NO: 101504 - DNA, 25 bp, Mus musculus
acagctttggaggtcagctcttttt

SEQ ID NO: 101505 - DNA, 25 bp, Mus musculus
acagctttgggaacttgtcctctgc

SEQ ID NO: 101506 - DNA, 25 bp, Mus musculus
acagctttgggatcttgtcctctgc

SEQ ID NO: 101507 - DNA, 25 bp, Mus musculus
acagctttgtcgctgtattccagtc

SEQ ID NO: 101508 - DNA, 25 bp, Mus musculus
acagctttgtcggtgtattccagtc

SEQ ID NO: 101509 - DNA, 25 bp, Mus musculus
acagctttgttgacctgccttagta

SEQ ID NO: 101510 - DNA, 25 bp, Mus musculus
acagctttgttgtcctgccttagta

SEQ ID NO: 101511 - DNA, 25 bp, Mus musculus
acagcttttaggaggttcagccaaa

SEQ ID NO: 101512 - DNA, 25 bp, Mus musculus
acagcttttaggtggttcagccaaa

SEQ ID NO: 101513 - DNA, 25 bp, Mus musculus
acagcttttctccatccgcagacag

SEQ ID NO: 101514 - DNA, 25 bp, Mus musculus
acagcttttctcgatccgcagacag

SEQ ID NO: 101515 - DNA, 25 bp, Mus musculus
acagcttttgccactcttggaagag

SEQ ID NO: 101516 - DNA, 25 bp, Mus musculus
acagcttttgcctctcttggaagag

SEQ ID NO: 101517 - DNA, 25 bp, Mus musculus
acagctttttaaaagcctggccacg

SEQ ID NO: 101518 - DNA, 25 bp, Mus musculus
acagctttttaatagcctggccacg

SEQ ID NO: 101519 - DNA, 25 bp, Mus musculus
acagctttttctccataaggcttct

SEQ ID NO: 101520 - DNA, 25 bp, Mus musculus
acagctttttctgcataaggcttct

SEQ ID NO: 101521 - DNA, 25 bp, Mus musculus
acagcttttttcctgaagggtgcct

SEQ ID NO: 101522 - DNA, 25 bp, Mus musculus
acagcttttttcgtgaagggtgcct

SEQ ID NO: 101523 - DNA, 25 bp, Mus musculus
acaggaaaacagatcgggcgcccgg

SEQ ID NO: 101524 - DNA, 25 bp, Mus musculus
acaggaaaacagttcgggcgcccgg

SEQ ID NO: 101525 - DNA, 25 bp, Mus musculus
acaggaaaagcccacgcgtgcactc

SEQ ID NO: 101526 - DNA, 25 bp, Mus musculus
acaggaaaagccgacgcgtgcactc

SEQ ID NO: 101527 - DNA, 25 bp, Mus musculus
acaggaaaatatcaagcacactctt

SEQ ID NO: 101528 - DNA, 25 bp, Mus musculus
acaggaaaatatgaagcacactctt

SEQ ID NO: 101529 - DNA, 25 bp, Mus musculus
acaggaaacagcaggccgtggttct

SEQ ID NO: 101530 - DNA, 25 bp, Mus musculus
acaggaaacagctggccgtggttct

SEQ ID NO: 101531 - DNA, 25 bp, Mus musculus
acaggaaaccctcttggtctcttag

SEQ ID NO: 101532 - DNA, 25 bp, Mus musculus
acaggaaaccctgttggtctcttag

SEQ ID NO: 101533 - DNA, 25 bp, Mus musculus
acaggaaacctccatgatccttctg

SEQ ID NO: 101534 - DNA, 25 bp, Mus musculus
acaggaaacctcgatgatccttctg

SEQ ID NO: 101535 - DNA, 25 bp, Mus musculus
acaggaaactgcaccaagcacctag

SEQ ID NO: 101536 - DNA, 25 bp, Mus musculus
acaggaaactgcatcttgacaatat

SEQ ID NO: 101537 - DNA, 25 bp, Mus musculus
acaggaaactgctccaagcacctag

SEQ ID NO: 101538 - DNA, 25 bp, Mus musculus
acaggaaactgcttcttgacaatat

SEQ ID NO: 101539 - DNA, 25 bp, Mus musculus
acaggaaactgtcctgcctgcagca

SEQ ID NO: 101540 - DNA, 25 bp, Mus musculus
acaggaaactgtgctgcctgcagca

SEQ ID NO: 101541 - DNA, 25 bp, Mus musculus
acaggaaagcatagtcccgactttt

SEQ ID NO: 101542 - DNA, 25 bp, Mus musculus
acaggaaagcattgtcccgactttt

SEQ ID NO: 101543 - DNA, 25 bp, Mus musculus
acaggaaattatctgcttctcaccc

SEQ ID NO: 101544 - DNA, 25 bp, Mus musculus
acaggaaattatgtgcttctcaccc

SEQ ID NO: 101545 - DNA, 25 bp, Mus musculus
acaggaacacagactgggcgtgctt

SEQ ID NO: 101546 - DNA, 25 bp, Mus musculus
acaggaacacagtctgggcgtgctt

SEQ ID NO: 101547 - DNA, 25 bp, Mus musculus
acaggaactattagccagatttggg

SEQ ID NO: 101548 - DNA, 25 bp, Mus musculus
acaggaactatttgccagatttggg

SEQ ID NO: 101549 - DNA, 25 bp, Mus musculus
acaggaactcagatgttcccacctt

SEQ ID NO: 101550 - DNA, 25 bp, Mus musculus
acaggaactcagttgttcccacctt

SEQ ID NO: 101551 - DNA, 25 bp, Mus musculus
acaggaactccaagcgccagaactc

SEQ ID NO: 101552 - DNA, 25 bp, Mus musculus
acaggaactccatgcgccagaactc

SEQ ID NO: 101553 - DNA, 25 bp, Mus musculus
acaggaactcctctggctggatgag

SEQ ID NO: 101554 - DNA, 25 bp, Mus musculus
acaggaactcctgtggctggatgag

SEQ ID NO: 101555 - DNA, 25 bp, Mus musculus
acaggaactcttattgcttgaccaa

SEQ ID NO: 101556 - DNA, 25 bp, Mus musculus
acaggaactctttttgcttgaccaa

SEQ ID NO: 101557 - DNA, 25 bp, Mus musculus
acaggaactgcaactccaggtgtac

SEQ ID NO: 101558 - DNA, 25 bp, Mus musculus
acaggaactgcatctccaggtgtac

SEQ ID NO: 101559 - DNA, 25 bp, Mus musculus
acaggaagagtacggctttctttct

SEQ ID NO: 101560 - DNA, 25 bp, Mus musculus
acaggaagagtagggctttctttct

SEQ ID NO: 101561 - DNA, 25 bp, Mus musculus
acaggaagcaaacaacacaacaggg

SEQ ID NO: 101562 - DNA, 25 bp, Mus musculus
acaggaagcaaagaacacaacaggg

SEQ ID NO: 101563 - DNA, 25 bp, Mus musculus
acaggaagccagacagcagcccaaa

SEQ ID NO: 101564 - DNA, 25 bp, Mus musculus
acaggaagccagtcagcagcccaaa

SEQ ID NO: 101565 - DNA, 25 bp, Mus musculus
acaggaagccatctctcgaatgagt

SEQ ID NO: 101566 - DNA, 25 bp, Mus musculus
acaggaagccatgtctcgaatgagt

SEQ ID NO: 101567 - DNA, 25 bp, Mus musculus
acaggaagcccacccagaagacttt

SEQ ID NO: 101568 - DNA, 25 bp, Mus musculus
acaggaagcccagccagaagacttt

SEQ ID NO: 101569 - DNA, 25 bp, Mus musculus
acaggaagcctcaaaacttcttgtt

SEQ ID NO: 101570 - DNA, 25 bp, Mus musculus
acaggaagcctctaaacttcttgtt

SEQ ID NO: 101571 - DNA, 25 bp, Mus musculus
acaggaagcgtacttttcttggact

SEQ ID NO: 101572 - DNA, 25 bp, Mus musculus
acaggaagcgtagttttcttggact

SEQ ID NO: 101573 - DNA, 25 bp, Mus musculus
acaggaagctgacaggttctgtgta

SEQ ID NO: 101574 - DNA, 25 bp, Mus musculus
acaggaagctgagaggttctgtgta

SEQ ID NO: 101575 - DNA, 25 bp, Mus musculus
acaggaagcttcagattataccgaa

SEQ ID NO: 101576 - DNA, 25 bp, Mus musculus
acaggaagcttctgattataccgaa

SEQ ID NO: 101577 - DNA, 25 bp, Mus musculus
acaggaaggcaaccacttactcgtc

SEQ ID NO: 101578 - DNA, 25 bp, Mus musculus
acaggaaggcaagcacttactcgtc

SEQ ID NO: 101579 - DNA, 25 bp, Mus musculus
acaggaaggcccaacctgcacggca

SEQ ID NO: 101580 - DNA, 25 bp, Mus musculus
acaggaaggccctacctgcacggca

SEQ ID NO: 101581 - DNA, 25 bp, Mus musculus
acaggaaggcttagcatggctgcac

SEQ ID NO: 101582 - DNA, 25 bp, Mus musculus
acaggaaggctttgcatggctgcac

SEQ ID NO: 101583 - DNA, 25 bp, Mus musculus
acaggaaggtttcttcttgcagttt

SEQ ID NO: 101584 - DNA, 25 bp, Mus musculus
acaggaaggtttgttcttgcagttt

SEQ ID NO: 101585 - DNA, 25 bp, Mus musculus
acaggaagtagcaggcacgccgcat

SEQ ID NO: 101586 - DNA, 25 bp, Mus musculus
acaggaagtagctggcacgccgcat

SEQ ID NO: 101587 - DNA, 25 bp, Mus musculus
acaggaagtcccatctttggaacaa

SEQ ID NO: 101588 - DNA, 25 bp, Mus musculus
acaggaagtcccttctttggaacaa

SEQ ID NO: 101589 - DNA, 25 bp, Mus musculus
acaggaagtggtcgccagacaggaa

SEQ ID NO: 101590 - DNA, 25 bp, Mus musculus
acaggaagtggtggccagacaggaa

SEQ ID NO: 101591 - DNA, 25 bp, Mus musculus
acaggaagttagcaaccagggccct

SEQ ID NO: 101592 - DNA, 25 bp, Mus musculus
acaggaagttaggaaccagggccct

SEQ ID NO: 101593 - DNA, 25 bp, Mus musculus
acaggaagttgtccttgtgcctctt

SEQ ID NO: 101594 - DNA, 25 bp, Mus musculus
acaggaagttgtgcttgtgcctctt

SEQ ID NO: 101595 - DNA, 25 bp, Mus musculus
acaggaatacaaagtctccatcccc

SEQ ID NO: 101596 - DNA, 25 bp, Mus musculus
acaggaatacaatgtctccatcccc

SEQ ID NO: 101597 - DNA, 25 bp, Mus musculus
acaggaatcaatcgccatgttaatt

SEQ ID NO: 101598 - DNA, 25 bp, Mus musculus
acaggaatcaatggccatgttaatt

SEQ ID NO: 101599 - DNA, 25 bp, Mus musculus
acaggaatccctagcagtttctcaa

SEQ ID NO: 101600 - DNA, 25 bp, Mus musculus
acaggaatcccttgcagtttctcaa

SEQ ID NO: 101601 - DNA, 25 bp, Mus musculus
acaggaatccttctgcaggagacca

SEQ ID NO: 101602 - DNA, 25 bp, Mus musculus
acaggaatccttgtgcaggagacca

SEQ ID NO: 101603 - DNA, 25 bp, Mus musculus
acaggaatctcaattggtgcagcat

SEQ ID NO: 101604 - DNA, 25 bp, Mus musculus
acaggaatctcatttggtgcagcat

SEQ ID NO: 101605 - DNA, 25 bp, Mus musculus
acaggaatctctacctgagcgctgg

SEQ ID NO: 101606 - DNA, 25 bp, Mus musculus
acaggaatctcttcctgagcgctgg

SEQ ID NO: 101607 - DNA, 25 bp, Mus musculus
acaggaatgcataaccttatttaga

SEQ ID NO: 101608 - DNA, 25 bp, Mus musculus
acaggaatgcattaccttatttaga

SEQ ID NO: 101609 - DNA, 25 bp, Mus musculus
acaggaatgcttacttaactcaaaa

SEQ ID NO: 101610 - DNA, 25 bp, Mus musculus
acaggaatgctttcttaactcaaaa

SEQ ID NO: 101611 - DNA, 25 bp, Mus musculus
acaggaatggccagacataggtgca

SEQ ID NO: 101612 - DNA, 25 bp, Mus musculus
acaggaatggcctgacataggtgca

SEQ ID NO: 101613 - DNA, 25 bp, Mus musculus
acaggaatggtgcttcttgggtttt

SEQ ID NO: 101614 - DNA, 25 bp, Mus musculus
acaggaatggtggttcttgggtttt

SEQ ID NO: 101615 - DNA, 25 bp, Mus musculus
acaggaattcttaatagttggccat

SEQ ID NO: 101616 - DNA, 25 bp, Mus musculus
acaggaattcttaatcccaattcaa

SEQ ID NO: 101617 - DNA, 25 bp, Mus musculus
acaggaattctttatagttggccat

SEQ ID NO: 101618 - DNA, 25 bp, Mus musculus
acaggaattctttatcccaattcaa

SEQ ID NO: 101619 - DNA, 25 bp, Mus musculus
acaggacaagtcctcctcagaaagg

SEQ ID NO: 101620 - DNA, 25 bp, Mus musculus
acaggacaagtcgtcctcagaaagg

SEQ ID NO: 101621 - DNA, 25 bp, Mus musculus
acaggacaatctcttcaggagtctt

SEQ ID NO: 101622 - DNA, 25 bp, Mus musculus
acaggacaatctgttcaggagtctt

SEQ ID NO: 101623 - DNA, 25 bp, Mus musculus
acaggacaatttaaccatcgtggct

SEQ ID NO: 101624 - DNA, 25 bp, Mus musculus
acaggacaattttaccatcgtggct

SEQ ID NO: 101625 - DNA, 25 bp, Mus musculus
acaggacacaggactgcagcacata

SEQ ID NO: 101626 - DNA, 25 bp, Mus musculus
acaggacacaggtctgcagcacata

SEQ ID NO: 101627 - DNA, 25 bp, Mus musculus
acaggacacatcaactctggtgaac

SEQ ID NO: 101628 - DNA, 25 bp, Mus musculus
acaggacacatctactctggtgaac

SEQ ID NO: 101629 - DNA, 25 bp, Mus musculus
acaggacaccttcggttcttctgta

SEQ ID NO: 101630 - DNA, 25 bp, Mus musculus
acaggacaccttgggttcttctgta

SEQ ID NO: 101631 - DNA, 25 bp, Mus musculus
acaggacagatacacaactatttga

SEQ ID NO: 101632 - DNA, 25 bp, Mus musculus
acaggacagatagacaactatttga

SEQ ID NO: 101633 - DNA, 25 bp, Mus musculus
acaggacaggaaacttacgtctgga

SEQ ID NO: 101634 - DNA, 25 bp, Mus musculus
acaggacaggaatcttacgtctgga

SEQ ID NO: 101635 - DNA, 25 bp, Mus musculus
acaggacagggcactggttctgcac

SEQ ID NO: 101636 - DNA, 25 bp, Mus musculus
acaggacagggctctggttctgcac

SEQ ID NO: 101637 - DNA, 25 bp, Mus musculus
acaggacagtggagaccccagactg

SEQ ID NO: 101638 - DNA, 25 bp, Mus musculus
acaggacagtggtgaccccagactg

SEQ ID NO: 101639 - DNA, 25 bp, Mus musculus
acaggacagtttcacactatcgagt

SEQ ID NO: 101640 - DNA, 25 bp, Mus musculus
acaggacagtttgacactatcgagt

SEQ ID NO: 101641 - DNA, 25 bp, Mus musculus
acaggacataggacactgcatgtta

SEQ ID NO: 101642 - DNA, 25 bp, Mus musculus
acaggacataggtcactgcatgtta

SEQ ID NO: 101643 - DNA, 25 bp, Mus musculus
acaggacatattagggcctgtcccc

SEQ ID NO: 101644 - DNA, 25 bp, Mus musculus
acaggacatatttgggcctgtcccc

SEQ ID NO: 101645 - DNA, 25 bp, Mus musculus
acaggacatccgaaatgcctatgcc

SEQ ID NO: 101646 - DNA, 25 bp, Mus musculus
acaggacatccgtaatgcctatgcc

SEQ ID NO: 101647 - DNA, 25 bp, Mus musculus
acaggaccctggatacagccatggt

SEQ ID NO: 101648 - DNA, 25 bp, Mus musculus
acaggaccctggttacagccatggt

SEQ ID NO: 101649 - DNA, 25 bp, Mus musculus
acaggaccgttcacagctgcctatc

SEQ ID NO: 101650 - DNA, 25 bp, Mus musculus
acaggaccgttctcagctgcctatc

SEQ ID NO: 101651 - DNA, 25 bp, Mus musculus
acaggaccgttgagaggatcaaaca

SEQ ID NO: 101652 - DNA, 25 bp, Mus musculus
acaggaccgttgtgaggatcaaaca

SEQ ID NO: 101653 - DNA, 25 bp, Mus musculus
acaggacctcttagtgcagtacaga

SEQ ID NO: 101654 - DNA, 25 bp, Mus musculus
acaggacctctttgtgcagtacaga

SEQ ID NO: 101655 - DNA, 25 bp, Mus musculus
acaggacctgaaacatgcttagcca

SEQ ID NO: 101656 - DNA, 25 bp, Mus musculus
acaggacctgaatcatgcttagcca

SEQ ID NO: 101657 - DNA, 25 bp, Mus musculus
acaggacctggaacgtgagcgctca

SEQ ID NO: 101658 - DNA, 25 bp, Mus musculus
acaggacctggaaggaagccacaga

SEQ ID NO: 101659 - DNA, 25 bp, Mus musculus
acaggacctggatcgtgagcgctca

SEQ ID NO: 101660 - DNA, 25 bp, Mus musculus
acaggacctggatggaagccacaga

SEQ ID NO: 101661 - DNA, 25 bp, Mus musculus
acaggaccttgcacgtggcttatgg

SEQ ID NO: 101662 - DNA, 25 bp, Mus musculus
acaggaccttgctcgtggcttatgg

SEQ ID NO: 101663 - DNA, 25 bp, Mus musculus
acaggacgaagaacactgtcatctt

SEQ ID NO: 101664 - DNA, 25 bp, Mus musculus
acaggacgaagatcactgtcatctt

SEQ ID NO: 101665 - DNA, 25 bp, Mus musculus
acaggacgacctaactggctcagga

SEQ ID NO: 101666 - DNA, 25 bp, Mus musculus
acaggacgaccttactggctcagga

SEQ ID NO: 101667 - DNA, 25 bp, Mus musculus
acaggacgactactcaaggccaaaa

SEQ ID NO: 101668 - DNA, 25 bp, Mus musculus
acaggacgactagtcaaggccaaaa

SEQ ID NO: 101669 - DNA, 25 bp, Mus musculus
acaggacgcgggacttgatgccctt

SEQ ID NO: 101670 - DNA, 25 bp, Mus musculus
acaggacgcgggtcttgatgccctt

SEQ ID NO: 101671 - DNA, 25 bp, Mus musculus
acaggacgcgtacaacatcttcagt

SEQ ID NO: 101672 - DNA, 25 bp, Mus musculus
acaggacgcgtagaacatcttcagt

SEQ ID NO: 101673 - DNA, 25 bp, Mus musculus
acaggacgctcgacgatcagctagg

SEQ ID NO: 101674 - DNA, 25 bp, Mus musculus
acaggacgctcgtcgatcagctagg

SEQ ID NO: 101675 - DNA, 25 bp, Mus musculus
acaggactactgctcattgcctttt

SEQ ID NO: 101676 - DNA, 25 bp, Mus musculus
acaggactactggtcattgcctttt

SEQ ID NO: 101677 - DNA, 25 bp, Mus musculus
acaggactattacattccagcaggg

SEQ ID NO: 101678 - DNA, 25 bp, Mus musculus
acaggactattagattccagcaggg

SEQ ID NO: 101679 - DNA, 25 bp, Mus musculus
acaggactcaggagcctggcatgat

SEQ ID NO: 101680 - DNA, 25 bp, Mus musculus
acaggactcaggattacttctcaac

SEQ ID NO: 101681 - DNA, 25 bp, Mus musculus
acaggactcaggtgcctggcatgat

SEQ ID NO: 101682 - DNA, 25 bp, Mus musculus
acaggactcaggtttacttctcaac

SEQ ID NO: 101683 - DNA, 25 bp, Mus musculus
acaggactcagtctcttctggtctc

SEQ ID NO: 101684 - DNA, 25 bp, Mus musculus
acaggactcagtgtcttctggtctc

SEQ ID NO: 101685 - DNA, 25 bp, Mus musculus
acaggactccgaccaggctttggct

SEQ ID NO: 101686 - DNA, 25 bp, Mus musculus
acaggactccgagcaggctttggct

SEQ ID NO: 101687 - DNA, 25 bp, Mus musculus
acaggactcctgcacctcatgtgca

SEQ ID NO: 101688 - DNA, 25 bp, Mus musculus
acaggactcctggacctcatgtgca

SEQ ID NO: 101689 - DNA, 25 bp, Mus musculus
acaggactcgaaattcattttgtaa

SEQ ID NO: 101690 - DNA, 25 bp, Mus musculus
acaggactcgaatttcattttgtaa

SEQ ID NO: 101691 - DNA, 25 bp, Mus musculus
acaggactcgcaaacagcagacaga

SEQ ID NO: 101692 - DNA, 25 bp, Mus musculus
acaggactcgcatacagcagacaga

SEQ ID NO: 101693 - DNA, 25 bp, Mus musculus
acaggactctgtacttatttacaaa

SEQ ID NO: 101694 - DNA, 25 bp, Mus musculus
acaggactctgttcttatttacaaa

SEQ ID NO: 101695 - DNA, 25 bp, Mus musculus
acaggactgagaacactctggaaag

SEQ ID NO: 101696 - DNA, 25 bp, Mus musculus
acaggactgagatcactctggaaag

SEQ ID NO: 101697 - DNA, 25 bp, Mus musculus
acaggactgagtatgcaattttatt

SEQ ID NO: 101698 - DNA, 25 bp, Mus musculus
acaggactgagtttgcaattttatt

SEQ ID NO: 101699 - DNA, 25 bp, Mus musculus
acaggactgctcacaattctccaag

SEQ ID NO: 101700 - DNA, 25 bp, Mus musculus
acaggactgctctcaattctccaag

SEQ ID NO: 101701 - DNA, 25 bp, Mus musculus
acaggactggctctaggaattggaa

SEQ ID NO: 101702 - DNA, 25 bp, Mus musculus
acaggactggctgtaggaattggaa

SEQ ID NO: 101703 - DNA, 25 bp, Mus musculus
acaggacttactcagcctgggcaag

SEQ ID NO: 101704 - DNA, 25 bp, Mus musculus
acaggacttactgagcctgggcaag

SEQ ID NO: 101705 - DNA, 25 bp, Mus musculus
acaggacttgccagggtcagaggct

SEQ ID NO: 101706 - DNA, 25 bp, Mus musculus
acaggacttgcctgggtcagaggct

SEQ ID NO: 101707 - DNA, 25 bp, Mus musculus
acaggacttgtgataaactaggtag

SEQ ID NO: 101708 - DNA, 25 bp, Mus musculus
acaggacttgtgttaaactaggtag

SEQ ID NO: 101709 - DNA, 25 bp, Mus musculus
acaggactttgcaatccatctggca

SEQ ID NO: 101710 - DNA, 25 bp, Mus musculus
acaggactttgctatccatctggca

SEQ ID NO: 101711 - DNA, 25 bp, Mus musculus
acaggagaaggccactacacagtcg

SEQ ID NO: 101712 - DNA, 25 bp, Mus musculus
acaggagaaggcgactacacagtcg

SEQ ID NO: 101713 - DNA, 25 bp, Mus musculus
acaggagaccctccttgaccaagga

SEQ ID NO: 101714 - DNA, 25 bp, Mus musculus
acaggagaccctgcttgaccaagga

SEQ ID NO: 101715 - DNA, 25 bp, Mus musculus
acaggagactgcataccccttaagt

SEQ ID NO: 101716 - DNA, 25 bp, Mus musculus
acaggagactgcttaccccttaagt

SEQ ID NO: 101717 - DNA, 25 bp, Mus musculus
acaggagactttaggagagctgcca

SEQ ID NO: 101718 - DNA, 25 bp, Mus musculus
acaggagacttttggagagctgcca

SEQ ID NO: 101719 - DNA, 25 bp, Mus musculus
acaggagagcaacatgcaggacatt

SEQ ID NO: 101720 - DNA, 25 bp, Mus musculus
acaggagagcaagatgcaggacatt

SEQ ID NO: 101721 - DNA, 25 bp, Mus musculus
acaggagagtacaggtaaacagcta

SEQ ID NO: 101722 - DNA, 25 bp, Mus musculus
acaggagagtactggtaaacagcta

SEQ ID NO: 101723 - DNA, 25 bp, Mus musculus
acaggagagttcatttgtagagagt

SEQ ID NO: 101724 - DNA, 25 bp, Mus musculus
acaggagagttcttttgtagagagt

SEQ ID NO: 101725 - DNA, 25 bp, Mus musculus
acaggagataggagctaaagctaca

SEQ ID NO: 101726 - DNA, 25 bp, Mus musculus
acaggagataggtgctaaagctaca

SEQ ID NO: 101727 - DNA, 25 bp, Mus musculus
acaggagatatgatccgtgacattt

SEQ ID NO: 101728 - DNA, 25 bp, Mus musculus
acaggagatatgttccgtgacattt

SEQ ID NO: 101729 - DNA, 25 bp, Mus musculus
acaggagatggaacgtgctctggca

SEQ ID NO: 101730 - DNA, 25 bp, Mus musculus
acaggagatggatcgtgctctggca

SEQ ID NO: 101731 - DNA, 25 bp, Mus musculus
acaggagcacacacccagattgtaa

SEQ ID NO: 101732 - DNA, 25 bp, Mus musculus
acaggagcacactcccagattgtaa

SEQ ID NO: 101733 - DNA, 25 bp, Mus musculus
acaggagcagcgattgcagtctcac

SEQ ID NO: 101734 - DNA, 25 bp, Mus musculus
acaggagcagcgtttgcagtctcac

SEQ ID NO: 101735 - DNA, 25 bp, Mus musculus
acaggagcagctacaaattaggaaa

SEQ ID NO: 101736 - DNA, 25 bp, Mus musculus
acaggagcagcttcaaattaggaaa

SEQ ID NO: 101737 - DNA, 25 bp, Mus musculus
acaggagccaatctccatactgact

SEQ ID NO: 101738 - DNA, 25 bp, Mus musculus
acaggagccaatgtccatactgact

SEQ ID NO: 101739 - DNA, 25 bp, Mus musculus
acaggagcccatcgagtgtccacat

SEQ ID NO: 101740 - DNA, 25 bp, Mus musculus
acaggagcccatggagtgtccacat

SEQ ID NO: 101741 - DNA, 25 bp, Mus musculus
acaggagccctaacgccaagagaaa

SEQ ID NO: 101742 - DNA, 25 bp, Mus musculus
acaggagccctatcgccaagagaaa

SEQ ID NO: 101743 - DNA, 25 bp, Mus musculus
acaggagccctcatgagtgtgcagg

SEQ ID NO: 101744 - DNA, 25 bp, Mus musculus
acaggagccctcttgagtgtgcagg

SEQ ID NO: 101745 - DNA, 25 bp, Mus musculus
acaggagccctgaaacttaatacca

SEQ ID NO: 101746 - DNA, 25 bp, Mus musculus
acaggagccctgtaacttaatacca

SEQ ID NO: 101747 - DNA, 25 bp, Mus musculus
acaggagcctggagcgcaactaact

SEQ ID NO: 101748 - DNA, 25 bp, Mus musculus
acaggagcctggcatggctatcctc

SEQ ID NO: 101749 - DNA, 25 bp, Mus musculus
acaggagcctgggatggctatcctc

SEQ ID NO: 101750 - DNA, 25 bp, Mus musculus
acaggagcctggtgcgcaactaact

SEQ ID NO: 101751 - DNA, 25 bp, Mus musculus
acaggagcgggcaactttgtgcaat

SEQ ID NO: 101752 - DNA, 25 bp, Mus musculus
acaggagcgggctactttgtgcaat

SEQ ID NO: 101753 - DNA, 25 bp, Mus musculus
acaggagcgtgcatgcagaactaaa

SEQ ID NO: 101754 - DNA, 25 bp, Mus musculus
acaggagcgtgcttgcagaactaaa

SEQ ID NO: 101755 - DNA, 25 bp, Mus musculus
acaggagctgcgctcactgcaggca

SEQ ID NO: 101756 - DNA, 25 bp, Mus musculus
acaggagctgcggtcactgcaggca

SEQ ID NO: 101757 - DNA, 25 bp, Mus musculus
acaggaggaagacaacgcggtccct

SEQ ID NO: 101758 - DNA, 25 bp, Mus musculus
acaggaggaagagaacgcggtccct

SEQ ID NO: 101759 - DNA, 25 bp, Mus musculus
acaggaggaagccagacagtgtaac

SEQ ID NO: 101760 - DNA, 25 bp, Mus musculus
acaggaggaagcgagacagtgtaac

SEQ ID NO: 101761 - DNA, 25 bp, Mus musculus
acaggaggagaaccacaccgtgtgc

SEQ ID NO: 101762 - DNA, 25 bp, Mus musculus
acaggaggagaagcacaccgtgtgc

SEQ ID NO: 101763 - DNA, 25 bp, Mus musculus
acaggaggataaagttggcctcagc

SEQ ID NO: 101764 - DNA, 25 bp, Mus musculus
acaggaggataatgttggcctcagc

SEQ ID NO: 101765 - DNA, 25 bp, Mus musculus
acaggaggcagcaggtcacgtcgta

SEQ ID NO: 101766 - DNA, 25 bp, Mus musculus
acaggaggcagctggtcacgtcgta

SEQ ID NO: 101767 - DNA, 25 bp, Mus musculus
acaggaggcatgacttcaagatcac

SEQ ID NO: 101768 - DNA, 25 bp, Mus musculus
acaggaggcatgtcttcaagatcac

SEQ ID NO: 101769 - DNA, 25 bp, Mus musculus
acaggaggcctgacagcgttacgtc

SEQ ID NO: 101770 - DNA, 25 bp, Mus musculus
acaggaggcctgtcagcgttacgtc

SEQ ID NO: 101771 - DNA, 25 bp, Mus musculus
acaggagggcgcacagagacattaa

SEQ ID NO: 101772 - DNA, 25 bp, Mus musculus
acaggagggcgctcagagacattaa

SEQ ID NO: 101773 - DNA, 25 bp, Mus musculus
acaggagtactgagcgtgaaattca

SEQ ID NO: 101774 - DNA, 25 bp, Mus musculus
acaggagtactgtgcgtgaaattca

SEQ ID NO: 101775 - DNA, 25 bp, Mus musculus
acaggagtacttagcctcatcatcg

SEQ ID NO: 101776 - DNA, 25 bp, Mus musculus
acaggagtactttgcctcatcatcg

SEQ ID NO: 101777 - DNA, 25 bp, Mus musculus
acaggagtagatcacaacactaact

SEQ ID NO: 101778 - DNA, 25 bp, Mus musculus
acaggagtagatgacaacactaact

SEQ ID NO: 101779 - DNA, 25 bp, Mus musculus
acaggagtatcacttctcatcctac

SEQ ID NO: 101780 - DNA, 25 bp, Mus musculus
acaggagtatcagttctcatcctac

SEQ ID NO: 101781 - DNA, 25 bp, Mus musculus
acaggagtcaagcttctcacagatt

SEQ ID NO: 101782 - DNA, 25 bp, Mus musculus
acaggagtcaaggttctcacagatt

SEQ ID NO: 101783 - DNA, 25 bp, Mus musculus
acaggagtcagcctcatcatagctc

SEQ ID NO: 101784 - DNA, 25 bp, Mus musculus
acaggagtcagcgtcatcatagctc

SEQ ID NO: 101785 - DNA, 25 bp, Mus musculus
acaggagtcccaagcaggcagggat

SEQ ID NO: 101786 - DNA, 25 bp, Mus musculus
acaggagtcccatgcaggcagggat

SEQ ID NO: 101787 - DNA, 25 bp, Mus musculus
acaggagtccttaatgaaccattta

SEQ ID NO: 101788 - DNA, 25 bp, Mus musculus
acaggagtcctttatgaaccattta

SEQ ID NO: 101789 - DNA, 25 bp, Mus musculus
acaggagtctccacgcttgttgagc

SEQ ID NO: 101790 - DNA, 25 bp, Mus musculus
acaggagtctcctcgcttgttgagc

SEQ ID NO: 101791 - DNA, 25 bp, Mus musculus
acaggagtgatcattccacccagga

SEQ ID NO: 101792 - DNA, 25 bp, Mus musculus
acaggagtgatctttccacccagga

SEQ ID NO: 101793 - DNA, 25 bp, Mus musculus
acaggagtgattcagacccaccgtg

SEQ ID NO: 101794 - DNA, 25 bp, Mus musculus
acaggagtgattgagacccaccgtg

SEQ ID NO: 101795 - DNA, 25 bp, Mus musculus
acaggagtgcctcgactggacaaac

SEQ ID NO: 101796 - DNA, 25 bp, Mus musculus
acaggagtgcctctctgagtttggc

SEQ ID NO: 101797 - DNA, 25 bp, Mus musculus
acaggagtgcctggactggacaaac

SEQ ID NO: 101798 - DNA, 25 bp, Mus musculus
acaggagtgcctgtctgagtttggc

SEQ ID NO: 101799 - DNA, 25 bp, Mus musculus
acaggagtgggacgcctgctccata

SEQ ID NO: 101800 - DNA, 25 bp, Mus musculus
acaggagtgggaggcctgctccata

SEQ ID NO: 101801 - DNA, 25 bp, Mus musculus
acaggagtggtaccctccacagaag

SEQ ID NO: 101802 - DNA, 25 bp, Mus musculus
acaggagtggtagcctccacagaag

SEQ ID NO: 101803 - DNA, 25 bp, Mus musculus
acaggagtggtgatacaaacctcta

SEQ ID NO: 101804 - DNA, 25 bp, Mus musculus
acaggagtggtgttacaaacctcta

SEQ ID NO: 101805 - DNA, 25 bp, Mus musculus
acaggagtgtgcaccgtacccggga

SEQ ID NO: 101806 - DNA, 25 bp, Mus musculus
acaggagtgtgcagcagaaatcgct

SEQ ID NO: 101807 - DNA, 25 bp, Mus musculus
acaggagtgtgctccgtacccggga

SEQ ID NO: 101808 - DNA, 25 bp, Mus musculus
acaggagtgtgctgcagaaatcgct

SEQ ID NO: 101809 - DNA, 25 bp, Mus musculus
acaggagtgtgtaccatgacaatac

SEQ ID NO: 101810 - DNA, 25 bp, Mus musculus
acaggagtgtgttccatgacaatac

SEQ ID NO: 101811 - DNA, 25 bp, Mus musculus
acaggagttccaagtgtccgctggc

SEQ ID NO: 101812 - DNA, 25 bp, Mus musculus
acaggagttccatgtgtccgctggc

SEQ ID NO: 101813 - DNA, 25 bp, Mus musculus
acaggagttcctctggctgagtatg

SEQ ID NO: 101814 - DNA, 25 bp, Mus musculus
acaggagttcctgtggctgagtatg

SEQ ID NO: 101815 - DNA, 25 bp, Mus musculus
acaggagttggactacggcccctca

SEQ ID NO: 101816 - DNA, 25 bp, Mus musculus
acaggagttggagtacggcccctca

SEQ ID NO: 101817 - DNA, 25 bp, Mus musculus
acaggagttgtaacattttgccaca

SEQ ID NO: 101818 - DNA, 25 bp, Mus musculus
acaggagttgtatcattttgccaca

SEQ ID NO: 101819 - DNA, 25 bp, Mus musculus
acaggataacgaatgcgcccttacg

SEQ ID NO: 101820 - DNA, 25 bp, Mus musculus
acaggataacgattgcgcccttacg

SEQ ID NO: 101821 - DNA, 25 bp, Mus musculus
acaggataatcccacttaactcagc

SEQ ID NO: 101822 - DNA, 25 bp, Mus musculus
acaggataatccgacttaactcagc

SEQ ID NO: 101823 - DNA, 25 bp, Mus musculus
acaggatacctaactgcacttcaga

SEQ ID NO: 101824 - DNA, 25 bp, Mus musculus
acaggatacctatctgcacttcaga

SEQ ID NO: 101825 - DNA, 25 bp, Mus musculus
acaggatatgacagctttctttttc

SEQ ID NO: 101826 - DNA, 25 bp, Mus musculus
acaggatatgactgctttctttttc

SEQ ID NO: 101827 - DNA, 25 bp, Mus musculus
acaggatattccattagtggtggaa

SEQ ID NO: 101828 - DNA, 25 bp, Mus musculus
acaggatattcctttagtggtggaa

SEQ ID NO: 101829 - DNA, 25 bp, Mus musculus
acaggatatttgatagccagcttct

SEQ ID NO: 101830 - DNA, 25 bp, Mus musculus
acaggatatttgttagccagcttct

SEQ ID NO: 101831 - DNA, 25 bp, Mus musculus
acaggatcaagcacgtggcaggttc

SEQ ID NO: 101832 - DNA, 25 bp, Mus musculus
acaggatcaagctcgtggcaggttc

SEQ ID NO: 101833 - DNA, 25 bp, Mus musculus
acaggatcagaacttatctgtgaaa

SEQ ID NO: 101834 - DNA, 25 bp, Mus musculus
acaggatcagaagttatctgtgaaa

SEQ ID NO: 101835 - DNA, 25 bp, Mus musculus
acaggatcatcacagcagccagagt

SEQ ID NO: 101836 - DNA, 25 bp, Mus musculus
acaggatcatcagagcagccagagt

SEQ ID NO: 101837 - DNA, 25 bp, Mus musculus
acaggatccagcatctgtttaaggt

SEQ ID NO: 101838 - DNA, 25 bp, Mus musculus
acaggatccagcttctgtttaaggt

SEQ ID NO: 101839 - DNA, 25 bp, Mus musculus
acaggatccatcattctgctgcatc

SEQ ID NO: 101840 - DNA, 25 bp, Mus musculus
acaggatccatctttctgctgcatc

SEQ ID NO: 101841 - DNA, 25 bp, Mus musculus
acaggatcccatcaggaattttgga

SEQ ID NO: 101842 - DNA, 25 bp, Mus musculus
acaggatcccatgaggaattttgga

SEQ ID NO: 101843 - DNA, 25 bp, Mus musculus
acaggatcccttccttgcctcttgg

SEQ ID NO: 101844 - DNA, 25 bp, Mus musculus
acaggatcccttgcttgcctcttgg

SEQ ID NO: 101845 - DNA, 25 bp, Mus musculus
acaggatcctgtattgttctcgggt

SEQ ID NO: 101846 - DNA, 25 bp, Mus musculus
acaggatcctgtctcatttcaagat

SEQ ID NO: 101847 - DNA, 25 bp, Mus musculus
acaggatcctgtgtcatttcaagat

SEQ ID NO: 101848 - DNA, 25 bp, Mus musculus
acaggatcctgttttgttctcgggt

SEQ ID NO: 101849 - DNA, 25 bp, Mus musculus
acaggatcgaagacctagtcagagt

SEQ ID NO: 101850 - DNA, 25 bp, Mus musculus
acaggatcgaagtcctagtcagagt

SEQ ID NO: 101851 - DNA, 25 bp, Mus musculus
acaggatctctgaacgactccattt

SEQ ID NO: 101852 - DNA, 25 bp, Mus musculus
acaggatctctgtacgactccattt

SEQ ID NO: 101853 - DNA, 25 bp, Mus musculus
acaggatctcttctgagtttgatgc

SEQ ID NO: 101854 - DNA, 25 bp, Mus musculus
acaggatctcttgtgagtttgatgc

SEQ ID NO: 101855 - DNA, 25 bp, Mus musculus
acaggatctgacacataggtgattt

SEQ ID NO: 101856 - DNA, 25 bp, Mus musculus
acaggatctgactcataggtgattt

SEQ ID NO: 101857 - DNA, 25 bp, Mus musculus
acaggatcttgcaggcggctatact

SEQ ID NO: 101858 - DNA, 25 bp, Mus musculus
acaggatcttgctggcggctatact

SEQ ID NO: 101859 - DNA, 25 bp, Mus musculus
acaggatcttttagtacggttggat

SEQ ID NO: 101860 - DNA, 25 bp, Mus musculus
acaggatctttttgtacggttggat

SEQ ID NO: 101861 - DNA, 25 bp, Mus musculus
acaggatgactacaaaaccagggct

SEQ ID NO: 101862 - DNA, 25 bp, Mus musculus
acaggatgactagaaaaccagggct

SEQ ID NO: 101863 - DNA, 25 bp, Mus musculus
acaggatgcgaacaagtgggacgac

SEQ ID NO: 101864 - DNA, 25 bp, Mus musculus
acaggatgcgaagaagtgggacgac

SEQ ID NO: 101865 - DNA, 25 bp, Mus musculus
acaggatgcggcacggatctgctgt

SEQ ID NO: 101866 - DNA, 25 bp, Mus musculus
acaggatgcggctcggatctgctgt

SEQ ID NO: 101867 - DNA, 25 bp, Mus musculus
acaggatggaccacacttcacactt

SEQ ID NO: 101868 - DNA, 25 bp, Mus musculus
acaggatggacctcacttcacactt

SEQ ID NO: 101869 - DNA, 25 bp, Mus musculus
acaggatggccgacgcatactgctg

SEQ ID NO: 101870 - DNA, 25 bp, Mus musculus
acaggatggccgtcgcatactgctg

SEQ ID NO: 101871 - DNA, 25 bp, Mus musculus
acaggatgggtgactcagcatttgc

SEQ ID NO: 101872 - DNA, 25 bp, Mus musculus
acaggatgggtgtctcagcatttgc

SEQ ID NO: 101873 - DNA, 25 bp, Mus musculus
acaggatggtgcacatgtctccagc

SEQ ID NO: 101874 - DNA, 25 bp, Mus musculus
acaggatggtgctcatgtctccagc

SEQ ID NO: 101875 - DNA, 25 bp, Mus musculus
acaggatgtatgatgggacatggaa

SEQ ID NO: 101876 - DNA, 25 bp, Mus musculus
acaggatgtatgttgggacatggaa

SEQ ID NO: 101877 - DNA, 25 bp, Mus musculus
acaggatgttatagggcagagcaag

SEQ ID NO: 101878 - DNA, 25 bp, Mus musculus
acaggatgttattgggcagagcaag

SEQ ID NO: 101879 - DNA, 25 bp, Mus musculus
acaggattacagctttggaaaatgc

SEQ ID NO: 101880 - DNA, 25 bp, Mus musculus
acaggattacaggtttggaaaatgc

SEQ ID NO: 101881 - DNA, 25 bp, Mus musculus
acaggattcctcattacagcaagtg

SEQ ID NO: 101882 - DNA, 25 bp, Mus musculus
acaggattcctctttacagcaagtg

SEQ ID NO: 101883 - DNA, 25 bp, Mus musculus
acaggattcctgagaaccccagggt

SEQ ID NO: 101884 - DNA, 25 bp, Mus musculus
acaggattcctgctaattgctgacc

SEQ ID NO: 101885 - DNA, 25 bp, Mus musculus
acaggattcctggtaattgctgacc

SEQ ID NO: 101886 - DNA, 25 bp, Mus musculus
acaggattcctgtgaaccccagggt

SEQ ID NO: 101887 - DNA, 25 bp, Mus musculus
acaggattcttcacggcaggcccga

SEQ ID NO: 101888 - DNA, 25 bp, Mus musculus
acaggattcttctcggcaggcccga

SEQ ID NO: 101889 - DNA, 25 bp, Mus musculus
acaggattcttgctgccggcttcac

SEQ ID NO: 101890 - DNA, 25 bp, Mus musculus
acaggattcttggtgccggcttcac

SEQ ID NO: 101891 - DNA, 25 bp, Mus musculus
acaggattctttcatccccagggtt

SEQ ID NO: 101892 - DNA, 25 bp, Mus musculus
acaggattctttgatccccagggtt

SEQ ID NO: 101893 - DNA, 25 bp, Mus musculus
acaggattgaggcaccatactaatt

SEQ ID NO: 101894 - DNA, 25 bp, Mus musculus
acaggattgagggaccatactaatt

SEQ ID NO: 101895 - DNA, 25 bp, Mus musculus
acaggattgtttacctctacaccaa

SEQ ID NO: 101896 - DNA, 25 bp, Mus musculus
acaggattgttttcctctacaccaa

SEQ ID NO: 101897 - DNA, 25 bp, Mus musculus
acaggatttatgctgctgtcccctc

SEQ ID NO: 101898 - DNA, 25 bp, Mus musculus
acaggatttatggtgctgtcccctc

SEQ ID NO: 101899 - DNA, 25 bp, Mus musculus
acaggatttgcacgcgcctctgaga

SEQ ID NO: 101900 - DNA, 25 bp, Mus musculus
acaggatttgcaggcgcctctgaga

SEQ ID NO: 101901 - DNA, 25 bp, Mus musculus
acaggatttgctcacactgaagtgt

SEQ ID NO: 101902 - DNA, 25 bp, Mus musculus
acaggatttgctgacactgaagtgt

SEQ ID NO: 101903 - DNA, 25 bp, Mus musculus
acaggattttctagatcatctctga

SEQ ID NO: 101904 - DNA, 25 bp, Mus musculus
acaggattttcttgatcatctctga

SEQ ID NO: 101905 - DNA, 25 bp, Mus musculus
acaggcaaacagaacatcccatttt

SEQ ID NO: 101906 - DNA, 25 bp, Mus musculus
acaggcaaacagtacatcccatttt

SEQ ID NO: 101907 - DNA, 25 bp, Mus musculus
acaggcaaacttctgctttatggca

SEQ ID NO: 101908 - DNA, 25 bp, Mus musculus
acaggcaaacttgtgctttatggca

SEQ ID NO: 101909 - DNA, 25 bp, Mus musculus
acaggcaaagatccagcccttgtca

SEQ ID NO: 101910 - DNA, 25 bp, Mus musculus
acaggcaaagatgcagcccttgtca

SEQ ID NO: 101911 - DNA, 25 bp, Mus musculus
acaggcaaatcacctgtcgcctgga

SEQ ID NO: 101912 - DNA, 25 bp, Mus musculus
acaggcaaatcagctgtcgcctgga

SEQ ID NO: 101913 - DNA, 25 bp, Mus musculus
acaggcaaccagactcatcaataaa

SEQ ID NO: 101914 - DNA, 25 bp, Mus musculus
acaggcaaccagtctcatcaataaa

SEQ ID NO: 101915 - DNA, 25 bp, Mus musculus
acaggcaagactcagcatgcatcct

SEQ ID NO: 101916 - DNA, 25 bp, Mus musculus
acaggcaagactgagcatgcatcct

SEQ ID NO: 101917 - DNA, 25 bp, Mus musculus
acaggcaaggtgatgacacgtccct

SEQ ID NO: 101918 - DNA, 25 bp, Mus musculus
acaggcaaggtgttgacacgtccct

SEQ ID NO: 101919 - DNA, 25 bp, Mus musculus
acaggcaagtgaccccagtggtcct

SEQ ID NO: 101920 - DNA, 25 bp, Mus musculus
acaggcaagtgagcccagtggtcct

SEQ ID NO: 101921 - DNA, 25 bp, Mus musculus
acaggcaagtggcacaggcttccaa

SEQ ID NO: 101922 - DNA, 25 bp, Mus musculus
acaggcaagtgggacaggcttccaa

SEQ ID NO: 101923 - DNA, 25 bp, Mus musculus
acaggcaataagcatccctaaggtt

SEQ ID NO: 101924 - DNA, 25 bp, Mus musculus
acaggcaataaggatccctaaggtt

SEQ ID NO: 101925 - DNA, 25 bp, Mus musculus
acaggcacacataagcacggtccaa

SEQ ID NO: 101926 - DNA, 25 bp, Mus musculus
acaggcacacattagcacggtccaa

SEQ ID NO: 101927 - DNA, 25 bp, Mus musculus
acaggcacaggcacaagcacagtca

SEQ ID NO: 101928 - DNA, 25 bp, Mus musculus
acaggcacaggctcaagcacagtca

SEQ ID NO: 101929 - DNA, 25 bp, Mus musculus
acaggcacagtaatctttttcttcc

SEQ ID NO: 101930 - DNA, 25 bp, Mus musculus
acaggcacagtattctttttcttcc

SEQ ID NO: 101931 - DNA, 25 bp, Mus musculus
acaggcacagtgctggccatgtcga

SEQ ID NO: 101932 - DNA, 25 bp, Mus musculus
acaggcacagtggtggccatgtcga

SEQ ID NO: 101933 - DNA, 25 bp, Mus musculus
acaggcacagttcttgctggctctg

SEQ ID NO: 101934 - DNA, 25 bp, Mus musculus
acaggcacagttgttgctggctctg

SEQ ID NO: 101935 - DNA, 25 bp, Mus musculus
acaggcaccgaaccacatggcgttt

SEQ ID NO: 101936 - DNA, 25 bp, Mus musculus
acaggcaccgaagcacatggcgttt

SEQ ID NO: 101937 - DNA, 25 bp, Mus musculus
acaggcaccgagatcacagtcacgg

SEQ ID NO: 101938 - DNA, 25 bp, Mus musculus
acaggcaccgagttcacagtcacgg

SEQ ID NO: 101939 - DNA, 25 bp, Mus musculus
acaggcaccggaagtcctcttctga

SEQ ID NO: 101940 - DNA, 25 bp, Mus musculus
acaggcaccggatgtcctcttctga

SEQ ID NO: 101941 - DNA, 25 bp, Mus musculus
acaggcacctacactaagactctag

SEQ ID NO: 101942 - DNA, 25 bp, Mus musculus
acaggcacctactctaagactctag

SEQ ID NO: 101943 - DNA, 25 bp, Mus musculus
acaggcacctgcaattgctgctgaa

SEQ ID NO: 101944 - DNA, 25 bp, Mus musculus
acaggcacctgctattgctgctgaa

SEQ ID NO: 101945 - DNA, 25 bp, Mus musculus
acaggcacctggatgaggtcactca

SEQ ID NO: 101946 - DNA, 25 bp, Mus musculus
acaggcacctggttgaggtcactca

SEQ ID NO: 101947 - DNA, 25 bp, Mus musculus
acaggcaccttaccagtggctaaaa

SEQ ID NO: 101948 - DNA, 25 bp, Mus musculus
acaggcaccttagcagtggctaaaa

SEQ ID NO: 101949 - DNA, 25 bp, Mus musculus
acaggcacctttcctgttgctgtgg

SEQ ID NO: 101950 - DNA, 25 bp, Mus musculus
acaggcacctttgctgttgctgtgg

SEQ ID NO: 101951 - DNA, 25 bp, Mus musculus
acaggcacgcttcactgctggcgga

SEQ ID NO: 101952 - DNA, 25 bp, Mus musculus
acaggcacgcttgactgctggcgga

SEQ ID NO: 101953 - DNA, 25 bp, Mus musculus
acaggcacggatcgatggacagtca

SEQ ID NO: 101954 - DNA, 25 bp, Mus musculus
acaggcacggatggatggacagtca

SEQ ID NO: 101955 - DNA, 25 bp, Mus musculus
acaggcacgggcatcaagcatttct

SEQ ID NO: 101956 - DNA, 25 bp, Mus musculus
acaggcacgggcttcaagcatttct

SEQ ID NO: 101957 - DNA, 25 bp, Mus musculus
acaggcactagcaggactcctttct

SEQ ID NO: 101958 - DNA, 25 bp, Mus musculus
acaggcactagctggactcctttct

SEQ ID NO: 101959 - DNA, 25 bp, Mus musculus
acaggcactgtcagccagtgaggca

SEQ ID NO: 101960 - DNA, 25 bp, Mus musculus
acaggcactgtctgccagtgaggca

SEQ ID NO: 101961 - DNA, 25 bp, Mus musculus
acaggcacttagaacaggtacacat

SEQ ID NO: 101962 - DNA, 25 bp, Mus musculus
acaggcacttagtacaggtacacat

SEQ ID NO: 101963 - DNA, 25 bp, Mus musculus
acaggcagaaagagtcagacttccc

SEQ ID NO: 101964 - DNA, 25 bp, Mus musculus
acaggcagaaagtgtcagacttccc

SEQ ID NO: 101965 - DNA, 25 bp, Mus musculus
acaggcagagagacgcagcaatcct

SEQ ID NO: 101966 - DNA, 25 bp, Mus musculus
acaggcagagagtcgcagcaatcct

SEQ ID NO: 101967 - DNA, 25 bp, Mus musculus
acaggcagatctcatgtgttccagc

SEQ ID NO: 101968 - DNA, 25 bp, Mus musculus
acaggcagatctgatgtgttccagc

SEQ ID NO: 101969 - DNA, 25 bp, Mus musculus
acaggcagatgtctcattgacccct

SEQ ID NO: 101970 - DNA, 25 bp, Mus musculus
acaggcagatgtgtcattgacccct

SEQ ID NO: 101971 - DNA, 25 bp, Mus musculus
acaggcagccatctttccaggtgtt

SEQ ID NO: 101972 - DNA, 25 bp, Mus musculus
acaggcagccatgtttccaggtgtt

SEQ ID NO: 101973 - DNA, 25 bp, Mus musculus
acaggcagcccaatgtacacttcag

SEQ ID NO: 101974 - DNA, 25 bp, Mus musculus
acaggcagcccattgtacacttcag

SEQ ID NO: 101975 - DNA, 25 bp, Mus musculus
acaggcagcctgcaaatgggacata

SEQ ID NO: 101976 - DNA, 25 bp, Mus musculus
acaggcagcctggaaatgggacata

SEQ ID NO: 101977 - DNA, 25 bp, Mus musculus
acaggcagctggcaggtcctttttt

SEQ ID NO: 101978 - DNA, 25 bp, Mus musculus
acaggcagctgggaggtcctttttt

SEQ ID NO: 101979 - DNA, 25 bp, Mus musculus
acaggcagcttgcttgcacacacca

SEQ ID NO: 101980 - DNA, 25 bp, Mus musculus
acaggcagcttggttgcacacacca

SEQ ID NO: 101981 - DNA, 25 bp, Mus musculus
acaggcaggcctcgttcagaacctt

SEQ ID NO: 101982 - DNA, 25 bp, Mus musculus
acaggcaggcctggttcagaacctt

SEQ ID NO: 101983 - DNA, 25 bp, Mus musculus
acaggcagggaacgcggcaccattc

SEQ ID NO: 101984 - DNA, 25 bp, Mus musculus
acaggcagggaaggcggcaccattc

SEQ ID NO: 101985 - DNA, 25 bp, Mus musculus
acaggcagggacaaggtgtagcaat

SEQ ID NO: 101986 - DNA, 25 bp, Mus musculus
acaggcagggactaggtgtagcaat

SEQ ID NO: 101987 - DNA, 25 bp, Mus musculus
acaggcagggcccttcgtgtaaaag

SEQ ID NO: 101988 - DNA, 25 bp, Mus musculus
acaggcagggccgttcgtgtaaaag

SEQ ID NO: 101989 - DNA, 25 bp, Mus musculus
acaggcagggtgactcagttcctca

SEQ ID NO: 101990 - DNA, 25 bp, Mus musculus
acaggcagggtgtctcagttcctca

SEQ ID NO: 101991 - DNA, 25 bp, Mus musculus
acaggcaggtggctgttttgacata

SEQ ID NO: 101992 - DNA, 25 bp, Mus musculus
acaggcaggtgggtgttttgacata

SEQ ID NO: 101993 - DNA, 25 bp, Mus musculus
acaggcagtattccaaggtattata

SEQ ID NO: 101994 - DNA, 25 bp, Mus musculus
acaggcagtattgcaaggtattata

SEQ ID NO: 101995 - DNA, 25 bp, Mus musculus
acaggcagtcttcggagctcgtgaa

SEQ ID NO: 101996 - DNA, 25 bp, Mus musculus
acaggcagtcttgggagctcgtgaa

SEQ ID NO: 101997 - DNA, 25 bp, Mus musculus
acaggcagtggcacagggctccttg

SEQ ID NO: 101998 - DNA, 25 bp, Mus musculus
acaggcagtggctcagggctccttg

SEQ ID NO: 101999 - DNA, 25 bp, Mus musculus
acaggcagtgggaccctcggaacct

SEQ ID NO: 102000 - DNA, 25 bp, Mus musculus
acaggcagtgggtccctcggaacct

SEQ ID NO: 102001 - DNA, 25 bp, Mus musculus
acaggcagtgtcagcagtgccccat

SEQ ID NO: 102002 - DNA, 25 bp, Mus musculus
acaggcagtgtctgcagtgccccat

SEQ ID NO: 102003 - DNA, 25 bp, Mus musculus
acaggcagttgaacgctctagcgca

SEQ ID NO: 102004 - DNA, 25 bp, Mus musculus
acaggcagttgatcgctctagcgca

SEQ ID NO: 102005 - DNA, 25 bp, Mus musculus
acaggcataatgcacctgcccaaat

SEQ ID NO: 102006 - DNA, 25 bp, Mus musculus
acaggcataatggacctgcccaaat

SEQ ID NO: 102007 - DNA, 25 bp, Mus musculus
acaggcatcacgcactcctgggcgg

SEQ ID NO: 102008 - DNA, 25 bp, Mus musculus
acaggcatcacggactcctgggcgg

SEQ ID NO: 102009 - DNA, 25 bp, Mus musculus
acaggcatcaggatatcttgtgttc

SEQ ID NO: 102010 - DNA, 25 bp, Mus musculus
acaggcatcaggttatcttgtgttc

SEQ ID NO: 102011 - DNA, 25 bp, Mus musculus
acaggcatccttctgagaacataaa

SEQ ID NO: 102012 - DNA, 25 bp, Mus musculus
acaggcatccttgtgagaacataaa

SEQ ID NO: 102013 - DNA, 25 bp, Mus musculus
acaggcatctcaattgtaagtgcat

SEQ ID NO: 102014 - DNA, 25 bp, Mus musculus
acaggcatctcatttgtaagtgcat

SEQ ID NO: 102015 - DNA, 25 bp, Mus musculus
acaggcatctgcaagctgtgtgacc

SEQ ID NO: 102016 - DNA, 25 bp, Mus musculus
acaggcatctgctagctgtgtgacc

SEQ ID NO: 102017 - DNA, 25 bp, Mus musculus
acaggcatcttgaatttccctaaag

SEQ ID NO: 102018 - DNA, 25 bp, Mus musculus
acaggcatcttgtatttccctaaag

SEQ ID NO: 102019 - DNA, 25 bp, Mus musculus
acaggcatggaacctcaggcagcag

SEQ ID NO: 102020 - DNA, 25 bp, Mus musculus
acaggcatggaagctcaggcagcag

SEQ ID NO: 102021 - DNA, 25 bp, Mus musculus
acaggcatggcaacgctcctgtaat

SEQ ID NO: 102022 - DNA, 25 bp, Mus musculus
acaggcatggcatcgctcctgtaat

SEQ ID NO: 102023 - DNA, 25 bp, Mus musculus
acaggcatggctatggtcttggtcc

SEQ ID NO: 102024 - DNA, 25 bp, Mus musculus
acaggcatggctttggtcttggtcc

SEQ ID NO: 102025 - DNA, 25 bp, Mus musculus
acaggcatgggcaactcctcatttg

SEQ ID NO: 102026 - DNA, 25 bp, Mus musculus
acaggcatgggcactttgggtatgt

SEQ ID NO: 102027 - DNA, 25 bp, Mus musculus
acaggcatgggctactcctcatttg

SEQ ID NO: 102028 - DNA, 25 bp, Mus musculus
acaggcatgggctctttgggtatgt

SEQ ID NO: 102029 - DNA, 25 bp, Mus musculus
acaggcatggtgcaatcctagtact

SEQ ID NO: 102030 - DNA, 25 bp, Mus musculus
acaggcatggtggaatcctagtact

SEQ ID NO: 102031 - DNA, 25 bp, Mus musculus
acaggcattgcacctgcctccatag

SEQ ID NO: 102032 - DNA, 25 bp, Mus musculus
acaggcattgcagctgcctccatag

SEQ ID NO: 102033 - DNA, 25 bp, Mus musculus
acaggcatttgtcatctcagctttg

SEQ ID NO: 102034 - DNA, 25 bp, Mus musculus
acaggcatttgtgatctcagctttg

SEQ ID NO: 102035 - DNA, 25 bp, Mus musculus
acaggcattttgaggacataagctt

SEQ ID NO: 102036 - DNA, 25 bp, Mus musculus
acaggcattttgtggacataagctt

SEQ ID NO: 102037 - DNA, 25 bp, Mus musculus
acaggccaaagtccgggtgattgct

SEQ ID NO: 102038 - DNA, 25 bp, Mus musculus
acaggccaaagtgcgggtgattgct

SEQ ID NO: 102039 - DNA, 25 bp, Mus musculus
acaggccaccccacacagggagtga

SEQ ID NO: 102040 - DNA, 25 bp, Mus musculus
acaggccacccctcacagggagtga

SEQ ID NO: 102041 - DNA, 25 bp, Mus musculus
acaggccacgagactgggacctaaa

SEQ ID NO: 102042 - DNA, 25 bp, Mus musculus
acaggccacgagtctgggacctaaa

SEQ ID NO: 102043 - DNA, 25 bp, Mus musculus
acaggccactggaaagtcgcggtta

SEQ ID NO: 102044 - DNA, 25 bp, Mus musculus
acaggccactggtaagtcgcggtta

SEQ ID NO: 102045 - DNA, 25 bp, Mus musculus
acaggccactttcctgctgctaaga

SEQ ID NO: 102046 - DNA, 25 bp, Mus musculus
acaggccactttgctgctgctaaga

SEQ ID NO: 102047 - DNA, 25 bp, Mus musculus
acaggccagaagaacctccttggta

SEQ ID NO: 102048 - DNA, 25 bp, Mus musculus
acaggccagaagtacctccttggta

SEQ ID NO: 102049 - DNA, 25 bp, Mus musculus
acaggccagctgagactatgtagtc

SEQ ID NO: 102050 - DNA, 25 bp, Mus musculus
acaggccagctgcagtcacttaact

SEQ ID NO: 102051 - DNA, 25 bp, Mus musculus
acaggccagctggagtcacttaact

SEQ ID NO: 102052 - DNA, 25 bp, Mus musculus
acaggccagctgtgactatgtagtc

SEQ ID NO: 102053 - DNA, 25 bp, Mus musculus
acaggccaggacaatgtcatcaaga

SEQ ID NO: 102054 - DNA, 25 bp, Mus musculus
acaggccaggactatgtcatcaaga

SEQ ID NO: 102055 - DNA, 25 bp, Mus musculus
acaggccagtggacacgcttcaaga

SEQ ID NO: 102056 - DNA, 25 bp, Mus musculus
acaggccagtggtcacgcttcaaga

SEQ ID NO: 102057 - DNA, 25 bp, Mus musculus
acaggccagttcatgcgtattcaga

SEQ ID NO: 102058 - DNA, 25 bp, Mus musculus
acaggccagttcttgcgtattcaga

SEQ ID NO: 102059 - DNA, 25 bp, Mus musculus
acaggccatctgcttttgccgctaa

SEQ ID NO: 102060 - DNA, 25 bp, Mus musculus
acaggccatctggttttgccgctaa

SEQ ID NO: 102061 - DNA, 25 bp, Mus musculus
acaggccatgttcttatcgtggatg

SEQ ID NO: 102062 - DNA, 25 bp, Mus musculus
acaggccatgttgttatcgtggatg

SEQ ID NO: 102063 - DNA, 25 bp, Mus musculus
acaggcccaactacagtttgtgttt

SEQ ID NO: 102064 - DNA, 25 bp, Mus musculus
acaggcccaacttcagtttgtgttt

SEQ ID NO: 102065 - DNA, 25 bp, Mus musculus
acaggcccaatgaatttatttatgt

SEQ ID NO: 102066 - DNA, 25 bp, Mus musculus
acaggcccaatgtatttatttatgt

SEQ ID NO: 102067 - DNA, 25 bp, Mus musculus
acaggcccacttaggccaggagaaa

SEQ ID NO: 102068 - DNA, 25 bp, Mus musculus
acaggcccactttggccaggagaaa

SEQ ID NO: 102069 - DNA, 25 bp, Mus musculus
acaggcccagagatggcaaccactc

SEQ ID NO: 102070 - DNA, 25 bp, Mus musculus
acaggcccagagttggcaaccactc

SEQ ID NO: 102071 - DNA, 25 bp, Mus musculus
acaggcccagtgctaatggatcaca

SEQ ID NO: 102072 - DNA, 25 bp, Mus musculus
acaggcccagtggtaatggatcaca

SEQ ID NO: 102073 - DNA, 25 bp, Mus musculus
acaggcccagttcagattgggccac

SEQ ID NO: 102074 - DNA, 25 bp, Mus musculus
acaggcccagttgagattgggccac

SEQ ID NO: 102075 - DNA, 25 bp, Mus musculus
acaggcccattcagtaaagcggagc

SEQ ID NO: 102076 - DNA, 25 bp, Mus musculus
acaggcccattctgtaaagcggagc

SEQ ID NO: 102077 - DNA, 25 bp, Mus musculus
acaggccccaaaccaatggctaatt

SEQ ID NO: 102078 - DNA, 25 bp, Mus musculus
acaggccccaaagcaatggctaatt

SEQ ID NO: 102079 - DNA, 25 bp, Mus musculus
acaggccccagacacgtgtgtgatc

SEQ ID NO: 102080 - DNA, 25 bp, Mus musculus
acaggccccagagacgtgtgtgatc

SEQ ID NO: 102081 - DNA, 25 bp, Mus musculus
acaggccccagtaattgtgaaaaca

SEQ ID NO: 102082 - DNA, 25 bp, Mus musculus
acaggccccagttattgtgaaaaca

SEQ ID NO: 102083 - DNA, 25 bp, Mus musculus
acaggcccctaactgtctactactt

SEQ ID NO: 102084 - DNA, 25 bp, Mus musculus
acaggcccctaagtgtctactactt

SEQ ID NO: 102085 - DNA, 25 bp, Mus musculus
acaggcccctcacagttcagaatgg

SEQ ID NO: 102086 - DNA, 25 bp, Mus musculus
acaggcccctcagagttcagaatgg

SEQ ID NO: 102087 - DNA, 25 bp, Mus musculus
acaggcccctgcatttgaatttgtc

SEQ ID NO: 102088 - DNA, 25 bp, Mus musculus
acaggcccctgcttttgaatttgtc

SEQ ID NO: 102089 - DNA, 25 bp, Mus musculus
acaggccctcctagagatgtagaga

SEQ ID NO: 102090 - DNA, 25 bp, Mus musculus
acaggccctccttgagatgtagaga

SEQ ID NO: 102091 - DNA, 25 bp, Mus musculus
acaggccctgagaccacctgtttgg

SEQ ID NO: 102092 - DNA, 25 bp, Mus musculus
acaggccctgagtccacctgtttgg

SEQ ID NO: 102093 - DNA, 25 bp, Mus musculus
acaggccctgggaatggtaaggcac

SEQ ID NO: 102094 - DNA, 25 bp, Mus musculus
acaggccctgggtatggtaaggcac

SEQ ID NO: 102095 - DNA, 25 bp, Mus musculus
acaggccctggtcagcaaagtacaa

SEQ ID NO: 102096 - DNA, 25 bp, Mus musculus
acaggccctggtgagcaaagtacaa

SEQ ID NO: 102097 - DNA, 25 bp, Mus musculus
acaggcccttggacatccatatggt

SEQ ID NO: 102098 - DNA, 25 bp, Mus musculus
acaggcccttggtcatccatatggt

SEQ ID NO: 102099 - DNA, 25 bp, Mus musculus
acaggccgcctgcttagaagagtga

SEQ ID NO: 102100 - DNA, 25 bp, Mus musculus
acaggccgcctggttagaagagtga

SEQ ID NO: 102101 - DNA, 25 bp, Mus musculus
acaggccggtcaacgcggtacacag

SEQ ID NO: 102102 - DNA, 25 bp, Mus musculus
acaggccggtcatcgcggtacacag

SEQ ID NO: 102103 - DNA, 25 bp, Mus musculus
acaggccgtatcatacgctggctgg

SEQ ID NO: 102104 - DNA, 25 bp, Mus musculus
acaggccgtatcttacgctggctgg

SEQ ID NO: 102105 - DNA, 25 bp, Mus musculus
acaggccgtgttaagttagacctcg

SEQ ID NO: 102106 - DNA, 25 bp, Mus musculus
acaggccgtgtttagttagacctcg

SEQ ID NO: 102107 - DNA, 25 bp, Mus musculus
acaggcctacagagttttcacagaa

SEQ ID NO: 102108 - DNA, 25 bp, Mus musculus
acaggcctacagtgttttcacagaa

SEQ ID NO: 102109 - DNA, 25 bp, Mus musculus
acaggcctagtaccaaagctttgct

SEQ ID NO: 102110 - DNA, 25 bp, Mus musculus
acaggcctagtagcaaagctttgct

SEQ ID NO: 102111 - DNA, 25 bp, Mus musculus
acaggcctcaggatatcatcgtgtt

SEQ ID NO: 102112 - DNA, 25 bp, Mus musculus
acaggcctcaggttatcatcgtgtt

SEQ ID NO: 102113 - DNA, 25 bp, Mus musculus
acaggcctcctgaagtcatagcaac

SEQ ID NO: 102114 - DNA, 25 bp, Mus musculus
acaggcctcctgtagtcatagcaac

SEQ ID NO: 102115 - DNA, 25 bp, Mus musculus
acaggcctccttagtaaatggtacg

SEQ ID NO: 102116 - DNA, 25 bp, Mus musculus
acaggcctcctttgtaaatggtacg

SEQ ID NO: 102117 - DNA, 25 bp, Mus musculus
acaggcctcgttccttggagttcac

SEQ ID NO: 102118 - DNA, 25 bp, Mus musculus
acaggcctcgttgcttggagttcac

SEQ ID NO: 102119 - DNA, 25 bp, Mus musculus
acaggcctctaacttgctaactctt

SEQ ID NO: 102120 - DNA, 25 bp, Mus musculus
acaggcctctaagttgctaactctt

SEQ ID NO: 102121 - DNA, 25 bp, Mus musculus
acaggcctctgaaggtgcagacaga

SEQ ID NO: 102122 - DNA, 25 bp, Mus musculus
acaggcctctgatggtgcagacaga

SEQ ID NO: 102123 - DNA, 25 bp, Mus musculus
acaggcctcttgctaccacggtaca

SEQ ID NO: 102124 - DNA, 25 bp, Mus musculus
acaggcctcttggtaccacggtaca

SEQ ID NO: 102125 - DNA, 25 bp, Mus musculus
acaggcctgaacagggggagtctac

SEQ ID NO: 102126 - DNA, 25 bp, Mus musculus
acaggcctgaactgggggagtctac

SEQ ID NO: 102127 - DNA, 25 bp, Mus musculus
acaggcctgagtccacacgtgtgta

SEQ ID NO: 102128 - DNA, 25 bp, Mus musculus
acaggcctgagtgcacacgtgtgta

SEQ ID NO: 102129 - DNA, 25 bp, Mus musculus
acaggcctgcagacatttttagcca

SEQ ID NO: 102130 - DNA, 25 bp, Mus musculus
acaggcctgcagatcttattttgga

SEQ ID NO: 102131 - DNA, 25 bp, Mus musculus
acaggcctgcagtcatttttagcca

SEQ ID NO: 102132 - DNA, 25 bp, Mus musculus
acaggcctgcagttcttattttgga

SEQ ID NO: 102133 - DNA, 25 bp, Mus musculus
acaggcctgctcaggttgagttgag

SEQ ID NO: 102134 - DNA, 25 bp, Mus musculus
acaggcctgctctggttgagttgag

SEQ ID NO: 102135 - DNA, 25 bp, Mus musculus
acaggcctggccaccagtatcatga

SEQ ID NO: 102136 - DNA, 25 bp, Mus musculus
acaggcctggcctccagtatcatga

SEQ ID NO: 102137 - DNA, 25 bp, Mus musculus
acaggcctgggcacggctgcagtta

SEQ ID NO: 102138 - DNA, 25 bp, Mus musculus
acaggcctgggcagatatctgagca

SEQ ID NO: 102139 - DNA, 25 bp, Mus musculus
acaggcctgggctcggctgcagtta

SEQ ID NO: 102140 - DNA, 25 bp, Mus musculus
acaggcctgggctgatatctgagca

SEQ ID NO: 102141 - DNA, 25 bp, Mus musculus
acaggcctgggtagctatgttccgg

SEQ ID NO: 102142 - DNA, 25 bp, Mus musculus
acaggcctgggttgctatgttccgg

SEQ ID NO: 102143 - DNA, 25 bp, Mus musculus
acaggcctgtgtaagctcgggtctc

SEQ ID NO: 102144 - DNA, 25 bp, Mus musculus
acaggcctgtgttagctcgggtctc

SEQ ID NO: 102145 - DNA, 25 bp, Mus musculus
acaggccttcccaggctcttctgaa

SEQ ID NO: 102146 - DNA, 25 bp, Mus musculus
acaggccttccctggctcttctgaa

SEQ ID NO: 102147 - DNA, 25 bp, Mus musculus
acaggccttcctagtgtttccaggg

SEQ ID NO: 102148 - DNA, 25 bp, Mus musculus
acaggccttccttgtgtttccaggg

SEQ ID NO: 102149 - DNA, 25 bp, Mus musculus
acaggccttcgtaggtgacattgca

SEQ ID NO: 102150 - DNA, 25 bp, Mus musculus
acaggccttcgttggtgacattgca

SEQ ID NO: 102151 - DNA, 25 bp, Mus musculus
acaggccttgtgacctcagtcttat

SEQ ID NO: 102152 - DNA, 25 bp, Mus musculus
acaggccttgtgtcctcagtcttat

SEQ ID NO: 102153 - DNA, 25 bp, Mus musculus
acaggcctttctcgtagatggcgtc

SEQ ID NO: 102154 - DNA, 25 bp, Mus musculus
acaggcctttctggtagatggcgtc

SEQ ID NO: 102155 - DNA, 25 bp, Mus musculus
acaggcgactgacgcggattttgaa

SEQ ID NO: 102156 - DNA, 25 bp, Mus musculus
acaggcgactgaggcggattttgaa

SEQ ID NO: 102157 - DNA, 25 bp, Mus musculus
acaggcgattccagagagcgaggct

SEQ ID NO: 102158 - DNA, 25 bp, Mus musculus
acaggcgattcctgagagcgaggct

SEQ ID NO: 102159 - DNA, 25 bp, Mus musculus
acaggcgcacggacttgcagatgtg

SEQ ID NO: 102160 - DNA, 25 bp, Mus musculus
acaggcgcacggtcttgcagatgtg

SEQ ID NO: 102161 - DNA, 25 bp, Mus musculus
acaggcgcagaaccgttagctccag

SEQ ID NO: 102162 - DNA, 25 bp, Mus musculus
acaggcgcagaagcgttagctccag

SEQ ID NO: 102163 - DNA, 25 bp, Mus musculus
acaggcgctgatcaccccggacacc

SEQ ID NO: 102164 - DNA, 25 bp, Mus musculus
acaggcgctgatgaccccggacacc

SEQ ID NO: 102165 - DNA, 25 bp, Mus musculus
acaggcggcaccagctattgaccat

SEQ ID NO: 102166 - DNA, 25 bp, Mus musculus
acaggcggcacctgctattgaccat

SEQ ID NO: 102167 - DNA, 25 bp, Mus musculus
acaggcggccccacagcagagaggc

SEQ ID NO: 102168 - DNA, 25 bp, Mus musculus
acaggcggcccctcagcagagaggc

SEQ ID NO: 102169 - DNA, 25 bp, Mus musculus
acaggcggcctgcacatcagcaaaa

SEQ ID NO: 102170 - DNA, 25 bp, Mus musculus
acaggcggcctggacatcagcaaaa

SEQ ID NO: 102171 - DNA, 25 bp, Mus musculus
acaggcggcttaagcccaccgtggt

SEQ ID NO: 102172 - DNA, 25 bp, Mus musculus
acaggcggcttatgcccaccgtggt

SEQ ID NO: 102173 - DNA, 25 bp, Mus musculus
acaggcgggcgacatcagttttgaa

SEQ ID NO: 102174 - DNA, 25 bp, Mus musculus
acaggcgggcgagatcagttttgaa

SEQ ID NO: 102175 - DNA, 25 bp, Mus musculus
acaggcgggtgaaggcttgactcta

SEQ ID NO: 102176 - DNA, 25 bp, Mus musculus
acaggcgggtgatggcttgactcta

SEQ ID NO: 102177 - DNA, 25 bp, Mus musculus
acaggcggtgcaattacttatagac

SEQ ID NO: 102178 - DNA, 25 bp, Mus musculus
acaggcggtgcatttacttatagac

SEQ ID NO: 102179 - DNA, 25 bp, Mus musculus
acaggcgtcagaatccaggttcatg

SEQ ID NO: 102180 - DNA, 25 bp, Mus musculus
acaggcgtcagattccaggttcatg

SEQ ID NO: 102181 - DNA, 25 bp, Mus musculus
acaggcgtctaaccttaaagggcgt

SEQ ID NO: 102182 - DNA, 25 bp, Mus musculus
acaggcgtctaagcttaaagggcgt

SEQ ID NO: 102183 - DNA, 25 bp, Mus musculus
acaggcgtgatgctagacactgctt

SEQ ID NO: 102184 - DNA, 25 bp, Mus musculus
acaggcgtgatggtagacactgctt

SEQ ID NO: 102185 - DNA, 25 bp, Mus musculus
acaggcgtgcctatagttgatatca

SEQ ID NO: 102186 - DNA, 25 bp, Mus musculus
acaggcgtgcctttagttgatatca

SEQ ID NO: 102187 - DNA, 25 bp, Mus musculus
acaggcgtttcaccagttgatgggt

SEQ ID NO: 102188 - DNA, 25 bp, Mus musculus
acaggcgtttcagcagttgatgggt

SEQ ID NO: 102189 - DNA, 25 bp, Mus musculus
acaggctaaaaaccctctcttgaac

SEQ ID NO: 102190 - DNA, 25 bp, Mus musculus
acaggctaaaaagcctctcttgaac

SEQ ID NO: 102191 - DNA, 25 bp, Mus musculus
acaggctaaaacagtggatctcaat

SEQ ID NO: 102192 - DNA, 25 bp, Mus musculus
acaggctaaaactgtggatctcaat

SEQ ID NO: 102193 - DNA, 25 bp, Mus musculus
acaggctaaaggcttcgctctacct

SEQ ID NO: 102194 - DNA, 25 bp, Mus musculus
acaggctaaagggttcgctctacct

SEQ ID NO: 102195 - DNA, 25 bp, Mus musculus
acaggctaagcacaggttccttcct

SEQ ID NO: 102196 - DNA, 25 bp, Mus musculus
acaggctaagcagaggttccttcct

SEQ ID NO: 102197 - DNA, 25 bp, Mus musculus
acaggctacagcaggaagtcgggaa

SEQ ID NO: 102198 - DNA, 25 bp, Mus musculus
acaggctacagctggaagtcgggaa

SEQ ID NO: 102199 - DNA, 25 bp, Mus musculus
acaggctacctgataacagacttgg

SEQ ID NO: 102200 - DNA, 25 bp, Mus musculus
acaggctacctgttaacagacttgg

SEQ ID NO: 102201 - DNA, 25 bp, Mus musculus
acaggctactctcgagccagtggtt

SEQ ID NO: 102202 - DNA, 25 bp, Mus musculus
acaggctactctggagccagtggtt

SEQ ID NO: 102203 - DNA, 25 bp, Mus musculus
acaggctagaagagcttgctcgtcc

SEQ ID NO: 102204 - DNA, 25 bp, Mus musculus
acaggctagaagtgcttgctcgtcc

SEQ ID NO: 102205 - DNA, 25 bp, Mus musculus
acaggctagagcacgttggcattgt

SEQ ID NO: 102206 - DNA, 25 bp, Mus musculus
acaggctagagctcgttggcattgt

SEQ ID NO: 102207 - DNA, 25 bp, Mus musculus
acaggctagccacgagaagccacca

SEQ ID NO: 102208 - DNA, 25 bp, Mus musculus
acaggctagccaggagaagccacca

SEQ ID NO: 102209 - DNA, 25 bp, Mus musculus
acaggctagcttactgtgagctgca

SEQ ID NO: 102210 - DNA, 25 bp, Mus musculus
acaggctagctttctgtgagctgca

SEQ ID NO: 102211 - DNA, 25 bp, Mus musculus
acaggctattcacgccccagcagct

SEQ ID NO: 102212 - DNA, 25 bp, Mus musculus
acaggctattcaggccccagcagct

SEQ ID NO: 102213 - DNA, 25 bp, Mus musculus
acaggctcacatagctccttgttta

SEQ ID NO: 102214 - DNA, 25 bp, Mus musculus
acaggctcacattgctccttgttta

SEQ ID NO: 102215 - DNA, 25 bp, Mus musculus
acaggctcagcaattatccactttg

SEQ ID NO: 102216 - DNA, 25 bp, Mus musculus
acaggctcagcatttatccactttg

SEQ ID NO: 102217 - DNA, 25 bp, Mus musculus
acaggctcaggcatgaagttcattt

SEQ ID NO: 102218 - DNA, 25 bp, Mus musculus
acaggctcaggcttgaagttcattt

SEQ ID NO: 102219 - DNA, 25 bp, Mus musculus
acaggctcaggtctgcaccaacata

SEQ ID NO: 102220 - DNA, 25 bp, Mus musculus
acaggctcaggtgtgcaccaacata

SEQ ID NO: 102221 - DNA, 25 bp, Mus musculus
acaggctcatgcatggtagtatctt

SEQ ID NO: 102222 - DNA, 25 bp, Mus musculus
acaggctcatgcttggtagtatctt

SEQ ID NO: 102223 - DNA, 25 bp, Mus musculus
acaggctcattcaggccgggagatg

SEQ ID NO: 102224 - DNA, 25 bp, Mus musculus
acaggctcattctggccgggagatg

SEQ ID NO: 102225 - DNA, 25 bp, Mus musculus
acaggctcccggctggctgctttct

SEQ ID NO: 102226 - DNA, 25 bp, Mus musculus
acaggctcccgggtggctgctttct

SEQ ID NO: 102227 - DNA, 25 bp, Mus musculus
acaggctcctcaatggtacagggtt

SEQ ID NO: 102228 - DNA, 25 bp, Mus musculus
acaggctcctcattggtacagggtt

SEQ ID NO: 102229 - DNA, 25 bp, Mus musculus
acaggctcctggcatagactttgtc

SEQ ID NO: 102230 - DNA, 25 bp, Mus musculus
acaggctcctgggatagactttgtc

SEQ ID NO: 102231 - DNA, 25 bp, Mus musculus
acaggctcctgtcaagtgcctatga

SEQ ID NO: 102232 - DNA, 25 bp, Mus musculus
acaggctcctgtgaagtgcctatga

SEQ ID NO: 102233 - DNA, 25 bp, Mus musculus
acaggctcgaacataatgcatgcag

SEQ ID NO: 102234 - DNA, 25 bp, Mus musculus
acaggctcgaacttaatgcatgcag

SEQ ID NO: 102235 - DNA, 25 bp, Mus musculus
acaggctcggcgacaaggccagata

SEQ ID NO: 102236 - DNA, 25 bp, Mus musculus
acaggctcggcgtcaaggccagata

SEQ ID NO: 102237 - DNA, 25 bp, Mus musculus
acaggctctacaagctgggacgcta

SEQ ID NO: 102238 - DNA, 25 bp, Mus musculus
acaggctctacatgctgggacgcta

SEQ ID NO: 102239 - DNA, 25 bp, Mus musculus
acaggctctcacaattagctatggt

SEQ ID NO: 102240 - DNA, 25 bp, Mus musculus
acaggctctcactattagctatggt

SEQ ID NO: 102241 - DNA, 25 bp, Mus musculus
acaggctctcttcggttcattgtaa

SEQ ID NO: 102242 - DNA, 25 bp, Mus musculus
acaggctctcttgggttcattgtaa

SEQ ID NO: 102243 - DNA, 25 bp, Mus musculus
acaggctctgcactggactcttcta

SEQ ID NO: 102244 - DNA, 25 bp, Mus musculus
acaggctctgcagtggactcttcta

SEQ ID NO: 102245 - DNA, 25 bp, Mus musculus
acaggctctgtgactcatttttcga

SEQ ID NO: 102246 - DNA, 25 bp, Mus musculus
acaggctctgtgtctcatttttcga

SEQ ID NO: 102247 - DNA, 25 bp, Mus musculus
acaggctctgttaccaagtttcaca

SEQ ID NO: 102248 - DNA, 25 bp, Mus musculus
acaggctctgtttccaagtttcaca

SEQ ID NO: 102249 - DNA, 25 bp, Mus musculus
acaggctcttatctggatgtcctaa

SEQ ID NO: 102250 - DNA, 25 bp, Mus musculus
acaggctcttatgtggatgtcctaa

SEQ ID NO: 102251 - DNA, 25 bp, Mus musculus
acaggctgaaggacatctcatggtg

SEQ ID NO: 102252 - DNA, 25 bp, Mus musculus
acaggctgaaggtcatctcatggtg

SEQ ID NO: 102253 - DNA, 25 bp, Mus musculus
acaggctgactgacgctaagttcat

SEQ ID NO: 102254 - DNA, 25 bp, Mus musculus
acaggctgactgtcgctaagttcat

SEQ ID NO: 102255 - DNA, 25 bp, Mus musculus
acaggctgagaaccaaagttttaga

SEQ ID NO: 102256 - DNA, 25 bp, Mus musculus
acaggctgagaagcaaagttttaga

SEQ ID NO: 102257 - DNA, 25 bp, Mus musculus
acaggctgagtcagggaaacctcga

SEQ ID NO: 102258 - DNA, 25 bp, Mus musculus
acaggctgagtctgggaaacctcga

SEQ ID NO: 102259 - DNA, 25 bp, Mus musculus
acaggctgcacaactgatggactta

SEQ ID NO: 102260 - DNA, 25 bp, Mus musculus
acaggctgcacatctgatggactta

SEQ ID NO: 102261 - DNA, 25 bp, Mus musculus
acaggctgcataaccaggtgacact

SEQ ID NO: 102262 - DNA, 25 bp, Mus musculus
acaggctgcatatccaggtgacact

SEQ ID NO: 102263 - DNA, 25 bp, Mus musculus
acaggctgccttagaaaaatcgggt

SEQ ID NO: 102264 - DNA, 25 bp, Mus musculus
acaggctgcctttgaaaaatcgggt

SEQ ID NO: 102265 - DNA, 25 bp, Mus musculus
acaggctgctcaccatgagatctat

SEQ ID NO: 102266 - DNA, 25 bp, Mus musculus
acaggctgctcagcatgagatctat

SEQ ID NO: 102267 - DNA, 25 bp, Mus musculus
acaggctgcttgctgtcattttcag

SEQ ID NO: 102268 - DNA, 25 bp, Mus musculus
acaggctgcttggtgtcattttcag

SEQ ID NO: 102269 - DNA, 25 bp, Mus musculus
acaggctggaacacgacctaccgct

SEQ ID NO: 102270 - DNA, 25 bp, Mus musculus
acaggctggaactcgacctaccgct

SEQ ID NO: 102271 - DNA, 25 bp, Mus musculus
acaggctggaccaagcccggaagga

SEQ ID NO: 102272 - DNA, 25 bp, Mus musculus
acaggctggacctagcccggaagga

SEQ ID NO: 102273 - DNA, 25 bp, Mus musculus
acaggctggactactcaaggaaggg

SEQ ID NO: 102274 - DNA, 25 bp, Mus musculus
acaggctggacttctcaaggaaggg

SEQ ID NO: 102275 - DNA, 25 bp, Mus musculus
acaggctggcctcacacggctcgga

SEQ ID NO: 102276 - DNA, 25 bp, Mus musculus
acaggctggcctgacacggctcgga

SEQ ID NO: 102277 - DNA, 25 bp, Mus musculus
acaggctggctccttccgtaggaag

SEQ ID NO: 102278 - DNA, 25 bp, Mus musculus
acaggctggctcgttccgtaggaag

SEQ ID NO: 102279 - DNA, 25 bp, Mus musculus
acaggctgggttcaattcctttgct

SEQ ID NO: 102280 - DNA, 25 bp, Mus musculus
acaggctgggttgaattcctttgct

SEQ ID NO: 102281 - DNA, 25 bp, Mus musculus
acaggctggtccacagggatgtcag

SEQ ID NO: 102282 - DNA, 25 bp, Mus musculus
acaggctggtcctcagggatgtcag

SEQ ID NO: 102283 - DNA, 25 bp, Mus musculus
acaggctgtaaaatgaacttcccac

SEQ ID NO: 102284 - DNA, 25 bp, Mus musculus
acaggctgtaaattgaacttcccac

SEQ ID NO: 102285 - DNA, 25 bp, Mus musculus
acaggctgtaccatcaggtgtctaa

SEQ ID NO: 102286 - DNA, 25 bp, Mus musculus
acaggctgtaccttcaggtgtctaa

SEQ ID NO: 102287 - DNA, 25 bp, Mus musculus
acaggctgtgttcctaactctttcg

SEQ ID NO: 102288 - DNA, 25 bp, Mus musculus
acaggctgtgttgctaactctttcg

SEQ ID NO: 102289 - DNA, 25 bp, Mus musculus
acaggctgttgtcaggtgcttaaca

SEQ ID NO: 102290 - DNA, 25 bp, Mus musculus
acaggctgttgtgaggtgcttaaca

SEQ ID NO: 102291 - DNA, 25 bp, Mus musculus
acaggctgttttactctggcttcag

SEQ ID NO: 102292 - DNA, 25 bp, Mus musculus
acaggctgtttttctctggcttcag

SEQ ID NO: 102293 - DNA, 25 bp, Mus musculus
acaggcttacggcttttccaggcac

SEQ ID NO: 102294 - DNA, 25 bp, Mus musculus
acaggcttacgggttttccaggcac

SEQ ID NO: 102295 - DNA, 25 bp, Mus musculus
acaggcttataaactcttcaccaag

SEQ ID NO: 102296 - DNA, 25 bp, Mus musculus
acaggcttataatctcttcaccaag

SEQ ID NO: 102297 - DNA, 25 bp, Mus musculus
acaggcttatagctgtgatgtacct

SEQ ID NO: 102298 - DNA, 25 bp, Mus musculus
acaggcttataggtgtgatgtacct

SEQ ID NO: 102299 - DNA, 25 bp, Mus musculus
acaggcttatttctaaaccatcatt

SEQ ID NO: 102300 - DNA, 25 bp, Mus musculus
acaggcttatttgtaaaccatcatt

SEQ ID NO: 102301 - DNA, 25 bp, Mus musculus
acaggcttcagtaatgtctccgctg

SEQ ID NO: 102302 - DNA, 25 bp, Mus musculus
acaggcttcagttatgtctccgctg

SEQ ID NO: 102303 - DNA, 25 bp, Mus musculus
acaggcttcatcagctttgacgcag

SEQ ID NO: 102304 - DNA, 25 bp, Mus musculus
acaggcttcatctgctttgacgcag

SEQ ID NO: 102305 - DNA, 25 bp, Mus musculus
acaggcttccaaaccaatctttgaa

SEQ ID NO: 102306 - DNA, 25 bp, Mus musculus
acaggcttccaatccaatctttgaa

SEQ ID NO: 102307 - DNA, 25 bp, Mus musculus
acaggcttccataccggcacttggg

SEQ ID NO: 102308 - DNA, 25 bp, Mus musculus
acaggcttccattccggcacttggg

SEQ ID NO: 102309 - DNA, 25 bp, Mus musculus
acaggcttccggaacaggcacaaag

SEQ ID NO: 102310 - DNA, 25 bp, Mus musculus
acaggcttccggtacaggcacaaag

SEQ ID NO: 102311 - DNA, 25 bp, Mus musculus
acaggcttcctacaggtcacatgca

SEQ ID NO: 102312 - DNA, 25 bp, Mus musculus
acaggcttcctagaggtcacatgca

SEQ ID NO: 102313 - DNA, 25 bp, Mus musculus
acaggcttcctgaccacatagaata

SEQ ID NO: 102314 - DNA, 25 bp, Mus musculus
acaggcttcctgtccacatagaata

SEQ ID NO: 102315 - DNA, 25 bp, Mus musculus
acaggcttcgtaatgtcagctgaaa

SEQ ID NO: 102316 - DNA, 25 bp, Mus musculus
acaggcttcgtattgtcagctgaaa

SEQ ID NO: 102317 - DNA, 25 bp, Mus musculus
acaggcttctatatctaccaccggt

SEQ ID NO: 102318 - DNA, 25 bp, Mus musculus
acaggcttctatcagctttgtctaa

SEQ ID NO: 102319 - DNA, 25 bp, Mus musculus
acaggcttctatctctgctttcttt

SEQ ID NO: 102320 - DNA, 25 bp, Mus musculus
acaggcttctatgagctttgtctaa

SEQ ID NO: 102321 - DNA, 25 bp, Mus musculus
acaggcttctatgtctgctttcttt

SEQ ID NO: 102322 - DNA, 25 bp, Mus musculus
acaggcttctatttctaccaccggt

SEQ ID NO: 102323 - DNA, 25 bp, Mus musculus
acaggcttctgcatatctgctagag

SEQ ID NO: 102324 - DNA, 25 bp, Mus musculus
acaggcttctgcttatctgctagag

SEQ ID NO: 102325 - DNA, 25 bp, Mus musculus
acaggcttcttacctgccgaaattg

SEQ ID NO: 102326 - DNA, 25 bp, Mus musculus
acaggcttcttagctgccgaaattg

SEQ ID NO: 102327 - DNA, 25 bp, Mus musculus
acaggcttgcacaatttctcatttt

SEQ ID NO: 102328 - DNA, 25 bp, Mus musculus
acaggcttgcactatttctcatttt

SEQ ID NO: 102329 - DNA, 25 bp, Mus musculus
acaggcttgtgtctctgagtgcaaa

SEQ ID NO: 102330 - DNA, 25 bp, Mus musculus
acaggcttgtgtgtctgagtgcaaa

SEQ ID NO: 102331 - DNA, 25 bp, Mus musculus
acaggcttgttcagggttgtgcact

SEQ ID NO: 102332 - DNA, 25 bp, Mus musculus
acaggcttgttctgggttgtgcact

SEQ ID NO: 102333 - DNA, 25 bp, Mus musculus
acaggctttatgcttgaggcttgag

SEQ ID NO: 102334 - DNA, 25 bp, Mus musculus
acaggctttatggttgaggcttgag

SEQ ID NO: 102335 - DNA, 25 bp, Mus musculus
acaggctttattaccttcaacagaa

SEQ ID NO: 102336 - DNA, 25 bp, Mus musculus
acaggctttatttccttcaacagaa

SEQ ID NO: 102337 - DNA, 25 bp, Mus musculus
acaggcttttataatctagacatca

SEQ ID NO: 102338 - DNA, 25 bp, Mus musculus
acaggcttttattatctagacatca

SEQ ID NO: 102339 - DNA, 25 bp, Mus musculus
acaggcttttgaattatggtcagaa

SEQ ID NO: 102340 - DNA, 25 bp, Mus musculus
acaggcttttgatttatggtcagaa

SEQ ID NO: 102341 - DNA, 25 bp, Mus musculus
acaggcttttgccgcagcgaaaaca

SEQ ID NO: 102342 - DNA, 25 bp, Mus musculus
acaggcttttgcggcagcgaaaaca

SEQ ID NO: 102343 - DNA, 25 bp, Mus musculus
acagggaaactcatttacaaagtag

SEQ ID NO: 102344 - DNA, 25 bp, Mus musculus
acagggaaactcttttacaaagtag

SEQ ID NO: 102345 - DNA, 25 bp, Mus musculus
acagggaaaggccattacgtatcat

SEQ ID NO: 102346 - DNA, 25 bp, Mus musculus
acagggaaaggcgattacgtatcat

SEQ ID NO: 102347 - DNA, 25 bp, Mus musculus
acagggaacaagcttattgtcgaat

SEQ ID NO: 102348 - DNA, 25 bp, Mus musculus
acagggaacaaggttattgtcgaat

SEQ ID NO: 102349 - DNA, 25 bp, Mus musculus
acagggaacattcctggcctaaatg

SEQ ID NO: 102350 - DNA, 25 bp, Mus musculus
acagggaacattgctggcctaaatg

SEQ ID NO: 102351 - DNA, 25 bp, Mus musculus
acagggaacttccactgggtttcag

SEQ ID NO: 102352 - DNA, 25 bp, Mus musculus
acagggaacttcgactgggtttcag

SEQ ID NO: 102353 - DNA, 25 bp, Mus musculus
acagggaagatacacgtttcattgt

SEQ ID NO: 102354 - DNA, 25 bp, Mus musculus
acagggaagatagacgtttcattgt

SEQ ID NO: 102355 - DNA, 25 bp, Mus musculus
acagggaaggagattccagccccac

SEQ ID NO: 102356 - DNA, 25 bp, Mus musculus
acagggaaggagtttccagccccac

SEQ ID NO: 102357 - DNA, 25 bp, Mus musculus
acagggaagtctacctcggaggcca

SEQ ID NO: 102358 - DNA, 25 bp, Mus musculus
acagggaagtcttcctcggaggcca

SEQ ID NO: 102359 - DNA, 25 bp, Mus musculus
acagggaatgagaccagaggtacca

SEQ ID NO: 102360 - DNA, 25 bp, Mus musculus
acagggaatgagtccagaggtacca

SEQ ID NO: 102361 - DNA, 25 bp, Mus musculus
acagggaatgtgaacagtagacttc

SEQ ID NO: 102362 - DNA, 25 bp, Mus musculus
acagggaatgtgtacagtagacttc

SEQ ID NO: 102363 - DNA, 25 bp, Mus musculus
acagggaattgtatctatcagagaa

SEQ ID NO: 102364 - DNA, 25 bp, Mus musculus
acagggaattgtttctatcagagaa

SEQ ID NO: 102365 - DNA, 25 bp, Mus musculus
acagggacaggaagcctcaaaactt

SEQ ID NO: 102366 - DNA, 25 bp, Mus musculus
acagggacaggatgcctcaaaactt

SEQ ID NO: 102367 - DNA, 25 bp, Mus musculus
acagggacatccattgacaagtttt

SEQ ID NO: 102368 - DNA, 25 bp, Mus musculus
acagggacatcctttgacaagtttt

SEQ ID NO: 102369 - DNA, 25 bp, Mus musculus
acagggacattcaaggtacagcagt

SEQ ID NO: 102370 - DNA, 25 bp, Mus musculus
acagggacattctaggtacagcagt

SEQ ID NO: 102371 - DNA, 25 bp, Mus musculus
acagggacccttcttatccctggat

SEQ ID NO: 102372 - DNA, 25 bp, Mus musculus
acagggacccttgttatccctggat

SEQ ID NO: 102373 - DNA, 25 bp, Mus musculus
acagggaccgtgctgactgactttg

SEQ ID NO: 102374 - DNA, 25 bp, Mus musculus
acagggaccgtggtgactgactttg

SEQ ID NO: 102375 - DNA, 25 bp, Mus musculus
acagggacctcacgtgcacacattc

SEQ ID NO: 102376 - DNA, 25 bp, Mus musculus
acagggacctcaggtgcacacattc

SEQ ID NO: 102377 - DNA, 25 bp, Mus musculus
acagggacctgtcttcataggatgt

SEQ ID NO: 102378 - DNA, 25 bp, Mus musculus
acagggacctgtgttcataggatgt

SEQ ID NO: 102379 - DNA, 25 bp, Mus musculus
acagggacgccaccctgaaggagct

SEQ ID NO: 102380 - DNA, 25 bp, Mus musculus
acagggacgccagcctgaaggagct

SEQ ID NO: 102381 - DNA, 25 bp, Mus musculus
acagggactaccatgcacgtttgat

SEQ ID NO: 102382 - DNA, 25 bp, Mus musculus
acagggactaccttgcacgtttgat

SEQ ID NO: 102383 - DNA, 25 bp, Mus musculus
acagggactatcagtgtagcccttg

SEQ ID NO: 102384 - DNA, 25 bp, Mus musculus
acagggactatctgtgtagcccttg

SEQ ID NO: 102385 - DNA, 25 bp, Mus musculus
acagggactcggcttgtgcacattt

SEQ ID NO: 102386 - DNA, 25 bp, Mus musculus
acagggactcgggttgtgcacattt

SEQ ID NO: 102387 - DNA, 25 bp, Mus musculus
acagggactgtaccttaactgtgag

SEQ ID NO: 102388 - DNA, 25 bp, Mus musculus
acagggactgtagcttaactgtgag

SEQ ID NO: 102389 - DNA, 25 bp, Mus musculus
acagggacttctcggtattcaccac

SEQ ID NO: 102390 - DNA, 25 bp, Mus musculus
acagggacttctgggtattcaccac

SEQ ID NO: 102391 - DNA, 25 bp, Mus musculus
acagggagacctccaaccccaagtg

SEQ ID NO: 102392 - DNA, 25 bp, Mus musculus
acagggagacctccatggtgcatga

SEQ ID NO: 102393 - DNA, 25 bp, Mus musculus
acagggagacctgcaaccccaagtg

SEQ ID NO: 102394 - DNA, 25 bp, Mus musculus
acagggagacctgcatggtgcatga

SEQ ID NO: 102395 - DNA, 25 bp, Mus musculus
acagggagaggtcccttttgtatcc

SEQ ID NO: 102396 - DNA, 25 bp, Mus musculus
acagggagaggtgccttttgtatcc

SEQ ID NO: 102397 - DNA, 25 bp, Mus musculus
acagggagatgccaaccttcctata

SEQ ID NO: 102398 - DNA, 25 bp, Mus musculus
acagggagatgcgaaccttcctata

SEQ ID NO: 102399 - DNA, 25 bp, Mus musculus
acagggagctcaatgttcttgcctt

SEQ ID NO: 102400 - DNA, 25 bp, Mus musculus
acagggagctcattgttcttgcctt

SEQ ID NO: 102401 - DNA, 25 bp, Mus musculus
acagggagctggagccttggttcac

SEQ ID NO: 102402 - DNA, 25 bp, Mus musculus
acagggagctggtgccttggttcac

SEQ ID NO: 102403 - DNA, 25 bp, Mus musculus
acagggaggctgcaggtaggtgtca

SEQ ID NO: 102404 - DNA, 25 bp, Mus musculus
acagggaggctggaggtaggtgtca

SEQ ID NO: 102405 - DNA, 25 bp, Mus musculus
acagggagggtcatgtccactcgtc

SEQ ID NO: 102406 - DNA, 25 bp, Mus musculus
acagggagggtcttgtccactcgtc

SEQ ID NO: 102407 - DNA, 25 bp, Mus musculus
acagggagtccaacacagcgggcaa

SEQ ID NO: 102408 - DNA, 25 bp, Mus musculus
acagggagtccatcacagcgggcaa

SEQ ID NO: 102409 - DNA, 25 bp, Mus musculus
acagggagtcttctttgagcctcac

SEQ ID NO: 102410 - DNA, 25 bp, Mus musculus
acagggagtcttgtttgagcctcac

SEQ ID NO: 102411 - DNA, 25 bp, Mus musculus
acagggagtgccaggtgcattctgc

SEQ ID NO: 102412 - DNA, 25 bp, Mus musculus
acagggagtgcctggtgcattctgc

SEQ ID NO: 102413 - DNA, 25 bp, Mus musculus
acagggagtgtacgtagctctctct

SEQ ID NO: 102414 - DNA, 25 bp, Mus musculus
acagggagtgtaggtagctctctct

SEQ ID NO: 102415 - DNA, 25 bp, Mus musculus
acagggagttgaagagcccctccta

SEQ ID NO: 102416 - DNA, 25 bp, Mus musculus
acagggagttgatgagcccctccta

SEQ ID NO: 102417 - DNA, 25 bp, Mus musculus
acagggagttgcagcttcagtgtgt

SEQ ID NO: 102418 - DNA, 25 bp, Mus musculus
acagggagttgctgcttcagtgtgt

SEQ ID NO: 102419 - DNA, 25 bp, Mus musculus
acagggatacctagggctaagcaac

SEQ ID NO: 102420 - DNA, 25 bp, Mus musculus
acagggataccttgggctaagcaac

SEQ ID NO: 102421 - DNA, 25 bp, Mus musculus
acagggatactacttgctgcatcat

SEQ ID NO: 102422 - DNA, 25 bp, Mus musculus
acagggatactagttgctgcatcat

SEQ ID NO: 102423 - DNA, 25 bp, Mus musculus
acagggatactgatgtccaggccca

SEQ ID NO: 102424 - DNA, 25 bp, Mus musculus
acagggatactgttgtccaggccca

SEQ ID NO: 102425 - DNA, 25 bp, Mus musculus
acagggatagtgactgcagcagcga

SEQ ID NO: 102426 - DNA, 25 bp, Mus musculus
acagggatagtgaggtttacctcaa

SEQ ID NO: 102427 - DNA, 25 bp, Mus musculus
acagggatagtgtctgcagcagcga

SEQ ID NO: 102428 - DNA, 25 bp, Mus musculus
acagggatagtgtggtttacctcaa

SEQ ID NO: 102429 - DNA, 25 bp, Mus musculus
acagggatatagacatggccttctc

SEQ ID NO: 102430 - DNA, 25 bp, Mus musculus
acagggatatagtcatggccttctc

SEQ ID NO: 102431 - DNA, 25 bp, Mus musculus
acagggatatgacgccgatcctccc

SEQ ID NO: 102432 - DNA, 25 bp, Mus musculus
acagggatatgaggccgatcctccc

SEQ ID NO: 102433 - DNA, 25 bp, Mus musculus
acagggatcaagagccccgagacca

SEQ ID NO: 102434 - DNA, 25 bp, Mus musculus
acagggatcaagtgccccgagacca

SEQ ID NO: 102435 - DNA, 25 bp, Mus musculus
acagggatcaccctgtgcatcacaa

SEQ ID NO: 102436 - DNA, 25 bp, Mus musculus
acagggatcaccgtgtgcatcacaa

SEQ ID NO: 102437 - DNA, 25 bp, Mus musculus
acagggatcccacagagaccaggct

SEQ ID NO: 102438 - DNA, 25 bp, Mus musculus
acagggatcccagagagaccaggct

SEQ ID NO: 102439 - DNA, 25 bp, Mus musculus
acagggatctgccttcaccacagaa

SEQ ID NO: 102440 - DNA, 25 bp, Mus musculus
acagggatctgcgttcaccacagaa

SEQ ID NO: 102441 - DNA, 25 bp, Mus musculus
acagggatctgtccttgtttacccg

SEQ ID NO: 102442 - DNA, 25 bp, Mus musculus
acagggatctgtgcttgtttacccg

SEQ ID NO: 102443 - DNA, 25 bp, Mus musculus
acagggatgactcaacacagctcag

SEQ ID NO: 102444 - DNA, 25 bp, Mus musculus
acagggatgactgaacacagctcag

SEQ ID NO: 102445 - DNA, 25 bp, Mus musculus
acagggatgctcctacttggcacag

SEQ ID NO: 102446 - DNA, 25 bp, Mus musculus
acagggatgctcgtacttggcacag

SEQ ID NO: 102447 - DNA, 25 bp, Mus musculus
acagggattcatcagcaaagcggct

SEQ ID NO: 102448 - DNA, 25 bp, Mus musculus
acagggattcatgagcaaagcggct

SEQ ID NO: 102449 - DNA, 25 bp, Mus musculus
acagggattctcacgtcttccagat

SEQ ID NO: 102450 - DNA, 25 bp, Mus musculus
acagggattctctcgtcttccagat

SEQ ID NO: 102451 - DNA, 25 bp, Mus musculus
acagggattctgatcgtgtccaata

SEQ ID NO: 102452 - DNA, 25 bp, Mus musculus
acagggattctgttcgtgtccaata

SEQ ID NO: 102453 - DNA, 25 bp, Mus musculus
acagggattgcaattctgttccatt

SEQ ID NO: 102454 - DNA, 25 bp, Mus musculus
acagggattgcatttctgttccatt

SEQ ID NO: 102455 - DNA, 25 bp, Mus musculus
acagggcaaatgaaaacctttgaat

SEQ ID NO: 102456 - DNA, 25 bp, Mus musculus
acagggcaaatgtaaacctttgaat

SEQ ID NO: 102457 - DNA, 25 bp, Mus musculus
acagggcaacatctaggtaggcatg

SEQ ID NO: 102458 - DNA, 25 bp, Mus musculus
acagggcaacatgtaggtaggcatg

SEQ ID NO: 102459 - DNA, 25 bp, Mus musculus
acagggcaactgagctgcttgctga

SEQ ID NO: 102460 - DNA, 25 bp, Mus musculus
acagggcaactgtgctgcttgctga

SEQ ID NO: 102461 - DNA, 25 bp, Mus musculus
acagggcaatgcatttcgctccgtg

SEQ ID NO: 102462 - DNA, 25 bp, Mus musculus
acagggcaatgcttttcgctccgtg

SEQ ID NO: 102463 - DNA, 25 bp, Mus musculus
acagggcaccctactgcactgactt

SEQ ID NO: 102464 - DNA, 25 bp, Mus musculus
acagggcacccttctgcactgactt

SEQ ID NO: 102465 - DNA, 25 bp, Mus musculus
acagggcactctcagcatgcttttc

SEQ ID NO: 102466 - DNA, 25 bp, Mus musculus
acagggcactctgagcatgcttttc

SEQ ID NO: 102467 - DNA, 25 bp, Mus musculus
acagggcaggccacacaggagtagt

SEQ ID NO: 102468 - DNA, 25 bp, Mus musculus
acagggcaggccatgttctgaactg

SEQ ID NO: 102469 - DNA, 25 bp, Mus musculus
acagggcaggcctcacaggagtagt

SEQ ID NO: 102470 - DNA, 25 bp, Mus musculus
acagggcaggccttgttctgaactg

SEQ ID NO: 102471 - DNA, 25 bp, Mus musculus
acagggcaggcgacttacatgggat

SEQ ID NO: 102472 - DNA, 25 bp, Mus musculus
acagggcaggcgtcttacatgggat

SEQ ID NO: 102473 - DNA, 25 bp, Mus musculus
acagggcaggttacgctgaacacat

SEQ ID NO: 102474 - DNA, 25 bp, Mus musculus
acagggcaggtttcgctgaacacat

SEQ ID NO: 102475 - DNA, 25 bp, Mus musculus
acagggcagtgtactggcctacagg

SEQ ID NO: 102476 - DNA, 25 bp, Mus musculus
acagggcagtgttctggcctacagg

SEQ ID NO: 102477 - DNA, 25 bp, Mus musculus
acagggcatatgctcctttttggaa

SEQ ID NO: 102478 - DNA, 25 bp, Mus musculus
acagggcatatggtcctttttggaa

SEQ ID NO: 102479 - DNA, 25 bp, Mus musculus
acagggccagccaaagaacttgata

SEQ ID NO: 102480 - DNA, 25 bp, Mus musculus
acagggccagcctaagaacttgata

SEQ ID NO: 102481 - DNA, 25 bp, Mus musculus
acagggccagctaccagaggccaaa

SEQ ID NO: 102482 - DNA, 25 bp, Mus musculus
acagggccagcttccagaggccaaa

SEQ ID NO: 102483 - DNA, 25 bp, Mus musculus
acagggccagtgatgcttttgtttt

SEQ ID NO: 102484 - DNA, 25 bp, Mus musculus
acagggccagtgttgcttttgtttt

SEQ ID NO: 102485 - DNA, 25 bp, Mus musculus
acagggccattgatggcggcacacc

SEQ ID NO: 102486 - DNA, 25 bp, Mus musculus
acagggccattgttggcggcacacc

SEQ ID NO: 102487 - DNA, 25 bp, Mus musculus
acagggcccaggcaccacagtggct

SEQ ID NO: 102488 - DNA, 25 bp, Mus musculus
acagggcccagggaccacagtggct

SEQ ID NO: 102489 - DNA, 25 bp, Mus musculus
acagggcccatcattggtcagggta

SEQ ID NO: 102490 - DNA, 25 bp, Mus musculus
acagggcccatctttggtcagggta

SEQ ID NO: 102491 - DNA, 25 bp, Mus musculus
acagggccccaaacctcatggttgg

SEQ ID NO: 102492 - DNA, 25 bp, Mus musculus
acagggccccaatcctcatggttgg

SEQ ID NO: 102493 - DNA, 25 bp, Mus musculus
acagggccctgaagaccgtcacaaa

SEQ ID NO: 102494 - DNA, 25 bp, Mus musculus
acagggccctgatgaccgtcacaaa

SEQ ID NO: 102495 - DNA, 25 bp, Mus musculus
acagggccctgtatcatgacttctg

SEQ ID NO: 102496 - DNA, 25 bp, Mus musculus
acagggccctgtttcatgacttctg

SEQ ID NO: 102497 - DNA, 25 bp, Mus musculus
acagggccgcctccgattttgtata

SEQ ID NO: 102498 - DNA, 25 bp, Mus musculus
acagggccgcctgcgattttgtata

SEQ ID NO: 102499 - DNA, 25 bp, Mus musculus
acagggccgcggaaagctgcatcaa

SEQ ID NO: 102500 - DNA, 25 bp, Mus musculus
acagggccgcggtaagctgcatcaa

SEQ ID NO: 102501 - DNA, 25 bp, Mus musculus
acagggccgggcacgtggactacag

SEQ ID NO: 102502 - DNA, 25 bp, Mus musculus
acagggccgggctcgtggactacag

SEQ ID NO: 102503 - DNA, 25 bp, Mus musculus
acagggccggtgactggaaactgct

SEQ ID NO: 102504 - DNA, 25 bp, Mus musculus
acagggccggtgtctggaaactgct

SEQ ID NO: 102505 - DNA, 25 bp, Mus musculus
acagggcctgagctttaggtcccaa

SEQ ID NO: 102506 - DNA, 25 bp, Mus musculus
acagggcctgaggtttaggtcccaa

SEQ ID NO: 102507 - DNA, 25 bp, Mus musculus
acagggcctgccattgttagccaga

SEQ ID NO: 102508 - DNA, 25 bp, Mus musculus
acagggcctgcctttgttagccaga

SEQ ID NO: 102509 - DNA, 25 bp, Mus musculus
acagggcgactgaccgatagctcac

SEQ ID NO: 102510 - DNA, 25 bp, Mus musculus
acagggcgactgtccgatagctcac

SEQ ID NO: 102511 - DNA, 25 bp, Mus musculus
acagggcggtagcagatttcttact

SEQ ID NO: 102512 - DNA, 25 bp, Mus musculus
acagggcggtaggagatttcttact

SEQ ID NO: 102513 - DNA, 25 bp, Mus musculus
acagggcgtcccctagtcggcggcg

SEQ ID NO: 102514 - DNA, 25 bp, Mus musculus
acagggcgtcccgtagtcggcggcg

SEQ ID NO: 102515 - DNA, 25 bp, Mus musculus
acagggcgtgtacttcgccaagcgt

SEQ ID NO: 102516 - DNA, 25 bp, Mus musculus
acagggcgtgtagttcgccaagcgt

SEQ ID NO: 102517 - DNA, 25 bp, Mus musculus
acagggctaatgctgtagatgctca

SEQ ID NO: 102518 - DNA, 25 bp, Mus musculus
acagggctaatggtgtagatgctca

SEQ ID NO: 102519 - DNA, 25 bp, Mus musculus
acagggctacagcttccaaaccttt

SEQ ID NO: 102520 - DNA, 25 bp, Mus musculus
acagggctacaggttccaaaccttt

SEQ ID NO: 102521 - DNA, 25 bp, Mus musculus
acagggctacttaccattagctaaa

SEQ ID NO: 102522 - DNA, 25 bp, Mus musculus
acagggctactttccattagctaaa

SEQ ID NO: 102523 - DNA, 25 bp, Mus musculus
acagggctaggaattcagcttggga

SEQ ID NO: 102524 - DNA, 25 bp, Mus musculus
acagggctaggatttcagcttggga

SEQ ID NO: 102525 - DNA, 25 bp, Mus musculus
acagggctcagtagcataaaccgat

SEQ ID NO: 102526 - DNA, 25 bp, Mus musculus
acagggctcagttgcataaaccgat

SEQ ID NO: 102527 - DNA, 25 bp, Mus musculus
acagggctcatcagataccggacac

SEQ ID NO: 102528 - DNA, 25 bp, Mus musculus
acagggctcatctgataccggacac

SEQ ID NO: 102529 - DNA, 25 bp, Mus musculus
acagggctcatgacctccatgagtg

SEQ ID NO: 102530 - DNA, 25 bp, Mus musculus
acagggctcatgtcctccatgagtg

SEQ ID NO: 102531 - DNA, 25 bp, Mus musculus
acagggctcctaaagcactcagcat

SEQ ID NO: 102532 - DNA, 25 bp, Mus musculus
acagggctcctatagcactcagcat

SEQ ID NO: 102533 - DNA, 25 bp, Mus musculus
acagggctcgcactgtttggctttt

SEQ ID NO: 102534 - DNA, 25 bp, Mus musculus
acagggctcgcagtgtttggctttt

SEQ ID NO: 102535 - DNA, 25 bp, Mus musculus
acagggctctcaatattacctccct

SEQ ID NO: 102536 - DNA, 25 bp, Mus musculus
acagggctctcattattacctccct

SEQ ID NO: 102537 - DNA, 25 bp, Mus musculus
acagggctctgcaatctgtcaccaa

SEQ ID NO: 102538 - DNA, 25 bp, Mus musculus
acagggctctgcacatcttgcgaga

SEQ ID NO: 102539 - DNA, 25 bp, Mus musculus
acagggctctgctatctgtcaccaa

SEQ ID NO: 102540 - DNA, 25 bp, Mus musculus
acagggctctgctcatcttgcgaga

SEQ ID NO: 102541 - DNA, 25 bp, Mus musculus
acagggctctggactagccaggaat

SEQ ID NO: 102542 - DNA, 25 bp, Mus musculus
acagggctctggaggacttcaaatc

SEQ ID NO: 102543 - DNA, 25 bp, Mus musculus
acagggctctggtctagccaggaat

SEQ ID NO: 102544 - DNA, 25 bp, Mus musculus
acagggctctggtggacttcaaatc

SEQ ID NO: 102545 - DNA, 25 bp, Mus musculus
acagggctgagtagtgtcatctctt

SEQ ID NO: 102546 - DNA, 25 bp, Mus musculus
acagggctgagttgtgtcatctctt

SEQ ID NO: 102547 - DNA, 25 bp, Mus musculus
acagggctgcacaggatcccgagag

SEQ ID NO: 102548 - DNA, 25 bp, Mus musculus
acagggctgcactggatcccgagag

SEQ ID NO: 102549 - DNA, 25 bp, Mus musculus
acagggctgccaattgtcaaagacc

SEQ ID NO: 102550 - DNA, 25 bp, Mus musculus
acagggctgccatttgtcaaagacc

SEQ ID NO: 102551 - DNA, 25 bp, Mus musculus
acagggctgcgtcaaatctcaagga

SEQ ID NO: 102552 - DNA, 25 bp, Mus musculus
acagggctgcgtgaaatctcaagga

SEQ ID NO: 102553 - DNA, 25 bp, Mus musculus
acagggctgctgatgtgttcacagg

SEQ ID NO: 102554 - DNA, 25 bp, Mus musculus
acagggctgctgttgtgttcacagg

SEQ ID NO: 102555 - DNA, 25 bp, Mus musculus
acagggctggctctagcctcagtcc

SEQ ID NO: 102556 - DNA, 25 bp, Mus musculus
acagggctggctgtagcctcagtcc

SEQ ID NO: 102557 - DNA, 25 bp, Mus musculus
acagggctgtcaagccctactgggt

SEQ ID NO: 102558 - DNA, 25 bp, Mus musculus
acagggctgtcatgccctactgggt

SEQ ID NO: 102559 - DNA, 25 bp, Mus musculus
acagggcttaacaaggcttctcatc

SEQ ID NO: 102560 - DNA, 25 bp, Mus musculus
acagggcttaactaggcttctcatc

SEQ ID NO: 102561 - DNA, 25 bp, Mus musculus
acagggcttcatctaccccaggcta

SEQ ID NO: 102562 - DNA, 25 bp, Mus musculus
acagggcttcatgtaccccaggcta

SEQ ID NO: 102563 - DNA, 25 bp, Mus musculus
acagggcttcctactaacaggacag

SEQ ID NO: 102564 - DNA, 25 bp, Mus musculus
acagggcttccttctaacaggacag

SEQ ID NO: 102565 - DNA, 25 bp, Mus musculus
acagggcttctgaacaggctcttag

SEQ ID NO: 102566 - DNA, 25 bp, Mus musculus
acagggcttctgtacaggctcttag

SEQ ID NO: 102567 - DNA, 25 bp, Mus musculus
acagggcttcttagagtgctccact

SEQ ID NO: 102568 - DNA, 25 bp, Mus musculus
acagggcttctttgagtgctccact

SEQ ID NO: 102569 - DNA, 25 bp, Mus musculus
acagggcttgacagggccaaagttt

SEQ ID NO: 102570 - DNA, 25 bp, Mus musculus
acagggcttgactgggccaaagttt

SEQ ID NO: 102571 - DNA, 25 bp, Mus musculus
acaggggcggctaccaaagtggaat

SEQ ID NO: 102572 - DNA, 25 bp, Mus musculus
acaggggcggcttccaaagtggaat

SEQ ID NO: 102573 - DNA, 25 bp, Mus musculus
acagggtaaagcaggttagtttctg

SEQ ID NO: 102574 - DNA, 25 bp, Mus musculus
acagggtaaagctggttagtttctg

SEQ ID NO: 102575 - DNA, 25 bp, Mus musculus
acagggtaacacatcactagccttc

SEQ ID NO: 102576 - DNA, 25 bp, Mus musculus
acagggtaacacttcactagccttc

SEQ ID NO: 102577 - DNA, 25 bp, Mus musculus
acagggtaacggagatctggacctt

SEQ ID NO: 102578 - DNA, 25 bp, Mus musculus
acagggtaacggtgatctggacctt

SEQ ID NO: 102579 - DNA, 25 bp, Mus musculus
acagggtaaggcagcctcagtcatc

SEQ ID NO: 102580 - DNA, 25 bp, Mus musculus
acagggtaaggctgcctcagtcatc

SEQ ID NO: 102581 - DNA, 25 bp, Mus musculus
acagggtaccaaacaggaatcagca

SEQ ID NO: 102582 - DNA, 25 bp, Mus musculus
acagggtaccaatcaggaatcagca

SEQ ID NO: 102583 - DNA, 25 bp, Mus musculus
acagggtatatgaacaaactttcta

SEQ ID NO: 102584 - DNA, 25 bp, Mus musculus
acagggtatatgtacaaactttcta

SEQ ID NO: 102585 - DNA, 25 bp, Mus musculus
acagggtatgcgaggccagtagcta

SEQ ID NO: 102586 - DNA, 25 bp, Mus musculus
acagggtatgcgtggccagtagcta

SEQ ID NO: 102587 - DNA, 25 bp, Mus musculus
acagggtattgcattattggaccat

SEQ ID NO: 102588 - DNA, 25 bp, Mus musculus
acagggtattgctttattggaccat

SEQ ID NO: 102589 - DNA, 25 bp, Mus musculus
acagggtatttgatccatagcacaa

SEQ ID NO: 102590 - DNA, 25 bp, Mus musculus
acagggtatttgttccatagcacaa

SEQ ID NO: 102591 - DNA, 25 bp, Mus musculus
acagggtcaacacaaggccgagcag

SEQ ID NO: 102592 - DNA, 25 bp, Mus musculus
acagggtcaacagaaggccgagcag

SEQ ID NO: 102593 - DNA, 25 bp, Mus musculus
acagggtcaaccactggacacttgg

SEQ ID NO: 102594 - DNA, 25 bp, Mus musculus
acagggtcaacctctggacacttgg

SEQ ID NO: 102595 - DNA, 25 bp, Mus musculus
acagggtcacacaatatagctcagg

SEQ ID NO: 102596 - DNA, 25 bp, Mus musculus
acagggtcacacaatctagccttga

SEQ ID NO: 102597 - DNA, 25 bp, Mus musculus
acagggtcacacattgcagctctgg

SEQ ID NO: 102598 - DNA, 25 bp, Mus musculus
acagggtcacacctttcatcttgag

SEQ ID NO: 102599 - DNA, 25 bp, Mus musculus
acagggtcacacgtttcatcttgag

SEQ ID NO: 102600 - DNA, 25 bp, Mus musculus
acagggtcacactatatagctcagg

SEQ ID NO: 102601 - DNA, 25 bp, Mus musculus
acagggtcacactatctagccttga

SEQ ID NO: 102602 - DNA, 25 bp, Mus musculus
acagggtcacactttgcagctctgg

SEQ ID NO: 102603 - DNA, 25 bp, Mus musculus
acagggtcactcagcaatgctttgg

SEQ ID NO: 102604 - DNA, 25 bp, Mus musculus
acagggtcactctgcaatgctttgg

SEQ ID NO: 102605 - DNA, 25 bp, Mus musculus
acagggtcagccagtttggattaca

SEQ ID NO: 102606 - DNA, 25 bp, Mus musculus
acagggtcagcctgtttggattaca

SEQ ID NO: 102607 - DNA, 25 bp, Mus musculus
acagggtcccttagcgggcatgtct

SEQ ID NO: 102608 - DNA, 25 bp, Mus musculus
acagggtcccttatgccaactgagg

SEQ ID NO: 102609 - DNA, 25 bp, Mus musculus
acagggtccctttgcgggcatgtct

SEQ ID NO: 102610 - DNA, 25 bp, Mus musculus
acagggtcccttttgccaactgagg

SEQ ID NO: 102611 - DNA, 25 bp, Mus musculus
acagggtctcatatagtctagccaa

SEQ ID NO: 102612 - DNA, 25 bp, Mus musculus
acagggtctcatcgagttccgtgac

SEQ ID NO: 102613 - DNA, 25 bp, Mus musculus
acagggtctcatggagttccgtgac

SEQ ID NO: 102614 - DNA, 25 bp, Mus musculus
acagggtctcatttagtctagccaa

SEQ ID NO: 102615 - DNA, 25 bp, Mus musculus
acagggtctcccactgcaaaggaat

SEQ ID NO: 102616 - DNA, 25 bp, Mus musculus
acagggtctccctctgcaaaggaat

SEQ ID NO: 102617 - DNA, 25 bp, Mus musculus
acagggtctctgcagatggaattga

SEQ ID NO: 102618 - DNA, 25 bp, Mus musculus
acagggtctctggagatggaattga

SEQ ID NO: 102619 - DNA, 25 bp, Mus musculus
acagggtctgctcccaagttgcaaa

SEQ ID NO: 102620 - DNA, 25 bp, Mus musculus
acagggtctgctgccaagttgcaaa

SEQ ID NO: 102621 - DNA, 25 bp, Mus musculus
acagggtctggcctagtcaagattt

SEQ ID NO: 102622 - DNA, 25 bp, Mus musculus
acagggtctggcgtagtcaagattt

SEQ ID NO: 102623 - DNA, 25 bp, Mus musculus
acagggtcttacatatgtactttga

SEQ ID NO: 102624 - DNA, 25 bp, Mus musculus
acagggtcttacttatgtactttga

SEQ ID NO: 102625 - DNA, 25 bp, Mus musculus
acagggtcttcacttactcagcgag

SEQ ID NO: 102626 - DNA, 25 bp, Mus musculus
acagggtcttcagttactcagcgag

SEQ ID NO: 102627 - DNA, 25 bp, Mus musculus
acagggtcttctacaggagttgcca

SEQ ID NO: 102628 - DNA, 25 bp, Mus musculus
acagggtcttcttcaggagttgcca

SEQ ID NO: 102629 - DNA, 25 bp, Mus musculus
acagggtcttgtatcatacacggaa

SEQ ID NO: 102630 - DNA, 25 bp, Mus musculus
acagggtcttgtttcatacacggaa

SEQ ID NO: 102631 - DNA, 25 bp, Mus musculus
acagggtctttaccttgcaccttct

SEQ ID NO: 102632 - DNA, 25 bp, Mus musculus
acagggtctttagcttgcaccttct

SEQ ID NO: 102633 - DNA, 25 bp, Mus musculus
acagggtgagagatcctcccgcttt

SEQ ID NO: 102634 - DNA, 25 bp, Mus musculus
acagggtgagagttcctcccgcttt

SEQ ID NO: 102635 - DNA, 25 bp, Mus musculus
acagggtgagggacggagggcacac

SEQ ID NO: 102636 - DNA, 25 bp, Mus musculus
acagggtgagggtcggagggcacac

SEQ ID NO: 102637 - DNA, 25 bp, Mus musculus
acagggtgatctattctgcataatg

SEQ ID NO: 102638 - DNA, 25 bp, Mus musculus
acagggtgatcttttctgcataatg

SEQ ID NO: 102639 - DNA, 25 bp, Mus musculus
acagggtgatgcaatcccatttcca

SEQ ID NO: 102640 - DNA, 25 bp, Mus musculus
acagggtgatgctatcccatttcca

SEQ ID NO: 102641 - DNA, 25 bp, Mus musculus
acagggtgcaggaagagagctcaaa

SEQ ID NO: 102642 - DNA, 25 bp, Mus musculus
acagggtgcaggtagagagctcaaa

SEQ ID NO: 102643 - DNA, 25 bp, Mus musculus
acagggtgccagatagattggaaaa

SEQ ID NO: 102644 - DNA, 25 bp, Mus musculus
acagggtgccagttagattggaaaa

SEQ ID NO: 102645 - DNA, 25 bp, Mus musculus
acagggtgccatatgcattcaagtg

SEQ ID NO: 102646 - DNA, 25 bp, Mus musculus
acagggtgccatttgcattcaagtg

SEQ ID NO: 102647 - DNA, 25 bp, Mus musculus
acagggtgcctgatcttgacaaatt

SEQ ID NO: 102648 - DNA, 25 bp, Mus musculus
acagggtgcctgttcttgacaaatt

SEQ ID NO: 102649 - DNA, 25 bp, Mus musculus
acagggtgctcgagaaccttgaccg

SEQ ID NO: 102650 - DNA, 25 bp, Mus musculus
acagggtgctcgtgaaccttgaccg

SEQ ID NO: 102651 - DNA, 25 bp, Mus musculus
acagggtgctgtcatcctatgagcc

SEQ ID NO: 102652 - DNA, 25 bp, Mus musculus
acagggtgctgtgatcctatgagcc

SEQ ID NO: 102653 - DNA, 25 bp, Mus musculus
acagggtggcatccatggtcacata

SEQ ID NO: 102654 - DNA, 25 bp, Mus musculus
acagggtggcatgcatggtcacata

SEQ ID NO: 102655 - DNA, 25 bp, Mus musculus
acagggtggcgacgactacagttat

SEQ ID NO: 102656 - DNA, 25 bp, Mus musculus
acagggtggcgaggactacagttat

SEQ ID NO: 102657 - DNA, 25 bp, Mus musculus
acagggtggcgtaacctcatgcagt

SEQ ID NO: 102658 - DNA, 25 bp, Mus musculus
acagggtggcgttacctcatgcagt

SEQ ID NO: 102659 - DNA, 25 bp, Mus musculus
acagggtggcttaaagctgctcagg

SEQ ID NO: 102660 - DNA, 25 bp, Mus musculus
acagggtggctttaagctgctcagg

SEQ ID NO: 102661 - DNA, 25 bp, Mus musculus
acagggtggtccaggatcctccgta

SEQ ID NO: 102662 - DNA, 25 bp, Mus musculus
acagggtggtcctggatcctccgta

SEQ ID NO: 102663 - DNA, 25 bp, Mus musculus
acagggtggtgcagatctagataga

SEQ ID NO: 102664 - DNA, 25 bp, Mus musculus
acagggtggtgctgatctagataga

SEQ ID NO: 102665 - DNA, 25 bp, Mus musculus
acagggtgtcttaatgtcagctatc

SEQ ID NO: 102666 - DNA, 25 bp, Mus musculus
acagggtgtctttatgtcagctatc

SEQ ID NO: 102667 - DNA, 25 bp, Mus musculus
acagggtgtgatctgcctcctgaac

SEQ ID NO: 102668 - DNA, 25 bp, Mus musculus
acagggtgtgatgtgcctcctgaac

SEQ ID NO: 102669 - DNA, 25 bp, Mus musculus
acagggttatgcaattctgtaacac

SEQ ID NO: 102670 - DNA, 25 bp, Mus musculus
acagggttatgctattctgtaacac

SEQ ID NO: 102671 - DNA, 25 bp, Mus musculus
acagggttcaagataagccttaaca

SEQ ID NO: 102672 - DNA, 25 bp, Mus musculus
acagggttcaagttaagccttaaca

SEQ ID NO: 102673 - DNA, 25 bp, Mus musculus
acagggttcacaaggtccagaccga

SEQ ID NO: 102674 - DNA, 25 bp, Mus musculus
acagggttcacatggtccagaccga

SEQ ID NO: 102675 - DNA, 25 bp, Mus musculus
acagggttcctgctgttgcatgcag

SEQ ID NO: 102676 - DNA, 25 bp, Mus musculus
acagggttcctggtgttgcatgcag

SEQ ID NO: 102677 - DNA, 25 bp, Mus musculus
acagggttctcaagccaaggcagcc

SEQ ID NO: 102678 - DNA, 25 bp, Mus musculus
acagggttctcatgccaaggcagcc

SEQ ID NO: 102679 - DNA, 25 bp, Mus musculus
acagggttctctagagttacagcac

SEQ ID NO: 102680 - DNA, 25 bp, Mus musculus
acagggttctcttgagttacagcac

SEQ ID NO: 102681 - DNA, 25 bp, Mus musculus
acagggttgagacgagttagaactt

SEQ ID NO: 102682 - DNA, 25 bp, Mus musculus
acagggttgagaggagttagaactt

SEQ ID NO: 102683 - DNA, 25 bp, Mus musculus
acagggttgatcatgacattcctca

SEQ ID NO: 102684 - DNA, 25 bp, Mus musculus
acagggttgatcttgacattcctca

SEQ ID NO: 102685 - DNA, 25 bp, Mus musculus
acagggttgcgtcctccagccaaat

SEQ ID NO: 102686 - DNA, 25 bp, Mus musculus
acagggttgcgtgctccagccaaat

SEQ ID NO: 102687 - DNA, 25 bp, Mus musculus
acagggttgctgacagctctggatc

SEQ ID NO: 102688 - DNA, 25 bp, Mus musculus
acagggttgctgtcagctctggatc

SEQ ID NO: 102689 - DNA, 25 bp, Mus musculus
acagggttggttagcttatagtcat

SEQ ID NO: 102690 - DNA, 25 bp, Mus musculus
acagggttggtttgcttatagtcat

SEQ ID NO: 102691 - DNA, 25 bp, Mus musculus
acagggttgtagagccttcttagca

SEQ ID NO: 102692 - DNA, 25 bp, Mus musculus
acagggttgtagtgccttcttagca

SEQ ID NO: 102693 - DNA, 25 bp, Mus musculus
acagggtttctcaaattcagggatc

SEQ ID NO: 102694 - DNA, 25 bp, Mus musculus
acagggtttctctaattcagggatc

SEQ ID NO: 102695 - DNA, 25 bp, Mus musculus
acagggtttggcagctgtcactcat

SEQ ID NO: 102696 - DNA, 25 bp, Mus musculus
acagggtttggctgctgtcactcat

SEQ ID NO: 102697 - DNA, 25 bp, Mus musculus
acagggttttatccctcaagcactt

SEQ ID NO: 102698 - DNA, 25 bp, Mus musculus
acagggttttatgcctcaagcactt

SEQ ID NO: 102699 - DNA, 25 bp, Mus musculus
acagggtttttgagatgtagcccag

SEQ ID NO: 102700 - DNA, 25 bp, Mus musculus
acagggtttttgtgatgtagcccag

SEQ ID NO: 102701 - DNA, 25 bp, Mus musculus
acaggtaacaggatcctcatcatta

SEQ ID NO: 102702 - DNA, 25 bp, Mus musculus
acaggtaacaggttcctcatcatta

SEQ ID NO: 102703 - DNA, 25 bp, Mus musculus
acaggtaaccttcagctcagcttgg

SEQ ID NO: 102704 - DNA, 25 bp, Mus musculus
acaggtaaccttgagctcagcttgg

SEQ ID NO: 102705 - DNA, 25 bp, Mus musculus
acaggtaagtgtctgggtcttgcca

SEQ ID NO: 102706 - DNA, 25 bp, Mus musculus
acaggtaagtgtgtgggtcttgcca

SEQ ID NO: 102707 - DNA, 25 bp, Mus musculus
acaggtacaaggatgcagttggcaa

SEQ ID NO: 102708 - DNA, 25 bp, Mus musculus
acaggtacaaggttgcagttggcaa

SEQ ID NO: 102709 - DNA, 25 bp, Mus musculus
acaggtacaccccatgtttcatttt

SEQ ID NO: 102710 - DNA, 25 bp, Mus musculus
acaggtacacccgatgtttcatttt

SEQ ID NO: 102711 - DNA, 25 bp, Mus musculus
acaggtacacgtcctgctgctactt

SEQ ID NO: 102712 - DNA, 25 bp, Mus musculus
acaggtacacgtgctgctgctactt

SEQ ID NO: 102713 - DNA, 25 bp, Mus musculus
acaggtacactaccactccagaggg

SEQ ID NO: 102714 - DNA, 25 bp, Mus musculus
acaggtacactagcactccagaggg

SEQ ID NO: 102715 - DNA, 25 bp, Mus musculus
acaggtacacttctgattttgttga

SEQ ID NO: 102716 - DNA, 25 bp, Mus musculus
acaggtacacttgtgattttgttga

SEQ ID NO: 102717 - DNA, 25 bp, Mus musculus
acaggtacagctctcttctcggaac

SEQ ID NO: 102718 - DNA, 25 bp, Mus musculus
acaggtacagctgtcttctcggaac

SEQ ID NO: 102719 - DNA, 25 bp, Mus musculus
acaggtacatcaaggcaccccagtc

SEQ ID NO: 102720 - DNA, 25 bp, Mus musculus
acaggtacatcatggcaccccagtc

SEQ ID NO: 102721 - DNA, 25 bp, Mus musculus
acaggtacatgtcttgttctgacat

SEQ ID NO: 102722 - DNA, 25 bp, Mus musculus
acaggtacatgtgttgttctgacat

SEQ ID NO: 102723 - DNA, 25 bp, Mus musculus
acaggtaccaggcactcttgtggta

SEQ ID NO: 102724 - DNA, 25 bp, Mus musculus
acaggtaccagggactcttgtggta

SEQ ID NO: 102725 - DNA, 25 bp, Mus musculus
acaggtaccagtaacccgtgtgtgt

SEQ ID NO: 102726 - DNA, 25 bp, Mus musculus
acaggtaccagtattagagttgtag

SEQ ID NO: 102727 - DNA, 25 bp, Mus musculus
acaggtaccagttacccgtgtgtgt

SEQ ID NO: 102728 - DNA, 25 bp, Mus musculus
acaggtaccagttttagagttgtag

SEQ ID NO: 102729 - DNA, 25 bp, Mus musculus
acaggtacctaacagctgcggagta

SEQ ID NO: 102730 - DNA, 25 bp, Mus musculus
acaggtacctaagagctgcggagta

SEQ ID NO: 102731 - DNA, 25 bp, Mus musculus
acaggtacctcaaacacattggaga

SEQ ID NO: 102732 - DNA, 25 bp, Mus musculus
acaggtacctcatacacattggaga

SEQ ID NO: 102733 - DNA, 25 bp, Mus musculus
acaggtacgcacatcagtttgggat

SEQ ID NO: 102734 - DNA, 25 bp, Mus musculus
acaggtacgcacttcagtttgggat

SEQ ID NO: 102735 - DNA, 25 bp, Mus musculus
acaggtactgtgatggtctatgagt

SEQ ID NO: 102736 - DNA, 25 bp, Mus musculus
acaggtactgtgttggtctatgagt

SEQ ID NO: 102737 - DNA, 25 bp, Mus musculus
acaggtagaagtaccagcccaggca

SEQ ID NO: 102738 - DNA, 25 bp, Mus musculus
acaggtagaagttccagcccaggca

SEQ ID NO: 102739 - DNA, 25 bp, Mus musculus
acaggtagcctcaggatacagttga

SEQ ID NO: 102740 - DNA, 25 bp, Mus musculus
acaggtagcctctggatacagttga

SEQ ID NO: 102741 - DNA, 25 bp, Mus musculus
acaggtagcctgattcctcttggat

SEQ ID NO: 102742 - DNA, 25 bp, Mus musculus
acaggtagcctgtttcctcttggat

SEQ ID NO: 102743 - DNA, 25 bp, Mus musculus
acaggtagctgtagttctaactgaa

SEQ ID NO: 102744 - DNA, 25 bp, Mus musculus
acaggtagctgttgttctaactgaa

SEQ ID NO: 102745 - DNA, 25 bp, Mus musculus
acaggtagtatgagccatcctgccc

SEQ ID NO: 102746 - DNA, 25 bp, Mus musculus
acaggtagtatgtgccatcctgccc

SEQ ID NO: 102747 - DNA, 25 bp, Mus musculus
acaggtataggtcgtgtgcccagca

SEQ ID NO: 102748 - DNA, 25 bp, Mus musculus
acaggtataggtggtgtgcccagca

SEQ ID NO: 102749 - DNA, 25 bp, Mus musculus
acaggtatatgtaggtccctatgta

SEQ ID NO: 102750 - DNA, 25 bp, Mus musculus
acaggtatatgttggtccctatgta

SEQ ID NO: 102751 - DNA, 25 bp, Mus musculus
acaggtatattaactgcttccctcc

SEQ ID NO: 102752 - DNA, 25 bp, Mus musculus
acaggtatattatctgcttccctcc

SEQ ID NO: 102753 - DNA, 25 bp, Mus musculus
acaggtatctgtagtttcaattcca

SEQ ID NO: 102754 - DNA, 25 bp, Mus musculus
acaggtatctgttgtttcaattcca

SEQ ID NO: 102755 - DNA, 25 bp, Mus musculus
acaggtattactagcagtttgtggc

SEQ ID NO: 102756 - DNA, 25 bp, Mus musculus
acaggtattacttgcagtttgtggc

SEQ ID NO: 102757 - DNA, 25 bp, Mus musculus
acaggtattcgacagctctggttcc

SEQ ID NO: 102758 - DNA, 25 bp, Mus musculus
acaggtattcgagagctctggttcc

SEQ ID NO: 102759 - DNA, 25 bp, Mus musculus
acaggtatttgcaaccacactgagc

SEQ ID NO: 102760 - DNA, 25 bp, Mus musculus
acaggtatttgctaccacactgagc

SEQ ID NO: 102761 - DNA, 25 bp, Mus musculus
acaggtcaaccaaccatcaaacaga

SEQ ID NO: 102762 - DNA, 25 bp, Mus musculus
acaggtcaaccatccatcaaacaga

SEQ ID NO: 102763 - DNA, 25 bp, Mus musculus
acaggtcaacctccactagtgaaat

SEQ ID NO: 102764 - DNA, 25 bp, Mus musculus
acaggtcaacctgcactagtgaaat

SEQ ID NO: 102765 - DNA, 25 bp, Mus musculus
acaggtcacggcacaaggtgttcgc

SEQ ID NO: 102766 - DNA, 25 bp, Mus musculus
acaggtcacggctcaaggtgttcgc

SEQ ID NO: 102767 - DNA, 25 bp, Mus musculus
acaggtcacggtacatcaacacagt

SEQ ID NO: 102768 - DNA, 25 bp, Mus musculus
acaggtcacggttcatcaacacagt

SEQ ID NO: 102769 - DNA, 25 bp, Mus musculus
acaggtcactgaaaataggtttaga

SEQ ID NO: 102770 - DNA, 25 bp, Mus musculus
acaggtcactgataataggtttaga

SEQ ID NO: 102771 - DNA, 25 bp, Mus musculus
acaggtcagaagctgcaccaatgag

SEQ ID NO: 102772 - DNA, 25 bp, Mus musculus
acaggtcagaaggtgcaccaatgag

SEQ ID NO: 102773 - DNA, 25 bp, Mus musculus
acaggtcagcatagccagttagtat

SEQ ID NO: 102774 - DNA, 25 bp, Mus musculus
acaggtcagcattgccagttagtat

SEQ ID NO: 102775 - DNA, 25 bp, Mus musculus
acaggtcaggataatcttcatgtat

SEQ ID NO: 102776 - DNA, 25 bp, Mus musculus
acaggtcaggattatcttcatgtat

SEQ ID NO: 102777 - DNA, 25 bp, Mus musculus
acaggtcaggctaaggaaacgagga

SEQ ID NO: 102778 - DNA, 25 bp, Mus musculus
acaggtcaggcttaggaaacgagga

SEQ ID NO: 102779 - DNA, 25 bp, Mus musculus
acaggtcatagcacacggctcaaat

SEQ ID NO: 102780 - DNA, 25 bp, Mus musculus
acaggtcatagctcacggctcaaat

SEQ ID NO: 102781 - DNA, 25 bp, Mus musculus
acaggtcattccatgtctgattaac

SEQ ID NO: 102782 - DNA, 25 bp, Mus musculus
acaggtcattccttgtctgattaac

SEQ ID NO: 102783 - DNA, 25 bp, Mus musculus
acaggtccaaccaggaccagatcct

SEQ ID NO: 102784 - DNA, 25 bp, Mus musculus
acaggtccaacctggaccagatcct

SEQ ID NO: 102785 - DNA, 25 bp, Mus musculus
acaggtccaagtaagagtgatgtgt

SEQ ID NO: 102786 - DNA, 25 bp, Mus musculus
acaggtccaagttagagtgatgtgt

SEQ ID NO: 102787 - DNA, 25 bp, Mus musculus
acaggtcccacaattctctgcagtt

SEQ ID NO: 102788 - DNA, 25 bp, Mus musculus
acaggtcccacatttctctgcagtt

SEQ ID NO: 102789 - DNA, 25 bp, Mus musculus
acaggtcccagcagttctagggtat

SEQ ID NO: 102790 - DNA, 25 bp, Mus musculus
acaggtcccagctgttctagggtat

SEQ ID NO: 102791 - DNA, 25 bp, Mus musculus
acaggtcccataacattcggttgct

SEQ ID NO: 102792 - DNA, 25 bp, Mus musculus
acaggtcccatatcattcggttgct

SEQ ID NO: 102793 - DNA, 25 bp, Mus musculus
acaggtccccatccagagggtggct

SEQ ID NO: 102794 - DNA, 25 bp, Mus musculus
acaggtccccatgcagagggtggct

SEQ ID NO: 102795 - DNA, 25 bp, Mus musculus
acaggtcccgttcctttacaagcag

SEQ ID NO: 102796 - DNA, 25 bp, Mus musculus
acaggtcccgttgctttacaagcag

SEQ ID NO: 102797 - DNA, 25 bp, Mus musculus
acaggtccctcgagcagtgttggaa

SEQ ID NO: 102798 - DNA, 25 bp, Mus musculus
acaggtccctcgtgcagtgttggaa

SEQ ID NO: 102799 - DNA, 25 bp, Mus musculus
acaggtcctaggatataacgcagtt

SEQ ID NO: 102800 - DNA, 25 bp, Mus musculus
acaggtcctaggttataacgcagtt

SEQ ID NO: 102801 - DNA, 25 bp, Mus musculus
acaggtcctgaaaaaccttctgtga

SEQ ID NO: 102802 - DNA, 25 bp, Mus musculus
acaggtcctgaacgatgtccatcat

SEQ ID NO: 102803 - DNA, 25 bp, Mus musculus
acaggtcctgaaggatgtccatcat

SEQ ID NO: 102804 - DNA, 25 bp, Mus musculus
acaggtcctgaataaccttctgtga

SEQ ID NO: 102805 - DNA, 25 bp, Mus musculus
acaggtcctgcacttgattccaaga

SEQ ID NO: 102806 - DNA, 25 bp, Mus musculus
acaggtcctgcagttgattccaaga

SEQ ID NO: 102807 - DNA, 25 bp, Mus musculus
acaggtccttccctggacaaagtct

SEQ ID NO: 102808 - DNA, 25 bp, Mus musculus
acaggtccttccgtggacaaagtct

SEQ ID NO: 102809 - DNA, 25 bp, Mus musculus
acaggtcgagaaacaccggcataga

SEQ ID NO: 102810 - DNA, 25 bp, Mus musculus
acaggtcgagaatcaccggcataga

SEQ ID NO: 102811 - DNA, 25 bp, Mus musculus
acaggtcggctgctttcatgcatgt

SEQ ID NO: 102812 - DNA, 25 bp, Mus musculus
acaggtcggctggtttcatgcatgt

SEQ ID NO: 102813 - DNA, 25 bp, Mus musculus
acaggtcggggtccaggaatctccc

SEQ ID NO: 102814 - DNA, 25 bp, Mus musculus
acaggtcggggtgcaggaatctccc

SEQ ID NO: 102815 - DNA, 25 bp, Mus musculus
acaggtcggttactgagttctctga

SEQ ID NO: 102816 - DNA, 25 bp, Mus musculus
acaggtcggttagtgagttctctga

SEQ ID NO: 102817 - DNA, 25 bp, Mus musculus
acaggtcgttatacttctaagcagt

SEQ ID NO: 102818 - DNA, 25 bp, Mus musculus
acaggtcgttattcttctaagcagt

SEQ ID NO: 102819 - DNA, 25 bp, Mus musculus
acaggtcgttgtcagccacaccaag

SEQ ID NO: 102820 - DNA, 25 bp, Mus musculus
acaggtcgttgtgagccacaccaag

SEQ ID NO: 102821 - DNA, 25 bp, Mus musculus
acaggtctaatgaattccttcttct

SEQ ID NO: 102822 - DNA, 25 bp, Mus musculus
acaggtctaatgtattccttcttct

SEQ ID NO: 102823 - DNA, 25 bp, Mus musculus
acaggtctacagatttcttgacgaa

SEQ ID NO: 102824 - DNA, 25 bp, Mus musculus
acaggtctacagttttcttgacgaa

SEQ ID NO: 102825 - DNA, 25 bp, Mus musculus
acaggtctattgatgtgagcccttc

SEQ ID NO: 102826 - DNA, 25 bp, Mus musculus
acaggtctattgttgtgagcccttc

SEQ ID NO: 102827 - DNA, 25 bp, Mus musculus
acaggtctcaccaccgggttaatgt

SEQ ID NO: 102828 - DNA, 25 bp, Mus musculus
acaggtctcacctccgggttaatgt

SEQ ID NO: 102829 - DNA, 25 bp, Mus musculus
acaggtctccacatttgataacttt

SEQ ID NO: 102830 - DNA, 25 bp, Mus musculus
acaggtctccacttttgataacttt

SEQ ID NO: 102831 - DNA, 25 bp, Mus musculus
acaggtctctctcacattccaactt

SEQ ID NO: 102832 - DNA, 25 bp, Mus musculus
acaggtctctctgacattccaactt

SEQ ID NO: 102833 - DNA, 25 bp, Mus musculus
acaggtctgccactgccctaatgtg

SEQ ID NO: 102834 - DNA, 25 bp, Mus musculus
acaggtctgccagtgccctaatgtg

SEQ ID NO: 102835 - DNA, 25 bp, Mus musculus
acaggtctgctcagcctttggaata

SEQ ID NO: 102836 - DNA, 25 bp, Mus musculus
acaggtctgctctgcctttggaata

SEQ ID NO: 102837 - DNA, 25 bp, Mus musculus
acaggtctgtggatatcttacccat

SEQ ID NO: 102838 - DNA, 25 bp, Mus musculus
acaggtctgtggttatcttacccat

SEQ ID NO: 102839 - DNA, 25 bp, Mus musculus
acaggtcttacaaagctcaagctgg

SEQ ID NO: 102840 - DNA, 25 bp, Mus musculus
acaggtcttacatagctcaagctgg

SEQ ID NO: 102841 - DNA, 25 bp, Mus musculus
acaggtcttagcctgcgcgagtcgc

SEQ ID NO: 102842 - DNA, 25 bp, Mus musculus
acaggtcttagcgtgcgcgagtcgc

SEQ ID NO: 102843 - DNA, 25 bp, Mus musculus
acaggtcttcagactctcatcagtg

SEQ ID NO: 102844 - DNA, 25 bp, Mus musculus
acaggtcttcagtctctcatcagtg

SEQ ID NO: 102845 - DNA, 25 bp, Mus musculus
acaggtcttgaacggccctttcttg

SEQ ID NO: 102846 - DNA, 25 bp, Mus musculus
acaggtcttgaagggccctttcttg

SEQ ID NO: 102847 - DNA, 25 bp, Mus musculus
acaggtctttaaacaacacaacatt

SEQ ID NO: 102848 - DNA, 25 bp, Mus musculus
acaggtctttaatcaacacaacatt

SEQ ID NO: 102849 - DNA, 25 bp, Mus musculus
acaggtctttgcatatagctgcgtt

SEQ ID NO: 102850 - DNA, 25 bp, Mus musculus
acaggtctttgcttatagctgcgtt

SEQ ID NO: 102851 - DNA, 25 bp, Mus musculus
acaggtgaacccatagctctcagca

SEQ ID NO: 102852 - DNA, 25 bp, Mus musculus
acaggtgaacccttagctctcagca

SEQ ID NO: 102853 - DNA, 25 bp, Mus musculus
acaggtgacccgagccgaggtgaca

SEQ ID NO: 102854 - DNA, 25 bp, Mus musculus
acaggtgacccgtgccgaggtgaca

SEQ ID NO: 102855 - DNA, 25 bp, Mus musculus
acaggtgactcactaagctccaaca

SEQ ID NO: 102856 - DNA, 25 bp, Mus musculus
acaggtgactcagtaagctccaaca

SEQ ID NO: 102857 - DNA, 25 bp, Mus musculus
acaggtgagcaccatgataaagtga

SEQ ID NO: 102858 - DNA, 25 bp, Mus musculus
acaggtgagcacgatgataaagtga

SEQ ID NO: 102859 - DNA, 25 bp, Mus musculus
acaggtgatcctccaacaagaatag

SEQ ID NO: 102860 - DNA, 25 bp, Mus musculus
acaggtgatcctgcaacaagaatag

SEQ ID NO: 102861 - DNA, 25 bp, Mus musculus
acaggtgattggctgtggcacctca

SEQ ID NO: 102862 - DNA, 25 bp, Mus musculus
acaggtgattgggtgtggcacctca

SEQ ID NO: 102863 - DNA, 25 bp, Mus musculus
acaggtgcacctcccaaggtaaaag

SEQ ID NO: 102864 - DNA, 25 bp, Mus musculus
acaggtgcacctgccaaggtaaaag

SEQ ID NO: 102865 - DNA, 25 bp, Mus musculus
acaggtgcaggtcccttgcttgcca

SEQ ID NO: 102866 - DNA, 25 bp, Mus musculus
acaggtgcaggtgccttgcttgcca

SEQ ID NO: 102867 - DNA, 25 bp, Mus musculus
acaggtgcagtcctcagacagtggc

SEQ ID NO: 102868 - DNA, 25 bp, Mus musculus
acaggtgcagtcgtcagacagtggc

SEQ ID NO: 102869 - DNA, 25 bp, Mus musculus
acaggtgccaaaagaccatgtgatt

SEQ ID NO: 102870 - DNA, 25 bp, Mus musculus
acaggtgccaaatgaccatgtgatt

SEQ ID NO: 102871 - DNA, 25 bp, Mus musculus
acaggtgccagtacagtaactctga

SEQ ID NO: 102872 - DNA, 25 bp, Mus musculus
acaggtgccagttcagtaactctga

SEQ ID NO: 102873 - DNA, 25 bp, Mus musculus
acaggtgccataatttctatattgc

SEQ ID NO: 102874 - DNA, 25 bp, Mus musculus
acaggtgccatattttctatattgc

SEQ ID NO: 102875 - DNA, 25 bp, Mus musculus
acaggtgccctgagcgcagatatct

SEQ ID NO: 102876 - DNA, 25 bp, Mus musculus
acaggtgccctgtgcgcagatatct

SEQ ID NO: 102877 - DNA, 25 bp, Mus musculus
acaggtgcctgtacatgtaaatgac

SEQ ID NO: 102878 - DNA, 25 bp, Mus musculus
acaggtgcctgttcatgtaaatgac

SEQ ID NO: 102879 - DNA, 25 bp, Mus musculus
acaggtgctcagagccaccaaggca

SEQ ID NO: 102880 - DNA, 25 bp, Mus musculus
acaggtgctcagtgccaccaaggca

SEQ ID NO: 102881 - DNA, 25 bp, Mus musculus
acaggtgctgacaccacggcagctg

SEQ ID NO: 102882 - DNA, 25 bp, Mus musculus
acaggtgctgactccacggcagctg

SEQ ID NO: 102883 - DNA, 25 bp, Mus musculus
acaggtgctgggacaaggtcattct

SEQ ID NO: 102884 - DNA, 25 bp, Mus musculus
acaggtgctgggtcaaggtcattct

SEQ ID NO: 102885 - DNA, 25 bp, Mus musculus
acaggtgctgtgaagacatttggaa

SEQ ID NO: 102886 - DNA, 25 bp, Mus musculus
acaggtgctgtgtagacatttggaa

SEQ ID NO: 102887 - DNA, 25 bp, Mus musculus
acaggtgctgttactttggtggttg

SEQ ID NO: 102888 - DNA, 25 bp, Mus musculus
acaggtgctgtttctttggtggttg

SEQ ID NO: 102889 - DNA, 25 bp, Mus musculus
acaggtggaccaaagtcaggaagaa

SEQ ID NO: 102890 - DNA, 25 bp, Mus musculus
acaggtggaccatagtcaggaagaa

SEQ ID NO: 102891 - DNA, 25 bp, Mus musculus
acaggtggacccatgtcccaaggag

SEQ ID NO: 102892 - DNA, 25 bp, Mus musculus
acaggtggacccttgtcccaaggag

SEQ ID NO: 102893 - DNA, 25 bp, Mus musculus
acaggtggagctaggctatgatcct

SEQ ID NO: 102894 - DNA, 25 bp, Mus musculus
acaggtggagcttggctatgatcct

SEQ ID NO: 102895 - DNA, 25 bp, Mus musculus
acaggtggatgcagacgtggcacaa

SEQ ID NO: 102896 - DNA, 25 bp, Mus musculus
acaggtggatgctgacgtggcacaa

SEQ ID NO: 102897 - DNA, 25 bp, Mus musculus
acaggtggccctcaccgagtatgtg

SEQ ID NO: 102898 - DNA, 25 bp, Mus musculus
acaggtggccctcatgtgcctgtac

SEQ ID NO: 102899 - DNA, 25 bp, Mus musculus
acaggtggccctgaccgagtatgtg

SEQ ID NO: 102900 - DNA, 25 bp, Mus musculus
acaggtggccctgatgtgcctgtac

SEQ ID NO: 102901 - DNA, 25 bp, Mus musculus
acaggtggcctccattggtagccaa

SEQ ID NO: 102902 - DNA, 25 bp, Mus musculus
acaggtggcctcgattggtagccaa

SEQ ID NO: 102903 - DNA, 25 bp, Mus musculus
acaggtggcctgatcggattccgca

SEQ ID NO: 102904 - DNA, 25 bp, Mus musculus
acaggtggcctgttcggattccgca

SEQ ID NO: 102905 - DNA, 25 bp, Mus musculus
acaggtggctacaagtggtcgacag

SEQ ID NO: 102906 - DNA, 25 bp, Mus musculus
acaggtggctactagtggtcgacag

SEQ ID NO: 102907 - DNA, 25 bp, Mus musculus
acaggtggctatattcatggttttg

SEQ ID NO: 102908 - DNA, 25 bp, Mus musculus
acaggtggctattttcatggttttg

SEQ ID NO: 102909 - DNA, 25 bp, Mus musculus
acaggtgggatgagcattctttatc

SEQ ID NO: 102910 - DNA, 25 bp, Mus musculus
acaggtgggatgtgcattctttatc

SEQ ID NO: 102911 - DNA, 25 bp, Mus musculus
acaggtgggcatcacactgagtttt

SEQ ID NO: 102912 - DNA, 25 bp, Mus musculus
acaggtgggcatgacactgagtttt

SEQ ID NO: 102913 - DNA, 25 bp, Mus musculus
acaggtggggcaacaattcaggaat

SEQ ID NO: 102914 - DNA, 25 bp, Mus musculus
acaggtggggcatcaattcaggaat

SEQ ID NO: 102915 - DNA, 25 bp, Mus musculus
acaggtgggtccctggcacccactg

SEQ ID NO: 102916 - DNA, 25 bp, Mus musculus
acaggtgggtccgtggcacccactg

SEQ ID NO: 102917 - DNA, 25 bp, Mus musculus
acaggtggtatgcacctggcctgca

SEQ ID NO: 102918 - DNA, 25 bp, Mus musculus
acaggtggtatggacctggcctgca

SEQ ID NO: 102919 - DNA, 25 bp, Mus musculus
acaggtggtcgtctcagccctgaaa

SEQ ID NO: 102920 - DNA, 25 bp, Mus musculus
acaggtggtcgtgtcagccctgaaa

SEQ ID NO: 102921 - DNA, 25 bp, Mus musculus
acaggtggtgtgcaatactctcaga

SEQ ID NO: 102922 - DNA, 25 bp, Mus musculus
acaggtggtgtggaatactctcaga

SEQ ID NO: 102923 - DNA, 25 bp, Mus musculus
acaggtggttataggtggcagaaat

SEQ ID NO: 102924 - DNA, 25 bp, Mus musculus
acaggtggttattggtggcagaaat

SEQ ID NO: 102925 - DNA, 25 bp, Mus musculus
acaggtgtaccccacaacgtaccat

SEQ ID NO: 102926 - DNA, 25 bp, Mus musculus
acaggtgtacccgacaacgtaccat

SEQ ID NO: 102927 - DNA, 25 bp, Mus musculus
acaggtgtatcacaacaggctctaa

SEQ ID NO: 102928 - DNA, 25 bp, Mus musculus
acaggtgtatcagaacaggctctaa

SEQ ID NO: 102929 - DNA, 25 bp, Mus musculus
acaggtgtcaccaggtgacccggga

SEQ ID NO: 102930 - DNA, 25 bp, Mus musculus
acaggtgtcacctggtgacccggga

SEQ ID NO: 102931 - DNA, 25 bp, Mus musculus
acaggtgtcatcagagagtgatcct

SEQ ID NO: 102932 - DNA, 25 bp, Mus musculus
acaggtgtcatctgagagtgatcct

SEQ ID NO: 102933 - DNA, 25 bp, Mus musculus
acaggtgtctgaatcgaggaacatc

SEQ ID NO: 102934 - DNA, 25 bp, Mus musculus
acaggtgtctgattcgaggaacatc

SEQ ID NO: 102935 - DNA, 25 bp, Mus musculus
acaggtgtctgtacattaccctgca

SEQ ID NO: 102936 - DNA, 25 bp, Mus musculus
acaggtgtctgtcgtcatcaatttt

SEQ ID NO: 102937 - DNA, 25 bp, Mus musculus
acaggtgtctgtggtcatcaatttt

SEQ ID NO: 102938 - DNA, 25 bp, Mus musculus
acaggtgtctgttcattaccctgca

SEQ ID NO: 102939 - DNA, 25 bp, Mus musculus
acaggtgtcttgctttgcatattca

SEQ ID NO: 102940 - DNA, 25 bp, Mus musculus
acaggtgtcttggtttgcatattca

SEQ ID NO: 102941 - DNA, 25 bp, Mus musculus
acaggtgtgaaccacactgagcctc

SEQ ID NO: 102942 - DNA, 25 bp, Mus musculus
acaggtgtgaacgacactgagcctc

SEQ ID NO: 102943 - DNA, 25 bp, Mus musculus
acaggtgtgcccagcgcagcatgtg

SEQ ID NO: 102944 - DNA, 25 bp, Mus musculus
acaggtgtgccctgcgcagcatgtg

SEQ ID NO: 102945 - DNA, 25 bp, Mus musculus
acaggtgtgcctctcactgtgtaaa

SEQ ID NO: 102946 - DNA, 25 bp, Mus musculus
acaggtgtgcctgtcactgtgtaaa

SEQ ID NO: 102947 - DNA, 25 bp, Mus musculus
acaggtgtgcgactgggacatccca

SEQ ID NO: 102948 - DNA, 25 bp, Mus musculus
acaggtgtgcgagtgggacatccca

SEQ ID NO: 102949 - DNA, 25 bp, Mus musculus
acaggtgtgtttcgtgcgtacttca

SEQ ID NO: 102950 - DNA, 25 bp, Mus musculus
acaggtgtgtttggtgcgtacttca

SEQ ID NO: 102951 - DNA, 25 bp, Mus musculus
acaggtgttcacaaaagacccatct

SEQ ID NO: 102952 - DNA, 25 bp, Mus musculus
acaggtgttcactaaagacccatct

SEQ ID NO: 102953 - DNA, 25 bp, Mus musculus
acaggtgttcctagtcacattccag

SEQ ID NO: 102954 - DNA, 25 bp, Mus musculus
acaggtgttccttgtcacattccag

SEQ ID NO: 102955 - DNA, 25 bp, Mus musculus
acaggtgttctgagagcttgcttgt

SEQ ID NO: 102956 - DNA, 25 bp, Mus musculus
acaggtgttctgtgagcttgcttgt

SEQ ID NO: 102957 - DNA, 25 bp, Mus musculus
acaggtgtttcgctttccttgtgac

SEQ ID NO: 102958 - DNA, 25 bp, Mus musculus
acaggtgtttcggtttccttgtgac

SEQ ID NO: 102959 - DNA, 25 bp, Mus musculus
acaggttaacaaatgccctctgcag

SEQ ID NO: 102960 - DNA, 25 bp, Mus musculus
acaggttaacaattgccctctgcag

SEQ ID NO: 102961 - DNA, 25 bp, Mus musculus
acaggttacaccagcaagattacag

SEQ ID NO: 102962 - DNA, 25 bp, Mus musculus
acaggttacacctgcaagattacag

SEQ ID NO: 102963 - DNA, 25 bp, Mus musculus
acaggttagattctggaaagtcagt

SEQ ID NO: 102964 - DNA, 25 bp, Mus musculus
acaggttagattgtggaaagtcagt

SEQ ID NO: 102965 - DNA, 25 bp, Mus musculus
acaggttaggtcaaacagtgcccca

SEQ ID NO: 102966 - DNA, 25 bp, Mus musculus
acaggttaggtctaacagtgcccca

SEQ ID NO: 102967 - DNA, 25 bp, Mus musculus
acaggttagtcaacaccaggcataa

SEQ ID NO: 102968 - DNA, 25 bp, Mus musculus
acaggttagtcatcaccaggcataa

SEQ ID NO: 102969 - DNA, 25 bp, Mus musculus
acaggttatcagattgtctgcagac

SEQ ID NO: 102970 - DNA, 25 bp, Mus musculus
acaggttatcagtttgtctgcagac

SEQ ID NO: 102971 - DNA, 25 bp, Mus musculus
acaggttatgatcagctgctccacg

SEQ ID NO: 102972 - DNA, 25 bp, Mus musculus
acaggttatgatgagctgctccacg

SEQ ID NO: 102973 - DNA, 25 bp, Mus musculus
acaggttatgttccctatttcttaa

SEQ ID NO: 102974 - DNA, 25 bp, Mus musculus
acaggttatgttgcctatttcttaa

SEQ ID NO: 102975 - DNA, 25 bp, Mus musculus
acaggttcaatgaggtttttcagtt

SEQ ID NO: 102976 - DNA, 25 bp, Mus musculus
acaggttcaatgtggtttttcagtt

SEQ ID NO: 102977 - DNA, 25 bp, Mus musculus
acaggttcacctcgtcatctgctct

SEQ ID NO: 102978 - DNA, 25 bp, Mus musculus
acaggttcacctggtcatctgctct

SEQ ID NO: 102979 - DNA, 25 bp, Mus musculus
acaggttcagaaaatggcaatcttc

SEQ ID NO: 102980 - DNA, 25 bp, Mus musculus
acaggttcagaatatggcaatcttc

SEQ ID NO: 102981 - DNA, 25 bp, Mus musculus
acaggttcattcatacagttcccaa

SEQ ID NO: 102982 - DNA, 25 bp, Mus musculus
acaggttcattcctagagctggcca

SEQ ID NO: 102983 - DNA, 25 bp, Mus musculus
acaggttcattcgtagagctggcca

SEQ ID NO: 102984 - DNA, 25 bp, Mus musculus
acaggttcattcttacagttcccaa

SEQ ID NO: 102985 - DNA, 25 bp, Mus musculus
acaggttccttcaggccttgaactt

SEQ ID NO: 102986 - DNA, 25 bp, Mus musculus
acaggttccttctggccttgaactt

SEQ ID NO: 102987 - DNA, 25 bp, Mus musculus
acaggttctactcagttcccttaca

SEQ ID NO: 102988 - DNA, 25 bp, Mus musculus
acaggttctactgagttcccttaca

SEQ ID NO: 102989 - DNA, 25 bp, Mus musculus
acaggttctaggagcttctggcagc

SEQ ID NO: 102990 - DNA, 25 bp, Mus musculus
acaggttctaggatctaagtcataa

SEQ ID NO: 102991 - DNA, 25 bp, Mus musculus
acaggttctaggtgcttctggcagc

SEQ ID NO: 102992 - DNA, 25 bp, Mus musculus
acaggttctaggttctaagtcataa

SEQ ID NO: 102993 - DNA, 25 bp, Mus musculus
acaggttctagtaccctctggaatt

SEQ ID NO: 102994 - DNA, 25 bp, Mus musculus
acaggttctagttccctctggaatt

SEQ ID NO: 102995 - DNA, 25 bp, Mus musculus
acaggttctcacaggcctgaatctt

SEQ ID NO: 102996 - DNA, 25 bp, Mus musculus
acaggttctcactggcctgaatctt

SEQ ID NO: 102997 - DNA, 25 bp, Mus musculus
acaggttctcttaactgaggattaa

SEQ ID NO: 102998 - DNA, 25 bp, Mus musculus
acaggttctctttactgaggattaa

SEQ ID NO: 102999 - DNA, 25 bp, Mus musculus
acaggttctgagctatgggatgact

SEQ ID NO: 103000 - DNA, 25 bp, Mus musculus
acaggttctgaggtatgggatgact

SEQ ID NO: 103001 - DNA, 25 bp, Mus musculus
acaggttctgccaggtctggcagag

SEQ ID NO: 103002 - DNA, 25 bp, Mus musculus
acaggttctgcctggtctggcagag

SEQ ID NO: 103003 - DNA, 25 bp, Mus musculus
acaggttctgtaaaccaacgccttt

SEQ ID NO: 103004 - DNA, 25 bp, Mus musculus
acaggttctgtataccaacgccttt

SEQ ID NO: 103005 - DNA, 25 bp, Mus musculus
acaggttcttctaggcaagcaatag

SEQ ID NO: 103006 - DNA, 25 bp, Mus musculus
acaggttcttctcagtgcggctgaa

SEQ ID NO: 103007 - DNA, 25 bp, Mus musculus
acaggttcttctgagtgcggctgaa

SEQ ID NO: 103008 - DNA, 25 bp, Mus musculus
acaggttcttcttggcaagcaatag

SEQ ID NO: 103009 - DNA, 25 bp, Mus musculus
acaggttgagccactgtaaggagct

SEQ ID NO: 103010 - DNA, 25 bp, Mus musculus
acaggttgagcctctgtaaggagct

SEQ ID NO: 103011 - DNA, 25 bp, Mus musculus
acaggttgagctacacagcgagtcc

SEQ ID NO: 103012 - DNA, 25 bp, Mus musculus
acaggttgagcttcacagcgagtcc

SEQ ID NO: 103013 - DNA, 25 bp, Mus musculus
acaggttgatgaccgtgctgctcca

SEQ ID NO: 103014 - DNA, 25 bp, Mus musculus
acaggttgatgagcgtgctgctcca

SEQ ID NO: 103015 - DNA, 25 bp, Mus musculus
acaggttgccccacgcgttgcggcg

SEQ ID NO: 103016 - DNA, 25 bp, Mus musculus
acaggttgcccctcgcgttgcggcg

SEQ ID NO: 103017 - DNA, 25 bp, Mus musculus
acaggttgctctccttgtatttcat

SEQ ID NO: 103018 - DNA, 25 bp, Mus musculus
acaggttgctctgcttgtatttcat

SEQ ID NO: 103019 - DNA, 25 bp, Mus musculus
acaggttgctggaataccccatgac

SEQ ID NO: 103020 - DNA, 25 bp, Mus musculus
acaggttgctggtataccccatgac

SEQ ID NO: 103021 - DNA, 25 bp, Mus musculus
acaggttggctcagatcccaggatg

SEQ ID NO: 103022 - DNA, 25 bp, Mus musculus
acaggttggctctgatcccaggatg

SEQ ID NO: 103023 - DNA, 25 bp, Mus musculus
acaggttggctgagggacctctgct

SEQ ID NO: 103024 - DNA, 25 bp, Mus musculus
acaggttggctgtgggacctctgct

SEQ ID NO: 103025 - DNA, 25 bp, Mus musculus
acaggttgtcctatgggttatccat

SEQ ID NO: 103026 - DNA, 25 bp, Mus musculus
acaggttgtcctttgggttatccat

SEQ ID NO: 103027 - DNA, 25 bp, Mus musculus
acaggttgtggtcccactggcaagt

SEQ ID NO: 103028 - DNA, 25 bp, Mus musculus
acaggttgtggtgccactggcaagt

SEQ ID NO: 103029 - DNA, 25 bp, Mus musculus
acaggttgtgtcacatactcttgca

SEQ ID NO: 103030 - DNA, 25 bp, Mus musculus
acaggttgtgtctcatactcttgca

SEQ ID NO: 103031 - DNA, 25 bp, Mus musculus
acaggtttaaatacgcttcagcagc

SEQ ID NO: 103032 - DNA, 25 bp, Mus musculus
acaggtttaaattcgcttcagcagc

SEQ ID NO: 103033 - DNA, 25 bp, Mus musculus
acaggtttaggactcaacggtctga

SEQ ID NO: 103034 - DNA, 25 bp, Mus musculus
acaggtttaggagtcaacggtctga

SEQ ID NO: 103035 - DNA, 25 bp, Mus musculus
acaggtttaggtctggcgtggaccg

SEQ ID NO: 103036 - DNA, 25 bp, Mus musculus
acaggtttaggtgtggcgtggaccg

SEQ ID NO: 103037 - DNA, 25 bp, Mus musculus
acaggtttatcccagatgatcagct

SEQ ID NO: 103038 - DNA, 25 bp, Mus musculus
acaggtttatccgagatgatcagct

SEQ ID NO: 103039 - DNA, 25 bp, Mus musculus
acaggtttatctaattctcatacag

SEQ ID NO: 103040 - DNA, 25 bp, Mus musculus
acaggtttatcttattctcatacag

SEQ ID NO: 103041 - DNA, 25 bp, Mus musculus
acaggtttatgtacaacgggctcag

SEQ ID NO: 103042 - DNA, 25 bp, Mus musculus
acaggtttatgttcaacgggctcag

SEQ ID NO: 103043 - DNA, 25 bp, Mus musculus
acaggtttcactctgagcttgccaa

SEQ ID NO: 103044 - DNA, 25 bp, Mus musculus
acaggtttcactgtgagcttgccaa

SEQ ID NO: 103045 - DNA, 25 bp, Mus musculus
acaggtttcagaacagtctatctcc

SEQ ID NO: 103046 - DNA, 25 bp, Mus musculus
acaggtttcagacctcccaaagatt

SEQ ID NO: 103047 - DNA, 25 bp, Mus musculus
acaggtttcagagctcccaaagatt

SEQ ID NO: 103048 - DNA, 25 bp, Mus musculus
acaggtttcagatcagtctatctcc

SEQ ID NO: 103049 - DNA, 25 bp, Mus musculus
acaggtttcaggcagttctggatga

SEQ ID NO: 103050 - DNA, 25 bp, Mus musculus
acaggtttcagggagttctggatga

SEQ ID NO: 103051 - DNA, 25 bp, Mus musculus
acaggtttcattacaagctttttct

SEQ ID NO: 103052 - DNA, 25 bp, Mus musculus
acaggtttcatttcaagctttttct

SEQ ID NO: 103053 - DNA, 25 bp, Mus musculus
acaggtttctggacaacttggtgaa

SEQ ID NO: 103054 - DNA, 25 bp, Mus musculus
acaggtttctggtcaacttggtgaa

SEQ ID NO: 103055 - DNA, 25 bp, Mus musculus
acaggtttgcccacattcgggtgat

SEQ ID NO: 103056 - DNA, 25 bp, Mus musculus
acaggtttgccctcattcgggtgat

SEQ ID NO: 103057 - DNA, 25 bp, Mus musculus
acaggtttggttactgcttgtgaac

SEQ ID NO: 103058 - DNA, 25 bp, Mus musculus
acaggtttggtttctgcttgtgaac

SEQ ID NO: 103059 - DNA, 25 bp, Mus musculus
acaggtttgtctattcttcacctat

SEQ ID NO: 103060 - DNA, 25 bp, Mus musculus
acaggtttgtcttttcttcacctat

SEQ ID NO: 103061 - DNA, 25 bp, Mus musculus
acaggttttaggctatcacttcaat

SEQ ID NO: 103062 - DNA, 25 bp, Mus musculus
acaggttttagggtatcacttcaat

SEQ ID NO: 103063 - DNA, 25 bp, Mus musculus
acaggttttatcagttgcatgctaa

SEQ ID NO: 103064 - DNA, 25 bp, Mus musculus
acaggttttatctgttgcatgctaa

SEQ ID NO: 103065 - DNA, 25 bp, Mus musculus
acaggttttctcaattatgcttcag

SEQ ID NO: 103066 - DNA, 25 bp, Mus musculus
acaggttttctctattatgcttcag

SEQ ID NO: 103067 - DNA, 25 bp, Mus musculus
acaggtttttgaaaattgccatact

SEQ ID NO: 103068 - DNA, 25 bp, Mus musculus
acaggtttttgataattgccatact

SEQ ID NO: 103069 - DNA, 25 bp, Mus musculus
acagtaaaagacacggacatgcccc

SEQ ID NO: 103070 - DNA, 25 bp, Mus musculus
acagtaaaagactcggacatgcccc

SEQ ID NO: 103071 - DNA, 25 bp, Mus musculus
acagtaaacgagcttgctatcggga

SEQ ID NO: 103072 - DNA, 25 bp, Mus musculus
acagtaaacgaggttgctatcggga

SEQ ID NO: 103073 - DNA, 25 bp, Mus musculus
acagtaaagcttaggcacatcagtg

SEQ ID NO: 103074 - DNA, 25 bp, Mus musculus
acagtaaagctttggcacatcagtg

SEQ ID NO: 103075 - DNA, 25 bp, Mus musculus
acagtaaagtagacccctgctcatg

SEQ ID NO: 103076 - DNA, 25 bp, Mus musculus
acagtaaagtagtcccctgctcatg

SEQ ID NO: 103077 - DNA, 25 bp, Mus musculus
acagtaaatataagagccccttgcc

SEQ ID NO: 103078 - DNA, 25 bp, Mus musculus
acagtaaatatatgagccccttgcc

SEQ ID NO: 103079 - DNA, 25 bp, Mus musculus
acagtaacaagtacctcgtccagct

SEQ ID NO: 103080 - DNA, 25 bp, Mus musculus
acagtaacaagttcctcgtccagct

SEQ ID NO: 103081 - DNA, 25 bp, Mus musculus
acagtaacattgactctttgggcaa

SEQ ID NO: 103082 - DNA, 25 bp, Mus musculus
acagtaacattgtctctttgggcaa

SEQ ID NO: 103083 - DNA, 25 bp, Mus musculus
acagtaaccagtctgtatagactcc

SEQ ID NO: 103084 - DNA, 25 bp, Mus musculus
acagtaaccagtgtgtatagactcc

SEQ ID NO: 103085 - DNA, 25 bp, Mus musculus
acagtaaccgtcatcacttctgtgt

SEQ ID NO: 103086 - DNA, 25 bp, Mus musculus
acagtaaccgtcttcacttctgtgt

SEQ ID NO: 103087 - DNA, 25 bp, Mus musculus
acagtaactgacatccatccaggaa

SEQ ID NO: 103088 - DNA, 25 bp, Mus musculus
acagtaactgacttccatccaggaa

SEQ ID NO: 103089 - DNA, 25 bp, Mus musculus
acagtaactggaacgtgggcgccac

SEQ ID NO: 103090 - DNA, 25 bp, Mus musculus
acagtaactggatcgtgggcgccac

SEQ ID NO: 103091 - DNA, 25 bp, Mus musculus
acagtaactggtattctgaacttaa

SEQ ID NO: 103092 - DNA, 25 bp, Mus musculus
acagtaactggttttctgaacttaa

SEQ ID NO: 103093 - DNA, 25 bp, Mus musculus
acagtaactttgatctctcctgtcc

SEQ ID NO: 103094 - DNA, 25 bp, Mus musculus
acagtaactttgttctctcctgtcc

SEQ ID NO: 103095 - DNA, 25 bp, Mus musculus
acagtaagaaacctgctctctgccc

SEQ ID NO: 103096 - DNA, 25 bp, Mus musculus
acagtaagaaacgtgctctctgccc

SEQ ID NO: 103097 - DNA, 25 bp, Mus musculus
acagtaagaaccctgagcgtcctta

SEQ ID NO: 103098 - DNA, 25 bp, Mus musculus
acagtaagaaccgtgagcgtcctta

SEQ ID NO: 103099 - DNA, 25 bp, Mus musculus
acagtaagaccacggagagggctct

SEQ ID NO: 103100 - DNA, 25 bp, Mus musculus
acagtaagaccagggagagggctct

SEQ ID NO: 103101 - DNA, 25 bp, Mus musculus
acagtaagatctcccaatttgttct

SEQ ID NO: 103102 - DNA, 25 bp, Mus musculus
acagtaagatctgccaatttgttct

SEQ ID NO: 103103 - DNA, 25 bp, Mus musculus
acagtaagccacctgcaaaaggacc

SEQ ID NO: 103104 - DNA, 25 bp, Mus musculus
acagtaagccacgtgcaaaaggacc

SEQ ID NO: 103105 - DNA, 25 bp, Mus musculus
acagtaagggtcaagcttggctaca

SEQ ID NO: 103106 - DNA, 25 bp, Mus musculus
acagtaagggtctagcttggctaca

SEQ ID NO: 103107 - DNA, 25 bp, Mus musculus
acagtaagtgctctcggtcccaggt

SEQ ID NO: 103108 - DNA, 25 bp, Mus musculus
acagtaagtgctgtcggtcccaggt

SEQ ID NO: 103109 - DNA, 25 bp, Mus musculus
acagtaagttacattgtctccatgg

SEQ ID NO: 103110 - DNA, 25 bp, Mus musculus
acagtaagttactttgtctccatgg

SEQ ID NO: 103111 - DNA, 25 bp, Mus musculus
acagtaatcactacctttagtcctc

SEQ ID NO: 103112 - DNA, 25 bp, Mus musculus
acagtaatcacttcctttagtcctc

SEQ ID NO: 103113 - DNA, 25 bp, Mus musculus
acagtaatctgtccaataattgtct

SEQ ID NO: 103114 - DNA, 25 bp, Mus musculus
acagtaatctgtgcaataattgtct

SEQ ID NO: 103115 - DNA, 25 bp, Mus musculus
acagtaatgccaattgggctttcta

SEQ ID NO: 103116 - DNA, 25 bp, Mus musculus
acagtaatgccatttgggctttcta

SEQ ID NO: 103117 - DNA, 25 bp, Mus musculus
acagtaattaccctattgcaatgaa

SEQ ID NO: 103118 - DNA, 25 bp, Mus musculus
acagtaattaccgtattgcaatgaa

SEQ ID NO: 103119 - DNA, 25 bp, Mus musculus
acagtacaaaaaacacaatgtggtt

SEQ ID NO: 103120 - DNA, 25 bp, Mus musculus
acagtacaaaaatcacaatgtggtt

SEQ ID NO: 103121 - DNA, 25 bp, Mus musculus
acagtacacactcagaccacacata

SEQ ID NO: 103122 - DNA, 25 bp, Mus musculus
acagtacacactgagaccacacata

SEQ ID NO: 103123 - DNA, 25 bp, Mus musculus
acagtacacaggcatccctaaatat

SEQ ID NO: 103124 - DNA, 25 bp, Mus musculus
acagtacacagggatccctaaatat

SEQ ID NO: 103125 - DNA, 25 bp, Mus musculus
acagtacaccatcgctgcccgggtg

SEQ ID NO: 103126 - DNA, 25 bp, Mus musculus
acagtacaccatggctgcccgggtg

SEQ ID NO: 103127 - DNA, 25 bp, Mus musculus
acagtacacgctatggtttttgcct

SEQ ID NO: 103128 - DNA, 25 bp, Mus musculus
acagtacacgctttggtttttgcct

SEQ ID NO: 103129 - DNA, 25 bp, Mus musculus
acagtacagagtcctgcgggccttg

SEQ ID NO: 103130 - DNA, 25 bp, Mus musculus
acagtacagagtgctgcgggccttg

SEQ ID NO: 103131 - DNA, 25 bp, Mus musculus
acagtacagtttaatgttacaacag

SEQ ID NO: 103132 - DNA, 25 bp, Mus musculus
acagtacagttttatgttacaacag

SEQ ID NO: 103133 - DNA, 25 bp, Mus musculus
acagtacatcatctgggtgctgccc

SEQ ID NO: 103134 - DNA, 25 bp, Mus musculus
acagtacatcatgtgggtgctgccc

SEQ ID NO: 103135 - DNA, 25 bp, Mus musculus
acagtacatggacgcctgaccttgt

SEQ ID NO: 103136 - DNA, 25 bp, Mus musculus
acagtacatggaggcctgaccttgt

SEQ ID NO: 103137 - DNA, 25 bp, Mus musculus
acagtacatggcaaatcttccccaa

SEQ ID NO: 103138 - DNA, 25 bp, Mus musculus
acagtacatggctaatcttccccaa

SEQ ID NO: 103139 - DNA, 25 bp, Mus musculus
acagtacatgggacttgcattggcc

SEQ ID NO: 103140 - DNA, 25 bp, Mus musculus
acagtacatgggagctggcttctga

SEQ ID NO: 103141 - DNA, 25 bp, Mus musculus
acagtacatgggtcttgcattggcc

SEQ ID NO: 103142 - DNA, 25 bp, Mus musculus
acagtacatgggtgctggcttctga

SEQ ID NO: 103143 - DNA, 25 bp, Mus musculus
acagtacattacctttgtgaagcct

SEQ ID NO: 103144 - DNA, 25 bp, Mus musculus
acagtacattacgtttgtgaagcct

SEQ ID NO: 103145 - DNA, 25 bp, Mus musculus
acagtacattttcctataacctcac

SEQ ID NO: 103146 - DNA, 25 bp, Mus musculus
acagtacattttgctataacctcac

SEQ ID NO: 103147 - DNA, 25 bp, Mus musculus
acagtaccacatccagctggccaaa

SEQ ID NO: 103148 - DNA, 25 bp, Mus musculus
acagtaccacatgcagctggccaaa

SEQ ID NO: 103149 - DNA, 25 bp, Mus musculus
acagtaccaggcctgtaacgatgag

SEQ ID NO: 103150 - DNA, 25 bp, Mus musculus
acagtaccaggcgtgtaacgatgag

SEQ ID NO: 103151 - DNA, 25 bp, Mus musculus
acagtaccgtgtaagcccctgcctg

SEQ ID NO: 103152 - DNA, 25 bp, Mus musculus
acagtaccgtgttagcccctgcctg

SEQ ID NO: 103153 - DNA, 25 bp, Mus musculus
acagtacctcagaagtcctgccatt

SEQ ID NO: 103154 - DNA, 25 bp, Mus musculus
acagtacctcagcatcatggcgggt

SEQ ID NO: 103155 - DNA, 25 bp, Mus musculus
acagtacctcaggatcatggcgggt

SEQ ID NO: 103156 - DNA, 25 bp, Mus musculus
acagtacctcagtagtcctgccatt

SEQ ID NO: 103157 - DNA, 25 bp, Mus musculus
acagtacctgacaccctgagcttga

SEQ ID NO: 103158 - DNA, 25 bp, Mus musculus
acagtacctgactccctgagcttga

SEQ ID NO: 103159 - DNA, 25 bp, Mus musculus
acagtaccttgcacacctgggccat

SEQ ID NO: 103160 - DNA, 25 bp, Mus musculus
acagtaccttgctcacctgggccat

SEQ ID NO: 103161 - DNA, 25 bp, Mus musculus
acagtactctccacatgaaactacc

SEQ ID NO: 103162 - DNA, 25 bp, Mus musculus
acagtactctcctcatgaaactacc

SEQ ID NO: 103163 - DNA, 25 bp, Mus musculus
acagtactctttactatgtctcacc

SEQ ID NO: 103164 - DNA, 25 bp, Mus musculus
acagtactctttcccttagtgttga

SEQ ID NO: 103165 - DNA, 25 bp, Mus musculus
acagtactctttgccttagtgttga

SEQ ID NO: 103166 - DNA, 25 bp, Mus musculus
acagtactcttttctatgtctcacc

SEQ ID NO: 103167 - DNA, 25 bp, Mus musculus
acagtactgagtcaagagcttcccc

SEQ ID NO: 103168 - DNA, 25 bp, Mus musculus
acagtactgagtgaagagcttcccc

SEQ ID NO: 103169 - DNA, 25 bp, Mus musculus
acagtactgcgaccaatggctgcct

SEQ ID NO: 103170 - DNA, 25 bp, Mus musculus
acagtactgcgagcaatggctgcct

SEQ ID NO: 103171 - DNA, 25 bp, Mus musculus
acagtactggtcctcatctctacag

SEQ ID NO: 103172 - DNA, 25 bp, Mus musculus
acagtactggtcgtcatctctacag

SEQ ID NO: 103173 - DNA, 25 bp, Mus musculus
acagtactggtgattgtgggcctct

SEQ ID NO: 103174 - DNA, 25 bp, Mus musculus
acagtactggtgtttgtgggcctct

SEQ ID NO: 103175 - DNA, 25 bp, Mus musculus
acagtactgttaagtgcttggcttt

SEQ ID NO: 103176 - DNA, 25 bp, Mus musculus
acagtactgttatgtgcttggcttt

SEQ ID NO: 103177 - DNA, 25 bp, Mus musculus
acagtacttctgaagcaacttaaca

SEQ ID NO: 103178 - DNA, 25 bp, Mus musculus
acagtacttctgtagcaacttaaca

SEQ ID NO: 103179 - DNA, 25 bp, Mus musculus
acagtacttgatctgtcggcttcca

SEQ ID NO: 103180 - DNA, 25 bp, Mus musculus
acagtacttgatgtgtcggcttcca

SEQ ID NO: 103181 - DNA, 25 bp, Mus musculus
acagtactttgacttcgagtttgag

SEQ ID NO: 103182 - DNA, 25 bp, Mus musculus
acagtactttgagttcgagtttgag

SEQ ID NO: 103183 - DNA, 25 bp, Mus musculus
acagtagaaggcaggcttcacatta

SEQ ID NO: 103184 - DNA, 25 bp, Mus musculus
acagtagaaggctggcttcacatta

SEQ ID NO: 103185 - DNA, 25 bp, Mus musculus
acagtagaggaacccgttgccaccc

SEQ ID NO: 103186 - DNA, 25 bp, Mus musculus
acagtagaggaagccgttgccaccc

SEQ ID NO: 103187 - DNA, 25 bp, Mus musculus
acagtagagtacagcccttgaaact

SEQ ID NO: 103188 - DNA, 25 bp, Mus musculus
acagtagagtactgcccttgaaact

SEQ ID NO: 103189 - DNA, 25 bp, Mus musculus
acagtagattgtcttgatcattgca

SEQ ID NO: 103190 - DNA, 25 bp, Mus musculus
acagtagattgtgttgatcattgca

SEQ ID NO: 103191 - DNA, 25 bp, Mus musculus
acagtagcaagtatccatatggcct

SEQ ID NO: 103192 - DNA, 25 bp, Mus musculus
acagtagcaagtttccatatggcct

SEQ ID NO: 103193 - DNA, 25 bp, Mus musculus
acagtagcagccagccccggccagg

SEQ ID NO: 103194 - DNA, 25 bp, Mus musculus
acagtagcagcctgccccggccagg

SEQ ID NO: 103195 - DNA, 25 bp, Mus musculus
acagtagcagtcctgtctcctgttg

SEQ ID NO: 103196 - DNA, 25 bp, Mus musculus
acagtagcagtcgtgtctcctgttg

SEQ ID NO: 103197 - DNA, 25 bp, Mus musculus
acagtagcatccacggacaggactt

SEQ ID NO: 103198 - DNA, 25 bp, Mus musculus
acagtagcatcctcggacaggactt

SEQ ID NO: 103199 - DNA, 25 bp, Mus musculus
acagtagccattctgtataaaggat

SEQ ID NO: 103200 - DNA, 25 bp, Mus musculus
acagtagccattgtgtataaaggat

SEQ ID NO: 103201 - DNA, 25 bp, Mus musculus
acagtagccgcgaataccatgaaag

SEQ ID NO: 103202 - DNA, 25 bp, Mus musculus
acagtagccgcgtataccatgaaag

SEQ ID NO: 103203 - DNA, 25 bp, Mus musculus
acagtagcgaaaatgaccaggagac

SEQ ID NO: 103204 - DNA, 25 bp, Mus musculus
acagtagcgaaattgaccaggagac

SEQ ID NO: 103205 - DNA, 25 bp, Mus musculus
acagtagctgctaactccagcttct

SEQ ID NO: 103206 - DNA, 25 bp, Mus musculus
acagtagctgcttactccagcttct

SEQ ID NO: 103207 - DNA, 25 bp, Mus musculus
acagtagctgtcactgtgagtccgt

SEQ ID NO: 103208 - DNA, 25 bp, Mus musculus
acagtagctgtctctgtgagtccgt

SEQ ID NO: 103209 - DNA, 25 bp, Mus musculus
acagtagctgttatctttagtcttt

SEQ ID NO: 103210 - DNA, 25 bp, Mus musculus
acagtagctgttttctttagtcttt

SEQ ID NO: 103211 - DNA, 25 bp, Mus musculus
acagtaggaagtcatggtctccaaa

SEQ ID NO: 103212 - DNA, 25 bp, Mus musculus
acagtaggaagtgatggtctccaaa

SEQ ID NO: 103213 - DNA, 25 bp, Mus musculus
acagtaggattcaacagacctgtag

SEQ ID NO: 103214 - DNA, 25 bp, Mus musculus
acagtaggattctacagacctgtag

SEQ ID NO: 103215 - DNA, 25 bp, Mus musculus
acagtagggagcatccgctcacgtt

SEQ ID NO: 103216 - DNA, 25 bp, Mus musculus
acagtagggagcttccgctcacgtt

SEQ ID NO: 103217 - DNA, 25 bp, Mus musculus
acagtagggtcactagggcttcttc

SEQ ID NO: 103218 - DNA, 25 bp, Mus musculus
acagtagggtcagtagggcttcttc

SEQ ID NO: 103219 - DNA, 25 bp, Mus musculus
acagtagggtgtctgatctccatca

SEQ ID NO: 103220 - DNA, 25 bp, Mus musculus
acagtagggtgtgtgatctccatca

SEQ ID NO: 103221 - DNA, 25 bp, Mus musculus
acagtaggtaccaggatgttcacag

SEQ ID NO: 103222 - DNA, 25 bp, Mus musculus
acagtaggtacctggatgttcacag

SEQ ID NO: 103223 - DNA, 25 bp, Mus musculus
acagtaggtactcagcaagggttgc

SEQ ID NO: 103224 - DNA, 25 bp, Mus musculus
acagtaggtactgagcaagggttgc

SEQ ID NO: 103225 - DNA, 25 bp, Mus musculus
acagtaggtttgctccccagatcaa

SEQ ID NO: 103226 - DNA, 25 bp, Mus musculus
acagtaggtttggtccccagatcaa

SEQ ID NO: 103227 - DNA, 25 bp, Mus musculus
acagtagtccagagcagttttcctc

SEQ ID NO: 103228 - DNA, 25 bp, Mus musculus
acagtagtccagtgcagttttcctc

SEQ ID NO: 103229 - DNA, 25 bp, Mus musculus
acagtagtcttgacgattctcctcc

SEQ ID NO: 103230 - DNA, 25 bp, Mus musculus
acagtagtcttgtcgattctcctcc

SEQ ID NO: 103231 - DNA, 25 bp, Mus musculus
acagtagtgatcactggatctactc

SEQ ID NO: 103232 - DNA, 25 bp, Mus musculus
acagtagtgatctctggatctactc

SEQ ID NO: 103233 - DNA, 25 bp, Mus musculus
acagtagtgcttatattacctctaa

SEQ ID NO: 103234 - DNA, 25 bp, Mus musculus
acagtagtgcttttattacctctaa

SEQ ID NO: 103235 - DNA, 25 bp, Mus musculus
acagtagtgtggcttctctcaggac

SEQ ID NO: 103236 - DNA, 25 bp, Mus musculus
acagtagtgtgggttctctcaggac

SEQ ID NO: 103237 - DNA, 25 bp, Mus musculus
acagtagttctgataccttgctgga

SEQ ID NO: 103238 - DNA, 25 bp, Mus musculus
acagtagttctgttaccttgctgga

SEQ ID NO: 103239 - DNA, 25 bp, Mus musculus
acagtataatgaagccggtctcccc

SEQ ID NO: 103240 - DNA, 25 bp, Mus musculus
acagtataatgatgccggtctcccc

SEQ ID NO: 103241 - DNA, 25 bp, Mus musculus
acagtataccttacccagaggctag

SEQ ID NO: 103242 - DNA, 25 bp, Mus musculus
acagtatacctttcccagaggctag

SEQ ID NO: 103243 - DNA, 25 bp, Mus musculus
acagtatacttaatgactgcccact

SEQ ID NO: 103244 - DNA, 25 bp, Mus musculus
acagtatacttattgactgcccact

SEQ ID NO: 103245 - DNA, 25 bp, Mus musculus
acagtatatcctaggctgcgagctc

SEQ ID NO: 103246 - DNA, 25 bp, Mus musculus
acagtatatccttggctgcgagctc

SEQ ID NO: 103247 - DNA, 25 bp, Mus musculus
acagtatatggcaaatgggtggcaa

SEQ ID NO: 103248 - DNA, 25 bp, Mus musculus
acagtatatggcatttccagacctg

SEQ ID NO: 103249 - DNA, 25 bp, Mus musculus
acagtatatggctaatgggtggcaa

SEQ ID NO: 103250 - DNA, 25 bp, Mus musculus
acagtatatggcttttccagacctg

SEQ ID NO: 103251 - DNA, 25 bp, Mus musculus
acagtatattcgagccaggcgtggt

SEQ ID NO: 103252 - DNA, 25 bp, Mus musculus
acagtatattcgtgccaggcgtggt

SEQ ID NO: 103253 - DNA, 25 bp, Mus musculus
acagtatcatgactcgggtggaaag

SEQ ID NO: 103254 - DNA, 25 bp, Mus musculus
acagtatcatgagtcgggtggaaag

SEQ ID NO: 103255 - DNA, 25 bp, Mus musculus
acagtatcccaaacatctgggtgct

SEQ ID NO: 103256 - DNA, 25 bp, Mus musculus
acagtatcccaatcatctgggtgct

SEQ ID NO: 103257 - DNA, 25 bp, Mus musculus
acagtatccctgagtaaatgattct

SEQ ID NO: 103258 - DNA, 25 bp, Mus musculus
acagtatccctgtgtaaatgattct

SEQ ID NO: 103259 - DNA, 25 bp, Mus musculus
acagtatcctgcatgacctgagtct

SEQ ID NO: 103260 - DNA, 25 bp, Mus musculus
acagtatcctgcttgacctgagtct

SEQ ID NO: 103261 - DNA, 25 bp, Mus musculus
acagtatcctggctatcgctggcca

SEQ ID NO: 103262 - DNA, 25 bp, Mus musculus
acagtatcctgggtatcgctggcca

SEQ ID NO: 103263 - DNA, 25 bp, Mus musculus
acagtatcgggcaaatataaaagtt

SEQ ID NO: 103264 - DNA, 25 bp, Mus musculus
acagtatcgggctaatataaaagtt

SEQ ID NO: 103265 - DNA, 25 bp, Mus musculus
acagtatctcacactagtccaagct

SEQ ID NO: 103266 - DNA, 25 bp, Mus musculus
acagtatctcactctagtccaagct

SEQ ID NO: 103267 - DNA, 25 bp, Mus musculus
acagtatctgcacctttccatgctt

SEQ ID NO: 103268 - DNA, 25 bp, Mus musculus
acagtatctgcagctttccatgctt

SEQ ID NO: 103269 - DNA, 25 bp, Mus musculus
acagtatcttggaccggcacctttt

SEQ ID NO: 103270 - DNA, 25 bp, Mus musculus
acagtatcttggtccggcacctttt

SEQ ID NO: 103271 - DNA, 25 bp, Mus musculus
acagtatgagaccactgagggatac

SEQ ID NO: 103272 - DNA, 25 bp, Mus musculus
acagtatgagacgactgagggatac

SEQ ID NO: 103273 - DNA, 25 bp, Mus musculus
acagtatgatcgcaggcacccaaaa

SEQ ID NO: 103274 - DNA, 25 bp, Mus musculus
acagtatgatcggaggcacccaaaa

SEQ ID NO: 103275 - DNA, 25 bp, Mus musculus
acagtatgcaagaccttctggccta

SEQ ID NO: 103276 - DNA, 25 bp, Mus musculus
acagtatgcaagtccttctggccta

SEQ ID NO: 103277 - DNA, 25 bp, Mus musculus
acagtatgcgtcagcagtacattca

SEQ ID NO: 103278 - DNA, 25 bp, Mus musculus
acagtatgcgtctgcagtacattca

SEQ ID NO: 103279 - DNA, 25 bp, Mus musculus
acagtatggaccctgtcacaggcta

SEQ ID NO: 103280 - DNA, 25 bp, Mus musculus
acagtatggaccgtgtcacaggcta

SEQ ID NO: 103281 - DNA, 25 bp, Mus musculus
acagtatggtccatttgcttggtct

SEQ ID NO: 103282 - DNA, 25 bp, Mus musculus
acagtatggtccttttgcttggtct

SEQ ID NO: 103283 - DNA, 25 bp, Mus musculus
acagtatggtggactgttcagggaa

SEQ ID NO: 103284 - DNA, 25 bp, Mus musculus
acagtatggtggtctgttcagggaa

SEQ ID NO: 103285 - DNA, 25 bp, Mus musculus
acagtatgtggcacttgcctgtagc

SEQ ID NO: 103286 - DNA, 25 bp, Mus musculus
acagtatgtggctcttgcctgtagc

SEQ ID NO: 103287 - DNA, 25 bp, Mus musculus
acagtatgtggtacctccagggacc

SEQ ID NO: 103288 - DNA, 25 bp, Mus musculus
acagtatgtggttcctccagggacc

SEQ ID NO: 103289 - DNA, 25 bp, Mus musculus
acagtattaaatcccgttactatgg

SEQ ID NO: 103290 - DNA, 25 bp, Mus musculus
acagtattaaatgccgttactatgg

SEQ ID NO: 103291 - DNA, 25 bp, Mus musculus
acagtattagccctataataggctt

SEQ ID NO: 103292 - DNA, 25 bp, Mus musculus
acagtattagccgtataataggctt

SEQ ID NO: 103293 - DNA, 25 bp, Mus musculus
acagtattatgcatttcacagaaac

SEQ ID NO: 103294 - DNA, 25 bp, Mus musculus
acagtattatgcttttcacagaaac

SEQ ID NO: 103295 - DNA, 25 bp, Mus musculus
acagtattatgtcctctgtgatcat

SEQ ID NO: 103296 - DNA, 25 bp, Mus musculus
acagtattatgtgctctgtgatcat

SEQ ID NO: 103297 - DNA, 25 bp, Mus musculus
acagtattccctcaagatcaacagc

SEQ ID NO: 103298 - DNA, 25 bp, Mus musculus
acagtattccctgaagatcaacagc

SEQ ID NO: 103299 - DNA, 25 bp, Mus musculus
acagtattgatacatagggctacac

SEQ ID NO: 103300 - DNA, 25 bp, Mus musculus
acagtattgatactcaccccatggt

SEQ ID NO: 103301 - DNA, 25 bp, Mus musculus
acagtattgatagatagggctacac

SEQ ID NO: 103302 - DNA, 25 bp, Mus musculus
acagtattgatagtcaccccatggt

SEQ ID NO: 103303 - DNA, 25 bp, Mus musculus
acagtattgatgcagtgaaagtata

SEQ ID NO: 103304 - DNA, 25 bp, Mus musculus
acagtattgatggagtgaaagtata

SEQ ID NO: 103305 - DNA, 25 bp, Mus musculus
acagtattgcatctgtttgtaccga

SEQ ID NO: 103306 - DNA, 25 bp, Mus musculus
acagtattgcatgtgtttgtaccga

SEQ ID NO: 103307 - DNA, 25 bp, Mus musculus
acagtattgctaattatattcatgc

SEQ ID NO: 103308 - DNA, 25 bp, Mus musculus
acagtattgctatttatattcatgc

SEQ ID NO: 103309 - DNA, 25 bp, Mus musculus
acagtattggctactcaggtctgga

SEQ ID NO: 103310 - DNA, 25 bp, Mus musculus
acagtattggcttctcaggtctgga

SEQ ID NO: 103311 - DNA, 25 bp, Mus musculus
acagtatttaatagtgcagtcccac

SEQ ID NO: 103312 - DNA, 25 bp, Mus musculus
acagtatttaattgtgcagtcccac

SEQ ID NO: 103313 - DNA, 25 bp, Mus musculus
acagtatttcccatgatgacctacc

SEQ ID NO: 103314 - DNA, 25 bp, Mus musculus
acagtatttcccttgatgacctacc

SEQ ID NO: 103315 - DNA, 25 bp, Mus musculus
acagtatttcctatgcatggttgca

SEQ ID NO: 103316 - DNA, 25 bp, Mus musculus
acagtatttcctcttgcgtttgact

SEQ ID NO: 103317 - DNA, 25 bp, Mus musculus
acagtatttcctgttgcgtttgact

SEQ ID NO: 103318 - DNA, 25 bp, Mus musculus
acagtatttcctttgcatggttgca

SEQ ID NO: 103319 - DNA, 25 bp, Mus musculus
acagtatttgcccattgtacagagc

SEQ ID NO: 103320 - DNA, 25 bp, Mus musculus
acagtatttgccgattgtacagagc

SEQ ID NO: 103321 - DNA, 25 bp, Mus musculus
acagtatttgggacactcagggcag

SEQ ID NO: 103322 - DNA, 25 bp, Mus musculus
acagtatttgggtcactcagggcag

SEQ ID NO: 103323 - DNA, 25 bp, Mus musculus
acagtattttgtcagctgcgacagc

SEQ ID NO: 103324 - DNA, 25 bp, Mus musculus
acagtattttgtgagctgcgacagc

SEQ ID NO: 103325 - DNA, 25 bp, Mus musculus
acagtcaaatatacctggcccagac

SEQ ID NO: 103326 - DNA, 25 bp, Mus musculus
acagtcaaatattcctggcccagac

SEQ ID NO: 103327 - DNA, 25 bp, Mus musculus
acagtcaaatggctctgcgtccttc

SEQ ID NO: 103328 - DNA, 25 bp, Mus musculus
acagtcaaatgggtctgcgtccttc

SEQ ID NO: 103329 - DNA, 25 bp, Mus musculus
acagtcaacagaacttggagtggaa

SEQ ID NO: 103330 - DNA, 25 bp, Mus musculus
acagtcaacagatcttggagtggaa

SEQ ID NO: 103331 - DNA, 25 bp, Mus musculus
acagtcaagcacaagctccttcaag

SEQ ID NO: 103332 - DNA, 25 bp, Mus musculus
acagtcaagcactagctccttcaag

SEQ ID NO: 103333 - DNA, 25 bp, Mus musculus
acagtcaataacaggcagtcagcgt

SEQ ID NO: 103334 - DNA, 25 bp, Mus musculus
acagtcaataactggcagtcagcgt

SEQ ID NO: 103335 - DNA, 25 bp, Mus musculus
acagtcaatgctaggtctcttacct

SEQ ID NO: 103336 - DNA, 25 bp, Mus musculus
acagtcaatgcttggtctcttacct

SEQ ID NO: 103337 - DNA, 25 bp, Mus musculus
acagtcacacaaccacactttttag

SEQ ID NO: 103338 - DNA, 25 bp, Mus musculus
acagtcacacaagcacactttttag

SEQ ID NO: 103339 - DNA, 25 bp, Mus musculus
acagtcacactcatgtcctgaacat

SEQ ID NO: 103340 - DNA, 25 bp, Mus musculus
acagtcacactcttgtcctgaacat

SEQ ID NO: 103341 - DNA, 25 bp, Mus musculus
acagtcacagataggccttttgcgg

SEQ ID NO: 103342 - DNA, 25 bp, Mus musculus
acagtcacagattggccttttgcgg

SEQ ID NO: 103343 - DNA, 25 bp, Mus musculus
acagtcaccagcatatccaatttct

SEQ ID NO: 103344 - DNA, 25 bp, Mus musculus
acagtcaccagcttatccaatttct

SEQ ID NO: 103345 - DNA, 25 bp, Mus musculus
acagtcacctcacgagaacctcagg

SEQ ID NO: 103346 - DNA, 25 bp, Mus musculus
acagtcacctcaggagaacctcagg

SEQ ID NO: 103347 - DNA, 25 bp, Mus musculus
acagtcacgaggacctccatatatc

SEQ ID NO: 103348 - DNA, 25 bp, Mus musculus
acagtcacgaggtcctccatatatc

SEQ ID NO: 103349 - DNA, 25 bp, Mus musculus
acagtcactcctaaatatctgcaag

SEQ ID NO: 103350 - DNA, 25 bp, Mus musculus
acagtcactccttaatatctgcaag

SEQ ID NO: 103351 - DNA, 25 bp, Mus musculus
acagtcactctgaggtgtacacaag

SEQ ID NO: 103352 - DNA, 25 bp, Mus musculus
acagtcactctgtggtgtacacaag

SEQ ID NO: 103353 - DNA, 25 bp, Mus musculus
acagtcactggaactccaagtctgc

SEQ ID NO: 103354 - DNA, 25 bp, Mus musculus
acagtcactggatctccaagtctgc

SEQ ID NO: 103355 - DNA, 25 bp, Mus musculus
acagtcagatccctgcatcttttga

SEQ ID NO: 103356 - DNA, 25 bp, Mus musculus
acagtcagatccgtgcatcttttga

SEQ ID NO: 103357 - DNA, 25 bp, Mus musculus
acagtcagcagacatggtgacctgg

SEQ ID NO: 103358 - DNA, 25 bp, Mus musculus
acagtcagcagagatggtgacctgg

SEQ ID NO: 103359 - DNA, 25 bp, Mus musculus
acagtcagcatactcgatcttggcc

SEQ ID NO: 103360 - DNA, 25 bp, Mus musculus
acagtcagcatagtcgatcttggcc

SEQ ID NO: 103361 - DNA, 25 bp, Mus musculus
acagtcagcgacaccaggttttaaa

SEQ ID NO: 103362 - DNA, 25 bp, Mus musculus
acagtcagcgactccaggttttaaa

SEQ ID NO: 103363 - DNA, 25 bp, Mus musculus
acagtcaggactccacatggaaacc

SEQ ID NO: 103364 - DNA, 25 bp, Mus musculus
acagtcaggactgcacatggaaacc

SEQ ID NO: 103365 - DNA, 25 bp, Mus musculus
acagtcagggtgcactggccctgtt

SEQ ID NO: 103366 - DNA, 25 bp, Mus musculus
acagtcagggtggactggccctgtt

SEQ ID NO: 103367 - DNA, 25 bp, Mus musculus
acagtcagtcctacaggccttggac

SEQ ID NO: 103368 - DNA, 25 bp, Mus musculus
acagtcagtccttcaggccttggac

SEQ ID NO: 103369 - DNA, 25 bp, Mus musculus
acagtcagtctccttggttagttaa

SEQ ID NO: 103370 - DNA, 25 bp, Mus musculus
acagtcagtctcgttggttagttaa

SEQ ID NO: 103371 - DNA, 25 bp, Mus musculus
acagtcagtgaacaaggtaacacat

SEQ ID NO: 103372 - DNA, 25 bp, Mus musculus
acagtcagtgaagaaggtaacacat

SEQ ID NO: 103373 - DNA, 25 bp, Mus musculus
acagtcagtgacatcagacctccag

SEQ ID NO: 103374 - DNA, 25 bp, Mus musculus
acagtcagtgacttcagacctccag

SEQ ID NO: 103375 - DNA, 25 bp, Mus musculus
acagtcagtttgagtgaggtcacca

SEQ ID NO: 103376 - DNA, 25 bp, Mus musculus
acagtcagtttgtgtgaggtcacca

SEQ ID NO: 103377 - DNA, 25 bp, Mus musculus
acagtcatctaactctaacccttga

SEQ ID NO: 103378 - DNA, 25 bp, Mus musculus
acagtcatctaagtctaacccttga

SEQ ID NO: 103379 - DNA, 25 bp, Mus musculus
acagtcatctgcatgcggcctgagt

SEQ ID NO: 103380 - DNA, 25 bp, Mus musculus
acagtcatctgcttgcggcctgagt

SEQ ID NO: 103381 - DNA, 25 bp, Mus musculus
acagtcatctgtaacatcagcgtat

SEQ ID NO: 103382 - DNA, 25 bp, Mus musculus
acagtcatctgtaaccccaattcca

SEQ ID NO: 103383 - DNA, 25 bp, Mus musculus
acagtcatctgttacatcagcgtat

SEQ ID NO: 103384 - DNA, 25 bp, Mus musculus
acagtcatctgttaccccaattcca

SEQ ID NO: 103385 - DNA, 25 bp, Mus musculus
acagtcatgaccacttactctttaa

SEQ ID NO: 103386 - DNA, 25 bp, Mus musculus
acagtcatgacctcttactctttaa

SEQ ID NO: 103387 - DNA, 25 bp, Mus musculus
acagtcatggacatctgacacccac

SEQ ID NO: 103388 - DNA, 25 bp, Mus musculus
acagtcatggacttctgacacccac

SEQ ID NO: 103389 - DNA, 25 bp, Mus musculus
acagtcatggtgactccgtgggaat

SEQ ID NO: 103390 - DNA, 25 bp, Mus musculus
acagtcatggtgtctccgtgggaat

SEQ ID NO: 103391 - DNA, 25 bp, Mus musculus
acagtcatgtctataacttgatttg

SEQ ID NO: 103392 - DNA, 25 bp, Mus musculus
acagtcatgtctttaacttgatttg

SEQ ID NO: 103393 - DNA, 25 bp, Mus musculus
acagtcatgtgcctcacagtgagga

SEQ ID NO: 103394 - DNA, 25 bp, Mus musculus
acagtcatgtgcgtcacagtgagga

SEQ ID NO: 103395 - DNA, 25 bp, Mus musculus
acagtcattcatcgtggtaatttct

SEQ ID NO: 103396 - DNA, 25 bp, Mus musculus
acagtcattcatggtggtaatttct

SEQ ID NO: 103397 - DNA, 25 bp, Mus musculus
acagtcattcggcaagagggtcctt

SEQ ID NO: 103398 - DNA, 25 bp, Mus musculus
acagtcattcgggaagagggtcctt

SEQ ID NO: 103399 - DNA, 25 bp, Mus musculus
acagtcatttatatggcaggtccac

SEQ ID NO: 103400 - DNA, 25 bp, Mus musculus
acagtcatttatttggcaggtccac

SEQ ID NO: 103401 - DNA, 25 bp, Mus musculus
acagtcatttgcactgcaccagtct

SEQ ID NO: 103402 - DNA, 25 bp, Mus musculus
acagtcatttgctctgcaccagtct

SEQ ID NO: 103403 - DNA, 25 bp, Mus musculus
acagtcatttggcttcttgggctga

SEQ ID NO: 103404 - DNA, 25 bp, Mus musculus
acagtcatttgggttcttgggctga

SEQ ID NO: 103405 - DNA, 25 bp, Mus musculus
acagtcatttgtcatctgcccaaca

SEQ ID NO: 103406 - DNA, 25 bp, Mus musculus
acagtcatttgtccagggtcaacga

SEQ ID NO: 103407 - DNA, 25 bp, Mus musculus
acagtcatttgtgatctgcccaaca

SEQ ID NO: 103408 - DNA, 25 bp, Mus musculus
acagtcatttgtgcagggtcaacga

SEQ ID NO: 103409 - DNA, 25 bp, Mus musculus
acagtccaagaaagtagatattgat

SEQ ID NO: 103410 - DNA, 25 bp, Mus musculus
acagtccaagaatgtagatattgat

SEQ ID NO: 103411 - DNA, 25 bp, Mus musculus
acagtccaagacatgaaagtagaaa

SEQ ID NO: 103412 - DNA, 25 bp, Mus musculus
acagtccaagacttgaaagtagaaa

SEQ ID NO: 103413 - DNA, 25 bp, Mus musculus
acagtccaagggattccagtgtgca

SEQ ID NO: 103414 - DNA, 25 bp, Mus musculus
acagtccaagggtttccagtgtgca

SEQ ID NO: 103415 - DNA, 25 bp, Mus musculus
acagtccaattgcacaacaggtcct

SEQ ID NO: 103416 - DNA, 25 bp, Mus musculus
acagtccaattggacaacaggtcct

SEQ ID NO: 103417 - DNA, 25 bp, Mus musculus
acagtccacctccaagctagtcagg

SEQ ID NO: 103418 - DNA, 25 bp, Mus musculus
acagtccacctcgaagctagtcagg

SEQ ID NO: 103419 - DNA, 25 bp, Mus musculus
acagtccagactcctcaggatcttg

SEQ ID NO: 103420 - DNA, 25 bp, Mus musculus
acagtccagactgctcaggatcttg

SEQ ID NO: 103421 - DNA, 25 bp, Mus musculus
acagtccagcagatgttcagtccat

SEQ ID NO: 103422 - DNA, 25 bp, Mus musculus
acagtccagcagttgttcagtccat

SEQ ID NO: 103423 - DNA, 25 bp, Mus musculus
acagtccaggtcacagacacttgcc

SEQ ID NO: 103424 - DNA, 25 bp, Mus musculus
acagtccaggtctcagacacttgcc

SEQ ID NO: 103425 - DNA, 25 bp, Mus musculus
acagtccaggtgctcttctcaaacc

SEQ ID NO: 103426 - DNA, 25 bp, Mus musculus
acagtccaggtggtcttctcaaacc

SEQ ID NO: 103427 - DNA, 25 bp, Mus musculus
acagtccagttgaattcttggccaa

SEQ ID NO: 103428 - DNA, 25 bp, Mus musculus
acagtccagttgtattcttggccaa

SEQ ID NO: 103429 - DNA, 25 bp, Mus musculus
acagtccagtttcctaccagatact

SEQ ID NO: 103430 - DNA, 25 bp, Mus musculus
acagtccagtttgctaccagatact

SEQ ID NO: 103431 - DNA, 25 bp, Mus musculus
acagtccatctgataggcattatct

SEQ ID NO: 103432 - DNA, 25 bp, Mus musculus
acagtccatctgttaggcattatct

SEQ ID NO: 103433 - DNA, 25 bp, Mus musculus
acagtcccaattactatggcttctc

SEQ ID NO: 103434 - DNA, 25 bp, Mus musculus
acagtcccaatttctatggcttctc

SEQ ID NO: 103435 - DNA, 25 bp, Mus musculus
acagtcccacaaaatcaaactcttt

SEQ ID NO: 103436 - DNA, 25 bp, Mus musculus
acagtcccacaatatcaaactcttt

SEQ ID NO: 103437 - DNA, 25 bp, Mus musculus
acagtcccactaagccctaggaaag

SEQ ID NO: 103438 - DNA, 25 bp, Mus musculus
acagtcccactatgccctaggaaag

SEQ ID NO: 103439 - DNA, 25 bp, Mus musculus
acagtcccactcatctaacataaaa

SEQ ID NO: 103440 - DNA, 25 bp, Mus musculus
acagtcccactcttctaacataaaa

SEQ ID NO: 103441 - DNA, 25 bp, Mus musculus
acagtcccactgatcatgaaataag

SEQ ID NO: 103442 - DNA, 25 bp, Mus musculus
acagtcccactgttcatgaaataag

SEQ ID NO: 103443 - DNA, 25 bp, Mus musculus
acagtcccagaacttatcgtcgcaa

SEQ ID NO: 103444 - DNA, 25 bp, Mus musculus
acagtcccagaagttatcgtcgcaa

SEQ ID NO: 103445 - DNA, 25 bp, Mus musculus
acagtccccacactctgggatagaa

SEQ ID NO: 103446 - DNA, 25 bp, Mus musculus
acagtccccacagtctgggatagaa

SEQ ID NO: 103447 - DNA, 25 bp, Mus musculus
acagtcccctgtatgttgatggtgc

SEQ ID NO: 103448 - DNA, 25 bp, Mus musculus
acagtcccctgtttgttgatggtgc

SEQ ID NO: 103449 - DNA, 25 bp, Mus musculus
acagtcccctttctagtaatggcaa

SEQ ID NO: 103450 - DNA, 25 bp, Mus musculus
acagtcccctttgtagtaatggcaa

SEQ ID NO: 103451 - DNA, 25 bp, Mus musculus
acagtccctgacatagcctaagctt

SEQ ID NO: 103452 - DNA, 25 bp, Mus musculus
acagtccctgacttagcctaagctt

SEQ ID NO: 103453 - DNA, 25 bp, Mus musculus
acagtccctgccaggccaagatctt

SEQ ID NO: 103454 - DNA, 25 bp, Mus musculus
acagtccctgcctggccaagatctt

SEQ ID NO: 103455 - DNA, 25 bp, Mus musculus
acagtccctgggacgtgagcctaat

SEQ ID NO: 103456 - DNA, 25 bp, Mus musculus
acagtccctgggtcgtgagcctaat

SEQ ID NO: 103457 - DNA, 25 bp, Mus musculus
acagtccctttgagggattaggacg

SEQ ID NO: 103458 - DNA, 25 bp, Mus musculus
acagtccctttgtgggattaggacg

SEQ ID NO: 103459 - DNA, 25 bp, Mus musculus
acagtccgagtgcagaaggccatct

SEQ ID NO: 103460 - DNA, 25 bp, Mus musculus
acagtccgagtggagaaggccatct

SEQ ID NO: 103461 - DNA, 25 bp, Mus musculus
acagtccgatcacaacagtggtcca

SEQ ID NO: 103462 - DNA, 25 bp, Mus musculus
acagtccgatcagaacagtggtcca

SEQ ID NO: 103463 - DNA, 25 bp, Mus musculus
acagtccgcagccaataaagtcggt

SEQ ID NO: 103464 - DNA, 25 bp, Mus musculus
acagtccgcagcgaataaagtcggt

SEQ ID NO: 103465 - DNA, 25 bp, Mus musculus
acagtccggaagctagcccctcagt

SEQ ID NO: 103466 - DNA, 25 bp, Mus musculus
acagtccggaaggtagcccctcagt

SEQ ID NO: 103467 - DNA, 25 bp, Mus musculus
acagtcctaaggagcctctgagtca

SEQ ID NO: 103468 - DNA, 25 bp, Mus musculus
acagtcctaaggtgcctctgagtca

SEQ ID NO: 103469 - DNA, 25 bp, Mus musculus
acagtcctagagaaagtcccggtat

SEQ ID NO: 103470 - DNA, 25 bp, Mus musculus
acagtcctagagtaagtcccggtat

SEQ ID NO: 103471 - DNA, 25 bp, Mus musculus
acagtcctatggagcgctaacggct

SEQ ID NO: 103472 - DNA, 25 bp, Mus musculus
acagtcctatggtgcgctaacggct

SEQ ID NO: 103473 - DNA, 25 bp, Mus musculus
acagtcctcaacaacatggccgtga

SEQ ID NO: 103474 - DNA, 25 bp, Mus musculus
acagtcctcaactacatggccgtga

SEQ ID NO: 103475 - DNA, 25 bp, Mus musculus
acagtcctcaccaggtagctgtgct

SEQ ID NO: 103476 - DNA, 25 bp, Mus musculus
acagtcctcacctggtagctgtgct

SEQ ID NO: 103477 - DNA, 25 bp, Mus musculus
acagtcctcataaaatttctatccc

SEQ ID NO: 103478 - DNA, 25 bp, Mus musculus
acagtcctcatataatttctatccc

SEQ ID NO: 103479 - DNA, 25 bp, Mus musculus
acagtcctcattcagtcttgctatg

SEQ ID NO: 103480 - DNA, 25 bp, Mus musculus
acagtcctcattgagtcttgctatg

SEQ ID NO: 103481 - DNA, 25 bp, Mus musculus
acagtcctccacaatttagggtcaa

SEQ ID NO: 103482 - DNA, 25 bp, Mus musculus
acagtcctccactatttagggtcaa

SEQ ID NO: 103483 - DNA, 25 bp, Mus musculus
acagtcctcctgagagcctcgggct

SEQ ID NO: 103484 - DNA, 25 bp, Mus musculus
acagtcctcctgtgagcctcgggct

SEQ ID NO: 103485 - DNA, 25 bp, Mus musculus
acagtcctcgtgataatacatggtg

SEQ ID NO: 103486 - DNA, 25 bp, Mus musculus
acagtcctcgtgttaatacatggtg

SEQ ID NO: 103487 - DNA, 25 bp, Mus musculus
acagtcctgctactgtaggctatat

SEQ ID NO: 103488 - DNA, 25 bp, Mus musculus
acagtcctgctagtgtaggctatat

SEQ ID NO: 103489 - DNA, 25 bp, Mus musculus
acagtcctggcaaatctgtcttcac

SEQ ID NO: 103490 - DNA, 25 bp, Mus musculus
acagtcctggcatatctgtcttcac

SEQ ID NO: 103491 - DNA, 25 bp, Mus musculus
acagtcctgggaaccctgttccgag

SEQ ID NO: 103492 - DNA, 25 bp, Mus musculus
acagtcctgggatccctgttccgag

SEQ ID NO: 103493 - DNA, 25 bp, Mus musculus
acagtcctgggtcttagcttcagct

SEQ ID NO: 103494 - DNA, 25 bp, Mus musculus
acagtcctgggtgttagcttcagct

SEQ ID NO: 103495 - DNA, 25 bp, Mus musculus
acagtcctgtacatttatggatcca

SEQ ID NO: 103496 - DNA, 25 bp, Mus musculus
acagtcctgtacttttatggatcca

SEQ ID NO: 103497 - DNA, 25 bp, Mus musculus
acagtcctgtatctgttcagatttt

SEQ ID NO: 103498 - DNA, 25 bp, Mus musculus
acagtcctgtatgtgttcagatttt

SEQ ID NO: 103499 - DNA, 25 bp, Mus musculus
acagtcctgtctatgtagccatcat

SEQ ID NO: 103500 - DNA, 25 bp, Mus musculus
acagtcctgtctttgtagccatcat

SEQ ID NO: 103501 - DNA, 25 bp, Mus musculus
acagtcctgtgcaattggtgatcgg

SEQ ID NO: 103502 - DNA, 25 bp, Mus musculus
acagtcctgtgctattggtgatcgg

SEQ ID NO: 103503 - DNA, 25 bp, Mus musculus
acagtcctgtggatgtttctagcga

SEQ ID NO: 103504 - DNA, 25 bp, Mus musculus
acagtcctgtggttgtttctagcga

SEQ ID NO: 103505 - DNA, 25 bp, Mus musculus
acagtcctgtgtagcccttgtccgt

SEQ ID NO: 103506 - DNA, 25 bp, Mus musculus
acagtcctgtgttgcccttgtccgt

SEQ ID NO: 103507 - DNA, 25 bp, Mus musculus
acagtccttataacagttcagcaac

SEQ ID NO: 103508 - DNA, 25 bp, Mus musculus
acagtccttatatcagttcagcaac

SEQ ID NO: 103509 - DNA, 25 bp, Mus musculus
acagtccttgtgacaatgtagagca

SEQ ID NO: 103510 - DNA, 25 bp, Mus musculus
acagtccttgtgtcaatgtagagca

SEQ ID NO: 103511 - DNA, 25 bp, Mus musculus
acagtccttgttacctagtgcagca

SEQ ID NO: 103512 - DNA, 25 bp, Mus musculus
acagtccttgttagcgattggtcaa

SEQ ID NO: 103513 - DNA, 25 bp, Mus musculus
acagtccttgtttcctagtgcagca

SEQ ID NO: 103514 - DNA, 25 bp, Mus musculus
acagtccttgtttgcgattggtcaa

SEQ ID NO: 103515 - DNA, 25 bp, Mus musculus
acagtcgaagccctgagcagacaca

SEQ ID NO: 103516 - DNA, 25 bp, Mus musculus
acagtcgaagccgtgagcagacaca

SEQ ID NO: 103517 - DNA, 25 bp, Mus musculus
acagtcgacgtccagaacctgaaga

SEQ ID NO: 103518 - DNA, 25 bp, Mus musculus
acagtcgacgtcgagaacctgaaga

SEQ ID NO: 103519 - DNA, 25 bp, Mus musculus
acagtcgcactgatgttggagagta

SEQ ID NO: 103520 - DNA, 25 bp, Mus musculus
acagtcgcactgttgttggagagta

SEQ ID NO: 103521 - DNA, 25 bp, Mus musculus
acagtcgccaacagtttcttcatgg

SEQ ID NO: 103522 - DNA, 25 bp, Mus musculus
acagtcgccaactgtttcttcatgg

SEQ ID NO: 103523 - DNA, 25 bp, Mus musculus
acagtcgcctctatggttaacacag

SEQ ID NO: 103524 - DNA, 25 bp, Mus musculus
acagtcgcctctttggttaacacag

SEQ ID NO: 103525 - DNA, 25 bp, Mus musculus
acagtcgcctgtcaatgtgagtttc

SEQ ID NO: 103526 - DNA, 25 bp, Mus musculus
acagtcgcctgtgaatgtgagtttc

SEQ ID NO: 103527 - DNA, 25 bp, Mus musculus
acagtcgcgtctctaaagcacagga

SEQ ID NO: 103528 - DNA, 25 bp, Mus musculus
acagtcgcgtctgtaaagcacagga

SEQ ID NO: 103529 - DNA, 25 bp, Mus musculus
acagtcggagaacctgcggacacta

SEQ ID NO: 103530 - DNA, 25 bp, Mus musculus
acagtcggagaagctgcggacacta

SEQ ID NO: 103531 - DNA, 25 bp, Mus musculus
acagtcggagctacacaaaccatga

SEQ ID NO: 103532 - DNA, 25 bp, Mus musculus
acagtcggagcttcacaaaccatga

SEQ ID NO: 103533 - DNA, 25 bp, Mus musculus
acagtcgtaagcagccacgtgtggg

SEQ ID NO: 103534 - DNA, 25 bp, Mus musculus
acagtcgtaagctgccacgtgtggg

SEQ ID NO: 103535 - DNA, 25 bp, Mus musculus
acagtcgtacaccatgcaggcatag

SEQ ID NO: 103536 - DNA, 25 bp, Mus musculus
acagtcgtacacgatgcaggcatag

SEQ ID NO: 103537 - DNA, 25 bp, Mus musculus
acagtcgtccctccaagagttacag

SEQ ID NO: 103538 - DNA, 25 bp, Mus musculus
acagtcgtccctgcaagagttacag

SEQ ID NO: 103539 - DNA, 25 bp, Mus musculus
acagtcgtgcttcgctgtgacaggc

SEQ ID NO: 103540 - DNA, 25 bp, Mus musculus
acagtcgtgcttggctgtgacaggc

SEQ ID NO: 103541 - DNA, 25 bp, Mus musculus
acagtcgtgggcagcggctcagaca

SEQ ID NO: 103542 - DNA, 25 bp, Mus musculus
acagtcgtgggctgcggctcagaca

SEQ ID NO: 103543 - DNA, 25 bp, Mus musculus
acagtcgtgtcgacgctagagattt

SEQ ID NO: 103544 - DNA, 25 bp, Mus musculus
acagtcgtgtcgtcgctagagattt

SEQ ID NO: 103545 - DNA, 25 bp, Mus musculus
acagtcgtgtctctaccggccaggg

SEQ ID NO: 103546 - DNA, 25 bp, Mus musculus
acagtcgtgtctgtaccggccaggg

SEQ ID NO: 103547 - DNA, 25 bp, Mus musculus
acagtcgttcctcgcttgtggctgg

SEQ ID NO: 103548 - DNA, 25 bp, Mus musculus
acagtcgttcctggcttgtggctgg

SEQ ID NO: 103549 - DNA, 25 bp, Mus musculus
acagtctactgcaagcctgggtcaa

SEQ ID NO: 103550 - DNA, 25 bp, Mus musculus
acagtctactgctagcctgggtcaa

SEQ ID NO: 103551 - DNA, 25 bp, Mus musculus
acagtctagggcattcattatttta

SEQ ID NO: 103552 - DNA, 25 bp, Mus musculus
acagtctagggctttcattatttta

SEQ ID NO: 103553 - DNA, 25 bp, Mus musculus
acagtctatcagctgctccaggagc

SEQ ID NO: 103554 - DNA, 25 bp, Mus musculus
acagtctatcaggtgctccaggagc

SEQ ID NO: 103555 - DNA, 25 bp, Mus musculus
acagtctatctaactagtctaccca

SEQ ID NO: 103556 - DNA, 25 bp, Mus musculus
acagtctatctatctagtctaccca

SEQ ID NO: 103557 - DNA, 25 bp, Mus musculus
acagtctcacacaaccgtgtataat

SEQ ID NO: 103558 - DNA, 25 bp, Mus musculus
acagtctcacactaccgtgtataat

SEQ ID NO: 103559 - DNA, 25 bp, Mus musculus
acagtctcacgcatatgcagcaagc

SEQ ID NO: 103560 - DNA, 25 bp, Mus musculus
acagtctcacgcttatgcagcaagc

SEQ ID NO: 103561 - DNA, 25 bp, Mus musculus
acagtctcactgagtattacaggct

SEQ ID NO: 103562 - DNA, 25 bp, Mus musculus
acagtctcactgtgtattacaggct

SEQ ID NO: 103563 - DNA, 25 bp, Mus musculus
acagtctcagccacagagaacaagg

SEQ ID NO: 103564 - DNA, 25 bp, Mus musculus
acagtctcagcctcagagaacaagg

SEQ ID NO: 103565 - DNA, 25 bp, Mus musculus
acagtctcaggacaagagaggccaa

SEQ ID NO: 103566 - DNA, 25 bp, Mus musculus
acagtctcaggagaagagaggccaa

SEQ ID NO: 103567 - DNA, 25 bp, Mus musculus
acagtctcatcccagcttgtgaatt

SEQ ID NO: 103568 - DNA, 25 bp, Mus musculus
acagtctcatccgagcttgtgaatt

SEQ ID NO: 103569 - DNA, 25 bp, Mus musculus
acagtctccatcagaattcagcggg

SEQ ID NO: 103570 - DNA, 25 bp, Mus musculus
acagtctccatctgaattcagcggg

SEQ ID NO: 103571 - DNA, 25 bp, Mus musculus
acagtctctcatacccaatgaggag

SEQ ID NO: 103572 - DNA, 25 bp, Mus musculus
acagtctctcattcccaatgaggag

SEQ ID NO: 103573 - DNA, 25 bp, Mus musculus
acagtctctgggacattgactactc

SEQ ID NO: 103574 - DNA, 25 bp, Mus musculus
acagtctctgggtcattgactactc

SEQ ID NO: 103575 - DNA, 25 bp, Mus musculus
acagtctgagcacagctctcctcac

SEQ ID NO: 103576 - DNA, 25 bp, Mus musculus
acagtctgagcagagctctcctcac

SEQ ID NO: 103577 - DNA, 25 bp, Mus musculus
acagtctgagtgcagcatccgggac

SEQ ID NO: 103578 - DNA, 25 bp, Mus musculus
acagtctgagtggagcatccgggac

SEQ ID NO: 103579 - DNA, 25 bp, Mus musculus
acagtctgattgagtttctaaccca

SEQ ID NO: 103580 - DNA, 25 bp, Mus musculus
acagtctgattgtgtttctaaccca

SEQ ID NO: 103581 - DNA, 25 bp, Mus musculus
acagtctgcaaaccgagatgccttc

SEQ ID NO: 103582 - DNA, 25 bp, Mus musculus
acagtctgcaaacgatcaggcccag

SEQ ID NO: 103583 - DNA, 25 bp, Mus musculus
acagtctgcaaagcgagatgccttc

SEQ ID NO: 103584 - DNA, 25 bp, Mus musculus
acagtctgcaaaggatcaggcccag

SEQ ID NO: 103585 - DNA, 25 bp, Mus musculus
acagtctgcataattgccatccagc

SEQ ID NO: 103586 - DNA, 25 bp, Mus musculus
acagtctgcatatttgccatccagc

SEQ ID NO: 103587 - DNA, 25 bp, Mus musculus
acagtctgcatcctcctagttggaa

SEQ ID NO: 103588 - DNA, 25 bp, Mus musculus
acagtctgcatcgtcctagttggaa

SEQ ID NO: 103589 - DNA, 25 bp, Mus musculus
acagtctgcctcatagttctataca

SEQ ID NO: 103590 - DNA, 25 bp, Mus musculus
acagtctgcctcttagttctataca

SEQ ID NO: 103591 - DNA, 25 bp, Mus musculus
acagtctgctttaacgtcccaggaa

SEQ ID NO: 103592 - DNA, 25 bp, Mus musculus
acagtctgcttttacgtcccaggaa

SEQ ID NO: 103593 - DNA, 25 bp, Mus musculus
acagtctggcttcggttttccttag

SEQ ID NO: 103594 - DNA, 25 bp, Mus musculus
acagtctggcttgggttttccttag

SEQ ID NO: 103595 - DNA, 25 bp, Mus musculus
acagtctgggctcttaaattaacaa

SEQ ID NO: 103596 - DNA, 25 bp, Mus musculus
acagtctgggctgttaaattaacaa

SEQ ID NO: 103597 - DNA, 25 bp, Mus musculus
acagtctgtaagaaccatggtctag

SEQ ID NO: 103598 - DNA, 25 bp, Mus musculus
acagtctgtaagtaccatggtctag

SEQ ID NO: 103599 - DNA, 25 bp, Mus musculus
acagtctgtactacaggacctagag

SEQ ID NO: 103600 - DNA, 25 bp, Mus musculus
acagtctgtacttcaggacctagag

SEQ ID NO: 103601 - DNA, 25 bp, Mus musculus
acagtctgtcaactgaaagtttcat

SEQ ID NO: 103602 - DNA, 25 bp, Mus musculus
acagtctgtcaagtgaaagtttcat

SEQ ID NO: 103603 - DNA, 25 bp, Mus musculus
acagtctgtgccatgttgatgtaca

SEQ ID NO: 103604 - DNA, 25 bp, Mus musculus
acagtctgtgccttgttgatgtaca

SEQ ID NO: 103605 - DNA, 25 bp, Mus musculus
acagtctgtgtcagtaaccttggtg

SEQ ID NO: 103606 - DNA, 25 bp, Mus musculus
acagtctgtgtctgtaaccttggtg

SEQ ID NO: 103607 - DNA, 25 bp, Mus musculus
acagtctgttacctgattctggcca

SEQ ID NO: 103608 - DNA, 25 bp, Mus musculus
acagtctgttacgtgattctggcca

SEQ ID NO: 103609 - DNA, 25 bp, Mus musculus
acagtctgttctccctcggtgggag

SEQ ID NO: 103610 - DNA, 25 bp, Mus musculus
acagtctgttctgcctcggtgggag

SEQ ID NO: 103611 - DNA, 25 bp, Mus musculus
acagtctgttttcttactgtataaa

SEQ ID NO: 103612 - DNA, 25 bp, Mus musculus
acagtctgttttgttactgtataaa

SEQ ID NO: 103613 - DNA, 25 bp, Mus musculus
acagtcttactacccgttccttatt

SEQ ID NO: 103614 - DNA, 25 bp, Mus musculus
acagtcttactagccgttccttatt

SEQ ID NO: 103615 - DNA, 25 bp, Mus musculus
acagtcttagtgattttctttccaa

SEQ ID NO: 103616 - DNA, 25 bp, Mus musculus
acagtcttagtgtttttctttccaa

SEQ ID NO: 103617 - DNA, 25 bp, Mus musculus
acagtcttcagtatcctcccagtta

SEQ ID NO: 103618 - DNA, 25 bp, Mus musculus
acagtcttcagtttcctcccagtta

SEQ ID NO: 103619 - DNA, 25 bp, Mus musculus
acagtcttcatgacataggtctcgg

SEQ ID NO: 103620 - DNA, 25 bp, Mus musculus
acagtcttcatgtcataggtctcgg

SEQ ID NO: 103621 - DNA, 25 bp, Mus musculus
acagtcttccagcagttcggcagta

SEQ ID NO: 103622 - DNA, 25 bp, Mus musculus
acagtcttccaggagttcggcagta

SEQ ID NO: 103623 - DNA, 25 bp, Mus musculus
acagtcttcctgattagtctaggct

SEQ ID NO: 103624 - DNA, 25 bp, Mus musculus
acagtcttcctgtttagtctaggct

SEQ ID NO: 103625 - DNA, 25 bp, Mus musculus
acagtcttgactcctttcagaatca

SEQ ID NO: 103626 - DNA, 25 bp, Mus musculus
acagtcttgactgctttcagaatca

SEQ ID NO: 103627 - DNA, 25 bp, Mus musculus
acagtcttgccaatcaattacaatt

SEQ ID NO: 103628 - DNA, 25 bp, Mus musculus
acagtcttgccattcaattacaatt

SEQ ID NO: 103629 - DNA, 25 bp, Mus musculus
acagtctttcctcggacctctgttt

SEQ ID NO: 103630 - DNA, 25 bp, Mus musculus
acagtctttcctgggacctctgttt

SEQ ID NO: 103631 - DNA, 25 bp, Mus musculus
acagtctttgaacccgttcctatgt

SEQ ID NO: 103632 - DNA, 25 bp, Mus musculus
acagtctttgaagccgttcctatgt

SEQ ID NO: 103633 - DNA, 25 bp, Mus musculus
acagtctttgtgaccaggtctctga

SEQ ID NO: 103634 - DNA, 25 bp, Mus musculus
acagtctttgtgtccaggtctctga

SEQ ID NO: 103635 - DNA, 25 bp, Mus musculus
acagtctttgttccgtccttatgaa

SEQ ID NO: 103636 - DNA, 25 bp, Mus musculus
acagtctttgttgcgtccttatgaa

SEQ ID NO: 103637 - DNA, 25 bp, Mus musculus
acagtcttttaactccagggtgcaa

SEQ ID NO: 103638 - DNA, 25 bp, Mus musculus
acagtcttttaagtccagggtgcaa

SEQ ID NO: 103639 - DNA, 25 bp, Mus musculus
acagtcttttagattgacgagcaac

SEQ ID NO: 103640 - DNA, 25 bp, Mus musculus
acagtcttttagtttgacgagcaac

SEQ ID NO: 103641 - DNA, 25 bp, Mus musculus
acagtctttttcatgggcgattcta

SEQ ID NO: 103642 - DNA, 25 bp, Mus musculus
acagtctttttcttgggcgattcta

SEQ ID NO: 103643 - DNA, 25 bp, Mus musculus
acagtgaaagtaatggtcgccagta

SEQ ID NO: 103644 - DNA, 25 bp, Mus musculus
acagtgaaagtattggtcgccagta

SEQ ID NO: 103645 - DNA, 25 bp, Mus musculus
acagtgaacagtccccgaggctgtc

SEQ ID NO: 103646 - DNA, 25 bp, Mus musculus
acagtgaacagtctttccttgttaa

SEQ ID NO: 103647 - DNA, 25 bp, Mus musculus
acagtgaacagtgcccgaggctgtc

SEQ ID NO: 103648 - DNA, 25 bp, Mus musculus
acagtgaacagtgtttccttgttaa

SEQ ID NO: 103649 - DNA, 25 bp, Mus musculus
acagtgaaccttcttatatgaccaa

SEQ ID NO: 103650 - DNA, 25 bp, Mus musculus
acagtgaaccttgttatatgaccaa

SEQ ID NO: 103651 - DNA, 25 bp, Mus musculus
acagtgaactataaagactgctcta

SEQ ID NO: 103652 - DNA, 25 bp, Mus musculus
acagtgaactattaagactgctcta

SEQ ID NO: 103653 - DNA, 25 bp, Mus musculus
acagtgaagagcatcatcgaggcag

SEQ ID NO: 103654 - DNA, 25 bp, Mus musculus
acagtgaagagcttcatcgaggcag

SEQ ID NO: 103655 - DNA, 25 bp, Mus musculus
acagtgaagatgacgagaaggcagc

SEQ ID NO: 103656 - DNA, 25 bp, Mus musculus
acagtgaagatgtcgagaaggcagc

SEQ ID NO: 103657 - DNA, 25 bp, Mus musculus
acagtgaagctccatgtctcctgga

SEQ ID NO: 103658 - DNA, 25 bp, Mus musculus
acagtgaagctcgatgtctcctgga

SEQ ID NO: 103659 - DNA, 25 bp, Mus musculus
acagtgaaggcaacccagttgacca

SEQ ID NO: 103660 - DNA, 25 bp, Mus musculus
acagtgaaggcatcccagttgacca

SEQ ID NO: 103661 - DNA, 25 bp, Mus musculus
acagtgaagtatctcatgttctgaa

SEQ ID NO: 103662 - DNA, 25 bp, Mus musculus
acagtgaagtatgtcatgttctgaa

SEQ ID NO: 103663 - DNA, 25 bp, Mus musculus
acagtgaatcctcagtcatcctgca

SEQ ID NO: 103664 - DNA, 25 bp, Mus musculus
acagtgaatcctgagtcatcctgca

SEQ ID NO: 103665 - DNA, 25 bp, Mus musculus
acagtgaatcggctgccagtggctc

SEQ ID NO: 103666 - DNA, 25 bp, Mus musculus
acagtgaatcgggtgccagtggctc

SEQ ID NO: 103667 - DNA, 25 bp, Mus musculus
acagtgaatctcacccaacataata

SEQ ID NO: 103668 - DNA, 25 bp, Mus musculus
acagtgaatctctcccaacataata

SEQ ID NO: 103669 - DNA, 25 bp, Mus musculus
acagtgaatgagactttccattgcc

SEQ ID NO: 103670 - DNA, 25 bp, Mus musculus
acagtgaatgagtctttccattgcc

SEQ ID NO: 103671 - DNA, 25 bp, Mus musculus
acagtgaatttcatggtacgaagtc

SEQ ID NO: 103672 - DNA, 25 bp, Mus musculus
acagtgaatttcttggtacgaagtc

SEQ ID NO: 103673 - DNA, 25 bp, Mus musculus
acagtgacacgacggcatcatctgc

SEQ ID NO: 103674 - DNA, 25 bp, Mus musculus
acagtgacacgagggcatcatctgc

SEQ ID NO: 103675 - DNA, 25 bp, Mus musculus
acagtgacagatcggcacaagacta

SEQ ID NO: 103676 - DNA, 25 bp, Mus musculus
acagtgacagatgggcacaagacta

SEQ ID NO: 103677 - DNA, 25 bp, Mus musculus
acagtgacagcgagccatgtgctgc

SEQ ID NO: 103678 - DNA, 25 bp, Mus musculus
acagtgacagcgtgccatgtgctgc

SEQ ID NO: 103679 - DNA, 25 bp, Mus musculus
acagtgacaggcctggctgctacca

SEQ ID NO: 103680 - DNA, 25 bp, Mus musculus
acagtgacaggcgtggctgctacca

SEQ ID NO: 103681 - DNA, 25 bp, Mus musculus
acagtgacaggtatatctttgcaaa

SEQ ID NO: 103682 - DNA, 25 bp, Mus musculus
acagtgacaggtttatctttgcaaa

SEQ ID NO: 103683 - DNA, 25 bp, Mus musculus
acagtgacatatctcttcacacctg

SEQ ID NO: 103684 - DNA, 25 bp, Mus musculus
acagtgacatatgtcttcacacctg

SEQ ID NO: 103685 - DNA, 25 bp, Mus musculus
acagtgacattgagagctgactcag

SEQ ID NO: 103686 - DNA, 25 bp, Mus musculus
acagtgacattgtgagctgactcag

SEQ ID NO: 103687 - DNA, 25 bp, Mus musculus
acagtgaccaagacacctgtgctct

SEQ ID NO: 103688 - DNA, 25 bp, Mus musculus
acagtgaccaagtcacctgtgctct

SEQ ID NO: 103689 - DNA, 25 bp, Mus musculus
acagtgaccatcacctgtgttggga

SEQ ID NO: 103690 - DNA, 25 bp, Mus musculus
acagtgaccatctcctgtgttggga

SEQ ID NO: 103691 - DNA, 25 bp, Mus musculus
acagtgaccgacagtaacctctccg

SEQ ID NO: 103692 - DNA, 25 bp, Mus musculus
acagtgaccgactgtaacctctccg

SEQ ID NO: 103693 - DNA, 25 bp, Mus musculus
acagtgacctcacacaccagaaggt

SEQ ID NO: 103694 - DNA, 25 bp, Mus musculus
acagtgacctcagacaccagaaggt

SEQ ID NO: 103695 - DNA, 25 bp, Mus musculus
acagtgacctgccaagtgcttcaag

SEQ ID NO: 103696 - DNA, 25 bp, Mus musculus
acagtgacctgcgaagtgcttcaag

SEQ ID NO: 103697 - DNA, 25 bp, Mus musculus
acagtgacctggactgtgggcctct

SEQ ID NO: 103698 - DNA, 25 bp, Mus musculus
acagtgacctggtctgtgggcctct

SEQ ID NO: 103699 - DNA, 25 bp, Mus musculus
acagtgactgtcctgtttacagaag

SEQ ID NO: 103700 - DNA, 25 bp, Mus musculus
acagtgactgtcgtgtttacagaag

SEQ ID NO: 103701 - DNA, 25 bp, Mus musculus
acagtgacttcaactactcataccc

SEQ ID NO: 103702 - DNA, 25 bp, Mus musculus
acagtgacttcatctactcataccc

SEQ ID NO: 103703 - DNA, 25 bp, Mus musculus
acagtgactttgcttgtggccctga

SEQ ID NO: 103704 - DNA, 25 bp, Mus musculus
acagtgactttggttgtggccctga

SEQ ID NO: 103705 - DNA, 25 bp, Mus musculus
acagtgagaagtcttcccgggcagc

SEQ ID NO: 103706 - DNA, 25 bp, Mus musculus
acagtgagaagtgttcccgggcagc

SEQ ID NO: 103707 - DNA, 25 bp, Mus musculus
acagtgagacacaattgtttttcta

SEQ ID NO: 103708 - DNA, 25 bp, Mus musculus
acagtgagacactattgtttttcta

SEQ ID NO: 103709 - DNA, 25 bp, Mus musculus
acagtgagactcagttgtcacactt

SEQ ID NO: 103710 - DNA, 25 bp, Mus musculus
acagtgagactctgttgtcacactt

SEQ ID NO: 103711 - DNA, 25 bp, Mus musculus
acagtgagaggtaccttccttctct

SEQ ID NO: 103712 - DNA, 25 bp, Mus musculus
acagtgagaggttccttccttctct

SEQ ID NO: 103713 - DNA, 25 bp, Mus musculus
acagtgagagtcaccgacctggtca

SEQ ID NO: 103714 - DNA, 25 bp, Mus musculus
acagtgagagtctccgacctggtca

SEQ ID NO: 103715 - DNA, 25 bp, Mus musculus
acagtgagcactctggagccacaca

SEQ ID NO: 103716 - DNA, 25 bp, Mus musculus
acagtgagcactgtggagccacaca

SEQ ID NO: 103717 - DNA, 25 bp, Mus musculus
acagtgagcataccaatctacccta

SEQ ID NO: 103718 - DNA, 25 bp, Mus musculus
acagtgagcatagcaatctacccta

SEQ ID NO: 103719 - DNA, 25 bp, Mus musculus
acagtgagccctatgggaggcccaa

SEQ ID NO: 103720 - DNA, 25 bp, Mus musculus
acagtgagccctttgggaggcccaa

SEQ ID NO: 103721 - DNA, 25 bp, Mus musculus
acagtgagcgcacggaaatcctccc

SEQ ID NO: 103722 - DNA, 25 bp, Mus musculus
acagtgagcgcagggaaatcctccc

SEQ ID NO: 103723 - DNA, 25 bp, Mus musculus
acagtgagctctatcccagccctag

SEQ ID NO: 103724 - DNA, 25 bp, Mus musculus
acagtgagctctttcccagccctag

SEQ ID NO: 103725 - DNA, 25 bp, Mus musculus
acagtgagctgaccattctctagca

SEQ ID NO: 103726 - DNA, 25 bp, Mus musculus
acagtgagctgagcattctctagca

SEQ ID NO: 103727 - DNA, 25 bp, Mus musculus
acagtgaggctgagcgtttcccagt

SEQ ID NO: 103728 - DNA, 25 bp, Mus musculus
acagtgaggctgtgcgtttcccagt

SEQ ID NO: 103729 - DNA, 25 bp, Mus musculus
acagtgagggtacgacttctctccc

SEQ ID NO: 103730 - DNA, 25 bp, Mus musculus
acagtgagggtaggacttctctccc

SEQ ID NO: 103731 - DNA, 25 bp, Mus musculus
acagtgaggttgctgactctctggc

SEQ ID NO: 103732 - DNA, 25 bp, Mus musculus
acagtgaggttggtgactctctggc

SEQ ID NO: 103733 - DNA, 25 bp, Mus musculus
acagtgagtcacatcgcacagtact

SEQ ID NO: 103734 - DNA, 25 bp, Mus musculus
acagtgagtcacttcgcacagtact

SEQ ID NO: 103735 - DNA, 25 bp, Mus musculus
acagtgagtctcaagtgcttcttac

SEQ ID NO: 103736 - DNA, 25 bp, Mus musculus
acagtgagtctctagtgcttcttac

SEQ ID NO: 103737 - DNA, 25 bp, Mus musculus
acagtgagtggacctttctgtgcca

SEQ ID NO: 103738 - DNA, 25 bp, Mus musculus
acagtgagtggagctttctgtgcca

SEQ ID NO: 103739 - DNA, 25 bp, Mus musculus
acagtgagtgtgactcctgctagcg

SEQ ID NO: 103740 - DNA, 25 bp, Mus musculus
acagtgagtgtgtctcctgctagcg

SEQ ID NO: 103741 - DNA, 25 bp, Mus musculus
acagtgatacatagtactcccctct

SEQ ID NO: 103742 - DNA, 25 bp, Mus musculus
acagtgatacattgtactcccctct

SEQ ID NO: 103743 - DNA, 25 bp, Mus musculus
acagtgatacctcgcttctctgtgc

SEQ ID NO: 103744 - DNA, 25 bp, Mus musculus
acagtgatacctggcttctctgtgc

SEQ ID NO: 103745 - DNA, 25 bp, Mus musculus
acagtgatattgaatggtagtataa

SEQ ID NO: 103746 - DNA, 25 bp, Mus musculus
acagtgatattgtatggtagtataa

SEQ ID NO: 103747 - DNA, 25 bp, Mus musculus
acagtgatctagcttgacgacagaa

SEQ ID NO: 103748 - DNA, 25 bp, Mus musculus
acagtgatctaggttgacgacagaa

SEQ ID NO: 103749 - DNA, 25 bp, Mus musculus
acagtgatgcctcatcctcctctgt

SEQ ID NO: 103750 - DNA, 25 bp, Mus musculus
acagtgatgcctgatcctcctctgt

SEQ ID NO: 103751 - DNA, 25 bp, Mus musculus
acagtgatgggcagcgtcttcttct

SEQ ID NO: 103752 - DNA, 25 bp, Mus musculus
acagtgatgggctgcgtcttcttct

SEQ ID NO: 103753 - DNA, 25 bp, Mus musculus
acagtgatgtggaacagctccggga

SEQ ID NO: 103754 - DNA, 25 bp, Mus musculus
acagtgatgtggtacagctccggga

SEQ ID NO: 103755 - DNA, 25 bp, Mus musculus
acagtgattctcagcccggactctg

SEQ ID NO: 103756 - DNA, 25 bp, Mus musculus
acagtgattctctgcccggactctg

SEQ ID NO: 103757 - DNA, 25 bp, Mus musculus
acagtgattggcagcatccttcctc

SEQ ID NO: 103758 - DNA, 25 bp, Mus musculus
acagtgattggcattcctgaattta

SEQ ID NO: 103759 - DNA, 25 bp, Mus musculus
acagtgattggctgcatccttcctc

SEQ ID NO: 103760 - DNA, 25 bp, Mus musculus
acagtgattggctttcctgaattta

SEQ ID NO: 103761 - DNA, 25 bp, Mus musculus
acagtgattggtacacctcccgaaa

SEQ ID NO: 103762 - DNA, 25 bp, Mus musculus
acagtgattggttcacctcccgaaa

SEQ ID NO: 103763 - DNA, 25 bp, Mus musculus
acagtgattgtgcaatcccgctgac

SEQ ID NO: 103764 - DNA, 25 bp, Mus musculus
acagtgattgtggaatcccgctgac

SEQ ID NO: 103765 - DNA, 25 bp, Mus musculus
acagtgattgttagtcagacacaca

SEQ ID NO: 103766 - DNA, 25 bp, Mus musculus
acagtgattgttcatttccattttt

SEQ ID NO: 103767 - DNA, 25 bp, Mus musculus
acagtgattgttgatttccattttt

SEQ ID NO: 103768 - DNA, 25 bp, Mus musculus
acagtgattgtttgtcagacacaca

SEQ ID NO: 103769 - DNA, 25 bp, Mus musculus
acagtgatttccatgtggtctccac

SEQ ID NO: 103770 - DNA, 25 bp, Mus musculus
acagtgatttccttgtggtctccac

SEQ ID NO: 103771 - DNA, 25 bp, Mus musculus
acagtgattttaccttcacgctgcc

SEQ ID NO: 103772 - DNA, 25 bp, Mus musculus
acagtgattttagcttcacgctgcc

SEQ ID NO: 103773 - DNA, 25 bp, Mus musculus
acagtgatttttacctgggcataga

SEQ ID NO: 103774 - DNA, 25 bp, Mus musculus
acagtgattttttcctgggcataga

SEQ ID NO: 103775 - DNA, 25 bp, Mus musculus
acagtgcaaaccattcctcaggcaa

SEQ ID NO: 103776 - DNA, 25 bp, Mus musculus
acagtgcaaacctttcctcaggcaa

SEQ ID NO: 103777 - DNA, 25 bp, Mus musculus
acagtgcaacgtaatgtggaaactt

SEQ ID NO: 103778 - DNA, 25 bp, Mus musculus
acagtgcaacgttatgtggaaactt

SEQ ID NO: 103779 - DNA, 25 bp, Mus musculus
acagtgcaagagatagatggatcct

SEQ ID NO: 103780 - DNA, 25 bp, Mus musculus
acagtgcaagagttagatggatcct

SEQ ID NO: 103781 - DNA, 25 bp, Mus musculus
acagtgcaagtacgttgaagctcga

SEQ ID NO: 103782 - DNA, 25 bp, Mus musculus
acagtgcaagtaggttgaagctcga

SEQ ID NO: 103783 - DNA, 25 bp, Mus musculus
acagtgcaatgaccaaatcctctga

SEQ ID NO: 103784 - DNA, 25 bp, Mus musculus
acagtgcaatgagcaaatcctctga

SEQ ID NO: 103785 - DNA, 25 bp, Mus musculus
acagtgcaccccaagaagagggcca

SEQ ID NO: 103786 - DNA, 25 bp, Mus musculus
acagtgcacccctagaagagggcca

SEQ ID NO: 103787 - DNA, 25 bp, Mus musculus
acagtgcaccctaggatcttttttc

SEQ ID NO: 103788 - DNA, 25 bp, Mus musculus
acagtgcacccttggatcttttttc

SEQ ID NO: 103789 - DNA, 25 bp, Mus musculus
acagtgcagaagaatgccagttttt

SEQ ID NO: 103790 - DNA, 25 bp, Mus musculus
acagtgcagaagattgccattccaa

SEQ ID NO: 103791 - DNA, 25 bp, Mus musculus
acagtgcagaagtatgccagttttt

SEQ ID NO: 103792 - DNA, 25 bp, Mus musculus
acagtgcagaagtttgccattccaa

SEQ ID NO: 103793 - DNA, 25 bp, Mus musculus
acagtgcagagaagtgacccttgag

SEQ ID NO: 103794 - DNA, 25 bp, Mus musculus
acagtgcagagatgtgacccttgag

SEQ ID NO: 103795 - DNA, 25 bp, Mus musculus
acagtgcagaggaagccagaagctt

SEQ ID NO: 103796 - DNA, 25 bp, Mus musculus
acagtgcagaggtagccagaagctt

SEQ ID NO: 103797 - DNA, 25 bp, Mus musculus
acagtgcagtgtcccctgaagggct

SEQ ID NO: 103798 - DNA, 25 bp, Mus musculus
acagtgcagtgtgccctgaagggct

SEQ ID NO: 103799 - DNA, 25 bp, Mus musculus
acagtgcagttcacacagtacccgt

SEQ ID NO: 103800 - DNA, 25 bp, Mus musculus
acagtgcagttctcacagtacccgt

SEQ ID NO: 103801 - DNA, 25 bp, Mus musculus
acagtgcatagacatgcatgcggat

SEQ ID NO: 103802 - DNA, 25 bp, Mus musculus
acagtgcatagagatgcatgcggat

SEQ ID NO: 103803 - DNA, 25 bp, Mus musculus
acagtgcatcatctccaaatatgac

SEQ ID NO: 103804 - DNA, 25 bp, Mus musculus
acagtgcatcatgtccaaatatgac

SEQ ID NO: 103805 - DNA, 25 bp, Mus musculus
acagtgcatcctagttgatgatatc

SEQ ID NO: 103806 - DNA, 25 bp, Mus musculus
acagtgcatccttgttgatgatatc

SEQ ID NO: 103807 - DNA, 25 bp, Mus musculus
acagtgcatcttagtctctgttgat

SEQ ID NO: 103808 - DNA, 25 bp, Mus musculus
acagtgcatctttgtctctgttgat

SEQ ID NO: 103809 - DNA, 25 bp, Mus musculus
acagtgcattcacgtgcttttctgc

SEQ ID NO: 103810 - DNA, 25 bp, Mus musculus
acagtgcattcaggtgcttttctgc

SEQ ID NO: 103811 - DNA, 25 bp, Mus musculus
acagtgccagctatttaattcccta

SEQ ID NO: 103812 - DNA, 25 bp, Mus musculus
acagtgccagctttttaattcccta

SEQ ID NO: 103813 - DNA, 25 bp, Mus musculus
acagtgccagtgacgttttgtactt

SEQ ID NO: 103814 - DNA, 25 bp, Mus musculus
acagtgccagtgtcgttttgtactt

SEQ ID NO: 103815 - DNA, 25 bp, Mus musculus
acagtgccattaccatatgtttgta

SEQ ID NO: 103816 - DNA, 25 bp, Mus musculus
acagtgccattagcatatgtttgta

SEQ ID NO: 103817 - DNA, 25 bp, Mus musculus
acagtgcccaagacagacagctcat

SEQ ID NO: 103818 - DNA, 25 bp, Mus musculus
acagtgcccaagtcagacagctcat

SEQ ID NO: 103819 - DNA, 25 bp, Mus musculus
acagtgcccagtacagtgctctgca

SEQ ID NO: 103820 - DNA, 25 bp, Mus musculus
acagtgcccagtatctgaccaggct

SEQ ID NO: 103821 - DNA, 25 bp, Mus musculus
acagtgcccagttcagtgctctgca

SEQ ID NO: 103822 - DNA, 25 bp, Mus musculus
acagtgcccagtttctgaccaggct

SEQ ID NO: 103823 - DNA, 25 bp, Mus musculus
acagtgcccgagctgaggacgccat

SEQ ID NO: 103824 - DNA, 25 bp, Mus musculus
acagtgcccgaggtgaggacgccat

SEQ ID NO: 103825 - DNA, 25 bp, Mus musculus
acagtgcccgatatcaggattctct

SEQ ID NO: 103826 - DNA, 25 bp, Mus musculus
acagtgcccgatttcaggattctct

SEQ ID NO: 103827 - DNA, 25 bp, Mus musculus
acagtgcccggcctcattgattcgc

SEQ ID NO: 103828 - DNA, 25 bp, Mus musculus
acagtgcccggcgtcattgattcgc

SEQ ID NO: 103829 - DNA, 25 bp, Mus musculus
acagtgccgcctaccagagcagaat

SEQ ID NO: 103830 - DNA, 25 bp, Mus musculus
acagtgccgccttccagagcagaat

SEQ ID NO: 103831 - DNA, 25 bp, Mus musculus
acagtgccggtgctgcccatgcaga

SEQ ID NO: 103832 - DNA, 25 bp, Mus musculus
acagtgccggtggtgcccatgcaga

SEQ ID NO: 103833 - DNA, 25 bp, Mus musculus
acagtgccgttgatttatgaaatgc

SEQ ID NO: 103834 - DNA, 25 bp, Mus musculus
acagtgccgttgttttatgaaatgc

SEQ ID NO: 103835 - DNA, 25 bp, Mus musculus
acagtgcctagactagatttcacag

SEQ ID NO: 103836 - DNA, 25 bp, Mus musculus
acagtgcctagagtagatttcacag

SEQ ID NO: 103837 - DNA, 25 bp, Mus musculus
acagtgcctctgaatgctttgtatt

SEQ ID NO: 103838 - DNA, 25 bp, Mus musculus
acagtgcctctgtatgctttgtatt

SEQ ID NO: 103839 - DNA, 25 bp, Mus musculus
acagtgcctgtgaaaagccttccca

SEQ ID NO: 103840 - DNA, 25 bp, Mus musculus
acagtgcctgtgtaaagccttccca

SEQ ID NO: 103841 - DNA, 25 bp, Mus musculus
acagtgccttcgcattttctggcat

SEQ ID NO: 103842 - DNA, 25 bp, Mus musculus
acagtgccttcggattttctggcat

SEQ ID NO: 103843 - DNA, 25 bp, Mus musculus
acagtgcgagttcgctatttccgat

SEQ ID NO: 103844 - DNA, 25 bp, Mus musculus
acagtgcgagttctccaaacaggag

SEQ ID NO: 103845 - DNA, 25 bp, Mus musculus
acagtgcgagttggctatttccgat

SEQ ID NO: 103846 - DNA, 25 bp, Mus musculus
acagtgcgagttgtccaaacaggag

SEQ ID NO: 103847 - DNA, 25 bp, Mus musculus
acagtgcgcatgctcggtagctgca

SEQ ID NO: 103848 - DNA, 25 bp, Mus musculus
acagtgcgcatggtcggtagctgca

SEQ ID NO: 103849 - DNA, 25 bp, Mus musculus
acagtgcgctctcatctcagggtag

SEQ ID NO: 103850 - DNA, 25 bp, Mus musculus
acagtgcgctctgatctcagggtag

SEQ ID NO: 103851 - DNA, 25 bp, Mus musculus
acagtgcgcttgagtgatggacttc

SEQ ID NO: 103852 - DNA, 25 bp, Mus musculus
acagtgcgcttgtgtgatggacttc

SEQ ID NO: 103853 - DNA, 25 bp, Mus musculus
acagtgcgtcctcgagccggactga

SEQ ID NO: 103854 - DNA, 25 bp, Mus musculus
acagtgcgtcctggagccggactga

SEQ ID NO: 103855 - DNA, 25 bp, Mus musculus
acagtgctaatgcatcctgggtgca

SEQ ID NO: 103856 - DNA, 25 bp, Mus musculus
acagtgctaatggatcctgggtgca

SEQ ID NO: 103857 - DNA, 25 bp, Mus musculus
acagtgctcacgaagcgcagcttaa

SEQ ID NO: 103858 - DNA, 25 bp, Mus musculus
acagtgctcacgtagcgcagcttaa

SEQ ID NO: 103859 - DNA, 25 bp, Mus musculus
acagtgctcaggctttactaaagag

SEQ ID NO: 103860 - DNA, 25 bp, Mus musculus
acagtgctcagggtttactaaagag

SEQ ID NO: 103861 - DNA, 25 bp, Mus musculus
acagtgctcggacgatgcctttgag

SEQ ID NO: 103862 - DNA, 25 bp, Mus musculus
acagtgctcggaggatgcctttgag

SEQ ID NO: 103863 - DNA, 25 bp, Mus musculus
acagtgctctaaccattaggttttt

SEQ ID NO: 103864 - DNA, 25 bp, Mus musculus
acagtgctctaagcattaggttttt

SEQ ID NO: 103865 - DNA, 25 bp, Mus musculus
acagtgctctatcagggccctgtgc

SEQ ID NO: 103866 - DNA, 25 bp, Mus musculus
acagtgctctatgagggccctgtgc

SEQ ID NO: 103867 - DNA, 25 bp, Mus musculus
acagtgctctccaagggcttatttt

SEQ ID NO: 103868 - DNA, 25 bp, Mus musculus
acagtgctctcctagggcttatttt

SEQ ID NO: 103869 - DNA, 25 bp, Mus musculus
acagtgctctgcacatagtaggtgc

SEQ ID NO: 103870 - DNA, 25 bp, Mus musculus
acagtgctctgctcatagtaggtgc

SEQ ID NO: 103871 - DNA, 25 bp, Mus musculus
acagtgctgaacacctacttcttgt

SEQ ID NO: 103872 - DNA, 25 bp, Mus musculus
acagtgctgaactcctacttcttgt

SEQ ID NO: 103873 - DNA, 25 bp, Mus musculus
acagtgctgcacaaacaagacgaga

SEQ ID NO: 103874 - DNA, 25 bp, Mus musculus
acagtgctgcactaacaagacgaga

SEQ ID NO: 103875 - DNA, 25 bp, Mus musculus
acagtgctgcatagcgtctgggtga

SEQ ID NO: 103876 - DNA, 25 bp, Mus musculus
acagtgctgcattgcgtctgggtga

SEQ ID NO: 103877 - DNA, 25 bp, Mus musculus
acagtgctgctcaaccaagtttggg

SEQ ID NO: 103878 - DNA, 25 bp, Mus musculus
acagtgctgctcaattttgggccac

SEQ ID NO: 103879 - DNA, 25 bp, Mus musculus
acagtgctgctctaccaagtttggg

SEQ ID NO: 103880 - DNA, 25 bp, Mus musculus
acagtgctgctctattttgggccac

SEQ ID NO: 103881 - DNA, 25 bp, Mus musculus
acagtgctggacatgctggaaaccc

SEQ ID NO: 103882 - DNA, 25 bp, Mus musculus
acagtgctggacttgctggaaaccc

SEQ ID NO: 103883 - DNA, 25 bp, Mus musculus
acagtgctggcccaggtgaacatta

SEQ ID NO: 103884 - DNA, 25 bp, Mus musculus
acagtgctggccgaggtgaacatta

SEQ ID NO: 103885 - DNA, 25 bp, Mus musculus
acagtgctgggtagccacacatggg

SEQ ID NO: 103886 - DNA, 25 bp, Mus musculus
acagtgctgggttgccacacatggg

SEQ ID NO: 103887 - DNA, 25 bp, Mus musculus
acagtgctgtatatctctgtgcgga

SEQ ID NO: 103888 - DNA, 25 bp, Mus musculus
acagtgctgtatttctctgtgcgga

SEQ ID NO: 103889 - DNA, 25 bp, Mus musculus
acagtgctgtggaagatggctcctt

SEQ ID NO: 103890 - DNA, 25 bp, Mus musculus
acagtgctgtggtagatggctcctt

SEQ ID NO: 103891 - DNA, 25 bp, Mus musculus
acagtgcttcttatacattcatttg

SEQ ID NO: 103892 - DNA, 25 bp, Mus musculus
acagtgcttcttttacattcatttg

SEQ ID NO: 103893 - DNA, 25 bp, Mus musculus
acagtgcttgacctctgagtcattg

SEQ ID NO: 103894 - DNA, 25 bp, Mus musculus
acagtgcttgacgtctgagtcattg

SEQ ID NO: 103895 - DNA, 25 bp, Mus musculus
acagtgcttgctctttctgttttca

SEQ ID NO: 103896 - DNA, 25 bp, Mus musculus
acagtgcttgctgtttctgttttca

SEQ ID NO: 103897 - DNA, 25 bp, Mus musculus
acagtgctttctcttgtgttggcat

SEQ ID NO: 103898 - DNA, 25 bp, Mus musculus
acagtgctttctgttgtgttggcat

SEQ ID NO: 103899 - DNA, 25 bp, Mus musculus
acagtggaatcaagtcggaagatgt

SEQ ID NO: 103900 - DNA, 25 bp, Mus musculus
acagtggaatcatgtcggaagatgt

SEQ ID NO: 103901 - DNA, 25 bp, Mus musculus
acagtggaatgtaagggcactcact

SEQ ID NO: 103902 - DNA, 25 bp, Mus musculus
acagtggaatgttagggcactcact

SEQ ID NO: 103903 - DNA, 25 bp, Mus musculus
acagtggacaacagcctcgggaaga

SEQ ID NO: 103904 - DNA, 25 bp, Mus musculus
acagtggacaactgcctcgggaaga

SEQ ID NO: 103905 - DNA, 25 bp, Mus musculus
acagtggacgtaagctggtccccgt

SEQ ID NO: 103906 - DNA, 25 bp, Mus musculus
acagtggacgtatgctggtccccgt

SEQ ID NO: 103907 - DNA, 25 bp, Mus musculus
acagtggacttgagcttacagctaa

SEQ ID NO: 103908 - DNA, 25 bp, Mus musculus
acagtggacttgtgcttacagctaa

SEQ ID NO: 103909 - DNA, 25 bp, Mus musculus
acagtggagacacatgtggcccata

SEQ ID NO: 103910 - DNA, 25 bp, Mus musculus
acagtggagacagatgtggcccata

SEQ ID NO: 103911 - DNA, 25 bp, Mus musculus
acagtggagcaaaacatctgccaag

SEQ ID NO: 103912 - DNA, 25 bp, Mus musculus
acagtggagcaatacatctgccaag

SEQ ID NO: 103913 - DNA, 25 bp, Mus musculus
acagtggagcacacccagtgggtct

SEQ ID NO: 103914 - DNA, 25 bp, Mus musculus
acagtggagcactcccagtgggtct

SEQ ID NO: 103915 - DNA, 25 bp, Mus musculus
acagtggatattaacctctgtcccc

SEQ ID NO: 103916 - DNA, 25 bp, Mus musculus
acagtggatatttacctctgtcccc

SEQ ID NO: 103917 - DNA, 25 bp, Mus musculus
acagtggatcacattgccaacccaa

SEQ ID NO: 103918 - DNA, 25 bp, Mus musculus
acagtggatcactttgccaacccaa

SEQ ID NO: 103919 - DNA, 25 bp, Mus musculus
acagtggatctgaatgagctactcc

SEQ ID NO: 103920 - DNA, 25 bp, Mus musculus
acagtggatctgtatgagctactcc

SEQ ID NO: 103921 - DNA, 25 bp, Mus musculus
acagtggatgtcatcagtgtggccc

SEQ ID NO: 103922 - DNA, 25 bp, Mus musculus
acagtggatgtcttcagtgtggccc

SEQ ID NO: 103923 - DNA, 25 bp, Mus musculus
acagtggcaataacaatattaccta

SEQ ID NO: 103924 - DNA, 25 bp, Mus musculus
acagtggcaatatcaatattaccta

SEQ ID NO: 103925 - DNA, 25 bp, Mus musculus
acagtggcactgattagccctgata

SEQ ID NO: 103926 - DNA, 25 bp, Mus musculus
acagtggcactgcattcctcagata

SEQ ID NO: 103927 - DNA, 25 bp, Mus musculus
acagtggcactggattcctcagata

SEQ ID NO: 103928 - DNA, 25 bp, Mus musculus
acagtggcactgtttagccctgata

SEQ ID NO: 103929 - DNA, 25 bp, Mus musculus
acagtggcagccatgaacctcctat

SEQ ID NO: 103930 - DNA, 25 bp, Mus musculus
acagtggcagccttgaacctcctat

SEQ ID NO: 103931 - DNA, 25 bp, Mus musculus
acagtggcagctatgaggacggcaa

SEQ ID NO: 103932 - DNA, 25 bp, Mus musculus
acagtggcagctttgaggacggcaa

SEQ ID NO: 103933 - DNA, 25 bp, Mus musculus
acagtggcatacacagtcccaaaga

SEQ ID NO: 103934 - DNA, 25 bp, Mus musculus
acagtggcatactcagtcccaaaga

SEQ ID NO: 103935 - DNA, 25 bp, Mus musculus
acagtggccacaactcatagttgag

SEQ ID NO: 103936 - DNA, 25 bp, Mus musculus
acagtggccacatctcatagttgag

SEQ ID NO: 103937 - DNA, 25 bp, Mus musculus
acagtggccaggctactgggtcctt

SEQ ID NO: 103938 - DNA, 25 bp, Mus musculus
acagtggccagggtactgggtcctt

SEQ ID NO: 103939 - DNA, 25 bp, Mus musculus
acagtggccatcctttgcaatattg

SEQ ID NO: 103940 - DNA, 25 bp, Mus musculus
acagtggccatcgtttgcaatattg

SEQ ID NO: 103941 - DNA, 25 bp, Mus musculus
acagtggcccatcatagaatcccca

SEQ ID NO: 103942 - DNA, 25 bp, Mus musculus
acagtggcccatgatagaatcccca

SEQ ID NO: 103943 - DNA, 25 bp, Mus musculus
acagtggccctaagtacctgcaagg

SEQ ID NO: 103944 - DNA, 25 bp, Mus musculus
acagtggccctatgtacctgcaagg

SEQ ID NO: 103945 - DNA, 25 bp, Mus musculus
acagtggccctcaagaaaatagaat

SEQ ID NO: 103946 - DNA, 25 bp, Mus musculus
acagtggccctctagaaaatagaat

SEQ ID NO: 103947 - DNA, 25 bp, Mus musculus
acagtggccgaccagatccgcttct

SEQ ID NO: 103948 - DNA, 25 bp, Mus musculus
acagtggccgacgagatccgcttct

SEQ ID NO: 103949 - DNA, 25 bp, Mus musculus
acagtggctacgagagtgcctacaa

SEQ ID NO: 103950 - DNA, 25 bp, Mus musculus
acagtggctacgtgagtgcctacaa

SEQ ID NO: 103951 - DNA, 25 bp, Mus musculus
acagtggctagaattctccagatag

SEQ ID NO: 103952 - DNA, 25 bp, Mus musculus
acagtggctagatttctccagatag

SEQ ID NO: 103953 - DNA, 25 bp, Mus musculus
acagtggctatgagacacataaggc

SEQ ID NO: 103954 - DNA, 25 bp, Mus musculus
acagtggctatgagtcattcatgga

SEQ ID NO: 103955 - DNA, 25 bp, Mus musculus
acagtggctatgtgacacataaggc

SEQ ID NO: 103956 - DNA, 25 bp, Mus musculus
acagtggctatgtgtcattcatgga

SEQ ID NO: 103957 - DNA, 25 bp, Mus musculus
acagtggctcagacttgttacctca

SEQ ID NO: 103958 - DNA, 25 bp, Mus musculus
acagtggctcagtcttgttacctca

SEQ ID NO: 103959 - DNA, 25 bp, Mus musculus
acagtggctcataacaacggtcttg

SEQ ID NO: 103960 - DNA, 25 bp, Mus musculus
acagtggctcattacaacggtcttg

SEQ ID NO: 103961 - DNA, 25 bp, Mus musculus
acagtggctctcacaggagaagctt

SEQ ID NO: 103962 - DNA, 25 bp, Mus musculus
acagtggctctctcaggagaagctt

SEQ ID NO: 103963 - DNA, 25 bp, Mus musculus
acagtggctgtaatccgctcgtgga

SEQ ID NO: 103964 - DNA, 25 bp, Mus musculus
acagtggctgtattccgctcgtgga

SEQ ID NO: 103965 - DNA, 25 bp, Mus musculus
acagtggctgtcaactcggagcagg

SEQ ID NO: 103966 - DNA, 25 bp, Mus musculus
acagtggctgtctactcggagcagg

SEQ ID NO: 103967 - DNA, 25 bp, Mus musculus
acagtggcttccagatggtggtgca

SEQ ID NO: 103968 - DNA, 25 bp, Mus musculus
acagtggcttcctgatggtggtgca

SEQ ID NO: 103969 - DNA, 25 bp, Mus musculus
acagtggcttggcttacacagcttg

SEQ ID NO: 103970 - DNA, 25 bp, Mus musculus
acagtggcttgggttacacagcttg

SEQ ID NO: 103971 - DNA, 25 bp, Mus musculus
acagtggcttttatgggcactcaca

SEQ ID NO: 103972 - DNA, 25 bp, Mus musculus
acagtggcttttttgggcactcaca

SEQ ID NO: 103973 - DNA, 25 bp, Mus musculus
acagtgggaaatacttcctcacagt

SEQ ID NO: 103974 - DNA, 25 bp, Mus musculus
acagtgggaaattcttcctcacagt

SEQ ID NO: 103975 - DNA, 25 bp, Mus musculus
acagtgggaaccaagcctcacaaga

SEQ ID NO: 103976 - DNA, 25 bp, Mus musculus
acagtgggaacctagcctcacaaga

SEQ ID NO: 103977 - DNA, 25 bp, Mus musculus
acagtgggacccacgcgttatgcac

SEQ ID NO: 103978 - DNA, 25 bp, Mus musculus
acagtgggaccctcgcgttatgcac

SEQ ID NO: 103979 - DNA, 25 bp, Mus musculus
acagtgggcaagctgcccttcaggc

SEQ ID NO: 103980 - DNA, 25 bp, Mus musculus
acagtgggcaaggtgcccttcaggc

SEQ ID NO: 103981 - DNA, 25 bp, Mus musculus
acagtgggcagaagctcgcagcgac

SEQ ID NO: 103982 - DNA, 25 bp, Mus musculus
acagtgggcagatgctcgcagcgac

SEQ ID NO: 103983 - DNA, 25 bp, Mus musculus
acagtgggcataacctccttttaat

SEQ ID NO: 103984 - DNA, 25 bp, Mus musculus
acagtgggcatatcctccttttaat

SEQ ID NO: 103985 - DNA, 25 bp, Mus musculus
acagtgggcattcctaggcctgtgc

SEQ ID NO: 103986 - DNA, 25 bp, Mus musculus
acagtgggcattgctaggcctgtgc

SEQ ID NO: 103987 - DNA, 25 bp, Mus musculus
acagtgggcccaactgaccttcaag

SEQ ID NO: 103988 - DNA, 25 bp, Mus musculus
acagtgggcccacaggtgctgattt

SEQ ID NO: 103989 - DNA, 25 bp, Mus musculus
acagtgggcccagaggtgctgattt

SEQ ID NO: 103990 - DNA, 25 bp, Mus musculus
acagtgggcccatctgaccttcaag

SEQ ID NO: 103991 - DNA, 25 bp, Mus musculus
acagtgggcctgagctttaatggca

SEQ ID NO: 103992 - DNA, 25 bp, Mus musculus
acagtgggcctgtgctttaatggca

SEQ ID NO: 103993 - DNA, 25 bp, Mus musculus
acagtgggctgcctggcttaacgac

SEQ ID NO: 103994 - DNA, 25 bp, Mus musculus
acagtgggctgcgtggcttaacgac

SEQ ID NO: 103995 - DNA, 25 bp, Mus musculus
acagtgggctggacctctgacatcc

SEQ ID NO: 103996 - DNA, 25 bp, Mus musculus
acagtgggctggtcctctgacatcc

SEQ ID NO: 103997 - DNA, 25 bp, Mus musculus
acagtgggctgtcccatcaccgggt

SEQ ID NO: 103998 - DNA, 25 bp, Mus musculus
acagtgggctgtgccatcaccgggt

SEQ ID NO: 103999 - DNA, 25 bp, Mus musculus
acagtggtacttcatcagtcctgca

SEQ ID NO: 104000 - DNA, 25 bp, Mus musculus
acagtggtacttgatcagtcctgca

SEQ ID NO: 104001 - DNA, 25 bp, Mus musculus
acagtggtatctccagttctgaagt

SEQ ID NO: 104002 - DNA, 25 bp, Mus musculus
acagtggtatctgcagttctgaagt

SEQ ID NO: 104003 - DNA, 25 bp, Mus musculus
acagtggtcacaattgccttggccg

SEQ ID NO: 104004 - DNA, 25 bp, Mus musculus
acagtggtcacatttgccttggccg

SEQ ID NO: 104005 - DNA, 25 bp, Mus musculus
acagtggtcagtccagcaggcctta

SEQ ID NO: 104006 - DNA, 25 bp, Mus musculus
acagtggtcagtgcagcaggcctta

SEQ ID NO: 104007 - DNA, 25 bp, Mus musculus
acagtggtccaccttcaggtggcta

SEQ ID NO: 104008 - DNA, 25 bp, Mus musculus
acagtggtccacgttcaggtggcta

SEQ ID NO: 104009 - DNA, 25 bp, Mus musculus
acagtggtcctaagaacagcctcca

SEQ ID NO: 104010 - DNA, 25 bp, Mus musculus
acagtggtcctatgaacagcctcca

SEQ ID NO: 104011 - DNA, 25 bp, Mus musculus
acagtggtcctgacacagacttcct

SEQ ID NO: 104012 - DNA, 25 bp, Mus musculus
acagtggtcctgacagtatgctgga

SEQ ID NO: 104013 - DNA, 25 bp, Mus musculus
acagtggtcctgtcacagacttcct

SEQ ID NO: 104014 - DNA, 25 bp, Mus musculus
acagtggtcctgtcagtatgctgga

SEQ ID NO: 104015 - DNA, 25 bp, Mus musculus
acagtggtctctccaggtctgggac

SEQ ID NO: 104016 - DNA, 25 bp, Mus musculus
acagtggtctctgcaggtctgggac

SEQ ID NO: 104017 - DNA, 25 bp, Mus musculus
acagtggtgctgaatggaagcaaat

SEQ ID NO: 104018 - DNA, 25 bp, Mus musculus
acagtggtgctgagaacgttgcagt

SEQ ID NO: 104019 - DNA, 25 bp, Mus musculus
acagtggtgctgatcgcagctctga

SEQ ID NO: 104020 - DNA, 25 bp, Mus musculus
acagtggtgctgtatggaagcaaat

SEQ ID NO: 104021 - DNA, 25 bp, Mus musculus
acagtggtgctgtgaacgttgcagt

SEQ ID NO: 104022 - DNA, 25 bp, Mus musculus
acagtggtgctgttcgcagctctga

SEQ ID NO: 104023 - DNA, 25 bp, Mus musculus
acagtggtggccagtcaggacctat

SEQ ID NO: 104024 - DNA, 25 bp, Mus musculus
acagtggtggccatacttggattcc

SEQ ID NO: 104025 - DNA, 25 bp, Mus musculus
acagtggtggcctgtcaggacctat

SEQ ID NO: 104026 - DNA, 25 bp, Mus musculus
acagtggtggccttacttggattcc

SEQ ID NO: 104027 - DNA, 25 bp, Mus musculus
acagtggttacaacgtgtccggaga

SEQ ID NO: 104028 - DNA, 25 bp, Mus musculus
acagtggttacatcgtgtccggaga

SEQ ID NO: 104029 - DNA, 25 bp, Mus musculus
acagtggtttctctcttggtggcat

SEQ ID NO: 104030 - DNA, 25 bp, Mus musculus
acagtggtttctgtcttggtggcat

SEQ ID NO: 104031 - DNA, 25 bp, Mus musculus
acagtgtaagaaacgggaatctggc

SEQ ID NO: 104032 - DNA, 25 bp, Mus musculus
acagtgtaagaatcgggaatctggc

SEQ ID NO: 104033 - DNA, 25 bp, Mus musculus
acagtgtaccatacagggagggcat

SEQ ID NO: 104034 - DNA, 25 bp, Mus musculus
acagtgtaccattcagggagggcat

SEQ ID NO: 104035 - DNA, 25 bp, Mus musculus
acagtgtacccaagcttgatctgtc

SEQ ID NO: 104036 - DNA, 25 bp, Mus musculus
acagtgtacccatgcttgatctgtc

SEQ ID NO: 104037 - DNA, 25 bp, Mus musculus
acagtgtacctacttggtgagctcc

SEQ ID NO: 104038 - DNA, 25 bp, Mus musculus
acagtgtacctagttggtgagctcc

SEQ ID NO: 104039 - DNA, 25 bp, Mus musculus
acagtgtaccttcattcctgccatt

SEQ ID NO: 104040 - DNA, 25 bp, Mus musculus
acagtgtaccttgattcctgccatt

SEQ ID NO: 104041 - DNA, 25 bp, Mus musculus
acagtgtactctagcctttctttct

SEQ ID NO: 104042 - DNA, 25 bp, Mus musculus
acagtgtactcttgcctttctttct

SEQ ID NO: 104043 - DNA, 25 bp, Mus musculus
acagtgtactgaatctgcttggtaa

SEQ ID NO: 104044 - DNA, 25 bp, Mus musculus
acagtgtactgattctgcttggtaa

SEQ ID NO: 104045 - DNA, 25 bp, Mus musculus
acagtgtaggcccatgaatgctgca

SEQ ID NO: 104046 - DNA, 25 bp, Mus musculus
acagtgtaggccgatgaatgctgca

SEQ ID NO: 104047 - DNA, 25 bp, Mus musculus
acagtgtatccacccagggtcatta

SEQ ID NO: 104048 - DNA, 25 bp, Mus musculus
acagtgtatccagccagggtcatta

SEQ ID NO: 104049 - DNA, 25 bp, Mus musculus
acagtgtatgcaagtccattctctc

SEQ ID NO: 104050 - DNA, 25 bp, Mus musculus
acagtgtatgcatgtccattctctc

SEQ ID NO: 104051 - DNA, 25 bp, Mus musculus
acagtgtatgtgacctgtctcctat

SEQ ID NO: 104052 - DNA, 25 bp, Mus musculus
acagtgtatgtgtcctgtctcctat

SEQ ID NO: 104053 - DNA, 25 bp, Mus musculus
acagtgtatgttagtgtgtgtgaca

SEQ ID NO: 104054 - DNA, 25 bp, Mus musculus
acagtgtatgtttgtgtgtgtgaca

SEQ ID NO: 104055 - DNA, 25 bp, Mus musculus
acagtgtattttactcatcctgaaa

SEQ ID NO: 104056 - DNA, 25 bp, Mus musculus
acagtgtatttttctcatcctgaaa

SEQ ID NO: 104057 - DNA, 25 bp, Mus musculus
acagtgtcacccctctaaaaggaga

SEQ ID NO: 104058 - DNA, 25 bp, Mus musculus
acagtgtcacccgtctaaaaggaga

SEQ ID NO: 104059 - DNA, 25 bp, Mus musculus
acagtgtcacggctgtcgtcacaga

SEQ ID NO: 104060 - DNA, 25 bp, Mus musculus
acagtgtcacgggtgtcgtcacaga

SEQ ID NO: 104061 - DNA, 25 bp, Mus musculus
acagtgtcactaatccttgatggag

SEQ ID NO: 104062 - DNA, 25 bp, Mus musculus
acagtgtcactattccttgatggag

SEQ ID NO: 104063 - DNA, 25 bp, Mus musculus
acagtgtcactgcaaggccgaggct

SEQ ID NO: 104064 - DNA, 25 bp, Mus musculus
acagtgtcactggaaggccgaggct

SEQ ID NO: 104065 - DNA, 25 bp, Mus musculus
acagtgtcagctatatgtgttacaa

SEQ ID NO: 104066 - DNA, 25 bp, Mus musculus
acagtgtcagctttatgtgttacaa

SEQ ID NO: 104067 - DNA, 25 bp, Mus musculus
acagtgtcagttcttagtggagtct

SEQ ID NO: 104068 - DNA, 25 bp, Mus musculus
acagtgtcagttgttagtggagtct

SEQ ID NO: 104069 - DNA, 25 bp, Mus musculus
acagtgtcatacaaactccccatgc

SEQ ID NO: 104070 - DNA, 25 bp, Mus musculus
acagtgtcatactaactccccatgc

SEQ ID NO: 104071 - DNA, 25 bp, Mus musculus
acagtgtcattcagatcccattata

SEQ ID NO: 104072 - DNA, 25 bp, Mus musculus
acagtgtcattctgatcccattata

SEQ ID NO: 104073 - DNA, 25 bp, Mus musculus
acagtgtcattgcagttctacagaa

SEQ ID NO: 104074 - DNA, 25 bp, Mus musculus
acagtgtcattggagttctacagaa

SEQ ID NO: 104075 - DNA, 25 bp, Mus musculus
acagtgtccacaacattttatcctc

SEQ ID NO: 104076 - DNA, 25 bp, Mus musculus
acagtgtccacatcattttatcctc

SEQ ID NO: 104077 - DNA, 25 bp, Mus musculus
acagtgtccagtacaagctgcctga

SEQ ID NO: 104078 - DNA, 25 bp, Mus musculus
acagtgtccagttcaagctgcctga

SEQ ID NO: 104079 - DNA, 25 bp, Mus musculus
acagtgtcccatagaatggtttcac

SEQ ID NO: 104080 - DNA, 25 bp, Mus musculus
acagtgtcccattgaatggtttcac

SEQ ID NO: 104081 - DNA, 25 bp, Mus musculus
acagtgtccccgagatcctagatgc

SEQ ID NO: 104082 - DNA, 25 bp, Mus musculus
acagtgtccccgatgaagagtctaa

SEQ ID NO: 104083 - DNA, 25 bp, Mus musculus
acagtgtccccgtgatcctagatgc

SEQ ID NO: 104084 - DNA, 25 bp, Mus musculus
acagtgtccccgttgaagagtctaa

SEQ ID NO: 104085 - DNA, 25 bp, Mus musculus
acagtgtcctccctaggtaacacaa

SEQ ID NO: 104086 - DNA, 25 bp, Mus musculus
acagtgtcctccgtaggtaacacaa

SEQ ID NO: 104087 - DNA, 25 bp, Mus musculus
acagtgtcctctagtttttcaagtt

SEQ ID NO: 104088 - DNA, 25 bp, Mus musculus
acagtgtcctcttgtttttcaagtt

SEQ ID NO: 104089 - DNA, 25 bp, Mus musculus
acagtgtcctgtcttgagccccagt

SEQ ID NO: 104090 - DNA, 25 bp, Mus musculus
acagtgtcctgtgttgagccccagt

SEQ ID NO: 104091 - DNA, 25 bp, Mus musculus
acagtgtctatcaatacccctgaga

SEQ ID NO: 104092 - DNA, 25 bp, Mus musculus
acagtgtctatctatacccctgaga

SEQ ID NO: 104093 - DNA, 25 bp, Mus musculus
acagtgtctcaccatatacgtaaat

SEQ ID NO: 104094 - DNA, 25 bp, Mus musculus
acagtgtctcacgatatacgtaaat

SEQ ID NO: 104095 - DNA, 25 bp, Mus musculus
acagtgtctgatactttaaactctt

SEQ ID NO: 104096 - DNA, 25 bp, Mus musculus
acagtgtctgattctttaaactctt

SEQ ID NO: 104097 - DNA, 25 bp, Mus musculus
acagtgtctggtccaggctcctgga

SEQ ID NO: 104098 - DNA, 25 bp, Mus musculus
acagtgtctggtgcaggctcctgga

SEQ ID NO: 104099 - DNA, 25 bp, Mus musculus
acagtgtctttaatatctcaaaggg

SEQ ID NO: 104100 - DNA, 25 bp, Mus musculus
acagtgtctttattatctcaaaggg

SEQ ID NO: 104101 - DNA, 25 bp, Mus musculus
acagtgtgacagatctccgagttac

SEQ ID NO: 104102 - DNA, 25 bp, Mus musculus
acagtgtgacagttctccgagttac

SEQ ID NO: 104103 - DNA, 25 bp, Mus musculus
acagtgtgagtgcttcttagtgcaa

SEQ ID NO: 104104 - DNA, 25 bp, Mus musculus
acagtgtgagtggttcttagtgcaa

SEQ ID NO: 104105 - DNA, 25 bp, Mus musculus
acagtgtgatccacagcgctggcat

SEQ ID NO: 104106 - DNA, 25 bp, Mus musculus
acagtgtgatcctcagcgctggcat

SEQ ID NO: 104107 - DNA, 25 bp, Mus musculus
acagtgtgccagactttcatgacat

SEQ ID NO: 104108 - DNA, 25 bp, Mus musculus
acagtgtgccagtctttcatgacat

SEQ ID NO: 104109 - DNA, 25 bp, Mus musculus
acagtgtgccatctgcccaatagaa

SEQ ID NO: 104110 - DNA, 25 bp, Mus musculus
acagtgtgccatgtgcccaatagaa

SEQ ID NO: 104111 - DNA, 25 bp, Mus musculus
acagtgtgcgcaacagcttcgccaa

SEQ ID NO: 104112 - DNA, 25 bp, Mus musculus
acagtgtgcgcaagcgtacggcttc

SEQ ID NO: 104113 - DNA, 25 bp, Mus musculus
acagtgtgcgcatcagcttcgccaa

SEQ ID NO: 104114 - DNA, 25 bp, Mus musculus
acagtgtgcgcatgcgtacggcttc

SEQ ID NO: 104115 - DNA, 25 bp, Mus musculus
acagtgtgctcacctgacattttgg

SEQ ID NO: 104116 - DNA, 25 bp, Mus musculus
acagtgtgctcagctgacattttgg

SEQ ID NO: 104117 - DNA, 25 bp, Mus musculus
acagtgtgctgtcttcctagtacta

SEQ ID NO: 104118 - DNA, 25 bp, Mus musculus
acagtgtgctgtgttcctagtacta

SEQ ID NO: 104119 - DNA, 25 bp, Mus musculus
acagtgtggaacagtgtgacacaca

SEQ ID NO: 104120 - DNA, 25 bp, Mus musculus
acagtgtggaactgtgtgacacaca

SEQ ID NO: 104121 - DNA, 25 bp, Mus musculus
acagtgtggacacccttgccttgag

SEQ ID NO: 104122 - DNA, 25 bp, Mus musculus
acagtgtggacagccttgccttgag

SEQ ID NO: 104123 - DNA, 25 bp, Mus musculus
acagtgtggagacgcaggtgctgca

SEQ ID NO: 104124 - DNA, 25 bp, Mus musculus
acagtgtggagaggcaggtgctgca

SEQ ID NO: 104125 - DNA, 25 bp, Mus musculus
acagtgtggagcaggctcagtttta

SEQ ID NO: 104126 - DNA, 25 bp, Mus musculus
acagtgtggagctggctcagtttta

SEQ ID NO: 104127 - DNA, 25 bp, Mus musculus
acagtgtgggcgagcactgacagcc

SEQ ID NO: 104128 - DNA, 25 bp, Mus musculus
acagtgtgggcgtgcactgacagcc

SEQ ID NO: 104129 - DNA, 25 bp, Mus musculus
acagtgtggtggcaacttcctagga

SEQ ID NO: 104130 - DNA, 25 bp, Mus musculus
acagtgtggtgggaacttcctagga

SEQ ID NO: 104131 - DNA, 25 bp, Mus musculus
acagtgtggtgtctcttggctagat

SEQ ID NO: 104132 - DNA, 25 bp, Mus musculus
acagtgtggtgtgtcttggctagat

SEQ ID NO: 104133 - DNA, 25 bp, Mus musculus
acagtgtgtctcaattctctatcaa

SEQ ID NO: 104134 - DNA, 25 bp, Mus musculus
acagtgtgtctctattctctatcaa

SEQ ID NO: 104135 - DNA, 25 bp, Mus musculus
acagtgtgtgccacatcaccgctaa

SEQ ID NO: 104136 - DNA, 25 bp, Mus musculus
acagtgtgtgcctcatcaccgctaa

SEQ ID NO: 104137 - DNA, 25 bp, Mus musculus
acagtgtgtgctctagaatgctcag

SEQ ID NO: 104138 - DNA, 25 bp, Mus musculus
acagtgtgtgctgtagaatgctcag

SEQ ID NO: 104139 - DNA, 25 bp, Mus musculus
acagtgtgtggcagagcgcttcagt

SEQ ID NO: 104140 - DNA, 25 bp, Mus musculus
acagtgtgtggctgagcgcttcagt

SEQ ID NO: 104141 - DNA, 25 bp, Mus musculus
acagtgtgtgtcagtagctctgtgg

SEQ ID NO: 104142 - DNA, 25 bp, Mus musculus
acagtgtgtgtctgtagctctgtgg

SEQ ID NO: 104143 - DNA, 25 bp, Mus musculus
acagtgtgttaaccaacgccggcaa

SEQ ID NO: 104144 - DNA, 25 bp, Mus musculus
acagtgtgttaagcaacgccggcaa

SEQ ID NO: 104145 - DNA, 25 bp, Mus musculus
acagtgttaaacagtctgtctgtct

SEQ ID NO: 104146 - DNA, 25 bp, Mus musculus
acagtgttaaactgtctgtctgtct

SEQ ID NO: 104147 - DNA, 25 bp, Mus musculus
acagtgttcatacttttaagtcttt

SEQ ID NO: 104148 - DNA, 25 bp, Mus musculus
acagtgttcatagttttaagtcttt

SEQ ID NO: 104149 - DNA, 25 bp, Mus musculus
acagtgttcatcaattaagcatttt

SEQ ID NO: 104150 - DNA, 25 bp, Mus musculus
acagtgttcatctattaagcatttt

SEQ ID NO: 104151 - DNA, 25 bp, Mus musculus
acagtgttcccacatacatgagcat

SEQ ID NO: 104152 - DNA, 25 bp, Mus musculus
acagtgttcccagatacatgagcat

SEQ ID NO: 104153 - DNA, 25 bp, Mus musculus
acagtgttccttaagcagtgtgttg

SEQ ID NO: 104154 - DNA, 25 bp, Mus musculus
acagtgttccttacttcctgtggaa

SEQ ID NO: 104155 - DNA, 25 bp, Mus musculus
acagtgttcctttagcagtgtgttg

SEQ ID NO: 104156 - DNA, 25 bp, Mus musculus
acagtgttcctttcttcctgtggaa

SEQ ID NO: 104157 - DNA, 25 bp, Mus musculus
acagtgttctatccagagggcttcc

SEQ ID NO: 104158 - DNA, 25 bp, Mus musculus
acagtgttctatgcagagggcttcc

SEQ ID NO: 104159 - DNA, 25 bp, Mus musculus
acagtgttctctctatcacctaaaa

SEQ ID NO: 104160 - DNA, 25 bp, Mus musculus
acagtgttctctgtatcacctaaaa

SEQ ID NO: 104161 - DNA, 25 bp, Mus musculus
acagtgttcttacctcctgggtgat

SEQ ID NO: 104162 - DNA, 25 bp, Mus musculus
acagtgttcttagctcctgggtgat

SEQ ID NO: 104163 - DNA, 25 bp, Mus musculus
acagtgttcttgaccagtgttggta

SEQ ID NO: 104164 - DNA, 25 bp, Mus musculus
acagtgttcttgctctataaaccgt

SEQ ID NO: 104165 - DNA, 25 bp, Mus musculus
acagtgttcttggtctataaaccgt

SEQ ID NO: 104166 - DNA, 25 bp, Mus musculus
acagtgttcttgtccagtgttggta

SEQ ID NO: 104167 - DNA, 25 bp, Mus musculus
acagtgttgaacagctcatcagaaa

SEQ ID NO: 104168 - DNA, 25 bp, Mus musculus
acagtgttgaactgctcatcagaaa

SEQ ID NO: 104169 - DNA, 25 bp, Mus musculus
acagtgttgctacaagtgtgtattc

SEQ ID NO: 104170 - DNA, 25 bp, Mus musculus
acagtgttgctagaagtgtgtattc

SEQ ID NO: 104171 - DNA, 25 bp, Mus musculus
acagtgttgctcacctagaatatag

SEQ ID NO: 104172 - DNA, 25 bp, Mus musculus
acagtgttgctctcctagaatatag

SEQ ID NO: 104173 - DNA, 25 bp, Mus musculus
acagtgttggagactcctgagcgct

SEQ ID NO: 104174 - DNA, 25 bp, Mus musculus
acagtgttggagtctcctgagcgct

SEQ ID NO: 104175 - DNA, 25 bp, Mus musculus
acagtgtttactctggtcccctgat

SEQ ID NO: 104176 - DNA, 25 bp, Mus musculus
acagtgtttactgtggtcccctgat

SEQ ID NO: 104177 - DNA, 25 bp, Mus musculus
acagtgtttcatatgacccattttt

SEQ ID NO: 104178 - DNA, 25 bp, Mus musculus
acagtgtttcatttgacccattttt

SEQ ID NO: 104179 - DNA, 25 bp, Mus musculus
acagtgtttcctagttaagatttat

SEQ ID NO: 104180 - DNA, 25 bp, Mus musculus
acagtgtttccttgttaagatttat

SEQ ID NO: 104181 - DNA, 25 bp, Mus musculus
acagtgtttgtacagtggctgcagc

SEQ ID NO: 104182 - DNA, 25 bp, Mus musculus
acagtgtttgtagagtggctgcagc

SEQ ID NO: 104183 - DNA, 25 bp, Mus musculus
acagtgtttgtgcacccctatgagg

SEQ ID NO: 104184 - DNA, 25 bp, Mus musculus
acagtgtttgtggacccctatgagg

SEQ ID NO: 104185 - DNA, 25 bp, Mus musculus
acagtgttttcacattccttacctt

SEQ ID NO: 104186 - DNA, 25 bp, Mus musculus
acagtgttttcagattccttacctt

SEQ ID NO: 104187 - DNA, 25 bp, Mus musculus
acagttaaccagctctccaccaggg

SEQ ID NO: 104188 - DNA, 25 bp, Mus musculus
acagttaaccaggtctccaccaggg

SEQ ID NO: 104189 - DNA, 25 bp, Mus musculus
acagttaatgcaagagccggagtaa

SEQ ID NO: 104190 - DNA, 25 bp, Mus musculus
acagttaatgcatgagccggagtaa

SEQ ID NO: 104191 - DNA, 25 bp, Mus musculus
acagttacactgaggctcttacctg

SEQ ID NO: 104192 - DNA, 25 bp, Mus musculus
acagttacactgtggctcttacctg

SEQ ID NO: 104193 - DNA, 25 bp, Mus musculus
acagttaccgccactaagtttcctg

SEQ ID NO: 104194 - DNA, 25 bp, Mus musculus
acagttaccgcctctaagtttcctg

SEQ ID NO: 104195 - DNA, 25 bp, Mus musculus
acagttactgaacctttttcttatg

SEQ ID NO: 104196 - DNA, 25 bp, Mus musculus
acagttactgaagctttttcttatg

SEQ ID NO: 104197 - DNA, 25 bp, Mus musculus
acagttactgtcagggtctgttcct

SEQ ID NO: 104198 - DNA, 25 bp, Mus musculus
acagttactgtctgggtctgttcct

SEQ ID NO: 104199 - DNA, 25 bp, Mus musculus
acagttacttacctggccttagctg

SEQ ID NO: 104200 - DNA, 25 bp, Mus musculus
acagttacttacgtggccttagctg

SEQ ID NO: 104201 - DNA, 25 bp, Mus musculus
acagttagctgccaacaagtattaa

SEQ ID NO: 104202 - DNA, 25 bp, Mus musculus
acagttagctgcgaacaagtattaa

SEQ ID NO: 104203 - DNA, 25 bp, Mus musculus
acagttagctgtcaaattatttgga

SEQ ID NO: 104204 - DNA, 25 bp, Mus musculus
acagttagctgtgaaattatttgga

SEQ ID NO: 104205 - DNA, 25 bp, Mus musculus
acagttagcttgcaagctggtcagc

SEQ ID NO: 104206 - DNA, 25 bp, Mus musculus
acagttagcttggaagctggtcagc

SEQ ID NO: 104207 - DNA, 25 bp, Mus musculus
acagttaggccgctgacacattagt

SEQ ID NO: 104208 - DNA, 25 bp, Mus musculus
acagttaggccggtgacacattagt

SEQ ID NO: 104209 - DNA, 25 bp, Mus musculus
acagttaggctgctcttgatctagg

SEQ ID NO: 104210 - DNA, 25 bp, Mus musculus
acagttaggctggtcttgatctagg

SEQ ID NO: 104211 - DNA, 25 bp, Mus musculus
acagttaggtttctaatccctgctt

SEQ ID NO: 104212 - DNA, 25 bp, Mus musculus
acagttaggtttgtaatccctgctt

SEQ ID NO: 104213 - DNA, 25 bp, Mus musculus
acagttagtaatctggcatctcaca

SEQ ID NO: 104214 - DNA, 25 bp, Mus musculus
acagttagtaatgtggcatctcaca

SEQ ID NO: 104215 - DNA, 25 bp, Mus musculus
acagttagtgcaaacatagcctcta

SEQ ID NO: 104216 - DNA, 25 bp, Mus musculus
acagttagtgcatacatagcctcta

SEQ ID NO: 104217 - DNA, 25 bp, Mus musculus
acagttatccgtatttgctttcctc

SEQ ID NO: 104218 - DNA, 25 bp, Mus musculus
acagttatccgtttttgctttcctc

SEQ ID NO: 104219 - DNA, 25 bp, Mus musculus
acagttatctggaccacaggaggca

SEQ ID NO: 104220 - DNA, 25 bp, Mus musculus
acagttatctggtccacaggaggca

SEQ ID NO: 104221 - DNA, 25 bp, Mus musculus
acagttatggccaaagcggtcatca

SEQ ID NO: 104222 - DNA, 25 bp, Mus musculus
acagttatggcctaagcggtcatca

SEQ ID NO: 104223 - DNA, 25 bp, Mus musculus
acagttatgtaaccagaagcatcta

SEQ ID NO: 104224 - DNA, 25 bp, Mus musculus
acagttatgtaagcagaagcatcta

SEQ ID NO: 104225 - DNA, 25 bp, Mus musculus
acagttatgtctagtatcaggatga

SEQ ID NO: 104226 - DNA, 25 bp, Mus musculus
acagttatgtcttgtatcaggatga

SEQ ID NO: 104227 - DNA, 25 bp, Mus musculus
acagttattacacggcttctgaaga

SEQ ID NO: 104228 - DNA, 25 bp, Mus musculus
acagttattacagggcttctgaaga

SEQ ID NO: 104229 - DNA, 25 bp, Mus musculus
acagttcaaagaactccccgatgaa

SEQ ID NO: 104230 - DNA, 25 bp, Mus musculus
acagttcaaagatctccccgatgaa

SEQ ID NO: 104231 - DNA, 25 bp, Mus musculus
acagttcaacctctgggaccacgct

SEQ ID NO: 104232 - DNA, 25 bp, Mus musculus
acagttcaacctgtgggaccacgct

SEQ ID NO: 104233 - DNA, 25 bp, Mus musculus
acagttcacagtagaatctcagcaa

SEQ ID NO: 104234 - DNA, 25 bp, Mus musculus
acagttcacagttgaatctcagcaa

SEQ ID NO: 104235 - DNA, 25 bp, Mus musculus
acagttcacccactggacgtgactt

SEQ ID NO: 104236 - DNA, 25 bp, Mus musculus
acagttcacccagtggacgtgactt

SEQ ID NO: 104237 - DNA, 25 bp, Mus musculus
acagttcacgtcagacatagccctt

SEQ ID NO: 104238 - DNA, 25 bp, Mus musculus
acagttcacgtctgacatagccctt

SEQ ID NO: 104239 - DNA, 25 bp, Mus musculus
acagttcagtttccctatggctcag

SEQ ID NO: 104240 - DNA, 25 bp, Mus musculus
acagttcagtttgcctatggctcag

SEQ ID NO: 104241 - DNA, 25 bp, Mus musculus
acagttcatgtgagaaatatggcca

SEQ ID NO: 104242 - DNA, 25 bp, Mus musculus
acagttcatgtgtgaaatatggcca

SEQ ID NO: 104243 - DNA, 25 bp, Mus musculus
acagttcatttactgcagcctggca

SEQ ID NO: 104244 - DNA, 25 bp, Mus musculus
acagttcatttagtgcagcctggca

SEQ ID NO: 104245 - DNA, 25 bp, Mus musculus
acagttcatttcattcattatagtt

SEQ ID NO: 104246 - DNA, 25 bp, Mus musculus
acagttcatttctttcattatagtt

SEQ ID NO: 104247 - DNA, 25 bp, Mus musculus
acagttccaagacaccctaggctac

SEQ ID NO: 104248 - DNA, 25 bp, Mus musculus
acagttccaagagaccctaggctac

SEQ ID NO: 104249 - DNA, 25 bp, Mus musculus
acagttccaccccaaatatgcagta

SEQ ID NO: 104250 - DNA, 25 bp, Mus musculus
acagttccacccgaaatatgcagta

SEQ ID NO: 104251 - DNA, 25 bp, Mus musculus
acagttccactgacgactctgagga

SEQ ID NO: 104252 - DNA, 25 bp, Mus musculus
acagttccactgtcgactctgagga

SEQ ID NO: 104253 - DNA, 25 bp, Mus musculus
acagttccagatcctcactatttct

SEQ ID NO: 104254 - DNA, 25 bp, Mus musculus
acagttccagatgctcactatttct

SEQ ID NO: 104255 - DNA, 25 bp, Mus musculus
acagttccatggagataccttccca

SEQ ID NO: 104256 - DNA, 25 bp, Mus musculus
acagttccatggtgataccttccca

SEQ ID NO: 104257 - DNA, 25 bp, Mus musculus
acagttccccacaatacattacctg

SEQ ID NO: 104258 - DNA, 25 bp, Mus musculus
acagttccccactatacattacctg

SEQ ID NO: 104259 - DNA, 25 bp, Mus musculus
acagttccccagaaggcagggtgct

SEQ ID NO: 104260 - DNA, 25 bp, Mus musculus
acagttccccagtaggcagggtgct

SEQ ID NO: 104261 - DNA, 25 bp, Mus musculus
acagttcccgtcacgtaagtcagtg

SEQ ID NO: 104262 - DNA, 25 bp, Mus musculus
acagttcccgtctcgtaagtcagtg

SEQ ID NO: 104263 - DNA, 25 bp, Mus musculus
acagttccctggactaggcctgaga

SEQ ID NO: 104264 - DNA, 25 bp, Mus musculus
acagttccctggtctaggcctgaga

SEQ ID NO: 104265 - DNA, 25 bp, Mus musculus
acagttcctaaaatggcacataaac

SEQ ID NO: 104266 - DNA, 25 bp, Mus musculus
acagttcctaaattggcacataaac

SEQ ID NO: 104267 - DNA, 25 bp, Mus musculus
acagttcctctgagattcttgaaga

SEQ ID NO: 104268 - DNA, 25 bp, Mus musculus
acagttcctctgtgattcttgaaga

SEQ ID NO: 104269 - DNA, 25 bp, Mus musculus
acagttcctgcgcagaacgtgaatg

SEQ ID NO: 104270 - DNA, 25 bp, Mus musculus
acagttcctgcggagaacgtgaatg

SEQ ID NO: 104271 - DNA, 25 bp, Mus musculus
acagttccttcccttacagctgtgt

SEQ ID NO: 104272 - DNA, 25 bp, Mus musculus
acagttccttccgttacagctgtgt

SEQ ID NO: 104273 - DNA, 25 bp, Mus musculus
acagttcgagtcaatctttccagtg

SEQ ID NO: 104274 - DNA, 25 bp, Mus musculus
acagttcgagtctatctttccagtg

SEQ ID NO: 104275 - DNA, 25 bp, Mus musculus
acagttcgctgcagcgagtgccggt

SEQ ID NO: 104276 - DNA, 25 bp, Mus musculus
acagttcgctgctgcgagtgccggt

SEQ ID NO: 104277 - DNA, 25 bp, Mus musculus
acagttctaggtatctgacaccatc

SEQ ID NO: 104278 - DNA, 25 bp, Mus musculus
acagttctaggtttctgacaccatc

SEQ ID NO: 104279 - DNA, 25 bp, Mus musculus
acagttctcagtccaggatggatta

SEQ ID NO: 104280 - DNA, 25 bp, Mus musculus
acagttctcagtgcaggatggatta

SEQ ID NO: 104281 - DNA, 25 bp, Mus musculus
acagttctccatatgatatcctgga

SEQ ID NO: 104282 - DNA, 25 bp, Mus musculus
acagttctccatttgatatcctgga

SEQ ID NO: 104283 - DNA, 25 bp, Mus musculus
acagttctccgaagtccagctggaa

SEQ ID NO: 104284 - DNA, 25 bp, Mus musculus
acagttctccgatgtccagctggaa

SEQ ID NO: 104285 - DNA, 25 bp, Mus musculus
acagttctcgaaagcgggttcttga

SEQ ID NO: 104286 - DNA, 25 bp, Mus musculus
acagttctcgaatgcgggttcttga

SEQ ID NO: 104287 - DNA, 25 bp, Mus musculus
acagttctctggctttctggaaaac

SEQ ID NO: 104288 - DNA, 25 bp, Mus musculus
acagttctctgggtttctggaaaac

SEQ ID NO: 104289 - DNA, 25 bp, Mus musculus
acagttctctttcacagtgtagcac

SEQ ID NO: 104290 - DNA, 25 bp, Mus musculus
acagttctctttgacagtgtagcac

SEQ ID NO: 104291 - DNA, 25 bp, Mus musculus
acagttctgataactcaggaccaag

SEQ ID NO: 104292 - DNA, 25 bp, Mus musculus
acagttctgatatctcaggaccaag

SEQ ID NO: 104293 - DNA, 25 bp, Mus musculus
acagttctgcttagataggtaggaa

SEQ ID NO: 104294 - DNA, 25 bp, Mus musculus
acagttctgctttgataggtaggaa

SEQ ID NO: 104295 - DNA, 25 bp, Mus musculus
acagttctgtagcatgactttcatc

SEQ ID NO: 104296 - DNA, 25 bp, Mus musculus
acagttctgtaggatgactttcatc

SEQ ID NO: 104297 - DNA, 25 bp, Mus musculus
acagttcttcaaccccttagtgagg

SEQ ID NO: 104298 - DNA, 25 bp, Mus musculus
acagttcttcaagcccttagtgagg

SEQ ID NO: 104299 - DNA, 25 bp, Mus musculus
acagttcttgagactagtgcctatc

SEQ ID NO: 104300 - DNA, 25 bp, Mus musculus
acagttcttgagtctagtgcctatc

SEQ ID NO: 104301 - DNA, 25 bp, Mus musculus
acagttcttggccaggtactccaca

SEQ ID NO: 104302 - DNA, 25 bp, Mus musculus
acagttcttggcgaggtactccaca

SEQ ID NO: 104303 - DNA, 25 bp, Mus musculus
acagttcttgttatggcttgattct

SEQ ID NO: 104304 - DNA, 25 bp, Mus musculus
acagttcttgttttggcttgattct

SEQ ID NO: 104305 - DNA, 25 bp, Mus musculus
acagttgaatgaaccccacatcctg

SEQ ID NO: 104306 - DNA, 25 bp, Mus musculus
acagttgaatgatccccacatcctg

SEQ ID NO: 104307 - DNA, 25 bp, Mus musculus
acagttgaatgcaacgggcactgtt

SEQ ID NO: 104308 - DNA, 25 bp, Mus musculus
acagttgaatgctacgggcactgtt

SEQ ID NO: 104309 - DNA, 25 bp, Mus musculus
acagttgacctaaactttggaaagt

SEQ ID NO: 104310 - DNA, 25 bp, Mus musculus
acagttgacctatactttggaaagt

SEQ ID NO: 104311 - DNA, 25 bp, Mus musculus
acagttgactacaggctttcagcct

SEQ ID NO: 104312 - DNA, 25 bp, Mus musculus
acagttgactactggctttcagcct

SEQ ID NO: 104313 - DNA, 25 bp, Mus musculus
acagttgactatcgctgctcagtgc

SEQ ID NO: 104314 - DNA, 25 bp, Mus musculus
acagttgactatggctgctcagtgc

SEQ ID NO: 104315 - DNA, 25 bp, Mus musculus
acagttgactccagatgttccagct

SEQ ID NO: 104316 - DNA, 25 bp, Mus musculus
acagttgactcctgatgttccagct

SEQ ID NO: 104317 - DNA, 25 bp, Mus musculus
acagttgactgcacttggcattcct

SEQ ID NO: 104318 - DNA, 25 bp, Mus musculus
acagttgactgctcttggcattcct

SEQ ID NO: 104319 - DNA, 25 bp, Mus musculus
acagttgaggacaaggacctctcca

SEQ ID NO: 104320 - DNA, 25 bp, Mus musculus
acagttgaggacagcatcgtcccca

SEQ ID NO: 104321 - DNA, 25 bp, Mus musculus
acagttgaggactaggacctctcca

SEQ ID NO: 104322 - DNA, 25 bp, Mus musculus
acagttgaggactgcatcgtcccca

SEQ ID NO: 104323 - DNA, 25 bp, Mus musculus
acagttgatcagctttctcccaaga

SEQ ID NO: 104324 - DNA, 25 bp, Mus musculus
acagttgatcaggtttctcccaaga

SEQ ID NO: 104325 - DNA, 25 bp, Mus musculus
acagttgatgatatgttcctgagaa

SEQ ID NO: 104326 - DNA, 25 bp, Mus musculus
acagttgatgatttgttcctgagaa

SEQ ID NO: 104327 - DNA, 25 bp, Mus musculus
acagttgatgtgacctccttctcag

SEQ ID NO: 104328 - DNA, 25 bp, Mus musculus
acagttgatgtgtcctccttctcag

SEQ ID NO: 104329 - DNA, 25 bp, Mus musculus
acagttgcaacccattaattccatt

SEQ ID NO: 104330 - DNA, 25 bp, Mus musculus
acagttgcaaccgattaattccatt

SEQ ID NO: 104331 - DNA, 25 bp, Mus musculus
acagttgcaagaatgttgaaacaca

SEQ ID NO: 104332 - DNA, 25 bp, Mus musculus
acagttgcaagattgttgaaacaca

SEQ ID NO: 104333 - DNA, 25 bp, Mus musculus
acagttgcaggcacccttgggaaag

SEQ ID NO: 104334 - DNA, 25 bp, Mus musculus
acagttgcaggctcccttgggaaag

SEQ ID NO: 104335 - DNA, 25 bp, Mus musculus
acagttgcagtaaacccttccacca

SEQ ID NO: 104336 - DNA, 25 bp, Mus musculus
acagttgcagtatacccttccacca

SEQ ID NO: 104337 - DNA, 25 bp, Mus musculus
acagttgccaagactttctgtctca

SEQ ID NO: 104338 - DNA, 25 bp, Mus musculus
acagttgccaagtctttctgtctca

SEQ ID NO: 104339 - DNA, 25 bp, Mus musculus
acagttgccaccagtgaccaaaggc

SEQ ID NO: 104340 - DNA, 25 bp, Mus musculus
acagttgccacctgtgaccaaaggc

SEQ ID NO: 104341 - DNA, 25 bp, Mus musculus
acagttgccatgatgtgtctccaca

SEQ ID NO: 104342 - DNA, 25 bp, Mus musculus
acagttgccatgttgtgtctccaca

SEQ ID NO: 104343 - DNA, 25 bp, Mus musculus
acagttgccggcaggagcatccacg

SEQ ID NO: 104344 - DNA, 25 bp, Mus musculus
acagttgccggctggagcatccacg

SEQ ID NO: 104345 - DNA, 25 bp, Mus musculus
acagttgccgtgctaatggtgtctt

SEQ ID NO: 104346 - DNA, 25 bp, Mus musculus
acagttgccgtggtaatggtgtctt

SEQ ID NO: 104347 - DNA, 25 bp, Mus musculus
acagttgcctacaaacagtgtgatg

SEQ ID NO: 104348 - DNA, 25 bp, Mus musculus
acagttgcctactaacagtgtgatg

SEQ ID NO: 104349 - DNA, 25 bp, Mus musculus
acagttgcctatcccatgaagccga

SEQ ID NO: 104350 - DNA, 25 bp, Mus musculus
acagttgcctatgccatgaagccga

SEQ ID NO: 104351 - DNA, 25 bp, Mus musculus
acagttgctaggaagtgttctctaa

SEQ ID NO: 104352 - DNA, 25 bp, Mus musculus
acagttgctaggtagtgttctctaa

SEQ ID NO: 104353 - DNA, 25 bp, Mus musculus
acagttgctcgcagtcaagcactaa

SEQ ID NO: 104354 - DNA, 25 bp, Mus musculus
acagttgctcgctgtcaagcactaa

SEQ ID NO: 104355 - DNA, 25 bp, Mus musculus
acagttgctctcattgtcccttctt

SEQ ID NO: 104356 - DNA, 25 bp, Mus musculus
acagttgctctctttgtcccttctt

SEQ ID NO: 104357 - DNA, 25 bp, Mus musculus
acagttgctgataagtacagttgac

SEQ ID NO: 104358 - DNA, 25 bp, Mus musculus
acagttgctgattagtacagttgac

SEQ ID NO: 104359 - DNA, 25 bp, Mus musculus
acagttgcttctaaacaggtactaa

SEQ ID NO: 104360 - DNA, 25 bp, Mus musculus
acagttgcttctagtctggccagtg

SEQ ID NO: 104361 - DNA, 25 bp, Mus musculus
acagttgcttcttaacaggtactaa

SEQ ID NO: 104362 - DNA, 25 bp, Mus musculus
acagttgcttcttgtctggccagtg

SEQ ID NO: 104363 - DNA, 25 bp, Mus musculus
acagttgctttaactgacaatcagc

SEQ ID NO: 104364 - DNA, 25 bp, Mus musculus
acagttgctttatctgacaatcagc

SEQ ID NO: 104365 - DNA, 25 bp, Mus musculus
acagttggaaaacatcttagagacg

SEQ ID NO: 104366 - DNA, 25 bp, Mus musculus
acagttggaaaagatcttagagacg

SEQ ID NO: 104367 - DNA, 25 bp, Mus musculus
acagttggacaactttgcagtcata

SEQ ID NO: 104368 - DNA, 25 bp, Mus musculus
acagttggacaagtttgcagtcata

SEQ ID NO: 104369 - DNA, 25 bp, Mus musculus
acagttggagagagcaggcccctga

SEQ ID NO: 104370 - DNA, 25 bp, Mus musculus
acagttggagagtgcaggcccctga

SEQ ID NO: 104371 - DNA, 25 bp, Mus musculus
acagttggatgacatcaatcagggc

SEQ ID NO: 104372 - DNA, 25 bp, Mus musculus
acagttggatgagatcaatcagggc

SEQ ID NO: 104373 - DNA, 25 bp, Mus musculus
acagttggcattagtcacggcagct

SEQ ID NO: 104374 - DNA, 25 bp, Mus musculus
acagttggcatttgtcacggcagct

SEQ ID NO: 104375 - DNA, 25 bp, Mus musculus
acagttggccatctctcctatcctt

SEQ ID NO: 104376 - DNA, 25 bp, Mus musculus
acagttggccatgtctcctatcctt

SEQ ID NO: 104377 - DNA, 25 bp, Mus musculus
acagttggctaacgcaggtttgctc

SEQ ID NO: 104378 - DNA, 25 bp, Mus musculus
acagttggctaaggcaggtttgctc

SEQ ID NO: 104379 - DNA, 25 bp, Mus musculus
acagttggctgtaattacacctgaa

SEQ ID NO: 104380 - DNA, 25 bp, Mus musculus
acagttggctgttattacacctgaa

SEQ ID NO: 104381 - DNA, 25 bp, Mus musculus
acagttgggactacattgtaagact

SEQ ID NO: 104382 - DNA, 25 bp, Mus musculus
acagttgggacttcattgtaagact

SEQ ID NO: 104383 - DNA, 25 bp, Mus musculus
acagttgggtagagagtgtttgcat

SEQ ID NO: 104384 - DNA, 25 bp, Mus musculus
acagttgggtagtgagtgtttgcat

SEQ ID NO: 104385 - DNA, 25 bp, Mus musculus
acagttggtcacagtctccggcggg

SEQ ID NO: 104386 - DNA, 25 bp, Mus musculus
acagttggtcactgtctccggcggg

SEQ ID NO: 104387 - DNA, 25 bp, Mus musculus
acagttggtggcatgtagcatcccc

SEQ ID NO: 104388 - DNA, 25 bp, Mus musculus
acagttggtggcttgtagcatcccc

SEQ ID NO: 104389 - DNA, 25 bp, Mus musculus
acagttgtaagtatcaggatttcca

SEQ ID NO: 104390 - DNA, 25 bp, Mus musculus
acagttgtaagtttcaggatttcca

SEQ ID NO: 104391 - DNA, 25 bp, Mus musculus
acagttgtaattcactgctggttat

SEQ ID NO: 104392 - DNA, 25 bp, Mus musculus
acagttgtaattgactgctggttat

SEQ ID NO: 104393 - DNA, 25 bp, Mus musculus
acagttgtactcctgtctctgctgg

SEQ ID NO: 104394 - DNA, 25 bp, Mus musculus
acagttgtactcgtgtctctgctgg

SEQ ID NO: 104395 - DNA, 25 bp, Mus musculus
acagttgtcactaggctggtagagc

SEQ ID NO: 104396 - DNA, 25 bp, Mus musculus
acagttgtcacttggctggtagagc

SEQ ID NO: 104397 - DNA, 25 bp, Mus musculus
acagttgtccagcattgcatgctga

SEQ ID NO: 104398 - DNA, 25 bp, Mus musculus
acagttgtccaggattgcatgctga

SEQ ID NO: 104399 - DNA, 25 bp, Mus musculus
acagttgtccctattagtggtcaat

SEQ ID NO: 104400 - DNA, 25 bp, Mus musculus
acagttgtcccttttagtggtcaat

SEQ ID NO: 104401 - DNA, 25 bp, Mus musculus
acagttgtctgaacccagttctcta

SEQ ID NO: 104402 - DNA, 25 bp, Mus musculus
acagttgtctgatcccagttctcta

SEQ ID NO: 104403 - DNA, 25 bp, Mus musculus
acagttgtctgcctagctgatgtcc

SEQ ID NO: 104404 - DNA, 25 bp, Mus musculus
acagttgtctgcgtagctgatgtcc

SEQ ID NO: 104405 - DNA, 25 bp, Mus musculus
acagttgtgaaacagctctctttgc

SEQ ID NO: 104406 - DNA, 25 bp, Mus musculus
acagttgtgaaagagctctctttgc

SEQ ID NO: 104407 - DNA, 25 bp, Mus musculus
acagttgtgcaccaagcactctgga

SEQ ID NO: 104408 - DNA, 25 bp, Mus musculus
acagttgtgcacgaagcactctgga

SEQ ID NO: 104409 - DNA, 25 bp, Mus musculus
acagttgtgcctagaatggacttaa

SEQ ID NO: 104410 - DNA, 25 bp, Mus musculus
acagttgtgcctccgttgggtcacg

SEQ ID NO: 104411 - DNA, 25 bp, Mus musculus
acagttgtgcctgcgttgggtcacg

SEQ ID NO: 104412 - DNA, 25 bp, Mus musculus
acagttgtgccttgaatggacttaa

SEQ ID NO: 104413 - DNA, 25 bp, Mus musculus
acagttgtgcttataatatcacatt

SEQ ID NO: 104414 - DNA, 25 bp, Mus musculus
acagttgtgcttttaatatcacatt

SEQ ID NO: 104415 - DNA, 25 bp, Mus musculus
acagttgttagaaaggcctcggcac

SEQ ID NO: 104416 - DNA, 25 bp, Mus musculus
acagttgttagataggcctcggcac

SEQ ID NO: 104417 - DNA, 25 bp, Mus musculus
acagttgttgaccttcttcagtgta

SEQ ID NO: 104418 - DNA, 25 bp, Mus musculus
acagttgttgacgttcttcagtgta

SEQ ID NO: 104419 - DNA, 25 bp, Mus musculus
acagttgttgctcaacattcacaaa

SEQ ID NO: 104420 - DNA, 25 bp, Mus musculus
acagttgttgctgaacattcacaaa

SEQ ID NO: 104421 - DNA, 25 bp, Mus musculus
acagttgttggcagatcatctgccc

SEQ ID NO: 104422 - DNA, 25 bp, Mus musculus
acagttgttggctgatcatctgccc

SEQ ID NO: 104423 - DNA, 25 bp, Mus musculus
acagttgttgtccagtgtcttcacc

SEQ ID NO: 104424 - DNA, 25 bp, Mus musculus
acagttgttgtcgagtgtcttcacc

SEQ ID NO: 104425 - DNA, 25 bp, Mus musculus
acagttgtttggcttggcgatgcct

SEQ ID NO: 104426 - DNA, 25 bp, Mus musculus
acagttgtttgggttggcgatgcct

SEQ ID NO: 104427 - DNA, 25 bp, Mus musculus
acagttgttttaatctcagccagac

SEQ ID NO: 104428 - DNA, 25 bp, Mus musculus
acagttgttttattctcagccagac

SEQ ID NO: 104429 - DNA, 25 bp, Mus musculus
acagtttaactgactctcataatgg

SEQ ID NO: 104430 - DNA, 25 bp, Mus musculus
acagtttaactgtctctcataatgg

SEQ ID NO: 104431 - DNA, 25 bp, Mus musculus
acagtttacaacagcggccctgttt

SEQ ID NO: 104432 - DNA, 25 bp, Mus musculus
acagtttacaactgcggccctgttt

SEQ ID NO: 104433 - DNA, 25 bp, Mus musculus
acagtttacgagaggctttcttggc

SEQ ID NO: 104434 - DNA, 25 bp, Mus musculus
acagtttacgagtggctttcttggc

SEQ ID NO: 104435 - DNA, 25 bp, Mus musculus
acagtttacttcctctctatatttc

SEQ ID NO: 104436 - DNA, 25 bp, Mus musculus
acagtttacttcgtctctatatttc

SEQ ID NO: 104437 - DNA, 25 bp, Mus musculus
acagtttagcccctatgtactacag

SEQ ID NO: 104438 - DNA, 25 bp, Mus musculus
acagtttagcccgtatgtactacag

SEQ ID NO: 104439 - DNA, 25 bp, Mus musculus
acagtttcaaagctttcagcccggg

SEQ ID NO: 104440 - DNA, 25 bp, Mus musculus
acagtttcaaaggtttcagcccggg

SEQ ID NO: 104441 - DNA, 25 bp, Mus musculus
acagtttcaattcggccttgcaggc

SEQ ID NO: 104442 - DNA, 25 bp, Mus musculus
acagtttcaattgggccttgcaggc

SEQ ID NO: 104443 - DNA, 25 bp, Mus musculus
acagtttcaggtccttgttgtgtga

SEQ ID NO: 104444 - DNA, 25 bp, Mus musculus
acagtttcaggtgcttgttgtgtga

SEQ ID NO: 104445 - DNA, 25 bp, Mus musculus
acagtttcagttccagatccagccc

SEQ ID NO: 104446 - DNA, 25 bp, Mus musculus
acagtttcagttgcagatccagccc

SEQ ID NO: 104447 - DNA, 25 bp, Mus musculus
acagtttccaatacctagagccagt

SEQ ID NO: 104448 - DNA, 25 bp, Mus musculus
acagtttccaattcctagagccagt

SEQ ID NO: 104449 - DNA, 25 bp, Mus musculus
acagtttcggctctgcagcagtata

SEQ ID NO: 104450 - DNA, 25 bp, Mus musculus
acagtttcggctgtgcagcagtata

SEQ ID NO: 104451 - DNA, 25 bp, Mus musculus
acagtttctatgattatccttggct

SEQ ID NO: 104452 - DNA, 25 bp, Mus musculus
acagtttctatgtttatccttggct

SEQ ID NO: 104453 - DNA, 25 bp, Mus musculus
acagtttctcacactagccagttaa

SEQ ID NO: 104454 - DNA, 25 bp, Mus musculus
acagtttctcactctagccagttaa

SEQ ID NO: 104455 - DNA, 25 bp, Mus musculus
acagtttctccgcactgtgcatgga

SEQ ID NO: 104456 - DNA, 25 bp, Mus musculus
acagtttctccggactgtgcatgga

SEQ ID NO: 104457 - DNA, 25 bp, Mus musculus
acagtttctgcccatgatgcaagct

SEQ ID NO: 104458 - DNA, 25 bp, Mus musculus
acagtttctgccgatgatgcaagct

SEQ ID NO: 104459 - DNA, 25 bp, Mus musculus
acagtttgagagcaggtagtcctag

SEQ ID NO: 104460 - DNA, 25 bp, Mus musculus
acagtttgagaggaggtagtcctag

SEQ ID NO: 104461 - DNA, 25 bp, Mus musculus
acagtttgcctgaggtttcaccaaa

SEQ ID NO: 104462 - DNA, 25 bp, Mus musculus
acagtttgcctgtggtttcaccaaa

SEQ ID NO: 104463 - DNA, 25 bp, Mus musculus
acagtttgcgatagtatttctctct

SEQ ID NO: 104464 - DNA, 25 bp, Mus musculus
acagtttgcgattgtatttctctct

SEQ ID NO: 104465 - DNA, 25 bp, Mus musculus
acagtttgctataatccagtcctct

SEQ ID NO: 104466 - DNA, 25 bp, Mus musculus
acagtttgctattatccagtcctct

SEQ ID NO: 104467 - DNA, 25 bp, Mus musculus
acagtttgctctatcagtgacgtca

SEQ ID NO: 104468 - DNA, 25 bp, Mus musculus
acagtttgctctttcagtgacgtca

SEQ ID NO: 104469 - DNA, 25 bp, Mus musculus
acagtttgtactcggcacctggttt

SEQ ID NO: 104470 - DNA, 25 bp, Mus musculus
acagtttgtactgggcacctggttt

SEQ ID NO: 104471 - DNA, 25 bp, Mus musculus
acagttttactgcaacatagccata

SEQ ID NO: 104472 - DNA, 25 bp, Mus musculus
acagttttactggaacatagccata

SEQ ID NO: 104473 - DNA, 25 bp, Mus musculus
acagttttagagagttagcccataa

SEQ ID NO: 104474 - DNA, 25 bp, Mus musculus
acagttttagagtgttagcccataa

SEQ ID NO: 104475 - DNA, 25 bp, Mus musculus
acagttttagtacatctgtgataaa

SEQ ID NO: 104476 - DNA, 25 bp, Mus musculus
acagttttagtagatctgtgataaa

SEQ ID NO: 104477 - DNA, 25 bp, Mus musculus
acagttttatgcacttttttactca

SEQ ID NO: 104478 - DNA, 25 bp, Mus musculus
acagttttatgccagtccttattag

SEQ ID NO: 104479 - DNA, 25 bp, Mus musculus
acagttttatgcgagtccttattag

SEQ ID NO: 104480 - DNA, 25 bp, Mus musculus
acagttttatgctcttttttactca

SEQ ID NO: 104481 - DNA, 25 bp, Mus musculus
acagttttcatgctcagctcccagt

SEQ ID NO: 104482 - DNA, 25 bp, Mus musculus
acagttttcatggtcagctcccagt

SEQ ID NO: 104483 - DNA, 25 bp, Mus musculus
acagttttcctaatgcacgatttca

SEQ ID NO: 104484 - DNA, 25 bp, Mus musculus
acagttttcctattgcacgatttca

SEQ ID NO: 104485 - DNA, 25 bp, Mus musculus
acagttttgatcacttccgctcgct

SEQ ID NO: 104486 - DNA, 25 bp, Mus musculus
acagttttgatctcttccgctcgct

SEQ ID NO: 104487 - DNA, 25 bp, Mus musculus
acagttttgcctcctaaattctcca

SEQ ID NO: 104488 - DNA, 25 bp, Mus musculus
acagttttgcctgctaaattctcca

SEQ ID NO: 104489 - DNA, 25 bp, Mus musculus
acagttttgctcatcggacagctgc

SEQ ID NO: 104490 - DNA, 25 bp, Mus musculus
acagttttgctcttcggacagctgc

SEQ ID NO: 104491 - DNA, 25 bp, Mus musculus
acagttttgctgaagctcaagctca

SEQ ID NO: 104492 - DNA, 25 bp, Mus musculus
acagttttgctgtagctcaagctca

SEQ ID NO: 104493 - DNA, 25 bp, Mus musculus
acagttttggccagatcccttcagg

SEQ ID NO: 104494 - DNA, 25 bp, Mus musculus
acagttttggcctgatcccttcagg

SEQ ID NO: 104495 - DNA, 25 bp, Mus musculus
acagttttggtgctctgggccctgc

SEQ ID NO: 104496 - DNA, 25 bp, Mus musculus
acagttttggtggtctgggccctgc

SEQ ID NO: 104497 - DNA, 25 bp, Mus musculus
acagttttgtggcagcgctggcctt

SEQ ID NO: 104498 - DNA, 25 bp, Mus musculus
acagttttgtgggagcgctggcctt

SEQ ID NO: 104499 - DNA, 25 bp, Mus musculus
acagtttttatgatgccactttact

SEQ ID NO: 104500 - DNA, 25 bp, Mus musculus
acagtttttatgttgccactttact

SEQ ID NO: 104501 - DNA, 25 bp, Mus musculus
acagtttttcacattttgctcaccc

SEQ ID NO: 104502 - DNA, 25 bp, Mus musculus
acagtttttcactttttgctcaccc

SEQ ID NO: 104503 - DNA, 25 bp, Mus musculus
acagttttttatagcggtacatggt

SEQ ID NO: 104504 - DNA, 25 bp, Mus musculus
acagttttttattgcggtacatggt

SEQ ID NO: 104505 - DNA, 25 bp, Mus musculus
acataaaaagacacgctgcctgtat

SEQ ID NO: 104506 - DNA, 25 bp, Mus musculus
acataaaaagactcgctgcctgtat

SEQ ID NO: 104507 - DNA, 25 bp, Mus musculus
acataaaacgttagctttagctcga

SEQ ID NO: 104508 - DNA, 25 bp, Mus musculus
acataaaacgtttgctttagctcga

SEQ ID NO: 104509 - DNA, 25 bp, Mus musculus
acataaaagtctaaggctggccctc

SEQ ID NO: 104510 - DNA, 25 bp, Mus musculus
acataaaagtcttaggctggccctc

SEQ ID NO: 104511 - DNA, 25 bp, Mus musculus
acataaaatcacaaccactgggctt

SEQ ID NO: 104512 - DNA, 25 bp, Mus musculus
acataaaatcactaccactgggctt

SEQ ID NO: 104513 - DNA, 25 bp, Mus musculus
acataaaatctgagaagccccttct

SEQ ID NO: 104514 - DNA, 25 bp, Mus musculus
acataaaatctgtgaagccccttct

SEQ ID NO: 104515 - DNA, 25 bp, Mus musculus
acataaacaaacaggccgatgtggg

SEQ ID NO: 104516 - DNA, 25 bp, Mus musculus
acataaacaaactggccgatgtggg

SEQ ID NO: 104517 - DNA, 25 bp, Mus musculus
acataaactggtcagctggattcaa

SEQ ID NO: 104518 - DNA, 25 bp, Mus musculus
acataaactggtgagctggattcaa

SEQ ID NO: 104519 - DNA, 25 bp, Mus musculus
acataaagcattatactgtgtgtga

SEQ ID NO: 104520 - DNA, 25 bp, Mus musculus
acataaagcattttactgtgtgtga

SEQ ID NO: 104521 - DNA, 25 bp, Mus musculus
acataaagctgccagatccgacttt

SEQ ID NO: 104522 - DNA, 25 bp, Mus musculus
acataaagctgcgagatccgacttt

SEQ ID NO: 104523 - DNA, 25 bp, Mus musculus
acataaagggacatgtgtctctagc

SEQ ID NO: 104524 - DNA, 25 bp, Mus musculus
acataaagggacttgtgtctctagc

SEQ ID NO: 104525 - DNA, 25 bp, Mus musculus
acataaaggtaaagtgcttaattga

SEQ ID NO: 104526 - DNA, 25 bp, Mus musculus
acataaaggtaatgtgcttaattga

SEQ ID NO: 104527 - DNA, 25 bp, Mus musculus
acataaaggttcctaactgcttggg

SEQ ID NO: 104528 - DNA, 25 bp, Mus musculus
acataaaggttcgtaactgcttggg

SEQ ID NO: 104529 - DNA, 25 bp, Mus musculus
acataaataaatcttgctgggcaat

SEQ ID NO: 104530 - DNA, 25 bp, Mus musculus
acataaataaatgttgctgggcaat

SEQ ID NO: 104531 - DNA, 25 bp, Mus musculus
acataaatgctcctttggatccaaa

SEQ ID NO: 104532 - DNA, 25 bp, Mus musculus
acataaatgctcgtttggatccaaa

SEQ ID NO: 104533 - DNA, 25 bp, Mus musculus
acataaattttgacgtcttctggac

SEQ ID NO: 104534 - DNA, 25 bp, Mus musculus
acataaattttgtcgtcttctggac

SEQ ID NO: 104535 - DNA, 25 bp, Mus musculus
acataacactcaacagtcttgggaa

SEQ ID NO: 104536 - DNA, 25 bp, Mus musculus
acataacactcatcagtcttgggaa

SEQ ID NO: 104537 - DNA, 25 bp, Mus musculus
acataaccaagaaatcatacactga

SEQ ID NO: 104538 - DNA, 25 bp, Mus musculus
acataaccaagatatcatacactga

SEQ ID NO: 104539 - DNA, 25 bp, Mus musculus
acataaccacaacacttcctggaaa

SEQ ID NO: 104540 - DNA, 25 bp, Mus musculus
acataaccacaagacttcctggaaa

SEQ ID NO: 104541 - DNA, 25 bp, Mus musculus
acataaccatctcctcatggccagt

SEQ ID NO: 104542 - DNA, 25 bp, Mus musculus
acataaccatctgctcatggccagt

SEQ ID NO: 104543 - DNA, 25 bp, Mus musculus
acataacctctaccttgtttgggaa

SEQ ID NO: 104544 - DNA, 25 bp, Mus musculus
acataacctctagcttgtttgggaa

SEQ ID NO: 104545 - DNA, 25 bp, Mus musculus
acataacctctcaatgtgcaatggg

SEQ ID NO: 104546 - DNA, 25 bp, Mus musculus
acataacctctctatgtgcaatggg

SEQ ID NO: 104547 - DNA, 25 bp, Mus musculus
acataacgaagtcgagcgccgccgc

SEQ ID NO: 104548 - DNA, 25 bp, Mus musculus
acataacgaagtggagcgccgccgc

SEQ ID NO: 104549 - DNA, 25 bp, Mus musculus
acataacgggacactatcttcaact

SEQ ID NO: 104550 - DNA, 25 bp, Mus musculus
acataacgggactctatcttcaact

SEQ ID NO: 104551 - DNA, 25 bp, Mus musculus
acataacgggcacggaacttcaaca

SEQ ID NO: 104552 - DNA, 25 bp, Mus musculus
acataacgggcagggaacttcaaca

SEQ ID NO: 104553 - DNA, 25 bp, Mus musculus
acataactacctagtcctgggaaga

SEQ ID NO: 104554 - DNA, 25 bp, Mus musculus
acataactaccttgtcctgggaaga

SEQ ID NO: 104555 - DNA, 25 bp, Mus musculus
acataactcatcattccccagaaac

SEQ ID NO: 104556 - DNA, 25 bp, Mus musculus
acataactcatctttccccagaaac

SEQ ID NO: 104557 - DNA, 25 bp, Mus musculus
acataactgaggcttttcccaagaa

SEQ ID NO: 104558 - DNA, 25 bp, Mus musculus
acataactgagggttttcccaagaa

SEQ ID NO: 104559 - DNA, 25 bp, Mus musculus
acataacttgctatacactcatctt

SEQ ID NO: 104560 - DNA, 25 bp, Mus musculus
acataacttgctttacactcatctt

SEQ ID NO: 104561 - DNA, 25 bp, Mus musculus
acataactttggagggattctgaca

SEQ ID NO: 104562 - DNA, 25 bp, Mus musculus
acataactttggtgggattctgaca

SEQ ID NO: 104563 - DNA, 25 bp, Mus musculus
acataagagtcaaagctttaaggct

SEQ ID NO: 104564 - DNA, 25 bp, Mus musculus
acataagagtcatagctttaaggct

SEQ ID NO: 104565 - DNA, 25 bp, Mus musculus
acataagatttcagggctggcaccc

SEQ ID NO: 104566 - DNA, 25 bp, Mus musculus
acataagatttctgggctggcaccc

SEQ ID NO: 104567 - DNA, 25 bp, Mus musculus
acataagcaagcaacagccccaaac

SEQ ID NO: 104568 - DNA, 25 bp, Mus musculus
acataagcaagctacagccccaaac

SEQ ID NO: 104569 - DNA, 25 bp, Mus musculus
acataagctgcgattgcacgggact

SEQ ID NO: 104570 - DNA, 25 bp, Mus musculus
acataagctgcgtttgcacgggact

SEQ ID NO: 104571 - DNA, 25 bp, Mus musculus
acataaggatgcacacttgggttca

SEQ ID NO: 104572 - DNA, 25 bp, Mus musculus
acataaggatgctcacttgggttca

SEQ ID NO: 104573 - DNA, 25 bp, Mus musculus
acataaggctctaagactcgtgtga

SEQ ID NO: 104574 - DNA, 25 bp, Mus musculus
acataaggctctaatactcctccga

SEQ ID NO: 104575 - DNA, 25 bp, Mus musculus
acataaggctcttagactcgtgtga

SEQ ID NO: 104576 - DNA, 25 bp, Mus musculus
acataaggctcttatactcctccga

SEQ ID NO: 104577 - DNA, 25 bp, Mus musculus
acataaggcttccagcacggtccat

SEQ ID NO: 104578 - DNA, 25 bp, Mus musculus
acataaggcttcgagcacggtccat

SEQ ID NO: 104579 - DNA, 25 bp, Mus musculus
acataagggcagctgtttatcagga

SEQ ID NO: 104580 - DNA, 25 bp, Mus musculus
acataagggcaggtgtttatcagga

SEQ ID NO: 104581 - DNA, 25 bp, Mus musculus
acataaggtcagaagtaggagtttg

SEQ ID NO: 104582 - DNA, 25 bp, Mus musculus
acataaggtcagtagtaggagtttg

SEQ ID NO: 104583 - DNA, 25 bp, Mus musculus
acataagtagtcacagtatcccagg

SEQ ID NO: 104584 - DNA, 25 bp, Mus musculus
acataagtagtctcagtatcccagg

SEQ ID NO: 104585 - DNA, 25 bp, Mus musculus
acataagtgaaaattgggctgcatc

SEQ ID NO: 104586 - DNA, 25 bp, Mus musculus
acataagtgaaatttgggctgcatc

SEQ ID NO: 104587 - DNA, 25 bp, Mus musculus
acataataacggattccatatggtt

SEQ ID NO: 104588 - DNA, 25 bp, Mus musculus
acataataacggtttccatatggtt

SEQ ID NO: 104589 - DNA, 25 bp, Mus musculus
acataatatgttcatgttcatggca

SEQ ID NO: 104590 - DNA, 25 bp, Mus musculus
acataatatgttgatgttcatggca

SEQ ID NO: 104591 - DNA, 25 bp, Mus musculus
acataatctcacatgaacctgtcaa

SEQ ID NO: 104592 - DNA, 25 bp, Mus musculus
acataatctcacttgaacctgtcaa

SEQ ID NO: 104593 - DNA, 25 bp, Mus musculus
acataatctccaagaccctttctct

SEQ ID NO: 104594 - DNA, 25 bp, Mus musculus
acataatctccatgaccctttctct

SEQ ID NO: 104595 - DNA, 25 bp, Mus musculus
acataatctttcattgccgtgaccg

SEQ ID NO: 104596 - DNA, 25 bp, Mus musculus
acataatctttctttgccgtgaccg

SEQ ID NO: 104597 - DNA, 25 bp, Mus musculus
acataatgacgtctgcatccgaacc

SEQ ID NO: 104598 - DNA, 25 bp, Mus musculus
acataatgacgtgtgcatccgaacc

SEQ ID NO: 104599 - DNA, 25 bp, Mus musculus
acataatgccctacgataacactga

SEQ ID NO: 104600 - DNA, 25 bp, Mus musculus
acataatgcccttcgataacactga

SEQ ID NO: 104601 - DNA, 25 bp, Mus musculus
acataatgctttactctctggacgt

SEQ ID NO: 104602 - DNA, 25 bp, Mus musculus
acataatgcttttctctctggacgt

SEQ ID NO: 104603 - DNA, 25 bp, Mus musculus
acataatgtttaagcctgccctcct

SEQ ID NO: 104604 - DNA, 25 bp, Mus musculus
acataatgtttatgcctgccctcct

SEQ ID NO: 104605 - DNA, 25 bp, Mus musculus
acataatttctgaacatcccaaagg

SEQ ID NO: 104606 - DNA, 25 bp, Mus musculus
acataatttctgtacatcccaaagg

SEQ ID NO: 104607 - DNA, 25 bp, Mus musculus
acataatttgtcattagcttatcag

SEQ ID NO: 104608 - DNA, 25 bp, Mus musculus
acataatttgtctttagcttatcag

SEQ ID NO: 104609 - DNA, 25 bp, Mus musculus
acataattttccagaactcgtcgaa

SEQ ID NO: 104610 - DNA, 25 bp, Mus musculus
acataattttcctgaactcgtcgaa

SEQ ID NO: 104611 - DNA, 25 bp, Mus musculus
acatacaaatttaccctagccagca

SEQ ID NO: 104612 - DNA, 25 bp, Mus musculus
acatacaaattttccctagccagca

SEQ ID NO: 104613 - DNA, 25 bp, Mus musculus
acatacaactgcattctggactgta

SEQ ID NO: 104614 - DNA, 25 bp, Mus musculus
acatacaactgctttctggactgta

SEQ ID NO: 104615 - DNA, 25 bp, Mus musculus
acatacacaaatagcccaagcctgt

SEQ ID NO: 104616 - DNA, 25 bp, Mus musculus
acatacacaaattgcccaagcctgt

SEQ ID NO: 104617 - DNA, 25 bp, Mus musculus
acatacacactaatgcaaaggctat

SEQ ID NO: 104618 - DNA, 25 bp, Mus musculus
acatacacactattgcaaaggctat

SEQ ID NO: 104619 - DNA, 25 bp, Mus musculus
acatacacactcagatcaccacagt

SEQ ID NO: 104620 - DNA, 25 bp, Mus musculus
acatacacactctgatcaccacagt

SEQ ID NO: 104621 - DNA, 25 bp, Mus musculus
acatacacagagcttgtatactgca

SEQ ID NO: 104622 - DNA, 25 bp, Mus musculus
acatacacagagctttttcttctga

SEQ ID NO: 104623 - DNA, 25 bp, Mus musculus
acatacacagaggttgtatactgca

SEQ ID NO: 104624 - DNA, 25 bp, Mus musculus
acatacacagaggtttttcttctga

SEQ ID NO: 104625 - DNA, 25 bp, Mus musculus
acatacacaggcctttctcgtagat

SEQ ID NO: 104626 - DNA, 25 bp, Mus musculus
acatacacaggcgtttctcgtagat

SEQ ID NO: 104627 - DNA, 25 bp, Mus musculus
acatacacatcccactgcatagatt

SEQ ID NO: 104628 - DNA, 25 bp, Mus musculus
acatacacatccgactgcatagatt

SEQ ID NO: 104629 - DNA, 25 bp, Mus musculus
acatacacatgcacggacatgcgct

SEQ ID NO: 104630 - DNA, 25 bp, Mus musculus
acatacacatgctcggacatgcgct

SEQ ID NO: 104631 - DNA, 25 bp, Mus musculus
acatacacatgtccagggaaaacac

SEQ ID NO: 104632 - DNA, 25 bp, Mus musculus
acatacacatgtgcagggaaaacac

SEQ ID NO: 104633 - DNA, 25 bp, Mus musculus
acatacagacttaaccctacaggac

SEQ ID NO: 104634 - DNA, 25 bp, Mus musculus
acatacagactttaccctacaggac

SEQ ID NO: 104635 - DNA, 25 bp, Mus musculus
acatacagagatccggctcagcaga

SEQ ID NO: 104636 - DNA, 25 bp, Mus musculus
acatacagagatgcggctcagcaga

SEQ ID NO: 104637 - DNA, 25 bp, Mus musculus
acatacagatgtatgctgggttcac

SEQ ID NO: 104638 - DNA, 25 bp, Mus musculus
acatacagatgtttgctgggttcac

SEQ ID NO: 104639 - DNA, 25 bp, Mus musculus
acatacagattcactatgcccatcc

SEQ ID NO: 104640 - DNA, 25 bp, Mus musculus
acatacagattctctatgcccatcc

SEQ ID NO: 104641 - DNA, 25 bp, Mus musculus
acatacagcgctagactgtcttgaa

SEQ ID NO: 104642 - DNA, 25 bp, Mus musculus
acatacagcgcttgactgtcttgaa

SEQ ID NO: 104643 - DNA, 25 bp, Mus musculus
acatacaggtctatgtgttttctca

SEQ ID NO: 104644 - DNA, 25 bp, Mus musculus
acatacaggtctttgtgttttctca

SEQ ID NO: 104645 - DNA, 25 bp, Mus musculus
acatacagtaccagttcttccttac

SEQ ID NO: 104646 - DNA, 25 bp, Mus musculus
acatacagtacctgttcttccttac

SEQ ID NO: 104647 - DNA, 25 bp, Mus musculus
acatacagtatgatggtttcccgaa

SEQ ID NO: 104648 - DNA, 25 bp, Mus musculus
acatacagtatgttggtttcccgaa

SEQ ID NO: 104649 - DNA, 25 bp, Mus musculus
acatacagtgggagtttctcttcaa

SEQ ID NO: 104650 - DNA, 25 bp, Mus musculus
acatacagtgggtgtttctcttcaa

SEQ ID NO: 104651 - DNA, 25 bp, Mus musculus
acatacagttagaccggtgaagcct

SEQ ID NO: 104652 - DNA, 25 bp, Mus musculus
acatacagttagtccggtgaagcct

SEQ ID NO: 104653 - DNA, 25 bp, Mus musculus
acatacagtttacgtccagaccgct

SEQ ID NO: 104654 - DNA, 25 bp, Mus musculus
acatacagtttaggtccagaccgct

SEQ ID NO: 104655 - DNA, 25 bp, Mus musculus
acatacataggaagcctacctgcct

SEQ ID NO: 104656 - DNA, 25 bp, Mus musculus
acatacataggatgcctacctgcct

SEQ ID NO: 104657 - DNA, 25 bp, Mus musculus
acatacatcaacagtggtggtacac

SEQ ID NO: 104658 - DNA, 25 bp, Mus musculus
acatacatcaactgtggtggtacac

SEQ ID NO: 104659 - DNA, 25 bp, Mus musculus
acatacatcatcctgtgctgggaaa

SEQ ID NO: 104660 - DNA, 25 bp, Mus musculus
acatacatcatcgtgtgctgggaaa

SEQ ID NO: 104661 - DNA, 25 bp, Mus musculus
acatacatcctcctgcagacgggag

SEQ ID NO: 104662 - DNA, 25 bp, Mus musculus
acatacatcctcgtgcagacgggag

SEQ ID NO: 104663 - DNA, 25 bp, Mus musculus
acatacatggagagaatggttcttc

SEQ ID NO: 104664 - DNA, 25 bp, Mus musculus
acatacatggagtgaatggttcttc

SEQ ID NO: 104665 - DNA, 25 bp, Mus musculus
acatacatgttcacccacgtgggaa

SEQ ID NO: 104666 - DNA, 25 bp, Mus musculus
acatacatgttctcccacgtgggaa

SEQ ID NO: 104667 - DNA, 25 bp, Mus musculus
acatacattcacacacatgcacaat

SEQ ID NO: 104668 - DNA, 25 bp, Mus musculus
acatacattcactcacatgcacaat

SEQ ID NO: 104669 - DNA, 25 bp, Mus musculus
acatacattctacgacaaatcactg

SEQ ID NO: 104670 - DNA, 25 bp, Mus musculus
acatacattctaggacaaatcactg

SEQ ID NO: 104671 - DNA, 25 bp, Mus musculus
acatacattgcaagagtcctccatc

SEQ ID NO: 104672 - DNA, 25 bp, Mus musculus
acatacattgcatgagtcctccatc

SEQ ID NO: 104673 - DNA, 25 bp, Mus musculus
acataccaagctaggtggtgcacac

SEQ ID NO: 104674 - DNA, 25 bp, Mus musculus
acataccaagcttggtggtgcacac

SEQ ID NO: 104675 - DNA, 25 bp, Mus musculus
acataccactgtatcaaatttaata

SEQ ID NO: 104676 - DNA, 25 bp, Mus musculus
acataccactgtttcaaatttaata

SEQ ID NO: 104677 - DNA, 25 bp, Mus musculus
acataccaggtacacaggctaacac

SEQ ID NO: 104678 - DNA, 25 bp, Mus musculus
acataccaggtagacaggctaacac

SEQ ID NO: 104679 - DNA, 25 bp, Mus musculus
acataccatatgaagcaggagcagc

SEQ ID NO: 104680 - DNA, 25 bp, Mus musculus
acataccatatgtagcaggagcagc

SEQ ID NO: 104681 - DNA, 25 bp, Mus musculus
acataccatgacactgtatctgtga

SEQ ID NO: 104682 - DNA, 25 bp, Mus musculus
acataccatgactctgtatctgtga

SEQ ID NO: 104683 - DNA, 25 bp, Mus musculus
acataccatggtcctggtgttttca

SEQ ID NO: 104684 - DNA, 25 bp, Mus musculus
acataccatggtgctggtgttttca

SEQ ID NO: 104685 - DNA, 25 bp, Mus musculus
acatacccaaccctgtagaagttag

SEQ ID NO: 104686 - DNA, 25 bp, Mus musculus
acatacccaaccgtgtagaagttag

SEQ ID NO: 104687 - DNA, 25 bp, Mus musculus
acatacccacgtccccagtcagatc

SEQ ID NO: 104688 - DNA, 25 bp, Mus musculus
acatacccacgtgcccagtcagatc

SEQ ID NO: 104689 - DNA, 25 bp, Mus musculus
acatacccagcaatatcagttgtaa

SEQ ID NO: 104690 - DNA, 25 bp, Mus musculus
acatacccagcattatcagttgtaa

SEQ ID NO: 104691 - DNA, 25 bp, Mus musculus
acatacccagttacttcacttcaag

SEQ ID NO: 104692 - DNA, 25 bp, Mus musculus
acatacccagtttcttcacttcaag

SEQ ID NO: 104693 - DNA, 25 bp, Mus musculus
acatacccatttccgtgggcgggcg

SEQ ID NO: 104694 - DNA, 25 bp, Mus musculus
acatacccatttgcgtgggcgggcg

SEQ ID NO: 104695 - DNA, 25 bp, Mus musculus
acataccccctaaatacatacacat

SEQ ID NO: 104696 - DNA, 25 bp, Mus musculus
acataccccctatatacatacacat

SEQ ID NO: 104697 - DNA, 25 bp, Mus musculus
acatacccgatgattttgtttatag

SEQ ID NO: 104698 - DNA, 25 bp, Mus musculus
acatacccgatgtttttgtttatag

SEQ ID NO: 104699 - DNA, 25 bp, Mus musculus
acataccctataaggtgacactggt

SEQ ID NO: 104700 - DNA, 25 bp, Mus musculus
acataccctatatggtgacactggt

SEQ ID NO: 104701 - DNA, 25 bp, Mus musculus
acataccctcttatgtttagtggtc

SEQ ID NO: 104702 - DNA, 25 bp, Mus musculus
acataccctcttttgtttagtggtc

SEQ ID NO: 104703 - DNA, 25 bp, Mus musculus
acataccctgcaagcacggtttaga

SEQ ID NO: 104704 - DNA, 25 bp, Mus musculus
acataccctgcatgcacggtttaga

SEQ ID NO: 104705 - DNA, 25 bp, Mus musculus
acataccctgctagcgtccgggaca

SEQ ID NO: 104706 - DNA, 25 bp, Mus musculus
acataccctgcttgcgtccgggaca

SEQ ID NO: 104707 - DNA, 25 bp, Mus musculus
acataccctgtaatccttgtgtttg

SEQ ID NO: 104708 - DNA, 25 bp, Mus musculus
acataccctgtattccttgtgtttg

SEQ ID NO: 104709 - DNA, 25 bp, Mus musculus
acatacccttaaaccgagtacttag

SEQ ID NO: 104710 - DNA, 25 bp, Mus musculus
acatacccttaatccgagtacttag

SEQ ID NO: 104711 - DNA, 25 bp, Mus musculus
acataccgctttattgttgagcaac

SEQ ID NO: 104712 - DNA, 25 bp, Mus musculus
acataccgcttttttgttgagcaac

SEQ ID NO: 104713 - DNA, 25 bp, Mus musculus
acatacctatggacttttgaccagg

SEQ ID NO: 104714 - DNA, 25 bp, Mus musculus
acatacctatggtcttttgaccagg

SEQ ID NO: 104715 - DNA, 25 bp, Mus musculus
acatacctcaggatcccaaatgctg

SEQ ID NO: 104716 - DNA, 25 bp, Mus musculus
acatacctcaggttcccaaatgctg

SEQ ID NO: 104717 - DNA, 25 bp, Mus musculus
acatacctccagcagctacagagta

SEQ ID NO: 104718 - DNA, 25 bp, Mus musculus
acatacctccaggagctacagagta

SEQ ID NO: 104719 - DNA, 25 bp, Mus musculus
acatacctctccctgtggaacatta

SEQ ID NO: 104720 - DNA, 25 bp, Mus musculus
acatacctctccgtgtggaacatta

SEQ ID NO: 104721 - DNA, 25 bp, Mus musculus
acatacctgcagattgtgccagctg

SEQ ID NO: 104722 - DNA, 25 bp, Mus musculus
acatacctgcagtttgtgccagctg

SEQ ID NO: 104723 - DNA, 25 bp, Mus musculus
acatacctggatcttgcccatgact

SEQ ID NO: 104724 - DNA, 25 bp, Mus musculus
acatacctggatgttgcccatgact

SEQ ID NO: 104725 - DNA, 25 bp, Mus musculus
acataccttaaaaactccatctgaa

SEQ ID NO: 104726 - DNA, 25 bp, Mus musculus
acataccttaaatactccatctgaa

SEQ ID NO: 104727 - DNA, 25 bp, Mus musculus
acataccttatgagtacctgcggcc

SEQ ID NO: 104728 - DNA, 25 bp, Mus musculus
acataccttatgtgtacctgcggcc

SEQ ID NO: 104729 - DNA, 25 bp, Mus musculus
acataccttctaaaacctagacatt

SEQ ID NO: 104730 - DNA, 25 bp, Mus musculus
acataccttctataacctagacatt

SEQ ID NO: 104731 - DNA, 25 bp, Mus musculus
acataccttggactacctgcctaat

SEQ ID NO: 104732 - DNA, 25 bp, Mus musculus
acataccttggagtacctgcctaat

SEQ ID NO: 104733 - DNA, 25 bp, Mus musculus
acatacctttctctgggccccaaat

SEQ ID NO: 104734 - DNA, 25 bp, Mus musculus
acatacctttctgtgggccccaaat

SEQ ID NO: 104735 - DNA, 25 bp, Mus musculus
acatacctttgaacgcgggactcag

SEQ ID NO: 104736 - DNA, 25 bp, Mus musculus
acatacctttgatcgcgggactcag

SEQ ID NO: 104737 - DNA, 25 bp, Mus musculus
acatacctttttcaagctacagaaa

SEQ ID NO: 104738 - DNA, 25 bp, Mus musculus
acatacctttttgaagctacagaaa

SEQ ID NO: 104739 - DNA, 25 bp, Mus musculus
acatacgatgttatggtggcagcag

SEQ ID NO: 104740 - DNA, 25 bp, Mus musculus
acatacgatgttttggtggcagcag

SEQ ID NO: 104741 - DNA, 25 bp, Mus musculus
acatacgccatcagcatgcctggtg

SEQ ID NO: 104742 - DNA, 25 bp, Mus musculus
acatacgccatctgcatgcctggtg

SEQ ID NO: 104743 - DNA, 25 bp, Mus musculus
acatacgtgcacagatactatcctt

SEQ ID NO: 104744 - DNA, 25 bp, Mus musculus
acatacgtgcactgatactatcctt

SEQ ID NO: 104745 - DNA, 25 bp, Mus musculus
acatacgtgtttacctggtgccaga

SEQ ID NO: 104746 - DNA, 25 bp, Mus musculus
acatacgtgttttcctggtgccaga

SEQ ID NO: 104747 - DNA, 25 bp, Mus musculus
acatactaatgtcgctccctttttt

SEQ ID NO: 104748 - DNA, 25 bp, Mus musculus
acatactaatgtggctccctttttt

SEQ ID NO: 104749 - DNA, 25 bp, Mus musculus
acatactacacaagcctggtaaaat

SEQ ID NO: 104750 - DNA, 25 bp, Mus musculus
acatactacacatgcctggtaaaat

SEQ ID NO: 104751 - DNA, 25 bp, Mus musculus
acatactacatcattggctcttgaa

SEQ ID NO: 104752 - DNA, 25 bp, Mus musculus
acatactacatctttggctcttgaa

SEQ ID NO: 104753 - DNA, 25 bp, Mus musculus
acatactatatcactcataagcaaa

SEQ ID NO: 104754 - DNA, 25 bp, Mus musculus
acatactatatctctcataagcaaa

SEQ ID NO: 104755 - DNA, 25 bp, Mus musculus
acatactatgccaacttgccctgga

SEQ ID NO: 104756 - DNA, 25 bp, Mus musculus
acatactatgcctacttgccctgga

SEQ ID NO: 104757 - DNA, 25 bp, Mus musculus
acatactcactcacttagggctttt

SEQ ID NO: 104758 - DNA, 25 bp, Mus musculus
acatactcactctcttagggctttt

SEQ ID NO: 104759 - DNA, 25 bp, Mus musculus
acatactcattgagaactctctgtt

SEQ ID NO: 104760 - DNA, 25 bp, Mus musculus
acatactcattgtgaactctctgtt

SEQ ID NO: 104761 - DNA, 25 bp, Mus musculus
acatactctggtctcaacacgctaa

SEQ ID NO: 104762 - DNA, 25 bp, Mus musculus
acatactctggtgtcaacacgctaa

SEQ ID NO: 104763 - DNA, 25 bp, Mus musculus
acatactctgtgaccttgatacctg

SEQ ID NO: 104764 - DNA, 25 bp, Mus musculus
acatactctgtgtccttgatacctg

SEQ ID NO: 104765 - DNA, 25 bp, Mus musculus
acatactgaggtccagctgtttgtt

SEQ ID NO: 104766 - DNA, 25 bp, Mus musculus
acatactgaggtgcagctgtttgtt

SEQ ID NO: 104767 - DNA, 25 bp, Mus musculus
acatactgatgcagtccttgaccta

SEQ ID NO: 104768 - DNA, 25 bp, Mus musculus
acatactgatgctgtccttgaccta

SEQ ID NO: 104769 - DNA, 25 bp, Mus musculus
acatactgcgctagcagaggactgg

SEQ ID NO: 104770 - DNA, 25 bp, Mus musculus
acatactgcgcttgcagaggactgg

SEQ ID NO: 104771 - DNA, 25 bp, Mus musculus
acatactggcatctgacttcttaga

SEQ ID NO: 104772 - DNA, 25 bp, Mus musculus
acatactggcatgtgacttcttaga

SEQ ID NO: 104773 - DNA, 25 bp, Mus musculus
acatactgtatgctttctacctgta

SEQ ID NO: 104774 - DNA, 25 bp, Mus musculus
acatactgtatggtttctacctgta

SEQ ID NO: 104775 - DNA, 25 bp, Mus musculus
acatacttatccacattgctgatcc

SEQ ID NO: 104776 - DNA, 25 bp, Mus musculus
acatacttatcctcattgctgatcc

SEQ ID NO: 104777 - DNA, 25 bp, Mus musculus
acatacttccatcaggcttgtgaca

SEQ ID NO: 104778 - DNA, 25 bp, Mus musculus
acatacttccatgaggcttgtgaca

SEQ ID NO: 104779 - DNA, 25 bp, Mus musculus
acatacttctatagaacattacaga

SEQ ID NO: 104780 - DNA, 25 bp, Mus musculus
acatacttctattgaacattacaga

SEQ ID NO: 104781 - DNA, 25 bp, Mus musculus
acatacttgaatacttgagttccct

SEQ ID NO: 104782 - DNA, 25 bp, Mus musculus
acatacttgaattcttgagttccct

SEQ ID NO: 104783 - DNA, 25 bp, Mus musculus
acatacttgccgctcttgggctggt

SEQ ID NO: 104784 - DNA, 25 bp, Mus musculus
acatacttgccggtcttgggctggt

SEQ ID NO: 104785 - DNA, 25 bp, Mus musculus
acatacttgggcattcaacctagaa

SEQ ID NO: 104786 - DNA, 25 bp, Mus musculus
acatacttgggctttcaacctagaa

SEQ ID NO: 104787 - DNA, 25 bp, Mus musculus
acatacttgtacagattggcctttc

SEQ ID NO: 104788 - DNA, 25 bp, Mus musculus
acatacttgtactgattggcctttc

SEQ ID NO: 104789 - DNA, 25 bp, Mus musculus
acatacttgtttcttcgttctctgg

SEQ ID NO: 104790 - DNA, 25 bp, Mus musculus
acatacttgtttgttcgttctctgg

SEQ ID NO: 104791 - DNA, 25 bp, Mus musculus
acatactttatcatgaactcccacc

SEQ ID NO: 104792 - DNA, 25 bp, Mus musculus
acatactttatcttgaactcccacc

SEQ ID NO: 104793 - DNA, 25 bp, Mus musculus
acatagaaatgtctccccaggagct

SEQ ID NO: 104794 - DNA, 25 bp, Mus musculus
acatagaaatgtgtccccaggagct

SEQ ID NO: 104795 - DNA, 25 bp, Mus musculus
acatagaataaaacagcggtctggt

SEQ ID NO: 104796 - DNA, 25 bp, Mus musculus
acatagaataaatcagcggtctggt

SEQ ID NO: 104797 - DNA, 25 bp, Mus musculus
acatagaatgccattctaagtaaac

SEQ ID NO: 104798 - DNA, 25 bp, Mus musculus
acatagaatgcctttctaagtaaac

SEQ ID NO: 104799 - DNA, 25 bp, Mus musculus
acatagaatgtgaaactgtcaggaa

SEQ ID NO: 104800 - DNA, 25 bp, Mus musculus
acatagaatgtgtaactgtcaggaa

SEQ ID NO: 104801 - DNA, 25 bp, Mus musculus
acatagacaatcactagcttcctgt

SEQ ID NO: 104802 - DNA, 25 bp, Mus musculus
acatagacaatctctagcttcctgt

SEQ ID NO: 104803 - DNA, 25 bp, Mus musculus
acatagacatctcaggtgccactgg

SEQ ID NO: 104804 - DNA, 25 bp, Mus musculus
acatagacatctgaggtgccactgg

SEQ ID NO: 104805 - DNA, 25 bp, Mus musculus
acatagagacccaatccctagaagc

SEQ ID NO: 104806 - DNA, 25 bp, Mus musculus
acatagagaccctatccctagaagc

SEQ ID NO: 104807 - DNA, 25 bp, Mus musculus
acatagagacgcagcagcgccggat

SEQ ID NO: 104808 - DNA, 25 bp, Mus musculus
acatagagacgctgcagcgccggat

SEQ ID NO: 104809 - DNA, 25 bp, Mus musculus
acatagaggtggagtccctgagaaa

SEQ ID NO: 104810 - DNA, 25 bp, Mus musculus
acatagaggtggtgtccctgagaaa

SEQ ID NO: 104811 - DNA, 25 bp, Mus musculus
acatagagttctaagccctgtcttc

SEQ ID NO: 104812 - DNA, 25 bp, Mus musculus
acatagagttcttagccctgtcttc

SEQ ID NO: 104813 - DNA, 25 bp, Mus musculus
acatagatactgactaagctggagc

SEQ ID NO: 104814 - DNA, 25 bp, Mus musculus
acatagatactgtctaagctggagc

SEQ ID NO: 104815 - DNA, 25 bp, Mus musculus
acatagatgaagacggcgactgtac

SEQ ID NO: 104816 - DNA, 25 bp, Mus musculus
acatagatgaagtcggcgactgtac

SEQ ID NO: 104817 - DNA, 25 bp, Mus musculus
acatagcactgacaaggttcctgga

SEQ ID NO: 104818 - DNA, 25 bp, Mus musculus
acatagcactgagaaggttcctgga

SEQ ID NO: 104819 - DNA, 25 bp, Mus musculus
acatagcatacactcacatttgtta

SEQ ID NO: 104820 - DNA, 25 bp, Mus musculus
acatagcatacagtcacatttgtta

SEQ ID NO: 104821 - DNA, 25 bp, Mus musculus
acatagcatcacagccagtcagggc

SEQ ID NO: 104822 - DNA, 25 bp, Mus musculus
acatagcatcactgccagtcagggc

SEQ ID NO: 104823 - DNA, 25 bp, Mus musculus
acatagcatgtacacttcagccaga

SEQ ID NO: 104824 - DNA, 25 bp, Mus musculus
acatagcatgtagacttcagccaga

SEQ ID NO: 104825 - DNA, 25 bp, Mus musculus
acatagcatttgacacctcagtctt

SEQ ID NO: 104826 - DNA, 25 bp, Mus musculus
acatagcatttgtcacctcagtctt

SEQ ID NO: 104827 - DNA, 25 bp, Mus musculus
acatagccaacaacgggcgcctggt

SEQ ID NO: 104828 - DNA, 25 bp, Mus musculus
acatagccaacatcgggcgcctggt

SEQ ID NO: 104829 - DNA, 25 bp, Mus musculus
acatagccatccctcttgaagtcaa

SEQ ID NO: 104830 - DNA, 25 bp, Mus musculus
acatagccatccgtcttgaagtcaa

SEQ ID NO: 104831 - DNA, 25 bp, Mus musculus
acatagccccttatattcctgactt

SEQ ID NO: 104832 - DNA, 25 bp, Mus musculus
acatagccccttttattcctgactt

SEQ ID NO: 104833 - DNA, 25 bp, Mus musculus
acatagcccgcaaggcagtggagct

SEQ ID NO: 104834 - DNA, 25 bp, Mus musculus
acatagcccgcatggcagtggagct

SEQ ID NO: 104835 - DNA, 25 bp, Mus musculus
acatagccggtgcagatcaagttcc

SEQ ID NO: 104836 - DNA, 25 bp, Mus musculus
acatagccggtggagatcaagttcc

SEQ ID NO: 104837 - DNA, 25 bp, Mus musculus
acatagcctggcactaatgctgatg

SEQ ID NO: 104838 - DNA, 25 bp, Mus musculus
acatagcctggctctaatgctgatg

SEQ ID NO: 104839 - DNA, 25 bp, Mus musculus
acatagcgatgactcttggcaccca

SEQ ID NO: 104840 - DNA, 25 bp, Mus musculus
acatagcgatgagtcttggcaccca

SEQ ID NO: 104841 - DNA, 25 bp, Mus musculus
acatagcgtttaatcaggtccacag

SEQ ID NO: 104842 - DNA, 25 bp, Mus musculus
acatagcgtttattcaggtccacag

SEQ ID NO: 104843 - DNA, 25 bp, Mus musculus
acatagctctgaaactcactgtgga

SEQ ID NO: 104844 - DNA, 25 bp, Mus musculus
acatagctctgatactcactgtgga

SEQ ID NO: 104845 - DNA, 25 bp, Mus musculus
acatagctctggaggtcttgcacat

SEQ ID NO: 104846 - DNA, 25 bp, Mus musculus
acatagctctggtggtcttgcacat

SEQ ID NO: 104847 - DNA, 25 bp, Mus musculus
acatagctgcaaacgtggtagccag

SEQ ID NO: 104848 - DNA, 25 bp, Mus musculus
acatagctgcaatcgtggtagccag

SEQ ID NO: 104849 - DNA, 25 bp, Mus musculus
acatagctggcaccaaggagacccc

SEQ ID NO: 104850 - DNA, 25 bp, Mus musculus
acatagctggcagcaaggagacccc

SEQ ID NO: 104851 - DNA, 25 bp, Mus musculus
acatagctggtgagtcaggagacaa

SEQ ID NO: 104852 - DNA, 25 bp, Mus musculus
acatagctggtgtgtcaggagacaa

SEQ ID NO: 104853 - DNA, 25 bp, Mus musculus
acatagctgttcagcatttcgatga

SEQ ID NO: 104854 - DNA, 25 bp, Mus musculus
acatagctgttctgcatttcgatga

SEQ ID NO: 104855 - DNA, 25 bp, Mus musculus
acatagcttactactctctctaaag

SEQ ID NO: 104856 - DNA, 25 bp, Mus musculus
acatagcttacttctctctctaaag

SEQ ID NO: 104857 - DNA, 25 bp, Mus musculus
acatagctttagcaactagcaccgt

SEQ ID NO: 104858 - DNA, 25 bp, Mus musculus
acatagctttaggaactagcaccgt

SEQ ID NO: 104859 - DNA, 25 bp, Mus musculus
acataggagggcatgtccccacaca

SEQ ID NO: 104860 - DNA, 25 bp, Mus musculus
acataggagggcttgtccccacaca

SEQ ID NO: 104861 - DNA, 25 bp, Mus musculus
acataggaggtcatggcttctgacc

SEQ ID NO: 104862 - DNA, 25 bp, Mus musculus
acataggaggtcttggcttctgacc

SEQ ID NO: 104863 - DNA, 25 bp, Mus musculus
acataggagtatacgcagtgctgat

SEQ ID NO: 104864 - DNA, 25 bp, Mus musculus
acataggagtattcgcagtgctgat

SEQ ID NO: 104865 - DNA, 25 bp, Mus musculus
acataggatcgccaggcggagtccc

SEQ ID NO: 104866 - DNA, 25 bp, Mus musculus
acataggatcgcgaggcggagtccc

SEQ ID NO: 104867 - DNA, 25 bp, Mus musculus
acataggatctaatctcttcctcgc

SEQ ID NO: 104868 - DNA, 25 bp, Mus musculus
acataggatctattctcttcctcgc

SEQ ID NO: 104869 - DNA, 25 bp, Mus musculus
acataggcaacccagcacatctgtt

SEQ ID NO: 104870 - DNA, 25 bp, Mus musculus
acataggcaaccgagcacatctgtt

SEQ ID NO: 104871 - DNA, 25 bp, Mus musculus
acataggcaatccattctaaaatcg

SEQ ID NO: 104872 - DNA, 25 bp, Mus musculus
acataggcaatcgattctaaaatcg

SEQ ID NO: 104873 - DNA, 25 bp, Mus musculus
acataggcaccaatggctcttttct

SEQ ID NO: 104874 - DNA, 25 bp, Mus musculus
acataggcaccattggctcttttct

SEQ ID NO: 104875 - DNA, 25 bp, Mus musculus
acataggcacctcagctctcatgga

SEQ ID NO: 104876 - DNA, 25 bp, Mus musculus
acataggcacctgagctctcatgga

SEQ ID NO: 104877 - DNA, 25 bp, Mus musculus
acataggcagcccacacacatgtgt

SEQ ID NO: 104878 - DNA, 25 bp, Mus musculus
acataggcagccgacacacatgtgt

SEQ ID NO: 104879 - DNA, 25 bp, Mus musculus
acataggcagtaattagtctcagag

SEQ ID NO: 104880 - DNA, 25 bp, Mus musculus
acataggcagtatttagtctcagag

SEQ ID NO: 104881 - DNA, 25 bp, Mus musculus
acataggccatgaaggtggcgtgtt

SEQ ID NO: 104882 - DNA, 25 bp, Mus musculus
acataggccatgtaggtggcgtgtt

SEQ ID NO: 104883 - DNA, 25 bp, Mus musculus
acataggccgccaccattgttcata

SEQ ID NO: 104884 - DNA, 25 bp, Mus musculus
acataggccgcctccattgttcata

SEQ ID NO: 104885 - DNA, 25 bp, Mus musculus
acataggcctatagcttcacctcag

SEQ ID NO: 104886 - DNA, 25 bp, Mus musculus
acataggcctattgcttcacctcag

SEQ ID NO: 104887 - DNA, 25 bp, Mus musculus
acataggcctgtctgttgcgttcac

SEQ ID NO: 104888 - DNA, 25 bp, Mus musculus
acataggcctgtgtgttgcgttcac

SEQ ID NO: 104889 - DNA, 25 bp, Mus musculus
acataggcgcccagcctcgattaat

SEQ ID NO: 104890 - DNA, 25 bp, Mus musculus
acataggcgccctgcctcgattaat

SEQ ID NO: 104891 - DNA, 25 bp, Mus musculus
acataggctctgctgacagctgctc

SEQ ID NO: 104892 - DNA, 25 bp, Mus musculus
acataggctctggtgacagctgctc

SEQ ID NO: 104893 - DNA, 25 bp, Mus musculus
acataggctgtcagtgtttggcttt

SEQ ID NO: 104894 - DNA, 25 bp, Mus musculus
acataggctgtctgtgtttggcttt

SEQ ID NO: 104895 - DNA, 25 bp, Mus musculus
acataggcttccctggtagtaccag

SEQ ID NO: 104896 - DNA, 25 bp, Mus musculus
acataggcttccgtggtagtaccag

SEQ ID NO: 104897 - DNA, 25 bp, Mus musculus
acataggcttctacacccctaatga

SEQ ID NO: 104898 - DNA, 25 bp, Mus musculus
acataggcttctctcagtgcagact

SEQ ID NO: 104899 - DNA, 25 bp, Mus musculus
acataggcttctgtcagtgcagact

SEQ ID NO: 104900 - DNA, 25 bp, Mus musculus
acataggcttcttcacccctaatga

SEQ ID NO: 104901 - DNA, 25 bp, Mus musculus
acatagggatatactgtgggacaca

SEQ ID NO: 104902 - DNA, 25 bp, Mus musculus
acatagggatattctgtgggacaca

SEQ ID NO: 104903 - DNA, 25 bp, Mus musculus
acatagggccccagtcacatttgat

SEQ ID NO: 104904 - DNA, 25 bp, Mus musculus
acatagggcccctgtcacatttgat

SEQ ID NO: 104905 - DNA, 25 bp, Mus musculus
acatagggctacactcattactgtt

SEQ ID NO: 104906 - DNA, 25 bp, Mus musculus
acatagggctactctcattactgtt

SEQ ID NO: 104907 - DNA, 25 bp, Mus musculus
acatagggctcaagtattttgttgt

SEQ ID NO: 104908 - DNA, 25 bp, Mus musculus
acatagggctcatgtattttgttgt

SEQ ID NO: 104909 - DNA, 25 bp, Mus musculus
acatagggctgacatgactaacctc

SEQ ID NO: 104910 - DNA, 25 bp, Mus musculus
acatagggctgagatgactaacctc

SEQ ID NO: 104911 - DNA, 25 bp, Mus musculus
acataggtcagcagaaaccccttgc

SEQ ID NO: 104912 - DNA, 25 bp, Mus musculus
acataggtcagctgaaaccccttgc

SEQ ID NO: 104913 - DNA, 25 bp, Mus musculus
acataggtggtgaatttcaacagat

SEQ ID NO: 104914 - DNA, 25 bp, Mus musculus
acataggtggtgtatttcaacagat

SEQ ID NO: 104915 - DNA, 25 bp, Mus musculus
acataggttcttcaagtctgtccat

SEQ ID NO: 104916 - DNA, 25 bp, Mus musculus
acataggttcttgaagtctgtccat

SEQ ID NO: 104917 - DNA, 25 bp, Mus musculus
acatagtaacatctgcctcaaaaaa

SEQ ID NO: 104918 - DNA, 25 bp, Mus musculus
acatagtaacatgtgcctcaaaaaa

SEQ ID NO: 104919 - DNA, 25 bp, Mus musculus
acatagtaaggccaggccagtcaag

SEQ ID NO: 104920 - DNA, 25 bp, Mus musculus
acatagtaaggcgaggccagtcaag

SEQ ID NO: 104921 - DNA, 25 bp, Mus musculus
acatagtacgaaacactgttacgct

SEQ ID NO: 104922 - DNA, 25 bp, Mus musculus
acatagtacgaatcactgttacgct

SEQ ID NO: 104923 - DNA, 25 bp, Mus musculus
acatagtactacactcaacctttag

SEQ ID NO: 104924 - DNA, 25 bp, Mus musculus
acatagtactactctcaacctttag

SEQ ID NO: 104925 - DNA, 25 bp, Mus musculus
acatagtagctgcactaagccctcc

SEQ ID NO: 104926 - DNA, 25 bp, Mus musculus
acatagtagctggactaagccctcc

SEQ ID NO: 104927 - DNA, 25 bp, Mus musculus
acatagtagtagatatttacaggag

SEQ ID NO: 104928 - DNA, 25 bp, Mus musculus
acatagtagtagttatttacaggag

SEQ ID NO: 104929 - DNA, 25 bp, Mus musculus
acatagtcaactacagcctgctgtc

SEQ ID NO: 104930 - DNA, 25 bp, Mus musculus
acatagtcaacttcagcctgctgtc

SEQ ID NO: 104931 - DNA, 25 bp, Mus musculus
acatagtcagagcactcagcactcc

SEQ ID NO: 104932 - DNA, 25 bp, Mus musculus
acatagtcagaggactcagcactcc

SEQ ID NO: 104933 - DNA, 25 bp, Mus musculus
acatagtcagctagtggccccttgt

SEQ ID NO: 104934 - DNA, 25 bp, Mus musculus
acatagtcagcttgtggccccttgt

SEQ ID NO: 104935 - DNA, 25 bp, Mus musculus
acatagtcagtcaagcaacactgtg

SEQ ID NO: 104936 - DNA, 25 bp, Mus musculus
acatagtcagtctagcaacactgtg

SEQ ID NO: 104937 - DNA, 25 bp, Mus musculus
acatagtcagttcatcttttaacaa

SEQ ID NO: 104938 - DNA, 25 bp, Mus musculus
acatagtcagttgatcttttaacaa

SEQ ID NO: 104939 - DNA, 25 bp, Mus musculus
acatagtcctatcttttcatattat

SEQ ID NO: 104940 - DNA, 25 bp, Mus musculus
acatagtcctatgttttcatattat

SEQ ID NO: 104941 - DNA, 25 bp, Mus musculus
acatagtccttgcattctgtgccat

SEQ ID NO: 104942 - DNA, 25 bp, Mus musculus
acatagtccttggattctgtgccat

SEQ ID NO: 104943 - DNA, 25 bp, Mus musculus
acatagtctacactgcttccttagc

SEQ ID NO: 104944 - DNA, 25 bp, Mus musculus
acatagtctacagtgcttccttagc

SEQ ID NO: 104945 - DNA, 25 bp, Mus musculus
acatagtgactacttgctctggctt

SEQ ID NO: 104946 - DNA, 25 bp, Mus musculus
acatagtgactagttgctctggctt

SEQ ID NO: 104947 - DNA, 25 bp, Mus musculus
acatagtgactgaaggggacccctc

SEQ ID NO: 104948 - DNA, 25 bp, Mus musculus
acatagtgactgtaggggacccctc

SEQ ID NO: 104949 - DNA, 25 bp, Mus musculus
acatagtgagcacaccctgtgatat

SEQ ID NO: 104950 - DNA, 25 bp, Mus musculus
acatagtgagcagaccctgtgatat

SEQ ID NO: 104951 - DNA, 25 bp, Mus musculus
acatagtgcaggcatcttcacttgc

SEQ ID NO: 104952 - DNA, 25 bp, Mus musculus
acatagtgcagggatcttcacttgc

SEQ ID NO: 104953 - DNA, 25 bp, Mus musculus
acatagtgcataatcctggccctga

SEQ ID NO: 104954 - DNA, 25 bp, Mus musculus
acatagtgcatattcctggccctga

SEQ ID NO: 104955 - DNA, 25 bp, Mus musculus
acatagtgtagaaccggctgggcct

SEQ ID NO: 104956 - DNA, 25 bp, Mus musculus
acatagtgtagatccggctgggcct

SEQ ID NO: 104957 - DNA, 25 bp, Mus musculus
acatagttatcccttttactgatca

SEQ ID NO: 104958 - DNA, 25 bp, Mus musculus
acatagttatccgttttactgatca

SEQ ID NO: 104959 - DNA, 25 bp, Mus musculus
acatagttgggcactgacacagacc

SEQ ID NO: 104960 - DNA, 25 bp, Mus musculus
acatagttgggctctgacacagacc

SEQ ID NO: 104961 - DNA, 25 bp, Mus musculus
acatagtttgttctgtcatccctgt

SEQ ID NO: 104962 - DNA, 25 bp, Mus musculus
acatagtttgttgtgtcatccctgt

SEQ ID NO: 104963 - DNA, 25 bp, Mus musculus
acatagttttggcattcttcacatc

SEQ ID NO: 104964 - DNA, 25 bp, Mus musculus
acatagttttgggattcttcacatc

SEQ ID NO: 104965 - DNA, 25 bp, Mus musculus
acatagttttgtctcttcctttgga

SEQ ID NO: 104966 - DNA, 25 bp, Mus musculus
acatagttttgtgtcttcctttgga

SEQ ID NO: 104967 - DNA, 25 bp, Mus musculus
acatataacgggagtgtgtgcaaca

SEQ ID NO: 104968 - DNA, 25 bp, Mus musculus
acatataacgggtgtgtgtgcaaca

SEQ ID NO: 104969 - DNA, 25 bp, Mus musculus
acatataagcccctcatggatcgtc

SEQ ID NO: 104970 - DNA, 25 bp, Mus musculus
acatataagcccgtcatggatcgtc

SEQ ID NO: 104971 - DNA, 25 bp, Mus musculus
acatataataatcgcgcctcacaac

SEQ ID NO: 104972 - DNA, 25 bp, Mus musculus
acatataataatggcgcctcacaac

SEQ ID NO: 104973 - DNA, 25 bp, Mus musculus
acatatacaccacactcaacaagtg

SEQ ID NO: 104974 - DNA, 25 bp, Mus musculus
acatatacaccagactcaacaagtg

SEQ ID NO: 104975 - DNA, 25 bp, Mus musculus
acatatacactcaccacaaattcta

SEQ ID NO: 104976 - DNA, 25 bp, Mus musculus
acatatacactctccacaaattcta

SEQ ID NO: 104977 - DNA, 25 bp, Mus musculus
acatatacacttcactaacctctgg

SEQ ID NO: 104978 - DNA, 25 bp, Mus musculus
acatatacacttgactaacctctgg

SEQ ID NO: 104979 - DNA, 25 bp, Mus musculus
acatatacaggtcaccctgacacgt

SEQ ID NO: 104980 - DNA, 25 bp, Mus musculus
acatatacaggtgaccctgacacgt

SEQ ID NO: 104981 - DNA, 25 bp, Mus musculus
acatatacatgcatgcccgcgcgcg

SEQ ID NO: 104982 - DNA, 25 bp, Mus musculus
acatatacatgcttgcccgcgcgcg

SEQ ID NO: 104983 - DNA, 25 bp, Mus musculus
acatatacccctatgcattttgatc

SEQ ID NO: 104984 - DNA, 25 bp, Mus musculus
acatatacccctttgcattttgatc

SEQ ID NO: 104985 - DNA, 25 bp, Mus musculus
acatatatgcacactagaggccaga

SEQ ID NO: 104986 - DNA, 25 bp, Mus musculus
acatatatgcactctagaggccaga

SEQ ID NO: 104987 - DNA, 25 bp, Mus musculus
acatatatgcttacagtgcacctag

SEQ ID NO: 104988 - DNA, 25 bp, Mus musculus
acatatatgctttcagtgcacctag

SEQ ID NO: 104989 - DNA, 25 bp, Mus musculus
acatatatgggcaagctggcggctt

SEQ ID NO: 104990 - DNA, 25 bp, Mus musculus
acatatatgggctagctggcggctt

SEQ ID NO: 104991 - DNA, 25 bp, Mus musculus
acatatatgtgaattctagcgatct

SEQ ID NO: 104992 - DNA, 25 bp, Mus musculus
acatatatgtgatttctagcgatct

SEQ ID NO: 104993 - DNA, 25 bp, Mus musculus
acatatattttcaaggactcactct

SEQ ID NO: 104994 - DNA, 25 bp, Mus musculus
acatatattttctaggactcactct

SEQ ID NO: 104995 - DNA, 25 bp, Mus musculus
acatatcaagtgcatcctatttctt

SEQ ID NO: 104996 - DNA, 25 bp, Mus musculus
acatatcaagtggatcctatttctt

SEQ ID NO: 104997 - DNA, 25 bp, Mus musculus
acatatcacaagaaggacctctcct

SEQ ID NO: 104998 - DNA, 25 bp, Mus musculus
acatatcacaagtaggacctctcct

SEQ ID NO: 104999 - DNA, 25 bp, Mus musculus
acatatcacctaatgttcacaagta

SEQ ID NO: 105000 - DNA, 25 bp, Mus musculus
acatatcacctattgttcacaagta

SEQ ID NO: 105001 - DNA, 25 bp, Mus musculus
acatatcacctgatcaggacaggcc

SEQ ID NO: 105002 - DNA, 25 bp, Mus musculus
acatatcacctgttcaggacaggcc

SEQ ID NO: 105003 - DNA, 25 bp, Mus musculus
acatatcactcactgctctttgctc

SEQ ID NO: 105004 - DNA, 25 bp, Mus musculus
acatatcactcagtgctctttgctc

SEQ ID NO: 105005 - DNA, 25 bp, Mus musculus
acatatcacttcctttagctcacag

SEQ ID NO: 105006 - DNA, 25 bp, Mus musculus
acatatcacttcgtttagctcacag

SEQ ID NO: 105007 - DNA, 25 bp, Mus musculus
acatatcagggtaatctagagctcc

SEQ ID NO: 105008 - DNA, 25 bp, Mus musculus
acatatcagggttatctagagctcc

SEQ ID NO: 105009 - DNA, 25 bp, Mus musculus
acatatcatcccatgttcattcgtc

SEQ ID NO: 105010 - DNA, 25 bp, Mus musculus
acatatcatcccttgttcattcgtc

SEQ ID NO: 105011 - DNA, 25 bp, Mus musculus
acatatcatcctcttcacgttgagt

SEQ ID NO: 105012 - DNA, 25 bp, Mus musculus
acatatcatcctgttcacgttgagt

SEQ ID NO: 105013 - DNA, 25 bp, Mus musculus
acatatccacatctcttctacattt

SEQ ID NO: 105014 - DNA, 25 bp, Mus musculus
acatatccacatgtcttctacattt

SEQ ID NO: 105015 - DNA, 25 bp, Mus musculus
acatatccaccgctacttttaattc

SEQ ID NO: 105016 - DNA, 25 bp, Mus musculus
acatatccaccggtacttttaattc

SEQ ID NO: 105017 - DNA, 25 bp, Mus musculus
acatatccagatactcgggtggctc

SEQ ID NO: 105018 - DNA, 25 bp, Mus musculus
acatatccagattctcgggtggctc

SEQ ID NO: 105019 - DNA, 25 bp, Mus musculus
acatatccaggtccggtgtgtgtat

SEQ ID NO: 105020 - DNA, 25 bp, Mus musculus
acatatccaggtgcggtgtgtgtat

SEQ ID NO: 105021 - DNA, 25 bp, Mus musculus
acatatcctgagatgtccctgtcag

SEQ ID NO: 105022 - DNA, 25 bp, Mus musculus
acatatcctgagttgtccctgtcag

SEQ ID NO: 105023 - DNA, 25 bp, Mus musculus
acatatcctgggaaaactgagctct

SEQ ID NO: 105024 - DNA, 25 bp, Mus musculus
acatatcctgggtaaactgagctct

SEQ ID NO: 105025 - DNA, 25 bp, Mus musculus
acatatcggtaactccagcacttaa

SEQ ID NO: 105026 - DNA, 25 bp, Mus musculus
acatatcggtaagtccagcacttaa

SEQ ID NO: 105027 - DNA, 25 bp, Mus musculus
acatatctattgatggttccattga

SEQ ID NO: 105028 - DNA, 25 bp, Mus musculus
acatatctattgttggttccattga

SEQ ID NO: 105029 - DNA, 25 bp, Mus musculus
acatatctcaggcttctttttcttt

SEQ ID NO: 105030 - DNA, 25 bp, Mus musculus
acatatctcagggttctttttcttt

SEQ ID NO: 105031 - DNA, 25 bp, Mus musculus
acatatctcttgaatatttacactt

SEQ ID NO: 105032 - DNA, 25 bp, Mus musculus
acatatctcttgtatatttacactt

SEQ ID NO: 105033 - DNA, 25 bp, Mus musculus
acatatctgatgatagccatgtcta

SEQ ID NO: 105034 - DNA, 25 bp, Mus musculus
acatatctgatgttagccatgtcta

SEQ ID NO: 105035 - DNA, 25 bp, Mus musculus
acatatctgtttcattctcctggag

SEQ ID NO: 105036 - DNA, 25 bp, Mus musculus
acatatctgtttgattctcctggag

SEQ ID NO: 105037 - DNA, 25 bp, Mus musculus
acatatctttgtctagcagggagta

SEQ ID NO: 105038 - DNA, 25 bp, Mus musculus
acatatctttgtgtagcagggagta

SEQ ID NO: 105039 - DNA, 25 bp, Mus musculus
acatatgacaggaattagtagggca

SEQ ID NO: 105040 - DNA, 25 bp, Mus musculus
acatatgacaggtattagtagggca

SEQ ID NO: 105041 - DNA, 25 bp, Mus musculus
acatatgaccaaattatcccctaat

SEQ ID NO: 105042 - DNA, 25 bp, Mus musculus
acatatgaccaatttatcccctaat

SEQ ID NO: 105043 - DNA, 25 bp, Mus musculus
acatatgatgctcgagtttctcttt

SEQ ID NO: 105044 - DNA, 25 bp, Mus musculus
acatatgatgctggagtttctcttt

SEQ ID NO: 105045 - DNA, 25 bp, Mus musculus
acatatgattgcacgatcactttag

SEQ ID NO: 105046 - DNA, 25 bp, Mus musculus
acatatgattgctcgatcactttag

SEQ ID NO: 105047 - DNA, 25 bp, Mus musculus
acatatgcaaggctcatgggcttaa

SEQ ID NO: 105048 - DNA, 25 bp, Mus musculus
acatatgcaagggtcatgggcttaa

SEQ ID NO: 105049 - DNA, 25 bp, Mus musculus
acatatgcagacactgtctcacaca

SEQ ID NO: 105050 - DNA, 25 bp, Mus musculus
acatatgcagactctgtctcacaca

SEQ ID NO: 105051 - DNA, 25 bp, Mus musculus
acatatgccttcatgggaacagcca

SEQ ID NO: 105052 - DNA, 25 bp, Mus musculus
acatatgccttcttgggaacagcca

SEQ ID NO: 105053 - DNA, 25 bp, Mus musculus
acatatgcgccacggtgctttgaag

SEQ ID NO: 105054 - DNA, 25 bp, Mus musculus
acatatgcgccagggtgctttgaag

SEQ ID NO: 105055 - DNA, 25 bp, Mus musculus
acatatgcggttcaagttttattat

SEQ ID NO: 105056 - DNA, 25 bp, Mus musculus
acatatgcggttgaagttttattat

SEQ ID NO: 105057 - DNA, 25 bp, Mus musculus
acatatggagccagctgtgcggagc

SEQ ID NO: 105058 - DNA, 25 bp, Mus musculus
acatatggagcctgctgtgcggagc

SEQ ID NO: 105059 - DNA, 25 bp, Mus musculus
acatatggatttctcctttgatata

SEQ ID NO: 105060 - DNA, 25 bp, Mus musculus
acatatggatttgtcctttgatata

SEQ ID NO: 105061 - DNA, 25 bp, Mus musculus
acatatggctttctcttgtatgcaa

SEQ ID NO: 105062 - DNA, 25 bp, Mus musculus
acatatggctttgtcttgtatgcaa

SEQ ID NO: 105063 - DNA, 25 bp, Mus musculus
acatatgggactagcgggcatccac

SEQ ID NO: 105064 - DNA, 25 bp, Mus musculus
acatatgggacttgcgggcatccac

SEQ ID NO: 105065 - DNA, 25 bp, Mus musculus
acatatgggcatccgagtgactact

SEQ ID NO: 105066 - DNA, 25 bp, Mus musculus
acatatgggcatgcgagtgactact

SEQ ID NO: 105067 - DNA, 25 bp, Mus musculus
acatatggtatgcttgaactgttaa

SEQ ID NO: 105068 - DNA, 25 bp, Mus musculus
acatatggtatggttgaactgttaa

SEQ ID NO: 105069 - DNA, 25 bp, Mus musculus
acatatgtccatctatttgcaagca

SEQ ID NO: 105070 - DNA, 25 bp, Mus musculus
acatatgtccatgtatttgcaagca

SEQ ID NO: 105071 - DNA, 25 bp, Mus musculus
acatatgtctccctagcacttggga

SEQ ID NO: 105072 - DNA, 25 bp, Mus musculus
acatatgtctccgtagcacttggga

SEQ ID NO: 105073 - DNA, 25 bp, Mus musculus
acatatgtgcacagctttagcaaat

SEQ ID NO: 105074 - DNA, 25 bp, Mus musculus
acatatgtgcactgctttagcaaat

SEQ ID NO: 105075 - DNA, 25 bp, Mus musculus
acatatgtggaactcaccagaccca

SEQ ID NO: 105076 - DNA, 25 bp, Mus musculus
acatatgtggaagtcaccagaccca

SEQ ID NO: 105077 - DNA, 25 bp, Mus musculus
acatatgtgtgcataatgtgtcagg

SEQ ID NO: 105078 - DNA, 25 bp, Mus musculus
acatatgtgtgcttaatgtgtcagg

SEQ ID NO: 105079 - DNA, 25 bp, Mus musculus
acatatgttcctagggatgccacca

SEQ ID NO: 105080 - DNA, 25 bp, Mus musculus
acatatgttccttgggatgccacca

SEQ ID NO: 105081 - DNA, 25 bp, Mus musculus
acatatgttgacaggcacctgtgac

SEQ ID NO: 105082 - DNA, 25 bp, Mus musculus
acatatgttgactggcacctgtgac

SEQ ID NO: 105083 - DNA, 25 bp, Mus musculus
acatatgttgttcagctccgatctt

SEQ ID NO: 105084 - DNA, 25 bp, Mus musculus
acatatgttgttgagctccgatctt

SEQ ID NO: 105085 - DNA, 25 bp, Mus musculus
acatatgtttacacttccaaggtga

SEQ ID NO: 105086 - DNA, 25 bp, Mus musculus
acatatgtttactcttccaaggtga

SEQ ID NO: 105087 - DNA, 25 bp, Mus musculus
acatatgttttacgtgtgggaacac

SEQ ID NO: 105088 - DNA, 25 bp, Mus musculus
acatatgttttaggtgtgggaacac

SEQ ID NO: 105089 - DNA, 25 bp, Mus musculus
acatattacggacgagagttgcaag

SEQ ID NO: 105090 - DNA, 25 bp, Mus musculus
acatattacggaggagagttgcaag

SEQ ID NO: 105091 - DNA, 25 bp, Mus musculus
acatattactgtcgaggaggactga

SEQ ID NO: 105092 - DNA, 25 bp, Mus musculus
acatattactgtggaggaggactga

SEQ ID NO: 105093 - DNA, 25 bp, Mus musculus
acatattagcttctatctgcagata

SEQ ID NO: 105094 - DNA, 25 bp, Mus musculus
acatattagcttgtatctgcagata

SEQ ID NO: 105095 - DNA, 25 bp, Mus musculus
acatattccctaactccttattttg

SEQ ID NO: 105096 - DNA, 25 bp, Mus musculus
acatattccctatctccttattttg

SEQ ID NO: 105097 - DNA, 25 bp, Mus musculus
acatattcctgacaacaatcaccct

SEQ ID NO: 105098 - DNA, 25 bp, Mus musculus
acatattcctgagaacaatcaccct

SEQ ID NO: 105099 - DNA, 25 bp, Mus musculus
acatattctgaaagttgagctccat

SEQ ID NO: 105100 - DNA, 25 bp, Mus musculus
acatattctgaatgttgagctccat

SEQ ID NO: 105101 - DNA, 25 bp, Mus musculus
acatattcttggataaccatggtta

SEQ ID NO: 105102 - DNA, 25 bp, Mus musculus
acatattcttggttaaccatggtta

SEQ ID NO: 105103 - DNA, 25 bp, Mus musculus
acatattgcaaaaggccgggccact

SEQ ID NO: 105104 - DNA, 25 bp, Mus musculus
acatattgcaaatggccgggccact

SEQ ID NO: 105105 - DNA, 25 bp, Mus musculus
acatattgggtgctaggacagcatc

SEQ ID NO: 105106 - DNA, 25 bp, Mus musculus
acatattgggtggtaggacagcatc

SEQ ID NO: 105107 - DNA, 25 bp, Mus musculus
acatatttacatcttcctagccaag

SEQ ID NO: 105108 - DNA, 25 bp, Mus musculus
acatatttacatgttcctagccaag

SEQ ID NO: 105109 - DNA, 25 bp, Mus musculus
acatatttctataccctgttaggtt

SEQ ID NO: 105110 - DNA, 25 bp, Mus musculus
acatatttctattccctgttaggtt

SEQ ID NO: 105111 - DNA, 25 bp, Mus musculus
acatatttctcacttgctggtacat

SEQ ID NO: 105112 - DNA, 25 bp, Mus musculus
acatatttctcagttgctggtacat

SEQ ID NO: 105113 - DNA, 25 bp, Mus musculus
acatcaaaagcaattcccactcttc

SEQ ID NO: 105114 - DNA, 25 bp, Mus musculus
acatcaaaagcatttcccactcttc

SEQ ID NO: 105115 - DNA, 25 bp, Mus musculus
acatcaaaagtgctttcttgtaaag

SEQ ID NO: 105116 - DNA, 25 bp, Mus musculus
acatcaaaagtggtttcttgtaaag

SEQ ID NO: 105117 - DNA, 25 bp, Mus musculus
acatcaaacggtacaggaagctgct

SEQ ID NO: 105118 - DNA, 25 bp, Mus musculus
acatcaaacggttcaggaagctgct

SEQ ID NO: 105119 - DNA, 25 bp, Mus musculus
acatcaaacgtcagctcaaggtggt

SEQ ID NO: 105120 - DNA, 25 bp, Mus musculus
acatcaaacgtctgctcaaggtggt

SEQ ID NO: 105121 - DNA, 25 bp, Mus musculus
acatcaaagaccctgcaggtcctct

SEQ ID NO: 105122 - DNA, 25 bp, Mus musculus
acatcaaagaccgtgcaggtcctct

SEQ ID NO: 105123 - DNA, 25 bp, Mus musculus
acatcaaagggcaacctgcgctttc

SEQ ID NO: 105124 - DNA, 25 bp, Mus musculus
acatcaaagggctacctgcgctttc

SEQ ID NO: 105125 - DNA, 25 bp, Mus musculus
acatcaaagtcactacacactgctc

SEQ ID NO: 105126 - DNA, 25 bp, Mus musculus
acatcaaagtcagtacacactgctc

SEQ ID NO: 105127 - DNA, 25 bp, Mus musculus
acatcaaatgctcaacttgattttt

SEQ ID NO: 105128 - DNA, 25 bp, Mus musculus
acatcaaatgctgaacttgattttt

SEQ ID NO: 105129 - DNA, 25 bp, Mus musculus
acatcaacacataccactcatagtc

SEQ ID NO: 105130 - DNA, 25 bp, Mus musculus
acatcaacacattccactcatagtc

SEQ ID NO: 105131 - DNA, 25 bp, Mus musculus
acatcaacaccaacagttacctctg

SEQ ID NO: 105132 - DNA, 25 bp, Mus musculus
acatcaacaccatcagttacctctg

SEQ ID NO: 105133 - DNA, 25 bp, Mus musculus
acatcaacaggccatatctccattt

SEQ ID NO: 105134 - DNA, 25 bp, Mus musculus
acatcaacaggcgatatctccattt

SEQ ID NO: 105135 - DNA, 25 bp, Mus musculus
acatcaacatgacctccccaatggg

SEQ ID NO: 105136 - DNA, 25 bp, Mus musculus
acatcaacatgagctccccaatggg

SEQ ID NO: 105137 - DNA, 25 bp, Mus musculus
acatcaacatgtctcctggtttcca

SEQ ID NO: 105138 - DNA, 25 bp, Mus musculus
acatcaacatgtgtcctggtttcca

SEQ ID NO: 105139 - DNA, 25 bp, Mus musculus
acatcaaccatacctggcaggccat

SEQ ID NO: 105140 - DNA, 25 bp, Mus musculus
acatcaaccatagctggcaggccat

SEQ ID NO: 105141 - DNA, 25 bp, Mus musculus
acatcaacccagagccttgtatatg

SEQ ID NO: 105142 - DNA, 25 bp, Mus musculus
acatcaacccagtgccttgtatatg

SEQ ID NO: 105143 - DNA, 25 bp, Mus musculus
acatcaacctgtacagcaccaagtg

SEQ ID NO: 105144 - DNA, 25 bp, Mus musculus
acatcaacctgttcagcaccaagtg

SEQ ID NO: 105145 - DNA, 25 bp, Mus musculus
acatcaacgtgcaggtgtatacacc

SEQ ID NO: 105146 - DNA, 25 bp, Mus musculus
acatcaacgtgctggtgtatacacc

SEQ ID NO: 105147 - DNA, 25 bp, Mus musculus
acatcaactatgagcccctgcagtt

SEQ ID NO: 105148 - DNA, 25 bp, Mus musculus
acatcaactatgtgcccctgcagtt

SEQ ID NO: 105149 - DNA, 25 bp, Mus musculus
acatcaactgttaaatagcatcttg

SEQ ID NO: 105150 - DNA, 25 bp, Mus musculus
acatcaactgtttaatagcatcttg

SEQ ID NO: 105151 - DNA, 25 bp, Mus musculus
acatcaagaaacactgcgtggcagg

SEQ ID NO: 105152 - DNA, 25 bp, Mus musculus
acatcaagaaactctgcgtggcagg

SEQ ID NO: 105153 - DNA, 25 bp, Mus musculus
acatcaaggtgcacatggccactaa

SEQ ID NO: 105154 - DNA, 25 bp, Mus musculus
acatcaaggtgctcatggccactaa

SEQ ID NO: 105155 - DNA, 25 bp, Mus musculus
acatcaagtctcagcagggatatac

SEQ ID NO: 105156 - DNA, 25 bp, Mus musculus
acatcaagtctctgcagggatatac

SEQ ID NO: 105157 - DNA, 25 bp, Mus musculus
acatcaatcccacggttcccagggt

SEQ ID NO: 105158 - DNA, 25 bp, Mus musculus
acatcaatcccagggttcccagggt

SEQ ID NO: 105159 - DNA, 25 bp, Mus musculus
acatcaatccttcgagctgcgtttg

SEQ ID NO: 105160 - DNA, 25 bp, Mus musculus
acatcaatccttggagctgcgtttg

SEQ ID NO: 105161 - DNA, 25 bp, Mus musculus
acatcaatgccaacatccaaatgaa

SEQ ID NO: 105162 - DNA, 25 bp, Mus musculus
acatcaatgccatcatccaaatgaa

SEQ ID NO: 105163 - DNA, 25 bp, Mus musculus
acatcaatgggccagtgctctacta

SEQ ID NO: 105164 - DNA, 25 bp, Mus musculus
acatcaatgggcgagtgctctacta

SEQ ID NO: 105165 - DNA, 25 bp, Mus musculus
acatcacaagtcctgctattcatta

SEQ ID NO: 105166 - DNA, 25 bp, Mus musculus
acatcacaagtcgtgctattcatta

SEQ ID NO: 105167 - DNA, 25 bp, Mus musculus
acatcacaatagatcgcgcctgtag

SEQ ID NO: 105168 - DNA, 25 bp, Mus musculus
acatcacaatagttcgcgcctgtag

SEQ ID NO: 105169 - DNA, 25 bp, Mus musculus
acatcacaatgtatgtctcccgcgt

SEQ ID NO: 105170 - DNA, 25 bp, Mus musculus
acatcacaatgtttgtctcccgcgt

SEQ ID NO: 105171 - DNA, 25 bp, Mus musculus
acatcacacaagcttccattagagg

SEQ ID NO: 105172 - DNA, 25 bp, Mus musculus
acatcacacaaggttccattagagg

SEQ ID NO: 105173 - DNA, 25 bp, Mus musculus
acatcacactatccaaccttggctg

SEQ ID NO: 105174 - DNA, 25 bp, Mus musculus
acatcacactatgcaaccttggctg

SEQ ID NO: 105175 - DNA, 25 bp, Mus musculus
acatcacactcaacattgcagtgga

SEQ ID NO: 105176 - DNA, 25 bp, Mus musculus
acatcacactcatcattgcagtgga

SEQ ID NO: 105177 - DNA, 25 bp, Mus musculus
acatcacactgaatgaggatctgca

SEQ ID NO: 105178 - DNA, 25 bp, Mus musculus
acatcacactgattgaggatctgca

SEQ ID NO: 105179 - DNA, 25 bp, Mus musculus
acatcacagcaaaagattttacaag

SEQ ID NO: 105180 - DNA, 25 bp, Mus musculus
acatcacagcaatagattttacaag

SEQ ID NO: 105181 - DNA, 25 bp, Mus musculus
acatcacagcgaaagtccttattgc

SEQ ID NO: 105182 - DNA, 25 bp, Mus musculus
acatcacagcgatagtccttattgc

SEQ ID NO: 105183 - DNA, 25 bp, Mus musculus
acatcacagctccaattccaggtct

SEQ ID NO: 105184 - DNA, 25 bp, Mus musculus
acatcacagctcgaattccaggtct

SEQ ID NO: 105185 - DNA, 25 bp, Mus musculus
acatcacaggatcatgggccccgat

SEQ ID NO: 105186 - DNA, 25 bp, Mus musculus
acatcacaggatgatgggccccgat

SEQ ID NO: 105187 - DNA, 25 bp, Mus musculus
acatcacagttcatccttttaactc

SEQ ID NO: 105188 - DNA, 25 bp, Mus musculus
acatcacagttcttccttttaactc

SEQ ID NO: 105189 - DNA, 25 bp, Mus musculus
acatcacatactactgaaataggac

SEQ ID NO: 105190 - DNA, 25 bp, Mus musculus
acatcacatacttctgaaataggac

SEQ ID NO: 105191 - DNA, 25 bp, Mus musculus
acatcacatctaaactttgaattca

SEQ ID NO: 105192 - DNA, 25 bp, Mus musculus
acatcacatctatactttgaattca

SEQ ID NO: 105193 - DNA, 25 bp, Mus musculus
acatcacatgttctctctagcgtct

SEQ ID NO: 105194 - DNA, 25 bp, Mus musculus
acatcacatgttgtctctagcgtct

SEQ ID NO: 105195 - DNA, 25 bp, Mus musculus
acatcaccacagaacgcttgtttcc

SEQ ID NO: 105196 - DNA, 25 bp, Mus musculus
acatcaccacagtacgcttgtttcc

SEQ ID NO: 105197 - DNA, 25 bp, Mus musculus
acatcaccacatcttcagtcagagg

SEQ ID NO: 105198 - DNA, 25 bp, Mus musculus
acatcaccacatgttcagtcagagg

SEQ ID NO: 105199 - DNA, 25 bp, Mus musculus
acatcaccacctctttttctacttt

SEQ ID NO: 105200 - DNA, 25 bp, Mus musculus
acatcaccacctgtttttctacttt

SEQ ID NO: 105201 - DNA, 25 bp, Mus musculus
acatcaccatgtatctctcaagttt

SEQ ID NO: 105202 - DNA, 25 bp, Mus musculus
acatcaccatgtttctctcaagttt

SEQ ID NO: 105203 - DNA, 25 bp, Mus musculus
acatcacccaacagtgtgccacaag

SEQ ID NO: 105204 - DNA, 25 bp, Mus musculus
acatcacccaactgtgtgccacaag

SEQ ID NO: 105205 - DNA, 25 bp, Mus musculus
acatcaccccaaccaaggaaatcga

SEQ ID NO: 105206 - DNA, 25 bp, Mus musculus
acatcaccccaagcaaggaaatcga

SEQ ID NO: 105207 - DNA, 25 bp, Mus musculus
acatcaccccttaaaggtcctgtct

SEQ ID NO: 105208 - DNA, 25 bp, Mus musculus
acatcacccctttaaggtcctgtct

SEQ ID NO: 105209 - DNA, 25 bp, Mus musculus
acatcaccctggatgatgccagtgc

SEQ ID NO: 105210 - DNA, 25 bp, Mus musculus
acatcaccctggttgatgccagtgc

SEQ ID NO: 105211 - DNA, 25 bp, Mus musculus
acatcaccgatgacaatagcctcct

SEQ ID NO: 105212 - DNA, 25 bp, Mus musculus
acatcaccgatgtcaatagcctcct

SEQ ID NO: 105213 - DNA, 25 bp, Mus musculus
acatcaccgcagcatatgtggagat

SEQ ID NO: 105214 - DNA, 25 bp, Mus musculus
acatcaccgcaggatatgtggagat

SEQ ID NO: 105215 - DNA, 25 bp, Mus musculus
acatcaccgtcactaactcatagag

SEQ ID NO: 105216 - DNA, 25 bp, Mus musculus
acatcaccgtcagtaactcatagag

SEQ ID NO: 105217 - DNA, 25 bp, Mus musculus
acatcacctcaaattatgactctga

SEQ ID NO: 105218 - DNA, 25 bp, Mus musculus
acatcacctcaatttatgactctga

SEQ ID NO: 105219 - DNA, 25 bp, Mus musculus
acatcacgaggaccccgtttgcata

SEQ ID NO: 105220 - DNA, 25 bp, Mus musculus
acatcacgaggagcccgtttgcata

SEQ ID NO: 105221 - DNA, 25 bp, Mus musculus
acatcacgccacagaagtgccagag

SEQ ID NO: 105222 - DNA, 25 bp, Mus musculus
acatcacgccactgaagtgccagag

SEQ ID NO: 105223 - DNA, 25 bp, Mus musculus
acatcacggagaatgtactggttct

SEQ ID NO: 105224 - DNA, 25 bp, Mus musculus
acatcacggagattgtactggttct

SEQ ID NO: 105225 - DNA, 25 bp, Mus musculus
acatcactacagctggtccctggaa

SEQ ID NO: 105226 - DNA, 25 bp, Mus musculus
acatcactacaggtggtccctggaa

SEQ ID NO: 105227 - DNA, 25 bp, Mus musculus
acatcactagcaatcttgaccggga

SEQ ID NO: 105228 - DNA, 25 bp, Mus musculus
acatcactagcattcttgaccggga

SEQ ID NO: 105229 - DNA, 25 bp, Mus musculus
acatcactaggtctgggacttgacc

SEQ ID NO: 105230 - DNA, 25 bp, Mus musculus
acatcactaggtgtgggacttgacc

SEQ ID NO: 105231 - DNA, 25 bp, Mus musculus
acatcactctctattcacctaggtt

SEQ ID NO: 105232 - DNA, 25 bp, Mus musculus
acatcactctcttttcacctaggtt

SEQ ID NO: 105233 - DNA, 25 bp, Mus musculus
acatcactctgcacctctgtaggag

SEQ ID NO: 105234 - DNA, 25 bp, Mus musculus
acatcactctgctcctctgtaggag

SEQ ID NO: 105235 - DNA, 25 bp, Mus musculus
acatcactgacgctgctcatttgca

SEQ ID NO: 105236 - DNA, 25 bp, Mus musculus
acatcactgacggtgctcatttgca

SEQ ID NO: 105237 - DNA, 25 bp, Mus musculus
acatcactgccaaagctgacttcag

SEQ ID NO: 105238 - DNA, 25 bp, Mus musculus
acatcactgccatagctgacttcag

SEQ ID NO: 105239 - DNA, 25 bp, Mus musculus
acatcactgctaaagcttgggctga

SEQ ID NO: 105240 - DNA, 25 bp, Mus musculus
acatcactgctatagcttgggctga

SEQ ID NO: 105241 - DNA, 25 bp, Mus musculus
acatcactggtaccagggaccccta

SEQ ID NO: 105242 - DNA, 25 bp, Mus musculus
acatcactggtagcagggaccccta

SEQ ID NO: 105243 - DNA, 25 bp, Mus musculus
acatcactggttcgtgacattaaac

SEQ ID NO: 105244 - DNA, 25 bp, Mus musculus
acatcactggttggtgacattaaac

SEQ ID NO: 105245 - DNA, 25 bp, Mus musculus
acatcactgtacatgtgccctgttt

SEQ ID NO: 105246 - DNA, 25 bp, Mus musculus
acatcactgtacttgtgccctgttt

SEQ ID NO: 105247 - DNA, 25 bp, Mus musculus
acatcactgtgaatggcctgacctt

SEQ ID NO: 105248 - DNA, 25 bp, Mus musculus
acatcactgtgattggcctgacctt

SEQ ID NO: 105249 - DNA, 25 bp, Mus musculus
acatcactgtggacaggccatgaga

SEQ ID NO: 105250 - DNA, 25 bp, Mus musculus
acatcactgtggtcaggccatgaga

SEQ ID NO: 105251 - DNA, 25 bp, Mus musculus
acatcacttgatcctatattcattt

SEQ ID NO: 105252 - DNA, 25 bp, Mus musculus
acatcacttgatgctatattcattt

SEQ ID NO: 105253 - DNA, 25 bp, Mus musculus
acatcacttgctcttgtgtcaggac

SEQ ID NO: 105254 - DNA, 25 bp, Mus musculus
acatcacttgctgttgtgtcaggac

SEQ ID NO: 105255 - DNA, 25 bp, Mus musculus
acatcagaacacacagttgtaaaat

SEQ ID NO: 105256 - DNA, 25 bp, Mus musculus
acatcagaacactcagttgtaaaat

SEQ ID NO: 105257 - DNA, 25 bp, Mus musculus
acatcagaacctctagccctggtgg

SEQ ID NO: 105258 - DNA, 25 bp, Mus musculus
acatcagaacctgtagccctggtgg

SEQ ID NO: 105259 - DNA, 25 bp, Mus musculus
acatcagaatctcctcttctaagac

SEQ ID NO: 105260 - DNA, 25 bp, Mus musculus
acatcagaatctgctcttctaagac

SEQ ID NO: 105261 - DNA, 25 bp, Mus musculus
acatcagacaaaacgttctacctcc

SEQ ID NO: 105262 - DNA, 25 bp, Mus musculus
acatcagacaaatcgttctacctcc

SEQ ID NO: 105263 - DNA, 25 bp, Mus musculus
acatcagacatcctcgccaatatgt

SEQ ID NO: 105264 - DNA, 25 bp, Mus musculus
acatcagacatcgtcgccaatatgt

SEQ ID NO: 105265 - DNA, 25 bp, Mus musculus
acatcagaccacattcctagaacca

SEQ ID NO: 105266 - DNA, 25 bp, Mus musculus
acatcagaccactttcctagaacca

SEQ ID NO: 105267 - DNA, 25 bp, Mus musculus
acatcagacccccttgtaagaactg

SEQ ID NO: 105268 - DNA, 25 bp, Mus musculus
acatcagaccccgttgtaagaactg

SEQ ID NO: 105269 - DNA, 25 bp, Mus musculus
acatcagagacaactggtttggaac

SEQ ID NO: 105270 - DNA, 25 bp, Mus musculus
acatcagagacatctggtttggaac

SEQ ID NO: 105271 - DNA, 25 bp, Mus musculus
acatcagagcacaggcttgtcagga

SEQ ID NO: 105272 - DNA, 25 bp, Mus musculus
acatcagagcactggcttgtcagga

SEQ ID NO: 105273 - DNA, 25 bp, Mus musculus
acatcagagcttaataacgaacttt

SEQ ID NO: 105274 - DNA, 25 bp, Mus musculus
acatcagagctttataacgaacttt

SEQ ID NO: 105275 - DNA, 25 bp, Mus musculus
acatcagataccacccatcgaggga

SEQ ID NO: 105276 - DNA, 25 bp, Mus musculus
acatcagatacctcccatcgaggga

SEQ ID NO: 105277 - DNA, 25 bp, Mus musculus
acatcagatgacagtcttgccatga

SEQ ID NO: 105278 - DNA, 25 bp, Mus musculus
acatcagatgactgtcttgccatga

SEQ ID NO: 105279 - DNA, 25 bp, Mus musculus
acatcagcaaatccctctagcagga

SEQ ID NO: 105280 - DNA, 25 bp, Mus musculus
acatcagcaaatgcctctagcagga

SEQ ID NO: 105281 - DNA, 25 bp, Mus musculus
acatcagcaacgctggacatccagg

SEQ ID NO: 105282 - DNA, 25 bp, Mus musculus
acatcagcaacggtggacatccagg

SEQ ID NO: 105283 - DNA, 25 bp, Mus musculus
acatcagcaagacactcgttacata

SEQ ID NO: 105284 - DNA, 25 bp, Mus musculus
acatcagcaagagactcgttacata

SEQ ID NO: 105285 - DNA, 25 bp, Mus musculus
acatcagcacagcaagagcctgcag

SEQ ID NO: 105286 - DNA, 25 bp, Mus musculus
acatcagcacaggaagagcctgcag

SEQ ID NO: 105287 - DNA, 25 bp, Mus musculus
acatcagcagttcattgtgttgcat

SEQ ID NO: 105288 - DNA, 25 bp, Mus musculus
acatcagcagttgattgtgttgcat

SEQ ID NO: 105289 - DNA, 25 bp, Mus musculus
acatcagcatctagtgaatgcctaa

SEQ ID NO: 105290 - DNA, 25 bp, Mus musculus
acatcagcatcttgtgaatgcctaa

SEQ ID NO: 105291 - DNA, 25 bp, Mus musculus
acatcagccaaacccgaataaacct

SEQ ID NO: 105292 - DNA, 25 bp, Mus musculus
acatcagccaaagccgaataaacct

SEQ ID NO: 105293 - DNA, 25 bp, Mus musculus
acatcagccatgatcttagggtctg

SEQ ID NO: 105294 - DNA, 25 bp, Mus musculus
acatcagccatgttcttagggtctg

SEQ ID NO: 105295 - DNA, 25 bp, Mus musculus
acatcagccccgctgggaggagagt

SEQ ID NO: 105296 - DNA, 25 bp, Mus musculus
acatcagccccggtgggaggagagt

SEQ ID NO: 105297 - DNA, 25 bp, Mus musculus
acatcagccctcattgttcaaaata

SEQ ID NO: 105298 - DNA, 25 bp, Mus musculus
acatcagccctctttgttcaaaata

SEQ ID NO: 105299 - DNA, 25 bp, Mus musculus
acatcagcctgtcaatactttccaa

SEQ ID NO: 105300 - DNA, 25 bp, Mus musculus
acatcagcctgtgaatactttccaa

SEQ ID NO: 105301 - DNA, 25 bp, Mus musculus
acatcagcggcacattgacttagaa

SEQ ID NO: 105302 - DNA, 25 bp, Mus musculus
acatcagcggcagattgacttagaa

SEQ ID NO: 105303 - DNA, 25 bp, Mus musculus
acatcagctagcaacagaagtaaca

SEQ ID NO: 105304 - DNA, 25 bp, Mus musculus
acatcagctagctacagaagtaaca

SEQ ID NO: 105305 - DNA, 25 bp, Mus musculus
acatcagctagtactctgaggaacc

SEQ ID NO: 105306 - DNA, 25 bp, Mus musculus
acatcagctagttctctgaggaacc

SEQ ID NO: 105307 - DNA, 25 bp, Mus musculus
acatcagctcagactttactgaaga

SEQ ID NO: 105308 - DNA, 25 bp, Mus musculus
acatcagctcagtctttactgaaga

SEQ ID NO: 105309 - DNA, 25 bp, Mus musculus
acatcagctcgtcaagcagtgtggg

SEQ ID NO: 105310 - DNA, 25 bp, Mus musculus
acatcagctcgtgaagcagtgtggg

SEQ ID NO: 105311 - DNA, 25 bp, Mus musculus
acatcagctgtgatcatcctctcag

SEQ ID NO: 105312 - DNA, 25 bp, Mus musculus
acatcagctgtgttcatcctctcag

SEQ ID NO: 105313 - DNA, 25 bp, Mus musculus
acatcagcttctaagactgacaccc

SEQ ID NO: 105314 - DNA, 25 bp, Mus musculus
acatcagcttcttagactgacaccc

SEQ ID NO: 105315 - DNA, 25 bp, Mus musculus
acatcaggaacactggctccaacat

SEQ ID NO: 105316 - DNA, 25 bp, Mus musculus
acatcaggaacagtggctccaacat

SEQ ID NO: 105317 - DNA, 25 bp, Mus musculus
acatcaggatggcacaccaggtaaa

SEQ ID NO: 105318 - DNA, 25 bp, Mus musculus
acatcaggatgggacaccaggtaaa

SEQ ID NO: 105319 - DNA, 25 bp, Mus musculus
acatcaggcatcatgcaaggaaaag

SEQ ID NO: 105320 - DNA, 25 bp, Mus musculus
acatcaggcatcttgcaaggaaaag

SEQ ID NO: 105321 - DNA, 25 bp, Mus musculus
acatcaggccaccagagtcttcagt

SEQ ID NO: 105322 - DNA, 25 bp, Mus musculus
acatcaggccacgagagtcttcagt

SEQ ID NO: 105323 - DNA, 25 bp, Mus musculus
acatcaggcccacattgaccagtat

SEQ ID NO: 105324 - DNA, 25 bp, Mus musculus
acatcaggcccagattgaccagtat

SEQ ID NO: 105325 - DNA, 25 bp, Mus musculus
acatcagggcacaatggcagtcggt

SEQ ID NO: 105326 - DNA, 25 bp, Mus musculus
acatcagggcacacctaatgggcaa

SEQ ID NO: 105327 - DNA, 25 bp, Mus musculus
acatcagggcactatggcagtcggt

SEQ ID NO: 105328 - DNA, 25 bp, Mus musculus
acatcagggcactcctaatgggcaa

SEQ ID NO: 105329 - DNA, 25 bp, Mus musculus
acatcagggtaactagccaaactta

SEQ ID NO: 105330 - DNA, 25 bp, Mus musculus
acatcagggtaagtagccaaactta

SEQ ID NO: 105331 - DNA, 25 bp, Mus musculus
acatcagggttcagtttgcgtacag

SEQ ID NO: 105332 - DNA, 25 bp, Mus musculus
acatcagggttctgtttgcgtacag

SEQ ID NO: 105333 - DNA, 25 bp, Mus musculus
acatcaggtatgaagagaggccctt

SEQ ID NO: 105334 - DNA, 25 bp, Mus musculus
acatcaggtatgtagagaggccctt

SEQ ID NO: 105335 - DNA, 25 bp, Mus musculus
acatcaggtctgctgaggcatctat

SEQ ID NO: 105336 - DNA, 25 bp, Mus musculus
acatcaggtctggtgaggcatctat

SEQ ID NO: 105337 - DNA, 25 bp, Mus musculus
acatcaggtgagcagcctgggctct

SEQ ID NO: 105338 - DNA, 25 bp, Mus musculus
acatcaggtgaggagcctgggctct

SEQ ID NO: 105339 - DNA, 25 bp, Mus musculus
acatcaggtggccacaagttctgct

SEQ ID NO: 105340 - DNA, 25 bp, Mus musculus
acatcaggtggcgacaagttctgct

SEQ ID NO: 105341 - DNA, 25 bp, Mus musculus
acatcaggtgggaaaagaccatgtt

SEQ ID NO: 105342 - DNA, 25 bp, Mus musculus
acatcaggtgggtaaagaccatgtt

SEQ ID NO: 105343 - DNA, 25 bp, Mus musculus
acatcaggtggtcttacgaccccgg

SEQ ID NO: 105344 - DNA, 25 bp, Mus musculus
acatcaggtggtgttacgaccccgg

SEQ ID NO: 105345 - DNA, 25 bp, Mus musculus
acatcaggttccatgttgggccgaa

SEQ ID NO: 105346 - DNA, 25 bp, Mus musculus
acatcaggttccttgttgggccgaa

SEQ ID NO: 105347 - DNA, 25 bp, Mus musculus
acatcaggttgaccacaggcagcac

SEQ ID NO: 105348 - DNA, 25 bp, Mus musculus
acatcaggttgagcacaggcagcac

SEQ ID NO: 105349 - DNA, 25 bp, Mus musculus
acatcagtaagaagccagcagaccg

SEQ ID NO: 105350 - DNA, 25 bp, Mus musculus
acatcagtaagatgccagcagaccg

SEQ ID NO: 105351 - DNA, 25 bp, Mus musculus
acatcagtaagccacccaattagaa

SEQ ID NO: 105352 - DNA, 25 bp, Mus musculus
acatcagtaagcgacccaattagaa

SEQ ID NO: 105353 - DNA, 25 bp, Mus musculus
acatcagtaataacatggtgcagag

SEQ ID NO: 105354 - DNA, 25 bp, Mus musculus
acatcagtaatatcatggtgcagag

SEQ ID NO: 105355 - DNA, 25 bp, Mus musculus
acatcagtacgaacttgtccctgtc

SEQ ID NO: 105356 - DNA, 25 bp, Mus musculus
acatcagtacgatcttgtccctgtc

SEQ ID NO: 105357 - DNA, 25 bp, Mus musculus
acatcagtcttacctcagggccata

SEQ ID NO: 105358 - DNA, 25 bp, Mus musculus
acatcagtcttagctcagggccata

SEQ ID NO: 105359 - DNA, 25 bp, Mus musculus
acatcagtgaggaaggcatcaccaa

SEQ ID NO: 105360 - DNA, 25 bp, Mus musculus
acatcagtgaggtaggcatcaccaa

SEQ ID NO: 105361 - DNA, 25 bp, Mus musculus
acatcagtgatcaagcaagcagtgt

SEQ ID NO: 105362 - DNA, 25 bp, Mus musculus
acatcagtgatctagcaagcagtgt

SEQ ID NO: 105363 - DNA, 25 bp, Mus musculus
acatcagtgattatcatgcatccat

SEQ ID NO: 105364 - DNA, 25 bp, Mus musculus
acatcagtgattttcatgcatccat

SEQ ID NO: 105365 - DNA, 25 bp, Mus musculus
acatcagtgcagagctgcgggatca

SEQ ID NO: 105366 - DNA, 25 bp, Mus musculus
acatcagtgcagtgctgcgggatca

SEQ ID NO: 105367 - DNA, 25 bp, Mus musculus
acatcagtgtgtcccgattttcctc

SEQ ID NO: 105368 - DNA, 25 bp, Mus musculus
acatcagtgtgtgccgattttcctc

SEQ ID NO: 105369 - DNA, 25 bp, Mus musculus
acatcagtttatctactagtggcta

SEQ ID NO: 105370 - DNA, 25 bp, Mus musculus
acatcagtttatgtactagtggcta

SEQ ID NO: 105371 - DNA, 25 bp, Mus musculus
acatcataagcgagcagtaccctca

SEQ ID NO: 105372 - DNA, 25 bp, Mus musculus
acatcataagcgtgcagtaccctca

SEQ ID NO: 105373 - DNA, 25 bp, Mus musculus
acatcatagcaacaactgtcgtgaa

SEQ ID NO: 105374 - DNA, 25 bp, Mus musculus
acatcatagcaagaactgtcgtgaa

SEQ ID NO: 105375 - DNA, 25 bp, Mus musculus
acatcatattcaccccatcacgctg

SEQ ID NO: 105376 - DNA, 25 bp, Mus musculus
acatcatattcagcccatcacgctg

SEQ ID NO: 105377 - DNA, 25 bp, Mus musculus
acatcatcaagtcctcctttttgta

SEQ ID NO: 105378 - DNA, 25 bp, Mus musculus
acatcatcaagtgctcctttttgta

SEQ ID NO: 105379 - DNA, 25 bp, Mus musculus
acatcatcacaccttttccttgttt

SEQ ID NO: 105380 - DNA, 25 bp, Mus musculus
acatcatcacacgttttccttgttt

SEQ ID NO: 105381 - DNA, 25 bp, Mus musculus
acatcatcatggcagagtgcagaca

SEQ ID NO: 105382 - DNA, 25 bp, Mus musculus
acatcatcatgggagagtgcagaca

SEQ ID NO: 105383 - DNA, 25 bp, Mus musculus
acatcatcatgtattcacttctaaa

SEQ ID NO: 105384 - DNA, 25 bp, Mus musculus
acatcatcatgttttcacttctaaa

SEQ ID NO: 105385 - DNA, 25 bp, Mus musculus
acatcatcatttcctccgtgatagg

SEQ ID NO: 105386 - DNA, 25 bp, Mus musculus
acatcatcatttgctccgtgatagg

SEQ ID NO: 105387 - DNA, 25 bp, Mus musculus
acatcatccagtccatccagcatgg

SEQ ID NO: 105388 - DNA, 25 bp, Mus musculus
acatcatccagtgcatccagcatgg

SEQ ID NO: 105389 - DNA, 25 bp, Mus musculus
acatcatcccaaatgtagcaggcgt

SEQ ID NO: 105390 - DNA, 25 bp, Mus musculus
acatcatcccaattgtagcaggcgt

SEQ ID NO: 105391 - DNA, 25 bp, Mus musculus
acatcatcccacagtagttggtggg

SEQ ID NO: 105392 - DNA, 25 bp, Mus musculus
acatcatcccactgtagttggtggg

SEQ ID NO: 105393 - DNA, 25 bp, Mus musculus
acatcatcccagaaatgaactcttg

SEQ ID NO: 105394 - DNA, 25 bp, Mus musculus
acatcatcccagtaatgaactcttg

SEQ ID NO: 105395 - DNA, 25 bp, Mus musculus
acatcatccccaacagggtgggtaa

SEQ ID NO: 105396 - DNA, 25 bp, Mus musculus
acatcatccccatcagggtgggtaa

SEQ ID NO: 105397 - DNA, 25 bp, Mus musculus
acatcatccgagctgtagaacaaca

SEQ ID NO: 105398 - DNA, 25 bp, Mus musculus
acatcatccgaggtgtagaacaaca

SEQ ID NO: 105399 - DNA, 25 bp, Mus musculus
acatcatcgacaagctggccaaggc

SEQ ID NO: 105400 - DNA, 25 bp, Mus musculus
acatcatcgacatgctggccaaggc

SEQ ID NO: 105401 - DNA, 25 bp, Mus musculus
acatcatctttcatgtctcacttga

SEQ ID NO: 105402 - DNA, 25 bp, Mus musculus
acatcatctttcttgtctcacttga

SEQ ID NO: 105403 - DNA, 25 bp, Mus musculus
acatcatgaaaccagcaccttttat

SEQ ID NO: 105404 - DNA, 25 bp, Mus musculus
acatcatgaaacgagcaccttttat

SEQ ID NO: 105405 - DNA, 25 bp, Mus musculus
acatcatgcagaacttccacttcaa

SEQ ID NO: 105406 - DNA, 25 bp, Mus musculus
acatcatgcagatcttccacttcaa

SEQ ID NO: 105407 - DNA, 25 bp, Mus musculus
acatcatgctgcaagacaatggcca

SEQ ID NO: 105408 - DNA, 25 bp, Mus musculus
acatcatgctgctagacaatggcca

SEQ ID NO: 105409 - DNA, 25 bp, Mus musculus
acatcatgctggcagatgacgactg

SEQ ID NO: 105410 - DNA, 25 bp, Mus musculus
acatcatgctgggagatgacgactg

SEQ ID NO: 105411 - DNA, 25 bp, Mus musculus
acatcatgcttaacgttttatacag

SEQ ID NO: 105412 - DNA, 25 bp, Mus musculus
acatcatgcttatcgttttatacag

SEQ ID NO: 105413 - DNA, 25 bp, Mus musculus
acatcatggatgaactcagcttact

SEQ ID NO: 105414 - DNA, 25 bp, Mus musculus
acatcatggatgtactcagcttact

SEQ ID NO: 105415 - DNA, 25 bp, Mus musculus
acatcatggcctctgtcggagcaga

SEQ ID NO: 105416 - DNA, 25 bp, Mus musculus
acatcatggcctgtgtcggagcaga

SEQ ID NO: 105417 - DNA, 25 bp, Mus musculus
acatcatgggttagctcagtgccac

SEQ ID NO: 105418 - DNA, 25 bp, Mus musculus
acatcatgggtttgctcagtgccac

SEQ ID NO: 105419 - DNA, 25 bp, Mus musculus
acatcatggtataccccttactaaa

SEQ ID NO: 105420 - DNA, 25 bp, Mus musculus
acatcatggtattccccttactaaa

SEQ ID NO: 105421 - DNA, 25 bp, Mus musculus
acatcatggtgtcctttgttgaccc

SEQ ID NO: 105422 - DNA, 25 bp, Mus musculus
acatcatggtgtgctttgttgaccc

SEQ ID NO: 105423 - DNA, 25 bp, Mus musculus
acatcatggtttatagttcttgggt

SEQ ID NO: 105424 - DNA, 25 bp, Mus musculus
acatcatggtttttagttcttgggt

SEQ ID NO: 105425 - DNA, 25 bp, Mus musculus
acatcatgtagacgctaacctttgc

SEQ ID NO: 105426 - DNA, 25 bp, Mus musculus
acatcatgtagaggctaacctttgc

SEQ ID NO: 105427 - DNA, 25 bp, Mus musculus
acatcattaccgcttgtctctaaag

SEQ ID NO: 105428 - DNA, 25 bp, Mus musculus
acatcattaccggttgtctctaaag

SEQ ID NO: 105429 - DNA, 25 bp, Mus musculus
acatcattactgctatttggcccca

SEQ ID NO: 105430 - DNA, 25 bp, Mus musculus
acatcattactggtatttggcccca

SEQ ID NO: 105431 - DNA, 25 bp, Mus musculus
acatcattctacaattcacctcttc

SEQ ID NO: 105432 - DNA, 25 bp, Mus musculus
acatcattctactattcacctcttc

SEQ ID NO: 105433 - DNA, 25 bp, Mus musculus
acatcattgacgacattcaggaaaa

SEQ ID NO: 105434 - DNA, 25 bp, Mus musculus
acatcattgacgtcattcaggaaaa

SEQ ID NO: 105435 - DNA, 25 bp, Mus musculus
acatcattgcacacggtccataaag

SEQ ID NO: 105436 - DNA, 25 bp, Mus musculus
acatcattgcactcggtccataaag

SEQ ID NO: 105437 - DNA, 25 bp, Mus musculus
acatcattgggcatctatgctggga

SEQ ID NO: 105438 - DNA, 25 bp, Mus musculus
acatcattgggcttctatgctggga

SEQ ID NO: 105439 - DNA, 25 bp, Mus musculus
acatcattgtgactgggtccataca

SEQ ID NO: 105440 - DNA, 25 bp, Mus musculus
acatcattgtgagtgggtccataca

SEQ ID NO: 105441 - DNA, 25 bp, Mus musculus
acatcatttcctcgtacctttgtgc

SEQ ID NO: 105442 - DNA, 25 bp, Mus musculus
acatcatttcctggtacctttgtgc

SEQ ID NO: 105443 - DNA, 25 bp, Mus musculus
acatcatttggtagaaagagtgctt

SEQ ID NO: 105444 - DNA, 25 bp, Mus musculus
acatcatttggttgaaagagtgctt

SEQ ID NO: 105445 - DNA, 25 bp, Mus musculus
acatcatttgtgaggcttcggagaa

SEQ ID NO: 105446 - DNA, 25 bp, Mus musculus
acatcatttgtgtggcttcggagaa

SEQ ID NO: 105447 - DNA, 25 bp, Mus musculus
acatccaaacacattgcggctacag

SEQ ID NO: 105448 - DNA, 25 bp, Mus musculus
acatccaaacactttgcggctacag

SEQ ID NO: 105449 - DNA, 25 bp, Mus musculus
acatccaacagtatcaatgtccttg

SEQ ID NO: 105450 - DNA, 25 bp, Mus musculus
acatccaacagtttcaatgtccttg

SEQ ID NO: 105451 - DNA, 25 bp, Mus musculus
acatccaactgaacttggctgtgga

SEQ ID NO: 105452 - DNA, 25 bp, Mus musculus
acatccaactgatcttggctgtgga

SEQ ID NO: 105453 - DNA, 25 bp, Mus musculus
acatccaacttaccccaaaatcaga

SEQ ID NO: 105454 - DNA, 25 bp, Mus musculus
acatccaacttagcccaaaatcaga

SEQ ID NO: 105455 - DNA, 25 bp, Mus musculus
acatccaagctgaccagacgcagga

SEQ ID NO: 105456 - DNA, 25 bp, Mus musculus
acatccaagctgctgttcagggact

SEQ ID NO: 105457 - DNA, 25 bp, Mus musculus
acatccaagctggtgttcagggact

SEQ ID NO: 105458 - DNA, 25 bp, Mus musculus
acatccaagctgtccagacgcagga

SEQ ID NO: 105459 - DNA, 25 bp, Mus musculus
acatccaaggaacgcagcaggcgcg

SEQ ID NO: 105460 - DNA, 25 bp, Mus musculus
acatccaaggaaggcagcaggcgcg

SEQ ID NO: 105461 - DNA, 25 bp, Mus musculus
acatccaaggacatcccacacatat

SEQ ID NO: 105462 - DNA, 25 bp, Mus musculus
acatccaaggacttcccacacatat

SEQ ID NO: 105463 - DNA, 25 bp, Mus musculus
acatccaagtttcatgccatctctg

SEQ ID NO: 105464 - DNA, 25 bp, Mus musculus
acatccaagtttgatgccatctctg

SEQ ID NO: 105465 - DNA, 25 bp, Mus musculus
acatccaatggaccccacaaacttt

SEQ ID NO: 105466 - DNA, 25 bp, Mus musculus
acatccaatggagcccacaaacttt

SEQ ID NO: 105467 - DNA, 25 bp, Mus musculus
acatccaatgtgacctcaacttgat

SEQ ID NO: 105468 - DNA, 25 bp, Mus musculus
acatccaatgtgtcctcaacttgat

SEQ ID NO: 105469 - DNA, 25 bp, Mus musculus
acatccaattggagctgagtcttgt

SEQ ID NO: 105470 - DNA, 25 bp, Mus musculus
acatccaattggtgctgagtcttgt

SEQ ID NO: 105471 - DNA, 25 bp, Mus musculus
acatccacaaatcgctgatcgggaa

SEQ ID NO: 105472 - DNA, 25 bp, Mus musculus
acatccacaaatggctgatcgggaa

SEQ ID NO: 105473 - DNA, 25 bp, Mus musculus
acatccacagatagactacgcataa

SEQ ID NO: 105474 - DNA, 25 bp, Mus musculus
acatccacagattgactacgcataa

SEQ ID NO: 105475 - DNA, 25 bp, Mus musculus
acatccacagcacctacaaggagct

SEQ ID NO: 105476 - DNA, 25 bp, Mus musculus
acatccacagcagctacaaggagct

SEQ ID NO: 105477 - DNA, 25 bp, Mus musculus
acatccacatgaacaagccccaggt

SEQ ID NO: 105478 - DNA, 25 bp, Mus musculus
acatccacatgatcaagccccaggt

SEQ ID NO: 105479 - DNA, 25 bp, Mus musculus
acatccaccattccatgaaaaacgg

SEQ ID NO: 105480 - DNA, 25 bp, Mus musculus
acatccaccattgcatgaaaaacgg

SEQ ID NO: 105481 - DNA, 25 bp, Mus musculus
acatccactcaactattctaggcat

SEQ ID NO: 105482 - DNA, 25 bp, Mus musculus
acatccactcaagtattctaggcat

SEQ ID NO: 105483 - DNA, 25 bp, Mus musculus
acatccactgaacctgaggcgcatt

SEQ ID NO: 105484 - DNA, 25 bp, Mus musculus
acatccactgaagctgaggcgcatt

SEQ ID NO: 105485 - DNA, 25 bp, Mus musculus
acatccactttacccatgtgtgact

SEQ ID NO: 105486 - DNA, 25 bp, Mus musculus
acatccactttagccatgtgtgact

SEQ ID NO: 105487 - DNA, 25 bp, Mus musculus
acatccagaaacagtcagtgaagaa

SEQ ID NO: 105488 - DNA, 25 bp, Mus musculus
acatccagaaactgtcagtgaagaa

SEQ ID NO: 105489 - DNA, 25 bp, Mus musculus
acatccagaggcagtgccaccggaa

SEQ ID NO: 105490 - DNA, 25 bp, Mus musculus
acatccagaggctgtgccaccggaa

SEQ ID NO: 105491 - DNA, 25 bp, Mus musculus
acatccagcgacagggacgcgggta

SEQ ID NO: 105492 - DNA, 25 bp, Mus musculus
acatccagcgactgggacgcgggta

SEQ ID NO: 105493 - DNA, 25 bp, Mus musculus
acatccagcgcaacatccaggaaaa

SEQ ID NO: 105494 - DNA, 25 bp, Mus musculus
acatccagcgcatcatccaggaaaa

SEQ ID NO: 105495 - DNA, 25 bp, Mus musculus
acatccagctatacataacactttt

SEQ ID NO: 105496 - DNA, 25 bp, Mus musculus
acatccagctattcataacactttt

SEQ ID NO: 105497 - DNA, 25 bp, Mus musculus
acatccagggatcaacagcttaaac

SEQ ID NO: 105498 - DNA, 25 bp, Mus musculus
acatccagggatctcagaacagggc

SEQ ID NO: 105499 - DNA, 25 bp, Mus musculus
acatccagggatgaacagcttaaac

SEQ ID NO: 105500 - DNA, 25 bp, Mus musculus
acatccagggatgtcagaacagggc

SEQ ID NO: 105501 - DNA, 25 bp, Mus musculus
acatccagggtcaaagcagtagcga

SEQ ID NO: 105502 - DNA, 25 bp, Mus musculus
acatccagggtctaagcagtagcga

SEQ ID NO: 105503 - DNA, 25 bp, Mus musculus
acatccagtggcactcagtgcggta

SEQ ID NO: 105504 - DNA, 25 bp, Mus musculus
acatccagtggctctcagtgcggta

SEQ ID NO: 105505 - DNA, 25 bp, Mus musculus
acatccagttatcttagtatcaact

SEQ ID NO: 105506 - DNA, 25 bp, Mus musculus
acatccagttatgttagtatcaact

SEQ ID NO: 105507 - DNA, 25 bp, Mus musculus
acatccataatgacatccagggccc

SEQ ID NO: 105508 - DNA, 25 bp, Mus musculus
acatccataatgtcatccagggccc

SEQ ID NO: 105509 - DNA, 25 bp, Mus musculus
acatccatacacatacatctttttt

SEQ ID NO: 105510 - DNA, 25 bp, Mus musculus
acatccatacacttacatctttttt

SEQ ID NO: 105511 - DNA, 25 bp, Mus musculus
acatccatacagcacaagatattcg

SEQ ID NO: 105512 - DNA, 25 bp, Mus musculus
acatccatacaggacaagatattcg

SEQ ID NO: 105513 - DNA, 25 bp, Mus musculus
acatccatacccaagtgaatgtgat

SEQ ID NO: 105514 - DNA, 25 bp, Mus musculus
acatccataccctagtgaatgtgat

SEQ ID NO: 105515 - DNA, 25 bp, Mus musculus
acatccatcaatcccactaaagcat

SEQ ID NO: 105516 - DNA, 25 bp, Mus musculus
acatccatcaatgccactaaagcat

SEQ ID NO: 105517 - DNA, 25 bp, Mus musculus
acatccatccctactcagtgaaaaa

SEQ ID NO: 105518 - DNA, 25 bp, Mus musculus
acatccatcccttctcagtgaaaaa

SEQ ID NO: 105519 - DNA, 25 bp, Mus musculus
acatccatccgtagtttggttttct

SEQ ID NO: 105520 - DNA, 25 bp, Mus musculus
acatccatccgttgtttggttttct

SEQ ID NO: 105521 - DNA, 25 bp, Mus musculus
acatccatcctgactcattagcaaa

SEQ ID NO: 105522 - DNA, 25 bp, Mus musculus
acatccatcctgtctcattagcaaa

SEQ ID NO: 105523 - DNA, 25 bp, Mus musculus
acatccatcggcaggagaagatcct

SEQ ID NO: 105524 - DNA, 25 bp, Mus musculus
acatccatcggctggagaagatcct

SEQ ID NO: 105525 - DNA, 25 bp, Mus musculus
acatccatctaaacgtatccatcgc

SEQ ID NO: 105526 - DNA, 25 bp, Mus musculus
acatccatctaatcgtatccatcgc

SEQ ID NO: 105527 - DNA, 25 bp, Mus musculus
acatccatctgtatagtcatcaagg

SEQ ID NO: 105528 - DNA, 25 bp, Mus musculus
acatccatctgtttagtcatcaagg

SEQ ID NO: 105529 - DNA, 25 bp, Mus musculus
acatccatgattctggttccagggc

SEQ ID NO: 105530 - DNA, 25 bp, Mus musculus
acatccatgattgtggttccagggc

SEQ ID NO: 105531 - DNA, 25 bp, Mus musculus
acatccatggctaacgcattgtctc

SEQ ID NO: 105532 - DNA, 25 bp, Mus musculus
acatccatggcttacgcattgtctc

SEQ ID NO: 105533 - DNA, 25 bp, Mus musculus
acatccatgtaaatccaacacccaa

SEQ ID NO: 105534 - DNA, 25 bp, Mus musculus
acatccatgtaattccaacacccaa

SEQ ID NO: 105535 - DNA, 25 bp, Mus musculus
acatccatgtgtactgtcacgttgt

SEQ ID NO: 105536 - DNA, 25 bp, Mus musculus
acatccatgtgttctgtcacgttgt

SEQ ID NO: 105537 - DNA, 25 bp, Mus musculus
acatccattaaacagtttgacctct

SEQ ID NO: 105538 - DNA, 25 bp, Mus musculus
acatccattaaagagtttgacctct

SEQ ID NO: 105539 - DNA, 25 bp, Mus musculus
acatccattgatatcccagttcatc

SEQ ID NO: 105540 - DNA, 25 bp, Mus musculus
acatccattgatttcccagttcatc

SEQ ID NO: 105541 - DNA, 25 bp, Mus musculus
acatccattggcacttctagactta

SEQ ID NO: 105542 - DNA, 25 bp, Mus musculus
acatccattggctcttctagactta

SEQ ID NO: 105543 - DNA, 25 bp, Mus musculus
acatccatttcccactttgttcggg

SEQ ID NO: 105544 - DNA, 25 bp, Mus musculus
acatccatttccgactttgttcggg

SEQ ID NO: 105545 - DNA, 25 bp, Mus musculus
acatcccaaatgacaaggcttcttt

SEQ ID NO: 105546 - DNA, 25 bp, Mus musculus
acatcccaaatgtcaaggcttcttt

SEQ ID NO: 105547 - DNA, 25 bp, Mus musculus
acatcccaagagaactccatactga

SEQ ID NO: 105548 - DNA, 25 bp, Mus musculus
acatcccaagagtactccatactga

SEQ ID NO: 105549 - DNA, 25 bp, Mus musculus
acatcccaagcaacagagtggctga

SEQ ID NO: 105550 - DNA, 25 bp, Mus musculus
acatcccaagcatcagagtggctga

SEQ ID NO: 105551 - DNA, 25 bp, Mus musculus
acatcccacgcaaagccatattgaa

SEQ ID NO: 105552 - DNA, 25 bp, Mus musculus
acatcccacgcatagccatattgaa

SEQ ID NO: 105553 - DNA, 25 bp, Mus musculus
acatcccactgcacttgtgatatta

SEQ ID NO: 105554 - DNA, 25 bp, Mus musculus
acatcccactgctcttgtgatatta

SEQ ID NO: 105555 - DNA, 25 bp, Mus musculus
acatcccagagaagagcagtcacct

SEQ ID NO: 105556 - DNA, 25 bp, Mus musculus
acatcccagagatgagcagtcacct

SEQ ID NO: 105557 - DNA, 25 bp, Mus musculus
acatcccagcagaggtaattcggag

SEQ ID NO: 105558 - DNA, 25 bp, Mus musculus
acatcccagcagtggtaattcggag

SEQ ID NO: 105559 - DNA, 25 bp, Mus musculus
acatcccaggcgagcgtccagagaa

SEQ ID NO: 105560 - DNA, 25 bp, Mus musculus
acatcccaggcgtgcgtccagagaa

SEQ ID NO: 105561 - DNA, 25 bp, Mus musculus
acatcccaggctccatgtctgaagt

SEQ ID NO: 105562 - DNA, 25 bp, Mus musculus
acatcccaggctgcatgtctgaagt

SEQ ID NO: 105563 - DNA, 25 bp, Mus musculus
acatcccagggaatctggacacttg

SEQ ID NO: 105564 - DNA, 25 bp, Mus musculus
acatcccagggattctggacacttg

SEQ ID NO: 105565 - DNA, 25 bp, Mus musculus
acatcccagggcatgccatgaagac

SEQ ID NO: 105566 - DNA, 25 bp, Mus musculus
acatcccagggcttgccatgaagac

SEQ ID NO: 105567 - DNA, 25 bp, Mus musculus
acatcccaggtaaacatgttacact

SEQ ID NO: 105568 - DNA, 25 bp, Mus musculus
acatcccaggtatacatgttacact

SEQ ID NO: 105569 - DNA, 25 bp, Mus musculus
acatcccatgtgagtcttagcatct

SEQ ID NO: 105570 - DNA, 25 bp, Mus musculus
acatcccatgtgtgtcttagcatct

SEQ ID NO: 105571 - DNA, 25 bp, Mus musculus
acatcccattcccatagtgatggat

SEQ ID NO: 105572 - DNA, 25 bp, Mus musculus
acatcccattccgatagtgatggat

SEQ ID NO: 105573 - DNA, 25 bp, Mus musculus
acatccccaaacacaattgttcgtt

SEQ ID NO: 105574 - DNA, 25 bp, Mus musculus
acatccccaaactcaattgttcgtt

SEQ ID NO: 105575 - DNA, 25 bp, Mus musculus
acatccccaagtcctgtggagtaga

SEQ ID NO: 105576 - DNA, 25 bp, Mus musculus
acatccccaagtgctgtggagtaga

SEQ ID NO: 105577 - DNA, 25 bp, Mus musculus
acatccccaatgctgtttctacaga

SEQ ID NO: 105578 - DNA, 25 bp, Mus musculus
acatccccaatggtgtttctacaga

SEQ ID NO: 105579 - DNA, 25 bp, Mus musculus
acatccccaccgaaagtgttgctaa

SEQ ID NO: 105580 - DNA, 25 bp, Mus musculus
acatccccaccgtaagtgttgctaa

SEQ ID NO: 105581 - DNA, 25 bp, Mus musculus
acatccccagacaaagggccatgga

SEQ ID NO: 105582 - DNA, 25 bp, Mus musculus
acatccccagactaagggccatgga

SEQ ID NO: 105583 - DNA, 25 bp, Mus musculus
acatccccagtactgtactgagatg

SEQ ID NO: 105584 - DNA, 25 bp, Mus musculus
acatccccagtagtgtactgagatg

SEQ ID NO: 105585 - DNA, 25 bp, Mus musculus
acatccccatctattagcattctaa

SEQ ID NO: 105586 - DNA, 25 bp, Mus musculus
acatccccatcttttagcattctaa

SEQ ID NO: 105587 - DNA, 25 bp, Mus musculus
acatccccatggctgaaccgttttg

SEQ ID NO: 105588 - DNA, 25 bp, Mus musculus
acatccccatgggtgaaccgttttg

SEQ ID NO: 105589 - DNA, 25 bp, Mus musculus
acatcccctgggattttactgctgg

SEQ ID NO: 105590 - DNA, 25 bp, Mus musculus
acatcccctgggtttttactgctgg

SEQ ID NO: 105591 - DNA, 25 bp, Mus musculus
acatccccttaacattgagttctgc

SEQ ID NO: 105592 - DNA, 25 bp, Mus musculus
acatccccttaagattgagttctgc

SEQ ID NO: 105593 - DNA, 25 bp, Mus musculus
acatcccgagctaattaccttcaag

SEQ ID NO: 105594 - DNA, 25 bp, Mus musculus
acatcccgagcttattaccttcaag

SEQ ID NO: 105595 - DNA, 25 bp, Mus musculus
acatcccgttaaatttcccatctga

SEQ ID NO: 105596 - DNA, 25 bp, Mus musculus
acatcccgttaattttcccatctga

SEQ ID NO: 105597 - DNA, 25 bp, Mus musculus
acatccctacttagagctgttctga

SEQ ID NO: 105598 - DNA, 25 bp, Mus musculus
acatccctacttcgtgatggacctg

SEQ ID NO: 105599 - DNA, 25 bp, Mus musculus
acatccctacttggtgatggacctg

SEQ ID NO: 105600 - DNA, 25 bp, Mus musculus
acatccctactttgagctgttctga

SEQ ID NO: 105601 - DNA, 25 bp, Mus musculus
acatccctcactagaatgtgtactg

SEQ ID NO: 105602 - DNA, 25 bp, Mus musculus
acatccctcacttgaatgtgtactg

SEQ ID NO: 105603 - DNA, 25 bp, Mus musculus
acatccctcagtatgcccaaagtga

SEQ ID NO: 105604 - DNA, 25 bp, Mus musculus
acatccctcagtttgcccaaagtga

SEQ ID NO: 105605 - DNA, 25 bp, Mus musculus
acatccctcatgatggatacccttt

SEQ ID NO: 105606 - DNA, 25 bp, Mus musculus
acatccctcatgttggatacccttt

SEQ ID NO: 105607 - DNA, 25 bp, Mus musculus
acatccctccacaaggcttcaagag

SEQ ID NO: 105608 - DNA, 25 bp, Mus musculus
acatccctccactaggcttcaagag

SEQ ID NO: 105609 - DNA, 25 bp, Mus musculus
acatccctcctaacatggtggtgaa

SEQ ID NO: 105610 - DNA, 25 bp, Mus musculus
acatccctcctatcatggtggtgaa

SEQ ID NO: 105611 - DNA, 25 bp, Mus musculus
acatccctgataaccgtgtgcacac

SEQ ID NO: 105612 - DNA, 25 bp, Mus musculus
acatccctgatatccgtgtgcacac

SEQ ID NO: 105613 - DNA, 25 bp, Mus musculus
acatccctgattatgtaagccacgg

SEQ ID NO: 105614 - DNA, 25 bp, Mus musculus
acatccctgattttgtaagccacgg

SEQ ID NO: 105615 - DNA, 25 bp, Mus musculus
acatccctggatacccttctaatca

SEQ ID NO: 105616 - DNA, 25 bp, Mus musculus
acatccctggatcaaatcacctctg

SEQ ID NO: 105617 - DNA, 25 bp, Mus musculus
acatccctggatgaaatcacctctg

SEQ ID NO: 105618 - DNA, 25 bp, Mus musculus
acatccctggattcccttctaatca

SEQ ID NO: 105619 - DNA, 25 bp, Mus musculus
acatcccttcctacagacataattg

SEQ ID NO: 105620 - DNA, 25 bp, Mus musculus
acatcccttccttcagacataattg

SEQ ID NO: 105621 - DNA, 25 bp, Mus musculus
acatcccttcttaccgttgatgcca

SEQ ID NO: 105622 - DNA, 25 bp, Mus musculus
acatcccttctttccgttgatgcca

SEQ ID NO: 105623 - DNA, 25 bp, Mus musculus
acatcccttgacacaaactcatggt

SEQ ID NO: 105624 - DNA, 25 bp, Mus musculus
acatcccttgactcaaactcatggt

SEQ ID NO: 105625 - DNA, 25 bp, Mus musculus
acatccgaatgtccctgaacttttt

SEQ ID NO: 105626 - DNA, 25 bp, Mus musculus
acatccgaatgtgcctgaacttttt

SEQ ID NO: 105627 - DNA, 25 bp, Mus musculus
acatccgaccggagcccaggaaatg

SEQ ID NO: 105628 - DNA, 25 bp, Mus musculus
acatccgaccggtgcccaggaaatg

SEQ ID NO: 105629 - DNA, 25 bp, Mus musculus
acatccgagatgagtgcctgtaccc

SEQ ID NO: 105630 - DNA, 25 bp, Mus musculus
acatccgagatgtgtgcctgtaccc

SEQ ID NO: 105631 - DNA, 25 bp, Mus musculus
acatccgagcccacatagacacatg

SEQ ID NO: 105632 - DNA, 25 bp, Mus musculus
acatccgagccctcatagacacatg

SEQ ID NO: 105633 - DNA, 25 bp, Mus musculus
acatccgagctgatgtgtggagcct

SEQ ID NO: 105634 - DNA, 25 bp, Mus musculus
acatccgagctgttgtgtggagcct

SEQ ID NO: 105635 - DNA, 25 bp, Mus musculus
acatccgagtgtatcctgagagaag

SEQ ID NO: 105636 - DNA, 25 bp, Mus musculus
acatccgagtgtttcctgagagaag

SEQ ID NO: 105637 - DNA, 25 bp, Mus musculus
acatccgatattatatgggcatcca

SEQ ID NO: 105638 - DNA, 25 bp, Mus musculus
acatccgatattttatgggcatcca

SEQ ID NO: 105639 - DNA, 25 bp, Mus musculus
acatccgcaaggctcacaatgagga

SEQ ID NO: 105640 - DNA, 25 bp, Mus musculus
acatccgcaagggtcacaatgagga

SEQ ID NO: 105641 - DNA, 25 bp, Mus musculus
acatccgcaccacctgtttgaaagc

SEQ ID NO: 105642 - DNA, 25 bp, Mus musculus
acatccgcaccagctgtttgaaagc

SEQ ID NO: 105643 - DNA, 25 bp, Mus musculus
acatccgcagggatcggatgaggac

SEQ ID NO: 105644 - DNA, 25 bp, Mus musculus
acatccgcagggttcggatgaggac

SEQ ID NO: 105645 - DNA, 25 bp, Mus musculus
acatccgccaagcactgttggacat

SEQ ID NO: 105646 - DNA, 25 bp, Mus musculus
acatccgccaaggactgttggacat

SEQ ID NO: 105647 - DNA, 25 bp, Mus musculus
acatccgccgccagcacaagattga

SEQ ID NO: 105648 - DNA, 25 bp, Mus musculus
acatccgccgcctgcacaagattga

SEQ ID NO: 105649 - DNA, 25 bp, Mus musculus
acatccgcctttactggagtgagga

SEQ ID NO: 105650 - DNA, 25 bp, Mus musculus
acatccgccttttctggagtgagga

SEQ ID NO: 105651 - DNA, 25 bp, Mus musculus
acatccgcgcacacacagaaaatgg

SEQ ID NO: 105652 - DNA, 25 bp, Mus musculus
acatccgcgcactcacagaaaatgg

SEQ ID NO: 105653 - DNA, 25 bp, Mus musculus
acatccgcgccaagagaaagcggga

SEQ ID NO: 105654 - DNA, 25 bp, Mus musculus
acatccgcgccatgagaaagcggga

SEQ ID NO: 105655 - DNA, 25 bp, Mus musculus
acatccgctgggagtgcgaggacat

SEQ ID NO: 105656 - DNA, 25 bp, Mus musculus
acatccgctgggtgtgcgaggacat

SEQ ID NO: 105657 - DNA, 25 bp, Mus musculus
acatccgctgtaactagcttgcaaa

SEQ ID NO: 105658 - DNA, 25 bp, Mus musculus
acatccgctgtatctagcttgcaaa

SEQ ID NO: 105659 - DNA, 25 bp, Mus musculus
acatccggactgatggcaagttggt

SEQ ID NO: 105660 - DNA, 25 bp, Mus musculus
acatccggactgttggcaagttggt

SEQ ID NO: 105661 - DNA, 25 bp, Mus musculus
acatccggaggactgcccctagaga

SEQ ID NO: 105662 - DNA, 25 bp, Mus musculus
acatccggaggagtgcccctagaga

SEQ ID NO: 105663 - DNA, 25 bp, Mus musculus
acatccggaggtataggctgccaca

SEQ ID NO: 105664 - DNA, 25 bp, Mus musculus
acatccggaggtttaggctgccaca

SEQ ID NO: 105665 - DNA, 25 bp, Mus musculus
acatccggctgaaggacagcgtggc

SEQ ID NO: 105666 - DNA, 25 bp, Mus musculus
acatccggctgatggacagcgtggc

SEQ ID NO: 105667 - DNA, 25 bp, Mus musculus
acatccgtatgaagggcaagcccct

SEQ ID NO: 105668 - DNA, 25 bp, Mus musculus
acatccgtatgatgggcaagcccct

SEQ ID NO: 105669 - DNA, 25 bp, Mus musculus
acatccgtgaagactctcctataaa

SEQ ID NO: 105670 - DNA, 25 bp, Mus musculus
acatccgtgaagtctctcctataaa

SEQ ID NO: 105671 - DNA, 25 bp, Mus musculus
acatccgtgcttcacttaattgaac

SEQ ID NO: 105672 - DNA, 25 bp, Mus musculus
acatccgtgcttgacttaattgaac

SEQ ID NO: 105673 - DNA, 25 bp, Mus musculus
acatccgtgtgtacccattcgcatt

SEQ ID NO: 105674 - DNA, 25 bp, Mus musculus
acatccgtgtgttcccattcgcatt

SEQ ID NO: 105675 - DNA, 25 bp, Mus musculus
acatccgttatgacatctcgcaagg

SEQ ID NO: 105676 - DNA, 25 bp, Mus musculus
acatccgttatgtcatctcgcaagg

SEQ ID NO: 105677 - DNA, 25 bp, Mus musculus
acatccgttcacatcatggtgactg

SEQ ID NO: 105678 - DNA, 25 bp, Mus musculus
acatccgttcacttcatggtgactg

SEQ ID NO: 105679 - DNA, 25 bp, Mus musculus
acatcctaaagtactgtatgacaca

SEQ ID NO: 105680 - DNA, 25 bp, Mus musculus
acatcctaaagttctgtatgacaca

SEQ ID NO: 105681 - DNA, 25 bp, Mus musculus
acatcctaaggacatattcaataaa

SEQ ID NO: 105682 - DNA, 25 bp, Mus musculus
acatcctaaggagatattcaataaa

SEQ ID NO: 105683 - DNA, 25 bp, Mus musculus
acatcctaatatagtcacgccctgt

SEQ ID NO: 105684 - DNA, 25 bp, Mus musculus
acatcctaatattgtcacgccctgt

SEQ ID NO: 105685 - DNA, 25 bp, Mus musculus
acatcctacagaacctcaaacgcag

SEQ ID NO: 105686 - DNA, 25 bp, Mus musculus
acatcctacagatcctcaaacgcag

SEQ ID NO: 105687 - DNA, 25 bp, Mus musculus
acatcctacatacatctgctgcagc

SEQ ID NO: 105688 - DNA, 25 bp, Mus musculus
acatcctacatagatctgctgcagc

SEQ ID NO: 105689 - DNA, 25 bp, Mus musculus
acatcctattttctggctccaaggc

SEQ ID NO: 105690 - DNA, 25 bp, Mus musculus
acatcctattttgtggctccaaggc

SEQ ID NO: 105691 - DNA, 25 bp, Mus musculus
acatcctcaataatcagcaagtcat

SEQ ID NO: 105692 - DNA, 25 bp, Mus musculus
acatcctcaatattcagcaagtcat

SEQ ID NO: 105693 - DNA, 25 bp, Mus musculus
acatcctcacatatacatgtgctca

SEQ ID NO: 105694 - DNA, 25 bp, Mus musculus
acatcctcacatttacatgtgctca

SEQ ID NO: 105695 - DNA, 25 bp, Mus musculus
acatcctcagagaaccatatagcaa

SEQ ID NO: 105696 - DNA, 25 bp, Mus musculus
acatcctcagagtaccatatagcaa

SEQ ID NO: 105697 - DNA, 25 bp, Mus musculus
acatcctcagtcctaggccttaata

SEQ ID NO: 105698 - DNA, 25 bp, Mus musculus
acatcctcagtcgtaggccttaata

SEQ ID NO: 105699 - DNA, 25 bp, Mus musculus
acatcctccaggactttgttattga

SEQ ID NO: 105700 - DNA, 25 bp, Mus musculus
acatcctccaggtctttgttattga

SEQ ID NO: 105701 - DNA, 25 bp, Mus musculus
acatcctcctctctagtaatgtaca

SEQ ID NO: 105702 - DNA, 25 bp, Mus musculus
acatcctcctctgtagtaatgtaca

SEQ ID NO: 105703 - DNA, 25 bp, Mus musculus
acatcctcctgaagatgccacggat

SEQ ID NO: 105704 - DNA, 25 bp, Mus musculus
acatcctcctgatgatgccacggat

SEQ ID NO: 105705 - DNA, 25 bp, Mus musculus
acatcctctctgaatggcttcataa

SEQ ID NO: 105706 - DNA, 25 bp, Mus musculus
acatcctctctgtatggcttcataa

SEQ ID NO: 105707 - DNA, 25 bp, Mus musculus
acatcctctgatagtttatcttgtg

SEQ ID NO: 105708 - DNA, 25 bp, Mus musculus
acatcctctgattgtttatcttgtg

SEQ ID NO: 105709 - DNA, 25 bp, Mus musculus
acatcctctgccaggttattgtatt

SEQ ID NO: 105710 - DNA, 25 bp, Mus musculus
acatcctctgcctggttattgtatt

SEQ ID NO: 105711 - DNA, 25 bp, Mus musculus
acatcctctgttctaagtgccttaa

SEQ ID NO: 105712 - DNA, 25 bp, Mus musculus
acatcctctgttgtaagtgccttaa

SEQ ID NO: 105713 - DNA, 25 bp, Mus musculus
acatcctcttgtaatttggcagtta

SEQ ID NO: 105714 - DNA, 25 bp, Mus musculus
acatcctcttgttatttggcagtta

SEQ ID NO: 105715 - DNA, 25 bp, Mus musculus
acatcctgaaatagagctccatctt

SEQ ID NO: 105716 - DNA, 25 bp, Mus musculus
acatcctgaaattgagctccatctt

SEQ ID NO: 105717 - DNA, 25 bp, Mus musculus
acatcctgaacgaggtgccgcgata

SEQ ID NO: 105718 - DNA, 25 bp, Mus musculus
acatcctgaacgtggtgccgcgata

SEQ ID NO: 105719 - DNA, 25 bp, Mus musculus
acatcctgactgaacttcctgttta

SEQ ID NO: 105720 - DNA, 25 bp, Mus musculus
acatcctgactgtacttcctgttta

SEQ ID NO: 105721 - DNA, 25 bp, Mus musculus
acatcctgagaaccacaaggtggga

SEQ ID NO: 105722 - DNA, 25 bp, Mus musculus
acatcctgagaagcacaaggtggga

SEQ ID NO: 105723 - DNA, 25 bp, Mus musculus
acatcctgatggcttccggttggaa

SEQ ID NO: 105724 - DNA, 25 bp, Mus musculus
acatcctgatgggttccggttggaa

SEQ ID NO: 105725 - DNA, 25 bp, Mus musculus
acatcctgattccttcagcacagag

SEQ ID NO: 105726 - DNA, 25 bp, Mus musculus
acatcctgattcgttcagcacagag

SEQ ID NO: 105727 - DNA, 25 bp, Mus musculus
acatcctgattgcagggctgggatt

SEQ ID NO: 105728 - DNA, 25 bp, Mus musculus
acatcctgattggagggctgggatt

SEQ ID NO: 105729 - DNA, 25 bp, Mus musculus
acatcctgcaatagtgtgttaccag

SEQ ID NO: 105730 - DNA, 25 bp, Mus musculus
acatcctgcaattgtgtgttaccag

SEQ ID NO: 105731 - DNA, 25 bp, Mus musculus
acatcctgcctcctgaactgaacaa

SEQ ID NO: 105732 - DNA, 25 bp, Mus musculus
acatcctgcctcgtgaactgaacaa

SEQ ID NO: 105733 - DNA, 25 bp, Mus musculus
acatcctgcgtgaggatccggtcaa

SEQ ID NO: 105734 - DNA, 25 bp, Mus musculus
acatcctgcgtgtggatccggtcaa

SEQ ID NO: 105735 - DNA, 25 bp, Mus musculus
acatcctgctagagagcgaccatgt

SEQ ID NO: 105736 - DNA, 25 bp, Mus musculus
acatcctgctagtgagcgaccatgt

SEQ ID NO: 105737 - DNA, 25 bp, Mus musculus
acatcctgctccatgtagcattgat

SEQ ID NO: 105738 - DNA, 25 bp, Mus musculus
acatcctgctccttgtagcattgat

SEQ ID NO: 105739 - DNA, 25 bp, Mus musculus
acatcctgctctcctggattgttaa

SEQ ID NO: 105740 - DNA, 25 bp, Mus musculus
acatcctgctctgctggattgttaa

SEQ ID NO: 105741 - DNA, 25 bp, Mus musculus
acatcctgcttgatccagttatcat

SEQ ID NO: 105742 - DNA, 25 bp, Mus musculus
acatcctgcttgttccagttatcat

SEQ ID NO: 105743 - DNA, 25 bp, Mus musculus
acatcctggaacacaagaactcggg

SEQ ID NO: 105744 - DNA, 25 bp, Mus musculus
acatcctggaactcaagaactcggg

SEQ ID NO: 105745 - DNA, 25 bp, Mus musculus
acatcctggcccaggcatagcattt

SEQ ID NO: 105746 - DNA, 25 bp, Mus musculus
acatcctggccctggcatagcattt

SEQ ID NO: 105747 - DNA, 25 bp, Mus musculus
acatcctggctaacatcggaatctt

SEQ ID NO: 105748 - DNA, 25 bp, Mus musculus
acatcctggctatcatcggaatctt

SEQ ID NO: 105749 - DNA, 25 bp, Mus musculus
acatcctggctgcaatgtggacatt

SEQ ID NO: 105750 - DNA, 25 bp, Mus musculus
acatcctggctggaatgtggacatt

SEQ ID NO: 105751 - DNA, 25 bp, Mus musculus
acatcctgggatctggtttcctaca

SEQ ID NO: 105752 - DNA, 25 bp, Mus musculus
acatcctgggatgtggtttcctaca

SEQ ID NO: 105753 - DNA, 25 bp, Mus musculus
acatcctgggctagtgtacaagcac

SEQ ID NO: 105754 - DNA, 25 bp, Mus musculus
acatcctgggcttgtgtacaagcac

SEQ ID NO: 105755 - DNA, 25 bp, Mus musculus
acatcctgggtacgtcctgggccag

SEQ ID NO: 105756 - DNA, 25 bp, Mus musculus
acatcctgggtaggtcctgggccag

SEQ ID NO: 105757 - DNA, 25 bp, Mus musculus
acatcctgggttctgtcagtgagca

SEQ ID NO: 105758 - DNA, 25 bp, Mus musculus
acatcctgggttgtgtcagtgagca

SEQ ID NO: 105759 - DNA, 25 bp, Mus musculus
acatcctggtcaatgttggagtggt

SEQ ID NO: 105760 - DNA, 25 bp, Mus musculus
acatcctggtcattgttggagtggt

SEQ ID NO: 105761 - DNA, 25 bp, Mus musculus
acatcctggtgtcatcacgtctaga

SEQ ID NO: 105762 - DNA, 25 bp, Mus musculus
acatcctggtgtgatcacgtctaga

SEQ ID NO: 105763 - DNA, 25 bp, Mus musculus
acatccttctttccttctggagctg

SEQ ID NO: 105764 - DNA, 25 bp, Mus musculus
acatccttctttgcttctggagctg

SEQ ID NO: 105765 - DNA, 25 bp, Mus musculus
acatccttgcgtatgtgtactgcaa

SEQ ID NO: 105766 - DNA, 25 bp, Mus musculus
acatccttgcgtttgtgtactgcaa

SEQ ID NO: 105767 - DNA, 25 bp, Mus musculus
acatccttggccaactcttcaggga

SEQ ID NO: 105768 - DNA, 25 bp, Mus musculus
acatccttggcctactcttcaggga

SEQ ID NO: 105769 - DNA, 25 bp, Mus musculus
acatccttgggtctagcttatctat

SEQ ID NO: 105770 - DNA, 25 bp, Mus musculus
acatccttgggtgtagcttatctat

SEQ ID NO: 105771 - DNA, 25 bp, Mus musculus
acatcctttaaacttcatccatcat

SEQ ID NO: 105772 - DNA, 25 bp, Mus musculus
acatcctttaaagttcatccatcat

SEQ ID NO: 105773 - DNA, 25 bp, Mus musculus
acatcctttataagaaacttcgtgt

SEQ ID NO: 105774 - DNA, 25 bp, Mus musculus
acatcctttatatgaaacttcgtgt

SEQ ID NO: 105775 - DNA, 25 bp, Mus musculus
acatcctttatcatgtttccaccct

SEQ ID NO: 105776 - DNA, 25 bp, Mus musculus
acatcctttatcttgtttccaccct

SEQ ID NO: 105777 - DNA, 25 bp, Mus musculus
acatcctttcaactgtctgcctcag

SEQ ID NO: 105778 - DNA, 25 bp, Mus musculus
acatcctttcaagtgtctgcctcag

SEQ ID NO: 105779 - DNA, 25 bp, Mus musculus
acatcctttgctcatagtaaaatgt

SEQ ID NO: 105780 - DNA, 25 bp, Mus musculus
acatcctttgctgatagtaaaatgt

SEQ ID NO: 105781 - DNA, 25 bp, Mus musculus
acatccttttggagagttgtgatcc

SEQ ID NO: 105782 - DNA, 25 bp, Mus musculus
acatccttttggtgagttgtgatcc

SEQ ID NO: 105783 - DNA, 25 bp, Mus musculus
acatccttttgtcggtggagtctcc

SEQ ID NO: 105784 - DNA, 25 bp, Mus musculus
acatccttttgtctcacttgttgaa

SEQ ID NO: 105785 - DNA, 25 bp, Mus musculus
acatccttttgtgggtggagtctcc

SEQ ID NO: 105786 - DNA, 25 bp, Mus musculus
acatccttttgtgtcacttgttgaa

SEQ ID NO: 105787 - DNA, 25 bp, Mus musculus
acatcctttttacagcatcactgta

SEQ ID NO: 105788 - DNA, 25 bp, Mus musculus
acatcctttttagagcatcactgta

SEQ ID NO: 105789 - DNA, 25 bp, Mus musculus
acatcgaaacatccttcagtaccag

SEQ ID NO: 105790 - DNA, 25 bp, Mus musculus
acatcgaaacatgcttcagtaccag

SEQ ID NO: 105791 - DNA, 25 bp, Mus musculus
acatcgaagaagctaaacagaaaga

SEQ ID NO: 105792 - DNA, 25 bp, Mus musculus
acatcgaagaaggtaaacagaaaga

SEQ ID NO: 105793 - DNA, 25 bp, Mus musculus
acatcgaatgcaccagccctgtaaa

SEQ ID NO: 105794 - DNA, 25 bp, Mus musculus
acatcgaatgcagcagccctgtaaa

SEQ ID NO: 105795 - DNA, 25 bp, Mus musculus
acatcgacagcaaacattcactagt

SEQ ID NO: 105796 - DNA, 25 bp, Mus musculus
acatcgacagcatacattcactagt

SEQ ID NO: 105797 - DNA, 25 bp, Mus musculus
acatcgaccacaatatagcacatta

SEQ ID NO: 105798 - DNA, 25 bp, Mus musculus
acatcgaccacattatagcacatta

SEQ ID NO: 105799 - DNA, 25 bp, Mus musculus
acatcgacttcactcacgctgtgtc

SEQ ID NO: 105800 - DNA, 25 bp, Mus musculus
acatcgacttcagtcacgctgtgtc

SEQ ID NO: 105801 - DNA, 25 bp, Mus musculus
acatcgagcgttctcgcttcttcct

SEQ ID NO: 105802 - DNA, 25 bp, Mus musculus
acatcgagcgttgtcgcttcttcct

SEQ ID NO: 105803 - DNA, 25 bp, Mus musculus
acatcgagggacagactggatgcca

SEQ ID NO: 105804 - DNA, 25 bp, Mus musculus
acatcgagggactgactggatgcca

SEQ ID NO: 105805 - DNA, 25 bp, Mus musculus
acatcgagtcagatgcctggcagga

SEQ ID NO: 105806 - DNA, 25 bp, Mus musculus
acatcgagtcagttgcctggcagga

SEQ ID NO: 105807 - DNA, 25 bp, Mus musculus
acatcgatctgtctccttgtgttgg

SEQ ID NO: 105808 - DNA, 25 bp, Mus musculus
acatcgatctgtgtccttgtgttgg

SEQ ID NO: 105809 - DNA, 25 bp, Mus musculus
acatcgatcttgatggaatgtgatc

SEQ ID NO: 105810 - DNA, 25 bp, Mus musculus
acatcgatcttgttggaatgtgatc

SEQ ID NO: 105811 - DNA, 25 bp, Mus musculus
acatcgatggcgacaaataaggaac

SEQ ID NO: 105812 - DNA, 25 bp, Mus musculus
acatcgatggcgtcaaataaggaac

SEQ ID NO: 105813 - DNA, 25 bp, Mus musculus
acatcgattggcaccttgagaagaa

SEQ ID NO: 105814 - DNA, 25 bp, Mus musculus
acatcgattggctccttgagaagaa

SEQ ID NO: 105815 - DNA, 25 bp, Mus musculus
acatcgcacctgaagttctgcctgg

SEQ ID NO: 105816 - DNA, 25 bp, Mus musculus
acatcgcacctgtagttctgcctgg

SEQ ID NO: 105817 - DNA, 25 bp, Mus musculus
acatcgcactgtagacagccacaag

SEQ ID NO: 105818 - DNA, 25 bp, Mus musculus
acatcgcactgttgacagccacaag

SEQ ID NO: 105819 - DNA, 25 bp, Mus musculus
acatcgccaatcagcttgggctaga

SEQ ID NO: 105820 - DNA, 25 bp, Mus musculus
acatcgccaatctgcttgggctaga

SEQ ID NO: 105821 - DNA, 25 bp, Mus musculus
acatcgccagcaactgtgtttgtaa

SEQ ID NO: 105822 - DNA, 25 bp, Mus musculus
acatcgccagcatctgtgtttgtaa

SEQ ID NO: 105823 - DNA, 25 bp, Mus musculus
acatcgccaggacgaaagcccttca

SEQ ID NO: 105824 - DNA, 25 bp, Mus musculus
acatcgccaggaggaaagcccttca

SEQ ID NO: 105825 - DNA, 25 bp, Mus musculus
acatcgccattgaagtctttgctgc

SEQ ID NO: 105826 - DNA, 25 bp, Mus musculus
acatcgccattgtagtctttgctgc

SEQ ID NO: 105827 - DNA, 25 bp, Mus musculus
acatcgccgacaacttccaggcatt

SEQ ID NO: 105828 - DNA, 25 bp, Mus musculus
acatcgccgacatcttccaggcatt

SEQ ID NO: 105829 - DNA, 25 bp, Mus musculus
acatcgcctgccagtagaattttta

SEQ ID NO: 105830 - DNA, 25 bp, Mus musculus
acatcgcctgcctgtagaattttta

SEQ ID NO: 105831 - DNA, 25 bp, Mus musculus
acatcgcgctatactgttttgcaag

SEQ ID NO: 105832 - DNA, 25 bp, Mus musculus
acatcgcgctattctgttttgcaag

SEQ ID NO: 105833 - DNA, 25 bp, Mus musculus
acatcgctcattctccatgtgagaa

SEQ ID NO: 105834 - DNA, 25 bp, Mus musculus
acatcgctcattgtccatgtgagaa

SEQ ID NO: 105835 - DNA, 25 bp, Mus musculus
acatcgctcggtctgtatggcctga

SEQ ID NO: 105836 - DNA, 25 bp, Mus musculus
acatcgctcggtgtgtatggcctga

SEQ ID NO: 105837 - DNA, 25 bp, Mus musculus
acatcgctgcaacgtcattctaata

SEQ ID NO: 105838 - DNA, 25 bp, Mus musculus
acatcgctgcaaggtcattctaata

SEQ ID NO: 105839 - DNA, 25 bp, Mus musculus
acatcgctgtgtccggtaccatggg

SEQ ID NO: 105840 - DNA, 25 bp, Mus musculus
acatcgctgtgtgcggtaccatggg

SEQ ID NO: 105841 - DNA, 25 bp, Mus musculus
acatcgcttatgcactggtatatac

SEQ ID NO: 105842 - DNA, 25 bp, Mus musculus
acatcgcttatggactggtatatac

SEQ ID NO: 105843 - DNA, 25 bp, Mus musculus
acatcggaccagaggagatctcaca

SEQ ID NO: 105844 - DNA, 25 bp, Mus musculus
acatcggaccagtggagatctcaca

SEQ ID NO: 105845 - DNA, 25 bp, Mus musculus
acatcggagctgactttgggcttgg

SEQ ID NO: 105846 - DNA, 25 bp, Mus musculus
acatcggagctgtctttgggcttgg

SEQ ID NO: 105847 - DNA, 25 bp, Mus musculus
acatcggaggaaacccatcttcaaa

SEQ ID NO: 105848 - DNA, 25 bp, Mus musculus
acatcggaggaatcccatcttcaaa

SEQ ID NO: 105849 - DNA, 25 bp, Mus musculus
acatcggcgagtagatcctgctcaa

SEQ ID NO: 105850 - DNA, 25 bp, Mus musculus
acatcggcgagttgatcctgctcaa

SEQ ID NO: 105851 - DNA, 25 bp, Mus musculus
acatcgggccatctctgatacctgg

SEQ ID NO: 105852 - DNA, 25 bp, Mus musculus
acatcgggccatgtctgatacctgg

SEQ ID NO: 105853 - DNA, 25 bp, Mus musculus
acatcggtccctccagtgttggttt

SEQ ID NO: 105854 - DNA, 25 bp, Mus musculus
acatcggtccctgcagtgttggttt

SEQ ID NO: 105855 - DNA, 25 bp, Mus musculus
acatcggtgagactttcctttccat

SEQ ID NO: 105856 - DNA, 25 bp, Mus musculus
acatcggtgagagtttcctttccat

SEQ ID NO: 105857 - DNA, 25 bp, Mus musculus
acatcggtgctacacaagctagagt

SEQ ID NO: 105858 - DNA, 25 bp, Mus musculus
acatcggtgctagacaagctagagt

SEQ ID NO: 105859 - DNA, 25 bp, Mus musculus
acatcggtgggtctggttctttagt

SEQ ID NO: 105860 - DNA, 25 bp, Mus musculus
acatcggtgggtgtggttctttagt

SEQ ID NO: 105861 - DNA, 25 bp, Mus musculus
acatcggtgtgtatgacaggcgtca

SEQ ID NO: 105862 - DNA, 25 bp, Mus musculus
acatcggtgtgtttgacaggcgtca

SEQ ID NO: 105863 - DNA, 25 bp, Mus musculus
acatcgtactgtctctgtgtggtcc

SEQ ID NO: 105864 - DNA, 25 bp, Mus musculus
acatcgtactgtgtctgtgtggtcc

SEQ ID NO: 105865 - DNA, 25 bp, Mus musculus
acatcgtatggaatgctgagtgcat

SEQ ID NO: 105866 - DNA, 25 bp, Mus musculus
acatcgtatggattgctgagtgcat

SEQ ID NO: 105867 - DNA, 25 bp, Mus musculus
acatcgtcaaccatgctgtggtgaa

SEQ ID NO: 105868 - DNA, 25 bp, Mus musculus
acatcgtcaaccttgctgtggtgaa

SEQ ID NO: 105869 - DNA, 25 bp, Mus musculus
acatcgtcaatgaggtgtgcccgct

SEQ ID NO: 105870 - DNA, 25 bp, Mus musculus
acatcgtcaatgtggtgtgcccgct

SEQ ID NO: 105871 - DNA, 25 bp, Mus musculus
acatcgtcaccaagggtcagctcct

SEQ ID NO: 105872 - DNA, 25 bp, Mus musculus
acatcgtcaccatgggtcagctcct

SEQ ID NO: 105873 - DNA, 25 bp, Mus musculus
acatcgtccatcatctagaaggtgg

SEQ ID NO: 105874 - DNA, 25 bp, Mus musculus
acatcgtccatcttctagaaggtgg

SEQ ID NO: 105875 - DNA, 25 bp, Mus musculus
acatcgtcgagtattccatctgtct

SEQ ID NO: 105876 - DNA, 25 bp, Mus musculus
acatcgtcgagttttccatctgtct

SEQ ID NO: 105877 - DNA, 25 bp, Mus musculus
acatcgtctgagaagcattctagga

SEQ ID NO: 105878 - DNA, 25 bp, Mus musculus
acatcgtctgagtagcattctagga

SEQ ID NO: 105879 - DNA, 25 bp, Mus musculus
acatcgtgcctgaacagctagcagt

SEQ ID NO: 105880 - DNA, 25 bp, Mus musculus
acatcgtgcctgtacagctagcagt

SEQ ID NO: 105881 - DNA, 25 bp, Mus musculus
acatcgtgcgctactttggagtctg

SEQ ID NO: 105882 - DNA, 25 bp, Mus musculus
acatcgtgcgcttctttggagtctg

SEQ ID NO: 105883 - DNA, 25 bp, Mus musculus
acatcgtgtgtaattgccaggtctg

SEQ ID NO: 105884 - DNA, 25 bp, Mus musculus
acatcgtgtgtatttgccaggtctg

SEQ ID NO: 105885 - DNA, 25 bp, Mus musculus
acatcgtgttgtcgaacagttacaa

SEQ ID NO: 105886 - DNA, 25 bp, Mus musculus
acatcgtgttgtggaacagttacaa

SEQ ID NO: 105887 - DNA, 25 bp, Mus musculus
acatcgtgtttcatccatacggagc

SEQ ID NO: 105888 - DNA, 25 bp, Mus musculus
acatcgtgtttcttccatacggagc

SEQ ID NO: 105889 - DNA, 25 bp, Mus musculus
acatcgttcgatccaggcctcatat

SEQ ID NO: 105890 - DNA, 25 bp, Mus musculus
acatcgttcgatgcaggcctcatat

SEQ ID NO: 105891 - DNA, 25 bp, Mus musculus
acatcgttcgcacgactggtttaca

SEQ ID NO: 105892 - DNA, 25 bp, Mus musculus
acatcgttcgcaggactggtttaca

SEQ ID NO: 105893 - DNA, 25 bp, Mus musculus
acatcgttgtaaccatggccactgt

SEQ ID NO: 105894 - DNA, 25 bp, Mus musculus
acatcgttgtaagcatggccactgt

SEQ ID NO: 105895 - DNA, 25 bp, Mus musculus
acatctaacaatcttcaggaggctg

SEQ ID NO: 105896 - DNA, 25 bp, Mus musculus
acatctaacaatgttcaggaggctg

SEQ ID NO: 105897 - DNA, 25 bp, Mus musculus
acatctaacctgactgtgggattga

SEQ ID NO: 105898 - DNA, 25 bp, Mus musculus
acatctaacctgtctgtgggattga

SEQ ID NO: 105899 - DNA, 25 bp, Mus musculus
acatctaaccttcggagtcttacct

SEQ ID NO: 105900 - DNA, 25 bp, Mus musculus
acatctaaccttgggagtcttacct

SEQ ID NO: 105901 - DNA, 25 bp, Mus musculus
acatctaagctgagcatttattcaa

SEQ ID NO: 105902 - DNA, 25 bp, Mus musculus
acatctaagctgtgcatttattcaa

SEQ ID NO: 105903 - DNA, 25 bp, Mus musculus
acatctaaggtgacagttgctggct

SEQ ID NO: 105904 - DNA, 25 bp, Mus musculus
acatctaaggtgtcagttgctggct

SEQ ID NO: 105905 - DNA, 25 bp, Mus musculus
acatctaatgccagattgtttttat

SEQ ID NO: 105906 - DNA, 25 bp, Mus musculus
acatctaatgcctgattgtttttat

SEQ ID NO: 105907 - DNA, 25 bp, Mus musculus
acatctacagctccctcgtggagca

SEQ ID NO: 105908 - DNA, 25 bp, Mus musculus
acatctacagctgcctcgtggagca

SEQ ID NO: 105909 - DNA, 25 bp, Mus musculus
acatctaccgtgagggctgcgcgca

SEQ ID NO: 105910 - DNA, 25 bp, Mus musculus
acatctaccgtgtgggctgcgcgca

SEQ ID NO: 105911 - DNA, 25 bp, Mus musculus
acatctacctacagttgaccaaaaa

SEQ ID NO: 105912 - DNA, 25 bp, Mus musculus
acatctacctactgttgaccaaaaa

SEQ ID NO: 105913 - DNA, 25 bp, Mus musculus
acatctacggctacgagggcgcaga

SEQ ID NO: 105914 - DNA, 25 bp, Mus musculus
acatctacggcttcgagggcgcaga

SEQ ID NO: 105915 - DNA, 25 bp, Mus musculus
acatctactcggagaagtccaggga

SEQ ID NO: 105916 - DNA, 25 bp, Mus musculus
acatctactcggtgaagtccaggga

SEQ ID NO: 105917 - DNA, 25 bp, Mus musculus
acatctactgctagtgtctctttgg

SEQ ID NO: 105918 - DNA, 25 bp, Mus musculus
acatctactgcttgtgtctctttgg

SEQ ID NO: 105919 - DNA, 25 bp, Mus musculus
acatctactgtaatattgctgaata

SEQ ID NO: 105920 - DNA, 25 bp, Mus musculus
acatctactgtattattgctgaata

SEQ ID NO: 105921 - DNA, 25 bp, Mus musculus
acatctacttgtatgcagtatgcac

SEQ ID NO: 105922 - DNA, 25 bp, Mus musculus
acatctacttgtttgcagtatgcac

SEQ ID NO: 105923 - DNA, 25 bp, Mus musculus
acatctagtcagaatagggttccaa

SEQ ID NO: 105924 - DNA, 25 bp, Mus musculus
acatctagtcagtatagggttccaa

SEQ ID NO: 105925 - DNA, 25 bp, Mus musculus
acatctataaatctagctccatagg

SEQ ID NO: 105926 - DNA, 25 bp, Mus musculus
acatctataaatgtagctccatagg

SEQ ID NO: 105927 - DNA, 25 bp, Mus musculus
acatctataactcagcctacctatc

SEQ ID NO: 105928 - DNA, 25 bp, Mus musculus
acatctataactgagcctacctatc

SEQ ID NO: 105929 - DNA, 25 bp, Mus musculus
acatctatcaagaactgcagcctcc

SEQ ID NO: 105930 - DNA, 25 bp, Mus musculus
acatctatcaagtactgcagcctcc

SEQ ID NO: 105931 - DNA, 25 bp, Mus musculus
acatctatcatgaactgggtctatt

SEQ ID NO: 105932 - DNA, 25 bp, Mus musculus
acatctatcatgtactgggtctatt

SEQ ID NO: 105933 - DNA, 25 bp, Mus musculus
acatctatctggctgctgggtcccg

SEQ ID NO: 105934 - DNA, 25 bp, Mus musculus
acatctatctgggtgctgggtcccg

SEQ ID NO: 105935 - DNA, 25 bp, Mus musculus
acatctatgaagctgttggatcccc

SEQ ID NO: 105936 - DNA, 25 bp, Mus musculus
acatctatgaaggtgttggatcccc

SEQ ID NO: 105937 - DNA, 25 bp, Mus musculus
acatctatgtgtactgtccaggaaa

SEQ ID NO: 105938 - DNA, 25 bp, Mus musculus
acatctatgtgttctgtccaggaaa

SEQ ID NO: 105939 - DNA, 25 bp, Mus musculus
acatctattaggaatcacaggtcac

SEQ ID NO: 105940 - DNA, 25 bp, Mus musculus
acatctattaggtatcacaggtcac

SEQ ID NO: 105941 - DNA, 25 bp, Mus musculus
acatctatttcaaggatcccctaaa

SEQ ID NO: 105942 - DNA, 25 bp, Mus musculus
acatctatttcatggatcccctaaa

SEQ ID NO: 105943 - DNA, 25 bp, Mus musculus
acatctcaaatcatctccttaacag

SEQ ID NO: 105944 - DNA, 25 bp, Mus musculus
acatctcaaatcttctccttaacag

SEQ ID NO: 105945 - DNA, 25 bp, Mus musculus
acatctcaaggtcggaagcctggct

SEQ ID NO: 105946 - DNA, 25 bp, Mus musculus
acatctcaaggtgggaagcctggct

SEQ ID NO: 105947 - DNA, 25 bp, Mus musculus
acatctcaagtcatccgtgtagcag

SEQ ID NO: 105948 - DNA, 25 bp, Mus musculus
acatctcaagtcttccgtgtagcag

SEQ ID NO: 105949 - DNA, 25 bp, Mus musculus
acatctcaagtgatacagactcccc

SEQ ID NO: 105950 - DNA, 25 bp, Mus musculus
acatctcaagtgttacagactcccc

SEQ ID NO: 105951 - DNA, 25 bp, Mus musculus
acatctcaatatatttcaccttggg

SEQ ID NO: 105952 - DNA, 25 bp, Mus musculus
acatctcaatatttttcaccttggg

SEQ ID NO: 105953 - DNA, 25 bp, Mus musculus
acatctcaatgtcacttaatacgtt

SEQ ID NO: 105954 - DNA, 25 bp, Mus musculus
acatctcaatgtgacttaatacgtt

SEQ ID NO: 105955 - DNA, 25 bp, Mus musculus
acatctcacaggcatcccaggaaat

SEQ ID NO: 105956 - DNA, 25 bp, Mus musculus
acatctcacagggatcccaggaaat

SEQ ID NO: 105957 - DNA, 25 bp, Mus musculus
acatctcaccatcctgtagttttag

SEQ ID NO: 105958 - DNA, 25 bp, Mus musculus
acatctcaccatgctgtagttttag

SEQ ID NO: 105959 - DNA, 25 bp, Mus musculus
acatctcaccgtaggtaatttgctt

SEQ ID NO: 105960 - DNA, 25 bp, Mus musculus
acatctcaccgttggtaatttgctt

SEQ ID NO: 105961 - DNA, 25 bp, Mus musculus
acatctcacggtacaatgacttcta

SEQ ID NO: 105962 - DNA, 25 bp, Mus musculus
acatctcacggttcaatgacttcta

SEQ ID NO: 105963 - DNA, 25 bp, Mus musculus
acatctcactgtcggagtcctggga

SEQ ID NO: 105964 - DNA, 25 bp, Mus musculus
acatctcactgtgggagtcctggga

SEQ ID NO: 105965 - DNA, 25 bp, Mus musculus
acatctcagcctagttttagtccac

SEQ ID NO: 105966 - DNA, 25 bp, Mus musculus
acatctcagccttgttttagtccac

SEQ ID NO: 105967 - DNA, 25 bp, Mus musculus
acatctcagcttaacacttttgtgc

SEQ ID NO: 105968 - DNA, 25 bp, Mus musculus
acatctcagctttacacttttgtgc

SEQ ID NO: 105969 - DNA, 25 bp, Mus musculus
acatctcaggacctggcatttgaaa

SEQ ID NO: 105970 - DNA, 25 bp, Mus musculus
acatctcaggacgtggcatttgaaa

SEQ ID NO: 105971 - DNA, 25 bp, Mus musculus
acatctcagggacgcctaggcaaca

SEQ ID NO: 105972 - DNA, 25 bp, Mus musculus
acatctcagggaggcctaggcaaca

SEQ ID NO: 105973 - DNA, 25 bp, Mus musculus
acatctcagggtctccaggccatgt

SEQ ID NO: 105974 - DNA, 25 bp, Mus musculus
acatctcagggtgtccaggccatgt

SEQ ID NO: 105975 - DNA, 25 bp, Mus musculus
acatctcataatcaacttcacccaa

SEQ ID NO: 105976 - DNA, 25 bp, Mus musculus
acatctcataatgaacttcacccaa

SEQ ID NO: 105977 - DNA, 25 bp, Mus musculus
acatctcatcctcgcaggtgtgggc

SEQ ID NO: 105978 - DNA, 25 bp, Mus musculus
acatctcatcctggcaggtgtgggc

SEQ ID NO: 105979 - DNA, 25 bp, Mus musculus
acatctcatgctctgcacccggagg

SEQ ID NO: 105980 - DNA, 25 bp, Mus musculus
acatctcatgctgtgcacccggagg

SEQ ID NO: 105981 - DNA, 25 bp, Mus musculus
acatctccacctcaaggctgctagg

SEQ ID NO: 105982 - DNA, 25 bp, Mus musculus
acatctccacctgaaggctgctagg

SEQ ID NO: 105983 - DNA, 25 bp, Mus musculus
acatctccagcactcatctaaaggc

SEQ ID NO: 105984 - DNA, 25 bp, Mus musculus
acatctccagcagtcatctaaaggc

SEQ ID NO: 105985 - DNA, 25 bp, Mus musculus
acatctccaggtactagcatttata

SEQ ID NO: 105986 - DNA, 25 bp, Mus musculus
acatctccaggttctagcatttata

SEQ ID NO: 105987 - DNA, 25 bp, Mus musculus
acatctccagtactgctgccttatt

SEQ ID NO: 105988 - DNA, 25 bp, Mus musculus
acatctccagtagtgctgccttatt

SEQ ID NO: 105989 - DNA, 25 bp, Mus musculus
acatctccatttcgtgttagcgcaa

SEQ ID NO: 105990 - DNA, 25 bp, Mus musculus
acatctccatttggtgttagcgcaa

SEQ ID NO: 105991 - DNA, 25 bp, Mus musculus
acatctcctgctaatgttgttgccc

SEQ ID NO: 105992 - DNA, 25 bp, Mus musculus
acatctcctgcttatgttgttgccc

SEQ ID NO: 105993 - DNA, 25 bp, Mus musculus
acatctcctggcacggtcttatctc

SEQ ID NO: 105994 - DNA, 25 bp, Mus musculus
acatctcctggctcggtcttatctc

SEQ ID NO: 105995 - DNA, 25 bp, Mus musculus
acatctcctgttatgaattggccta

SEQ ID NO: 105996 - DNA, 25 bp, Mus musculus
acatctcctgttttgaattggccta

SEQ ID NO: 105997 - DNA, 25 bp, Mus musculus
acatctccttctacagcttcagaga

SEQ ID NO: 105998 - DNA, 25 bp, Mus musculus
acatctccttcttcagcttcagaga

SEQ ID NO: 105999 - DNA, 25 bp, Mus musculus
acatctccttgaaaagccttcagag

SEQ ID NO: 106000 - DNA, 25 bp, Mus musculus
acatctccttgataagccttcagag

SEQ ID NO: 106001 - DNA, 25 bp, Mus musculus
acatctccttgtaggtattacacta

SEQ ID NO: 106002 - DNA, 25 bp, Mus musculus
acatctccttgttggtattacacta

SEQ ID NO: 106003 - DNA, 25 bp, Mus musculus
acatctcgaactccaggcctgggaa

SEQ ID NO: 106004 - DNA, 25 bp, Mus musculus
acatctcgaactgcaggcctgggaa

SEQ ID NO: 106005 - DNA, 25 bp, Mus musculus
acatctcgaatgctcaggtgttgga

SEQ ID NO: 106006 - DNA, 25 bp, Mus musculus
acatctcgaatggtcaggtgttgga

SEQ ID NO: 106007 - DNA, 25 bp, Mus musculus
acatctcgctgcatagctgccagta

SEQ ID NO: 106008 - DNA, 25 bp, Mus musculus
acatctcgctgcttagctgccagta

SEQ ID NO: 106009 - DNA, 25 bp, Mus musculus
acatctcggagcatcagtttccaaa

SEQ ID NO: 106010 - DNA, 25 bp, Mus musculus
acatctcggagcttcagtttccaaa

SEQ ID NO: 106011 - DNA, 25 bp, Mus musculus
acatctcgggcaacaaatattcaca

SEQ ID NO: 106012 - DNA, 25 bp, Mus musculus
acatctcgggcatcaaatattcaca

SEQ ID NO: 106013 - DNA, 25 bp, Mus musculus
acatctcgggctatgtcagcggcct

SEQ ID NO: 106014 - DNA, 25 bp, Mus musculus
acatctcgggctttgtcagcggcct

SEQ ID NO: 106015 - DNA, 25 bp, Mus musculus
acatctcgtgtcaattcttagtgga

SEQ ID NO: 106016 - DNA, 25 bp, Mus musculus
acatctcgtgtctattcttagtgga

SEQ ID NO: 106017 - DNA, 25 bp, Mus musculus
acatctctacacacatccagaaaga

SEQ ID NO: 106018 - DNA, 25 bp, Mus musculus
acatctctacacacctagggtgagg

SEQ ID NO: 106019 - DNA, 25 bp, Mus musculus
acatctctacactcatccagaaaga

SEQ ID NO: 106020 - DNA, 25 bp, Mus musculus
acatctctacactcctagggtgagg

SEQ ID NO: 106021 - DNA, 25 bp, Mus musculus
acatctctacatcgttttgtgcatc

SEQ ID NO: 106022 - DNA, 25 bp, Mus musculus
acatctctacatggttttgtgcatc

SEQ ID NO: 106023 - DNA, 25 bp, Mus musculus
acatctctacggaaatgtgccggga

SEQ ID NO: 106024 - DNA, 25 bp, Mus musculus
acatctctacggtaatgtgccggga

SEQ ID NO: 106025 - DNA, 25 bp, Mus musculus
acatctctccttactgcagatacag

SEQ ID NO: 106026 - DNA, 25 bp, Mus musculus
acatctctcctttctgcagatacag

SEQ ID NO: 106027 - DNA, 25 bp, Mus musculus
acatctctctgactttaaaagaacg

SEQ ID NO: 106028 - DNA, 25 bp, Mus musculus
acatctctctgagtttaaaagaacg

SEQ ID NO: 106029 - DNA, 25 bp, Mus musculus
acatctctctgcaccttgagaaagg

SEQ ID NO: 106030 - DNA, 25 bp, Mus musculus
acatctctctgctccttgagaaagg

SEQ ID NO: 106031 - DNA, 25 bp, Mus musculus
acatctctctttctgttgagcttat

SEQ ID NO: 106032 - DNA, 25 bp, Mus musculus
acatctctctttgtgttgagcttat

SEQ ID NO: 106033 - DNA, 25 bp, Mus musculus
acatctctgaagaccctttttctaa

SEQ ID NO: 106034 - DNA, 25 bp, Mus musculus
acatctctgaagtccctttttctaa

SEQ ID NO: 106035 - DNA, 25 bp, Mus musculus
acatctctgaatctgaaactgcatt

SEQ ID NO: 106036 - DNA, 25 bp, Mus musculus
acatctctgaatgtgaaactgcatt

SEQ ID NO: 106037 - DNA, 25 bp, Mus musculus
acatctctgactcttcacaatggaa

SEQ ID NO: 106038 - DNA, 25 bp, Mus musculus
acatctctgactgttcacaatggaa

SEQ ID NO: 106039 - DNA, 25 bp, Mus musculus
acatctctgagaacccgttgcaatt

SEQ ID NO: 106040 - DNA, 25 bp, Mus musculus
acatctctgagatcccgttgcaatt

SEQ ID NO: 106041 - DNA, 25 bp, Mus musculus
acatctctgaggagccgggttccat

SEQ ID NO: 106042 - DNA, 25 bp, Mus musculus
acatctctgaggtgccgggttccat

SEQ ID NO: 106043 - DNA, 25 bp, Mus musculus
acatctctgcgtacagcttgagtgt

SEQ ID NO: 106044 - DNA, 25 bp, Mus musculus
acatctctgcgttcagcttgagtgt

SEQ ID NO: 106045 - DNA, 25 bp, Mus musculus
acatctctggcgctgataactattg

SEQ ID NO: 106046 - DNA, 25 bp, Mus musculus
acatctctggcggtgataactattg

SEQ ID NO: 106047 - DNA, 25 bp, Mus musculus
acatctctggtaaaagcaacatttg

SEQ ID NO: 106048 - DNA, 25 bp, Mus musculus
acatctctggtataagcaacatttg

SEQ ID NO: 106049 - DNA, 25 bp, Mus musculus
acatctctgtgaattagctggcgtc

SEQ ID NO: 106050 - DNA, 25 bp, Mus musculus
acatctctgtgatttagctggcgtc

SEQ ID NO: 106051 - DNA, 25 bp, Mus musculus
acatctcttggcctctggatatatg

SEQ ID NO: 106052 - DNA, 25 bp, Mus musculus
acatctcttggcgtctggatatatg

SEQ ID NO: 106053 - DNA, 25 bp, Mus musculus
acatctcttggtcatgtcctcttct

SEQ ID NO: 106054 - DNA, 25 bp, Mus musculus
acatctcttggtgatgtcctcttct

SEQ ID NO: 106055 - DNA, 25 bp, Mus musculus
acatctcttgtacacttggctagag

SEQ ID NO: 106056 - DNA, 25 bp, Mus musculus
acatctcttgtagacttggctagag

SEQ ID NO: 106057 - DNA, 25 bp, Mus musculus
acatctctttacaactgtaattgcg

SEQ ID NO: 106058 - DNA, 25 bp, Mus musculus
acatctctttactactgtaattgcg

SEQ ID NO: 106059 - DNA, 25 bp, Mus musculus
acatctgaacatatggctctcatga

SEQ ID NO: 106060 - DNA, 25 bp, Mus musculus
acatctgaacatttggctctcatga

SEQ ID NO: 106061 - DNA, 25 bp, Mus musculus
acatctgaagcgacgttgccctgga

SEQ ID NO: 106062 - DNA, 25 bp, Mus musculus
acatctgaagcgtcgttgccctgga

SEQ ID NO: 106063 - DNA, 25 bp, Mus musculus
acatctgagaacaacctacgtggtg

SEQ ID NO: 106064 - DNA, 25 bp, Mus musculus
acatctgagaactacctacgtggtg

SEQ ID NO: 106065 - DNA, 25 bp, Mus musculus
acatctgaggttactttcttcagtc

SEQ ID NO: 106066 - DNA, 25 bp, Mus musculus
acatctgaggtttctttcttcagtc

SEQ ID NO: 106067 - DNA, 25 bp, Mus musculus
acatctgatgaaactgctcctcgga

SEQ ID NO: 106068 - DNA, 25 bp, Mus musculus
acatctgatgaatctgctcctcgga

SEQ ID NO: 106069 - DNA, 25 bp, Mus musculus
acatctgatgctaacgttctgacta

SEQ ID NO: 106070 - DNA, 25 bp, Mus musculus
acatctgatgcttacgttctgacta

SEQ ID NO: 106071 - DNA, 25 bp, Mus musculus
acatctgatggccaggcagttccat

SEQ ID NO: 106072 - DNA, 25 bp, Mus musculus
acatctgatggcgaggcagttccat

SEQ ID NO: 106073 - DNA, 25 bp, Mus musculus
acatctgatgtcagctctccagtgg

SEQ ID NO: 106074 - DNA, 25 bp, Mus musculus
acatctgatgtctgctctccagtgg

SEQ ID NO: 106075 - DNA, 25 bp, Mus musculus
acatctgcagagaggtggaaccatc

SEQ ID NO: 106076 - DNA, 25 bp, Mus musculus
acatctgcagagtggtggaaccatc

SEQ ID NO: 106077 - DNA, 25 bp, Mus musculus
acatctgcagctacaggttgtgcct

SEQ ID NO: 106078 - DNA, 25 bp, Mus musculus
acatctgcagcttcaggttgtgcct

SEQ ID NO: 106079 - DNA, 25 bp, Mus musculus
acatctgcattgaacacatctgcaa

SEQ ID NO: 106080 - DNA, 25 bp, Mus musculus
acatctgcattgtacacatctgcaa

SEQ ID NO: 106081 - DNA, 25 bp, Mus musculus
acatctgccaagacattttctggat

SEQ ID NO: 106082 - DNA, 25 bp, Mus musculus
acatctgccaagtcattttctggat

SEQ ID NO: 106083 - DNA, 25 bp, Mus musculus
acatctgccattctctaaggtcaca

SEQ ID NO: 106084 - DNA, 25 bp, Mus musculus
acatctgccattgtctaaggtcaca

SEQ ID NO: 106085 - DNA, 25 bp, Mus musculus
acatctgcctctactagcggagagc

SEQ ID NO: 106086 - DNA, 25 bp, Mus musculus
acatctgcctcttctagcggagagc

SEQ ID NO: 106087 - DNA, 25 bp, Mus musculus
acatctgcgattcctctgttgcctt

SEQ ID NO: 106088 - DNA, 25 bp, Mus musculus
acatctgcgattgctctgttgcctt

SEQ ID NO: 106089 - DNA, 25 bp, Mus musculus
acatctgcgtatcctagttgctagg

SEQ ID NO: 106090 - DNA, 25 bp, Mus musculus
acatctgcgtatgctagttgctagg

SEQ ID NO: 106091 - DNA, 25 bp, Mus musculus
acatctgcgtgtattacaagctact

SEQ ID NO: 106092 - DNA, 25 bp, Mus musculus
acatctgcgtgttttacaagctact

SEQ ID NO: 106093 - DNA, 25 bp, Mus musculus
acatctgctaaaatgcccctactaa

SEQ ID NO: 106094 - DNA, 25 bp, Mus musculus
acatctgctaaattgcccctactaa

SEQ ID NO: 106095 - DNA, 25 bp, Mus musculus
acatctgctcagacattatacttta

SEQ ID NO: 106096 - DNA, 25 bp, Mus musculus
acatctgctcagactattgggtata

SEQ ID NO: 106097 - DNA, 25 bp, Mus musculus
acatctgctcagtcattatacttta

SEQ ID NO: 106098 - DNA, 25 bp, Mus musculus
acatctgctcagtctattgggtata

SEQ ID NO: 106099 - DNA, 25 bp, Mus musculus
acatctgctcctatgacgtgtgatt

SEQ ID NO: 106100 - DNA, 25 bp, Mus musculus
acatctgctcctttgacgtgtgatt

SEQ ID NO: 106101 - DNA, 25 bp, Mus musculus
acatctgctcggatgtacaaataac

SEQ ID NO: 106102 - DNA, 25 bp, Mus musculus
acatctgctcggttgtacaaataac

SEQ ID NO: 106103 - DNA, 25 bp, Mus musculus
acatctgctcgtataacaccgtgta

SEQ ID NO: 106104 - DNA, 25 bp, Mus musculus
acatctgctcgtttaacaccgtgta

SEQ ID NO: 106105 - DNA, 25 bp, Mus musculus
acatctgctgcaactgctttaggag

SEQ ID NO: 106106 - DNA, 25 bp, Mus musculus
acatctgctgcacttccatggaacc

SEQ ID NO: 106107 - DNA, 25 bp, Mus musculus
acatctgctgcagttccatggaacc

SEQ ID NO: 106108 - DNA, 25 bp, Mus musculus
acatctgctgcatctgctttaggag

SEQ ID NO: 106109 - DNA, 25 bp, Mus musculus
acatctggaacgacactggtgccaa

SEQ ID NO: 106110 - DNA, 25 bp, Mus musculus
acatctggaacgatggccgggagaa

SEQ ID NO: 106111 - DNA, 25 bp, Mus musculus
acatctggaacgtcactggtgccaa

SEQ ID NO: 106112 - DNA, 25 bp, Mus musculus
acatctggaacgttggccgggagaa

SEQ ID NO: 106113 - DNA, 25 bp, Mus musculus
acatctggaccaaggttatgatcat

SEQ ID NO: 106114 - DNA, 25 bp, Mus musculus
acatctggaccatggttatgatcat

SEQ ID NO: 106115 - DNA, 25 bp, Mus musculus
acatctggacgtccagctggagagc

SEQ ID NO: 106116 - DNA, 25 bp, Mus musculus
acatctggacgtgcagctggagagc

SEQ ID NO: 106117 - DNA, 25 bp, Mus musculus
acatctggataactaaactcttcaa

SEQ ID NO: 106118 - DNA, 25 bp, Mus musculus
acatctggataagtaaactcttcaa

SEQ ID NO: 106119 - DNA, 25 bp, Mus musculus
acatctggatctcaaggctcgcact

SEQ ID NO: 106120 - DNA, 25 bp, Mus musculus
acatctggatctgaaggctcgcact

SEQ ID NO: 106121 - DNA, 25 bp, Mus musculus
acatctggcaaaaccttttcagcaa

SEQ ID NO: 106122 - DNA, 25 bp, Mus musculus
acatctggcaaatccttttcagcaa

SEQ ID NO: 106123 - DNA, 25 bp, Mus musculus
acatctggcaagatccgtcgtggca

SEQ ID NO: 106124 - DNA, 25 bp, Mus musculus
acatctggcaagttccgtcgtggca

SEQ ID NO: 106125 - DNA, 25 bp, Mus musculus
acatctggcatgactttctttgcct

SEQ ID NO: 106126 - DNA, 25 bp, Mus musculus
acatctggcatgtctttctttgcct

SEQ ID NO: 106127 - DNA, 25 bp, Mus musculus
acatctggccacaggcactcatgtg

SEQ ID NO: 106128 - DNA, 25 bp, Mus musculus
acatctggccactggcactcatgtg

SEQ ID NO: 106129 - DNA, 25 bp, Mus musculus
acatctggcccacagactatatttt

SEQ ID NO: 106130 - DNA, 25 bp, Mus musculus
acatctggcccagagactatatttt

SEQ ID NO: 106131 - DNA, 25 bp, Mus musculus
acatctggccctagtgatccatgag

SEQ ID NO: 106132 - DNA, 25 bp, Mus musculus
acatctggcccttgtgatccatgag

SEQ ID NO: 106133 - DNA, 25 bp, Mus musculus
acatctggctggacagtgttctatt

SEQ ID NO: 106134 - DNA, 25 bp, Mus musculus
acatctggctggtcagtgttctatt

SEQ ID NO: 106135 - DNA, 25 bp, Mus musculus
acatctggctgtctggactgtctga

SEQ ID NO: 106136 - DNA, 25 bp, Mus musculus
acatctggctgtgtggactgtctga

SEQ ID NO: 106137 - DNA, 25 bp, Mus musculus
acatctggcttgagttttggaatct

SEQ ID NO: 106138 - DNA, 25 bp, Mus musculus
acatctggcttgatcttcctccatt

SEQ ID NO: 106139 - DNA, 25 bp, Mus musculus
acatctggcttgtgttttggaatct

SEQ ID NO: 106140 - DNA, 25 bp, Mus musculus
acatctggcttgttcttcctccatt

SEQ ID NO: 106141 - DNA, 25 bp, Mus musculus
acatctggctttcatcacaggacag

SEQ ID NO: 106142 - DNA, 25 bp, Mus musculus
acatctggctttgatcacaggacag

SEQ ID NO: 106143 - DNA, 25 bp, Mus musculus
acatctgggacaatagaaccctggt

SEQ ID NO: 106144 - DNA, 25 bp, Mus musculus
acatctgggacaccctggagtcaga

SEQ ID NO: 106145 - DNA, 25 bp, Mus musculus
acatctgggacagcctggagtcaga

SEQ ID NO: 106146 - DNA, 25 bp, Mus musculus
acatctgggacattagaaccctggt

SEQ ID NO: 106147 - DNA, 25 bp, Mus musculus
acatctgggtctcatggccatcatg

SEQ ID NO: 106148 - DNA, 25 bp, Mus musculus
acatctgggtctgatggccatcatg

SEQ ID NO: 106149 - DNA, 25 bp, Mus musculus
acatctggtagaaagccctcgacgg

SEQ ID NO: 106150 - DNA, 25 bp, Mus musculus
acatctggtagatagccctcgacgg

SEQ ID NO: 106151 - DNA, 25 bp, Mus musculus
acatctggtatcagacctttctgta

SEQ ID NO: 106152 - DNA, 25 bp, Mus musculus
acatctggtatctgacctttctgta

SEQ ID NO: 106153 - DNA, 25 bp, Mus musculus
acatctggtgccctgactgtttctt

SEQ ID NO: 106154 - DNA, 25 bp, Mus musculus
acatctggtgccgtgactgtttctt

SEQ ID NO: 106155 - DNA, 25 bp, Mus musculus
acatctgtaaagatcgattcaccag

SEQ ID NO: 106156 - DNA, 25 bp, Mus musculus
acatctgtaaagttcgattcaccag

SEQ ID NO: 106157 - DNA, 25 bp, Mus musculus
acatctgtatggagacggttctttt

SEQ ID NO: 106158 - DNA, 25 bp, Mus musculus
acatctgtatggtgacggttctttt

SEQ ID NO: 106159 - DNA, 25 bp, Mus musculus
acatctgtattgacagtgattcttg

SEQ ID NO: 106160 - DNA, 25 bp, Mus musculus
acatctgtattgtcagtgattcttg

SEQ ID NO: 106161 - DNA, 25 bp, Mus musculus
acatctgtatttctcgaaccagacc

SEQ ID NO: 106162 - DNA, 25 bp, Mus musculus
acatctgtatttgtcgaaccagacc

SEQ ID NO: 106163 - DNA, 25 bp, Mus musculus
acatctgtcaatcggcgtgtctctt

SEQ ID NO: 106164 - DNA, 25 bp, Mus musculus
acatctgtcaatctatatgacacct

SEQ ID NO: 106165 - DNA, 25 bp, Mus musculus
acatctgtcaatgggcgtgtctctt

SEQ ID NO: 106166 - DNA, 25 bp, Mus musculus
acatctgtcaatgtatatgacacct

SEQ ID NO: 106167 - DNA, 25 bp, Mus musculus
acatctgtcaccatggtgggagcca

SEQ ID NO: 106168 - DNA, 25 bp, Mus musculus
acatctgtcaccttggtgggagcca

SEQ ID NO: 106169 - DNA, 25 bp, Mus musculus
acatctgtcagaccctatcatagtg

SEQ ID NO: 106170 - DNA, 25 bp, Mus musculus
acatctgtcagagcctatcatagtg

SEQ ID NO: 106171 - DNA, 25 bp, Mus musculus
acatctgtcagccacttcgagggaa

SEQ ID NO: 106172 - DNA, 25 bp, Mus musculus
acatctgtcagcgacttcgagggaa

SEQ ID NO: 106173 - DNA, 25 bp, Mus musculus
acatctgtcagtcttggcaacctca

SEQ ID NO: 106174 - DNA, 25 bp, Mus musculus
acatctgtcagtgttggcaacctca

SEQ ID NO: 106175 - DNA, 25 bp, Mus musculus
acatctgtccagagacttggcagtg

SEQ ID NO: 106176 - DNA, 25 bp, Mus musculus
acatctgtccagtgacttggcagtg

SEQ ID NO: 106177 - DNA, 25 bp, Mus musculus
acatctgtccccaacattatggtaa

SEQ ID NO: 106178 - DNA, 25 bp, Mus musculus
acatctgtcccctacattatggtaa

SEQ ID NO: 106179 - DNA, 25 bp, Mus musculus
acatctgtcgttagtgctcaggcta

SEQ ID NO: 106180 - DNA, 25 bp, Mus musculus
acatctgtcgtttgtgctcaggcta

SEQ ID NO: 106181 - DNA, 25 bp, Mus musculus
acatctgtctcacctactcggaagg

SEQ ID NO: 106182 - DNA, 25 bp, Mus musculus
acatctgtctcagctactcggaagg

SEQ ID NO: 106183 - DNA, 25 bp, Mus musculus
acatctgtctctcgctgtggattta

SEQ ID NO: 106184 - DNA, 25 bp, Mus musculus
acatctgtctctggctgtggattta

SEQ ID NO: 106185 - DNA, 25 bp, Mus musculus
acatctgtctgtcgcaatgagaaga

SEQ ID NO: 106186 - DNA, 25 bp, Mus musculus
acatctgtctgtggcaatgagaaga

SEQ ID NO: 106187 - DNA, 25 bp, Mus musculus
acatctgtctttatgctgtgtcaag

SEQ ID NO: 106188 - DNA, 25 bp, Mus musculus
acatctgtctttttgctgtgtcaag

SEQ ID NO: 106189 - DNA, 25 bp, Mus musculus
acatctgtgaccatagcaatagcgt

SEQ ID NO: 106190 - DNA, 25 bp, Mus musculus
acatctgtgaccttagcaatagcgt

SEQ ID NO: 106191 - DNA, 25 bp, Mus musculus
acatctgtgatgacgaggacttcta

SEQ ID NO: 106192 - DNA, 25 bp, Mus musculus
acatctgtgatgtcgaggacttcta

SEQ ID NO: 106193 - DNA, 25 bp, Mus musculus
acatctgtgcacagactttgccatt

SEQ ID NO: 106194 - DNA, 25 bp, Mus musculus
acatctgtgcactgactttgccatt

SEQ ID NO: 106195 - DNA, 25 bp, Mus musculus
acatctgtgctcactgcaaggctga

SEQ ID NO: 106196 - DNA, 25 bp, Mus musculus
acatctgtgctctctgcaaggctga

SEQ ID NO: 106197 - DNA, 25 bp, Mus musculus
acatctgtgctgatgctttgtgaaa

SEQ ID NO: 106198 - DNA, 25 bp, Mus musculus
acatctgtgctgttgctttgtgaaa

SEQ ID NO: 106199 - DNA, 25 bp, Mus musculus
acatctgtgggcaatttctaaattc

SEQ ID NO: 106200 - DNA, 25 bp, Mus musculus
acatctgtgggctatttctaaattc

SEQ ID NO: 106201 - DNA, 25 bp, Mus musculus
acatctgtggtgagttgggaagaac

SEQ ID NO: 106202 - DNA, 25 bp, Mus musculus
acatctgtggtgtgttgggaagaac

SEQ ID NO: 106203 - DNA, 25 bp, Mus musculus
acatctgtgttacttcattttgaca

SEQ ID NO: 106204 - DNA, 25 bp, Mus musculus
acatctgtgttagttcattttgaca

SEQ ID NO: 106205 - DNA, 25 bp, Mus musculus
acatctgtgttgagattccacctgt

SEQ ID NO: 106206 - DNA, 25 bp, Mus musculus
acatctgtgttgtgattccacctgt

SEQ ID NO: 106207 - DNA, 25 bp, Mus musculus
acatctgtgtttcaggtcttttttg

SEQ ID NO: 106208 - DNA, 25 bp, Mus musculus
acatctgtgtttgaggtcttttttg

SEQ ID NO: 106209 - DNA, 25 bp, Mus musculus
acatctgttaatctttttatctaaa

SEQ ID NO: 106210 - DNA, 25 bp, Mus musculus
acatctgttaatgtttttatctaaa

SEQ ID NO: 106211 - DNA, 25 bp, Mus musculus
acatctgttattactgtcgtgagaa

SEQ ID NO: 106212 - DNA, 25 bp, Mus musculus
acatctgttatttctgtcgtgagaa

SEQ ID NO: 106213 - DNA, 25 bp, Mus musculus
acatctgttcagatagtatttcttt

SEQ ID NO: 106214 - DNA, 25 bp, Mus musculus
acatctgttcagttagtatttcttt

SEQ ID NO: 106215 - DNA, 25 bp, Mus musculus
acatctgttcatagtggtttggtca

SEQ ID NO: 106216 - DNA, 25 bp, Mus musculus
acatctgttcattgtggtttggtca

SEQ ID NO: 106217 - DNA, 25 bp, Mus musculus
acatctgttcctactgcaacaacga

SEQ ID NO: 106218 - DNA, 25 bp, Mus musculus
acatctgttccttctgcaacaacga

SEQ ID NO: 106219 - DNA, 25 bp, Mus musculus
acatctgttgcaacttggtcttcta

SEQ ID NO: 106220 - DNA, 25 bp, Mus musculus
acatctgttgcacccgcttacaagc

SEQ ID NO: 106221 - DNA, 25 bp, Mus musculus
acatctgttgcagccgcttacaagc

SEQ ID NO: 106222 - DNA, 25 bp, Mus musculus
acatctgttgcatcttggtcttcta

SEQ ID NO: 106223 - DNA, 25 bp, Mus musculus
acatctgttggacacctggcatatg

SEQ ID NO: 106224 - DNA, 25 bp, Mus musculus
acatctgttggagacctggcatatg

SEQ ID NO: 106225 - DNA, 25 bp, Mus musculus
acatctgtttgacattagccgtgta

SEQ ID NO: 106226 - DNA, 25 bp, Mus musculus
acatctgtttgagattagccgtgta

SEQ ID NO: 106227 - DNA, 25 bp, Mus musculus
acatcttaaatcagtgaggaaggtt

SEQ ID NO: 106228 - DNA, 25 bp, Mus musculus
acatcttaaatctgtgaggaaggtt

SEQ ID NO: 106229 - DNA, 25 bp, Mus musculus
acatcttaaattaaatggtctcatg

SEQ ID NO: 106230 - DNA, 25 bp, Mus musculus
acatcttaaatttaatggtctcatg

SEQ ID NO: 106231 - DNA, 25 bp, Mus musculus
acatcttaagggaacagttgaccaa

SEQ ID NO: 106232 - DNA, 25 bp, Mus musculus
acatcttaagggtacagttgaccaa

SEQ ID NO: 106233 - DNA, 25 bp, Mus musculus
acatcttaagtcatggcagggccct

SEQ ID NO: 106234 - DNA, 25 bp, Mus musculus
acatcttaagtcttggcagggccct

SEQ ID NO: 106235 - DNA, 25 bp, Mus musculus
acatcttaatgtatccctccgtgtt

SEQ ID NO: 106236 - DNA, 25 bp, Mus musculus
acatcttaatgtttccctccgtgtt

SEQ ID NO: 106237 - DNA, 25 bp, Mus musculus
acatcttactggaccagccattcac

SEQ ID NO: 106238 - DNA, 25 bp, Mus musculus
acatcttactggtccagccattcac

SEQ ID NO: 106239 - DNA, 25 bp, Mus musculus
acatcttaggtgctacccagggcct

SEQ ID NO: 106240 - DNA, 25 bp, Mus musculus
acatcttaggtggtacccagggcct

SEQ ID NO: 106241 - DNA, 25 bp, Mus musculus
acatcttattatatccacaacgttg

SEQ ID NO: 106242 - DNA, 25 bp, Mus musculus
acatcttattatttccacaacgttg

SEQ ID NO: 106243 - DNA, 25 bp, Mus musculus
acatcttattctatggcctttctta

SEQ ID NO: 106244 - DNA, 25 bp, Mus musculus
acatcttattctttggcctttctta

SEQ ID NO: 106245 - DNA, 25 bp, Mus musculus
acatcttcaaatactactcgtactt

SEQ ID NO: 106246 - DNA, 25 bp, Mus musculus
acatcttcaaattctactcgtactt

SEQ ID NO: 106247 - DNA, 25 bp, Mus musculus
acatcttcaaccatagaaatggcat

SEQ ID NO: 106248 - DNA, 25 bp, Mus musculus
acatcttcaaccttagaaatggcat

SEQ ID NO: 106249 - DNA, 25 bp, Mus musculus
acatcttcagttcctatccaggtat

SEQ ID NO: 106250 - DNA, 25 bp, Mus musculus
acatcttcagttgctatccaggtat

SEQ ID NO: 106251 - DNA, 25 bp, Mus musculus
acatcttcatgtcaatctctggtct

SEQ ID NO: 106252 - DNA, 25 bp, Mus musculus
acatcttcatgtgaatctctggtct

SEQ ID NO: 106253 - DNA, 25 bp, Mus musculus
acatcttcatttacggtgatcctca

SEQ ID NO: 106254 - DNA, 25 bp, Mus musculus
acatcttcattttcggtgatcctca

SEQ ID NO: 106255 - DNA, 25 bp, Mus musculus
acatcttcccctactttacttattg

SEQ ID NO: 106256 - DNA, 25 bp, Mus musculus
acatcttccccttctttacttattg

SEQ ID NO: 106257 - DNA, 25 bp, Mus musculus
acatcttcctcaagacaatatatgt

SEQ ID NO: 106258 - DNA, 25 bp, Mus musculus
acatcttcctcatgacaatatatgt

SEQ ID NO: 106259 - DNA, 25 bp, Mus musculus
acatcttcctctctcactgaaatag

SEQ ID NO: 106260 - DNA, 25 bp, Mus musculus
acatcttcctctgtcactgaaatag

SEQ ID NO: 106261 - DNA, 25 bp, Mus musculus
acatcttccttaccacattatactt

SEQ ID NO: 106262 - DNA, 25 bp, Mus musculus
acatcttccttagcacattatactt

SEQ ID NO: 106263 - DNA, 25 bp, Mus musculus
acatcttccttgcaatgcctaattt

SEQ ID NO: 106264 - DNA, 25 bp, Mus musculus
acatcttccttggaatgcctaattt

SEQ ID NO: 106265 - DNA, 25 bp, Mus musculus
acatcttctcccagtagacaaaaag

SEQ ID NO: 106266 - DNA, 25 bp, Mus musculus
acatcttctccctgtagacaaaaag

SEQ ID NO: 106267 - DNA, 25 bp, Mus musculus
acatcttctcctacctaggatagca

SEQ ID NO: 106268 - DNA, 25 bp, Mus musculus
acatcttctccttcctaggatagca

SEQ ID NO: 106269 - DNA, 25 bp, Mus musculus
acatcttctgcccacattatgaaag

SEQ ID NO: 106270 - DNA, 25 bp, Mus musculus
acatcttctgccgacattatgaaag

SEQ ID NO: 106271 - DNA, 25 bp, Mus musculus
acatcttgaacccagactccgtgtg

SEQ ID NO: 106272 - DNA, 25 bp, Mus musculus
acatcttgaaccgagactccgtgtg

SEQ ID NO: 106273 - DNA, 25 bp, Mus musculus
acatcttgaatgaggccatctcttc

SEQ ID NO: 106274 - DNA, 25 bp, Mus musculus
acatcttgaatgtggccatctcttc

SEQ ID NO: 106275 - DNA, 25 bp, Mus musculus
acatcttgaggcagtagtaagtcac

SEQ ID NO: 106276 - DNA, 25 bp, Mus musculus
acatcttgaggctgtagtaagtcac

SEQ ID NO: 106277 - DNA, 25 bp, Mus musculus
acatcttgagggatcctccatggtt

SEQ ID NO: 106278 - DNA, 25 bp, Mus musculus
acatcttgagggttcctccatggtt

SEQ ID NO: 106279 - DNA, 25 bp, Mus musculus
acatcttgcctgacatattctagga

SEQ ID NO: 106280 - DNA, 25 bp, Mus musculus
acatcttgcctgtcatattctagga

SEQ ID NO: 106281 - DNA, 25 bp, Mus musculus
acatcttgctacaggctttagatct

SEQ ID NO: 106282 - DNA, 25 bp, Mus musculus
acatcttgctactggctttagatct

SEQ ID NO: 106283 - DNA, 25 bp, Mus musculus
acatcttggctgatcatgttctggc

SEQ ID NO: 106284 - DNA, 25 bp, Mus musculus
acatcttggctgttcatgttctggc

SEQ ID NO: 106285 - DNA, 25 bp, Mus musculus
acatcttggtccagaatcaatgtca

SEQ ID NO: 106286 - DNA, 25 bp, Mus musculus
acatcttggtcctgaatcaatgtca

SEQ ID NO: 106287 - DNA, 25 bp, Mus musculus
acatctttaaataagtgcctggcaa

SEQ ID NO: 106288 - DNA, 25 bp, Mus musculus
acatctttaaattagtgcctggcaa

SEQ ID NO: 106289 - DNA, 25 bp, Mus musculus
acatctttactactgcataggagga

SEQ ID NO: 106290 - DNA, 25 bp, Mus musculus
acatctttactagtgcataggagga

SEQ ID NO: 106291 - DNA, 25 bp, Mus musculus
acatctttatccaaagaagttccac

SEQ ID NO: 106292 - DNA, 25 bp, Mus musculus
acatctttatccaggtggaggctct

SEQ ID NO: 106293 - DNA, 25 bp, Mus musculus
acatctttatcctaagaagttccac

SEQ ID NO: 106294 - DNA, 25 bp, Mus musculus
acatctttatcctggtggaggctct

SEQ ID NO: 106295 - DNA, 25 bp, Mus musculus
acatctttatctagtgtgtaaacag

SEQ ID NO: 106296 - DNA, 25 bp, Mus musculus
acatctttatcttgtgtgtaaacag

SEQ ID NO: 106297 - DNA, 25 bp, Mus musculus
acatctttatgtccttcccaggcaa

SEQ ID NO: 106298 - DNA, 25 bp, Mus musculus
acatctttatgtgcttcccaggcaa

SEQ ID NO: 106299 - DNA, 25 bp, Mus musculus
acatctttattacaccgtacctcat

SEQ ID NO: 106300 - DNA, 25 bp, Mus musculus
acatctttattagaccgtacctcat

SEQ ID NO: 106301 - DNA, 25 bp, Mus musculus
acatctttcagcatcccagtgagag

SEQ ID NO: 106302 - DNA, 25 bp, Mus musculus
acatctttcagcttcccagtgagag

SEQ ID NO: 106303 - DNA, 25 bp, Mus musculus
acatctttccgactgaccttattct

SEQ ID NO: 106304 - DNA, 25 bp, Mus musculus
acatctttccgagtgaccttattct

SEQ ID NO: 106305 - DNA, 25 bp, Mus musculus
acatctttcctcctattgtggttct

SEQ ID NO: 106306 - DNA, 25 bp, Mus musculus
acatctttcctcgtattgtggttct

SEQ ID NO: 106307 - DNA, 25 bp, Mus musculus
acatctttccttagaagttcagcta

SEQ ID NO: 106308 - DNA, 25 bp, Mus musculus
acatctttcctttgaagttcagcta

SEQ ID NO: 106309 - DNA, 25 bp, Mus musculus
acatctttctgaatcttggtcaatt

SEQ ID NO: 106310 - DNA, 25 bp, Mus musculus
acatctttctgattcttggtcaatt

SEQ ID NO: 106311 - DNA, 25 bp, Mus musculus
acatctttctgtcacaacagggagt

SEQ ID NO: 106312 - DNA, 25 bp, Mus musculus
acatctttctgtgacaacagggagt

SEQ ID NO: 106313 - DNA, 25 bp, Mus musculus
acatctttcttaacgtctttgtcct

SEQ ID NO: 106314 - DNA, 25 bp, Mus musculus
acatctttcttatcgtctttgtcct

SEQ ID NO: 106315 - DNA, 25 bp, Mus musculus
acatctttgattcggctctggttga

SEQ ID NO: 106316 - DNA, 25 bp, Mus musculus
acatctttgattgggctctggttga

SEQ ID NO: 106317 - DNA, 25 bp, Mus musculus
acatctttgctaacttttagtcctg

SEQ ID NO: 106318 - DNA, 25 bp, Mus musculus
acatctttgctatcttttagtcctg

SEQ ID NO: 106319 - DNA, 25 bp, Mus musculus
acatctttgtggacttggttctcat

SEQ ID NO: 106320 - DNA, 25 bp, Mus musculus
acatctttgtggtcttggttctcat

SEQ ID NO: 106321 - DNA, 25 bp, Mus musculus
acatctttgtgtatatgggcagcag

SEQ ID NO: 106322 - DNA, 25 bp, Mus musculus
acatctttgtgtttatgggcagcag

SEQ ID NO: 106323 - DNA, 25 bp, Mus musculus
acatcttttaagattcagctgcatt

SEQ ID NO: 106324 - DNA, 25 bp, Mus musculus
acatcttttaagtttcagctgcatt

SEQ ID NO: 106325 - DNA, 25 bp, Mus musculus
acatcttttctcatctgtaagacca

SEQ ID NO: 106326 - DNA, 25 bp, Mus musculus
acatcttttctcttctgtaagacca

SEQ ID NO: 106327 - DNA, 25 bp, Mus musculus
acatgaaaactgactttgttgtatg

SEQ ID NO: 106328 - DNA, 25 bp, Mus musculus
acatgaaaactgtctttgttgtatg

SEQ ID NO: 106329 - DNA, 25 bp, Mus musculus
acatgaaaaggtagatgcagcagtc

SEQ ID NO: 106330 - DNA, 25 bp, Mus musculus
acatgaaaaggttgatgcagcagtc

SEQ ID NO: 106331 - DNA, 25 bp, Mus musculus
acatgaaaattaaccagcagagaca

SEQ ID NO: 106332 - DNA, 25 bp, Mus musculus
acatgaaaattatccagcagagaca

SEQ ID NO: 106333 - DNA, 25 bp, Mus musculus
acatgaaactatcgagaccccgtct

SEQ ID NO: 106334 - DNA, 25 bp, Mus musculus
acatgaaactatggagaccccgtct

SEQ ID NO: 106335 - DNA, 25 bp, Mus musculus
acatgaaagttcacaacagtctgta

SEQ ID NO: 106336 - DNA, 25 bp, Mus musculus
acatgaaagttctcaacagtctgta

SEQ ID NO: 106337 - DNA, 25 bp, Mus musculus
acatgaacaatgctgaccgccaaga

SEQ ID NO: 106338 - DNA, 25 bp, Mus musculus
acatgaacaatggtgaccgccaaga

SEQ ID NO: 106339 - DNA, 25 bp, Mus musculus
acatgaacctcgaattttgactaat

SEQ ID NO: 106340 - DNA, 25 bp, Mus musculus
acatgaacctcgtattttgactaat

SEQ ID NO: 106341 - DNA, 25 bp, Mus musculus
acatgaaccttgcacagctctgctc

SEQ ID NO: 106342 - DNA, 25 bp, Mus musculus
acatgaaccttggacagctctgctc

SEQ ID NO: 106343 - DNA, 25 bp, Mus musculus
acatgaacgtccaccgtggtgtcaa

SEQ ID NO: 106344 - DNA, 25 bp, Mus musculus
acatgaacgtcctccgtggtgtcaa

SEQ ID NO: 106345 - DNA, 25 bp, Mus musculus
acatgaactaggaagccgggctctg

SEQ ID NO: 106346 - DNA, 25 bp, Mus musculus
acatgaactaggtagccgggctctg

SEQ ID NO: 106347 - DNA, 25 bp, Mus musculus
acatgaactcttctggaaaactcca

SEQ ID NO: 106348 - DNA, 25 bp, Mus musculus
acatgaactcttgtggaaaactcca

SEQ ID NO: 106349 - DNA, 25 bp, Mus musculus
acatgaactgtcagatgtccaacat

SEQ ID NO: 106350 - DNA, 25 bp, Mus musculus
acatgaactgtctgatgtccaacat

SEQ ID NO: 106351 - DNA, 25 bp, Mus musculus
acatgaacttttcttgctcccataa

SEQ ID NO: 106352 - DNA, 25 bp, Mus musculus
acatgaacttttgttgctcccataa

SEQ ID NO: 106353 - DNA, 25 bp, Mus musculus
acatgaagaagcagagcgactcggt

SEQ ID NO: 106354 - DNA, 25 bp, Mus musculus
acatgaagaagctgagcgactcggt

SEQ ID NO: 106355 - DNA, 25 bp, Mus musculus
acatgaagacctactgttcttggga

SEQ ID NO: 106356 - DNA, 25 bp, Mus musculus
acatgaagaccttctgttcttggga

SEQ ID NO: 106357 - DNA, 25 bp, Mus musculus
acatgaagacgcacgggcagatcgg

SEQ ID NO: 106358 - DNA, 25 bp, Mus musculus
acatgaagacgctcgggcagatcgg

SEQ ID NO: 106359 - DNA, 25 bp, Mus musculus
acatgaagactcacgccccggaaag

SEQ ID NO: 106360 - DNA, 25 bp, Mus musculus
acatgaagactctcgccccggaaag

SEQ ID NO: 106361 - DNA, 25 bp, Mus musculus
acatgaagattcactgcaagtcccc

SEQ ID NO: 106362 - DNA, 25 bp, Mus musculus
acatgaagattctctgcaagtcccc

SEQ ID NO: 106363 - DNA, 25 bp, Mus musculus
acatgaagccttctacagctcagct

SEQ ID NO: 106364 - DNA, 25 bp, Mus musculus
acatgaagccttgtacagctcagct

SEQ ID NO: 106365 - DNA, 25 bp, Mus musculus
acatgaagtcacagggcattcctgc

SEQ ID NO: 106366 - DNA, 25 bp, Mus musculus
acatgaagtcactgggcattcctgc

SEQ ID NO: 106367 - DNA, 25 bp, Mus musculus
acatgaagtgttattcgacaggcga

SEQ ID NO: 106368 - DNA, 25 bp, Mus musculus
acatgaagtgtttttcgacaggcga

SEQ ID NO: 106369 - DNA, 25 bp, Mus musculus
acatgaagttgcagcttgctgaaga

SEQ ID NO: 106370 - DNA, 25 bp, Mus musculus
acatgaagttgctgcttgctgaaga

SEQ ID NO: 106371 - DNA, 25 bp, Mus musculus
acatgaagtttgcaagtctccaccc

SEQ ID NO: 106372 - DNA, 25 bp, Mus musculus
acatgaagtttggaagtctccaccc

SEQ ID NO: 106373 - DNA, 25 bp, Mus musculus
acatgaataagaaggtggcgcaccc

SEQ ID NO: 106374 - DNA, 25 bp, Mus musculus
acatgaataagatggtggcgcaccc

SEQ ID NO: 106375 - DNA, 25 bp, Mus musculus
acatgaataatacgtgtcctgtatt

SEQ ID NO: 106376 - DNA, 25 bp, Mus musculus
acatgaataataggtgtcctgtatt

SEQ ID NO: 106377 - DNA, 25 bp, Mus musculus
acatgaatactgcactgttccttga

SEQ ID NO: 106378 - DNA, 25 bp, Mus musculus
acatgaatactggactgttccttga

SEQ ID NO: 106379 - DNA, 25 bp, Mus musculus
acatgaatatttagcctgtttgatt

SEQ ID NO: 106380 - DNA, 25 bp, Mus musculus
acatgaatattttgcctgtttgatt

SEQ ID NO: 106381 - DNA, 25 bp, Mus musculus
acatgaatctggaccgtagggccac

SEQ ID NO: 106382 - DNA, 25 bp, Mus musculus
acatgaatctggtccgtagggccac

SEQ ID NO: 106383 - DNA, 25 bp, Mus musculus
acatgaatgacacccttcgcacaga

SEQ ID NO: 106384 - DNA, 25 bp, Mus musculus
acatgaatgacagccttcgcacaga

SEQ ID NO: 106385 - DNA, 25 bp, Mus musculus
acatgaatgattagatccattcccc

SEQ ID NO: 106386 - DNA, 25 bp, Mus musculus
acatgaatgatttgatccattcccc

SEQ ID NO: 106387 - DNA, 25 bp, Mus musculus
acatgaatgcatagttactctttaa

SEQ ID NO: 106388 - DNA, 25 bp, Mus musculus
acatgaatgcattgttactctttaa

SEQ ID NO: 106389 - DNA, 25 bp, Mus musculus
acatgaattatgctagctggcaaca

SEQ ID NO: 106390 - DNA, 25 bp, Mus musculus
acatgaattatggtagctggcaaca

SEQ ID NO: 106391 - DNA, 25 bp, Mus musculus
acatgaattcaactgggaagttatc

SEQ ID NO: 106392 - DNA, 25 bp, Mus musculus
acatgaattcaagtgggaagttatc

SEQ ID NO: 106393 - DNA, 25 bp, Mus musculus
acatgaattctgcttgtaactgtta

SEQ ID NO: 106394 - DNA, 25 bp, Mus musculus
acatgaattctggttgtaactgtta

SEQ ID NO: 106395 - DNA, 25 bp, Mus musculus
acatgaattgctcctctgttatata

SEQ ID NO: 106396 - DNA, 25 bp, Mus musculus
acatgaattgctgctctgttatata

SEQ ID NO: 106397 - DNA, 25 bp, Mus musculus
acatgaattgtcagccattgtgtgg

SEQ ID NO: 106398 - DNA, 25 bp, Mus musculus
acatgaattgtctgccattgtgtgg

SEQ ID NO: 106399 - DNA, 25 bp, Mus musculus
acatgacaacggctaggatccccat

SEQ ID NO: 106400 - DNA, 25 bp, Mus musculus
acatgacaacgggtaggatccccat

SEQ ID NO: 106401 - DNA, 25 bp, Mus musculus
acatgacacgtgacatcactttggg

SEQ ID NO: 106402 - DNA, 25 bp, Mus musculus
acatgacacgtgtcatcactttggg

SEQ ID NO: 106403 - DNA, 25 bp, Mus musculus
acatgacataagacactgcttctaa

SEQ ID NO: 106404 - DNA, 25 bp, Mus musculus
acatgacataagtcactgcttctaa

SEQ ID NO: 106405 - DNA, 25 bp, Mus musculus
acatgacatacaattgagccccagg

SEQ ID NO: 106406 - DNA, 25 bp, Mus musculus
acatgacatacatttgagccccagg

SEQ ID NO: 106407 - DNA, 25 bp, Mus musculus
acatgacatccacggcagccggcta

SEQ ID NO: 106408 - DNA, 25 bp, Mus musculus
acatgacatccagggcagccggcta

SEQ ID NO: 106409 - DNA, 25 bp, Mus musculus
acatgacatgtcctggactccatat

SEQ ID NO: 106410 - DNA, 25 bp, Mus musculus
acatgacatgtcgtggactccatat

SEQ ID NO: 106411 - DNA, 25 bp, Mus musculus
acatgacatgttaacttggactaaa

SEQ ID NO: 106412 - DNA, 25 bp, Mus musculus
acatgacatgtttacttggactaaa

SEQ ID NO: 106413 - DNA, 25 bp, Mus musculus
acatgaccaaacaaggaacctggag

SEQ ID NO: 106414 - DNA, 25 bp, Mus musculus
acatgaccaaactaggaacctggag

SEQ ID NO: 106415 - DNA, 25 bp, Mus musculus
acatgaccagtgcttattatggttc

SEQ ID NO: 106416 - DNA, 25 bp, Mus musculus
acatgaccagtggttattatggttc

SEQ ID NO: 106417 - DNA, 25 bp, Mus musculus
acatgacccaacctgttaaaaatca

SEQ ID NO: 106418 - DNA, 25 bp, Mus musculus
acatgacccaacgtgttaaaaatca

SEQ ID NO: 106419 - DNA, 25 bp, Mus musculus
acatgacccaccacgagctgaagag

SEQ ID NO: 106420 - DNA, 25 bp, Mus musculus
acatgacccacctcgagctgaagag

SEQ ID NO: 106421 - DNA, 25 bp, Mus musculus
acatgacccgtgcttatctgcactg

SEQ ID NO: 106422 - DNA, 25 bp, Mus musculus
acatgacccgtggttatctgcactg

SEQ ID NO: 106423 - DNA, 25 bp, Mus musculus
acatgaccgctcaggagtagttcct

SEQ ID NO: 106424 - DNA, 25 bp, Mus musculus
acatgaccgctctggagtagttcct

SEQ ID NO: 106425 - DNA, 25 bp, Mus musculus
acatgacctcggagaaaacagtcct

SEQ ID NO: 106426 - DNA, 25 bp, Mus musculus
acatgacctcggtgaaaacagtcct

SEQ ID NO: 106427 - DNA, 25 bp, Mus musculus
acatgacggtggctactctgaagat

SEQ ID NO: 106428 - DNA, 25 bp, Mus musculus
acatgacggtgggtactctgaagat

SEQ ID NO: 106429 - DNA, 25 bp, Mus musculus
acatgactaaccactgttaatggcc

SEQ ID NO: 106430 - DNA, 25 bp, Mus musculus
acatgactaacctctgttaatggcc

SEQ ID NO: 106431 - DNA, 25 bp, Mus musculus
acatgactagaccaggttttctttc

SEQ ID NO: 106432 - DNA, 25 bp, Mus musculus
acatgactagacgaggttttctttc

SEQ ID NO: 106433 - DNA, 25 bp, Mus musculus
acatgactatgtatgctgcatttta

SEQ ID NO: 106434 - DNA, 25 bp, Mus musculus
acatgactatgtttgctgcatttta

SEQ ID NO: 106435 - DNA, 25 bp, Mus musculus
acatgactcaacacccaagtggtgt

SEQ ID NO: 106436 - DNA, 25 bp, Mus musculus
acatgactcaactcccaagtggtgt

SEQ ID NO: 106437 - DNA, 25 bp, Mus musculus
acatgactcagcagtttgtccgggt

SEQ ID NO: 106438 - DNA, 25 bp, Mus musculus
acatgactcagctgtttgtccgggt

SEQ ID NO: 106439 - DNA, 25 bp, Mus musculus
acatgactcaggactcctaacacat

SEQ ID NO: 106440 - DNA, 25 bp, Mus musculus
acatgactcaggtctcctaacacat

SEQ ID NO: 106441 - DNA, 25 bp, Mus musculus
acatgactctggaaggcgacgacct

SEQ ID NO: 106442 - DNA, 25 bp, Mus musculus
acatgactctggtaggcgacgacct

SEQ ID NO: 106443 - DNA, 25 bp, Mus musculus
acatgactgtagcttctacctcttg

SEQ ID NO: 106444 - DNA, 25 bp, Mus musculus
acatgactgtaggttctacctcttg

SEQ ID NO: 106445 - DNA, 25 bp, Mus musculus
acatgactgtatcgttcctgtcaaa

SEQ ID NO: 106446 - DNA, 25 bp, Mus musculus
acatgactgtatggttcctgtcaaa

SEQ ID NO: 106447 - DNA, 25 bp, Mus musculus
acatgacttcctagaatctgctcct

SEQ ID NO: 106448 - DNA, 25 bp, Mus musculus
acatgacttccttgaatctgctcct

SEQ ID NO: 106449 - DNA, 25 bp, Mus musculus
acatgacttcttcattttacaaata

SEQ ID NO: 106450 - DNA, 25 bp, Mus musculus
acatgacttcttgattttacaaata

SEQ ID NO: 106451 - DNA, 25 bp, Mus musculus
acatgacttgaacctctagttttct

SEQ ID NO: 106452 - DNA, 25 bp, Mus musculus
acatgacttgaagctctagttttct

SEQ ID NO: 106453 - DNA, 25 bp, Mus musculus
acatgacttggcactgtgctgttat

SEQ ID NO: 106454 - DNA, 25 bp, Mus musculus
acatgacttggctctgtgctgttat

SEQ ID NO: 106455 - DNA, 25 bp, Mus musculus
acatgagaccttatctgctattcag

SEQ ID NO: 106456 - DNA, 25 bp, Mus musculus
acatgagaccttttctgctattcag

SEQ ID NO: 106457 - DNA, 25 bp, Mus musculus
acatgagcatggctcaccccaggag

SEQ ID NO: 106458 - DNA, 25 bp, Mus musculus
acatgagcatgggtcaccccaggag

SEQ ID NO: 106459 - DNA, 25 bp, Mus musculus
acatgagccagaaagacagagtagg

SEQ ID NO: 106460 - DNA, 25 bp, Mus musculus
acatgagccagatagacagagtagg

SEQ ID NO: 106461 - DNA, 25 bp, Mus musculus
acatgagcctccatcggaaccgcat

SEQ ID NO: 106462 - DNA, 25 bp, Mus musculus
acatgagcctccttcggaaccgcat

SEQ ID NO: 106463 - DNA, 25 bp, Mus musculus
acatgagcgcgtcgccttcgggcta

SEQ ID NO: 106464 - DNA, 25 bp, Mus musculus
acatgagcgcgtggccttcgggcta

SEQ ID NO: 106465 - DNA, 25 bp, Mus musculus
acatgagcggcgacgcaagtaccac

SEQ ID NO: 106466 - DNA, 25 bp, Mus musculus
acatgagcggcgtcgcaagtaccac

SEQ ID NO: 106467 - DNA, 25 bp, Mus musculus
acatgagctgtaagttaaggaaccc

SEQ ID NO: 106468 - DNA, 25 bp, Mus musculus
acatgagctgtatgttaaggaaccc

SEQ ID NO: 106469 - DNA, 25 bp, Mus musculus
acatgagctttgctgttttcctggt

SEQ ID NO: 106470 - DNA, 25 bp, Mus musculus
acatgagctttggtgttttcctggt

SEQ ID NO: 106471 - DNA, 25 bp, Mus musculus
acatgaggaagcagctcgaccgcct

SEQ ID NO: 106472 - DNA, 25 bp, Mus musculus
acatgaggaagctgctcgaccgcct

SEQ ID NO: 106473 - DNA, 25 bp, Mus musculus
acatgaggaccacagtgtggactgc

SEQ ID NO: 106474 - DNA, 25 bp, Mus musculus
acatgaggaccagagtgtggactgc

SEQ ID NO: 106475 - DNA, 25 bp, Mus musculus
acatgaggagtgcaagccgccctga

SEQ ID NO: 106476 - DNA, 25 bp, Mus musculus
acatgaggagtggaagccgccctga

SEQ ID NO: 106477 - DNA, 25 bp, Mus musculus
acatgagggtacctgccatcatctc

SEQ ID NO: 106478 - DNA, 25 bp, Mus musculus
acatgagggtacgtgccatcatctc

SEQ ID NO: 106479 - DNA, 25 bp, Mus musculus
acatgaggtgttacccttctctctg

SEQ ID NO: 106480 - DNA, 25 bp, Mus musculus
acatgaggtgtttcccttctctctg

SEQ ID NO: 106481 - DNA, 25 bp, Mus musculus
acatgagtaccaaccgccgacagtt

SEQ ID NO: 106482 - DNA, 25 bp, Mus musculus
acatgagtaccatccgccgacagtt

SEQ ID NO: 106483 - DNA, 25 bp, Mus musculus
acatgagtccctccttagccaaaat

SEQ ID NO: 106484 - DNA, 25 bp, Mus musculus
acatgagtccctgcttagccaaaat

SEQ ID NO: 106485 - DNA, 25 bp, Mus musculus
acatgagtgcctctggccagatgtc

SEQ ID NO: 106486 - DNA, 25 bp, Mus musculus
acatgagtgcctgtggccagatgtc

SEQ ID NO: 106487 - DNA, 25 bp, Mus musculus
acatgagtgcgtccattggactttt

SEQ ID NO: 106488 - DNA, 25 bp, Mus musculus
acatgagtgcgtgcattggactttt

SEQ ID NO: 106489 - DNA, 25 bp, Mus musculus
acatgagtgctgagggtctgaattt

SEQ ID NO: 106490 - DNA, 25 bp, Mus musculus
acatgagtgctgtgggtctgaattt

SEQ ID NO: 106491 - DNA, 25 bp, Mus musculus
acatgagtggcaagagctgggtact

SEQ ID NO: 106492 - DNA, 25 bp, Mus musculus
acatgagtggcatgagctgggtact

SEQ ID NO: 106493 - DNA, 25 bp, Mus musculus
acatgagttaccagtggaccaacct

SEQ ID NO: 106494 - DNA, 25 bp, Mus musculus
acatgagttacctgtggaccaacct

SEQ ID NO: 106495 - DNA, 25 bp, Mus musculus
acatgagtttgcaggtggagaagat

SEQ ID NO: 106496 - DNA, 25 bp, Mus musculus
acatgagtttgctggtggagaagat

SEQ ID NO: 106497 - DNA, 25 bp, Mus musculus
acatgatacttaccaccgagggaca

SEQ ID NO: 106498 - DNA, 25 bp, Mus musculus
acatgatacttagcaccgagggaca

SEQ ID NO: 106499 - DNA, 25 bp, Mus musculus
acatgatattgtcacttggacctca

SEQ ID NO: 106500 - DNA, 25 bp, Mus musculus
acatgatattgtgacttggacctca

SEQ ID NO: 106501 - DNA, 25 bp, Mus musculus
acatgatcaacaaggcagccctgcc

SEQ ID NO: 106502 - DNA, 25 bp, Mus musculus
acatgatcaacatggcagccctgcc

SEQ ID NO: 106503 - DNA, 25 bp, Mus musculus
acatgatcaataccaccactcttat

SEQ ID NO: 106504 - DNA, 25 bp, Mus musculus
acatgatcaatagcaccactcttat

SEQ ID NO: 106505 - DNA, 25 bp, Mus musculus
acatgatcagggacttagggacgat

SEQ ID NO: 106506 - DNA, 25 bp, Mus musculus
acatgatcagggtcttagggacgat

SEQ ID NO: 106507 - DNA, 25 bp, Mus musculus
acatgatccgggaggtgtgcggctt

SEQ ID NO: 106508 - DNA, 25 bp, Mus musculus
acatgatccgggtggtgtgcggctt

SEQ ID NO: 106509 - DNA, 25 bp, Mus musculus
acatgatcctagaggaccattccct

SEQ ID NO: 106510 - DNA, 25 bp, Mus musculus
acatgatcctagtggaccattccct

SEQ ID NO: 106511 - DNA, 25 bp, Mus musculus
acatgatcctggctgtgggcctcaa

SEQ ID NO: 106512 - DNA, 25 bp, Mus musculus
acatgatcctgggtgtgggcctcaa

SEQ ID NO: 106513 - DNA, 25 bp, Mus musculus
acatgatcctgtacatttcctataa

SEQ ID NO: 106514 - DNA, 25 bp, Mus musculus
acatgatcctgttcatttcctataa

SEQ ID NO: 106515 - DNA, 25 bp, Mus musculus
acatgatctagtcgcttctgctaat

SEQ ID NO: 106516 - DNA, 25 bp, Mus musculus
acatgatctagtggcttctgctaat

SEQ ID NO: 106517 - DNA, 25 bp, Mus musculus
acatgatgacgtcctacctgttcca

SEQ ID NO: 106518 - DNA, 25 bp, Mus musculus
acatgatgacgtgctacctgttcca

SEQ ID NO: 106519 - DNA, 25 bp, Mus musculus
acatgatgagccctagcctatggtt

SEQ ID NO: 106520 - DNA, 25 bp, Mus musculus
acatgatgagccgtagcctatggtt

SEQ ID NO: 106521 - DNA, 25 bp, Mus musculus
acatgatgcaatcgcttgttcttcc

SEQ ID NO: 106522 - DNA, 25 bp, Mus musculus
acatgatgcaatggcttgttcttcc

SEQ ID NO: 106523 - DNA, 25 bp, Mus musculus
acatgatgcccacccgtgagagctt

SEQ ID NO: 106524 - DNA, 25 bp, Mus musculus
acatgatgcccagccgtgagagctt

SEQ ID NO: 106525 - DNA, 25 bp, Mus musculus
acatgatgctgaccgccctacactg

SEQ ID NO: 106526 - DNA, 25 bp, Mus musculus
acatgatgctgagcgccctacactg

SEQ ID NO: 106527 - DNA, 25 bp, Mus musculus
acatgatggaagcaaactggctttc

SEQ ID NO: 106528 - DNA, 25 bp, Mus musculus
acatgatggaaggaaactggctttc

SEQ ID NO: 106529 - DNA, 25 bp, Mus musculus
acatgatggaatccccttgtctaca

SEQ ID NO: 106530 - DNA, 25 bp, Mus musculus
acatgatggaatgcccttgtctaca

SEQ ID NO: 106531 - DNA, 25 bp, Mus musculus
acatgatgtcacagccagaccaggc

SEQ ID NO: 106532 - DNA, 25 bp, Mus musculus
acatgatgtcactgccagaccaggc

SEQ ID NO: 106533 - DNA, 25 bp, Mus musculus
acatgatgtggtctgattccagata

SEQ ID NO: 106534 - DNA, 25 bp, Mus musculus
acatgatgtggtgtgattccagata

SEQ ID NO: 106535 - DNA, 25 bp, Mus musculus
acatgattaagcaggctcttcccca

SEQ ID NO: 106536 - DNA, 25 bp, Mus musculus
acatgattaagctggctcttcccca

SEQ ID NO: 106537 - DNA, 25 bp, Mus musculus
acatgattatacacacacccacagg

SEQ ID NO: 106538 - DNA, 25 bp, Mus musculus
acatgattatactcacacccacagg

SEQ ID NO: 106539 - DNA, 25 bp, Mus musculus
acatgattatcacctgctctacgaa

SEQ ID NO: 106540 - DNA, 25 bp, Mus musculus
acatgattatcagctgctctacgaa

SEQ ID NO: 106541 - DNA, 25 bp, Mus musculus
acatgattatgaatagtgtggatct

SEQ ID NO: 106542 - DNA, 25 bp, Mus musculus
acatgattatgactggagggttcca

SEQ ID NO: 106543 - DNA, 25 bp, Mus musculus
acatgattatgagtggagggttcca

SEQ ID NO: 106544 - DNA, 25 bp, Mus musculus
acatgattatgattagtgtggatct

SEQ ID NO: 106545 - DNA, 25 bp, Mus musculus
acatgattcgttaccacatctgaag

SEQ ID NO: 106546 - DNA, 25 bp, Mus musculus
acatgattcgtttccacatctgaag

SEQ ID NO: 106547 - DNA, 25 bp, Mus musculus
acatgattgtcaatggtgggctcaa

SEQ ID NO: 106548 - DNA, 25 bp, Mus musculus
acatgattgtcattggtgggctcaa

SEQ ID NO: 106549 - DNA, 25 bp, Mus musculus
acatgattgtgcactcgcctgtgaa

SEQ ID NO: 106550 - DNA, 25 bp, Mus musculus
acatgattgtgctctcgcctgtgaa

SEQ ID NO: 106551 - DNA, 25 bp, Mus musculus
acatgatttaacaggcactgttgac

SEQ ID NO: 106552 - DNA, 25 bp, Mus musculus
acatgatttaactggcactgttgac

SEQ ID NO: 106553 - DNA, 25 bp, Mus musculus
acatgatttatcaaacccttgagga

SEQ ID NO: 106554 - DNA, 25 bp, Mus musculus
acatgatttatctaacccttgagga

SEQ ID NO: 106555 - DNA, 25 bp, Mus musculus
acatgatttcataacctccacaggc

SEQ ID NO: 106556 - DNA, 25 bp, Mus musculus
acatgatttcattacctccacaggc

SEQ ID NO: 106557 - DNA, 25 bp, Mus musculus
acatgatttctaacctgtggacaaa

SEQ ID NO: 106558 - DNA, 25 bp, Mus musculus
acatgatttctatcctgtggacaaa

SEQ ID NO: 106559 - DNA, 25 bp, Mus musculus
acatgatttctgaatgacatcttgt

SEQ ID NO: 106560 - DNA, 25 bp, Mus musculus
acatgatttctgtatgacatcttgt

SEQ ID NO: 106561 - DNA, 25 bp, Mus musculus
acatgatttgcccagagcttcccag

SEQ ID NO: 106562 - DNA, 25 bp, Mus musculus
acatgatttgccgagagcttcccag

SEQ ID NO: 106563 - DNA, 25 bp, Mus musculus
acatgattttaaagctccagagctg

SEQ ID NO: 106564 - DNA, 25 bp, Mus musculus
acatgattttaatgctccagagctg

SEQ ID NO: 106565 - DNA, 25 bp, Mus musculus
acatgattttcacatctacctaggg

SEQ ID NO: 106566 - DNA, 25 bp, Mus musculus
acatgattttcagatctacctaggg

SEQ ID NO: 106567 - DNA, 25 bp, Mus musculus
acatgcaaaaggcactgacttcttg

SEQ ID NO: 106568 - DNA, 25 bp, Mus musculus
acatgcaaaagggactgacttcttg

SEQ ID NO: 106569 - DNA, 25 bp, Mus musculus
acatgcaaacagacatacggacagc

SEQ ID NO: 106570 - DNA, 25 bp, Mus musculus
acatgcaaacagtcatacggacagc

SEQ ID NO: 106571 - DNA, 25 bp, Mus musculus
acatgcaaagaccatacagcaccaa

SEQ ID NO: 106572 - DNA, 25 bp, Mus musculus
acatgcaaagacgatacagcaccaa

SEQ ID NO: 106573 - DNA, 25 bp, Mus musculus
acatgcaaatacctgttctacattt

SEQ ID NO: 106574 - DNA, 25 bp, Mus musculus
acatgcaaatacgtgttctacattt

SEQ ID NO: 106575 - DNA, 25 bp, Mus musculus
acatgcaagaggacaagtacagcac

SEQ ID NO: 106576 - DNA, 25 bp, Mus musculus
acatgcaagaggtcaagtacagcac

SEQ ID NO: 106577 - DNA, 25 bp, Mus musculus
acatgcaaggacaagggacccggaa

SEQ ID NO: 106578 - DNA, 25 bp, Mus musculus
acatgcaaggactagggacccggaa

SEQ ID NO: 106579 - DNA, 25 bp, Mus musculus
acatgcaataagacgcgtagtttca

SEQ ID NO: 106580 - DNA, 25 bp, Mus musculus
acatgcaataagtcgcgtagtttca

SEQ ID NO: 106581 - DNA, 25 bp, Mus musculus
acatgcacacagcagcacactccct

SEQ ID NO: 106582 - DNA, 25 bp, Mus musculus
acatgcacacaggagcacactccct

SEQ ID NO: 106583 - DNA, 25 bp, Mus musculus
acatgcacacatcggacttcggaaa

SEQ ID NO: 106584 - DNA, 25 bp, Mus musculus
acatgcacacatgggacttcggaaa

SEQ ID NO: 106585 - DNA, 25 bp, Mus musculus
acatgcacacccatatacaacacag

SEQ ID NO: 106586 - DNA, 25 bp, Mus musculus
acatgcacacccttatacaacacag

SEQ ID NO: 106587 - DNA, 25 bp, Mus musculus
acatgcacactaatttattggtact

SEQ ID NO: 106588 - DNA, 25 bp, Mus musculus
acatgcacactattttattggtact

SEQ ID NO: 106589 - DNA, 25 bp, Mus musculus
acatgcaccgtgcagttctgcaaga

SEQ ID NO: 106590 - DNA, 25 bp, Mus musculus
acatgcaccgtggagttctgcaaga

SEQ ID NO: 106591 - DNA, 25 bp, Mus musculus
acatgcacctcgagagacctgggat

SEQ ID NO: 106592 - DNA, 25 bp, Mus musculus
acatgcacctcgtgagacctgggat

SEQ ID NO: 106593 - DNA, 25 bp, Mus musculus
acatgcactaccacatttaatccag

SEQ ID NO: 106594 - DNA, 25 bp, Mus musculus
acatgcactacctcatttaatccag

SEQ ID NO: 106595 - DNA, 25 bp, Mus musculus
acatgcactcgacgttgtgttctta

SEQ ID NO: 106596 - DNA, 25 bp, Mus musculus
acatgcactcgaggttgtgttctta

SEQ ID NO: 106597 - DNA, 25 bp, Mus musculus
acatgcactgacatcatcaatctat

SEQ ID NO: 106598 - DNA, 25 bp, Mus musculus
acatgcactgacttcatcaatctat

SEQ ID NO: 106599 - DNA, 25 bp, Mus musculus
acatgcactgccaaagttccaggat

SEQ ID NO: 106600 - DNA, 25 bp, Mus musculus
acatgcactgcctaagttccaggat

SEQ ID NO: 106601 - DNA, 25 bp, Mus musculus
acatgcagacagacattactagatg

SEQ ID NO: 106602 - DNA, 25 bp, Mus musculus
acatgcagacagtcattactagatg

SEQ ID NO: 106603 - DNA, 25 bp, Mus musculus
acatgcagcccactttagtcactgg

SEQ ID NO: 106604 - DNA, 25 bp, Mus musculus
acatgcagcccagtttagtcactgg

SEQ ID NO: 106605 - DNA, 25 bp, Mus musculus
acatgcagcctgagcatgcgccagg

SEQ ID NO: 106606 - DNA, 25 bp, Mus musculus
acatgcagcctgtgcatgcgccagg

SEQ ID NO: 106607 - DNA, 25 bp, Mus musculus
acatgcagcggtaataagccagatt

SEQ ID NO: 106608 - DNA, 25 bp, Mus musculus
acatgcagcggttataagccagatt

SEQ ID NO: 106609 - DNA, 25 bp, Mus musculus
acatgcaggattataggtggtctca

SEQ ID NO: 106610 - DNA, 25 bp, Mus musculus
acatgcaggattttaggtggtctca

SEQ ID NO: 106611 - DNA, 25 bp, Mus musculus
acatgcagggttactgagcttctcc

SEQ ID NO: 106612 - DNA, 25 bp, Mus musculus
acatgcagggtttctgagcttctcc

SEQ ID NO: 106613 - DNA, 25 bp, Mus musculus
acatgcagtcagagagttccccata

SEQ ID NO: 106614 - DNA, 25 bp, Mus musculus
acatgcagtcagtgagttccccata

SEQ ID NO: 106615 - DNA, 25 bp, Mus musculus
acatgcagtctcaccattgattggt

SEQ ID NO: 106616 - DNA, 25 bp, Mus musculus
acatgcagtctctccattgattggt

SEQ ID NO: 106617 - DNA, 25 bp, Mus musculus
acatgcagtcttacacttcgcggcc

SEQ ID NO: 106618 - DNA, 25 bp, Mus musculus
acatgcagtctttcacttcgcggcc

SEQ ID NO: 106619 - DNA, 25 bp, Mus musculus
acatgcagtggcacacagcgcccat

SEQ ID NO: 106620 - DNA, 25 bp, Mus musculus
acatgcagtggctcacagcgcccat

SEQ ID NO: 106621 - DNA, 25 bp, Mus musculus
acatgcagtggtaaatagcctctag

SEQ ID NO: 106622 - DNA, 25 bp, Mus musculus
acatgcagtggttaatagcctctag

SEQ ID NO: 106623 - DNA, 25 bp, Mus musculus
acatgcagttgtcggcgtttctttg

SEQ ID NO: 106624 - DNA, 25 bp, Mus musculus
acatgcagttgtgggcgtttctttg

SEQ ID NO: 106625 - DNA, 25 bp, Mus musculus
acatgcatactcaacatgccatcaa

SEQ ID NO: 106626 - DNA, 25 bp, Mus musculus
acatgcatactctacatgccatcaa

SEQ ID NO: 106627 - DNA, 25 bp, Mus musculus
acatgcatagcaactgacaccacag

SEQ ID NO: 106628 - DNA, 25 bp, Mus musculus
acatgcatagcatctgacaccacag

SEQ ID NO: 106629 - DNA, 25 bp, Mus musculus
acatgcatatgacctttgtgtttaa

SEQ ID NO: 106630 - DNA, 25 bp, Mus musculus
acatgcatatgagctttgtgtttaa

SEQ ID NO: 106631 - DNA, 25 bp, Mus musculus
acatgcatcagactggctagccttt

SEQ ID NO: 106632 - DNA, 25 bp, Mus musculus
acatgcatcagagtggctagccttt

SEQ ID NO: 106633 - DNA, 25 bp, Mus musculus
acatgcatcctcaagtgtcatctct

SEQ ID NO: 106634 - DNA, 25 bp, Mus musculus
acatgcatcctctagtgtcatctct

SEQ ID NO: 106635 - DNA, 25 bp, Mus musculus
acatgcatccttcaaaagccagtga

SEQ ID NO: 106636 - DNA, 25 bp, Mus musculus
acatgcatccttgaaaagccagtga

SEQ ID NO: 106637 - DNA, 25 bp, Mus musculus
acatgcatcggtatggcttttgagg

SEQ ID NO: 106638 - DNA, 25 bp, Mus musculus
acatgcatcggtttggcttttgagg

SEQ ID NO: 106639 - DNA, 25 bp, Mus musculus
acatgcatgacaaaggcctgcctgc

SEQ ID NO: 106640 - DNA, 25 bp, Mus musculus
acatgcatgacataggcctgcctgc

SEQ ID NO: 106641 - DNA, 25 bp, Mus musculus
acatgcatgcatacctttgtgtgcc

SEQ ID NO: 106642 - DNA, 25 bp, Mus musculus
acatgcatgcattcctttgtgtgcc

SEQ ID NO: 106643 - DNA, 25 bp, Mus musculus
acatgcatgcctcgttcactctgag

SEQ ID NO: 106644 - DNA, 25 bp, Mus musculus
acatgcatgcctggttcactctgag

SEQ ID NO: 106645 - DNA, 25 bp, Mus musculus
acatgcatgctaagacactcaggca

SEQ ID NO: 106646 - DNA, 25 bp, Mus musculus
acatgcatgctatgacactcaggca

SEQ ID NO: 106647 - DNA, 25 bp, Mus musculus
acatgcatgcttcagtcagtctctc

SEQ ID NO: 106648 - DNA, 25 bp, Mus musculus
acatgcatgcttgagtcagtctctc

SEQ ID NO: 106649 - DNA, 25 bp, Mus musculus
acatgcatggagagaggccgtgtct

SEQ ID NO: 106650 - DNA, 25 bp, Mus musculus
acatgcatggagtgaggccgtgtct

SEQ ID NO: 106651 - DNA, 25 bp, Mus musculus
acatgcatggtgctttcggacatta

SEQ ID NO: 106652 - DNA, 25 bp, Mus musculus
acatgcatggtggtttcggacatta

SEQ ID NO: 106653 - DNA, 25 bp, Mus musculus
acatgcattattatggtgctcaaat

SEQ ID NO: 106654 - DNA, 25 bp, Mus musculus
acatgcattattttggtgctcaaat

SEQ ID NO: 106655 - DNA, 25 bp, Mus musculus
acatgcattcctaggagggcacaca

SEQ ID NO: 106656 - DNA, 25 bp, Mus musculus
acatgcattcctccattttacagat

SEQ ID NO: 106657 - DNA, 25 bp, Mus musculus
acatgcattcctgcattttacagat

SEQ ID NO: 106658 - DNA, 25 bp, Mus musculus
acatgcattccttggagggcacaca

SEQ ID NO: 106659 - DNA, 25 bp, Mus musculus
acatgcattgtcattggaatccgtg

SEQ ID NO: 106660 - DNA, 25 bp, Mus musculus
acatgcattgtctttggaatccgtg

SEQ ID NO: 106661 - DNA, 25 bp, Mus musculus
acatgcatttgtctagactaaggaa

SEQ ID NO: 106662 - DNA, 25 bp, Mus musculus
acatgcatttgtgtagactaaggaa

SEQ ID NO: 106663 - DNA, 25 bp, Mus musculus
acatgccaaatgaccggaccatcaa

SEQ ID NO: 106664 - DNA, 25 bp, Mus musculus
acatgccaaatgtccggaccatcaa

SEQ ID NO: 106665 - DNA, 25 bp, Mus musculus
acatgccaagtgatctactgttgaa

SEQ ID NO: 106666 - DNA, 25 bp, Mus musculus
acatgccaagtgttctactgttgaa

SEQ ID NO: 106667 - DNA, 25 bp, Mus musculus
acatgccaagttacaggaggattgg

SEQ ID NO: 106668 - DNA, 25 bp, Mus musculus
acatgccaagtttcaggaggattgg

SEQ ID NO: 106669 - DNA, 25 bp, Mus musculus
acatgccacatgagactgggcctga

SEQ ID NO: 106670 - DNA, 25 bp, Mus musculus
acatgccacatgtgactgggcctga

SEQ ID NO: 106671 - DNA, 25 bp, Mus musculus
acatgccaccgacacttgctgaaca

SEQ ID NO: 106672 - DNA, 25 bp, Mus musculus
acatgccaccgagacttgctgaaca

SEQ ID NO: 106673 - DNA, 25 bp, Mus musculus
acatgccactgtacattcagatatt

SEQ ID NO: 106674 - DNA, 25 bp, Mus musculus
acatgccactgttcattcagatatt

SEQ ID NO: 106675 - DNA, 25 bp, Mus musculus
acatgccaggctatgccacaggaaa

SEQ ID NO: 106676 - DNA, 25 bp, Mus musculus
acatgccaggctttgccacaggaaa

SEQ ID NO: 106677 - DNA, 25 bp, Mus musculus
acatgccagtcccttgtggaagaat

SEQ ID NO: 106678 - DNA, 25 bp, Mus musculus
acatgccagtccgttgtggaagaat

SEQ ID NO: 106679 - DNA, 25 bp, Mus musculus
acatgccatacacgtactttgggac

SEQ ID NO: 106680 - DNA, 25 bp, Mus musculus
acatgccatacaggtactttgggac

SEQ ID NO: 106681 - DNA, 25 bp, Mus musculus
acatgccatctaacgctactcactg

SEQ ID NO: 106682 - DNA, 25 bp, Mus musculus
acatgccatctatcgctactcactg

SEQ ID NO: 106683 - DNA, 25 bp, Mus musculus
acatgccatgttctatgccaggctg

SEQ ID NO: 106684 - DNA, 25 bp, Mus musculus
acatgccatgttgtatgccaggctg

SEQ ID NO: 106685 - DNA, 25 bp, Mus musculus
acatgcccaaacctggcctggaagt

SEQ ID NO: 106686 - DNA, 25 bp, Mus musculus
acatgcccaaacgtggcctggaagt

SEQ ID NO: 106687 - DNA, 25 bp, Mus musculus
acatgcccaagcctgtgtagtgaaa

SEQ ID NO: 106688 - DNA, 25 bp, Mus musculus
acatgcccaagcgtgtgtagtgaaa

SEQ ID NO: 106689 - DNA, 25 bp, Mus musculus
acatgcccatacactagacacaaat

SEQ ID NO: 106690 - DNA, 25 bp, Mus musculus
acatgcccatactctagacacaaat

SEQ ID NO: 106691 - DNA, 25 bp, Mus musculus
acatgcccatgacgtacacagtgaa

SEQ ID NO: 106692 - DNA, 25 bp, Mus musculus
acatgcccatgaggtacacagtgaa

SEQ ID NO: 106693 - DNA, 25 bp, Mus musculus
acatgccccattcattggtaatttt

SEQ ID NO: 106694 - DNA, 25 bp, Mus musculus
acatgccccattgattggtaatttt

SEQ ID NO: 106695 - DNA, 25 bp, Mus musculus
acatgcccctgtctaattggtgaca

SEQ ID NO: 106696 - DNA, 25 bp, Mus musculus
acatgcccctgtgtaattggtgaca

SEQ ID NO: 106697 - DNA, 25 bp, Mus musculus
acatgccccttgacagcatcttaat

SEQ ID NO: 106698 - DNA, 25 bp, Mus musculus
acatgccccttgtcagcatcttaat

SEQ ID NO: 106699 - DNA, 25 bp, Mus musculus
acatgccctatcagaggaggctaca

SEQ ID NO: 106700 - DNA, 25 bp, Mus musculus
acatgccctatctgaggaggctaca

SEQ ID NO: 106701 - DNA, 25 bp, Mus musculus
acatgccctcttaggatcattgaca

SEQ ID NO: 106702 - DNA, 25 bp, Mus musculus
acatgccctctttggatcattgaca

SEQ ID NO: 106703 - DNA, 25 bp, Mus musculus
acatgccctgtgaagtgtgtgcctt

SEQ ID NO: 106704 - DNA, 25 bp, Mus musculus
acatgccctgtgctgtttacagtgt

SEQ ID NO: 106705 - DNA, 25 bp, Mus musculus
acatgccctgtggtgtttacagtgt

SEQ ID NO: 106706 - DNA, 25 bp, Mus musculus
acatgccctgtgtagtgtgtgcctt

SEQ ID NO: 106707 - DNA, 25 bp, Mus musculus
acatgcccttaccttatttggagaa

SEQ ID NO: 106708 - DNA, 25 bp, Mus musculus
acatgcccttacgttatttggagaa

SEQ ID NO: 106709 - DNA, 25 bp, Mus musculus
acatgccgtgttcactgtcagcact

SEQ ID NO: 106710 - DNA, 25 bp, Mus musculus
acatgccgtgttgactgtcagcact

SEQ ID NO: 106711 - DNA, 25 bp, Mus musculus
acatgcctaagcacccggagctggc

SEQ ID NO: 106712 - DNA, 25 bp, Mus musculus
acatgcctaagctcccggagctggc

SEQ ID NO: 106713 - DNA, 25 bp, Mus musculus
acatgcctactgagcgtacgttaca

SEQ ID NO: 106714 - DNA, 25 bp, Mus musculus
acatgcctactgtgcgtacgttaca

SEQ ID NO: 106715 - DNA, 25 bp, Mus musculus
acatgcctagccctcttttcatttt

SEQ ID NO: 106716 - DNA, 25 bp, Mus musculus
acatgcctagccgtcttttcatttt

SEQ ID NO: 106717 - DNA, 25 bp, Mus musculus
acatgcctagtaccacacacagttt

SEQ ID NO: 106718 - DNA, 25 bp, Mus musculus
acatgcctagtagcacacacagttt

SEQ ID NO: 106719 - DNA, 25 bp, Mus musculus
acatgcctcctgaatgcactcaatt

SEQ ID NO: 106720 - DNA, 25 bp, Mus musculus
acatgcctcctgtatgcactcaatt

SEQ ID NO: 106721 - DNA, 25 bp, Mus musculus
acatgcctgaggactggttccactt

SEQ ID NO: 106722 - DNA, 25 bp, Mus musculus
acatgcctgaggtctggttccactt

SEQ ID NO: 106723 - DNA, 25 bp, Mus musculus
acatgcctgagtcgtgctttaccga

SEQ ID NO: 106724 - DNA, 25 bp, Mus musculus
acatgcctgagtggtgctttaccga

SEQ ID NO: 106725 - DNA, 25 bp, Mus musculus
acatgcctgatgacttagaaaacta

SEQ ID NO: 106726 - DNA, 25 bp, Mus musculus
acatgcctgatgtcttagaaaacta

SEQ ID NO: 106727 - DNA, 25 bp, Mus musculus
acatgcctgctgcagatgcccagct

SEQ ID NO: 106728 - DNA, 25 bp, Mus musculus
acatgcctgctggagatgcccagct

SEQ ID NO: 106729 - DNA, 25 bp, Mus musculus
acatgcctggagcacgtatggccct

SEQ ID NO: 106730 - DNA, 25 bp, Mus musculus
acatgcctggaggacgtatggccct

SEQ ID NO: 106731 - DNA, 25 bp, Mus musculus
acatgcctggtcagacatcctgtgt

SEQ ID NO: 106732 - DNA, 25 bp, Mus musculus
acatgcctggtctgacatcctgtgt

SEQ ID NO: 106733 - DNA, 25 bp, Mus musculus
acatgcctggtgacagcaaggccgg

SEQ ID NO: 106734 - DNA, 25 bp, Mus musculus
acatgcctggtgtcagcaaggccgg

SEQ ID NO: 106735 - DNA, 25 bp, Mus musculus
acatgcctgtttcgtaggcctctag

SEQ ID NO: 106736 - DNA, 25 bp, Mus musculus
acatgcctgtttggtaggcctctag

SEQ ID NO: 106737 - DNA, 25 bp, Mus musculus
acatgccttactcctgagactgctg

SEQ ID NO: 106738 - DNA, 25 bp, Mus musculus
acatgccttactgctgagactgctg

SEQ ID NO: 106739 - DNA, 25 bp, Mus musculus
acatgccttaggctttagatacctt

SEQ ID NO: 106740 - DNA, 25 bp, Mus musculus
acatgccttagggtttagatacctt

SEQ ID NO: 106741 - DNA, 25 bp, Mus musculus
acatgcctttttagccaaggtcata

SEQ ID NO: 106742 - DNA, 25 bp, Mus musculus
acatgccttttttgccaaggtcata

SEQ ID NO: 106743 - DNA, 25 bp, Mus musculus
acatgcgaggctacaaagaactgat

SEQ ID NO: 106744 - DNA, 25 bp, Mus musculus
acatgcgaggcttcaaagaactgat

SEQ ID NO: 106745 - DNA, 25 bp, Mus musculus
acatgcgcagcacaacattctgaag

SEQ ID NO: 106746 - DNA, 25 bp, Mus musculus
acatgcgcagcagaacattctgaag

SEQ ID NO: 106747 - DNA, 25 bp, Mus musculus
acatgcggatttctggccagccaag

SEQ ID NO: 106748 - DNA, 25 bp, Mus musculus
acatgcggatttgtggccagccaag

SEQ ID NO: 106749 - DNA, 25 bp, Mus musculus
acatgcggcatcactagggcctgaa

SEQ ID NO: 106750 - DNA, 25 bp, Mus musculus
acatgcggcatctctagggcctgaa

SEQ ID NO: 106751 - DNA, 25 bp, Mus musculus
acatgcggctgaccagacttttgta

SEQ ID NO: 106752 - DNA, 25 bp, Mus musculus
acatgcggctgagcagacttttgta

SEQ ID NO: 106753 - DNA, 25 bp, Mus musculus
acatgcgggactatggttttggttg

SEQ ID NO: 106754 - DNA, 25 bp, Mus musculus
acatgcgggactttggttttggttg

SEQ ID NO: 106755 - DNA, 25 bp, Mus musculus
acatgcggtagcaagctggtgacaa

SEQ ID NO: 106756 - DNA, 25 bp, Mus musculus
acatgcggtagctagctggtgacaa

SEQ ID NO: 106757 - DNA, 25 bp, Mus musculus
acatgcgtactgagcgctttgggca

SEQ ID NO: 106758 - DNA, 25 bp, Mus musculus
acatgcgtactgtgcgctttgggca

SEQ ID NO: 106759 - DNA, 25 bp, Mus musculus
acatgcgtgtataggtccacttttc

SEQ ID NO: 106760 - DNA, 25 bp, Mus musculus
acatgcgtgtattggtccacttttc

SEQ ID NO: 106761 - DNA, 25 bp, Mus musculus
acatgcgtgtgtaaattttccttct

SEQ ID NO: 106762 - DNA, 25 bp, Mus musculus
acatgcgtgtgttaattttccttct

SEQ ID NO: 106763 - DNA, 25 bp, Mus musculus
acatgcgttttcaaagcttctacct

SEQ ID NO: 106764 - DNA, 25 bp, Mus musculus
acatgcgttttctaagcttctacct

SEQ ID NO: 106765 - DNA, 25 bp, Mus musculus
acatgctaacacatgctctgcacat

SEQ ID NO: 106766 - DNA, 25 bp, Mus musculus
acatgctaacacttgctctgcacat

SEQ ID NO: 106767 - DNA, 25 bp, Mus musculus
acatgctaacctcgcacatcttata

SEQ ID NO: 106768 - DNA, 25 bp, Mus musculus
acatgctaacctggcacatcttata

SEQ ID NO: 106769 - DNA, 25 bp, Mus musculus
acatgctaaggcacttgtattatat

SEQ ID NO: 106770 - DNA, 25 bp, Mus musculus
acatgctaaggctcttgtattatat

SEQ ID NO: 106771 - DNA, 25 bp, Mus musculus
acatgctaccagactccaaagtaag

SEQ ID NO: 106772 - DNA, 25 bp, Mus musculus
acatgctaccagtctccaaagtaag

SEQ ID NO: 106773 - DNA, 25 bp, Mus musculus
acatgctacccgaatccctttgatt

SEQ ID NO: 106774 - DNA, 25 bp, Mus musculus
acatgctacccgtatccctttgatt

SEQ ID NO: 106775 - DNA, 25 bp, Mus musculus
acatgctacggacctggatgggtaa

SEQ ID NO: 106776 - DNA, 25 bp, Mus musculus
acatgctacggagctggatgggtaa

SEQ ID NO: 106777 - DNA, 25 bp, Mus musculus
acatgctactataggccatccagga

SEQ ID NO: 106778 - DNA, 25 bp, Mus musculus
acatgctactattggccatccagga

SEQ ID NO: 106779 - DNA, 25 bp, Mus musculus
acatgctactgtacccataataaat

SEQ ID NO: 106780 - DNA, 25 bp, Mus musculus
acatgctactgttcccataataaat

SEQ ID NO: 106781 - DNA, 25 bp, Mus musculus
acatgctagacaagtgatctgctac

SEQ ID NO: 106782 - DNA, 25 bp, Mus musculus
acatgctagacatgtgatctgctac

SEQ ID NO: 106783 - DNA, 25 bp, Mus musculus
acatgctagcacacagaagctttgt

SEQ ID NO: 106784 - DNA, 25 bp, Mus musculus
acatgctagcactcagaagctttgt

SEQ ID NO: 106785 - DNA, 25 bp, Mus musculus
acatgctaggtaattattctgccaa

SEQ ID NO: 106786 - DNA, 25 bp, Mus musculus
acatgctaggtatttattctgccaa

SEQ ID NO: 106787 - DNA, 25 bp, Mus musculus
acatgctatagcagtcctgggtgac

SEQ ID NO: 106788 - DNA, 25 bp, Mus musculus
acatgctatagctgtcctgggtgac

SEQ ID NO: 106789 - DNA, 25 bp, Mus musculus
acatgctatgtaacggcttggcttc

SEQ ID NO: 106790 - DNA, 25 bp, Mus musculus
acatgctatgtatcggcttggcttc

SEQ ID NO: 106791 - DNA, 25 bp, Mus musculus
acatgctatgttcgtcagcgtccac

SEQ ID NO: 106792 - DNA, 25 bp, Mus musculus
acatgctatgttggtcagcgtccac

SEQ ID NO: 106793 - DNA, 25 bp, Mus musculus
acatgctattataccttcattcagg

SEQ ID NO: 106794 - DNA, 25 bp, Mus musculus
acatgctattattccttcattcagg

SEQ ID NO: 106795 - DNA, 25 bp, Mus musculus
acatgctcaaacctggctattacaa

SEQ ID NO: 106796 - DNA, 25 bp, Mus musculus
acatgctcaaacgtggctattacaa

SEQ ID NO: 106797 - DNA, 25 bp, Mus musculus
acatgctcaaatacggtgcagcccg

SEQ ID NO: 106798 - DNA, 25 bp, Mus musculus
acatgctcaaattcggtgcagcccg

SEQ ID NO: 106799 - DNA, 25 bp, Mus musculus
acatgctcacatccgtgtacacagg

SEQ ID NO: 106800 - DNA, 25 bp, Mus musculus
acatgctcacatgcgtgtacacagg

SEQ ID NO: 106801 - DNA, 25 bp, Mus musculus
acatgctcacgtctttattgcccgt

SEQ ID NO: 106802 - DNA, 25 bp, Mus musculus
acatgctcacgtgtttattgcccgt

SEQ ID NO: 106803 - DNA, 25 bp, Mus musculus
acatgctcactcctttacctgtgct

SEQ ID NO: 106804 - DNA, 25 bp, Mus musculus
acatgctcactcgtttacctgtgct

SEQ ID NO: 106805 - DNA, 25 bp, Mus musculus
acatgctcagcactggaccttacgt

SEQ ID NO: 106806 - DNA, 25 bp, Mus musculus
acatgctcagcagtggaccttacgt

SEQ ID NO: 106807 - DNA, 25 bp, Mus musculus
acatgctcatgcagccgtgatcaag

SEQ ID NO: 106808 - DNA, 25 bp, Mus musculus
acatgctcatgctgccgtgatcaag

SEQ ID NO: 106809 - DNA, 25 bp, Mus musculus
acatgctccgagaactgggcgatac

SEQ ID NO: 106810 - DNA, 25 bp, Mus musculus
acatgctccgagtactgggcgatac

SEQ ID NO: 106811 - DNA, 25 bp, Mus musculus
acatgctcgctccactcggaagaag

SEQ ID NO: 106812 - DNA, 25 bp, Mus musculus
acatgctcgctcgactcggaagaag

SEQ ID NO: 106813 - DNA, 25 bp, Mus musculus
acatgctcggatacaggccgctgct

SEQ ID NO: 106814 - DNA, 25 bp, Mus musculus
acatgctcggattcaggccgctgct

SEQ ID NO: 106815 - DNA, 25 bp, Mus musculus
acatgctctatgaggagttgtttac

SEQ ID NO: 106816 - DNA, 25 bp, Mus musculus
acatgctctatgtggagttgtttac

SEQ ID NO: 106817 - DNA, 25 bp, Mus musculus
acatgctctctgcaaataagtaaag

SEQ ID NO: 106818 - DNA, 25 bp, Mus musculus
acatgctctctggaaataagtaaag

SEQ ID NO: 106819 - DNA, 25 bp, Mus musculus
acatgctctgtgatgtggatctctc

SEQ ID NO: 106820 - DNA, 25 bp, Mus musculus
acatgctctgtgttgtggatctctc

SEQ ID NO: 106821 - DNA, 25 bp, Mus musculus
acatgctcttacatgctcatccatc

SEQ ID NO: 106822 - DNA, 25 bp, Mus musculus
acatgctcttacttgctcatccatc

SEQ ID NO: 106823 - DNA, 25 bp, Mus musculus
acatgctcttcaaggtgcatccaga

SEQ ID NO: 106824 - DNA, 25 bp, Mus musculus
acatgctcttcatggtgcatccaga

SEQ ID NO: 106825 - DNA, 25 bp, Mus musculus
acatgctcttgactcctctgaacgg

SEQ ID NO: 106826 - DNA, 25 bp, Mus musculus
acatgctcttgagtcctctgaacgg

SEQ ID NO: 106827 - DNA, 25 bp, Mus musculus
acatgctctttgctatgacctttgc

SEQ ID NO: 106828 - DNA, 25 bp, Mus musculus
acatgctctttggtatgacctttgc

SEQ ID NO: 106829 - DNA, 25 bp, Mus musculus
acatgctgaacaatgcactgcctag

SEQ ID NO: 106830 - DNA, 25 bp, Mus musculus
acatgctgaacattgcactgcctag

SEQ ID NO: 106831 - DNA, 25 bp, Mus musculus
acatgctgacatcgtgtcgtagaca

SEQ ID NO: 106832 - DNA, 25 bp, Mus musculus
acatgctgacatggtgtcgtagaca

SEQ ID NO: 106833 - DNA, 25 bp, Mus musculus
acatgctgcacaaagccatcttgct

SEQ ID NO: 106834 - DNA, 25 bp, Mus musculus
acatgctgcacatagccatcttgct

SEQ ID NO: 106835 - DNA, 25 bp, Mus musculus
acatgctgcatgacaccgaggcaga

SEQ ID NO: 106836 - DNA, 25 bp, Mus musculus
acatgctgcatgtcaccgaggcaga

SEQ ID NO: 106837 - DNA, 25 bp, Mus musculus
acatgctgcctaagggtgtttcctt

SEQ ID NO: 106838 - DNA, 25 bp, Mus musculus
acatgctgcctatgggtgtttcctt

SEQ ID NO: 106839 - DNA, 25 bp, Mus musculus
acatgctgcggaagcgaccggtgat

SEQ ID NO: 106840 - DNA, 25 bp, Mus musculus
acatgctgcggatgcgaccggtgat

SEQ ID NO: 106841 - DNA, 25 bp, Mus musculus
acatgctgcggtcctgtagatccat

SEQ ID NO: 106842 - DNA, 25 bp, Mus musculus
acatgctgcggtgctgtagatccat

SEQ ID NO: 106843 - DNA, 25 bp, Mus musculus
acatgctgcgtgacctccagaaagg

SEQ ID NO: 106844 - DNA, 25 bp, Mus musculus
acatgctgcgtgtcctccagaaagg

SEQ ID NO: 106845 - DNA, 25 bp, Mus musculus
acatgctgctagatctgtttggctc

SEQ ID NO: 106846 - DNA, 25 bp, Mus musculus
acatgctgctagttctgtttggctc

SEQ ID NO: 106847 - DNA, 25 bp, Mus musculus
acatgctgctcacgcttaggaggct

SEQ ID NO: 106848 - DNA, 25 bp, Mus musculus
acatgctgctcaggcttaggaggct

SEQ ID NO: 106849 - DNA, 25 bp, Mus musculus
acatgctgctgcagcttgatgggtc

SEQ ID NO: 106850 - DNA, 25 bp, Mus musculus
acatgctgctgctgcttgatgggtc

SEQ ID NO: 106851 - DNA, 25 bp, Mus musculus
acatgctgggttactgtaccagaaa

SEQ ID NO: 106852 - DNA, 25 bp, Mus musculus
acatgctgggtttctgtaccagaaa

SEQ ID NO: 106853 - DNA, 25 bp, Mus musculus
acatgctggtatatgcccatgacca

SEQ ID NO: 106854 - DNA, 25 bp, Mus musculus
acatgctggtatttgcccatgacca

SEQ ID NO: 106855 - DNA, 25 bp, Mus musculus
acatgctgtataaggagcctgcctt

SEQ ID NO: 106856 - DNA, 25 bp, Mus musculus
acatgctgtatatggagcctgcctt

SEQ ID NO: 106857 - DNA, 25 bp, Mus musculus
acatgctgtcaccaatagaggccca

SEQ ID NO: 106858 - DNA, 25 bp, Mus musculus
acatgctgtcacgaatagaggccca

SEQ ID NO: 106859 - DNA, 25 bp, Mus musculus
acatgctgtcagcactgggtaactt

SEQ ID NO: 106860 - DNA, 25 bp, Mus musculus
acatgctgtcaggactgggtaactt

SEQ ID NO: 106861 - DNA, 25 bp, Mus musculus
acatgctgtgctagtgaccttgagc

SEQ ID NO: 106862 - DNA, 25 bp, Mus musculus
acatgctgtgcttgtgaccttgagc

SEQ ID NO: 106863 - DNA, 25 bp, Mus musculus
acatgctgtgtcagcctaaaacctg

SEQ ID NO: 106864 - DNA, 25 bp, Mus musculus
acatgctgtgtctgcctaaaacctg

SEQ ID NO: 106865 - DNA, 25 bp, Mus musculus
acatgctgtgtgacggtgtggcttc

SEQ ID NO: 106866 - DNA, 25 bp, Mus musculus
acatgctgtgtgtcggtgtggcttc

SEQ ID NO: 106867 - DNA, 25 bp, Mus musculus
acatgctgttcaacccattcaagaa

SEQ ID NO: 106868 - DNA, 25 bp, Mus musculus
acatgctgttcatcccattcaagaa

SEQ ID NO: 106869 - DNA, 25 bp, Mus musculus
acatgctgttccatggctttggaat

SEQ ID NO: 106870 - DNA, 25 bp, Mus musculus
acatgctgttccttggctttggaat

SEQ ID NO: 106871 - DNA, 25 bp, Mus musculus
acatgctgttctatgcaagtgtaca

SEQ ID NO: 106872 - DNA, 25 bp, Mus musculus
acatgctgttctttgcaagtgtaca

SEQ ID NO: 106873 - DNA, 25 bp, Mus musculus
acatgctgtttcaaggtgccaccga

SEQ ID NO: 106874 - DNA, 25 bp, Mus musculus
acatgctgtttctaggtgccaccga

SEQ ID NO: 106875 - DNA, 25 bp, Mus musculus
acatgcttacacatgggctactatt

SEQ ID NO: 106876 - DNA, 25 bp, Mus musculus
acatgcttacacttgggctactatt

SEQ ID NO: 106877 - DNA, 25 bp, Mus musculus
acatgcttacagcacagggttgtct

SEQ ID NO: 106878 - DNA, 25 bp, Mus musculus
acatgcttacaggacagggttgtct

SEQ ID NO: 106879 - DNA, 25 bp, Mus musculus
acatgcttagcacagattcacaact

SEQ ID NO: 106880 - DNA, 25 bp, Mus musculus
acatgcttagcagagattcacaact

SEQ ID NO: 106881 - DNA, 25 bp, Mus musculus
acatgcttatcaccacacttgaagt

SEQ ID NO: 106882 - DNA, 25 bp, Mus musculus
acatgcttatcagcacacttgaagt

SEQ ID NO: 106883 - DNA, 25 bp, Mus musculus
acatgcttatccactgtgtcaccag

SEQ ID NO: 106884 - DNA, 25 bp, Mus musculus
acatgcttatcctctgtgtcaccag

SEQ ID NO: 106885 - DNA, 25 bp, Mus musculus
acatgcttatgtctcctgcctgata

SEQ ID NO: 106886 - DNA, 25 bp, Mus musculus
acatgcttatgtgtcctgcctgata

SEQ ID NO: 106887 - DNA, 25 bp, Mus musculus
acatgcttattgctgatttcatcca

SEQ ID NO: 106888 - DNA, 25 bp, Mus musculus
acatgcttattggtgatttcatcca

SEQ ID NO: 106889 - DNA, 25 bp, Mus musculus
acatgcttcagacgcacgtgtcaca

SEQ ID NO: 106890 - DNA, 25 bp, Mus musculus
acatgcttcagaggcacgtgtcaca

SEQ ID NO: 106891 - DNA, 25 bp, Mus musculus
acatgcttcgctccatggtatgggt

SEQ ID NO: 106892 - DNA, 25 bp, Mus musculus
acatgcttcgctgcatggtatgggt

SEQ ID NO: 106893 - DNA, 25 bp, Mus musculus
acatgcttctggagtgaggtcctgt

SEQ ID NO: 106894 - DNA, 25 bp, Mus musculus
acatgcttctggtgtgaggtcctgt

SEQ ID NO: 106895 - DNA, 25 bp, Mus musculus
acatgcttcttcaggtatcacacaa

SEQ ID NO: 106896 - DNA, 25 bp, Mus musculus
acatgcttcttctggtatcacacaa

SEQ ID NO: 106897 - DNA, 25 bp, Mus musculus
acatgcttggcaaactagattggat

SEQ ID NO: 106898 - DNA, 25 bp, Mus musculus
acatgcttggcatactagattggat

SEQ ID NO: 106899 - DNA, 25 bp, Mus musculus
acatgcttgtgcagcagttctggta

SEQ ID NO: 106900 - DNA, 25 bp, Mus musculus
acatgcttgtgctgcagttctggta

SEQ ID NO: 106901 - DNA, 25 bp, Mus musculus
acatgcttgtgtctccatgttctgt

SEQ ID NO: 106902 - DNA, 25 bp, Mus musculus
acatgcttgtgtgtccatgttctgt

SEQ ID NO: 106903 - DNA, 25 bp, Mus musculus
acatgctttaccacaggctggagca

SEQ ID NO: 106904 - DNA, 25 bp, Mus musculus
acatgctttacctcaggctggagca

SEQ ID NO: 106905 - DNA, 25 bp, Mus musculus
acatgctttatcactgaacctcaga

SEQ ID NO: 106906 - DNA, 25 bp, Mus musculus
acatgctttatctctgaacctcaga

SEQ ID NO: 106907 - DNA, 25 bp, Mus musculus
acatgctttcctaactgtttcgtat

SEQ ID NO: 106908 - DNA, 25 bp, Mus musculus
acatgctttccttactgtttcgtat

SEQ ID NO: 106909 - DNA, 25 bp, Mus musculus
acatgctttctgaaccattcactta

SEQ ID NO: 106910 - DNA, 25 bp, Mus musculus
acatgctttctgtaccattcactta

SEQ ID NO: 106911 - DNA, 25 bp, Mus musculus
acatgctttggactttggaatcgaa

SEQ ID NO: 106912 - DNA, 25 bp, Mus musculus
acatgctttggagtttggaatcgaa

SEQ ID NO: 106913 - DNA, 25 bp, Mus musculus
acatgctttggtagtcaagggtgac

SEQ ID NO: 106914 - DNA, 25 bp, Mus musculus
acatgctttggttgtcaagggtgac

SEQ ID NO: 106915 - DNA, 25 bp, Mus musculus
acatgcttttcccagttatttgtgg

SEQ ID NO: 106916 - DNA, 25 bp, Mus musculus
acatgcttttccgagttatttgtgg

SEQ ID NO: 106917 - DNA, 25 bp, Mus musculus
acatggaaagtgagttctgtcaaaa

SEQ ID NO: 106918 - DNA, 25 bp, Mus musculus
acatggaaagtgtgttctgtcaaaa

SEQ ID NO: 106919 - DNA, 25 bp, Mus musculus
acatggaacacacgacagcgcgcaa

SEQ ID NO: 106920 - DNA, 25 bp, Mus musculus
acatggaacacaggacagcgcgcaa

SEQ ID NO: 106921 - DNA, 25 bp, Mus musculus
acatggaaggctatttgtgacaatc

SEQ ID NO: 106922 - DNA, 25 bp, Mus musculus
acatggaaggctttttgtgacaatc

SEQ ID NO: 106923 - DNA, 25 bp, Mus musculus
acatggaagggcaagtcctccactt

SEQ ID NO: 106924 - DNA, 25 bp, Mus musculus
acatggaagggctagtcctccactt

SEQ ID NO: 106925 - DNA, 25 bp, Mus musculus
acatggaagtccaccgtctcctcgg

SEQ ID NO: 106926 - DNA, 25 bp, Mus musculus
acatggaagtcctccgtctcctcgg

SEQ ID NO: 106927 - DNA, 25 bp, Mus musculus
acatggaagtggaccagtgccagcg

SEQ ID NO: 106928 - DNA, 25 bp, Mus musculus
acatggaagtggtccagtgccagcg

SEQ ID NO: 106929 - DNA, 25 bp, Mus musculus
acatggaatccgctcccaggaagaa

SEQ ID NO: 106930 - DNA, 25 bp, Mus musculus
acatggaatccggtcccaggaagaa

SEQ ID NO: 106931 - DNA, 25 bp, Mus musculus
acatggaatgccagagtgcctgctc

SEQ ID NO: 106932 - DNA, 25 bp, Mus musculus
acatggaatgcctgagtgcctgctc

SEQ ID NO: 106933 - DNA, 25 bp, Mus musculus
acatggaattcacccgtaacacctt

SEQ ID NO: 106934 - DNA, 25 bp, Mus musculus
acatggaattcagccgtaacacctt

SEQ ID NO: 106935 - DNA, 25 bp, Mus musculus
acatggacaatcacttgcccatcat

SEQ ID NO: 106936 - DNA, 25 bp, Mus musculus
acatggacaatctcttgcccatcat

SEQ ID NO: 106937 - DNA, 25 bp, Mus musculus
acatggacacctatttattgggtga

SEQ ID NO: 106938 - DNA, 25 bp, Mus musculus
acatggacacctttttattgggtga

SEQ ID NO: 106939 - DNA, 25 bp, Mus musculus
acatggacagctccctggtctacgg

SEQ ID NO: 106940 - DNA, 25 bp, Mus musculus
acatggacagctgcctggtctacgg

SEQ ID NO: 106941 - DNA, 25 bp, Mus musculus
acatggacagtgaggctttgcaccc

SEQ ID NO: 106942 - DNA, 25 bp, Mus musculus
acatggacagtgtggctttgcaccc

SEQ ID NO: 106943 - DNA, 25 bp, Mus musculus
acatggacatggctaagtaagaatt

SEQ ID NO: 106944 - DNA, 25 bp, Mus musculus
acatggacatgggtaagtaagaatt

SEQ ID NO: 106945 - DNA, 25 bp, Mus musculus
acatggaccatgctggctcctttga

SEQ ID NO: 106946 - DNA, 25 bp, Mus musculus
acatggaccatggtggctcctttga

SEQ ID NO: 106947 - DNA, 25 bp, Mus musculus
acatggacccatagctgttgcaatt

SEQ ID NO: 106948 - DNA, 25 bp, Mus musculus
acatggacccattgctgttgcaatt

SEQ ID NO: 106949 - DNA, 25 bp, Mus musculus
acatggaccctcagtgtgggagaca

SEQ ID NO: 106950 - DNA, 25 bp, Mus musculus
acatggaccctctgtgtgggagaca

SEQ ID NO: 106951 - DNA, 25 bp, Mus musculus
acatggacggttccactctatctaa

SEQ ID NO: 106952 - DNA, 25 bp, Mus musculus
acatggacggttgcactctatctaa

SEQ ID NO: 106953 - DNA, 25 bp, Mus musculus
acatggacttcacgcttcttgtagc

SEQ ID NO: 106954 - DNA, 25 bp, Mus musculus
acatggacttcaggcttcttgtagc

SEQ ID NO: 106955 - DNA, 25 bp, Mus musculus
acatggagatagagagcagctgccc

SEQ ID NO: 106956 - DNA, 25 bp, Mus musculus
acatggagatagtgagcagctgccc

SEQ ID NO: 106957 - DNA, 25 bp, Mus musculus
acatggagcctcaccgtagacagat

SEQ ID NO: 106958 - DNA, 25 bp, Mus musculus
acatggagcctctccgtagacagat

SEQ ID NO: 106959 - DNA, 25 bp, Mus musculus
acatggagctatcgtggctttgtgt

SEQ ID NO: 106960 - DNA, 25 bp, Mus musculus
acatggagctatggtggctttgtgt

SEQ ID NO: 106961 - DNA, 25 bp, Mus musculus
acatggagctgtaaggacttgtagt

SEQ ID NO: 106962 - DNA, 25 bp, Mus musculus
acatggagctgtcccctagaactaa

SEQ ID NO: 106963 - DNA, 25 bp, Mus musculus
acatggagctgtgccctagaactaa

SEQ ID NO: 106964 - DNA, 25 bp, Mus musculus
acatggagctgttaggacttgtagt

SEQ ID NO: 106965 - DNA, 25 bp, Mus musculus
acatggagggacaagcctgcccaaa

SEQ ID NO: 106966 - DNA, 25 bp, Mus musculus
acatggagggactagcctgcccaaa

SEQ ID NO: 106967 - DNA, 25 bp, Mus musculus
acatggaggtcccaggaattgaact

SEQ ID NO: 106968 - DNA, 25 bp, Mus musculus
acatggaggtccgaggaattgaact

SEQ ID NO: 106969 - DNA, 25 bp, Mus musculus
acatggataagtctgtgtgtgcaga

SEQ ID NO: 106970 - DNA, 25 bp, Mus musculus
acatggataagtgtgtgtgtgcaga

SEQ ID NO: 106971 - DNA, 25 bp, Mus musculus
acatggatacttcgttcctgctcaa

SEQ ID NO: 106972 - DNA, 25 bp, Mus musculus
acatggatacttggttcctgctcaa

SEQ ID NO: 106973 - DNA, 25 bp, Mus musculus
acatggatcaagagggtcccggttt

SEQ ID NO: 106974 - DNA, 25 bp, Mus musculus
acatggatcaagtgggtcccggttt

SEQ ID NO: 106975 - DNA, 25 bp, Mus musculus
acatggatcgaactctcaggttctt

SEQ ID NO: 106976 - DNA, 25 bp, Mus musculus
acatggatcgaagtctcaggttctt

SEQ ID NO: 106977 - DNA, 25 bp, Mus musculus
acatggatcttgacttgacttgctg

SEQ ID NO: 106978 - DNA, 25 bp, Mus musculus
acatggatcttgtcttgacttgctg

SEQ ID NO: 106979 - DNA, 25 bp, Mus musculus
acatggatggctcagaccctgcttc

SEQ ID NO: 106980 - DNA, 25 bp, Mus musculus
acatggatggctgagaccctgcttc

SEQ ID NO: 106981 - DNA, 25 bp, Mus musculus
acatggatggttatgctggattagg

SEQ ID NO: 106982 - DNA, 25 bp, Mus musculus
acatggatggttttgctggattagg

SEQ ID NO: 106983 - DNA, 25 bp, Mus musculus
acatggatgtagacctgttctttag

SEQ ID NO: 106984 - DNA, 25 bp, Mus musculus
acatggatgtagtcctgttctttag

SEQ ID NO: 106985 - DNA, 25 bp, Mus musculus
acatggatgttgctgatgctgtttg

SEQ ID NO: 106986 - DNA, 25 bp, Mus musculus
acatggatgttggtgatgctgtttg

SEQ ID NO: 106987 - DNA, 25 bp, Mus musculus
acatggattatgatcaagcccagga

SEQ ID NO: 106988 - DNA, 25 bp, Mus musculus
acatggattatgttcaagcccagga

SEQ ID NO: 106989 - DNA, 25 bp, Mus musculus
acatggattcaacctaggaagcttg

SEQ ID NO: 106990 - DNA, 25 bp, Mus musculus
acatggattcaagctaggaagcttg

SEQ ID NO: 106991 - DNA, 25 bp, Mus musculus
acatggcaagcacattctgtttctt

SEQ ID NO: 106992 - DNA, 25 bp, Mus musculus
acatggcaagcagattctgtttctt

SEQ ID NO: 106993 - DNA, 25 bp, Mus musculus
acatggcaaggaattcaaaactctc

SEQ ID NO: 106994 - DNA, 25 bp, Mus musculus
acatggcaaggatttcaaaactctc

SEQ ID NO: 106995 - DNA, 25 bp, Mus musculus
acatggcacctgatggacagcggtt

SEQ ID NO: 106996 - DNA, 25 bp, Mus musculus
acatggcacctgttggacagcggtt

SEQ ID NO: 106997 - DNA, 25 bp, Mus musculus
acatggcactgactaggacccgacc

SEQ ID NO: 106998 - DNA, 25 bp, Mus musculus
acatggcactgagtaggacccgacc

SEQ ID NO: 106999 - DNA, 25 bp, Mus musculus
acatggcagacacagctgctgagat

SEQ ID NO: 107000 - DNA, 25 bp, Mus musculus
acatggcagacagagctgctgagat

SEQ ID NO: 107001 - DNA, 25 bp, Mus musculus
acatggcagagcaggtgagcaaacc

SEQ ID NO: 107002 - DNA, 25 bp, Mus musculus
acatggcagagctggtgagcaaacc

SEQ ID NO: 107003 - DNA, 25 bp, Mus musculus
acatggcagcatatgcacacacctg

SEQ ID NO: 107004 - DNA, 25 bp, Mus musculus
acatggcagcatttgcacacacctg

SEQ ID NO: 107005 - DNA, 25 bp, Mus musculus
acatggcaggacacagcgtgcgaaa

SEQ ID NO: 107006 - DNA, 25 bp, Mus musculus
acatggcaggactcagcgtgcgaaa

SEQ ID NO: 107007 - DNA, 25 bp, Mus musculus
acatggcaggtcctagagactcaaa

SEQ ID NO: 107008 - DNA, 25 bp, Mus musculus
acatggcaggtcgtagagactcaaa

SEQ ID NO: 107009 - DNA, 25 bp, Mus musculus
acatggcatgaacgatcctgagatc

SEQ ID NO: 107010 - DNA, 25 bp, Mus musculus
acatggcatgaaggatcctgagatc

SEQ ID NO: 107011 - DNA, 25 bp, Mus musculus
acatggcatgccagaacacacaaat

SEQ ID NO: 107012 - DNA, 25 bp, Mus musculus
acatggcatgcctgaacacacaaat

SEQ ID NO: 107013 - DNA, 25 bp, Mus musculus
acatggcatgtaccgtgttttatat

SEQ ID NO: 107014 - DNA, 25 bp, Mus musculus
acatggcatgtagcgtgttttatat

SEQ ID NO: 107015 - DNA, 25 bp, Mus musculus
acatggccaaacaatcttctctcat

SEQ ID NO: 107016 - DNA, 25 bp, Mus musculus
acatggccaaactatcttctctcat

SEQ ID NO: 107017 - DNA, 25 bp, Mus musculus
acatggccaaggatctgaggttcga

SEQ ID NO: 107018 - DNA, 25 bp, Mus musculus
acatggccaaggttctgaggttcga

SEQ ID NO: 107019 - DNA, 25 bp, Mus musculus
acatggccacctctgtatacaagtg

SEQ ID NO: 107020 - DNA, 25 bp, Mus musculus
acatggccacctgtgtatacaagtg

SEQ ID NO: 107021 - DNA, 25 bp, Mus musculus
acatggccagatactactccgctct

SEQ ID NO: 107022 - DNA, 25 bp, Mus musculus
acatggccagattctactccgctct

SEQ ID NO: 107023 - DNA, 25 bp, Mus musculus
acatggccaggcatgcttagtttca

SEQ ID NO: 107024 - DNA, 25 bp, Mus musculus
acatggccaggcttgcttagtttca

SEQ ID NO: 107025 - DNA, 25 bp, Mus musculus
acatggccagttatatgttccctct

SEQ ID NO: 107026 - DNA, 25 bp, Mus musculus
acatggccagttttatgttccctct

SEQ ID NO: 107027 - DNA, 25 bp, Mus musculus
acatggccatctatgagtgtgagaa

SEQ ID NO: 107028 - DNA, 25 bp, Mus musculus
acatggccatctttgagtgtgagaa

SEQ ID NO: 107029 - DNA, 25 bp, Mus musculus
acatggccctgaagaagctttcctg

SEQ ID NO: 107030 - DNA, 25 bp, Mus musculus
acatggccctgatgaagctttcctg

SEQ ID NO: 107031 - DNA, 25 bp, Mus musculus
acatggccctggctattaccagtcc

SEQ ID NO: 107032 - DNA, 25 bp, Mus musculus
acatggccctgggtattaccagtcc

SEQ ID NO: 107033 - DNA, 25 bp, Mus musculus
acatggccgagcacgtgacaccgtg

SEQ ID NO: 107034 - DNA, 25 bp, Mus musculus
acatggccgagctcgtgacaccgtg

SEQ ID NO: 107035 - DNA, 25 bp, Mus musculus
acatggcctagacttcagatccttt

SEQ ID NO: 107036 - DNA, 25 bp, Mus musculus
acatggcctagagttcagatccttt

SEQ ID NO: 107037 - DNA, 25 bp, Mus musculus
acatggcctgctctactaacatctg

SEQ ID NO: 107038 - DNA, 25 bp, Mus musculus
acatggcctgctgtactaacatctg

SEQ ID NO: 107039 - DNA, 25 bp, Mus musculus
acatggcctttgctattgctctgag

SEQ ID NO: 107040 - DNA, 25 bp, Mus musculus
acatggcctttggtattgctctgag

SEQ ID NO: 107041 - DNA, 25 bp, Mus musculus
acatggcgacacagcctagccttga

SEQ ID NO: 107042 - DNA, 25 bp, Mus musculus
acatggcgacactgcctagccttga

SEQ ID NO: 107043 - DNA, 25 bp, Mus musculus
acatggcggcggatggagacttcaa

SEQ ID NO: 107044 - DNA, 25 bp, Mus musculus
acatggcggcggttggagacttcaa

SEQ ID NO: 107045 - DNA, 25 bp, Mus musculus
acatggcggtaactcaaacccagac

SEQ ID NO: 107046 - DNA, 25 bp, Mus musculus
acatggcggtaagtcaaacccagac

SEQ ID NO: 107047 - DNA, 25 bp, Mus musculus
acatggcgttaacaagctccacaca

SEQ ID NO: 107048 - DNA, 25 bp, Mus musculus
acatggcgttaagaagctccacaca

SEQ ID NO: 107049 - DNA, 25 bp, Mus musculus
acatggctacctaaaggtgacctga

SEQ ID NO: 107050 - DNA, 25 bp, Mus musculus
acatggctaccttaaggtgacctga

SEQ ID NO: 107051 - DNA, 25 bp, Mus musculus
acatggctactcaaagggttcctgc

SEQ ID NO: 107052 - DNA, 25 bp, Mus musculus
acatggctactctaagggttcctgc

SEQ ID NO: 107053 - DNA, 25 bp, Mus musculus
acatggctataacttatgccgctgg

SEQ ID NO: 107054 - DNA, 25 bp, Mus musculus
acatggctataagttatgccgctgg

SEQ ID NO: 107055 - DNA, 25 bp, Mus musculus
acatggctcactagtccagtctata

SEQ ID NO: 107056 - DNA, 25 bp, Mus musculus
acatggctcacttgtccagtctata

SEQ ID NO: 107057 - DNA, 25 bp, Mus musculus
acatggctcatgattctttcccact

SEQ ID NO: 107058 - DNA, 25 bp, Mus musculus
acatggctcatgtttctttcccact

SEQ ID NO: 107059 - DNA, 25 bp, Mus musculus
acatggctcattcgtgtgttttcat

SEQ ID NO: 107060 - DNA, 25 bp, Mus musculus
acatggctcattggtgtgttttcat

SEQ ID NO: 107061 - DNA, 25 bp, Mus musculus
acatggctccggcttctacctctag

SEQ ID NO: 107062 - DNA, 25 bp, Mus musculus
acatggctccgggttctacctctag

SEQ ID NO: 107063 - DNA, 25 bp, Mus musculus
acatggctcctgagagttgtcctct

SEQ ID NO: 107064 - DNA, 25 bp, Mus musculus
acatggctcctgtgagttgtcctct

SEQ ID NO: 107065 - DNA, 25 bp, Mus musculus
acatggctctaccacagacagtagg

SEQ ID NO: 107066 - DNA, 25 bp, Mus musculus
acatggctctacgacagacagtagg

SEQ ID NO: 107067 - DNA, 25 bp, Mus musculus
acatggctcttcaggttattctaaa

SEQ ID NO: 107068 - DNA, 25 bp, Mus musculus
acatggctcttctggttattctaaa

SEQ ID NO: 107069 - DNA, 25 bp, Mus musculus
acatggctgacgctgggattcacac

SEQ ID NO: 107070 - DNA, 25 bp, Mus musculus
acatggctgacggtgggattcacac

SEQ ID NO: 107071 - DNA, 25 bp, Mus musculus
acatggctgcctatacaagacctgt

SEQ ID NO: 107072 - DNA, 25 bp, Mus musculus
acatggctgcctttacaagacctgt

SEQ ID NO: 107073 - DNA, 25 bp, Mus musculus
acatggctgcgtactgttatatttt

SEQ ID NO: 107074 - DNA, 25 bp, Mus musculus
acatggctgcgtatagaaattcttt

SEQ ID NO: 107075 - DNA, 25 bp, Mus musculus
acatggctgcgttctgttatatttt

SEQ ID NO: 107076 - DNA, 25 bp, Mus musculus
acatggctgcgtttagaaattcttt

SEQ ID NO: 107077 - DNA, 25 bp, Mus musculus
acatggctgctgcacttgaaccggc

SEQ ID NO: 107078 - DNA, 25 bp, Mus musculus
acatggctgctgcatacattgcaat

SEQ ID NO: 107079 - DNA, 25 bp, Mus musculus
acatggctgctgctggtacttgaga

SEQ ID NO: 107080 - DNA, 25 bp, Mus musculus
acatggctgctggacttgaaccggc

SEQ ID NO: 107081 - DNA, 25 bp, Mus musculus
acatggctgctggatacattgcaat

SEQ ID NO: 107082 - DNA, 25 bp, Mus musculus
acatggctgctggtggtacttgaga

SEQ ID NO: 107083 - DNA, 25 bp, Mus musculus
acatggctggacaggatagggtcat

SEQ ID NO: 107084 - DNA, 25 bp, Mus musculus
acatggctggactggatagggtcat

SEQ ID NO: 107085 - DNA, 25 bp, Mus musculus
acatggctggttaactctcctcagt

SEQ ID NO: 107086 - DNA, 25 bp, Mus musculus
acatggctggtttactctcctcagt

SEQ ID NO: 107087 - DNA, 25 bp, Mus musculus
acatggctgtccaggcatctatgtc

SEQ ID NO: 107088 - DNA, 25 bp, Mus musculus
acatggctgtcctggcatctatgtc

SEQ ID NO: 107089 - DNA, 25 bp, Mus musculus
acatggctgtgtcaccagggctttg

SEQ ID NO: 107090 - DNA, 25 bp, Mus musculus
acatggctgtgtccattcagcaata

SEQ ID NO: 107091 - DNA, 25 bp, Mus musculus
acatggctgtgtgaccagggctttg

SEQ ID NO: 107092 - DNA, 25 bp, Mus musculus
acatggctgtgtgcattcagcaata

SEQ ID NO: 107093 - DNA, 25 bp, Mus musculus
acatggctgttgactgtcttggcag

SEQ ID NO: 107094 - DNA, 25 bp, Mus musculus
acatggctgttgtctgtcttggcag

SEQ ID NO: 107095 - DNA, 25 bp, Mus musculus
acatggctgtttctaagggcccaca

SEQ ID NO: 107096 - DNA, 25 bp, Mus musculus
acatggctgtttgtaagggcccaca

SEQ ID NO: 107097 - DNA, 25 bp, Mus musculus
acatggcttccaaaaaggaggcgag

SEQ ID NO: 107098 - DNA, 25 bp, Mus musculus
acatggcttccacttctaatttgtt

SEQ ID NO: 107099 - DNA, 25 bp, Mus musculus
acatggcttccagttctaatttgtt

SEQ ID NO: 107100 - DNA, 25 bp, Mus musculus
acatggcttccataaaggaggcgag

SEQ ID NO: 107101 - DNA, 25 bp, Mus musculus
acatggcttgcacagggagtcgtct

SEQ ID NO: 107102 - DNA, 25 bp, Mus musculus
acatggcttgcagagggagtcgtct

SEQ ID NO: 107103 - DNA, 25 bp, Mus musculus
acatggctttgtctaggctaataga

SEQ ID NO: 107104 - DNA, 25 bp, Mus musculus
acatggctttgtgtaggctaataga

SEQ ID NO: 107105 - DNA, 25 bp, Mus musculus
acatgggaaaccctctgattttaat

SEQ ID NO: 107106 - DNA, 25 bp, Mus musculus
acatgggaaaccgtctgattttaat

SEQ ID NO: 107107 - DNA, 25 bp, Mus musculus
acatgggaaggtctctccttttctt

SEQ ID NO: 107108 - DNA, 25 bp, Mus musculus
acatgggaaggtgtctccttttctt

SEQ ID NO: 107109 - DNA, 25 bp, Mus musculus
acatgggaattcctctgtagcctca

SEQ ID NO: 107110 - DNA, 25 bp, Mus musculus
acatgggaattcgtctgtagcctca

SEQ ID NO: 107111 - DNA, 25 bp, Mus musculus
acatgggaccttattgaagtagact

SEQ ID NO: 107112 - DNA, 25 bp, Mus musculus
acatgggacctttttgaagtagact

SEQ ID NO: 107113 - DNA, 25 bp, Mus musculus
acatgggagagtaggtgccctcacc

SEQ ID NO: 107114 - DNA, 25 bp, Mus musculus
acatgggagagttggtgccctcacc

SEQ ID NO: 107115 - DNA, 25 bp, Mus musculus
acatgggagcttattgtaggtccac

SEQ ID NO: 107116 - DNA, 25 bp, Mus musculus
acatgggagctttttgtaggtccac

SEQ ID NO: 107117 - DNA, 25 bp, Mus musculus
acatgggataccagagactctgtag

SEQ ID NO: 107118 - DNA, 25 bp, Mus musculus
acatgggatacctgagactctgtag

SEQ ID NO: 107119 - DNA, 25 bp, Mus musculus
acatgggatgagaacgttactgtgg

SEQ ID NO: 107120 - DNA, 25 bp, Mus musculus
acatgggatgagtacgttactgtgg

SEQ ID NO: 107121 - DNA, 25 bp, Mus musculus
acatgggcacttcagggccgagcct

SEQ ID NO: 107122 - DNA, 25 bp, Mus musculus
acatgggcacttgagggccgagcct

SEQ ID NO: 107123 - DNA, 25 bp, Mus musculus
acatgggcagggacgtcacccacga

SEQ ID NO: 107124 - DNA, 25 bp, Mus musculus
acatgggcagggtcgtcacccacga

SEQ ID NO: 107125 - DNA, 25 bp, Mus musculus
acatgggcattgctcgactggcatg

SEQ ID NO: 107126 - DNA, 25 bp, Mus musculus
acatgggcattggtcgactggcatg

SEQ ID NO: 107127 - DNA, 25 bp, Mus musculus
acatgggccatccagataccagact

SEQ ID NO: 107128 - DNA, 25 bp, Mus musculus
acatgggccatcgagataccagact

SEQ ID NO: 107129 - DNA, 25 bp, Mus musculus
acatgggcccacaaaatttttatca

SEQ ID NO: 107130 - DNA, 25 bp, Mus musculus
acatgggcccactaaatttttatca

SEQ ID NO: 107131 - DNA, 25 bp, Mus musculus
acatgggcccagctaattgccagaa

SEQ ID NO: 107132 - DNA, 25 bp, Mus musculus
acatgggcccaggtaattgccagaa

SEQ ID NO: 107133 - DNA, 25 bp, Mus musculus
acatgggcccctaaaacacttggat

SEQ ID NO: 107134 - DNA, 25 bp, Mus musculus
acatgggccccttaaacacttggat

SEQ ID NO: 107135 - DNA, 25 bp, Mus musculus
acatgggcgcgcagcagtacagccc

SEQ ID NO: 107136 - DNA, 25 bp, Mus musculus
acatgggcgcgctgcagtacagccc

SEQ ID NO: 107137 - DNA, 25 bp, Mus musculus
acatgggcggtaaggccttgaccta

SEQ ID NO: 107138 - DNA, 25 bp, Mus musculus
acatgggcggtatggccttgaccta

SEQ ID NO: 107139 - DNA, 25 bp, Mus musculus
acatgggctcaaacttggcctgaga

SEQ ID NO: 107140 - DNA, 25 bp, Mus musculus
acatgggctcaatcttggcctgaga

SEQ ID NO: 107141 - DNA, 25 bp, Mus musculus
acatgggctgcaccaccacatggac

SEQ ID NO: 107142 - DNA, 25 bp, Mus musculus
acatgggctgcacgtacaaacgtaa

SEQ ID NO: 107143 - DNA, 25 bp, Mus musculus
acatgggctgcagcaccacatggac

SEQ ID NO: 107144 - DNA, 25 bp, Mus musculus
acatgggctgcaggtacaaacgtaa

SEQ ID NO: 107145 - DNA, 25 bp, Mus musculus
acatgggctggacgcagatgttcct

SEQ ID NO: 107146 - DNA, 25 bp, Mus musculus
acatgggctggaggcagatgttcct

SEQ ID NO: 107147 - DNA, 25 bp, Mus musculus
acatgggcttatcggcaggcttttt

SEQ ID NO: 107148 - DNA, 25 bp, Mus musculus
acatgggcttatgggcaggcttttt

SEQ ID NO: 107149 - DNA, 25 bp, Mus musculus
acatgggcttctaacaggtgcttct

SEQ ID NO: 107150 - DNA, 25 bp, Mus musculus
acatgggcttcttacaggtgcttct

SEQ ID NO: 107151 - DNA, 25 bp, Mus musculus
acatgggcttgtagggctactgcac

SEQ ID NO: 107152 - DNA, 25 bp, Mus musculus
acatgggcttgttgggctactgcac

SEQ ID NO: 107153 - DNA, 25 bp, Mus musculus
acatgggctttgacacagtggtggc

SEQ ID NO: 107154 - DNA, 25 bp, Mus musculus
acatgggctttgtcacagtggtggc

SEQ ID NO: 107155 - DNA, 25 bp, Mus musculus
acatgggcttttagagggcttttca

SEQ ID NO: 107156 - DNA, 25 bp, Mus musculus
acatgggctttttgagggcttttca

SEQ ID NO: 107157 - DNA, 25 bp, Mus musculus
acatgggtcactcgctcaccaggaa

SEQ ID NO: 107158 - DNA, 25 bp, Mus musculus
acatgggtcactggctcaccaggaa

SEQ ID NO: 107159 - DNA, 25 bp, Mus musculus
acatgggtcagtcagcacttgccag

SEQ ID NO: 107160 - DNA, 25 bp, Mus musculus
acatgggtcagtgagcacttgccag

SEQ ID NO: 107161 - DNA, 25 bp, Mus musculus
acatgggtcataactcactcccgag

SEQ ID NO: 107162 - DNA, 25 bp, Mus musculus
acatgggtcatatctcactcccgag

SEQ ID NO: 107163 - DNA, 25 bp, Mus musculus
acatgggtcatgagaatatttttcc

SEQ ID NO: 107164 - DNA, 25 bp, Mus musculus
acatgggtcatgcttcagtcaaaga

SEQ ID NO: 107165 - DNA, 25 bp, Mus musculus
acatgggtcatggttcagtcaaaga

SEQ ID NO: 107166 - DNA, 25 bp, Mus musculus
acatgggtcatgtgaatatttttcc

SEQ ID NO: 107167 - DNA, 25 bp, Mus musculus
acatgggtcattacctgatgcagca

SEQ ID NO: 107168 - DNA, 25 bp, Mus musculus
acatgggtcatttcctgatgcagca

SEQ ID NO: 107169 - DNA, 25 bp, Mus musculus
acatgggtccctcaatggttgctgt

SEQ ID NO: 107170 - DNA, 25 bp, Mus musculus
acatgggtccctgaatggttgctgt

SEQ ID NO: 107171 - DNA, 25 bp, Mus musculus
acatgggtccggcaaccgtgcctca

SEQ ID NO: 107172 - DNA, 25 bp, Mus musculus
acatgggtccgggaaccgtgcctca

SEQ ID NO: 107173 - DNA, 25 bp, Mus musculus
acatgggtcttgctaatgggaagta

SEQ ID NO: 107174 - DNA, 25 bp, Mus musculus
acatgggtcttggtaatgggaagta

SEQ ID NO: 107175 - DNA, 25 bp, Mus musculus
acatgggtgagccttgaaaatctac

SEQ ID NO: 107176 - DNA, 25 bp, Mus musculus
acatgggtgagcgttgaaaatctac

SEQ ID NO: 107177 - DNA, 25 bp, Mus musculus
acatgggtggcaaggccggccttca

SEQ ID NO: 107178 - DNA, 25 bp, Mus musculus
acatgggtggcatggccggccttca

SEQ ID NO: 107179 - DNA, 25 bp, Mus musculus
acatgggtgtatctgttgcattcat

SEQ ID NO: 107180 - DNA, 25 bp, Mus musculus
acatgggtgtatgtgttgcattcat

SEQ ID NO: 107181 - DNA, 25 bp, Mus musculus
acatgggttctgcatgccagcctgg

SEQ ID NO: 107182 - DNA, 25 bp, Mus musculus
acatgggttctggatgccagcctgg

SEQ ID NO: 107183 - DNA, 25 bp, Mus musculus
acatgggttcttaaggttgtggaga

SEQ ID NO: 107184 - DNA, 25 bp, Mus musculus
acatgggttctttaggttgtggaga

SEQ ID NO: 107185 - DNA, 25 bp, Mus musculus
acatgggtttctagccccaaactgg

SEQ ID NO: 107186 - DNA, 25 bp, Mus musculus
acatgggtttcttgccccaaactgg

SEQ ID NO: 107187 - DNA, 25 bp, Mus musculus
acatgggtttttcagcagtgcttct

SEQ ID NO: 107188 - DNA, 25 bp, Mus musculus
acatgggtttttgagcagtgcttct

SEQ ID NO: 107189 - DNA, 25 bp, Mus musculus
acatggtaaaagctgtctcctccct

SEQ ID NO: 107190 - DNA, 25 bp, Mus musculus
acatggtaaaaggtgtctcctccct

SEQ ID NO: 107191 - DNA, 25 bp, Mus musculus
acatggtacacaaaaactcacggaa

SEQ ID NO: 107192 - DNA, 25 bp, Mus musculus
acatggtacacataaactcacggaa

SEQ ID NO: 107193 - DNA, 25 bp, Mus musculus
acatggtacaggagccacctcggat

SEQ ID NO: 107194 - DNA, 25 bp, Mus musculus
acatggtacaggtgccacctcggat

SEQ ID NO: 107195 - DNA, 25 bp, Mus musculus
acatggtacattccagcatttccct

SEQ ID NO: 107196 - DNA, 25 bp, Mus musculus
acatggtacattgcagcatttccct

SEQ ID NO: 107197 - DNA, 25 bp, Mus musculus
acatggtacggcagatccgggctct

SEQ ID NO: 107198 - DNA, 25 bp, Mus musculus
acatggtacggctgatccgggctct

SEQ ID NO: 107199 - DNA, 25 bp, Mus musculus
acatggtactcaacgtgggctgaga

SEQ ID NO: 107200 - DNA, 25 bp, Mus musculus
acatggtactcatcgtgggctgaga

SEQ ID NO: 107201 - DNA, 25 bp, Mus musculus
acatggtagggcaggcctgtctcct

SEQ ID NO: 107202 - DNA, 25 bp, Mus musculus
acatggtagggctggcctgtctcct

SEQ ID NO: 107203 - DNA, 25 bp, Mus musculus
acatggtaggtcacacagttccaga

SEQ ID NO: 107204 - DNA, 25 bp, Mus musculus
acatggtaggtctcacagttccaga

SEQ ID NO: 107205 - DNA, 25 bp, Mus musculus
acatggtagttgacattcagagaga

SEQ ID NO: 107206 - DNA, 25 bp, Mus musculus
acatggtagttgtcattcagagaga

SEQ ID NO: 107207 - DNA, 25 bp, Mus musculus
acatggtatctgaacctgggtccta

SEQ ID NO: 107208 - DNA, 25 bp, Mus musculus
acatggtatctgtacctgggtccta

SEQ ID NO: 107209 - DNA, 25 bp, Mus musculus
acatggtatgtcaccagtcagtggg

SEQ ID NO: 107210 - DNA, 25 bp, Mus musculus
acatggtatgtctccagtcagtggg

SEQ ID NO: 107211 - DNA, 25 bp, Mus musculus
acatggtattctctgttcccattca

SEQ ID NO: 107212 - DNA, 25 bp, Mus musculus
acatggtattctgtgttcccattca

SEQ ID NO: 107213 - DNA, 25 bp, Mus musculus
acatggtcacaacacatccctgaga

SEQ ID NO: 107214 - DNA, 25 bp, Mus musculus
acatggtcacaagacatccctgaga

SEQ ID NO: 107215 - DNA, 25 bp, Mus musculus
acatggtcacatcccactgagttat

SEQ ID NO: 107216 - DNA, 25 bp, Mus musculus
acatggtcacatgccactgagttat

SEQ ID NO: 107217 - DNA, 25 bp, Mus musculus
acatggtcacctctttatatggcac

SEQ ID NO: 107218 - DNA, 25 bp, Mus musculus
acatggtcacctgtttatatggcac

SEQ ID NO: 107219 - DNA, 25 bp, Mus musculus
acatggtccaaacatttcttctctc

SEQ ID NO: 107220 - DNA, 25 bp, Mus musculus
acatggtccaaagatttcttctctc

SEQ ID NO: 107221 - DNA, 25 bp, Mus musculus
acatggtctcagcagtgaaacagaa

SEQ ID NO: 107222 - DNA, 25 bp, Mus musculus
acatggtctcaggagtgaaacagaa

SEQ ID NO: 107223 - DNA, 25 bp, Mus musculus
acatggtctcttcgtcaccctaatt

SEQ ID NO: 107224 - DNA, 25 bp, Mus musculus
acatggtctcttggtcaccctaatt

SEQ ID NO: 107225 - DNA, 25 bp, Mus musculus
acatggtctgaacaacctgcccaca

SEQ ID NO: 107226 - DNA, 25 bp, Mus musculus
acatggtctgaagaacctgcccaca

SEQ ID NO: 107227 - DNA, 25 bp, Mus musculus
acatggtctgtgatttcttatgcat

SEQ ID NO: 107228 - DNA, 25 bp, Mus musculus
acatggtctgtgttttcttatgcat

SEQ ID NO: 107229 - DNA, 25 bp, Mus musculus
acatggtcttacaaactgctgcagc

SEQ ID NO: 107230 - DNA, 25 bp, Mus musculus
acatggtcttactaactgctgcagc

SEQ ID NO: 107231 - DNA, 25 bp, Mus musculus
acatggtctttaaggcgtaccgctc

SEQ ID NO: 107232 - DNA, 25 bp, Mus musculus
acatggtctttatggcgtaccgctc

SEQ ID NO: 107233 - DNA, 25 bp, Mus musculus
acatggtgactcaaggctgactata

SEQ ID NO: 107234 - DNA, 25 bp, Mus musculus
acatggtgactctaggctgactata

SEQ ID NO: 107235 - DNA, 25 bp, Mus musculus
acatggtgatcgatgctgttctggg

SEQ ID NO: 107236 - DNA, 25 bp, Mus musculus
acatggtgatcgttgctgttctggg

SEQ ID NO: 107237 - DNA, 25 bp, Mus musculus
acatggtgatttacgtactggtact

SEQ ID NO: 107238 - DNA, 25 bp, Mus musculus
acatggtgattttcgtactggtact

SEQ ID NO: 107239 - DNA, 25 bp, Mus musculus
acatggtgcaacacaggagcagcta

SEQ ID NO: 107240 - DNA, 25 bp, Mus musculus
acatggtgcaactcaggagcagcta

SEQ ID NO: 107241 - DNA, 25 bp, Mus musculus
acatggtgcatacaagggttgtccc

SEQ ID NO: 107242 - DNA, 25 bp, Mus musculus
acatggtgcatagaagggttgtccc

SEQ ID NO: 107243 - DNA, 25 bp, Mus musculus
acatggtgctcaaagtacctcctgc

SEQ ID NO: 107244 - DNA, 25 bp, Mus musculus
acatggtgctcatagtacctcctgc

SEQ ID NO: 107245 - DNA, 25 bp, Mus musculus
acatggtgcttactggtcctggcaa

SEQ ID NO: 107246 - DNA, 25 bp, Mus musculus
acatggtgcttagtggtcctggcaa

SEQ ID NO: 107247 - DNA, 25 bp, Mus musculus
acatggtgcttcctagccacaaatg

SEQ ID NO: 107248 - DNA, 25 bp, Mus musculus
acatggtgcttcgtagccacaaatg

SEQ ID NO: 107249 - DNA, 25 bp, Mus musculus
acatggtggcccatgcaggtgcgta

SEQ ID NO: 107250 - DNA, 25 bp, Mus musculus
acatggtggcccttgcaggtgcgta

SEQ ID NO: 107251 - DNA, 25 bp, Mus musculus
acatggtggcgtacctgctctagga

SEQ ID NO: 107252 - DNA, 25 bp, Mus musculus
acatggtggcgtccaactcctctgg

SEQ ID NO: 107253 - DNA, 25 bp, Mus musculus
acatggtggcgtgcaactcctctgg

SEQ ID NO: 107254 - DNA, 25 bp, Mus musculus
acatggtggcgttcctgctctagga

SEQ ID NO: 107255 - DNA, 25 bp, Mus musculus
acatggtggctcaactagtctgtta

SEQ ID NO: 107256 - DNA, 25 bp, Mus musculus
acatggtggctcatcctctgcgtgg

SEQ ID NO: 107257 - DNA, 25 bp, Mus musculus
acatggtggctctactagtctgtta

SEQ ID NO: 107258 - DNA, 25 bp, Mus musculus
acatggtggctcttcctctgcgtgg

SEQ ID NO: 107259 - DNA, 25 bp, Mus musculus
acatggtggcttccagaggtctgta

SEQ ID NO: 107260 - DNA, 25 bp, Mus musculus
acatggtggcttgcagaggtctgta

SEQ ID NO: 107261 - DNA, 25 bp, Mus musculus
acatggtgggaaattgccaggaacc

SEQ ID NO: 107262 - DNA, 25 bp, Mus musculus
acatggtgggaatttgccaggaacc

SEQ ID NO: 107263 - DNA, 25 bp, Mus musculus
acatggtgggtgatagcccttcagt

SEQ ID NO: 107264 - DNA, 25 bp, Mus musculus
acatggtgggtgttagcccttcagt

SEQ ID NO: 107265 - DNA, 25 bp, Mus musculus
acatggtgtgagaacctcgctctaa

SEQ ID NO: 107266 - DNA, 25 bp, Mus musculus
acatggtgtgagtacctcgctctaa

SEQ ID NO: 107267 - DNA, 25 bp, Mus musculus
acatggtgtggccaccacccacgtt

SEQ ID NO: 107268 - DNA, 25 bp, Mus musculus
acatggtgtggcgaccacccacgtt

SEQ ID NO: 107269 - DNA, 25 bp, Mus musculus
acatggtgtgtcatgatttgccctc

SEQ ID NO: 107270 - DNA, 25 bp, Mus musculus
acatggtgtgtcttgatttgccctc

SEQ ID NO: 107271 - DNA, 25 bp, Mus musculus
acatggttaattctaccctgcagga

SEQ ID NO: 107272 - DNA, 25 bp, Mus musculus
acatggttaattgtaccctgcagga

SEQ ID NO: 107273 - DNA, 25 bp, Mus musculus
acatggttacatatacatatgttca

SEQ ID NO: 107274 - DNA, 25 bp, Mus musculus
acatggttacatttacatatgttca

SEQ ID NO: 107275 - DNA, 25 bp, Mus musculus
acatggttacttctgtcactggaca

SEQ ID NO: 107276 - DNA, 25 bp, Mus musculus
acatggttacttgtgtcactggaca

SEQ ID NO: 107277 - DNA, 25 bp, Mus musculus
acatggttccatctaggcagacttt

SEQ ID NO: 107278 - DNA, 25 bp, Mus musculus
acatggttccatgtaggcagacttt

SEQ ID NO: 107279 - DNA, 25 bp, Mus musculus
acatggttccttagtttgtccccag

SEQ ID NO: 107280 - DNA, 25 bp, Mus musculus
acatggttcctttgtttgtccccag

SEQ ID NO: 107281 - DNA, 25 bp, Mus musculus
acatggttctggctttacagtcaag

SEQ ID NO: 107282 - DNA, 25 bp, Mus musculus
acatggttctgggtttacagtcaag

SEQ ID NO: 107283 - DNA, 25 bp, Mus musculus
acatggttctgtcaggtgctgatat

SEQ ID NO: 107284 - DNA, 25 bp, Mus musculus
acatggttctgtgaggtgctgatat

SEQ ID NO: 107285 - DNA, 25 bp, Mus musculus
acatggttgaataagccctgggtcc

SEQ ID NO: 107286 - DNA, 25 bp, Mus musculus
acatggttgaattagccctgggtcc

SEQ ID NO: 107287 - DNA, 25 bp, Mus musculus
acatggttgccacagagtccctaag

SEQ ID NO: 107288 - DNA, 25 bp, Mus musculus
acatggttgccagagagtccctaag

SEQ ID NO: 107289 - DNA, 25 bp, Mus musculus
acatggttgcctaactttctgtgag

SEQ ID NO: 107290 - DNA, 25 bp, Mus musculus
acatggttgccttactttctgtgag

SEQ ID NO: 107291 - DNA, 25 bp, Mus musculus
acatggttgctgagaagcggctcat

SEQ ID NO: 107292 - DNA, 25 bp, Mus musculus
acatggttgctgaggcagtgtgcac

SEQ ID NO: 107293 - DNA, 25 bp, Mus musculus
acatggttgctgtgaagcggctcat

SEQ ID NO: 107294 - DNA, 25 bp, Mus musculus
acatggttgctgtggcagtgtgcac

SEQ ID NO: 107295 - DNA, 25 bp, Mus musculus
acatggttggccagactttgtctcc

SEQ ID NO: 107296 - DNA, 25 bp, Mus musculus
acatggttggcctgactttgtctcc

SEQ ID NO: 107297 - DNA, 25 bp, Mus musculus
acatggttgggcaatttcgtcaata

SEQ ID NO: 107298 - DNA, 25 bp, Mus musculus
acatggttgggctatttcgtcaata

SEQ ID NO: 107299 - DNA, 25 bp, Mus musculus
acatggttgttaccttagaccacta

SEQ ID NO: 107300 - DNA, 25 bp, Mus musculus
acatggttgttagcttagaccacta

SEQ ID NO: 107301 - DNA, 25 bp, Mus musculus
acatggtttcagaggtcttcaggct

SEQ ID NO: 107302 - DNA, 25 bp, Mus musculus
acatggtttcagtggtcttcaggct

SEQ ID NO: 107303 - DNA, 25 bp, Mus musculus
acatggtttggaagcttctatattg

SEQ ID NO: 107304 - DNA, 25 bp, Mus musculus
acatggtttggatgcttctatattg

SEQ ID NO: 107305 - DNA, 25 bp, Mus musculus
acatggtttttaacgtgtccgtgta

SEQ ID NO: 107306 - DNA, 25 bp, Mus musculus
acatggtttttatcgtgtccgtgta

SEQ ID NO: 107307 - DNA, 25 bp, Mus musculus
acatggtttttgactgtgtcacctt

SEQ ID NO: 107308 - DNA, 25 bp, Mus musculus
acatggtttttgtctgtgtcacctt

SEQ ID NO: 107309 - DNA, 25 bp, Mus musculus
acatgtaaacacattcttactagaa

SEQ ID NO: 107310 - DNA, 25 bp, Mus musculus
acatgtaaacactttcttactagaa

SEQ ID NO: 107311 - DNA, 25 bp, Mus musculus
acatgtaaagggagtgttgtagact

SEQ ID NO: 107312 - DNA, 25 bp, Mus musculus
acatgtaaagggtgtgttgtagact

SEQ ID NO: 107313 - DNA, 25 bp, Mus musculus
acatgtaacaacacctgcagatcga

SEQ ID NO: 107314 - DNA, 25 bp, Mus musculus
acatgtaacaactcctgcagatcga

SEQ ID NO: 107315 - DNA, 25 bp, Mus musculus
acatgtaacacaagaccactgagga

SEQ ID NO: 107316 - DNA, 25 bp, Mus musculus
acatgtaacacatgaccactgagga

SEQ ID NO: 107317 - DNA, 25 bp, Mus musculus
acatgtaactgacgccaagctgtct

SEQ ID NO: 107318 - DNA, 25 bp, Mus musculus
acatgtaactgaggccaagctgtct

SEQ ID NO: 107319 - DNA, 25 bp, Mus musculus
acatgtaagccaagtctgggccctg

SEQ ID NO: 107320 - DNA, 25 bp, Mus musculus
acatgtaagccatgtctgggccctg

SEQ ID NO: 107321 - DNA, 25 bp, Mus musculus
acatgtaatagaatttttccaaggg

SEQ ID NO: 107322 - DNA, 25 bp, Mus musculus
acatgtaatagattttttccaaggg

SEQ ID NO: 107323 - DNA, 25 bp, Mus musculus
acatgtaatctgcttacttctgtaa

SEQ ID NO: 107324 - DNA, 25 bp, Mus musculus
acatgtaatctggttacttctgtaa

SEQ ID NO: 107325 - DNA, 25 bp, Mus musculus
acatgtaatgtgagcctgtgctcct

SEQ ID NO: 107326 - DNA, 25 bp, Mus musculus
acatgtaatgtgtgcctgtgctcct

SEQ ID NO: 107327 - DNA, 25 bp, Mus musculus
acatgtaattgtcaggttttggcca

SEQ ID NO: 107328 - DNA, 25 bp, Mus musculus
acatgtaattgtgaggttttggcca

SEQ ID NO: 107329 - DNA, 25 bp, Mus musculus
acatgtaatttacagcttcttcagt

SEQ ID NO: 107330 - DNA, 25 bp, Mus musculus
acatgtaatttagagcttcttcagt

SEQ ID NO: 107331 - DNA, 25 bp, Mus musculus
acatgtacaagcaccgcacaaacct

SEQ ID NO: 107332 - DNA, 25 bp, Mus musculus
acatgtacaagctccgcacaaacct

SEQ ID NO: 107333 - DNA, 25 bp, Mus musculus
acatgtacagcgaccctttgacatt

SEQ ID NO: 107334 - DNA, 25 bp, Mus musculus
acatgtacagcgtccctttgacatt

SEQ ID NO: 107335 - DNA, 25 bp, Mus musculus
acatgtaccatcaagtctggcttta

SEQ ID NO: 107336 - DNA, 25 bp, Mus musculus
acatgtaccatctagtctggcttta

SEQ ID NO: 107337 - DNA, 25 bp, Mus musculus
acatgtacccagcaaagttctccag

SEQ ID NO: 107338 - DNA, 25 bp, Mus musculus
acatgtacccaggaaagttctccag

SEQ ID NO: 107339 - DNA, 25 bp, Mus musculus
acatgtacccttccatactgttcca

SEQ ID NO: 107340 - DNA, 25 bp, Mus musculus
acatgtacccttgcatactgttcca

SEQ ID NO: 107341 - DNA, 25 bp, Mus musculus
acatgtacctgaaactctgctgtca

SEQ ID NO: 107342 - DNA, 25 bp, Mus musculus
acatgtacctgatactctgctgtca

SEQ ID NO: 107343 - DNA, 25 bp, Mus musculus
acatgtacctggcatcggcccggct

SEQ ID NO: 107344 - DNA, 25 bp, Mus musculus
acatgtacctgggatcggcccggct

SEQ ID NO: 107345 - DNA, 25 bp, Mus musculus
acatgtactacccacttgttgttag

SEQ ID NO: 107346 - DNA, 25 bp, Mus musculus
acatgtactaccgacttgttgttag

SEQ ID NO: 107347 - DNA, 25 bp, Mus musculus
acatgtactattactccgagctagc

SEQ ID NO: 107348 - DNA, 25 bp, Mus musculus
acatgtactatttctccgagctagc

SEQ ID NO: 107349 - DNA, 25 bp, Mus musculus
acatgtactgatcagcctggtggtc

SEQ ID NO: 107350 - DNA, 25 bp, Mus musculus
acatgtactgatgagcctggtggtc

SEQ ID NO: 107351 - DNA, 25 bp, Mus musculus
acatgtagaagtctttgtccagaac

SEQ ID NO: 107352 - DNA, 25 bp, Mus musculus
acatgtagaagtgtttgtccagaac

SEQ ID NO: 107353 - DNA, 25 bp, Mus musculus
acatgtagaatccagattccctgag

SEQ ID NO: 107354 - DNA, 25 bp, Mus musculus
acatgtagaatcgagattccctgag

SEQ ID NO: 107355 - DNA, 25 bp, Mus musculus
acatgtagaccaactccatcagctg

SEQ ID NO: 107356 - DNA, 25 bp, Mus musculus
acatgtagaccatctccatcagctg

SEQ ID NO: 107357 - DNA, 25 bp, Mus musculus
acatgtagattgaggccaagtccct

SEQ ID NO: 107358 - DNA, 25 bp, Mus musculus
acatgtagattgtggccaagtccct

SEQ ID NO: 107359 - DNA, 25 bp, Mus musculus
acatgtagctgcagggtctctgtgg

SEQ ID NO: 107360 - DNA, 25 bp, Mus musculus
acatgtagctgctgggtctctgtgg

SEQ ID NO: 107361 - DNA, 25 bp, Mus musculus
acatgtagcttactggtgggatcaa

SEQ ID NO: 107362 - DNA, 25 bp, Mus musculus
acatgtagcttagtggtgggatcaa

SEQ ID NO: 107363 - DNA, 25 bp, Mus musculus
acatgtaggagcatgtctaggcccc

SEQ ID NO: 107364 - DNA, 25 bp, Mus musculus
acatgtaggagcttgtctaggcccc

SEQ ID NO: 107365 - DNA, 25 bp, Mus musculus
acatgtaggaggatggccaagacat

SEQ ID NO: 107366 - DNA, 25 bp, Mus musculus
acatgtaggaggttggccaagacat

SEQ ID NO: 107367 - DNA, 25 bp, Mus musculus
acatgtaggccacgtgagggtttca

SEQ ID NO: 107368 - DNA, 25 bp, Mus musculus
acatgtaggccaggtgagggtttca

SEQ ID NO: 107369 - DNA, 25 bp, Mus musculus
acatgtaggcttctgccagttgcac

SEQ ID NO: 107370 - DNA, 25 bp, Mus musculus
acatgtaggcttgtgccagttgcac

SEQ ID NO: 107371 - DNA, 25 bp, Mus musculus
acatgtagggccaactctaaaggtc

SEQ ID NO: 107372 - DNA, 25 bp, Mus musculus
acatgtagggcctactctaaaggtc

SEQ ID NO: 107373 - DNA, 25 bp, Mus musculus
acatgtagtgttaactctgccagta

SEQ ID NO: 107374 - DNA, 25 bp, Mus musculus
acatgtagtgtttactctgccagta

SEQ ID NO: 107375 - DNA, 25 bp, Mus musculus
acatgtatactgaaccctatagtta

SEQ ID NO: 107376 - DNA, 25 bp, Mus musculus
acatgtatactgtaccctatagtta

SEQ ID NO: 107377 - DNA, 25 bp, Mus musculus
acatgtatagctctcacacggctgt

SEQ ID NO: 107378 - DNA, 25 bp, Mus musculus
acatgtatagctgtcacacggctgt

SEQ ID NO: 107379 - DNA, 25 bp, Mus musculus
acatgtatccccatattatctttcg

SEQ ID NO: 107380 - DNA, 25 bp, Mus musculus
acatgtatccccttattatctttcg

SEQ ID NO: 107381 - DNA, 25 bp, Mus musculus
acatgtatcctcagatcctgatagt

SEQ ID NO: 107382 - DNA, 25 bp, Mus musculus
acatgtatcctctgatcctgatagt

SEQ ID NO: 107383 - DNA, 25 bp, Mus musculus
acatgtatcctgaatttctcctggc

SEQ ID NO: 107384 - DNA, 25 bp, Mus musculus
acatgtatcctgtatttctcctggc

SEQ ID NO: 107385 - DNA, 25 bp, Mus musculus
acatgtatctctactctattgtaag

SEQ ID NO: 107386 - DNA, 25 bp, Mus musculus
acatgtatctcttctctattgtaag

SEQ ID NO: 107387 - DNA, 25 bp, Mus musculus
acatgtatcttgcaggtgaattccc

SEQ ID NO: 107388 - DNA, 25 bp, Mus musculus
acatgtatcttggaggtgaattccc

SEQ ID NO: 107389 - DNA, 25 bp, Mus musculus
acatgtatgcaactacccagaggta

SEQ ID NO: 107390 - DNA, 25 bp, Mus musculus
acatgtatgcaagtacccagaggta

SEQ ID NO: 107391 - DNA, 25 bp, Mus musculus
acatgtatgcatagaagggtctgaa

SEQ ID NO: 107392 - DNA, 25 bp, Mus musculus
acatgtatgcattgaagggtctgaa

SEQ ID NO: 107393 - DNA, 25 bp, Mus musculus
acatgtatgcgacggtcaccgggtc

SEQ ID NO: 107394 - DNA, 25 bp, Mus musculus
acatgtatgcgagggtcaccgggtc

SEQ ID NO: 107395 - DNA, 25 bp, Mus musculus
acatgtatggcccatgtggtggctc

SEQ ID NO: 107396 - DNA, 25 bp, Mus musculus
acatgtatggccgatgtggtggctc

SEQ ID NO: 107397 - DNA, 25 bp, Mus musculus
acatgtatgtatctaaccacattca

SEQ ID NO: 107398 - DNA, 25 bp, Mus musculus
acatgtatgtatgtaaccacattca

SEQ ID NO: 107399 - DNA, 25 bp, Mus musculus
acatgtatgtgtcttctttccatgg

SEQ ID NO: 107400 - DNA, 25 bp, Mus musculus
acatgtatgtgtgttctttccatgg

SEQ ID NO: 107401 - DNA, 25 bp, Mus musculus
acatgtattaagatccctggtatct

SEQ ID NO: 107402 - DNA, 25 bp, Mus musculus
acatgtattaagttccctggtatct

SEQ ID NO: 107403 - DNA, 25 bp, Mus musculus
acatgtattactatcatcacttgaa

SEQ ID NO: 107404 - DNA, 25 bp, Mus musculus
acatgtattactttcatcacttgaa

SEQ ID NO: 107405 - DNA, 25 bp, Mus musculus
acatgtattagtcttcctgagagat

SEQ ID NO: 107406 - DNA, 25 bp, Mus musculus
acatgtattagtgttcctgagagat

SEQ ID NO: 107407 - DNA, 25 bp, Mus musculus
acatgtcaccaacctcgcgaggaaa

SEQ ID NO: 107408 - DNA, 25 bp, Mus musculus
acatgtcaccaagctcgcgaggaaa

SEQ ID NO: 107409 - DNA, 25 bp, Mus musculus
acatgtcaccacctgtgctttgaga

SEQ ID NO: 107410 - DNA, 25 bp, Mus musculus
acatgtcaccacgtgtgctttgaga

SEQ ID NO: 107411 - DNA, 25 bp, Mus musculus
acatgtcactctccaggtgccgggc

SEQ ID NO: 107412 - DNA, 25 bp, Mus musculus
acatgtcactctgcaggtgccgggc

SEQ ID NO: 107413 - DNA, 25 bp, Mus musculus
acatgtcactttcccttgcatagtt

SEQ ID NO: 107414 - DNA, 25 bp, Mus musculus
acatgtcactttgccttgcatagtt

SEQ ID NO: 107415 - DNA, 25 bp, Mus musculus
acatgtcagcaaacagccatactca

SEQ ID NO: 107416 - DNA, 25 bp, Mus musculus
acatgtcagcaatcagccatactca

SEQ ID NO: 107417 - DNA, 25 bp, Mus musculus
acatgtcagctaattgtttgccaaa

SEQ ID NO: 107418 - DNA, 25 bp, Mus musculus
acatgtcagctatttgtttgccaaa

SEQ ID NO: 107419 - DNA, 25 bp, Mus musculus
acatgtcaggaaatgcaacgtggca

SEQ ID NO: 107420 - DNA, 25 bp, Mus musculus
acatgtcaggaattgcaacgtggca

SEQ ID NO: 107421 - DNA, 25 bp, Mus musculus
acatgtcattctatcactgtcaggg

SEQ ID NO: 107422 - DNA, 25 bp, Mus musculus
acatgtcattctttcactgtcaggg

SEQ ID NO: 107423 - DNA, 25 bp, Mus musculus
acatgtccaactactatatagccta

SEQ ID NO: 107424 - DNA, 25 bp, Mus musculus
acatgtccaacttctatatagccta

SEQ ID NO: 107425 - DNA, 25 bp, Mus musculus
acatgtccaagtatttacagtacgg

SEQ ID NO: 107426 - DNA, 25 bp, Mus musculus
acatgtccaagtttttacagtacgg

SEQ ID NO: 107427 - DNA, 25 bp, Mus musculus
acatgtccacggatatgagccggaa

SEQ ID NO: 107428 - DNA, 25 bp, Mus musculus
acatgtccacggttatgagccggaa

SEQ ID NO: 107429 - DNA, 25 bp, Mus musculus
acatgtccagtgagtactcgagata

SEQ ID NO: 107430 - DNA, 25 bp, Mus musculus
acatgtccagtgtgtactcgagata

SEQ ID NO: 107431 - DNA, 25 bp, Mus musculus
acatgtccatttcctaacagttgag

SEQ ID NO: 107432 - DNA, 25 bp, Mus musculus
acatgtccatttgctaacagttgag

SEQ ID NO: 107433 - DNA, 25 bp, Mus musculus
acatgtcccaggactcctaacacgt

SEQ ID NO: 107434 - DNA, 25 bp, Mus musculus
acatgtcccaggtctcctaacacgt

SEQ ID NO: 107435 - DNA, 25 bp, Mus musculus
acatgtcccagtctgtattcatatg

SEQ ID NO: 107436 - DNA, 25 bp, Mus musculus
acatgtcccagtgtgtattcatatg

SEQ ID NO: 107437 - DNA, 25 bp, Mus musculus
acatgtcccattcgctcagcaagga

SEQ ID NO: 107438 - DNA, 25 bp, Mus musculus
acatgtcccattggctcagcaagga

SEQ ID NO: 107439 - DNA, 25 bp, Mus musculus
acatgtccccatagattttagtgag

SEQ ID NO: 107440 - DNA, 25 bp, Mus musculus
acatgtccccatagctgatcagaac

SEQ ID NO: 107441 - DNA, 25 bp, Mus musculus
acatgtccccattgattttagtgag

SEQ ID NO: 107442 - DNA, 25 bp, Mus musculus
acatgtccccattgctgatcagaac

SEQ ID NO: 107443 - DNA, 25 bp, Mus musculus
acatgtcccgtgattgtaagcccaa

SEQ ID NO: 107444 - DNA, 25 bp, Mus musculus
acatgtcccgtgtttgtaagcccaa

SEQ ID NO: 107445 - DNA, 25 bp, Mus musculus
acatgtccctatccagtgagcacac

SEQ ID NO: 107446 - DNA, 25 bp, Mus musculus
acatgtccctatgcagtgagcacac

SEQ ID NO: 107447 - DNA, 25 bp, Mus musculus
acatgtcccttcaagtcggtaacta

SEQ ID NO: 107448 - DNA, 25 bp, Mus musculus
acatgtcccttctagtcggtaacta

SEQ ID NO: 107449 - DNA, 25 bp, Mus musculus
acatgtccctttaagatttatcgaa

SEQ ID NO: 107450 - DNA, 25 bp, Mus musculus
acatgtccctttatactagctatga

SEQ ID NO: 107451 - DNA, 25 bp, Mus musculus
acatgtcccttttagatttatcgaa

SEQ ID NO: 107452 - DNA, 25 bp, Mus musculus
acatgtccctttttactagctatga

SEQ ID NO: 107453 - DNA, 25 bp, Mus musculus
acatgtccgatacccatcatggcaa

SEQ ID NO: 107454 - DNA, 25 bp, Mus musculus
acatgtccgatagccatcatggcaa

SEQ ID NO: 107455 - DNA, 25 bp, Mus musculus
acatgtcctctacacacgtgccatg

SEQ ID NO: 107456 - DNA, 25 bp, Mus musculus
acatgtcctctagacacgtgccatg

SEQ ID NO: 107457 - DNA, 25 bp, Mus musculus
acatgtcctgcacgtgtcttgaact

SEQ ID NO: 107458 - DNA, 25 bp, Mus musculus
acatgtcctgcaggtgtcttgaact

SEQ ID NO: 107459 - DNA, 25 bp, Mus musculus
acatgtcctgccaactttctgtcaa

SEQ ID NO: 107460 - DNA, 25 bp, Mus musculus
acatgtcctgcctactttctgtcaa

SEQ ID NO: 107461 - DNA, 25 bp, Mus musculus
acatgtcctggtcttcattctttat

SEQ ID NO: 107462 - DNA, 25 bp, Mus musculus
acatgtcctggtgttcattctttat

SEQ ID NO: 107463 - DNA, 25 bp, Mus musculus
acatgtcgacctcattttgagacta

SEQ ID NO: 107464 - DNA, 25 bp, Mus musculus
acatgtcgacctgattttgagacta

SEQ ID NO: 107465 - DNA, 25 bp, Mus musculus
acatgtcgatggcagtctactttga

SEQ ID NO: 107466 - DNA, 25 bp, Mus musculus
acatgtcgatgggagtctactttga

SEQ ID NO: 107467 - DNA, 25 bp, Mus musculus
acatgtcgattcacgatgtgtcagt

SEQ ID NO: 107468 - DNA, 25 bp, Mus musculus
acatgtcgattctcgatgtgtcagt

SEQ ID NO: 107469 - DNA, 25 bp, Mus musculus
acatgtctaagaaagtccacaggct

SEQ ID NO: 107470 - DNA, 25 bp, Mus musculus
acatgtctaagatagtccacaggct

SEQ ID NO: 107471 - DNA, 25 bp, Mus musculus
acatgtctagaacgagctctgcccc

SEQ ID NO: 107472 - DNA, 25 bp, Mus musculus
acatgtctagaaggagctctgcccc

SEQ ID NO: 107473 - DNA, 25 bp, Mus musculus
acatgtctatgacggttcggcgcca

SEQ ID NO: 107474 - DNA, 25 bp, Mus musculus
acatgtctatgagggttcggcgcca

SEQ ID NO: 107475 - DNA, 25 bp, Mus musculus
acatgtctcaatccatagaagtctt

SEQ ID NO: 107476 - DNA, 25 bp, Mus musculus
acatgtctcaatgcatagaagtctt

SEQ ID NO: 107477 - DNA, 25 bp, Mus musculus
acatgtctcataaaactccatcatt

SEQ ID NO: 107478 - DNA, 25 bp, Mus musculus
acatgtctcataaccgtgtccagaa

SEQ ID NO: 107479 - DNA, 25 bp, Mus musculus
acatgtctcatataactccatcatt

SEQ ID NO: 107480 - DNA, 25 bp, Mus musculus
acatgtctcatatccgtgtccagaa

SEQ ID NO: 107481 - DNA, 25 bp, Mus musculus
acatgtctctgtcaacgggttgaaa

SEQ ID NO: 107482 - DNA, 25 bp, Mus musculus
acatgtctctgtctgcaacttacaa

SEQ ID NO: 107483 - DNA, 25 bp, Mus musculus
acatgtctctgtgaacgggttgaaa

SEQ ID NO: 107484 - DNA, 25 bp, Mus musculus
acatgtctctgtgtgcaacttacaa

SEQ ID NO: 107485 - DNA, 25 bp, Mus musculus
acatgtctgaagcacaggctggatt

SEQ ID NO: 107486 - DNA, 25 bp, Mus musculus
acatgtctgaaggacaggctggatt

SEQ ID NO: 107487 - DNA, 25 bp, Mus musculus
acatgtctgaatatcttaggcccat

SEQ ID NO: 107488 - DNA, 25 bp, Mus musculus
acatgtctgaatttcttaggcccat

SEQ ID NO: 107489 - DNA, 25 bp, Mus musculus
acatgtctgaggaccaagcctacat

SEQ ID NO: 107490 - DNA, 25 bp, Mus musculus
acatgtctgaggtccaagcctacat

SEQ ID NO: 107491 - DNA, 25 bp, Mus musculus
acatgtctgagtcttaccttttttc

SEQ ID NO: 107492 - DNA, 25 bp, Mus musculus
acatgtctgagtgttaccttttttc

SEQ ID NO: 107493 - DNA, 25 bp, Mus musculus
acatgtctgatgcacagcttccagg

SEQ ID NO: 107494 - DNA, 25 bp, Mus musculus
acatgtctgatggacagcttccagg

SEQ ID NO: 107495 - DNA, 25 bp, Mus musculus
acatgtctgcaaagtggtgggtcta

SEQ ID NO: 107496 - DNA, 25 bp, Mus musculus
acatgtctgcaatgtggtgggtcta

SEQ ID NO: 107497 - DNA, 25 bp, Mus musculus
acatgtctgctaaggaacgtttccg

SEQ ID NO: 107498 - DNA, 25 bp, Mus musculus
acatgtctgctatggaacgtttccg

SEQ ID NO: 107499 - DNA, 25 bp, Mus musculus
acatgtctggagagtctggctggct

SEQ ID NO: 107500 - DNA, 25 bp, Mus musculus
acatgtctggagtgtctggctggct

SEQ ID NO: 107501 - DNA, 25 bp, Mus musculus
acatgtcttcttcttgagcctacta

SEQ ID NO: 107502 - DNA, 25 bp, Mus musculus
acatgtcttcttgttgagcctacta

SEQ ID NO: 107503 - DNA, 25 bp, Mus musculus
acatgtcttgagcttcttggtgcta

SEQ ID NO: 107504 - DNA, 25 bp, Mus musculus
acatgtcttgaggttcttggtgcta

SEQ ID NO: 107505 - DNA, 25 bp, Mus musculus
acatgtcttggcacacaggaaaagg

SEQ ID NO: 107506 - DNA, 25 bp, Mus musculus
acatgtcttggctcacaggaaaagg

SEQ ID NO: 107507 - DNA, 25 bp, Mus musculus
acatgtgaaaagagacttctggagt

SEQ ID NO: 107508 - DNA, 25 bp, Mus musculus
acatgtgaaaagtgacttctggagt

SEQ ID NO: 107509 - DNA, 25 bp, Mus musculus
acatgtgaccctcgatagaattgta

SEQ ID NO: 107510 - DNA, 25 bp, Mus musculus
acatgtgaccctggatagaattgta

SEQ ID NO: 107511 - DNA, 25 bp, Mus musculus
acatgtgaccttatctcaaaaacaa

SEQ ID NO: 107512 - DNA, 25 bp, Mus musculus
acatgtgaccttttctcaaaaacaa

SEQ ID NO: 107513 - DNA, 25 bp, Mus musculus
acatgtgactcacgacctacggatt

SEQ ID NO: 107514 - DNA, 25 bp, Mus musculus
acatgtgactcaggacctacggatt

SEQ ID NO: 107515 - DNA, 25 bp, Mus musculus
acatgtgacttgaccatttccggct

SEQ ID NO: 107516 - DNA, 25 bp, Mus musculus
acatgtgacttgtccatttccggct

SEQ ID NO: 107517 - DNA, 25 bp, Mus musculus
acatgtgagatcagtgcctacgctg

SEQ ID NO: 107518 - DNA, 25 bp, Mus musculus
acatgtgagatctgtgcctacgctg

SEQ ID NO: 107519 - DNA, 25 bp, Mus musculus
acatgtgagcccctgggtgattctc

SEQ ID NO: 107520 - DNA, 25 bp, Mus musculus
acatgtgagcccgtgggtgattctc

SEQ ID NO: 107521 - DNA, 25 bp, Mus musculus
acatgtgatgtcctgactccctgaa

SEQ ID NO: 107522 - DNA, 25 bp, Mus musculus
acatgtgatgtcgtgactccctgaa

SEQ ID NO: 107523 - DNA, 25 bp, Mus musculus
acatgtgattacagttggccaattt

SEQ ID NO: 107524 - DNA, 25 bp, Mus musculus
acatgtgattactgttggccaattt

SEQ ID NO: 107525 - DNA, 25 bp, Mus musculus
acatgtgcacaccagagagactcat

SEQ ID NO: 107526 - DNA, 25 bp, Mus musculus
acatgtgcacacgagagagactcat

SEQ ID NO: 107527 - DNA, 25 bp, Mus musculus
acatgtgcacatagtctgggaaaga

SEQ ID NO: 107528 - DNA, 25 bp, Mus musculus
acatgtgcacattgtctgggaaaga

SEQ ID NO: 107529 - DNA, 25 bp, Mus musculus
acatgtgcaccaaaacacacacaaa

SEQ ID NO: 107530 - DNA, 25 bp, Mus musculus
acatgtgcaccataacacacacaaa

SEQ ID NO: 107531 - DNA, 25 bp, Mus musculus
acatgtgcagagatcccagggcccg

SEQ ID NO: 107532 - DNA, 25 bp, Mus musculus
acatgtgcagagttcccagggcccg

SEQ ID NO: 107533 - DNA, 25 bp, Mus musculus
acatgtgcaggtcccgctctggaaa

SEQ ID NO: 107534 - DNA, 25 bp, Mus musculus
acatgtgcaggtgccgctctggaaa

SEQ ID NO: 107535 - DNA, 25 bp, Mus musculus
acatgtgcatatagttttccaagag

SEQ ID NO: 107536 - DNA, 25 bp, Mus musculus
acatgtgcatattgttttccaagag

SEQ ID NO: 107537 - DNA, 25 bp, Mus musculus
acatgtgcatgcactttcccagaca

SEQ ID NO: 107538 - DNA, 25 bp, Mus musculus
acatgtgcatgccatttccctggaa

SEQ ID NO: 107539 - DNA, 25 bp, Mus musculus
acatgtgcatgcgatttccctggaa

SEQ ID NO: 107540 - DNA, 25 bp, Mus musculus
acatgtgcatgctctttcccagaca

SEQ ID NO: 107541 - DNA, 25 bp, Mus musculus
acatgtgccatgagaacccactcta

SEQ ID NO: 107542 - DNA, 25 bp, Mus musculus
acatgtgccatgtgaacccactcta

SEQ ID NO: 107543 - DNA, 25 bp, Mus musculus
acatgtgccattccttcactggact

SEQ ID NO: 107544 - DNA, 25 bp, Mus musculus
acatgtgccattgcttcactggact

SEQ ID NO: 107545 - DNA, 25 bp, Mus musculus
acatgtgcgagtctggtgtctctta

SEQ ID NO: 107546 - DNA, 25 bp, Mus musculus
acatgtgcgagtgtggtgtctctta

SEQ ID NO: 107547 - DNA, 25 bp, Mus musculus
acatgtgcgattcttccattacttc

SEQ ID NO: 107548 - DNA, 25 bp, Mus musculus
acatgtgcgattgttccattacttc

SEQ ID NO: 107549 - DNA, 25 bp, Mus musculus
acatgtgcgccgatcactgccagag

SEQ ID NO: 107550 - DNA, 25 bp, Mus musculus
acatgtgcgccgttcactgccagag

SEQ ID NO: 107551 - DNA, 25 bp, Mus musculus
acatgtgcgcctcactaggagggaa

SEQ ID NO: 107552 - DNA, 25 bp, Mus musculus
acatgtgcgcctgactaggagggaa

SEQ ID NO: 107553 - DNA, 25 bp, Mus musculus
acatgtgctaccactgtctgtcatc

SEQ ID NO: 107554 - DNA, 25 bp, Mus musculus
acatgtgctacctctgtctgtcatc

SEQ ID NO: 107555 - DNA, 25 bp, Mus musculus
acatgtgctgccataagtgtctggg

SEQ ID NO: 107556 - DNA, 25 bp, Mus musculus
acatgtgctgccttaagtgtctggg

SEQ ID NO: 107557 - DNA, 25 bp, Mus musculus
acatgtgctggcagcaggcttcctg

SEQ ID NO: 107558 - DNA, 25 bp, Mus musculus
acatgtgctggctgcaggcttcctg

SEQ ID NO: 107559 - DNA, 25 bp, Mus musculus
acatgtgctgtgaaagggattattt

SEQ ID NO: 107560 - DNA, 25 bp, Mus musculus
acatgtgctgtgtaagggattattt

SEQ ID NO: 107561 - DNA, 25 bp, Mus musculus
acatgtgcttccacttgtgtacaga

SEQ ID NO: 107562 - DNA, 25 bp, Mus musculus
acatgtgcttcctcttgtgtacaga

SEQ ID NO: 107563 - DNA, 25 bp, Mus musculus
acatgtgcttgacgcatgaaggcca

SEQ ID NO: 107564 - DNA, 25 bp, Mus musculus
acatgtgcttgaggcatgaaggcca

SEQ ID NO: 107565 - DNA, 25 bp, Mus musculus
acatgtggaagtacacaagcatctg

SEQ ID NO: 107566 - DNA, 25 bp, Mus musculus
acatgtggaagtatgtcccgatgct

SEQ ID NO: 107567 - DNA, 25 bp, Mus musculus
acatgtggaagttcacaagcatctg

SEQ ID NO: 107568 - DNA, 25 bp, Mus musculus
acatgtggaagtttgtcccgatgct

SEQ ID NO: 107569 - DNA, 25 bp, Mus musculus
acatgtggacacattcagggtggtt

SEQ ID NO: 107570 - DNA, 25 bp, Mus musculus
acatgtggacactttcagggtggtt

SEQ ID NO: 107571 - DNA, 25 bp, Mus musculus
acatgtggacttccagtgacccagg

SEQ ID NO: 107572 - DNA, 25 bp, Mus musculus
acatgtggacttgcagtgacccagg

SEQ ID NO: 107573 - DNA, 25 bp, Mus musculus
acatgtggaggcactctaacttaga

SEQ ID NO: 107574 - DNA, 25 bp, Mus musculus
acatgtggaggctctctaacttaga

SEQ ID NO: 107575 - DNA, 25 bp, Mus musculus
acatgtggatgcacggatcggttca

SEQ ID NO: 107576 - DNA, 25 bp, Mus musculus
acatgtggatgctcggatcggttca

SEQ ID NO: 107577 - DNA, 25 bp, Mus musculus
acatgtggatgtagacagcagatca

SEQ ID NO: 107578 - DNA, 25 bp, Mus musculus
acatgtggatgttgacagcagatca

SEQ ID NO: 107579 - DNA, 25 bp, Mus musculus
acatgtggccctacctcatcctgga

SEQ ID NO: 107580 - DNA, 25 bp, Mus musculus
acatgtggcccttcctcatcctgga

SEQ ID NO: 107581 - DNA, 25 bp, Mus musculus
acatgtggcctcaagcgtggtggct

SEQ ID NO: 107582 - DNA, 25 bp, Mus musculus
acatgtggcctctagcgtggtggct

SEQ ID NO: 107583 - DNA, 25 bp, Mus musculus
acatgtggcggaagctcctgtgtga

SEQ ID NO: 107584 - DNA, 25 bp, Mus musculus
acatgtggcggatgctcctgtgtga

SEQ ID NO: 107585 - DNA, 25 bp, Mus musculus
acatgtggctagcttattactgatc

SEQ ID NO: 107586 - DNA, 25 bp, Mus musculus
acatgtggctaggttattactgatc

SEQ ID NO: 107587 - DNA, 25 bp, Mus musculus
acatgtggctttcttctcagtgacc

SEQ ID NO: 107588 - DNA, 25 bp, Mus musculus
acatgtggctttgttctcagtgacc

SEQ ID NO: 107589 - DNA, 25 bp, Mus musculus
acatgtgggactatgtgctgacccc

SEQ ID NO: 107590 - DNA, 25 bp, Mus musculus
acatgtgggactttgtgctgacccc

SEQ ID NO: 107591 - DNA, 25 bp, Mus musculus
acatgtgggcaaaggctttcttcat

SEQ ID NO: 107592 - DNA, 25 bp, Mus musculus
acatgtgggcaatggctttcttcat

SEQ ID NO: 107593 - DNA, 25 bp, Mus musculus
acatgtgggcagcatatggtattac

SEQ ID NO: 107594 - DNA, 25 bp, Mus musculus
acatgtgggcaggatatggtattac

SEQ ID NO: 107595 - DNA, 25 bp, Mus musculus
acatgtggtcccaggtcaatatgga

SEQ ID NO: 107596 - DNA, 25 bp, Mus musculus
acatgtggtccctggtcaatatgga

SEQ ID NO: 107597 - DNA, 25 bp, Mus musculus
acatgtggtctaaacttgacttcca

SEQ ID NO: 107598 - DNA, 25 bp, Mus musculus
acatgtggtctatacttgacttcca

SEQ ID NO: 107599 - DNA, 25 bp, Mus musculus
acatgtggtgatattactgctaaac

SEQ ID NO: 107600 - DNA, 25 bp, Mus musculus
acatgtggtgattttactgctaaac

SEQ ID NO: 107601 - DNA, 25 bp, Mus musculus
acatgtggttccacgtgttactcac

SEQ ID NO: 107602 - DNA, 25 bp, Mus musculus
acatgtggttcctcgtgttactcac

SEQ ID NO: 107603 - DNA, 25 bp, Mus musculus
acatgtgtaagtctgcctaaatagg

SEQ ID NO: 107604 - DNA, 25 bp, Mus musculus
acatgtgtaagtgtgcctaaatagg

SEQ ID NO: 107605 - DNA, 25 bp, Mus musculus
acatgtgtacatagatgcttgccta

SEQ ID NO: 107606 - DNA, 25 bp, Mus musculus
acatgtgtacattgatgcttgccta

SEQ ID NO: 107607 - DNA, 25 bp, Mus musculus
acatgtgtagggagggagtaatata

SEQ ID NO: 107608 - DNA, 25 bp, Mus musculus
acatgtgtagggtgggagtaatata

SEQ ID NO: 107609 - DNA, 25 bp, Mus musculus
acatgtgtatcgaggcactgccatc

SEQ ID NO: 107610 - DNA, 25 bp, Mus musculus
acatgtgtatcgtggcactgccatc

SEQ ID NO: 107611 - DNA, 25 bp, Mus musculus
acatgtgtatgtcaaaccagaagaa

SEQ ID NO: 107612 - DNA, 25 bp, Mus musculus
acatgtgtatgtgaaaccagaagaa

SEQ ID NO: 107613 - DNA, 25 bp, Mus musculus
acatgtgtccacagttcagcatcga

SEQ ID NO: 107614 - DNA, 25 bp, Mus musculus
acatgtgtccactgttcagcatcga

SEQ ID NO: 107615 - DNA, 25 bp, Mus musculus
acatgtgtcctactcagtaagccca

SEQ ID NO: 107616 - DNA, 25 bp, Mus musculus
acatgtgtcctagtcagtaagccca

SEQ ID NO: 107617 - DNA, 25 bp, Mus musculus
acatgtgtctgcactggctagtttc

SEQ ID NO: 107618 - DNA, 25 bp, Mus musculus
acatgtgtctgctctggctagtttc

SEQ ID NO: 107619 - DNA, 25 bp, Mus musculus
acatgtgtcttcatggtggtgctgc

SEQ ID NO: 107620 - DNA, 25 bp, Mus musculus
acatgtgtcttcttggtggtgctgc

SEQ ID NO: 107621 - DNA, 25 bp, Mus musculus
acatgtgtgacacatgcggcatatt

SEQ ID NO: 107622 - DNA, 25 bp, Mus musculus
acatgtgtgacagatgcggcatatt

SEQ ID NO: 107623 - DNA, 25 bp, Mus musculus
acatgtgtgattcaggtacctttac

SEQ ID NO: 107624 - DNA, 25 bp, Mus musculus
acatgtgtgattgaggtacctttac

SEQ ID NO: 107625 - DNA, 25 bp, Mus musculus
acatgtgtgcagctcctagagtcaa

SEQ ID NO: 107626 - DNA, 25 bp, Mus musculus
acatgtgtgcaggtcctagagtcaa

SEQ ID NO: 107627 - DNA, 25 bp, Mus musculus
acatgtgtgtgtagaagtattgctt

SEQ ID NO: 107628 - DNA, 25 bp, Mus musculus
acatgtgtgtgttgaagtattgctt

SEQ ID NO: 107629 - DNA, 25 bp, Mus musculus
acatgtgttcacaattcaggctcca

SEQ ID NO: 107630 - DNA, 25 bp, Mus musculus
acatgtgttcactattcaggctcca

SEQ ID NO: 107631 - DNA, 25 bp, Mus musculus
acatgtgttcttaaatgggcaaggc

SEQ ID NO: 107632 - DNA, 25 bp, Mus musculus
acatgtgttctttaatgggcaaggc

SEQ ID NO: 107633 - DNA, 25 bp, Mus musculus
acatgtgttggtacaccttgcatag

SEQ ID NO: 107634 - DNA, 25 bp, Mus musculus
acatgtgttggtaggtacctcctac

SEQ ID NO: 107635 - DNA, 25 bp, Mus musculus
acatgtgttggttcaccttgcatag

SEQ ID NO: 107636 - DNA, 25 bp, Mus musculus
acatgtgttggttggtacctcctac

SEQ ID NO: 107637 - DNA, 25 bp, Mus musculus
acatgtgtttctcaacttggtggaa

SEQ ID NO: 107638 - DNA, 25 bp, Mus musculus
acatgtgtttctgaacttggtggaa

SEQ ID NO: 107639 - DNA, 25 bp, Mus musculus
acatgttacaatacagcctttgtct

SEQ ID NO: 107640 - DNA, 25 bp, Mus musculus
acatgttacaattcagcctttgtct

SEQ ID NO: 107641 - DNA, 25 bp, Mus musculus
acatgttaggatcacgttgcccgtg

SEQ ID NO: 107642 - DNA, 25 bp, Mus musculus
acatgttaggatgacgttgcccgtg

SEQ ID NO: 107643 - DNA, 25 bp, Mus musculus
acatgttagttcattcacatctccc

SEQ ID NO: 107644 - DNA, 25 bp, Mus musculus
acatgttagttctttcacatctccc

SEQ ID NO: 107645 - DNA, 25 bp, Mus musculus
acatgttataccactgtgacctttt

SEQ ID NO: 107646 - DNA, 25 bp, Mus musculus
acatgttatacctctgtgacctttt

SEQ ID NO: 107647 - DNA, 25 bp, Mus musculus
acatgttatgtaaggctgccctttc

SEQ ID NO: 107648 - DNA, 25 bp, Mus musculus
acatgttatgtatggctgccctttc

SEQ ID NO: 107649 - DNA, 25 bp, Mus musculus
acatgttattatcatctggctcaga

SEQ ID NO: 107650 - DNA, 25 bp, Mus musculus
acatgttattatgatctggctcaga

SEQ ID NO: 107651 - DNA, 25 bp, Mus musculus
acatgttcaccaattggctgggcta

SEQ ID NO: 107652 - DNA, 25 bp, Mus musculus
acatgttcaccatttggctgggcta

SEQ ID NO: 107653 - DNA, 25 bp, Mus musculus
acatgttcacttatgatgcctacct

SEQ ID NO: 107654 - DNA, 25 bp, Mus musculus
acatgttcacttttgatgcctacct

SEQ ID NO: 107655 - DNA, 25 bp, Mus musculus
acatgttcaggcaggctagggtccc

SEQ ID NO: 107656 - DNA, 25 bp, Mus musculus
acatgttcaggctggctagggtccc

SEQ ID NO: 107657 - DNA, 25 bp, Mus musculus
acatgttcatacactgaggcaccag

SEQ ID NO: 107658 - DNA, 25 bp, Mus musculus
acatgttcatactctgaggcaccag

SEQ ID NO: 107659 - DNA, 25 bp, Mus musculus
acatgttcatatcctgtctcgtgat

SEQ ID NO: 107660 - DNA, 25 bp, Mus musculus
acatgttcatatgctgtctcgtgat

SEQ ID NO: 107661 - DNA, 25 bp, Mus musculus
acatgttcatgccaccacactaaat

SEQ ID NO: 107662 - DNA, 25 bp, Mus musculus
acatgttcatgcgaccacactaaat

SEQ ID NO: 107663 - DNA, 25 bp, Mus musculus
acatgttccagtatgactccactca

SEQ ID NO: 107664 - DNA, 25 bp, Mus musculus
acatgttccagtttgactccactca

SEQ ID NO: 107665 - DNA, 25 bp, Mus musculus
acatgttcccatatgtcctgtctgt

SEQ ID NO: 107666 - DNA, 25 bp, Mus musculus
acatgttcccatttgtcctgtctgt

SEQ ID NO: 107667 - DNA, 25 bp, Mus musculus
acatgttcctggatgcttcataaaa

SEQ ID NO: 107668 - DNA, 25 bp, Mus musculus
acatgttcctggttgcttcataaaa

SEQ ID NO: 107669 - DNA, 25 bp, Mus musculus
acatgttctcatatctcagttcctt

SEQ ID NO: 107670 - DNA, 25 bp, Mus musculus
acatgttctcatttctcagttcctt

SEQ ID NO: 107671 - DNA, 25 bp, Mus musculus
acatgttctcctagacacaactgtt

SEQ ID NO: 107672 - DNA, 25 bp, Mus musculus
acatgttctccttgacacaactgtt

SEQ ID NO: 107673 - DNA, 25 bp, Mus musculus
acatgttctgaaaaggctggctcaa

SEQ ID NO: 107674 - DNA, 25 bp, Mus musculus
acatgttctgaataggctggctcaa

SEQ ID NO: 107675 - DNA, 25 bp, Mus musculus
acatgttctggcagcccgagctgac

SEQ ID NO: 107676 - DNA, 25 bp, Mus musculus
acatgttctggctgcccgagctgac

SEQ ID NO: 107677 - DNA, 25 bp, Mus musculus
acatgttctggtatggctgttggtt

SEQ ID NO: 107678 - DNA, 25 bp, Mus musculus
acatgttctggtttggctgttggtt

SEQ ID NO: 107679 - DNA, 25 bp, Mus musculus
acatgttctgtacagccagggctga

SEQ ID NO: 107680 - DNA, 25 bp, Mus musculus
acatgttctgtagagccagggctga

SEQ ID NO: 107681 - DNA, 25 bp, Mus musculus
acatgttcttccaatggttccagct

SEQ ID NO: 107682 - DNA, 25 bp, Mus musculus
acatgttcttcctatggttccagct

SEQ ID NO: 107683 - DNA, 25 bp, Mus musculus
acatgttcttgtagctggattctag

SEQ ID NO: 107684 - DNA, 25 bp, Mus musculus
acatgttcttgttgctggattctag

SEQ ID NO: 107685 - DNA, 25 bp, Mus musculus
acatgttgacgtcgacattcctgtc

SEQ ID NO: 107686 - DNA, 25 bp, Mus musculus
acatgttgacgtggacattcctgtc

SEQ ID NO: 107687 - DNA, 25 bp, Mus musculus
acatgttgacttacttctacttttt

SEQ ID NO: 107688 - DNA, 25 bp, Mus musculus
acatgttgactttcttctacttttt

SEQ ID NO: 107689 - DNA, 25 bp, Mus musculus
acatgttgagtgctgagttccttcc

SEQ ID NO: 107690 - DNA, 25 bp, Mus musculus
acatgttgagtggtgagttccttcc

SEQ ID NO: 107691 - DNA, 25 bp, Mus musculus
acatgttgataacgctgctgtggct

SEQ ID NO: 107692 - DNA, 25 bp, Mus musculus
acatgttgataaggctgctgtggct

SEQ ID NO: 107693 - DNA, 25 bp, Mus musculus
acatgttgcacaagcttagcctctt

SEQ ID NO: 107694 - DNA, 25 bp, Mus musculus
acatgttgcacatgcttagcctctt

SEQ ID NO: 107695 - DNA, 25 bp, Mus musculus
acatgttgctaaccgagcgttggcc

SEQ ID NO: 107696 - DNA, 25 bp, Mus musculus
acatgttgctaagcgagcgttggcc

SEQ ID NO: 107697 - DNA, 25 bp, Mus musculus
acatgttgctatacagccagcctgg

SEQ ID NO: 107698 - DNA, 25 bp, Mus musculus
acatgttgctattcagccagcctgg

SEQ ID NO: 107699 - DNA, 25 bp, Mus musculus
acatgttggattacctggaggtgga

SEQ ID NO: 107700 - DNA, 25 bp, Mus musculus
acatgttggatttcctggaggtgga

SEQ ID NO: 107701 - DNA, 25 bp, Mus musculus
acatgttggctcaatgatggcttcc

SEQ ID NO: 107702 - DNA, 25 bp, Mus musculus
acatgttggctctatgatggcttcc

SEQ ID NO: 107703 - DNA, 25 bp, Mus musculus
acatgttggcttcccatggaacctt

SEQ ID NO: 107704 - DNA, 25 bp, Mus musculus
acatgttggcttgccatggaacctt

SEQ ID NO: 107705 - DNA, 25 bp, Mus musculus
acatgttgtacaaactgcggcgctc

SEQ ID NO: 107706 - DNA, 25 bp, Mus musculus
acatgttgtacatactgcggcgctc

SEQ ID NO: 107707 - DNA, 25 bp, Mus musculus
acatgttgtatgactctgagcaata

SEQ ID NO: 107708 - DNA, 25 bp, Mus musculus
acatgttgtatgtctctgagcaata

SEQ ID NO: 107709 - DNA, 25 bp, Mus musculus
acatgtttaatgatcgtgccttagg

SEQ ID NO: 107710 - DNA, 25 bp, Mus musculus
acatgtttaatgttcgtgccttagg

SEQ ID NO: 107711 - DNA, 25 bp, Mus musculus
acatgtttactaaccattcattggg

SEQ ID NO: 107712 - DNA, 25 bp, Mus musculus
acatgtttactatccattcattggg

SEQ ID NO: 107713 - DNA, 25 bp, Mus musculus
acatgtttactgataagtccttgca

SEQ ID NO: 107714 - DNA, 25 bp, Mus musculus
acatgtttactgttaagtccttgca

SEQ ID NO: 107715 - DNA, 25 bp, Mus musculus
acatgtttcatgaccaagtgcttaa

SEQ ID NO: 107716 - DNA, 25 bp, Mus musculus
acatgtttcatgtccaagtgcttaa

SEQ ID NO: 107717 - DNA, 25 bp, Mus musculus
acatgtttcattactcacgaaatac

SEQ ID NO: 107718 - DNA, 25 bp, Mus musculus
acatgtttcatttctcacgaaatac

SEQ ID NO: 107719 - DNA, 25 bp, Mus musculus
acatgtttccctcgtactttgtaag

SEQ ID NO: 107720 - DNA, 25 bp, Mus musculus
acatgtttccctggtactttgtaag

SEQ ID NO: 107721 - DNA, 25 bp, Mus musculus
acatgtttctttcttactctcgtcc

SEQ ID NO: 107722 - DNA, 25 bp, Mus musculus
acatgtttctttgttactctcgtcc

SEQ ID NO: 107723 - DNA, 25 bp, Mus musculus
acatgtttgcacattacactgtgta

SEQ ID NO: 107724 - DNA, 25 bp, Mus musculus
acatgtttgcactttacactgtgta

SEQ ID NO: 107725 - DNA, 25 bp, Mus musculus
acatgtttgctacctccactgtgtt

SEQ ID NO: 107726 - DNA, 25 bp, Mus musculus
acatgtttgctagctccactgtgtt

SEQ ID NO: 107727 - DNA, 25 bp, Mus musculus
acatgtttgctgatggcaacttcaa

SEQ ID NO: 107728 - DNA, 25 bp, Mus musculus
acatgtttgctgttggcaacttcaa

SEQ ID NO: 107729 - DNA, 25 bp, Mus musculus
acatgtttgtgtccaggtaggtgta

SEQ ID NO: 107730 - DNA, 25 bp, Mus musculus
acatgtttgtgtgcaggtaggtgta

SEQ ID NO: 107731 - DNA, 25 bp, Mus musculus
acatgttttaccaagggatccttct

SEQ ID NO: 107732 - DNA, 25 bp, Mus musculus
acatgttttacctagggatccttct

SEQ ID NO: 107733 - DNA, 25 bp, Mus musculus
acatgttttatccagtcttcactct

SEQ ID NO: 107734 - DNA, 25 bp, Mus musculus
acatgttttatcgagtcttcactct

SEQ ID NO: 107735 - DNA, 25 bp, Mus musculus
acatgttttttgaaggctgtgagta

SEQ ID NO: 107736 - DNA, 25 bp, Mus musculus
acatgttttttgtaggctgtgagta

SEQ ID NO: 107737 - DNA, 25 bp, Mus musculus
acattaaaactgcagtcactctttt

SEQ ID NO: 107738 - DNA, 25 bp, Mus musculus
acattaaaactggagtcactctttt

SEQ ID NO: 107739 - DNA, 25 bp, Mus musculus
acattaaacttgattccattctcat

SEQ ID NO: 107740 - DNA, 25 bp, Mus musculus
acattaaacttgtttccattctcat

SEQ ID NO: 107741 - DNA, 25 bp, Mus musculus
acattaaaggctacatctcccatca

SEQ ID NO: 107742 - DNA, 25 bp, Mus musculus
acattaaaggcttcatctcccatca

SEQ ID NO: 107743 - DNA, 25 bp, Mus musculus
acattaaatgacacttccctcaatt

SEQ ID NO: 107744 - DNA, 25 bp, Mus musculus
acattaaatgactcttccctcaatt

SEQ ID NO: 107745 - DNA, 25 bp, Mus musculus
acattaacattaaccggagcagaag

SEQ ID NO: 107746 - DNA, 25 bp, Mus musculus
acattaacattatccggagcagaag

SEQ ID NO: 107747 - DNA, 25 bp, Mus musculus
acattaactctaccctgaagtgatg

SEQ ID NO: 107748 - DNA, 25 bp, Mus musculus
acattaactctagcctgaagtgatg

SEQ ID NO: 107749 - DNA, 25 bp, Mus musculus
acattaactctcaatcatcgtctat

SEQ ID NO: 107750 - DNA, 25 bp, Mus musculus
acattaactctctatcatcgtctat

SEQ ID NO: 107751 - DNA, 25 bp, Mus musculus
acattaacttggaagattgccttaa

SEQ ID NO: 107752 - DNA, 25 bp, Mus musculus
acattaacttggtagattgccttaa

SEQ ID NO: 107753 - DNA, 25 bp, Mus musculus
acattaaggcttacagggcttttct

SEQ ID NO: 107754 - DNA, 25 bp, Mus musculus
acattaaggctttcagggcttttct

SEQ ID NO: 107755 - DNA, 25 bp, Mus musculus
acattaataactagagggcgtggct

SEQ ID NO: 107756 - DNA, 25 bp, Mus musculus
acattaataacttgagggcgtggct

SEQ ID NO: 107757 - DNA, 25 bp, Mus musculus
acattaatcacaactgcctctgact

SEQ ID NO: 107758 - DNA, 25 bp, Mus musculus
acattaatcacatctgcctctgact

SEQ ID NO: 107759 - DNA, 25 bp, Mus musculus
acattaattactctaggctgctcac

SEQ ID NO: 107760 - DNA, 25 bp, Mus musculus
acattaattactgtaggctgctcac

SEQ ID NO: 107761 - DNA, 25 bp, Mus musculus
acattaattggcctgctgttgtaca

SEQ ID NO: 107762 - DNA, 25 bp, Mus musculus
acattaattggcgtgctgttgtaca

SEQ ID NO: 107763 - DNA, 25 bp, Mus musculus
acattacactcgatctagggctcag

SEQ ID NO: 107764 - DNA, 25 bp, Mus musculus
acattacactcgttctagggctcag

SEQ ID NO: 107765 - DNA, 25 bp, Mus musculus
acattacagcacactgctctgtgaa

SEQ ID NO: 107766 - DNA, 25 bp, Mus musculus
acattacagcactctgctctgtgaa

SEQ ID NO: 107767 - DNA, 25 bp, Mus musculus
acattacagtggagcccagagattc

SEQ ID NO: 107768 - DNA, 25 bp, Mus musculus
acattacagtggtgcccagagattc

SEQ ID NO: 107769 - DNA, 25 bp, Mus musculus
acattacatccccttgggtggcaca

SEQ ID NO: 107770 - DNA, 25 bp, Mus musculus
acattacatcccgttgggtggcaca

SEQ ID NO: 107771 - DNA, 25 bp, Mus musculus
acattacattctatcttctctattc

SEQ ID NO: 107772 - DNA, 25 bp, Mus musculus
acattacattctttcttctctattc

SEQ ID NO: 107773 - DNA, 25 bp, Mus musculus
acattaccagctaaattgcctcttc

SEQ ID NO: 107774 - DNA, 25 bp, Mus musculus
acattaccagcttaattgcctcttc

SEQ ID NO: 107775 - DNA, 25 bp, Mus musculus
acattacctacacttggacttccac

SEQ ID NO: 107776 - DNA, 25 bp, Mus musculus
acattacctacagttggacttccac

SEQ ID NO: 107777 - DNA, 25 bp, Mus musculus
acattacctggcactgtgtatatta

SEQ ID NO: 107778 - DNA, 25 bp, Mus musculus
acattacctggctctgtgtatatta

SEQ ID NO: 107779 - DNA, 25 bp, Mus musculus
acattacctgtcatttcttaactat

SEQ ID NO: 107780 - DNA, 25 bp, Mus musculus
acattacctgtcttttcttaactat

SEQ ID NO: 107781 - DNA, 25 bp, Mus musculus
acattacggcaacaccatggctggg

SEQ ID NO: 107782 - DNA, 25 bp, Mus musculus
acattacggcaagaccatggctggg

SEQ ID NO: 107783 - DNA, 25 bp, Mus musculus
acattactacgtcatggtcatctgc

SEQ ID NO: 107784 - DNA, 25 bp, Mus musculus
acattactacgtgatggtcatctgc

SEQ ID NO: 107785 - DNA, 25 bp, Mus musculus
acattacttcttctgttcttgagag

SEQ ID NO: 107786 - DNA, 25 bp, Mus musculus
acattacttcttgtgttcttgagag

SEQ ID NO: 107787 - DNA, 25 bp, Mus musculus
acattacttgctctcattagctgag

SEQ ID NO: 107788 - DNA, 25 bp, Mus musculus
acattacttgctgtcattagctgag

SEQ ID NO: 107789 - DNA, 25 bp, Mus musculus
acattagaaagcactcgagccgcct

SEQ ID NO: 107790 - DNA, 25 bp, Mus musculus
acattagaaagctctcgagccgcct

SEQ ID NO: 107791 - DNA, 25 bp, Mus musculus
acattagaacccagtaatcagtaga

SEQ ID NO: 107792 - DNA, 25 bp, Mus musculus
acattagaaccctgtaatcagtaga

SEQ ID NO: 107793 - DNA, 25 bp, Mus musculus
acattagcggctcatctgttctgta

SEQ ID NO: 107794 - DNA, 25 bp, Mus musculus
acattagcggctgatctgttctgta

SEQ ID NO: 107795 - DNA, 25 bp, Mus musculus
acattagctcttatgtagcagaaag

SEQ ID NO: 107796 - DNA, 25 bp, Mus musculus
acattagctcttttgtagcagaaag

SEQ ID NO: 107797 - DNA, 25 bp, Mus musculus
acattagctgaccttctgtgttaaa

SEQ ID NO: 107798 - DNA, 25 bp, Mus musculus
acattagctgacgttctgtgttaaa

SEQ ID NO: 107799 - DNA, 25 bp, Mus musculus
acattagctggcagatgccattctc

SEQ ID NO: 107800 - DNA, 25 bp, Mus musculus
acattagctggctgatgccattctc

SEQ ID NO: 107801 - DNA, 25 bp, Mus musculus
acattaggaatgctcgcttcggcag

SEQ ID NO: 107802 - DNA, 25 bp, Mus musculus
acattaggaatggtcgcttcggcag

SEQ ID NO: 107803 - DNA, 25 bp, Mus musculus
acattaggctgaccttgcggaaccc

SEQ ID NO: 107804 - DNA, 25 bp, Mus musculus
acattaggctgagcttgcggaaccc

SEQ ID NO: 107805 - DNA, 25 bp, Mus musculus
acattaggctggatgcgaccttcat

SEQ ID NO: 107806 - DNA, 25 bp, Mus musculus
acattaggctggttgcgaccttcat

SEQ ID NO: 107807 - DNA, 25 bp, Mus musculus
acattagggaacactcctgcgaggt

SEQ ID NO: 107808 - DNA, 25 bp, Mus musculus
acattagggaactctcctgcgaggt

SEQ ID NO: 107809 - DNA, 25 bp, Mus musculus
acattagggcagcaagttcaacatc

SEQ ID NO: 107810 - DNA, 25 bp, Mus musculus
acattagggcaggaagttcaacatc

SEQ ID NO: 107811 - DNA, 25 bp, Mus musculus
acattaggtgacattcttgggagct

SEQ ID NO: 107812 - DNA, 25 bp, Mus musculus
acattaggtgactttcttgggagct

SEQ ID NO: 107813 - DNA, 25 bp, Mus musculus
acattaggtggtattcagcatttta

SEQ ID NO: 107814 - DNA, 25 bp, Mus musculus
acattaggtggttttcagcatttta

SEQ ID NO: 107815 - DNA, 25 bp, Mus musculus
acattagtagtcagccttattttaa

SEQ ID NO: 107816 - DNA, 25 bp, Mus musculus
acattagtagtctgccttattttaa

SEQ ID NO: 107817 - DNA, 25 bp, Mus musculus
acattagttacactggtggcacttt

SEQ ID NO: 107818 - DNA, 25 bp, Mus musculus
acattagttacagtggtggcacttt

SEQ ID NO: 107819 - DNA, 25 bp, Mus musculus
acattagttattcgccgtaccgtgg

SEQ ID NO: 107820 - DNA, 25 bp, Mus musculus
acattagttattggccgtaccgtgg

SEQ ID NO: 107821 - DNA, 25 bp, Mus musculus
acattagttgttcttacagctggac

SEQ ID NO: 107822 - DNA, 25 bp, Mus musculus
acattagttgttgttacagctggac

SEQ ID NO: 107823 - DNA, 25 bp, Mus musculus
acattataaccccatctgtctgata

SEQ ID NO: 107824 - DNA, 25 bp, Mus musculus
acattataacccgatctgtctgata

SEQ ID NO: 107825 - DNA, 25 bp, Mus musculus
acattataacttctgtttgtccaaa

SEQ ID NO: 107826 - DNA, 25 bp, Mus musculus
acattataacttgtgtttgtccaaa

SEQ ID NO: 107827 - DNA, 25 bp, Mus musculus
acattatactgactgagccggttat

SEQ ID NO: 107828 - DNA, 25 bp, Mus musculus
acattatactgagtgagccggttat

SEQ ID NO: 107829 - DNA, 25 bp, Mus musculus
acattatactttcctgggtggctca

SEQ ID NO: 107830 - DNA, 25 bp, Mus musculus
acattatactttgctgggtggctca

SEQ ID NO: 107831 - DNA, 25 bp, Mus musculus
acattatatttcagagtgaccagac

SEQ ID NO: 107832 - DNA, 25 bp, Mus musculus
acattatatttctgagtgaccagac

SEQ ID NO: 107833 - DNA, 25 bp, Mus musculus
acattatcaaagcagagtggcagag

SEQ ID NO: 107834 - DNA, 25 bp, Mus musculus
acattatcaaaggagagtggcagag

SEQ ID NO: 107835 - DNA, 25 bp, Mus musculus
acattatcaagtaccaacatcatgg

SEQ ID NO: 107836 - DNA, 25 bp, Mus musculus
acattatcaagttccaacatcatgg

SEQ ID NO: 107837 - DNA, 25 bp, Mus musculus
acattatctaagctaacaccatctg

SEQ ID NO: 107838 - DNA, 25 bp, Mus musculus
acattatctaaggtaacaccatctg

SEQ ID NO: 107839 - DNA, 25 bp, Mus musculus
acattatctacaagctcctttgtct

SEQ ID NO: 107840 - DNA, 25 bp, Mus musculus
acattatctacatgctcctttgtct

SEQ ID NO: 107841 - DNA, 25 bp, Mus musculus
acattatctggacgtaactgcttgc

SEQ ID NO: 107842 - DNA, 25 bp, Mus musculus
acattatctggaggtaactgcttgc

SEQ ID NO: 107843 - DNA, 25 bp, Mus musculus
acattatctgtgactcttacccagt

SEQ ID NO: 107844 - DNA, 25 bp, Mus musculus
acattatctgtgtctcttacccagt

SEQ ID NO: 107845 - DNA, 25 bp, Mus musculus
acattatgagtcacctggaagcggc

SEQ ID NO: 107846 - DNA, 25 bp, Mus musculus
acattatgagtctcctggaagcggc

SEQ ID NO: 107847 - DNA, 25 bp, Mus musculus
acattatgcgctccagtttcctgaa

SEQ ID NO: 107848 - DNA, 25 bp, Mus musculus
acattatgcgctgcagtttcctgaa

SEQ ID NO: 107849 - DNA, 25 bp, Mus musculus
acattatgtatcactgactggtcta

SEQ ID NO: 107850 - DNA, 25 bp, Mus musculus
acattatgtatctctgactggtcta

SEQ ID NO: 107851 - DNA, 25 bp, Mus musculus
acattatgtcacagctaaaagttat

SEQ ID NO: 107852 - DNA, 25 bp, Mus musculus
acattatgtcactgctaaaagttat

SEQ ID NO: 107853 - DNA, 25 bp, Mus musculus
acattattctgcagtgcttgagcac

SEQ ID NO: 107854 - DNA, 25 bp, Mus musculus
acattattctgccacctgcactgag

SEQ ID NO: 107855 - DNA, 25 bp, Mus musculus
acattattctgcgacctgcactgag

SEQ ID NO: 107856 - DNA, 25 bp, Mus musculus
acattattctgctgtgcttgagcac

SEQ ID NO: 107857 - DNA, 25 bp, Mus musculus
acattattctggcatatagcagcag

SEQ ID NO: 107858 - DNA, 25 bp, Mus musculus
acattattctgggatatagcagcag

SEQ ID NO: 107859 - DNA, 25 bp, Mus musculus
acattattgaccacaacagcccttt

SEQ ID NO: 107860 - DNA, 25 bp, Mus musculus
acattattgacctcaacagcccttt

SEQ ID NO: 107861 - DNA, 25 bp, Mus musculus
acattattgattctgccctttctcc

SEQ ID NO: 107862 - DNA, 25 bp, Mus musculus
acattattgattgtgccctttctcc

SEQ ID NO: 107863 - DNA, 25 bp, Mus musculus
acattattgtccatgggagactcta

SEQ ID NO: 107864 - DNA, 25 bp, Mus musculus
acattattgtccttgggagactcta

SEQ ID NO: 107865 - DNA, 25 bp, Mus musculus
acattatttctgagagacctgtgca

SEQ ID NO: 107866 - DNA, 25 bp, Mus musculus
acattatttctgtgagacctgtgca

SEQ ID NO: 107867 - DNA, 25 bp, Mus musculus
acattatttgtcacactggaaggga

SEQ ID NO: 107868 - DNA, 25 bp, Mus musculus
acattatttgtctcactggaaggga

SEQ ID NO: 107869 - DNA, 25 bp, Mus musculus
acattatttgttcacactgtccatc

SEQ ID NO: 107870 - DNA, 25 bp, Mus musculus
acattatttgttgacactgtccatc

SEQ ID NO: 107871 - DNA, 25 bp, Mus musculus
acattattttctaaattgttagcta

SEQ ID NO: 107872 - DNA, 25 bp, Mus musculus
acattattttcttaattgttagcta

SEQ ID NO: 107873 - DNA, 25 bp, Mus musculus
acattattttgcagagcactctaat

SEQ ID NO: 107874 - DNA, 25 bp, Mus musculus
acattattttgctgagcactctaat

SEQ ID NO: 107875 - DNA, 25 bp, Mus musculus
acattcaaccctagtcatcgttgga

SEQ ID NO: 107876 - DNA, 25 bp, Mus musculus
acattcaacccttgtcatcgttgga

SEQ ID NO: 107877 - DNA, 25 bp, Mus musculus
acattcaacgcacccttttcttaat

SEQ ID NO: 107878 - DNA, 25 bp, Mus musculus
acattcaacgcagccttttcttaat

SEQ ID NO: 107879 - DNA, 25 bp, Mus musculus
acattcaagaaacctgccccacgag

SEQ ID NO: 107880 - DNA, 25 bp, Mus musculus
acattcaagaaagctgccccacgag

SEQ ID NO: 107881 - DNA, 25 bp, Mus musculus
acattcaagtttcaggtgaaccctt

SEQ ID NO: 107882 - DNA, 25 bp, Mus musculus
acattcaagtttgaggtgaaccctt

SEQ ID NO: 107883 - DNA, 25 bp, Mus musculus
acattcaatagacatgacttgcttg

SEQ ID NO: 107884 - DNA, 25 bp, Mus musculus
acattcaatagagatgacttgcttg

SEQ ID NO: 107885 - DNA, 25 bp, Mus musculus
acattcaatttcaggatctttcgag

SEQ ID NO: 107886 - DNA, 25 bp, Mus musculus
acattcaatttctggatctttcgag

SEQ ID NO: 107887 - DNA, 25 bp, Mus musculus
acattcaattttcgctttgtttggg

SEQ ID NO: 107888 - DNA, 25 bp, Mus musculus
acattcaattttggctttgtttggg

SEQ ID NO: 107889 - DNA, 25 bp, Mus musculus
acattcacaacaaacactactcaca

SEQ ID NO: 107890 - DNA, 25 bp, Mus musculus
acattcacaacatacactactcaca

SEQ ID NO: 107891 - DNA, 25 bp, Mus musculus
acattcacaatgacgaacccttcgt

SEQ ID NO: 107892 - DNA, 25 bp, Mus musculus
acattcacaatgtcgaacccttcgt

SEQ ID NO: 107893 - DNA, 25 bp, Mus musculus
acattcacacctaagttgctgccaa

SEQ ID NO: 107894 - DNA, 25 bp, Mus musculus
acattcacaccttagttgctgccaa

SEQ ID NO: 107895 - DNA, 25 bp, Mus musculus
acattcacaggtccaatgggagcct

SEQ ID NO: 107896 - DNA, 25 bp, Mus musculus
acattcacaggtgcaatgggagcct

SEQ ID NO: 107897 - DNA, 25 bp, Mus musculus
acattcaccaagcagctgctctgtt

SEQ ID NO: 107898 - DNA, 25 bp, Mus musculus
acattcaccaaggagctgctctgtt

SEQ ID NO: 107899 - DNA, 25 bp, Mus musculus
acattcacgccacacacttggaagt

SEQ ID NO: 107900 - DNA, 25 bp, Mus musculus
acattcacgccagacacttggaagt

SEQ ID NO: 107901 - DNA, 25 bp, Mus musculus
acattcactcaacatcaaggcgctg

SEQ ID NO: 107902 - DNA, 25 bp, Mus musculus
acattcactcaagatcaaggcgctg

SEQ ID NO: 107903 - DNA, 25 bp, Mus musculus
acattcactgcacctgctattggag

SEQ ID NO: 107904 - DNA, 25 bp, Mus musculus
acattcactgcagctgctattggag

SEQ ID NO: 107905 - DNA, 25 bp, Mus musculus
acattcactgtgactgcagttccga

SEQ ID NO: 107906 - DNA, 25 bp, Mus musculus
acattcactgtgtctgcagttccga

SEQ ID NO: 107907 - DNA, 25 bp, Mus musculus
acattcagagatctccactgtccac

SEQ ID NO: 107908 - DNA, 25 bp, Mus musculus
acattcagagatgtccactgtccac

SEQ ID NO: 107909 - DNA, 25 bp, Mus musculus
acattcagagggaccctggctaagc

SEQ ID NO: 107910 - DNA, 25 bp, Mus musculus
acattcagagggtccctggctaagc

SEQ ID NO: 107911 - DNA, 25 bp, Mus musculus
acattcagctcactgcttaactgaa

SEQ ID NO: 107912 - DNA, 25 bp, Mus musculus
acattcagctcagtgcttaactgaa

SEQ ID NO: 107913 - DNA, 25 bp, Mus musculus
acattcagctccatcatattacaca

SEQ ID NO: 107914 - DNA, 25 bp, Mus musculus
acattcagctccttcatattacaca

SEQ ID NO: 107915 - DNA, 25 bp, Mus musculus
acattcaggacaatgtctccacctt

SEQ ID NO: 107916 - DNA, 25 bp, Mus musculus
acattcaggacattgtctccacctt

SEQ ID NO: 107917 - DNA, 25 bp, Mus musculus
acattcaggcaccacgggtggctaa

SEQ ID NO: 107918 - DNA, 25 bp, Mus musculus
acattcaggcacgacgggtggctaa

SEQ ID NO: 107919 - DNA, 25 bp, Mus musculus
acattcaggcagaccagtgcggcaa

SEQ ID NO: 107920 - DNA, 25 bp, Mus musculus
acattcaggcagtccagtgcggcaa

SEQ ID NO: 107921 - DNA, 25 bp, Mus musculus
acattcagggagactcatcccacct

SEQ ID NO: 107922 - DNA, 25 bp, Mus musculus
acattcagggagtctcatcccacct

SEQ ID NO: 107923 - DNA, 25 bp, Mus musculus
acattcaggttcagtatgtccagct

SEQ ID NO: 107924 - DNA, 25 bp, Mus musculus
acattcaggttctgtatgtccagct

SEQ ID NO: 107925 - DNA, 25 bp, Mus musculus
acattcagtacgagcaagtgccggt

SEQ ID NO: 107926 - DNA, 25 bp, Mus musculus
acattcagtacgtgcaagtgccggt

SEQ ID NO: 107927 - DNA, 25 bp, Mus musculus
acattcagtaggaggtaattgtgct

SEQ ID NO: 107928 - DNA, 25 bp, Mus musculus
acattcagtaggtggtaattgtgct

SEQ ID NO: 107929 - DNA, 25 bp, Mus musculus
acattcagtgatatctcttctacag

SEQ ID NO: 107930 - DNA, 25 bp, Mus musculus
acattcagtgatttctcttctacag

SEQ ID NO: 107931 - DNA, 25 bp, Mus musculus
acattcatacctagtgcccagaggt

SEQ ID NO: 107932 - DNA, 25 bp, Mus musculus
acattcataccttgtgcccagaggt

SEQ ID NO: 107933 - DNA, 25 bp, Mus musculus
acattcatagcgatgggcatcaccc

SEQ ID NO: 107934 - DNA, 25 bp, Mus musculus
acattcatagcgttgggcatcaccc

SEQ ID NO: 107935 - DNA, 25 bp, Mus musculus
acattcataggcaacttgtctgtcc

SEQ ID NO: 107936 - DNA, 25 bp, Mus musculus
acattcataggctacttgtctgtcc

SEQ ID NO: 107937 - DNA, 25 bp, Mus musculus
acattcatatctaggcctgatgaca

SEQ ID NO: 107938 - DNA, 25 bp, Mus musculus
acattcatatcttggcctgatgaca

SEQ ID NO: 107939 - DNA, 25 bp, Mus musculus
acattcatccgacgacaggtgtcat

SEQ ID NO: 107940 - DNA, 25 bp, Mus musculus
acattcatccgaggacaggtgtcat

SEQ ID NO: 107941 - DNA, 25 bp, Mus musculus
acattcatgcatacaaactttggga

SEQ ID NO: 107942 - DNA, 25 bp, Mus musculus
acattcatgcattcaaactttggga

SEQ ID NO: 107943 - DNA, 25 bp, Mus musculus
acattcatggagacagcgagcttta

SEQ ID NO: 107944 - DNA, 25 bp, Mus musculus
acattcatggagtcagcgagcttta

SEQ ID NO: 107945 - DNA, 25 bp, Mus musculus
acattcatgtatatgctgtaacaag

SEQ ID NO: 107946 - DNA, 25 bp, Mus musculus
acattcatgtatttgctgtaacaag

SEQ ID NO: 107947 - DNA, 25 bp, Mus musculus
acattcattcacacgtgcacacagg

SEQ ID NO: 107948 - DNA, 25 bp, Mus musculus
acattcattcaccttatccttggga

SEQ ID NO: 107949 - DNA, 25 bp, Mus musculus
acattcattcacgttatccttggga

SEQ ID NO: 107950 - DNA, 25 bp, Mus musculus
acattcattcactcgtgcacacagg

SEQ ID NO: 107951 - DNA, 25 bp, Mus musculus
acattcattcataatggctctgaga

SEQ ID NO: 107952 - DNA, 25 bp, Mus musculus
acattcattcattatggctctgaga

SEQ ID NO: 107953 - DNA, 25 bp, Mus musculus
acattcatttctctgggacggtgcc

SEQ ID NO: 107954 - DNA, 25 bp, Mus musculus
acattcatttctgtgggacggtgcc

SEQ ID NO: 107955 - DNA, 25 bp, Mus musculus
acattcattttaatgccattttcta

SEQ ID NO: 107956 - DNA, 25 bp, Mus musculus
acattcattttattgccattttcta

SEQ ID NO: 107957 - DNA, 25 bp, Mus musculus
acattccaaggtatctgagtgtttg

SEQ ID NO: 107958 - DNA, 25 bp, Mus musculus
acattccaaggtttctgagtgtttg

SEQ ID NO: 107959 - DNA, 25 bp, Mus musculus
acattccacccaagaattcttctag

SEQ ID NO: 107960 - DNA, 25 bp, Mus musculus
acattccacccatgaattcttctag

SEQ ID NO: 107961 - DNA, 25 bp, Mus musculus
acattccacctgcaaatgagactga

SEQ ID NO: 107962 - DNA, 25 bp, Mus musculus
acattccacctggaaatgagactga

SEQ ID NO: 107963 - DNA, 25 bp, Mus musculus
acattccactatagtttgattgaaa

SEQ ID NO: 107964 - DNA, 25 bp, Mus musculus
acattccactattgtttgattgaaa

SEQ ID NO: 107965 - DNA, 25 bp, Mus musculus
acattccactgcagtttctgaggac

SEQ ID NO: 107966 - DNA, 25 bp, Mus musculus
acattccactgctgtttctgaggac

SEQ ID NO: 107967 - DNA, 25 bp, Mus musculus
acattccactgtaggcacgaagact

SEQ ID NO: 107968 - DNA, 25 bp, Mus musculus
acattccactgttggcacgaagact

SEQ ID NO: 107969 - DNA, 25 bp, Mus musculus
acattccagaccacagcacattaaa

SEQ ID NO: 107970 - DNA, 25 bp, Mus musculus
acattccagacctcagcacattaaa

SEQ ID NO: 107971 - DNA, 25 bp, Mus musculus
acattccagagtctctctgggcctt

SEQ ID NO: 107972 - DNA, 25 bp, Mus musculus
acattccagagtgtctctgggcctt

SEQ ID NO: 107973 - DNA, 25 bp, Mus musculus
acattccagcccatatcagcagaca

SEQ ID NO: 107974 - DNA, 25 bp, Mus musculus
acattccagcccttatcagcagaca

SEQ ID NO: 107975 - DNA, 25 bp, Mus musculus
acattccagctcacagtgtgcacct

SEQ ID NO: 107976 - DNA, 25 bp, Mus musculus
acattccagctctcagtgtgcacct

SEQ ID NO: 107977 - DNA, 25 bp, Mus musculus
acattccaggctattcgactttagg

SEQ ID NO: 107978 - DNA, 25 bp, Mus musculus
acattccaggcttttcgactttagg

SEQ ID NO: 107979 - DNA, 25 bp, Mus musculus
acattccagggccagcgcagaacca

SEQ ID NO: 107980 - DNA, 25 bp, Mus musculus
acattccagggcgagcgcagaacca

SEQ ID NO: 107981 - DNA, 25 bp, Mus musculus
acattccaggttacctctgggagta

SEQ ID NO: 107982 - DNA, 25 bp, Mus musculus
acattccaggtttcctctgggagta

SEQ ID NO: 107983 - DNA, 25 bp, Mus musculus
acattccagtaacaactcggttcct

SEQ ID NO: 107984 - DNA, 25 bp, Mus musculus
acattccagtaagaactcggttcct

SEQ ID NO: 107985 - DNA, 25 bp, Mus musculus
acattccagttcatccgattgtttg

SEQ ID NO: 107986 - DNA, 25 bp, Mus musculus
acattccagttcttccgattgtttg

SEQ ID NO: 107987 - DNA, 25 bp, Mus musculus
acattccatgctaggctggaggcca

SEQ ID NO: 107988 - DNA, 25 bp, Mus musculus
acattccatgcttggctggaggcca

SEQ ID NO: 107989 - DNA, 25 bp, Mus musculus
acattccattacaaaattgcttctg

SEQ ID NO: 107990 - DNA, 25 bp, Mus musculus
acattccattactaaattgcttctg

SEQ ID NO: 107991 - DNA, 25 bp, Mus musculus
acattcccactccttatggcctata

SEQ ID NO: 107992 - DNA, 25 bp, Mus musculus
acattcccactcgttatggcctata

SEQ ID NO: 107993 - DNA, 25 bp, Mus musculus
acattcccactgaagctgtcaaggc

SEQ ID NO: 107994 - DNA, 25 bp, Mus musculus
acattcccactgtagctgtcaaggc

SEQ ID NO: 107995 - DNA, 25 bp, Mus musculus
acattcccaggtatgatctgacaga

SEQ ID NO: 107996 - DNA, 25 bp, Mus musculus
acattcccaggtttgatctgacaga

SEQ ID NO: 107997 - DNA, 25 bp, Mus musculus
acattcccagttattgggcccttag

SEQ ID NO: 107998 - DNA, 25 bp, Mus musculus
acattcccagtttttgggcccttag

SEQ ID NO: 107999 - DNA, 25 bp, Mus musculus
acattccccgatctcggatttcgct

SEQ ID NO: 108000 - DNA, 25 bp, Mus musculus
acattccccgatgtcggatttcgct

SEQ ID NO: 108001 - DNA, 25 bp, Mus musculus
acattcccgacaagtgggtcctgca

SEQ ID NO: 108002 - DNA, 25 bp, Mus musculus
acattcccgacatgtgggtcctgca

SEQ ID NO: 108003 - DNA, 25 bp, Mus musculus
acattccctaccactcttaaagatc

SEQ ID NO: 108004 - DNA, 25 bp, Mus musculus
acattccctacctctcttaaagatc

SEQ ID NO: 108005 - DNA, 25 bp, Mus musculus
acattccctactatgtctaaccagg

SEQ ID NO: 108006 - DNA, 25 bp, Mus musculus
acattccctactttgtctaaccagg

SEQ ID NO: 108007 - DNA, 25 bp, Mus musculus
acattccctcatataagcctcttga

SEQ ID NO: 108008 - DNA, 25 bp, Mus musculus
acattccctcatttaagcctcttga

SEQ ID NO: 108009 - DNA, 25 bp, Mus musculus
acattccctcccatatatgaagtga

SEQ ID NO: 108010 - DNA, 25 bp, Mus musculus
acattccctcccttatatgaagtga

SEQ ID NO: 108011 - DNA, 25 bp, Mus musculus
acattccctggactgtacattaata

SEQ ID NO: 108012 - DNA, 25 bp, Mus musculus
acattccctggagtgtacattaata

SEQ ID NO: 108013 - DNA, 25 bp, Mus musculus
acattccctgttcagagtgggtagg

SEQ ID NO: 108014 - DNA, 25 bp, Mus musculus
acattccctgttgagagtgggtagg

SEQ ID NO: 108015 - DNA, 25 bp, Mus musculus
acattccgaaaaactcatctgttat

SEQ ID NO: 108016 - DNA, 25 bp, Mus musculus
acattccgaaaatctcatctgttat

SEQ ID NO: 108017 - DNA, 25 bp, Mus musculus
acattccgaggaagacactagaaga

SEQ ID NO: 108018 - DNA, 25 bp, Mus musculus
acattccgaggatgacactagaaga

SEQ ID NO: 108019 - DNA, 25 bp, Mus musculus
acattccggaacccagatgatgtct

SEQ ID NO: 108020 - DNA, 25 bp, Mus musculus
acattccggaacgcagatgatgtct

SEQ ID NO: 108021 - DNA, 25 bp, Mus musculus
acattccggcttccacatgcacata

SEQ ID NO: 108022 - DNA, 25 bp, Mus musculus
acattccggcttgcacatgcacata

SEQ ID NO: 108023 - DNA, 25 bp, Mus musculus
acattcctatgtctgttgacagact

SEQ ID NO: 108024 - DNA, 25 bp, Mus musculus
acattcctatgtgtgttgacagact

SEQ ID NO: 108025 - DNA, 25 bp, Mus musculus
acattcctcaagctctatgctagtc

SEQ ID NO: 108026 - DNA, 25 bp, Mus musculus
acattcctcaaggtctatgctagtc

SEQ ID NO: 108027 - DNA, 25 bp, Mus musculus
acattcctcattataccgtacattt

SEQ ID NO: 108028 - DNA, 25 bp, Mus musculus
acattcctcattttaccgtacattt

SEQ ID NO: 108029 - DNA, 25 bp, Mus musculus
acattcctccaaagtttgttgtttt

SEQ ID NO: 108030 - DNA, 25 bp, Mus musculus
acattcctccaatgtttgttgtttt

SEQ ID NO: 108031 - DNA, 25 bp, Mus musculus
acattcctctgcatcataggtgttc

SEQ ID NO: 108032 - DNA, 25 bp, Mus musculus
acattcctctgcatggaggccatga

SEQ ID NO: 108033 - DNA, 25 bp, Mus musculus
acattcctctgcttcataggtgttc

SEQ ID NO: 108034 - DNA, 25 bp, Mus musculus
acattcctctgcttggaggccatga

SEQ ID NO: 108035 - DNA, 25 bp, Mus musculus
acattcctcttcatcaactgctgag

SEQ ID NO: 108036 - DNA, 25 bp, Mus musculus
acattcctcttcttcaactgctgag

SEQ ID NO: 108037 - DNA, 25 bp, Mus musculus
acattcctgcgaagtttccattaca

SEQ ID NO: 108038 - DNA, 25 bp, Mus musculus
acattcctgcgatgtttccattaca

SEQ ID NO: 108039 - DNA, 25 bp, Mus musculus
acattcctggtcatctaccctgagg

SEQ ID NO: 108040 - DNA, 25 bp, Mus musculus
acattcctggtcttctaccctgagg

SEQ ID NO: 108041 - DNA, 25 bp, Mus musculus
acattccttccacgcttgggtgttg

SEQ ID NO: 108042 - DNA, 25 bp, Mus musculus
acattccttccaggcttgggtgttg

SEQ ID NO: 108043 - DNA, 25 bp, Mus musculus
acattccttgaacactatctgactt

SEQ ID NO: 108044 - DNA, 25 bp, Mus musculus
acattccttgaagactatctgactt

SEQ ID NO: 108045 - DNA, 25 bp, Mus musculus
acattccttgcaatactgatggtgg

SEQ ID NO: 108046 - DNA, 25 bp, Mus musculus
acattccttgcattactgatggtgg

SEQ ID NO: 108047 - DNA, 25 bp, Mus musculus
acattccttgccaacattagagctc

SEQ ID NO: 108048 - DNA, 25 bp, Mus musculus
acattccttgcctacattagagctc

SEQ ID NO: 108049 - DNA, 25 bp, Mus musculus
acattccttggaccaggtgtgggtt

SEQ ID NO: 108050 - DNA, 25 bp, Mus musculus
acattccttggagcaggtgtgggtt

SEQ ID NO: 108051 - DNA, 25 bp, Mus musculus
acattcctttgtaccagtgtttgaa

SEQ ID NO: 108052 - DNA, 25 bp, Mus musculus
acattcctttgttccagtgtttgaa

SEQ ID NO: 108053 - DNA, 25 bp, Mus musculus
acattcgatttcagcttgtctcagg

SEQ ID NO: 108054 - DNA, 25 bp, Mus musculus
acattcgatttctgcttgtctcagg

SEQ ID NO: 108055 - DNA, 25 bp, Mus musculus
acattcgatttgagctgttggcccg

SEQ ID NO: 108056 - DNA, 25 bp, Mus musculus
acattcgatttgtgctgttggcccg

SEQ ID NO: 108057 - DNA, 25 bp, Mus musculus
acattcgcagttcataggctatccc

SEQ ID NO: 108058 - DNA, 25 bp, Mus musculus
acattcgcagttgataggctatccc

SEQ ID NO: 108059 - DNA, 25 bp, Mus musculus
acattcgcccagcttttggctgtac

SEQ ID NO: 108060 - DNA, 25 bp, Mus musculus
acattcgcccaggttttggctgtac

SEQ ID NO: 108061 - DNA, 25 bp, Mus musculus
acattcggagacattgggtggcaag

SEQ ID NO: 108062 - DNA, 25 bp, Mus musculus
acattcggagactttgggtggcaag

SEQ ID NO: 108063 - DNA, 25 bp, Mus musculus
acattcgggaaaatcataagtctac

SEQ ID NO: 108064 - DNA, 25 bp, Mus musculus
acattcgggaaattcataagtctac

SEQ ID NO: 108065 - DNA, 25 bp, Mus musculus
acattcgggtaaatagcttcctgcc

SEQ ID NO: 108066 - DNA, 25 bp, Mus musculus
acattcgggtaattagcttcctgcc

SEQ ID NO: 108067 - DNA, 25 bp, Mus musculus
acattcggtctcctctggagtgtga

SEQ ID NO: 108068 - DNA, 25 bp, Mus musculus
acattcggtctcgtctggagtgtga

SEQ ID NO: 108069 - DNA, 25 bp, Mus musculus
acattcgtccttaccatagagcagg

SEQ ID NO: 108070 - DNA, 25 bp, Mus musculus
acattcgtcctttccatagagcagg

SEQ ID NO: 108071 - DNA, 25 bp, Mus musculus
acattctaaagcagtgtaacttgta

SEQ ID NO: 108072 - DNA, 25 bp, Mus musculus
acattctaaagctgtgtaacttgta

SEQ ID NO: 108073 - DNA, 25 bp, Mus musculus
acattctaagatactactgtgtcaa

SEQ ID NO: 108074 - DNA, 25 bp, Mus musculus
acattctaagattctactgtgtcaa

SEQ ID NO: 108075 - DNA, 25 bp, Mus musculus
acattctacattcagatgccccagc

SEQ ID NO: 108076 - DNA, 25 bp, Mus musculus
acattctacattgagatgccccagc

SEQ ID NO: 108077 - DNA, 25 bp, Mus musculus
acattctagattatcatctttgaaa

SEQ ID NO: 108078 - DNA, 25 bp, Mus musculus
acattctagattttcatctttgaaa

SEQ ID NO: 108079 - DNA, 25 bp, Mus musculus
acattctagcgaagctcatacacat

SEQ ID NO: 108080 - DNA, 25 bp, Mus musculus
acattctagcgatgctcatacacat

SEQ ID NO: 108081 - DNA, 25 bp, Mus musculus
acattctaggataacctggcccaaa

SEQ ID NO: 108082 - DNA, 25 bp, Mus musculus
acattctaggattacctggcccaaa

SEQ ID NO: 108083 - DNA, 25 bp, Mus musculus
acattctatgtaaatccccaacacc

SEQ ID NO: 108084 - DNA, 25 bp, Mus musculus
acattctatgtatatccccaacacc

SEQ ID NO: 108085 - DNA, 25 bp, Mus musculus
acattctcacatacttggactcttg

SEQ ID NO: 108086 - DNA, 25 bp, Mus musculus
acattctcacattcttggactcttg

SEQ ID NO: 108087 - DNA, 25 bp, Mus musculus
acattctcagaaaagctccagtttg

SEQ ID NO: 108088 - DNA, 25 bp, Mus musculus
acattctcagaatagctccagtttg

SEQ ID NO: 108089 - DNA, 25 bp, Mus musculus
acattctcagtgctcgtgccatggt

SEQ ID NO: 108090 - DNA, 25 bp, Mus musculus
acattctcagtggtcgtgccatggt

SEQ ID NO: 108091 - DNA, 25 bp, Mus musculus
acattctcatagagatccgttccac

SEQ ID NO: 108092 - DNA, 25 bp, Mus musculus
acattctcatagtgatccgttccac

SEQ ID NO: 108093 - DNA, 25 bp, Mus musculus
acattctcccctcggagtttggagt

SEQ ID NO: 108094 - DNA, 25 bp, Mus musculus
acattctcccctgggagtttggagt

SEQ ID NO: 108095 - DNA, 25 bp, Mus musculus
acattctctataccattctacacat

SEQ ID NO: 108096 - DNA, 25 bp, Mus musculus
acattctctatagcattctacacat

SEQ ID NO: 108097 - DNA, 25 bp, Mus musculus
acattctctcgtagcgtgtgtgcat

SEQ ID NO: 108098 - DNA, 25 bp, Mus musculus
acattctctcgttgcgtgtgtgcat

SEQ ID NO: 108099 - DNA, 25 bp, Mus musculus
acattctctgatacactgcttgcta

SEQ ID NO: 108100 - DNA, 25 bp, Mus musculus
acattctctgattcactgcttgcta

SEQ ID NO: 108101 - DNA, 25 bp, Mus musculus
acattctctgccatggagctcacag

SEQ ID NO: 108102 - DNA, 25 bp, Mus musculus
acattctctgccttggagctcacag

SEQ ID NO: 108103 - DNA, 25 bp, Mus musculus
acattctctttaaagttcctgactc

SEQ ID NO: 108104 - DNA, 25 bp, Mus musculus
acattctctttatagttcctgactc

SEQ ID NO: 108105 - DNA, 25 bp, Mus musculus
acattctgacatactcctgacaaat

SEQ ID NO: 108106 - DNA, 25 bp, Mus musculus
acattctgacattctcctgacaaat

SEQ ID NO: 108107 - DNA, 25 bp, Mus musculus
acattctgacggcggctagcctgac

SEQ ID NO: 108108 - DNA, 25 bp, Mus musculus
acattctgacgggggctagcctgac

SEQ ID NO: 108109 - DNA, 25 bp, Mus musculus
acattctgagggatacctaaccagt

SEQ ID NO: 108110 - DNA, 25 bp, Mus musculus
acattctgagggttacctaaccagt

SEQ ID NO: 108111 - DNA, 25 bp, Mus musculus
acattctgaggtcccagtagaactg

SEQ ID NO: 108112 - DNA, 25 bp, Mus musculus
acattctgaggtgccagtagaactg

SEQ ID NO: 108113 - DNA, 25 bp, Mus musculus
acattctgcaatctgattctaaaca

SEQ ID NO: 108114 - DNA, 25 bp, Mus musculus
acattctgcaatgtgattctaaaca

SEQ ID NO: 108115 - DNA, 25 bp, Mus musculus
acattctgggacagagactgccctg

SEQ ID NO: 108116 - DNA, 25 bp, Mus musculus
acattctgggactgagactgccctg

SEQ ID NO: 108117 - DNA, 25 bp, Mus musculus
acattctgtaacatgttggctgaag

SEQ ID NO: 108118 - DNA, 25 bp, Mus musculus
acattctgtaacttgttggctgaag

SEQ ID NO: 108119 - DNA, 25 bp, Mus musculus
acattctgtagcaaagtccttttca

SEQ ID NO: 108120 - DNA, 25 bp, Mus musculus
acattctgtagctaagtccttttca

SEQ ID NO: 108121 - DNA, 25 bp, Mus musculus
acattctgtctgcatggagttgctc

SEQ ID NO: 108122 - DNA, 25 bp, Mus musculus
acattctgtctggatggagttgctc

SEQ ID NO: 108123 - DNA, 25 bp, Mus musculus
acattctgtgtgaaggtcctctacc

SEQ ID NO: 108124 - DNA, 25 bp, Mus musculus
acattctgtgtgtaggtcctctacc

SEQ ID NO: 108125 - DNA, 25 bp, Mus musculus
acattctgttagatcgtgtaataat

SEQ ID NO: 108126 - DNA, 25 bp, Mus musculus
acattctgttagttcgtgtaataat

SEQ ID NO: 108127 - DNA, 25 bp, Mus musculus
acattcttagataggagttcgcatt

SEQ ID NO: 108128 - DNA, 25 bp, Mus musculus
acattcttagattggagttcgcatt

SEQ ID NO: 108129 - DNA, 25 bp, Mus musculus
acattcttcagtatgataggtctta

SEQ ID NO: 108130 - DNA, 25 bp, Mus musculus
acattcttcagtttgataggtctta

SEQ ID NO: 108131 - DNA, 25 bp, Mus musculus
acattcttcccaaggcaaagagcag

SEQ ID NO: 108132 - DNA, 25 bp, Mus musculus
acattcttcccatggcaaagagcag

SEQ ID NO: 108133 - DNA, 25 bp, Mus musculus
acattcttctcaaggcagtgacgtg

SEQ ID NO: 108134 - DNA, 25 bp, Mus musculus
acattcttctcatggcagtgacgtg

SEQ ID NO: 108135 - DNA, 25 bp, Mus musculus
acattcttctgcagggtgtctcagg

SEQ ID NO: 108136 - DNA, 25 bp, Mus musculus
acattcttctgctgggtgtctcagg

SEQ ID NO: 108137 - DNA, 25 bp, Mus musculus
acattcttctggcagggttaataca

SEQ ID NO: 108138 - DNA, 25 bp, Mus musculus
acattcttctgggagggttaataca

SEQ ID NO: 108139 - DNA, 25 bp, Mus musculus
acattcttgaagagcgcttggtgaa

SEQ ID NO: 108140 - DNA, 25 bp, Mus musculus
acattcttgaagtgcgcttggtgaa

SEQ ID NO: 108141 - DNA, 25 bp, Mus musculus
acattcttgaggagtttgctacctt

SEQ ID NO: 108142 - DNA, 25 bp, Mus musculus
acattcttgaggtgtttgctacctt

SEQ ID NO: 108143 - DNA, 25 bp, Mus musculus
acattcttggctcacaggttttgga

SEQ ID NO: 108144 - DNA, 25 bp, Mus musculus
acattcttggctgacaggttttgga

SEQ ID NO: 108145 - DNA, 25 bp, Mus musculus
acattcttgtaacatactccctcat

SEQ ID NO: 108146 - DNA, 25 bp, Mus musculus
acattcttgtaagatactccctcat

SEQ ID NO: 108147 - DNA, 25 bp, Mus musculus
acattcttgtatagggcagtcgttt

SEQ ID NO: 108148 - DNA, 25 bp, Mus musculus
acattcttgtattgggcagtcgttt

SEQ ID NO: 108149 - DNA, 25 bp, Mus musculus
acattcttgtcaaccgatactcttg

SEQ ID NO: 108150 - DNA, 25 bp, Mus musculus
acattcttgtcatccgatactcttg

SEQ ID NO: 108151 - DNA, 25 bp, Mus musculus
acattctttaaccacccttgagctg

SEQ ID NO: 108152 - DNA, 25 bp, Mus musculus
acattctttaacgacccttgagctg

SEQ ID NO: 108153 - DNA, 25 bp, Mus musculus
acattctttagcagttttctagtaa

SEQ ID NO: 108154 - DNA, 25 bp, Mus musculus
acattctttagctgttttctagtaa

SEQ ID NO: 108155 - DNA, 25 bp, Mus musculus
acattctttctcagtctgcagaaga

SEQ ID NO: 108156 - DNA, 25 bp, Mus musculus
acattctttctctgtctgcagaaga

SEQ ID NO: 108157 - DNA, 25 bp, Mus musculus
acattgaacttgcagggcagacctg

SEQ ID NO: 108158 - DNA, 25 bp, Mus musculus
acattgaacttggagggcagacctg

SEQ ID NO: 108159 - DNA, 25 bp, Mus musculus
acattgaagcggaccaggagctgga

SEQ ID NO: 108160 - DNA, 25 bp, Mus musculus
acattgaagcggtccaggagctgga

SEQ ID NO: 108161 - DNA, 25 bp, Mus musculus
acattgaaggccactgcacatctac

SEQ ID NO: 108162 - DNA, 25 bp, Mus musculus
acattgaaggcctctgcacatctac

SEQ ID NO: 108163 - DNA, 25 bp, Mus musculus
acattgaatgcgctctattgcccat

SEQ ID NO: 108164 - DNA, 25 bp, Mus musculus
acattgaatgcggtctattgcccat

SEQ ID NO: 108165 - DNA, 25 bp, Mus musculus
acattgacacgcaaaagatgcctct

SEQ ID NO: 108166 - DNA, 25 bp, Mus musculus
acattgacacgctaaagatgcctct

SEQ ID NO: 108167 - DNA, 25 bp, Mus musculus
acattgacattcaacgggaccctga

SEQ ID NO: 108168 - DNA, 25 bp, Mus musculus
acattgacattctacgggaccctga

SEQ ID NO: 108169 - DNA, 25 bp, Mus musculus
acattgacattgacggagcaggcca

SEQ ID NO: 108170 - DNA, 25 bp, Mus musculus
acattgacattgtcggagcaggcca

SEQ ID NO: 108171 - DNA, 25 bp, Mus musculus
acattgacccatctgtgtcatccta

SEQ ID NO: 108172 - DNA, 25 bp, Mus musculus
acattgacccatgtgtgtcatccta

SEQ ID NO: 108173 - DNA, 25 bp, Mus musculus
acattgaccgttacagtggacgccc

SEQ ID NO: 108174 - DNA, 25 bp, Mus musculus
acattgaccgtttcagtggacgccc

SEQ ID NO: 108175 - DNA, 25 bp, Mus musculus
acattgacctgtacggcagtgacga

SEQ ID NO: 108176 - DNA, 25 bp, Mus musculus
acattgacctgttcggcagtgacga

SEQ ID NO: 108177 - DNA, 25 bp, Mus musculus
acattgacgaggaccagtgcattct

SEQ ID NO: 108178 - DNA, 25 bp, Mus musculus
acattgacgaggtccagtgcattct

SEQ ID NO: 108179 - DNA, 25 bp, Mus musculus
acattgacgcaaagccacttgtggc

SEQ ID NO: 108180 - DNA, 25 bp, Mus musculus
acattgacgcaatgccacttgtggc

SEQ ID NO: 108181 - DNA, 25 bp, Mus musculus
acattgacgtcaagccatctttttt

SEQ ID NO: 108182 - DNA, 25 bp, Mus musculus
acattgacgtcatgccatctttttt

SEQ ID NO: 108183 - DNA, 25 bp, Mus musculus
acattgacttggcactattctgagt

SEQ ID NO: 108184 - DNA, 25 bp, Mus musculus
acattgacttgggactattctgagt

SEQ ID NO: 108185 - DNA, 25 bp, Mus musculus
acattgagaagcacccaagatacgg

SEQ ID NO: 108186 - DNA, 25 bp, Mus musculus
acattgagaagctcccaagatacgg

SEQ ID NO: 108187 - DNA, 25 bp, Mus musculus
acattgagattcagttccagagact

SEQ ID NO: 108188 - DNA, 25 bp, Mus musculus
acattgagattctgttccagagact

SEQ ID NO: 108189 - DNA, 25 bp, Mus musculus
acattgagctccatgagagtgtcct

SEQ ID NO: 108190 - DNA, 25 bp, Mus musculus
acattgagctccttgagagtgtcct

SEQ ID NO: 108191 - DNA, 25 bp, Mus musculus
acattgaggcttagtttggtttatt

SEQ ID NO: 108192 - DNA, 25 bp, Mus musculus
acattgaggctttgtttggtttatt

SEQ ID NO: 108193 - DNA, 25 bp, Mus musculus
acattgagggcgactttcctgagaa

SEQ ID NO: 108194 - DNA, 25 bp, Mus musculus
acattgagggcgtctttcctgagaa

SEQ ID NO: 108195 - DNA, 25 bp, Mus musculus
acattgagggtcatcagtggagaac

SEQ ID NO: 108196 - DNA, 25 bp, Mus musculus
acattgagggtcttcagtggagaac

SEQ ID NO: 108197 - DNA, 25 bp, Mus musculus
acattgagtggcatggactgggcct

SEQ ID NO: 108198 - DNA, 25 bp, Mus musculus
acattgagtggcttggactgggcct

SEQ ID NO: 108199 - DNA, 25 bp, Mus musculus
acattgagtgttacgtctgcgggca

SEQ ID NO: 108200 - DNA, 25 bp, Mus musculus
acattgagtgtttcgtctgcgggca

SEQ ID NO: 108201 - DNA, 25 bp, Mus musculus
acattgatagttcatctctggaaac

SEQ ID NO: 108202 - DNA, 25 bp, Mus musculus
acattgatagttgatctctggaaac

SEQ ID NO: 108203 - DNA, 25 bp, Mus musculus
acattgatcactcgttttgatgcta

SEQ ID NO: 108204 - DNA, 25 bp, Mus musculus
acattgatcactggttttgatgcta

SEQ ID NO: 108205 - DNA, 25 bp, Mus musculus
acattgatcgcacgaggagcaagga

SEQ ID NO: 108206 - DNA, 25 bp, Mus musculus
acattgatcgcaggaggagcaagga

SEQ ID NO: 108207 - DNA, 25 bp, Mus musculus
acattgatctttctgctctcagctg

SEQ ID NO: 108208 - DNA, 25 bp, Mus musculus
acattgatctttgtgctctcagctg

SEQ ID NO: 108209 - DNA, 25 bp, Mus musculus
acattgatgaagaattgaagaccca

SEQ ID NO: 108210 - DNA, 25 bp, Mus musculus
acattgatgaagtattgaagaccca

SEQ ID NO: 108211 - DNA, 25 bp, Mus musculus
acattgatgagtcactgacgtggca

SEQ ID NO: 108212 - DNA, 25 bp, Mus musculus
acattgatgagtctgtgaccggcat

SEQ ID NO: 108213 - DNA, 25 bp, Mus musculus
acattgatgagtgactgacgtggca

SEQ ID NO: 108214 - DNA, 25 bp, Mus musculus
acattgatgagtgtgtgaccggcat

SEQ ID NO: 108215 - DNA, 25 bp, Mus musculus
acattgatggcccacactgtgtcaa

SEQ ID NO: 108216 - DNA, 25 bp, Mus musculus
acattgatggcccagaccacaagct

SEQ ID NO: 108217 - DNA, 25 bp, Mus musculus
acattgatggccgacactgtgtcaa

SEQ ID NO: 108218 - DNA, 25 bp, Mus musculus
acattgatggccgagaccacaagct

SEQ ID NO: 108219 - DNA, 25 bp, Mus musculus
acattgcaaaatactccgctcttct

SEQ ID NO: 108220 - DNA, 25 bp, Mus musculus
acattgcaaaattctccgctcttct

SEQ ID NO: 108221 - DNA, 25 bp, Mus musculus
acattgcaagcaagttaggcccagc

SEQ ID NO: 108222 - DNA, 25 bp, Mus musculus
acattgcaagcatgttaggcccagc

SEQ ID NO: 108223 - DNA, 25 bp, Mus musculus
acattgcacacacctggtactcagg

SEQ ID NO: 108224 - DNA, 25 bp, Mus musculus
acattgcacacagctggtactcagg

SEQ ID NO: 108225 - DNA, 25 bp, Mus musculus
acattgcacactatactcatgcctg

SEQ ID NO: 108226 - DNA, 25 bp, Mus musculus
acattgcacactttactcatgcctg

SEQ ID NO: 108227 - DNA, 25 bp, Mus musculus
acattgcagaacattatgaaggcct

SEQ ID NO: 108228 - DNA, 25 bp, Mus musculus
acattgcagaactttatgaaggcct

SEQ ID NO: 108229 - DNA, 25 bp, Mus musculus
acattgcagatcactcagtcttgag

SEQ ID NO: 108230 - DNA, 25 bp, Mus musculus
acattgcagatctctcagtcttgag

SEQ ID NO: 108231 - DNA, 25 bp, Mus musculus
acattgcatcatcaggctcagctga

SEQ ID NO: 108232 - DNA, 25 bp, Mus musculus
acattgcatcatgaggctcagctga

SEQ ID NO: 108233 - DNA, 25 bp, Mus musculus
acattgccacaaagccctaggttag

SEQ ID NO: 108234 - DNA, 25 bp, Mus musculus
acattgccacaatgccctaggttag

SEQ ID NO: 108235 - DNA, 25 bp, Mus musculus
acattgccacttcttgaccctagag

SEQ ID NO: 108236 - DNA, 25 bp, Mus musculus
acattgccacttgttgaccctagag

SEQ ID NO: 108237 - DNA, 25 bp, Mus musculus
acattgcctctcactaccaaaggag

SEQ ID NO: 108238 - DNA, 25 bp, Mus musculus
acattgcctctctctaccaaaggag

SEQ ID NO: 108239 - DNA, 25 bp, Mus musculus
acattgcctgttcaccttatcatgg

SEQ ID NO: 108240 - DNA, 25 bp, Mus musculus
acattgcctgttgaccttatcatgg

SEQ ID NO: 108241 - DNA, 25 bp, Mus musculus
acattgccttatagtttctgctcag

SEQ ID NO: 108242 - DNA, 25 bp, Mus musculus
acattgccttattgtttctgctcag

SEQ ID NO: 108243 - DNA, 25 bp, Mus musculus
acattgcctttcaaacacagctttg

SEQ ID NO: 108244 - DNA, 25 bp, Mus musculus
acattgcctttctaacacagctttg

SEQ ID NO: 108245 - DNA, 25 bp, Mus musculus
acattgctaaggatgatgctgtcta

SEQ ID NO: 108246 - DNA, 25 bp, Mus musculus
acattgctaaggttgatgctgtcta

SEQ ID NO: 108247 - DNA, 25 bp, Mus musculus
acattgctaatgactcacacttgga

SEQ ID NO: 108248 - DNA, 25 bp, Mus musculus
acattgctaatgtctcacacttgga

SEQ ID NO: 108249 - DNA, 25 bp, Mus musculus
acattgctactgatttgtatgaaat

SEQ ID NO: 108250 - DNA, 25 bp, Mus musculus
acattgctactgttttgtatgaaat

SEQ ID NO: 108251 - DNA, 25 bp, Mus musculus
acattgctcgcaaagctactgacga

SEQ ID NO: 108252 - DNA, 25 bp, Mus musculus
acattgctcgcatagctactgacga

SEQ ID NO: 108253 - DNA, 25 bp, Mus musculus
acattgctggtgctagacccaaaac

SEQ ID NO: 108254 - DNA, 25 bp, Mus musculus
acattgctggtggtagacccaaaac

SEQ ID NO: 108255 - DNA, 25 bp, Mus musculus
acattgcttcatattataacggtca

SEQ ID NO: 108256 - DNA, 25 bp, Mus musculus
acattgcttcattttataacggtca

SEQ ID NO: 108257 - DNA, 25 bp, Mus musculus
acattgcttcgtctctatctagtta

SEQ ID NO: 108258 - DNA, 25 bp, Mus musculus
acattgcttcgtgtctatctagtta

SEQ ID NO: 108259 - DNA, 25 bp, Mus musculus
acattgcttgacattccttgttgtc

SEQ ID NO: 108260 - DNA, 25 bp, Mus musculus
acattgcttgacctgatttatgcag

SEQ ID NO: 108261 - DNA, 25 bp, Mus musculus
acattgcttgacgtgatttatgcag

SEQ ID NO: 108262 - DNA, 25 bp, Mus musculus
acattgcttgactttccttgttgtc

SEQ ID NO: 108263 - DNA, 25 bp, Mus musculus
acattgcttggcctgtttgaggtgc

SEQ ID NO: 108264 - DNA, 25 bp, Mus musculus
acattgcttggcgtgtttgaggtgc

SEQ ID NO: 108265 - DNA, 25 bp, Mus musculus
acattgcttttaatgacattcacac

SEQ ID NO: 108266 - DNA, 25 bp, Mus musculus
acattgcttttacctctgcttcaga

SEQ ID NO: 108267 - DNA, 25 bp, Mus musculus
acattgcttttagctctgcttcaga

SEQ ID NO: 108268 - DNA, 25 bp, Mus musculus
acattgcttttattgacattcacac

SEQ ID NO: 108269 - DNA, 25 bp, Mus musculus
acattggaaacccacttacacatcc

SEQ ID NO: 108270 - DNA, 25 bp, Mus musculus
acattggaaaccgacttacacatcc

SEQ ID NO: 108271 - DNA, 25 bp, Mus musculus
acattggacactagtttgattcgat

SEQ ID NO: 108272 - DNA, 25 bp, Mus musculus
acattggacacttgtttgattcgat

SEQ ID NO: 108273 - DNA, 25 bp, Mus musculus
acattggacagaaatcactcgcctt

SEQ ID NO: 108274 - DNA, 25 bp, Mus musculus
acattggacagatatcactcgcctt

SEQ ID NO: 108275 - DNA, 25 bp, Mus musculus
acattggaccacagagccttagaat

SEQ ID NO: 108276 - DNA, 25 bp, Mus musculus
acattggaccactgagccttagaat

SEQ ID NO: 108277 - DNA, 25 bp, Mus musculus
acattggacggcagctggtgttctc

SEQ ID NO: 108278 - DNA, 25 bp, Mus musculus
acattggacggctgctggtgttctc

SEQ ID NO: 108279 - DNA, 25 bp, Mus musculus
acattggactcgatttccaaccact

SEQ ID NO: 108280 - DNA, 25 bp, Mus musculus
acattggactcgttttccaaccact

SEQ ID NO: 108281 - DNA, 25 bp, Mus musculus
acattggagagacgaccacttcctc

SEQ ID NO: 108282 - DNA, 25 bp, Mus musculus
acattggagagaggaccacttcctc

SEQ ID NO: 108283 - DNA, 25 bp, Mus musculus
acattggagcaacctgacgtccggg

SEQ ID NO: 108284 - DNA, 25 bp, Mus musculus
acattggagcaagctgacgtccggg

SEQ ID NO: 108285 - DNA, 25 bp, Mus musculus
acattggagcatctttctgcagcct

SEQ ID NO: 108286 - DNA, 25 bp, Mus musculus
acattggagcatgtttctgcagcct

SEQ ID NO: 108287 - DNA, 25 bp, Mus musculus
acattggatccactaaccagcttca

SEQ ID NO: 108288 - DNA, 25 bp, Mus musculus
acattggatccagtaaccagcttca

SEQ ID NO: 108289 - DNA, 25 bp, Mus musculus
acattggatgtgaccaagtgcttaa

SEQ ID NO: 108290 - DNA, 25 bp, Mus musculus
acattggatgtgtccaagtgcttaa

SEQ ID NO: 108291 - DNA, 25 bp, Mus musculus
acattggcacctcttgtacctaaat

SEQ ID NO: 108292 - DNA, 25 bp, Mus musculus
acattggcacctgttgtacctaaat

SEQ ID NO: 108293 - DNA, 25 bp, Mus musculus
acattggcacgcatccgcaacaagg

SEQ ID NO: 108294 - DNA, 25 bp, Mus musculus
acattggcacgcttccgcaacaagg

SEQ ID NO: 108295 - DNA, 25 bp, Mus musculus
acattggcagccctgaccagatcat

SEQ ID NO: 108296 - DNA, 25 bp, Mus musculus
acattggcagccgtgaccagatcat

SEQ ID NO: 108297 - DNA, 25 bp, Mus musculus
acattggcagtgcttgactttcctt

SEQ ID NO: 108298 - DNA, 25 bp, Mus musculus
acattggcagtggttgactttcctt

SEQ ID NO: 108299 - DNA, 25 bp, Mus musculus
acattggcatggatgaccggcgtcg

SEQ ID NO: 108300 - DNA, 25 bp, Mus musculus
acattggcatggttgaccggcgtcg

SEQ ID NO: 108301 - DNA, 25 bp, Mus musculus
acattggccaggacatcatgtccat

SEQ ID NO: 108302 - DNA, 25 bp, Mus musculus
acattggccaggtcatcatgtccat

SEQ ID NO: 108303 - DNA, 25 bp, Mus musculus
acattggccagtcctagtcatctct

SEQ ID NO: 108304 - DNA, 25 bp, Mus musculus
acattggccagtgctagtcatctct

SEQ ID NO: 108305 - DNA, 25 bp, Mus musculus
acattggcccgtaggctggccgaga

SEQ ID NO: 108306 - DNA, 25 bp, Mus musculus
acattggcccgttggctggccgaga

SEQ ID NO: 108307 - DNA, 25 bp, Mus musculus
acattggccctgctacggttctgtg

SEQ ID NO: 108308 - DNA, 25 bp, Mus musculus
acattggccctggtacggttctgtg

SEQ ID NO: 108309 - DNA, 25 bp, Mus musculus
acattggcgccacctggtgttctcg

SEQ ID NO: 108310 - DNA, 25 bp, Mus musculus
acattggcgccagctggtgttctcg

SEQ ID NO: 108311 - DNA, 25 bp, Mus musculus
acattggctgcactgtggctactaa

SEQ ID NO: 108312 - DNA, 25 bp, Mus musculus
acattggctgcagtgtggctactaa

SEQ ID NO: 108313 - DNA, 25 bp, Mus musculus
acattggctggcaggtgatagctct

SEQ ID NO: 108314 - DNA, 25 bp, Mus musculus
acattggctggctggtgatagctct

SEQ ID NO: 108315 - DNA, 25 bp, Mus musculus
acattggcttccctgctgtggcctt

SEQ ID NO: 108316 - DNA, 25 bp, Mus musculus
acattggcttccgtgctgtggcctt

SEQ ID NO: 108317 - DNA, 25 bp, Mus musculus
acattggcttggcattcccacgtac

SEQ ID NO: 108318 - DNA, 25 bp, Mus musculus
acattggcttgggattcccacgtac

SEQ ID NO: 108319 - DNA, 25 bp, Mus musculus
acattgggactgaactctcctatct

SEQ ID NO: 108320 - DNA, 25 bp, Mus musculus
acattgggactgtactctcctatct

SEQ ID NO: 108321 - DNA, 25 bp, Mus musculus
acattgggagtgatccttagctcct

SEQ ID NO: 108322 - DNA, 25 bp, Mus musculus
acattgggagtgttccttagctcct

SEQ ID NO: 108323 - DNA, 25 bp, Mus musculus
acattgggccagactccgtgggaga

SEQ ID NO: 108324 - DNA, 25 bp, Mus musculus
acattgggccagtctccgtgggaga

SEQ ID NO: 108325 - DNA, 25 bp, Mus musculus
acattgggcgcgagaatgcccatga

SEQ ID NO: 108326 - DNA, 25 bp, Mus musculus
acattgggcgcgtgaatgcccatga

SEQ ID NO: 108327 - DNA, 25 bp, Mus musculus
acattgggctatacacaggcactta

SEQ ID NO: 108328 - DNA, 25 bp, Mus musculus
acattgggctattcacaggcactta

SEQ ID NO: 108329 - DNA, 25 bp, Mus musculus
acattgggctgtcctatgggaattg

SEQ ID NO: 108330 - DNA, 25 bp, Mus musculus
acattgggctgtgctatgggaattg

SEQ ID NO: 108331 - DNA, 25 bp, Mus musculus
acattggtccttctgagaacctcac

SEQ ID NO: 108332 - DNA, 25 bp, Mus musculus
acattggtccttgtgagaacctcac

SEQ ID NO: 108333 - DNA, 25 bp, Mus musculus
acattggtctgtaaagctagttgca

SEQ ID NO: 108334 - DNA, 25 bp, Mus musculus
acattggtctgtctgtgcctgcttc

SEQ ID NO: 108335 - DNA, 25 bp, Mus musculus
acattggtctgtgtgtgcctgcttc

SEQ ID NO: 108336 - DNA, 25 bp, Mus musculus
acattggtctgttaagctagttgca

SEQ ID NO: 108337 - DNA, 25 bp, Mus musculus
acattggtggctcgcctcttttata

SEQ ID NO: 108338 - DNA, 25 bp, Mus musculus
acattggtggctggcctcttttata

SEQ ID NO: 108339 - DNA, 25 bp, Mus musculus
acattggtgggcaccgagttcagtg

SEQ ID NO: 108340 - DNA, 25 bp, Mus musculus
acattggtgggctccgagttcagtg

SEQ ID NO: 108341 - DNA, 25 bp, Mus musculus
acattggtgtgtatagagatttagt

SEQ ID NO: 108342 - DNA, 25 bp, Mus musculus
acattggtgtgtttagagatttagt

SEQ ID NO: 108343 - DNA, 25 bp, Mus musculus
acattggtgttaattctcgaggacc

SEQ ID NO: 108344 - DNA, 25 bp, Mus musculus
acattggtgttatttctcgaggacc

SEQ ID NO: 108345 - DNA, 25 bp, Mus musculus
acattggtgttcactttgatagctc

SEQ ID NO: 108346 - DNA, 25 bp, Mus musculus
acattggtgttcatgtagctggaac

SEQ ID NO: 108347 - DNA, 25 bp, Mus musculus
acattggtgttctctttgatagctc

SEQ ID NO: 108348 - DNA, 25 bp, Mus musculus
acattggtgttcttgtagctggaac

SEQ ID NO: 108349 - DNA, 25 bp, Mus musculus
acattggttatcagtgtggtaaaga

SEQ ID NO: 108350 - DNA, 25 bp, Mus musculus
acattggttatctgtgtggtaaaga

SEQ ID NO: 108351 - DNA, 25 bp, Mus musculus
acattggttcctctgagcatctgac

SEQ ID NO: 108352 - DNA, 25 bp, Mus musculus
acattggttcctgtgagcatctgac

SEQ ID NO: 108353 - DNA, 25 bp, Mus musculus
acattggtttgcagatagccttctt

SEQ ID NO: 108354 - DNA, 25 bp, Mus musculus
acattggtttgctgatagccttctt

SEQ ID NO: 108355 - DNA, 25 bp, Mus musculus
acattggttttgaaatcctgggctt

SEQ ID NO: 108356 - DNA, 25 bp, Mus musculus
acattggttttgtaatcctgggctt

SEQ ID NO: 108357 - DNA, 25 bp, Mus musculus
acattgtaagttctgcagggctgca

SEQ ID NO: 108358 - DNA, 25 bp, Mus musculus
acattgtaagttgtgcagggctgca

SEQ ID NO: 108359 - DNA, 25 bp, Mus musculus
acattgtaatccatgcctcagacct

SEQ ID NO: 108360 - DNA, 25 bp, Mus musculus
acattgtaatccttgcctcagacct

SEQ ID NO: 108361 - DNA, 25 bp, Mus musculus
acattgtacatgataagccttcccc

SEQ ID NO: 108362 - DNA, 25 bp, Mus musculus
acattgtacatgttaagccttcccc

SEQ ID NO: 108363 - DNA, 25 bp, Mus musculus
acattgtactgtactgccttgaaag

SEQ ID NO: 108364 - DNA, 25 bp, Mus musculus
acattgtactgttctgccttgaaag

SEQ ID NO: 108365 - DNA, 25 bp, Mus musculus
acattgtagttaaacttgatactta

SEQ ID NO: 108366 - DNA, 25 bp, Mus musculus
acattgtagttatacttgatactta

SEQ ID NO: 108367 - DNA, 25 bp, Mus musculus
acattgtatacaacgtagcccagat

SEQ ID NO: 108368 - DNA, 25 bp, Mus musculus
acattgtatacatcgtagcccagat

SEQ ID NO: 108369 - DNA, 25 bp, Mus musculus
acattgtatctgatccacctggtga

SEQ ID NO: 108370 - DNA, 25 bp, Mus musculus
acattgtatctgttccacctggtga

SEQ ID NO: 108371 - DNA, 25 bp, Mus musculus
acattgtcaaatcttctttgcacta

SEQ ID NO: 108372 - DNA, 25 bp, Mus musculus
acattgtcaaatgttctttgcacta

SEQ ID NO: 108373 - DNA, 25 bp, Mus musculus
acattgtcacaactcagccaacagg

SEQ ID NO: 108374 - DNA, 25 bp, Mus musculus
acattgtcacaagtcagccaacagg

SEQ ID NO: 108375 - DNA, 25 bp, Mus musculus
acattgtcactcacgctctggagag

SEQ ID NO: 108376 - DNA, 25 bp, Mus musculus
acattgtcactctcgctctggagag

SEQ ID NO: 108377 - DNA, 25 bp, Mus musculus
acattgtccagtatgtgcccttcag

SEQ ID NO: 108378 - DNA, 25 bp, Mus musculus
acattgtccagtttgtgcccttcag

SEQ ID NO: 108379 - DNA, 25 bp, Mus musculus
acattgtctcaacaggaacacccca

SEQ ID NO: 108380 - DNA, 25 bp, Mus musculus
acattgtctcaagaggaacacccca

SEQ ID NO: 108381 - DNA, 25 bp, Mus musculus
acattgtctctaatttgtacacggg

SEQ ID NO: 108382 - DNA, 25 bp, Mus musculus
acattgtctctattttgtacacggg

SEQ ID NO: 108383 - DNA, 25 bp, Mus musculus
acattgtctgtgctgtccctgaaac

SEQ ID NO: 108384 - DNA, 25 bp, Mus musculus
acattgtctgtggtgtccctgaaac

SEQ ID NO: 108385 - DNA, 25 bp, Mus musculus
acattgtcttcaagtgtgtttacct

SEQ ID NO: 108386 - DNA, 25 bp, Mus musculus
acattgtcttcatgtgtgtttacct

SEQ ID NO: 108387 - DNA, 25 bp, Mus musculus
acattgtgatatccagcggcttcgt

SEQ ID NO: 108388 - DNA, 25 bp, Mus musculus
acattgtgatatgcagcggcttcgt

SEQ ID NO: 108389 - DNA, 25 bp, Mus musculus
acattgtgcatgattaccccttttc

SEQ ID NO: 108390 - DNA, 25 bp, Mus musculus
acattgtgcatgtttaccccttttc

SEQ ID NO: 108391 - DNA, 25 bp, Mus musculus
acattgtgccttacacttcggagag

SEQ ID NO: 108392 - DNA, 25 bp, Mus musculus
acattgtgcctttcacttcggagag

SEQ ID NO: 108393 - DNA, 25 bp, Mus musculus
acattgtgcgccctgcctgtgaaag

SEQ ID NO: 108394 - DNA, 25 bp, Mus musculus
acattgtgcgccgtgcctgtgaaag

SEQ ID NO: 108395 - DNA, 25 bp, Mus musculus
acattgtgcttactgttgtagtaat

SEQ ID NO: 108396 - DNA, 25 bp, Mus musculus
acattgtgcttagtgttgtagtaat

SEQ ID NO: 108397 - DNA, 25 bp, Mus musculus
acattgtgtgtgaagccatatttga

SEQ ID NO: 108398 - DNA, 25 bp, Mus musculus
acattgtgtgtgtagccatatttga

SEQ ID NO: 108399 - DNA, 25 bp, Mus musculus
acattgtgttggaggcatctttggc

SEQ ID NO: 108400 - DNA, 25 bp, Mus musculus
acattgtgttggtggcatctttggc

SEQ ID NO: 108401 - DNA, 25 bp, Mus musculus
acattgtgtttacctgtttggcctc

SEQ ID NO: 108402 - DNA, 25 bp, Mus musculus
acattgtgtttagctgtttggcctc

SEQ ID NO: 108403 - DNA, 25 bp, Mus musculus
acattgtgtttcatcccactataat

SEQ ID NO: 108404 - DNA, 25 bp, Mus musculus
acattgtgtttcttcccactataat

SEQ ID NO: 108405 - DNA, 25 bp, Mus musculus
acattgttacatatattctcaagtg

SEQ ID NO: 108406 - DNA, 25 bp, Mus musculus
acattgttacatttattctcaagtg

SEQ ID NO: 108407 - DNA, 25 bp, Mus musculus
acattgttcaccattaggcacctga

SEQ ID NO: 108408 - DNA, 25 bp, Mus musculus
acattgttcacctttaggcacctga

SEQ ID NO: 108409 - DNA, 25 bp, Mus musculus
acattgttcagtctggcttttgcat

SEQ ID NO: 108410 - DNA, 25 bp, Mus musculus
acattgttcagtgtggcttttgcat

SEQ ID NO: 108411 - DNA, 25 bp, Mus musculus
acattgttccataacagtggatgaa

SEQ ID NO: 108412 - DNA, 25 bp, Mus musculus
acattgttccattacagtggatgaa

SEQ ID NO: 108413 - DNA, 25 bp, Mus musculus
acattgttcctaattctgttttctg

SEQ ID NO: 108414 - DNA, 25 bp, Mus musculus
acattgttcctatttctgttttctg

SEQ ID NO: 108415 - DNA, 25 bp, Mus musculus
acattgttcttgagtgccagtttct

SEQ ID NO: 108416 - DNA, 25 bp, Mus musculus
acattgttcttgtgtgccagtttct

SEQ ID NO: 108417 - DNA, 25 bp, Mus musculus
acattgtttaccatttgtgcttctt

SEQ ID NO: 108418 - DNA, 25 bp, Mus musculus
acattgtttaccttttgtgcttctt

SEQ ID NO: 108419 - DNA, 25 bp, Mus musculus
acattgtttcctattatctggtggt

SEQ ID NO: 108420 - DNA, 25 bp, Mus musculus
acattgtttccttttatctggtggt

SEQ ID NO: 108421 - DNA, 25 bp, Mus musculus
acattgtttctcaaccatggagcta

SEQ ID NO: 108422 - DNA, 25 bp, Mus musculus
acattgtttctctaccatggagcta

SEQ ID NO: 108423 - DNA, 25 bp, Mus musculus
acattgtttgctacgctgttccttt

SEQ ID NO: 108424 - DNA, 25 bp, Mus musculus
acattgtttgcttcgctgttccttt

SEQ ID NO: 108425 - DNA, 25 bp, Mus musculus
acattgtttgtactgagctttttgc

SEQ ID NO: 108426 - DNA, 25 bp, Mus musculus
acattgtttgtagtgagctttttgc

SEQ ID NO: 108427 - DNA, 25 bp, Mus musculus
acattgtttgtgaactggagtttct

SEQ ID NO: 108428 - DNA, 25 bp, Mus musculus
acattgtttgtgtactggagtttct

SEQ ID NO: 108429 - DNA, 25 bp, Mus musculus
acattgtttgttactattcttagca

SEQ ID NO: 108430 - DNA, 25 bp, Mus musculus
acattgtttgtttctattcttagca

SEQ ID NO: 108431 - DNA, 25 bp, Mus musculus
acatttaaattgctcgagaagctgc

SEQ ID NO: 108432 - DNA, 25 bp, Mus musculus
acatttaaattggtcgagaagctgc

SEQ ID NO: 108433 - DNA, 25 bp, Mus musculus
acatttaaccctatgagtccttgct

SEQ ID NO: 108434 - DNA, 25 bp, Mus musculus
acatttaaccctttgagtccttgct

SEQ ID NO: 108435 - DNA, 25 bp, Mus musculus
acatttaactgtagactgggttgta

SEQ ID NO: 108436 - DNA, 25 bp, Mus musculus
acatttaactgttgactgggttgta

SEQ ID NO: 108437 - DNA, 25 bp, Mus musculus
acatttaatgacagcacttgcccac

SEQ ID NO: 108438 - DNA, 25 bp, Mus musculus
acatttaatgactgcacttgcccac

SEQ ID NO: 108439 - DNA, 25 bp, Mus musculus
acatttacagtaaacctatttcgtc

SEQ ID NO: 108440 - DNA, 25 bp, Mus musculus
acatttacagtatacctatttcgtc

SEQ ID NO: 108441 - DNA, 25 bp, Mus musculus
acatttacattgacaccttctggcg

SEQ ID NO: 108442 - DNA, 25 bp, Mus musculus
acatttacattgtcaccttctggcg

SEQ ID NO: 108443 - DNA, 25 bp, Mus musculus
acatttacgtagaagtccttgaaga

SEQ ID NO: 108444 - DNA, 25 bp, Mus musculus
acatttacgtagtagtccttgaaga

SEQ ID NO: 108445 - DNA, 25 bp, Mus musculus
acatttactaagaaaagcagccaag

SEQ ID NO: 108446 - DNA, 25 bp, Mus musculus
acatttactaagctgtgctgggtcc

SEQ ID NO: 108447 - DNA, 25 bp, Mus musculus
acatttactaaggtgtgctgggtcc

SEQ ID NO: 108448 - DNA, 25 bp, Mus musculus
acatttactaagtaaagcagccaag

SEQ ID NO: 108449 - DNA, 25 bp, Mus musculus
acatttacttcaagaggctacacct

SEQ ID NO: 108450 - DNA, 25 bp, Mus musculus
acatttacttcacactcaagcccga

SEQ ID NO: 108451 - DNA, 25 bp, Mus musculus
acatttacttcagactcaagcccga

SEQ ID NO: 108452 - DNA, 25 bp, Mus musculus
acatttacttcatgaggctacacct

SEQ ID NO: 108453 - DNA, 25 bp, Mus musculus
acatttacttgtacatggtgtgcat

SEQ ID NO: 108454 - DNA, 25 bp, Mus musculus
acatttacttgttcatggtgtgcat

SEQ ID NO: 108455 - DNA, 25 bp, Mus musculus
acatttagcaacagcgtcctttggg

SEQ ID NO: 108456 - DNA, 25 bp, Mus musculus
acatttagcaactgcgtcctttggg

SEQ ID NO: 108457 - DNA, 25 bp, Mus musculus
acatttagctctctgtcctcaatat

SEQ ID NO: 108458 - DNA, 25 bp, Mus musculus
acatttagctctgtgtcctcaatat

SEQ ID NO: 108459 - DNA, 25 bp, Mus musculus
acatttaggcatcagctcttggcag

SEQ ID NO: 108460 - DNA, 25 bp, Mus musculus
acatttaggcatgagctcttggcag

SEQ ID NO: 108461 - DNA, 25 bp, Mus musculus
acatttagggatcttctgcttcttt

SEQ ID NO: 108462 - DNA, 25 bp, Mus musculus
acatttagggatgttctgcttcttt

SEQ ID NO: 108463 - DNA, 25 bp, Mus musculus
acatttagggttaatcagagcttaa

SEQ ID NO: 108464 - DNA, 25 bp, Mus musculus
acatttagggtttatcagagcttaa

SEQ ID NO: 108465 - DNA, 25 bp, Mus musculus
acatttagtcatcttttttgcacaa

SEQ ID NO: 108466 - DNA, 25 bp, Mus musculus
acatttagtcatgttttttgcacaa

SEQ ID NO: 108467 - DNA, 25 bp, Mus musculus
acatttatcctaactgtctttcata

SEQ ID NO: 108468 - DNA, 25 bp, Mus musculus
acatttatcctatctgtctttcata

SEQ ID NO: 108469 - DNA, 25 bp, Mus musculus
acatttatgaagagcccatggaggc

SEQ ID NO: 108470 - DNA, 25 bp, Mus musculus
acatttatgaagtgcccatggaggc

SEQ ID NO: 108471 - DNA, 25 bp, Mus musculus
acatttatgactacctgctcactgg

SEQ ID NO: 108472 - DNA, 25 bp, Mus musculus
acatttatgacttcctgctcactgg

SEQ ID NO: 108473 - DNA, 25 bp, Mus musculus
acatttatgcacattgtatcaccgt

SEQ ID NO: 108474 - DNA, 25 bp, Mus musculus
acatttatgcactttgtatcaccgt

SEQ ID NO: 108475 - DNA, 25 bp, Mus musculus
acatttatggaacagcccctgtgcc

SEQ ID NO: 108476 - DNA, 25 bp, Mus musculus
acatttatggaagagcccctgtgcc

SEQ ID NO: 108477 - DNA, 25 bp, Mus musculus
acatttatgtccagggcagggtgag

SEQ ID NO: 108478 - DNA, 25 bp, Mus musculus
acatttatgtcctgggcagggtgag

SEQ ID NO: 108479 - DNA, 25 bp, Mus musculus
acatttatgtctcctgtcatctact

SEQ ID NO: 108480 - DNA, 25 bp, Mus musculus
acatttatgtctgctgtcatctact

SEQ ID NO: 108481 - DNA, 25 bp, Mus musculus
acatttattacaatcttccttacct

SEQ ID NO: 108482 - DNA, 25 bp, Mus musculus
acatttattacattcttccttacct

SEQ ID NO: 108483 - DNA, 25 bp, Mus musculus
acatttattcatcccggtctgttgc

SEQ ID NO: 108484 - DNA, 25 bp, Mus musculus
acatttattcatgccggtctgttgc

SEQ ID NO: 108485 - DNA, 25 bp, Mus musculus
acatttattcctccccgggattcgt

SEQ ID NO: 108486 - DNA, 25 bp, Mus musculus
acatttattcctgcccgggattcgt

SEQ ID NO: 108487 - DNA, 25 bp, Mus musculus
acatttatttccctagatcttttat

SEQ ID NO: 108488 - DNA, 25 bp, Mus musculus
acatttatttccgtagatcttttat

SEQ ID NO: 108489 - DNA, 25 bp, Mus musculus
acatttcaagaacatctcccggatc

SEQ ID NO: 108490 - DNA, 25 bp, Mus musculus
acatttcaagaagatctcccggatc

SEQ ID NO: 108491 - DNA, 25 bp, Mus musculus
acatttcacagtctggttctgggac

SEQ ID NO: 108492 - DNA, 25 bp, Mus musculus
acatttcacagtgtggttctgggac

SEQ ID NO: 108493 - DNA, 25 bp, Mus musculus
acatttcacatccttgcactataca

SEQ ID NO: 108494 - DNA, 25 bp, Mus musculus
acatttcacatcgttgcactataca

SEQ ID NO: 108495 - DNA, 25 bp, Mus musculus
acatttcacttaatctcgtaggctt

SEQ ID NO: 108496 - DNA, 25 bp, Mus musculus
acatttcacttattctcgtaggctt

SEQ ID NO: 108497 - DNA, 25 bp, Mus musculus
acatttcagatgacgttccagaccc

SEQ ID NO: 108498 - DNA, 25 bp, Mus musculus
acatttcagatgtcgttccagaccc

SEQ ID NO: 108499 - DNA, 25 bp, Mus musculus
acatttcagattcccataaaggagg

SEQ ID NO: 108500 - DNA, 25 bp, Mus musculus
acatttcagattgccataaaggagg

SEQ ID NO: 108501 - DNA, 25 bp, Mus musculus
acatttcagctgagtgacggaacat

SEQ ID NO: 108502 - DNA, 25 bp, Mus musculus
acatttcagctgtgtgacggaacat

SEQ ID NO: 108503 - DNA, 25 bp, Mus musculus
acatttcagcttaggaaacaccaaa

SEQ ID NO: 108504 - DNA, 25 bp, Mus musculus
acatttcagcttctgctatcttcca

SEQ ID NO: 108505 - DNA, 25 bp, Mus musculus
acatttcagcttgtgctatcttcca

SEQ ID NO: 108506 - DNA, 25 bp, Mus musculus
acatttcagctttggaaacaccaaa

SEQ ID NO: 108507 - DNA, 25 bp, Mus musculus
acatttcagggtacagtaactctta

SEQ ID NO: 108508 - DNA, 25 bp, Mus musculus
acatttcagggttcagtaactctta

SEQ ID NO: 108509 - DNA, 25 bp, Mus musculus
acatttcatagtacctaggcttagg

SEQ ID NO: 108510 - DNA, 25 bp, Mus musculus
acatttcatagttcctaggcttagg

SEQ ID NO: 108511 - DNA, 25 bp, Mus musculus
acatttcatatcactccatttctac

SEQ ID NO: 108512 - DNA, 25 bp, Mus musculus
acatttcatatctctccatttctac

SEQ ID NO: 108513 - DNA, 25 bp, Mus musculus
acatttccaccgacagtgaagctgt

SEQ ID NO: 108514 - DNA, 25 bp, Mus musculus
acatttccaccgtcagtgaagctgt

SEQ ID NO: 108515 - DNA, 25 bp, Mus musculus
acatttccagatacagataacttgc

SEQ ID NO: 108516 - DNA, 25 bp, Mus musculus
acatttccagattcagataacttgc

SEQ ID NO: 108517 - DNA, 25 bp, Mus musculus
acatttccagctcattctcaaaggc

SEQ ID NO: 108518 - DNA, 25 bp, Mus musculus
acatttccagctgattctcaaaggc

SEQ ID NO: 108519 - DNA, 25 bp, Mus musculus
acatttccagtgaagcaccaggttt

SEQ ID NO: 108520 - DNA, 25 bp, Mus musculus
acatttccagtgtagcaccaggttt

SEQ ID NO: 108521 - DNA, 25 bp, Mus musculus
acatttccatcgcagtattgaccat

SEQ ID NO: 108522 - DNA, 25 bp, Mus musculus
acatttccatcggagtattgaccat

SEQ ID NO: 108523 - DNA, 25 bp, Mus musculus
acatttccatctattcttgggcata

SEQ ID NO: 108524 - DNA, 25 bp, Mus musculus
acatttccatcttttcttgggcata

SEQ ID NO: 108525 - DNA, 25 bp, Mus musculus
acatttccatgtagcaggtactcaa

SEQ ID NO: 108526 - DNA, 25 bp, Mus musculus
acatttccatgttgcaggtactcaa

SEQ ID NO: 108527 - DNA, 25 bp, Mus musculus
acatttccattgaaagcacatttca

SEQ ID NO: 108528 - DNA, 25 bp, Mus musculus
acatttccattgtaagcacatttca

SEQ ID NO: 108529 - DNA, 25 bp, Mus musculus
acatttcccatgattccatgaggca

SEQ ID NO: 108530 - DNA, 25 bp, Mus musculus
acatttcccatgatttcccgaggac

SEQ ID NO: 108531 - DNA, 25 bp, Mus musculus
acatttcccatgtttccatgaggca

SEQ ID NO: 108532 - DNA, 25 bp, Mus musculus
acatttcccatgttttcccgaggac

SEQ ID NO: 108533 - DNA, 25 bp, Mus musculus
acatttccctgacagttcccaagta

SEQ ID NO: 108534 - DNA, 25 bp, Mus musculus
acatttccctgagagttcccaagta

SEQ ID NO: 108535 - DNA, 25 bp, Mus musculus
acatttccgggcacagctttctggc

SEQ ID NO: 108536 - DNA, 25 bp, Mus musculus
acatttccgggctcagctttctggc

SEQ ID NO: 108537 - DNA, 25 bp, Mus musculus
acatttcctattatcgcattttcaa

SEQ ID NO: 108538 - DNA, 25 bp, Mus musculus
acatttcctattctttgctgttctg

SEQ ID NO: 108539 - DNA, 25 bp, Mus musculus
acatttcctattgtttgctgttctg

SEQ ID NO: 108540 - DNA, 25 bp, Mus musculus
acatttcctattttcgcattttcaa

SEQ ID NO: 108541 - DNA, 25 bp, Mus musculus
acatttcctcatcccgagagtacag

SEQ ID NO: 108542 - DNA, 25 bp, Mus musculus
acatttcctcatgccgagagtacag

SEQ ID NO: 108543 - DNA, 25 bp, Mus musculus
acatttcctcctacattgaccagac

SEQ ID NO: 108544 - DNA, 25 bp, Mus musculus
acatttcctccttcattgaccagac

SEQ ID NO: 108545 - DNA, 25 bp, Mus musculus
acatttcctcgtatagctcttatca

SEQ ID NO: 108546 - DNA, 25 bp, Mus musculus
acatttcctcgtttagctcttatca

SEQ ID NO: 108547 - DNA, 25 bp, Mus musculus
acatttcctctcagttgggcagcag

SEQ ID NO: 108548 - DNA, 25 bp, Mus musculus
acatttcctctctgttgggcagcag

SEQ ID NO: 108549 - DNA, 25 bp, Mus musculus
acatttcctggacccttctgtaggt

SEQ ID NO: 108550 - DNA, 25 bp, Mus musculus
acatttcctggagccttctgtaggt

SEQ ID NO: 108551 - DNA, 25 bp, Mus musculus
acatttccttcaagatcacagccgg

SEQ ID NO: 108552 - DNA, 25 bp, Mus musculus
acatttccttcaaggctggattaac

SEQ ID NO: 108553 - DNA, 25 bp, Mus musculus
acatttccttcatgatcacagccgg

SEQ ID NO: 108554 - DNA, 25 bp, Mus musculus
acatttccttcatggctggattaac

SEQ ID NO: 108555 - DNA, 25 bp, Mus musculus
acatttccttcgctggtattgttta

SEQ ID NO: 108556 - DNA, 25 bp, Mus musculus
acatttccttcggtggtattgttta

SEQ ID NO: 108557 - DNA, 25 bp, Mus musculus
acatttcctttgcagagtctgccct

SEQ ID NO: 108558 - DNA, 25 bp, Mus musculus
acatttcctttggagagtctgccct

SEQ ID NO: 108559 - DNA, 25 bp, Mus musculus
acatttcgtttgctgtgtggtccag

SEQ ID NO: 108560 - DNA, 25 bp, Mus musculus
acatttcgtttggtgtgtggtccag

SEQ ID NO: 108561 - DNA, 25 bp, Mus musculus
acatttctaaccagagctttcctgc

SEQ ID NO: 108562 - DNA, 25 bp, Mus musculus
acatttctaacctgagctttcctgc

SEQ ID NO: 108563 - DNA, 25 bp, Mus musculus
acatttctccatctatagcttgcaa

SEQ ID NO: 108564 - DNA, 25 bp, Mus musculus
acatttctccatgtatagcttgcaa

SEQ ID NO: 108565 - DNA, 25 bp, Mus musculus
acatttctgcggatacctttgacat

SEQ ID NO: 108566 - DNA, 25 bp, Mus musculus
acatttctgcggttacctttgacat

SEQ ID NO: 108567 - DNA, 25 bp, Mus musculus
acatttctggataatgtccggccgc

SEQ ID NO: 108568 - DNA, 25 bp, Mus musculus
acatttctggattatgtccggccgc

SEQ ID NO: 108569 - DNA, 25 bp, Mus musculus
acatttctggtccttttctgtgttc

SEQ ID NO: 108570 - DNA, 25 bp, Mus musculus
acatttctggtcgttttctgtgttc

SEQ ID NO: 108571 - DNA, 25 bp, Mus musculus
acatttctggtgcagctatgctggc

SEQ ID NO: 108572 - DNA, 25 bp, Mus musculus
acatttctggtggagctatgctggc

SEQ ID NO: 108573 - DNA, 25 bp, Mus musculus
acatttctgtagatccttcctatta

SEQ ID NO: 108574 - DNA, 25 bp, Mus musculus
acatttctgtagttccttcctatta

SEQ ID NO: 108575 - DNA, 25 bp, Mus musculus
acatttctgtctaccagttgttggg

SEQ ID NO: 108576 - DNA, 25 bp, Mus musculus
acatttctgtcttccagttgttggg

SEQ ID NO: 108577 - DNA, 25 bp, Mus musculus
acatttctgtgtagagtggttattc

SEQ ID NO: 108578 - DNA, 25 bp, Mus musculus
acatttctgtgttgagtggttattc

SEQ ID NO: 108579 - DNA, 25 bp, Mus musculus
acatttctgtttctgttgcgctcac

SEQ ID NO: 108580 - DNA, 25 bp, Mus musculus
acatttctgtttgtgttgcgctcac

SEQ ID NO: 108581 - DNA, 25 bp, Mus musculus
acatttcttagcatgacctacctca

SEQ ID NO: 108582 - DNA, 25 bp, Mus musculus
acatttcttagcttgacctacctca

SEQ ID NO: 108583 - DNA, 25 bp, Mus musculus
acatttcttgaaatccagctagcat

SEQ ID NO: 108584 - DNA, 25 bp, Mus musculus
acatttcttgaattccagctagcat

SEQ ID NO: 108585 - DNA, 25 bp, Mus musculus
acatttctttacagcttcctactga

SEQ ID NO: 108586 - DNA, 25 bp, Mus musculus
acatttctttactgcttcctactga

SEQ ID NO: 108587 - DNA, 25 bp, Mus musculus
acatttctttcactgcctggtggaa

SEQ ID NO: 108588 - DNA, 25 bp, Mus musculus
acatttctttcagtgcctggtggaa

SEQ ID NO: 108589 - DNA, 25 bp, Mus musculus
acatttgaaatcatactggtctgaa

SEQ ID NO: 108590 - DNA, 25 bp, Mus musculus
acatttgaaatcttactggtctgaa

SEQ ID NO: 108591 - DNA, 25 bp, Mus musculus
acatttgaagtcagcatttgtgcca

SEQ ID NO: 108592 - DNA, 25 bp, Mus musculus
acatttgaagtctgcatttgtgcca

SEQ ID NO: 108593 - DNA, 25 bp, Mus musculus
acatttgaatgtctggtccctggtt

SEQ ID NO: 108594 - DNA, 25 bp, Mus musculus
acatttgaatgtgtggtccctggtt

SEQ ID NO: 108595 - DNA, 25 bp, Mus musculus
acatttgaccaaacgttctttcaga

SEQ ID NO: 108596 - DNA, 25 bp, Mus musculus
acatttgaccaacctagtagctaaa

SEQ ID NO: 108597 - DNA, 25 bp, Mus musculus
acatttgaccaagctagtagctaaa

SEQ ID NO: 108598 - DNA, 25 bp, Mus musculus
acatttgaccaatcgttctttcaga

SEQ ID NO: 108599 - DNA, 25 bp, Mus musculus
acatttgacttcaatgtttgccccg

SEQ ID NO: 108600 - DNA, 25 bp, Mus musculus
acatttgacttctatgtttgccccg

SEQ ID NO: 108601 - DNA, 25 bp, Mus musculus
acatttgagaccctgcattggaaac

SEQ ID NO: 108602 - DNA, 25 bp, Mus musculus
acatttgagaccgtgcattggaaac

SEQ ID NO: 108603 - DNA, 25 bp, Mus musculus
acatttgagcttcacttccgtggtc

SEQ ID NO: 108604 - DNA, 25 bp, Mus musculus
acatttgagcttgacttccgtggtc

SEQ ID NO: 108605 - DNA, 25 bp, Mus musculus
acatttgaggctatcgctggtacag

SEQ ID NO: 108606 - DNA, 25 bp, Mus musculus
acatttgaggctttcgctggtacag

SEQ ID NO: 108607 - DNA, 25 bp, Mus musculus
acatttgagggcattcttacctata

SEQ ID NO: 108608 - DNA, 25 bp, Mus musculus
acatttgagggctttcttacctata

SEQ ID NO: 108609 - DNA, 25 bp, Mus musculus
acatttgatacaacactgtcagctt

SEQ ID NO: 108610 - DNA, 25 bp, Mus musculus
acatttgatacatcactgtcagctt

SEQ ID NO: 108611 - DNA, 25 bp, Mus musculus
acatttgatacccattaagcacagg

SEQ ID NO: 108612 - DNA, 25 bp, Mus musculus
acatttgataccgattaagcacagg

SEQ ID NO: 108613 - DNA, 25 bp, Mus musculus
acatttgatgtcatcgtagtatggc

SEQ ID NO: 108614 - DNA, 25 bp, Mus musculus
acatttgatgtcttcgtagtatggc

SEQ ID NO: 108615 - DNA, 25 bp, Mus musculus
acatttgattgaagacccagcctaa

SEQ ID NO: 108616 - DNA, 25 bp, Mus musculus
acatttgattgatgacccagcctaa

SEQ ID NO: 108617 - DNA, 25 bp, Mus musculus
acatttgattgcctctccacttgga

SEQ ID NO: 108618 - DNA, 25 bp, Mus musculus
acatttgattgcgtctccacttgga

SEQ ID NO: 108619 - DNA, 25 bp, Mus musculus
acatttgcaggaagtcccttggttt

SEQ ID NO: 108620 - DNA, 25 bp, Mus musculus
acatttgcaggatgtcccttggttt

SEQ ID NO: 108621 - DNA, 25 bp, Mus musculus
acatttgcatgtaatgggcttccat

SEQ ID NO: 108622 - DNA, 25 bp, Mus musculus
acatttgcatgttatgggcttccat

SEQ ID NO: 108623 - DNA, 25 bp, Mus musculus
acatttgccggaattgccagctgct

SEQ ID NO: 108624 - DNA, 25 bp, Mus musculus
acatttgccggatttgccagctgct

SEQ ID NO: 108625 - DNA, 25 bp, Mus musculus
acatttgctgatagtgggccataaa

SEQ ID NO: 108626 - DNA, 25 bp, Mus musculus
acatttgctgattgtgggccataaa

SEQ ID NO: 108627 - DNA, 25 bp, Mus musculus
acatttgctgccctaggacgagtga

SEQ ID NO: 108628 - DNA, 25 bp, Mus musculus
acatttgctgccgtaggacgagtga

SEQ ID NO: 108629 - DNA, 25 bp, Mus musculus
acatttgctggtccgctagaggtga

SEQ ID NO: 108630 - DNA, 25 bp, Mus musculus
acatttgctggtgcgctagaggtga

SEQ ID NO: 108631 - DNA, 25 bp, Mus musculus
acatttgcttcactgttctgttcca

SEQ ID NO: 108632 - DNA, 25 bp, Mus musculus
acatttgcttcagtgttctgttcca

SEQ ID NO: 108633 - DNA, 25 bp, Mus musculus
acatttggacttcccttcctttggg

SEQ ID NO: 108634 - DNA, 25 bp, Mus musculus
acatttggacttgccttcctttggg

SEQ ID NO: 108635 - DNA, 25 bp, Mus musculus
acatttgggtagagcgttgcccagc

SEQ ID NO: 108636 - DNA, 25 bp, Mus musculus
acatttgggtagtgcgttgcccagc

SEQ ID NO: 108637 - DNA, 25 bp, Mus musculus
acatttggtcaaatatggctggcat

SEQ ID NO: 108638 - DNA, 25 bp, Mus musculus
acatttggtcaattatggctggcat

SEQ ID NO: 108639 - DNA, 25 bp, Mus musculus
acatttggtcacatctatctttaca

SEQ ID NO: 108640 - DNA, 25 bp, Mus musculus
acatttggtcacttctatctttaca

SEQ ID NO: 108641 - DNA, 25 bp, Mus musculus
acatttggtgatagggtaaactgca

SEQ ID NO: 108642 - DNA, 25 bp, Mus musculus
acatttggtgattgggtaaactgca

SEQ ID NO: 108643 - DNA, 25 bp, Mus musculus
acatttggtgttcacacttcctcag

SEQ ID NO: 108644 - DNA, 25 bp, Mus musculus
acatttggtgttgacacttcctcag

SEQ ID NO: 108645 - DNA, 25 bp, Mus musculus
acatttggttggagcaggcctctta

SEQ ID NO: 108646 - DNA, 25 bp, Mus musculus
acatttggttggtgcaggcctctta

SEQ ID NO: 108647 - DNA, 25 bp, Mus musculus
acatttgtaatgaattggcagtaaa

SEQ ID NO: 108648 - DNA, 25 bp, Mus musculus
acatttgtaatgtattggcagtaaa

SEQ ID NO: 108649 - DNA, 25 bp, Mus musculus
acatttgtaccaaatataagccaag

SEQ ID NO: 108650 - DNA, 25 bp, Mus musculus
acatttgtaccacatgtgcatcttg

SEQ ID NO: 108651 - DNA, 25 bp, Mus musculus
acatttgtaccagatgtgcatcttg

SEQ ID NO: 108652 - DNA, 25 bp, Mus musculus
acatttgtaccatatataagccaag

SEQ ID NO: 108653 - DNA, 25 bp, Mus musculus
acatttgtagctctgtgtgccatgc

SEQ ID NO: 108654 - DNA, 25 bp, Mus musculus
acatttgtagctgtgtgtgccatgc

SEQ ID NO: 108655 - DNA, 25 bp, Mus musculus
acatttgtatatatcagtggaacag

SEQ ID NO: 108656 - DNA, 25 bp, Mus musculus
acatttgtatatttcagtggaacag

SEQ ID NO: 108657 - DNA, 25 bp, Mus musculus
acatttgtcagtcaagttgcctaca

SEQ ID NO: 108658 - DNA, 25 bp, Mus musculus
acatttgtcagtgaagttgcctaca

SEQ ID NO: 108659 - DNA, 25 bp, Mus musculus
acatttgtccagagggctagctaac

SEQ ID NO: 108660 - DNA, 25 bp, Mus musculus
acatttgtccagtgggctagctaac

SEQ ID NO: 108661 - DNA, 25 bp, Mus musculus
acatttgtcccaaatgtttcttccc

SEQ ID NO: 108662 - DNA, 25 bp, Mus musculus
acatttgtcccatatgtttcttccc

SEQ ID NO: 108663 - DNA, 25 bp, Mus musculus
acatttgtctgtaacactcaagtat

SEQ ID NO: 108664 - DNA, 25 bp, Mus musculus
acatttgtctgtcgccattactggt

SEQ ID NO: 108665 - DNA, 25 bp, Mus musculus
acatttgtctgtggccattactggt

SEQ ID NO: 108666 - DNA, 25 bp, Mus musculus
acatttgtctgttacactcaagtat

SEQ ID NO: 108667 - DNA, 25 bp, Mus musculus
acatttgtgaggaagaagctggttt

SEQ ID NO: 108668 - DNA, 25 bp, Mus musculus
acatttgtgaggtagaagctggttt

SEQ ID NO: 108669 - DNA, 25 bp, Mus musculus
acatttgtgccaatcaaggtgccac

SEQ ID NO: 108670 - DNA, 25 bp, Mus musculus
acatttgtgccattcaaggtgccac

SEQ ID NO: 108671 - DNA, 25 bp, Mus musculus
acatttgtgcctcgtacctggtgcc

SEQ ID NO: 108672 - DNA, 25 bp, Mus musculus
acatttgtgcctggtacctggtgcc

SEQ ID NO: 108673 - DNA, 25 bp, Mus musculus
acatttgtgcttactgtggatctgt

SEQ ID NO: 108674 - DNA, 25 bp, Mus musculus
acatttgtgctttctgtggatctgt

SEQ ID NO: 108675 - DNA, 25 bp, Mus musculus
acatttgtggatacaccgtctgcag

SEQ ID NO: 108676 - DNA, 25 bp, Mus musculus
acatttgtggattcaccgtctgcag

SEQ ID NO: 108677 - DNA, 25 bp, Mus musculus
acatttgtgggtactcttagcagac

SEQ ID NO: 108678 - DNA, 25 bp, Mus musculus
acatttgtgggttctcttagcagac

SEQ ID NO: 108679 - DNA, 25 bp, Mus musculus
acatttgtgtgtagcattagggagg

SEQ ID NO: 108680 - DNA, 25 bp, Mus musculus
acatttgtgtgttgcattagggagg

SEQ ID NO: 108681 - DNA, 25 bp, Mus musculus
acatttgtgttacttgtgtatccca

SEQ ID NO: 108682 - DNA, 25 bp, Mus musculus
acatttgtgttagttgtgtatccca

SEQ ID NO: 108683 - DNA, 25 bp, Mus musculus
acatttgttcctagggaggtttgca

SEQ ID NO: 108684 - DNA, 25 bp, Mus musculus
acatttgttccttgggaggtttgca

SEQ ID NO: 108685 - DNA, 25 bp, Mus musculus
acatttgttcttcacttcagaattc

SEQ ID NO: 108686 - DNA, 25 bp, Mus musculus
acatttgttcttgacttcagaattc

SEQ ID NO: 108687 - DNA, 25 bp, Mus musculus
acatttgttggaacacggcagtgga

SEQ ID NO: 108688 - DNA, 25 bp, Mus musculus
acatttgttggatcacggcagtgga

SEQ ID NO: 108689 - DNA, 25 bp, Mus musculus
acatttgttgggatggtcaactctt

SEQ ID NO: 108690 - DNA, 25 bp, Mus musculus
acatttgttgggttggtcaactctt

SEQ ID NO: 108691 - DNA, 25 bp, Mus musculus
acatttgttgtcagatttcttgatg

SEQ ID NO: 108692 - DNA, 25 bp, Mus musculus
acatttgttgtctgatttcttgatg

SEQ ID NO: 108693 - DNA, 25 bp, Mus musculus
acattttaacaacctattctgggag

SEQ ID NO: 108694 - DNA, 25 bp, Mus musculus
acattttaacaagctattctgggag

SEQ ID NO: 108695 - DNA, 25 bp, Mus musculus
acattttaacatacgtatagctcag

SEQ ID NO: 108696 - DNA, 25 bp, Mus musculus
acattttaacattcgtatagctcag

SEQ ID NO: 108697 - DNA, 25 bp, Mus musculus
acattttaaggcattctctgtctag

SEQ ID NO: 108698 - DNA, 25 bp, Mus musculus
acattttaaggctttctctgtctag

SEQ ID NO: 108699 - DNA, 25 bp, Mus musculus
acattttacattcgtgcttgtgact

SEQ ID NO: 108700 - DNA, 25 bp, Mus musculus
acattttacattggtgcttgtgact

SEQ ID NO: 108701 - DNA, 25 bp, Mus musculus
acattttaccttcactgacttgggc

SEQ ID NO: 108702 - DNA, 25 bp, Mus musculus
acattttaccttgactgacttgggc

SEQ ID NO: 108703 - DNA, 25 bp, Mus musculus
acattttaggcaaatctgtggacaa

SEQ ID NO: 108704 - DNA, 25 bp, Mus musculus
acattttaggcatatctgtggacaa

SEQ ID NO: 108705 - DNA, 25 bp, Mus musculus
acattttagggcaggctggctttgg

SEQ ID NO: 108706 - DNA, 25 bp, Mus musculus
acattttagggctggctggctttgg

SEQ ID NO: 108707 - DNA, 25 bp, Mus musculus
acattttatctacccaccatgagag

SEQ ID NO: 108708 - DNA, 25 bp, Mus musculus
acattttatctagccaccatgagag

SEQ ID NO: 108709 - DNA, 25 bp, Mus musculus
acattttatggcacacactttgcgt

SEQ ID NO: 108710 - DNA, 25 bp, Mus musculus
acattttatggctcacactttgcgt

SEQ ID NO: 108711 - DNA, 25 bp, Mus musculus
acattttcacaaagctcattgccaa

SEQ ID NO: 108712 - DNA, 25 bp, Mus musculus
acattttcacaatgctcattgccaa

SEQ ID NO: 108713 - DNA, 25 bp, Mus musculus
acattttcacatctttgcatcttca

SEQ ID NO: 108714 - DNA, 25 bp, Mus musculus
acattttcacatgtttgcatcttca

SEQ ID NO: 108715 - DNA, 25 bp, Mus musculus
acattttcacccagttctactgact

SEQ ID NO: 108716 - DNA, 25 bp, Mus musculus
acattttcacccatgatgtcctaaa

SEQ ID NO: 108717 - DNA, 25 bp, Mus musculus
acattttcaccctgttctactgact

SEQ ID NO: 108718 - DNA, 25 bp, Mus musculus
acattttcacccttgatgtcctaaa

SEQ ID NO: 108719 - DNA, 25 bp, Mus musculus
acattttcactgctaatcactggat

SEQ ID NO: 108720 - DNA, 25 bp, Mus musculus
acattttcactggtaatcactggat

SEQ ID NO: 108721 - DNA, 25 bp, Mus musculus
acattttccaaccatagcaggtcat

SEQ ID NO: 108722 - DNA, 25 bp, Mus musculus
acattttccaacgatagcaggtcat

SEQ ID NO: 108723 - DNA, 25 bp, Mus musculus
acattttccgtcataccatgtctaa

SEQ ID NO: 108724 - DNA, 25 bp, Mus musculus
acattttccgtcttaccatgtctaa

SEQ ID NO: 108725 - DNA, 25 bp, Mus musculus
acattttcctgaaccgggtgtgcat

SEQ ID NO: 108726 - DNA, 25 bp, Mus musculus
acattttcctgatccgggtgtgcat

SEQ ID NO: 108727 - DNA, 25 bp, Mus musculus
acattttcctgtcactgttcattaa

SEQ ID NO: 108728 - DNA, 25 bp, Mus musculus
acattttcctgtgactgttcattaa

SEQ ID NO: 108729 - DNA, 25 bp, Mus musculus
acattttccttgatctttgtcattg

SEQ ID NO: 108730 - DNA, 25 bp, Mus musculus
acattttccttgttctttgtcattg

SEQ ID NO: 108731 - DNA, 25 bp, Mus musculus
acattttcgcagaacattgctttaa

SEQ ID NO: 108732 - DNA, 25 bp, Mus musculus
acattttcgcagtacattgctttaa

SEQ ID NO: 108733 - DNA, 25 bp, Mus musculus
acattttcggagacaagtctagccc

SEQ ID NO: 108734 - DNA, 25 bp, Mus musculus
acattttcggagtcaagtctagccc

SEQ ID NO: 108735 - DNA, 25 bp, Mus musculus
acattttctaccctgcttccacttt

SEQ ID NO: 108736 - DNA, 25 bp, Mus musculus
acattttctaccgtgcttccacttt

SEQ ID NO: 108737 - DNA, 25 bp, Mus musculus
acattttctagcactaatttcgaga

SEQ ID NO: 108738 - DNA, 25 bp, Mus musculus
acattttctagctctaatttcgaga

SEQ ID NO: 108739 - DNA, 25 bp, Mus musculus
acattttctatgaggttcagactaa

SEQ ID NO: 108740 - DNA, 25 bp, Mus musculus
acattttctatgtggttcagactaa

SEQ ID NO: 108741 - DNA, 25 bp, Mus musculus
acattttctcttagaggttttcatt

SEQ ID NO: 108742 - DNA, 25 bp, Mus musculus
acattttctctttgaggttttcatt

SEQ ID NO: 108743 - DNA, 25 bp, Mus musculus
acattttctgaccacacgttgtgtt

SEQ ID NO: 108744 - DNA, 25 bp, Mus musculus
acattttctgacgacacgttgtgtt

SEQ ID NO: 108745 - DNA, 25 bp, Mus musculus
acattttctgtcagctaagtcatgc

SEQ ID NO: 108746 - DNA, 25 bp, Mus musculus
acattttctgtctgctaagtcatgc

SEQ ID NO: 108747 - DNA, 25 bp, Mus musculus
acattttgaactcccctcagatttc

SEQ ID NO: 108748 - DNA, 25 bp, Mus musculus
acattttgaactgccctcagatttc

SEQ ID NO: 108749 - DNA, 25 bp, Mus musculus
acattttgaaggatctgtattctca

SEQ ID NO: 108750 - DNA, 25 bp, Mus musculus
acattttgaaggttctgtattctca

SEQ ID NO: 108751 - DNA, 25 bp, Mus musculus
acattttgaatcacactagttcctg

SEQ ID NO: 108752 - DNA, 25 bp, Mus musculus
acattttgaatcagagtcttgtttt

SEQ ID NO: 108753 - DNA, 25 bp, Mus musculus
acattttgaatctcactagttcctg

SEQ ID NO: 108754 - DNA, 25 bp, Mus musculus
acattttgaatctgagtcttgtttt

SEQ ID NO: 108755 - DNA, 25 bp, Mus musculus
acattttgagcaccctccaaatttt

SEQ ID NO: 108756 - DNA, 25 bp, Mus musculus
acattttgagcagcctccaaatttt

SEQ ID NO: 108757 - DNA, 25 bp, Mus musculus
acattttgagctcctttaaagtaga

SEQ ID NO: 108758 - DNA, 25 bp, Mus musculus
acattttgagctgctttaaagtaga

SEQ ID NO: 108759 - DNA, 25 bp, Mus musculus
acattttgcatacagttgctgcctc

SEQ ID NO: 108760 - DNA, 25 bp, Mus musculus
acattttgcatagagttgctgcctc

SEQ ID NO: 108761 - DNA, 25 bp, Mus musculus
acattttgcctgatgaacctgccat

SEQ ID NO: 108762 - DNA, 25 bp, Mus musculus
acattttgcctgttgaacctgccat

SEQ ID NO: 108763 - DNA, 25 bp, Mus musculus
acattttgccttctggagtcccatt

SEQ ID NO: 108764 - DNA, 25 bp, Mus musculus
acattttgccttgtggagtcccatt

SEQ ID NO: 108765 - DNA, 25 bp, Mus musculus
acattttggtatagtgcttgccaga

SEQ ID NO: 108766 - DNA, 25 bp, Mus musculus
acattttggtattgtgcttgccaga

SEQ ID NO: 108767 - DNA, 25 bp, Mus musculus
acattttgtaagctgttttctttct

SEQ ID NO: 108768 - DNA, 25 bp, Mus musculus
acattttgtaaggtgttttctttct

SEQ ID NO: 108769 - DNA, 25 bp, Mus musculus
acattttgtcctatagggaatgact

SEQ ID NO: 108770 - DNA, 25 bp, Mus musculus
acattttgtcctttagggaatgact

SEQ ID NO: 108771 - DNA, 25 bp, Mus musculus
acattttgtgtcagggcttgtccgt

SEQ ID NO: 108772 - DNA, 25 bp, Mus musculus
acattttgtgtctgggcttgtccgt

SEQ ID NO: 108773 - DNA, 25 bp, Mus musculus
acattttgttcaatggcttccacga

SEQ ID NO: 108774 - DNA, 25 bp, Mus musculus
acattttgttcattggcttccacga

SEQ ID NO: 108775 - DNA, 25 bp, Mus musculus
acattttgttgaatccagcacaaac

SEQ ID NO: 108776 - DNA, 25 bp, Mus musculus
acattttgttgattccagcacaaac

SEQ ID NO: 108777 - DNA, 25 bp, Mus musculus
acattttgtttgagtctcctgcctt

SEQ ID NO: 108778 - DNA, 25 bp, Mus musculus
acattttgtttgtgtctcctgcctt

SEQ ID NO: 108779 - DNA, 25 bp, Mus musculus
acatttttaaagctgatcctggaga

SEQ ID NO: 108780 - DNA, 25 bp, Mus musculus
acatttttaaaggtgatcctggaga

SEQ ID NO: 108781 - DNA, 25 bp, Mus musculus
acatttttaaggctctaacacatag

SEQ ID NO: 108782 - DNA, 25 bp, Mus musculus
acatttttaagggtctaacacatag

SEQ ID NO: 108783 - DNA, 25 bp, Mus musculus
acatttttactcattagctggattt

SEQ ID NO: 108784 - DNA, 25 bp, Mus musculus
acatttttactctttagctggattt

SEQ ID NO: 108785 - DNA, 25 bp, Mus musculus
acatttttaggccagttttcataca

SEQ ID NO: 108786 - DNA, 25 bp, Mus musculus
acatttttaggcgagttttcataca

SEQ ID NO: 108787 - DNA, 25 bp, Mus musculus
acatttttatcactgctttcggagc

SEQ ID NO: 108788 - DNA, 25 bp, Mus musculus
acatttttatcagtgctttcggagc

SEQ ID NO: 108789 - DNA, 25 bp, Mus musculus
acatttttatgcacagtaccggttg

SEQ ID NO: 108790 - DNA, 25 bp, Mus musculus
acatttttatgcactgtctggctag

SEQ ID NO: 108791 - DNA, 25 bp, Mus musculus
acatttttatgctcagtaccggttg

SEQ ID NO: 108792 - DNA, 25 bp, Mus musculus
acatttttatgctctgtctggctag

SEQ ID NO: 108793 - DNA, 25 bp, Mus musculus
acatttttatgtcatcggtttacca

SEQ ID NO: 108794 - DNA, 25 bp, Mus musculus
acatttttatgtgatcggtttacca

SEQ ID NO: 108795 - DNA, 25 bp, Mus musculus
acatttttccatattatgctctatg

SEQ ID NO: 108796 - DNA, 25 bp, Mus musculus
acatttttccattttatgctctatg

SEQ ID NO: 108797 - DNA, 25 bp, Mus musculus
acatttttcttgctatgtatagacc

SEQ ID NO: 108798 - DNA, 25 bp, Mus musculus
acatttttcttggtatgtatagacc

SEQ ID NO: 108799 - DNA, 25 bp, Mus musculus
acatttttgctgctataatccctta

SEQ ID NO: 108800 - DNA, 25 bp, Mus musculus
acatttttgctggtataatccctta

SEQ ID NO: 108801 - DNA, 25 bp, Mus musculus
acatttttggctagttcaagagaca

SEQ ID NO: 108802 - DNA, 25 bp, Mus musculus
acatttttggcttgttcaagagaca

SEQ ID NO: 108803 - DNA, 25 bp, Mus musculus
acatttttgtacagcagatgcttcg

SEQ ID NO: 108804 - DNA, 25 bp, Mus musculus
acatttttgtactgcagatgcttcg

SEQ ID NO: 108805 - DNA, 25 bp, Mus musculus
acatttttgtagataacagaacact

SEQ ID NO: 108806 - DNA, 25 bp, Mus musculus
acatttttgtagttaacagaacact

SEQ ID NO: 108807 - DNA, 25 bp, Mus musculus
acattttttaccacactgtagcttg

SEQ ID NO: 108808 - DNA, 25 bp, Mus musculus
acattttttacctcactgtagcttg

SEQ ID NO: 108809 - DNA, 25 bp, Mus musculus
acattttttgagctctgctcagata

SEQ ID NO: 108810 - DNA, 25 bp, Mus musculus
acattttttgaggtctgctcagata

SEQ ID NO: 108811 - DNA, 25 bp, Mus musculus
accaaaaactttctgttgctcttat

SEQ ID NO: 108812 - DNA, 25 bp, Mus musculus
accaaaaactttgtgttgctcttat

SEQ ID NO: 108813 - DNA, 25 bp, Mus musculus
accaaaaattcaccagcactgagga

SEQ ID NO: 108814 - DNA, 25 bp, Mus musculus
accaaaaattcagcagcactgagga

SEQ ID NO: 108815 - DNA, 25 bp, Mus musculus
accaaaacacaacctatttcctggg

SEQ ID NO: 108816 - DNA, 25 bp, Mus musculus
accaaaacacaagctatttcctggg

SEQ ID NO: 108817 - DNA, 25 bp, Mus musculus
accaaaacacacaaggccttcctag

SEQ ID NO: 108818 - DNA, 25 bp, Mus musculus
accaaaacacactaggccttcctag

SEQ ID NO: 108819 - DNA, 25 bp, Mus musculus
accaaaaccaatcgctgcctcaagg

SEQ ID NO: 108820 - DNA, 25 bp, Mus musculus
accaaaaccaatggctgcctcaagg

SEQ ID NO: 108821 - DNA, 25 bp, Mus musculus
accaaaaccattactggatgtctcc

SEQ ID NO: 108822 - DNA, 25 bp, Mus musculus
accaaaaccatttctggatgtctcc

SEQ ID NO: 108823 - DNA, 25 bp, Mus musculus
accaaaaccgttcttcgtgacagtg

SEQ ID NO: 108824 - DNA, 25 bp, Mus musculus
accaaaaccgttgttcgtgacagtg

SEQ ID NO: 108825 - DNA, 25 bp, Mus musculus
accaaaagcacaaccagccagtggc

SEQ ID NO: 108826 - DNA, 25 bp, Mus musculus
accaaaagcacatccagccagtggc

SEQ ID NO: 108827 - DNA, 25 bp, Mus musculus
accaaaatctgtacctgttctcaag

SEQ ID NO: 108828 - DNA, 25 bp, Mus musculus
accaaaatctgttcctgttctcaag

SEQ ID NO: 108829 - DNA, 25 bp, Mus musculus
accaaaatgaagagctccaggacag

SEQ ID NO: 108830 - DNA, 25 bp, Mus musculus
accaaaatgaagtgctccaggacag

SEQ ID NO: 108831 - DNA, 25 bp, Mus musculus
accaaaatgtgcactattcggatga

SEQ ID NO: 108832 - DNA, 25 bp, Mus musculus
accaaaatgtgctctattcggatga

SEQ ID NO: 108833 - DNA, 25 bp, Mus musculus
accaaaattatgaccgttccagtct

SEQ ID NO: 108834 - DNA, 25 bp, Mus musculus
accaaaattatgtccgttccagtct

SEQ ID NO: 108835 - DNA, 25 bp, Mus musculus
accaaacaaccgattggtgctgttt

SEQ ID NO: 108836 - DNA, 25 bp, Mus musculus
accaaacaaccgtttggtgctgttt

SEQ ID NO: 108837 - DNA, 25 bp, Mus musculus
accaaacaatagaacccctgcaggg

SEQ ID NO: 108838 - DNA, 25 bp, Mus musculus
accaaacaatagtacccctgcaggg

SEQ ID NO: 108839 - DNA, 25 bp, Mus musculus
accaaacaggtgctcggtggctttt

SEQ ID NO: 108840 - DNA, 25 bp, Mus musculus
accaaacaggtggtcggtggctttt

SEQ ID NO: 108841 - DNA, 25 bp, Mus musculus
accaaacagtgacggcgttggcaga

SEQ ID NO: 108842 - DNA, 25 bp, Mus musculus
accaaacagtgagggcgttggcaga

SEQ ID NO: 108843 - DNA, 25 bp, Mus musculus
accaaacccagactctatggaagat

SEQ ID NO: 108844 - DNA, 25 bp, Mus musculus
accaaacccagagtctatggaagat

SEQ ID NO: 108845 - DNA, 25 bp, Mus musculus
accaaaccgcatacgtgtggatttt

SEQ ID NO: 108846 - DNA, 25 bp, Mus musculus
accaaaccgcattcgtgtggatttt

SEQ ID NO: 108847 - DNA, 25 bp, Mus musculus
accaaaccggttatgtcagcagctt

SEQ ID NO: 108848 - DNA, 25 bp, Mus musculus
accaaaccggttttgtcagcagctt

SEQ ID NO: 108849 - DNA, 25 bp, Mus musculus
accaaactcattatccttcattctg

SEQ ID NO: 108850 - DNA, 25 bp, Mus musculus
accaaactcattttccttcattctg

SEQ ID NO: 108851 - DNA, 25 bp, Mus musculus
accaaactccagcactattgcggat

SEQ ID NO: 108852 - DNA, 25 bp, Mus musculus
accaaactccaggactattgcggat

SEQ ID NO: 108853 - DNA, 25 bp, Mus musculus
accaaactcctacctctacaaggat

SEQ ID NO: 108854 - DNA, 25 bp, Mus musculus
accaaactcctagctctacaaggat

SEQ ID NO: 108855 - DNA, 25 bp, Mus musculus
accaaactcctccaagacttgtatt

SEQ ID NO: 108856 - DNA, 25 bp, Mus musculus
accaaactcctcgaagacttgtatt

SEQ ID NO: 108857 - DNA, 25 bp, Mus musculus
accaaactctgcagaacaaggattc

SEQ ID NO: 108858 - DNA, 25 bp, Mus musculus
accaaactctgctgaacaaggattc

SEQ ID NO: 108859 - DNA, 25 bp, Mus musculus
accaaactgagcagggtagagtccc

SEQ ID NO: 108860 - DNA, 25 bp, Mus musculus
accaaactgagctgggtagagtccc

SEQ ID NO: 108861 - DNA, 25 bp, Mus musculus
accaaactgcccctcaagtattcat

SEQ ID NO: 108862 - DNA, 25 bp, Mus musculus
accaaactgcccgtcaagtattcat

SEQ ID NO: 108863 - DNA, 25 bp, Mus musculus
accaaactgttcagcttgttccctt

SEQ ID NO: 108864 - DNA, 25 bp, Mus musculus
accaaactgttcatgtagcctgaga

SEQ ID NO: 108865 - DNA, 25 bp, Mus musculus
accaaactgttctgcttgttccctt

SEQ ID NO: 108866 - DNA, 25 bp, Mus musculus
accaaactgttcttgtagcctgaga

SEQ ID NO: 108867 - DNA, 25 bp, Mus musculus
accaaacttctccagctgataaaca

SEQ ID NO: 108868 - DNA, 25 bp, Mus musculus
accaaacttctcgagctgataaaca

SEQ ID NO: 108869 - DNA, 25 bp, Mus musculus
accaaacttggtagctctaaggtct

SEQ ID NO: 108870 - DNA, 25 bp, Mus musculus
accaaacttggttgctctaaggtct

SEQ ID NO: 108871 - DNA, 25 bp, Mus musculus
accaaagaaatcactcattgagctg

SEQ ID NO: 108872 - DNA, 25 bp, Mus musculus
accaaagaaatctctcattgagctg

SEQ ID NO: 108873 - DNA, 25 bp, Mus musculus
accaaagacggactccatggcttaa

SEQ ID NO: 108874 - DNA, 25 bp, Mus musculus
accaaagacggagtccatggcttaa

SEQ ID NO: 108875 - DNA, 25 bp, Mus musculus
accaaagacttcatatgtgtaccat

SEQ ID NO: 108876 - DNA, 25 bp, Mus musculus
accaaagacttcttatgtgtaccat

SEQ ID NO: 108877 - DNA, 25 bp, Mus musculus
accaaagagcacactgcatgagtta

SEQ ID NO: 108878 - DNA, 25 bp, Mus musculus
accaaagagcactctgcatgagtta

SEQ ID NO: 108879 - DNA, 25 bp, Mus musculus
accaaagaggtcagatggactagca

SEQ ID NO: 108880 - DNA, 25 bp, Mus musculus
accaaagaggtctgatggactagca

SEQ ID NO: 108881 - DNA, 25 bp, Mus musculus
accaaagattgcaggcatgtgcagg

SEQ ID NO: 108882 - DNA, 25 bp, Mus musculus
accaaagattgctggcatgtgcagg

SEQ ID NO: 108883 - DNA, 25 bp, Mus musculus
accaaagcaagtcatttctagtaaa

SEQ ID NO: 108884 - DNA, 25 bp, Mus musculus
accaaagcaagtgatttctagtaaa

SEQ ID NO: 108885 - DNA, 25 bp, Mus musculus
accaaagcatttaagactcctcagt

SEQ ID NO: 108886 - DNA, 25 bp, Mus musculus
accaaagcattttagactcctcagt

SEQ ID NO: 108887 - DNA, 25 bp, Mus musculus
accaaagcccatagaactgcctgtt

SEQ ID NO: 108888 - DNA, 25 bp, Mus musculus
accaaagcccattgaactgcctgtt

SEQ ID NO: 108889 - DNA, 25 bp, Mus musculus
accaaagccgtgcagcatgcagacg

SEQ ID NO: 108890 - DNA, 25 bp, Mus musculus
accaaagccgtggagcatgcagacg

SEQ ID NO: 108891 - DNA, 25 bp, Mus musculus
accaaagcggtgatcctaatgaaat

SEQ ID NO: 108892 - DNA, 25 bp, Mus musculus
accaaagcggtgttcctaatgaaat

SEQ ID NO: 108893 - DNA, 25 bp, Mus musculus
accaaaggacccatactggcgagaa

SEQ ID NO: 108894 - DNA, 25 bp, Mus musculus
accaaaggacccttactggcgagaa

SEQ ID NO: 108895 - DNA, 25 bp, Mus musculus
accaaaggactcactgattgacagg

SEQ ID NO: 108896 - DNA, 25 bp, Mus musculus
accaaaggactctctgattgacagg

SEQ ID NO: 108897 - DNA, 25 bp, Mus musculus
accaaaggatctcaaggccgctgtc

SEQ ID NO: 108898 - DNA, 25 bp, Mus musculus
accaaaggatctgaaggccgctgtc

SEQ ID NO: 108899 - DNA, 25 bp, Mus musculus
accaaaggcgtgatgaccttgttga

SEQ ID NO: 108900 - DNA, 25 bp, Mus musculus
accaaaggcgtgttgaccttgttga

SEQ ID NO: 108901 - DNA, 25 bp, Mus musculus
accaaaggctttcgctgccatttgg

SEQ ID NO: 108902 - DNA, 25 bp, Mus musculus
accaaaggctttggctgccatttgg

SEQ ID NO: 108903 - DNA, 25 bp, Mus musculus
accaaagtaatcaataagttcaatg

SEQ ID NO: 108904 - DNA, 25 bp, Mus musculus
accaaagtaatctataagttcaatg

SEQ ID NO: 108905 - DNA, 25 bp, Mus musculus
accaaagtcaaaatctggaggagct

SEQ ID NO: 108906 - DNA, 25 bp, Mus musculus
accaaagtcaaattctggaggagct

SEQ ID NO: 108907 - DNA, 25 bp, Mus musculus
accaaatactgcagtgttcttatac

SEQ ID NO: 108908 - DNA, 25 bp, Mus musculus
accaaatactgctgtgttcttatac

SEQ ID NO: 108909 - DNA, 25 bp, Mus musculus
accaaatagaccagcttcagcggga

SEQ ID NO: 108910 - DNA, 25 bp, Mus musculus
accaaatagacctgcttcagcggga

SEQ ID NO: 108911 - DNA, 25 bp, Mus musculus
accaaatcaacactaaagccacaag

SEQ ID NO: 108912 - DNA, 25 bp, Mus musculus
accaaatcaacagtaaagccacaag

SEQ ID NO: 108913 - DNA, 25 bp, Mus musculus
accaaatcacttactatactagcaa

SEQ ID NO: 108914 - DNA, 25 bp, Mus musculus
accaaatcactttctatactagcaa

SEQ ID NO: 108915 - DNA, 25 bp, Mus musculus
accaaatcaggtactatcaagatac

SEQ ID NO: 108916 - DNA, 25 bp, Mus musculus
accaaatcaggttctatcaagatac

SEQ ID NO: 108917 - DNA, 25 bp, Mus musculus
accaaatccatgagagcactccgaa

SEQ ID NO: 108918 - DNA, 25 bp, Mus musculus
accaaatccatgtgagcactccgaa

SEQ ID NO: 108919 - DNA, 25 bp, Mus musculus
accaaatcccacacattttattaag

SEQ ID NO: 108920 - DNA, 25 bp, Mus musculus
accaaatcccactcattttattaag

SEQ ID NO: 108921 - DNA, 25 bp, Mus musculus
accaaatcccagatcaactcagact

SEQ ID NO: 108922 - DNA, 25 bp, Mus musculus
accaaatcccagttcaactcagact

SEQ ID NO: 108923 - DNA, 25 bp, Mus musculus
accaaatccgagaaggttgttccag

SEQ ID NO: 108924 - DNA, 25 bp, Mus musculus
accaaatccgagtaggttgttccag

SEQ ID NO: 108925 - DNA, 25 bp, Mus musculus
accaaatctgacatattaagcctga

SEQ ID NO: 108926 - DNA, 25 bp, Mus musculus
accaaatctgacttattaagcctga

SEQ ID NO: 108927 - DNA, 25 bp, Mus musculus
accaaatgccttacggtgcctgatg

SEQ ID NO: 108928 - DNA, 25 bp, Mus musculus
accaaatgcctttcggtgcctgatg

SEQ ID NO: 108929 - DNA, 25 bp, Mus musculus
accaaatggctaaggcagcagcagc

SEQ ID NO: 108930 - DNA, 25 bp, Mus musculus
accaaatggctatggcagcagcagc

SEQ ID NO: 108931 - DNA, 25 bp, Mus musculus
accaaatgtgttaaagcttatgctt

SEQ ID NO: 108932 - DNA, 25 bp, Mus musculus
accaaatgtgtttaagcttatgctt

SEQ ID NO: 108933 - DNA, 25 bp, Mus musculus
accaaattcaggagcatcagcccaa

SEQ ID NO: 108934 - DNA, 25 bp, Mus musculus
accaaattcaggtgcatcagcccaa

SEQ ID NO: 108935 - DNA, 25 bp, Mus musculus
accaaattctggatcctcaggacag

SEQ ID NO: 108936 - DNA, 25 bp, Mus musculus
accaaattctggttcctcaggacag

SEQ ID NO: 108937 - DNA, 25 bp, Mus musculus
accaaattgcacagttccctcaagg

SEQ ID NO: 108938 - DNA, 25 bp, Mus musculus
accaaattgcactgttccctcaagg

SEQ ID NO: 108939 - DNA, 25 bp, Mus musculus
accaaattgtcactgcgtatccttt

SEQ ID NO: 108940 - DNA, 25 bp, Mus musculus
accaaattgtcagtgcgtatccttt

SEQ ID NO: 108941 - DNA, 25 bp, Mus musculus
accaaatttgagcagcatgtgcaga

SEQ ID NO: 108942 - DNA, 25 bp, Mus musculus
accaaatttgagctgaccatgccct

SEQ ID NO: 108943 - DNA, 25 bp, Mus musculus
accaaatttgaggagcatgtgcaga

SEQ ID NO: 108944 - DNA, 25 bp, Mus musculus
accaaatttgaggtgaccatgccct

SEQ ID NO: 108945 - DNA, 25 bp, Mus musculus
accaaatttggccttccagagactg

SEQ ID NO: 108946 - DNA, 25 bp, Mus musculus
accaaatttggcgttccagagactg

SEQ ID NO: 108947 - DNA, 25 bp, Mus musculus
accaacaaaagacccactgtgtgga

SEQ ID NO: 108948 - DNA, 25 bp, Mus musculus
accaacaaaagagccactgtgtgga

SEQ ID NO: 108949 - DNA, 25 bp, Mus musculus
accaacaacagtactggacacagag

SEQ ID NO: 108950 - DNA, 25 bp, Mus musculus
accaacaacagttctggacacagag

SEQ ID NO: 108951 - DNA, 25 bp, Mus musculus
accaacaactggagcagtgaccaca

SEQ ID NO: 108952 - DNA, 25 bp, Mus musculus
accaacaactggtgcagtgaccaca

SEQ ID NO: 108953 - DNA, 25 bp, Mus musculus
accaacaatagaatcctttcaggaa

SEQ ID NO: 108954 - DNA, 25 bp, Mus musculus
accaacaatagattcctttcaggaa

SEQ ID NO: 108955 - DNA, 25 bp, Mus musculus
accaacaattggaattctgtacagg

SEQ ID NO: 108956 - DNA, 25 bp, Mus musculus
accaacaattggtattctgtacagg

SEQ ID NO: 108957 - DNA, 25 bp, Mus musculus
accaacacccagcgcttgcagtggg

SEQ ID NO: 108958 - DNA, 25 bp, Mus musculus
accaacacccagggcttgcagtggg

SEQ ID NO: 108959 - DNA, 25 bp, Mus musculus
accaacacgtccagctatgagtaca

SEQ ID NO: 108960 - DNA, 25 bp, Mus musculus
accaacacgtcctgctatgagtaca

SEQ ID NO: 108961 - DNA, 25 bp, Mus musculus
accaacactagaattgcagaccgaa

SEQ ID NO: 108962 - DNA, 25 bp, Mus musculus
accaacactagatttgcagaccgaa

SEQ ID NO: 108963 - DNA, 25 bp, Mus musculus
accaacactgccagctgattttatt

SEQ ID NO: 108964 - DNA, 25 bp, Mus musculus
accaacactgcctgctgattttatt

SEQ ID NO: 108965 - DNA, 25 bp, Mus musculus
accaacactgtgcttagacctagag

SEQ ID NO: 108966 - DNA, 25 bp, Mus musculus
accaacactgtggttagacctagag

SEQ ID NO: 108967 - DNA, 25 bp, Mus musculus
accaacagccgtcctttctagggaa

SEQ ID NO: 108968 - DNA, 25 bp, Mus musculus
accaacagccgtgctttctagggaa

SEQ ID NO: 108969 - DNA, 25 bp, Mus musculus
accaacagcgttcagatggcagttt

SEQ ID NO: 108970 - DNA, 25 bp, Mus musculus
accaacagcgttgagatggcagttt

SEQ ID NO: 108971 - DNA, 25 bp, Mus musculus
accaacaggccaatgtagcacatgt

SEQ ID NO: 108972 - DNA, 25 bp, Mus musculus
accaacaggccattgtagcacatgt

SEQ ID NO: 108973 - DNA, 25 bp, Mus musculus
accaacaggttactcatccgtgtgt

SEQ ID NO: 108974 - DNA, 25 bp, Mus musculus
accaacaggttagtcatccgtgtgt

SEQ ID NO: 108975 - DNA, 25 bp, Mus musculus
accaacagtcatatggtagctctca

SEQ ID NO: 108976 - DNA, 25 bp, Mus musculus
accaacagtcatttggtagctctca

SEQ ID NO: 108977 - DNA, 25 bp, Mus musculus
accaacagtgatatagtgtgcctaa

SEQ ID NO: 108978 - DNA, 25 bp, Mus musculus
accaacagtgatttagtgtgcctaa

SEQ ID NO: 108979 - DNA, 25 bp, Mus musculus
accaacatacccattttgagacaac

SEQ ID NO: 108980 - DNA, 25 bp, Mus musculus
accaacataccctttttgagacaac

SEQ ID NO: 108981 - DNA, 25 bp, Mus musculus
accaacatgccgatgatgcaggcac

SEQ ID NO: 108982 - DNA, 25 bp, Mus musculus
accaacatgccgttgatgcaggcac

SEQ ID NO: 108983 - DNA, 25 bp, Mus musculus
accaacatttttagagctctgctca

SEQ ID NO: 108984 - DNA, 25 bp, Mus musculus
accaacattttttgagctctgctca

SEQ ID NO: 108985 - DNA, 25 bp, Mus musculus
accaaccaaaggagtttattgactg

SEQ ID NO: 108986 - DNA, 25 bp, Mus musculus
accaaccaaaggtgtttattgactg

SEQ ID NO: 108987 - DNA, 25 bp, Mus musculus
accaaccaaatcatcctgtgaggat

SEQ ID NO: 108988 - DNA, 25 bp, Mus musculus
accaaccaaatcttcctgtgaggat

SEQ ID NO: 108989 - DNA, 25 bp, Mus musculus
accaaccaacacagcgttatccagg

SEQ ID NO: 108990 - DNA, 25 bp, Mus musculus
accaaccaacactgcgttatccagg

SEQ ID NO: 108991 - DNA, 25 bp, Mus musculus
accaaccaatgacaaccaaccaatg

SEQ ID NO: 108992 - DNA, 25 bp, Mus musculus
accaaccaatgagaaccaaccaatg

SEQ ID NO: 108993 - DNA, 25 bp, Mus musculus
accaaccactgccacgggacggagg

SEQ ID NO: 108994 - DNA, 25 bp, Mus musculus
accaaccactgcgacgggacggagg

SEQ ID NO: 108995 - DNA, 25 bp, Mus musculus
accaaccagatgctgttcaagactg

SEQ ID NO: 108996 - DNA, 25 bp, Mus musculus
accaaccagatggtgttcaagactg

SEQ ID NO: 108997 - DNA, 25 bp, Mus musculus
accaaccatgctctttacaacctgt

SEQ ID NO: 108998 - DNA, 25 bp, Mus musculus
accaaccatgctgtttacaacctgt

SEQ ID NO: 108999 - DNA, 25 bp, Mus musculus
accaaccatgtcactccagaagaga

SEQ ID NO: 109000 - DNA, 25 bp, Mus musculus
accaaccatgtctctccagaagaga

SEQ ID NO: 109001 - DNA, 25 bp, Mus musculus
accaacccaaaccagacaaatcgat

SEQ ID NO: 109002 - DNA, 25 bp, Mus musculus
accaacccaaacgagacaaatcgat

SEQ ID NO: 109003 - DNA, 25 bp, Mus musculus
accaacccatgaatctgtcactttt

SEQ ID NO: 109004 - DNA, 25 bp, Mus musculus
accaacccatgattctgtcactttt

SEQ ID NO: 109005 - DNA, 25 bp, Mus musculus
accaaccctcatcacatcgtagaaa

SEQ ID NO: 109006 - DNA, 25 bp, Mus musculus
accaaccctcatgacatcgtagaaa

SEQ ID NO: 109007 - DNA, 25 bp, Mus musculus
accaaccgttgtctggagccctatg

SEQ ID NO: 109008 - DNA, 25 bp, Mus musculus
accaaccgttgtgtggagccctatg

SEQ ID NO: 109009 - DNA, 25 bp, Mus musculus
accaacctgcgaccctggatgctga

SEQ ID NO: 109010 - DNA, 25 bp, Mus musculus
accaacctgcgagcctggatgctga

SEQ ID NO: 109011 - DNA, 25 bp, Mus musculus
accaacctgctacctactttgattg

SEQ ID NO: 109012 - DNA, 25 bp, Mus musculus
accaacctgctagctactttgattg

SEQ ID NO: 109013 - DNA, 25 bp, Mus musculus
accaacctggagatcattaaagtgg

SEQ ID NO: 109014 - DNA, 25 bp, Mus musculus
accaacctggagttcattaaagtgg

SEQ ID NO: 109015 - DNA, 25 bp, Mus musculus
accaacctgggactgtgccactaat

SEQ ID NO: 109016 - DNA, 25 bp, Mus musculus
accaacctgggagtgtgccactaat

SEQ ID NO: 109017 - DNA, 25 bp, Mus musculus
accaacctgggcaagcatatataaa

SEQ ID NO: 109018 - DNA, 25 bp, Mus musculus
accaacctgggctagcatatataaa

SEQ ID NO: 109019 - DNA, 25 bp, Mus musculus
accaacgagttcctgctgcttatca

SEQ ID NO: 109020 - DNA, 25 bp, Mus musculus
accaacgagttcgtgctgcttatca

SEQ ID NO: 109021 - DNA, 25 bp, Mus musculus
accaacgcactcaccgtggcgtgag

SEQ ID NO: 109022 - DNA, 25 bp, Mus musculus
accaacgcactctccgtggcgtgag

SEQ ID NO: 109023 - DNA, 25 bp, Mus musculus
accaacgcctgcagtctatgagggt

SEQ ID NO: 109024 - DNA, 25 bp, Mus musculus
accaacgcctgctgtctatgagggt

SEQ ID NO: 109025 - DNA, 25 bp, Mus musculus
accaacgctgttagtctcctgatga

SEQ ID NO: 109026 - DNA, 25 bp, Mus musculus
accaacgctgtttgtctcctgatga

SEQ ID NO: 109027 - DNA, 25 bp, Mus musculus
accaacggcttcatctgcgggtggc

SEQ ID NO: 109028 - DNA, 25 bp, Mus musculus
accaacggcttcttctgcgggtggc

SEQ ID NO: 109029 - DNA, 25 bp, Mus musculus
accaacgggcttcctgtggagctga

SEQ ID NO: 109030 - DNA, 25 bp, Mus musculus
accaacgggcttgctgtggagctga

SEQ ID NO: 109031 - DNA, 25 bp, Mus musculus
accaacgtgactcatttgctgcaat

SEQ ID NO: 109032 - DNA, 25 bp, Mus musculus
accaacgtgactgatttgctgcaat

SEQ ID NO: 109033 - DNA, 25 bp, Mus musculus
accaacgtgtgcatgctttcggttt

SEQ ID NO: 109034 - DNA, 25 bp, Mus musculus
accaacgtgtgcttgctttcggttt

SEQ ID NO: 109035 - DNA, 25 bp, Mus musculus
accaacgttgctcacatcatctctt

SEQ ID NO: 109036 - DNA, 25 bp, Mus musculus
accaacgttgctgacatcatctctt

SEQ ID NO: 109037 - DNA, 25 bp, Mus musculus
accaactaggtacttccatacgtat

SEQ ID NO: 109038 - DNA, 25 bp, Mus musculus
accaactaggtagttccatacgtat

SEQ ID NO: 109039 - DNA, 25 bp, Mus musculus
accaactatgccacagacgatgaca

SEQ ID NO: 109040 - DNA, 25 bp, Mus musculus
accaactatgcctcagacgatgaca

SEQ ID NO: 109041 - DNA, 25 bp, Mus musculus
accaactattgtcggtgtcacataa

SEQ ID NO: 109042 - DNA, 25 bp, Mus musculus
accaactattgtgggtgtcacataa

SEQ ID NO: 109043 - DNA, 25 bp, Mus musculus
accaactcaggacgttcattcacga

SEQ ID NO: 109044 - DNA, 25 bp, Mus musculus
accaactcaggaggttcattcacga

SEQ ID NO: 109045 - DNA, 25 bp, Mus musculus
accaactcatctcctgactggaagt

SEQ ID NO: 109046 - DNA, 25 bp, Mus musculus
accaactcatctgctgactggaagt

SEQ ID NO: 109047 - DNA, 25 bp, Mus musculus
accaactccctcatggacagacaga

SEQ ID NO: 109048 - DNA, 25 bp, Mus musculus
accaactccctcttggacagacaga

SEQ ID NO: 109049 - DNA, 25 bp, Mus musculus
accaactctcaaataggtcacccgt

SEQ ID NO: 109050 - DNA, 25 bp, Mus musculus
accaactctcaattaggtcacccgt

SEQ ID NO: 109051 - DNA, 25 bp, Mus musculus
accaactcttctcgcgaatttacca

SEQ ID NO: 109052 - DNA, 25 bp, Mus musculus
accaactcttctggcgaatttacca

SEQ ID NO: 109053 - DNA, 25 bp, Mus musculus
accaactgcaatcacgacgagacct

SEQ ID NO: 109054 - DNA, 25 bp, Mus musculus
accaactgcaatgacgacgagacct

SEQ ID NO: 109055 - DNA, 25 bp, Mus musculus
accaactgctcgacatgtcctatga

SEQ ID NO: 109056 - DNA, 25 bp, Mus musculus
accaactgctcgtcatgtcctatga

SEQ ID NO: 109057 - DNA, 25 bp, Mus musculus
accaactgctgcatggcgggcagat

SEQ ID NO: 109058 - DNA, 25 bp, Mus musculus
accaactgctgcttggcgggcagat

SEQ ID NO: 109059 - DNA, 25 bp, Mus musculus
accaactggcatctatgtatctcaa

SEQ ID NO: 109060 - DNA, 25 bp, Mus musculus
accaactggcatgtatgtatctcaa

SEQ ID NO: 109061 - DNA, 25 bp, Mus musculus
accaactggtgcagcgctgtcagca

SEQ ID NO: 109062 - DNA, 25 bp, Mus musculus
accaactggtgctgcgctgtcagca

SEQ ID NO: 109063 - DNA, 25 bp, Mus musculus
accaactgtaagatatcctctgagc

SEQ ID NO: 109064 - DNA, 25 bp, Mus musculus
accaactgtaagttatcctctgagc

SEQ ID NO: 109065 - DNA, 25 bp, Mus musculus
accaactgtgaaaagctgccgcttg

SEQ ID NO: 109066 - DNA, 25 bp, Mus musculus
accaactgtgaatagctgccgcttg

SEQ ID NO: 109067 - DNA, 25 bp, Mus musculus
accaacttctgcagccagggattat

SEQ ID NO: 109068 - DNA, 25 bp, Mus musculus
accaacttctgctgccagggattat

SEQ ID NO: 109069 - DNA, 25 bp, Mus musculus
accaagaacagcagtgcaagcaacc

SEQ ID NO: 109070 - DNA, 25 bp, Mus musculus
accaagaacagctgtgcaagcaacc

SEQ ID NO: 109071 - DNA, 25 bp, Mus musculus
accaagaagcctctcatttcaaagg

SEQ ID NO: 109072 - DNA, 25 bp, Mus musculus
accaagaagcctgtcatttcaaagg

SEQ ID NO: 109073 - DNA, 25 bp, Mus musculus
accaagaatcggagcagtgtgtcat

SEQ ID NO: 109074 - DNA, 25 bp, Mus musculus
accaagaatcggtgcagtgtgtcat

SEQ ID NO: 109075 - DNA, 25 bp, Mus musculus
accaagacagttcgtggcacagggt

SEQ ID NO: 109076 - DNA, 25 bp, Mus musculus
accaagacagttggtggcacagggt

SEQ ID NO: 109077 - DNA, 25 bp, Mus musculus
accaagacatctagcttcatccaaa

SEQ ID NO: 109078 - DNA, 25 bp, Mus musculus
accaagacatcttgcttcatccaaa

SEQ ID NO: 109079 - DNA, 25 bp, Mus musculus
accaagacctcacgtattagtggaa

SEQ ID NO: 109080 - DNA, 25 bp, Mus musculus
accaagacctcaggtattagtggaa

SEQ ID NO: 109081 - DNA, 25 bp, Mus musculus
accaagactgtcagacttcaagcaa

SEQ ID NO: 109082 - DNA, 25 bp, Mus musculus
accaagactgtctgacttcaagcaa

SEQ ID NO: 109083 - DNA, 25 bp, Mus musculus
accaagagactgatacttaggccca

SEQ ID NO: 109084 - DNA, 25 bp, Mus musculus
accaagagactgttacttaggccca

SEQ ID NO: 109085 - DNA, 25 bp, Mus musculus
accaagagatccaactacttctgcc

SEQ ID NO: 109086 - DNA, 25 bp, Mus musculus
accaagagatcctactacttctgcc

SEQ ID NO: 109087 - DNA, 25 bp, Mus musculus
accaagagatgcctgcttcctggag

SEQ ID NO: 109088 - DNA, 25 bp, Mus musculus
accaagagatgcgtgcttcctggag

SEQ ID NO: 109089 - DNA, 25 bp, Mus musculus
accaagagccttctacaccctaaag

SEQ ID NO: 109090 - DNA, 25 bp, Mus musculus
accaagagccttgtacaccctaaag

SEQ ID NO: 109091 - DNA, 25 bp, Mus musculus
accaagagctacaaccacagtgagg

SEQ ID NO: 109092 - DNA, 25 bp, Mus musculus
accaagagctactaccacagtgagg

SEQ ID NO: 109093 - DNA, 25 bp, Mus musculus
accaagaggagcctctgatcatggc

SEQ ID NO: 109094 - DNA, 25 bp, Mus musculus
accaagaggagcgtctgatcatggc

SEQ ID NO: 109095 - DNA, 25 bp, Mus musculus
accaagaggctgatgcccttatgga

SEQ ID NO: 109096 - DNA, 25 bp, Mus musculus
accaagaggctgttgcccttatgga

SEQ ID NO: 109097 - DNA, 25 bp, Mus musculus
accaagagggccaggttctgtccag

SEQ ID NO: 109098 - DNA, 25 bp, Mus musculus
accaagagggcctggttctgtccag

SEQ ID NO: 109099 - DNA, 25 bp, Mus musculus
accaagatatacctttctctctgtc

SEQ ID NO: 109100 - DNA, 25 bp, Mus musculus
accaagatatacgtttctctctgtc

SEQ ID NO: 109101 - DNA, 25 bp, Mus musculus
accaagatccaaactatgtctgagc

SEQ ID NO: 109102 - DNA, 25 bp, Mus musculus
accaagatccaatctatgtctgagc

SEQ ID NO: 109103 - DNA, 25 bp, Mus musculus
accaagatgcttagcttcacagtga

SEQ ID NO: 109104 - DNA, 25 bp, Mus musculus
accaagatgctttgcttcacagtga

SEQ ID NO: 109105 - DNA, 25 bp, Mus musculus
accaagatgggcactcggcttttgt

SEQ ID NO: 109106 - DNA, 25 bp, Mus musculus
accaagatgggctctcggcttttgt

SEQ ID NO: 109107 - DNA, 25 bp, Mus musculus
accaagatggtcaagatcagcagtt

SEQ ID NO: 109108 - DNA, 25 bp, Mus musculus
accaagatggtctagatcagcagtt

SEQ ID NO: 109109 - DNA, 25 bp, Mus musculus
accaagatgtggatccctttgataa

SEQ ID NO: 109110 - DNA, 25 bp, Mus musculus
accaagatgtggttccctttgataa

SEQ ID NO: 109111 - DNA, 25 bp, Mus musculus
accaagcaaatccagttcttttctt

SEQ ID NO: 109112 - DNA, 25 bp, Mus musculus
accaagcaaatcgagttcttttctt

SEQ ID NO: 109113 - DNA, 25 bp, Mus musculus
accaagcaactcctttttactgcat

SEQ ID NO: 109114 - DNA, 25 bp, Mus musculus
accaagcaactcgtttttactgcat

SEQ ID NO: 109115 - DNA, 25 bp, Mus musculus
accaagcacctgaactagatgggct

SEQ ID NO: 109116 - DNA, 25 bp, Mus musculus
accaagcacctgtactagatgggct

SEQ ID NO: 109117 - DNA, 25 bp, Mus musculus
accaagcagattaagttcagagtct

SEQ ID NO: 109118 - DNA, 25 bp, Mus musculus
accaagcagatttagttcagagtct

SEQ ID NO: 109119 - DNA, 25 bp, Mus musculus
accaagcagcgcaccagggaagggc

SEQ ID NO: 109120 - DNA, 25 bp, Mus musculus
accaagcagcgctccagggaagggc

SEQ ID NO: 109121 - DNA, 25 bp, Mus musculus
accaagcagttaactgttcctgagg

SEQ ID NO: 109122 - DNA, 25 bp, Mus musculus
accaagcagttatctgttcctgagg

SEQ ID NO: 109123 - DNA, 25 bp, Mus musculus
accaagcagttgagggcaatccaag

SEQ ID NO: 109124 - DNA, 25 bp, Mus musculus
accaagcagttgtgggcaatccaag

SEQ ID NO: 109125 - DNA, 25 bp, Mus musculus
accaagcatgcaagtggtccacagt

SEQ ID NO: 109126 - DNA, 25 bp, Mus musculus
accaagcatgcatgtggtccacagt

SEQ ID NO: 109127 - DNA, 25 bp, Mus musculus
accaagccagcgatcagagtaagca

SEQ ID NO: 109128 - DNA, 25 bp, Mus musculus
accaagccagcgttcagagtaagca

SEQ ID NO: 109129 - DNA, 25 bp, Mus musculus
accaagccagtgctcctgggtgata

SEQ ID NO: 109130 - DNA, 25 bp, Mus musculus
accaagccagtggtcctgggtgata

SEQ ID NO: 109131 - DNA, 25 bp, Mus musculus
accaagccatgcattcagctgtaac

SEQ ID NO: 109132 - DNA, 25 bp, Mus musculus
accaagccatgctttcagctgtaac

SEQ ID NO: 109133 - DNA, 25 bp, Mus musculus
accaagccatttatctagtacccgt

SEQ ID NO: 109134 - DNA, 25 bp, Mus musculus
accaagccatttttctagtacccgt

SEQ ID NO: 109135 - DNA, 25 bp, Mus musculus
accaagcccacaaagctactggcgg

SEQ ID NO: 109136 - DNA, 25 bp, Mus musculus
accaagcccacatagctactggcgg

SEQ ID NO: 109137 - DNA, 25 bp, Mus musculus
accaagcccactcattgcttcaatg

SEQ ID NO: 109138 - DNA, 25 bp, Mus musculus
accaagcccactgattgcttcaatg

SEQ ID NO: 109139 - DNA, 25 bp, Mus musculus
accaagcccatgaggttcctgggag

SEQ ID NO: 109140 - DNA, 25 bp, Mus musculus
accaagcccatgtggttcctgggag

SEQ ID NO: 109141 - DNA, 25 bp, Mus musculus
accaagccccatcaaagtatgcaaa

SEQ ID NO: 109142 - DNA, 25 bp, Mus musculus
accaagccccatgaaagtatgcaaa

SEQ ID NO: 109143 - DNA, 25 bp, Mus musculus
accaagccgcagactttctatctgg

SEQ ID NO: 109144 - DNA, 25 bp, Mus musculus
accaagccgcagtctttctatctgg

SEQ ID NO: 109145 - DNA, 25 bp, Mus musculus
accaagcctaacagtctgagctcaa

SEQ ID NO: 109146 - DNA, 25 bp, Mus musculus
accaagcctaactgtctgagctcaa

SEQ ID NO: 109147 - DNA, 25 bp, Mus musculus
accaagcctcgacattttttcacac

SEQ ID NO: 109148 - DNA, 25 bp, Mus musculus
accaagcctcgagattttttcacac

SEQ ID NO: 109149 - DNA, 25 bp, Mus musculus
accaagcctggtcgaattgtcttaa

SEQ ID NO: 109150 - DNA, 25 bp, Mus musculus
accaagcctggtggaattgtcttaa

SEQ ID NO: 109151 - DNA, 25 bp, Mus musculus
accaagccttatcaccgcaaagaag

SEQ ID NO: 109152 - DNA, 25 bp, Mus musculus
accaagccttatgaccgcaaagaag

SEQ ID NO: 109153 - DNA, 25 bp, Mus musculus
accaagcgaaagaagctgttgtgct

SEQ ID NO: 109154 - DNA, 25 bp, Mus musculus
accaagcgaaagtagctgttgtgct

SEQ ID NO: 109155 - DNA, 25 bp, Mus musculus
accaagcgatttcctgacgttatgt

SEQ ID NO: 109156 - DNA, 25 bp, Mus musculus
accaagcgatttgctgacgttatgt

SEQ ID NO: 109157 - DNA, 25 bp, Mus musculus
accaagctacagagatcctgcagcg

SEQ ID NO: 109158 - DNA, 25 bp, Mus musculus
accaagctacagtgatcctgcagcg

SEQ ID NO: 109159 - DNA, 25 bp, Mus musculus
accaagctacatctcctcagaagat

SEQ ID NO: 109160 - DNA, 25 bp, Mus musculus
accaagctacatgtcctcagaagat

SEQ ID NO: 109161 - DNA, 25 bp, Mus musculus
accaagctcaggaacctggtgttaa

SEQ ID NO: 109162 - DNA, 25 bp, Mus musculus
accaagctcaggtacctggtgttaa

SEQ ID NO: 109163 - DNA, 25 bp, Mus musculus
accaagctccaaaaaacgtactagg

SEQ ID NO: 109164 - DNA, 25 bp, Mus musculus
accaagctccaataaacgtactagg

SEQ ID NO: 109165 - DNA, 25 bp, Mus musculus
accaagctccagatggactccgtgg

SEQ ID NO: 109166 - DNA, 25 bp, Mus musculus
accaagctccagttggactccgtgg

SEQ ID NO: 109167 - DNA, 25 bp, Mus musculus
accaagctctctcttcctttagaga

SEQ ID NO: 109168 - DNA, 25 bp, Mus musculus
accaagctctctgttcctttagaga

SEQ ID NO: 109169 - DNA, 25 bp, Mus musculus
accaagctctgaaaggatgtgccaa

SEQ ID NO: 109170 - DNA, 25 bp, Mus musculus
accaagctctgataggatgtgccaa

SEQ ID NO: 109171 - DNA, 25 bp, Mus musculus
accaagctctggatgaaggcaagct

SEQ ID NO: 109172 - DNA, 25 bp, Mus musculus
accaagctctggttgaaggcaagct

SEQ ID NO: 109173 - DNA, 25 bp, Mus musculus
accaagctgagcagcatggtaggca

SEQ ID NO: 109174 - DNA, 25 bp, Mus musculus
accaagctgagctgcatggtaggca

SEQ ID NO: 109175 - DNA, 25 bp, Mus musculus
accaagctgaggctgtggaaaccat

SEQ ID NO: 109176 - DNA, 25 bp, Mus musculus
accaagctgagggtgtggaaaccat

SEQ ID NO: 109177 - DNA, 25 bp, Mus musculus
accaagctgccaatccataggacga

SEQ ID NO: 109178 - DNA, 25 bp, Mus musculus
accaagctgccattccataggacga

SEQ ID NO: 109179 - DNA, 25 bp, Mus musculus
accaagctggaactacaggctcatt

SEQ ID NO: 109180 - DNA, 25 bp, Mus musculus
accaagctggaagtacaggctcatt

SEQ ID NO: 109181 - DNA, 25 bp, Mus musculus
accaagctggatagtaaagtcacaa

SEQ ID NO: 109182 - DNA, 25 bp, Mus musculus
accaagctggattgtaaagtcacaa

SEQ ID NO: 109183 - DNA, 25 bp, Mus musculus
accaagctgtgcactcagaagtgca

SEQ ID NO: 109184 - DNA, 25 bp, Mus musculus
accaagctgtgccatgtccatgtac

SEQ ID NO: 109185 - DNA, 25 bp, Mus musculus
accaagctgtgcgatgtccatgtac

SEQ ID NO: 109186 - DNA, 25 bp, Mus musculus
accaagctgtgctctcagaagtgca

SEQ ID NO: 109187 - DNA, 25 bp, Mus musculus
accaagcttcaaagtgagggttttg

SEQ ID NO: 109188 - DNA, 25 bp, Mus musculus
accaagcttcaaatgtttcaatcag

SEQ ID NO: 109189 - DNA, 25 bp, Mus musculus
accaagcttcaatgtgagggttttg

SEQ ID NO: 109190 - DNA, 25 bp, Mus musculus
accaagcttcaattgtttcaatcag

SEQ ID NO: 109191 - DNA, 25 bp, Mus musculus
accaagcttgatattcgtgccgaac

SEQ ID NO: 109192 - DNA, 25 bp, Mus musculus
accaagcttgattttcgtgccgaac

SEQ ID NO: 109193 - DNA, 25 bp, Mus musculus
accaagcttgctctattgccaatag

SEQ ID NO: 109194 - DNA, 25 bp, Mus musculus
accaagcttgctgtattgccaatag

SEQ ID NO: 109195 - DNA, 25 bp, Mus musculus
accaaggaattgcagacggtcctct

SEQ ID NO: 109196 - DNA, 25 bp, Mus musculus
accaaggaattggagacggtcctct

SEQ ID NO: 109197 - DNA, 25 bp, Mus musculus
accaaggacgagctgatccgcctga

SEQ ID NO: 109198 - DNA, 25 bp, Mus musculus
accaaggacgaggtgatccgcctga

SEQ ID NO: 109199 - DNA, 25 bp, Mus musculus
accaaggagagcatggtcttctcaa

SEQ ID NO: 109200 - DNA, 25 bp, Mus musculus
accaaggagagcttggtcttctcaa

SEQ ID NO: 109201 - DNA, 25 bp, Mus musculus
accaaggagcagatcgtggagatgc

SEQ ID NO: 109202 - DNA, 25 bp, Mus musculus
accaaggagcagttcgtggagatgc

SEQ ID NO: 109203 - DNA, 25 bp, Mus musculus
accaaggagcctagcattttcttcc

SEQ ID NO: 109204 - DNA, 25 bp, Mus musculus
accaaggagccttgcattttcttcc

SEQ ID NO: 109205 - DNA, 25 bp, Mus musculus
accaaggaggtcattctggacgctg

SEQ ID NO: 109206 - DNA, 25 bp, Mus musculus
accaaggaggtctttctggacgctg

SEQ ID NO: 109207 - DNA, 25 bp, Mus musculus
accaaggaggttccgggcattctgt

SEQ ID NO: 109208 - DNA, 25 bp, Mus musculus
accaaggaggttgcgggcattctgt

SEQ ID NO: 109209 - DNA, 25 bp, Mus musculus
accaaggatcgaccaatcttttctt

SEQ ID NO: 109210 - DNA, 25 bp, Mus musculus
accaaggatcgagcaatcttttctt

SEQ ID NO: 109211 - DNA, 25 bp, Mus musculus
accaaggatctcaactcattactaa

SEQ ID NO: 109212 - DNA, 25 bp, Mus musculus
accaaggatctctactcattactaa

SEQ ID NO: 109213 - DNA, 25 bp, Mus musculus
accaaggcaaatactgttgcctact

SEQ ID NO: 109214 - DNA, 25 bp, Mus musculus
accaaggcaaattctgttgcctact

SEQ ID NO: 109215 - DNA, 25 bp, Mus musculus
accaaggcagcacgaaggaccaacc

SEQ ID NO: 109216 - DNA, 25 bp, Mus musculus
accaaggcagcaggaaggaccaacc

SEQ ID NO: 109217 - DNA, 25 bp, Mus musculus
accaaggcaggacggtcacttttga

SEQ ID NO: 109218 - DNA, 25 bp, Mus musculus
accaaggcaggagggtcacttttga

SEQ ID NO: 109219 - DNA, 25 bp, Mus musculus
accaaggcagtacctatgattctag

SEQ ID NO: 109220 - DNA, 25 bp, Mus musculus
accaaggcagtagctatgattctag

SEQ ID NO: 109221 - DNA, 25 bp, Mus musculus
accaaggcatatcgcatccgctttg

SEQ ID NO: 109222 - DNA, 25 bp, Mus musculus
accaaggcatatggcatccgctttg

SEQ ID NO: 109223 - DNA, 25 bp, Mus musculus
accaaggccagtctatttgacctga

SEQ ID NO: 109224 - DNA, 25 bp, Mus musculus
accaaggccagtgtatttgacctga

SEQ ID NO: 109225 - DNA, 25 bp, Mus musculus
accaaggctatcactaggtctgaga

SEQ ID NO: 109226 - DNA, 25 bp, Mus musculus
accaaggctatctctaggtctgaga

SEQ ID NO: 109227 - DNA, 25 bp, Mus musculus
accaaggctattacagtgaggacat

SEQ ID NO: 109228 - DNA, 25 bp, Mus musculus
accaaggctatttcagtgaggacat

SEQ ID NO: 109229 - DNA, 25 bp, Mus musculus
accaagggacctcataacctgatta

SEQ ID NO: 109230 - DNA, 25 bp, Mus musculus
accaagggacctgataacctgatta

SEQ ID NO: 109231 - DNA, 25 bp, Mus musculus
accaagggcaaacacacctgactgg

SEQ ID NO: 109232 - DNA, 25 bp, Mus musculus
accaagggcaaagacacctgactgg

SEQ ID NO: 109233 - DNA, 25 bp, Mus musculus
accaagggcctaaatactcagtctc

SEQ ID NO: 109234 - DNA, 25 bp, Mus musculus
accaagggcctaatctcccattgac

SEQ ID NO: 109235 - DNA, 25 bp, Mus musculus
accaagggcctatatactcagtctc

SEQ ID NO: 109236 - DNA, 25 bp, Mus musculus
accaagggcctattctcccattgac

SEQ ID NO: 109237 - DNA, 25 bp, Mus musculus
accaagggcgccagctacaagtatg

SEQ ID NO: 109238 - DNA, 25 bp, Mus musculus
accaagggcgcctgctacaagtatg

SEQ ID NO: 109239 - DNA, 25 bp, Mus musculus
accaagggctcaaggctttgttttc

SEQ ID NO: 109240 - DNA, 25 bp, Mus musculus
accaagggctcatggctttgttttc

SEQ ID NO: 109241 - DNA, 25 bp, Mus musculus
accaagggctgccaataggactgca

SEQ ID NO: 109242 - DNA, 25 bp, Mus musculus
accaagggctgcgaataggactgca

SEQ ID NO: 109243 - DNA, 25 bp, Mus musculus
accaagggggtcatcatttctgtgg

SEQ ID NO: 109244 - DNA, 25 bp, Mus musculus
accaagggggtcttcatttctgtgg

SEQ ID NO: 109245 - DNA, 25 bp, Mus musculus
accaaggtagacactgagcacagac

SEQ ID NO: 109246 - DNA, 25 bp, Mus musculus
accaaggtagactctgagcacagac

SEQ ID NO: 109247 - DNA, 25 bp, Mus musculus
accaaggtatacaagtaccgatcag

SEQ ID NO: 109248 - DNA, 25 bp, Mus musculus
accaaggtatactagtaccgatcag

SEQ ID NO: 109249 - DNA, 25 bp, Mus musculus
accaaggtccaacgcgatccagaga

SEQ ID NO: 109250 - DNA, 25 bp, Mus musculus
accaaggtccaaggcgatccagaga

SEQ ID NO: 109251 - DNA, 25 bp, Mus musculus
accaaggtgaccaatgtggctccaa

SEQ ID NO: 109252 - DNA, 25 bp, Mus musculus
accaaggtgacctatgtggctccaa

SEQ ID NO: 109253 - DNA, 25 bp, Mus musculus
accaaggtgtgcaagtatgtgaact

SEQ ID NO: 109254 - DNA, 25 bp, Mus musculus
accaaggtgtgctagtatgtgaact

SEQ ID NO: 109255 - DNA, 25 bp, Mus musculus
accaaggttatcacagggccaggga

SEQ ID NO: 109256 - DNA, 25 bp, Mus musculus
accaaggttatctcagggccaggga

SEQ ID NO: 109257 - DNA, 25 bp, Mus musculus
accaaggttcgtaacgctcgagact

SEQ ID NO: 109258 - DNA, 25 bp, Mus musculus
accaaggttcgttacgctcgagact

SEQ ID NO: 109259 - DNA, 25 bp, Mus musculus
accaaggttgggaggctagagacct

SEQ ID NO: 109260 - DNA, 25 bp, Mus musculus
accaaggttgggtggctagagacct

SEQ ID NO: 109261 - DNA, 25 bp, Mus musculus
accaaggttgtgaccgccgcagagg

SEQ ID NO: 109262 - DNA, 25 bp, Mus musculus
accaaggttgtgtccgccgcagagg

SEQ ID NO: 109263 - DNA, 25 bp, Mus musculus
accaagtacgtgcaagccaaggact

SEQ ID NO: 109264 - DNA, 25 bp, Mus musculus
accaagtacgtggaagccaaggact

SEQ ID NO: 109265 - DNA, 25 bp, Mus musculus
accaagtagggcagtccagtgccat

SEQ ID NO: 109266 - DNA, 25 bp, Mus musculus
accaagtagggctgtccagtgccat

SEQ ID NO: 109267 - DNA, 25 bp, Mus musculus
accaagtagtggcacccgcaaagag

SEQ ID NO: 109268 - DNA, 25 bp, Mus musculus
accaagtagtgggacccgcaaagag

SEQ ID NO: 109269 - DNA, 25 bp, Mus musculus
accaagtatcagcactgtagcccag

SEQ ID NO: 109270 - DNA, 25 bp, Mus musculus
accaagtatcaggactgtagcccag

SEQ ID NO: 109271 - DNA, 25 bp, Mus musculus
accaagtattgaatcctgctgctgc

SEQ ID NO: 109272 - DNA, 25 bp, Mus musculus
accaagtattgattcctgctgctgc

SEQ ID NO: 109273 - DNA, 25 bp, Mus musculus
accaagtccatgagtgaatgattta

SEQ ID NO: 109274 - DNA, 25 bp, Mus musculus
accaagtccatgtgtgaatgattta

SEQ ID NO: 109275 - DNA, 25 bp, Mus musculus
accaagtcctgcagcggaaagggca

SEQ ID NO: 109276 - DNA, 25 bp, Mus musculus
accaagtcctgctgcggaaagggca

SEQ ID NO: 109277 - DNA, 25 bp, Mus musculus
accaagtctattctgactggagccc

SEQ ID NO: 109278 - DNA, 25 bp, Mus musculus
accaagtctattgtgactggagccc

SEQ ID NO: 109279 - DNA, 25 bp, Mus musculus
accaagtctgaccacaatcctgaga

SEQ ID NO: 109280 - DNA, 25 bp, Mus musculus
accaagtctgacgacaatcctgaga

SEQ ID NO: 109281 - DNA, 25 bp, Mus musculus
accaagtcttatacagtctgtgctc

SEQ ID NO: 109282 - DNA, 25 bp, Mus musculus
accaagtcttattcagtctgtgctc

SEQ ID NO: 109283 - DNA, 25 bp, Mus musculus
accaagtgatctaggctgagccatc

SEQ ID NO: 109284 - DNA, 25 bp, Mus musculus
accaagtgatcttggctgagccatc

SEQ ID NO: 109285 - DNA, 25 bp, Mus musculus
accaagtgcagcagtgcaggaccca

SEQ ID NO: 109286 - DNA, 25 bp, Mus musculus
accaagtgcagctgtgcaggaccca

SEQ ID NO: 109287 - DNA, 25 bp, Mus musculus
accaagtgcccaaggtggagattga

SEQ ID NO: 109288 - DNA, 25 bp, Mus musculus
accaagtgcccatggtggagattga

SEQ ID NO: 109289 - DNA, 25 bp, Mus musculus
accaagtgctctccagaagcaatca

SEQ ID NO: 109290 - DNA, 25 bp, Mus musculus
accaagtgctctgcagaagcaatca

SEQ ID NO: 109291 - DNA, 25 bp, Mus musculus
accaagtggaaacattgtccccaga

SEQ ID NO: 109292 - DNA, 25 bp, Mus musculus
accaagtggaaagattgtccccaga

SEQ ID NO: 109293 - DNA, 25 bp, Mus musculus
accaagtggcccatgctgttgacac

SEQ ID NO: 109294 - DNA, 25 bp, Mus musculus
accaagtggcccttgctgttgacac

SEQ ID NO: 109295 - DNA, 25 bp, Mus musculus
accaagtgtaatagccttttcctgg

SEQ ID NO: 109296 - DNA, 25 bp, Mus musculus
accaagtgtaattgccttttcctgg

SEQ ID NO: 109297 - DNA, 25 bp, Mus musculus
accaagtgtactccgttcccagtgt

SEQ ID NO: 109298 - DNA, 25 bp, Mus musculus
accaagtgtactgcgttcccagtgt

SEQ ID NO: 109299 - DNA, 25 bp, Mus musculus
accaagtgtccaatatgtgttaact

SEQ ID NO: 109300 - DNA, 25 bp, Mus musculus
accaagtgtccattatgtgttaact

SEQ ID NO: 109301 - DNA, 25 bp, Mus musculus
accaagtgtgtgccgagaccagaga

SEQ ID NO: 109302 - DNA, 25 bp, Mus musculus
accaagtgtgtggcgagaccagaga

SEQ ID NO: 109303 - DNA, 25 bp, Mus musculus
accaagttaccaactccatatactg

SEQ ID NO: 109304 - DNA, 25 bp, Mus musculus
accaagttaccatctccatatactg

SEQ ID NO: 109305 - DNA, 25 bp, Mus musculus
accaagttcattcttactttttgat

SEQ ID NO: 109306 - DNA, 25 bp, Mus musculus
accaagttcattgttactttttgat

SEQ ID NO: 109307 - DNA, 25 bp, Mus musculus
accaagttccccaaattagagagca

SEQ ID NO: 109308 - DNA, 25 bp, Mus musculus
accaagttcccctaattagagagca

SEQ ID NO: 109309 - DNA, 25 bp, Mus musculus
accaagttcttacttggatgtaagg

SEQ ID NO: 109310 - DNA, 25 bp, Mus musculus
accaagttcttagttggatgtaagg

SEQ ID NO: 109311 - DNA, 25 bp, Mus musculus
accaagttcttcctacagtatgctg

SEQ ID NO: 109312 - DNA, 25 bp, Mus musculus
accaagttcttcgtacagtatgctg

SEQ ID NO: 109313 - DNA, 25 bp, Mus musculus
accaagttgtttcctctgagaaaag

SEQ ID NO: 109314 - DNA, 25 bp, Mus musculus
accaagttgtttgctctgagaaaag

SEQ ID NO: 109315 - DNA, 25 bp, Mus musculus
accaagttttcaagggtctcccatg

SEQ ID NO: 109316 - DNA, 25 bp, Mus musculus
accaagttttcatgggtctcccatg

SEQ ID NO: 109317 - DNA, 25 bp, Mus musculus
accaataaaataaccgtgcttcatg

SEQ ID NO: 109318 - DNA, 25 bp, Mus musculus
accaataaaatatccgtgcttcatg

SEQ ID NO: 109319 - DNA, 25 bp, Mus musculus
accaataaagataatgctacatgca

SEQ ID NO: 109320 - DNA, 25 bp, Mus musculus
accaataaagattatgctacatgca

SEQ ID NO: 109321 - DNA, 25 bp, Mus musculus
accaataagccccaagaactcaaag

SEQ ID NO: 109322 - DNA, 25 bp, Mus musculus
accaataagcccgaagaactcaaag

SEQ ID NO: 109323 - DNA, 25 bp, Mus musculus
accaatagcaggaggctgggaatga

SEQ ID NO: 109324 - DNA, 25 bp, Mus musculus
accaatagcaggtggctgggaatga

SEQ ID NO: 109325 - DNA, 25 bp, Mus musculus
accaataggtgacatctgagccctt

SEQ ID NO: 109326 - DNA, 25 bp, Mus musculus
accaataggtgagatctgagccctt

SEQ ID NO: 109327 - DNA, 25 bp, Mus musculus
accaatatcctgacttattttccag

SEQ ID NO: 109328 - DNA, 25 bp, Mus musculus
accaatatcctgtcttattttccag

SEQ ID NO: 109329 - DNA, 25 bp, Mus musculus
accaatcaggagcgccctgtctgta

SEQ ID NO: 109330 - DNA, 25 bp, Mus musculus
accaatcaggagggccctgtctgta

SEQ ID NO: 109331 - DNA, 25 bp, Mus musculus
accaatcaggatacgatgtttgtaa

SEQ ID NO: 109332 - DNA, 25 bp, Mus musculus
accaatcaggattcgatgtttgtaa

SEQ ID NO: 109333 - DNA, 25 bp, Mus musculus
accaatcatggaccctcgtgagcta

SEQ ID NO: 109334 - DNA, 25 bp, Mus musculus
accaatcatggagcctcgtgagcta

SEQ ID NO: 109335 - DNA, 25 bp, Mus musculus
accaatccaatgatgttccatctca

SEQ ID NO: 109336 - DNA, 25 bp, Mus musculus
accaatccaatgttgttccatctca

SEQ ID NO: 109337 - DNA, 25 bp, Mus musculus
accaatccagtcacaggactctgtg

SEQ ID NO: 109338 - DNA, 25 bp, Mus musculus
accaatccagtctcaggactctgtg

SEQ ID NO: 109339 - DNA, 25 bp, Mus musculus
accaatccattcatggcgcctgttg

SEQ ID NO: 109340 - DNA, 25 bp, Mus musculus
accaatccattcttggcgcctgttg

SEQ ID NO: 109341 - DNA, 25 bp, Mus musculus
accaatcgagtgatattctgcctat

SEQ ID NO: 109342 - DNA, 25 bp, Mus musculus
accaatcgagtgttattctgcctat

SEQ ID NO: 109343 - DNA, 25 bp, Mus musculus
accaatctggtcatcaaatcgagtc

SEQ ID NO: 109344 - DNA, 25 bp, Mus musculus
accaatctggtcttcaaatcgagtc

SEQ ID NO: 109345 - DNA, 25 bp, Mus musculus
accaatcttaataagaggccagtct

SEQ ID NO: 109346 - DNA, 25 bp, Mus musculus
accaatcttaattagaggccagtct

SEQ ID NO: 109347 - DNA, 25 bp, Mus musculus
accaatctttgtacaggtggatgat

SEQ ID NO: 109348 - DNA, 25 bp, Mus musculus
accaatctttgttcaggtggatgat

SEQ ID NO: 109349 - DNA, 25 bp, Mus musculus
accaatgaaaacctttgattttgca

SEQ ID NO: 109350 - DNA, 25 bp, Mus musculus
accaatgaaaacgtttgattttgca

SEQ ID NO: 109351 - DNA, 25 bp, Mus musculus
accaatgaatcaagccaggccgtga

SEQ ID NO: 109352 - DNA, 25 bp, Mus musculus
accaatgaatcatgccaggccgtga

SEQ ID NO: 109353 - DNA, 25 bp, Mus musculus
accaatgaccagctatccacttttc

SEQ ID NO: 109354 - DNA, 25 bp, Mus musculus
accaatgaccaggtatccacttttc

SEQ ID NO: 109355 - DNA, 25 bp, Mus musculus
accaatgacggtctgactgctgagg

SEQ ID NO: 109356 - DNA, 25 bp, Mus musculus
accaatgacggtgtgactgctgagg

SEQ ID NO: 109357 - DNA, 25 bp, Mus musculus
accaatgacgtcaagcagtgggtat

SEQ ID NO: 109358 - DNA, 25 bp, Mus musculus
accaatgacgtctagcagtgggtat

SEQ ID NO: 109359 - DNA, 25 bp, Mus musculus
accaatgagaatacttcaggcgatg

SEQ ID NO: 109360 - DNA, 25 bp, Mus musculus
accaatgagaattcttcaggcgatg

SEQ ID NO: 109361 - DNA, 25 bp, Mus musculus
accaatgataataccctagagaggc

SEQ ID NO: 109362 - DNA, 25 bp, Mus musculus
accaatgataattccctagagaggc

SEQ ID NO: 109363 - DNA, 25 bp, Mus musculus
accaatgatgatatgagttcctcgg

SEQ ID NO: 109364 - DNA, 25 bp, Mus musculus
accaatgatgatttgagttcctcgg

SEQ ID NO: 109365 - DNA, 25 bp, Mus musculus
accaatgatggcagtgctcgggcga

SEQ ID NO: 109366 - DNA, 25 bp, Mus musculus
accaatgatggctgtgctcgggcga

SEQ ID NO: 109367 - DNA, 25 bp, Mus musculus
accaatgcacatcgaattttttaat

SEQ ID NO: 109368 - DNA, 25 bp, Mus musculus
accaatgcacatggaattttttaat

SEQ ID NO: 109369 - DNA, 25 bp, Mus musculus
accaatgcatgtctggtactcatga

SEQ ID NO: 109370 - DNA, 25 bp, Mus musculus
accaatgcatgtgtggtactcatga

SEQ ID NO: 109371 - DNA, 25 bp, Mus musculus
accaatgctcggcttagatgccatc

SEQ ID NO: 109372 - DNA, 25 bp, Mus musculus
accaatgctcgggttagatgccatc

SEQ ID NO: 109373 - DNA, 25 bp, Mus musculus
accaatgctctaactatattgctag

SEQ ID NO: 109374 - DNA, 25 bp, Mus musculus
accaatgctctatctatattgctag

SEQ ID NO: 109375 - DNA, 25 bp, Mus musculus
accaatgcttcacatcatctctgca

SEQ ID NO: 109376 - DNA, 25 bp, Mus musculus
accaatgcttcagatcatctctgca

SEQ ID NO: 109377 - DNA, 25 bp, Mus musculus
accaatggccagctgcctcggaaaa

SEQ ID NO: 109378 - DNA, 25 bp, Mus musculus
accaatggccaggtgcctcggaaaa

SEQ ID NO: 109379 - DNA, 25 bp, Mus musculus
accaatggctgccaatgctatgatt

SEQ ID NO: 109380 - DNA, 25 bp, Mus musculus
accaatggctgcgaatgctatgatt

SEQ ID NO: 109381 - DNA, 25 bp, Mus musculus
accaatggcttaatgcttgcttgtt

SEQ ID NO: 109382 - DNA, 25 bp, Mus musculus
accaatggcttattgcttgcttgtt

SEQ ID NO: 109383 - DNA, 25 bp, Mus musculus
accaatgggtttccaggagtggcca

SEQ ID NO: 109384 - DNA, 25 bp, Mus musculus
accaatgggtttgcaggagtggcca

SEQ ID NO: 109385 - DNA, 25 bp, Mus musculus
accaatgtaatcagtcacccttagg

SEQ ID NO: 109386 - DNA, 25 bp, Mus musculus
accaatgtaatctgtcacccttagg

SEQ ID NO: 109387 - DNA, 25 bp, Mus musculus
accaatgtagtaacttcctctgagg

SEQ ID NO: 109388 - DNA, 25 bp, Mus musculus
accaatgtagtatcttcctctgagg

SEQ ID NO: 109389 - DNA, 25 bp, Mus musculus
accaatgtctgcctggagcccgggc

SEQ ID NO: 109390 - DNA, 25 bp, Mus musculus
accaatgtctgcgtggagcccgggc

SEQ ID NO: 109391 - DNA, 25 bp, Mus musculus
accaatgtcttcataggccatctac

SEQ ID NO: 109392 - DNA, 25 bp, Mus musculus
accaatgtcttcttaggccatctac

SEQ ID NO: 109393 - DNA, 25 bp, Mus musculus
accaatgtgaacaggcacagactta

SEQ ID NO: 109394 - DNA, 25 bp, Mus musculus
accaatgtgaactggcacagactta

SEQ ID NO: 109395 - DNA, 25 bp, Mus musculus
accaatgtgcgcaggaagcccttca

SEQ ID NO: 109396 - DNA, 25 bp, Mus musculus
accaatgtgcgctggaagcccttca

SEQ ID NO: 109397 - DNA, 25 bp, Mus musculus
accaatgtgcttatccctcacccat

SEQ ID NO: 109398 - DNA, 25 bp, Mus musculus
accaatgtgcttttccctcacccat

SEQ ID NO: 109399 - DNA, 25 bp, Mus musculus
accaatgtggaacgaactgcatgca

SEQ ID NO: 109400 - DNA, 25 bp, Mus musculus
accaatgtggaaggaactgcatgca

SEQ ID NO: 109401 - DNA, 25 bp, Mus musculus
accaatgttgagctagccttccaga

SEQ ID NO: 109402 - DNA, 25 bp, Mus musculus
accaatgttgaggtagccttccaga

SEQ ID NO: 109403 - DNA, 25 bp, Mus musculus
accaatgtttctctgttaaaagctt

SEQ ID NO: 109404 - DNA, 25 bp, Mus musculus
accaatgtttctgtgttaaaagctt

SEQ ID NO: 109405 - DNA, 25 bp, Mus musculus
accaatgttttccaccaacctggag

SEQ ID NO: 109406 - DNA, 25 bp, Mus musculus
accaatgttttcgaccaacctggag

SEQ ID NO: 109407 - DNA, 25 bp, Mus musculus
accaattccagcaattattcctaag

SEQ ID NO: 109408 - DNA, 25 bp, Mus musculus
accaattccagctattattcctaag

SEQ ID NO: 109409 - DNA, 25 bp, Mus musculus
accaattccaggcttatagctatag

SEQ ID NO: 109410 - DNA, 25 bp, Mus musculus
accaattccagggttatagctatag

SEQ ID NO: 109411 - DNA, 25 bp, Mus musculus
accaattctcaaaagctgtcttcca

SEQ ID NO: 109412 - DNA, 25 bp, Mus musculus
accaattctcaatagctgtcttcca

SEQ ID NO: 109413 - DNA, 25 bp, Mus musculus
accaattctctaaacgttcatggaa

SEQ ID NO: 109414 - DNA, 25 bp, Mus musculus
accaattctctatacgttcatggaa

SEQ ID NO: 109415 - DNA, 25 bp, Mus musculus
accaattctgaaaggtctggcctgt

SEQ ID NO: 109416 - DNA, 25 bp, Mus musculus
accaattctgaatggtctggcctgt

SEQ ID NO: 109417 - DNA, 25 bp, Mus musculus
accaattgttcaagccttcttcggg

SEQ ID NO: 109418 - DNA, 25 bp, Mus musculus
accaattgttcatgccttcttcggg

SEQ ID NO: 109419 - DNA, 25 bp, Mus musculus
accaatttccctatgtcctgaaagc

SEQ ID NO: 109420 - DNA, 25 bp, Mus musculus
accaatttccctttgtcctgaaagc

SEQ ID NO: 109421 - DNA, 25 bp, Mus musculus
accaatttctgtcccattttgtatt

SEQ ID NO: 109422 - DNA, 25 bp, Mus musculus
accaatttctgtgccattttgtatt

SEQ ID NO: 109423 - DNA, 25 bp, Mus musculus
accaatttgggaacaggtgttcaat

SEQ ID NO: 109424 - DNA, 25 bp, Mus musculus
accaatttgggatcaggtgttcaat

SEQ ID NO: 109425 - DNA, 25 bp, Mus musculus
accaatttgtgaagcagcagctatg

SEQ ID NO: 109426 - DNA, 25 bp, Mus musculus
accaatttgtgatgcagcagctatg

SEQ ID NO: 109427 - DNA, 25 bp, Mus musculus
accaatttgtggcaagcttcctgaa

SEQ ID NO: 109428 - DNA, 25 bp, Mus musculus
accaatttgtgggaagcttcctgaa

SEQ ID NO: 109429 - DNA, 25 bp, Mus musculus
accaattttagcctttttgtgatca

SEQ ID NO: 109430 - DNA, 25 bp, Mus musculus
accaattttagcgtttttgtgatca

SEQ ID NO: 109431 - DNA, 25 bp, Mus musculus
accacaaagcccaatcagtagggtt

SEQ ID NO: 109432 - DNA, 25 bp, Mus musculus
accacaaagccctatcagtagggtt

SEQ ID NO: 109433 - DNA, 25 bp, Mus musculus
accacaaagtccaggttcttcccat

SEQ ID NO: 109434 - DNA, 25 bp, Mus musculus
accacaaagtcctggttcttcccat

SEQ ID NO: 109435 - DNA, 25 bp, Mus musculus
accacaaagtgaatctttatcctgg

SEQ ID NO: 109436 - DNA, 25 bp, Mus musculus
accacaaagtgattctttatcctgg

SEQ ID NO: 109437 - DNA, 25 bp, Mus musculus
accacaaatgggagtcaaaggtcat

SEQ ID NO: 109438 - DNA, 25 bp, Mus musculus
accacaaatgggtgtcaaaggtcat

SEQ ID NO: 109439 - DNA, 25 bp, Mus musculus
accacaaccacgatgagaaggcgtt

SEQ ID NO: 109440 - DNA, 25 bp, Mus musculus
accacaaccacgttgagaaggcgtt

SEQ ID NO: 109441 - DNA, 25 bp, Mus musculus
accacaactctgattctccactggg

SEQ ID NO: 109442 - DNA, 25 bp, Mus musculus
accacaactctgtttctccactggg

SEQ ID NO: 109443 - DNA, 25 bp, Mus musculus
accacaactgccaagtcctgaggac

SEQ ID NO: 109444 - DNA, 25 bp, Mus musculus
accacaactgcccagctaaaatatt

SEQ ID NO: 109445 - DNA, 25 bp, Mus musculus
accacaactgccgagctaaaatatt

SEQ ID NO: 109446 - DNA, 25 bp, Mus musculus
accacaactgcctagtcctgaggac

SEQ ID NO: 109447 - DNA, 25 bp, Mus musculus
accacaactgttcttagctctcaga

SEQ ID NO: 109448 - DNA, 25 bp, Mus musculus
accacaactgttgttagctctcaga

SEQ ID NO: 109449 - DNA, 25 bp, Mus musculus
accacaagattgattgaccagggca

SEQ ID NO: 109450 - DNA, 25 bp, Mus musculus
accacaagattgtttgaccagggca

SEQ ID NO: 109451 - DNA, 25 bp, Mus musculus
accacaagctggcaggcctaacaaa

SEQ ID NO: 109452 - DNA, 25 bp, Mus musculus
accacaagctgggaggcctaacaaa

SEQ ID NO: 109453 - DNA, 25 bp, Mus musculus
accacaagttctcacggtgcaagtg

SEQ ID NO: 109454 - DNA, 25 bp, Mus musculus
accacaagttctgacggtgcaagtg

SEQ ID NO: 109455 - DNA, 25 bp, Mus musculus
accacaatagggagggctttgtctc

SEQ ID NO: 109456 - DNA, 25 bp, Mus musculus
accacaatagggtgggctttgtctc

SEQ ID NO: 109457 - DNA, 25 bp, Mus musculus
accacaatggtgaagagaggacgca

SEQ ID NO: 109458 - DNA, 25 bp, Mus musculus
accacaatggtgtagagaggacgca

SEQ ID NO: 109459 - DNA, 25 bp, Mus musculus
accacaatgtggaactgacccatag

SEQ ID NO: 109460 - DNA, 25 bp, Mus musculus
accacaatgtggtactgacccatag

SEQ ID NO: 109461 - DNA, 25 bp, Mus musculus
accacacacaagatgaccgtcgtga

SEQ ID NO: 109462 - DNA, 25 bp, Mus musculus
accacacacaagttgaccgtcgtga

SEQ ID NO: 109463 - DNA, 25 bp, Mus musculus
accacacacgcgatcattgtcagag

SEQ ID NO: 109464 - DNA, 25 bp, Mus musculus
accacacacgcgttcattgtcagag

SEQ ID NO: 109465 - DNA, 25 bp, Mus musculus
accacacacttccttatcatcagtg

SEQ ID NO: 109466 - DNA, 25 bp, Mus musculus
accacacacttcgttatcatcagtg

SEQ ID NO: 109467 - DNA, 25 bp, Mus musculus
accacacaggccaacctagaatgga

SEQ ID NO: 109468 - DNA, 25 bp, Mus musculus
accacacaggcctacctagaatgga

SEQ ID NO: 109469 - DNA, 25 bp, Mus musculus
accacaccaagcagagaaaagtatt

SEQ ID NO: 109470 - DNA, 25 bp, Mus musculus
accacaccaagctgagaaaagtatt

SEQ ID NO: 109471 - DNA, 25 bp, Mus musculus
accacaccaaggaccgggctggcag

SEQ ID NO: 109472 - DNA, 25 bp, Mus musculus
accacaccaaggtccgggctggcag

SEQ ID NO: 109473 - DNA, 25 bp, Mus musculus
accacaccaggaatctagggttgac

SEQ ID NO: 109474 - DNA, 25 bp, Mus musculus
accacaccaggattctagggttgac

SEQ ID NO: 109475 - DNA, 25 bp, Mus musculus
accacacccacaccgtaaatgtgat

SEQ ID NO: 109476 - DNA, 25 bp, Mus musculus
accacacccacagcgtaaatgtgat

SEQ ID NO: 109477 - DNA, 25 bp, Mus musculus
accacacccagaagtcttggctatg

SEQ ID NO: 109478 - DNA, 25 bp, Mus musculus
accacacccagatgtcttggctatg

SEQ ID NO: 109479 - DNA, 25 bp, Mus musculus
accacacccagtctaggttgttctg

SEQ ID NO: 109480 - DNA, 25 bp, Mus musculus
accacacccagtgtaggttgttctg

SEQ ID NO: 109481 - DNA, 25 bp, Mus musculus
accacacccggcctattatggagtt

SEQ ID NO: 109482 - DNA, 25 bp, Mus musculus
accacacccggcgtattatggagtt

SEQ ID NO: 109483 - DNA, 25 bp, Mus musculus
accacaccctccagaaatttcattt

SEQ ID NO: 109484 - DNA, 25 bp, Mus musculus
accacaccctcctgaaatttcattt

SEQ ID NO: 109485 - DNA, 25 bp, Mus musculus
accacaccctgcataaaataaaccg

SEQ ID NO: 109486 - DNA, 25 bp, Mus musculus
accacaccctgcttaaaataaaccg

SEQ ID NO: 109487 - DNA, 25 bp, Mus musculus
accacaccggaactgtcttatgtac

SEQ ID NO: 109488 - DNA, 25 bp, Mus musculus
accacaccggaagtgtcttatgtac

SEQ ID NO: 109489 - DNA, 25 bp, Mus musculus
accacacctagtcctttgttcattg

SEQ ID NO: 109490 - DNA, 25 bp, Mus musculus
accacacctagtgctttgttcattg

SEQ ID NO: 109491 - DNA, 25 bp, Mus musculus
accacacctggcacaaatgttacta

SEQ ID NO: 109492 - DNA, 25 bp, Mus musculus
accacacctggcctataaagtacct

SEQ ID NO: 109493 - DNA, 25 bp, Mus musculus
accacacctggcgtataaagtacct

SEQ ID NO: 109494 - DNA, 25 bp, Mus musculus
accacacctggctcaaatgttacta

SEQ ID NO: 109495 - DNA, 25 bp, Mus musculus
accacacctggtcataggactgttt

SEQ ID NO: 109496 - DNA, 25 bp, Mus musculus
accacacctggtgataggactgttt

SEQ ID NO: 109497 - DNA, 25 bp, Mus musculus
accacacctgtccagtctatattct

SEQ ID NO: 109498 - DNA, 25 bp, Mus musculus
accacacctgtcgagtctatattct

SEQ ID NO: 109499 - DNA, 25 bp, Mus musculus
accacaccttctacaatgagctgcg

SEQ ID NO: 109500 - DNA, 25 bp, Mus musculus
accacaccttcttcaatgagctgcg

SEQ ID NO: 109501 - DNA, 25 bp, Mus musculus
accacaccttgtatctttttagagt

SEQ ID NO: 109502 - DNA, 25 bp, Mus musculus
accacaccttgtttctttttagagt

SEQ ID NO: 109503 - DNA, 25 bp, Mus musculus
accacacgagatcccgctttactgg

SEQ ID NO: 109504 - DNA, 25 bp, Mus musculus
accacacgagatgccgctttactgg

SEQ ID NO: 109505 - DNA, 25 bp, Mus musculus
accacacgcaggcatttggggtgct

SEQ ID NO: 109506 - DNA, 25 bp, Mus musculus
accacacgcagggatttggggtgct

SEQ ID NO: 109507 - DNA, 25 bp, Mus musculus
accacacggcagatgaacaacctat

SEQ ID NO: 109508 - DNA, 25 bp, Mus musculus
accacacggcagttgaacaacctat

SEQ ID NO: 109509 - DNA, 25 bp, Mus musculus
accacacggctcagacgccatgagt

SEQ ID NO: 109510 - DNA, 25 bp, Mus musculus
accacacggctctgacgccatgagt

SEQ ID NO: 109511 - DNA, 25 bp, Mus musculus
accacactaagtatgtttgtaacca

SEQ ID NO: 109512 - DNA, 25 bp, Mus musculus
accacactaagtttgtttgtaacca

SEQ ID NO: 109513 - DNA, 25 bp, Mus musculus
accacactcacacgccgaatgttag

SEQ ID NO: 109514 - DNA, 25 bp, Mus musculus
accacactcacaggccgaatgttag

SEQ ID NO: 109515 - DNA, 25 bp, Mus musculus
accacactcactcggagggcattta

SEQ ID NO: 109516 - DNA, 25 bp, Mus musculus
accacactcactgggagggcattta

SEQ ID NO: 109517 - DNA, 25 bp, Mus musculus
accacactcgagagggtgccctgaa

SEQ ID NO: 109518 - DNA, 25 bp, Mus musculus
accacactcgagtgggtgccctgaa

SEQ ID NO: 109519 - DNA, 25 bp, Mus musculus
accacactgcaaacagggacttcca

SEQ ID NO: 109520 - DNA, 25 bp, Mus musculus
accacactgcaatcagggacttcca

SEQ ID NO: 109521 - DNA, 25 bp, Mus musculus
accacactggtgcaagggctcaaaa

SEQ ID NO: 109522 - DNA, 25 bp, Mus musculus
accacactggtggaagggctcaaaa

SEQ ID NO: 109523 - DNA, 25 bp, Mus musculus
accacactgtgcacaatgccttaat

SEQ ID NO: 109524 - DNA, 25 bp, Mus musculus
accacactgtgctcaatgccttaat

SEQ ID NO: 109525 - DNA, 25 bp, Mus musculus
accacactgtggagaacacgtcact

SEQ ID NO: 109526 - DNA, 25 bp, Mus musculus
accacactgtggtgaacacgtcact

SEQ ID NO: 109527 - DNA, 25 bp, Mus musculus
accacacttaagacttgaatatttg

SEQ ID NO: 109528 - DNA, 25 bp, Mus musculus
accacacttaagtcttgaatatttg

SEQ ID NO: 109529 - DNA, 25 bp, Mus musculus
accacactttggctgccctggtaga

SEQ ID NO: 109530 - DNA, 25 bp, Mus musculus
accacactttgggtgccctggtaga

SEQ ID NO: 109531 - DNA, 25 bp, Mus musculus
accacagaaaccatgcaaggtgagt

SEQ ID NO: 109532 - DNA, 25 bp, Mus musculus
accacagaaaccttgcaaggtgagt

SEQ ID NO: 109533 - DNA, 25 bp, Mus musculus
accacagacatgcagaaactccttc

SEQ ID NO: 109534 - DNA, 25 bp, Mus musculus
accacagacatggagaaactccttc

SEQ ID NO: 109535 - DNA, 25 bp, Mus musculus
accacagaccagctaagccagctga

SEQ ID NO: 109536 - DNA, 25 bp, Mus musculus
accacagaccaggtaagccagctga

SEQ ID NO: 109537 - DNA, 25 bp, Mus musculus
accacagagtggacagtcatgcggt

SEQ ID NO: 109538 - DNA, 25 bp, Mus musculus
accacagagtggtcagtcatgcggt

SEQ ID NO: 109539 - DNA, 25 bp, Mus musculus
accacagatggactcttgttcttct

SEQ ID NO: 109540 - DNA, 25 bp, Mus musculus
accacagatggagtcttgttcttct

SEQ ID NO: 109541 - DNA, 25 bp, Mus musculus
accacagcacctcttttcttgagga

SEQ ID NO: 109542 - DNA, 25 bp, Mus musculus
accacagcacctgttttcttgagga

SEQ ID NO: 109543 - DNA, 25 bp, Mus musculus
accacagcagaaatcagggatgact

SEQ ID NO: 109544 - DNA, 25 bp, Mus musculus
accacagcagaattcagggatgact

SEQ ID NO: 109545 - DNA, 25 bp, Mus musculus
accacagcagtgacccaagtacatg

SEQ ID NO: 109546 - DNA, 25 bp, Mus musculus
accacagcagtgtcccaagtacatg

SEQ ID NO: 109547 - DNA, 25 bp, Mus musculus
accacagcagttcaatagactccaa

SEQ ID NO: 109548 - DNA, 25 bp, Mus musculus
accacagcagttctgctcagtgcca

SEQ ID NO: 109549 - DNA, 25 bp, Mus musculus
accacagcagttgaatagactccaa

SEQ ID NO: 109550 - DNA, 25 bp, Mus musculus
accacagcagttgtgctcagtgcca

SEQ ID NO: 109551 - DNA, 25 bp, Mus musculus
accacagccaagcagcgggtgcctg

SEQ ID NO: 109552 - DNA, 25 bp, Mus musculus
accacagccaaggagcgggtgcctg

SEQ ID NO: 109553 - DNA, 25 bp, Mus musculus
accacagccagccagttttacaaag

SEQ ID NO: 109554 - DNA, 25 bp, Mus musculus
accacagccagcgagttttacaaag

SEQ ID NO: 109555 - DNA, 25 bp, Mus musculus
accacagcccatcctttgatgaacg

SEQ ID NO: 109556 - DNA, 25 bp, Mus musculus
accacagcccatgctttgatgaacg

SEQ ID NO: 109557 - DNA, 25 bp, Mus musculus
accacagcctgaattttgttgtcat

SEQ ID NO: 109558 - DNA, 25 bp, Mus musculus
accacagcctgatttttgttgtcat

SEQ ID NO: 109559 - DNA, 25 bp, Mus musculus
accacagcggggatgtatctgcaaa

SEQ ID NO: 109560 - DNA, 25 bp, Mus musculus
accacagcggggttgtatctgcaaa

SEQ ID NO: 109561 - DNA, 25 bp, Mus musculus
accacagctctcaaagtcacatttt

SEQ ID NO: 109562 - DNA, 25 bp, Mus musculus
accacagctctctaagtcacatttt

SEQ ID NO: 109563 - DNA, 25 bp, Mus musculus
accacagctggacatgtcatcacac

SEQ ID NO: 109564 - DNA, 25 bp, Mus musculus
accacagctggagatgtcatcacac

SEQ ID NO: 109565 - DNA, 25 bp, Mus musculus
accacagctgtgatgctcaggaagg

SEQ ID NO: 109566 - DNA, 25 bp, Mus musculus
accacagctgtgatggaccgggagt

SEQ ID NO: 109567 - DNA, 25 bp, Mus musculus
accacagctgtgttgctcaggaagg

SEQ ID NO: 109568 - DNA, 25 bp, Mus musculus
accacagctgtgttggaccgggagt

SEQ ID NO: 109569 - DNA, 25 bp, Mus musculus
accacagcttccagagcatttttta

SEQ ID NO: 109570 - DNA, 25 bp, Mus musculus
accacagcttcctgagcatttttta

SEQ ID NO: 109571 - DNA, 25 bp, Mus musculus
accacagcttggctctcatggagag

SEQ ID NO: 109572 - DNA, 25 bp, Mus musculus
accacagcttgggtctcatggagag

SEQ ID NO: 109573 - DNA, 25 bp, Mus musculus
accacaggaattcacgcctcggtga

SEQ ID NO: 109574 - DNA, 25 bp, Mus musculus
accacaggaattgacgcctcggtga

SEQ ID NO: 109575 - DNA, 25 bp, Mus musculus
accacaggactccaggctgaggtgt

SEQ ID NO: 109576 - DNA, 25 bp, Mus musculus
accacaggactcgaggctgaggtgt

SEQ ID NO: 109577 - DNA, 25 bp, Mus musculus
accacaggactgacacactttgttc

SEQ ID NO: 109578 - DNA, 25 bp, Mus musculus
accacaggactgtcacactttgttc

SEQ ID NO: 109579 - DNA, 25 bp, Mus musculus
accacaggagacatgaccctcggta

SEQ ID NO: 109580 - DNA, 25 bp, Mus musculus
accacaggagacttgaccctcggta

SEQ ID NO: 109581 - DNA, 25 bp, Mus musculus
accacaggatctctcctgacagatt

SEQ ID NO: 109582 - DNA, 25 bp, Mus musculus
accacaggatctgtcctgacagatt

SEQ ID NO: 109583 - DNA, 25 bp, Mus musculus
accacaggccggattaatggccagt

SEQ ID NO: 109584 - DNA, 25 bp, Mus musculus
accacaggccggtttaatggccagt

SEQ ID NO: 109585 - DNA, 25 bp, Mus musculus
accacaggcctccatggtaccatgt

SEQ ID NO: 109586 - DNA, 25 bp, Mus musculus
accacaggcctcgatggtaccatgt

SEQ ID NO: 109587 - DNA, 25 bp, Mus musculus
accacaggcgcacgtcccacagatg

SEQ ID NO: 109588 - DNA, 25 bp, Mus musculus
accacaggcgcaggtcccacagatg

SEQ ID NO: 109589 - DNA, 25 bp, Mus musculus
accacaggctctaagcagtcacata

SEQ ID NO: 109590 - DNA, 25 bp, Mus musculus
accacaggctcttagcagtcacata

SEQ ID NO: 109591 - DNA, 25 bp, Mus musculus
accacaggtaccagggcaagttcat

SEQ ID NO: 109592 - DNA, 25 bp, Mus musculus
accacaggtacctgggcaagttcat

SEQ ID NO: 109593 - DNA, 25 bp, Mus musculus
accacaggtggaaaacgaatgctct

SEQ ID NO: 109594 - DNA, 25 bp, Mus musculus
accacaggtggaagcgcactgacac

SEQ ID NO: 109595 - DNA, 25 bp, Mus musculus
accacaggtggataacgaatgctct

SEQ ID NO: 109596 - DNA, 25 bp, Mus musculus
accacaggtggatgcgcactgacac

SEQ ID NO: 109597 - DNA, 25 bp, Mus musculus
accacagtacaaccacagtgctcaa

SEQ ID NO: 109598 - DNA, 25 bp, Mus musculus
accacagtacaagcacagtgctcaa

SEQ ID NO: 109599 - DNA, 25 bp, Mus musculus
accacagtactaaccgtcgtaggcg

SEQ ID NO: 109600 - DNA, 25 bp, Mus musculus
accacagtactatccgtcgtaggcg

SEQ ID NO: 109601 - DNA, 25 bp, Mus musculus
accacagtctccactggttcggatc

SEQ ID NO: 109602 - DNA, 25 bp, Mus musculus
accacagtctcctctggttcggatc

SEQ ID NO: 109603 - DNA, 25 bp, Mus musculus
accacagtcttcacatctaggcaag

SEQ ID NO: 109604 - DNA, 25 bp, Mus musculus
accacagtcttctcatctaggcaag

SEQ ID NO: 109605 - DNA, 25 bp, Mus musculus
accacagtgactacaagggcctgtt

SEQ ID NO: 109606 - DNA, 25 bp, Mus musculus
accacagtgacttcaagggcctgtt

SEQ ID NO: 109607 - DNA, 25 bp, Mus musculus
accacagtgagccatcgataccaca

SEQ ID NO: 109608 - DNA, 25 bp, Mus musculus
accacagtgagcgatcgataccaca

SEQ ID NO: 109609 - DNA, 25 bp, Mus musculus
accacagtggccatgcggagaaagc

SEQ ID NO: 109610 - DNA, 25 bp, Mus musculus
accacagtggccttgcggagaaagc

SEQ ID NO: 109611 - DNA, 25 bp, Mus musculus
accacagtggctaattccccaggga

SEQ ID NO: 109612 - DNA, 25 bp, Mus musculus
accacagtggcttattccccaggga

SEQ ID NO: 109613 - DNA, 25 bp, Mus musculus
accacagttactctttccatttgaa

SEQ ID NO: 109614 - DNA, 25 bp, Mus musculus
accacagttactgtttccatttgaa

SEQ ID NO: 109615 - DNA, 25 bp, Mus musculus
accacagttctactttcacacaaga

SEQ ID NO: 109616 - DNA, 25 bp, Mus musculus
accacagttctagtttcacacaaga

SEQ ID NO: 109617 - DNA, 25 bp, Mus musculus
accacagttggtctcatttgttgga

SEQ ID NO: 109618 - DNA, 25 bp, Mus musculus
accacagttggtgtcatttgttgga

SEQ ID NO: 109619 - DNA, 25 bp, Mus musculus
accacagtttataggatgggcactg

SEQ ID NO: 109620 - DNA, 25 bp, Mus musculus
accacagtttattggatgggcactg

SEQ ID NO: 109621 - DNA, 25 bp, Mus musculus
accacagtttgtatccagggtgcca

SEQ ID NO: 109622 - DNA, 25 bp, Mus musculus
accacagtttgtttccagggtgcca

SEQ ID NO: 109623 - DNA, 25 bp, Mus musculus
accacataatctaggctttgggtgt

SEQ ID NO: 109624 - DNA, 25 bp, Mus musculus
accacataatcttggctttgggtgt

SEQ ID NO: 109625 - DNA, 25 bp, Mus musculus
accacatacatgagatgcccacaga

SEQ ID NO: 109626 - DNA, 25 bp, Mus musculus
accacatacatgtgatgcccacaga

SEQ ID NO: 109627 - DNA, 25 bp, Mus musculus
accacatacccgacctaacaatttg

SEQ ID NO: 109628 - DNA, 25 bp, Mus musculus
accacatacccgtcctaacaatttg

SEQ ID NO: 109629 - DNA, 25 bp, Mus musculus
accacatagcatatactggccttga

SEQ ID NO: 109630 - DNA, 25 bp, Mus musculus
accacatagcatttactggccttga

SEQ ID NO: 109631 - DNA, 25 bp, Mus musculus
accacatatccaccgctacttttaa

SEQ ID NO: 109632 - DNA, 25 bp, Mus musculus
accacatatccagcgctacttttaa

SEQ ID NO: 109633 - DNA, 25 bp, Mus musculus
accacatatctgaagcgattcgcac

SEQ ID NO: 109634 - DNA, 25 bp, Mus musculus
accacatatctgtagcgattcgcac

SEQ ID NO: 109635 - DNA, 25 bp, Mus musculus
accacatcagcacaggaagagcctg

SEQ ID NO: 109636 - DNA, 25 bp, Mus musculus
accacatcagcagaggaagagcctg

SEQ ID NO: 109637 - DNA, 25 bp, Mus musculus
accacatcagggacagaatacagac

SEQ ID NO: 109638 - DNA, 25 bp, Mus musculus
accacatcagggtcagaatacagac

SEQ ID NO: 109639 - DNA, 25 bp, Mus musculus
accacatcatccctggactagttta

SEQ ID NO: 109640 - DNA, 25 bp, Mus musculus
accacatcatccgtggactagttta

SEQ ID NO: 109641 - DNA, 25 bp, Mus musculus
accacatccaggctgttacttgtgt

SEQ ID NO: 109642 - DNA, 25 bp, Mus musculus
accacatccagggtgttacttgtgt

SEQ ID NO: 109643 - DNA, 25 bp, Mus musculus
accacatcctgactttctgtttatt

SEQ ID NO: 109644 - DNA, 25 bp, Mus musculus
accacatcctgagtttctgtttatt

SEQ ID NO: 109645 - DNA, 25 bp, Mus musculus
accacatctggcagcagggttttct

SEQ ID NO: 109646 - DNA, 25 bp, Mus musculus
accacatctggctgcagggttttct

SEQ ID NO: 109647 - DNA, 25 bp, Mus musculus
accacatctgtgcattagctgcaga

SEQ ID NO: 109648 - DNA, 25 bp, Mus musculus
accacatctgtggattagctgcaga

SEQ ID NO: 109649 - DNA, 25 bp, Mus musculus
accacatcttttactagttctctag

SEQ ID NO: 109650 - DNA, 25 bp, Mus musculus
accacatctttttctagttctctag

SEQ ID NO: 109651 - DNA, 25 bp, Mus musculus
accacatgacttactttgaggcctc

SEQ ID NO: 109652 - DNA, 25 bp, Mus musculus
accacatgactttctttgaggcctc

SEQ ID NO: 109653 - DNA, 25 bp, Mus musculus
accacatgagccaatatcagtcatt

SEQ ID NO: 109654 - DNA, 25 bp, Mus musculus
accacatgagcctatatcagtcatt

SEQ ID NO: 109655 - DNA, 25 bp, Mus musculus
accacatgatgtcattgcctttatg

SEQ ID NO: 109656 - DNA, 25 bp, Mus musculus
accacatgatgtgattgcctttatg

SEQ ID NO: 109657 - DNA, 25 bp, Mus musculus
accacatgctgcactgagactttct

SEQ ID NO: 109658 - DNA, 25 bp, Mus musculus
accacatgctgctctgagactttct

SEQ ID NO: 109659 - DNA, 25 bp, Mus musculus
accacatggaaccactaacttgggt

SEQ ID NO: 109660 - DNA, 25 bp, Mus musculus
accacatggaacgactaacttgggt

SEQ ID NO: 109661 - DNA, 25 bp, Mus musculus
accacatggccaacctcagtgaggc

SEQ ID NO: 109662 - DNA, 25 bp, Mus musculus
accacatggccatcctcagtgaggc

SEQ ID NO: 109663 - DNA, 25 bp, Mus musculus
accacatggctacgcttgtcttaaa

SEQ ID NO: 109664 - DNA, 25 bp, Mus musculus
accacatggctaggcttgtcttaaa

SEQ ID NO: 109665 - DNA, 25 bp, Mus musculus
accacatggtagcttcaacaaccat

SEQ ID NO: 109666 - DNA, 25 bp, Mus musculus
accacatggtaggttcaacaaccat

SEQ ID NO: 109667 - DNA, 25 bp, Mus musculus
accacatgtacccaggaaatgccca

SEQ ID NO: 109668 - DNA, 25 bp, Mus musculus
accacatgtaccgaggaaatgccca

SEQ ID NO: 109669 - DNA, 25 bp, Mus musculus
accacatgtgagatgaggtgacctg

SEQ ID NO: 109670 - DNA, 25 bp, Mus musculus
accacatgtgagttgaggtgacctg

SEQ ID NO: 109671 - DNA, 25 bp, Mus musculus
accacatgtttcaaagtgtcccatc

SEQ ID NO: 109672 - DNA, 25 bp, Mus musculus
accacatgtttctaagtgtcccatc

SEQ ID NO: 109673 - DNA, 25 bp, Mus musculus
accacattatcacctggctcagaat

SEQ ID NO: 109674 - DNA, 25 bp, Mus musculus
accacattatcagctggctcagaat

SEQ ID NO: 109675 - DNA, 25 bp, Mus musculus
accacattcagtctagggccttttc

SEQ ID NO: 109676 - DNA, 25 bp, Mus musculus
accacattcagtgtagggccttttc

SEQ ID NO: 109677 - DNA, 25 bp, Mus musculus
accacattcctaccactaggtggtg

SEQ ID NO: 109678 - DNA, 25 bp, Mus musculus
accacattcctagcactaggtggtg

SEQ ID NO: 109679 - DNA, 25 bp, Mus musculus
accacattctgcacacggacatgat

SEQ ID NO: 109680 - DNA, 25 bp, Mus musculus
accacattctgctcacggacatgat

SEQ ID NO: 109681 - DNA, 25 bp, Mus musculus
accacattgccacaagtttatgatt

SEQ ID NO: 109682 - DNA, 25 bp, Mus musculus
accacattgccagaagtttatgatt

SEQ ID NO: 109683 - DNA, 25 bp, Mus musculus
accacattgtgcacagtattttagt

SEQ ID NO: 109684 - DNA, 25 bp, Mus musculus
accacattgtgctcagtattttagt

SEQ ID NO: 109685 - DNA, 25 bp, Mus musculus
accacattgtgtaaggattctgaag

SEQ ID NO: 109686 - DNA, 25 bp, Mus musculus
accacattgtgttaggattctgaag

SEQ ID NO: 109687 - DNA, 25 bp, Mus musculus
accacattgttaactgtaggagctg

SEQ ID NO: 109688 - DNA, 25 bp, Mus musculus
accacattgttatctgtaggagctg

SEQ ID NO: 109689 - DNA, 25 bp, Mus musculus
accacatttagtctcctgagtcgta

SEQ ID NO: 109690 - DNA, 25 bp, Mus musculus
accacatttagtgtcctgagtcgta

SEQ ID NO: 109691 - DNA, 25 bp, Mus musculus
accacatttcatcctcgttttaaaa

SEQ ID NO: 109692 - DNA, 25 bp, Mus musculus
accacatttcatgctcgttttaaaa

SEQ ID NO: 109693 - DNA, 25 bp, Mus musculus
accacatttctgcttgactgggcct

SEQ ID NO: 109694 - DNA, 25 bp, Mus musculus
accacatttctggttgactgggcct

SEQ ID NO: 109695 - DNA, 25 bp, Mus musculus
accacatttgtacctccttttattt

SEQ ID NO: 109696 - DNA, 25 bp, Mus musculus
accacatttgtagctccttttattt

SEQ ID NO: 109697 - DNA, 25 bp, Mus musculus
accacattttatcagccattagcca

SEQ ID NO: 109698 - DNA, 25 bp, Mus musculus
accacattttatgagccattagcca

SEQ ID NO: 109699 - DNA, 25 bp, Mus musculus
accacattttggatcctagcaacca

SEQ ID NO: 109700 - DNA, 25 bp, Mus musculus
accacattttggttcctagcaacca

SEQ ID NO: 109701 - DNA, 25 bp, Mus musculus
accaccaaacttatagtccgctcaa

SEQ ID NO: 109702 - DNA, 25 bp, Mus musculus
accaccaaacttttagtccgctcaa

SEQ ID NO: 109703 - DNA, 25 bp, Mus musculus
accaccaaggagatatatccagatt

SEQ ID NO: 109704 - DNA, 25 bp, Mus musculus
accaccaaggagttatatccagatt

SEQ ID NO: 109705 - DNA, 25 bp, Mus musculus
accaccaaggctcgaaaactggctt

SEQ ID NO: 109706 - DNA, 25 bp, Mus musculus
accaccaaggctggaaaactggctt

SEQ ID NO: 109707 - DNA, 25 bp, Mus musculus
accaccaagtgaagcttttacaagc

SEQ ID NO: 109708 - DNA, 25 bp, Mus musculus
accaccaagtgatgcttttacaagc

SEQ ID NO: 109709 - DNA, 25 bp, Mus musculus
accaccaagtggctcgggatctgaa

SEQ ID NO: 109710 - DNA, 25 bp, Mus musculus
accaccaagtgggtcgggatctgaa

SEQ ID NO: 109711 - DNA, 25 bp, Mus musculus
accaccaatcacaggcatttggacc

SEQ ID NO: 109712 - DNA, 25 bp, Mus musculus
accaccaatcactggcatttggacc

SEQ ID NO: 109713 - DNA, 25 bp, Mus musculus
accaccacaaacatactgcatctgt

SEQ ID NO: 109714 - DNA, 25 bp, Mus musculus
accaccacaaacttactgcatctgt

SEQ ID NO: 109715 - DNA, 25 bp, Mus musculus
accaccacaactatgtttctagtat

SEQ ID NO: 109716 - DNA, 25 bp, Mus musculus
accaccacaactttgtttctagtat

SEQ ID NO: 109717 - DNA, 25 bp, Mus musculus
accaccacacatcctaggaaggtcg

SEQ ID NO: 109718 - DNA, 25 bp, Mus musculus
accaccacacatgctaggaaggtcg

SEQ ID NO: 109719 - DNA, 25 bp, Mus musculus
accaccacacctaaatgatgatcct

SEQ ID NO: 109720 - DNA, 25 bp, Mus musculus
accaccacaccttaatgatgatcct

SEQ ID NO: 109721 - DNA, 25 bp, Mus musculus
accaccacactgatgagatggacac

SEQ ID NO: 109722 - DNA, 25 bp, Mus musculus
accaccacactgttgagatggacac

SEQ ID NO: 109723 - DNA, 25 bp, Mus musculus
accaccacagtgagtaaacaactaa

SEQ ID NO: 109724 - DNA, 25 bp, Mus musculus
accaccacagtgtgtaaacaactaa

SEQ ID NO: 109725 - DNA, 25 bp, Mus musculus
accaccaccactagaactttgcagg

SEQ ID NO: 109726 - DNA, 25 bp, Mus musculus
accaccaccacttgaactttgcagg

SEQ ID NO: 109727 - DNA, 25 bp, Mus musculus
accaccaccgacagtgacattgtaa

SEQ ID NO: 109728 - DNA, 25 bp, Mus musculus
accaccaccgactgtgacattgtaa

SEQ ID NO: 109729 - DNA, 25 bp, Mus musculus
accaccacctttaaccgaaagcatg

SEQ ID NO: 109730 - DNA, 25 bp, Mus musculus
accaccaccttttaccgaaagcatg

SEQ ID NO: 109731 - DNA, 25 bp, Mus musculus
accaccactatcactcgaagcgagg

SEQ ID NO: 109732 - DNA, 25 bp, Mus musculus
accaccactatctctcgaagcgagg

SEQ ID NO: 109733 - DNA, 25 bp, Mus musculus
accaccactccccagagtgtagatg

SEQ ID NO: 109734 - DNA, 25 bp, Mus musculus
accaccactcccgagagtgtagatg

SEQ ID NO: 109735 - DNA, 25 bp, Mus musculus
accaccactctgacgggaaggcttt

SEQ ID NO: 109736 - DNA, 25 bp, Mus musculus
accaccactctgtcgggaaggcttt

SEQ ID NO: 109737 - DNA, 25 bp, Mus musculus
accaccacttgaagtcttctctttc

SEQ ID NO: 109738 - DNA, 25 bp, Mus musculus
accaccacttgatgtcttctctttc

SEQ ID NO: 109739 - DNA, 25 bp, Mus musculus
accaccacttttcagcagggctgtg

SEQ ID NO: 109740 - DNA, 25 bp, Mus musculus
accaccacttttgagcagggctgtg

SEQ ID NO: 109741 - DNA, 25 bp, Mus musculus
accaccagaagtagtaccaggacca

SEQ ID NO: 109742 - DNA, 25 bp, Mus musculus
accaccagaagttgtaccaggacca

SEQ ID NO: 109743 - DNA, 25 bp, Mus musculus
accaccagcactactaattcatttt

SEQ ID NO: 109744 - DNA, 25 bp, Mus musculus
accaccagcacttctaattcatttt

SEQ ID NO: 109745 - DNA, 25 bp, Mus musculus
accaccagcagtaaagccgggcgag

SEQ ID NO: 109746 - DNA, 25 bp, Mus musculus
accaccagcagtcatgggtgtcttt

SEQ ID NO: 109747 - DNA, 25 bp, Mus musculus
accaccagcagtgatgggtgtcttt

SEQ ID NO: 109748 - DNA, 25 bp, Mus musculus
accaccagcagttaagccgggcgag

SEQ ID NO: 109749 - DNA, 25 bp, Mus musculus
accaccagcatcaaatcatctgcat

SEQ ID NO: 109750 - DNA, 25 bp, Mus musculus
accaccagcatctaatcatctgcat

SEQ ID NO: 109751 - DNA, 25 bp, Mus musculus
accaccagcattaatttcctgggcc

SEQ ID NO: 109752 - DNA, 25 bp, Mus musculus
accaccagcattctttgggtcaact

SEQ ID NO: 109753 - DNA, 25 bp, Mus musculus
accaccagcattgtttgggtcaact

SEQ ID NO: 109754 - DNA, 25 bp, Mus musculus
accaccagcatttatttcctgggcc

SEQ ID NO: 109755 - DNA, 25 bp, Mus musculus
accaccagccttagaaagtctctgt

SEQ ID NO: 109756 - DNA, 25 bp, Mus musculus
accaccagcctttgaaagtctctgt

SEQ ID NO: 109757 - DNA, 25 bp, Mus musculus
accaccagcgtgatccaaggatgaa

SEQ ID NO: 109758 - DNA, 25 bp, Mus musculus
accaccagcgtgttccaaggatgaa

SEQ ID NO: 109759 - DNA, 25 bp, Mus musculus
accaccagcttcacggaggaacatt

SEQ ID NO: 109760 - DNA, 25 bp, Mus musculus
accaccagcttctcggaggaacatt

SEQ ID NO: 109761 - DNA, 25 bp, Mus musculus
accaccaggacgctgaaggcccgga

SEQ ID NO: 109762 - DNA, 25 bp, Mus musculus
accaccaggacggtgaaggcccgga

SEQ ID NO: 109763 - DNA, 25 bp, Mus musculus
accaccaggcttatcactcagtagt

SEQ ID NO: 109764 - DNA, 25 bp, Mus musculus
accaccaggcttttcactcagtagt

SEQ ID NO: 109765 - DNA, 25 bp, Mus musculus
accaccagggcaacacatatactaa

SEQ ID NO: 109766 - DNA, 25 bp, Mus musculus
accaccagggcatcacatatactaa

SEQ ID NO: 109767 - DNA, 25 bp, Mus musculus
accaccagtgagactttttcttgta

SEQ ID NO: 109768 - DNA, 25 bp, Mus musculus
accaccagtgagtctttttcttgta

SEQ ID NO: 109769 - DNA, 25 bp, Mus musculus
accaccagtgctccaagcctaagaa

SEQ ID NO: 109770 - DNA, 25 bp, Mus musculus
accaccagtgctgcaagcctaagaa

SEQ ID NO: 109771 - DNA, 25 bp, Mus musculus
accaccatacccagtatatataatt

SEQ ID NO: 109772 - DNA, 25 bp, Mus musculus
accaccatacccagtgatagttttt

SEQ ID NO: 109773 - DNA, 25 bp, Mus musculus
accaccataccctgtatatataatt

SEQ ID NO: 109774 - DNA, 25 bp, Mus musculus
accaccataccctgtgatagttttt

SEQ ID NO: 109775 - DNA, 25 bp, Mus musculus
accaccatccacataaccaaagacc

SEQ ID NO: 109776 - DNA, 25 bp, Mus musculus
accaccatccacttaaccaaagacc

SEQ ID NO: 109777 - DNA, 25 bp, Mus musculus
accaccatccagctacaaatatgtt

SEQ ID NO: 109778 - DNA, 25 bp, Mus musculus
accaccatccaggtacaaatatgtt

SEQ ID NO: 109779 - DNA, 25 bp, Mus musculus
accaccatctatattgtgaactttg

SEQ ID NO: 109780 - DNA, 25 bp, Mus musculus
accaccatctattttgtgaactttg

SEQ ID NO: 109781 - DNA, 25 bp, Mus musculus
accaccatgctccaacaaggactgt

SEQ ID NO: 109782 - DNA, 25 bp, Mus musculus
accaccatgctcgaacaaggactgt

SEQ ID NO: 109783 - DNA, 25 bp, Mus musculus
accaccatgggcaggactcgctgaa

SEQ ID NO: 109784 - DNA, 25 bp, Mus musculus
accaccatgggctggactcgctgaa

SEQ ID NO: 109785 - DNA, 25 bp, Mus musculus
accaccatggtcacatttgaacctg

SEQ ID NO: 109786 - DNA, 25 bp, Mus musculus
accaccatggtctcatttgaacctg

SEQ ID NO: 109787 - DNA, 25 bp, Mus musculus
accaccatgttcagaccgtttttat

SEQ ID NO: 109788 - DNA, 25 bp, Mus musculus
accaccatgttctgaccgtttttat

SEQ ID NO: 109789 - DNA, 25 bp, Mus musculus
accaccattacactgccaaactgaa

SEQ ID NO: 109790 - DNA, 25 bp, Mus musculus
accaccattacagtgccaaactgaa

SEQ ID NO: 109791 - DNA, 25 bp, Mus musculus
accaccattctaattcagaacaagt

SEQ ID NO: 109792 - DNA, 25 bp, Mus musculus
accaccattctatttcagaacaagt

SEQ ID NO: 109793 - DNA, 25 bp, Mus musculus
accaccattctccagtatactacag

SEQ ID NO: 109794 - DNA, 25 bp, Mus musculus
accaccattctcgagtatactacag

SEQ ID NO: 109795 - DNA, 25 bp, Mus musculus
accaccattgagcacgaagacacca

SEQ ID NO: 109796 - DNA, 25 bp, Mus musculus
accaccattgagcgcgtttaagata

SEQ ID NO: 109797 - DNA, 25 bp, Mus musculus
accaccattgaggacgaagacacca

SEQ ID NO: 109798 - DNA, 25 bp, Mus musculus
accaccattgagggcgtttaagata

SEQ ID NO: 109799 - DNA, 25 bp, Mus musculus
accaccattgtactcagctgaatcg

SEQ ID NO: 109800 - DNA, 25 bp, Mus musculus
accaccattgtagtcagctgaatcg

SEQ ID NO: 109801 - DNA, 25 bp, Mus musculus
accaccattgtcattgccatgatca

SEQ ID NO: 109802 - DNA, 25 bp, Mus musculus
accaccattgtctttgccatgatca

SEQ ID NO: 109803 - DNA, 25 bp, Mus musculus
accaccatttaaagcaattcatagt

SEQ ID NO: 109804 - DNA, 25 bp, Mus musculus
accaccatttaatgcaattcatagt

SEQ ID NO: 109805 - DNA, 25 bp, Mus musculus
accaccatttatagttggccaggag

SEQ ID NO: 109806 - DNA, 25 bp, Mus musculus
accaccatttattgttggccaggag

SEQ ID NO: 109807 - DNA, 25 bp, Mus musculus
accaccattttaagtatagcttcta

SEQ ID NO: 109808 - DNA, 25 bp, Mus musculus
accaccattttatgtatagcttcta

SEQ ID NO: 109809 - DNA, 25 bp, Mus musculus
accacccaagtaatgccaggtctta

SEQ ID NO: 109810 - DNA, 25 bp, Mus musculus
accacccaagtattgccaggtctta

SEQ ID NO: 109811 - DNA, 25 bp, Mus musculus
accacccaagtcattatatcactgc

SEQ ID NO: 109812 - DNA, 25 bp, Mus musculus
accacccaagtctttatatcactgc

SEQ ID NO: 109813 - DNA, 25 bp, Mus musculus
accacccaagtgacatgccaaataa

SEQ ID NO: 109814 - DNA, 25 bp, Mus musculus
accacccaagtgtcatgccaaataa

SEQ ID NO: 109815 - DNA, 25 bp, Mus musculus
accacccaatgcaagccttgaactt

SEQ ID NO: 109816 - DNA, 25 bp, Mus musculus
accacccaatgctagccttgaactt

SEQ ID NO: 109817 - DNA, 25 bp, Mus musculus
accacccacgcacagaagttatctt

SEQ ID NO: 109818 - DNA, 25 bp, Mus musculus
accacccacgcagagaagttatctt

SEQ ID NO: 109819 - DNA, 25 bp, Mus musculus
accacccactgcagtggatttgaac

SEQ ID NO: 109820 - DNA, 25 bp, Mus musculus
accacccactgctgtggatttgaac

SEQ ID NO: 109821 - DNA, 25 bp, Mus musculus
accacccagacaaccaactagttga

SEQ ID NO: 109822 - DNA, 25 bp, Mus musculus
accacccagacatccaactagttga

SEQ ID NO: 109823 - DNA, 25 bp, Mus musculus
accacccagagtatccatttgtgga

SEQ ID NO: 109824 - DNA, 25 bp, Mus musculus
accacccagagtttccatttgtgga

SEQ ID NO: 109825 - DNA, 25 bp, Mus musculus
accacccagcgacatacatggtttt

SEQ ID NO: 109826 - DNA, 25 bp, Mus musculus
accacccagcgagatacatggtttt

SEQ ID NO: 109827 - DNA, 25 bp, Mus musculus
accacccagctcaatcattaatcaa

SEQ ID NO: 109828 - DNA, 25 bp, Mus musculus
accacccagctctatcattaatcaa

SEQ ID NO: 109829 - DNA, 25 bp, Mus musculus
accacccattaaatcgttttgtatg

SEQ ID NO: 109830 - DNA, 25 bp, Mus musculus
accacccattaattcgttttgtatg

SEQ ID NO: 109831 - DNA, 25 bp, Mus musculus
accaccccacagagcctatatttaa

SEQ ID NO: 109832 - DNA, 25 bp, Mus musculus
accaccccacagtgcctatatttaa

SEQ ID NO: 109833 - DNA, 25 bp, Mus musculus
accaccccggtgcatagagaaatcc

SEQ ID NO: 109834 - DNA, 25 bp, Mus musculus
accaccccggtggatagagaaatcc

SEQ ID NO: 109835 - DNA, 25 bp, Mus musculus
accaccctaagcagttgaacaatac

SEQ ID NO: 109836 - DNA, 25 bp, Mus musculus
accaccctaagctgttgaacaatac

SEQ ID NO: 109837 - DNA, 25 bp, Mus musculus
accaccctaggtacaaaagctgccg

SEQ ID NO: 109838 - DNA, 25 bp, Mus musculus
accaccctaggtactagagatgcac

SEQ ID NO: 109839 - DNA, 25 bp, Mus musculus
accaccctaggttcaaaagctgccg

SEQ ID NO: 109840 - DNA, 25 bp, Mus musculus
accaccctaggttctagagatgcac

SEQ ID NO: 109841 - DNA, 25 bp, Mus musculus
accaccctcacaatattgaatccta

SEQ ID NO: 109842 - DNA, 25 bp, Mus musculus
accaccctcacattattgaatccta

SEQ ID NO: 109843 - DNA, 25 bp, Mus musculus
accaccctggaccaaatactattca

SEQ ID NO: 109844 - DNA, 25 bp, Mus musculus
accaccctggacgaaatactattca

SEQ ID NO: 109845 - DNA, 25 bp, Mus musculus
accaccctgggcacatagtaagact

SEQ ID NO: 109846 - DNA, 25 bp, Mus musculus
accaccctgggctcatagtaagact

SEQ ID NO: 109847 - DNA, 25 bp, Mus musculus
accaccctgttgcacgtggaggaaa

SEQ ID NO: 109848 - DNA, 25 bp, Mus musculus
accaccctgttggacgtggaggaaa

SEQ ID NO: 109849 - DNA, 25 bp, Mus musculus
accaccgacaagcactttgcagagc

SEQ ID NO: 109850 - DNA, 25 bp, Mus musculus
accaccgacaaggactttgcagagc

SEQ ID NO: 109851 - DNA, 25 bp, Mus musculus
accaccgacctgcacttgagtgtac

SEQ ID NO: 109852 - DNA, 25 bp, Mus musculus
accaccgacctggacttgagtgtac

SEQ ID NO: 109853 - DNA, 25 bp, Mus musculus
accaccgagctcaggacgctgagga

SEQ ID NO: 109854 - DNA, 25 bp, Mus musculus
accaccgagctctggacgctgagga

SEQ ID NO: 109855 - DNA, 25 bp, Mus musculus
accaccgatgtaaggcaagcactat

SEQ ID NO: 109856 - DNA, 25 bp, Mus musculus
accaccgatgtatggcaagcactat

SEQ ID NO: 109857 - DNA, 25 bp, Mus musculus
accaccgattcactgcagagactac

SEQ ID NO: 109858 - DNA, 25 bp, Mus musculus
accaccgattcagtgcagagactac

SEQ ID NO: 109859 - DNA, 25 bp, Mus musculus
accaccgcaggacaggcatgagtcg

SEQ ID NO: 109860 - DNA, 25 bp, Mus musculus
accaccgcaggagaggcatgagtcg

SEQ ID NO: 109861 - DNA, 25 bp, Mus musculus
accaccggatcactggctttctaag

SEQ ID NO: 109862 - DNA, 25 bp, Mus musculus
accaccggatcagtggctttctaag

SEQ ID NO: 109863 - DNA, 25 bp, Mus musculus
accaccggccagaggaagcagtgca

SEQ ID NO: 109864 - DNA, 25 bp, Mus musculus
accaccggccagtggaagcagtgca

SEQ ID NO: 109865 - DNA, 25 bp, Mus musculus
accaccggctagataggcaccatgt

SEQ ID NO: 109866 - DNA, 25 bp, Mus musculus
accaccggctagttaggcaccatgt

SEQ ID NO: 109867 - DNA, 25 bp, Mus musculus
accaccgggaccaactggaagcaga

SEQ ID NO: 109868 - DNA, 25 bp, Mus musculus
accaccgggacctactggaagcaga

SEQ ID NO: 109869 - DNA, 25 bp, Mus musculus
accaccggtattacctaacaacatg

SEQ ID NO: 109870 - DNA, 25 bp, Mus musculus
accaccggtatttcctaacaacatg

SEQ ID NO: 109871 - DNA, 25 bp, Mus musculus
accaccgtctggcagctttaggaaa

SEQ ID NO: 109872 - DNA, 25 bp, Mus musculus
accaccgtctgggagctttaggaaa

SEQ ID NO: 109873 - DNA, 25 bp, Mus musculus
accaccgtgagaccgactgtgacca

SEQ ID NO: 109874 - DNA, 25 bp, Mus musculus
accaccgtgagagcgactgtgacca

SEQ ID NO: 109875 - DNA, 25 bp, Mus musculus
accaccgtgaggaccatccagagca

SEQ ID NO: 109876 - DNA, 25 bp, Mus musculus
accaccgtgaggtccatccagagca

SEQ ID NO: 109877 - DNA, 25 bp, Mus musculus
accaccgtgccgagctaagttcaca

SEQ ID NO: 109878 - DNA, 25 bp, Mus musculus
accaccgtgccgtgctaagttcaca

SEQ ID NO: 109879 - DNA, 25 bp, Mus musculus
accacctaaaatatgtcatcttcct

SEQ ID NO: 109880 - DNA, 25 bp, Mus musculus
accacctaaaatttgtcatcttcct

SEQ ID NO: 109881 - DNA, 25 bp, Mus musculus
accacctacatcagggagcgagaag

SEQ ID NO: 109882 - DNA, 25 bp, Mus musculus
accacctacatctgggagcgagaag

SEQ ID NO: 109883 - DNA, 25 bp, Mus musculus
accacctactgtcactattcatgta

SEQ ID NO: 109884 - DNA, 25 bp, Mus musculus
accacctactgtctgttatttgctt

SEQ ID NO: 109885 - DNA, 25 bp, Mus musculus
accacctactgtgactattcatgta

SEQ ID NO: 109886 - DNA, 25 bp, Mus musculus
accacctactgtgtgttatttgctt

SEQ ID NO: 109887 - DNA, 25 bp, Mus musculus
accacctacttgctgtaacacgtat

SEQ ID NO: 109888 - DNA, 25 bp, Mus musculus
accacctacttggtgtaacacgtat

SEQ ID NO: 109889 - DNA, 25 bp, Mus musculus
accacctatattatctccgcttgat

SEQ ID NO: 109890 - DNA, 25 bp, Mus musculus
accacctatattttctccgcttgat

SEQ ID NO: 109891 - DNA, 25 bp, Mus musculus
accacctatctccatcaacagatga

SEQ ID NO: 109892 - DNA, 25 bp, Mus musculus
accacctatctcgatcaacagatga

SEQ ID NO: 109893 - DNA, 25 bp, Mus musculus
accacctatgtgattgttcccaagt

SEQ ID NO: 109894 - DNA, 25 bp, Mus musculus
accacctatgtgtttgttcccaagt

SEQ ID NO: 109895 - DNA, 25 bp, Mus musculus
accacctcaatcagtagcagaaaga

SEQ ID NO: 109896 - DNA, 25 bp, Mus musculus
accacctcaatctgtagcagaaaga

SEQ ID NO: 109897 - DNA, 25 bp, Mus musculus
accacctcaatgactgtccatggaa

SEQ ID NO: 109898 - DNA, 25 bp, Mus musculus
accacctcaatgtctgtccatggaa

SEQ ID NO: 109899 - DNA, 25 bp, Mus musculus
accacctcacaacctttttctgtgt

SEQ ID NO: 109900 - DNA, 25 bp, Mus musculus
accacctcacaagctttttctgtgt

SEQ ID NO: 109901 - DNA, 25 bp, Mus musculus
accacctcagtaagtcgatgacgtg

SEQ ID NO: 109902 - DNA, 25 bp, Mus musculus
accacctcagtactcacttggtaag

SEQ ID NO: 109903 - DNA, 25 bp, Mus musculus
accacctcagtagtcacttggtaag

SEQ ID NO: 109904 - DNA, 25 bp, Mus musculus
accacctcagtatgtcgatgacgtg

SEQ ID NO: 109905 - DNA, 25 bp, Mus musculus
accacctcagtgaaccaagcttgaa

SEQ ID NO: 109906 - DNA, 25 bp, Mus musculus
accacctcagtgtaccaagcttgaa

SEQ ID NO: 109907 - DNA, 25 bp, Mus musculus
accacctccaggctatttatagttg

SEQ ID NO: 109908 - DNA, 25 bp, Mus musculus
accacctccagggtatttatagttg

SEQ ID NO: 109909 - DNA, 25 bp, Mus musculus
accacctccgtgaatatttgtatgc

SEQ ID NO: 109910 - DNA, 25 bp, Mus musculus
accacctccgtgtatatttgtatgc

SEQ ID NO: 109911 - DNA, 25 bp, Mus musculus
accacctcctgcacatgggtttggg

SEQ ID NO: 109912 - DNA, 25 bp, Mus musculus
accacctcctgctcatgggtttggg

SEQ ID NO: 109913 - DNA, 25 bp, Mus musculus
accacctcggtaatagctctgcaaa

SEQ ID NO: 109914 - DNA, 25 bp, Mus musculus
accacctcggtattagctctgcaaa

SEQ ID NO: 109915 - DNA, 25 bp, Mus musculus
accacctctaataccaactcaaggg

SEQ ID NO: 109916 - DNA, 25 bp, Mus musculus
accacctctaattccaactcaaggg

SEQ ID NO: 109917 - DNA, 25 bp, Mus musculus
accacctctaccataagattcctgg

SEQ ID NO: 109918 - DNA, 25 bp, Mus musculus
accacctctaccttaagattcctgg

SEQ ID NO: 109919 - DNA, 25 bp, Mus musculus
accacctctgagatcctagtaaaag

SEQ ID NO: 109920 - DNA, 25 bp, Mus musculus
accacctctgagttcctagtaaaag

SEQ ID NO: 109921 - DNA, 25 bp, Mus musculus
accacctctgatccttcagaacatg

SEQ ID NO: 109922 - DNA, 25 bp, Mus musculus
accacctctgatgcttcagaacatg

SEQ ID NO: 109923 - DNA, 25 bp, Mus musculus
accacctcttccatatggcagaaag

SEQ ID NO: 109924 - DNA, 25 bp, Mus musculus
accacctcttccttatggcagaaag

SEQ ID NO: 109925 - DNA, 25 bp, Mus musculus
accacctgagagagggcgacacagt

SEQ ID NO: 109926 - DNA, 25 bp, Mus musculus
accacctgagagtgggcgacacagt

SEQ ID NO: 109927 - DNA, 25 bp, Mus musculus
accacctgaggtaaagaagtcacat

SEQ ID NO: 109928 - DNA, 25 bp, Mus musculus
accacctgaggttaagaagtcacat

SEQ ID NO: 109929 - DNA, 25 bp, Mus musculus
accacctgcagcagaagtccaagtt

SEQ ID NO: 109930 - DNA, 25 bp, Mus musculus
accacctgcagctgaagtccaagtt

SEQ ID NO: 109931 - DNA, 25 bp, Mus musculus
accacctgctatagcctgagccttt

SEQ ID NO: 109932 - DNA, 25 bp, Mus musculus
accacctgctattgcctgagccttt

SEQ ID NO: 109933 - DNA, 25 bp, Mus musculus
accacctgctcgaaatcgttctaag

SEQ ID NO: 109934 - DNA, 25 bp, Mus musculus
accacctgctcgtaatcgttctaag

SEQ ID NO: 109935 - DNA, 25 bp, Mus musculus
accacctgctgcatgattttcaatt

SEQ ID NO: 109936 - DNA, 25 bp, Mus musculus
accacctgctgcttgattttcaatt

SEQ ID NO: 109937 - DNA, 25 bp, Mus musculus
accacctgctgtaagagactcactg

SEQ ID NO: 109938 - DNA, 25 bp, Mus musculus
accacctgctgttagagactcactg

SEQ ID NO: 109939 - DNA, 25 bp, Mus musculus
accacctggacacagatgacaccaa

SEQ ID NO: 109940 - DNA, 25 bp, Mus musculus
accacctggacagagatgacaccaa

SEQ ID NO: 109941 - DNA, 25 bp, Mus musculus
accacctggagacattgtttccttg

SEQ ID NO: 109942 - DNA, 25 bp, Mus musculus
accacctggagagattgtttccttg

SEQ ID NO: 109943 - DNA, 25 bp, Mus musculus
accacctggtggcaccatggtgtat

SEQ ID NO: 109944 - DNA, 25 bp, Mus musculus
accacctggtgggaccatggtgtat

SEQ ID NO: 109945 - DNA, 25 bp, Mus musculus
accacctgtgggaccatgtttgact

SEQ ID NO: 109946 - DNA, 25 bp, Mus musculus
accacctgtgggtccatgtttgact

SEQ ID NO: 109947 - DNA, 25 bp, Mus musculus
accacctgtggtcttacggttgaag

SEQ ID NO: 109948 - DNA, 25 bp, Mus musculus
accacctgtggtgttacggttgaag

SEQ ID NO: 109949 - DNA, 25 bp, Mus musculus
accaccttatgacttctgtaactaa

SEQ ID NO: 109950 - DNA, 25 bp, Mus musculus
accaccttatgagttctgtaactaa

SEQ ID NO: 109951 - DNA, 25 bp, Mus musculus
accaccttatggaaactgggcacat

SEQ ID NO: 109952 - DNA, 25 bp, Mus musculus
accaccttatggtaactgggcacat

SEQ ID NO: 109953 - DNA, 25 bp, Mus musculus
accaccttattgctgagtattgtca

SEQ ID NO: 109954 - DNA, 25 bp, Mus musculus
accaccttattggtgagtattgtca

SEQ ID NO: 109955 - DNA, 25 bp, Mus musculus
accaccttcagacgtcaacctggga

SEQ ID NO: 109956 - DNA, 25 bp, Mus musculus
accaccttcagaggtcaacctggga

SEQ ID NO: 109957 - DNA, 25 bp, Mus musculus
accaccttctacagtgttgactaag

SEQ ID NO: 109958 - DNA, 25 bp, Mus musculus
accaccttctactgtgttgactaag

SEQ ID NO: 109959 - DNA, 25 bp, Mus musculus
accaccttctggaaggcttcctgtg

SEQ ID NO: 109960 - DNA, 25 bp, Mus musculus
accaccttctggtaggcttcctgtg

SEQ ID NO: 109961 - DNA, 25 bp, Mus musculus
accaccttctgtcaggcttgcttgg

SEQ ID NO: 109962 - DNA, 25 bp, Mus musculus
accaccttctgtgaggcttgcttgg

SEQ ID NO: 109963 - DNA, 25 bp, Mus musculus
accaccttgcctaacacatgaagag

SEQ ID NO: 109964 - DNA, 25 bp, Mus musculus
accaccttgccttacacatgaagag

SEQ ID NO: 109965 - DNA, 25 bp, Mus musculus
accacctttccaattggcctatgag

SEQ ID NO: 109966 - DNA, 25 bp, Mus musculus
accacctttccatttggcctatgag

SEQ ID NO: 109967 - DNA, 25 bp, Mus musculus
accacctttgtaccttgtttcggat

SEQ ID NO: 109968 - DNA, 25 bp, Mus musculus
accacctttgtagcttgtttcggat

SEQ ID NO: 109969 - DNA, 25 bp, Mus musculus
accacgacccacacaaatggaggat

SEQ ID NO: 109970 - DNA, 25 bp, Mus musculus
accacgacccactcaaatggaggat

SEQ ID NO: 109971 - DNA, 25 bp, Mus musculus
accacgacctgcagaagtgcaacat

SEQ ID NO: 109972 - DNA, 25 bp, Mus musculus
accacgacctgctgaagtgcaacat

SEQ ID NO: 109973 - DNA, 25 bp, Mus musculus
accacgagcgctcgcacagggtcca

SEQ ID NO: 109974 - DNA, 25 bp, Mus musculus
accacgagcgctggcacagggtcca

SEQ ID NO: 109975 - DNA, 25 bp, Mus musculus
accacgatgagaaggcgtttgaggt

SEQ ID NO: 109976 - DNA, 25 bp, Mus musculus
accacgatgagatggcgtttgaggt

SEQ ID NO: 109977 - DNA, 25 bp, Mus musculus
accacgatgcttccagaattgggac

SEQ ID NO: 109978 - DNA, 25 bp, Mus musculus
accacgatgcttgcagaattgggac

SEQ ID NO: 109979 - DNA, 25 bp, Mus musculus
accacgcatctgctgatcattgcct

SEQ ID NO: 109980 - DNA, 25 bp, Mus musculus
accacgcatctggtgatcattgcct

SEQ ID NO: 109981 - DNA, 25 bp, Mus musculus
accacgccactaactcttgtttagt

SEQ ID NO: 109982 - DNA, 25 bp, Mus musculus
accacgccactatctcttgtttagt

SEQ ID NO: 109983 - DNA, 25 bp, Mus musculus
accacgcccagcatggttcttttaa

SEQ ID NO: 109984 - DNA, 25 bp, Mus musculus
accacgcccagcttggttcttttaa

SEQ ID NO: 109985 - DNA, 25 bp, Mus musculus
accacgcccaggatgtcattttaga

SEQ ID NO: 109986 - DNA, 25 bp, Mus musculus
accacgcccaggttgtcattttaga

SEQ ID NO: 109987 - DNA, 25 bp, Mus musculus
accacgcccggcaggaatgctattt

SEQ ID NO: 109988 - DNA, 25 bp, Mus musculus
accacgcccggctggaatgctattt

SEQ ID NO: 109989 - DNA, 25 bp, Mus musculus
accacgccctctctttctgtgttca

SEQ ID NO: 109990 - DNA, 25 bp, Mus musculus
accacgccctctgtttctgtgttca

SEQ ID NO: 109991 - DNA, 25 bp, Mus musculus
accacgcctggccagaaatttctta

SEQ ID NO: 109992 - DNA, 25 bp, Mus musculus
accacgcctggcgagaaatttctta

SEQ ID NO: 109993 - DNA, 25 bp, Mus musculus
accacgcctgggatgaggagcccaa

SEQ ID NO: 109994 - DNA, 25 bp, Mus musculus
accacgcctgggttgaggagcccaa

SEQ ID NO: 109995 - DNA, 25 bp, Mus musculus
accacgcgatccattcggttatagg

SEQ ID NO: 109996 - DNA, 25 bp, Mus musculus
accacgcgatcctttcggttatagg

SEQ ID NO: 109997 - DNA, 25 bp, Mus musculus
accacgcgttcccaatgtgtagacg

SEQ ID NO: 109998 - DNA, 25 bp, Mus musculus
accacgcgttccgaatgtgtagacg

SEQ ID NO: 109999 - DNA, 25 bp, Mus musculus
accacgctatgaaatcaactccttg

SEQ ID NO: 110000 - DNA, 25 bp, Mus musculus
accacgctatgatatcaactccttg

SEQ ID NO: 110001 - DNA, 25 bp, Mus musculus
accacgctatgccatttgcttatat

SEQ ID NO: 110002 - DNA, 25 bp, Mus musculus
accacgctatgcgatttgcttatat

SEQ ID NO: 110003 - DNA, 25 bp, Mus musculus
accacgctcaacctagttcatgaat

SEQ ID NO: 110004 - DNA, 25 bp, Mus musculus
accacgctcaacgtagttcatgaat

SEQ ID NO: 110005 - DNA, 25 bp, Mus musculus
accacgctcatactctcaattctaa

SEQ ID NO: 110006 - DNA, 25 bp, Mus musculus
accacgctcatagtctcaattctaa

SEQ ID NO: 110007 - DNA, 25 bp, Mus musculus
accacgctgggcatgcaattccgtt

SEQ ID NO: 110008 - DNA, 25 bp, Mus musculus
accacgctgggcttgcaattccgtt

SEQ ID NO: 110009 - DNA, 25 bp, Mus musculus
accacggagatgagcagtgcctgga

SEQ ID NO: 110010 - DNA, 25 bp, Mus musculus
accacggagatgtgcagtgcctgga

SEQ ID NO: 110011 - DNA, 25 bp, Mus musculus
accacggagcccattctgccaaagt

SEQ ID NO: 110012 - DNA, 25 bp, Mus musculus
accacggagccctttctgccaaagt

SEQ ID NO: 110013 - DNA, 25 bp, Mus musculus
accacggaggagcagtacctgcact

SEQ ID NO: 110014 - DNA, 25 bp, Mus musculus
accacggaggaggagtacctgcact

SEQ ID NO: 110015 - DNA, 25 bp, Mus musculus
accacggagtgaagggactccctat

SEQ ID NO: 110016 - DNA, 25 bp, Mus musculus
accacggagtgatgggactccctat

SEQ ID NO: 110017 - DNA, 25 bp, Mus musculus
accacggatttacaggatgccagca

SEQ ID NO: 110018 - DNA, 25 bp, Mus musculus
accacggatttagaggatgccagca

SEQ ID NO: 110019 - DNA, 25 bp, Mus musculus
accacggctgtgaaactattcatag

SEQ ID NO: 110020 - DNA, 25 bp, Mus musculus
accacggctgtgctggacactgaag

SEQ ID NO: 110021 - DNA, 25 bp, Mus musculus
accacggctgtggtggacactgaag

SEQ ID NO: 110022 - DNA, 25 bp, Mus musculus
accacggctgtgtaactattcatag

SEQ ID NO: 110023 - DNA, 25 bp, Mus musculus
accacgggcgaccatttcgggatga

SEQ ID NO: 110024 - DNA, 25 bp, Mus musculus
accacgggcgacgatttcgggatga

SEQ ID NO: 110025 - DNA, 25 bp, Mus musculus
accacgggtgccatgtacgcctggt

SEQ ID NO: 110026 - DNA, 25 bp, Mus musculus
accacgggtgccttgtacgcctggt

SEQ ID NO: 110027 - DNA, 25 bp, Mus musculus
accacggtcacaacaatagtcaagt

SEQ ID NO: 110028 - DNA, 25 bp, Mus musculus
accacggtcacatcaatagtcaagt

SEQ ID NO: 110029 - DNA, 25 bp, Mus musculus
accacggtctcactgttggccatga

SEQ ID NO: 110030 - DNA, 25 bp, Mus musculus
accacggtctcagtgttggccatga

SEQ ID NO: 110031 - DNA, 25 bp, Mus musculus
accacgtatccaagttgtgcacata

SEQ ID NO: 110032 - DNA, 25 bp, Mus musculus
accacgtatccatgttgtgcacata

SEQ ID NO: 110033 - DNA, 25 bp, Mus musculus
accacgtcactcataacagctgtta

SEQ ID NO: 110034 - DNA, 25 bp, Mus musculus
accacgtcactcttaacagctgtta

SEQ ID NO: 110035 - DNA, 25 bp, Mus musculus
accacgtctggcatttatctcatat

SEQ ID NO: 110036 - DNA, 25 bp, Mus musculus
accacgtctggcttttatctcatat

SEQ ID NO: 110037 - DNA, 25 bp, Mus musculus
accacgtctttcatacgctgagatg

SEQ ID NO: 110038 - DNA, 25 bp, Mus musculus
accacgtctttcttacgctgagatg

SEQ ID NO: 110039 - DNA, 25 bp, Mus musculus
accacgtgaccaacaggctaaagga

SEQ ID NO: 110040 - DNA, 25 bp, Mus musculus
accacgtgaccatcaggctaaagga

SEQ ID NO: 110041 - DNA, 25 bp, Mus musculus
accacgtgcacgagtttttacctag

SEQ ID NO: 110042 - DNA, 25 bp, Mus musculus
accacgtgcacgtgtttttacctag

SEQ ID NO: 110043 - DNA, 25 bp, Mus musculus
accacgtggatgaaggctgatgaag

SEQ ID NO: 110044 - DNA, 25 bp, Mus musculus
accacgtggatgtaggctgatgaag

SEQ ID NO: 110045 - DNA, 25 bp, Mus musculus
accacgtggtctcgcaggatgagca

SEQ ID NO: 110046 - DNA, 25 bp, Mus musculus
accacgtggtctggcaggatgagca

SEQ ID NO: 110047 - DNA, 25 bp, Mus musculus
accacgtggtgcatgctcagatgga

SEQ ID NO: 110048 - DNA, 25 bp, Mus musculus
accacgtggtgcttgctcagatgga

SEQ ID NO: 110049 - DNA, 25 bp, Mus musculus
accacgtgtggcatgctatgttttt

SEQ ID NO: 110050 - DNA, 25 bp, Mus musculus
accacgtgtggcttgctatgttttt

SEQ ID NO: 110051 - DNA, 25 bp, Mus musculus
accacgtgtggtcttcctggatttc

SEQ ID NO: 110052 - DNA, 25 bp, Mus musculus
accacgtgtggtgttcctggatttc

SEQ ID NO: 110053 - DNA, 25 bp, Mus musculus
accacgtgttcccaagactgagcgt

SEQ ID NO: 110054 - DNA, 25 bp, Mus musculus
accacgtgttccgaagactgagcgt

SEQ ID NO: 110055 - DNA, 25 bp, Mus musculus
accacgtgtttgaaatttgatcaag

SEQ ID NO: 110056 - DNA, 25 bp, Mus musculus
accacgtgtttgtaatttgatcaag

SEQ ID NO: 110057 - DNA, 25 bp, Mus musculus
accacgttcatgcagtgctcaagaa

SEQ ID NO: 110058 - DNA, 25 bp, Mus musculus
accacgttcatggagtgctcaagaa

SEQ ID NO: 110059 - DNA, 25 bp, Mus musculus
accacgttggagcaggatagctcag

SEQ ID NO: 110060 - DNA, 25 bp, Mus musculus
accacgttggaggaggatagctcag

SEQ ID NO: 110061 - DNA, 25 bp, Mus musculus
accacgttgtgtctctcagctgcaa

SEQ ID NO: 110062 - DNA, 25 bp, Mus musculus
accacgttgtgtgtctcagctgcaa

SEQ ID NO: 110063 - DNA, 25 bp, Mus musculus
accacgtttacacggtaggcacagt

SEQ ID NO: 110064 - DNA, 25 bp, Mus musculus
accacgtttacagggtaggcacagt

SEQ ID NO: 110065 - DNA, 25 bp, Mus musculus
accactaaccacacagattcatttc

SEQ ID NO: 110066 - DNA, 25 bp, Mus musculus
accactaaccactcagattcatttc

SEQ ID NO: 110067 - DNA, 25 bp, Mus musculus
accactaagcttcccaagtgtgctg

SEQ ID NO: 110068 - DNA, 25 bp, Mus musculus
accactaagcttgccaagtgtgctg

SEQ ID NO: 110069 - DNA, 25 bp, Mus musculus
accactaatgagacatggccgttta

SEQ ID NO: 110070 - DNA, 25 bp, Mus musculus
accactaatgagtcatggccgttta

SEQ ID NO: 110071 - DNA, 25 bp, Mus musculus
accactaatggcaggcctttctgtg

SEQ ID NO: 110072 - DNA, 25 bp, Mus musculus
accactaatggctggcctttctgtg

SEQ ID NO: 110073 - DNA, 25 bp, Mus musculus
accactaatggtattgctctgtaag

SEQ ID NO: 110074 - DNA, 25 bp, Mus musculus
accactaatggtccttttctgctct

SEQ ID NO: 110075 - DNA, 25 bp, Mus musculus
accactaatggtgcttttctgctct

SEQ ID NO: 110076 - DNA, 25 bp, Mus musculus
accactaatggttttgctctgtaag

SEQ ID NO: 110077 - DNA, 25 bp, Mus musculus
accactacatcacgcctcaagaagg

SEQ ID NO: 110078 - DNA, 25 bp, Mus musculus
accactacatcaggcctcaagaagg

SEQ ID NO: 110079 - DNA, 25 bp, Mus musculus
accactacatcccattctgttttgt

SEQ ID NO: 110080 - DNA, 25 bp, Mus musculus
accactacatccgattctgttttgt

SEQ ID NO: 110081 - DNA, 25 bp, Mus musculus
accactagaggtagcaattcgtttt

SEQ ID NO: 110082 - DNA, 25 bp, Mus musculus
accactagaggttgcaattcgtttt

SEQ ID NO: 110083 - DNA, 25 bp, Mus musculus
accactatcaagagaaaaacatttt

SEQ ID NO: 110084 - DNA, 25 bp, Mus musculus
accactatcaagtgaaaaacatttt

SEQ ID NO: 110085 - DNA, 25 bp, Mus musculus
accactatccagctgcttttagctt

SEQ ID NO: 110086 - DNA, 25 bp, Mus musculus
accactatccaggtgcttttagctt

SEQ ID NO: 110087 - DNA, 25 bp, Mus musculus
accactatgattcttgttctgtttc

SEQ ID NO: 110088 - DNA, 25 bp, Mus musculus
accactatgattgttgttctgtttc

SEQ ID NO: 110089 - DNA, 25 bp, Mus musculus
accactatggctcggaggtggccca

SEQ ID NO: 110090 - DNA, 25 bp, Mus musculus
accactatggctgggaggtggccca

SEQ ID NO: 110091 - DNA, 25 bp, Mus musculus
accactatgtggagagattgcttta

SEQ ID NO: 110092 - DNA, 25 bp, Mus musculus
accactatgtggtgagattgcttta

SEQ ID NO: 110093 - DNA, 25 bp, Mus musculus
accactattcacatatcagagacag

SEQ ID NO: 110094 - DNA, 25 bp, Mus musculus
accactattcacttatcagagacag

SEQ ID NO: 110095 - DNA, 25 bp, Mus musculus
accactattctcatcatcgttatag

SEQ ID NO: 110096 - DNA, 25 bp, Mus musculus
accactattctcttcatcgttatag

SEQ ID NO: 110097 - DNA, 25 bp, Mus musculus
accactattcttatgatatttgcat

SEQ ID NO: 110098 - DNA, 25 bp, Mus musculus
accactattcttttgatatttgcat

SEQ ID NO: 110099 - DNA, 25 bp, Mus musculus
accactatttttctcatcttgagga

SEQ ID NO: 110100 - DNA, 25 bp, Mus musculus
accactatttttgtcatcttgagga

SEQ ID NO: 110101 - DNA, 25 bp, Mus musculus
accactcacctgacaagaagggctt

SEQ ID NO: 110102 - DNA, 25 bp, Mus musculus
accactcacctgtcaagaagggctt

SEQ ID NO: 110103 - DNA, 25 bp, Mus musculus
accactcacggtcattggttcctga

SEQ ID NO: 110104 - DNA, 25 bp, Mus musculus
accactcacggtgattggttcctga

SEQ ID NO: 110105 - DNA, 25 bp, Mus musculus
accactcactgcacacgggtgtgtg

SEQ ID NO: 110106 - DNA, 25 bp, Mus musculus
accactcactgctcacgggtgtgtg

SEQ ID NO: 110107 - DNA, 25 bp, Mus musculus
accactcaggtgacagtatttctcc

SEQ ID NO: 110108 - DNA, 25 bp, Mus musculus
accactcaggtgtcagtatttctcc

SEQ ID NO: 110109 - DNA, 25 bp, Mus musculus
accactcagtctagtgcagtgctgg

SEQ ID NO: 110110 - DNA, 25 bp, Mus musculus
accactcagtcttgtgcagtgctgg

SEQ ID NO: 110111 - DNA, 25 bp, Mus musculus
accactcagtttccatcagttcatg

SEQ ID NO: 110112 - DNA, 25 bp, Mus musculus
accactcagtttgcatcagttcatg

SEQ ID NO: 110113 - DNA, 25 bp, Mus musculus
accactcatgcacaacggcaagctg

SEQ ID NO: 110114 - DNA, 25 bp, Mus musculus
accactcatgcagaacggcaagctg

SEQ ID NO: 110115 - DNA, 25 bp, Mus musculus
accactccaagcagttgataaccct

SEQ ID NO: 110116 - DNA, 25 bp, Mus musculus
accactccaagctgttgataaccct

SEQ ID NO: 110117 - DNA, 25 bp, Mus musculus
accactccgtctacgtgaaatcatg

SEQ ID NO: 110118 - DNA, 25 bp, Mus musculus
accactccgtcttcgtgaaatcatg

SEQ ID NO: 110119 - DNA, 25 bp, Mus musculus
accactcctaaacctagtcctgatt

SEQ ID NO: 110120 - DNA, 25 bp, Mus musculus
accactcctaaagctagtcctgatt

SEQ ID NO: 110121 - DNA, 25 bp, Mus musculus
accactcctgaaagttggccttggg

SEQ ID NO: 110122 - DNA, 25 bp, Mus musculus
accactcctgaatgttggccttggg

SEQ ID NO: 110123 - DNA, 25 bp, Mus musculus
accactcctggcatggattaattct

SEQ ID NO: 110124 - DNA, 25 bp, Mus musculus
accactcctggcttggattaattct

SEQ ID NO: 110125 - DNA, 25 bp, Mus musculus
accactcctggtcaagacagacaga

SEQ ID NO: 110126 - DNA, 25 bp, Mus musculus
accactcctggtgaagacagacaga

SEQ ID NO: 110127 - DNA, 25 bp, Mus musculus
accactcctgtgatcagagtttcct

SEQ ID NO: 110128 - DNA, 25 bp, Mus musculus
accactcctgtgttcagagtttcct

SEQ ID NO: 110129 - DNA, 25 bp, Mus musculus
accactccttcaagatcgtttacag

SEQ ID NO: 110130 - DNA, 25 bp, Mus musculus
accactccttcatgatcgtttacag

SEQ ID NO: 110131 - DNA, 25 bp, Mus musculus
accactcggcagctggagtctttga

SEQ ID NO: 110132 - DNA, 25 bp, Mus musculus
accactcggcaggtggagtctttga

SEQ ID NO: 110133 - DNA, 25 bp, Mus musculus
accactctaagaactactggcccat

SEQ ID NO: 110134 - DNA, 25 bp, Mus musculus
accactctaagatctactggcccat

SEQ ID NO: 110135 - DNA, 25 bp, Mus musculus
accactctatttacagcttcctttg

SEQ ID NO: 110136 - DNA, 25 bp, Mus musculus
accactctattttcagcttcctttg

SEQ ID NO: 110137 - DNA, 25 bp, Mus musculus
accactctctcgcatctgtaggaaa

SEQ ID NO: 110138 - DNA, 25 bp, Mus musculus
accactctctcggatctgtaggaaa

SEQ ID NO: 110139 - DNA, 25 bp, Mus musculus
accactcttacacacgcagttttgt

SEQ ID NO: 110140 - DNA, 25 bp, Mus musculus
accactcttacagacgcagttttgt

SEQ ID NO: 110141 - DNA, 25 bp, Mus musculus
accactcttattccatgctgtcata

SEQ ID NO: 110142 - DNA, 25 bp, Mus musculus
accactcttattgcatgctgtcata

SEQ ID NO: 110143 - DNA, 25 bp, Mus musculus
accactcttcttagggttgtgttca

SEQ ID NO: 110144 - DNA, 25 bp, Mus musculus
accactcttcttcacatgctgaaag

SEQ ID NO: 110145 - DNA, 25 bp, Mus musculus
accactcttcttgacatgctgaaag

SEQ ID NO: 110146 - DNA, 25 bp, Mus musculus
accactcttctttgggttgtgttca

SEQ ID NO: 110147 - DNA, 25 bp, Mus musculus
accactcttgccacacaacaagtga

SEQ ID NO: 110148 - DNA, 25 bp, Mus musculus
accactcttgcctcacaacaagtga

SEQ ID NO: 110149 - DNA, 25 bp, Mus musculus
accactgaacttaaccttggcgatt

SEQ ID NO: 110150 - DNA, 25 bp, Mus musculus
accactgaactttaccttggcgatt

SEQ ID NO: 110151 - DNA, 25 bp, Mus musculus
accactgaagagaccttaaaagaat

SEQ ID NO: 110152 - DNA, 25 bp, Mus musculus
accactgaagagtccttaaaagaat

SEQ ID NO: 110153 - DNA, 25 bp, Mus musculus
accactgaaggtacttaagctggag

SEQ ID NO: 110154 - DNA, 25 bp, Mus musculus
accactgaaggttcttaagctggag

SEQ ID NO: 110155 - DNA, 25 bp, Mus musculus
accactgacaggagccaaggactta

SEQ ID NO: 110156 - DNA, 25 bp, Mus musculus
accactgacaggtgccaaggactta

SEQ ID NO: 110157 - DNA, 25 bp, Mus musculus
accactgactctatggtacttcagg

SEQ ID NO: 110158 - DNA, 25 bp, Mus musculus
accactgactctttggtacttcagg

SEQ ID NO: 110159 - DNA, 25 bp, Mus musculus
accactgagaggacgtggaggcccc

SEQ ID NO: 110160 - DNA, 25 bp, Mus musculus
accactgagaggtcgtggaggcccc

SEQ ID NO: 110161 - DNA, 25 bp, Mus musculus
accactgagcagctgctagcccgaa

SEQ ID NO: 110162 - DNA, 25 bp, Mus musculus
accactgagcaggtgctagcccgaa

SEQ ID NO: 110163 - DNA, 25 bp, Mus musculus
accactgagctcagctagctttctg

SEQ ID NO: 110164 - DNA, 25 bp, Mus musculus
accactgagctctgctagctttctg

SEQ ID NO: 110165 - DNA, 25 bp, Mus musculus
accactgagtgacctgttaggattc

SEQ ID NO: 110166 - DNA, 25 bp, Mus musculus
accactgagtgagctgttaggattc

SEQ ID NO: 110167 - DNA, 25 bp, Mus musculus
accactgatctacaagaatccataa

SEQ ID NO: 110168 - DNA, 25 bp, Mus musculus
accactgatctagaagaatccataa

SEQ ID NO: 110169 - DNA, 25 bp, Mus musculus
accactgatgtacttctgtaagcaa

SEQ ID NO: 110170 - DNA, 25 bp, Mus musculus
accactgatgtagttctgtaagcaa

SEQ ID NO: 110171 - DNA, 25 bp, Mus musculus
accactgatgttatagctgatggtg

SEQ ID NO: 110172 - DNA, 25 bp, Mus musculus
accactgatgttttagctgatggtg

SEQ ID NO: 110173 - DNA, 25 bp, Mus musculus
accactgattggaatgttcaacaaa

SEQ ID NO: 110174 - DNA, 25 bp, Mus musculus
accactgattggtatgttcaacaaa

SEQ ID NO: 110175 - DNA, 25 bp, Mus musculus
accactgattgtagactgctctgag

SEQ ID NO: 110176 - DNA, 25 bp, Mus musculus
accactgattgttgactgctctgag

SEQ ID NO: 110177 - DNA, 25 bp, Mus musculus
accactgcagatcaatgtagctcgg

SEQ ID NO: 110178 - DNA, 25 bp, Mus musculus
accactgcagatgaatgtagctcgg

SEQ ID NO: 110179 - DNA, 25 bp, Mus musculus
accactgcatctcctaggcgaaaca

SEQ ID NO: 110180 - DNA, 25 bp, Mus musculus
accactgcatctgctaggcgaaaca

SEQ ID NO: 110181 - DNA, 25 bp, Mus musculus
accactgcatttcctagaactgctg

SEQ ID NO: 110182 - DNA, 25 bp, Mus musculus
accactgcatttgctagaactgctg

SEQ ID NO: 110183 - DNA, 25 bp, Mus musculus
accactgccatgaggatgactggat

SEQ ID NO: 110184 - DNA, 25 bp, Mus musculus
accactgccatgtggatgactggat

SEQ ID NO: 110185 - DNA, 25 bp, Mus musculus
accactgccgtgagagctggagagc

SEQ ID NO: 110186 - DNA, 25 bp, Mus musculus
accactgccgtgtgagctggagagc

SEQ ID NO: 110187 - DNA, 25 bp, Mus musculus
accactgcctgactgcagctttttt

SEQ ID NO: 110188 - DNA, 25 bp, Mus musculus
accactgcctgagtgcagctttttt

SEQ ID NO: 110189 - DNA, 25 bp, Mus musculus
accactgcgcacatgggtgtcagag

SEQ ID NO: 110190 - DNA, 25 bp, Mus musculus
accactgcgcacttgggtgtcagag

SEQ ID NO: 110191 - DNA, 25 bp, Mus musculus
accactgcggacatcatgatgacct

SEQ ID NO: 110192 - DNA, 25 bp, Mus musculus
accactgcggacttcatgatgacct

SEQ ID NO: 110193 - DNA, 25 bp, Mus musculus
accactgcgtatctatggcctttca

SEQ ID NO: 110194 - DNA, 25 bp, Mus musculus
accactgcgtatgtatggcctttca

SEQ ID NO: 110195 - DNA, 25 bp, Mus musculus
accactgctccacttacgaagattg

SEQ ID NO: 110196 - DNA, 25 bp, Mus musculus
accactgctccagttacgaagattg

SEQ ID NO: 110197 - DNA, 25 bp, Mus musculus
accactgctgcaactctttgagaag

SEQ ID NO: 110198 - DNA, 25 bp, Mus musculus
accactgctgcatctctttgagaag

SEQ ID NO: 110199 - DNA, 25 bp, Mus musculus
accactgcttctattgaaaatagtc

SEQ ID NO: 110200 - DNA, 25 bp, Mus musculus
accactgcttcttttgaaaatagtc

SEQ ID NO: 110201 - DNA, 25 bp, Mus musculus
accactggacaacgcctgtgcagag

SEQ ID NO: 110202 - DNA, 25 bp, Mus musculus
accactggacaaggcctgtgcagag

SEQ ID NO: 110203 - DNA, 25 bp, Mus musculus
accactggagacatgtagcattcat

SEQ ID NO: 110204 - DNA, 25 bp, Mus musculus
accactggagacttgtagcattcat

SEQ ID NO: 110205 - DNA, 25 bp, Mus musculus
accactggagtcacttcacacaatt

SEQ ID NO: 110206 - DNA, 25 bp, Mus musculus
accactggagtctcttcacacaatt

SEQ ID NO: 110207 - DNA, 25 bp, Mus musculus
accactggcgcaaccagggctgcag

SEQ ID NO: 110208 - DNA, 25 bp, Mus musculus
accactggcgcatccagggctgcag

SEQ ID NO: 110209 - DNA, 25 bp, Mus musculus
accactgggaaactacgtagcttag

SEQ ID NO: 110210 - DNA, 25 bp, Mus musculus
accactgggaaagtacgtagcttag

SEQ ID NO: 110211 - DNA, 25 bp, Mus musculus
accactgggtgcatgaccagggcat

SEQ ID NO: 110212 - DNA, 25 bp, Mus musculus
accactgggtgcttgaccagggcat

SEQ ID NO: 110213 - DNA, 25 bp, Mus musculus
accactggtcagagcctcgtatgaa

SEQ ID NO: 110214 - DNA, 25 bp, Mus musculus
accactggtcagtgcctcgtatgaa

SEQ ID NO: 110215 - DNA, 25 bp, Mus musculus
accactggtctcctgacaatgtctt

SEQ ID NO: 110216 - DNA, 25 bp, Mus musculus
accactggtctcgtgacaatgtctt

SEQ ID NO: 110217 - DNA, 25 bp, Mus musculus
accactggtgaccttggccacctgg

SEQ ID NO: 110218 - DNA, 25 bp, Mus musculus
accactggtgacgttggccacctgg

SEQ ID NO: 110219 - DNA, 25 bp, Mus musculus
accactggttgactttccatctgat

SEQ ID NO: 110220 - DNA, 25 bp, Mus musculus
accactggttgagtttccatctgat

SEQ ID NO: 110221 - DNA, 25 bp, Mus musculus
accactgtacagactggggaccagc

SEQ ID NO: 110222 - DNA, 25 bp, Mus musculus
accactgtacagtctggggaccagc

SEQ ID NO: 110223 - DNA, 25 bp, Mus musculus
accactgtcaccatgtgtgtttgat

SEQ ID NO: 110224 - DNA, 25 bp, Mus musculus
accactgtcaccttgtgtgtttgat

SEQ ID NO: 110225 - DNA, 25 bp, Mus musculus
accactgtcactatgcataagtaca

SEQ ID NO: 110226 - DNA, 25 bp, Mus musculus
accactgtcactttgcataagtaca

SEQ ID NO: 110227 - DNA, 25 bp, Mus musculus
accactgtcatcacaggattagcag

SEQ ID NO: 110228 - DNA, 25 bp, Mus musculus
accactgtcatctcaggattagcag

SEQ ID NO: 110229 - DNA, 25 bp, Mus musculus
accactgtcccgagtgtggcaaggc

SEQ ID NO: 110230 - DNA, 25 bp, Mus musculus
accactgtcccgtgtgtggcaaggc

SEQ ID NO: 110231 - DNA, 25 bp, Mus musculus
accactgtcctcactgcagtataat

SEQ ID NO: 110232 - DNA, 25 bp, Mus musculus
accactgtcctctctgcagtataat

SEQ ID NO: 110233 - DNA, 25 bp, Mus musculus
accactgtctagaacacagggtgtt

SEQ ID NO: 110234 - DNA, 25 bp, Mus musculus
accactgtctagtacacagggtgtt

SEQ ID NO: 110235 - DNA, 25 bp, Mus musculus
accactgtctctcggtttttgtatc

SEQ ID NO: 110236 - DNA, 25 bp, Mus musculus
accactgtctctgggtttttgtatc

SEQ ID NO: 110237 - DNA, 25 bp, Mus musculus
accactgtctgaccattctagtttg

SEQ ID NO: 110238 - DNA, 25 bp, Mus musculus
accactgtctgagcattctagtttg

SEQ ID NO: 110239 - DNA, 25 bp, Mus musculus
accactgtgactccattgaaggatg

SEQ ID NO: 110240 - DNA, 25 bp, Mus musculus
accactgtgactgcattgaaggatg

SEQ ID NO: 110241 - DNA, 25 bp, Mus musculus
accactgtgcgaaccacggagatta

SEQ ID NO: 110242 - DNA, 25 bp, Mus musculus
accactgtgcgatccacggagatta

SEQ ID NO: 110243 - DNA, 25 bp, Mus musculus
accactgtgctgaaggccaagcgat

SEQ ID NO: 110244 - DNA, 25 bp, Mus musculus
accactgtgctgtaggccaagcgat

SEQ ID NO: 110245 - DNA, 25 bp, Mus musculus
accactgtgtaccatctggtgtatt

SEQ ID NO: 110246 - DNA, 25 bp, Mus musculus
accactgtgtacgatctggtgtatt

SEQ ID NO: 110247 - DNA, 25 bp, Mus musculus
accactgtgtttagcatgctcagaa

SEQ ID NO: 110248 - DNA, 25 bp, Mus musculus
accactgtgttttgcatgctcagaa

SEQ ID NO: 110249 - DNA, 25 bp, Mus musculus
accactgttcccatgaggattaaca

SEQ ID NO: 110250 - DNA, 25 bp, Mus musculus
accactgttcccttgaggattaaca

SEQ ID NO: 110251 - DNA, 25 bp, Mus musculus
accactgttcggagcttgaagctac

SEQ ID NO: 110252 - DNA, 25 bp, Mus musculus
accactgttcggtgcttgaagctac

SEQ ID NO: 110253 - DNA, 25 bp, Mus musculus
accactgttgaaataatccgttcgg

SEQ ID NO: 110254 - DNA, 25 bp, Mus musculus
accactgttgaattaatccgttcgg

SEQ ID NO: 110255 - DNA, 25 bp, Mus musculus
accactgttgacaatctcgaacctg

SEQ ID NO: 110256 - DNA, 25 bp, Mus musculus
accactgttgactatctcgaacctg

SEQ ID NO: 110257 - DNA, 25 bp, Mus musculus
accactgttgctcgcttatgaagac

SEQ ID NO: 110258 - DNA, 25 bp, Mus musculus
accactgttgctggcttatgaagac

SEQ ID NO: 110259 - DNA, 25 bp, Mus musculus
accacttaagccaaaatgactcatt

SEQ ID NO: 110260 - DNA, 25 bp, Mus musculus
accacttaagcctaaatgactcatt

SEQ ID NO: 110261 - DNA, 25 bp, Mus musculus
accacttacttcaaaatgtcttcag

SEQ ID NO: 110262 - DNA, 25 bp, Mus musculus
accacttacttctaaatgtcttcag

SEQ ID NO: 110263 - DNA, 25 bp, Mus musculus
accacttacttgaagcaagcccttg

SEQ ID NO: 110264 - DNA, 25 bp, Mus musculus
accacttacttgtagcaagcccttg

SEQ ID NO: 110265 - DNA, 25 bp, Mus musculus
accacttatctcattcttcttgcag

SEQ ID NO: 110266 - DNA, 25 bp, Mus musculus
accacttatctctttcttcttgcag

SEQ ID NO: 110267 - DNA, 25 bp, Mus musculus
accacttcagcccagtgttcacagg

SEQ ID NO: 110268 - DNA, 25 bp, Mus musculus
accacttcagccgagtgttcacagg

SEQ ID NO: 110269 - DNA, 25 bp, Mus musculus
accacttcatgtatagaccagcgac

SEQ ID NO: 110270 - DNA, 25 bp, Mus musculus
accacttcatgtttagaccagcgac

SEQ ID NO: 110271 - DNA, 25 bp, Mus musculus
accacttccagcagatttcctgtga

SEQ ID NO: 110272 - DNA, 25 bp, Mus musculus
accacttccagctgatttcctgtga

SEQ ID NO: 110273 - DNA, 25 bp, Mus musculus
accacttccaggaaaaatctctcca

SEQ ID NO: 110274 - DNA, 25 bp, Mus musculus
accacttccaggtaaaatctctcca

SEQ ID NO: 110275 - DNA, 25 bp, Mus musculus
accacttccatactttctgtagaga

SEQ ID NO: 110276 - DNA, 25 bp, Mus musculus
accacttccatagtttctgtagaga

SEQ ID NO: 110277 - DNA, 25 bp, Mus musculus
accacttcccacattcagataatga

SEQ ID NO: 110278 - DNA, 25 bp, Mus musculus
accacttcccactttcagataatga

SEQ ID NO: 110279 - DNA, 25 bp, Mus musculus
accacttcctaaatgtttcacaact

SEQ ID NO: 110280 - DNA, 25 bp, Mus musculus
accacttcctaattgtttcacaact

SEQ ID NO: 110281 - DNA, 25 bp, Mus musculus
accacttcctgaatgtttctgactt

SEQ ID NO: 110282 - DNA, 25 bp, Mus musculus
accacttcctgattgtttctgactt

SEQ ID NO: 110283 - DNA, 25 bp, Mus musculus
accacttctcacattttgcacaatt

SEQ ID NO: 110284 - DNA, 25 bp, Mus musculus
accacttctcactttttgcacaatt

SEQ ID NO: 110285 - DNA, 25 bp, Mus musculus
accacttcttcaatcccagaggatg

SEQ ID NO: 110286 - DNA, 25 bp, Mus musculus
accacttcttcattcccagaggatg

SEQ ID NO: 110287 - DNA, 25 bp, Mus musculus
accacttcttctatgataagcccaa

SEQ ID NO: 110288 - DNA, 25 bp, Mus musculus
accacttcttctttgataagcccaa

SEQ ID NO: 110289 - DNA, 25 bp, Mus musculus
accacttcttttcctcggctataca

SEQ ID NO: 110290 - DNA, 25 bp, Mus musculus
accacttcttttgctcggctataca

SEQ ID NO: 110291 - DNA, 25 bp, Mus musculus
accacttgacttcatcaatatttga

SEQ ID NO: 110292 - DNA, 25 bp, Mus musculus
accacttgacttgatcaatatttga

SEQ ID NO: 110293 - DNA, 25 bp, Mus musculus
accacttgagatcattagcatgcca

SEQ ID NO: 110294 - DNA, 25 bp, Mus musculus
accacttgagatgattagcatgcca

SEQ ID NO: 110295 - DNA, 25 bp, Mus musculus
accacttgatgcctacagtttaaca

SEQ ID NO: 110296 - DNA, 25 bp, Mus musculus
accacttgatgcgtacagtttaaca

SEQ ID NO: 110297 - DNA, 25 bp, Mus musculus
accacttgcatcatgtgttcctcct

SEQ ID NO: 110298 - DNA, 25 bp, Mus musculus
accacttgcatcttgtgttcctcct

SEQ ID NO: 110299 - DNA, 25 bp, Mus musculus
accacttggtggcttgaaattatgt

SEQ ID NO: 110300 - DNA, 25 bp, Mus musculus
accacttggtgggttgaaattatgt

SEQ ID NO: 110301 - DNA, 25 bp, Mus musculus
accactttacctacaaggagcacaa

SEQ ID NO: 110302 - DNA, 25 bp, Mus musculus
accactttaccttcaaggagcacaa

SEQ ID NO: 110303 - DNA, 25 bp, Mus musculus
accactttatcccatcagctgaaaa

SEQ ID NO: 110304 - DNA, 25 bp, Mus musculus
accactttatccgatcagctgaaaa

SEQ ID NO: 110305 - DNA, 25 bp, Mus musculus
accactttcaagctctcacataaat

SEQ ID NO: 110306 - DNA, 25 bp, Mus musculus
accactttcaaggtctcacataaat

SEQ ID NO: 110307 - DNA, 25 bp, Mus musculus
accactttcggtactcttctgattg

SEQ ID NO: 110308 - DNA, 25 bp, Mus musculus
accactttcggttctcttctgattg

SEQ ID NO: 110309 - DNA, 25 bp, Mus musculus
accactttctagagtccttgtgcaa

SEQ ID NO: 110310 - DNA, 25 bp, Mus musculus
accactttctagtgtccttgtgcaa

SEQ ID NO: 110311 - DNA, 25 bp, Mus musculus
accactttctggcaactgactggca

SEQ ID NO: 110312 - DNA, 25 bp, Mus musculus
accactttctgggaactgactggca

SEQ ID NO: 110313 - DNA, 25 bp, Mus musculus
accactttggatacatctgccgaga

SEQ ID NO: 110314 - DNA, 25 bp, Mus musculus
accactttggattcatctgccgaga

SEQ ID NO: 110315 - DNA, 25 bp, Mus musculus
accactttgtgactgttcctagcta

SEQ ID NO: 110316 - DNA, 25 bp, Mus musculus
accactttgtgagtgttcctagcta

SEQ ID NO: 110317 - DNA, 25 bp, Mus musculus
accacttttccaactgttaccagat

SEQ ID NO: 110318 - DNA, 25 bp, Mus musculus
accacttttccatctgttaccagat

SEQ ID NO: 110319 - DNA, 25 bp, Mus musculus
accacttttgcaagctgttttgttt

SEQ ID NO: 110320 - DNA, 25 bp, Mus musculus
accacttttgcatgctgttttgttt

SEQ ID NO: 110321 - DNA, 25 bp, Mus musculus
accacttttgctattagccaggcac

SEQ ID NO: 110322 - DNA, 25 bp, Mus musculus
accacttttgcttttagccaggcac

SEQ ID NO: 110323 - DNA, 25 bp, Mus musculus
accactttttgaagaggaccctgct

SEQ ID NO: 110324 - DNA, 25 bp, Mus musculus
accactttttgatgaggaccctgct

SEQ ID NO: 110325 - DNA, 25 bp, Mus musculus
accagaaatcctaccgataagccca

SEQ ID NO: 110326 - DNA, 25 bp, Mus musculus
accagaaatccttccgataagccca

SEQ ID NO: 110327 - DNA, 25 bp, Mus musculus
accagaaatttccacgagtccacca

SEQ ID NO: 110328 - DNA, 25 bp, Mus musculus
accagaaatttcgacgagtccacca

SEQ ID NO: 110329 - DNA, 25 bp, Mus musculus
accagaacatgtcctcaggcttgta

SEQ ID NO: 110330 - DNA, 25 bp, Mus musculus
accagaacatgtgctcaggcttgta

SEQ ID NO: 110331 - DNA, 25 bp, Mus musculus
accagaaccagcaagaagtccagag

SEQ ID NO: 110332 - DNA, 25 bp, Mus musculus
accagaaccagctagaagtccagag

SEQ ID NO: 110333 - DNA, 25 bp, Mus musculus
accagaaccagtagcctgggagtct

SEQ ID NO: 110334 - DNA, 25 bp, Mus musculus
accagaaccagttgcctgggagtct

SEQ ID NO: 110335 - DNA, 25 bp, Mus musculus
accagaacctatactcctatgtgag

SEQ ID NO: 110336 - DNA, 25 bp, Mus musculus
accagaacctattctcctatgtgag

SEQ ID NO: 110337 - DNA, 25 bp, Mus musculus
accagaacctggagcggtggctaca

SEQ ID NO: 110338 - DNA, 25 bp, Mus musculus
accagaacctggtgcggtggctaca

SEQ ID NO: 110339 - DNA, 25 bp, Mus musculus
accagaacggttatgatagcactca

SEQ ID NO: 110340 - DNA, 25 bp, Mus musculus
accagaacggttttgatagcactca

SEQ ID NO: 110341 - DNA, 25 bp, Mus musculus
accagaacgtcacggcggccggtat

SEQ ID NO: 110342 - DNA, 25 bp, Mus musculus
accagaacgtcagggcggccggtat

SEQ ID NO: 110343 - DNA, 25 bp, Mus musculus
accagaactaccacatactcttcaa

SEQ ID NO: 110344 - DNA, 25 bp, Mus musculus
accagaactacctcatactcttcaa

SEQ ID NO: 110345 - DNA, 25 bp, Mus musculus
accagaacttcgactgtgtcactat

SEQ ID NO: 110346 - DNA, 25 bp, Mus musculus
accagaacttcgtctgtgtcactat

SEQ ID NO: 110347 - DNA, 25 bp, Mus musculus
accagaacttctccttaatcctttc

SEQ ID NO: 110348 - DNA, 25 bp, Mus musculus
accagaacttctgcttaatcctttc

SEQ ID NO: 110349 - DNA, 25 bp, Mus musculus
accagaactttcattgtcactgtct

SEQ ID NO: 110350 - DNA, 25 bp, Mus musculus
accagaactttctttgtcactgtct

SEQ ID NO: 110351 - DNA, 25 bp, Mus musculus
accagaagactccttatgtcccctt

SEQ ID NO: 110352 - DNA, 25 bp, Mus musculus
accagaagactcgttatgtcccctt

SEQ ID NO: 110353 - DNA, 25 bp, Mus musculus
accagaagatgtcacaccttgtttc

SEQ ID NO: 110354 - DNA, 25 bp, Mus musculus
accagaagatgtgacaccttgtttc

SEQ ID NO: 110355 - DNA, 25 bp, Mus musculus
accagaagcatcaaactattatgta

SEQ ID NO: 110356 - DNA, 25 bp, Mus musculus
accagaagcatctaactattatgta

SEQ ID NO: 110357 - DNA, 25 bp, Mus musculus
accagaagccaacctcatgtcagca

SEQ ID NO: 110358 - DNA, 25 bp, Mus musculus
accagaagccaagctcatgtcagca

SEQ ID NO: 110359 - DNA, 25 bp, Mus musculus
accagaagcgacagccggtagtggt

SEQ ID NO: 110360 - DNA, 25 bp, Mus musculus
accagaagcgactgccggtagtggt

SEQ ID NO: 110361 - DNA, 25 bp, Mus musculus
accagaagctatatgacctgaataa

SEQ ID NO: 110362 - DNA, 25 bp, Mus musculus
accagaagctatttgacctgaataa

SEQ ID NO: 110363 - DNA, 25 bp, Mus musculus
accagaagctgtccagaagcagatc

SEQ ID NO: 110364 - DNA, 25 bp, Mus musculus
accagaagctgtgcagaagcagatc

SEQ ID NO: 110365 - DNA, 25 bp, Mus musculus
accagaaggactccacggcctgcag

SEQ ID NO: 110366 - DNA, 25 bp, Mus musculus
accagaaggactgcacggcctgcag

SEQ ID NO: 110367 - DNA, 25 bp, Mus musculus
accagaaggagtaccaccgggagct

SEQ ID NO: 110368 - DNA, 25 bp, Mus musculus
accagaaggagttccaccgggagct

SEQ ID NO: 110369 - DNA, 25 bp, Mus musculus
accagaagtattaggcagccagccc

SEQ ID NO: 110370 - DNA, 25 bp, Mus musculus
accagaagtatttggcagccagccc

SEQ ID NO: 110371 - DNA, 25 bp, Mus musculus
accagaagtcgaccgagctgctgat

SEQ ID NO: 110372 - DNA, 25 bp, Mus musculus
accagaagtcgagcgagctgctgat

SEQ ID NO: 110373 - DNA, 25 bp, Mus musculus
accagaagttctcttgccctgacat

SEQ ID NO: 110374 - DNA, 25 bp, Mus musculus
accagaagttctgttgccctgacat

SEQ ID NO: 110375 - DNA, 25 bp, Mus musculus
accagaatactacaacctgcatctc

SEQ ID NO: 110376 - DNA, 25 bp, Mus musculus
accagaatactagaacctgcatctc

SEQ ID NO: 110377 - DNA, 25 bp, Mus musculus
accagaatcaggactattgcgcgcc

SEQ ID NO: 110378 - DNA, 25 bp, Mus musculus
accagaatcaggtctattgcgcgcc

SEQ ID NO: 110379 - DNA, 25 bp, Mus musculus
accagaatcagtcttaatttcatat

SEQ ID NO: 110380 - DNA, 25 bp, Mus musculus
accagaatcagtgttaatttcatat

SEQ ID NO: 110381 - DNA, 25 bp, Mus musculus
accagaatctctccatatgtgccct

SEQ ID NO: 110382 - DNA, 25 bp, Mus musculus
accagaatctctgcatatgtgccct

SEQ ID NO: 110383 - DNA, 25 bp, Mus musculus
accagaatcttactgaactcttgga

SEQ ID NO: 110384 - DNA, 25 bp, Mus musculus
accagaatcttagtgaactcttgga

SEQ ID NO: 110385 - DNA, 25 bp, Mus musculus
accagaatgtacactggagcctggt

SEQ ID NO: 110386 - DNA, 25 bp, Mus musculus
accagaatgtactctggagcctggt

SEQ ID NO: 110387 - DNA, 25 bp, Mus musculus
accagaattctcagccggtgagatt

SEQ ID NO: 110388 - DNA, 25 bp, Mus musculus
accagaattctctgccggtgagatt

SEQ ID NO: 110389 - DNA, 25 bp, Mus musculus
accagaattgcccactaaactccat

SEQ ID NO: 110390 - DNA, 25 bp, Mus musculus
accagaattgccgactaaactccat

SEQ ID NO: 110391 - DNA, 25 bp, Mus musculus
accagacaacatcggaagaccttct

SEQ ID NO: 110392 - DNA, 25 bp, Mus musculus
accagacaacatgggaagaccttct

SEQ ID NO: 110393 - DNA, 25 bp, Mus musculus
accagacaacctcttgaggcgtata

SEQ ID NO: 110394 - DNA, 25 bp, Mus musculus
accagacaacctgttgaggcgtata

SEQ ID NO: 110395 - DNA, 25 bp, Mus musculus
accagacaccgtagaggactcgcgt

SEQ ID NO: 110396 - DNA, 25 bp, Mus musculus
accagacaccgttgaggactcgcgt

SEQ ID NO: 110397 - DNA, 25 bp, Mus musculus
accagacacgcaaggctgctttaat

SEQ ID NO: 110398 - DNA, 25 bp, Mus musculus
accagacacgcatggctgctttaat

SEQ ID NO: 110399 - DNA, 25 bp, Mus musculus
accagacactaacgaagcttgcgca

SEQ ID NO: 110400 - DNA, 25 bp, Mus musculus
accagacactaaggaagcttgcgca

SEQ ID NO: 110401 - DNA, 25 bp, Mus musculus
accagacactatcgtcagatcccat

SEQ ID NO: 110402 - DNA, 25 bp, Mus musculus
accagacactatggtcagatcccat

SEQ ID NO: 110403 - DNA, 25 bp, Mus musculus
accagacatactcataggccaacct

SEQ ID NO: 110404 - DNA, 25 bp, Mus musculus
accagacatactgataggccaacct

SEQ ID NO: 110405 - DNA, 25 bp, Mus musculus
accagacatagacggacgtgcttat

SEQ ID NO: 110406 - DNA, 25 bp, Mus musculus
accagacatagagggacgtgcttat

SEQ ID NO: 110407 - DNA, 25 bp, Mus musculus
accagacataggatctgacttcaaa

SEQ ID NO: 110408 - DNA, 25 bp, Mus musculus
accagacataggttctgacttcaaa

SEQ ID NO: 110409 - DNA, 25 bp, Mus musculus
accagacatctgaagactcagtact

SEQ ID NO: 110410 - DNA, 25 bp, Mus musculus
accagacatctgtagactcagtact

SEQ ID NO: 110411 - DNA, 25 bp, Mus musculus
accagacatggacggatatgccttt

SEQ ID NO: 110412 - DNA, 25 bp, Mus musculus
accagacatggagggatatgccttt

SEQ ID NO: 110413 - DNA, 25 bp, Mus musculus
accagacattagcattcacaacagt

SEQ ID NO: 110414 - DNA, 25 bp, Mus musculus
accagacattaggattcacaacagt

SEQ ID NO: 110415 - DNA, 25 bp, Mus musculus
accagacattcaatgccagttcggg

SEQ ID NO: 110416 - DNA, 25 bp, Mus musculus
accagacattcattgccagttcggg

SEQ ID NO: 110417 - DNA, 25 bp, Mus musculus
accagaccacctcttaaggattttg

SEQ ID NO: 110418 - DNA, 25 bp, Mus musculus
accagaccacctgttaaggattttg

SEQ ID NO: 110419 - DNA, 25 bp, Mus musculus
accagaccactgaggagagcctgct

SEQ ID NO: 110420 - DNA, 25 bp, Mus musculus
accagaccactgtggagagcctgct

SEQ ID NO: 110421 - DNA, 25 bp, Mus musculus
accagaccattccgcttcaaggcag

SEQ ID NO: 110422 - DNA, 25 bp, Mus musculus
accagaccattcggcttcaaggcag

SEQ ID NO: 110423 - DNA, 25 bp, Mus musculus
accagaccctctacttgtttgccaa

SEQ ID NO: 110424 - DNA, 25 bp, Mus musculus
accagaccctcttcttgtttgccaa

SEQ ID NO: 110425 - DNA, 25 bp, Mus musculus
accagaccctgtcttcgaattataa

SEQ ID NO: 110426 - DNA, 25 bp, Mus musculus
accagaccctgtgttcgaattataa

SEQ ID NO: 110427 - DNA, 25 bp, Mus musculus
accagaccctttcactccagagtag

SEQ ID NO: 110428 - DNA, 25 bp, Mus musculus
accagaccctttgactccagagtag

SEQ ID NO: 110429 - DNA, 25 bp, Mus musculus
accagaccgagtcactgaattctcc

SEQ ID NO: 110430 - DNA, 25 bp, Mus musculus
accagaccgagtgactgaattctcc

SEQ ID NO: 110431 - DNA, 25 bp, Mus musculus
accagacctcctctattcatttctt

SEQ ID NO: 110432 - DNA, 25 bp, Mus musculus
accagacctcctgtattcatttctt

SEQ ID NO: 110433 - DNA, 25 bp, Mus musculus
accagacctgtgaacacgtggatgg

SEQ ID NO: 110434 - DNA, 25 bp, Mus musculus
accagacctgtgtacacgtggatgg

SEQ ID NO: 110435 - DNA, 25 bp, Mus musculus
accagaccttccattgtattcatcc

SEQ ID NO: 110436 - DNA, 25 bp, Mus musculus
accagaccttcccatcagggaagag

SEQ ID NO: 110437 - DNA, 25 bp, Mus musculus
accagaccttccgatcagggaagag

SEQ ID NO: 110438 - DNA, 25 bp, Mus musculus
accagaccttcctttgtattcatcc

SEQ ID NO: 110439 - DNA, 25 bp, Mus musculus
accagacgcaggcatatggctgtgt

SEQ ID NO: 110440 - DNA, 25 bp, Mus musculus
accagacgcagggatatggctgtgt

SEQ ID NO: 110441 - DNA, 25 bp, Mus musculus
accagactagagctccctgaggagg

SEQ ID NO: 110442 - DNA, 25 bp, Mus musculus
accagactagaggtccctgaggagg

SEQ ID NO: 110443 - DNA, 25 bp, Mus musculus
accagactagtcattcttctcacca

SEQ ID NO: 110444 - DNA, 25 bp, Mus musculus
accagactagtctttcttctcacca

SEQ ID NO: 110445 - DNA, 25 bp, Mus musculus
accagactattaattaacattccag

SEQ ID NO: 110446 - DNA, 25 bp, Mus musculus
accagactattatttaacattccag

SEQ ID NO: 110447 - DNA, 25 bp, Mus musculus
accagactcactacaaactcataga

SEQ ID NO: 110448 - DNA, 25 bp, Mus musculus
accagactcacttcaaactcataga

SEQ ID NO: 110449 - DNA, 25 bp, Mus musculus
accagactcgtcatacgtggcggct

SEQ ID NO: 110450 - DNA, 25 bp, Mus musculus
accagactcgtcttacgtggcggct

SEQ ID NO: 110451 - DNA, 25 bp, Mus musculus
accagactctctacatccaaagatg

SEQ ID NO: 110452 - DNA, 25 bp, Mus musculus
accagactctcttcatccaaagatg

SEQ ID NO: 110453 - DNA, 25 bp, Mus musculus
accagactgattctgaggcacaaat

SEQ ID NO: 110454 - DNA, 25 bp, Mus musculus
accagactgattgtgaggcacaaat

SEQ ID NO: 110455 - DNA, 25 bp, Mus musculus
accagactgttgctggtgagttcaa

SEQ ID NO: 110456 - DNA, 25 bp, Mus musculus
accagactgttggtggtgagttcaa

SEQ ID NO: 110457 - DNA, 25 bp, Mus musculus
accagacttcaaataaaacagtgct

SEQ ID NO: 110458 - DNA, 25 bp, Mus musculus
accagacttcaattaaaacagtgct

SEQ ID NO: 110459 - DNA, 25 bp, Mus musculus
accagacttcctatattgctatatt

SEQ ID NO: 110460 - DNA, 25 bp, Mus musculus
accagacttcctttattgctatatt

SEQ ID NO: 110461 - DNA, 25 bp, Mus musculus
accagacttgtaatgctttcccctc

SEQ ID NO: 110462 - DNA, 25 bp, Mus musculus
accagacttgtattgctttcccctc

SEQ ID NO: 110463 - DNA, 25 bp, Mus musculus
accagagaatagcaggtcatttcac

SEQ ID NO: 110464 - DNA, 25 bp, Mus musculus
accagagaataggaggtcatttcac

SEQ ID NO: 110465 - DNA, 25 bp, Mus musculus
accagagaatttagaccacagtgca

SEQ ID NO: 110466 - DNA, 25 bp, Mus musculus
accagagaattttgaccacagtgca

SEQ ID NO: 110467 - DNA, 25 bp, Mus musculus
accagagactcaccactttcaggca

SEQ ID NO: 110468 - DNA, 25 bp, Mus musculus
accagagactcagcactttcaggca

SEQ ID NO: 110469 - DNA, 25 bp, Mus musculus
accagagactgaaagggcggagcca

SEQ ID NO: 110470 - DNA, 25 bp, Mus musculus
accagagactgatagggcggagcca

SEQ ID NO: 110471 - DNA, 25 bp, Mus musculus
accagagaggagctggccttccatg

SEQ ID NO: 110472 - DNA, 25 bp, Mus musculus
accagagaggaggtggccttccatg

SEQ ID NO: 110473 - DNA, 25 bp, Mus musculus
accagagagtcgattctatttgcaa

SEQ ID NO: 110474 - DNA, 25 bp, Mus musculus
accagagagtcgtttctatttgcaa

SEQ ID NO: 110475 - DNA, 25 bp, Mus musculus
accagagatgtgagtcgtcacagct

SEQ ID NO: 110476 - DNA, 25 bp, Mus musculus
accagagatgtgtgtcgtcacagct

SEQ ID NO: 110477 - DNA, 25 bp, Mus musculus
accagagcacggagacttctgccta

SEQ ID NO: 110478 - DNA, 25 bp, Mus musculus
accagagcacggtgacttctgccta

SEQ ID NO: 110479 - DNA, 25 bp, Mus musculus
accagagcatggagactcggacaca

SEQ ID NO: 110480 - DNA, 25 bp, Mus musculus
accagagcatggtgactcggacaca

SEQ ID NO: 110481 - DNA, 25 bp, Mus musculus
accagagccatgcagaatgtgctaa

SEQ ID NO: 110482 - DNA, 25 bp, Mus musculus
accagagccatggagaatgtgctaa

SEQ ID NO: 110483 - DNA, 25 bp, Mus musculus
accagagcctctctcagctagaaga

SEQ ID NO: 110484 - DNA, 25 bp, Mus musculus
accagagcctctgtcagctagaaga

SEQ ID NO: 110485 - DNA, 25 bp, Mus musculus
accagagcggccagcagatggagca

SEQ ID NO: 110486 - DNA, 25 bp, Mus musculus
accagagcggcctgcagatggagca

SEQ ID NO: 110487 - DNA, 25 bp, Mus musculus
accagagctctgagcatagatgagc

SEQ ID NO: 110488 - DNA, 25 bp, Mus musculus
accagagctctgtgcatagatgagc

SEQ ID NO: 110489 - DNA, 25 bp, Mus musculus
accagagctttcaccatcagggtta

SEQ ID NO: 110490 - DNA, 25 bp, Mus musculus
accagagctttctccatcagggtta

SEQ ID NO: 110491 - DNA, 25 bp, Mus musculus
accagaggaagaccgccctggagtt

SEQ ID NO: 110492 - DNA, 25 bp, Mus musculus
accagaggaagagcgccctggagtt

SEQ ID NO: 110493 - DNA, 25 bp, Mus musculus
accagaggactgacggcatgtacat

SEQ ID NO: 110494 - DNA, 25 bp, Mus musculus
accagaggactgtcggcatgtacat

SEQ ID NO: 110495 - DNA, 25 bp, Mus musculus
accagaggacttactcagtggccat

SEQ ID NO: 110496 - DNA, 25 bp, Mus musculus
accagaggactttctcagtggccat

SEQ ID NO: 110497 - DNA, 25 bp, Mus musculus
accagaggcaaaagtgacccgtcac

SEQ ID NO: 110498 - DNA, 25 bp, Mus musculus
accagaggcaaatgtgacccgtcac

SEQ ID NO: 110499 - DNA, 25 bp, Mus musculus
accagaggctggctacgtggctact

SEQ ID NO: 110500 - DNA, 25 bp, Mus musculus
accagaggctgggtacgtggctact

SEQ ID NO: 110501 - DNA, 25 bp, Mus musculus
accagaggcttcaaaggcgagtctt

SEQ ID NO: 110502 - DNA, 25 bp, Mus musculus
accagaggcttctaaggcgagtctt

SEQ ID NO: 110503 - DNA, 25 bp, Mus musculus
accagagggacgaggcgccgctcac

SEQ ID NO: 110504 - DNA, 25 bp, Mus musculus
accagagggacgtggcgccgctcac

SEQ ID NO: 110505 - DNA, 25 bp, Mus musculus
accagagggtatacggaggcccagc

SEQ ID NO: 110506 - DNA, 25 bp, Mus musculus
accagagggtattcggaggcccagc

SEQ ID NO: 110507 - DNA, 25 bp, Mus musculus
accagagggtgcactaccacgagta

SEQ ID NO: 110508 - DNA, 25 bp, Mus musculus
accagagggtgctctaccacgagta

SEQ ID NO: 110509 - DNA, 25 bp, Mus musculus
accagaggtgccagctatcgcgtat

SEQ ID NO: 110510 - DNA, 25 bp, Mus musculus
accagaggtgcctgctatcgcgtat

SEQ ID NO: 110511 - DNA, 25 bp, Mus musculus
accagaggtgtcagatactagagct

SEQ ID NO: 110512 - DNA, 25 bp, Mus musculus
accagaggtgtctgatactagagct

SEQ ID NO: 110513 - DNA, 25 bp, Mus musculus
accagagtatgaaatagcttccggg

SEQ ID NO: 110514 - DNA, 25 bp, Mus musculus
accagagtatgatatagcttccggg

SEQ ID NO: 110515 - DNA, 25 bp, Mus musculus
accagagtcagacacctggattcaa

SEQ ID NO: 110516 - DNA, 25 bp, Mus musculus
accagagtcagagacctggattcaa

SEQ ID NO: 110517 - DNA, 25 bp, Mus musculus
accagagtcctgcagggaaatatct

SEQ ID NO: 110518 - DNA, 25 bp, Mus musculus
accagagtcctggagggaaatatct

SEQ ID NO: 110519 - DNA, 25 bp, Mus musculus
accagagtcgggatagttctctctg

SEQ ID NO: 110520 - DNA, 25 bp, Mus musculus
accagagtcgggttagttctctctg

SEQ ID NO: 110521 - DNA, 25 bp, Mus musculus
accagagtctgtcgatgccgttaca

SEQ ID NO: 110522 - DNA, 25 bp, Mus musculus
accagagtctgtggatgccgttaca

SEQ ID NO: 110523 - DNA, 25 bp, Mus musculus
accagagtgcccagacagtcatggt

SEQ ID NO: 110524 - DNA, 25 bp, Mus musculus
accagagtgccctgacagtcatggt

SEQ ID NO: 110525 - DNA, 25 bp, Mus musculus
accagagttatcacagcagcactga

SEQ ID NO: 110526 - DNA, 25 bp, Mus musculus
accagagttatctcagcagcactga

SEQ ID NO: 110527 - DNA, 25 bp, Mus musculus
accagagttctgaggcactgaggca

SEQ ID NO: 110528 - DNA, 25 bp, Mus musculus
accagagttctgtggcactgaggca

SEQ ID NO: 110529 - DNA, 25 bp, Mus musculus
accagagttgatactcttcttccgc

SEQ ID NO: 110530 - DNA, 25 bp, Mus musculus
accagagttgattctcttcttccgc

SEQ ID NO: 110531 - DNA, 25 bp, Mus musculus
accagagttgcacggttgggcctta

SEQ ID NO: 110532 - DNA, 25 bp, Mus musculus
accagagttgcagggttgggcctta

SEQ ID NO: 110533 - DNA, 25 bp, Mus musculus
accagagtttccatcttcctctgct

SEQ ID NO: 110534 - DNA, 25 bp, Mus musculus
accagagtttccttcttcctctgct

SEQ ID NO: 110535 - DNA, 25 bp, Mus musculus
accagatacggtcgtaggagaccat

SEQ ID NO: 110536 - DNA, 25 bp, Mus musculus
accagatacggtggtaggagaccat

SEQ ID NO: 110537 - DNA, 25 bp, Mus musculus
accagatatttcctactacagctta

SEQ ID NO: 110538 - DNA, 25 bp, Mus musculus
accagatatttcgtactacagctta

SEQ ID NO: 110539 - DNA, 25 bp, Mus musculus
accagatcagatctcgtgcctcagt

SEQ ID NO: 110540 - DNA, 25 bp, Mus musculus
accagatcagatgtcgtgcctcagt

SEQ ID NO: 110541 - DNA, 25 bp, Mus musculus
accagatcagctctgcatccttcat

SEQ ID NO: 110542 - DNA, 25 bp, Mus musculus
accagatcagctgtgcatccttcat

SEQ ID NO: 110543 - DNA, 25 bp, Mus musculus
accagatcaggaatgggaatcgcat

SEQ ID NO: 110544 - DNA, 25 bp, Mus musculus
accagatcaggattgggaatcgcat

SEQ ID NO: 110545 - DNA, 25 bp, Mus musculus
accagatccactacagggcccaagt

SEQ ID NO: 110546 - DNA, 25 bp, Mus musculus
accagatccacttcagggcccaagt

SEQ ID NO: 110547 - DNA, 25 bp, Mus musculus
accagatcctggacccatgggtgta

SEQ ID NO: 110548 - DNA, 25 bp, Mus musculus
accagatcctggtcccatgggtgta

SEQ ID NO: 110549 - DNA, 25 bp, Mus musculus
accagatctcagctagcttactaca

SEQ ID NO: 110550 - DNA, 25 bp, Mus musculus
accagatctcaggtagcttactaca

SEQ ID NO: 110551 - DNA, 25 bp, Mus musculus
accagatctccaccagggctttctt

SEQ ID NO: 110552 - DNA, 25 bp, Mus musculus
accagatctccagcagggctttctt

SEQ ID NO: 110553 - DNA, 25 bp, Mus musculus
accagatctgagatcgtgcttaagc

SEQ ID NO: 110554 - DNA, 25 bp, Mus musculus
accagatctgagttcgtgcttaagc

SEQ ID NO: 110555 - DNA, 25 bp, Mus musculus
accagatctgtaaagtaagaccctg

SEQ ID NO: 110556 - DNA, 25 bp, Mus musculus
accagatctgtatagtaagaccctg

SEQ ID NO: 110557 - DNA, 25 bp, Mus musculus
accagatctgtgataaggcttttgc

SEQ ID NO: 110558 - DNA, 25 bp, Mus musculus
accagatctgtgttaaggcttttgc

SEQ ID NO: 110559 - DNA, 25 bp, Mus musculus
accagatgagacaccctttcccggt

SEQ ID NO: 110560 - DNA, 25 bp, Mus musculus
accagatgagactccctttcccggt

SEQ ID NO: 110561 - DNA, 25 bp, Mus musculus
accagatgccttccaggacgaactc

SEQ ID NO: 110562 - DNA, 25 bp, Mus musculus
accagatgccttgcaggacgaactc

SEQ ID NO: 110563 - DNA, 25 bp, Mus musculus
accagatgctgtcccatcaacctgg

SEQ ID NO: 110564 - DNA, 25 bp, Mus musculus
accagatgctgtgccatcaacctgg

SEQ ID NO: 110565 - DNA, 25 bp, Mus musculus
accagatgggttctcgaggcactgt

SEQ ID NO: 110566 - DNA, 25 bp, Mus musculus
accagatgggttgtcgaggcactgt

SEQ ID NO: 110567 - DNA, 25 bp, Mus musculus
accagatggttacacgtctctctta

SEQ ID NO: 110568 - DNA, 25 bp, Mus musculus
accagatggttagacgtctctctta

SEQ ID NO: 110569 - DNA, 25 bp, Mus musculus
accagatgtttcagatttgagaaga

SEQ ID NO: 110570 - DNA, 25 bp, Mus musculus
accagatgtttctgatttgagaaga

SEQ ID NO: 110571 - DNA, 25 bp, Mus musculus
accagattcaatatccaatacctag

SEQ ID NO: 110572 - DNA, 25 bp, Mus musculus
accagattcaatttccaatacctag

SEQ ID NO: 110573 - DNA, 25 bp, Mus musculus
accagattcagcaacctatcttcaa

SEQ ID NO: 110574 - DNA, 25 bp, Mus musculus
accagattcagctacctatcttcaa

SEQ ID NO: 110575 - DNA, 25 bp, Mus musculus
accagattcaggagtttgcgctgtg

SEQ ID NO: 110576 - DNA, 25 bp, Mus musculus
accagattcaggtgtttgcgctgtg

SEQ ID NO: 110577 - DNA, 25 bp, Mus musculus
accagattggttctccgcagaggca

SEQ ID NO: 110578 - DNA, 25 bp, Mus musculus
accagattggttgtccgcagaggca

SEQ ID NO: 110579 - DNA, 25 bp, Mus musculus
accagatttcatagttggagatcca

SEQ ID NO: 110580 - DNA, 25 bp, Mus musculus
accagatttcatcacagtcacaaag

SEQ ID NO: 110581 - DNA, 25 bp, Mus musculus
accagatttcatgacagtcacaaag

SEQ ID NO: 110582 - DNA, 25 bp, Mus musculus
accagatttcattgttggagatcca

SEQ ID NO: 110583 - DNA, 25 bp, Mus musculus
accagatttgacagcctttgctaaa

SEQ ID NO: 110584 - DNA, 25 bp, Mus musculus
accagatttgactgcctttgctaaa

SEQ ID NO: 110585 - DNA, 25 bp, Mus musculus
accagatttgtactaacatgcgttg

SEQ ID NO: 110586 - DNA, 25 bp, Mus musculus
accagatttgtagtaacatgcgttg

SEQ ID NO: 110587 - DNA, 25 bp, Mus musculus
accagcaaaagccaggttttataat

SEQ ID NO: 110588 - DNA, 25 bp, Mus musculus
accagcaaaagcgaggttttataat

SEQ ID NO: 110589 - DNA, 25 bp, Mus musculus
accagcaaagtaacgggccatcctc

SEQ ID NO: 110590 - DNA, 25 bp, Mus musculus
accagcaaagtatcgggccatcctc

SEQ ID NO: 110591 - DNA, 25 bp, Mus musculus
accagcaaatgaacacctgttttaa

SEQ ID NO: 110592 - DNA, 25 bp, Mus musculus
accagcaaatgatcacctgttttaa

SEQ ID NO: 110593 - DNA, 25 bp, Mus musculus
accagcaaattgactcatcatgtaa

SEQ ID NO: 110594 - DNA, 25 bp, Mus musculus
accagcaaattgtctcatcatgtaa

SEQ ID NO: 110595 - DNA, 25 bp, Mus musculus
accagcaacctgagaaagtgtttta

SEQ ID NO: 110596 - DNA, 25 bp, Mus musculus
accagcaacctgtgaaagtgtttta

SEQ ID NO: 110597 - DNA, 25 bp, Mus musculus
accagcaactcaatgacctgaaaac

SEQ ID NO: 110598 - DNA, 25 bp, Mus musculus
accagcaactcattgacctgaaaac

SEQ ID NO: 110599 - DNA, 25 bp, Mus musculus
accagcaagcacatcaaagtcaggt

SEQ ID NO: 110600 - DNA, 25 bp, Mus musculus
accagcaagcacttcaaagtcaggt

SEQ ID NO: 110601 - DNA, 25 bp, Mus musculus
accagcaagctgagttaggtcacga

SEQ ID NO: 110602 - DNA, 25 bp, Mus musculus
accagcaagctgtgttaggtcacga

SEQ ID NO: 110603 - DNA, 25 bp, Mus musculus
accagcaagtggagaatttaagagg

SEQ ID NO: 110604 - DNA, 25 bp, Mus musculus
accagcaagtggtgaatttaagagg

SEQ ID NO: 110605 - DNA, 25 bp, Mus musculus
accagcaatcctatttgtctcctaa

SEQ ID NO: 110606 - DNA, 25 bp, Mus musculus
accagcaatcctttttgtctcctaa

SEQ ID NO: 110607 - DNA, 25 bp, Mus musculus
accagcaatgctaccagtgacttaa

SEQ ID NO: 110608 - DNA, 25 bp, Mus musculus
accagcaatgcttccagtgacttaa

SEQ ID NO: 110609 - DNA, 25 bp, Mus musculus
accagcacacttagccgggccttga

SEQ ID NO: 110610 - DNA, 25 bp, Mus musculus
accagcacactttgccgggccttga

SEQ ID NO: 110611 - DNA, 25 bp, Mus musculus
accagcacatatagcatcccaggat

SEQ ID NO: 110612 - DNA, 25 bp, Mus musculus
accagcacatattgcatcccaggat

SEQ ID NO: 110613 - DNA, 25 bp, Mus musculus
accagcaccaacctttgccttcaga

SEQ ID NO: 110614 - DNA, 25 bp, Mus musculus
accagcaccaacgtttgccttcaga

SEQ ID NO: 110615 - DNA, 25 bp, Mus musculus
accagcacgggaaacatgaaatcct

SEQ ID NO: 110616 - DNA, 25 bp, Mus musculus
accagcacgggatacatgaaatcct

SEQ ID NO: 110617 - DNA, 25 bp, Mus musculus
accagcactggacagttgcttatca

SEQ ID NO: 110618 - DNA, 25 bp, Mus musculus
accagcactggagagttgcttatca

SEQ ID NO: 110619 - DNA, 25 bp, Mus musculus
accagcacttaacgcctaggacaca

SEQ ID NO: 110620 - DNA, 25 bp, Mus musculus
accagcacttaaggcctaggacaca

SEQ ID NO: 110621 - DNA, 25 bp, Mus musculus
accagcacttggcacagggcccact

SEQ ID NO: 110622 - DNA, 25 bp, Mus musculus
accagcacttgggacagggcccact

SEQ ID NO: 110623 - DNA, 25 bp, Mus musculus
accagcagaactctgccaaggaact

SEQ ID NO: 110624 - DNA, 25 bp, Mus musculus
accagcagaactgtgccaaggaact

SEQ ID NO: 110625 - DNA, 25 bp, Mus musculus
accagcagattactcctgtgggtgt

SEQ ID NO: 110626 - DNA, 25 bp, Mus musculus
accagcagattagtcctgtgggtgt

SEQ ID NO: 110627 - DNA, 25 bp, Mus musculus
accagcagcaagagctccaatcttg

SEQ ID NO: 110628 - DNA, 25 bp, Mus musculus
accagcagcaagtgctccaatcttg

SEQ ID NO: 110629 - DNA, 25 bp, Mus musculus
accagcagcagcctagagagaacac

SEQ ID NO: 110630 - DNA, 25 bp, Mus musculus
accagcagcagcgtagagagaacac

SEQ ID NO: 110631 - DNA, 25 bp, Mus musculus
accagcagcaggagtcccaaagaag

SEQ ID NO: 110632 - DNA, 25 bp, Mus musculus
accagcagcaggctcgagaagcaga

SEQ ID NO: 110633 - DNA, 25 bp, Mus musculus
accagcagcagggtcgagaagcaga

SEQ ID NO: 110634 - DNA, 25 bp, Mus musculus
accagcagcaggtgtcccaaagaag

SEQ ID NO: 110635 - DNA, 25 bp, Mus musculus
accagcagcctacgtgactgtcagt

SEQ ID NO: 110636 - DNA, 25 bp, Mus musculus
accagcagcctaggtgactgtcagt

SEQ ID NO: 110637 - DNA, 25 bp, Mus musculus
accagcagctggcaaaactagcgaa

SEQ ID NO: 110638 - DNA, 25 bp, Mus musculus
accagcagctgggaaaactagcgaa

SEQ ID NO: 110639 - DNA, 25 bp, Mus musculus
accagcaggcacacatgttcagtaa

SEQ ID NO: 110640 - DNA, 25 bp, Mus musculus
accagcaggcactcatgttcagtaa

SEQ ID NO: 110641 - DNA, 25 bp, Mus musculus
accagcagggttcaggctgtactct

SEQ ID NO: 110642 - DNA, 25 bp, Mus musculus
accagcagggttgaggctgtactct

SEQ ID NO: 110643 - DNA, 25 bp, Mus musculus
accagcaggtgaatggacagaggac

SEQ ID NO: 110644 - DNA, 25 bp, Mus musculus
accagcaggtgattggacagaggac

SEQ ID NO: 110645 - DNA, 25 bp, Mus musculus
accagcaggtgtatcttgcaaacta

SEQ ID NO: 110646 - DNA, 25 bp, Mus musculus
accagcaggtgtttcttgcaaacta

SEQ ID NO: 110647 - DNA, 25 bp, Mus musculus
accagcagtcatcggtgtctttcta

SEQ ID NO: 110648 - DNA, 25 bp, Mus musculus
accagcagtcatgggtgtctttcta

SEQ ID NO: 110649 - DNA, 25 bp, Mus musculus
accagcagtgctagagttatccagt

SEQ ID NO: 110650 - DNA, 25 bp, Mus musculus
accagcagtgcttgagttatccagt

SEQ ID NO: 110651 - DNA, 25 bp, Mus musculus
accagcatatagattgcccatggga

SEQ ID NO: 110652 - DNA, 25 bp, Mus musculus
accagcatatagtttgcccatggga

SEQ ID NO: 110653 - DNA, 25 bp, Mus musculus
accagcatcactagtaaagggagcc

SEQ ID NO: 110654 - DNA, 25 bp, Mus musculus
accagcatcacttgtaaagggagcc

SEQ ID NO: 110655 - DNA, 25 bp, Mus musculus
accagcatcatcaattactaatcta

SEQ ID NO: 110656 - DNA, 25 bp, Mus musculus
accagcatcatctattactaatcta

SEQ ID NO: 110657 - DNA, 25 bp, Mus musculus
accagcatctcaatggattttggat

SEQ ID NO: 110658 - DNA, 25 bp, Mus musculus
accagcatctcattggattttggat

SEQ ID NO: 110659 - DNA, 25 bp, Mus musculus
accagcatctcgaatccagaggatt

SEQ ID NO: 110660 - DNA, 25 bp, Mus musculus
accagcatctcgtatccagaggatt

SEQ ID NO: 110661 - DNA, 25 bp, Mus musculus
accagcatgaagcaactttttccaa

SEQ ID NO: 110662 - DNA, 25 bp, Mus musculus
accagcatgaaggaactttttccaa

SEQ ID NO: 110663 - DNA, 25 bp, Mus musculus
accagcatgactatcagacagcagt

SEQ ID NO: 110664 - DNA, 25 bp, Mus musculus
accagcatgactttcagacagcagt

SEQ ID NO: 110665 - DNA, 25 bp, Mus musculus
accagcatgcaacggccatctttct

SEQ ID NO: 110666 - DNA, 25 bp, Mus musculus
accagcatgcaagggccatctttct

SEQ ID NO: 110667 - DNA, 25 bp, Mus musculus
accagcatgcagctcattaaaccaa

SEQ ID NO: 110668 - DNA, 25 bp, Mus musculus
accagcatgcaggtcattaaaccaa

SEQ ID NO: 110669 - DNA, 25 bp, Mus musculus
accagcatgcatcacgtttaatttg

SEQ ID NO: 110670 - DNA, 25 bp, Mus musculus
accagcatgcatgacgtttaatttg

SEQ ID NO: 110671 - DNA, 25 bp, Mus musculus
accagcatgtgcatggaaatcagat

SEQ ID NO: 110672 - DNA, 25 bp, Mus musculus
accagcatgtgcttggaaatcagat

SEQ ID NO: 110673 - DNA, 25 bp, Mus musculus
accagcattctcagagcatagccat

SEQ ID NO: 110674 - DNA, 25 bp, Mus musculus
accagcattctctgagcatagccat

SEQ ID NO: 110675 - DNA, 25 bp, Mus musculus
accagcattggaattctctcagttg

SEQ ID NO: 110676 - DNA, 25 bp, Mus musculus
accagcattggatttctctcagttg

SEQ ID NO: 110677 - DNA, 25 bp, Mus musculus
accagccaacacatacttacaattt

SEQ ID NO: 110678 - DNA, 25 bp, Mus musculus
accagccaacacttacttacaattt

SEQ ID NO: 110679 - DNA, 25 bp, Mus musculus
accagccaacccctgagagtttgat

SEQ ID NO: 110680 - DNA, 25 bp, Mus musculus
accagccaacccgtgagagtttgat

SEQ ID NO: 110681 - DNA, 25 bp, Mus musculus
accagccaagctcactacaagtgct

SEQ ID NO: 110682 - DNA, 25 bp, Mus musculus
accagccaagctgactacaagtgct

SEQ ID NO: 110683 - DNA, 25 bp, Mus musculus
accagccaaggaatgtacacccatt

SEQ ID NO: 110684 - DNA, 25 bp, Mus musculus
accagccaaggattgtacacccatt

SEQ ID NO: 110685 - DNA, 25 bp, Mus musculus
accagccaaggtcatgtgaccagtt

SEQ ID NO: 110686 - DNA, 25 bp, Mus musculus
accagccaaggtgatgtgaccagtt

SEQ ID NO: 110687 - DNA, 25 bp, Mus musculus
accagccaataaccacaggagcaaa

SEQ ID NO: 110688 - DNA, 25 bp, Mus musculus
accagccaataagcacaggagcaaa

SEQ ID NO: 110689 - DNA, 25 bp, Mus musculus
accagccacattcaggaactctgtt

SEQ ID NO: 110690 - DNA, 25 bp, Mus musculus
accagccacattgaggaactctgtt

SEQ ID NO: 110691 - DNA, 25 bp, Mus musculus
accagccagaagagcacatgtgacc

SEQ ID NO: 110692 - DNA, 25 bp, Mus musculus
accagccagaagtgcacatgtgacc

SEQ ID NO: 110693 - DNA, 25 bp, Mus musculus
accagccagaatctcgcaatacaga

SEQ ID NO: 110694 - DNA, 25 bp, Mus musculus
accagccagaatgtcgcaatacaga

SEQ ID NO: 110695 - DNA, 25 bp, Mus musculus
accagccagctaacaactcgcgccc

SEQ ID NO: 110696 - DNA, 25 bp, Mus musculus
accagccagctatcaactcgcgccc

SEQ ID NO: 110697 - DNA, 25 bp, Mus musculus
accagccagggtatagtgcagtgat

SEQ ID NO: 110698 - DNA, 25 bp, Mus musculus
accagccagggtttagtgcagtgat

SEQ ID NO: 110699 - DNA, 25 bp, Mus musculus
accagccatctacaccaaccttatt

SEQ ID NO: 110700 - DNA, 25 bp, Mus musculus
accagccatctagaccaaccttatt

SEQ ID NO: 110701 - DNA, 25 bp, Mus musculus
accagccatgccagagaacctgact

SEQ ID NO: 110702 - DNA, 25 bp, Mus musculus
accagccatgcctgagaacctgact

SEQ ID NO: 110703 - DNA, 25 bp, Mus musculus
accagcccactaaagggactcagac

SEQ ID NO: 110704 - DNA, 25 bp, Mus musculus
accagcccactatagggactcagac

SEQ ID NO: 110705 - DNA, 25 bp, Mus musculus
accagcccagggatgatcgacgtca

SEQ ID NO: 110706 - DNA, 25 bp, Mus musculus
accagcccagggttgatcgacgtca

SEQ ID NO: 110707 - DNA, 25 bp, Mus musculus
accagcccatcgagaacctgtgaag

SEQ ID NO: 110708 - DNA, 25 bp, Mus musculus
accagcccatcgtgaacctgtgaag

SEQ ID NO: 110709 - DNA, 25 bp, Mus musculus
accagcccatgacatttttatcacc

SEQ ID NO: 110710 - DNA, 25 bp, Mus musculus
accagcccatgagatttttatcacc

SEQ ID NO: 110711 - DNA, 25 bp, Mus musculus
accagccccactagctgaggtcagg

SEQ ID NO: 110712 - DNA, 25 bp, Mus musculus
accagccccacttgctgaggtcagg

SEQ ID NO: 110713 - DNA, 25 bp, Mus musculus
accagccctatactgctaatgtctg

SEQ ID NO: 110714 - DNA, 25 bp, Mus musculus
accagccctatagtgctaatgtctg

SEQ ID NO: 110715 - DNA, 25 bp, Mus musculus
accagccctgttagtaaaaccatct

SEQ ID NO: 110716 - DNA, 25 bp, Mus musculus
accagccctgtttgtaaaaccatct

SEQ ID NO: 110717 - DNA, 25 bp, Mus musculus
accagcccttgtaatcaaataactt

SEQ ID NO: 110718 - DNA, 25 bp, Mus musculus
accagcccttgttatcaaataactt

SEQ ID NO: 110719 - DNA, 25 bp, Mus musculus
accagccggcacctttgtaaataat

SEQ ID NO: 110720 - DNA, 25 bp, Mus musculus
accagccggcacgtttgtaaataat

SEQ ID NO: 110721 - DNA, 25 bp, Mus musculus
accagcctaattccacaaatttctc

SEQ ID NO: 110722 - DNA, 25 bp, Mus musculus
accagcctaattgcacaaatttctc

SEQ ID NO: 110723 - DNA, 25 bp, Mus musculus
accagcctaccacctatagacaaag

SEQ ID NO: 110724 - DNA, 25 bp, Mus musculus
accagcctaccagctatagacaaag

SEQ ID NO: 110725 - DNA, 25 bp, Mus musculus
accagcctcagaatcagcgtttaaa

SEQ ID NO: 110726 - DNA, 25 bp, Mus musculus
accagcctcagattcagcgtttaaa

SEQ ID NO: 110727 - DNA, 25 bp, Mus musculus
accagcctcctgcttgtggtgagag

SEQ ID NO: 110728 - DNA, 25 bp, Mus musculus
accagcctcctggttgtggtgagag

SEQ ID NO: 110729 - DNA, 25 bp, Mus musculus
accagcctggccagtactcgggagc

SEQ ID NO: 110730 - DNA, 25 bp, Mus musculus
accagcctggcctgtactcgggagc

SEQ ID NO: 110731 - DNA, 25 bp, Mus musculus
accagcctggctccgatttttagac

SEQ ID NO: 110732 - DNA, 25 bp, Mus musculus
accagcctggctgcgatttttagac

SEQ ID NO: 110733 - DNA, 25 bp, Mus musculus
accagcctggtcatgttatttgcat

SEQ ID NO: 110734 - DNA, 25 bp, Mus musculus
accagcctggtcttgttatttgcat

SEQ ID NO: 110735 - DNA, 25 bp, Mus musculus
accagcctggttatttgataccttg

SEQ ID NO: 110736 - DNA, 25 bp, Mus musculus
accagcctggttttttgataccttg

SEQ ID NO: 110737 - DNA, 25 bp, Mus musculus
accagccttcccatgctgtgttaaa

SEQ ID NO: 110738 - DNA, 25 bp, Mus musculus
accagccttcccttgctgtgttaaa

SEQ ID NO: 110739 - DNA, 25 bp, Mus musculus
accagccttcctcaggacaaggttg

SEQ ID NO: 110740 - DNA, 25 bp, Mus musculus
accagccttcctgaggacaaggttg

SEQ ID NO: 110741 - DNA, 25 bp, Mus musculus
accagccttctgctttgcattggga

SEQ ID NO: 110742 - DNA, 25 bp, Mus musculus
accagccttctggtttgcattggga

SEQ ID NO: 110743 - DNA, 25 bp, Mus musculus
accagccttgtcatcatatcaagct

SEQ ID NO: 110744 - DNA, 25 bp, Mus musculus
accagccttgtcttcatatcaagct

SEQ ID NO: 110745 - DNA, 25 bp, Mus musculus
accagcctttgtattcatttcaagt

SEQ ID NO: 110746 - DNA, 25 bp, Mus musculus
accagcctttgttttcatttcaagt

SEQ ID NO: 110747 - DNA, 25 bp, Mus musculus
accagcgaatttattccgcgttttg

SEQ ID NO: 110748 - DNA, 25 bp, Mus musculus
accagcgaattttttccgcgttttg

SEQ ID NO: 110749 - DNA, 25 bp, Mus musculus
accagcgacctgaagatgttaaacg

SEQ ID NO: 110750 - DNA, 25 bp, Mus musculus
accagcgacctgcagaggagcatca

SEQ ID NO: 110751 - DNA, 25 bp, Mus musculus
accagcgacctggagaggagcatca

SEQ ID NO: 110752 - DNA, 25 bp, Mus musculus
accagcgacctgtagatgttaaacg

SEQ ID NO: 110753 - DNA, 25 bp, Mus musculus
accagcgagcgcacttgggagacaa

SEQ ID NO: 110754 - DNA, 25 bp, Mus musculus
accagcgagcgctcttgggagacaa

SEQ ID NO: 110755 - DNA, 25 bp, Mus musculus
accagcgataatccatcactcgtta

SEQ ID NO: 110756 - DNA, 25 bp, Mus musculus
accagcgataatgcatcactcgtta

SEQ ID NO: 110757 - DNA, 25 bp, Mus musculus
accagcgattcacactcgggctaag

SEQ ID NO: 110758 - DNA, 25 bp, Mus musculus
accagcgattcagactcgggctaag

SEQ ID NO: 110759 - DNA, 25 bp, Mus musculus
accagcgcagacaggcgcgccccag

SEQ ID NO: 110760 - DNA, 25 bp, Mus musculus
accagcgcagactggcgcgccccag

SEQ ID NO: 110761 - DNA, 25 bp, Mus musculus
accagcgcagtgacgttggccatga

SEQ ID NO: 110762 - DNA, 25 bp, Mus musculus
accagcgcagtgtcgttggccatga

SEQ ID NO: 110763 - DNA, 25 bp, Mus musculus
accagcgccaggatgaactcattga

SEQ ID NO: 110764 - DNA, 25 bp, Mus musculus
accagcgccaggttgaactcattga

SEQ ID NO: 110765 - DNA, 25 bp, Mus musculus
accagcgccgaacatgagggcatct

SEQ ID NO: 110766 - DNA, 25 bp, Mus musculus
accagcgccgaagatgagggcatct

SEQ ID NO: 110767 - DNA, 25 bp, Mus musculus
accagcggctacacaggaggactga

SEQ ID NO: 110768 - DNA, 25 bp, Mus musculus
accagcggctactcaggaggactga

SEQ ID NO: 110769 - DNA, 25 bp, Mus musculus
accagcgggctcagggccaagttca

SEQ ID NO: 110770 - DNA, 25 bp, Mus musculus
accagcgggctctgggccaagttca

SEQ ID NO: 110771 - DNA, 25 bp, Mus musculus
accagcggtctgcaagcgaatccta

SEQ ID NO: 110772 - DNA, 25 bp, Mus musculus
accagcggtctggaagcgaatccta

SEQ ID NO: 110773 - DNA, 25 bp, Mus musculus
accagcggtgggaggattatctatc

SEQ ID NO: 110774 - DNA, 25 bp, Mus musculus
accagcggtgggtggattatctatc

SEQ ID NO: 110775 - DNA, 25 bp, Mus musculus
accagcggtgtcatacggaatccag

SEQ ID NO: 110776 - DNA, 25 bp, Mus musculus
accagcggtgtcttacggaatccag

SEQ ID NO: 110777 - DNA, 25 bp, Mus musculus
accagcgtcattatgatgaagatgc

SEQ ID NO: 110778 - DNA, 25 bp, Mus musculus
accagcgtcattttgatgaagatgc

SEQ ID NO: 110779 - DNA, 25 bp, Mus musculus
accagcgtccagactgtgcgagagg

SEQ ID NO: 110780 - DNA, 25 bp, Mus musculus
accagcgtccagtctgtgcgagagg

SEQ ID NO: 110781 - DNA, 25 bp, Mus musculus
accagcgtctgtctttactagcaaa

SEQ ID NO: 110782 - DNA, 25 bp, Mus musculus
accagcgtctgtgtttactagcaaa

SEQ ID NO: 110783 - DNA, 25 bp, Mus musculus
accagcgtgaaaagacagcctatag

SEQ ID NO: 110784 - DNA, 25 bp, Mus musculus
accagcgtgaaatgacagcctatag

SEQ ID NO: 110785 - DNA, 25 bp, Mus musculus
accagcgtgatgaggattgccaaca

SEQ ID NO: 110786 - DNA, 25 bp, Mus musculus
accagcgtgatgtggattgccaaca

SEQ ID NO: 110787 - DNA, 25 bp, Mus musculus
accagcgtgggtcttctgcttcgtg

SEQ ID NO: 110788 - DNA, 25 bp, Mus musculus
accagcgtgggtgttctgcttcgtg

SEQ ID NO: 110789 - DNA, 25 bp, Mus musculus
accagcgtggtgaacaggtcggtca

SEQ ID NO: 110790 - DNA, 25 bp, Mus musculus
accagcgtggtgtacaggtcggtca

SEQ ID NO: 110791 - DNA, 25 bp, Mus musculus
accagcgttgccagctaggcagcaa

SEQ ID NO: 110792 - DNA, 25 bp, Mus musculus
accagcgttgcctgctaggcagcaa

SEQ ID NO: 110793 - DNA, 25 bp, Mus musculus
accagcgttttgagcaccggctaga

SEQ ID NO: 110794 - DNA, 25 bp, Mus musculus
accagcgttttgtgcaccggctaga

SEQ ID NO: 110795 - DNA, 25 bp, Mus musculus
accagctaacctagactaagccttc

SEQ ID NO: 110796 - DNA, 25 bp, Mus musculus
accagctaaccttgactaagccttc

SEQ ID NO: 110797 - DNA, 25 bp, Mus musculus
accagctaagcccagtcgaaggatc

SEQ ID NO: 110798 - DNA, 25 bp, Mus musculus
accagctaagccgagtcgaaggatc

SEQ ID NO: 110799 - DNA, 25 bp, Mus musculus
accagctaattaacattccagtcca

SEQ ID NO: 110800 - DNA, 25 bp, Mus musculus
accagctaattatcattccagtcca

SEQ ID NO: 110801 - DNA, 25 bp, Mus musculus
accagctacgtgcattcgtgcccat

SEQ ID NO: 110802 - DNA, 25 bp, Mus musculus
accagctacgtggattcgtgcccat

SEQ ID NO: 110803 - DNA, 25 bp, Mus musculus
accagctagagtcttcaccgtagag

SEQ ID NO: 110804 - DNA, 25 bp, Mus musculus
accagctagagtgttcaccgtagag

SEQ ID NO: 110805 - DNA, 25 bp, Mus musculus
accagctagctgacaaaggcttccg

SEQ ID NO: 110806 - DNA, 25 bp, Mus musculus
accagctagctgctttactgtgtga

SEQ ID NO: 110807 - DNA, 25 bp, Mus musculus
accagctagctggtttactgtgtga

SEQ ID NO: 110808 - DNA, 25 bp, Mus musculus
accagctagctgtcaaaggcttccg

SEQ ID NO: 110809 - DNA, 25 bp, Mus musculus
accagctatccaagatggccatgtg

SEQ ID NO: 110810 - DNA, 25 bp, Mus musculus
accagctatccatgatggccatgtg

SEQ ID NO: 110811 - DNA, 25 bp, Mus musculus
accagctatggcaaattgccaagta

SEQ ID NO: 110812 - DNA, 25 bp, Mus musculus
accagctatggctaattgccaagta

SEQ ID NO: 110813 - DNA, 25 bp, Mus musculus
accagctattttccagggtgtagta

SEQ ID NO: 110814 - DNA, 25 bp, Mus musculus
accagctattttgcagggtgtagta

SEQ ID NO: 110815 - DNA, 25 bp, Mus musculus
accagctcaagtaagtgcctgtcac

SEQ ID NO: 110816 - DNA, 25 bp, Mus musculus
accagctcaagtagtacgccagtca

SEQ ID NO: 110817 - DNA, 25 bp, Mus musculus
accagctcaagttagtgcctgtcac

SEQ ID NO: 110818 - DNA, 25 bp, Mus musculus
accagctcaagttgtacgccagtca

SEQ ID NO: 110819 - DNA, 25 bp, Mus musculus
accagctcacacactttgctgaggg

SEQ ID NO: 110820 - DNA, 25 bp, Mus musculus
accagctcacactctttgctgaggg

SEQ ID NO: 110821 - DNA, 25 bp, Mus musculus
accagctcacatccagctctaaagg

SEQ ID NO: 110822 - DNA, 25 bp, Mus musculus
accagctcacatgcagctctaaagg

SEQ ID NO: 110823 - DNA, 25 bp, Mus musculus
accagctcacctcacaatgtagaaa

SEQ ID NO: 110824 - DNA, 25 bp, Mus musculus
accagctcacctgacaatgtagaaa

SEQ ID NO: 110825 - DNA, 25 bp, Mus musculus
accagctcactcagttttacagaag

SEQ ID NO: 110826 - DNA, 25 bp, Mus musculus
accagctcactctgttttacagaag

SEQ ID NO: 110827 - DNA, 25 bp, Mus musculus
accagctcagaaccaggcacctagg

SEQ ID NO: 110828 - DNA, 25 bp, Mus musculus
accagctcagaagcaggcacctagg

SEQ ID NO: 110829 - DNA, 25 bp, Mus musculus
accagctcagatagcccagacttta

SEQ ID NO: 110830 - DNA, 25 bp, Mus musculus
accagctcagattgcccagacttta

SEQ ID NO: 110831 - DNA, 25 bp, Mus musculus
accagctcagccaaatctgcaagta

SEQ ID NO: 110832 - DNA, 25 bp, Mus musculus
accagctcagcctaatctgcaagta

SEQ ID NO: 110833 - DNA, 25 bp, Mus musculus
accagctcatggatgcactgggcga

SEQ ID NO: 110834 - DNA, 25 bp, Mus musculus
accagctcatggttgcactgggcga

SEQ ID NO: 110835 - DNA, 25 bp, Mus musculus
accagctccaagagatcctgccaag

SEQ ID NO: 110836 - DNA, 25 bp, Mus musculus
accagctccaagtgatcctgccaag

SEQ ID NO: 110837 - DNA, 25 bp, Mus musculus
accagctccccgaaatctaaacatt

SEQ ID NO: 110838 - DNA, 25 bp, Mus musculus
accagctccccgtaatctaaacatt

SEQ ID NO: 110839 - DNA, 25 bp, Mus musculus
accagctccttaatcacaggtgaag

SEQ ID NO: 110840 - DNA, 25 bp, Mus musculus
accagctccttattcacaggtgaag

SEQ ID NO: 110841 - DNA, 25 bp, Mus musculus
accagctcttagactacttgtcagc

SEQ ID NO: 110842 - DNA, 25 bp, Mus musculus
accagctcttagtctacttgtcagc

SEQ ID NO: 110843 - DNA, 25 bp, Mus musculus
accagctcttcacttctttaatctt

SEQ ID NO: 110844 - DNA, 25 bp, Mus musculus
accagctcttcagttctttaatctt

SEQ ID NO: 110845 - DNA, 25 bp, Mus musculus
accagctgaggtccaactatgttcc

SEQ ID NO: 110846 - DNA, 25 bp, Mus musculus
accagctgaggtgcaactatgttcc

SEQ ID NO: 110847 - DNA, 25 bp, Mus musculus
accagctgcaaactgttttgtacca

SEQ ID NO: 110848 - DNA, 25 bp, Mus musculus
accagctgcaaagtgttttgtacca

SEQ ID NO: 110849 - DNA, 25 bp, Mus musculus
accagctgccaactatttgcattag

SEQ ID NO: 110850 - DNA, 25 bp, Mus musculus
accagctgccaagtatttgcattag

SEQ ID NO: 110851 - DNA, 25 bp, Mus musculus
accagctgcccaatttgtgagattt

SEQ ID NO: 110852 - DNA, 25 bp, Mus musculus
accagctgcccattttgtgagattt

SEQ ID NO: 110853 - DNA, 25 bp, Mus musculus
accagctgcctgctgagtttcagct

SEQ ID NO: 110854 - DNA, 25 bp, Mus musculus
accagctgcctggtgagtttcagct

SEQ ID NO: 110855 - DNA, 25 bp, Mus musculus
accagctgcggtagactttgtaaca

SEQ ID NO: 110856 - DNA, 25 bp, Mus musculus
accagctgcggttgactttgtaaca

SEQ ID NO: 110857 - DNA, 25 bp, Mus musculus
accagctgctggagggaatcatcca

SEQ ID NO: 110858 - DNA, 25 bp, Mus musculus
accagctgctggattcaggctacag

SEQ ID NO: 110859 - DNA, 25 bp, Mus musculus
accagctgctggtgggaatcatcca

SEQ ID NO: 110860 - DNA, 25 bp, Mus musculus
accagctgctggtttcaggctacag

SEQ ID NO: 110861 - DNA, 25 bp, Mus musculus
accagctggacacacttgaattgaa

SEQ ID NO: 110862 - DNA, 25 bp, Mus musculus
accagctggacagacttgaattgaa

SEQ ID NO: 110863 - DNA, 25 bp, Mus musculus
accagctggattatccctgtgcatg

SEQ ID NO: 110864 - DNA, 25 bp, Mus musculus
accagctggattttccctgtgcatg

SEQ ID NO: 110865 - DNA, 25 bp, Mus musculus
accagctggcacactgtacagactg

SEQ ID NO: 110866 - DNA, 25 bp, Mus musculus
accagctggcactctgtacagactg

SEQ ID NO: 110867 - DNA, 25 bp, Mus musculus
accagctggcccataattcttagag

SEQ ID NO: 110868 - DNA, 25 bp, Mus musculus
accagctggcccttaattcttagag

SEQ ID NO: 110869 - DNA, 25 bp, Mus musculus
accagctggcgcagagactggcaca

SEQ ID NO: 110870 - DNA, 25 bp, Mus musculus
accagctggcgctgagactggcaca

SEQ ID NO: 110871 - DNA, 25 bp, Mus musculus
accagctggctgaagactcggagac

SEQ ID NO: 110872 - DNA, 25 bp, Mus musculus
accagctggctgaagagcgggccca

SEQ ID NO: 110873 - DNA, 25 bp, Mus musculus
accagctggctgtagactcggagac

SEQ ID NO: 110874 - DNA, 25 bp, Mus musculus
accagctggctgtagagcgggccca

SEQ ID NO: 110875 - DNA, 25 bp, Mus musculus
accagctgggtcactctcaaagatg

SEQ ID NO: 110876 - DNA, 25 bp, Mus musculus
accagctgggtctctctcaaagatg

SEQ ID NO: 110877 - DNA, 25 bp, Mus musculus
accagctggtggaaggcccgacaga

SEQ ID NO: 110878 - DNA, 25 bp, Mus musculus
accagctggtggtaggcccgacaga

SEQ ID NO: 110879 - DNA, 25 bp, Mus musculus
accagctgtaacatcagcgtctttg

SEQ ID NO: 110880 - DNA, 25 bp, Mus musculus
accagctgtaacttcagcgtctttg

SEQ ID NO: 110881 - DNA, 25 bp, Mus musculus
accagctgtcaaaatgtttttccca

SEQ ID NO: 110882 - DNA, 25 bp, Mus musculus
accagctgtcaatatgtttttccca

SEQ ID NO: 110883 - DNA, 25 bp, Mus musculus
accagctgtcagcaatgttctcagt

SEQ ID NO: 110884 - DNA, 25 bp, Mus musculus
accagctgtcaggaatgttctcagt

SEQ ID NO: 110885 - DNA, 25 bp, Mus musculus
accagctgtgatcttgtgctttcca

SEQ ID NO: 110886 - DNA, 25 bp, Mus musculus
accagctgtgatgttgtgctttcca

SEQ ID NO: 110887 - DNA, 25 bp, Mus musculus
accagctgtggaattaagcccagtc

SEQ ID NO: 110888 - DNA, 25 bp, Mus musculus
accagctgtggatttaagcccagtc

SEQ ID NO: 110889 - DNA, 25 bp, Mus musculus
accagctgttgcctgcgtttgggaa

SEQ ID NO: 110890 - DNA, 25 bp, Mus musculus
accagctgttgcgtgcgtttgggaa

SEQ ID NO: 110891 - DNA, 25 bp, Mus musculus
accagcttagatctccaacaagaga

SEQ ID NO: 110892 - DNA, 25 bp, Mus musculus
accagcttagatgtccaacaagaga

SEQ ID NO: 110893 - DNA, 25 bp, Mus musculus
accagcttcaccatcttaacaaggt

SEQ ID NO: 110894 - DNA, 25 bp, Mus musculus
accagcttcaccttcttaacaaggt

SEQ ID NO: 110895 - DNA, 25 bp, Mus musculus
accagcttcagcatcacacagaata

SEQ ID NO: 110896 - DNA, 25 bp, Mus musculus
accagcttcagcatccactttgaca

SEQ ID NO: 110897 - DNA, 25 bp, Mus musculus
accagcttcagcttcacacagaata

SEQ ID NO: 110898 - DNA, 25 bp, Mus musculus
accagcttcagcttccactttgaca

SEQ ID NO: 110899 - DNA, 25 bp, Mus musculus
accagcttcatcaccgctagtgtaa

SEQ ID NO: 110900 - DNA, 25 bp, Mus musculus
accagcttcatctccgctagtgtaa

SEQ ID NO: 110901 - DNA, 25 bp, Mus musculus
accagcttctaacatccgtgtttga

SEQ ID NO: 110902 - DNA, 25 bp, Mus musculus
accagcttctaagatccgtgtttga

SEQ ID NO: 110903 - DNA, 25 bp, Mus musculus
accagcttgccaactctgatgtgca

SEQ ID NO: 110904 - DNA, 25 bp, Mus musculus
accagcttgccatctctgatgtgca

SEQ ID NO: 110905 - DNA, 25 bp, Mus musculus
accagcttgttccagtcgcgggaga

SEQ ID NO: 110906 - DNA, 25 bp, Mus musculus
accagcttgttcgagtcgcgggaga

SEQ ID NO: 110907 - DNA, 25 bp, Mus musculus
accagcttgtttcaaccggggagtg

SEQ ID NO: 110908 - DNA, 25 bp, Mus musculus
accagcttgtttgaaccggggagtg

SEQ ID NO: 110909 - DNA, 25 bp, Mus musculus
accagctttaagaatgccatcgtag

SEQ ID NO: 110910 - DNA, 25 bp, Mus musculus
accagctttaagtatgccatcgtag

SEQ ID NO: 110911 - DNA, 25 bp, Mus musculus
accagctttgcacttacgtacgtaa

SEQ ID NO: 110912 - DNA, 25 bp, Mus musculus
accagctttgcagttacgtacgtaa

SEQ ID NO: 110913 - DNA, 25 bp, Mus musculus
accagctttgtgaccagcatgggct

SEQ ID NO: 110914 - DNA, 25 bp, Mus musculus
accagctttgtgtccagcatgggct

SEQ ID NO: 110915 - DNA, 25 bp, Mus musculus
accaggaaacccaccacgaagaatg

SEQ ID NO: 110916 - DNA, 25 bp, Mus musculus
accaggaaaccctccacgaagaatg

SEQ ID NO: 110917 - DNA, 25 bp, Mus musculus
accaggaaacctatgtcgtgtatca

SEQ ID NO: 110918 - DNA, 25 bp, Mus musculus
accaggaaacctttgtcgtgtatca

SEQ ID NO: 110919 - DNA, 25 bp, Mus musculus
accaggaaagagaccacggcagcat

SEQ ID NO: 110920 - DNA, 25 bp, Mus musculus
accaggaaagagtccacggcagcat

SEQ ID NO: 110921 - DNA, 25 bp, Mus musculus
accaggaaagttcggtcctgccagt

SEQ ID NO: 110922 - DNA, 25 bp, Mus musculus
accaggaaagttgggtcctgccagt

SEQ ID NO: 110923 - DNA, 25 bp, Mus musculus
accaggaaccagatgccgagtagca

SEQ ID NO: 110924 - DNA, 25 bp, Mus musculus
accaggaaccagttgccgagtagca

SEQ ID NO: 110925 - DNA, 25 bp, Mus musculus
accaggaagatgactcgggcagcct

SEQ ID NO: 110926 - DNA, 25 bp, Mus musculus
accaggaagatgtctcgggcagcct

SEQ ID NO: 110927 - DNA, 25 bp, Mus musculus
accaggaagcgaattcctgacccca

SEQ ID NO: 110928 - DNA, 25 bp, Mus musculus
accaggaagcgatttcctgacccca

SEQ ID NO: 110929 - DNA, 25 bp, Mus musculus
accaggaagcttatgctgaactgtt

SEQ ID NO: 110930 - DNA, 25 bp, Mus musculus
accaggaagcttttgctgaactgtt

SEQ ID NO: 110931 - DNA, 25 bp, Mus musculus
accaggaatcccctttcaggagaga

SEQ ID NO: 110932 - DNA, 25 bp, Mus musculus
accaggaatcccgtttcaggagaga

SEQ ID NO: 110933 - DNA, 25 bp, Mus musculus
accaggaatcctcagggtcaattat

SEQ ID NO: 110934 - DNA, 25 bp, Mus musculus
accaggaatcctgagggtcaattat

SEQ ID NO: 110935 - DNA, 25 bp, Mus musculus
accaggaatggtctcttcgctgcag

SEQ ID NO: 110936 - DNA, 25 bp, Mus musculus
accaggaatggtgtcttcgctgcag

SEQ ID NO: 110937 - DNA, 25 bp, Mus musculus
accaggaattcaccaccaaactcgt

SEQ ID NO: 110938 - DNA, 25 bp, Mus musculus
accaggaattcagcaccaaactcgt

SEQ ID NO: 110939 - DNA, 25 bp, Mus musculus
accaggaattcgaaatcacgcaaac

SEQ ID NO: 110940 - DNA, 25 bp, Mus musculus
accaggaattcgtaatcacgcaaac

SEQ ID NO: 110941 - DNA, 25 bp, Mus musculus
accaggacaaggcacctaccttgct

SEQ ID NO: 110942 - DNA, 25 bp, Mus musculus
accaggacaagggacctaccttgct

SEQ ID NO: 110943 - DNA, 25 bp, Mus musculus
accaggacagatcaactatctttac

SEQ ID NO: 110944 - DNA, 25 bp, Mus musculus
accaggacagatgaactatctttac

SEQ ID NO: 110945 - DNA, 25 bp, Mus musculus
accaggaccacgagaagctgttcga

SEQ ID NO: 110946 - DNA, 25 bp, Mus musculus
accaggaccacgtgaagctgttcga

SEQ ID NO: 110947 - DNA, 25 bp, Mus musculus
accaggaccagaacctcaataacct

SEQ ID NO: 110948 - DNA, 25 bp, Mus musculus
accaggaccagaccctcatgtagac

SEQ ID NO: 110949 - DNA, 25 bp, Mus musculus
accaggaccagagcctcatgtagac

SEQ ID NO: 110950 - DNA, 25 bp, Mus musculus
accaggaccagatcctcaataacct

SEQ ID NO: 110951 - DNA, 25 bp, Mus musculus
accaggaccattaacgacgttgctt

SEQ ID NO: 110952 - DNA, 25 bp, Mus musculus
accaggaccatttacgacgttgctt

SEQ ID NO: 110953 - DNA, 25 bp, Mus musculus
accaggacctggataagattgacca

SEQ ID NO: 110954 - DNA, 25 bp, Mus musculus
accaggacctggttaagattgacca

SEQ ID NO: 110955 - DNA, 25 bp, Mus musculus
accaggacgccactgcggaggagga

SEQ ID NO: 110956 - DNA, 25 bp, Mus musculus
accaggacgccagtgcggaggagga

SEQ ID NO: 110957 - DNA, 25 bp, Mus musculus
accaggacggtgatctcgcggcaga

SEQ ID NO: 110958 - DNA, 25 bp, Mus musculus
accaggacggtgttctcgcggcaga

SEQ ID NO: 110959 - DNA, 25 bp, Mus musculus
accaggactcgcacagggcaggatg

SEQ ID NO: 110960 - DNA, 25 bp, Mus musculus
accaggactcgctcagggcaggatg

SEQ ID NO: 110961 - DNA, 25 bp, Mus musculus
accaggactcttcggtactactgtc

SEQ ID NO: 110962 - DNA, 25 bp, Mus musculus
accaggactcttgggtactactgtc

SEQ ID NO: 110963 - DNA, 25 bp, Mus musculus
accaggactggaccagggccctctt

SEQ ID NO: 110964 - DNA, 25 bp, Mus musculus
accaggactggagcagggccctctt

SEQ ID NO: 110965 - DNA, 25 bp, Mus musculus
accaggactgtgatgctatgttgtg

SEQ ID NO: 110966 - DNA, 25 bp, Mus musculus
accaggactgtgttgctatgttgtg

SEQ ID NO: 110967 - DNA, 25 bp, Mus musculus
accaggacttcaagatggcgtcact

SEQ ID NO: 110968 - DNA, 25 bp, Mus musculus
accaggacttcatgatggcgtcact

SEQ ID NO: 110969 - DNA, 25 bp, Mus musculus
accaggagaaacagtctttgtacca

SEQ ID NO: 110970 - DNA, 25 bp, Mus musculus
accaggagaaactgtctttgtacca

SEQ ID NO: 110971 - DNA, 25 bp, Mus musculus
accaggagagagatcttctgcttcc

SEQ ID NO: 110972 - DNA, 25 bp, Mus musculus
accaggagagagttcttctgcttcc

SEQ ID NO: 110973 - DNA, 25 bp, Mus musculus
accaggagagtgaagttgcaatgtc

SEQ ID NO: 110974 - DNA, 25 bp, Mus musculus
accaggagagtgtagttgcaatgtc

SEQ ID NO: 110975 - DNA, 25 bp, Mus musculus
accaggagatgcctgtggccagctt

SEQ ID NO: 110976 - DNA, 25 bp, Mus musculus
accaggagatgcgtgtggccagctt

SEQ ID NO: 110977 - DNA, 25 bp, Mus musculus
accaggagcaagactgcctcagcag

SEQ ID NO: 110978 - DNA, 25 bp, Mus musculus
accaggagcaagtctgcctcagcag

SEQ ID NO: 110979 - DNA, 25 bp, Mus musculus
accaggagccagactcatatactta

SEQ ID NO: 110980 - DNA, 25 bp, Mus musculus
accaggagccagtctcatatactta

SEQ ID NO: 110981 - DNA, 25 bp, Mus musculus
accaggagccataatcaagaggact

SEQ ID NO: 110982 - DNA, 25 bp, Mus musculus
accaggagccattatcaagaggact

SEQ ID NO: 110983 - DNA, 25 bp, Mus musculus
accaggagcctgagtgatgtaccca

SEQ ID NO: 110984 - DNA, 25 bp, Mus musculus
accaggagcctgtgtgatgtaccca

SEQ ID NO: 110985 - DNA, 25 bp, Mus musculus
accaggagctggagctagcacacca

SEQ ID NO: 110986 - DNA, 25 bp, Mus musculus
accaggagctggcatctttaattgc

SEQ ID NO: 110987 - DNA, 25 bp, Mus musculus
accaggagctgggatctttaattgc

SEQ ID NO: 110988 - DNA, 25 bp, Mus musculus
accaggagctggtgctagcacacca

SEQ ID NO: 110989 - DNA, 25 bp, Mus musculus
accaggaggcccctgaccctaatag

SEQ ID NO: 110990 - DNA, 25 bp, Mus musculus
accaggaggcccgtgaccctaatag

SEQ ID NO: 110991 - DNA, 25 bp, Mus musculus
accaggaggctgatatggtgttatg

SEQ ID NO: 110992 - DNA, 25 bp, Mus musculus
accaggaggctgttatggtgttatg

SEQ ID NO: 110993 - DNA, 25 bp, Mus musculus
accaggagggcaaccggctgagcaa

SEQ ID NO: 110994 - DNA, 25 bp, Mus musculus
accaggagggcatccggctgagcaa

SEQ ID NO: 110995 - DNA, 25 bp, Mus musculus
accaggagggtcatgaacattactt

SEQ ID NO: 110996 - DNA, 25 bp, Mus musculus
accaggagggtcttgaacattactt

SEQ ID NO: 110997 - DNA, 25 bp, Mus musculus
accaggaggtcacgttgtctattca

SEQ ID NO: 110998 - DNA, 25 bp, Mus musculus
accaggaggtcaggttgtctattca

SEQ ID NO: 110999 - DNA, 25 bp, Mus musculus
accaggagtatcaggacctgtccat

SEQ ID NO: 111000 - DNA, 25 bp, Mus musculus
accaggagtatctggacctgtccat

SEQ ID NO: 111001 - DNA, 25 bp, Mus musculus
accaggagttccatcagggactatt

SEQ ID NO: 111002 - DNA, 25 bp, Mus musculus
accaggagttccttcagggactatt

SEQ ID NO: 111003 - DNA, 25 bp, Mus musculus
accaggataatcatggctacatctg

SEQ ID NO: 111004 - DNA, 25 bp, Mus musculus
accaggataatcttggctacatctg

SEQ ID NO: 111005 - DNA, 25 bp, Mus musculus
accaggatctatatggatctgccac

SEQ ID NO: 111006 - DNA, 25 bp, Mus musculus
accaggatctatttggatctgccac

SEQ ID NO: 111007 - DNA, 25 bp, Mus musculus
accaggatctgcatgagtgtcccac

SEQ ID NO: 111008 - DNA, 25 bp, Mus musculus
accaggatctgcatggataggccac

SEQ ID NO: 111009 - DNA, 25 bp, Mus musculus
accaggatctgcttgagtgtcccac

SEQ ID NO: 111010 - DNA, 25 bp, Mus musculus
accaggatctgcttggataggccac

SEQ ID NO: 111011 - DNA, 25 bp, Mus musculus
accaggatcttgatgcggagttctc

SEQ ID NO: 111012 - DNA, 25 bp, Mus musculus
accaggatcttgttgcggagttctc

SEQ ID NO: 111013 - DNA, 25 bp, Mus musculus
accaggatgaggagcaccgcatcaa

SEQ ID NO: 111014 - DNA, 25 bp, Mus musculus
accaggatgaggtgcaccgcatcaa

SEQ ID NO: 111015 - DNA, 25 bp, Mus musculus
accaggatgatgatgcccgtgtctc

SEQ ID NO: 111016 - DNA, 25 bp, Mus musculus
accaggatgatgttgcccgtgtctc

SEQ ID NO: 111017 - DNA, 25 bp, Mus musculus
accaggatgcagaccaacaggctct

SEQ ID NO: 111018 - DNA, 25 bp, Mus musculus
accaggatgcagtccaacaggctct

SEQ ID NO: 111019 - DNA, 25 bp, Mus musculus
accaggatgtggatgtcaagtactt

SEQ ID NO: 111020 - DNA, 25 bp, Mus musculus
accaggatgtggttgtcaagtactt

SEQ ID NO: 111021 - DNA, 25 bp, Mus musculus
accaggatttagataccagcagctc

SEQ ID NO: 111022 - DNA, 25 bp, Mus musculus
accaggatttagttaccagcagctc

SEQ ID NO: 111023 - DNA, 25 bp, Mus musculus
accaggattttcatacacggatgca

SEQ ID NO: 111024 - DNA, 25 bp, Mus musculus
accaggattttcttacacggatgca

SEQ ID NO: 111025 - DNA, 25 bp, Mus musculus
accaggcaaattctctgccacaata

SEQ ID NO: 111026 - DNA, 25 bp, Mus musculus
accaggcaaattgtctgccacaata

SEQ ID NO: 111027 - DNA, 25 bp, Mus musculus
accaggcactgtctgatctgagccg

SEQ ID NO: 111028 - DNA, 25 bp, Mus musculus
accaggcactgtgtgatctgagccg

SEQ ID NO: 111029 - DNA, 25 bp, Mus musculus
accaggcagaagcaacgtgttacac

SEQ ID NO: 111030 - DNA, 25 bp, Mus musculus
accaggcagaagctccagtagatca

SEQ ID NO: 111031 - DNA, 25 bp, Mus musculus
accaggcagaaggaacgtgttacac

SEQ ID NO: 111032 - DNA, 25 bp, Mus musculus
accaggcagaaggtccagtagatca

SEQ ID NO: 111033 - DNA, 25 bp, Mus musculus
accaggcagctgatcattgttcttt

SEQ ID NO: 111034 - DNA, 25 bp, Mus musculus
accaggcagctgttcattgttcttt

SEQ ID NO: 111035 - DNA, 25 bp, Mus musculus
accaggcagggtctcaagtcgcaag

SEQ ID NO: 111036 - DNA, 25 bp, Mus musculus
accaggcagggtgtcaagtcgcaag

SEQ ID NO: 111037 - DNA, 25 bp, Mus musculus
accaggcatcacatgaggttgtgca

SEQ ID NO: 111038 - DNA, 25 bp, Mus musculus
accaggcatcacttgaggttgtgca

SEQ ID NO: 111039 - DNA, 25 bp, Mus musculus
accaggcatctaagtagtacacaga

SEQ ID NO: 111040 - DNA, 25 bp, Mus musculus
accaggcatctatgtagtacacaga

SEQ ID NO: 111041 - DNA, 25 bp, Mus musculus
accaggccaggacccaagctgtgga

SEQ ID NO: 111042 - DNA, 25 bp, Mus musculus
accaggccaggagccaagctgtgga

SEQ ID NO: 111043 - DNA, 25 bp, Mus musculus
accaggcccaaacctatttggcttt

SEQ ID NO: 111044 - DNA, 25 bp, Mus musculus
accaggcccaaagctatttggcttt

SEQ ID NO: 111045 - DNA, 25 bp, Mus musculus
accaggccccgcagtgagcaatgag

SEQ ID NO: 111046 - DNA, 25 bp, Mus musculus
accaggccccgctgtgagcaatgag

SEQ ID NO: 111047 - DNA, 25 bp, Mus musculus
accaggccgagtctgcgctcaatga

SEQ ID NO: 111048 - DNA, 25 bp, Mus musculus
accaggccgagtgtgcgctcaatga

SEQ ID NO: 111049 - DNA, 25 bp, Mus musculus
accaggccgcacaagacgtgaggaa

SEQ ID NO: 111050 - DNA, 25 bp, Mus musculus
accaggccgcactagacgtgaggaa

SEQ ID NO: 111051 - DNA, 25 bp, Mus musculus
accaggcctgagctaagtttgaact

SEQ ID NO: 111052 - DNA, 25 bp, Mus musculus
accaggcctgaggtaagtttgaact

SEQ ID NO: 111053 - DNA, 25 bp, Mus musculus
accaggcctggacaaggcgtctgat

SEQ ID NO: 111054 - DNA, 25 bp, Mus musculus
accaggcctggagaaggcgtctgat

SEQ ID NO: 111055 - DNA, 25 bp, Mus musculus
accaggccttacagagctcagagag

SEQ ID NO: 111056 - DNA, 25 bp, Mus musculus
accaggccttactgagctcagagag

SEQ ID NO: 111057 - DNA, 25 bp, Mus musculus
accaggccttttcgtgctattcctt

SEQ ID NO: 111058 - DNA, 25 bp, Mus musculus
accaggccttttggtgctattcctt

SEQ ID NO: 111059 - DNA, 25 bp, Mus musculus
accaggcgacacagtgtgcgtctaa

SEQ ID NO: 111060 - DNA, 25 bp, Mus musculus
accaggcgacactgtgtgcgtctaa

SEQ ID NO: 111061 - DNA, 25 bp, Mus musculus
accaggcgcgaaccttgctgttaga

SEQ ID NO: 111062 - DNA, 25 bp, Mus musculus
accaggcgcgaagcttgctgttaga

SEQ ID NO: 111063 - DNA, 25 bp, Mus musculus
accaggcgcggcaacttctttctta

SEQ ID NO: 111064 - DNA, 25 bp, Mus musculus
accaggcgcggctacttctttctta

SEQ ID NO: 111065 - DNA, 25 bp, Mus musculus
accaggcgctggctaggttttactg

SEQ ID NO: 111066 - DNA, 25 bp, Mus musculus
accaggcgctgggtaggttttactg

SEQ ID NO: 111067 - DNA, 25 bp, Mus musculus
accaggcgggtgagtctgttagtaa

SEQ ID NO: 111068 - DNA, 25 bp, Mus musculus
accaggcgggtgtgtctgttagtaa

SEQ ID NO: 111069 - DNA, 25 bp, Mus musculus
accaggcgtagtcgtgcaggccttt

SEQ ID NO: 111070 - DNA, 25 bp, Mus musculus
accaggcgtagtggtgcaggccttt

SEQ ID NO: 111071 - DNA, 25 bp, Mus musculus
accaggcgtttacgacagagttcaa

SEQ ID NO: 111072 - DNA, 25 bp, Mus musculus
accaggcgtttaggacagagttcaa

SEQ ID NO: 111073 - DNA, 25 bp, Mus musculus
accaggctaccacctagggctctag

SEQ ID NO: 111074 - DNA, 25 bp, Mus musculus
accaggctaccagctagggctctag

SEQ ID NO: 111075 - DNA, 25 bp, Mus musculus
accaggctacctcttagtttgagtt

SEQ ID NO: 111076 - DNA, 25 bp, Mus musculus
accaggctacctgttagtttgagtt

SEQ ID NO: 111077 - DNA, 25 bp, Mus musculus
accaggctcatcctgtccatcgtgt

SEQ ID NO: 111078 - DNA, 25 bp, Mus musculus
accaggctcatcgtgtccatcgtgt

SEQ ID NO: 111079 - DNA, 25 bp, Mus musculus
accaggctccacaccatggtgtttc

SEQ ID NO: 111080 - DNA, 25 bp, Mus musculus
accaggctccactccatggtgtttc

SEQ ID NO: 111081 - DNA, 25 bp, Mus musculus
accaggctccataaccatgtgcttg

SEQ ID NO: 111082 - DNA, 25 bp, Mus musculus
accaggctccattaccatgtgcttg

SEQ ID NO: 111083 - DNA, 25 bp, Mus musculus
accaggctcctcaagacaagtgaca

SEQ ID NO: 111084 - DNA, 25 bp, Mus musculus
accaggctcctctagacaagtgaca

SEQ ID NO: 111085 - DNA, 25 bp, Mus musculus
accaggctcctgacattgatgtgca

SEQ ID NO: 111086 - DNA, 25 bp, Mus musculus
accaggctcctgtcattgatgtgca

SEQ ID NO: 111087 - DNA, 25 bp, Mus musculus
accaggctggcaacggacttgtagt

SEQ ID NO: 111088 - DNA, 25 bp, Mus musculus
accaggctggcatcggacttgtagt

SEQ ID NO: 111089 - DNA, 25 bp, Mus musculus
accaggctgggactctaatgtaatt

SEQ ID NO: 111090 - DNA, 25 bp, Mus musculus
accaggctgggagtctaatgtaatt

SEQ ID NO: 111091 - DNA, 25 bp, Mus musculus
accaggctgggtcagagattcaact

SEQ ID NO: 111092 - DNA, 25 bp, Mus musculus
accaggctgggtgagagattcaact

SEQ ID NO: 111093 - DNA, 25 bp, Mus musculus
accaggctggtgcttactgccgaaa

SEQ ID NO: 111094 - DNA, 25 bp, Mus musculus
accaggctggtggttactgccgaaa

SEQ ID NO: 111095 - DNA, 25 bp, Mus musculus
accaggcttccaattcagattacta

SEQ ID NO: 111096 - DNA, 25 bp, Mus musculus
accaggcttccatttcagattacta

SEQ ID NO: 111097 - DNA, 25 bp, Mus musculus
accaggcttgagaaattacagcagc

SEQ ID NO: 111098 - DNA, 25 bp, Mus musculus
accaggcttgagtaattacagcagc

SEQ ID NO: 111099 - DNA, 25 bp, Mus musculus
accaggcttggcatctgaagggcac

SEQ ID NO: 111100 - DNA, 25 bp, Mus musculus
accaggcttggcttctgaagggcac

SEQ ID NO: 111101 - DNA, 25 bp, Mus musculus
accaggcttggtaagctctcagaga

SEQ ID NO: 111102 - DNA, 25 bp, Mus musculus
accaggcttggttagctctcagaga

SEQ ID NO: 111103 - DNA, 25 bp, Mus musculus
accaggctttcacggttgccaagga

SEQ ID NO: 111104 - DNA, 25 bp, Mus musculus
accaggctttcagggttgccaagga

SEQ ID NO: 111105 - DNA, 25 bp, Mus musculus
accagggaacagccagtcagggacc

SEQ ID NO: 111106 - DNA, 25 bp, Mus musculus
accagggaacaggcagtcagggacc

SEQ ID NO: 111107 - DNA, 25 bp, Mus musculus
accagggacctgatcataaactacg

SEQ ID NO: 111108 - DNA, 25 bp, Mus musculus
accagggacctgttcataaactacg

SEQ ID NO: 111109 - DNA, 25 bp, Mus musculus
accagggaccttcagcagcgactca

SEQ ID NO: 111110 - DNA, 25 bp, Mus musculus
accagggaccttgagcagcgactca

SEQ ID NO: 111111 - DNA, 25 bp, Mus musculus
accagggaggttatgaagatttcgt

SEQ ID NO: 111112 - DNA, 25 bp, Mus musculus
accagggaggttttgaagatttcgt

SEQ ID NO: 111113 - DNA, 25 bp, Mus musculus
accagggccactcatctgtggaaga

SEQ ID NO: 111114 - DNA, 25 bp, Mus musculus
accagggccactgatctgtggaaga

SEQ ID NO: 111115 - DNA, 25 bp, Mus musculus
accagggccagacctcaacgtgtac

SEQ ID NO: 111116 - DNA, 25 bp, Mus musculus
accagggccagagctcaacgtgtac

SEQ ID NO: 111117 - DNA, 25 bp, Mus musculus
accagggctgccatttgcagtggca

SEQ ID NO: 111118 - DNA, 25 bp, Mus musculus
accagggctgccttttgcagtggca

SEQ ID NO: 111119 - DNA, 25 bp, Mus musculus
accagggcttgcctttacatccact

SEQ ID NO: 111120 - DNA, 25 bp, Mus musculus
accagggcttgcgtttacatccact

SEQ ID NO: 111121 - DNA, 25 bp, Mus musculus
accagggcttggacttggctgtgtt

SEQ ID NO: 111122 - DNA, 25 bp, Mus musculus
accagggcttggtcttggctgtgtt

SEQ ID NO: 111123 - DNA, 25 bp, Mus musculus
accagggctttgaggctgtctacca

SEQ ID NO: 111124 - DNA, 25 bp, Mus musculus
accagggctttgtggctgtctacca

SEQ ID NO: 111125 - DNA, 25 bp, Mus musculus
accagggtagaaacaacagtctttt

SEQ ID NO: 111126 - DNA, 25 bp, Mus musculus
accagggtagaatcaacagtctttt

SEQ ID NO: 111127 - DNA, 25 bp, Mus musculus
accagggtagggatactctccagat

SEQ ID NO: 111128 - DNA, 25 bp, Mus musculus
accagggtagggttactctccagat

SEQ ID NO: 111129 - DNA, 25 bp, Mus musculus
accagggtcattcaggcctctcaag

SEQ ID NO: 111130 - DNA, 25 bp, Mus musculus
accagggtcattgaggcctctcaag

SEQ ID NO: 111131 - DNA, 25 bp, Mus musculus
accagggtctcccagtacatagact

SEQ ID NO: 111132 - DNA, 25 bp, Mus musculus
accagggtctccgagtacatagact

SEQ ID NO: 111133 - DNA, 25 bp, Mus musculus
accagggtctgcacaagctagctag

SEQ ID NO: 111134 - DNA, 25 bp, Mus musculus
accagggtctgctcaagctagctag

SEQ ID NO: 111135 - DNA, 25 bp, Mus musculus
accagggtctggacacctcgaggga

SEQ ID NO: 111136 - DNA, 25 bp, Mus musculus
accagggtctggtcacctcgaggga

SEQ ID NO: 111137 - DNA, 25 bp, Mus musculus
accagggttcatagtctgccatatg

SEQ ID NO: 111138 - DNA, 25 bp, Mus musculus
accagggttcattgtctgccatatg

SEQ ID NO: 111139 - DNA, 25 bp, Mus musculus
accagggttcggcatcaattccaga

SEQ ID NO: 111140 - DNA, 25 bp, Mus musculus
accagggttcgggatcaattccaga

SEQ ID NO: 111141 - DNA, 25 bp, Mus musculus
accaggtaccgccatgccgaagtgc

SEQ ID NO: 111142 - DNA, 25 bp, Mus musculus
accaggtaccgcgatgccgaagtgc

SEQ ID NO: 111143 - DNA, 25 bp, Mus musculus
accaggtagaatatgcacagtgtca

SEQ ID NO: 111144 - DNA, 25 bp, Mus musculus
accaggtagaatttgcacagtgtca

SEQ ID NO: 111145 - DNA, 25 bp, Mus musculus
accaggtagacaaccccatggagaa

SEQ ID NO: 111146 - DNA, 25 bp, Mus musculus
accaggtagacatccccatggagaa

SEQ ID NO: 111147 - DNA, 25 bp, Mus musculus
accaggtatccacgttagatcctaa

SEQ ID NO: 111148 - DNA, 25 bp, Mus musculus
accaggtatccaggttagatcctaa

SEQ ID NO: 111149 - DNA, 25 bp, Mus musculus
accaggtatgtactccttatgcttt

SEQ ID NO: 111150 - DNA, 25 bp, Mus musculus
accaggtatgtagtccttatgcttt

SEQ ID NO: 111151 - DNA, 25 bp, Mus musculus
accaggtattccaaacaattcttat

SEQ ID NO: 111152 - DNA, 25 bp, Mus musculus
accaggtattcctaacaattcttat

SEQ ID NO: 111153 - DNA, 25 bp, Mus musculus
accaggtattctacctaacagtatg

SEQ ID NO: 111154 - DNA, 25 bp, Mus musculus
accaggtattcttcctaacagtatg

SEQ ID NO: 111155 - DNA, 25 bp, Mus musculus
accaggtcaacacggacttgggctt

SEQ ID NO: 111156 - DNA, 25 bp, Mus musculus
accaggtcaacagggacttgggctt

SEQ ID NO: 111157 - DNA, 25 bp, Mus musculus
accaggtcaagtacaacgtctttca

SEQ ID NO: 111158 - DNA, 25 bp, Mus musculus
accaggtcaagttcaacgtctttca

SEQ ID NO: 111159 - DNA, 25 bp, Mus musculus
accaggtcatccactggttctggaa

SEQ ID NO: 111160 - DNA, 25 bp, Mus musculus
accaggtcatcctctggttctggaa

SEQ ID NO: 111161 - DNA, 25 bp, Mus musculus
accaggtcatggagtctgagggcat

SEQ ID NO: 111162 - DNA, 25 bp, Mus musculus
accaggtcatggtgtctgagggcat

SEQ ID NO: 111163 - DNA, 25 bp, Mus musculus
accaggtccctccatggtccaataa

SEQ ID NO: 111164 - DNA, 25 bp, Mus musculus
accaggtccctcgatggtccaataa

SEQ ID NO: 111165 - DNA, 25 bp, Mus musculus
accaggtccctgacaagaccaaagg

SEQ ID NO: 111166 - DNA, 25 bp, Mus musculus
accaggtccctgcaaatcatgagga

SEQ ID NO: 111167 - DNA, 25 bp, Mus musculus
accaggtccctggaaatcatgagga

SEQ ID NO: 111168 - DNA, 25 bp, Mus musculus
accaggtccctgtcaagaccaaagg

SEQ ID NO: 111169 - DNA, 25 bp, Mus musculus
accaggtcctcaccttgctaatgct

SEQ ID NO: 111170 - DNA, 25 bp, Mus musculus
accaggtcctcagcttgctaatgct

SEQ ID NO: 111171 - DNA, 25 bp, Mus musculus
accaggtcctgtctagggttgcttg

SEQ ID NO: 111172 - DNA, 25 bp, Mus musculus
accaggtcctgtgtagggttgcttg

SEQ ID NO: 111173 - DNA, 25 bp, Mus musculus
accaggtccttgagcatgttcgtaa

SEQ ID NO: 111174 - DNA, 25 bp, Mus musculus
accaggtccttgtgcatgttcgtaa

SEQ ID NO: 111175 - DNA, 25 bp, Mus musculus
accaggtcggcgatactagacgagc

SEQ ID NO: 111176 - DNA, 25 bp, Mus musculus
accaggtcggcgttactagacgagc

SEQ ID NO: 111177 - DNA, 25 bp, Mus musculus
accaggtctaggctgcctggcagca

SEQ ID NO: 111178 - DNA, 25 bp, Mus musculus
accaggtctagggtgcctggcagca

SEQ ID NO: 111179 - DNA, 25 bp, Mus musculus
accaggtgactcaggcggtagcgaa

SEQ ID NO: 111180 - DNA, 25 bp, Mus musculus
accaggtgactctggcggtagcgaa

SEQ ID NO: 111181 - DNA, 25 bp, Mus musculus
accaggtgccacagaaggtgctgct

SEQ ID NO: 111182 - DNA, 25 bp, Mus musculus
accaggtgccactgaaggtgctgct

SEQ ID NO: 111183 - DNA, 25 bp, Mus musculus
accaggtgccctctggatctgtcag

SEQ ID NO: 111184 - DNA, 25 bp, Mus musculus
accaggtgccctgtggatctgtcag

SEQ ID NO: 111185 - DNA, 25 bp, Mus musculus
accaggtgccttacaaatttagaag

SEQ ID NO: 111186 - DNA, 25 bp, Mus musculus
accaggtgcctttcaaatttagaag

SEQ ID NO: 111187 - DNA, 25 bp, Mus musculus
accaggtggaacaggacctggcaga

SEQ ID NO: 111188 - DNA, 25 bp, Mus musculus
accaggtggaactggacctggcaga

SEQ ID NO: 111189 - DNA, 25 bp, Mus musculus
accaggtggataagagtgcagcggc

SEQ ID NO: 111190 - DNA, 25 bp, Mus musculus
accaggtggatatgagtgcagcggc

SEQ ID NO: 111191 - DNA, 25 bp, Mus musculus
accaggtggcctactcttggttact

SEQ ID NO: 111192 - DNA, 25 bp, Mus musculus
accaggtggccttctcttggttact

SEQ ID NO: 111193 - DNA, 25 bp, Mus musculus
accaggtgggagatctggctgtcac

SEQ ID NO: 111194 - DNA, 25 bp, Mus musculus
accaggtgggagttctggctgtcac

SEQ ID NO: 111195 - DNA, 25 bp, Mus musculus
accaggtgtcatattgtccacattg

SEQ ID NO: 111196 - DNA, 25 bp, Mus musculus
accaggtgtcattttgtccacattg

SEQ ID NO: 111197 - DNA, 25 bp, Mus musculus
accaggtgtgccagagatgcagttt

SEQ ID NO: 111198 - DNA, 25 bp, Mus musculus
accaggtgtgcccacaagtgttcaa

SEQ ID NO: 111199 - DNA, 25 bp, Mus musculus
accaggtgtgccgacaagtgttcaa

SEQ ID NO: 111200 - DNA, 25 bp, Mus musculus
accaggtgtgcctgagatgcagttt

SEQ ID NO: 111201 - DNA, 25 bp, Mus musculus
accaggtgttttcagctgtgtccaa

SEQ ID NO: 111202 - DNA, 25 bp, Mus musculus
accaggtgttttgagctgtgtccaa

SEQ ID NO: 111203 - DNA, 25 bp, Mus musculus
accaggttcactctgggaactttga

SEQ ID NO: 111204 - DNA, 25 bp, Mus musculus
accaggttcactgtgggaactttga

SEQ ID NO: 111205 - DNA, 25 bp, Mus musculus
accaggttctcaactcgggtaatac

SEQ ID NO: 111206 - DNA, 25 bp, Mus musculus
accaggttctcatctcgggtaatac

SEQ ID NO: 111207 - DNA, 25 bp, Mus musculus
accaggttctgtcattgatgccaca

SEQ ID NO: 111208 - DNA, 25 bp, Mus musculus
accaggttctgtgattgatgccaca

SEQ ID NO: 111209 - DNA, 25 bp, Mus musculus
accaggttcttcacaggctacataa

SEQ ID NO: 111210 - DNA, 25 bp, Mus musculus
accaggttcttctcaggctacataa

SEQ ID NO: 111211 - DNA, 25 bp, Mus musculus
accaggttcttgatgtgtattagca

SEQ ID NO: 111212 - DNA, 25 bp, Mus musculus
accaggttcttgttgtgtattagca

SEQ ID NO: 111213 - DNA, 25 bp, Mus musculus
accaggttgagcatccttaatccaa

SEQ ID NO: 111214 - DNA, 25 bp, Mus musculus
accaggttgagcttccttaatccaa

SEQ ID NO: 111215 - DNA, 25 bp, Mus musculus
accaggttggttcacactgttcatt

SEQ ID NO: 111216 - DNA, 25 bp, Mus musculus
accaggttggttgacactgttcatt

SEQ ID NO: 111217 - DNA, 25 bp, Mus musculus
accaggttgtagagctgaattccaa

SEQ ID NO: 111218 - DNA, 25 bp, Mus musculus
accaggttgtagtgctgaattccaa

SEQ ID NO: 111219 - DNA, 25 bp, Mus musculus
accaggttgtctcctgcgacttcaa

SEQ ID NO: 111220 - DNA, 25 bp, Mus musculus
accaggttgtctgctgcgacttcaa

SEQ ID NO: 111221 - DNA, 25 bp, Mus musculus
accaggttgttgatgctgatactca

SEQ ID NO: 111222 - DNA, 25 bp, Mus musculus
accaggttgttgttgctgatactca

SEQ ID NO: 111223 - DNA, 25 bp, Mus musculus
accaggtttcaacggctacagggat

SEQ ID NO: 111224 - DNA, 25 bp, Mus musculus
accaggtttcaagggctacagggat

SEQ ID NO: 111225 - DNA, 25 bp, Mus musculus
accaggtttgggaaatctcttctca

SEQ ID NO: 111226 - DNA, 25 bp, Mus musculus
accaggtttgggtaatctcttctca

SEQ ID NO: 111227 - DNA, 25 bp, Mus musculus
accagtaaccccacaatggcagata

SEQ ID NO: 111228 - DNA, 25 bp, Mus musculus
accagtaacccctcaatggcagata

SEQ ID NO: 111229 - DNA, 25 bp, Mus musculus
accagtaactccatttccaaggcat

SEQ ID NO: 111230 - DNA, 25 bp, Mus musculus
accagtaactccttttccaaggcat

SEQ ID NO: 111231 - DNA, 25 bp, Mus musculus
accagtaagccaccttcagttaaat

SEQ ID NO: 111232 - DNA, 25 bp, Mus musculus
accagtaagccagcttcagttaaat

SEQ ID NO: 111233 - DNA, 25 bp, Mus musculus
accagtaagtatacgggctcccaca

SEQ ID NO: 111234 - DNA, 25 bp, Mus musculus
accagtaagtattcgggctcccaca

SEQ ID NO: 111235 - DNA, 25 bp, Mus musculus
accagtaagtgaaaacacccatcca

SEQ ID NO: 111236 - DNA, 25 bp, Mus musculus
accagtaagtgataacacccatcca

SEQ ID NO: 111237 - DNA, 25 bp, Mus musculus
accagtaagttgatccatccagatg

SEQ ID NO: 111238 - DNA, 25 bp, Mus musculus
accagtaagttgttccatccagatg

SEQ ID NO: 111239 - DNA, 25 bp, Mus musculus
accagtaattgcacccatctaggga

SEQ ID NO: 111240 - DNA, 25 bp, Mus musculus
accagtaattgctcccatctaggga

SEQ ID NO: 111241 - DNA, 25 bp, Mus musculus
accagtaccactcagtcttgtgcag

SEQ ID NO: 111242 - DNA, 25 bp, Mus musculus
accagtaccactgagtcttgtgcag

SEQ ID NO: 111243 - DNA, 25 bp, Mus musculus
accagtacccctacacaggaatcag

SEQ ID NO: 111244 - DNA, 25 bp, Mus musculus
accagtaccccttcacaggaatcag

SEQ ID NO: 111245 - DNA, 25 bp, Mus musculus
accagtacctggaggccaccgggag

SEQ ID NO: 111246 - DNA, 25 bp, Mus musculus
accagtacctggtggccaccgggag

SEQ ID NO: 111247 - DNA, 25 bp, Mus musculus
accagtactaggctcaatttctgta

SEQ ID NO: 111248 - DNA, 25 bp, Mus musculus
accagtactagggtcaatttctgta

SEQ ID NO: 111249 - DNA, 25 bp, Mus musculus
accagtactgacattcacttcctag

SEQ ID NO: 111250 - DNA, 25 bp, Mus musculus
accagtactgactttcacttcctag

SEQ ID NO: 111251 - DNA, 25 bp, Mus musculus
accagtacttccagagacgtggaga

SEQ ID NO: 111252 - DNA, 25 bp, Mus musculus
accagtacttcctgagacgtggaga

SEQ ID NO: 111253 - DNA, 25 bp, Mus musculus
accagtagcctcagtgtgtgcgtaa

SEQ ID NO: 111254 - DNA, 25 bp, Mus musculus
accagtagcctctgtgtgtgcgtaa

SEQ ID NO: 111255 - DNA, 25 bp, Mus musculus
accagtaggtgtcaggccagcatct

SEQ ID NO: 111256 - DNA, 25 bp, Mus musculus
accagtaggtgtgaggccagcatct

SEQ ID NO: 111257 - DNA, 25 bp, Mus musculus
accagtagtcttcgcactagctgaa

SEQ ID NO: 111258 - DNA, 25 bp, Mus musculus
accagtagtcttggcactagctgaa

SEQ ID NO: 111259 - DNA, 25 bp, Mus musculus
accagtatattgaccccgtggtata

SEQ ID NO: 111260 - DNA, 25 bp, Mus musculus
accagtatattgtccccgtggtata

SEQ ID NO: 111261 - DNA, 25 bp, Mus musculus
accagtatcagcctttgagtctcag

SEQ ID NO: 111262 - DNA, 25 bp, Mus musculus
accagtatcagcgtttgagtctcag

SEQ ID NO: 111263 - DNA, 25 bp, Mus musculus
accagtatctcaattgcagccggac

SEQ ID NO: 111264 - DNA, 25 bp, Mus musculus
accagtatctcatttgcagccggac

SEQ ID NO: 111265 - DNA, 25 bp, Mus musculus
accagtatctccagagctccttggg

SEQ ID NO: 111266 - DNA, 25 bp, Mus musculus
accagtatctcctgagctccttggg

SEQ ID NO: 111267 - DNA, 25 bp, Mus musculus
accagtatgcagatgcgtctatagg

SEQ ID NO: 111268 - DNA, 25 bp, Mus musculus
accagtatgcagttgcgtctatagg

SEQ ID NO: 111269 - DNA, 25 bp, Mus musculus
accagtatgttcagtacattttctg

SEQ ID NO: 111270 - DNA, 25 bp, Mus musculus
accagtatgttcattgcatttaatc

SEQ ID NO: 111271 - DNA, 25 bp, Mus musculus
accagtatgttctgtacattttctg

SEQ ID NO: 111272 - DNA, 25 bp, Mus musculus
accagtatgttctttgcatttaatc

SEQ ID NO: 111273 - DNA, 25 bp, Mus musculus
accagtcactggcaagaggcaaagc

SEQ ID NO: 111274 - DNA, 25 bp, Mus musculus
accagtcactgggaagaggcaaagc

SEQ ID NO: 111275 - DNA, 25 bp, Mus musculus
accagtcagcagagccataggccag

SEQ ID NO: 111276 - DNA, 25 bp, Mus musculus
accagtcagcagtgccataggccag

SEQ ID NO: 111277 - DNA, 25 bp, Mus musculus
accagtcagcttatttcagccatta

SEQ ID NO: 111278 - DNA, 25 bp, Mus musculus
accagtcagcttttttcagccatta

SEQ ID NO: 111279 - DNA, 25 bp, Mus musculus
accagtcatcatctacgtctctgaa

SEQ ID NO: 111280 - DNA, 25 bp, Mus musculus
accagtcatcatgtacgtctctgaa

SEQ ID NO: 111281 - DNA, 25 bp, Mus musculus
accagtcatggtatgtgcaacttgc

SEQ ID NO: 111282 - DNA, 25 bp, Mus musculus
accagtcatggtttgtgcaacttgc

SEQ ID NO: 111283 - DNA, 25 bp, Mus musculus
accagtccaaggctgctggaacaag

SEQ ID NO: 111284 - DNA, 25 bp, Mus musculus
accagtccaagggtgctggaacaag

SEQ ID NO: 111285 - DNA, 25 bp, Mus musculus
accagtccagagaggccggcgcgac

SEQ ID NO: 111286 - DNA, 25 bp, Mus musculus
accagtccagagtggccggcgcgac

SEQ ID NO: 111287 - DNA, 25 bp, Mus musculus
accagtccaggtcctgacacttgac

SEQ ID NO: 111288 - DNA, 25 bp, Mus musculus
accagtccaggtgctgacacttgac

SEQ ID NO: 111289 - DNA, 25 bp, Mus musculus
accagtccagttccagctactacta

SEQ ID NO: 111290 - DNA, 25 bp, Mus musculus
accagtccagttgcagctactacta

SEQ ID NO: 111291 - DNA, 25 bp, Mus musculus
accagtccatatatagttcaagatg

SEQ ID NO: 111292 - DNA, 25 bp, Mus musculus
accagtccatatttagttcaagatg

SEQ ID NO: 111293 - DNA, 25 bp, Mus musculus
accagtcccagcatagaataacatt

SEQ ID NO: 111294 - DNA, 25 bp, Mus musculus
accagtcccagcttagaataacatt

SEQ ID NO: 111295 - DNA, 25 bp, Mus musculus
accagtcccgaaatcaccattgaga

SEQ ID NO: 111296 - DNA, 25 bp, Mus musculus
accagtcccgaattcaccattgaga

SEQ ID NO: 111297 - DNA, 25 bp, Mus musculus
accagtccgccgagacgtagcgggc

SEQ ID NO: 111298 - DNA, 25 bp, Mus musculus
accagtccgccgtgacgtagcgggc

SEQ ID NO: 111299 - DNA, 25 bp, Mus musculus
accagtcctactaccttcaagatat

SEQ ID NO: 111300 - DNA, 25 bp, Mus musculus
accagtcctacttccttcaagatat

SEQ ID NO: 111301 - DNA, 25 bp, Mus musculus
accagtcctgcgaacgatgttcaac

SEQ ID NO: 111302 - DNA, 25 bp, Mus musculus
accagtcctgcgtacgatgttcaac

SEQ ID NO: 111303 - DNA, 25 bp, Mus musculus
accagtcctggtacacatgtgcaca

SEQ ID NO: 111304 - DNA, 25 bp, Mus musculus
accagtcctggttcacatgtgcaca

SEQ ID NO: 111305 - DNA, 25 bp, Mus musculus
accagtccttccaggactttctaag

SEQ ID NO: 111306 - DNA, 25 bp, Mus musculus
accagtccttcctggactttctaag

SEQ ID NO: 111307 - DNA, 25 bp, Mus musculus
accagtcgctatccagtgatgtcca

SEQ ID NO: 111308 - DNA, 25 bp, Mus musculus
accagtcgctatgcagtgatgtcca

SEQ ID NO: 111309 - DNA, 25 bp, Mus musculus
accagtcggccaccggatcagtgct

SEQ ID NO: 111310 - DNA, 25 bp, Mus musculus
accagtcggccagcggatcagtgct

SEQ ID NO: 111311 - DNA, 25 bp, Mus musculus
accagtctaacactgaagctctcct

SEQ ID NO: 111312 - DNA, 25 bp, Mus musculus
accagtctaacagtgaagctctcct

SEQ ID NO: 111313 - DNA, 25 bp, Mus musculus
accagtctcaggctttgggtgcaaa

SEQ ID NO: 111314 - DNA, 25 bp, Mus musculus
accagtctcagggtttgggtgcaaa

SEQ ID NO: 111315 - DNA, 25 bp, Mus musculus
accagtctccctctgatgctaagaa

SEQ ID NO: 111316 - DNA, 25 bp, Mus musculus
accagtctccctgtgatgctaagaa

SEQ ID NO: 111317 - DNA, 25 bp, Mus musculus
accagtctctagaaagttcctggca

SEQ ID NO: 111318 - DNA, 25 bp, Mus musculus
accagtctctagtaagttcctggca

SEQ ID NO: 111319 - DNA, 25 bp, Mus musculus
accagtctctggcaagtaaatctta

SEQ ID NO: 111320 - DNA, 25 bp, Mus musculus
accagtctctgggaagtaaatctta

SEQ ID NO: 111321 - DNA, 25 bp, Mus musculus
accagtctctttcaggtgactccta

SEQ ID NO: 111322 - DNA, 25 bp, Mus musculus
accagtctctttgaggtgactccta

SEQ ID NO: 111323 - DNA, 25 bp, Mus musculus
accagtctgcataaggctgcggaga

SEQ ID NO: 111324 - DNA, 25 bp, Mus musculus
accagtctgcattaggctgcggaga

SEQ ID NO: 111325 - DNA, 25 bp, Mus musculus
accagtctgtacagctaattctcta

SEQ ID NO: 111326 - DNA, 25 bp, Mus musculus
accagtctgtactgctaattctcta

SEQ ID NO: 111327 - DNA, 25 bp, Mus musculus
accagtctgtttccaacttttcatg

SEQ ID NO: 111328 - DNA, 25 bp, Mus musculus
accagtctgtttgcaacttttcatg

SEQ ID NO: 111329 - DNA, 25 bp, Mus musculus
accagtcttatgatcttaaccaaca

SEQ ID NO: 111330 - DNA, 25 bp, Mus musculus
accagtcttatgttcttaaccaaca

SEQ ID NO: 111331 - DNA, 25 bp, Mus musculus
accagtcttcaaaaggacgcagtaa

SEQ ID NO: 111332 - DNA, 25 bp, Mus musculus
accagtcttcaataggacgcagtaa

SEQ ID NO: 111333 - DNA, 25 bp, Mus musculus
accagtctttttcgtctgtgtgtct

SEQ ID NO: 111334 - DNA, 25 bp, Mus musculus
accagtctttttggtctgtgtgtct

SEQ ID NO: 111335 - DNA, 25 bp, Mus musculus
accagtgaatttccggttcatctcc

SEQ ID NO: 111336 - DNA, 25 bp, Mus musculus
accagtgaatttgcggttcatctcc

SEQ ID NO: 111337 - DNA, 25 bp, Mus musculus
accagtgaccaaaggctcccagcag

SEQ ID NO: 111338 - DNA, 25 bp, Mus musculus
accagtgaccaatggctcccagcag

SEQ ID NO: 111339 - DNA, 25 bp, Mus musculus
accagtgactaaaacctagaatcag

SEQ ID NO: 111340 - DNA, 25 bp, Mus musculus
accagtgactaatacctagaatcag

SEQ ID NO: 111341 - DNA, 25 bp, Mus musculus
accagtgactctccttcactttgaa

SEQ ID NO: 111342 - DNA, 25 bp, Mus musculus
accagtgactctgcttcactttgaa

SEQ ID NO: 111343 - DNA, 25 bp, Mus musculus
accagtgagattcactgcccacagg

SEQ ID NO: 111344 - DNA, 25 bp, Mus musculus
accagtgagattccatgtggacctg

SEQ ID NO: 111345 - DNA, 25 bp, Mus musculus
accagtgagattgactgcccacagg

SEQ ID NO: 111346 - DNA, 25 bp, Mus musculus
accagtgagattgcatgtggacctg

SEQ ID NO: 111347 - DNA, 25 bp, Mus musculus
accagtgaggagagtacttccagta

SEQ ID NO: 111348 - DNA, 25 bp, Mus musculus
accagtgaggagtgtacttccagta

SEQ ID NO: 111349 - DNA, 25 bp, Mus musculus
accagtgaggataactgatgttcac

SEQ ID NO: 111350 - DNA, 25 bp, Mus musculus
accagtgaggattactgatgttcac

SEQ ID NO: 111351 - DNA, 25 bp, Mus musculus
accagtgataacctcccagtgcgtg

SEQ ID NO: 111352 - DNA, 25 bp, Mus musculus
accagtgataacgtcccagtgcgtg

SEQ ID NO: 111353 - DNA, 25 bp, Mus musculus
accagtgcacagagaggtgttcttt

SEQ ID NO: 111354 - DNA, 25 bp, Mus musculus
accagtgcacagtgaggtgttcttt

SEQ ID NO: 111355 - DNA, 25 bp, Mus musculus
accagtgcaggtcatccaagtaaag

SEQ ID NO: 111356 - DNA, 25 bp, Mus musculus
accagtgcaggtgatccaagtaaag

SEQ ID NO: 111357 - DNA, 25 bp, Mus musculus
accagtgcattgatattgtccagtg

SEQ ID NO: 111358 - DNA, 25 bp, Mus musculus
accagtgcattgttattgtccagtg

SEQ ID NO: 111359 - DNA, 25 bp, Mus musculus
accagtgccacgatgggtcagctgt

SEQ ID NO: 111360 - DNA, 25 bp, Mus musculus
accagtgccacgttgggtcagctgt

SEQ ID NO: 111361 - DNA, 25 bp, Mus musculus
accagtgcccataggctgattggtg

SEQ ID NO: 111362 - DNA, 25 bp, Mus musculus
accagtgcccattggctgattggtg

SEQ ID NO: 111363 - DNA, 25 bp, Mus musculus
accagtgccgttatgtgtagtcaca

SEQ ID NO: 111364 - DNA, 25 bp, Mus musculus
accagtgccgttttgtgtagtcaca

SEQ ID NO: 111365 - DNA, 25 bp, Mus musculus
accagtgcctataggtatcataccc

SEQ ID NO: 111366 - DNA, 25 bp, Mus musculus
accagtgcctattggtatcataccc

SEQ ID NO: 111367 - DNA, 25 bp, Mus musculus
accagtgcggctcctttgacttcac

SEQ ID NO: 111368 - DNA, 25 bp, Mus musculus
accagtgcggctgctttgacttcac

SEQ ID NO: 111369 - DNA, 25 bp, Mus musculus
accagtgcttttcagttactattca

SEQ ID NO: 111370 - DNA, 25 bp, Mus musculus
accagtgcttttgagttactattca

SEQ ID NO: 111371 - DNA, 25 bp, Mus musculus
accagtggaagtcgccaatatgacc

SEQ ID NO: 111372 - DNA, 25 bp, Mus musculus
accagtggaagtggccaatatgacc

SEQ ID NO: 111373 - DNA, 25 bp, Mus musculus
accagtggaccactaatgtcctaga

SEQ ID NO: 111374 - DNA, 25 bp, Mus musculus
accagtggaccagtaatgtcctaga

SEQ ID NO: 111375 - DNA, 25 bp, Mus musculus
accagtggagaaccatcgttcgcaa

SEQ ID NO: 111376 - DNA, 25 bp, Mus musculus
accagtggagaagcatcgttcgcaa

SEQ ID NO: 111377 - DNA, 25 bp, Mus musculus
accagtggagggatcttagggctct

SEQ ID NO: 111378 - DNA, 25 bp, Mus musculus
accagtggagggttcttagggctct

SEQ ID NO: 111379 - DNA, 25 bp, Mus musculus
accagtggccacatatgcgtataaa

SEQ ID NO: 111380 - DNA, 25 bp, Mus musculus
accagtggccacttatgcgtataaa

SEQ ID NO: 111381 - DNA, 25 bp, Mus musculus
accagtggccatcctgttactagtc

SEQ ID NO: 111382 - DNA, 25 bp, Mus musculus
accagtggccatgctgttactagtc

SEQ ID NO: 111383 - DNA, 25 bp, Mus musculus
accagtggccgcagtgagcaacaaa

SEQ ID NO: 111384 - DNA, 25 bp, Mus musculus
accagtggccgctgtgagcaacaaa

SEQ ID NO: 111385 - DNA, 25 bp, Mus musculus
accagtggctaaagaggtcccgact

SEQ ID NO: 111386 - DNA, 25 bp, Mus musculus
accagtggctaatgaggtcccgact

SEQ ID NO: 111387 - DNA, 25 bp, Mus musculus
accagtggctcaccttatctattga

SEQ ID NO: 111388 - DNA, 25 bp, Mus musculus
accagtggctcagcttatctattga

SEQ ID NO: 111389 - DNA, 25 bp, Mus musculus
accagtgggaagattgatgtcctca

SEQ ID NO: 111390 - DNA, 25 bp, Mus musculus
accagtgggaagtttgatgtcctca

SEQ ID NO: 111391 - DNA, 25 bp, Mus musculus
accagtgggcgcacaggaatctaga

SEQ ID NO: 111392 - DNA, 25 bp, Mus musculus
accagtgggcgctcaggaatctaga

SEQ ID NO: 111393 - DNA, 25 bp, Mus musculus
accagtgggctgcaagacatcctcc

SEQ ID NO: 111394 - DNA, 25 bp, Mus musculus
accagtgggctggaagacatcctcc

SEQ ID NO: 111395 - DNA, 25 bp, Mus musculus
accagtggggttatagctgttcaat

SEQ ID NO: 111396 - DNA, 25 bp, Mus musculus
accagtggggttttagctgttcaat

SEQ ID NO: 111397 - DNA, 25 bp, Mus musculus
accagtgggtctacttccttggata

SEQ ID NO: 111398 - DNA, 25 bp, Mus musculus
accagtgggtcttcttccttggata

SEQ ID NO: 111399 - DNA, 25 bp, Mus musculus
accagtggtcgaaggcctggtcagt

SEQ ID NO: 111400 - DNA, 25 bp, Mus musculus
accagtggtcgatggcctggtcagt

SEQ ID NO: 111401 - DNA, 25 bp, Mus musculus
accagtggttgcaggatgctttcca

SEQ ID NO: 111402 - DNA, 25 bp, Mus musculus
accagtggttgctggatgctttcca

SEQ ID NO: 111403 - DNA, 25 bp, Mus musculus
accagtggttttcgcgagtgagaaa

SEQ ID NO: 111404 - DNA, 25 bp, Mus musculus
accagtggttttggcgagtgagaaa

SEQ ID NO: 111405 - DNA, 25 bp, Mus musculus
accagtgtactgaggaagctgtcta

SEQ ID NO: 111406 - DNA, 25 bp, Mus musculus
accagtgtactgtggaagctgtcta

SEQ ID NO: 111407 - DNA, 25 bp, Mus musculus
accagtgtagccaagagcctcggag

SEQ ID NO: 111408 - DNA, 25 bp, Mus musculus
accagtgtagcctagagcctcggag

SEQ ID NO: 111409 - DNA, 25 bp, Mus musculus
accagtgtagctaggtactgtattt

SEQ ID NO: 111410 - DNA, 25 bp, Mus musculus
accagtgtagcttggtactgtattt

SEQ ID NO: 111411 - DNA, 25 bp, Mus musculus
accagtgtattgctggcagctattg

SEQ ID NO: 111412 - DNA, 25 bp, Mus musculus
accagtgtattggtggcagctattg

SEQ ID NO: 111413 - DNA, 25 bp, Mus musculus
accagtgtctccattgtctgaagac

SEQ ID NO: 111414 - DNA, 25 bp, Mus musculus
accagtgtctcctttgtctgaagac

SEQ ID NO: 111415 - DNA, 25 bp, Mus musculus
accagtgtgactatttgactattcc

SEQ ID NO: 111416 - DNA, 25 bp, Mus musculus
accagtgtgactttttgactattcc

SEQ ID NO: 111417 - DNA, 25 bp, Mus musculus
accagtgtgatacccagaacttaca

SEQ ID NO: 111418 - DNA, 25 bp, Mus musculus
accagtgtgatagccagaacttaca

SEQ ID NO: 111419 - DNA, 25 bp, Mus musculus
accagtgtgcttcacctgggtctag

SEQ ID NO: 111420 - DNA, 25 bp, Mus musculus
accagtgtgcttgacctgggtctag

SEQ ID NO: 111421 - DNA, 25 bp, Mus musculus
accagtgtggataggcctgagtcct

SEQ ID NO: 111422 - DNA, 25 bp, Mus musculus
accagtgtggattggcctgagtcct

SEQ ID NO: 111423 - DNA, 25 bp, Mus musculus
accagtgtgggcacacttgtgagga

SEQ ID NO: 111424 - DNA, 25 bp, Mus musculus
accagtgtgggctcacttgtgagga

SEQ ID NO: 111425 - DNA, 25 bp, Mus musculus
accagtgtggtacctctggcttcat

SEQ ID NO: 111426 - DNA, 25 bp, Mus musculus
accagtgtggtagctctggcttcat

SEQ ID NO: 111427 - DNA, 25 bp, Mus musculus
accagtgtgtgaattacctttccta

SEQ ID NO: 111428 - DNA, 25 bp, Mus musculus
accagtgtgtgacagctcacctcct

SEQ ID NO: 111429 - DNA, 25 bp, Mus musculus
accagtgtgtgagagctcacctcct

SEQ ID NO: 111430 - DNA, 25 bp, Mus musculus
accagtgtgtgatttacctttccta

SEQ ID NO: 111431 - DNA, 25 bp, Mus musculus
accagtgtgttcattagccttgtgt

SEQ ID NO: 111432 - DNA, 25 bp, Mus musculus
accagtgtgttctttagccttgtgt

SEQ ID NO: 111433 - DNA, 25 bp, Mus musculus
accagtgttcacattgtcctcgaaa

SEQ ID NO: 111434 - DNA, 25 bp, Mus musculus
accagtgttcactttgtcctcgaaa

SEQ ID NO: 111435 - DNA, 25 bp, Mus musculus
accagtgttgggagccaggtgatcc

SEQ ID NO: 111436 - DNA, 25 bp, Mus musculus
accagtgttgggtgccaggtgatcc

SEQ ID NO: 111437 - DNA, 25 bp, Mus musculus
accagtgttttactatctaacctca

SEQ ID NO: 111438 - DNA, 25 bp, Mus musculus
accagtgttttagtatctaacctca

SEQ ID NO: 111439 - DNA, 25 bp, Mus musculus
accagttaacacctttgttccacat

SEQ ID NO: 111440 - DNA, 25 bp, Mus musculus
accagttaacacgtttgttccacat

SEQ ID NO: 111441 - DNA, 25 bp, Mus musculus
accagttaacagacaggccaacctt

SEQ ID NO: 111442 - DNA, 25 bp, Mus musculus
accagttaacagtcaggccaacctt

SEQ ID NO: 111443 - DNA, 25 bp, Mus musculus
accagttaaggacaaggaacacagt

SEQ ID NO: 111444 - DNA, 25 bp, Mus musculus
accagttaaggagaaggaacacagt

SEQ ID NO: 111445 - DNA, 25 bp, Mus musculus
accagttacctgaatgctcatctaa

SEQ ID NO: 111446 - DNA, 25 bp, Mus musculus
accagttacctgtatgctcatctaa

SEQ ID NO: 111447 - DNA, 25 bp, Mus musculus
accagttagagtagatatccagaga

SEQ ID NO: 111448 - DNA, 25 bp, Mus musculus
accagttagagttgatatccagaga

SEQ ID NO: 111449 - DNA, 25 bp, Mus musculus
accagttagcacagtttagggagac

SEQ ID NO: 111450 - DNA, 25 bp, Mus musculus
accagttagcactgtttagggagac

SEQ ID NO: 111451 - DNA, 25 bp, Mus musculus
accagttagcgcacctgcatgaaaa

SEQ ID NO: 111452 - DNA, 25 bp, Mus musculus
accagttagcgctcctgcatgaaaa

SEQ ID NO: 111453 - DNA, 25 bp, Mus musculus
accagttcaaggagcctcgggactg

SEQ ID NO: 111454 - DNA, 25 bp, Mus musculus
accagttcaaggtgcctcgggactg

SEQ ID NO: 111455 - DNA, 25 bp, Mus musculus
accagttccaacctccgctgtaaat

SEQ ID NO: 111456 - DNA, 25 bp, Mus musculus
accagttccaacgtccgctgtaaat

SEQ ID NO: 111457 - DNA, 25 bp, Mus musculus
accagttccgctacttgctggaaaa

SEQ ID NO: 111458 - DNA, 25 bp, Mus musculus
accagttccgcttcttgctggaaaa

SEQ ID NO: 111459 - DNA, 25 bp, Mus musculus
accagttcctatcgcttggagtcta

SEQ ID NO: 111460 - DNA, 25 bp, Mus musculus
accagttcctatggcttggagtcta

SEQ ID NO: 111461 - DNA, 25 bp, Mus musculus
accagttcctgtatcgatgtgagtt

SEQ ID NO: 111462 - DNA, 25 bp, Mus musculus
accagttcctgtttcgatgtgagtt

SEQ ID NO: 111463 - DNA, 25 bp, Mus musculus
accagttctcccctgagtttgtgga

SEQ ID NO: 111464 - DNA, 25 bp, Mus musculus
accagttctcccgtgagtttgtgga

SEQ ID NO: 111465 - DNA, 25 bp, Mus musculus
accagttctgcccaatgaagcttaa

SEQ ID NO: 111466 - DNA, 25 bp, Mus musculus
accagttctgccgaatgaagcttaa

SEQ ID NO: 111467 - DNA, 25 bp, Mus musculus
accagttctgtgaaacggtacctca

SEQ ID NO: 111468 - DNA, 25 bp, Mus musculus
accagttctgtgcacacaggtgaac

SEQ ID NO: 111469 - DNA, 25 bp, Mus musculus
accagttctgtggacacaggtgaac

SEQ ID NO: 111470 - DNA, 25 bp, Mus musculus
accagttctgtgtaacggtacctca

SEQ ID NO: 111471 - DNA, 25 bp, Mus musculus
accagttcttggatccatggcaaaa

SEQ ID NO: 111472 - DNA, 25 bp, Mus musculus
accagttcttggttccatggcaaaa

SEQ ID NO: 111473 - DNA, 25 bp, Mus musculus
accagttgacccatcacacagagtg

SEQ ID NO: 111474 - DNA, 25 bp, Mus musculus
accagttgacccttcacacagagtg

SEQ ID NO: 111475 - DNA, 25 bp, Mus musculus
accagttgagttccagatcctatac

SEQ ID NO: 111476 - DNA, 25 bp, Mus musculus
accagttgagttgcagatcctatac

SEQ ID NO: 111477 - DNA, 25 bp, Mus musculus
accagttgccatagctcattgctgt

SEQ ID NO: 111478 - DNA, 25 bp, Mus musculus
accagttgccattgctcattgctgt

SEQ ID NO: 111479 - DNA, 25 bp, Mus musculus
accagttgcctgagcgggagtagaa

SEQ ID NO: 111480 - DNA, 25 bp, Mus musculus
accagttgcctgtgcgggagtagaa

SEQ ID NO: 111481 - DNA, 25 bp, Mus musculus
accagttgctgtactttgtatatag

SEQ ID NO: 111482 - DNA, 25 bp, Mus musculus
accagttgctgttctttgtatatag

SEQ ID NO: 111483 - DNA, 25 bp, Mus musculus
accagttggactatttgcagtcaag

SEQ ID NO: 111484 - DNA, 25 bp, Mus musculus
accagttggactttttgcagtcaag

SEQ ID NO: 111485 - DNA, 25 bp, Mus musculus
accagttggtctatggagaggtctt

SEQ ID NO: 111486 - DNA, 25 bp, Mus musculus
accagttggtctttggagaggtctt

SEQ ID NO: 111487 - DNA, 25 bp, Mus musculus
accagttggtgcagggcccagatca

SEQ ID NO: 111488 - DNA, 25 bp, Mus musculus
accagttggtgctgggcccagatca

SEQ ID NO: 111489 - DNA, 25 bp, Mus musculus
accagttgtaggcaggcacgtgtcc

SEQ ID NO: 111490 - DNA, 25 bp, Mus musculus
accagttgtagggaggcacgtgtcc

SEQ ID NO: 111491 - DNA, 25 bp, Mus musculus
accagttgtctaaaccactgacctg

SEQ ID NO: 111492 - DNA, 25 bp, Mus musculus
accagttgtctataccactgacctg

SEQ ID NO: 111493 - DNA, 25 bp, Mus musculus
accagttgtggtcttacagccgggc

SEQ ID NO: 111494 - DNA, 25 bp, Mus musculus
accagttgtggtgttacagccgggc

SEQ ID NO: 111495 - DNA, 25 bp, Mus musculus
accagtttactgaagataagccaac

SEQ ID NO: 111496 - DNA, 25 bp, Mus musculus
accagtttactgtagataagccaac

SEQ ID NO: 111497 - DNA, 25 bp, Mus musculus
accagtttagtcaggactctacccg

SEQ ID NO: 111498 - DNA, 25 bp, Mus musculus
accagtttagtctggactctacccg

SEQ ID NO: 111499 - DNA, 25 bp, Mus musculus
accagtttcaagatgcgcttcacaa

SEQ ID NO: 111500 - DNA, 25 bp, Mus musculus
accagtttcaagttgcgcttcacaa

SEQ ID NO: 111501 - DNA, 25 bp, Mus musculus
accagtttcagtagggatagcagca

SEQ ID NO: 111502 - DNA, 25 bp, Mus musculus
accagtttcagttgggatagcagca

SEQ ID NO: 111503 - DNA, 25 bp, Mus musculus
accagtttcctaatcgagataatta

SEQ ID NO: 111504 - DNA, 25 bp, Mus musculus
accagtttcctattcgagataatta

SEQ ID NO: 111505 - DNA, 25 bp, Mus musculus
accagtttccttctggcggttgatc

SEQ ID NO: 111506 - DNA, 25 bp, Mus musculus
accagtttccttgtggcggttgatc

SEQ ID NO: 111507 - DNA, 25 bp, Mus musculus
accagtttctcaaagatttctacca

SEQ ID NO: 111508 - DNA, 25 bp, Mus musculus
accagtttctcatagatttctacca

SEQ ID NO: 111509 - DNA, 25 bp, Mus musculus
accagttttaggcattgcctgagct

SEQ ID NO: 111510 - DNA, 25 bp, Mus musculus
accagttttagggattgcctgagct

SEQ ID NO: 111511 - DNA, 25 bp, Mus musculus
accagttttcagaccatcattttac

SEQ ID NO: 111512 - DNA, 25 bp, Mus musculus
accagttttcagagggtctctcagg

SEQ ID NO: 111513 - DNA, 25 bp, Mus musculus
accagttttcagtccatcattttac

SEQ ID NO: 111514 - DNA, 25 bp, Mus musculus
accagttttcagtgggtctctcagg

SEQ ID NO: 111515 - DNA, 25 bp, Mus musculus
accataaatgagctcttgggctgtt

SEQ ID NO: 111516 - DNA, 25 bp, Mus musculus
accataaatgaggtcttgggctgtt

SEQ ID NO: 111517 - DNA, 25 bp, Mus musculus
accataacacctcgtgggcatcgag

SEQ ID NO: 111518 - DNA, 25 bp, Mus musculus
accataacacctggtgggcatcgag

SEQ ID NO: 111519 - DNA, 25 bp, Mus musculus
accataacagtccatttgataatag

SEQ ID NO: 111520 - DNA, 25 bp, Mus musculus
accataacagtcgatttgataatag

SEQ ID NO: 111521 - DNA, 25 bp, Mus musculus
accataacatacagtgactcatcaa

SEQ ID NO: 111522 - DNA, 25 bp, Mus musculus
accataacatactgtgactcatcaa

SEQ ID NO: 111523 - DNA, 25 bp, Mus musculus
accataacgagaatagcaattccca

SEQ ID NO: 111524 - DNA, 25 bp, Mus musculus
accataacgagattagcaattccca

SEQ ID NO: 111525 - DNA, 25 bp, Mus musculus
accataagcgaaatgccttctggca

SEQ ID NO: 111526 - DNA, 25 bp, Mus musculus
accataagcgaattgccttctggca

SEQ ID NO: 111527 - DNA, 25 bp, Mus musculus
accataaggagcatcgtaagcggtt

SEQ ID NO: 111528 - DNA, 25 bp, Mus musculus
accataaggagcttcgtaagcggtt

SEQ ID NO: 111529 - DNA, 25 bp, Mus musculus
accataagtcgtatgggccatgctc

SEQ ID NO: 111530 - DNA, 25 bp, Mus musculus
accataagtcgtttgggccatgctc

SEQ ID NO: 111531 - DNA, 25 bp, Mus musculus
accataatgagtctccaccgcggag

SEQ ID NO: 111532 - DNA, 25 bp, Mus musculus
accataatgagtgtccaccgcggag

SEQ ID NO: 111533 - DNA, 25 bp, Mus musculus
accataattggcagctgcttaccat

SEQ ID NO: 111534 - DNA, 25 bp, Mus musculus
accataattggctgctgcttaccat

SEQ ID NO: 111535 - DNA, 25 bp, Mus musculus
accatacagtagagcaccgtgcagt

SEQ ID NO: 111536 - DNA, 25 bp, Mus musculus
accatacagtagtgcaccgtgcagt

SEQ ID NO: 111537 - DNA, 25 bp, Mus musculus
accatacatcttcgaattctgtaag

SEQ ID NO: 111538 - DNA, 25 bp, Mus musculus
accatacatcttggaattctgtaag

SEQ ID NO: 111539 - DNA, 25 bp, Mus musculus
accataccacttattgttgccatga

SEQ ID NO: 111540 - DNA, 25 bp, Mus musculus
accataccactttttgttgccatga

SEQ ID NO: 111541 - DNA, 25 bp, Mus musculus
accatacccctgcaatattgcctga

SEQ ID NO: 111542 - DNA, 25 bp, Mus musculus
accatacccctggaatattgcctga

SEQ ID NO: 111543 - DNA, 25 bp, Mus musculus
accatacctagcatgttcctatttt

SEQ ID NO: 111544 - DNA, 25 bp, Mus musculus
accatacctagcttgttcctatttt

SEQ ID NO: 111545 - DNA, 25 bp, Mus musculus
accatactaggtccactggcgtgga

SEQ ID NO: 111546 - DNA, 25 bp, Mus musculus
accatactaggtgcactggcgtgga

SEQ ID NO: 111547 - DNA, 25 bp, Mus musculus
accatacttttcaagctccttaaat

SEQ ID NO: 111548 - DNA, 25 bp, Mus musculus
accatacttttctagctccttaaat

SEQ ID NO: 111549 - DNA, 25 bp, Mus musculus
accatagaagacagtgagcagtgct

SEQ ID NO: 111550 - DNA, 25 bp, Mus musculus
accatagaagactgtgagcagtgct

SEQ ID NO: 111551 - DNA, 25 bp, Mus musculus
accatagagtcgactgaaggtccag

SEQ ID NO: 111552 - DNA, 25 bp, Mus musculus
accatagagtcgtctgaaggtccag

SEQ ID NO: 111553 - DNA, 25 bp, Mus musculus
accatagattcacgtgatcctccat

SEQ ID NO: 111554 - DNA, 25 bp, Mus musculus
accatagattcaggtgatcctccat

SEQ ID NO: 111555 - DNA, 25 bp, Mus musculus
accatagcacatcatcagtgagcta

SEQ ID NO: 111556 - DNA, 25 bp, Mus musculus
accatagcacatgatcagtgagcta

SEQ ID NO: 111557 - DNA, 25 bp, Mus musculus
accatagcaggaaatttgtattgaa

SEQ ID NO: 111558 - DNA, 25 bp, Mus musculus
accatagcaggatatttgtattgaa

SEQ ID NO: 111559 - DNA, 25 bp, Mus musculus
accataggattcatgatttctgata

SEQ ID NO: 111560 - DNA, 25 bp, Mus musculus
accataggattcttgatttctgata

SEQ ID NO: 111561 - DNA, 25 bp, Mus musculus
accatagtacacaagagggttgcta

SEQ ID NO: 111562 - DNA, 25 bp, Mus musculus
accatagtacactagagggttgcta

SEQ ID NO: 111563 - DNA, 25 bp, Mus musculus
accatagtattaacaggatccggag

SEQ ID NO: 111564 - DNA, 25 bp, Mus musculus
accatagtattatcaggatccggag

SEQ ID NO: 111565 - DNA, 25 bp, Mus musculus
accatagtccgtccgtccggaggta

SEQ ID NO: 111566 - DNA, 25 bp, Mus musculus
accatagtccgtgcgtccggaggta

SEQ ID NO: 111567 - DNA, 25 bp, Mus musculus
accatagtgggcactttgagaccca

SEQ ID NO: 111568 - DNA, 25 bp, Mus musculus
accatagtgggctctttgagaccca

SEQ ID NO: 111569 - DNA, 25 bp, Mus musculus
accatagttcttagcttgcatgtgt

SEQ ID NO: 111570 - DNA, 25 bp, Mus musculus
accatagttctttgcttgcatgtgt

SEQ ID NO: 111571 - DNA, 25 bp, Mus musculus
accatatagcgcattatactcattc

SEQ ID NO: 111572 - DNA, 25 bp, Mus musculus
accatatagcgctttatactcattc

SEQ ID NO: 111573 - DNA, 25 bp, Mus musculus
accatatagttgacattgctgaata

SEQ ID NO: 111574 - DNA, 25 bp, Mus musculus
accatatagttgtcattgctgaata

SEQ ID NO: 111575 - DNA, 25 bp, Mus musculus
accatatatttaagctctgttttgg

SEQ ID NO: 111576 - DNA, 25 bp, Mus musculus
accatatatttatgctctgttttgg

SEQ ID NO: 111577 - DNA, 25 bp, Mus musculus
accatatccttacccgacatatcaa

SEQ ID NO: 111578 - DNA, 25 bp, Mus musculus
accatatccttagccgacatatcaa

SEQ ID NO: 111579 - DNA, 25 bp, Mus musculus
accatatgtcttatctcagtgctaa

SEQ ID NO: 111580 - DNA, 25 bp, Mus musculus
accatatgtcttttctcagtgctaa

SEQ ID NO: 111581 - DNA, 25 bp, Mus musculus
accatatgtgatatgtcttgtctat

SEQ ID NO: 111582 - DNA, 25 bp, Mus musculus
accatatgtgatttgtcttgtctat

SEQ ID NO: 111583 - DNA, 25 bp, Mus musculus
accatattaaagctttgtacagtgt

SEQ ID NO: 111584 - DNA, 25 bp, Mus musculus
accatattaaaggtttgtacagtgt

SEQ ID NO: 111585 - DNA, 25 bp, Mus musculus
accatattcagacagctggcagctc

SEQ ID NO: 111586 - DNA, 25 bp, Mus musculus
accatattcagagagctggcagctc

SEQ ID NO: 111587 - DNA, 25 bp, Mus musculus
accatattccctcctgtctttttta

SEQ ID NO: 111588 - DNA, 25 bp, Mus musculus
accatattccctgctgtctttttta

SEQ ID NO: 111589 - DNA, 25 bp, Mus musculus
accatattcctaattttctaccttg

SEQ ID NO: 111590 - DNA, 25 bp, Mus musculus
accatattcctatttttctaccttg

SEQ ID NO: 111591 - DNA, 25 bp, Mus musculus
accatattcgtgctcatcatagacc

SEQ ID NO: 111592 - DNA, 25 bp, Mus musculus
accatattcgtggtcatcatagacc

SEQ ID NO: 111593 - DNA, 25 bp, Mus musculus
accatattctagagcgcctggacgc

SEQ ID NO: 111594 - DNA, 25 bp, Mus musculus
accatattctagtgcgcctggacgc

SEQ ID NO: 111595 - DNA, 25 bp, Mus musculus
accatatttattcctcaatgctgag

SEQ ID NO: 111596 - DNA, 25 bp, Mus musculus
accatatttattgctcaatgctgag

SEQ ID NO: 111597 - DNA, 25 bp, Mus musculus
accatcaacaaaaacgccttcatca

SEQ ID NO: 111598 - DNA, 25 bp, Mus musculus
accatcaacaaatacgccttcatca

SEQ ID NO: 111599 - DNA, 25 bp, Mus musculus
accatcaaggttatgttgcagggcc

SEQ ID NO: 111600 - DNA, 25 bp, Mus musculus
accatcaaggttttgttgcagggcc

SEQ ID NO: 111601 - DNA, 25 bp, Mus musculus
accatcaagtgtcggcgtctgcaga

SEQ ID NO: 111602 - DNA, 25 bp, Mus musculus
accatcaagtgtgggcgtctgcaga

SEQ ID NO: 111603 - DNA, 25 bp, Mus musculus
accatcacatctcggtcaccatggg

SEQ ID NO: 111604 - DNA, 25 bp, Mus musculus
accatcacatctgggtcaccatggg

SEQ ID NO: 111605 - DNA, 25 bp, Mus musculus
accatcaccacgctgagatgctgat

SEQ ID NO: 111606 - DNA, 25 bp, Mus musculus
accatcaccacggtgagatgctgat

SEQ ID NO: 111607 - DNA, 25 bp, Mus musculus
accatcaccagtatcaagtcttcaa

SEQ ID NO: 111608 - DNA, 25 bp, Mus musculus
accatcaccagtttcaagtcttcaa

SEQ ID NO: 111609 - DNA, 25 bp, Mus musculus
accatcacccggcatgttttggatt

SEQ ID NO: 111610 - DNA, 25 bp, Mus musculus
accatcacccgggatgttttggatt

SEQ ID NO: 111611 - DNA, 25 bp, Mus musculus
accatcacctgcagctttatgaaga

SEQ ID NO: 111612 - DNA, 25 bp, Mus musculus
accatcacctgctgctttatgaaga

SEQ ID NO: 111613 - DNA, 25 bp, Mus musculus
accatcactagtacttctgagctca

SEQ ID NO: 111614 - DNA, 25 bp, Mus musculus
accatcactagttcttctgagctca

SEQ ID NO: 111615 - DNA, 25 bp, Mus musculus
accatcactctgctgttgatctgta

SEQ ID NO: 111616 - DNA, 25 bp, Mus musculus
accatcactctggtgttgatctgta

SEQ ID NO: 111617 - DNA, 25 bp, Mus musculus
accatcactggaagcggaaaatcga

SEQ ID NO: 111618 - DNA, 25 bp, Mus musculus
accatcactggatgcggaaaatcga

SEQ ID NO: 111619 - DNA, 25 bp, Mus musculus
accatcagaggcacagcactacagt

SEQ ID NO: 111620 - DNA, 25 bp, Mus musculus
accatcagaggctcagcactacagt

SEQ ID NO: 111621 - DNA, 25 bp, Mus musculus
accatcagagtaactgccttgcctg

SEQ ID NO: 111622 - DNA, 25 bp, Mus musculus
accatcagagtatctgccttgcctg

SEQ ID NO: 111623 - DNA, 25 bp, Mus musculus
accatcagcaatctgcagtctgagg

SEQ ID NO: 111624 - DNA, 25 bp, Mus musculus
accatcagcaatgtgcagtctgagg

SEQ ID NO: 111625 - DNA, 25 bp, Mus musculus
accatcagcacaaaattctttggga

SEQ ID NO: 111626 - DNA, 25 bp, Mus musculus
accatcagcacataattctttggga

SEQ ID NO: 111627 - DNA, 25 bp, Mus musculus
accatcagcagcctggagtatgaag

SEQ ID NO: 111628 - DNA, 25 bp, Mus musculus
accatcagcagcgtggagtatgaag

SEQ ID NO: 111629 - DNA, 25 bp, Mus musculus
accatcagtgatcctgacctgggct

SEQ ID NO: 111630 - DNA, 25 bp, Mus musculus
accatcagtgatgctgacctgggct

SEQ ID NO: 111631 - DNA, 25 bp, Mus musculus
accatcagtggtatcttctagttga

SEQ ID NO: 111632 - DNA, 25 bp, Mus musculus
accatcagtggtttcttctagttga

SEQ ID NO: 111633 - DNA, 25 bp, Mus musculus
accatcagttagagagtcagcttca

SEQ ID NO: 111634 - DNA, 25 bp, Mus musculus
accatcagttagtgagtcagcttca

SEQ ID NO: 111635 - DNA, 25 bp, Mus musculus
accatcagtttcaaccctattgaca

SEQ ID NO: 111636 - DNA, 25 bp, Mus musculus
accatcagtttctaccctattgaca

SEQ ID NO: 111637 - DNA, 25 bp, Mus musculus
accatcatatgcagggagtttccca

SEQ ID NO: 111638 - DNA, 25 bp, Mus musculus
accatcatatgctgggagtttccca

SEQ ID NO: 111639 - DNA, 25 bp, Mus musculus
accatcatcaggcatttctataacc

SEQ ID NO: 111640 - DNA, 25 bp, Mus musculus
accatcatcagggatttctataacc

SEQ ID NO: 111641 - DNA, 25 bp, Mus musculus
accatcatccataattttgtctcag

SEQ ID NO: 111642 - DNA, 25 bp, Mus musculus
accatcatccattattttgtctcag

SEQ ID NO: 111643 - DNA, 25 bp, Mus musculus
accatcatgacccagtaaatcctac

SEQ ID NO: 111644 - DNA, 25 bp, Mus musculus
accatcatgaccgagtaaatcctac

SEQ ID NO: 111645 - DNA, 25 bp, Mus musculus
accatcattccaagattgtagtgtt

SEQ ID NO: 111646 - DNA, 25 bp, Mus musculus
accatcattccatgattgtagtgtt

SEQ ID NO: 111647 - DNA, 25 bp, Mus musculus
accatcattttcagtatcccagagg

SEQ ID NO: 111648 - DNA, 25 bp, Mus musculus
accatcattttctgtatcccagagg

SEQ ID NO: 111649 - DNA, 25 bp, Mus musculus
accatccaccttctagagtagctta

SEQ ID NO: 111650 - DNA, 25 bp, Mus musculus
accatccaccttgtagagtagctta

SEQ ID NO: 111651 - DNA, 25 bp, Mus musculus
accatccagataaaattgtggtgct

SEQ ID NO: 111652 - DNA, 25 bp, Mus musculus
accatccagatataattgtggtgct

SEQ ID NO: 111653 - DNA, 25 bp, Mus musculus
accatccagccgcttaagagggatt

SEQ ID NO: 111654 - DNA, 25 bp, Mus musculus
accatccagccggttaagagggatt

SEQ ID NO: 111655 - DNA, 25 bp, Mus musculus
accatccaggaacacacatctctaa

SEQ ID NO: 111656 - DNA, 25 bp, Mus musculus
accatccaggaagacacatctctaa

SEQ ID NO: 111657 - DNA, 25 bp, Mus musculus
accatccaggatcccctgagaatga

SEQ ID NO: 111658 - DNA, 25 bp, Mus musculus
accatccaggatgccctgagaatga

SEQ ID NO: 111659 - DNA, 25 bp, Mus musculus
accatccatacaagggagatattta

SEQ ID NO: 111660 - DNA, 25 bp, Mus musculus
accatccatacatgggagatattta

SEQ ID NO: 111661 - DNA, 25 bp, Mus musculus
accatccatccaaaaatccttgttg

SEQ ID NO: 111662 - DNA, 25 bp, Mus musculus
accatccatccataaatccttgttg

SEQ ID NO: 111663 - DNA, 25 bp, Mus musculus
accatccatgacagagtttctctgc

SEQ ID NO: 111664 - DNA, 25 bp, Mus musculus
accatccatgactgagtttctctgc

SEQ ID NO: 111665 - DNA, 25 bp, Mus musculus
accatccatggacattccctggcag

SEQ ID NO: 111666 - DNA, 25 bp, Mus musculus
accatccatggagattccctggcag

SEQ ID NO: 111667 - DNA, 25 bp, Mus musculus
accatccatgtactgtgaggccaag

SEQ ID NO: 111668 - DNA, 25 bp, Mus musculus
accatccatgtagtgtgaggccaag

SEQ ID NO: 111669 - DNA, 25 bp, Mus musculus
accatcccacctctgtacaatgata

SEQ ID NO: 111670 - DNA, 25 bp, Mus musculus
accatcccacctgtgtacaatgata

SEQ ID NO: 111671 - DNA, 25 bp, Mus musculus
accatcccaggtatagtgagctgaa

SEQ ID NO: 111672 - DNA, 25 bp, Mus musculus
accatcccaggtttagtgagctgaa

SEQ ID NO: 111673 - DNA, 25 bp, Mus musculus
accatcccatggactactactggtg

SEQ ID NO: 111674 - DNA, 25 bp, Mus musculus
accatcccatggtctactactggtg

SEQ ID NO: 111675 - DNA, 25 bp, Mus musculus
accatccccatgctataacagaatc

SEQ ID NO: 111676 - DNA, 25 bp, Mus musculus
accatccccatggtataacagaatc

SEQ ID NO: 111677 - DNA, 25 bp, Mus musculus
accatccccggacagatcagcgagg

SEQ ID NO: 111678 - DNA, 25 bp, Mus musculus
accatccccggagagatcagcgagg

SEQ ID NO: 111679 - DNA, 25 bp, Mus musculus
accatcccgaccattgggtttaatg

SEQ ID NO: 111680 - DNA, 25 bp, Mus musculus
accatcccgacctttgggtttaatg

SEQ ID NO: 111681 - DNA, 25 bp, Mus musculus
accatccctatgacgccaaagatgt

SEQ ID NO: 111682 - DNA, 25 bp, Mus musculus
accatccctatgtcgccaaagatgt

SEQ ID NO: 111683 - DNA, 25 bp, Mus musculus
accatcccttggatggactgcttag

SEQ ID NO: 111684 - DNA, 25 bp, Mus musculus
accatcccttggttggactgcttag

SEQ ID NO: 111685 - DNA, 25 bp, Mus musculus
accatccgacttcagtagctgcaaa

SEQ ID NO: 111686 - DNA, 25 bp, Mus musculus
accatccgacttgagtagctgcaaa

SEQ ID NO: 111687 - DNA, 25 bp, Mus musculus
accatccgcgatatctttgggttta

SEQ ID NO: 111688 - DNA, 25 bp, Mus musculus
accatccgcgatttctttgggttta

SEQ ID NO: 111689 - DNA, 25 bp, Mus musculus
accatccggaagattttagtgatgc

SEQ ID NO: 111690 - DNA, 25 bp, Mus musculus
accatccggaagtttttagtgatgc

SEQ ID NO: 111691 - DNA, 25 bp, Mus musculus
accatccgtatgagcttcgtcaaag

SEQ ID NO: 111692 - DNA, 25 bp, Mus musculus
accatccgtatgtgcttcgtcaaag

SEQ ID NO: 111693 - DNA, 25 bp, Mus musculus
accatcctaccaagaagcctctaag

SEQ ID NO: 111694 - DNA, 25 bp, Mus musculus
accatcctaccaagttcctgctttt

SEQ ID NO: 111695 - DNA, 25 bp, Mus musculus
accatcctaccatgaagcctctaag

SEQ ID NO: 111696 - DNA, 25 bp, Mus musculus
accatcctaccatgttcctgctttt

SEQ ID NO: 111697 - DNA, 25 bp, Mus musculus
accatcctcgacagaaagaccacaa

SEQ ID NO: 111698 - DNA, 25 bp, Mus musculus
accatcctcgactgaaagaccacaa

SEQ ID NO: 111699 - DNA, 25 bp, Mus musculus
accatcctgcacaagacaaccaaaa

SEQ ID NO: 111700 - DNA, 25 bp, Mus musculus
accatcctgcactagacaaccaaaa

SEQ ID NO: 111701 - DNA, 25 bp, Mus musculus
accatcctggatctaacttacacgt

SEQ ID NO: 111702 - DNA, 25 bp, Mus musculus
accatcctggatgtaacttacacgt

SEQ ID NO: 111703 - DNA, 25 bp, Mus musculus
accatcctggcactatttgatgctg

SEQ ID NO: 111704 - DNA, 25 bp, Mus musculus
accatcctggcagtatttgatgctg

SEQ ID NO: 111705 - DNA, 25 bp, Mus musculus
accatcctgggacacaaagcccatg

SEQ ID NO: 111706 - DNA, 25 bp, Mus musculus
accatcctgggagacaaagcccatg

SEQ ID NO: 111707 - DNA, 25 bp, Mus musculus
accatccttagtacctgagcagaga

SEQ ID NO: 111708 - DNA, 25 bp, Mus musculus
accatccttagttcctgagcagaga

SEQ ID NO: 111709 - DNA, 25 bp, Mus musculus
accatccttcacaacagtttcaaca

SEQ ID NO: 111710 - DNA, 25 bp, Mus musculus
accatccttcactacagtttcaaca

SEQ ID NO: 111711 - DNA, 25 bp, Mus musculus
accatccttgaaatgactgtccttt

SEQ ID NO: 111712 - DNA, 25 bp, Mus musculus
accatccttgaattgactgtccttt

SEQ ID NO: 111713 - DNA, 25 bp, Mus musculus
accatccttgtgaccttgtagagat

SEQ ID NO: 111714 - DNA, 25 bp, Mus musculus
accatccttgtgtccttgtagagat

SEQ ID NO: 111715 - DNA, 25 bp, Mus musculus
accatcctttggaagtttcatgaca

SEQ ID NO: 111716 - DNA, 25 bp, Mus musculus
accatcctttggcatcccgatggag

SEQ ID NO: 111717 - DNA, 25 bp, Mus musculus
accatcctttgggatcccgatggag

SEQ ID NO: 111718 - DNA, 25 bp, Mus musculus
accatcctttggtagtttcatgaca

SEQ ID NO: 111719 - DNA, 25 bp, Mus musculus
accatcggtcttatagcctgttgag

SEQ ID NO: 111720 - DNA, 25 bp, Mus musculus
accatcggtcttttagcctgttgag

SEQ ID NO: 111721 - DNA, 25 bp, Mus musculus
accatcgtggttcgctcatgcaaat

SEQ ID NO: 111722 - DNA, 25 bp, Mus musculus
accatcgtggttggctcatgcaaat

SEQ ID NO: 111723 - DNA, 25 bp, Mus musculus
accatcgttggaattactctctggg

SEQ ID NO: 111724 - DNA, 25 bp, Mus musculus
accatcgttggatttactctctggg

SEQ ID NO: 111725 - DNA, 25 bp, Mus musculus
accatctaagatagtcgtctctacc

SEQ ID NO: 111726 - DNA, 25 bp, Mus musculus
accatctaagattgtcgtctctacc

SEQ ID NO: 111727 - DNA, 25 bp, Mus musculus
accatctagaaactgccatacccag

SEQ ID NO: 111728 - DNA, 25 bp, Mus musculus
accatctagaaagtgccatacccag

SEQ ID NO: 111729 - DNA, 25 bp, Mus musculus
accatctagggcctgtcttgcgtag

SEQ ID NO: 111730 - DNA, 25 bp, Mus musculus
accatctagggcgtgtcttgcgtag

SEQ ID NO: 111731 - DNA, 25 bp, Mus musculus
accatctattacatgaacactgttc

SEQ ID NO: 111732 - DNA, 25 bp, Mus musculus
accatctattacttgaacactgttc

SEQ ID NO: 111733 - DNA, 25 bp, Mus musculus
accatctcagctaactagggcaggc

SEQ ID NO: 111734 - DNA, 25 bp, Mus musculus
accatctcagcttactagggcaggc

SEQ ID NO: 111735 - DNA, 25 bp, Mus musculus
accatctcagttctatccagcgatg

SEQ ID NO: 111736 - DNA, 25 bp, Mus musculus
accatctcagttgtatccagcgatg

SEQ ID NO: 111737 - DNA, 25 bp, Mus musculus
accatctccaggacggtgaaagaga

SEQ ID NO: 111738 - DNA, 25 bp, Mus musculus
accatctccaggtcggtgaaagaga

SEQ ID NO: 111739 - DNA, 25 bp, Mus musculus
accatctcctgactttttgccattt

SEQ ID NO: 111740 - DNA, 25 bp, Mus musculus
accatctcctgagtttttgccattt

SEQ ID NO: 111741 - DNA, 25 bp, Mus musculus
accatctctctgctacaagtgattt

SEQ ID NO: 111742 - DNA, 25 bp, Mus musculus
accatctctctggtacaagtgattt

SEQ ID NO: 111743 - DNA, 25 bp, Mus musculus
accatctctgagaccacggaggtgt

SEQ ID NO: 111744 - DNA, 25 bp, Mus musculus
accatctctgagtccacggaggtgt

SEQ ID NO: 111745 - DNA, 25 bp, Mus musculus
accatctctttcattcactttggga

SEQ ID NO: 111746 - DNA, 25 bp, Mus musculus
accatctctttctttcactttggga

SEQ ID NO: 111747 - DNA, 25 bp, Mus musculus
accatctctttgatttgctctctat

SEQ ID NO: 111748 - DNA, 25 bp, Mus musculus
accatctctttgttttgctctctat

SEQ ID NO: 111749 - DNA, 25 bp, Mus musculus
accatctcttttcccagttactaaa

SEQ ID NO: 111750 - DNA, 25 bp, Mus musculus
accatctcttttgccagttactaaa

SEQ ID NO: 111751 - DNA, 25 bp, Mus musculus
accatctgatatagaggttctcaca

SEQ ID NO: 111752 - DNA, 25 bp, Mus musculus
accatctgatattgaggttctcaca

SEQ ID NO: 111753 - DNA, 25 bp, Mus musculus
accatctgcgtgaagtcttgtctgt

SEQ ID NO: 111754 - DNA, 25 bp, Mus musculus
accatctgcgtgtagtcttgtctgt

SEQ ID NO: 111755 - DNA, 25 bp, Mus musculus
accatctgctggctttgggttctaa

SEQ ID NO: 111756 - DNA, 25 bp, Mus musculus
accatctgctgggtttgggttctaa

SEQ ID NO: 111757 - DNA, 25 bp, Mus musculus
accatctggaataaagtgacatgct

SEQ ID NO: 111758 - DNA, 25 bp, Mus musculus
accatctggaattaagtgacatgct

SEQ ID NO: 111759 - DNA, 25 bp, Mus musculus
accatctgggccatcatcactctgt

SEQ ID NO: 111760 - DNA, 25 bp, Mus musculus
accatctgggccttcatcactctgt

SEQ ID NO: 111761 - DNA, 25 bp, Mus musculus
accatctggtttccaaggtgccacc

SEQ ID NO: 111762 - DNA, 25 bp, Mus musculus
accatctggtttgcaaggtgccacc

SEQ ID NO: 111763 - DNA, 25 bp, Mus musculus
accatctgtaacagccatggaatgg

SEQ ID NO: 111764 - DNA, 25 bp, Mus musculus
accatctgtaactgccatggaatgg

SEQ ID NO: 111765 - DNA, 25 bp, Mus musculus
accatctgtaatatccttggcacaa

SEQ ID NO: 111766 - DNA, 25 bp, Mus musculus
accatctgtaatttccttggcacaa

SEQ ID NO: 111767 - DNA, 25 bp, Mus musculus
accatctgtaggaggatctcgagag

SEQ ID NO: 111768 - DNA, 25 bp, Mus musculus
accatctgtaggtggatctcgagag

SEQ ID NO: 111769 - DNA, 25 bp, Mus musculus
accatctgtgaccagcagctgaagc

SEQ ID NO: 111770 - DNA, 25 bp, Mus musculus
accatctgtgaccatagcctagcta

SEQ ID NO: 111771 - DNA, 25 bp, Mus musculus
accatctgtgacgagcagctgaagc

SEQ ID NO: 111772 - DNA, 25 bp, Mus musculus
accatctgtgacgatagcctagcta

SEQ ID NO: 111773 - DNA, 25 bp, Mus musculus
accatctgtgctcggtattgtatga

SEQ ID NO: 111774 - DNA, 25 bp, Mus musculus
accatctgtgctgggtattgtatga

SEQ ID NO: 111775 - DNA, 25 bp, Mus musculus
accatcttagatatcctctgggacc

SEQ ID NO: 111776 - DNA, 25 bp, Mus musculus
accatcttagatttcctctgggacc

SEQ ID NO: 111777 - DNA, 25 bp, Mus musculus
accatcttccttcttaatgctgtga

SEQ ID NO: 111778 - DNA, 25 bp, Mus musculus
accatcttccttgttaatgctgtga

SEQ ID NO: 111779 - DNA, 25 bp, Mus musculus
accatcttctcacttctcaggttgg

SEQ ID NO: 111780 - DNA, 25 bp, Mus musculus
accatcttctcagttctcaggttgg

SEQ ID NO: 111781 - DNA, 25 bp, Mus musculus
accatcttctttacgtttctctgag

SEQ ID NO: 111782 - DNA, 25 bp, Mus musculus
accatcttctttcattctgtgctgt

SEQ ID NO: 111783 - DNA, 25 bp, Mus musculus
accatcttctttgattctgtgctgt

SEQ ID NO: 111784 - DNA, 25 bp, Mus musculus
accatcttcttttcgtttctctgag

SEQ ID NO: 111785 - DNA, 25 bp, Mus musculus
accatcttgcccataggtccagatc

SEQ ID NO: 111786 - DNA, 25 bp, Mus musculus
accatcttgcccttaggtccagatc

SEQ ID NO: 111787 - DNA, 25 bp, Mus musculus
accatcttgcctatgaagcgtgaaa

SEQ ID NO: 111788 - DNA, 25 bp, Mus musculus
accatcttgcctttgaagcgtgaaa

SEQ ID NO: 111789 - DNA, 25 bp, Mus musculus
accatcttgtttctcctacgtgaaa

SEQ ID NO: 111790 - DNA, 25 bp, Mus musculus
accatcttgtttgtcctacgtgaaa

SEQ ID NO: 111791 - DNA, 25 bp, Mus musculus
accatctttacgcacgccaaggagt

SEQ ID NO: 111792 - DNA, 25 bp, Mus musculus
accatctttacggacgccaaggagt

SEQ ID NO: 111793 - DNA, 25 bp, Mus musculus
accatctttactcctgaggcagttt

SEQ ID NO: 111794 - DNA, 25 bp, Mus musculus
accatctttactgctgaggcagttt

SEQ ID NO: 111795 - DNA, 25 bp, Mus musculus
accatctttattagttgcacattat

SEQ ID NO: 111796 - DNA, 25 bp, Mus musculus
accatctttatttgttgcacattat

SEQ ID NO: 111797 - DNA, 25 bp, Mus musculus
accatctttcaaattgcctttccag

SEQ ID NO: 111798 - DNA, 25 bp, Mus musculus
accatctttcaatttgcctttccag

SEQ ID NO: 111799 - DNA, 25 bp, Mus musculus
accatctttctgatactattctgtt

SEQ ID NO: 111800 - DNA, 25 bp, Mus musculus
accatctttctgttactattctgtt

SEQ ID NO: 111801 - DNA, 25 bp, Mus musculus
accatctttgcccttgtactgctat

SEQ ID NO: 111802 - DNA, 25 bp, Mus musculus
accatctttgccgttgtactgctat

SEQ ID NO: 111803 - DNA, 25 bp, Mus musculus
accatctttgttcttgagctgccga

SEQ ID NO: 111804 - DNA, 25 bp, Mus musculus
accatctttgttgttgagctgccga

SEQ ID NO: 111805 - DNA, 25 bp, Mus musculus
accatgaacaccaatgtctgcgtgg

SEQ ID NO: 111806 - DNA, 25 bp, Mus musculus
accatgaacacctatgtctgcgtgg

SEQ ID NO: 111807 - DNA, 25 bp, Mus musculus
accatgaacagtcagttggtttcaa

SEQ ID NO: 111808 - DNA, 25 bp, Mus musculus
accatgaacagtgagttggtttcaa

SEQ ID NO: 111809 - DNA, 25 bp, Mus musculus
accatgaaggacaggcagggaacca

SEQ ID NO: 111810 - DNA, 25 bp, Mus musculus
accatgaaggactggcagggaacca

SEQ ID NO: 111811 - DNA, 25 bp, Mus musculus
accatgaaggtcactgctttcctgt

SEQ ID NO: 111812 - DNA, 25 bp, Mus musculus
accatgaaggtccagctgtgcagtt

SEQ ID NO: 111813 - DNA, 25 bp, Mus musculus
accatgaaggtcgagctgtgcagtt

SEQ ID NO: 111814 - DNA, 25 bp, Mus musculus
accatgaaggtctctgctttcctgt

SEQ ID NO: 111815 - DNA, 25 bp, Mus musculus
accatgacaaggctgcttctgttaa

SEQ ID NO: 111816 - DNA, 25 bp, Mus musculus
accatgacaagggtgcttctgttaa

SEQ ID NO: 111817 - DNA, 25 bp, Mus musculus
accatgactgtcaggcagccgtagg

SEQ ID NO: 111818 - DNA, 25 bp, Mus musculus
accatgactgtcatattttgataac

SEQ ID NO: 111819 - DNA, 25 bp, Mus musculus
accatgactgtctggcagccgtagg

SEQ ID NO: 111820 - DNA, 25 bp, Mus musculus
accatgactgtcttattttgataac

SEQ ID NO: 111821 - DNA, 25 bp, Mus musculus
accatgactgtgctctgctgataga

SEQ ID NO: 111822 - DNA, 25 bp, Mus musculus
accatgactgtggtctgctgataga

SEQ ID NO: 111823 - DNA, 25 bp, Mus musculus
accatgacttagaagggacccaact

SEQ ID NO: 111824 - DNA, 25 bp, Mus musculus
accatgacttagtagggacccaact

SEQ ID NO: 111825 - DNA, 25 bp, Mus musculus
accatgagaaggacctcggaggctg

SEQ ID NO: 111826 - DNA, 25 bp, Mus musculus
accatgagaaggtcctcggaggctg

SEQ ID NO: 111827 - DNA, 25 bp, Mus musculus
accatgagagtcctctgagcagagt

SEQ ID NO: 111828 - DNA, 25 bp, Mus musculus
accatgagagtcgtctgagcagagt

SEQ ID NO: 111829 - DNA, 25 bp, Mus musculus
accatgagcctacaggtgattggac

SEQ ID NO: 111830 - DNA, 25 bp, Mus musculus
accatgagcctagaggtgattggac

SEQ ID NO: 111831 - DNA, 25 bp, Mus musculus
accatgagcgctcctccgatggtga

SEQ ID NO: 111832 - DNA, 25 bp, Mus musculus
accatgagcgctgctccgatggtga

SEQ ID NO: 111833 - DNA, 25 bp, Mus musculus
accatgagtggtatttagagttact

SEQ ID NO: 111834 - DNA, 25 bp, Mus musculus
accatgagtggtttttagagttact

SEQ ID NO: 111835 - DNA, 25 bp, Mus musculus
accatgatattcagacagttgccaa

SEQ ID NO: 111836 - DNA, 25 bp, Mus musculus
accatgatattctgacagttgccaa

SEQ ID NO: 111837 - DNA, 25 bp, Mus musculus
accatgatcataagcccctcgggat

SEQ ID NO: 111838 - DNA, 25 bp, Mus musculus
accatgatcatatgcccctcgggat

SEQ ID NO: 111839 - DNA, 25 bp, Mus musculus
accatgatctacaacgccgagagga

SEQ ID NO: 111840 - DNA, 25 bp, Mus musculus
accatgatctacactgcctggcaca

SEQ ID NO: 111841 - DNA, 25 bp, Mus musculus
accatgatctactacgccgagagga

SEQ ID NO: 111842 - DNA, 25 bp, Mus musculus
accatgatctactctgcctggcaca

SEQ ID NO: 111843 - DNA, 25 bp, Mus musculus
accatgatggacaacattctcttca

SEQ ID NO: 111844 - DNA, 25 bp, Mus musculus
accatgatggactacattctcttca

SEQ ID NO: 111845 - DNA, 25 bp, Mus musculus
accatgatggagcaccaccccggat

SEQ ID NO: 111846 - DNA, 25 bp, Mus musculus
accatgatggaggaccaccccggat

SEQ ID NO: 111847 - DNA, 25 bp, Mus musculus
accatgatgggtctttccctaagat

SEQ ID NO: 111848 - DNA, 25 bp, Mus musculus
accatgatgggtgtttccctaagat

SEQ ID NO: 111849 - DNA, 25 bp, Mus musculus
accatgatgttcaggatgctgcttc

SEQ ID NO: 111850 - DNA, 25 bp, Mus musculus
accatgatgttctggatgctgcttc

SEQ ID NO: 111851 - DNA, 25 bp, Mus musculus
accatgcaacatacttactcctaaa

SEQ ID NO: 111852 - DNA, 25 bp, Mus musculus
accatgcaacattcttactcctaaa

SEQ ID NO: 111853 - DNA, 25 bp, Mus musculus
accatgcaaggtcacccacttgaga

SEQ ID NO: 111854 - DNA, 25 bp, Mus musculus
accatgcaaggtgacccacttgaga

SEQ ID NO: 111855 - DNA, 25 bp, Mus musculus
accatgcacacaagtggtgggtaca

SEQ ID NO: 111856 - DNA, 25 bp, Mus musculus
accatgcacacatgtggtgggtaca

SEQ ID NO: 111857 - DNA, 25 bp, Mus musculus
accatgcagatgactcagccagctt

SEQ ID NO: 111858 - DNA, 25 bp, Mus musculus
accatgcagatgtctcagccagctt

SEQ ID NO: 111859 - DNA, 25 bp, Mus musculus
accatgcaggtcactagatttattc

SEQ ID NO: 111860 - DNA, 25 bp, Mus musculus
accatgcaggtctctagatttattc

SEQ ID NO: 111861 - DNA, 25 bp, Mus musculus
accatgcaggtgactctcaaaaact

SEQ ID NO: 111862 - DNA, 25 bp, Mus musculus
accatgcaggtgtctctcaaaaact

SEQ ID NO: 111863 - DNA, 25 bp, Mus musculus
accatgcatggaaccccagtagttt

SEQ ID NO: 111864 - DNA, 25 bp, Mus musculus
accatgcatggatccccagtagttt

SEQ ID NO: 111865 - DNA, 25 bp, Mus musculus
accatgccaaagactggatgaccct

SEQ ID NO: 111866 - DNA, 25 bp, Mus musculus
accatgccaaagtctggatgaccct

SEQ ID NO: 111867 - DNA, 25 bp, Mus musculus
accatgccaagcacctgaattgttt

SEQ ID NO: 111868 - DNA, 25 bp, Mus musculus
accatgccaagctcctgaattgttt

SEQ ID NO: 111869 - DNA, 25 bp, Mus musculus
accatgccaggtccaggcaggatac

SEQ ID NO: 111870 - DNA, 25 bp, Mus musculus
accatgccaggtgcaggcaggatac

SEQ ID NO: 111871 - DNA, 25 bp, Mus musculus
accatgcccagcattgttattgttt

SEQ ID NO: 111872 - DNA, 25 bp, Mus musculus
accatgcccagctttgttattgttt

SEQ ID NO: 111873 - DNA, 25 bp, Mus musculus
accatgcccggcatccgatgtgtaa

SEQ ID NO: 111874 - DNA, 25 bp, Mus musculus
accatgcccggcttccgatgtgtaa

SEQ ID NO: 111875 - DNA, 25 bp, Mus musculus
accatgcctaccaagatattgccat

SEQ ID NO: 111876 - DNA, 25 bp, Mus musculus
accatgcctacctagatattgccat

SEQ ID NO: 111877 - DNA, 25 bp, Mus musculus
accatgcctgaactgagaggttttt

SEQ ID NO: 111878 - DNA, 25 bp, Mus musculus
accatgcctgaagtgagaggttttt

SEQ ID NO: 111879 - DNA, 25 bp, Mus musculus
accatgcctgatagtgactctagta

SEQ ID NO: 111880 - DNA, 25 bp, Mus musculus
accatgcctgattgtgactctagta

SEQ ID NO: 111881 - DNA, 25 bp, Mus musculus
accatgcctggcatatgcagtgcta

SEQ ID NO: 111882 - DNA, 25 bp, Mus musculus
accatgcctggcttatgcagtgcta

SEQ ID NO: 111883 - DNA, 25 bp, Mus musculus
accatgccttagctctgttaacacc

SEQ ID NO: 111884 - DNA, 25 bp, Mus musculus
accatgccttaggtctgttaacacc

SEQ ID NO: 111885 - DNA, 25 bp, Mus musculus
accatgccttccatttcatgataga

SEQ ID NO: 111886 - DNA, 25 bp, Mus musculus
accatgccttccttttcatgataga

SEQ ID NO: 111887 - DNA, 25 bp, Mus musculus
accatgccttcgaaagtgtgtgtgc

SEQ ID NO: 111888 - DNA, 25 bp, Mus musculus
accatgccttcgtaagtgtgtgtgc

SEQ ID NO: 111889 - DNA, 25 bp, Mus musculus
accatgccttgacagtgacccattt

SEQ ID NO: 111890 - DNA, 25 bp, Mus musculus
accatgccttgagagtgacccattt

SEQ ID NO: 111891 - DNA, 25 bp, Mus musculus
accatgccttttctgcagtctttgc

SEQ ID NO: 111892 - DNA, 25 bp, Mus musculus
accatgccttttgtgcagtctttgc

SEQ ID NO: 111893 - DNA, 25 bp, Mus musculus
accatgctcagcatgcaggcacctt

SEQ ID NO: 111894 - DNA, 25 bp, Mus musculus
accatgctcagcttgcaggcacctt

SEQ ID NO: 111895 - DNA, 25 bp, Mus musculus
accatgctcgagattcttcctgtag

SEQ ID NO: 111896 - DNA, 25 bp, Mus musculus
accatgctcgagtttcttcctgtag

SEQ ID NO: 111897 - DNA, 25 bp, Mus musculus
accatgctctggagccctggccgtg

SEQ ID NO: 111898 - DNA, 25 bp, Mus musculus
accatgctctggtgccctggccgtg

SEQ ID NO: 111899 - DNA, 25 bp, Mus musculus
accatgctctgtatgaaaattccat

SEQ ID NO: 111900 - DNA, 25 bp, Mus musculus
accatgctctgtttgaaaattccat

SEQ ID NO: 111901 - DNA, 25 bp, Mus musculus
accatgctgaaacggctgcctctga

SEQ ID NO: 111902 - DNA, 25 bp, Mus musculus
accatgctgaaagggctgcctctga

SEQ ID NO: 111903 - DNA, 25 bp, Mus musculus
accatgctgctgatgtaccttaata

SEQ ID NO: 111904 - DNA, 25 bp, Mus musculus
accatgctgctgttgtaccttaata

SEQ ID NO: 111905 - DNA, 25 bp, Mus musculus
accatgctgtccatgtggagtcttg

SEQ ID NO: 111906 - DNA, 25 bp, Mus musculus
accatgctgtccttgtggagtcttg

SEQ ID NO: 111907 - DNA, 25 bp, Mus musculus
accatgcttctgaggtgggaggatt

SEQ ID NO: 111908 - DNA, 25 bp, Mus musculus
accatgcttctgtggtgggaggatt

SEQ ID NO: 111909 - DNA, 25 bp, Mus musculus
accatggaacccagtcggaagcaaa

SEQ ID NO: 111910 - DNA, 25 bp, Mus musculus
accatggaaccctgtcggaagcaaa

SEQ ID NO: 111911 - DNA, 25 bp, Mus musculus
accatggaattcaacgtgggtgctg

SEQ ID NO: 111912 - DNA, 25 bp, Mus musculus
accatggaattctacgtgggtgctg

SEQ ID NO: 111913 - DNA, 25 bp, Mus musculus
accatggaccgtagcgtgtgctcgg

SEQ ID NO: 111914 - DNA, 25 bp, Mus musculus
accatggaccgttgcgtgtgctcgg

SEQ ID NO: 111915 - DNA, 25 bp, Mus musculus
accatggactggagacctggcagct

SEQ ID NO: 111916 - DNA, 25 bp, Mus musculus
accatggactggtgacctggcagct

SEQ ID NO: 111917 - DNA, 25 bp, Mus musculus
accatggagctgatacttccttctg

SEQ ID NO: 111918 - DNA, 25 bp, Mus musculus
accatggagctgttacttccttctg

SEQ ID NO: 111919 - DNA, 25 bp, Mus musculus
accatggagtgcaggtgattaccaa

SEQ ID NO: 111920 - DNA, 25 bp, Mus musculus
accatggagtgctggtgattaccaa

SEQ ID NO: 111921 - DNA, 25 bp, Mus musculus
accatggatggtaccccagcgagac

SEQ ID NO: 111922 - DNA, 25 bp, Mus musculus
accatggatggttccccagcgagac

SEQ ID NO: 111923 - DNA, 25 bp, Mus musculus
accatggattatacccctgtttaat

SEQ ID NO: 111924 - DNA, 25 bp, Mus musculus
accatggattattcccctgtttaat

SEQ ID NO: 111925 - DNA, 25 bp, Mus musculus
accatggcaagcaccgccaagagga

SEQ ID NO: 111926 - DNA, 25 bp, Mus musculus
accatggcaagctccgccaagagga

SEQ ID NO: 111927 - DNA, 25 bp, Mus musculus
accatggcatatcccctgaaagctt

SEQ ID NO: 111928 - DNA, 25 bp, Mus musculus
accatggcatatgccctgaaagctt

SEQ ID NO: 111929 - DNA, 25 bp, Mus musculus
accatggccatcatgcttcataaat

SEQ ID NO: 111930 - DNA, 25 bp, Mus musculus
accatggccatcttgcttcataaat

SEQ ID NO: 111931 - DNA, 25 bp, Mus musculus
accatggcccggcaacacagattta

SEQ ID NO: 111932 - DNA, 25 bp, Mus musculus
accatggcccgggaacacagattta

SEQ ID NO: 111933 - DNA, 25 bp, Mus musculus
accatggccctcatgggtccaactg

SEQ ID NO: 111934 - DNA, 25 bp, Mus musculus
accatggccctcttgggtccaactg

SEQ ID NO: 111935 - DNA, 25 bp, Mus musculus
accatggcccttagtgttgtgtctc

SEQ ID NO: 111936 - DNA, 25 bp, Mus musculus
accatggccctttgtgttgtgtctc

SEQ ID NO: 111937 - DNA, 25 bp, Mus musculus
accatggccgccagcttgttggtgc

SEQ ID NO: 111938 - DNA, 25 bp, Mus musculus
accatggccgcctgcttgttggtgc

SEQ ID NO: 111939 - DNA, 25 bp, Mus musculus
accatggcgcccaggtgagttgcag

SEQ ID NO: 111940 - DNA, 25 bp, Mus musculus
accatggcgccctggtgagttgcag

SEQ ID NO: 111941 - DNA, 25 bp, Mus musculus
accatggcgtaacacagctttccct

SEQ ID NO: 111942 - DNA, 25 bp, Mus musculus
accatggcgtaagacagctttccct

SEQ ID NO: 111943 - DNA, 25 bp, Mus musculus
accatggctcacacgtaaatacaca

SEQ ID NO: 111944 - DNA, 25 bp, Mus musculus
accatggctcactcgtaaatacaca

SEQ ID NO: 111945 - DNA, 25 bp, Mus musculus
accatggctcccatgagcaaatgga

SEQ ID NO: 111946 - DNA, 25 bp, Mus musculus
accatggctcccttgagcaaatgga

SEQ ID NO: 111947 - DNA, 25 bp, Mus musculus
accatggctgagctccagatgcgat

SEQ ID NO: 111948 - DNA, 25 bp, Mus musculus
accatggctgaggtccagatgcgat

SEQ ID NO: 111949 - DNA, 25 bp, Mus musculus
accatggcttatcttgtatccctaa

SEQ ID NO: 111950 - DNA, 25 bp, Mus musculus
accatggcttatgttgtatccctaa

SEQ ID NO: 111951 - DNA, 25 bp, Mus musculus
accatgggacttctgaatccggcga

SEQ ID NO: 111952 - DNA, 25 bp, Mus musculus
accatgggacttgtgaatccggcga

SEQ ID NO: 111953 - DNA, 25 bp, Mus musculus
accatgggagaaccctgccgtgacc

SEQ ID NO: 111954 - DNA, 25 bp, Mus musculus
accatgggagaagcctgccgtgacc

SEQ ID NO: 111955 - DNA, 25 bp, Mus musculus
accatgggcagacatggctgccgct

SEQ ID NO: 111956 - DNA, 25 bp, Mus musculus
accatgggcagagatggctgccgct

SEQ ID NO: 111957 - DNA, 25 bp, Mus musculus
accatgggcctcctatttctgggat

SEQ ID NO: 111958 - DNA, 25 bp, Mus musculus
accatgggcctcgtatttctgggat

SEQ ID NO: 111959 - DNA, 25 bp, Mus musculus
accatgggctctcccatcagcagga

SEQ ID NO: 111960 - DNA, 25 bp, Mus musculus
accatgggctctgccatcagcagga

SEQ ID NO: 111961 - DNA, 25 bp, Mus musculus
accatgggctgtcgtcatgaagcaa

SEQ ID NO: 111962 - DNA, 25 bp, Mus musculus
accatgggctgtctgataatagatt

SEQ ID NO: 111963 - DNA, 25 bp, Mus musculus
accatgggctgtggtcatgaagcaa

SEQ ID NO: 111964 - DNA, 25 bp, Mus musculus
accatgggctgtgtgataatagatt

SEQ ID NO: 111965 - DNA, 25 bp, Mus musculus
accatgggcttcagagtcatccaaa

SEQ ID NO: 111966 - DNA, 25 bp, Mus musculus
accatgggcttctgagtcatccaaa

SEQ ID NO: 111967 - DNA, 25 bp, Mus musculus
accatgggtagcagactgcttttct

SEQ ID NO: 111968 - DNA, 25 bp, Mus musculus
accatgggtagctgactgcttttct

SEQ ID NO: 111969 - DNA, 25 bp, Mus musculus
accatgggtctcagcagttgcgggc

SEQ ID NO: 111970 - DNA, 25 bp, Mus musculus
accatgggtctctgcagttgcgggc

SEQ ID NO: 111971 - DNA, 25 bp, Mus musculus
accatgggtctgctggagggtgtct

SEQ ID NO: 111972 - DNA, 25 bp, Mus musculus
accatgggtctggtggagggtgtct

SEQ ID NO: 111973 - DNA, 25 bp, Mus musculus
accatgggtgctcttagttccctaa

SEQ ID NO: 111974 - DNA, 25 bp, Mus musculus
accatgggtgctgttagttccctaa

SEQ ID NO: 111975 - DNA, 25 bp, Mus musculus
accatgggttctcgcaggctggctt

SEQ ID NO: 111976 - DNA, 25 bp, Mus musculus
accatgggttctggcaggctggctt

SEQ ID NO: 111977 - DNA, 25 bp, Mus musculus
accatggtaacaacttattctaatg

SEQ ID NO: 111978 - DNA, 25 bp, Mus musculus
accatggtaacatcttattctaatg

SEQ ID NO: 111979 - DNA, 25 bp, Mus musculus
accatggtcaccactttccataaat

SEQ ID NO: 111980 - DNA, 25 bp, Mus musculus
accatggtcacctctttccataaat

SEQ ID NO: 111981 - DNA, 25 bp, Mus musculus
accatggtcattccccaagggatgg

SEQ ID NO: 111982 - DNA, 25 bp, Mus musculus
accatggtcattgcccaagggatgg

SEQ ID NO: 111983 - DNA, 25 bp, Mus musculus
accatggtcggaccttaggcacttt

SEQ ID NO: 111984 - DNA, 25 bp, Mus musculus
accatggtcggagcttaggcacttt

SEQ ID NO: 111985 - DNA, 25 bp, Mus musculus
accatggtgaacctcctgggtgatg

SEQ ID NO: 111986 - DNA, 25 bp, Mus musculus
accatggtgaacgtcctgggtgatg

SEQ ID NO: 111987 - DNA, 25 bp, Mus musculus
accatggtgaggcaatgtacggcat

SEQ ID NO: 111988 - DNA, 25 bp, Mus musculus
accatggtgagggaatgtacggcat

SEQ ID NO: 111989 - DNA, 25 bp, Mus musculus
accatggtgatcctgctgagtgctg

SEQ ID NO: 111990 - DNA, 25 bp, Mus musculus
accatggtgatcgtgctgagtgctg

SEQ ID NO: 111991 - DNA, 25 bp, Mus musculus
accatggtgctcctccggacctgaa

SEQ ID NO: 111992 - DNA, 25 bp, Mus musculus
accatggtgctcgtccggacctgaa

SEQ ID NO: 111993 - DNA, 25 bp, Mus musculus
accatggtggagcatactgcccgtt

SEQ ID NO: 111994 - DNA, 25 bp, Mus musculus
accatggtggaggatactgcccgtt

SEQ ID NO: 111995 - DNA, 25 bp, Mus musculus
accatggtggtacactacggtattt

SEQ ID NO: 111996 - DNA, 25 bp, Mus musculus
accatggtggtagactacggtattt

SEQ ID NO: 111997 - DNA, 25 bp, Mus musculus
accatggtggttagcctttagtagc

SEQ ID NO: 111998 - DNA, 25 bp, Mus musculus
accatggtggtttgcctttagtagc

SEQ ID NO: 111999 - DNA, 25 bp, Mus musculus
accatggtgtctccacacctgtact

SEQ ID NO: 112000 - DNA, 25 bp, Mus musculus
accatggtgtctgcacacctgtact

SEQ ID NO: 112001 - DNA, 25 bp, Mus musculus
accatggtgtgtataagccttgaac

SEQ ID NO: 112002 - DNA, 25 bp, Mus musculus
accatggtgtgtttaagccttgaac

SEQ ID NO: 112003 - DNA, 25 bp, Mus musculus
accatggttcagattgatcacaggc

SEQ ID NO: 112004 - DNA, 25 bp, Mus musculus
accatggttcagcactcactgcaga

SEQ ID NO: 112005 - DNA, 25 bp, Mus musculus
accatggttcaggactcactgcaga

SEQ ID NO: 112006 - DNA, 25 bp, Mus musculus
accatggttcagtttgatcacaggc

SEQ ID NO: 112007 - DNA, 25 bp, Mus musculus
accatggttccaatgctatagcatc

SEQ ID NO: 112008 - DNA, 25 bp, Mus musculus
accatggttccattgctatagcatc

SEQ ID NO: 112009 - DNA, 25 bp, Mus musculus
accatggttgtcatacattgtcaat

SEQ ID NO: 112010 - DNA, 25 bp, Mus musculus
accatggttgtcttacattgtcaat

SEQ ID NO: 112011 - DNA, 25 bp, Mus musculus
accatgtacccacgcattgctgaca

SEQ ID NO: 112012 - DNA, 25 bp, Mus musculus
accatgtacccaggcattgctgaca

SEQ ID NO: 112013 - DNA, 25 bp, Mus musculus
accatgtacgagctggagtcctcaa

SEQ ID NO: 112014 - DNA, 25 bp, Mus musculus
accatgtacgaggtggagtcctcaa

SEQ ID NO: 112015 - DNA, 25 bp, Mus musculus
accatgtatgcacttgttgatttta

SEQ ID NO: 112016 - DNA, 25 bp, Mus musculus
accatgtatgcagttgttgatttta

SEQ ID NO: 112017 - DNA, 25 bp, Mus musculus
accatgtcaaacatagccctggctt

SEQ ID NO: 112018 - DNA, 25 bp, Mus musculus
accatgtcaaacttagccctggctt

SEQ ID NO: 112019 - DNA, 25 bp, Mus musculus
accatgtccaatccagttattccag

SEQ ID NO: 112020 - DNA, 25 bp, Mus musculus
accatgtccaatgcagttattccag

SEQ ID NO: 112021 - DNA, 25 bp, Mus musculus
accatgtcctctaatcccagatggg

SEQ ID NO: 112022 - DNA, 25 bp, Mus musculus
accatgtcctcttatcccagatggg

SEQ ID NO: 112023 - DNA, 25 bp, Mus musculus
accatgtcgaccatcgccaaggaaa

SEQ ID NO: 112024 - DNA, 25 bp, Mus musculus
accatgtcgaccttcgccaaggaaa

SEQ ID NO: 112025 - DNA, 25 bp, Mus musculus
accatgtctggtatcatagccgttt

SEQ ID NO: 112026 - DNA, 25 bp, Mus musculus
accatgtctggtttcatagccgttt

SEQ ID NO: 112027 - DNA, 25 bp, Mus musculus
accatgtcttccaatgagctgcgga

SEQ ID NO: 112028 - DNA, 25 bp, Mus musculus
accatgtcttcctatgagctgcgga

SEQ ID NO: 112029 - DNA, 25 bp, Mus musculus
accatgtcttgtccattctctgtat

SEQ ID NO: 112030 - DNA, 25 bp, Mus musculus
accatgtcttgtgcattctctgtat

SEQ ID NO: 112031 - DNA, 25 bp, Mus musculus
accatgtgaatcagcctgctcactg

SEQ ID NO: 112032 - DNA, 25 bp, Mus musculus
accatgtgaatctgcctgctcactg

SEQ ID NO: 112033 - DNA, 25 bp, Mus musculus
accatgtgacaaccatagctccttg

SEQ ID NO: 112034 - DNA, 25 bp, Mus musculus
accatgtgacaagcatagctccttg

SEQ ID NO: 112035 - DNA, 25 bp, Mus musculus
accatgtgagctccatccttaaatg

SEQ ID NO: 112036 - DNA, 25 bp, Mus musculus
accatgtgagctgcatccttaaatg

SEQ ID NO: 112037 - DNA, 25 bp, Mus musculus
accatgtgcatgaagtctctgcaga

SEQ ID NO: 112038 - DNA, 25 bp, Mus musculus
accatgtgcatgtagtctctgcaga

SEQ ID NO: 112039 - DNA, 25 bp, Mus musculus
accatgtgcattactggtgccaagg

SEQ ID NO: 112040 - DNA, 25 bp, Mus musculus
accatgtgcatttctggtgccaagg

SEQ ID NO: 112041 - DNA, 25 bp, Mus musculus
accatgtgccttaatgagtctctaa

SEQ ID NO: 112042 - DNA, 25 bp, Mus musculus
accatgtgcctttatgagtctctaa

SEQ ID NO: 112043 - DNA, 25 bp, Mus musculus
accatgtggagccagtgtggaatca

SEQ ID NO: 112044 - DNA, 25 bp, Mus musculus
accatgtggagcgagtgtggaatca

SEQ ID NO: 112045 - DNA, 25 bp, Mus musculus
accatgtggccgaaatgctgctctt

SEQ ID NO: 112046 - DNA, 25 bp, Mus musculus
accatgtggccgtaatgctgctctt

SEQ ID NO: 112047 - DNA, 25 bp, Mus musculus
accatgtggctgaaccgagcctgag

SEQ ID NO: 112048 - DNA, 25 bp, Mus musculus
accatgtggctgtaccgagcctgag

SEQ ID NO: 112049 - DNA, 25 bp, Mus musculus
accatgtggtacaggaaaggtgtca

SEQ ID NO: 112050 - DNA, 25 bp, Mus musculus
accatgtggtactggaaaggtgtca

SEQ ID NO: 112051 - DNA, 25 bp, Mus musculus
accatgtgtcttctgctgattctga

SEQ ID NO: 112052 - DNA, 25 bp, Mus musculus
accatgtgtcttgtgctgattctga

SEQ ID NO: 112053 - DNA, 25 bp, Mus musculus
accatgtgtgctcgctaggcatata

SEQ ID NO: 112054 - DNA, 25 bp, Mus musculus
accatgtgtgctggctaggcatata

SEQ ID NO: 112055 - DNA, 25 bp, Mus musculus
accatgtgtggcaggccaaggctat

SEQ ID NO: 112056 - DNA, 25 bp, Mus musculus
accatgtgtggctggccaaggctat

SEQ ID NO: 112057 - DNA, 25 bp, Mus musculus
accatgtgttttataggctgatact

SEQ ID NO: 112058 - DNA, 25 bp, Mus musculus
accatgtgttttttaggctgatact

SEQ ID NO: 112059 - DNA, 25 bp, Mus musculus
accatgttagggagggtctatcctc

SEQ ID NO: 112060 - DNA, 25 bp, Mus musculus
accatgttagggtgggtctatcctc

SEQ ID NO: 112061 - DNA, 25 bp, Mus musculus
accatgttagtacagctacagttta

SEQ ID NO: 112062 - DNA, 25 bp, Mus musculus
accatgttagtagagctacagttta

SEQ ID NO: 112063 - DNA, 25 bp, Mus musculus
accatgttcagtctgctttcctgtg

SEQ ID NO: 112064 - DNA, 25 bp, Mus musculus
accatgttcagtgtgctttcctgtg

SEQ ID NO: 112065 - DNA, 25 bp, Mus musculus
accatgttctaaatctggccgagat

SEQ ID NO: 112066 - DNA, 25 bp, Mus musculus
accatgttctaattctggccgagat

SEQ ID NO: 112067 - DNA, 25 bp, Mus musculus
accatgttgccaatcaatactggag

SEQ ID NO: 112068 - DNA, 25 bp, Mus musculus
accatgttgccattcaatactggag

SEQ ID NO: 112069 - DNA, 25 bp, Mus musculus
accatgttggagcaccttgctggca

SEQ ID NO: 112070 - DNA, 25 bp, Mus musculus
accatgttggaggaccttgctggca

SEQ ID NO: 112071 - DNA, 25 bp, Mus musculus
accatgttgttcacttggcctttaa

SEQ ID NO: 112072 - DNA, 25 bp, Mus musculus
accatgttgttctcttggcctttaa

SEQ ID NO: 112073 - DNA, 25 bp, Mus musculus
accatgtttaggaatcacaggcagt

SEQ ID NO: 112074 - DNA, 25 bp, Mus musculus
accatgtttaggtatcacaggcagt

SEQ ID NO: 112075 - DNA, 25 bp, Mus musculus
accatgtttgatccctctttggaaa

SEQ ID NO: 112076 - DNA, 25 bp, Mus musculus
accatgtttgatgcctctttggaaa

SEQ ID NO: 112077 - DNA, 25 bp, Mus musculus
accatgtttgctattatggcttctg

SEQ ID NO: 112078 - DNA, 25 bp, Mus musculus
accatgtttgcttttatggcttctg

SEQ ID NO: 112079 - DNA, 25 bp, Mus musculus
accatgtttgtacagcgtttgccat

SEQ ID NO: 112080 - DNA, 25 bp, Mus musculus
accatgtttgtagagcgtttgccat

SEQ ID NO: 112081 - DNA, 25 bp, Mus musculus
accattaaactccattccagtacac

SEQ ID NO: 112082 - DNA, 25 bp, Mus musculus
accattaaactcgattccagtacac

SEQ ID NO: 112083 - DNA, 25 bp, Mus musculus
accattaagccaccaggatgatcaa

SEQ ID NO: 112084 - DNA, 25 bp, Mus musculus
accattaagccagcaggatgatcaa

SEQ ID NO: 112085 - DNA, 25 bp, Mus musculus
accattaagctactaagatggctct

SEQ ID NO: 112086 - DNA, 25 bp, Mus musculus
accattaagctagtaagatggctct

SEQ ID NO: 112087 - DNA, 25 bp, Mus musculus
accattaatcccactaaagtacaca

SEQ ID NO: 112088 - DNA, 25 bp, Mus musculus
accattaatccctctaaagtacaca

SEQ ID NO: 112089 - DNA, 25 bp, Mus musculus
accattaattggctcaggacctttg

SEQ ID NO: 112090 - DNA, 25 bp, Mus musculus
accattaattgggtcaggacctttg

SEQ ID NO: 112091 - DNA, 25 bp, Mus musculus
accattacaccaccatgtgcttgga

SEQ ID NO: 112092 - DNA, 25 bp, Mus musculus
accattacaccagcatgtgcttgga

SEQ ID NO: 112093 - DNA, 25 bp, Mus musculus
accattacatcaattctgaagcaaa

SEQ ID NO: 112094 - DNA, 25 bp, Mus musculus
accattacatcatttctgaagcaaa

SEQ ID NO: 112095 - DNA, 25 bp, Mus musculus
accattacctcaatacctctttgaa

SEQ ID NO: 112096 - DNA, 25 bp, Mus musculus
accattacctcattacctctttgaa

SEQ ID NO: 112097 - DNA, 25 bp, Mus musculus
accattagcaaccatgttttaccta

SEQ ID NO: 112098 - DNA, 25 bp, Mus musculus
accattagcaacgatgttttaccta

SEQ ID NO: 112099 - DNA, 25 bp, Mus musculus
accattagcgggagacaggcagcca

SEQ ID NO: 112100 - DNA, 25 bp, Mus musculus
accattagcgggtgacaggcagcca

SEQ ID NO: 112101 - DNA, 25 bp, Mus musculus
accattagcggtaacttcaatcctt

SEQ ID NO: 112102 - DNA, 25 bp, Mus musculus
accattagcggttacttcaatcctt

SEQ ID NO: 112103 - DNA, 25 bp, Mus musculus
accattaggaccatgctgctgctat

SEQ ID NO: 112104 - DNA, 25 bp, Mus musculus
accattaggaccttgctgctgctat

SEQ ID NO: 112105 - DNA, 25 bp, Mus musculus
accattagtggaattcacagcaaat

SEQ ID NO: 112106 - DNA, 25 bp, Mus musculus
accattagtggatttcacagcaaat

SEQ ID NO: 112107 - DNA, 25 bp, Mus musculus
accattatgattattctgtagacag

SEQ ID NO: 112108 - DNA, 25 bp, Mus musculus
accattatgatttttctgtagacag

SEQ ID NO: 112109 - DNA, 25 bp, Mus musculus
accattcaagatacctgaccttgga

SEQ ID NO: 112110 - DNA, 25 bp, Mus musculus
accattcaagattcctgaccttgga

SEQ ID NO: 112111 - DNA, 25 bp, Mus musculus
accattcacctgacagacctagaat

SEQ ID NO: 112112 - DNA, 25 bp, Mus musculus
accattcacctgtcagacctagaat

SEQ ID NO: 112113 - DNA, 25 bp, Mus musculus
accattcagatgctgcggtcccaga

SEQ ID NO: 112114 - DNA, 25 bp, Mus musculus
accattcagatggtgcggtcccaga

SEQ ID NO: 112115 - DNA, 25 bp, Mus musculus
accattcagggaagtagttttcact

SEQ ID NO: 112116 - DNA, 25 bp, Mus musculus
accattcagggatgtagttttcact

SEQ ID NO: 112117 - DNA, 25 bp, Mus musculus
accattcagttcattgcctctggga

SEQ ID NO: 112118 - DNA, 25 bp, Mus musculus
accattcagttctttgcctctggga

SEQ ID NO: 112119 - DNA, 25 bp, Mus musculus
accattcagtttatcccctgaggag

SEQ ID NO: 112120 - DNA, 25 bp, Mus musculus
accattcagtttttcccctgaggag

SEQ ID NO: 112121 - DNA, 25 bp, Mus musculus
accattcatgtcagtatagtctcca

SEQ ID NO: 112122 - DNA, 25 bp, Mus musculus
accattcatgtctgtatagtctcca

SEQ ID NO: 112123 - DNA, 25 bp, Mus musculus
accattcattggagctgactacata

SEQ ID NO: 112124 - DNA, 25 bp, Mus musculus
accattcattggtgctgactacata

SEQ ID NO: 112125 - DNA, 25 bp, Mus musculus
accattccacccatcttgagagttg

SEQ ID NO: 112126 - DNA, 25 bp, Mus musculus
accattccacccttcttgagagttg

SEQ ID NO: 112127 - DNA, 25 bp, Mus musculus
accattcccagtatatatgtggtgc

SEQ ID NO: 112128 - DNA, 25 bp, Mus musculus
accattcccagtttatatgtggtgc

SEQ ID NO: 112129 - DNA, 25 bp, Mus musculus
accattccctctatattctgctgtt

SEQ ID NO: 112130 - DNA, 25 bp, Mus musculus
accattccctctttattctgctgtt

SEQ ID NO: 112131 - DNA, 25 bp, Mus musculus
accattccgagacctgcagtgttct

SEQ ID NO: 112132 - DNA, 25 bp, Mus musculus
accattccgagagctgcagtgttct

SEQ ID NO: 112133 - DNA, 25 bp, Mus musculus
accattccggtaccatcaatagcta

SEQ ID NO: 112134 - DNA, 25 bp, Mus musculus
accattccggtagcatcaatagcta

SEQ ID NO: 112135 - DNA, 25 bp, Mus musculus
accattcctaaaacactcaggctgt

SEQ ID NO: 112136 - DNA, 25 bp, Mus musculus
accattcctaaatcactcaggctgt

SEQ ID NO: 112137 - DNA, 25 bp, Mus musculus
accattcctggaaactatatacttt

SEQ ID NO: 112138 - DNA, 25 bp, Mus musculus
accattcctggatactatatacttt

SEQ ID NO: 112139 - DNA, 25 bp, Mus musculus
accattccttttacagtgctgtgaa

SEQ ID NO: 112140 - DNA, 25 bp, Mus musculus
accattcctttttcagtgctgtgaa

SEQ ID NO: 112141 - DNA, 25 bp, Mus musculus
accattcggtagcaacagcggctag

SEQ ID NO: 112142 - DNA, 25 bp, Mus musculus
accattcggtaggaacagcggctag

SEQ ID NO: 112143 - DNA, 25 bp, Mus musculus
accattctaaccagggctacactat

SEQ ID NO: 112144 - DNA, 25 bp, Mus musculus
accattctaacctgggctacactat

SEQ ID NO: 112145 - DNA, 25 bp, Mus musculus
accattctagatctatttcagcctt

SEQ ID NO: 112146 - DNA, 25 bp, Mus musculus
accattctagatgtatttcagcctt

SEQ ID NO: 112147 - DNA, 25 bp, Mus musculus
accattctagctacacagtgagggc

SEQ ID NO: 112148 - DNA, 25 bp, Mus musculus
accattctagcttcacagtgagggc

SEQ ID NO: 112149 - DNA, 25 bp, Mus musculus
accattctagtgaactgccatttcc

SEQ ID NO: 112150 - DNA, 25 bp, Mus musculus
accattctagtgtactgccatttcc

SEQ ID NO: 112151 - DNA, 25 bp, Mus musculus
accattctagttcagtttgtcttag

SEQ ID NO: 112152 - DNA, 25 bp, Mus musculus
accattctagttgagtttgtcttag

SEQ ID NO: 112153 - DNA, 25 bp, Mus musculus
accattctatatactcagactgatg

SEQ ID NO: 112154 - DNA, 25 bp, Mus musculus
accattctatattctcagactgatg

SEQ ID NO: 112155 - DNA, 25 bp, Mus musculus
accattctcaagatatctatgtgtg

SEQ ID NO: 112156 - DNA, 25 bp, Mus musculus
accattctcaagttatctatgtgtg

SEQ ID NO: 112157 - DNA, 25 bp, Mus musculus
accattctctggctgccttggaata

SEQ ID NO: 112158 - DNA, 25 bp, Mus musculus
accattctctgggtgccttggaata

SEQ ID NO: 112159 - DNA, 25 bp, Mus musculus
accattctcttacgccttccttata

SEQ ID NO: 112160 - DNA, 25 bp, Mus musculus
accattctcttaggccttccttata

SEQ ID NO: 112161 - DNA, 25 bp, Mus musculus
accattctgacgcaggtgctgatga

SEQ ID NO: 112162 - DNA, 25 bp, Mus musculus
accattctgacggaggtgctgatga

SEQ ID NO: 112163 - DNA, 25 bp, Mus musculus
accattctgattatccttctggaac

SEQ ID NO: 112164 - DNA, 25 bp, Mus musculus
accattctgattttccttctggaac

SEQ ID NO: 112165 - DNA, 25 bp, Mus musculus
accattctgctcaggatggacaggc

SEQ ID NO: 112166 - DNA, 25 bp, Mus musculus
accattctgctctggatggacaggc

SEQ ID NO: 112167 - DNA, 25 bp, Mus musculus
accattctgtaaatccattctccac

SEQ ID NO: 112168 - DNA, 25 bp, Mus musculus
accattctgtaattccattctccac

SEQ ID NO: 112169 - DNA, 25 bp, Mus musculus
accattctgtgcctgagggtaacag

SEQ ID NO: 112170 - DNA, 25 bp, Mus musculus
accattctgtgcgtgagggtaacag

SEQ ID NO: 112171 - DNA, 25 bp, Mus musculus
accattctgttgaggtgctcactgt

SEQ ID NO: 112172 - DNA, 25 bp, Mus musculus
accattctgttgtggtgctcactgt

SEQ ID NO: 112173 - DNA, 25 bp, Mus musculus
accattcttcaccacgttaaactgt

SEQ ID NO: 112174 - DNA, 25 bp, Mus musculus
accattcttcacgacgttaaactgt

SEQ ID NO: 112175 - DNA, 25 bp, Mus musculus
accattcttgtcactgtggtctttc

SEQ ID NO: 112176 - DNA, 25 bp, Mus musculus
accattcttgtctctgtggtctttc

SEQ ID NO: 112177 - DNA, 25 bp, Mus musculus
accattgaagaactcacacgggaac

SEQ ID NO: 112178 - DNA, 25 bp, Mus musculus
accattgaagaagtcacacgggaac

SEQ ID NO: 112179 - DNA, 25 bp, Mus musculus
accattgacgtcacatcctgtaaac

SEQ ID NO: 112180 - DNA, 25 bp, Mus musculus
accattgacgtctcatcctgtaaac

SEQ ID NO: 112181 - DNA, 25 bp, Mus musculus
accattgattaaacttcatacctga

SEQ ID NO: 112182 - DNA, 25 bp, Mus musculus
accattgattaatcttcatacctga

SEQ ID NO: 112183 - DNA, 25 bp, Mus musculus
accattgattggatgacccctttct

SEQ ID NO: 112184 - DNA, 25 bp, Mus musculus
accattgattggttgacccctttct

SEQ ID NO: 112185 - DNA, 25 bp, Mus musculus
accattgcaatcatagcttgggttg

SEQ ID NO: 112186 - DNA, 25 bp, Mus musculus
accattgcaatcttagcttgggttg

SEQ ID NO: 112187 - DNA, 25 bp, Mus musculus
accattgcagagagaacccgactcc

SEQ ID NO: 112188 - DNA, 25 bp, Mus musculus
accattgcagagtgaacccgactcc

SEQ ID NO: 112189 - DNA, 25 bp, Mus musculus
accattgcagcaaaccggaagatgc

SEQ ID NO: 112190 - DNA, 25 bp, Mus musculus
accattgcagcataccggaagatgc

SEQ ID NO: 112191 - DNA, 25 bp, Mus musculus
accattgcatcacagctgactgact

SEQ ID NO: 112192 - DNA, 25 bp, Mus musculus
accattgcatcagagctgactgact

SEQ ID NO: 112193 - DNA, 25 bp, Mus musculus
accattgccaaaatgggtagagaac

SEQ ID NO: 112194 - DNA, 25 bp, Mus musculus
accattgccaaactctattccatga

SEQ ID NO: 112195 - DNA, 25 bp, Mus musculus
accattgccaaagtctattccatga

SEQ ID NO: 112196 - DNA, 25 bp, Mus musculus
accattgccaaattgggtagagaac

SEQ ID NO: 112197 - DNA, 25 bp, Mus musculus
accattgccaacaactagatccaag

SEQ ID NO: 112198 - DNA, 25 bp, Mus musculus
accattgccaactactagatccaag

SEQ ID NO: 112199 - DNA, 25 bp, Mus musculus
accattgccgagaccagcgaggacg

SEQ ID NO: 112200 - DNA, 25 bp, Mus musculus
accattgccgagctgctgcgtttgc

SEQ ID NO: 112201 - DNA, 25 bp, Mus musculus
accattgccgaggtgctgcgtttgc

SEQ ID NO: 112202 - DNA, 25 bp, Mus musculus
accattgccgagtccagcgaggacg

SEQ ID NO: 112203 - DNA, 25 bp, Mus musculus
accattgcctctaggagccctgcgt

SEQ ID NO: 112204 - DNA, 25 bp, Mus musculus
accattgcctcttggagccctgcgt

SEQ ID NO: 112205 - DNA, 25 bp, Mus musculus
accattgctggcctttccctgttgt

SEQ ID NO: 112206 - DNA, 25 bp, Mus musculus
accattgctggcgtttccctgttgt

SEQ ID NO: 112207 - DNA, 25 bp, Mus musculus
accattggaagacttcggcctccag

SEQ ID NO: 112208 - DNA, 25 bp, Mus musculus
accattggaagagttcggcctccag

SEQ ID NO: 112209 - DNA, 25 bp, Mus musculus
accattggacagaaacatgcacact

SEQ ID NO: 112210 - DNA, 25 bp, Mus musculus
accattggacagtaacatgcacact

SEQ ID NO: 112211 - DNA, 25 bp, Mus musculus
accattggacctagcctaggggttg

SEQ ID NO: 112212 - DNA, 25 bp, Mus musculus
accattggacctagctgttaatttt

SEQ ID NO: 112213 - DNA, 25 bp, Mus musculus
accattggaccttgcctaggggttg

SEQ ID NO: 112214 - DNA, 25 bp, Mus musculus
accattggaccttgctgttaatttt

SEQ ID NO: 112215 - DNA, 25 bp, Mus musculus
accattggacttcaaacctgttcaa

SEQ ID NO: 112216 - DNA, 25 bp, Mus musculus
accattggacttgaaacctgttcaa

SEQ ID NO: 112217 - DNA, 25 bp, Mus musculus
accattggaggcagatgttgccact

SEQ ID NO: 112218 - DNA, 25 bp, Mus musculus
accattggaggctgatgttgccact

SEQ ID NO: 112219 - DNA, 25 bp, Mus musculus
accattggatagcacgtcatctcta

SEQ ID NO: 112220 - DNA, 25 bp, Mus musculus
accattggataggacgtcatctcta

SEQ ID NO: 112221 - DNA, 25 bp, Mus musculus
accattggcagaatgtcccaggcga

SEQ ID NO: 112222 - DNA, 25 bp, Mus musculus
accattggcagattgtcccaggcga

SEQ ID NO: 112223 - DNA, 25 bp, Mus musculus
accattggccggatgagttcagaga

SEQ ID NO: 112224 - DNA, 25 bp, Mus musculus
accattggccggttgagttcagaga

SEQ ID NO: 112225 - DNA, 25 bp, Mus musculus
accattggctgaaccaggctttatc

SEQ ID NO: 112226 - DNA, 25 bp, Mus musculus
accattggctgatccaggctttatc

SEQ ID NO: 112227 - DNA, 25 bp, Mus musculus
accattgggctcacttcctgcttcg

SEQ ID NO: 112228 - DNA, 25 bp, Mus musculus
accattgggctccagataccaggtt

SEQ ID NO: 112229 - DNA, 25 bp, Mus musculus
accattgggctcgagataccaggtt

SEQ ID NO: 112230 - DNA, 25 bp, Mus musculus
accattgggctctcttcctgcttcg

SEQ ID NO: 112231 - DNA, 25 bp, Mus musculus
accattgggttgatccctgctgtga

SEQ ID NO: 112232 - DNA, 25 bp, Mus musculus
accattgggttgttccctgctgtga

SEQ ID NO: 112233 - DNA, 25 bp, Mus musculus
accattggtcacaaggctacaactt

SEQ ID NO: 112234 - DNA, 25 bp, Mus musculus
accattggtcactaggctacaactt

SEQ ID NO: 112235 - DNA, 25 bp, Mus musculus
accattggtctcagccagctgaagt

SEQ ID NO: 112236 - DNA, 25 bp, Mus musculus
accattggtctctgccagctgaagt

SEQ ID NO: 112237 - DNA, 25 bp, Mus musculus
accattggttaccttctggcacagc

SEQ ID NO: 112238 - DNA, 25 bp, Mus musculus
accattggttacgttctggcacagc

SEQ ID NO: 112239 - DNA, 25 bp, Mus musculus
accattgtacttacataggactttc

SEQ ID NO: 112240 - DNA, 25 bp, Mus musculus
accattgtactttcataggactttc

SEQ ID NO: 112241 - DNA, 25 bp, Mus musculus
accattgtcaggattcttctttact

SEQ ID NO: 112242 - DNA, 25 bp, Mus musculus
accattgtcaggtttcttctttact

SEQ ID NO: 112243 - DNA, 25 bp, Mus musculus
accattgtcatcctcgaatgcataa

SEQ ID NO: 112244 - DNA, 25 bp, Mus musculus
accattgtcatcgtcgaatgcataa

SEQ ID NO: 112245 - DNA, 25 bp, Mus musculus
accattgtcatgagcacctgtgctt

SEQ ID NO: 112246 - DNA, 25 bp, Mus musculus
accattgtcatgtgcacctgtgctt

SEQ ID NO: 112247 - DNA, 25 bp, Mus musculus
accattgtgcttactgagatccgtg

SEQ ID NO: 112248 - DNA, 25 bp, Mus musculus
accattgtgctttctgagatccgtg

SEQ ID NO: 112249 - DNA, 25 bp, Mus musculus
accattgtggtgatgcaggctgtca

SEQ ID NO: 112250 - DNA, 25 bp, Mus musculus
accattgtggtgttgcaggctgtca

SEQ ID NO: 112251 - DNA, 25 bp, Mus musculus
accattgtgtttaagctgtattgaa

SEQ ID NO: 112252 - DNA, 25 bp, Mus musculus
accattgtgttttagctgtattgaa

SEQ ID NO: 112253 - DNA, 25 bp, Mus musculus
accattgttaatagtctgtctctat

SEQ ID NO: 112254 - DNA, 25 bp, Mus musculus
accattgttaattgtctgtctctat

SEQ ID NO: 112255 - DNA, 25 bp, Mus musculus
accattgttacgctttgtaaagcat

SEQ ID NO: 112256 - DNA, 25 bp, Mus musculus
accattgttacggtttgtaaagcat

SEQ ID NO: 112257 - DNA, 25 bp, Mus musculus
accattgttcatctgtgtatttttc

SEQ ID NO: 112258 - DNA, 25 bp, Mus musculus
accattgttcatgtgtgtatttttc

SEQ ID NO: 112259 - DNA, 25 bp, Mus musculus
accattgttccaagcattctcaaga

SEQ ID NO: 112260 - DNA, 25 bp, Mus musculus
accattgttccatgcattctcaaga

SEQ ID NO: 112261 - DNA, 25 bp, Mus musculus
accattgttcgtatccatatgctct

SEQ ID NO: 112262 - DNA, 25 bp, Mus musculus
accattgttcgtttccatatgctct

SEQ ID NO: 112263 - DNA, 25 bp, Mus musculus
accatttacacccttggtactggtg

SEQ ID NO: 112264 - DNA, 25 bp, Mus musculus
accatttacaccgttggtactggtg

SEQ ID NO: 112265 - DNA, 25 bp, Mus musculus
accatttacacgcaccatcagaaga

SEQ ID NO: 112266 - DNA, 25 bp, Mus musculus
accatttacacggaccatcagaaga

SEQ ID NO: 112267 - DNA, 25 bp, Mus musculus
accatttatcatcacttagacattg

SEQ ID NO: 112268 - DNA, 25 bp, Mus musculus
accatttatcatgacttagacattg

SEQ ID NO: 112269 - DNA, 25 bp, Mus musculus
accatttatctgctgaaatatgtga

SEQ ID NO: 112270 - DNA, 25 bp, Mus musculus
accatttatctggtgaaatatgtga

SEQ ID NO: 112271 - DNA, 25 bp, Mus musculus
accatttcagctctgggctttgtca

SEQ ID NO: 112272 - DNA, 25 bp, Mus musculus
accatttcagctgtgggctttgtca

SEQ ID NO: 112273 - DNA, 25 bp, Mus musculus
accatttcatagctgtgggctatca

SEQ ID NO: 112274 - DNA, 25 bp, Mus musculus
accatttcataggtgtgggctatca

SEQ ID NO: 112275 - DNA, 25 bp, Mus musculus
accatttcattcactgtattagtag

SEQ ID NO: 112276 - DNA, 25 bp, Mus musculus
accatttcattctctgtattagtag

SEQ ID NO: 112277 - DNA, 25 bp, Mus musculus
accatttccatcagcaagcatctta

SEQ ID NO: 112278 - DNA, 25 bp, Mus musculus
accatttccatctgcaagcatctta

SEQ ID NO: 112279 - DNA, 25 bp, Mus musculus
accatttcccaaaggctgcaacagc

SEQ ID NO: 112280 - DNA, 25 bp, Mus musculus
accatttcccaatggctgcaacagc

SEQ ID NO: 112281 - DNA, 25 bp, Mus musculus
accatttccttcagctacttttgag

SEQ ID NO: 112282 - DNA, 25 bp, Mus musculus
accatttccttctgctacttttgag

SEQ ID NO: 112283 - DNA, 25 bp, Mus musculus
accatttctgataactgtgtgcttc

SEQ ID NO: 112284 - DNA, 25 bp, Mus musculus
accatttctgatattttcaccacga

SEQ ID NO: 112285 - DNA, 25 bp, Mus musculus
accatttctgattactgtgtgcttc

SEQ ID NO: 112286 - DNA, 25 bp, Mus musculus
accatttctgattttttcaccacga

SEQ ID NO: 112287 - DNA, 25 bp, Mus musculus
accatttctgcgctgggagcaatag

SEQ ID NO: 112288 - DNA, 25 bp, Mus musculus
accatttctgcggtgggagcaatag

SEQ ID NO: 112289 - DNA, 25 bp, Mus musculus
accatttgaggaagcgtcgtttgct

SEQ ID NO: 112290 - DNA, 25 bp, Mus musculus
accatttgaggatgcgtcgtttgct

SEQ ID NO: 112291 - DNA, 25 bp, Mus musculus
accatttgctcacgctagctaggca

SEQ ID NO: 112292 - DNA, 25 bp, Mus musculus
accatttgctcaggctagctaggca

SEQ ID NO: 112293 - DNA, 25 bp, Mus musculus
accatttgctgcatttctcttagga

SEQ ID NO: 112294 - DNA, 25 bp, Mus musculus
accatttgctgcttttctcttagga

SEQ ID NO: 112295 - DNA, 25 bp, Mus musculus
accatttgtacacaatgaatttcaa

SEQ ID NO: 112296 - DNA, 25 bp, Mus musculus
accatttgtacagaatgaatttcaa

SEQ ID NO: 112297 - DNA, 25 bp, Mus musculus
accatttgtattatgtccttcacag

SEQ ID NO: 112298 - DNA, 25 bp, Mus musculus
accatttgtattttgtccttcacag

SEQ ID NO: 112299 - DNA, 25 bp, Mus musculus
accatttgtcggacttccatgagaa

SEQ ID NO: 112300 - DNA, 25 bp, Mus musculus
accatttgtcggtcttccatgagaa

SEQ ID NO: 112301 - DNA, 25 bp, Mus musculus
accatttgttgtactgtcttctact

SEQ ID NO: 112302 - DNA, 25 bp, Mus musculus
accatttgttgttctgtcttctact

SEQ ID NO: 112303 - DNA, 25 bp, Mus musculus
accattttaattagttggctggatg

SEQ ID NO: 112304 - DNA, 25 bp, Mus musculus
accattttaatttgttggctggatg

SEQ ID NO: 112305 - DNA, 25 bp, Mus musculus
accattttatgcagaactgtagaac

SEQ ID NO: 112306 - DNA, 25 bp, Mus musculus
accattttatgctgaactgtagaac

SEQ ID NO: 112307 - DNA, 25 bp, Mus musculus
accattttatgtaccatctgctgaa

SEQ ID NO: 112308 - DNA, 25 bp, Mus musculus
accattttatgttccatctgctgaa

SEQ ID NO: 112309 - DNA, 25 bp, Mus musculus
accattttcagtaatttgctgtgca

SEQ ID NO: 112310 - DNA, 25 bp, Mus musculus
accattttcagttatttgctgtgca

SEQ ID NO: 112311 - DNA, 25 bp, Mus musculus
accattttccagaaggacctctaat

SEQ ID NO: 112312 - DNA, 25 bp, Mus musculus
accattttccagtaggacctctaat

SEQ ID NO: 112313 - DNA, 25 bp, Mus musculus
accattttcccaagtggcctttgat

SEQ ID NO: 112314 - DNA, 25 bp, Mus musculus
accattttcccatgtggcctttgat

SEQ ID NO: 112315 - DNA, 25 bp, Mus musculus
accattttcggtcaggctgaggctg

SEQ ID NO: 112316 - DNA, 25 bp, Mus musculus
accattttcggtgaggctgaggctg

SEQ ID NO: 112317 - DNA, 25 bp, Mus musculus
accattttcttcagatcagggcaga

SEQ ID NO: 112318 - DNA, 25 bp, Mus musculus
accattttcttctgatcagggcaga

SEQ ID NO: 112319 - DNA, 25 bp, Mus musculus
accattttgctaccagtttcattga

SEQ ID NO: 112320 - DNA, 25 bp, Mus musculus
accattttgctagcagtttcattga

SEQ ID NO: 112321 - DNA, 25 bp, Mus musculus
accattttgtcactctcttctgcat

SEQ ID NO: 112322 - DNA, 25 bp, Mus musculus
accattttgtcagtctcttctgcat

SEQ ID NO: 112323 - DNA, 25 bp, Mus musculus
accattttgtctcagggtttcctct

SEQ ID NO: 112324 - DNA, 25 bp, Mus musculus
accattttgtctgagggtttcctct

SEQ ID NO: 112325 - DNA, 25 bp, Mus musculus
accatttttctgctttgctaggcat

SEQ ID NO: 112326 - DNA, 25 bp, Mus musculus
accatttttctggtttgctaggcat

SEQ ID NO: 112327 - DNA, 25 bp, Mus musculus
accatttttgtaaactgaacttcta

SEQ ID NO: 112328 - DNA, 25 bp, Mus musculus
accatttttgtatactgaacttcta

SEQ ID NO: 112329 - DNA, 25 bp, Mus musculus
acccaaaaagtcagtctcctagaag

SEQ ID NO: 112330 - DNA, 25 bp, Mus musculus
acccaaaaagtctgtctcctagaag

SEQ ID NO: 112331 - DNA, 25 bp, Mus musculus
acccaaaactttaagcctgctcctg

SEQ ID NO: 112332 - DNA, 25 bp, Mus musculus
acccaaaacttttagcctgctcctg

SEQ ID NO: 112333 - DNA, 25 bp, Mus musculus
acccaaaagggcaaaggcacagtat

SEQ ID NO: 112334 - DNA, 25 bp, Mus musculus
acccaaaagggctaaggcacagtat

SEQ ID NO: 112335 - DNA, 25 bp, Mus musculus
acccaaaatgctcaggtccttgtgg

SEQ ID NO: 112336 - DNA, 25 bp, Mus musculus
acccaaaatgctgaggtccttgtgg

SEQ ID NO: 112337 - DNA, 25 bp, Mus musculus
acccaaaattagctgacctgcccat

SEQ ID NO: 112338 - DNA, 25 bp, Mus musculus
acccaaaattaggtgacctgcccat

SEQ ID NO: 112339 - DNA, 25 bp, Mus musculus
acccaaacagatatggttgccacca

SEQ ID NO: 112340 - DNA, 25 bp, Mus musculus
acccaaacagatttggttgccacca

SEQ ID NO: 112341 - DNA, 25 bp, Mus musculus
acccaaacatcgacctggacaagtt

SEQ ID NO: 112342 - DNA, 25 bp, Mus musculus
acccaaacatcgtcctggacaagtt

SEQ ID NO: 112343 - DNA, 25 bp, Mus musculus
acccaaacctggacactcagcaaag

SEQ ID NO: 112344 - DNA, 25 bp, Mus musculus
acccaaacctggtcactcagcaaag

SEQ ID NO: 112345 - DNA, 25 bp, Mus musculus
acccaaactgccataggagatgctg

SEQ ID NO: 112346 - DNA, 25 bp, Mus musculus
acccaaactgccttaggagatgctg

SEQ ID NO: 112347 - DNA, 25 bp, Mus musculus
acccaaacttcacgtcagaatccag

SEQ ID NO: 112348 - DNA, 25 bp, Mus musculus
acccaaacttcaggtcagaatccag

SEQ ID NO: 112349 - DNA, 25 bp, Mus musculus
acccaaagacgtcgtatctgtccaa

SEQ ID NO: 112350 - DNA, 25 bp, Mus musculus
acccaaagacgtggtatctgtccaa

SEQ ID NO: 112351 - DNA, 25 bp, Mus musculus
acccaaagagcgactaccaggttga

SEQ ID NO: 112352 - DNA, 25 bp, Mus musculus
acccaaagagcgtctaccaggttga

SEQ ID NO: 112353 - DNA, 25 bp, Mus musculus
acccaaagtgcccaattttcatctt

SEQ ID NO: 112354 - DNA, 25 bp, Mus musculus
acccaaagtgccgaattttcatctt

SEQ ID NO: 112355 - DNA, 25 bp, Mus musculus
acccaaagttcaccaagagctagga

SEQ ID NO: 112356 - DNA, 25 bp, Mus musculus
acccaaagttcagcaagagctagga

SEQ ID NO: 112357 - DNA, 25 bp, Mus musculus
acccaaagttgtacgtgcccagcac

SEQ ID NO: 112358 - DNA, 25 bp, Mus musculus
acccaaagttgttcgtgcccagcac

SEQ ID NO: 112359 - DNA, 25 bp, Mus musculus
acccaaatactgagccatttttcta

SEQ ID NO: 112360 - DNA, 25 bp, Mus musculus
acccaaatactgtgccatttttcta

SEQ ID NO: 112361 - DNA, 25 bp, Mus musculus
acccaacaaaccagtgatggctttt

SEQ ID NO: 112362 - DNA, 25 bp, Mus musculus
acccaacaaacctgtgatggctttt

SEQ ID NO: 112363 - DNA, 25 bp, Mus musculus
acccaacaactgatgcaagctgatg

SEQ ID NO: 112364 - DNA, 25 bp, Mus musculus
acccaacaactgttgcaagctgatg

SEQ ID NO: 112365 - DNA, 25 bp, Mus musculus
acccaacaagcccagaagctgaaag

SEQ ID NO: 112366 - DNA, 25 bp, Mus musculus
acccaacaagccgagaagctgaaag

SEQ ID NO: 112367 - DNA, 25 bp, Mus musculus
acccaacacaatactaatctcttct

SEQ ID NO: 112368 - DNA, 25 bp, Mus musculus
acccaacacaattctaatctcttct

SEQ ID NO: 112369 - DNA, 25 bp, Mus musculus
acccaacaccttctcatgaaacaat

SEQ ID NO: 112370 - DNA, 25 bp, Mus musculus
acccaacaccttgtcatgaaacaat

SEQ ID NO: 112371 - DNA, 25 bp, Mus musculus
acccaacacgctcttcgagaagaaa

SEQ ID NO: 112372 - DNA, 25 bp, Mus musculus
acccaacacgctgttcgagaagaaa

SEQ ID NO: 112373 - DNA, 25 bp, Mus musculus
acccaacagtgtctgctggaaaccc

SEQ ID NO: 112374 - DNA, 25 bp, Mus musculus
acccaacagtgtgtgctggaaaccc

SEQ ID NO: 112375 - DNA, 25 bp, Mus musculus
acccaaccaaagagatctaaagtct

SEQ ID NO: 112376 - DNA, 25 bp, Mus musculus
acccaaccaaagtgatctaaagtct

SEQ ID NO: 112377 - DNA, 25 bp, Mus musculus
acccaacccaatcccatttgagatt

SEQ ID NO: 112378 - DNA, 25 bp, Mus musculus
acccaacccaatgccatttgagatt

SEQ ID NO: 112379 - DNA, 25 bp, Mus musculus
acccaaccctgtctactctgtatta

SEQ ID NO: 112380 - DNA, 25 bp, Mus musculus
acccaaccctgtgtactctgtatta

SEQ ID NO: 112381 - DNA, 25 bp, Mus musculus
acccaacctgatctgtggcacggat

SEQ ID NO: 112382 - DNA, 25 bp, Mus musculus
acccaacctgatgtgtggcacggat

SEQ ID NO: 112383 - DNA, 25 bp, Mus musculus
acccaacctttcagggatgtgctga

SEQ ID NO: 112384 - DNA, 25 bp, Mus musculus
acccaacctttctgggatgtgctga

SEQ ID NO: 112385 - DNA, 25 bp, Mus musculus
acccaactcgcaccttgcatggaat

SEQ ID NO: 112386 - DNA, 25 bp, Mus musculus
acccaactcgcagcttgcatggaat

SEQ ID NO: 112387 - DNA, 25 bp, Mus musculus
acccaactgacaacttcctatggaa

SEQ ID NO: 112388 - DNA, 25 bp, Mus musculus
acccaactgacatcttcctatggaa

SEQ ID NO: 112389 - DNA, 25 bp, Mus musculus
acccaactgatacggcttcacacag

SEQ ID NO: 112390 - DNA, 25 bp, Mus musculus
acccaactgatagggcttcacacag

SEQ ID NO: 112391 - DNA, 25 bp, Mus musculus
acccaacttgttcttcctggtcaag

SEQ ID NO: 112392 - DNA, 25 bp, Mus musculus
acccaacttgttgttcctggtcaag

SEQ ID NO: 112393 - DNA, 25 bp, Mus musculus
acccaagaagcaaatatcccagatt

SEQ ID NO: 112394 - DNA, 25 bp, Mus musculus
acccaagaagcatatatcccagatt

SEQ ID NO: 112395 - DNA, 25 bp, Mus musculus
acccaagagcaaataagggcttcag

SEQ ID NO: 112396 - DNA, 25 bp, Mus musculus
acccaagagcaattaagggcttcag

SEQ ID NO: 112397 - DNA, 25 bp, Mus musculus
acccaagccagtacaaaatgtcctc

SEQ ID NO: 112398 - DNA, 25 bp, Mus musculus
acccaagccagttcaaaatgtcctc

SEQ ID NO: 112399 - DNA, 25 bp, Mus musculus
acccaagccatcaaactcagaggag

SEQ ID NO: 112400 - DNA, 25 bp, Mus musculus
acccaagccatctaactcagaggag

SEQ ID NO: 112401 - DNA, 25 bp, Mus musculus
acccaagcccgccagagtgaagaag

SEQ ID NO: 112402 - DNA, 25 bp, Mus musculus
acccaagcccgcgagagtgaagaag

SEQ ID NO: 112403 - DNA, 25 bp, Mus musculus
acccaagcttacctagtgctcttaa

SEQ ID NO: 112404 - DNA, 25 bp, Mus musculus
acccaagcttacgtagtgctcttaa

SEQ ID NO: 112405 - DNA, 25 bp, Mus musculus
acccaagcttgcctagatctttatg

SEQ ID NO: 112406 - DNA, 25 bp, Mus musculus
acccaagcttgcgtagatctttatg

SEQ ID NO: 112407 - DNA, 25 bp, Mus musculus
acccaaggcggacgcccagtgcgta

SEQ ID NO: 112408 - DNA, 25 bp, Mus musculus
acccaaggcggaggcccagtgcgta

SEQ ID NO: 112409 - DNA, 25 bp, Mus musculus
acccaaggctgtcatgaaataagat

SEQ ID NO: 112410 - DNA, 25 bp, Mus musculus
acccaaggctgtgatgaaataagat

SEQ ID NO: 112411 - DNA, 25 bp, Mus musculus
acccaaggcttgatatttgtggttg

SEQ ID NO: 112412 - DNA, 25 bp, Mus musculus
acccaaggcttgttatttgtggttg

SEQ ID NO: 112413 - DNA, 25 bp, Mus musculus
acccaagggacaattccaacttgct

SEQ ID NO: 112414 - DNA, 25 bp, Mus musculus
acccaagggacatttccaacttgct

SEQ ID NO: 112415 - DNA, 25 bp, Mus musculus
acccaagggccaatgttcaataaat

SEQ ID NO: 112416 - DNA, 25 bp, Mus musculus
acccaagggccattgttcaataaat

SEQ ID NO: 112417 - DNA, 25 bp, Mus musculus
acccaagggcctcgctggacagagt

SEQ ID NO: 112418 - DNA, 25 bp, Mus musculus
acccaagggcctggctggacagagt

SEQ ID NO: 112419 - DNA, 25 bp, Mus musculus
acccaagggtagctctcagtgcatg

SEQ ID NO: 112420 - DNA, 25 bp, Mus musculus
acccaagggtaggtctcagtgcatg

SEQ ID NO: 112421 - DNA, 25 bp, Mus musculus
acccaaggttaaagccccagcactg

SEQ ID NO: 112422 - DNA, 25 bp, Mus musculus
acccaaggttaatgccccagcactg

SEQ ID NO: 112423 - DNA, 25 bp, Mus musculus
acccaaggttctctattttcagcac

SEQ ID NO: 112424 - DNA, 25 bp, Mus musculus
acccaaggttctgtattttcagcac

SEQ ID NO: 112425 - DNA, 25 bp, Mus musculus
acccaagtatgcaaggttgaggtat

SEQ ID NO: 112426 - DNA, 25 bp, Mus musculus
acccaagtatgctaggttgaggtat

SEQ ID NO: 112427 - DNA, 25 bp, Mus musculus
acccaagtcatgacctgtagctaat

SEQ ID NO: 112428 - DNA, 25 bp, Mus musculus
acccaagtcatgtcctgtagctaat

SEQ ID NO: 112429 - DNA, 25 bp, Mus musculus
acccaagtctagagataaaatccaa

SEQ ID NO: 112430 - DNA, 25 bp, Mus musculus
acccaagtctagtgataaaatccaa

SEQ ID NO: 112431 - DNA, 25 bp, Mus musculus
acccaagtctgtcgcagaggtctct

SEQ ID NO: 112432 - DNA, 25 bp, Mus musculus
acccaagtctgtggcagaggtctct

SEQ ID NO: 112433 - DNA, 25 bp, Mus musculus
acccaagtggacagtgccagtatag

SEQ ID NO: 112434 - DNA, 25 bp, Mus musculus
acccaagtggactgtgccagtatag

SEQ ID NO: 112435 - DNA, 25 bp, Mus musculus
acccaagtggtgagtggcaggttct

SEQ ID NO: 112436 - DNA, 25 bp, Mus musculus
acccaagtggtgtgtggcaggttct

SEQ ID NO: 112437 - DNA, 25 bp, Mus musculus
acccaagtggttcagacgattatca

SEQ ID NO: 112438 - DNA, 25 bp, Mus musculus
acccaagtggttgagacgattatca

SEQ ID NO: 112439 - DNA, 25 bp, Mus musculus
acccaagttaacaagcagattccaa

SEQ ID NO: 112440 - DNA, 25 bp, Mus musculus
acccaagttaactagcagattccaa

SEQ ID NO: 112441 - DNA, 25 bp, Mus musculus
acccaagttccacatatgcttcatt

SEQ ID NO: 112442 - DNA, 25 bp, Mus musculus
acccaagttccagatatgcttcatt

SEQ ID NO: 112443 - DNA, 25 bp, Mus musculus
acccaagttctccattttgctgtag

SEQ ID NO: 112444 - DNA, 25 bp, Mus musculus
acccaagttctcgattttgctgtag

SEQ ID NO: 112445 - DNA, 25 bp, Mus musculus
acccaagttgcccagttctgagtag

SEQ ID NO: 112446 - DNA, 25 bp, Mus musculus
acccaagttgccgagttctgagtag

SEQ ID NO: 112447 - DNA, 25 bp, Mus musculus
acccaagtttaaccttatttgcatg

SEQ ID NO: 112448 - DNA, 25 bp, Mus musculus
acccaagtttaagcttatttgcatg

SEQ ID NO: 112449 - DNA, 25 bp, Mus musculus
acccaagttttcaccagtgaactat

SEQ ID NO: 112450 - DNA, 25 bp, Mus musculus
acccaagttttctccagtgaactat

SEQ ID NO: 112451 - DNA, 25 bp, Mus musculus
acccaagttttgagttctatgtgtg

SEQ ID NO: 112452 - DNA, 25 bp, Mus musculus
acccaagttttgtgttctatgtgtg

SEQ ID NO: 112453 - DNA, 25 bp, Mus musculus
acccaatcagctcaggatctttgtg

SEQ ID NO: 112454 - DNA, 25 bp, Mus musculus
acccaatcagctgaggatctttgtg

SEQ ID NO: 112455 - DNA, 25 bp, Mus musculus
acccaatccattctacctgatgtca

SEQ ID NO: 112456 - DNA, 25 bp, Mus musculus
acccaatccattgtacctgatgtca

SEQ ID NO: 112457 - DNA, 25 bp, Mus musculus
acccaatgactaatgctgcaacaat

SEQ ID NO: 112458 - DNA, 25 bp, Mus musculus
acccaatgactattgctgcaacaat

SEQ ID NO: 112459 - DNA, 25 bp, Mus musculus
acccaatgcaagatgccatctctca

SEQ ID NO: 112460 - DNA, 25 bp, Mus musculus
acccaatgcaagttgccatctctca

SEQ ID NO: 112461 - DNA, 25 bp, Mus musculus
acccaatgccttcgtcgtatacaga

SEQ ID NO: 112462 - DNA, 25 bp, Mus musculus
acccaatgccttggtcgtatacaga

SEQ ID NO: 112463 - DNA, 25 bp, Mus musculus
acccaatggactactgtggttagga

SEQ ID NO: 112464 - DNA, 25 bp, Mus musculus
acccaatggacttctgtggttagga

SEQ ID NO: 112465 - DNA, 25 bp, Mus musculus
acccaatggccgagcaacgtatatt

SEQ ID NO: 112466 - DNA, 25 bp, Mus musculus
acccaatggccgtgcaacgtatatt

SEQ ID NO: 112467 - DNA, 25 bp, Mus musculus
acccaatgtattatagctattttag

SEQ ID NO: 112468 - DNA, 25 bp, Mus musculus
acccaatgtattttagctattttag

SEQ ID NO: 112469 - DNA, 25 bp, Mus musculus
acccaattgccaagttcaggtggtt

SEQ ID NO: 112470 - DNA, 25 bp, Mus musculus
acccaattgccatgttcaggtggtt

SEQ ID NO: 112471 - DNA, 25 bp, Mus musculus
acccaatttcttcccatttattgta

SEQ ID NO: 112472 - DNA, 25 bp, Mus musculus
acccaatttcttgccatttattgta

SEQ ID NO: 112473 - DNA, 25 bp, Mus musculus
acccacaaagaaccaggttaaatgt

SEQ ID NO: 112474 - DNA, 25 bp, Mus musculus
acccacaaagaagcaggttaaatgt

SEQ ID NO: 112475 - DNA, 25 bp, Mus musculus
acccacaaggcaatgacttcaacct

SEQ ID NO: 112476 - DNA, 25 bp, Mus musculus
acccacaaggcattgacttcaacct

SEQ ID NO: 112477 - DNA, 25 bp, Mus musculus
acccacaaggctctggtcttcaaga

SEQ ID NO: 112478 - DNA, 25 bp, Mus musculus
acccacaaggctgtggtcttcaaga

SEQ ID NO: 112479 - DNA, 25 bp, Mus musculus
acccacaatgtaactttcacctttt

SEQ ID NO: 112480 - DNA, 25 bp, Mus musculus
acccacaatgtatctttcacctttt

SEQ ID NO: 112481 - DNA, 25 bp, Mus musculus
acccacacaaataccgcatgcttat

SEQ ID NO: 112482 - DNA, 25 bp, Mus musculus
acccacacaaattccgcatgcttat

SEQ ID NO: 112483 - DNA, 25 bp, Mus musculus
acccacacacatactggtagcacag

SEQ ID NO: 112484 - DNA, 25 bp, Mus musculus
acccacacacattctggtagcacag

SEQ ID NO: 112485 - DNA, 25 bp, Mus musculus
acccacaccatcactgatgctgtta

SEQ ID NO: 112486 - DNA, 25 bp, Mus musculus
acccacaccatctctgatgctgtta

SEQ ID NO: 112487 - DNA, 25 bp, Mus musculus
acccacacctctataagtatgcagc

SEQ ID NO: 112488 - DNA, 25 bp, Mus musculus
acccacacctctttaagtatgcagc

SEQ ID NO: 112489 - DNA, 25 bp, Mus musculus
acccacaccttaattgctgtttgaa

SEQ ID NO: 112490 - DNA, 25 bp, Mus musculus
acccacaccttatttgctgtttgaa

SEQ ID NO: 112491 - DNA, 25 bp, Mus musculus
acccacacgaataggagcctgagaa

SEQ ID NO: 112492 - DNA, 25 bp, Mus musculus
acccacacgaattggagcctgagaa

SEQ ID NO: 112493 - DNA, 25 bp, Mus musculus
acccacacgggccagagaagtaact

SEQ ID NO: 112494 - DNA, 25 bp, Mus musculus
acccacacgggcgagagaagtaact

SEQ ID NO: 112495 - DNA, 25 bp, Mus musculus
acccacactgggagacacagcaggg

SEQ ID NO: 112496 - DNA, 25 bp, Mus musculus
acccacactgggtgacacagcaggg

SEQ ID NO: 112497 - DNA, 25 bp, Mus musculus
acccacagaacaaaaattctcttta

SEQ ID NO: 112498 - DNA, 25 bp, Mus musculus
acccacagaacataaattctcttta

SEQ ID NO: 112499 - DNA, 25 bp, Mus musculus
acccacagaacgcatgcaaatatcc

SEQ ID NO: 112500 - DNA, 25 bp, Mus musculus
acccacagaacggatgcaaatatcc

SEQ ID NO: 112501 - DNA, 25 bp, Mus musculus
acccacagagctacttacatggtat

SEQ ID NO: 112502 - DNA, 25 bp, Mus musculus
acccacagagctccgggcattggtg

SEQ ID NO: 112503 - DNA, 25 bp, Mus musculus
acccacagagctgcgggcattggtg

SEQ ID NO: 112504 - DNA, 25 bp, Mus musculus
acccacagagcttcttacatggtat

SEQ ID NO: 112505 - DNA, 25 bp, Mus musculus
acccacaggacacagagtgcaacaa

SEQ ID NO: 112506 - DNA, 25 bp, Mus musculus
acccacaggacagagagtgcaacaa

SEQ ID NO: 112507 - DNA, 25 bp, Mus musculus
acccacaggttcagagacggttcta

SEQ ID NO: 112508 - DNA, 25 bp, Mus musculus
acccacaggttctgagacggttcta

SEQ ID NO: 112509 - DNA, 25 bp, Mus musculus
acccacagtacaatctaaaagccag

SEQ ID NO: 112510 - DNA, 25 bp, Mus musculus
acccacagtacattctaaaagccag

SEQ ID NO: 112511 - DNA, 25 bp, Mus musculus
acccacagtggccatttaagaagaa

SEQ ID NO: 112512 - DNA, 25 bp, Mus musculus
acccacagtggcgatttaagaagaa

SEQ ID NO: 112513 - DNA, 25 bp, Mus musculus
acccacagtgggacacagcgataga

SEQ ID NO: 112514 - DNA, 25 bp, Mus musculus
acccacagtgggtcacagcgataga

SEQ ID NO: 112515 - DNA, 25 bp, Mus musculus
acccacagtgttagcagcggttttt

SEQ ID NO: 112516 - DNA, 25 bp, Mus musculus
acccacagtgtttgcagcggttttt

SEQ ID NO: 112517 - DNA, 25 bp, Mus musculus
acccacatacatatctgccagtgtt

SEQ ID NO: 112518 - DNA, 25 bp, Mus musculus
acccacatacatttctgccagtgtt

SEQ ID NO: 112519 - DNA, 25 bp, Mus musculus
acccacataggaccagattgcacat

SEQ ID NO: 112520 - DNA, 25 bp, Mus musculus
acccacataggagcagattgcacat

SEQ ID NO: 112521 - DNA, 25 bp, Mus musculus
acccacatagtgctgttagttctag

SEQ ID NO: 112522 - DNA, 25 bp, Mus musculus
acccacatagtggtgttagttctag

SEQ ID NO: 112523 - DNA, 25 bp, Mus musculus
acccacatcactctttttaggcagt

SEQ ID NO: 112524 - DNA, 25 bp, Mus musculus
acccacatcactgtttttaggcagt

SEQ ID NO: 112525 - DNA, 25 bp, Mus musculus
acccacatcagccagctctgtgaag

SEQ ID NO: 112526 - DNA, 25 bp, Mus musculus
acccacatcagcgagctctgtgaag

SEQ ID NO: 112527 - DNA, 25 bp, Mus musculus
acccacatctttacaataatagtac

SEQ ID NO: 112528 - DNA, 25 bp, Mus musculus
acccacatcttttcaataatagtac

SEQ ID NO: 112529 - DNA, 25 bp, Mus musculus
acccacatgaatcctcacagtcttt

SEQ ID NO: 112530 - DNA, 25 bp, Mus musculus
acccacatgaatgctcacagtcttt

SEQ ID NO: 112531 - DNA, 25 bp, Mus musculus
acccacatggaaccttttaacagtt

SEQ ID NO: 112532 - DNA, 25 bp, Mus musculus
acccacatggaagcttttaacagtt

SEQ ID NO: 112533 - DNA, 25 bp, Mus musculus
acccacatgggtatttatatctgaa

SEQ ID NO: 112534 - DNA, 25 bp, Mus musculus
acccacatgggtttttatatctgaa

SEQ ID NO: 112535 - DNA, 25 bp, Mus musculus
acccacattcttctgaaggctgatt

SEQ ID NO: 112536 - DNA, 25 bp, Mus musculus
acccacattcttgtgaaggctgatt

SEQ ID NO: 112537 - DNA, 25 bp, Mus musculus
acccacattttcaataaaaggctgt

SEQ ID NO: 112538 - DNA, 25 bp, Mus musculus
acccacattttctataaaaggctgt

SEQ ID NO: 112539 - DNA, 25 bp, Mus musculus
acccaccagcatcaagtttcggaca

SEQ ID NO: 112540 - DNA, 25 bp, Mus musculus
acccaccagcatgaagtttcggaca

SEQ ID NO: 112541 - DNA, 25 bp, Mus musculus
acccaccaggataaaccaagtgagt

SEQ ID NO: 112542 - DNA, 25 bp, Mus musculus
acccaccaggattaaccaagtgagt

SEQ ID NO: 112543 - DNA, 25 bp, Mus musculus
acccaccagggcacgtgagaaagta

SEQ ID NO: 112544 - DNA, 25 bp, Mus musculus
acccaccagggctcgtgagaaagta

SEQ ID NO: 112545 - DNA, 25 bp, Mus musculus
acccaccagtgacgattactgatgt

SEQ ID NO: 112546 - DNA, 25 bp, Mus musculus
acccaccagtgaggattactgatgt

SEQ ID NO: 112547 - DNA, 25 bp, Mus musculus
acccaccatgatcttggtagcttag

SEQ ID NO: 112548 - DNA, 25 bp, Mus musculus
acccaccatgatgttggtagcttag

SEQ ID NO: 112549 - DNA, 25 bp, Mus musculus
acccaccatgcgagcacttttaaaa

SEQ ID NO: 112550 - DNA, 25 bp, Mus musculus
acccaccatgcgtgcacttttaaaa

SEQ ID NO: 112551 - DNA, 25 bp, Mus musculus
acccaccattgtcagatttaagcca

SEQ ID NO: 112552 - DNA, 25 bp, Mus musculus
acccaccattgtgagatttaagcca

SEQ ID NO: 112553 - DNA, 25 bp, Mus musculus
acccaccattttaatgtgtgatgag

SEQ ID NO: 112554 - DNA, 25 bp, Mus musculus
acccaccatttttatgtgtgatgag

SEQ ID NO: 112555 - DNA, 25 bp, Mus musculus
acccacccagatatgacagttcagg

SEQ ID NO: 112556 - DNA, 25 bp, Mus musculus
acccacccagatttgacagttcagg

SEQ ID NO: 112557 - DNA, 25 bp, Mus musculus
acccacccagctaaggatggagact

SEQ ID NO: 112558 - DNA, 25 bp, Mus musculus
acccacccagcttaggatggagact

SEQ ID NO: 112559 - DNA, 25 bp, Mus musculus
acccacccaggcagtagtgctaaga

SEQ ID NO: 112560 - DNA, 25 bp, Mus musculus
acccacccaggctgtagtgctaaga

SEQ ID NO: 112561 - DNA, 25 bp, Mus musculus
acccaccccagcaaggacactgagc

SEQ ID NO: 112562 - DNA, 25 bp, Mus musculus
acccaccccagctaggacactgagc

SEQ ID NO: 112563 - DNA, 25 bp, Mus musculus
acccacccgcagatgtaatttcttg

SEQ ID NO: 112564 - DNA, 25 bp, Mus musculus
acccacccgcagttgtaatttcttg

SEQ ID NO: 112565 - DNA, 25 bp, Mus musculus
acccaccctctaagtttttgtagag

SEQ ID NO: 112566 - DNA, 25 bp, Mus musculus
acccaccctctatgtttttgtagag

SEQ ID NO: 112567 - DNA, 25 bp, Mus musculus
acccaccctgggataagagagtact

SEQ ID NO: 112568 - DNA, 25 bp, Mus musculus
acccaccctgggttaagagagtact

SEQ ID NO: 112569 - DNA, 25 bp, Mus musculus
acccacccttacctggaggagctgt

SEQ ID NO: 112570 - DNA, 25 bp, Mus musculus
acccacccttacgtggaggagctgt

SEQ ID NO: 112571 - DNA, 25 bp, Mus musculus
acccacctacagatccctatttccg

SEQ ID NO: 112572 - DNA, 25 bp, Mus musculus
acccacctacagttccctatttccg

SEQ ID NO: 112573 - DNA, 25 bp, Mus musculus
acccacctaccaagaatgcaggaga

SEQ ID NO: 112574 - DNA, 25 bp, Mus musculus
acccacctaccatgaatgcaggaga

SEQ ID NO: 112575 - DNA, 25 bp, Mus musculus
acccacctagagctgaagagattaa

SEQ ID NO: 112576 - DNA, 25 bp, Mus musculus
acccacctagaggtgaagagattaa

SEQ ID NO: 112577 - DNA, 25 bp, Mus musculus
acccacctatttacttcgcacaggc

SEQ ID NO: 112578 - DNA, 25 bp, Mus musculus
acccacctattttcttcgcacaggc

SEQ ID NO: 112579 - DNA, 25 bp, Mus musculus
acccacctgagacactttctcattt

SEQ ID NO: 112580 - DNA, 25 bp, Mus musculus
acccacctgagagactttctcattt

SEQ ID NO: 112581 - DNA, 25 bp, Mus musculus
acccacctgcccatagtggaggaaa

SEQ ID NO: 112582 - DNA, 25 bp, Mus musculus
acccacctgcccttagtggaggaaa

SEQ ID NO: 112583 - DNA, 25 bp, Mus musculus
acccacctgcctcataatttaagag

SEQ ID NO: 112584 - DNA, 25 bp, Mus musculus
acccacctgcctgataatttaagag

SEQ ID NO: 112585 - DNA, 25 bp, Mus musculus
acccaccttgcgcttttatgaaatg

SEQ ID NO: 112586 - DNA, 25 bp, Mus musculus
acccaccttgcggttttatgaaatg

SEQ ID NO: 112587 - DNA, 25 bp, Mus musculus
acccaccttggacatgtgcctaagg

SEQ ID NO: 112588 - DNA, 25 bp, Mus musculus
acccaccttggagatgtgcctaagg

SEQ ID NO: 112589 - DNA, 25 bp, Mus musculus
acccacctttcaattccacaagtga

SEQ ID NO: 112590 - DNA, 25 bp, Mus musculus
acccacctttcatttccacaagtga

SEQ ID NO: 112591 - DNA, 25 bp, Mus musculus
acccacgataaactgcttgcaggga

SEQ ID NO: 112592 - DNA, 25 bp, Mus musculus
acccacgataaagtgcttgcaggga

SEQ ID NO: 112593 - DNA, 25 bp, Mus musculus
acccacgcaggacggctttgtgctg

SEQ ID NO: 112594 - DNA, 25 bp, Mus musculus
acccacgcaggagggctttgtgctg

SEQ ID NO: 112595 - DNA, 25 bp, Mus musculus
acccacgcgggaagcgctggacacg

SEQ ID NO: 112596 - DNA, 25 bp, Mus musculus
acccacgcgggatgcgctggacacg

SEQ ID NO: 112597 - DNA, 25 bp, Mus musculus
acccacgctgggacagggacttcta

SEQ ID NO: 112598 - DNA, 25 bp, Mus musculus
acccacgctgggtcagggacttcta

SEQ ID NO: 112599 - DNA, 25 bp, Mus musculus
acccacggacacatttctgtctaga

SEQ ID NO: 112600 - DNA, 25 bp, Mus musculus
acccacggacacttttctgtctaga

SEQ ID NO: 112601 - DNA, 25 bp, Mus musculus
acccacggcttccatagcagtgata

SEQ ID NO: 112602 - DNA, 25 bp, Mus musculus
acccacggcttcgatagcagtgata

SEQ ID NO: 112603 - DNA, 25 bp, Mus musculus
acccacgtaaggcatcgtcatctaa

SEQ ID NO: 112604 - DNA, 25 bp, Mus musculus
acccacgtaagggatcgtcatctaa

SEQ ID NO: 112605 - DNA, 25 bp, Mus musculus
acccacgtctgtccgtatgcggaaa

SEQ ID NO: 112606 - DNA, 25 bp, Mus musculus
acccacgtctgtgcgtatgcggaaa

SEQ ID NO: 112607 - DNA, 25 bp, Mus musculus
acccacgtgatcagatttccaagac

SEQ ID NO: 112608 - DNA, 25 bp, Mus musculus
acccacgtgatctgatttccaagac

SEQ ID NO: 112609 - DNA, 25 bp, Mus musculus
acccacgtgggcatcaaggctgtga

SEQ ID NO: 112610 - DNA, 25 bp, Mus musculus
acccacgtgggcttcaaggctgtga

SEQ ID NO: 112611 - DNA, 25 bp, Mus musculus
acccacgtggttacatggtctaggt

SEQ ID NO: 112612 - DNA, 25 bp, Mus musculus
acccacgtggtttcatggtctaggt

SEQ ID NO: 112613 - DNA, 25 bp, Mus musculus
acccactactggaagatcacattgc

SEQ ID NO: 112614 - DNA, 25 bp, Mus musculus
acccactactggtagatcacattgc

SEQ ID NO: 112615 - DNA, 25 bp, Mus musculus
acccactattccatgttttgccata

SEQ ID NO: 112616 - DNA, 25 bp, Mus musculus
acccactattccttgttttgccata

SEQ ID NO: 112617 - DNA, 25 bp, Mus musculus
acccactcactgactactgagctag

SEQ ID NO: 112618 - DNA, 25 bp, Mus musculus
acccactcactgtctactgagctag

SEQ ID NO: 112619 - DNA, 25 bp, Mus musculus
acccactcatcgaggttgtgatcac

SEQ ID NO: 112620 - DNA, 25 bp, Mus musculus
acccactcatcgctggcaagtagag

SEQ ID NO: 112621 - DNA, 25 bp, Mus musculus
acccactcatcggtggcaagtagag

SEQ ID NO: 112622 - DNA, 25 bp, Mus musculus
acccactcatcgtggttgtgatcac

SEQ ID NO: 112623 - DNA, 25 bp, Mus musculus
acccactcccaacttttgctgattt

SEQ ID NO: 112624 - DNA, 25 bp, Mus musculus
acccactcccaagttttgctgattt

SEQ ID NO: 112625 - DNA, 25 bp, Mus musculus
acccactcgggtcctatggtgaaag

SEQ ID NO: 112626 - DNA, 25 bp, Mus musculus
acccactcgggtgctatggtgaaag

SEQ ID NO: 112627 - DNA, 25 bp, Mus musculus
acccactctctcaggtgacagttat

SEQ ID NO: 112628 - DNA, 25 bp, Mus musculus
acccactctctctggtgacagttat

SEQ ID NO: 112629 - DNA, 25 bp, Mus musculus
acccactctgttatctgttcagtta

SEQ ID NO: 112630 - DNA, 25 bp, Mus musculus
acccactctgttttctgttcagtta

SEQ ID NO: 112631 - DNA, 25 bp, Mus musculus
acccactgaatgaatttcctctgac

SEQ ID NO: 112632 - DNA, 25 bp, Mus musculus
acccactgaatgtatttcctctgac

SEQ ID NO: 112633 - DNA, 25 bp, Mus musculus
acccactgactgatgtcccatagct

SEQ ID NO: 112634 - DNA, 25 bp, Mus musculus
acccactgactgttgtcccatagct

SEQ ID NO: 112635 - DNA, 25 bp, Mus musculus
acccactgagggagaattctgagtt

SEQ ID NO: 112636 - DNA, 25 bp, Mus musculus
acccactgagggtgaattctgagtt

SEQ ID NO: 112637 - DNA, 25 bp, Mus musculus
acccactgagtaatgtttgtggcta

SEQ ID NO: 112638 - DNA, 25 bp, Mus musculus
acccactgagtattgtttgtggcta

SEQ ID NO: 112639 - DNA, 25 bp, Mus musculus
acccactgcaggatcacaatgtata

SEQ ID NO: 112640 - DNA, 25 bp, Mus musculus
acccactgcaggttcacaatgtata

SEQ ID NO: 112641 - DNA, 25 bp, Mus musculus
acccactgccatcttagttatactg

SEQ ID NO: 112642 - DNA, 25 bp, Mus musculus
acccactgccatgttagttatactg

SEQ ID NO: 112643 - DNA, 25 bp, Mus musculus
acccactggctacattcgatttgaa

SEQ ID NO: 112644 - DNA, 25 bp, Mus musculus
acccactggctagattcgatttgaa

SEQ ID NO: 112645 - DNA, 25 bp, Mus musculus
acccactgggagacgagggagtcca

SEQ ID NO: 112646 - DNA, 25 bp, Mus musculus
acccactgggagtcgagggagtcca

SEQ ID NO: 112647 - DNA, 25 bp, Mus musculus
acccactgggctcagcgcattgcta

SEQ ID NO: 112648 - DNA, 25 bp, Mus musculus
acccactgggctgagcgcattgcta

SEQ ID NO: 112649 - DNA, 25 bp, Mus musculus
acccactggttgatattctgtaaca

SEQ ID NO: 112650 - DNA, 25 bp, Mus musculus
acccactggttgctgacactgctga

SEQ ID NO: 112651 - DNA, 25 bp, Mus musculus
acccactggttggtgacactgctga

SEQ ID NO: 112652 - DNA, 25 bp, Mus musculus
acccactggttgttattctgtaaca

SEQ ID NO: 112653 - DNA, 25 bp, Mus musculus
acccactgtggcaagcagttcagct

SEQ ID NO: 112654 - DNA, 25 bp, Mus musculus
acccactgtggcagtgcagcgagaa

SEQ ID NO: 112655 - DNA, 25 bp, Mus musculus
acccactgtggctagcagttcagct

SEQ ID NO: 112656 - DNA, 25 bp, Mus musculus
acccactgtggctgtgcagcgagaa

SEQ ID NO: 112657 - DNA, 25 bp, Mus musculus
acccacttacagcagtcggcagagg

SEQ ID NO: 112658 - DNA, 25 bp, Mus musculus
acccacttacaggagtcggcagagg

SEQ ID NO: 112659 - DNA, 25 bp, Mus musculus
acccacttagccactgtatttcaat

SEQ ID NO: 112660 - DNA, 25 bp, Mus musculus
acccacttagcctctgtatttcaat

SEQ ID NO: 112661 - DNA, 25 bp, Mus musculus
acccacttcaggcagggactggact

SEQ ID NO: 112662 - DNA, 25 bp, Mus musculus
acccacttcagggagggactggact

SEQ ID NO: 112663 - DNA, 25 bp, Mus musculus
acccacttcgggaggcttacaacag

SEQ ID NO: 112664 - DNA, 25 bp, Mus musculus
acccacttcgggtggcttacaacag

SEQ ID NO: 112665 - DNA, 25 bp, Mus musculus
acccacttctttaggactcggtgag

SEQ ID NO: 112666 - DNA, 25 bp, Mus musculus
acccacttcttttggactcggtgag

SEQ ID NO: 112667 - DNA, 25 bp, Mus musculus
acccacttgcccaacacaggtgagg

SEQ ID NO: 112668 - DNA, 25 bp, Mus musculus
acccacttgccctacacaggtgagg

SEQ ID NO: 112669 - DNA, 25 bp, Mus musculus
acccacttgggcactatatctgtaa

SEQ ID NO: 112670 - DNA, 25 bp, Mus musculus
acccacttgggctctatatctgtaa

SEQ ID NO: 112671 - DNA, 25 bp, Mus musculus
acccactttcctcacaatgatgatg

SEQ ID NO: 112672 - DNA, 25 bp, Mus musculus
acccactttcctgacaatgatgatg

SEQ ID NO: 112673 - DNA, 25 bp, Mus musculus
acccactttctacactatactacta

SEQ ID NO: 112674 - DNA, 25 bp, Mus musculus
acccactttctagactatactacta

SEQ ID NO: 112675 - DNA, 25 bp, Mus musculus
acccactttctgacaggtgtgtctg

SEQ ID NO: 112676 - DNA, 25 bp, Mus musculus
acccactttctgtcaggtgtgtctg

SEQ ID NO: 112677 - DNA, 25 bp, Mus musculus
acccactttgttagtactgaagctt

SEQ ID NO: 112678 - DNA, 25 bp, Mus musculus
acccactttgtttgtactgaagctt

SEQ ID NO: 112679 - DNA, 25 bp, Mus musculus
acccacttttcactgagtgcatacc

SEQ ID NO: 112680 - DNA, 25 bp, Mus musculus
acccacttttcagtgagtgcatacc

SEQ ID NO: 112681 - DNA, 25 bp, Mus musculus
acccagaaatttaccaatgaggaga

SEQ ID NO: 112682 - DNA, 25 bp, Mus musculus
acccagaaattttccaatgaggaga

SEQ ID NO: 112683 - DNA, 25 bp, Mus musculus
acccagaagccacagggtcagctgg

SEQ ID NO: 112684 - DNA, 25 bp, Mus musculus
acccagaagccagagggtcagctgg

SEQ ID NO: 112685 - DNA, 25 bp, Mus musculus
acccagaagcttatatacttctcgt

SEQ ID NO: 112686 - DNA, 25 bp, Mus musculus
acccagaagcttttatacttctcgt

SEQ ID NO: 112687 - DNA, 25 bp, Mus musculus
acccagaagggtcaagtgcatcagg

SEQ ID NO: 112688 - DNA, 25 bp, Mus musculus
acccagaagggtgaagtgcatcagg

SEQ ID NO: 112689 - DNA, 25 bp, Mus musculus
acccagaagtacctgtgctttccaa

SEQ ID NO: 112690 - DNA, 25 bp, Mus musculus
acccagaagtacgtgtgctttccaa

SEQ ID NO: 112691 - DNA, 25 bp, Mus musculus
acccagaagtggctctacctgtgcc

SEQ ID NO: 112692 - DNA, 25 bp, Mus musculus
acccagaagtgggtctacctgtgcc

SEQ ID NO: 112693 - DNA, 25 bp, Mus musculus
acccagacagccaccgttttctaga

SEQ ID NO: 112694 - DNA, 25 bp, Mus musculus
acccagacagcctccgttttctaga

SEQ ID NO: 112695 - DNA, 25 bp, Mus musculus
acccagacagctattgtgatgtttc

SEQ ID NO: 112696 - DNA, 25 bp, Mus musculus
acccagacagcttttgtgatgtttc

SEQ ID NO: 112697 - DNA, 25 bp, Mus musculus
acccagacagttccatactcattta

SEQ ID NO: 112698 - DNA, 25 bp, Mus musculus
acccagacagttgcatactcattta

SEQ ID NO: 112699 - DNA, 25 bp, Mus musculus
acccagacatagagccaggactggc

SEQ ID NO: 112700 - DNA, 25 bp, Mus musculus
acccagacatagtgccaggactggc

SEQ ID NO: 112701 - DNA, 25 bp, Mus musculus
acccagaccaagctatttaatgaat

SEQ ID NO: 112702 - DNA, 25 bp, Mus musculus
acccagaccaaggtatttaatgaat

SEQ ID NO: 112703 - DNA, 25 bp, Mus musculus
acccagacccagatcgatgagtact

SEQ ID NO: 112704 - DNA, 25 bp, Mus musculus
acccagacccagttcgatgagtact

SEQ ID NO: 112705 - DNA, 25 bp, Mus musculus
acccagaccgcacgaaggacgcatg

SEQ ID NO: 112706 - DNA, 25 bp, Mus musculus
acccagaccgcaggaaggacgcatg

SEQ ID NO: 112707 - DNA, 25 bp, Mus musculus
acccagaccttcatgagttgcaacc

SEQ ID NO: 112708 - DNA, 25 bp, Mus musculus
acccagaccttcttgagttgcaacc

SEQ ID NO: 112709 - DNA, 25 bp, Mus musculus
acccagacggtccactgcaggaaac

SEQ ID NO: 112710 - DNA, 25 bp, Mus musculus
acccagacggtcgactgcaggaaac

SEQ ID NO: 112711 - DNA, 25 bp, Mus musculus
acccagagaatcaccgctgttgcaa

SEQ ID NO: 112712 - DNA, 25 bp, Mus musculus
acccagagaatctccgctgttgcaa

SEQ ID NO: 112713 - DNA, 25 bp, Mus musculus
acccagagacatccatcctagttgg

SEQ ID NO: 112714 - DNA, 25 bp, Mus musculus
acccagagacatgcatcctagttgg

SEQ ID NO: 112715 - DNA, 25 bp, Mus musculus
acccagagaggtccacatgaatgag

SEQ ID NO: 112716 - DNA, 25 bp, Mus musculus
acccagagaggtgcacatgaatgag

SEQ ID NO: 112717 - DNA, 25 bp, Mus musculus
acccagagatctacgggcacctgaa

SEQ ID NO: 112718 - DNA, 25 bp, Mus musculus
acccagagatcttcgggcacctgaa

SEQ ID NO: 112719 - DNA, 25 bp, Mus musculus
acccagagcagcagaacactttctt

SEQ ID NO: 112720 - DNA, 25 bp, Mus musculus
acccagagcagctgaacactttctt

SEQ ID NO: 112721 - DNA, 25 bp, Mus musculus
acccagagccttctagttggcaaat

SEQ ID NO: 112722 - DNA, 25 bp, Mus musculus
acccagagccttgtagttggcaaat

SEQ ID NO: 112723 - DNA, 25 bp, Mus musculus
acccagagctgcctataccagaaag

SEQ ID NO: 112724 - DNA, 25 bp, Mus musculus
acccagagctgcgtataccagaaag

SEQ ID NO: 112725 - DNA, 25 bp, Mus musculus
acccagagcttgacttctcagcaac

SEQ ID NO: 112726 - DNA, 25 bp, Mus musculus
acccagagcttgatggttatccatg

SEQ ID NO: 112727 - DNA, 25 bp, Mus musculus
acccagagcttgtcttctcagcaac

SEQ ID NO: 112728 - DNA, 25 bp, Mus musculus
acccagagcttgttggttatccatg

SEQ ID NO: 112729 - DNA, 25 bp, Mus musculus
acccagagctttccctgatgattga

SEQ ID NO: 112730 - DNA, 25 bp, Mus musculus
acccagagctttgcctgatgattga

SEQ ID NO: 112731 - DNA, 25 bp, Mus musculus
acccagaggcttcgcgaatggtgta

SEQ ID NO: 112732 - DNA, 25 bp, Mus musculus
acccagaggcttggcgaatggtgta

SEQ ID NO: 112733 - DNA, 25 bp, Mus musculus
acccagagtaagcaatggccttatt

SEQ ID NO: 112734 - DNA, 25 bp, Mus musculus
acccagagtaaggaatggccttatt

SEQ ID NO: 112735 - DNA, 25 bp, Mus musculus
acccagagtacacgccagaggacaa

SEQ ID NO: 112736 - DNA, 25 bp, Mus musculus
acccagagtacaggccagaggacaa

SEQ ID NO: 112737 - DNA, 25 bp, Mus musculus
acccagagtcttagtgaggaattgt

SEQ ID NO: 112738 - DNA, 25 bp, Mus musculus
acccagagtctttgtgaggaattgt

SEQ ID NO: 112739 - DNA, 25 bp, Mus musculus
acccagagtgccacttttcattcat

SEQ ID NO: 112740 - DNA, 25 bp, Mus musculus
acccagagtgcctcttttcattcat

SEQ ID NO: 112741 - DNA, 25 bp, Mus musculus
acccagatatagctgacgaaatcca

SEQ ID NO: 112742 - DNA, 25 bp, Mus musculus
acccagatataggtgacgaaatcca

SEQ ID NO: 112743 - DNA, 25 bp, Mus musculus
acccagatgctcatgtgtgaacaca

SEQ ID NO: 112744 - DNA, 25 bp, Mus musculus
acccagatgctcttgtgtgaacaca

SEQ ID NO: 112745 - DNA, 25 bp, Mus musculus
acccagatgctgaccgtgagtttga

SEQ ID NO: 112746 - DNA, 25 bp, Mus musculus
acccagatgctgtccgtgagtttga

SEQ ID NO: 112747 - DNA, 25 bp, Mus musculus
acccagatgggaagacagcctctct

SEQ ID NO: 112748 - DNA, 25 bp, Mus musculus
acccagatgggatgacagcctctct

SEQ ID NO: 112749 - DNA, 25 bp, Mus musculus
acccagcaaccacctgatgtgtaat

SEQ ID NO: 112750 - DNA, 25 bp, Mus musculus
acccagcaaccagctgatgtgtaat

SEQ ID NO: 112751 - DNA, 25 bp, Mus musculus
acccagcaacccacagaaatgtaaa

SEQ ID NO: 112752 - DNA, 25 bp, Mus musculus
acccagcaaccctcagaaatgtaaa

SEQ ID NO: 112753 - DNA, 25 bp, Mus musculus
acccagcaatatcagttgtaagcac

SEQ ID NO: 112754 - DNA, 25 bp, Mus musculus
acccagcaatatgagttgtaagcac

SEQ ID NO: 112755 - DNA, 25 bp, Mus musculus
acccagcaatggatacaggacatca

SEQ ID NO: 112756 - DNA, 25 bp, Mus musculus
acccagcaatggttacaggacatca

SEQ ID NO: 112757 - DNA, 25 bp, Mus musculus
acccagcaattgagcctagctagca

SEQ ID NO: 112758 - DNA, 25 bp, Mus musculus
acccagcaattgtgcctagctagca

SEQ ID NO: 112759 - DNA, 25 bp, Mus musculus
acccagcacattctctcaggtgaag

SEQ ID NO: 112760 - DNA, 25 bp, Mus musculus
acccagcacattgtctcaggtgaag

SEQ ID NO: 112761 - DNA, 25 bp, Mus musculus
acccagcaggctacagcaggcttca

SEQ ID NO: 112762 - DNA, 25 bp, Mus musculus
acccagcaggcttcagcaggcttca

SEQ ID NO: 112763 - DNA, 25 bp, Mus musculus
acccagcagtcaccaagacagttgg

SEQ ID NO: 112764 - DNA, 25 bp, Mus musculus
acccagcagtcagcaagacagttgg

SEQ ID NO: 112765 - DNA, 25 bp, Mus musculus
acccagcatggtcattgctccttaa

SEQ ID NO: 112766 - DNA, 25 bp, Mus musculus
acccagcatggtgattgctccttaa

SEQ ID NO: 112767 - DNA, 25 bp, Mus musculus
acccagccaaggaggtttccagtgg

SEQ ID NO: 112768 - DNA, 25 bp, Mus musculus
acccagccaaggtggtttccagtgg

SEQ ID NO: 112769 - DNA, 25 bp, Mus musculus
acccagccacgacttgtagttcaca

SEQ ID NO: 112770 - DNA, 25 bp, Mus musculus
acccagccacgagttgtagttcaca

SEQ ID NO: 112771 - DNA, 25 bp, Mus musculus
acccagccagataaggatgtatttt

SEQ ID NO: 112772 - DNA, 25 bp, Mus musculus
acccagccagattaggatgtatttt

SEQ ID NO: 112773 - DNA, 25 bp, Mus musculus
acccagcccagaaggccaagagctg

SEQ ID NO: 112774 - DNA, 25 bp, Mus musculus
acccagcccagatggccaagagctg

SEQ ID NO: 112775 - DNA, 25 bp, Mus musculus
acccagccccacagggactttccat

SEQ ID NO: 112776 - DNA, 25 bp, Mus musculus
acccagccccactgggactttccat

SEQ ID NO: 112777 - DNA, 25 bp, Mus musculus
acccagccctagagaactatcagtg

SEQ ID NO: 112778 - DNA, 25 bp, Mus musculus
acccagccctagtgaactatcagtg

SEQ ID NO: 112779 - DNA, 25 bp, Mus musculus
acccagccggctcacggtgaagtat

SEQ ID NO: 112780 - DNA, 25 bp, Mus musculus
acccagccggctgacggtgaagtat

SEQ ID NO: 112781 - DNA, 25 bp, Mus musculus
acccagcctcgtaccaaagatgaga

SEQ ID NO: 112782 - DNA, 25 bp, Mus musculus
acccagcctcgttccaaagatgaga

SEQ ID NO: 112783 - DNA, 25 bp, Mus musculus
acccagcctcttaagctatcatttg

SEQ ID NO: 112784 - DNA, 25 bp, Mus musculus
acccagcctctttagctatcatttg

SEQ ID NO: 112785 - DNA, 25 bp, Mus musculus
acccagcctgaaccttgtacttgat

SEQ ID NO: 112786 - DNA, 25 bp, Mus musculus
acccagcctgaagcttgtacttgat

SEQ ID NO: 112787 - DNA, 25 bp, Mus musculus
acccagccttccatcaggtgaagga

SEQ ID NO: 112788 - DNA, 25 bp, Mus musculus
acccagccttccttcaggtgaagga

SEQ ID NO: 112789 - DNA, 25 bp, Mus musculus
acccagcctttcaggagccggacga

SEQ ID NO: 112790 - DNA, 25 bp, Mus musculus
acccagcctttctggagccggacga

SEQ ID NO: 112791 - DNA, 25 bp, Mus musculus
acccagcctttgagtctgccctgtg

SEQ ID NO: 112792 - DNA, 25 bp, Mus musculus
acccagcctttgatggttagtggca

SEQ ID NO: 112793 - DNA, 25 bp, Mus musculus
acccagcctttgtgtctgccctgtg

SEQ ID NO: 112794 - DNA, 25 bp, Mus musculus
acccagcctttgttggttagtggca

SEQ ID NO: 112795 - DNA, 25 bp, Mus musculus
acccagcgccaactctaacaagttt

SEQ ID NO: 112796 - DNA, 25 bp, Mus musculus
acccagcgccaagtctaacaagttt

SEQ ID NO: 112797 - DNA, 25 bp, Mus musculus
acccagcggtggcatttccagaaga

SEQ ID NO: 112798 - DNA, 25 bp, Mus musculus
acccagcggtgggatttccagaaga

SEQ ID NO: 112799 - DNA, 25 bp, Mus musculus
acccagcgttccatgcagaagacaa

SEQ ID NO: 112800 - DNA, 25 bp, Mus musculus
acccagcgttccttgcagaagacaa

SEQ ID NO: 112801 - DNA, 25 bp, Mus musculus
acccagctaacaacaggccggatga

SEQ ID NO: 112802 - DNA, 25 bp, Mus musculus
acccagctaacatcaggccggatga

SEQ ID NO: 112803 - DNA, 25 bp, Mus musculus
acccagctacaactttgccaaaggc

SEQ ID NO: 112804 - DNA, 25 bp, Mus musculus
acccagctacaagtttgccaaaggc

SEQ ID NO: 112805 - DNA, 25 bp, Mus musculus
acccagctactaatacgtccattga

SEQ ID NO: 112806 - DNA, 25 bp, Mus musculus
acccagctactattacgtccattga

SEQ ID NO: 112807 - DNA, 25 bp, Mus musculus
acccagctagacagtctttccagta

SEQ ID NO: 112808 - DNA, 25 bp, Mus musculus
acccagctagactgtctttccagta

SEQ ID NO: 112809 - DNA, 25 bp, Mus musculus
acccagctcagaccaagtgagcagt

SEQ ID NO: 112810 - DNA, 25 bp, Mus musculus
acccagctcagagcaagtgagcagt

SEQ ID NO: 112811 - DNA, 25 bp, Mus musculus
acccagctccagattcagatttaat

SEQ ID NO: 112812 - DNA, 25 bp, Mus musculus
acccagctccagtttcagatttaat

SEQ ID NO: 112813 - DNA, 25 bp, Mus musculus
acccagctcttaacagctacatgag

SEQ ID NO: 112814 - DNA, 25 bp, Mus musculus
acccagctcttatcagctacatgag

SEQ ID NO: 112815 - DNA, 25 bp, Mus musculus
acccagctgaccatctttgttgttg

SEQ ID NO: 112816 - DNA, 25 bp, Mus musculus
acccagctgaccttctttgttgttg

SEQ ID NO: 112817 - DNA, 25 bp, Mus musculus
acccagctgactactctgtttaggc

SEQ ID NO: 112818 - DNA, 25 bp, Mus musculus
acccagctgacttctctgtttaggc

SEQ ID NO: 112819 - DNA, 25 bp, Mus musculus
acccagctgggtcttttctctatct

SEQ ID NO: 112820 - DNA, 25 bp, Mus musculus
acccagctgggtgttttctctatct

SEQ ID NO: 112821 - DNA, 25 bp, Mus musculus
acccagctggttaggtctctgagcc

SEQ ID NO: 112822 - DNA, 25 bp, Mus musculus
acccagctggtttggtctctgagcc

SEQ ID NO: 112823 - DNA, 25 bp, Mus musculus
acccagcttagcaacgtgagaatta

SEQ ID NO: 112824 - DNA, 25 bp, Mus musculus
acccagcttagctacgtgagaatta

SEQ ID NO: 112825 - DNA, 25 bp, Mus musculus
acccagcttagtacttgtgatactg

SEQ ID NO: 112826 - DNA, 25 bp, Mus musculus
acccagcttagtccagagaacctga

SEQ ID NO: 112827 - DNA, 25 bp, Mus musculus
acccagcttagtgcagagaacctga

SEQ ID NO: 112828 - DNA, 25 bp, Mus musculus
acccagcttagttcttgtgatactg

SEQ ID NO: 112829 - DNA, 25 bp, Mus musculus
acccagcttatgatgataaggacaa

SEQ ID NO: 112830 - DNA, 25 bp, Mus musculus
acccagcttatgttgataaggacaa

SEQ ID NO: 112831 - DNA, 25 bp, Mus musculus
acccagcttcggatccactaaggag

SEQ ID NO: 112832 - DNA, 25 bp, Mus musculus
acccagcttcggttccactaaggag

SEQ ID NO: 112833 - DNA, 25 bp, Mus musculus
acccagcttgggaactatgtaacaa

SEQ ID NO: 112834 - DNA, 25 bp, Mus musculus
acccagcttgggtactatgtaacaa

SEQ ID NO: 112835 - DNA, 25 bp, Mus musculus
acccagctttatctaaatactacca

SEQ ID NO: 112836 - DNA, 25 bp, Mus musculus
acccagctttatgtaaatactacca

SEQ ID NO: 112837 - DNA, 25 bp, Mus musculus
acccagctttcgatcatttcattgt

SEQ ID NO: 112838 - DNA, 25 bp, Mus musculus
acccagctttcgttcatttcattgt

SEQ ID NO: 112839 - DNA, 25 bp, Mus musculus
acccagctttgaagcgcaaggccag

SEQ ID NO: 112840 - DNA, 25 bp, Mus musculus
acccagctttgatgcgcaaggccag

SEQ ID NO: 112841 - DNA, 25 bp, Mus musculus
acccagcttttgcatcttcaggaag

SEQ ID NO: 112842 - DNA, 25 bp, Mus musculus
acccagcttttggatcttcaggaag

SEQ ID NO: 112843 - DNA, 25 bp, Mus musculus
acccaggaaattacagatgagacca

SEQ ID NO: 112844 - DNA, 25 bp, Mus musculus
acccaggaaatttcagatgagacca

SEQ ID NO: 112845 - DNA, 25 bp, Mus musculus
acccaggaagctctattgtcacctt

SEQ ID NO: 112846 - DNA, 25 bp, Mus musculus
acccaggaagctgtattgtcacctt

SEQ ID NO: 112847 - DNA, 25 bp, Mus musculus
acccaggaagtcagcgatgtctcaa

SEQ ID NO: 112848 - DNA, 25 bp, Mus musculus
acccaggaagtctgcgatgtctcaa

SEQ ID NO: 112849 - DNA, 25 bp, Mus musculus
acccaggacagtacaattcgtgagc

SEQ ID NO: 112850 - DNA, 25 bp, Mus musculus
acccaggacagttcaattcgtgagc

SEQ ID NO: 112851 - DNA, 25 bp, Mus musculus
acccaggaccgtcgtaaggcacttg

SEQ ID NO: 112852 - DNA, 25 bp, Mus musculus
acccaggaccgtggtaaggcacttg

SEQ ID NO: 112853 - DNA, 25 bp, Mus musculus
acccaggaccttctatacttgacac

SEQ ID NO: 112854 - DNA, 25 bp, Mus musculus
acccaggaccttgtatacttgacac

SEQ ID NO: 112855 - DNA, 25 bp, Mus musculus
acccaggactcgagcgtttcagacg

SEQ ID NO: 112856 - DNA, 25 bp, Mus musculus
acccaggactcgtgcgtttcagacg

SEQ ID NO: 112857 - DNA, 25 bp, Mus musculus
acccaggagagaagcgctgtgccgt

SEQ ID NO: 112858 - DNA, 25 bp, Mus musculus
acccaggagagatgcgctgtgccgt

SEQ ID NO: 112859 - DNA, 25 bp, Mus musculus
acccaggagcaaaacagaaggtgga

SEQ ID NO: 112860 - DNA, 25 bp, Mus musculus
acccaggagcaatacagaaggtgga

SEQ ID NO: 112861 - DNA, 25 bp, Mus musculus
acccaggagcagacctttctcagta

SEQ ID NO: 112862 - DNA, 25 bp, Mus musculus
acccaggagcagtcctttctcagta

SEQ ID NO: 112863 - DNA, 25 bp, Mus musculus
acccaggagcatctttctaagtgta

SEQ ID NO: 112864 - DNA, 25 bp, Mus musculus
acccaggagcatgtttctaagtgta

SEQ ID NO: 112865 - DNA, 25 bp, Mus musculus
acccaggagcttagctgcagtcaag

SEQ ID NO: 112866 - DNA, 25 bp, Mus musculus
acccaggagctttgctgcagtcaag

SEQ ID NO: 112867 - DNA, 25 bp, Mus musculus
acccaggagtgaaggatgctgctct

SEQ ID NO: 112868 - DNA, 25 bp, Mus musculus
acccaggagtgatggatgctgctct

SEQ ID NO: 112869 - DNA, 25 bp, Mus musculus
acccaggatcatacctttggttagt

SEQ ID NO: 112870 - DNA, 25 bp, Mus musculus
acccaggatcattcctttggttagt

SEQ ID NO: 112871 - DNA, 25 bp, Mus musculus
acccaggattttcagattcttaaat

SEQ ID NO: 112872 - DNA, 25 bp, Mus musculus
acccaggattttgagattcttaaat

SEQ ID NO: 112873 - DNA, 25 bp, Mus musculus
acccaggcagaaactctcagagtct

SEQ ID NO: 112874 - DNA, 25 bp, Mus musculus
acccaggcagaatctctcagagtct

SEQ ID NO: 112875 - DNA, 25 bp, Mus musculus
acccaggcatggaggtaggtgtcta

SEQ ID NO: 112876 - DNA, 25 bp, Mus musculus
acccaggcatggtggtaggtgtcta

SEQ ID NO: 112877 - DNA, 25 bp, Mus musculus
acccaggcattgagaccagacacaa

SEQ ID NO: 112878 - DNA, 25 bp, Mus musculus
acccaggcattgtgaccagacacaa

SEQ ID NO: 112879 - DNA, 25 bp, Mus musculus
acccaggcccacagtcagtttgatg

SEQ ID NO: 112880 - DNA, 25 bp, Mus musculus
acccaggcccactgtcagtttgatg

SEQ ID NO: 112881 - DNA, 25 bp, Mus musculus
acccaggccctgaaagacaataaga

SEQ ID NO: 112882 - DNA, 25 bp, Mus musculus
acccaggccctgtaagacaataaga

SEQ ID NO: 112883 - DNA, 25 bp, Mus musculus
acccaggccttactacttagcatac

SEQ ID NO: 112884 - DNA, 25 bp, Mus musculus
acccaggccttagtacttagcatac

SEQ ID NO: 112885 - DNA, 25 bp, Mus musculus
acccaggcgtgtacagtaaacagca

SEQ ID NO: 112886 - DNA, 25 bp, Mus musculus
acccaggcgtgttcagtaaacagca

SEQ ID NO: 112887 - DNA, 25 bp, Mus musculus
acccaggctctcatgacagactaaa

SEQ ID NO: 112888 - DNA, 25 bp, Mus musculus
acccaggctctcttgacagactaaa

SEQ ID NO: 112889 - DNA, 25 bp, Mus musculus
acccagggaggtcttttcacataca

SEQ ID NO: 112890 - DNA, 25 bp, Mus musculus
acccagggaggtgttttcacataca

SEQ ID NO: 112891 - DNA, 25 bp, Mus musculus
acccagggatggattgctttgcact

SEQ ID NO: 112892 - DNA, 25 bp, Mus musculus
acccagggatggtttgctttgcact

SEQ ID NO: 112893 - DNA, 25 bp, Mus musculus
acccagggatttctgtgcgctaggc

SEQ ID NO: 112894 - DNA, 25 bp, Mus musculus
acccagggatttgtgtgcgctaggc

SEQ ID NO: 112895 - DNA, 25 bp, Mus musculus
acccagggccacagtaagagatact

SEQ ID NO: 112896 - DNA, 25 bp, Mus musculus
acccagggccactgtaagagatact

SEQ ID NO: 112897 - DNA, 25 bp, Mus musculus
acccagggccagacaagcatgttga

SEQ ID NO: 112898 - DNA, 25 bp, Mus musculus
acccagggccagactcttggtgctg

SEQ ID NO: 112899 - DNA, 25 bp, Mus musculus
acccagggccagtcaagcatgttga

SEQ ID NO: 112900 - DNA, 25 bp, Mus musculus
acccagggccagtctcttggtgctg

SEQ ID NO: 112901 - DNA, 25 bp, Mus musculus
acccagggcggcaccatagtccagg

SEQ ID NO: 112902 - DNA, 25 bp, Mus musculus
acccagggcggctccatagtccagg

SEQ ID NO: 112903 - DNA, 25 bp, Mus musculus
acccagggctgaattgtggatccca

SEQ ID NO: 112904 - DNA, 25 bp, Mus musculus
acccagggctgatttgtggatccca

SEQ ID NO: 112905 - DNA, 25 bp, Mus musculus
acccagggcttcatcggatggcgat

SEQ ID NO: 112906 - DNA, 25 bp, Mus musculus
acccagggcttcttcggatggcgat

SEQ ID NO: 112907 - DNA, 25 bp, Mus musculus
acccagggtcacatctcagttatag

SEQ ID NO: 112908 - DNA, 25 bp, Mus musculus
acccagggtcacttctcagttatag

SEQ ID NO: 112909 - DNA, 25 bp, Mus musculus
acccagggtctcatacaagttatgg

SEQ ID NO: 112910 - DNA, 25 bp, Mus musculus
acccagggtctcttacaagttatgg

SEQ ID NO: 112911 - DNA, 25 bp, Mus musculus
acccagggtgggatgattgtctctt

SEQ ID NO: 112912 - DNA, 25 bp, Mus musculus
acccagggtgggttgattgtctctt

SEQ ID NO: 112913 - DNA, 25 bp, Mus musculus
acccagggttggatccataaggctt

SEQ ID NO: 112914 - DNA, 25 bp, Mus musculus
acccagggttggcattgtgagcata

SEQ ID NO: 112915 - DNA, 25 bp, Mus musculus
acccagggttgggattgtgagcata

SEQ ID NO: 112916 - DNA, 25 bp, Mus musculus
acccagggttggttccataaggctt

SEQ ID NO: 112917 - DNA, 25 bp, Mus musculus
acccaggtccctagagaaagcagtg

SEQ ID NO: 112918 - DNA, 25 bp, Mus musculus
acccaggtcccttgagaaagcagtg

SEQ ID NO: 112919 - DNA, 25 bp, Mus musculus
acccaggtcctaagaaagcagttgt

SEQ ID NO: 112920 - DNA, 25 bp, Mus musculus
acccaggtcctatgaaagcagttgt

SEQ ID NO: 112921 - DNA, 25 bp, Mus musculus
acccaggtccttcgttcacatggaa

SEQ ID NO: 112922 - DNA, 25 bp, Mus musculus
acccaggtccttggttcacatggaa

SEQ ID NO: 112923 - DNA, 25 bp, Mus musculus
acccaggtggctagcggtgcgacca

SEQ ID NO: 112924 - DNA, 25 bp, Mus musculus
acccaggtggcttgcggtgcgacca

SEQ ID NO: 112925 - DNA, 25 bp, Mus musculus
acccaggtggtgacccctgctctga

SEQ ID NO: 112926 - DNA, 25 bp, Mus musculus
acccaggtggtgtcccctgctctga

SEQ ID NO: 112927 - DNA, 25 bp, Mus musculus
acccaggtgtgacctaagccagtgg

SEQ ID NO: 112928 - DNA, 25 bp, Mus musculus
acccaggtgtgagctaagccagtgg

SEQ ID NO: 112929 - DNA, 25 bp, Mus musculus
acccaggtgttcagagggtgcgtct

SEQ ID NO: 112930 - DNA, 25 bp, Mus musculus
acccaggtgttctgagggtgcgtct

SEQ ID NO: 112931 - DNA, 25 bp, Mus musculus
acccaggtttgaagagttacttgac

SEQ ID NO: 112932 - DNA, 25 bp, Mus musculus
acccaggtttgatgagttacttgac

SEQ ID NO: 112933 - DNA, 25 bp, Mus musculus
acccagtactggaggcagaaggtat

SEQ ID NO: 112934 - DNA, 25 bp, Mus musculus
acccagtactggtggcagaaggtat

SEQ ID NO: 112935 - DNA, 25 bp, Mus musculus
acccagtagccccattggtggtata

SEQ ID NO: 112936 - DNA, 25 bp, Mus musculus
acccagtagcccgattggtggtata

SEQ ID NO: 112937 - DNA, 25 bp, Mus musculus
acccagtatataaagtctgttcata

SEQ ID NO: 112938 - DNA, 25 bp, Mus musculus
acccagtatatatagtctgttcata

SEQ ID NO: 112939 - DNA, 25 bp, Mus musculus
acccagtatgtgcttgtcctattta

SEQ ID NO: 112940 - DNA, 25 bp, Mus musculus
acccagtatgtggttgtcctattta

SEQ ID NO: 112941 - DNA, 25 bp, Mus musculus
acccagtattacacagaagttattg

SEQ ID NO: 112942 - DNA, 25 bp, Mus musculus
acccagtattactcagaagttattg

SEQ ID NO: 112943 - DNA, 25 bp, Mus musculus
acccagtatttacatttccatattg

SEQ ID NO: 112944 - DNA, 25 bp, Mus musculus
acccagtatttagatttccatattg

SEQ ID NO: 112945 - DNA, 25 bp, Mus musculus
acccagtccgtcctgaatgttcaga

SEQ ID NO: 112946 - DNA, 25 bp, Mus musculus
acccagtccgtcgtgaatgttcaga

SEQ ID NO: 112947 - DNA, 25 bp, Mus musculus
acccagtctcttcaccagaagttac

SEQ ID NO: 112948 - DNA, 25 bp, Mus musculus
acccagtctcttgaccagaagttac

SEQ ID NO: 112949 - DNA, 25 bp, Mus musculus
acccagtgaacacctgtggcctcag

SEQ ID NO: 112950 - DNA, 25 bp, Mus musculus
acccagtgaacagctgtggcctcag

SEQ ID NO: 112951 - DNA, 25 bp, Mus musculus
acccagtgacacatctttggctaag

SEQ ID NO: 112952 - DNA, 25 bp, Mus musculus
acccagtgacacttctttggctaag

SEQ ID NO: 112953 - DNA, 25 bp, Mus musculus
acccagtgagttatagtcaacgtct

SEQ ID NO: 112954 - DNA, 25 bp, Mus musculus
acccagtgagttttagtcaacgtct

SEQ ID NO: 112955 - DNA, 25 bp, Mus musculus
acccagtgatccagtccattgagaa

SEQ ID NO: 112956 - DNA, 25 bp, Mus musculus
acccagtgatcctgtccattgagaa

SEQ ID NO: 112957 - DNA, 25 bp, Mus musculus
acccagtgctctcactttgatgaaa

SEQ ID NO: 112958 - DNA, 25 bp, Mus musculus
acccagtgctctgactttgatgaaa

SEQ ID NO: 112959 - DNA, 25 bp, Mus musculus
acccagtgctgaagtatccttttaa

SEQ ID NO: 112960 - DNA, 25 bp, Mus musculus
acccagtgctgatgtatccttttaa

SEQ ID NO: 112961 - DNA, 25 bp, Mus musculus
acccagtggatcagcaatgtgttct

SEQ ID NO: 112962 - DNA, 25 bp, Mus musculus
acccagtggatctgcaatgtgttct

SEQ ID NO: 112963 - DNA, 25 bp, Mus musculus
acccagtgtactagtcatttgcata

SEQ ID NO: 112964 - DNA, 25 bp, Mus musculus
acccagtgtacttgtcatttgcata

SEQ ID NO: 112965 - DNA, 25 bp, Mus musculus
acccagtgtctgctcagtagtgttt

SEQ ID NO: 112966 - DNA, 25 bp, Mus musculus
acccagtgtctggtcagtagtgttt

SEQ ID NO: 112967 - DNA, 25 bp, Mus musculus
acccagtgttccagttgtcatttac

SEQ ID NO: 112968 - DNA, 25 bp, Mus musculus
acccagtgttccatcgctttagctg

SEQ ID NO: 112969 - DNA, 25 bp, Mus musculus
acccagtgttcctgttgtcatttac

SEQ ID NO: 112970 - DNA, 25 bp, Mus musculus
acccagtgttccttcgctttagctg

SEQ ID NO: 112971 - DNA, 25 bp, Mus musculus
acccagtgttggagccccgaggaat

SEQ ID NO: 112972 - DNA, 25 bp, Mus musculus
acccagtgttggtgccccgaggaat

SEQ ID NO: 112973 - DNA, 25 bp, Mus musculus
acccagttagatcttggtagagact

SEQ ID NO: 112974 - DNA, 25 bp, Mus musculus
acccagttagatgttggtagagact

SEQ ID NO: 112975 - DNA, 25 bp, Mus musculus
acccagttcttcacgggtgataatg

SEQ ID NO: 112976 - DNA, 25 bp, Mus musculus
acccagttcttctcgggtgataatg

SEQ ID NO: 112977 - DNA, 25 bp, Mus musculus
acccagttgcttccaggcagtagaa

SEQ ID NO: 112978 - DNA, 25 bp, Mus musculus
acccagttgcttgcaggcagtagaa

SEQ ID NO: 112979 - DNA, 25 bp, Mus musculus
acccagttgtctccacagctctgat

SEQ ID NO: 112980 - DNA, 25 bp, Mus musculus
acccagttgtctgcacagctctgat

SEQ ID NO: 112981 - DNA, 25 bp, Mus musculus
acccagtttgagcaaatgaccgaca

SEQ ID NO: 112982 - DNA, 25 bp, Mus musculus
acccagtttgaggaaatgaccgaca

SEQ ID NO: 112983 - DNA, 25 bp, Mus musculus
acccataaacgaattctgctcctca

SEQ ID NO: 112984 - DNA, 25 bp, Mus musculus
acccataaacgatttctgctcctca

SEQ ID NO: 112985 - DNA, 25 bp, Mus musculus
acccatacttctcgcagtgcctgaa

SEQ ID NO: 112986 - DNA, 25 bp, Mus musculus
acccatacttctggcagtgcctgaa

SEQ ID NO: 112987 - DNA, 25 bp, Mus musculus
acccatagctgaagcgaggccgtgt

SEQ ID NO: 112988 - DNA, 25 bp, Mus musculus
acccatagctgatgcgaggccgtgt

SEQ ID NO: 112989 - DNA, 25 bp, Mus musculus
acccatagctgcatcatgtcacaaa

SEQ ID NO: 112990 - DNA, 25 bp, Mus musculus
acccatagctgcttcatgtcacaaa

SEQ ID NO: 112991 - DNA, 25 bp, Mus musculus
acccataggactcgctctgagtatt

SEQ ID NO: 112992 - DNA, 25 bp, Mus musculus
acccataggactggctctgagtatt

SEQ ID NO: 112993 - DNA, 25 bp, Mus musculus
acccataggctgatttatgtttgtt

SEQ ID NO: 112994 - DNA, 25 bp, Mus musculus
acccataggctgttttatgtttgtt

SEQ ID NO: 112995 - DNA, 25 bp, Mus musculus
acccatatcaatcttaacccagaag

SEQ ID NO: 112996 - DNA, 25 bp, Mus musculus
acccatatcaatgttaacccagaag

SEQ ID NO: 112997 - DNA, 25 bp, Mus musculus
acccatatcccgatttctgagcaga

SEQ ID NO: 112998 - DNA, 25 bp, Mus musculus
acccatatcccgttttctgagcaga

SEQ ID NO: 112999 - DNA, 25 bp, Mus musculus
acccatatctctacgagttacttca

SEQ ID NO: 113000 - DNA, 25 bp, Mus musculus
acccatatctcttcgagttacttca

SEQ ID NO: 113001 - DNA, 25 bp, Mus musculus
acccatatgcacctgtgtacacaca

SEQ ID NO: 113002 - DNA, 25 bp, Mus musculus
acccatatgcacgtgtgtacacaca

SEQ ID NO: 113003 - DNA, 25 bp, Mus musculus
acccatatggcactttacatgtgtt

SEQ ID NO: 113004 - DNA, 25 bp, Mus musculus
acccatatggcagtttacatgtgtt

SEQ ID NO: 113005 - DNA, 25 bp, Mus musculus
acccatatgtgcaacgtttgtgtgt

SEQ ID NO: 113006 - DNA, 25 bp, Mus musculus
acccatatgtgctacgtttgtgtgt

SEQ ID NO: 113007 - DNA, 25 bp, Mus musculus
acccatattagaaggctcacaacta

SEQ ID NO: 113008 - DNA, 25 bp, Mus musculus
acccatattagatggctcacaacta

SEQ ID NO: 113009 - DNA, 25 bp, Mus musculus
acccatattgttatgctggaatcaa

SEQ ID NO: 113010 - DNA, 25 bp, Mus musculus
acccatattgttttgctggaatcaa

SEQ ID NO: 113011 - DNA, 25 bp, Mus musculus
acccatattttgcacaactgccttg

SEQ ID NO: 113012 - DNA, 25 bp, Mus musculus
acccatattttggacaactgccttg

SEQ ID NO: 113013 - DNA, 25 bp, Mus musculus
acccatcaaatgcttcatggtcact

SEQ ID NO: 113014 - DNA, 25 bp, Mus musculus
acccatcaaatggttcatggtcact

SEQ ID NO: 113015 - DNA, 25 bp, Mus musculus
acccatcagacgagtcactgggaca

SEQ ID NO: 113016 - DNA, 25 bp, Mus musculus
acccatcagacgtgtcactgggaca

SEQ ID NO: 113017 - DNA, 25 bp, Mus musculus
acccatcagccacgtgagcatttgc

SEQ ID NO: 113018 - DNA, 25 bp, Mus musculus
acccatcagccaggtgagcatttgc

SEQ ID NO: 113019 - DNA, 25 bp, Mus musculus
acccatcaggaaaggtgactgcctc

SEQ ID NO: 113020 - DNA, 25 bp, Mus musculus
acccatcaggaatggtgactgcctc

SEQ ID NO: 113021 - DNA, 25 bp, Mus musculus
acccatcatcatcttgcgtagcatg

SEQ ID NO: 113022 - DNA, 25 bp, Mus musculus
acccatcatcatgttgcgtagcatg

SEQ ID NO: 113023 - DNA, 25 bp, Mus musculus
acccatcatcctaaaggttgtgtca

SEQ ID NO: 113024 - DNA, 25 bp, Mus musculus
acccatcatccttaaggttgtgtca

SEQ ID NO: 113025 - DNA, 25 bp, Mus musculus
acccatcatgctcctgtcgtgaaaa

SEQ ID NO: 113026 - DNA, 25 bp, Mus musculus
acccatcatgctgctgtcgtgaaaa

SEQ ID NO: 113027 - DNA, 25 bp, Mus musculus
acccatccagtcaccttagttatta

SEQ ID NO: 113028 - DNA, 25 bp, Mus musculus
acccatccagtctccttagttatta

SEQ ID NO: 113029 - DNA, 25 bp, Mus musculus
acccatccattaactcctatgagat

SEQ ID NO: 113030 - DNA, 25 bp, Mus musculus
acccatccattatctcctatgagat

SEQ ID NO: 113031 - DNA, 25 bp, Mus musculus
acccatccctaaaccatgcagtggt

SEQ ID NO: 113032 - DNA, 25 bp, Mus musculus
acccatccctaatccatgcagtggt

SEQ ID NO: 113033 - DNA, 25 bp, Mus musculus
acccatccctagcagatctgctgag

SEQ ID NO: 113034 - DNA, 25 bp, Mus musculus
acccatccctaggagatctgctgag

SEQ ID NO: 113035 - DNA, 25 bp, Mus musculus
acccatcctccaattgtgtttattt

SEQ ID NO: 113036 - DNA, 25 bp, Mus musculus
acccatcctccatttgtgtttattt

SEQ ID NO: 113037 - DNA, 25 bp, Mus musculus
acccatccttctcttgaatttttca

SEQ ID NO: 113038 - DNA, 25 bp, Mus musculus
acccatccttctgttgaatttttca

SEQ ID NO: 113039 - DNA, 25 bp, Mus musculus
acccatccttttccttgaggataga

SEQ ID NO: 113040 - DNA, 25 bp, Mus musculus
acccatccttttgcttgaggataga

SEQ ID NO: 113041 - DNA, 25 bp, Mus musculus
acccatcgaggtagaggacattgct

SEQ ID NO: 113042 - DNA, 25 bp, Mus musculus
acccatcgaggttgaggacattgct

SEQ ID NO: 113043 - DNA, 25 bp, Mus musculus
acccatcgtctgagttcatgctgaa

SEQ ID NO: 113044 - DNA, 25 bp, Mus musculus
acccatcgtctgtgttcatgctgaa

SEQ ID NO: 113045 - DNA, 25 bp, Mus musculus
acccatctactgcagaatccttcgg

SEQ ID NO: 113046 - DNA, 25 bp, Mus musculus
acccatctactggagaatccttcgg

SEQ ID NO: 113047 - DNA, 25 bp, Mus musculus
acccatctagatcaaagagactctg

SEQ ID NO: 113048 - DNA, 25 bp, Mus musculus
acccatctagatgaaagagactctg

SEQ ID NO: 113049 - DNA, 25 bp, Mus musculus
acccatctctatagtcccagatttt

SEQ ID NO: 113050 - DNA, 25 bp, Mus musculus
acccatctctattgtcccagatttt

SEQ ID NO: 113051 - DNA, 25 bp, Mus musculus
acccatctctggatgccagtctata

SEQ ID NO: 113052 - DNA, 25 bp, Mus musculus
acccatctctggttgccagtctata

SEQ ID NO: 113053 - DNA, 25 bp, Mus musculus
acccatctgataatgctggactcct

SEQ ID NO: 113054 - DNA, 25 bp, Mus musculus
acccatctgatattgctggactcct

SEQ ID NO: 113055 - DNA, 25 bp, Mus musculus
acccatctgatgctctggctagcag

SEQ ID NO: 113056 - DNA, 25 bp, Mus musculus
acccatctgatggtctggctagcag

SEQ ID NO: 113057 - DNA, 25 bp, Mus musculus
acccatctgcttacagctgggtggg

SEQ ID NO: 113058 - DNA, 25 bp, Mus musculus
acccatctgctttcagctgggtggg

SEQ ID NO: 113059 - DNA, 25 bp, Mus musculus
acccatctggtaaagaggtccaagt

SEQ ID NO: 113060 - DNA, 25 bp, Mus musculus
acccatctggtatagaggtccaagt

SEQ ID NO: 113061 - DNA, 25 bp, Mus musculus
acccatcttcctattgtgaatgacc

SEQ ID NO: 113062 - DNA, 25 bp, Mus musculus
acccatcttccttttgtgaatgacc

SEQ ID NO: 113063 - DNA, 25 bp, Mus musculus
acccatcttggcattcctatatata

SEQ ID NO: 113064 - DNA, 25 bp, Mus musculus
acccatcttggctttcctatatata

SEQ ID NO: 113065 - DNA, 25 bp, Mus musculus
acccatcttgtcactctttatgatt

SEQ ID NO: 113066 - DNA, 25 bp, Mus musculus
acccatcttgtctctctttatgatt

SEQ ID NO: 113067 - DNA, 25 bp, Mus musculus
acccatctttatcattagcctcgaa

SEQ ID NO: 113068 - DNA, 25 bp, Mus musculus
acccatctttatgattagcctcgaa

SEQ ID NO: 113069 - DNA, 25 bp, Mus musculus
acccatctttcactctcagctttga

SEQ ID NO: 113070 - DNA, 25 bp, Mus musculus
acccatctttcagtctcagctttga

SEQ ID NO: 113071 - DNA, 25 bp, Mus musculus
acccatgaatggatgtttgtttcag

SEQ ID NO: 113072 - DNA, 25 bp, Mus musculus
acccatgaatggttgtttgtttcag

SEQ ID NO: 113073 - DNA, 25 bp, Mus musculus
acccatgaccatatactaagtgaat

SEQ ID NO: 113074 - DNA, 25 bp, Mus musculus
acccatgaccatttactaagtgaat

SEQ ID NO: 113075 - DNA, 25 bp, Mus musculus
acccatgagtttaagagcttttcct

SEQ ID NO: 113076 - DNA, 25 bp, Mus musculus
acccatgagttttagagcttttcct

SEQ ID NO: 113077 - DNA, 25 bp, Mus musculus
acccatgatagtaagctttgaactg

SEQ ID NO: 113078 - DNA, 25 bp, Mus musculus
acccatgatagttagctttgaactg

SEQ ID NO: 113079 - DNA, 25 bp, Mus musculus
acccatgattagatgttaccttgaa

SEQ ID NO: 113080 - DNA, 25 bp, Mus musculus
acccatgattagttgttaccttgaa

SEQ ID NO: 113081 - DNA, 25 bp, Mus musculus
acccatgcatccacgtacatgtgta

SEQ ID NO: 113082 - DNA, 25 bp, Mus musculus
acccatgcatcctcgtacatgtgta

SEQ ID NO: 113083 - DNA, 25 bp, Mus musculus
acccatgcattcactgtgtatccat

SEQ ID NO: 113084 - DNA, 25 bp, Mus musculus
acccatgcattctctgtgtatccat

SEQ ID NO: 113085 - DNA, 25 bp, Mus musculus
acccatgcctctcgaacgggtgcag

SEQ ID NO: 113086 - DNA, 25 bp, Mus musculus
acccatgcctctggaacgggtgcag

SEQ ID NO: 113087 - DNA, 25 bp, Mus musculus
acccatgccttgctatatgagtatc

SEQ ID NO: 113088 - DNA, 25 bp, Mus musculus
acccatgccttggtatatgagtatc

SEQ ID NO: 113089 - DNA, 25 bp, Mus musculus
acccatgcggcacaaggcctgggaa

SEQ ID NO: 113090 - DNA, 25 bp, Mus musculus
acccatgcggcagaaggcctgggaa

SEQ ID NO: 113091 - DNA, 25 bp, Mus musculus
acccatgctggacgaagtcttagga

SEQ ID NO: 113092 - DNA, 25 bp, Mus musculus
acccatgctggaggaagtcttagga

SEQ ID NO: 113093 - DNA, 25 bp, Mus musculus
acccatgctggtattatcttgtatt

SEQ ID NO: 113094 - DNA, 25 bp, Mus musculus
acccatgctggttttatcttgtatt

SEQ ID NO: 113095 - DNA, 25 bp, Mus musculus
acccatgctgttcattgctaaatgt

SEQ ID NO: 113096 - DNA, 25 bp, Mus musculus
acccatgctgttgattgctaaatgt

SEQ ID NO: 113097 - DNA, 25 bp, Mus musculus
acccatgcttacagcttccttggag

SEQ ID NO: 113098 - DNA, 25 bp, Mus musculus
acccatgcttactgcttccttggag

SEQ ID NO: 113099 - DNA, 25 bp, Mus musculus
acccatgcttgaagcaccgagtgga

SEQ ID NO: 113100 - DNA, 25 bp, Mus musculus
acccatgcttgatgcaccgagtgga

SEQ ID NO: 113101 - DNA, 25 bp, Mus musculus
acccatgcttgcagtttgacctgga

SEQ ID NO: 113102 - DNA, 25 bp, Mus musculus
acccatgcttgctgtttgacctgga

SEQ ID NO: 113103 - DNA, 25 bp, Mus musculus
acccatggacccagagacttggggg

SEQ ID NO: 113104 - DNA, 25 bp, Mus musculus
acccatggaccctgagacttggggg

SEQ ID NO: 113105 - DNA, 25 bp, Mus musculus
acccatggactcaatatgcttctca

SEQ ID NO: 113106 - DNA, 25 bp, Mus musculus
acccatggactctatatgcttctca

SEQ ID NO: 113107 - DNA, 25 bp, Mus musculus
acccatggagatcaggacctggcca

SEQ ID NO: 113108 - DNA, 25 bp, Mus musculus
acccatggagatgaggacctggcca

SEQ ID NO: 113109 - DNA, 25 bp, Mus musculus
acccatggcactagtgttaaataaa

SEQ ID NO: 113110 - DNA, 25 bp, Mus musculus
acccatggcacttgtgttaaataaa

SEQ ID NO: 113111 - DNA, 25 bp, Mus musculus
acccatggcctcacaagatgctgat

SEQ ID NO: 113112 - DNA, 25 bp, Mus musculus
acccatggcctctcaagatgctgat

SEQ ID NO: 113113 - DNA, 25 bp, Mus musculus
acccatgggattatttagctcatta

SEQ ID NO: 113114 - DNA, 25 bp, Mus musculus
acccatgggattttttagctcatta

SEQ ID NO: 113115 - DNA, 25 bp, Mus musculus
acccatgggcaaaaatgggagctgt

SEQ ID NO: 113116 - DNA, 25 bp, Mus musculus
acccatgggcaataatgggagctgt

SEQ ID NO: 113117 - DNA, 25 bp, Mus musculus
acccatggtcctatattattattta

SEQ ID NO: 113118 - DNA, 25 bp, Mus musculus
acccatggtcctttattattattta

SEQ ID NO: 113119 - DNA, 25 bp, Mus musculus
acccatggtcttcttcagttgctga

SEQ ID NO: 113120 - DNA, 25 bp, Mus musculus
acccatggtcttgttcagttgctga

SEQ ID NO: 113121 - DNA, 25 bp, Mus musculus
acccatggtgggatcgtgtatcgtg

SEQ ID NO: 113122 - DNA, 25 bp, Mus musculus
acccatggtgggttcgtgtatcgtg

SEQ ID NO: 113123 - DNA, 25 bp, Mus musculus
acccatgtaaccaacacgtgtgtga

SEQ ID NO: 113124 - DNA, 25 bp, Mus musculus
acccatgtaacctacacgtgtgtga

SEQ ID NO: 113125 - DNA, 25 bp, Mus musculus
acccatgtactcagggctggcagaa

SEQ ID NO: 113126 - DNA, 25 bp, Mus musculus
acccatgtactctgggctggcagaa

SEQ ID NO: 113127 - DNA, 25 bp, Mus musculus
acccatgtcggccaaagtttacagt

SEQ ID NO: 113128 - DNA, 25 bp, Mus musculus
acccatgtcggcgaaagtttacagt

SEQ ID NO: 113129 - DNA, 25 bp, Mus musculus
acccatgtctgaagatccccaactt

SEQ ID NO: 113130 - DNA, 25 bp, Mus musculus
acccatgtctgatgatccccaactt

SEQ ID NO: 113131 - DNA, 25 bp, Mus musculus
acccatgtctgtatatttgaggagc

SEQ ID NO: 113132 - DNA, 25 bp, Mus musculus
acccatgtctgtttatttgaggagc

SEQ ID NO: 113133 - DNA, 25 bp, Mus musculus
acccatgtcttacgcacgtttccat

SEQ ID NO: 113134 - DNA, 25 bp, Mus musculus
acccatgtcttaggcacgtttccat

SEQ ID NO: 113135 - DNA, 25 bp, Mus musculus
acccatgtgactcttttccaatcga

SEQ ID NO: 113136 - DNA, 25 bp, Mus musculus
acccatgtgactgttttccaatcga

SEQ ID NO: 113137 - DNA, 25 bp, Mus musculus
acccatgtgcctataagcctatagc

SEQ ID NO: 113138 - DNA, 25 bp, Mus musculus
acccatgtgcctttaagcctatagc

SEQ ID NO: 113139 - DNA, 25 bp, Mus musculus
acccatgtgtcgatgccaggcataa

SEQ ID NO: 113140 - DNA, 25 bp, Mus musculus
acccatgtgtcgttgccaggcataa

SEQ ID NO: 113141 - DNA, 25 bp, Mus musculus
acccatgtgttgagtcacagtcgtt

SEQ ID NO: 113142 - DNA, 25 bp, Mus musculus
acccatgtgttgtgtcacagtcgtt

SEQ ID NO: 113143 - DNA, 25 bp, Mus musculus
acccatgttcatccagatgtggctg

SEQ ID NO: 113144 - DNA, 25 bp, Mus musculus
acccatgttcatgcagatgtggctg

SEQ ID NO: 113145 - DNA, 25 bp, Mus musculus
acccatgttctcaagcatttctgtc

SEQ ID NO: 113146 - DNA, 25 bp, Mus musculus
acccatgttctctagcatttctgtc

SEQ ID NO: 113147 - DNA, 25 bp, Mus musculus
acccatgttgtacaggtcttcataa

SEQ ID NO: 113148 - DNA, 25 bp, Mus musculus
acccatgttgtagaggtcttcataa

SEQ ID NO: 113149 - DNA, 25 bp, Mus musculus
acccatgtttaaattgctttctctt

SEQ ID NO: 113150 - DNA, 25 bp, Mus musculus
acccatgtttaatttgctttctctt

SEQ ID NO: 113151 - DNA, 25 bp, Mus musculus
acccattacctcacactggtgtggc

SEQ ID NO: 113152 - DNA, 25 bp, Mus musculus
acccattacctctcactggtgtggc

SEQ ID NO: 113153 - DNA, 25 bp, Mus musculus
acccattcacggcacttttgctgag

SEQ ID NO: 113154 - DNA, 25 bp, Mus musculus
acccattcacgggacttttgctgag

SEQ ID NO: 113155 - DNA, 25 bp, Mus musculus
acccattcatcgagcagttcaatga

SEQ ID NO: 113156 - DNA, 25 bp, Mus musculus
acccattcatcgtgcagttcaatga

SEQ ID NO: 113157 - DNA, 25 bp, Mus musculus
acccattcattcaccactgtaaata

SEQ ID NO: 113158 - DNA, 25 bp, Mus musculus
acccattcattctccactgtaaata

SEQ ID NO: 113159 - DNA, 25 bp, Mus musculus
acccattccacaataacaaatttat

SEQ ID NO: 113160 - DNA, 25 bp, Mus musculus
acccattccacattaacaaatttat

SEQ ID NO: 113161 - DNA, 25 bp, Mus musculus
acccattccatactggtgccaggaa

SEQ ID NO: 113162 - DNA, 25 bp, Mus musculus
acccattccatagtggtgccaggaa

SEQ ID NO: 113163 - DNA, 25 bp, Mus musculus
acccattccatgagaaactaccaat

SEQ ID NO: 113164 - DNA, 25 bp, Mus musculus
acccattccatgtgaaactaccaat

SEQ ID NO: 113165 - DNA, 25 bp, Mus musculus
acccattccctcaggtgtctaagaa

SEQ ID NO: 113166 - DNA, 25 bp, Mus musculus
acccattccctctggtgtctaagaa

SEQ ID NO: 113167 - DNA, 25 bp, Mus musculus
acccattccctgacttggagactga

SEQ ID NO: 113168 - DNA, 25 bp, Mus musculus
acccattccctgtcttggagactga

SEQ ID NO: 113169 - DNA, 25 bp, Mus musculus
acccattcctcacattacgttattc

SEQ ID NO: 113170 - DNA, 25 bp, Mus musculus
acccattcctcagattacgttattc

SEQ ID NO: 113171 - DNA, 25 bp, Mus musculus
acccattcctccagccattttggga

SEQ ID NO: 113172 - DNA, 25 bp, Mus musculus
acccattcctcctgccattttggga

SEQ ID NO: 113173 - DNA, 25 bp, Mus musculus
acccattcctgaactcctatcattt

SEQ ID NO: 113174 - DNA, 25 bp, Mus musculus
acccattcctgatctcctatcattt

SEQ ID NO: 113175 - DNA, 25 bp, Mus musculus
acccattctcttcaacacactggga

SEQ ID NO: 113176 - DNA, 25 bp, Mus musculus
acccattctcttgaacacactggga

SEQ ID NO: 113177 - DNA, 25 bp, Mus musculus
acccattcttatatcaatttctcct

SEQ ID NO: 113178 - DNA, 25 bp, Mus musculus
acccattcttatttcaatttctcct

SEQ ID NO: 113179 - DNA, 25 bp, Mus musculus
acccattcttccatgtcagtcttga

SEQ ID NO: 113180 - DNA, 25 bp, Mus musculus
acccattcttccttgtcagtcttga

SEQ ID NO: 113181 - DNA, 25 bp, Mus musculus
acccattgaagaattctttttcaga

SEQ ID NO: 113182 - DNA, 25 bp, Mus musculus
acccattgaagatttctttttcaga

SEQ ID NO: 113183 - DNA, 25 bp, Mus musculus
acccattgaccacgagccatctaag

SEQ ID NO: 113184 - DNA, 25 bp, Mus musculus
acccattgaccaggagccatctaag

SEQ ID NO: 113185 - DNA, 25 bp, Mus musculus
acccattgccatcaactgtggtcta

SEQ ID NO: 113186 - DNA, 25 bp, Mus musculus
acccattgccatgaactgtggtcta

SEQ ID NO: 113187 - DNA, 25 bp, Mus musculus
acccattgccggagtgaggctcctg

SEQ ID NO: 113188 - DNA, 25 bp, Mus musculus
acccattgccggtgtgaggctcctg

SEQ ID NO: 113189 - DNA, 25 bp, Mus musculus
acccattgtactactcaaagccttt

SEQ ID NO: 113190 - DNA, 25 bp, Mus musculus
acccattgtacttctcaaagccttt

SEQ ID NO: 113191 - DNA, 25 bp, Mus musculus
acccatttactgaccacttgtgaaa

SEQ ID NO: 113192 - DNA, 25 bp, Mus musculus
acccatttactgccttctcggctta

SEQ ID NO: 113193 - DNA, 25 bp, Mus musculus
acccatttactggcttctcggctta

SEQ ID NO: 113194 - DNA, 25 bp, Mus musculus
acccatttactgtccacttgtgaaa

SEQ ID NO: 113195 - DNA, 25 bp, Mus musculus
acccatttccctcagcaaggctgaa

SEQ ID NO: 113196 - DNA, 25 bp, Mus musculus
acccatttccctgagcaaggctgaa

SEQ ID NO: 113197 - DNA, 25 bp, Mus musculus
acccatttctatcatccattccgat

SEQ ID NO: 113198 - DNA, 25 bp, Mus musculus
acccatttctatgatccattccgat

SEQ ID NO: 113199 - DNA, 25 bp, Mus musculus
acccatttctctctggttcgtgaat

SEQ ID NO: 113200 - DNA, 25 bp, Mus musculus
acccatttctctgtggttcgtgaat

SEQ ID NO: 113201 - DNA, 25 bp, Mus musculus
acccatttgacacgaacgcccagga

SEQ ID NO: 113202 - DNA, 25 bp, Mus musculus
acccatttgacaggaacgcccagga

SEQ ID NO: 113203 - DNA, 25 bp, Mus musculus
acccattttactatcatgtcccaat

SEQ ID NO: 113204 - DNA, 25 bp, Mus musculus
acccattttactttcatgtcccaat

SEQ ID NO: 113205 - DNA, 25 bp, Mus musculus
acccattttcaccagttgcttatta

SEQ ID NO: 113206 - DNA, 25 bp, Mus musculus
acccattttcacgagttgcttatta

SEQ ID NO: 113207 - DNA, 25 bp, Mus musculus
acccattttcctccagatgacagac

SEQ ID NO: 113208 - DNA, 25 bp, Mus musculus
acccattttcctgcagatgacagac

SEQ ID NO: 113209 - DNA, 25 bp, Mus musculus
acccattttcttaactcttcactat

SEQ ID NO: 113210 - DNA, 25 bp, Mus musculus
acccattttctttactcttcactat

SEQ ID NO: 113211 - DNA, 25 bp, Mus musculus
acccattttgtgactttttctcaat

SEQ ID NO: 113212 - DNA, 25 bp, Mus musculus
acccattttgtgtctttttctcaat

SEQ ID NO: 113213 - DNA, 25 bp, Mus musculus
acccatttttataaccgcttcattg

SEQ ID NO: 113214 - DNA, 25 bp, Mus musculus
acccatttttattaccgcttcattg

SEQ ID NO: 113215 - DNA, 25 bp, Mus musculus
acccatttttctctgcatgctttca

SEQ ID NO: 113216 - DNA, 25 bp, Mus musculus
acccatttttctgtgcatgctttca

SEQ ID NO: 113217 - DNA, 25 bp, Mus musculus
acccattttttcctagtgcatgaga

SEQ ID NO: 113218 - DNA, 25 bp, Mus musculus
acccattttttcgtagtgcatgaga

SEQ ID NO: 113219 - DNA, 25 bp, Mus musculus
accccaaaagctctgcaggttcaaa

SEQ ID NO: 113220 - DNA, 25 bp, Mus musculus
accccaaaagctgtgcaggttcaaa

SEQ ID NO: 113221 - DNA, 25 bp, Mus musculus
accccaaaatccattgcctatcttg

SEQ ID NO: 113222 - DNA, 25 bp, Mus musculus
accccaaaatcctttgcctatcttg

SEQ ID NO: 113223 - DNA, 25 bp, Mus musculus
accccaaactccatagcatgcagga

SEQ ID NO: 113224 - DNA, 25 bp, Mus musculus
accccaaactccttagcatgcagga

SEQ ID NO: 113225 - DNA, 25 bp, Mus musculus
accccaaactgaatagtatctgtga

SEQ ID NO: 113226 - DNA, 25 bp, Mus musculus
accccaaactgattagtatctgtga

SEQ ID NO: 113227 - DNA, 25 bp, Mus musculus
accccaaagcggctcgtgcagtagg

SEQ ID NO: 113228 - DNA, 25 bp, Mus musculus
accccaaagcgggtcgtgcagtagg

SEQ ID NO: 113229 - DNA, 25 bp, Mus musculus
accccaaagcttccttgtagttgag

SEQ ID NO: 113230 - DNA, 25 bp, Mus musculus
accccaaagcttgcttgtagttgag

SEQ ID NO: 113231 - DNA, 25 bp, Mus musculus
accccaaatcttaagcttgcaaact

SEQ ID NO: 113232 - DNA, 25 bp, Mus musculus
accccaaatctttagcttgcaaact

SEQ ID NO: 113233 - DNA, 25 bp, Mus musculus
accccaaattagcttctctgcatag

SEQ ID NO: 113234 - DNA, 25 bp, Mus musculus
accccaaattaggttctctgcatag

SEQ ID NO: 113235 - DNA, 25 bp, Mus musculus
accccaacatggctatggccagtct

SEQ ID NO: 113236 - DNA, 25 bp, Mus musculus
accccaacatgggtatggccagtct

SEQ ID NO: 113237 - DNA, 25 bp, Mus musculus
accccaaccgtcatcatggagggag

SEQ ID NO: 113238 - DNA, 25 bp, Mus musculus
accccaaccgtcttcatggagggag

SEQ ID NO: 113239 - DNA, 25 bp, Mus musculus
accccaactccactgaacaattatt

SEQ ID NO: 113240 - DNA, 25 bp, Mus musculus
accccaactccagtgaacaattatt

SEQ ID NO: 113241 - DNA, 25 bp, Mus musculus
accccaagactgatgtagctgtgtg

SEQ ID NO: 113242 - DNA, 25 bp, Mus musculus
accccaagactgttgtagctgtgtg

SEQ ID NO: 113243 - DNA, 25 bp, Mus musculus
accccaagagctagcctgaaattga

SEQ ID NO: 113244 - DNA, 25 bp, Mus musculus
accccaagagcttgcctgaaattga

SEQ ID NO: 113245 - DNA, 25 bp, Mus musculus
accccaagcacaaggcaactggagt

SEQ ID NO: 113246 - DNA, 25 bp, Mus musculus
accccaagcacatggcaactggagt

SEQ ID NO: 113247 - DNA, 25 bp, Mus musculus
accccaagctttctgatggacggtg

SEQ ID NO: 113248 - DNA, 25 bp, Mus musculus
accccaagctttgtgatggacggtg

SEQ ID NO: 113249 - DNA, 25 bp, Mus musculus
accccaaggacacagagcatagaaa

SEQ ID NO: 113250 - DNA, 25 bp, Mus musculus
accccaaggacagagagcatagaaa

SEQ ID NO: 113251 - DNA, 25 bp, Mus musculus
accccaagtgagatctgcttttctg

SEQ ID NO: 113252 - DNA, 25 bp, Mus musculus
accccaagtgagttctgcttttctg

SEQ ID NO: 113253 - DNA, 25 bp, Mus musculus
accccaagtggccagtttggagccg

SEQ ID NO: 113254 - DNA, 25 bp, Mus musculus
accccaagtggcgagtttggagccg

SEQ ID NO: 113255 - DNA, 25 bp, Mus musculus
accccaagtggtcaataagtcttat

SEQ ID NO: 113256 - DNA, 25 bp, Mus musculus
accccaagtggtgaataagtcttat

SEQ ID NO: 113257 - DNA, 25 bp, Mus musculus
accccaagttggctttgcatctatt

SEQ ID NO: 113258 - DNA, 25 bp, Mus musculus
accccaagttgggtttgcatctatt

SEQ ID NO: 113259 - DNA, 25 bp, Mus musculus
accccaatctgcaagggctgggtcc

SEQ ID NO: 113260 - DNA, 25 bp, Mus musculus
accccaatctgctagggctgggtcc

SEQ ID NO: 113261 - DNA, 25 bp, Mus musculus
accccaattattatatccctatatg

SEQ ID NO: 113262 - DNA, 25 bp, Mus musculus
accccaattattttatccctatatg

SEQ ID NO: 113263 - DNA, 25 bp, Mus musculus
accccaattgtcagtgccaggtggc

SEQ ID NO: 113264 - DNA, 25 bp, Mus musculus
accccaattgtctgtgccaggtggc

SEQ ID NO: 113265 - DNA, 25 bp, Mus musculus
accccacaaaaaacagctacatatt

SEQ ID NO: 113266 - DNA, 25 bp, Mus musculus
accccacaaaaatcagctacatatt

SEQ ID NO: 113267 - DNA, 25 bp, Mus musculus
accccacaaccaatcatttgtctta

SEQ ID NO: 113268 - DNA, 25 bp, Mus musculus
accccacaaccattcatttgtctta

SEQ ID NO: 113269 - DNA, 25 bp, Mus musculus
accccacactgaagagtcccaaaaa

SEQ ID NO: 113270 - DNA, 25 bp, Mus musculus
accccacactgatgagtcccaaaaa

SEQ ID NO: 113271 - DNA, 25 bp, Mus musculus
accccacagagcctatatttaaaca

SEQ ID NO: 113272 - DNA, 25 bp, Mus musculus
accccacagagcgtatatttaaaca

SEQ ID NO: 113273 - DNA, 25 bp, Mus musculus
accccacagcttctttgtttctttg

SEQ ID NO: 113274 - DNA, 25 bp, Mus musculus
accccacagcttgtttgtttctttg

SEQ ID NO: 113275 - DNA, 25 bp, Mus musculus
accccacagttacgattgtcggtgt

SEQ ID NO: 113276 - DNA, 25 bp, Mus musculus
accccacagttaggattgtcggtgt

SEQ ID NO: 113277 - DNA, 25 bp, Mus musculus
accccacattataaaccatttccag

SEQ ID NO: 113278 - DNA, 25 bp, Mus musculus
accccacattattaaccatttccag

SEQ ID NO: 113279 - DNA, 25 bp, Mus musculus
accccaccaaatcacaacttagagg

SEQ ID NO: 113280 - DNA, 25 bp, Mus musculus
accccaccaaatgacaacttagagg

SEQ ID NO: 113281 - DNA, 25 bp, Mus musculus
accccaccactgattgcttaatttg

SEQ ID NO: 113282 - DNA, 25 bp, Mus musculus
accccaccactgtttgcttaatttg

SEQ ID NO: 113283 - DNA, 25 bp, Mus musculus
accccaccagagagtagcgattgct

SEQ ID NO: 113284 - DNA, 25 bp, Mus musculus
accccaccagagtgtagcgattgct

SEQ ID NO: 113285 - DNA, 25 bp, Mus musculus
accccaccgtcgacattgtatgtta

SEQ ID NO: 113286 - DNA, 25 bp, Mus musculus
accccaccgtcgtcattgtatgtta

SEQ ID NO: 113287 - DNA, 25 bp, Mus musculus
accccacctgcaagacgatttattt

SEQ ID NO: 113288 - DNA, 25 bp, Mus musculus
accccacctgcatgacgatttattt

SEQ ID NO: 113289 - DNA, 25 bp, Mus musculus
accccaccttaaatagttctgtgca

SEQ ID NO: 113290 - DNA, 25 bp, Mus musculus
accccaccttaattagttctgtgca

SEQ ID NO: 113291 - DNA, 25 bp, Mus musculus
accccacgggctaagacagttgtca

SEQ ID NO: 113292 - DNA, 25 bp, Mus musculus
accccacgggcttagacagttgtca

SEQ ID NO: 113293 - DNA, 25 bp, Mus musculus
accccactacctcaggagtcgggat

SEQ ID NO: 113294 - DNA, 25 bp, Mus musculus
accccactacctgaggagtcgggat

SEQ ID NO: 113295 - DNA, 25 bp, Mus musculus
accccactagctctgggcagtgtta

SEQ ID NO: 113296 - DNA, 25 bp, Mus musculus
accccactagctgtgggcagtgtta

SEQ ID NO: 113297 - DNA, 25 bp, Mus musculus
accccactcgggatagaggtgtgct

SEQ ID NO: 113298 - DNA, 25 bp, Mus musculus
accccactcgggttagaggtgtgct

SEQ ID NO: 113299 - DNA, 25 bp, Mus musculus
accccactgaccctggagatgtact

SEQ ID NO: 113300 - DNA, 25 bp, Mus musculus
accccactgaccgtggagatgtact

SEQ ID NO: 113301 - DNA, 25 bp, Mus musculus
accccactgcagatctaacactgga

SEQ ID NO: 113302 - DNA, 25 bp, Mus musculus
accccactgcagttctaacactgga

SEQ ID NO: 113303 - DNA, 25 bp, Mus musculus
accccactggagaacactgcacaaa

SEQ ID NO: 113304 - DNA, 25 bp, Mus musculus
accccactggagtacactgcacaaa

SEQ ID NO: 113305 - DNA, 25 bp, Mus musculus
accccacttcttaaacgatgctgta

SEQ ID NO: 113306 - DNA, 25 bp, Mus musculus
accccacttctttaacgatgctgta

SEQ ID NO: 113307 - DNA, 25 bp, Mus musculus
accccactttggcagtcatgtcggt

SEQ ID NO: 113308 - DNA, 25 bp, Mus musculus
accccactttgggagtcatgtcggt

SEQ ID NO: 113309 - DNA, 25 bp, Mus musculus
accccagaactgaattcacctcaaa

SEQ ID NO: 113310 - DNA, 25 bp, Mus musculus
accccagaactgtattcacctcaaa

SEQ ID NO: 113311 - DNA, 25 bp, Mus musculus
accccagactgccagtactgtacaa

SEQ ID NO: 113312 - DNA, 25 bp, Mus musculus
accccagactgcgagtactgtacaa

SEQ ID NO: 113313 - DNA, 25 bp, Mus musculus
accccagagaacatcagctgatttc

SEQ ID NO: 113314 - DNA, 25 bp, Mus musculus
accccagagaacttcagctgatttc

SEQ ID NO: 113315 - DNA, 25 bp, Mus musculus
accccagaggatacaagcccttgaa

SEQ ID NO: 113316 - DNA, 25 bp, Mus musculus
accccagaggattcaagcccttgaa

SEQ ID NO: 113317 - DNA, 25 bp, Mus musculus
accccagatactcaccatacatggt

SEQ ID NO: 113318 - DNA, 25 bp, Mus musculus
accccagatactgaccatacatggt

SEQ ID NO: 113319 - DNA, 25 bp, Mus musculus
accccagatcaccagctgatgagtg

SEQ ID NO: 113320 - DNA, 25 bp, Mus musculus
accccagatcacgagctgatgagtg

SEQ ID NO: 113321 - DNA, 25 bp, Mus musculus
accccagatgctagcctggaacatt

SEQ ID NO: 113322 - DNA, 25 bp, Mus musculus
accccagatgcttgcctggaacatt

SEQ ID NO: 113323 - DNA, 25 bp, Mus musculus
accccagatgtccagatgttttgca

SEQ ID NO: 113324 - DNA, 25 bp, Mus musculus
accccagatgtcgagatgttttgca

SEQ ID NO: 113325 - DNA, 25 bp, Mus musculus
accccagattaacgtggagcccatc

SEQ ID NO: 113326 - DNA, 25 bp, Mus musculus
accccagattaaggtggagcccatc

SEQ ID NO: 113327 - DNA, 25 bp, Mus musculus
accccagcaaggacattgggcaagg

SEQ ID NO: 113328 - DNA, 25 bp, Mus musculus
accccagcaaggtcattgggcaagg

SEQ ID NO: 113329 - DNA, 25 bp, Mus musculus
accccagcacaaagtgcagctgatt

SEQ ID NO: 113330 - DNA, 25 bp, Mus musculus
accccagcacaatgtgcagctgatt

SEQ ID NO: 113331 - DNA, 25 bp, Mus musculus
accccagcacacaactggtagtttt

SEQ ID NO: 113332 - DNA, 25 bp, Mus musculus
accccagcacactactggtagtttt

SEQ ID NO: 113333 - DNA, 25 bp, Mus musculus
accccagcagccagttgattgaacg

SEQ ID NO: 113334 - DNA, 25 bp, Mus musculus
accccagcagcctgttgattgaacg

SEQ ID NO: 113335 - DNA, 25 bp, Mus musculus
accccagcataaatcgccagagatt

SEQ ID NO: 113336 - DNA, 25 bp, Mus musculus
accccagcataattcgccagagatt

SEQ ID NO: 113337 - DNA, 25 bp, Mus musculus
accccagcctcacattgacaaggaa

SEQ ID NO: 113338 - DNA, 25 bp, Mus musculus
accccagcctcagattgacaaggaa

SEQ ID NO: 113339 - DNA, 25 bp, Mus musculus
accccagcctgcaggagtgggatgc

SEQ ID NO: 113340 - DNA, 25 bp, Mus musculus
accccagcctgctggagtgggatgc

SEQ ID NO: 113341 - DNA, 25 bp, Mus musculus
accccagccttaatgggctcagcag

SEQ ID NO: 113342 - DNA, 25 bp, Mus musculus
accccagccttattgggctcagcag

SEQ ID NO: 113343 - DNA, 25 bp, Mus musculus
accccagctagaataaagacaccta

SEQ ID NO: 113344 - DNA, 25 bp, Mus musculus
accccagctagattaaagacaccta

SEQ ID NO: 113345 - DNA, 25 bp, Mus musculus
accccagctatccttgcaaagagtt

SEQ ID NO: 113346 - DNA, 25 bp, Mus musculus
accccagctatcgttgcaaagagtt

SEQ ID NO: 113347 - DNA, 25 bp, Mus musculus
accccaggactgctggttctccaag

SEQ ID NO: 113348 - DNA, 25 bp, Mus musculus
accccaggactggtggttctccaag

SEQ ID NO: 113349 - DNA, 25 bp, Mus musculus
accccaggcacgcatgcaggatgag

SEQ ID NO: 113350 - DNA, 25 bp, Mus musculus
accccaggcacggatgcaggatgag

SEQ ID NO: 113351 - DNA, 25 bp, Mus musculus
accccaggcagaaggagtgtaccgt

SEQ ID NO: 113352 - DNA, 25 bp, Mus musculus
accccaggcagatggagtgtaccgt

SEQ ID NO: 113353 - DNA, 25 bp, Mus musculus
accccaggctctctcaagtgcagtt

SEQ ID NO: 113354 - DNA, 25 bp, Mus musculus
accccaggctctgtcaagtgcagtt

SEQ ID NO: 113355 - DNA, 25 bp, Mus musculus
accccaggcttgatggacagaggga

SEQ ID NO: 113356 - DNA, 25 bp, Mus musculus
accccaggcttgttggacagaggga

SEQ ID NO: 113357 - DNA, 25 bp, Mus musculus
accccagggaggatgatccgtgact

SEQ ID NO: 113358 - DNA, 25 bp, Mus musculus
accccagggaggttgatccgtgact

SEQ ID NO: 113359 - DNA, 25 bp, Mus musculus
accccagggcaaaggcattaagtgt

SEQ ID NO: 113360 - DNA, 25 bp, Mus musculus
accccagggcaatggcattaagtgt

SEQ ID NO: 113361 - DNA, 25 bp, Mus musculus
accccaggggctcagcttctgaaga

SEQ ID NO: 113362 - DNA, 25 bp, Mus musculus
accccaggggctgagcttctgaaga

SEQ ID NO: 113363 - DNA, 25 bp, Mus musculus
accccaggtagtaacggcacagaat

SEQ ID NO: 113364 - DNA, 25 bp, Mus musculus
accccaggtagttacggcacagaat

SEQ ID NO: 113365 - DNA, 25 bp, Mus musculus
accccaggtgtgaccatcttaggga

SEQ ID NO: 113366 - DNA, 25 bp, Mus musculus
accccaggtgtgtccatcttaggga

SEQ ID NO: 113367 - DNA, 25 bp, Mus musculus
accccagtaggaagtcggcttcatg

SEQ ID NO: 113368 - DNA, 25 bp, Mus musculus
accccagtaggatgtcggcttcatg

SEQ ID NO: 113369 - DNA, 25 bp, Mus musculus
accccagtatttacataatcccaca

SEQ ID NO: 113370 - DNA, 25 bp, Mus musculus
accccagtattttcataatcccaca

SEQ ID NO: 113371 - DNA, 25 bp, Mus musculus
accccagtcacgagctgttataatg

SEQ ID NO: 113372 - DNA, 25 bp, Mus musculus
accccagtcacgtgctgttataatg

SEQ ID NO: 113373 - DNA, 25 bp, Mus musculus
accccagtctaaaaatgtccatcga

SEQ ID NO: 113374 - DNA, 25 bp, Mus musculus
accccagtctaataatgtccatcga

SEQ ID NO: 113375 - DNA, 25 bp, Mus musculus
accccagtgggaagttctacaagag

SEQ ID NO: 113376 - DNA, 25 bp, Mus musculus
accccagtgggatgttctacaagag

SEQ ID NO: 113377 - DNA, 25 bp, Mus musculus
accccagttcttccaggtgttgact

SEQ ID NO: 113378 - DNA, 25 bp, Mus musculus
accccagttcttgcaggtgttgact

SEQ ID NO: 113379 - DNA, 25 bp, Mus musculus
accccataatctacaggacagtctg

SEQ ID NO: 113380 - DNA, 25 bp, Mus musculus
accccataatcttcaggacagtctg

SEQ ID NO: 113381 - DNA, 25 bp, Mus musculus
accccatacaggactctaatgctta

SEQ ID NO: 113382 - DNA, 25 bp, Mus musculus
accccatacaggtctctaatgctta

SEQ ID NO: 113383 - DNA, 25 bp, Mus musculus
accccatacatcacaccagtaaaat

SEQ ID NO: 113384 - DNA, 25 bp, Mus musculus
accccatacatctcaccagtaaaat

SEQ ID NO: 113385 - DNA, 25 bp, Mus musculus
accccatacatgcttctgcatatgt

SEQ ID NO: 113386 - DNA, 25 bp, Mus musculus
accccatacatggttctgcatatgt

SEQ ID NO: 113387 - DNA, 25 bp, Mus musculus
accccatatattctctccatgaaag

SEQ ID NO: 113388 - DNA, 25 bp, Mus musculus
accccatatattgtctccatgaaag

SEQ ID NO: 113389 - DNA, 25 bp, Mus musculus
accccatatggtaacagcacagctg

SEQ ID NO: 113390 - DNA, 25 bp, Mus musculus
accccatatggttacagcacagctg

SEQ ID NO: 113391 - DNA, 25 bp, Mus musculus
accccatattctagcaccttttgca

SEQ ID NO: 113392 - DNA, 25 bp, Mus musculus
accccatattcttgcaccttttgca

SEQ ID NO: 113393 - DNA, 25 bp, Mus musculus
accccatcaaccagtgagagtgtga

SEQ ID NO: 113394 - DNA, 25 bp, Mus musculus
accccatcaacctgtgagagtgtga

SEQ ID NO: 113395 - DNA, 25 bp, Mus musculus
accccatcacagaggtgttaccaga

SEQ ID NO: 113396 - DNA, 25 bp, Mus musculus
accccatcacagtggtgttaccaga

SEQ ID NO: 113397 - DNA, 25 bp, Mus musculus
accccatcaggtagcttcagtggat

SEQ ID NO: 113398 - DNA, 25 bp, Mus musculus
accccatcaggttgcttcagtggat

SEQ ID NO: 113399 - DNA, 25 bp, Mus musculus
accccatcataaacgtgggcgacga

SEQ ID NO: 113400 - DNA, 25 bp, Mus musculus
accccatcataatcgtgggcgacga

SEQ ID NO: 113401 - DNA, 25 bp, Mus musculus
accccatccatgatcatgtctgtat

SEQ ID NO: 113402 - DNA, 25 bp, Mus musculus
accccatccatgttcatgtctgtat

SEQ ID NO: 113403 - DNA, 25 bp, Mus musculus
accccatccttaatgagtaggtcag

SEQ ID NO: 113404 - DNA, 25 bp, Mus musculus
accccatccttattgagtaggtcag

SEQ ID NO: 113405 - DNA, 25 bp, Mus musculus
accccatcgagtcagagtctggaga

SEQ ID NO: 113406 - DNA, 25 bp, Mus musculus
accccatcgagtgagagtctggaga

SEQ ID NO: 113407 - DNA, 25 bp, Mus musculus
accccatctgacctagagctattta

SEQ ID NO: 113408 - DNA, 25 bp, Mus musculus
accccatctgacgtagagctattta

SEQ ID NO: 113409 - DNA, 25 bp, Mus musculus
accccatctgcaaccttagcaatag

SEQ ID NO: 113410 - DNA, 25 bp, Mus musculus
accccatctgcatccttagcaatag

SEQ ID NO: 113411 - DNA, 25 bp, Mus musculus
accccatctgctattgggcgtcggt

SEQ ID NO: 113412 - DNA, 25 bp, Mus musculus
accccatctgcttttgggcgtcggt

SEQ ID NO: 113413 - DNA, 25 bp, Mus musculus
accccatgactcctgggccaagatg

SEQ ID NO: 113414 - DNA, 25 bp, Mus musculus
accccatgactcgtgggccaagatg

SEQ ID NO: 113415 - DNA, 25 bp, Mus musculus
accccatgagacaagacttcctttt

SEQ ID NO: 113416 - DNA, 25 bp, Mus musculus
accccatgagactagacttcctttt

SEQ ID NO: 113417 - DNA, 25 bp, Mus musculus
accccatgataacagaagcagccta

SEQ ID NO: 113418 - DNA, 25 bp, Mus musculus
accccatgataagagaagcagccta

SEQ ID NO: 113419 - DNA, 25 bp, Mus musculus
accccatgatcgaacaagcctttat

SEQ ID NO: 113420 - DNA, 25 bp, Mus musculus
accccatgatcgtacaagcctttat

SEQ ID NO: 113421 - DNA, 25 bp, Mus musculus
accccatgatgaagttgctctcaga

SEQ ID NO: 113422 - DNA, 25 bp, Mus musculus
accccatgatgatgttgctctcaga

SEQ ID NO: 113423 - DNA, 25 bp, Mus musculus
accccatgatggctgtaggatgcta

SEQ ID NO: 113424 - DNA, 25 bp, Mus musculus
accccatgatgggtgtaggatgcta

SEQ ID NO: 113425 - DNA, 25 bp, Mus musculus
accccatggtctacatgatgcttgt

SEQ ID NO: 113426 - DNA, 25 bp, Mus musculus
accccatggtcttcatgatgcttgt

SEQ ID NO: 113427 - DNA, 25 bp, Mus musculus
accccatgtaaacgtgcaacacact

SEQ ID NO: 113428 - DNA, 25 bp, Mus musculus
accccatgtaaaggtgcaacacact

SEQ ID NO: 113429 - DNA, 25 bp, Mus musculus
accccatgtggcagtgagggatgca

SEQ ID NO: 113430 - DNA, 25 bp, Mus musculus
accccatgtggctgtgagggatgca

SEQ ID NO: 113431 - DNA, 25 bp, Mus musculus
accccatgtgttagtaaatactctg

SEQ ID NO: 113432 - DNA, 25 bp, Mus musculus
accccatgtgtttgtaaatactctg

SEQ ID NO: 113433 - DNA, 25 bp, Mus musculus
accccatgttttacaatggagagcc

SEQ ID NO: 113434 - DNA, 25 bp, Mus musculus
accccatgtttttcaatggagagcc

SEQ ID NO: 113435 - DNA, 25 bp, Mus musculus
accccattcagcagttcaaacgtga

SEQ ID NO: 113436 - DNA, 25 bp, Mus musculus
accccattcagctgttcaaacgtga

SEQ ID NO: 113437 - DNA, 25 bp, Mus musculus
accccattgctgctagacaattttc

SEQ ID NO: 113438 - DNA, 25 bp, Mus musculus
accccattgctggtagacaattttc

SEQ ID NO: 113439 - DNA, 25 bp, Mus musculus
accccattgggcagcttttatgtag

SEQ ID NO: 113440 - DNA, 25 bp, Mus musculus
accccattgggctgcttttatgtag

SEQ ID NO: 113441 - DNA, 25 bp, Mus musculus
accccattgtcccttagaagtactg

SEQ ID NO: 113442 - DNA, 25 bp, Mus musculus
accccattgtccgttagaagtactg

SEQ ID NO: 113443 - DNA, 25 bp, Mus musculus
accccatttatgacattgtcacctt

SEQ ID NO: 113444 - DNA, 25 bp, Mus musculus
accccatttatgtcattgtcacctt

SEQ ID NO: 113445 - DNA, 25 bp, Mus musculus
accccatttctacttctaatcagga

SEQ ID NO: 113446 - DNA, 25 bp, Mus musculus
accccatttctagttctaatcagga

SEQ ID NO: 113447 - DNA, 25 bp, Mus musculus
accccatttgcactcttaacggaag

SEQ ID NO: 113448 - DNA, 25 bp, Mus musculus
accccatttgcagtcttaacggaag

SEQ ID NO: 113449 - DNA, 25 bp, Mus musculus
acccccaacttgataaatgacacga

SEQ ID NO: 113450 - DNA, 25 bp, Mus musculus
acccccaacttgttaaatgacacga

SEQ ID NO: 113451 - DNA, 25 bp, Mus musculus
acccccatatccattggatctcgtt

SEQ ID NO: 113452 - DNA, 25 bp, Mus musculus
acccccatatcctttggatctcgtt

SEQ ID NO: 113453 - DNA, 25 bp, Mus musculus
accccgacctctcagtgaatagtga

SEQ ID NO: 113454 - DNA, 25 bp, Mus musculus
accccgacctctgagtgaatagtga

SEQ ID NO: 113455 - DNA, 25 bp, Mus musculus
accccgactggtctaggacttatgg

SEQ ID NO: 113456 - DNA, 25 bp, Mus musculus
accccgactggtgtaggacttatgg

SEQ ID NO: 113457 - DNA, 25 bp, Mus musculus
accccgagacaacttgaaacacttg

SEQ ID NO: 113458 - DNA, 25 bp, Mus musculus
accccgagacaagttgaaacacttg

SEQ ID NO: 113459 - DNA, 25 bp, Mus musculus
accccgagcacgctttctatgagtt

SEQ ID NO: 113460 - DNA, 25 bp, Mus musculus
accccgagcacggtttctatgagtt

SEQ ID NO: 113461 - DNA, 25 bp, Mus musculus
accccgaggtgaatctagggcgcca

SEQ ID NO: 113462 - DNA, 25 bp, Mus musculus
accccgaggtgattctagggcgcca

SEQ ID NO: 113463 - DNA, 25 bp, Mus musculus
accccgagtgataggcaccaaacag

SEQ ID NO: 113464 - DNA, 25 bp, Mus musculus
accccgagtgattggcaccaaacag

SEQ ID NO: 113465 - DNA, 25 bp, Mus musculus
accccgagttgcaatcggctgtcag

SEQ ID NO: 113466 - DNA, 25 bp, Mus musculus
accccgagttgctatcggctgtcag

SEQ ID NO: 113467 - DNA, 25 bp, Mus musculus
accccgatcaggaccactggtgcta

SEQ ID NO: 113468 - DNA, 25 bp, Mus musculus
accccgatcaggtccactggtgcta

SEQ ID NO: 113469 - DNA, 25 bp, Mus musculus
accccgcagaaccagcttgtgcatg

SEQ ID NO: 113470 - DNA, 25 bp, Mus musculus
accccgcagaacgagcttgtgcatg

SEQ ID NO: 113471 - DNA, 25 bp, Mus musculus
accccgcagactaacaggagacata

SEQ ID NO: 113472 - DNA, 25 bp, Mus musculus
accccgcagacttacaggagacata

SEQ ID NO: 113473 - DNA, 25 bp, Mus musculus
accccgcagtgtatgttttcaggaa

SEQ ID NO: 113474 - DNA, 25 bp, Mus musculus
accccgcagtgtttgttttcaggaa

SEQ ID NO: 113475 - DNA, 25 bp, Mus musculus
accccgccatgaacaggaatgcagt

SEQ ID NO: 113476 - DNA, 25 bp, Mus musculus
accccgccatgatcaggaatgcagt

SEQ ID NO: 113477 - DNA, 25 bp, Mus musculus
accccgcctcatcggacaaggagtt

SEQ ID NO: 113478 - DNA, 25 bp, Mus musculus
accccgcctcatgggacaaggagtt

SEQ ID NO: 113479 - DNA, 25 bp, Mus musculus
accccgccttggaagggcacactgg

SEQ ID NO: 113480 - DNA, 25 bp, Mus musculus
accccgccttggtagggcacactgg

SEQ ID NO: 113481 - DNA, 25 bp, Mus musculus
accccgcttggtagaatgttagcac

SEQ ID NO: 113482 - DNA, 25 bp, Mus musculus
accccgcttggttgaatgttagcac

SEQ ID NO: 113483 - DNA, 25 bp, Mus musculus
accccggcgcagacatggagcatca

SEQ ID NO: 113484 - DNA, 25 bp, Mus musculus
accccggcgcagtcatggagcatca

SEQ ID NO: 113485 - DNA, 25 bp, Mus musculus
accccggctgaacagctagtgttag

SEQ ID NO: 113486 - DNA, 25 bp, Mus musculus
accccggctgaagagctagtgttag

SEQ ID NO: 113487 - DNA, 25 bp, Mus musculus
accccgggacgcagagtgatgacat

SEQ ID NO: 113488 - DNA, 25 bp, Mus musculus
accccgggacgctgagtgatgacat

SEQ ID NO: 113489 - DNA, 25 bp, Mus musculus
accccgggcagcaggtccagttgat

SEQ ID NO: 113490 - DNA, 25 bp, Mus musculus
accccgggcagctggtccagttgat

SEQ ID NO: 113491 - DNA, 25 bp, Mus musculus
accccgggtggaaggtctcatttct

SEQ ID NO: 113492 - DNA, 25 bp, Mus musculus
accccgggtggatggtctcatttct

SEQ ID NO: 113493 - DNA, 25 bp, Mus musculus
accccggtatttaatgctgcacaca

SEQ ID NO: 113494 - DNA, 25 bp, Mus musculus
accccggtattttatgctgcacaca

SEQ ID NO: 113495 - DNA, 25 bp, Mus musculus
accccggtgggacgtcagatgactc

SEQ ID NO: 113496 - DNA, 25 bp, Mus musculus
accccggtgggaggtcagatgactc

SEQ ID NO: 113497 - DNA, 25 bp, Mus musculus
accccggtggttcttatgcacagga

SEQ ID NO: 113498 - DNA, 25 bp, Mus musculus
accccggtggttgttatgcacagga

SEQ ID NO: 113499 - DNA, 25 bp, Mus musculus
accccggtgttcatgctctgtaagg

SEQ ID NO: 113500 - DNA, 25 bp, Mus musculus
accccggtgttcatgggtctgagtg

SEQ ID NO: 113501 - DNA, 25 bp, Mus musculus
accccggtgttcttgctctgtaagg

SEQ ID NO: 113502 - DNA, 25 bp, Mus musculus
accccggtgttcttgggtctgagtg

SEQ ID NO: 113503 - DNA, 25 bp, Mus musculus
accccgtgacgactggaatgatttc

SEQ ID NO: 113504 - DNA, 25 bp, Mus musculus
accccgtgacgagtggaatgatttc

SEQ ID NO: 113505 - DNA, 25 bp, Mus musculus
accccgtgacggagttcattgctca

SEQ ID NO: 113506 - DNA, 25 bp, Mus musculus
accccgtgacggtgttcattgctca

SEQ ID NO: 113507 - DNA, 25 bp, Mus musculus
accccgtgtgatatatgtgtgtctg

SEQ ID NO: 113508 - DNA, 25 bp, Mus musculus
accccgtgtgatttatgtgtgtctg

SEQ ID NO: 113509 - DNA, 25 bp, Mus musculus
acccctaagctaacctgttgagtga

SEQ ID NO: 113510 - DNA, 25 bp, Mus musculus
acccctaagctatcctgttgagtga

SEQ ID NO: 113511 - DNA, 25 bp, Mus musculus
acccctaagtggagaatcttctcag

SEQ ID NO: 113512 - DNA, 25 bp, Mus musculus
acccctaagtggtgaatcttctcag

SEQ ID NO: 113513 - DNA, 25 bp, Mus musculus
acccctaataccacatttctggaag

SEQ ID NO: 113514 - DNA, 25 bp, Mus musculus
acccctaatacctcatttctggaag

SEQ ID NO: 113515 - DNA, 25 bp, Mus musculus
acccctacagacctgcgggatgttg

SEQ ID NO: 113516 - DNA, 25 bp, Mus musculus
acccctacagacgtgcgggatgttg

SEQ ID NO: 113517 - DNA, 25 bp, Mus musculus
acccctacaggtagcccaatatatt

SEQ ID NO: 113518 - DNA, 25 bp, Mus musculus
acccctacaggttgcccaatatatt

SEQ ID NO: 113519 - DNA, 25 bp, Mus musculus
acccctaccactaacatcgatgata

SEQ ID NO: 113520 - DNA, 25 bp, Mus musculus
acccctaccacttacatcgatgata

SEQ ID NO: 113521 - DNA, 25 bp, Mus musculus
acccctactttaatgccatcattgc

SEQ ID NO: 113522 - DNA, 25 bp, Mus musculus
acccctactttattgccatcattgc

SEQ ID NO: 113523 - DNA, 25 bp, Mus musculus
acccctagaggacatgtggattgag

SEQ ID NO: 113524 - DNA, 25 bp, Mus musculus
acccctagaggagatgtggattgag

SEQ ID NO: 113525 - DNA, 25 bp, Mus musculus
acccctagagtgacacttcttgctt

SEQ ID NO: 113526 - DNA, 25 bp, Mus musculus
acccctagagtgtcacttcttgctt

SEQ ID NO: 113527 - DNA, 25 bp, Mus musculus
acccctagccacagcattgtttagt

SEQ ID NO: 113528 - DNA, 25 bp, Mus musculus
acccctagccactgcattgtttagt

SEQ ID NO: 113529 - DNA, 25 bp, Mus musculus
acccctaggaccaggttgttctgat

SEQ ID NO: 113530 - DNA, 25 bp, Mus musculus
acccctaggacctggttgttctgat

SEQ ID NO: 113531 - DNA, 25 bp, Mus musculus
acccctaggtctagaaatcgtgact

SEQ ID NO: 113532 - DNA, 25 bp, Mus musculus
acccctaggtcttgaaatcgtgact

SEQ ID NO: 113533 - DNA, 25 bp, Mus musculus
acccctataggcctgtgacaatacc

SEQ ID NO: 113534 - DNA, 25 bp, Mus musculus
acccctataggcgtgtgacaatacc

SEQ ID NO: 113535 - DNA, 25 bp, Mus musculus
acccctatcagtaaaagacaagccg

SEQ ID NO: 113536 - DNA, 25 bp, Mus musculus
acccctatcagttaaagacaagccg

SEQ ID NO: 113537 - DNA, 25 bp, Mus musculus
acccctatcttgatggcgtgacaca

SEQ ID NO: 113538 - DNA, 25 bp, Mus musculus
acccctatcttgttggcgtgacaca

SEQ ID NO: 113539 - DNA, 25 bp, Mus musculus
acccctcaacctaaaggcaggctag

SEQ ID NO: 113540 - DNA, 25 bp, Mus musculus
acccctcaaccttaaggcaggctag

SEQ ID NO: 113541 - DNA, 25 bp, Mus musculus
acccctcacacaaggcagagctggt

SEQ ID NO: 113542 - DNA, 25 bp, Mus musculus
acccctcacacatggcagagctggt

SEQ ID NO: 113543 - DNA, 25 bp, Mus musculus
acccctcacatccataatgttcttt

SEQ ID NO: 113544 - DNA, 25 bp, Mus musculus
acccctcacatcgataatgttcttt

SEQ ID NO: 113545 - DNA, 25 bp, Mus musculus
acccctcaccctaaacatatatagt

SEQ ID NO: 113546 - DNA, 25 bp, Mus musculus
acccctcacccttaacatatatagt

SEQ ID NO: 113547 - DNA, 25 bp, Mus musculus
acccctcactttctttccatgaaga

SEQ ID NO: 113548 - DNA, 25 bp, Mus musculus
acccctcactttgtttccatgaaga

SEQ ID NO: 113549 - DNA, 25 bp, Mus musculus
acccctcagggtccaggtctgggat

SEQ ID NO: 113550 - DNA, 25 bp, Mus musculus
acccctcagggtgcaggtctgggat

SEQ ID NO: 113551 - DNA, 25 bp, Mus musculus
acccctccacagctatttacttggg

SEQ ID NO: 113552 - DNA, 25 bp, Mus musculus
acccctccacaggtatttacttggg

SEQ ID NO: 113553 - DNA, 25 bp, Mus musculus
acccctccaggaacagggtgagcag

SEQ ID NO: 113554 - DNA, 25 bp, Mus musculus
acccctccaggatcagggtgagcag

SEQ ID NO: 113555 - DNA, 25 bp, Mus musculus
acccctccatggctatggagttcag

SEQ ID NO: 113556 - DNA, 25 bp, Mus musculus
acccctccatgggtatggagttcag

SEQ ID NO: 113557 - DNA, 25 bp, Mus musculus
acccctcccatacttatgtgttgta

SEQ ID NO: 113558 - DNA, 25 bp, Mus musculus
acccctcccatagttatgtgttgta

SEQ ID NO: 113559 - DNA, 25 bp, Mus musculus
acccctcctctcagtattctatgga

SEQ ID NO: 113560 - DNA, 25 bp, Mus musculus
acccctcctctctgtattctatgga

SEQ ID NO: 113561 - DNA, 25 bp, Mus musculus
acccctcctgaaagcttagcagcta

SEQ ID NO: 113562 - DNA, 25 bp, Mus musculus
acccctcctgaatgcttagcagcta

SEQ ID NO: 113563 - DNA, 25 bp, Mus musculus
acccctccttatccctggaatgtat

SEQ ID NO: 113564 - DNA, 25 bp, Mus musculus
acccctccttatgcctggaatgtat

SEQ ID NO: 113565 - DNA, 25 bp, Mus musculus
acccctccttgtaggatgggatcaa

SEQ ID NO: 113566 - DNA, 25 bp, Mus musculus
acccctccttgttggatgggatcaa

SEQ ID NO: 113567 - DNA, 25 bp, Mus musculus
acccctcgagctcatgtgattggat

SEQ ID NO: 113568 - DNA, 25 bp, Mus musculus
acccctcgagctgatgtgattggat

SEQ ID NO: 113569 - DNA, 25 bp, Mus musculus
acccctctagttactgtaaatattg

SEQ ID NO: 113570 - DNA, 25 bp, Mus musculus
acccctctagtttctgtaaatattg

SEQ ID NO: 113571 - DNA, 25 bp, Mus musculus
acccctctatctctacagttgcttg

SEQ ID NO: 113572 - DNA, 25 bp, Mus musculus
acccctctatctgtacagttgcttg

SEQ ID NO: 113573 - DNA, 25 bp, Mus musculus
acccctctcaggaatcaagtgcaga

SEQ ID NO: 113574 - DNA, 25 bp, Mus musculus
acccctctcaggtatcaagtgcaga

SEQ ID NO: 113575 - DNA, 25 bp, Mus musculus
acccctctctgaaatgcgctttgtt

SEQ ID NO: 113576 - DNA, 25 bp, Mus musculus
acccctctctgatatgcgctttgtt

SEQ ID NO: 113577 - DNA, 25 bp, Mus musculus
acccctctctgtagtcatttcatgt

SEQ ID NO: 113578 - DNA, 25 bp, Mus musculus
acccctctctgttgtcatttcatgt

SEQ ID NO: 113579 - DNA, 25 bp, Mus musculus
acccctctgccaatcgggttatggc

SEQ ID NO: 113580 - DNA, 25 bp, Mus musculus
acccctctgccattcgggttatggc

SEQ ID NO: 113581 - DNA, 25 bp, Mus musculus
acccctctgggcaacgtggaggaat

SEQ ID NO: 113582 - DNA, 25 bp, Mus musculus
acccctctgggctacgtggaggaat

SEQ ID NO: 113583 - DNA, 25 bp, Mus musculus
acccctctgtcaaagtgtctgatgg

SEQ ID NO: 113584 - DNA, 25 bp, Mus musculus
acccctctgtcatagtgtctgatgg

SEQ ID NO: 113585 - DNA, 25 bp, Mus musculus
acccctcttcaaaaactgccaggag

SEQ ID NO: 113586 - DNA, 25 bp, Mus musculus
acccctcttcaataactgccaggag

SEQ ID NO: 113587 - DNA, 25 bp, Mus musculus
acccctctttcaaagcacatgacag

SEQ ID NO: 113588 - DNA, 25 bp, Mus musculus
acccctctttcatagcacatgacag

SEQ ID NO: 113589 - DNA, 25 bp, Mus musculus
acccctctttgtacagtggcttgaa

SEQ ID NO: 113590 - DNA, 25 bp, Mus musculus
acccctctttgttcagtggcttgaa

SEQ ID NO: 113591 - DNA, 25 bp, Mus musculus
acccctgaaagtctaagccctgata

SEQ ID NO: 113592 - DNA, 25 bp, Mus musculus
acccctgaaagtgtaagccctgata

SEQ ID NO: 113593 - DNA, 25 bp, Mus musculus
acccctgaagagaccatgtttttgt

SEQ ID NO: 113594 - DNA, 25 bp, Mus musculus
acccctgaagagtccatgtttttgt

SEQ ID NO: 113595 - DNA, 25 bp, Mus musculus
acccctgacacgatttcaagcacag

SEQ ID NO: 113596 - DNA, 25 bp, Mus musculus
acccctgacacgttttcaagcacag

SEQ ID NO: 113597 - DNA, 25 bp, Mus musculus
acccctgacccaagcagaggcggta

SEQ ID NO: 113598 - DNA, 25 bp, Mus musculus
acccctgacccatgcagaggcggta

SEQ ID NO: 113599 - DNA, 25 bp, Mus musculus
acccctgacctgacgggctggactt

SEQ ID NO: 113600 - DNA, 25 bp, Mus musculus
acccctgacctgtcgggctggactt

SEQ ID NO: 113601 - DNA, 25 bp, Mus musculus
acccctgactcgattctgtactgtg

SEQ ID NO: 113602 - DNA, 25 bp, Mus musculus
acccctgactcgtttctgtactgtg

SEQ ID NO: 113603 - DNA, 25 bp, Mus musculus
acccctgacttcaactgggacagag

SEQ ID NO: 113604 - DNA, 25 bp, Mus musculus
acccctgacttctactgggacagag

SEQ ID NO: 113605 - DNA, 25 bp, Mus musculus
acccctgagcagaacaagatgtgca

SEQ ID NO: 113606 - DNA, 25 bp, Mus musculus
acccctgagcagtacaagatgtgca

SEQ ID NO: 113607 - DNA, 25 bp, Mus musculus
acccctgaggagaagccattggact

SEQ ID NO: 113608 - DNA, 25 bp, Mus musculus
acccctgaggagtagccattggact

SEQ ID NO: 113609 - DNA, 25 bp, Mus musculus
acccctgagggtacgcgcttctgca

SEQ ID NO: 113610 - DNA, 25 bp, Mus musculus
acccctgagggttcgcgcttctgca

SEQ ID NO: 113611 - DNA, 25 bp, Mus musculus
acccctgagtggcttacagttctgg

SEQ ID NO: 113612 - DNA, 25 bp, Mus musculus
acccctgagtgggttacagttctgg

SEQ ID NO: 113613 - DNA, 25 bp, Mus musculus
acccctgagttcctagcaaacttat

SEQ ID NO: 113614 - DNA, 25 bp, Mus musculus
acccctgagttcgtagcaaacttat

SEQ ID NO: 113615 - DNA, 25 bp, Mus musculus
acccctgatcagattggaagcttgg

SEQ ID NO: 113616 - DNA, 25 bp, Mus musculus
acccctgatcagtttggaagcttgg

SEQ ID NO: 113617 - DNA, 25 bp, Mus musculus
acccctgcacatcttaacagttctg

SEQ ID NO: 113618 - DNA, 25 bp, Mus musculus
acccctgcacatgttaacagttctg

SEQ ID NO: 113619 - DNA, 25 bp, Mus musculus
acccctgccactattgttactgttg

SEQ ID NO: 113620 - DNA, 25 bp, Mus musculus
acccctgccacttttgttactgttg

SEQ ID NO: 113621 - DNA, 25 bp, Mus musculus
acccctgcctgtcctaagcaggaga

SEQ ID NO: 113622 - DNA, 25 bp, Mus musculus
acccctgcctgtcctgagtgaaaag

SEQ ID NO: 113623 - DNA, 25 bp, Mus musculus
acccctgcctgtgctaagcaggaga

SEQ ID NO: 113624 - DNA, 25 bp, Mus musculus
acccctgcctgtgctgagtgaaaag

SEQ ID NO: 113625 - DNA, 25 bp, Mus musculus
acccctgcctttatggatcaatcgt

SEQ ID NO: 113626 - DNA, 25 bp, Mus musculus
acccctgcctttttggatcaatcgt

SEQ ID NO: 113627 - DNA, 25 bp, Mus musculus
acccctgctaaactgcgaacaggtg

SEQ ID NO: 113628 - DNA, 25 bp, Mus musculus
acccctgctaaagtgcgaacaggtg

SEQ ID NO: 113629 - DNA, 25 bp, Mus musculus
acccctgctacacttggccagagag

SEQ ID NO: 113630 - DNA, 25 bp, Mus musculus
acccctgctacagttggccagagag

SEQ ID NO: 113631 - DNA, 25 bp, Mus musculus
acccctgctcgtattccgggctcag

SEQ ID NO: 113632 - DNA, 25 bp, Mus musculus
acccctgctcgttttccgggctcag

SEQ ID NO: 113633 - DNA, 25 bp, Mus musculus
acccctgctgctatcggaattgcaa

SEQ ID NO: 113634 - DNA, 25 bp, Mus musculus
acccctgctgctttcggaattgcaa

SEQ ID NO: 113635 - DNA, 25 bp, Mus musculus
acccctgctggacctcatgaatgat

SEQ ID NO: 113636 - DNA, 25 bp, Mus musculus
acccctgctggagctcatgaatgat

SEQ ID NO: 113637 - DNA, 25 bp, Mus musculus
acccctggagatacttttcttgaat

SEQ ID NO: 113638 - DNA, 25 bp, Mus musculus
acccctggagattcttttcttgaat

SEQ ID NO: 113639 - DNA, 25 bp, Mus musculus
acccctggagtcatggacagcttct

SEQ ID NO: 113640 - DNA, 25 bp, Mus musculus
acccctggagtcttggacagcttct

SEQ ID NO: 113641 - DNA, 25 bp, Mus musculus
acccctggcaatcgcacagaaacaa

SEQ ID NO: 113642 - DNA, 25 bp, Mus musculus
acccctggcaatggcacagaaacaa

SEQ ID NO: 113643 - DNA, 25 bp, Mus musculus
acccctgggacaagtatactctaga

SEQ ID NO: 113644 - DNA, 25 bp, Mus musculus
acccctgggacatgtatactctaga

SEQ ID NO: 113645 - DNA, 25 bp, Mus musculus
acccctgggcaaatctgctgtgaga

SEQ ID NO: 113646 - DNA, 25 bp, Mus musculus
acccctgggcaattctgctgtgaga

SEQ ID NO: 113647 - DNA, 25 bp, Mus musculus
acccctgggtgcagtcaagaactgt

SEQ ID NO: 113648 - DNA, 25 bp, Mus musculus
acccctgggtgctgtcaagaactgt

SEQ ID NO: 113649 - DNA, 25 bp, Mus musculus
acccctggtgtcagcatctttatac

SEQ ID NO: 113650 - DNA, 25 bp, Mus musculus
acccctggtgtctgcatctttatac

SEQ ID NO: 113651 - DNA, 25 bp, Mus musculus
acccctggttctcctttcatgctga

SEQ ID NO: 113652 - DNA, 25 bp, Mus musculus
acccctggttctgctttcatgctga

SEQ ID NO: 113653 - DNA, 25 bp, Mus musculus
acccctgtaggaaagctgctgtttg

SEQ ID NO: 113654 - DNA, 25 bp, Mus musculus
acccctgtaggatagctgctgtttg

SEQ ID NO: 113655 - DNA, 25 bp, Mus musculus
acccctgtatgtctctacatctgga

SEQ ID NO: 113656 - DNA, 25 bp, Mus musculus
acccctgtatgtgtctacatctgga

SEQ ID NO: 113657 - DNA, 25 bp, Mus musculus
acccctgtctcaaatgctgtgattg

SEQ ID NO: 113658 - DNA, 25 bp, Mus musculus
acccctgtctcatatgctgtgattg

SEQ ID NO: 113659 - DNA, 25 bp, Mus musculus
acccctgtctgtcgttttgtgctga

SEQ ID NO: 113660 - DNA, 25 bp, Mus musculus
acccctgtctgtggttttgtgctga

SEQ ID NO: 113661 - DNA, 25 bp, Mus musculus
acccctgtgctcaagcaatcattgt

SEQ ID NO: 113662 - DNA, 25 bp, Mus musculus
acccctgtgctctagcaatcattgt

SEQ ID NO: 113663 - DNA, 25 bp, Mus musculus
acccctgtgtcaagggctagtgtga

SEQ ID NO: 113664 - DNA, 25 bp, Mus musculus
acccctgtgtcatgggctagtgtga

SEQ ID NO: 113665 - DNA, 25 bp, Mus musculus
acccctgtgtgcctcagtattagat

SEQ ID NO: 113666 - DNA, 25 bp, Mus musculus
acccctgtgtgccttgttgaagaga

SEQ ID NO: 113667 - DNA, 25 bp, Mus musculus
acccctgtgtgcgtcagtattagat

SEQ ID NO: 113668 - DNA, 25 bp, Mus musculus
acccctgtgtgcgttgttgaagaga

SEQ ID NO: 113669 - DNA, 25 bp, Mus musculus
acccctgttcctcctatgagaagtt

SEQ ID NO: 113670 - DNA, 25 bp, Mus musculus
acccctgttcctgctatgagaagtt

SEQ ID NO: 113671 - DNA, 25 bp, Mus musculus
accccttaagcacaactaaactctg

SEQ ID NO: 113672 - DNA, 25 bp, Mus musculus
accccttaagcagaactaaactctg

SEQ ID NO: 113673 - DNA, 25 bp, Mus musculus
accccttaagtgacattttcctgat

SEQ ID NO: 113674 - DNA, 25 bp, Mus musculus
accccttaagtgtcattttcctgat

SEQ ID NO: 113675 - DNA, 25 bp, Mus musculus
accccttacttgctgagtgaccttg

SEQ ID NO: 113676 - DNA, 25 bp, Mus musculus
accccttacttggtgagtgaccttg

SEQ ID NO: 113677 - DNA, 25 bp, Mus musculus
accccttcaagacgccagtggtatg

SEQ ID NO: 113678 - DNA, 25 bp, Mus musculus
accccttcaagaggccagtggtatg

SEQ ID NO: 113679 - DNA, 25 bp, Mus musculus
accccttcaagcctgccaataatga

SEQ ID NO: 113680 - DNA, 25 bp, Mus musculus
accccttcaagcgtgccaataatga

SEQ ID NO: 113681 - DNA, 25 bp, Mus musculus
accccttcaatgagacggtgcgcag

SEQ ID NO: 113682 - DNA, 25 bp, Mus musculus
accccttcaatgtgacggtgcgcag

SEQ ID NO: 113683 - DNA, 25 bp, Mus musculus
accccttcatgtcctaaggaagaca

SEQ ID NO: 113684 - DNA, 25 bp, Mus musculus
accccttcatgtgctaaggaagaca

SEQ ID NO: 113685 - DNA, 25 bp, Mus musculus
accccttcttacaatacaacttcag

SEQ ID NO: 113686 - DNA, 25 bp, Mus musculus
accccttcttactatacaacttcag

SEQ ID NO: 113687 - DNA, 25 bp, Mus musculus
accccttcttggagaaacttgtcag

SEQ ID NO: 113688 - DNA, 25 bp, Mus musculus
accccttcttggtgaaacttgtcag

SEQ ID NO: 113689 - DNA, 25 bp, Mus musculus
accccttgaactaaatcctccatgg

SEQ ID NO: 113690 - DNA, 25 bp, Mus musculus
accccttgaacttaatcctccatgg

SEQ ID NO: 113691 - DNA, 25 bp, Mus musculus
accccttgcctgaggaacgctgttg

SEQ ID NO: 113692 - DNA, 25 bp, Mus musculus
accccttgcctgtggaacgctgttg

SEQ ID NO: 113693 - DNA, 25 bp, Mus musculus
accccttgcttacttagctcagtga

SEQ ID NO: 113694 - DNA, 25 bp, Mus musculus
accccttgcttagttagctcagtga

SEQ ID NO: 113695 - DNA, 25 bp, Mus musculus
accccttgctttcaccattgcatga

SEQ ID NO: 113696 - DNA, 25 bp, Mus musculus
accccttgctttgaccattgcatga

SEQ ID NO: 113697 - DNA, 25 bp, Mus musculus
accccttggatcaacaatggatgct

SEQ ID NO: 113698 - DNA, 25 bp, Mus musculus
accccttggatctacaatggatgct

SEQ ID NO: 113699 - DNA, 25 bp, Mus musculus
accccttgtagaaactgccttaaca

SEQ ID NO: 113700 - DNA, 25 bp, Mus musculus
accccttgtagatactgccttaaca

SEQ ID NO: 113701 - DNA, 25 bp, Mus musculus
accccttgtgatcctgctggaacag

SEQ ID NO: 113702 - DNA, 25 bp, Mus musculus
accccttgtgatgctgctggaacag

SEQ ID NO: 113703 - DNA, 25 bp, Mus musculus
accccttgtggcacacttctgagag

SEQ ID NO: 113704 - DNA, 25 bp, Mus musculus
accccttgtggctcacttctgagag

SEQ ID NO: 113705 - DNA, 25 bp, Mus musculus
acccctttcagtagtcagatacttg

SEQ ID NO: 113706 - DNA, 25 bp, Mus musculus
acccctttcagttgtcagatacttg

SEQ ID NO: 113707 - DNA, 25 bp, Mus musculus
acccctttctgtccatgggtgcaat

SEQ ID NO: 113708 - DNA, 25 bp, Mus musculus
acccctttctgtgcatgggtgcaat

SEQ ID NO: 113709 - DNA, 25 bp, Mus musculus
acccctttgacgacggttgcagata

SEQ ID NO: 113710 - DNA, 25 bp, Mus musculus
acccctttgacgtcggttgcagata

SEQ ID NO: 113711 - DNA, 25 bp, Mus musculus
acccctttgctcattatctgctgag

SEQ ID NO: 113712 - DNA, 25 bp, Mus musculus
acccctttgctctttatctgctgag

SEQ ID NO: 113713 - DNA, 25 bp, Mus musculus
acccctttgggtcctggagagactg

SEQ ID NO: 113714 - DNA, 25 bp, Mus musculus
acccctttgggtgctggagagactg

SEQ ID NO: 113715 - DNA, 25 bp, Mus musculus
accccttttacactgtttctgtgat

SEQ ID NO: 113716 - DNA, 25 bp, Mus musculus
accccttttacagtgtttctgtgat

SEQ ID NO: 113717 - DNA, 25 bp, Mus musculus
accccttttgctcaaattcttggca

SEQ ID NO: 113718 - DNA, 25 bp, Mus musculus
accccttttgctgaaattcttggca

SEQ ID NO: 113719 - DNA, 25 bp, Mus musculus
acccgaaaattcctgacgtgcttgt

SEQ ID NO: 113720 - DNA, 25 bp, Mus musculus
acccgaaaattcgtgacgtgcttgt

SEQ ID NO: 113721 - DNA, 25 bp, Mus musculus
acccgaagctgacccagctagatgt

SEQ ID NO: 113722 - DNA, 25 bp, Mus musculus
acccgaagctgagccagctagatgt

SEQ ID NO: 113723 - DNA, 25 bp, Mus musculus
acccgacagtagcagtgcttcataa

SEQ ID NO: 113724 - DNA, 25 bp, Mus musculus
acccgacagtaggagtgcttcataa

SEQ ID NO: 113725 - DNA, 25 bp, Mus musculus
acccgacattaacttctctggcgaa

SEQ ID NO: 113726 - DNA, 25 bp, Mus musculus
acccgacattaagttctctggcgaa

SEQ ID NO: 113727 - DNA, 25 bp, Mus musculus
acccgaccccatacaaatcagagtg

SEQ ID NO: 113728 - DNA, 25 bp, Mus musculus
acccgaccccattcaaatcagagtg

SEQ ID NO: 113729 - DNA, 25 bp, Mus musculus
acccgaccctgcatttatgatatag

SEQ ID NO: 113730 - DNA, 25 bp, Mus musculus
acccgaccctgcttttatgatatag

SEQ ID NO: 113731 - DNA, 25 bp, Mus musculus
acccgactacacacctgtccacagg

SEQ ID NO: 113732 - DNA, 25 bp, Mus musculus
acccgactacactcctgtccacagg

SEQ ID NO: 113733 - DNA, 25 bp, Mus musculus
acccgactcctaatgatgactccta

SEQ ID NO: 113734 - DNA, 25 bp, Mus musculus
acccgactcctattgatgactccta

SEQ ID NO: 113735 - DNA, 25 bp, Mus musculus
acccgactttgcacgtggtgttgag

SEQ ID NO: 113736 - DNA, 25 bp, Mus musculus
acccgactttgctcgtggtgttgag

SEQ ID NO: 113737 - DNA, 25 bp, Mus musculus
acccgacttttcagttactgaagtg

SEQ ID NO: 113738 - DNA, 25 bp, Mus musculus
acccgacttttctgttactgaagtg

SEQ ID NO: 113739 - DNA, 25 bp, Mus musculus
acccgagacgaacgtgttctgtggt

SEQ ID NO: 113740 - DNA, 25 bp, Mus musculus
acccgagacgaacgtgtttctgtgg

SEQ ID NO: 113741 - DNA, 25 bp, Mus musculus
acccgagacgaaggtgttctgtggt

SEQ ID NO: 113742 - DNA, 25 bp, Mus musculus
acccgagacgaaggtgtttctgtgg

SEQ ID NO: 113743 - DNA, 25 bp, Mus musculus
acccgagagcccagtgtcatgtgtg

SEQ ID NO: 113744 - DNA, 25 bp, Mus musculus
acccgagagccctgtgtcatgtgtg

SEQ ID NO: 113745 - DNA, 25 bp, Mus musculus
acccgagccacccagtgagggagga

SEQ ID NO: 113746 - DNA, 25 bp, Mus musculus
acccgagccaccgagtgagggagga

SEQ ID NO: 113747 - DNA, 25 bp, Mus musculus
acccgagcttgactccagaatggca

SEQ ID NO: 113748 - DNA, 25 bp, Mus musculus
acccgagcttgagtccagaatggca

SEQ ID NO: 113749 - DNA, 25 bp, Mus musculus
acccgagggtcactacacattggag

SEQ ID NO: 113750 - DNA, 25 bp, Mus musculus
acccgagggtcagtacacattggag

SEQ ID NO: 113751 - DNA, 25 bp, Mus musculus
acccgagtcaagctgctcacaatta

SEQ ID NO: 113752 - DNA, 25 bp, Mus musculus
acccgagtcaaggtgctcacaatta

SEQ ID NO: 113753 - DNA, 25 bp, Mus musculus
acccgagtcagtcagatcccagata

SEQ ID NO: 113754 - DNA, 25 bp, Mus musculus
acccgagtcagtgagatcccagata

SEQ ID NO: 113755 - DNA, 25 bp, Mus musculus
acccgagtctatcctaggaccttaa

SEQ ID NO: 113756 - DNA, 25 bp, Mus musculus
acccgagtctatgctaggaccttaa

SEQ ID NO: 113757 - DNA, 25 bp, Mus musculus
acccgatctcgtcagagctgacggt

SEQ ID NO: 113758 - DNA, 25 bp, Mus musculus
acccgatctcgtgagagctgacggt

SEQ ID NO: 113759 - DNA, 25 bp, Mus musculus
acccgatctgctccgattttctgct

SEQ ID NO: 113760 - DNA, 25 bp, Mus musculus
acccgatctgctgcgattttctgct

SEQ ID NO: 113761 - DNA, 25 bp, Mus musculus
acccgatgtcttactgggaagcaga

SEQ ID NO: 113762 - DNA, 25 bp, Mus musculus
acccgatgtctttctgggaagcaga

SEQ ID NO: 113763 - DNA, 25 bp, Mus musculus
acccgattccacagctgtagttaaa

SEQ ID NO: 113764 - DNA, 25 bp, Mus musculus
acccgattccactgctgtagttaaa

SEQ ID NO: 113765 - DNA, 25 bp, Mus musculus
acccgattccatcttcggcatgtaa

SEQ ID NO: 113766 - DNA, 25 bp, Mus musculus
acccgattccatgttcggcatgtaa

SEQ ID NO: 113767 - DNA, 25 bp, Mus musculus
acccgattccggatacaggcatttt

SEQ ID NO: 113768 - DNA, 25 bp, Mus musculus
acccgattccggttacaggcatttt

SEQ ID NO: 113769 - DNA, 25 bp, Mus musculus
acccgattcggcctatattgatttg

SEQ ID NO: 113770 - DNA, 25 bp, Mus musculus
acccgattcggcgtatattgatttg

SEQ ID NO: 113771 - DNA, 25 bp, Mus musculus
acccgcaacaaacctcgtgtacata

SEQ ID NO: 113772 - DNA, 25 bp, Mus musculus
acccgcaacaaagctcgtgtacata

SEQ ID NO: 113773 - DNA, 25 bp, Mus musculus
acccgcacaattaattacctggcaa

SEQ ID NO: 113774 - DNA, 25 bp, Mus musculus
acccgcacaatttattacctggcaa

SEQ ID NO: 113775 - DNA, 25 bp, Mus musculus
acccgcacacatcaaccatgagaat

SEQ ID NO: 113776 - DNA, 25 bp, Mus musculus
acccgcacacatgaaccatgagaat

SEQ ID NO: 113777 - DNA, 25 bp, Mus musculus
acccgcacacgcactgtgtaaattt

SEQ ID NO: 113778 - DNA, 25 bp, Mus musculus
acccgcacacgctctgtgtaaattt

SEQ ID NO: 113779 - DNA, 25 bp, Mus musculus
acccgcagagcaatgaacgttctat

SEQ ID NO: 113780 - DNA, 25 bp, Mus musculus
acccgcagagcattgaacgttctat

SEQ ID NO: 113781 - DNA, 25 bp, Mus musculus
acccgcagccgcaaagcttagggaa

SEQ ID NO: 113782 - DNA, 25 bp, Mus musculus
acccgcagccgctaagcttagggaa

SEQ ID NO: 113783 - DNA, 25 bp, Mus musculus
acccgcagctggcacagaactggtc

SEQ ID NO: 113784 - DNA, 25 bp, Mus musculus
acccgcagctgggacagaactggtc

SEQ ID NO: 113785 - DNA, 25 bp, Mus musculus
acccgcatccttcgaataaattcta

SEQ ID NO: 113786 - DNA, 25 bp, Mus musculus
acccgcatccttggaataaattcta

SEQ ID NO: 113787 - DNA, 25 bp, Mus musculus
acccgcatgcatccacgggatctga

SEQ ID NO: 113788 - DNA, 25 bp, Mus musculus
acccgcatgcatgcacgggatctga

SEQ ID NO: 113789 - DNA, 25 bp, Mus musculus
acccgccaggaccatgagggagtta

SEQ ID NO: 113790 - DNA, 25 bp, Mus musculus
acccgccaggacgatgagggagtta

SEQ ID NO: 113791 - DNA, 25 bp, Mus musculus
acccgcccatggacgacgtttatgc

SEQ ID NO: 113792 - DNA, 25 bp, Mus musculus
acccgcccatggtcgacgtttatgc

SEQ ID NO: 113793 - DNA, 25 bp, Mus musculus
acccgcctcacaatgaaatccaaat

SEQ ID NO: 113794 - DNA, 25 bp, Mus musculus
acccgcctcacattgaaatccaaat

SEQ ID NO: 113795 - DNA, 25 bp, Mus musculus
acccgcctgggcagccatgaatgta

SEQ ID NO: 113796 - DNA, 25 bp, Mus musculus
acccgcctgggctgccatgaatgta

SEQ ID NO: 113797 - DNA, 25 bp, Mus musculus
acccgctacattccgagtctgaagc

SEQ ID NO: 113798 - DNA, 25 bp, Mus musculus
acccgctacattgcgagtctgaagc

SEQ ID NO: 113799 - DNA, 25 bp, Mus musculus
acccgctacgggacaacagtggatg

SEQ ID NO: 113800 - DNA, 25 bp, Mus musculus
acccgctacgggtcaacagtggatg

SEQ ID NO: 113801 - DNA, 25 bp, Mus musculus
acccgctatgcaaatgtgcttttgt

SEQ ID NO: 113802 - DNA, 25 bp, Mus musculus
acccgctatgcatatgtgcttttgt

SEQ ID NO: 113803 - DNA, 25 bp, Mus musculus
acccgctcaactctgacctataggg

SEQ ID NO: 113804 - DNA, 25 bp, Mus musculus
acccgctcaactgtgacctataggg

SEQ ID NO: 113805 - DNA, 25 bp, Mus musculus
acccgctcactcattgtgaattgat

SEQ ID NO: 113806 - DNA, 25 bp, Mus musculus
acccgctcactctttgtgaattgat

SEQ ID NO: 113807 - DNA, 25 bp, Mus musculus
acccgctcccacaagcaaagttgtg

SEQ ID NO: 113808 - DNA, 25 bp, Mus musculus
acccgctcccactagcaaagttgtg

SEQ ID NO: 113809 - DNA, 25 bp, Mus musculus
acccgctgagctattcttttttagt

SEQ ID NO: 113810 - DNA, 25 bp, Mus musculus
acccgctgagcttttcttttttagt

SEQ ID NO: 113811 - DNA, 25 bp, Mus musculus
acccgctgatgactggttttatttt

SEQ ID NO: 113812 - DNA, 25 bp, Mus musculus
acccgctgatgagtggttttatttt

SEQ ID NO: 113813 - DNA, 25 bp, Mus musculus
acccgctgtgaaatgtccctgtaga

SEQ ID NO: 113814 - DNA, 25 bp, Mus musculus
acccgctgtgaattgtccctgtaga

SEQ ID NO: 113815 - DNA, 25 bp, Mus musculus
acccgcttcatacttacttcttatt

SEQ ID NO: 113816 - DNA, 25 bp, Mus musculus
acccgcttcatagttacttcttatt

SEQ ID NO: 113817 - DNA, 25 bp, Mus musculus
acccgcttctcactttcttagtaga

SEQ ID NO: 113818 - DNA, 25 bp, Mus musculus
acccgcttctcagtttcttagtaga

SEQ ID NO: 113819 - DNA, 25 bp, Mus musculus
acccgcttgcttactctataaaact

SEQ ID NO: 113820 - DNA, 25 bp, Mus musculus
acccgcttgctttctctataaaact

SEQ ID NO: 113821 - DNA, 25 bp, Mus musculus
acccgctttcctaaagtacttgctg

SEQ ID NO: 113822 - DNA, 25 bp, Mus musculus
acccgctttccttaagtacttgctg

SEQ ID NO: 113823 - DNA, 25 bp, Mus musculus
acccgctttgcgaccagagaaggag

SEQ ID NO: 113824 - DNA, 25 bp, Mus musculus
acccgctttgcgtccagagaaggag

SEQ ID NO: 113825 - DNA, 25 bp, Mus musculus
acccggaacaatcagctgcgtcgtc

SEQ ID NO: 113826 - DNA, 25 bp, Mus musculus
acccggaacaatgagctgcgtcgtc

SEQ ID NO: 113827 - DNA, 25 bp, Mus musculus
acccggaaccaacgagattcagact

SEQ ID NO: 113828 - DNA, 25 bp, Mus musculus
acccggaaccaaggagattcagact

SEQ ID NO: 113829 - DNA, 25 bp, Mus musculus
acccggaatccaaacttactgtgct

SEQ ID NO: 113830 - DNA, 25 bp, Mus musculus
acccggaatccatacttactgtgct

SEQ ID NO: 113831 - DNA, 25 bp, Mus musculus
acccggacaccgagccgagagcgag

SEQ ID NO: 113832 - DNA, 25 bp, Mus musculus
acccggacaccgtgccgagagcgag

SEQ ID NO: 113833 - DNA, 25 bp, Mus musculus
acccggacctgtcctgcggctgaag

SEQ ID NO: 113834 - DNA, 25 bp, Mus musculus
acccggacctgtgctgcggctgaag

SEQ ID NO: 113835 - DNA, 25 bp, Mus musculus
acccggactagacctgacacaacat

SEQ ID NO: 113836 - DNA, 25 bp, Mus musculus
acccggactagagctgacacaacat

SEQ ID NO: 113837 - DNA, 25 bp, Mus musculus
acccggactagcagacatatgacaa

SEQ ID NO: 113838 - DNA, 25 bp, Mus musculus
acccggactagctgacatatgacaa

SEQ ID NO: 113839 - DNA, 25 bp, Mus musculus
acccggagactccatttgtccaagt

SEQ ID NO: 113840 - DNA, 25 bp, Mus musculus
acccggagactcgatttgtccaagt

SEQ ID NO: 113841 - DNA, 25 bp, Mus musculus
acccggaggccgatgaacatttatg

SEQ ID NO: 113842 - DNA, 25 bp, Mus musculus
acccggaggccgttgaacatttatg

SEQ ID NO: 113843 - DNA, 25 bp, Mus musculus
acccggaggctcaataacttctggg

SEQ ID NO: 113844 - DNA, 25 bp, Mus musculus
acccggaggctctataacttctggg

SEQ ID NO: 113845 - DNA, 25 bp, Mus musculus
acccggagtcgaaacaagaggcaga

SEQ ID NO: 113846 - DNA, 25 bp, Mus musculus
acccggagtcgatacaagaggcaga

SEQ ID NO: 113847 - DNA, 25 bp, Mus musculus
acccggatatacacaaggagcgcat

SEQ ID NO: 113848 - DNA, 25 bp, Mus musculus
acccggatatactcaaggagcgcat

SEQ ID NO: 113849 - DNA, 25 bp, Mus musculus
acccggatcagtcaggtcacatgat

SEQ ID NO: 113850 - DNA, 25 bp, Mus musculus
acccggatcagtgaggtcacatgat

SEQ ID NO: 113851 - DNA, 25 bp, Mus musculus
acccggatgacgagaccttcgtgaa

SEQ ID NO: 113852 - DNA, 25 bp, Mus musculus
acccggatgacgtgaccttcgtgaa

SEQ ID NO: 113853 - DNA, 25 bp, Mus musculus
acccggatgcggagaagcttttcac

SEQ ID NO: 113854 - DNA, 25 bp, Mus musculus
acccggatgcggtgaagcttttcac

SEQ ID NO: 113855 - DNA, 25 bp, Mus musculus
acccggatggcaagcagaagtcaaa

SEQ ID NO: 113856 - DNA, 25 bp, Mus musculus
acccggatggcatgcagaagtcaaa

SEQ ID NO: 113857 - DNA, 25 bp, Mus musculus
acccggcacatcctaggtgcttaat

SEQ ID NO: 113858 - DNA, 25 bp, Mus musculus
acccggcacatcgtaggtgcttaat

SEQ ID NO: 113859 - DNA, 25 bp, Mus musculus
acccggcagaagatcgtagagctag

SEQ ID NO: 113860 - DNA, 25 bp, Mus musculus
acccggcagaagttcgtagagctag

SEQ ID NO: 113861 - DNA, 25 bp, Mus musculus
acccggcagtggagaagcctcattt

SEQ ID NO: 113862 - DNA, 25 bp, Mus musculus
acccggcagtggtgaagcctcattt

SEQ ID NO: 113863 - DNA, 25 bp, Mus musculus
acccggcatccaagagatggcgcga

SEQ ID NO: 113864 - DNA, 25 bp, Mus musculus
acccggcatccatgagatggcgcga

SEQ ID NO: 113865 - DNA, 25 bp, Mus musculus
acccggcattgtaggtgtggctcca

SEQ ID NO: 113866 - DNA, 25 bp, Mus musculus
acccggcattgttggtgtggctcca

SEQ ID NO: 113867 - DNA, 25 bp, Mus musculus
acccggcatttgcaaggtaccagtg

SEQ ID NO: 113868 - DNA, 25 bp, Mus musculus
acccggcatttggaaggtaccagtg

SEQ ID NO: 113869 - DNA, 25 bp, Mus musculus
acccggccagcaattcagagttgtt

SEQ ID NO: 113870 - DNA, 25 bp, Mus musculus
acccggccagcatttcagagttgtt

SEQ ID NO: 113871 - DNA, 25 bp, Mus musculus
acccggccctttccagcatgagaaa

SEQ ID NO: 113872 - DNA, 25 bp, Mus musculus
acccggccctttgcagcatgagaaa

SEQ ID NO: 113873 - DNA, 25 bp, Mus musculus
acccggcggaggaacagtgccaccg

SEQ ID NO: 113874 - DNA, 25 bp, Mus musculus
acccggcggaggtacagtgccaccg

SEQ ID NO: 113875 - DNA, 25 bp, Mus musculus
acccggctgtacatgcatttttaaa

SEQ ID NO: 113876 - DNA, 25 bp, Mus musculus
acccggctgtacttgcatttttaaa

SEQ ID NO: 113877 - DNA, 25 bp, Mus musculus
acccggcttgcaacactagtcagca

SEQ ID NO: 113878 - DNA, 25 bp, Mus musculus
acccggcttgcatcactagtcagca

SEQ ID NO: 113879 - DNA, 25 bp, Mus musculus
acccgggaatagcagggacacttct

SEQ ID NO: 113880 - DNA, 25 bp, Mus musculus
acccgggaataggagggacacttct

SEQ ID NO: 113881 - DNA, 25 bp, Mus musculus
acccgggacattctgctacctgatg

SEQ ID NO: 113882 - DNA, 25 bp, Mus musculus
acccgggacattgtgctacctgatg

SEQ ID NO: 113883 - DNA, 25 bp, Mus musculus
acccgggagatgagtgtgctaacct

SEQ ID NO: 113884 - DNA, 25 bp, Mus musculus
acccgggagatgtgtgtgctaacct

SEQ ID NO: 113885 - DNA, 25 bp, Mus musculus
acccgggatatgctccgtgttctca

SEQ ID NO: 113886 - DNA, 25 bp, Mus musculus
acccgggatatggtccgtgttctca

SEQ ID NO: 113887 - DNA, 25 bp, Mus musculus
acccgggatgccaggcagtatgctg

SEQ ID NO: 113888 - DNA, 25 bp, Mus musculus
acccgggatgcctggcagtatgctg

SEQ ID NO: 113889 - DNA, 25 bp, Mus musculus
acccgggcatgcacggtatgctcaa

SEQ ID NO: 113890 - DNA, 25 bp, Mus musculus
acccgggcatgctcggtatgctcaa

SEQ ID NO: 113891 - DNA, 25 bp, Mus musculus
acccgggtatgtatccaaaagatca

SEQ ID NO: 113892 - DNA, 25 bp, Mus musculus
acccgggtatgtttccaaaagatca

SEQ ID NO: 113893 - DNA, 25 bp, Mus musculus
acccgggtctggacaccataggact

SEQ ID NO: 113894 - DNA, 25 bp, Mus musculus
acccgggtctggtcaccataggact

SEQ ID NO: 113895 - DNA, 25 bp, Mus musculus
acccgggtgatacgaggaccagtca

SEQ ID NO: 113896 - DNA, 25 bp, Mus musculus
acccgggtgataggaggaccagtca

SEQ ID NO: 113897 - DNA, 25 bp, Mus musculus
acccgggtggaacatgctctgatca

SEQ ID NO: 113898 - DNA, 25 bp, Mus musculus
acccgggtggaagatgctctgatca

SEQ ID NO: 113899 - DNA, 25 bp, Mus musculus
acccggtctacacatctataagatt

SEQ ID NO: 113900 - DNA, 25 bp, Mus musculus
acccggtctacagatctataagatt

SEQ ID NO: 113901 - DNA, 25 bp, Mus musculus
acccggtgcacgaacaaacgcagga

SEQ ID NO: 113902 - DNA, 25 bp, Mus musculus
acccggtgcacgtacaaacgcagga

SEQ ID NO: 113903 - DNA, 25 bp, Mus musculus
acccggtgtacaacgtgcaggagat

SEQ ID NO: 113904 - DNA, 25 bp, Mus musculus
acccggtgtacatcgtgcaggagat

SEQ ID NO: 113905 - DNA, 25 bp, Mus musculus
acccggtgttcactgagtttctcat

SEQ ID NO: 113906 - DNA, 25 bp, Mus musculus
acccggtgttcagtgagtttctcat

SEQ ID NO: 113907 - DNA, 25 bp, Mus musculus
acccggtttggtcatactgcctaca

SEQ ID NO: 113908 - DNA, 25 bp, Mus musculus
acccggtttggtgatactgcctaca

SEQ ID NO: 113909 - DNA, 25 bp, Mus musculus
acccgtacagtactcttgataacca

SEQ ID NO: 113910 - DNA, 25 bp, Mus musculus
acccgtacagtagtcttgataacca

SEQ ID NO: 113911 - DNA, 25 bp, Mus musculus
acccgtatcactagtttgccagaat

SEQ ID NO: 113912 - DNA, 25 bp, Mus musculus
acccgtatcacttgtttgccagaat

SEQ ID NO: 113913 - DNA, 25 bp, Mus musculus
acccgtatcttccaagtgccaagtg

SEQ ID NO: 113914 - DNA, 25 bp, Mus musculus
acccgtatcttcgaagtgccaagtg

SEQ ID NO: 113915 - DNA, 25 bp, Mus musculus
acccgtatgaaccagctcgccagaa

SEQ ID NO: 113916 - DNA, 25 bp, Mus musculus
acccgtatgaacgagctcgccagaa

SEQ ID NO: 113917 - DNA, 25 bp, Mus musculus
acccgtcaaataagaatacccagat

SEQ ID NO: 113918 - DNA, 25 bp, Mus musculus
acccgtcaaatatgaatacccagat

SEQ ID NO: 113919 - DNA, 25 bp, Mus musculus
acccgtcagaatattttgcccaaag

SEQ ID NO: 113920 - DNA, 25 bp, Mus musculus
acccgtcagaattttttgcccaaag

SEQ ID NO: 113921 - DNA, 25 bp, Mus musculus
acccgtcagcccaattgaggcttaa

SEQ ID NO: 113922 - DNA, 25 bp, Mus musculus
acccgtcagccctattgaggcttaa

SEQ ID NO: 113923 - DNA, 25 bp, Mus musculus
acccgtcatatacgaacccgcagat

SEQ ID NO: 113924 - DNA, 25 bp, Mus musculus
acccgtcatataggaacccgcagat

SEQ ID NO: 113925 - DNA, 25 bp, Mus musculus
acccgtcgggctcagtatgaaacct

SEQ ID NO: 113926 - DNA, 25 bp, Mus musculus
acccgtcgggctgagtatgaaacct

SEQ ID NO: 113927 - DNA, 25 bp, Mus musculus
acccgtctcctcatggttagactta

SEQ ID NO: 113928 - DNA, 25 bp, Mus musculus
acccgtctcctcttggttagactta

SEQ ID NO: 113929 - DNA, 25 bp, Mus musculus
acccgtctgcagctgtctttacata

SEQ ID NO: 113930 - DNA, 25 bp, Mus musculus
acccgtctgcaggtgtctttacata

SEQ ID NO: 113931 - DNA, 25 bp, Mus musculus
acccgtctgcgtccacgcggatgag

SEQ ID NO: 113932 - DNA, 25 bp, Mus musculus
acccgtctgcgtgcacgcggatgag

SEQ ID NO: 113933 - DNA, 25 bp, Mus musculus
acccgtcttaatatgggagctccca

SEQ ID NO: 113934 - DNA, 25 bp, Mus musculus
acccgtcttaatttgggagctccca

SEQ ID NO: 113935 - DNA, 25 bp, Mus musculus
acccgtgacaaccagccatgagcag

SEQ ID NO: 113936 - DNA, 25 bp, Mus musculus
acccgtgacaacgagccatgagcag

SEQ ID NO: 113937 - DNA, 25 bp, Mus musculus
acccgtgagggcagaatggatagat

SEQ ID NO: 113938 - DNA, 25 bp, Mus musculus
acccgtgagggctgaatggatagat

SEQ ID NO: 113939 - DNA, 25 bp, Mus musculus
acccgtgcaaataaaccagtatggc

SEQ ID NO: 113940 - DNA, 25 bp, Mus musculus
acccgtgcaaattaaccagtatggc

SEQ ID NO: 113941 - DNA, 25 bp, Mus musculus
acccgtgtctgtacactgaccaaag

SEQ ID NO: 113942 - DNA, 25 bp, Mus musculus
acccgtgtctgttcactgaccaaag

SEQ ID NO: 113943 - DNA, 25 bp, Mus musculus
acccgtgtgtgtctccaattaatgg

SEQ ID NO: 113944 - DNA, 25 bp, Mus musculus
acccgtgtgtgtgtccaattaatgg

SEQ ID NO: 113945 - DNA, 25 bp, Mus musculus
acccgttactccctgtggtatagat

SEQ ID NO: 113946 - DNA, 25 bp, Mus musculus
acccgttactccgtgtggtatagat

SEQ ID NO: 113947 - DNA, 25 bp, Mus musculus
acccgttcctgtagctccagagatg

SEQ ID NO: 113948 - DNA, 25 bp, Mus musculus
acccgttcctgttgctccagagatg

SEQ ID NO: 113949 - DNA, 25 bp, Mus musculus
acccgttctatgacatgttggccac

SEQ ID NO: 113950 - DNA, 25 bp, Mus musculus
acccgttctatgtcatgttggccac

SEQ ID NO: 113951 - DNA, 25 bp, Mus musculus
acccgttcttggactgcatgcagat

SEQ ID NO: 113952 - DNA, 25 bp, Mus musculus
acccgttcttggtctgcatgcagat

SEQ ID NO: 113953 - DNA, 25 bp, Mus musculus
acccgttgtagcctttggctgtagt

SEQ ID NO: 113954 - DNA, 25 bp, Mus musculus
acccgttgtagcgtttggctgtagt

SEQ ID NO: 113955 - DNA, 25 bp, Mus musculus
acccgttgttgcatctgccaatgga

SEQ ID NO: 113956 - DNA, 25 bp, Mus musculus
acccgttgttgcttctgccaatgga

SEQ ID NO: 113957 - DNA, 25 bp, Mus musculus
accctaaacattaactttgtatgag

SEQ ID NO: 113958 - DNA, 25 bp, Mus musculus
accctaaacatttactttgtatgag

SEQ ID NO: 113959 - DNA, 25 bp, Mus musculus
accctaaactttccttggcactgag

SEQ ID NO: 113960 - DNA, 25 bp, Mus musculus
accctaaactttgcttggcactgag

SEQ ID NO: 113961 - DNA, 25 bp, Mus musculus
accctaaatggcatctgcagtgatt

SEQ ID NO: 113962 - DNA, 25 bp, Mus musculus
accctaaatggcttctgcagtgatt

SEQ ID NO: 113963 - DNA, 25 bp, Mus musculus
accctaaatgggataagcagagcct

SEQ ID NO: 113964 - DNA, 25 bp, Mus musculus
accctaaatgggttaagcagagcct

SEQ ID NO: 113965 - DNA, 25 bp, Mus musculus
accctaacctcaattcatgtgttgt

SEQ ID NO: 113966 - DNA, 25 bp, Mus musculus
accctaacctcatttcatgtgttgt

SEQ ID NO: 113967 - DNA, 25 bp, Mus musculus
accctaacctctctttagtgtctga

SEQ ID NO: 113968 - DNA, 25 bp, Mus musculus
accctaacctctgtttagtgtctga

SEQ ID NO: 113969 - DNA, 25 bp, Mus musculus
accctaactaaaacatgcatcgaat

SEQ ID NO: 113970 - DNA, 25 bp, Mus musculus
accctaactaaatcatgcatcgaat

SEQ ID NO: 113971 - DNA, 25 bp, Mus musculus
accctaagacaactgtgtacctact

SEQ ID NO: 113972 - DNA, 25 bp, Mus musculus
accctaagacaagtgtgtacctact

SEQ ID NO: 113973 - DNA, 25 bp, Mus musculus
accctaagagaaagcagcccgttcg

SEQ ID NO: 113974 - DNA, 25 bp, Mus musculus
accctaagagaatgcagcccgttcg

SEQ ID NO: 113975 - DNA, 25 bp, Mus musculus
accctaagccagagcgtgtgtgtga

SEQ ID NO: 113976 - DNA, 25 bp, Mus musculus
accctaagccagtgcgtgtgtgtga

SEQ ID NO: 113977 - DNA, 25 bp, Mus musculus
accctaagccctctatgagtggagg

SEQ ID NO: 113978 - DNA, 25 bp, Mus musculus
accctaagccctgtatgagtggagg

SEQ ID NO: 113979 - DNA, 25 bp, Mus musculus
accctaaggcataattattctatta

SEQ ID NO: 113980 - DNA, 25 bp, Mus musculus
accctaaggcattattattctatta

SEQ ID NO: 113981 - DNA, 25 bp, Mus musculus
accctaagggcaccacttgcagtgg

SEQ ID NO: 113982 - DNA, 25 bp, Mus musculus
accctaagggcagcacttgcagtgg

SEQ ID NO: 113983 - DNA, 25 bp, Mus musculus
accctaagggctatttctaacacag

SEQ ID NO: 113984 - DNA, 25 bp, Mus musculus
accctaagggctttttctaacacag

SEQ ID NO: 113985 - DNA, 25 bp, Mus musculus
accctaagtggtagcatgactctgc

SEQ ID NO: 113986 - DNA, 25 bp, Mus musculus
accctaagtggttgcatgactctgc

SEQ ID NO: 113987 - DNA, 25 bp, Mus musculus
accctaatgtatccagcagccatga

SEQ ID NO: 113988 - DNA, 25 bp, Mus musculus
accctaatgtatgcagcagccatga

SEQ ID NO: 113989 - DNA, 25 bp, Mus musculus
accctaattacaatactctaatttg

SEQ ID NO: 113990 - DNA, 25 bp, Mus musculus
accctaattacattactctaatttg

SEQ ID NO: 113991 - DNA, 25 bp, Mus musculus
accctaattatgcttacacaagctt

SEQ ID NO: 113992 - DNA, 25 bp, Mus musculus
accctaattatggttacacaagctt

SEQ ID NO: 113993 - DNA, 25 bp, Mus musculus
accctaattgaaactttgcagcttt

SEQ ID NO: 113994 - DNA, 25 bp, Mus musculus
accctaattgaatctttgcagcttt

SEQ ID NO: 113995 - DNA, 25 bp, Mus musculus
accctaatttatctggcctgtcaat

SEQ ID NO: 113996 - DNA, 25 bp, Mus musculus
accctaatttatgtggcctgtcaat

SEQ ID NO: 113997 - DNA, 25 bp, Mus musculus
accctacacttgatccagctctttg

SEQ ID NO: 113998 - DNA, 25 bp, Mus musculus
accctacacttgttccagctctttg

SEQ ID NO: 113999 - DNA, 25 bp, Mus musculus
accctacagggcacctgactaaggg

SEQ ID NO: 114000 - DNA, 25 bp, Mus musculus
accctacagggctcctgactaaggg

SEQ ID NO: 114001 - DNA, 25 bp, Mus musculus
accctacagggtaccttgtgctctg

SEQ ID NO: 114002 - DNA, 25 bp, Mus musculus
accctacagggttccttgtgctctg

SEQ ID NO: 114003 - DNA, 25 bp, Mus musculus
accctaccaacaaatctctgcggat

SEQ ID NO: 114004 - DNA, 25 bp, Mus musculus
accctaccaacatatctctgcggat

SEQ ID NO: 114005 - DNA, 25 bp, Mus musculus
accctaccacaacaagcgaaagtat

SEQ ID NO: 114006 - DNA, 25 bp, Mus musculus
accctaccacaagaagcgaaagtat

SEQ ID NO: 114007 - DNA, 25 bp, Mus musculus
accctacccttccatgtggtgaaga

SEQ ID NO: 114008 - DNA, 25 bp, Mus musculus
accctacccttcgatgtggtgaaga

SEQ ID NO: 114009 - DNA, 25 bp, Mus musculus
accctacggagcagcaaacttacta

SEQ ID NO: 114010 - DNA, 25 bp, Mus musculus
accctacggagctgcaaacttacta

SEQ ID NO: 114011 - DNA, 25 bp, Mus musculus
accctactaagtaaacacctgctag

SEQ ID NO: 114012 - DNA, 25 bp, Mus musculus
accctactaagttaacacctgctag

SEQ ID NO: 114013 - DNA, 25 bp, Mus musculus
accctactatgaaagctctgctatg

SEQ ID NO: 114014 - DNA, 25 bp, Mus musculus
accctactatgatagctctgctatg

SEQ ID NO: 114015 - DNA, 25 bp, Mus musculus
accctactgtctaccttagattgtt

SEQ ID NO: 114016 - DNA, 25 bp, Mus musculus
accctactgtcttccttagattgtt

SEQ ID NO: 114017 - DNA, 25 bp, Mus musculus
accctacttcttctcttgattattg

SEQ ID NO: 114018 - DNA, 25 bp, Mus musculus
accctacttcttgtcttgattattg

SEQ ID NO: 114019 - DNA, 25 bp, Mus musculus
accctagaaatgactgcggcacaga

SEQ ID NO: 114020 - DNA, 25 bp, Mus musculus
accctagaaatgtctgcggcacaga

SEQ ID NO: 114021 - DNA, 25 bp, Mus musculus
accctagaacacacaaatccaaaag

SEQ ID NO: 114022 - DNA, 25 bp, Mus musculus
accctagaacactcaaatccaaaag

SEQ ID NO: 114023 - DNA, 25 bp, Mus musculus
accctagagcggcagtccacaatgg

SEQ ID NO: 114024 - DNA, 25 bp, Mus musculus
accctagagcgggagtccacaatgg

SEQ ID NO: 114025 - DNA, 25 bp, Mus musculus
accctagatccaattgccaaaattc

SEQ ID NO: 114026 - DNA, 25 bp, Mus musculus
accctagatccatttgccaaaattc

SEQ ID NO: 114027 - DNA, 25 bp, Mus musculus
accctagatggtctggattctgagc

SEQ ID NO: 114028 - DNA, 25 bp, Mus musculus
accctagatggtgtggattctgagc

SEQ ID NO: 114029 - DNA, 25 bp, Mus musculus
accctagcgaatacacttgtcaatc

SEQ ID NO: 114030 - DNA, 25 bp, Mus musculus
accctagcgaattcacttgtcaatc

SEQ ID NO: 114031 - DNA, 25 bp, Mus musculus
accctagctttcacgactgcagaga

SEQ ID NO: 114032 - DNA, 25 bp, Mus musculus
accctagctttctcgactgcagaga

SEQ ID NO: 114033 - DNA, 25 bp, Mus musculus
accctaggatttaagcctgaccaca

SEQ ID NO: 114034 - DNA, 25 bp, Mus musculus
accctaggattttagcctgaccaca

SEQ ID NO: 114035 - DNA, 25 bp, Mus musculus
accctaggctttatcaactgcacag

SEQ ID NO: 114036 - DNA, 25 bp, Mus musculus
accctaggctttttcaactgcacag

SEQ ID NO: 114037 - DNA, 25 bp, Mus musculus
accctagggccactgccagagctgg

SEQ ID NO: 114038 - DNA, 25 bp, Mus musculus
accctagggccagtgccagagctgg

SEQ ID NO: 114039 - DNA, 25 bp, Mus musculus
accctaggtgttatctcagttgtgg

SEQ ID NO: 114040 - DNA, 25 bp, Mus musculus
accctaggtgttttctcagttgtgg

SEQ ID NO: 114041 - DNA, 25 bp, Mus musculus
accctagtgccactgaaggtcatga

SEQ ID NO: 114042 - DNA, 25 bp, Mus musculus
accctagtgccagtgaaggtcatga

SEQ ID NO: 114043 - DNA, 25 bp, Mus musculus
accctagtgggcagtactgtatgca

SEQ ID NO: 114044 - DNA, 25 bp, Mus musculus
accctagtgggctgtactgtatgca

SEQ ID NO: 114045 - DNA, 25 bp, Mus musculus
accctagtgttcaccaaatctgttg

SEQ ID NO: 114046 - DNA, 25 bp, Mus musculus
accctagtgttctccaaatctgttg

SEQ ID NO: 114047 - DNA, 25 bp, Mus musculus
accctagttacacgatttgctcgaa

SEQ ID NO: 114048 - DNA, 25 bp, Mus musculus
accctagttacaggatttgctcgaa

SEQ ID NO: 114049 - DNA, 25 bp, Mus musculus
accctatatgttcaccattgtattt

SEQ ID NO: 114050 - DNA, 25 bp, Mus musculus
accctatatgttgaccattgtattt

SEQ ID NO: 114051 - DNA, 25 bp, Mus musculus
accctatcagtactaccgtattttg

SEQ ID NO: 114052 - DNA, 25 bp, Mus musculus
accctatcagtagtaccgtattttg

SEQ ID NO: 114053 - DNA, 25 bp, Mus musculus
accctatcagttccatggtcattca

SEQ ID NO: 114054 - DNA, 25 bp, Mus musculus
accctatcagttgcatggtcattca

SEQ ID NO: 114055 - DNA, 25 bp, Mus musculus
accctatcatgacccctattataga

SEQ ID NO: 114056 - DNA, 25 bp, Mus musculus
accctatcatgagccctattataga

SEQ ID NO: 114057 - DNA, 25 bp, Mus musculus
accctatcctagaggaatccaggct

SEQ ID NO: 114058 - DNA, 25 bp, Mus musculus
accctatcctagtggaatccaggct

SEQ ID NO: 114059 - DNA, 25 bp, Mus musculus
accctatgaattaaaccagtgtagc

SEQ ID NO: 114060 - DNA, 25 bp, Mus musculus
accctatgaatttaaccagtgtagc

SEQ ID NO: 114061 - DNA, 25 bp, Mus musculus
accctatgccatccgttggaaacag

SEQ ID NO: 114062 - DNA, 25 bp, Mus musculus
accctatgccatgcgttggaaacag

SEQ ID NO: 114063 - DNA, 25 bp, Mus musculus
accctatgccctcagggaatccgga

SEQ ID NO: 114064 - DNA, 25 bp, Mus musculus
accctatgccctgagggaatccgga

SEQ ID NO: 114065 - DNA, 25 bp, Mus musculus
accctatggcttccccaatgagaat

SEQ ID NO: 114066 - DNA, 25 bp, Mus musculus
accctatggcttgcccaatgagaat

SEQ ID NO: 114067 - DNA, 25 bp, Mus musculus
accctatgtggtctgctcctgtgaa

SEQ ID NO: 114068 - DNA, 25 bp, Mus musculus
accctatgtggtgtgctcctgtgaa

SEQ ID NO: 114069 - DNA, 25 bp, Mus musculus
accctattaaatatgggatactgag

SEQ ID NO: 114070 - DNA, 25 bp, Mus musculus
accctattaaatttgggatactgag

SEQ ID NO: 114071 - DNA, 25 bp, Mus musculus
accctattaatcacccttgggcatt

SEQ ID NO: 114072 - DNA, 25 bp, Mus musculus
accctattaatctcccttgggcatt

SEQ ID NO: 114073 - DNA, 25 bp, Mus musculus
accctattctatcacctgtgttcaa

SEQ ID NO: 114074 - DNA, 25 bp, Mus musculus
accctattctatgacctgtgttcaa

SEQ ID NO: 114075 - DNA, 25 bp, Mus musculus
accctattgcttctacagtgctgtg

SEQ ID NO: 114076 - DNA, 25 bp, Mus musculus
accctattgcttgtacagtgctgtg

SEQ ID NO: 114077 - DNA, 25 bp, Mus musculus
accctatttaatatgctccactttt

SEQ ID NO: 114078 - DNA, 25 bp, Mus musculus
accctatttaatttgctccactttt

SEQ ID NO: 114079 - DNA, 25 bp, Mus musculus
accctcaacaatctgtctcagtatc

SEQ ID NO: 114080 - DNA, 25 bp, Mus musculus
accctcaacaatgtgtctcagtatc

SEQ ID NO: 114081 - DNA, 25 bp, Mus musculus
accctcaactgcaggaccatgactt

SEQ ID NO: 114082 - DNA, 25 bp, Mus musculus
accctcaactgctggaccatgactt

SEQ ID NO: 114083 - DNA, 25 bp, Mus musculus
accctcaagaagcagctctggtgat

SEQ ID NO: 114084 - DNA, 25 bp, Mus musculus
accctcaagaagctgcacctttagt

SEQ ID NO: 114085 - DNA, 25 bp, Mus musculus
accctcaagaaggagctctggtgat

SEQ ID NO: 114086 - DNA, 25 bp, Mus musculus
accctcaagaaggtgcacctttagt

SEQ ID NO: 114087 - DNA, 25 bp, Mus musculus
accctcaagtcaagtcagcggatgt

SEQ ID NO: 114088 - DNA, 25 bp, Mus musculus
accctcaagtcatgtcagcggatgt

SEQ ID NO: 114089 - DNA, 25 bp, Mus musculus
accctcacaaggaggctctaggagc

SEQ ID NO: 114090 - DNA, 25 bp, Mus musculus
accctcacaaggtggctctaggagc

SEQ ID NO: 114091 - DNA, 25 bp, Mus musculus
accctcacactgaaggcagcgtggg

SEQ ID NO: 114092 - DNA, 25 bp, Mus musculus
accctcacactgacacacatgatag

SEQ ID NO: 114093 - DNA, 25 bp, Mus musculus
accctcacactgtaggcagcgtggg

SEQ ID NO: 114094 - DNA, 25 bp, Mus musculus
accctcacactgtcacacatgatag

SEQ ID NO: 114095 - DNA, 25 bp, Mus musculus
accctcacagtcatatagcacaata

SEQ ID NO: 114096 - DNA, 25 bp, Mus musculus
accctcacagtcttatagcacaata

SEQ ID NO: 114097 - DNA, 25 bp, Mus musculus
accctcacatcaacttttctgtaag

SEQ ID NO: 114098 - DNA, 25 bp, Mus musculus
accctcacatcatcttttctgtaag

SEQ ID NO: 114099 - DNA, 25 bp, Mus musculus
accctcacattcattagtttctttg

SEQ ID NO: 114100 - DNA, 25 bp, Mus musculus
accctcacattctttagtttctttg

SEQ ID NO: 114101 - DNA, 25 bp, Mus musculus
accctcaccagcacggtagatgaga

SEQ ID NO: 114102 - DNA, 25 bp, Mus musculus
accctcaccagctcggtagatgaga

SEQ ID NO: 114103 - DNA, 25 bp, Mus musculus
accctcaccatgaaggttctagcta

SEQ ID NO: 114104 - DNA, 25 bp, Mus musculus
accctcaccatgtaggttctagcta

SEQ ID NO: 114105 - DNA, 25 bp, Mus musculus
accctcacctgaagcaagaacacat

SEQ ID NO: 114106 - DNA, 25 bp, Mus musculus
accctcacctgatgcaagaacacat

SEQ ID NO: 114107 - DNA, 25 bp, Mus musculus
accctcacgggactttgtaactgat

SEQ ID NO: 114108 - DNA, 25 bp, Mus musculus
accctcacgggagtttgtaactgat

SEQ ID NO: 114109 - DNA, 25 bp, Mus musculus
accctcacgttgaccaaggacgagt

SEQ ID NO: 114110 - DNA, 25 bp, Mus musculus
accctcacgttgtccaaggacgagt

SEQ ID NO: 114111 - DNA, 25 bp, Mus musculus
accctcactagtcgtcacagctgat

SEQ ID NO: 114112 - DNA, 25 bp, Mus musculus
accctcactagtggtcacagctgat

SEQ ID NO: 114113 - DNA, 25 bp, Mus musculus
accctcactggccactaagagatag

SEQ ID NO: 114114 - DNA, 25 bp, Mus musculus
accctcactggcgactaagagatag

SEQ ID NO: 114115 - DNA, 25 bp, Mus musculus
accctcactggtctgacgtcatttt

SEQ ID NO: 114116 - DNA, 25 bp, Mus musculus
accctcactggtgtgacgtcatttt

SEQ ID NO: 114117 - DNA, 25 bp, Mus musculus
accctcactgttcaagctgctcaga

SEQ ID NO: 114118 - DNA, 25 bp, Mus musculus
accctcactgttgaagctgctcaga

SEQ ID NO: 114119 - DNA, 25 bp, Mus musculus
accctcacttgaacatacagcagac

SEQ ID NO: 114120 - DNA, 25 bp, Mus musculus
accctcacttgatcatacagcagac

SEQ ID NO: 114121 - DNA, 25 bp, Mus musculus
accctcacttggactttagatctgt

SEQ ID NO: 114122 - DNA, 25 bp, Mus musculus
accctcacttggtctttagatctgt

SEQ ID NO: 114123 - DNA, 25 bp, Mus musculus
accctcagaaagctcatcctatgga

SEQ ID NO: 114124 - DNA, 25 bp, Mus musculus
accctcagaaaggtcatcctatgga

SEQ ID NO: 114125 - DNA, 25 bp, Mus musculus
accctcagacctatgtagtgctttg

SEQ ID NO: 114126 - DNA, 25 bp, Mus musculus
accctcagacctttgtagtgctttg

SEQ ID NO: 114127 - DNA, 25 bp, Mus musculus
accctcagcaaaagatgtgtccttg

SEQ ID NO: 114128 - DNA, 25 bp, Mus musculus
accctcagcaaatgatgtgtccttg

SEQ ID NO: 114129 - DNA, 25 bp, Mus musculus
accctcagcaatcgtgtgaacaacc

SEQ ID NO: 114130 - DNA, 25 bp, Mus musculus
accctcagcaatggtgtgaacaacc

SEQ ID NO: 114131 - DNA, 25 bp, Mus musculus
accctcagcactaaccattgtaata

SEQ ID NO: 114132 - DNA, 25 bp, Mus musculus
accctcagcacttaccattgtaata

SEQ ID NO: 114133 - DNA, 25 bp, Mus musculus
accctcaggaggactgctcaggaat

SEQ ID NO: 114134 - DNA, 25 bp, Mus musculus
accctcaggaggtctgctcaggaat

SEQ ID NO: 114135 - DNA, 25 bp, Mus musculus
accctcaggccaaatggtgaataag

SEQ ID NO: 114136 - DNA, 25 bp, Mus musculus
accctcaggccatatggtgaataag

SEQ ID NO: 114137 - DNA, 25 bp, Mus musculus
accctcaggctgcattctagaaaca

SEQ ID NO: 114138 - DNA, 25 bp, Mus musculus
accctcaggctggattctagaaaca

SEQ ID NO: 114139 - DNA, 25 bp, Mus musculus
accctcagggtgaccttggaggtct

SEQ ID NO: 114140 - DNA, 25 bp, Mus musculus
accctcagggtgtccttggaggtct

SEQ ID NO: 114141 - DNA, 25 bp, Mus musculus
accctcaggtccatgctggttttat

SEQ ID NO: 114142 - DNA, 25 bp, Mus musculus
accctcaggtccttgctggttttat

SEQ ID NO: 114143 - DNA, 25 bp, Mus musculus
accctcagtagccagcctgaaagaa

SEQ ID NO: 114144 - DNA, 25 bp, Mus musculus
accctcagtagcgagcctgaaagaa

SEQ ID NO: 114145 - DNA, 25 bp, Mus musculus
accctcagtggtcctgattctttga

SEQ ID NO: 114146 - DNA, 25 bp, Mus musculus
accctcagtggtgctgattctttga

SEQ ID NO: 114147 - DNA, 25 bp, Mus musculus
accctcatcagactcgtggtgtcga

SEQ ID NO: 114148 - DNA, 25 bp, Mus musculus
accctcatcagactgatggtctcaa

SEQ ID NO: 114149 - DNA, 25 bp, Mus musculus
accctcatcagagtcgtggtgtcga

SEQ ID NO: 114150 - DNA, 25 bp, Mus musculus
accctcatcagagtgatggtctcaa

SEQ ID NO: 114151 - DNA, 25 bp, Mus musculus
accctcatcctcaatgaggaccttg

SEQ ID NO: 114152 - DNA, 25 bp, Mus musculus
accctcatcctctatgaggaccttg

SEQ ID NO: 114153 - DNA, 25 bp, Mus musculus
accctcatcgtgcttattgtgtttt

SEQ ID NO: 114154 - DNA, 25 bp, Mus musculus
accctcatcgtggttattgtgtttt

SEQ ID NO: 114155 - DNA, 25 bp, Mus musculus
accctcatctcacgttgtgacttgg

SEQ ID NO: 114156 - DNA, 25 bp, Mus musculus
accctcatctcaggttgtgacttgg

SEQ ID NO: 114157 - DNA, 25 bp, Mus musculus
accctcatgagaatgtgagcttcat

SEQ ID NO: 114158 - DNA, 25 bp, Mus musculus
accctcatgagattgtgagcttcat

SEQ ID NO: 114159 - DNA, 25 bp, Mus musculus
accctcatgccgaccagaagagaga

SEQ ID NO: 114160 - DNA, 25 bp, Mus musculus
accctcatgccgtccagaagagaga

SEQ ID NO: 114161 - DNA, 25 bp, Mus musculus
accctcatgttgcaagccctgacta

SEQ ID NO: 114162 - DNA, 25 bp, Mus musculus
accctcatgttggaagccctgacta

SEQ ID NO: 114163 - DNA, 25 bp, Mus musculus
accctcattcagatacatggacgga

SEQ ID NO: 114164 - DNA, 25 bp, Mus musculus
accctcattcagttacatggacgga

SEQ ID NO: 114165 - DNA, 25 bp, Mus musculus
accctcattctcaagcgtgaagaca

SEQ ID NO: 114166 - DNA, 25 bp, Mus musculus
accctcattctctagcgtgaagaca

SEQ ID NO: 114167 - DNA, 25 bp, Mus musculus
accctcatttatccccaaggagatg

SEQ ID NO: 114168 - DNA, 25 bp, Mus musculus
accctcatttatgcccaaggagatg

SEQ ID NO: 114169 - DNA, 25 bp, Mus musculus
accctccaaggtcgtctgtgacctt

SEQ ID NO: 114170 - DNA, 25 bp, Mus musculus
accctccaaggtggtctgtgacctt

SEQ ID NO: 114171 - DNA, 25 bp, Mus musculus
accctccacaccagatagtaggcag

SEQ ID NO: 114172 - DNA, 25 bp, Mus musculus
accctccacacctgatagtaggcag

SEQ ID NO: 114173 - DNA, 25 bp, Mus musculus
accctccagtacaggcattccactt

SEQ ID NO: 114174 - DNA, 25 bp, Mus musculus
accctccagtactggcattccactt

SEQ ID NO: 114175 - DNA, 25 bp, Mus musculus
accctccagtctccactttgatttg

SEQ ID NO: 114176 - DNA, 25 bp, Mus musculus
accctccagtctgcactttgatttg

SEQ ID NO: 114177 - DNA, 25 bp, Mus musculus
accctccatgttcaggctggatgag

SEQ ID NO: 114178 - DNA, 25 bp, Mus musculus
accctccatgttgaggctggatgag

SEQ ID NO: 114179 - DNA, 25 bp, Mus musculus
accctcccaacactatagcttaaag

SEQ ID NO: 114180 - DNA, 25 bp, Mus musculus
accctcccaacagtatagcttaaag

SEQ ID NO: 114181 - DNA, 25 bp, Mus musculus
accctcccgcgcataggagcaggtg

SEQ ID NO: 114182 - DNA, 25 bp, Mus musculus
accctcccgcgcttaggagcaggtg

SEQ ID NO: 114183 - DNA, 25 bp, Mus musculus
accctccctccaccattttgaattg

SEQ ID NO: 114184 - DNA, 25 bp, Mus musculus
accctccctccagcattttgaattg

SEQ ID NO: 114185 - DNA, 25 bp, Mus musculus
accctccctgtgatgttgatagcca

SEQ ID NO: 114186 - DNA, 25 bp, Mus musculus
accctccctgtgttgttgatagcca

SEQ ID NO: 114187 - DNA, 25 bp, Mus musculus
accctccctgttcaagctgatggaa

SEQ ID NO: 114188 - DNA, 25 bp, Mus musculus
accctccctgttgaagctgatggaa

SEQ ID NO: 114189 - DNA, 25 bp, Mus musculus
accctccgatggagactgtgggatt

SEQ ID NO: 114190 - DNA, 25 bp, Mus musculus
accctccgatggtgactgtgggatt

SEQ ID NO: 114191 - DNA, 25 bp, Mus musculus
accctccgctggagcatggtgcgtg

SEQ ID NO: 114192 - DNA, 25 bp, Mus musculus
accctccgctggtgcatggtgcgtg

SEQ ID NO: 114193 - DNA, 25 bp, Mus musculus
accctcctaagtacagcgtggctaa

SEQ ID NO: 114194 - DNA, 25 bp, Mus musculus
accctcctaagttcagcgtggctaa

SEQ ID NO: 114195 - DNA, 25 bp, Mus musculus
accctcctaccaatctcagatggat

SEQ ID NO: 114196 - DNA, 25 bp, Mus musculus
accctcctaccattctcagatggat

SEQ ID NO: 114197 - DNA, 25 bp, Mus musculus
accctcctcagtattgtacttgtgg

SEQ ID NO: 114198 - DNA, 25 bp, Mus musculus
accctcctcagttttgtacttgtgg

SEQ ID NO: 114199 - DNA, 25 bp, Mus musculus
accctcctgaggaaggtctggcatt

SEQ ID NO: 114200 - DNA, 25 bp, Mus musculus
accctcctgaggtaggtctggcatt

SEQ ID NO: 114201 - DNA, 25 bp, Mus musculus
accctcctgctactgtgtgtattga

SEQ ID NO: 114202 - DNA, 25 bp, Mus musculus
accctcctgctagtgtgtgtattga

SEQ ID NO: 114203 - DNA, 25 bp, Mus musculus
accctcctgtgtacaagtaggttca

SEQ ID NO: 114204 - DNA, 25 bp, Mus musculus
accctcctgtgttcaagtaggttca

SEQ ID NO: 114205 - DNA, 25 bp, Mus musculus
accctcctttagcatctccagagga

SEQ ID NO: 114206 - DNA, 25 bp, Mus musculus
accctcctttaggatctccagagga

SEQ ID NO: 114207 - DNA, 25 bp, Mus musculus
accctcgataagatccttctgtgta

SEQ ID NO: 114208 - DNA, 25 bp, Mus musculus
accctcgataagttccttctgtgta

SEQ ID NO: 114209 - DNA, 25 bp, Mus musculus
accctcggaagactcgccagaaagt

SEQ ID NO: 114210 - DNA, 25 bp, Mus musculus
accctcggaagagtcgccagaaagt

SEQ ID NO: 114211 - DNA, 25 bp, Mus musculus
accctcgggagtaccagtatggcga

SEQ ID NO: 114212 - DNA, 25 bp, Mus musculus
accctcgggagttccagtatggcga

SEQ ID NO: 114213 - DNA, 25 bp, Mus musculus
accctcggtctaagcactcatgatt

SEQ ID NO: 114214 - DNA, 25 bp, Mus musculus
accctcggtctatgcactcatgatt

SEQ ID NO: 114215 - DNA, 25 bp, Mus musculus
accctcgtggatatggtcacattgg

SEQ ID NO: 114216 - DNA, 25 bp, Mus musculus
accctcgtggatttggtcacattgg

SEQ ID NO: 114217 - DNA, 25 bp, Mus musculus
accctcgtggcaagcgtgtcgtaga

SEQ ID NO: 114218 - DNA, 25 bp, Mus musculus
accctcgtggcatgcgtgtcgtaga

SEQ ID NO: 114219 - DNA, 25 bp, Mus musculus
accctctaaggaaatgctgtcattc

SEQ ID NO: 114220 - DNA, 25 bp, Mus musculus
accctctaaggatatgctgtcattc

SEQ ID NO: 114221 - DNA, 25 bp, Mus musculus
accctctaataaatttgctcttact

SEQ ID NO: 114222 - DNA, 25 bp, Mus musculus
accctctaataattttgctcttact

SEQ ID NO: 114223 - DNA, 25 bp, Mus musculus
accctctacattcagtggcagacat

SEQ ID NO: 114224 - DNA, 25 bp, Mus musculus
accctctacattgagtggcagacat

SEQ ID NO: 114225 - DNA, 25 bp, Mus musculus
accctctaccaccaagtgaagcttt

SEQ ID NO: 114226 - DNA, 25 bp, Mus musculus
accctctaccacgaagtgaagcttt

SEQ ID NO: 114227 - DNA, 25 bp, Mus musculus
accctctacctcattagtactgtga

SEQ ID NO: 114228 - DNA, 25 bp, Mus musculus
accctctacctctttagtactgtga

SEQ ID NO: 114229 - DNA, 25 bp, Mus musculus
accctctaccttctttgcatttatt

SEQ ID NO: 114230 - DNA, 25 bp, Mus musculus
accctctaccttgtttgcatttatt

SEQ ID NO: 114231 - DNA, 25 bp, Mus musculus
accctctacgaactctgtgtggcaa

SEQ ID NO: 114232 - DNA, 25 bp, Mus musculus
accctctacgaagtctgtgtggcaa

SEQ ID NO: 114233 - DNA, 25 bp, Mus musculus
accctctagatccaagcctttggga

SEQ ID NO: 114234 - DNA, 25 bp, Mus musculus
accctctagatcgaagcctttggga

SEQ ID NO: 114235 - DNA, 25 bp, Mus musculus
accctctaggcgctcagaaacaaaa

SEQ ID NO: 114236 - DNA, 25 bp, Mus musculus
accctctaggcggtcagaaacaaaa

SEQ ID NO: 114237 - DNA, 25 bp, Mus musculus
accctctatccaaaagcagttccaa

SEQ ID NO: 114238 - DNA, 25 bp, Mus musculus
accctctatccataagcagttccaa

SEQ ID NO: 114239 - DNA, 25 bp, Mus musculus
accctctatgttattgtagagcaaa

SEQ ID NO: 114240 - DNA, 25 bp, Mus musculus
accctctatgtttttgtagagcaaa

SEQ ID NO: 114241 - DNA, 25 bp, Mus musculus
accctctcaaacacaggctagcaga

SEQ ID NO: 114242 - DNA, 25 bp, Mus musculus
accctctcaaactcaggctagcaga

SEQ ID NO: 114243 - DNA, 25 bp, Mus musculus
accctctcataaatgtggacctgtt

SEQ ID NO: 114244 - DNA, 25 bp, Mus musculus
accctctcataattgtggacctgtt

SEQ ID NO: 114245 - DNA, 25 bp, Mus musculus
accctctcattgatggcagcagaac

SEQ ID NO: 114246 - DNA, 25 bp, Mus musculus
accctctcattgttggcagcagaac

SEQ ID NO: 114247 - DNA, 25 bp, Mus musculus
accctctccatactgtgtggctaaa

SEQ ID NO: 114248 - DNA, 25 bp, Mus musculus
accctctccatagtgtgtggctaaa

SEQ ID NO: 114249 - DNA, 25 bp, Mus musculus
accctctcccgtagttatcattgtt

SEQ ID NO: 114250 - DNA, 25 bp, Mus musculus
accctctcccgttgttatcattgtt

SEQ ID NO: 114251 - DNA, 25 bp, Mus musculus
accctctcctcaatctgtagatgtt

SEQ ID NO: 114252 - DNA, 25 bp, Mus musculus
accctctcctcattctgtagatgtt

SEQ ID NO: 114253 - DNA, 25 bp, Mus musculus
accctctctgataacaacatccaga

SEQ ID NO: 114254 - DNA, 25 bp, Mus musculus
accctctctgattacaacatccaga

SEQ ID NO: 114255 - DNA, 25 bp, Mus musculus
accctctcttcaaactctatgagca

SEQ ID NO: 114256 - DNA, 25 bp, Mus musculus
accctctcttcatactctatgagca

SEQ ID NO: 114257 - DNA, 25 bp, Mus musculus
accctctgagacagtgctctgcgag

SEQ ID NO: 114258 - DNA, 25 bp, Mus musculus
accctctgagactgtgctctgcgag

SEQ ID NO: 114259 - DNA, 25 bp, Mus musculus
accctctgatcacatgtagcttaca

SEQ ID NO: 114260 - DNA, 25 bp, Mus musculus
accctctgatcagatgtagcttaca

SEQ ID NO: 114261 - DNA, 25 bp, Mus musculus
accctctgctgtccttgtgtagtga

SEQ ID NO: 114262 - DNA, 25 bp, Mus musculus
accctctgctgtgcttgtgtagtga

SEQ ID NO: 114263 - DNA, 25 bp, Mus musculus
accctctggaccaggtgctgaagtc

SEQ ID NO: 114264 - DNA, 25 bp, Mus musculus
accctctggacctggtgctgaagtc

SEQ ID NO: 114265 - DNA, 25 bp, Mus musculus
accctctggcttacaaatgtacact

SEQ ID NO: 114266 - DNA, 25 bp, Mus musculus
accctctggctttcaaatgtacact

SEQ ID NO: 114267 - DNA, 25 bp, Mus musculus
accctctgggtacacaatgtctgtt

SEQ ID NO: 114268 - DNA, 25 bp, Mus musculus
accctctgggtagacaatgtctgtt

SEQ ID NO: 114269 - DNA, 25 bp, Mus musculus
accctctggtgacctcatatcaaag

SEQ ID NO: 114270 - DNA, 25 bp, Mus musculus
accctctggtgagctcatatcaaag

SEQ ID NO: 114271 - DNA, 25 bp, Mus musculus
accctctggtgtagattcgacactt

SEQ ID NO: 114272 - DNA, 25 bp, Mus musculus
accctctggtgttgattcgacactt

SEQ ID NO: 114273 - DNA, 25 bp, Mus musculus
accctctggttaccttcgtcactca

SEQ ID NO: 114274 - DNA, 25 bp, Mus musculus
accctctggttagcttcgtcactca

SEQ ID NO: 114275 - DNA, 25 bp, Mus musculus
accctctggtttaagctcatgcgtg

SEQ ID NO: 114276 - DNA, 25 bp, Mus musculus
accctctggttttagctcatgcgtg

SEQ ID NO: 114277 - DNA, 25 bp, Mus musculus
accctctgtactacctggtgctttt

SEQ ID NO: 114278 - DNA, 25 bp, Mus musculus
accctctgtacttcctggtgctttt

SEQ ID NO: 114279 - DNA, 25 bp, Mus musculus
accctctgtattccgtacctgatga

SEQ ID NO: 114280 - DNA, 25 bp, Mus musculus
accctctgtattgcgtacctgatga

SEQ ID NO: 114281 - DNA, 25 bp, Mus musculus
accctctgtgatcgtttggttacaa

SEQ ID NO: 114282 - DNA, 25 bp, Mus musculus
accctctgtgatggtttggttacaa

SEQ ID NO: 114283 - DNA, 25 bp, Mus musculus
accctctgtgccagtcaagcaaagg

SEQ ID NO: 114284 - DNA, 25 bp, Mus musculus
accctctgtgcctgtcaagcaaagg

SEQ ID NO: 114285 - DNA, 25 bp, Mus musculus
accctcttcaatctaattcctgtag

SEQ ID NO: 114286 - DNA, 25 bp, Mus musculus
accctcttcaatgtaattcctgtag

SEQ ID NO: 114287 - DNA, 25 bp, Mus musculus
accctcttcataatggctttattcc

SEQ ID NO: 114288 - DNA, 25 bp, Mus musculus
accctcttcatattggctttattcc

SEQ ID NO: 114289 - DNA, 25 bp, Mus musculus
accctcttctaactgatactgccag

SEQ ID NO: 114290 - DNA, 25 bp, Mus musculus
accctcttctaagtgatactgccag

SEQ ID NO: 114291 - DNA, 25 bp, Mus musculus
accctcttctctcgtgttacgatta

SEQ ID NO: 114292 - DNA, 25 bp, Mus musculus
accctcttctctggtgttacgatta

SEQ ID NO: 114293 - DNA, 25 bp, Mus musculus
accctcttgagcctccttgctaagg

SEQ ID NO: 114294 - DNA, 25 bp, Mus musculus
accctcttgagcgtccttgctaagg

SEQ ID NO: 114295 - DNA, 25 bp, Mus musculus
accctcttgcaaagtatagttttta

SEQ ID NO: 114296 - DNA, 25 bp, Mus musculus
accctcttgcaatgtatagttttta

SEQ ID NO: 114297 - DNA, 25 bp, Mus musculus
accctcttgggtctcattaaggatg

SEQ ID NO: 114298 - DNA, 25 bp, Mus musculus
accctcttgggtgtcattaaggatg

SEQ ID NO: 114299 - DNA, 25 bp, Mus musculus
accctcttgtcacttgtttgggaga

SEQ ID NO: 114300 - DNA, 25 bp, Mus musculus
accctcttgtcagttgtttgggaga

SEQ ID NO: 114301 - DNA, 25 bp, Mus musculus
accctgaaaaatagcatcctgatac

SEQ ID NO: 114302 - DNA, 25 bp, Mus musculus
accctgaaaaattgcatcctgatac

SEQ ID NO: 114303 - DNA, 25 bp, Mus musculus
accctgaaactcaacttctaagtag

SEQ ID NO: 114304 - DNA, 25 bp, Mus musculus
accctgaaactctacttctaagtag

SEQ ID NO: 114305 - DNA, 25 bp, Mus musculus
accctgaagacactgtcataaattg

SEQ ID NO: 114306 - DNA, 25 bp, Mus musculus
accctgaagacagtgtcataaattg

SEQ ID NO: 114307 - DNA, 25 bp, Mus musculus
accctgaaggttcctcatgtgttca

SEQ ID NO: 114308 - DNA, 25 bp, Mus musculus
accctgaaggttgctcatgtgttca

SEQ ID NO: 114309 - DNA, 25 bp, Mus musculus
accctgaagtatagcttcccaagga

SEQ ID NO: 114310 - DNA, 25 bp, Mus musculus
accctgaagtattgcttcccaagga

SEQ ID NO: 114311 - DNA, 25 bp, Mus musculus
accctgaagtctagacctcttattt

SEQ ID NO: 114312 - DNA, 25 bp, Mus musculus
accctgaagtctagagcttgtctgc

SEQ ID NO: 114313 - DNA, 25 bp, Mus musculus
accctgaagtcttgacctcttattt

SEQ ID NO: 114314 - DNA, 25 bp, Mus musculus
accctgaagtcttgagcttgtctgc

SEQ ID NO: 114315 - DNA, 25 bp, Mus musculus
accctgaagttaagtgccacgcaag

SEQ ID NO: 114316 - DNA, 25 bp, Mus musculus
accctgaagttatgtgccacgcaag

SEQ ID NO: 114317 - DNA, 25 bp, Mus musculus
accctgaatggaaactgaggaatca

SEQ ID NO: 114318 - DNA, 25 bp, Mus musculus
accctgaatggatactgaggaatca

SEQ ID NO: 114319 - DNA, 25 bp, Mus musculus
accctgaatgtgctccatggtgctt

SEQ ID NO: 114320 - DNA, 25 bp, Mus musculus
accctgaatgtggtccatggtgctt

SEQ ID NO: 114321 - DNA, 25 bp, Mus musculus
accctgaatttacctggcgtctaca

SEQ ID NO: 114322 - DNA, 25 bp, Mus musculus
accctgaatttagctggcgtctaca

SEQ ID NO: 114323 - DNA, 25 bp, Mus musculus
accctgacacatcccacagtaggat

SEQ ID NO: 114324 - DNA, 25 bp, Mus musculus
accctgacacatgccacagtaggat

SEQ ID NO: 114325 - DNA, 25 bp, Mus musculus
accctgacaccactgaatgccagat

SEQ ID NO: 114326 - DNA, 25 bp, Mus musculus
accctgacaccagtgaatgccagat

SEQ ID NO: 114327 - DNA, 25 bp, Mus musculus
accctgacacgtccctaagttattg

SEQ ID NO: 114328 - DNA, 25 bp, Mus musculus
accctgacacgtgcctaagttattg

SEQ ID NO: 114329 - DNA, 25 bp, Mus musculus
accctgacatcaaaagaacggccca

SEQ ID NO: 114330 - DNA, 25 bp, Mus musculus
accctgacatcataagaacggccca

SEQ ID NO: 114331 - DNA, 25 bp, Mus musculus
accctgaccagcattaactactttg

SEQ ID NO: 114332 - DNA, 25 bp, Mus musculus
accctgaccagctttaactactttg

SEQ ID NO: 114333 - DNA, 25 bp, Mus musculus
accctgaccatgaatgcacttgttg

SEQ ID NO: 114334 - DNA, 25 bp, Mus musculus
accctgaccatgtatgcacttgttg

SEQ ID NO: 114335 - DNA, 25 bp, Mus musculus
accctgaccttgacgatagctgtaa

SEQ ID NO: 114336 - DNA, 25 bp, Mus musculus
accctgaccttgtcgatagctgtaa

SEQ ID NO: 114337 - DNA, 25 bp, Mus musculus
accctgacctttcggcgagatggag

SEQ ID NO: 114338 - DNA, 25 bp, Mus musculus
accctgacctttgggcgagatggag

SEQ ID NO: 114339 - DNA, 25 bp, Mus musculus
accctgacgtgacaaacaatgtgtt

SEQ ID NO: 114340 - DNA, 25 bp, Mus musculus
accctgacgtgagaaacaatgtgtt

SEQ ID NO: 114341 - DNA, 25 bp, Mus musculus
accctgactaatacatggtccatca

SEQ ID NO: 114342 - DNA, 25 bp, Mus musculus
accctgactaattcatggtccatca

SEQ ID NO: 114343 - DNA, 25 bp, Mus musculus
accctgactcagactagtggaccat

SEQ ID NO: 114344 - DNA, 25 bp, Mus musculus
accctgactcagtctagtggaccat

SEQ ID NO: 114345 - DNA, 25 bp, Mus musculus
accctgactcataccttactggtag

SEQ ID NO: 114346 - DNA, 25 bp, Mus musculus
accctgactcattccttactggtag

SEQ ID NO: 114347 - DNA, 25 bp, Mus musculus
accctgactctcaaagttgtccaag

SEQ ID NO: 114348 - DNA, 25 bp, Mus musculus
accctgactctctaagttgtccaag

SEQ ID NO: 114349 - DNA, 25 bp, Mus musculus
accctgactgagacctgtgaagatg

SEQ ID NO: 114350 - DNA, 25 bp, Mus musculus
accctgactgagtcctgtgaagatg

SEQ ID NO: 114351 - DNA, 25 bp, Mus musculus
accctgacttcactacatggatcaa

SEQ ID NO: 114352 - DNA, 25 bp, Mus musculus
accctgacttcagtacatggatcaa

SEQ ID NO: 114353 - DNA, 25 bp, Mus musculus
accctgagacctcgagtactgcata

SEQ ID NO: 114354 - DNA, 25 bp, Mus musculus
accctgagacctggagtactgcata

SEQ ID NO: 114355 - DNA, 25 bp, Mus musculus
accctgagaggtcgcttgaacaaga

SEQ ID NO: 114356 - DNA, 25 bp, Mus musculus
accctgagaggtggcttgaacaaga

SEQ ID NO: 114357 - DNA, 25 bp, Mus musculus
accctgagagtgcagatccatgcaa

SEQ ID NO: 114358 - DNA, 25 bp, Mus musculus
accctgagagtggagatccatgcaa

SEQ ID NO: 114359 - DNA, 25 bp, Mus musculus
accctgagccctagactatgaaaaa

SEQ ID NO: 114360 - DNA, 25 bp, Mus musculus
accctgagcccttgactatgaaaaa

SEQ ID NO: 114361 - DNA, 25 bp, Mus musculus
accctgagcggcatttcttggtgaa

SEQ ID NO: 114362 - DNA, 25 bp, Mus musculus
accctgagcggcttttcttggtgaa

SEQ ID NO: 114363 - DNA, 25 bp, Mus musculus
accctgaggaacaggctgctcttga

SEQ ID NO: 114364 - DNA, 25 bp, Mus musculus
accctgaggaactggctgctcttga

SEQ ID NO: 114365 - DNA, 25 bp, Mus musculus
accctgaggactcggacgtgttcga

SEQ ID NO: 114366 - DNA, 25 bp, Mus musculus
accctgaggactgggacgtgttcga

SEQ ID NO: 114367 - DNA, 25 bp, Mus musculus
accctgaggtgaaaagcgccatcga

SEQ ID NO: 114368 - DNA, 25 bp, Mus musculus
accctgaggtgataagcgccatcga

SEQ ID NO: 114369 - DNA, 25 bp, Mus musculus
accctgaggtgtcgaaagccgccag

SEQ ID NO: 114370 - DNA, 25 bp, Mus musculus
accctgaggtgtggaaagccgccag

SEQ ID NO: 114371 - DNA, 25 bp, Mus musculus
accctgagtggaatggagccatgca

SEQ ID NO: 114372 - DNA, 25 bp, Mus musculus
accctgagtggattggagccatgca

SEQ ID NO: 114373 - DNA, 25 bp, Mus musculus
accctgatagccacaatgaacacct

SEQ ID NO: 114374 - DNA, 25 bp, Mus musculus
accctgatagcctcaatgaacacct

SEQ ID NO: 114375 - DNA, 25 bp, Mus musculus
accctgatcagaagcttgttgaaag

SEQ ID NO: 114376 - DNA, 25 bp, Mus musculus
accctgatcagatgcttgttgaaag

SEQ ID NO: 114377 - DNA, 25 bp, Mus musculus
accctgatctcacaaagttcctgat

SEQ ID NO: 114378 - DNA, 25 bp, Mus musculus
accctgatctcagaaagttcctgat

SEQ ID NO: 114379 - DNA, 25 bp, Mus musculus
accctgatgcctactcgagttaaaa

SEQ ID NO: 114380 - DNA, 25 bp, Mus musculus
accctgatgccttctcgagttaaaa

SEQ ID NO: 114381 - DNA, 25 bp, Mus musculus
accctgatgtacagagtgatctcta

SEQ ID NO: 114382 - DNA, 25 bp, Mus musculus
accctgatgtactgagtgatctcta

SEQ ID NO: 114383 - DNA, 25 bp, Mus musculus
accctgatgtatcgcagagcccttg

SEQ ID NO: 114384 - DNA, 25 bp, Mus musculus
accctgatgtatggcagagcccttg

SEQ ID NO: 114385 - DNA, 25 bp, Mus musculus
accctgattaagacacgtccactgg

SEQ ID NO: 114386 - DNA, 25 bp, Mus musculus
accctgattaagtcacgtccactgg

SEQ ID NO: 114387 - DNA, 25 bp, Mus musculus
accctgattcttatctgatctctaa

SEQ ID NO: 114388 - DNA, 25 bp, Mus musculus
accctgattcttttctgatctctaa

SEQ ID NO: 114389 - DNA, 25 bp, Mus musculus
accctgattggacgccacgttctta

SEQ ID NO: 114390 - DNA, 25 bp, Mus musculus
accctgattggaggccacgttctta

SEQ ID NO: 114391 - DNA, 25 bp, Mus musculus
accctgcaatcacatacaactgaca

SEQ ID NO: 114392 - DNA, 25 bp, Mus musculus
accctgcaatcagatacaactgaca

SEQ ID NO: 114393 - DNA, 25 bp, Mus musculus
accctgcaatccctatagcagtggg

SEQ ID NO: 114394 - DNA, 25 bp, Mus musculus
accctgcaatccgtatagcagtggg

SEQ ID NO: 114395 - DNA, 25 bp, Mus musculus
accctgcacattactacatgctagt

SEQ ID NO: 114396 - DNA, 25 bp, Mus musculus
accctgcacatttctacatgctagt

SEQ ID NO: 114397 - DNA, 25 bp, Mus musculus
accctgcagcatcggctatgtggct

SEQ ID NO: 114398 - DNA, 25 bp, Mus musculus
accctgcagcatgggctatgtggct

SEQ ID NO: 114399 - DNA, 25 bp, Mus musculus
accctgcagctgagtatccgtgatt

SEQ ID NO: 114400 - DNA, 25 bp, Mus musculus
accctgcagctgtgtatccgtgatt

SEQ ID NO: 114401 - DNA, 25 bp, Mus musculus
accctgcagtctatgttactatgaa

SEQ ID NO: 114402 - DNA, 25 bp, Mus musculus
accctgcagtctttgttactatgaa

SEQ ID NO: 114403 - DNA, 25 bp, Mus musculus
accctgcagttccatttgttcaatc

SEQ ID NO: 114404 - DNA, 25 bp, Mus musculus
accctgcagttcgatttgttcaatc

SEQ ID NO: 114405 - DNA, 25 bp, Mus musculus
accctgcatcctattatttaagaca

SEQ ID NO: 114406 - DNA, 25 bp, Mus musculus
accctgcatccttttatttaagaca

SEQ ID NO: 114407 - DNA, 25 bp, Mus musculus
accctgcatgcgatatcattccata

SEQ ID NO: 114408 - DNA, 25 bp, Mus musculus
accctgcatgcgttatcattccata

SEQ ID NO: 114409 - DNA, 25 bp, Mus musculus
accctgccagatacggagtttctga

SEQ ID NO: 114410 - DNA, 25 bp, Mus musculus
accctgccagattcggagtttctga

SEQ ID NO: 114411 - DNA, 25 bp, Mus musculus
accctgccagcgagagtgtcttact

SEQ ID NO: 114412 - DNA, 25 bp, Mus musculus
accctgccagcgtgagtgtcttact

SEQ ID NO: 114413 - DNA, 25 bp, Mus musculus
accctgccatggagaccgtgctgga

SEQ ID NO: 114414 - DNA, 25 bp, Mus musculus
accctgccatggtgaccgtgctgga

SEQ ID NO: 114415 - DNA, 25 bp, Mus musculus
accctgccatgtaacagcatctgtt

SEQ ID NO: 114416 - DNA, 25 bp, Mus musculus
accctgccatgttacagcatctgtt

SEQ ID NO: 114417 - DNA, 25 bp, Mus musculus
accctgcccatcaatgagtcaagaa

SEQ ID NO: 114418 - DNA, 25 bp, Mus musculus
accctgcccatctatgagtcaagaa

SEQ ID NO: 114419 - DNA, 25 bp, Mus musculus
accctgccgaccaaagagaccattg

SEQ ID NO: 114420 - DNA, 25 bp, Mus musculus
accctgccgacctaagagaccattg

SEQ ID NO: 114421 - DNA, 25 bp, Mus musculus
accctgcctcataggctaagtgtta

SEQ ID NO: 114422 - DNA, 25 bp, Mus musculus
accctgcctcattggctaagtgtta

SEQ ID NO: 114423 - DNA, 25 bp, Mus musculus
accctgcctctcagtttatataata

SEQ ID NO: 114424 - DNA, 25 bp, Mus musculus
accctgcctctctgtttatataata

SEQ ID NO: 114425 - DNA, 25 bp, Mus musculus
accctgcctgggatgtccccaatga

SEQ ID NO: 114426 - DNA, 25 bp, Mus musculus
accctgcctgggttgtccccaatga

SEQ ID NO: 114427 - DNA, 25 bp, Mus musculus
accctgccttgcctattttatgtgg

SEQ ID NO: 114428 - DNA, 25 bp, Mus musculus
accctgccttgcgtattttatgtgg

SEQ ID NO: 114429 - DNA, 25 bp, Mus musculus
accctgccttgtattagtgtctagt

SEQ ID NO: 114430 - DNA, 25 bp, Mus musculus
accctgccttgttttagtgtctagt

SEQ ID NO: 114431 - DNA, 25 bp, Mus musculus
accctgcctttccaagttcaaatct

SEQ ID NO: 114432 - DNA, 25 bp, Mus musculus
accctgcctttcgaagttcaaatct

SEQ ID NO: 114433 - DNA, 25 bp, Mus musculus
accctgctataaccttagaagtcta

SEQ ID NO: 114434 - DNA, 25 bp, Mus musculus
accctgctataagcttagaagtcta

SEQ ID NO: 114435 - DNA, 25 bp, Mus musculus
accctgctccccaatattggaggct

SEQ ID NO: 114436 - DNA, 25 bp, Mus musculus
accctgctcccctatattggaggct

SEQ ID NO: 114437 - DNA, 25 bp, Mus musculus
accctgctgcagatgctgtgagagt

SEQ ID NO: 114438 - DNA, 25 bp, Mus musculus
accctgctgcagttgctgtgagagt

SEQ ID NO: 114439 - DNA, 25 bp, Mus musculus
accctgctgcatctgaacatctgtg

SEQ ID NO: 114440 - DNA, 25 bp, Mus musculus
accctgctgcatgtgaacatctgtg

SEQ ID NO: 114441 - DNA, 25 bp, Mus musculus
accctgctgctgaagtcgtgaaaca

SEQ ID NO: 114442 - DNA, 25 bp, Mus musculus
accctgctgctgatgataaccatag

SEQ ID NO: 114443 - DNA, 25 bp, Mus musculus
accctgctgctgtagtcgtgaaaca

SEQ ID NO: 114444 - DNA, 25 bp, Mus musculus
accctgctgctgttgataaccatag

SEQ ID NO: 114445 - DNA, 25 bp, Mus musculus
accctgctggacctgaacgagatgt

SEQ ID NO: 114446 - DNA, 25 bp, Mus musculus
accctgctggacgtgaacgagatgt

SEQ ID NO: 114447 - DNA, 25 bp, Mus musculus
accctgcttccacaatccgttggta

SEQ ID NO: 114448 - DNA, 25 bp, Mus musculus
accctgcttccagaatccgttggta

SEQ ID NO: 114449 - DNA, 25 bp, Mus musculus
accctgctttccatctttgttagag

SEQ ID NO: 114450 - DNA, 25 bp, Mus musculus
accctgctttccttctttgttagag

SEQ ID NO: 114451 - DNA, 25 bp, Mus musculus
accctgcttttcaaaaggtgctgaa

SEQ ID NO: 114452 - DNA, 25 bp, Mus musculus
accctgcttttctaaaggtgctgaa

SEQ ID NO: 114453 - DNA, 25 bp, Mus musculus
accctgctttttcatctctctatat

SEQ ID NO: 114454 - DNA, 25 bp, Mus musculus
accctgctttttgatctctctatat

SEQ ID NO: 114455 - DNA, 25 bp, Mus musculus
accctggaaatcagactggaggttc

SEQ ID NO: 114456 - DNA, 25 bp, Mus musculus
accctggaaatctgactggaggttc

SEQ ID NO: 114457 - DNA, 25 bp, Mus musculus
accctggaagatactgttgtccact

SEQ ID NO: 114458 - DNA, 25 bp, Mus musculus
accctggaagattctgttgtccact

SEQ ID NO: 114459 - DNA, 25 bp, Mus musculus
accctggaccctagatattcttaga

SEQ ID NO: 114460 - DNA, 25 bp, Mus musculus
accctggacccttgatattcttaga

SEQ ID NO: 114461 - DNA, 25 bp, Mus musculus
accctggacgtccagcccagtgtta

SEQ ID NO: 114462 - DNA, 25 bp, Mus musculus
accctggacgtcgagcccagtgtta

SEQ ID NO: 114463 - DNA, 25 bp, Mus musculus
accctggagatcagtgctcctgatg

SEQ ID NO: 114464 - DNA, 25 bp, Mus musculus
accctggagatctgtgctcctgatg

SEQ ID NO: 114465 - DNA, 25 bp, Mus musculus
accctggagatgacgggtctgtctt

SEQ ID NO: 114466 - DNA, 25 bp, Mus musculus
accctggagatgtcgggtctgtctt

SEQ ID NO: 114467 - DNA, 25 bp, Mus musculus
accctggaggacaacgatgtctctt

SEQ ID NO: 114468 - DNA, 25 bp, Mus musculus
accctggaggacaccaatcatcggt

SEQ ID NO: 114469 - DNA, 25 bp, Mus musculus
accctggaggactacgatgtctctt

SEQ ID NO: 114470 - DNA, 25 bp, Mus musculus
accctggaggactccaatcatcggt

SEQ ID NO: 114471 - DNA, 25 bp, Mus musculus
accctggaggatatgagcttgagct

SEQ ID NO: 114472 - DNA, 25 bp, Mus musculus
accctggaggatttgagcttgagct

SEQ ID NO: 114473 - DNA, 25 bp, Mus musculus
accctggaggccaataccaagcaga

SEQ ID NO: 114474 - DNA, 25 bp, Mus musculus
accctggaggcctataccaagcaga

SEQ ID NO: 114475 - DNA, 25 bp, Mus musculus
accctggaggctcatgtggacattc

SEQ ID NO: 114476 - DNA, 25 bp, Mus musculus
accctggaggctgatgtggacattc

SEQ ID NO: 114477 - DNA, 25 bp, Mus musculus
accctggaggttagctagtgtgtga

SEQ ID NO: 114478 - DNA, 25 bp, Mus musculus
accctggaggtttgctagtgtgtga

SEQ ID NO: 114479 - DNA, 25 bp, Mus musculus
accctggagtgtatgatctttggcc

SEQ ID NO: 114480 - DNA, 25 bp, Mus musculus
accctggagtgtttgatctttggcc

SEQ ID NO: 114481 - DNA, 25 bp, Mus musculus
accctggatattatcattgcaagtg

SEQ ID NO: 114482 - DNA, 25 bp, Mus musculus
accctggatattttcattgcaagtg

SEQ ID NO: 114483 - DNA, 25 bp, Mus musculus
accctggatccaaatgctactttgt

SEQ ID NO: 114484 - DNA, 25 bp, Mus musculus
accctggatccatatgctactttgt

SEQ ID NO: 114485 - DNA, 25 bp, Mus musculus
accctggatctgcaaatctgaccct

SEQ ID NO: 114486 - DNA, 25 bp, Mus musculus
accctggatctggaaatctgaccct

SEQ ID NO: 114487 - DNA, 25 bp, Mus musculus
accctggatgacctttctcatgcag

SEQ ID NO: 114488 - DNA, 25 bp, Mus musculus
accctggatgacgtttctcatgcag

SEQ ID NO: 114489 - DNA, 25 bp, Mus musculus
accctggatgatcgcgatgttataa

SEQ ID NO: 114490 - DNA, 25 bp, Mus musculus
accctggatgatggcgatgttataa

SEQ ID NO: 114491 - DNA, 25 bp, Mus musculus
accctggcaagacggttctgtggat

SEQ ID NO: 114492 - DNA, 25 bp, Mus musculus
accctggcaagagggttctgtggat

SEQ ID NO: 114493 - DNA, 25 bp, Mus musculus
accctggcactactgagccagttta

SEQ ID NO: 114494 - DNA, 25 bp, Mus musculus
accctggcactagtgagccagttta

SEQ ID NO: 114495 - DNA, 25 bp, Mus musculus
accctggcactgaacctcagaggta

SEQ ID NO: 114496 - DNA, 25 bp, Mus musculus
accctggcactgtacctcagaggta

SEQ ID NO: 114497 - DNA, 25 bp, Mus musculus
accctggcagttaatcatagacctt

SEQ ID NO: 114498 - DNA, 25 bp, Mus musculus
accctggcagtttatcatagacctt

SEQ ID NO: 114499 - DNA, 25 bp, Mus musculus
accctggcctgcaacctggactttg

SEQ ID NO: 114500 - DNA, 25 bp, Mus musculus
accctggcctgctacctggactttg

SEQ ID NO: 114501 - DNA, 25 bp, Mus musculus
accctggcctgtaggtttctgatta

SEQ ID NO: 114502 - DNA, 25 bp, Mus musculus
accctggcctgttggtttctgatta

SEQ ID NO: 114503 - DNA, 25 bp, Mus musculus
accctggcctttagacaggatctta

SEQ ID NO: 114504 - DNA, 25 bp, Mus musculus
accctggccttttgacaggatctta

SEQ ID NO: 114505 - DNA, 25 bp, Mus musculus
accctggcgagcaagtgcgcaccga

SEQ ID NO: 114506 - DNA, 25 bp, Mus musculus
accctggcgagctagtgcgcaccga

SEQ ID NO: 114507 - DNA, 25 bp, Mus musculus
accctggctgagaggcaaaggaaac

SEQ ID NO: 114508 - DNA, 25 bp, Mus musculus
accctggctgagtggcaaaggaaac

SEQ ID NO: 114509 - DNA, 25 bp, Mus musculus
accctggctgcccagaaggaggcct

SEQ ID NO: 114510 - DNA, 25 bp, Mus musculus
accctggctgccgagaaggaggcct

SEQ ID NO: 114511 - DNA, 25 bp, Mus musculus
accctggctgggagcctacctaaag

SEQ ID NO: 114512 - DNA, 25 bp, Mus musculus
accctggctgggtgcctacctaaag

SEQ ID NO: 114513 - DNA, 25 bp, Mus musculus
accctgggaacgcagcaactcggtg

SEQ ID NO: 114514 - DNA, 25 bp, Mus musculus
accctgggaacggagcaactcggtg

SEQ ID NO: 114515 - DNA, 25 bp, Mus musculus
accctgggaataagcctgggaatat

SEQ ID NO: 114516 - DNA, 25 bp, Mus musculus
accctgggaatatgcctgggaatat

SEQ ID NO: 114517 - DNA, 25 bp, Mus musculus
accctgggaccaacctatttagatg

SEQ ID NO: 114518 - DNA, 25 bp, Mus musculus
accctgggaccatcctatttagatg

SEQ ID NO: 114519 - DNA, 25 bp, Mus musculus
accctgggatgcagcccactatgat

SEQ ID NO: 114520 - DNA, 25 bp, Mus musculus
accctgggatgctgcccactatgat

SEQ ID NO: 114521 - DNA, 25 bp, Mus musculus
accctgggattactggcactatcta

SEQ ID NO: 114522 - DNA, 25 bp, Mus musculus
accctgggattagtggcactatcta

SEQ ID NO: 114523 - DNA, 25 bp, Mus musculus
accctgggcagcagtttccgatggt

SEQ ID NO: 114524 - DNA, 25 bp, Mus musculus
accctgggcagctgtttccgatggt

SEQ ID NO: 114525 - DNA, 25 bp, Mus musculus
accctgggcatccatagctaagtca

SEQ ID NO: 114526 - DNA, 25 bp, Mus musculus
accctgggcatcgatagctaagtca

SEQ ID NO: 114527 - DNA, 25 bp, Mus musculus
accctgggctcaaagtaagacttat

SEQ ID NO: 114528 - DNA, 25 bp, Mus musculus
accctgggctcatagtaagacttat

SEQ ID NO: 114529 - DNA, 25 bp, Mus musculus
accctgggttgaatagcatatgctt

SEQ ID NO: 114530 - DNA, 25 bp, Mus musculus
accctgggttgattagcatatgctt

SEQ ID NO: 114531 - DNA, 25 bp, Mus musculus
accctggtcagtacgtgtggcctaa

SEQ ID NO: 114532 - DNA, 25 bp, Mus musculus
accctggtcagttcgtgtggcctaa

SEQ ID NO: 114533 - DNA, 25 bp, Mus musculus
accctggtccgcctacttgaaaatg

SEQ ID NO: 114534 - DNA, 25 bp, Mus musculus
accctggtccgcgtacttgaaaatg

SEQ ID NO: 114535 - DNA, 25 bp, Mus musculus
accctggtctggatatttgggcagc

SEQ ID NO: 114536 - DNA, 25 bp, Mus musculus
accctggtctggttatttgggcagc

SEQ ID NO: 114537 - DNA, 25 bp, Mus musculus
accctggtgaagcagaagccccatg

SEQ ID NO: 114538 - DNA, 25 bp, Mus musculus
accctggtgaaggagaagccccatg

SEQ ID NO: 114539 - DNA, 25 bp, Mus musculus
accctggtgctgactatccagttga

SEQ ID NO: 114540 - DNA, 25 bp, Mus musculus
accctggtgctgagctcggtgaaga

SEQ ID NO: 114541 - DNA, 25 bp, Mus musculus
accctggtgctgtctatccagttga

SEQ ID NO: 114542 - DNA, 25 bp, Mus musculus
accctggtgctgtgctcggtgaaga

SEQ ID NO: 114543 - DNA, 25 bp, Mus musculus
accctggtggatcgagtagtgttac

SEQ ID NO: 114544 - DNA, 25 bp, Mus musculus
accctggtggatggagtagtgttac

SEQ ID NO: 114545 - DNA, 25 bp, Mus musculus
accctggttatcacagacaaggaaa

SEQ ID NO: 114546 - DNA, 25 bp, Mus musculus
accctggttatctcagacaaggaaa

SEQ ID NO: 114547 - DNA, 25 bp, Mus musculus
accctggttcccaggtctgtggtgt

SEQ ID NO: 114548 - DNA, 25 bp, Mus musculus
accctggttccctggtctgtggtgt

SEQ ID NO: 114549 - DNA, 25 bp, Mus musculus
accctggttgccctagaacttgcta

SEQ ID NO: 114550 - DNA, 25 bp, Mus musculus
accctggttgccgtagaacttgcta

SEQ ID NO: 114551 - DNA, 25 bp, Mus musculus
accctggtttcccacgtgtataatg

SEQ ID NO: 114552 - DNA, 25 bp, Mus musculus
accctggtttccctatttcacagca

SEQ ID NO: 114553 - DNA, 25 bp, Mus musculus
accctggtttccgacgtgtataatg

SEQ ID NO: 114554 - DNA, 25 bp, Mus musculus
accctggtttccgtatttcacagca

SEQ ID NO: 114555 - DNA, 25 bp, Mus musculus
accctggtttctactgatactacca

SEQ ID NO: 114556 - DNA, 25 bp, Mus musculus
accctggtttcttctgatactacca

SEQ ID NO: 114557 - DNA, 25 bp, Mus musculus
accctgtaaaatcaacttgtccctg

SEQ ID NO: 114558 - DNA, 25 bp, Mus musculus
accctgtaaaatgaacttgtccctg

SEQ ID NO: 114559 - DNA, 25 bp, Mus musculus
accctgtaaagcaccctgtcggtat

SEQ ID NO: 114560 - DNA, 25 bp, Mus musculus
accctgtaaagctccctgtcggtat

SEQ ID NO: 114561 - DNA, 25 bp, Mus musculus
accctgtaacagaagggtctgggag

SEQ ID NO: 114562 - DNA, 25 bp, Mus musculus
accctgtaacagtagggtctgggag

SEQ ID NO: 114563 - DNA, 25 bp, Mus musculus
accctgtaaggtagattgtggaaca

SEQ ID NO: 114564 - DNA, 25 bp, Mus musculus
accctgtaaggttgattgtggaaca

SEQ ID NO: 114565 - DNA, 25 bp, Mus musculus
accctgtactatccacccggaagta

SEQ ID NO: 114566 - DNA, 25 bp, Mus musculus
accctgtactatgcacccggaagta

SEQ ID NO: 114567 - DNA, 25 bp, Mus musculus
accctgtacttcattgggcttactt

SEQ ID NO: 114568 - DNA, 25 bp, Mus musculus
accctgtacttctttgggcttactt

SEQ ID NO: 114569 - DNA, 25 bp, Mus musculus
accctgtagaaaacctggtggccag

SEQ ID NO: 114570 - DNA, 25 bp, Mus musculus
accctgtagaaatcctggtggccag

SEQ ID NO: 114571 - DNA, 25 bp, Mus musculus
accctgtagatgacaaactttgctt

SEQ ID NO: 114572 - DNA, 25 bp, Mus musculus
accctgtagatgtcaaactttgctt

SEQ ID NO: 114573 - DNA, 25 bp, Mus musculus
accctgtagggcctgtgttggtgta

SEQ ID NO: 114574 - DNA, 25 bp, Mus musculus
accctgtagggcgtgtgttggtgta

SEQ ID NO: 114575 - DNA, 25 bp, Mus musculus
accctgtagtttctggacgtttgtg

SEQ ID NO: 114576 - DNA, 25 bp, Mus musculus
accctgtagtttgtggacgtttgtg

SEQ ID NO: 114577 - DNA, 25 bp, Mus musculus
accctgtatacgctcaagagttaat

SEQ ID NO: 114578 - DNA, 25 bp, Mus musculus
accctgtatacggtcaagagttaat

SEQ ID NO: 114579 - DNA, 25 bp, Mus musculus
accctgtatgaaattctacttggaa

SEQ ID NO: 114580 - DNA, 25 bp, Mus musculus
accctgtatgaatttctacttggaa

SEQ ID NO: 114581 - DNA, 25 bp, Mus musculus
accctgtatgacaacaccacagtat

SEQ ID NO: 114582 - DNA, 25 bp, Mus musculus
accctgtatgactacaccacagtat

SEQ ID NO: 114583 - DNA, 25 bp, Mus musculus
accctgtcaccacacgtggctgtgg

SEQ ID NO: 114584 - DNA, 25 bp, Mus musculus
accctgtcaccagacgtggctgtgg

SEQ ID NO: 114585 - DNA, 25 bp, Mus musculus
accctgtcacggacgagtggaaagc

SEQ ID NO: 114586 - DNA, 25 bp, Mus musculus
accctgtcacggtcgagtggaaagc

SEQ ID NO: 114587 - DNA, 25 bp, Mus musculus
accctgtcaggaagcctaagctcaa

SEQ ID NO: 114588 - DNA, 25 bp, Mus musculus
accctgtcaggatgcctaagctcaa

SEQ ID NO: 114589 - DNA, 25 bp, Mus musculus
accctgtccaaacagaatctagaga

SEQ ID NO: 114590 - DNA, 25 bp, Mus musculus
accctgtccaaagagaatctagaga

SEQ ID NO: 114591 - DNA, 25 bp, Mus musculus
accctgtccctgattatagcttatg

SEQ ID NO: 114592 - DNA, 25 bp, Mus musculus
accctgtccctgtttatagcttatg

SEQ ID NO: 114593 - DNA, 25 bp, Mus musculus
accctgtcctacatgttagtagatg

SEQ ID NO: 114594 - DNA, 25 bp, Mus musculus
accctgtcctacttgttagtagatg

SEQ ID NO: 114595 - DNA, 25 bp, Mus musculus
accctgtcgcaccagcaagtaaatg

SEQ ID NO: 114596 - DNA, 25 bp, Mus musculus
accctgtcgcacgagcaagtaaatg

SEQ ID NO: 114597 - DNA, 25 bp, Mus musculus
accctgtctcggacataaggtggaa

SEQ ID NO: 114598 - DNA, 25 bp, Mus musculus
accctgtctcggtcataaggtggaa

SEQ ID NO: 114599 - DNA, 25 bp, Mus musculus
accctgtctcgtctctcaaaaaaca

SEQ ID NO: 114600 - DNA, 25 bp, Mus musculus
accctgtctcgtgtctcaaaaaaca

SEQ ID NO: 114601 - DNA, 25 bp, Mus musculus
accctgtctgctctaggctaatagt

SEQ ID NO: 114602 - DNA, 25 bp, Mus musculus
accctgtctgctgtaggctaatagt

SEQ ID NO: 114603 - DNA, 25 bp, Mus musculus
accctgtctggaagatttggctcta

SEQ ID NO: 114604 - DNA, 25 bp, Mus musculus
accctgtctggatgatttggctcta

SEQ ID NO: 114605 - DNA, 25 bp, Mus musculus
accctgtcttaccatgtgtggaaga

SEQ ID NO: 114606 - DNA, 25 bp, Mus musculus
accctgtcttacgatgtgtggaaga

SEQ ID NO: 114607 - DNA, 25 bp, Mus musculus
accctgtgaaaaatgtccgatgcca

SEQ ID NO: 114608 - DNA, 25 bp, Mus musculus
accctgtgaaaattgtccgatgcca

SEQ ID NO: 114609 - DNA, 25 bp, Mus musculus
accctgtgaaatcctcctttgtcca

SEQ ID NO: 114610 - DNA, 25 bp, Mus musculus
accctgtgaaatgctcctttgtcca

SEQ ID NO: 114611 - DNA, 25 bp, Mus musculus
accctgtgatccctcagagattgaa

SEQ ID NO: 114612 - DNA, 25 bp, Mus musculus
accctgtgatccgtcagagattgaa

SEQ ID NO: 114613 - DNA, 25 bp, Mus musculus
accctgtgatgcatgaagtgatttt

SEQ ID NO: 114614 - DNA, 25 bp, Mus musculus
accctgtgatgcttgaagtgatttt

SEQ ID NO: 114615 - DNA, 25 bp, Mus musculus
accctgtgcacactcccatggatgg

SEQ ID NO: 114616 - DNA, 25 bp, Mus musculus
accctgtgcacagtcccatggatgg

SEQ ID NO: 114617 - DNA, 25 bp, Mus musculus
accctgtgcagaaaatgggcatcat

SEQ ID NO: 114618 - DNA, 25 bp, Mus musculus
accctgtgcagataatgggcatcat

SEQ ID NO: 114619 - DNA, 25 bp, Mus musculus
accctgtgcagtatcctgaggaaga

SEQ ID NO: 114620 - DNA, 25 bp, Mus musculus
accctgtgcagtcgagcttcctagt

SEQ ID NO: 114621 - DNA, 25 bp, Mus musculus
accctgtgcagtggagcttcctagt

SEQ ID NO: 114622 - DNA, 25 bp, Mus musculus
accctgtgcagtttcctgaggaaga

SEQ ID NO: 114623 - DNA, 25 bp, Mus musculus
accctgtgcgaaagaatggacctat

SEQ ID NO: 114624 - DNA, 25 bp, Mus musculus
accctgtgcgaatgaatggacctat

SEQ ID NO: 114625 - DNA, 25 bp, Mus musculus
accctgtgctgcacaccgaggcccc

SEQ ID NO: 114626 - DNA, 25 bp, Mus musculus
accctgtgctgcagttaaacctgct

SEQ ID NO: 114627 - DNA, 25 bp, Mus musculus
accctgtgctgctcaccgaggcccc

SEQ ID NO: 114628 - DNA, 25 bp, Mus musculus
accctgtgctgctgttaaacctgct

SEQ ID NO: 114629 - DNA, 25 bp, Mus musculus
accctgtgctttccgttttggtctg

SEQ ID NO: 114630 - DNA, 25 bp, Mus musculus
accctgtgctttgcgttttggtctg

SEQ ID NO: 114631 - DNA, 25 bp, Mus musculus
accctgtggaaacaatctgtggatg

SEQ ID NO: 114632 - DNA, 25 bp, Mus musculus
accctgtggaaagaatctgtggatg

SEQ ID NO: 114633 - DNA, 25 bp, Mus musculus
accctgtggaccaggaagcgaattc

SEQ ID NO: 114634 - DNA, 25 bp, Mus musculus
accctgtggacctggaagcgaattc

SEQ ID NO: 114635 - DNA, 25 bp, Mus musculus
accctgtggcctccatttggaagaa

SEQ ID NO: 114636 - DNA, 25 bp, Mus musculus
accctgtggcctgcatttggaagaa

SEQ ID NO: 114637 - DNA, 25 bp, Mus musculus
accctgtgggagctgctgatgctct

SEQ ID NO: 114638 - DNA, 25 bp, Mus musculus
accctgtgggaggtgctgatgctct

SEQ ID NO: 114639 - DNA, 25 bp, Mus musculus
accctgtgggttagtgcagactggt

SEQ ID NO: 114640 - DNA, 25 bp, Mus musculus
accctgtgggtttgtgcagactggt

SEQ ID NO: 114641 - DNA, 25 bp, Mus musculus
accctgtgtattaaacgatgtggca

SEQ ID NO: 114642 - DNA, 25 bp, Mus musculus
accctgtgtatttaacgatgtggca

SEQ ID NO: 114643 - DNA, 25 bp, Mus musculus
accctgtgtctgctgtcattaagtg

SEQ ID NO: 114644 - DNA, 25 bp, Mus musculus
accctgtgtctggtgtcattaagtg

SEQ ID NO: 114645 - DNA, 25 bp, Mus musculus
accctgtgtgaaacccaactgtcta

SEQ ID NO: 114646 - DNA, 25 bp, Mus musculus
accctgtgtgaatcccaactgtcta

SEQ ID NO: 114647 - DNA, 25 bp, Mus musculus
accctgtgtgttatagtgatgtcat

SEQ ID NO: 114648 - DNA, 25 bp, Mus musculus
accctgtgtgttttagtgatgtcat

SEQ ID NO: 114649 - DNA, 25 bp, Mus musculus
accctgttactacaaattaccagct

SEQ ID NO: 114650 - DNA, 25 bp, Mus musculus
accctgttactagaaattaccagct

SEQ ID NO: 114651 - DNA, 25 bp, Mus musculus
accctgttcgccacagtaagtctaa

SEQ ID NO: 114652 - DNA, 25 bp, Mus musculus
accctgttcgcctcagtaagtctaa

SEQ ID NO: 114653 - DNA, 25 bp, Mus musculus
accctgttctgcattccatggagtt

SEQ ID NO: 114654 - DNA, 25 bp, Mus musculus
accctgttctgctttccatggagtt

SEQ ID NO: 114655 - DNA, 25 bp, Mus musculus
accctgttgggtcattctctagaag

SEQ ID NO: 114656 - DNA, 25 bp, Mus musculus
accctgttgggtgattctctagaag

SEQ ID NO: 114657 - DNA, 25 bp, Mus musculus
accctgttggtgcttcctggtacca

SEQ ID NO: 114658 - DNA, 25 bp, Mus musculus
accctgttggtggttcctggtacca

SEQ ID NO: 114659 - DNA, 25 bp, Mus musculus
accctgtttaacctgtgagagtctc

SEQ ID NO: 114660 - DNA, 25 bp, Mus musculus
accctgtttaacgtgtgagagtctc

SEQ ID NO: 114661 - DNA, 25 bp, Mus musculus
accctgtttctgcatgtcattttga

SEQ ID NO: 114662 - DNA, 25 bp, Mus musculus
accctgtttctggatgtcattttga

SEQ ID NO: 114663 - DNA, 25 bp, Mus musculus
acccttaaaacgatgcagcagcaga

SEQ ID NO: 114664 - DNA, 25 bp, Mus musculus
acccttaaaacgttgcagcagcaga

SEQ ID NO: 114665 - DNA, 25 bp, Mus musculus
acccttacgactaggctttgtggct

SEQ ID NO: 114666 - DNA, 25 bp, Mus musculus
acccttacgacttggctttgtggct

SEQ ID NO: 114667 - DNA, 25 bp, Mus musculus
acccttactacaaatgtggatccca

SEQ ID NO: 114668 - DNA, 25 bp, Mus musculus
acccttactacatatgtggatccca

SEQ ID NO: 114669 - DNA, 25 bp, Mus musculus
acccttagatcaaatgtggacttat

SEQ ID NO: 114670 - DNA, 25 bp, Mus musculus
acccttagatcatatgtggacttat

SEQ ID NO: 114671 - DNA, 25 bp, Mus musculus
acccttagctctcccattattgtta

SEQ ID NO: 114672 - DNA, 25 bp, Mus musculus
acccttagctctgccattattgtta

SEQ ID NO: 114673 - DNA, 25 bp, Mus musculus
acccttagggtgctagtgctctgga

SEQ ID NO: 114674 - DNA, 25 bp, Mus musculus
acccttagggtggtagtgctctgga

SEQ ID NO: 114675 - DNA, 25 bp, Mus musculus
acccttagtactctcagctctatca

SEQ ID NO: 114676 - DNA, 25 bp, Mus musculus
acccttagtactgtcagctctatca

SEQ ID NO: 114677 - DNA, 25 bp, Mus musculus
acccttagtgacacaagtgcactgt

SEQ ID NO: 114678 - DNA, 25 bp, Mus musculus
acccttagtgactcaagtgcactgt

SEQ ID NO: 114679 - DNA, 25 bp, Mus musculus
acccttagtgccatgtagatgatct

SEQ ID NO: 114680 - DNA, 25 bp, Mus musculus
acccttagtgccttgtagatgatct

SEQ ID NO: 114681 - DNA, 25 bp, Mus musculus
acccttatctagagcccttggtaga

SEQ ID NO: 114682 - DNA, 25 bp, Mus musculus
acccttatctagtgcccttggtaga

SEQ ID NO: 114683 - DNA, 25 bp, Mus musculus
acccttatctgcattgtggacaaca

SEQ ID NO: 114684 - DNA, 25 bp, Mus musculus
acccttatctgctttgtggacaaca

SEQ ID NO: 114685 - DNA, 25 bp, Mus musculus
acccttatgtatatattagttagtg

SEQ ID NO: 114686 - DNA, 25 bp, Mus musculus
acccttatgtatttattagttagtg

SEQ ID NO: 114687 - DNA, 25 bp, Mus musculus
acccttattttgactagtagctgaa

SEQ ID NO: 114688 - DNA, 25 bp, Mus musculus
acccttattttgtctagtagctgaa

SEQ ID NO: 114689 - DNA, 25 bp, Mus musculus
acccttcaattgaggtcaagtgtgg

SEQ ID NO: 114690 - DNA, 25 bp, Mus musculus
acccttcaattgtggtcaagtgtgg

SEQ ID NO: 114691 - DNA, 25 bp, Mus musculus
acccttcagcatacaagtccttata

SEQ ID NO: 114692 - DNA, 25 bp, Mus musculus
acccttcagcattcaagtccttata

SEQ ID NO: 114693 - DNA, 25 bp, Mus musculus
acccttcagggtagagcagacttga

SEQ ID NO: 114694 - DNA, 25 bp, Mus musculus
acccttcagggttgagcagacttga

SEQ ID NO: 114695 - DNA, 25 bp, Mus musculus
acccttcatcctacactggaataaa

SEQ ID NO: 114696 - DNA, 25 bp, Mus musculus
acccttcatccttcactggaataaa

SEQ ID NO: 114697 - DNA, 25 bp, Mus musculus
acccttcattcgacagagcctggat

SEQ ID NO: 114698 - DNA, 25 bp, Mus musculus
acccttcattcgtcagagcctggat

SEQ ID NO: 114699 - DNA, 25 bp, Mus musculus
acccttccagctcttaggctagaga

SEQ ID NO: 114700 - DNA, 25 bp, Mus musculus
acccttccagctgttaggctagaga

SEQ ID NO: 114701 - DNA, 25 bp, Mus musculus
acccttccagtgaggcgcagcgatt

SEQ ID NO: 114702 - DNA, 25 bp, Mus musculus
acccttccagtgtggcgcagcgatt

SEQ ID NO: 114703 - DNA, 25 bp, Mus musculus
acccttccatatagccacaatcaag

SEQ ID NO: 114704 - DNA, 25 bp, Mus musculus
acccttccatattgccacaatcaag

SEQ ID NO: 114705 - DNA, 25 bp, Mus musculus
acccttcccagcataaagatgcttg

SEQ ID NO: 114706 - DNA, 25 bp, Mus musculus
acccttcccagcttaaagatgcttg

SEQ ID NO: 114707 - DNA, 25 bp, Mus musculus
acccttcccatccaagtagattatg

SEQ ID NO: 114708 - DNA, 25 bp, Mus musculus
acccttcccatcgaagtagattatg

SEQ ID NO: 114709 - DNA, 25 bp, Mus musculus
acccttcccttgctgatcttaagag

SEQ ID NO: 114710 - DNA, 25 bp, Mus musculus
acccttcccttggtgatcttaagag

SEQ ID NO: 114711 - DNA, 25 bp, Mus musculus
acccttcctacacagtcacttgtta

SEQ ID NO: 114712 - DNA, 25 bp, Mus musculus
acccttcctacagagtcacttgtta

SEQ ID NO: 114713 - DNA, 25 bp, Mus musculus
acccttcctcaaagtgcctcgatga

SEQ ID NO: 114714 - DNA, 25 bp, Mus musculus
acccttcctcaatgtgcctcgatga

SEQ ID NO: 114715 - DNA, 25 bp, Mus musculus
acccttcctggaaatagttcggcaa

SEQ ID NO: 114716 - DNA, 25 bp, Mus musculus
acccttcctggatatagttcggcaa

SEQ ID NO: 114717 - DNA, 25 bp, Mus musculus
acccttcctggtagagtaagttgtg

SEQ ID NO: 114718 - DNA, 25 bp, Mus musculus
acccttcctggtcaaaagaagccat

SEQ ID NO: 114719 - DNA, 25 bp, Mus musculus
acccttcctggtgaaaagaagccat

SEQ ID NO: 114720 - DNA, 25 bp, Mus musculus
acccttcctggttgagtaagttgtg

SEQ ID NO: 114721 - DNA, 25 bp, Mus musculus
acccttcctgtccacagtaaaactg

SEQ ID NO: 114722 - DNA, 25 bp, Mus musculus
acccttcctgtcgacagtaaaactg

SEQ ID NO: 114723 - DNA, 25 bp, Mus musculus
acccttccttcaatatggagccttc

SEQ ID NO: 114724 - DNA, 25 bp, Mus musculus
acccttccttcattatggagccttc

SEQ ID NO: 114725 - DNA, 25 bp, Mus musculus
acccttccttccacaagatatgtct

SEQ ID NO: 114726 - DNA, 25 bp, Mus musculus
acccttccttccagggtatgattca

SEQ ID NO: 114727 - DNA, 25 bp, Mus musculus
acccttccttcctcaagatatgtct

SEQ ID NO: 114728 - DNA, 25 bp, Mus musculus
acccttccttcctgggtatgattca

SEQ ID NO: 114729 - DNA, 25 bp, Mus musculus
acccttccttttcagattaagtctg

SEQ ID NO: 114730 - DNA, 25 bp, Mus musculus
acccttccttttgagattaagtctg

SEQ ID NO: 114731 - DNA, 25 bp, Mus musculus
acccttcgctggaggagcttcagga

SEQ ID NO: 114732 - DNA, 25 bp, Mus musculus
acccttcgctggtggagcttcagga

SEQ ID NO: 114733 - DNA, 25 bp, Mus musculus
acccttctatccaatcaactgacaa

SEQ ID NO: 114734 - DNA, 25 bp, Mus musculus
acccttctatcctatcaactgacaa

SEQ ID NO: 114735 - DNA, 25 bp, Mus musculus
acccttctctaaatctccttgtaat

SEQ ID NO: 114736 - DNA, 25 bp, Mus musculus
acccttctctaattctccttgtaat

SEQ ID NO: 114737 - DNA, 25 bp, Mus musculus
acccttctctccagtaaatgtcaag

SEQ ID NO: 114738 - DNA, 25 bp, Mus musculus
acccttctctcctgtaaatgtcaag

SEQ ID NO: 114739 - DNA, 25 bp, Mus musculus
acccttctctctccactccaggaga

SEQ ID NO: 114740 - DNA, 25 bp, Mus musculus
acccttctctctgcactccaggaga

SEQ ID NO: 114741 - DNA, 25 bp, Mus musculus
acccttctggagatgagcctatctt

SEQ ID NO: 114742 - DNA, 25 bp, Mus musculus
acccttctggagttgagcctatctt

SEQ ID NO: 114743 - DNA, 25 bp, Mus musculus
acccttctgggtatcgtgctgtctg

SEQ ID NO: 114744 - DNA, 25 bp, Mus musculus
acccttctgggtttcgtgctgtctg

SEQ ID NO: 114745 - DNA, 25 bp, Mus musculus
acccttctggtcaggctcagcactg

SEQ ID NO: 114746 - DNA, 25 bp, Mus musculus
acccttctggtctggctcagcactg

SEQ ID NO: 114747 - DNA, 25 bp, Mus musculus
acccttcttgtccttctagattaat

SEQ ID NO: 114748 - DNA, 25 bp, Mus musculus
acccttcttgtcgttctagattaat

SEQ ID NO: 114749 - DNA, 25 bp, Mus musculus
acccttgaagatctagcttccgaat

SEQ ID NO: 114750 - DNA, 25 bp, Mus musculus
acccttgaagatgtagcttccgaat

SEQ ID NO: 114751 - DNA, 25 bp, Mus musculus
acccttgacctgctatgtttttgag

SEQ ID NO: 114752 - DNA, 25 bp, Mus musculus
acccttgacctggtatgtttttgag

SEQ ID NO: 114753 - DNA, 25 bp, Mus musculus
acccttgacttgcatcacaactggt

SEQ ID NO: 114754 - DNA, 25 bp, Mus musculus
acccttgacttggatcacaactggt

SEQ ID NO: 114755 - DNA, 25 bp, Mus musculus
acccttgagaatcaactcacctggg

SEQ ID NO: 114756 - DNA, 25 bp, Mus musculus
acccttgagaatgaactcacctggg

SEQ ID NO: 114757 - DNA, 25 bp, Mus musculus
acccttgagaggatgttcccagtgt

SEQ ID NO: 114758 - DNA, 25 bp, Mus musculus
acccttgagaggttgttcccagtgt

SEQ ID NO: 114759 - DNA, 25 bp, Mus musculus
acccttgagtccattcgtgagtgaa

SEQ ID NO: 114760 - DNA, 25 bp, Mus musculus
acccttgagtcctttcgtgagtgaa

SEQ ID NO: 114761 - DNA, 25 bp, Mus musculus
acccttgatgggagtaacggatgga

SEQ ID NO: 114762 - DNA, 25 bp, Mus musculus
acccttgatgggtgtaacggatgga

SEQ ID NO: 114763 - DNA, 25 bp, Mus musculus
acccttgatggtatagtttgtcctt

SEQ ID NO: 114764 - DNA, 25 bp, Mus musculus
acccttgatggtttagtttgtcctt

SEQ ID NO: 114765 - DNA, 25 bp, Mus musculus
acccttgatttgaagatttgctcct

SEQ ID NO: 114766 - DNA, 25 bp, Mus musculus
acccttgatttgtagatttgctcct

SEQ ID NO: 114767 - DNA, 25 bp, Mus musculus
acccttgcaactcttgtgaataaca

SEQ ID NO: 114768 - DNA, 25 bp, Mus musculus
acccttgcaactgttgtgaataaca

SEQ ID NO: 114769 - DNA, 25 bp, Mus musculus
acccttgcacttctcttaggctggg

SEQ ID NO: 114770 - DNA, 25 bp, Mus musculus
acccttgcacttgtcttaggctggg

SEQ ID NO: 114771 - DNA, 25 bp, Mus musculus
acccttgcagcgctttgacaagtgt

SEQ ID NO: 114772 - DNA, 25 bp, Mus musculus
acccttgcagcggtttgacaagtgt

SEQ ID NO: 114773 - DNA, 25 bp, Mus musculus
acccttgcaggacccttaaggcttg

SEQ ID NO: 114774 - DNA, 25 bp, Mus musculus
acccttgcaggagccttaaggcttg

SEQ ID NO: 114775 - DNA, 25 bp, Mus musculus
acccttgccaaaagcctttatgaac

SEQ ID NO: 114776 - DNA, 25 bp, Mus musculus
acccttgccaaaatgtcagagtccc

SEQ ID NO: 114777 - DNA, 25 bp, Mus musculus
acccttgccaaatgcctttatgaac

SEQ ID NO: 114778 - DNA, 25 bp, Mus musculus
acccttgccaaattgtcagagtccc

SEQ ID NO: 114779 - DNA, 25 bp, Mus musculus
acccttgccaggctgggtgcagact

SEQ ID NO: 114780 - DNA, 25 bp, Mus musculus
acccttgccagggtgggtgcagact

SEQ ID NO: 114781 - DNA, 25 bp, Mus musculus
acccttgccctcaacagttaggaag

SEQ ID NO: 114782 - DNA, 25 bp, Mus musculus
acccttgccctctacagttaggaag

SEQ ID NO: 114783 - DNA, 25 bp, Mus musculus
acccttgccttaaggctctagcgtg

SEQ ID NO: 114784 - DNA, 25 bp, Mus musculus
acccttgccttatggctctagcgtg

SEQ ID NO: 114785 - DNA, 25 bp, Mus musculus
acccttgcgcagattcgtggttaaa

SEQ ID NO: 114786 - DNA, 25 bp, Mus musculus
acccttgcgcagtttcgtggttaaa

SEQ ID NO: 114787 - DNA, 25 bp, Mus musculus
acccttgctctgcagtatcccagga

SEQ ID NO: 114788 - DNA, 25 bp, Mus musculus
acccttgctctggagtatcccagga

SEQ ID NO: 114789 - DNA, 25 bp, Mus musculus
acccttggagatccctagaatatct

SEQ ID NO: 114790 - DNA, 25 bp, Mus musculus
acccttggagatgcctagaatatct

SEQ ID NO: 114791 - DNA, 25 bp, Mus musculus
acccttggagcgcattgctcatgag

SEQ ID NO: 114792 - DNA, 25 bp, Mus musculus
acccttggagcggattgctcatgag

SEQ ID NO: 114793 - DNA, 25 bp, Mus musculus
acccttggagctagtgcatacagag

SEQ ID NO: 114794 - DNA, 25 bp, Mus musculus
acccttggagcttgtgcatacagag

SEQ ID NO: 114795 - DNA, 25 bp, Mus musculus
acccttggcctgactggagaacaac

SEQ ID NO: 114796 - DNA, 25 bp, Mus musculus
acccttggcctgtctggagaacaac

SEQ ID NO: 114797 - DNA, 25 bp, Mus musculus
acccttggctttagcgctgtgaggc

SEQ ID NO: 114798 - DNA, 25 bp, Mus musculus
acccttggcttttgcgctgtgaggc

SEQ ID NO: 114799 - DNA, 25 bp, Mus musculus
acccttgggcgtacacaggtagtca

SEQ ID NO: 114800 - DNA, 25 bp, Mus musculus
acccttgggcgttcacaggtagtca

SEQ ID NO: 114801 - DNA, 25 bp, Mus musculus
acccttgggctaaatgacctatggc

SEQ ID NO: 114802 - DNA, 25 bp, Mus musculus
acccttgggctatatgacctatggc

SEQ ID NO: 114803 - DNA, 25 bp, Mus musculus
acccttgggtacctgtgcatattaa

SEQ ID NO: 114804 - DNA, 25 bp, Mus musculus
acccttgggtacgtgtgcatattaa

SEQ ID NO: 114805 - DNA, 25 bp, Mus musculus
acccttgggtgtatgctgtcatgac

SEQ ID NO: 114806 - DNA, 25 bp, Mus musculus
acccttgggtgtttgctgtcatgac

SEQ ID NO: 114807 - DNA, 25 bp, Mus musculus
acccttgggttgaggctcattgact

SEQ ID NO: 114808 - DNA, 25 bp, Mus musculus
acccttgggttgctgagctcacatt

SEQ ID NO: 114809 - DNA, 25 bp, Mus musculus
acccttgggttggtgagctcacatt

SEQ ID NO: 114810 - DNA, 25 bp, Mus musculus
acccttgggttgtggctcattgact

SEQ ID NO: 114811 - DNA, 25 bp, Mus musculus
acccttggtcctcaatagtggagtt

SEQ ID NO: 114812 - DNA, 25 bp, Mus musculus
acccttggtcctgaatagtggagtt

SEQ ID NO: 114813 - DNA, 25 bp, Mus musculus
acccttggtctgagtgcaaacgttg

SEQ ID NO: 114814 - DNA, 25 bp, Mus musculus
acccttggtctgtgtgcaaacgttg

SEQ ID NO: 114815 - DNA, 25 bp, Mus musculus
acccttggtttgatctctggttcca

SEQ ID NO: 114816 - DNA, 25 bp, Mus musculus
acccttggtttgttctctggttcca

SEQ ID NO: 114817 - DNA, 25 bp, Mus musculus
acccttgtaaaactgtctccctgca

SEQ ID NO: 114818 - DNA, 25 bp, Mus musculus
acccttgtaaaagtgtctccctgca

SEQ ID NO: 114819 - DNA, 25 bp, Mus musculus
acccttgtccttcagctgagacagg

SEQ ID NO: 114820 - DNA, 25 bp, Mus musculus
acccttgtccttgagctgagacagg

SEQ ID NO: 114821 - DNA, 25 bp, Mus musculus
acccttgtgattccctcaaaaccaa

SEQ ID NO: 114822 - DNA, 25 bp, Mus musculus
acccttgtgattcttagtgcatagt

SEQ ID NO: 114823 - DNA, 25 bp, Mus musculus
acccttgtgattgcctcaaaaccaa

SEQ ID NO: 114824 - DNA, 25 bp, Mus musculus
acccttgtgattgttagtgcatagt

SEQ ID NO: 114825 - DNA, 25 bp, Mus musculus
acccttgtgtctcagtatctctgct

SEQ ID NO: 114826 - DNA, 25 bp, Mus musculus
acccttgtgtctgagtatctctgct

SEQ ID NO: 114827 - DNA, 25 bp, Mus musculus
acccttgtgttgctgtcctgcctgt

SEQ ID NO: 114828 - DNA, 25 bp, Mus musculus
acccttgtgttggtgtcctgcctgt

SEQ ID NO: 114829 - DNA, 25 bp, Mus musculus
acccttgttaatcgtgtgcccgtgc

SEQ ID NO: 114830 - DNA, 25 bp, Mus musculus
acccttgttaatggtgtgcccgtgc

SEQ ID NO: 114831 - DNA, 25 bp, Mus musculus
acccttgttagacggtgtgcggcaa

SEQ ID NO: 114832 - DNA, 25 bp, Mus musculus
acccttgttagagggtgtgcggcaa

SEQ ID NO: 114833 - DNA, 25 bp, Mus musculus
acccttgttattagactggcttatt

SEQ ID NO: 114834 - DNA, 25 bp, Mus musculus
acccttgttatttgactggcttatt

SEQ ID NO: 114835 - DNA, 25 bp, Mus musculus
acccttgttgctattctgcatgatg

SEQ ID NO: 114836 - DNA, 25 bp, Mus musculus
acccttgttgcttttctgcatgatg

SEQ ID NO: 114837 - DNA, 25 bp, Mus musculus
acccttgttgttaatcctcatttgc

SEQ ID NO: 114838 - DNA, 25 bp, Mus musculus
acccttgttgtttatcctcatttgc

SEQ ID NO: 114839 - DNA, 25 bp, Mus musculus
accctttacttaagcacctgttgaa

SEQ ID NO: 114840 - DNA, 25 bp, Mus musculus
accctttacttatgcacctgttgaa

SEQ ID NO: 114841 - DNA, 25 bp, Mus musculus
accctttatagtcatggattggatt

SEQ ID NO: 114842 - DNA, 25 bp, Mus musculus
accctttatagtgatggattggatt

SEQ ID NO: 114843 - DNA, 25 bp, Mus musculus
accctttatggaagcagccctttag

SEQ ID NO: 114844 - DNA, 25 bp, Mus musculus
accctttatggatgcagccctttag

SEQ ID NO: 114845 - DNA, 25 bp, Mus musculus
accctttcagttaacattgtgacat

SEQ ID NO: 114846 - DNA, 25 bp, Mus musculus
accctttcagtttacattgtgacat

SEQ ID NO: 114847 - DNA, 25 bp, Mus musculus
accctttcgcagataagacacctaa

SEQ ID NO: 114848 - DNA, 25 bp, Mus musculus
accctttcgcagttaagacacctaa

SEQ ID NO: 114849 - DNA, 25 bp, Mus musculus
accctttctgtgactgttggagtga

SEQ ID NO: 114850 - DNA, 25 bp, Mus musculus
accctttctgtgtctgttggagtga

SEQ ID NO: 114851 - DNA, 25 bp, Mus musculus
accctttgaaaaactctgcttatga

SEQ ID NO: 114852 - DNA, 25 bp, Mus musculus
accctttgaaaatctctgcttatga

SEQ ID NO: 114853 - DNA, 25 bp, Mus musculus
accctttgacttcagattttcagga

SEQ ID NO: 114854 - DNA, 25 bp, Mus musculus
accctttgacttgagattttcagga

SEQ ID NO: 114855 - DNA, 25 bp, Mus musculus
accctttgagtcctcttgcattttg

SEQ ID NO: 114856 - DNA, 25 bp, Mus musculus
accctttgagtcgtcttgcattttg

SEQ ID NO: 114857 - DNA, 25 bp, Mus musculus
accctttgagttagtgtcctgagac

SEQ ID NO: 114858 - DNA, 25 bp, Mus musculus
accctttgagtttgtgtcctgagac

SEQ ID NO: 114859 - DNA, 25 bp, Mus musculus
accctttgatgaccgagaggcgcaa

SEQ ID NO: 114860 - DNA, 25 bp, Mus musculus
accctttgatgagcgagaggcgcaa

SEQ ID NO: 114861 - DNA, 25 bp, Mus musculus
accctttgatttctctcagagctgc

SEQ ID NO: 114862 - DNA, 25 bp, Mus musculus
accctttgatttgtctcagagctgc

SEQ ID NO: 114863 - DNA, 25 bp, Mus musculus
accctttgcctcacgggagaagcag

SEQ ID NO: 114864 - DNA, 25 bp, Mus musculus
accctttgcctctcgggagaagcag

SEQ ID NO: 114865 - DNA, 25 bp, Mus musculus
accctttggatgctaagctcgtgtc

SEQ ID NO: 114866 - DNA, 25 bp, Mus musculus
accctttggatggtaagctcgtgtc

SEQ ID NO: 114867 - DNA, 25 bp, Mus musculus
accctttggcggaccttttgatgtg

SEQ ID NO: 114868 - DNA, 25 bp, Mus musculus
accctttggcggtccttttgatgtg

SEQ ID NO: 114869 - DNA, 25 bp, Mus musculus
accctttggtgtatggcgtgtctgg

SEQ ID NO: 114870 - DNA, 25 bp, Mus musculus
accctttggtgtttggcgtgtctgg

SEQ ID NO: 114871 - DNA, 25 bp, Mus musculus
accctttggttgatgttagcttctc

SEQ ID NO: 114872 - DNA, 25 bp, Mus musculus
accctttggttgttgttagcttctc

SEQ ID NO: 114873 - DNA, 25 bp, Mus musculus
accctttgtaccaggacaggtgaca

SEQ ID NO: 114874 - DNA, 25 bp, Mus musculus
accctttgtacctggacaggtgaca

SEQ ID NO: 114875 - DNA, 25 bp, Mus musculus
accctttgtcacctcatttcattgt

SEQ ID NO: 114876 - DNA, 25 bp, Mus musculus
accctttgtcacgtcatttcattgt

SEQ ID NO: 114877 - DNA, 25 bp, Mus musculus
accctttgtccacccgagactagag

SEQ ID NO: 114878 - DNA, 25 bp, Mus musculus
accctttgtccagccgagactagag

SEQ ID NO: 114879 - DNA, 25 bp, Mus musculus
accctttgtggactccagggctttg

SEQ ID NO: 114880 - DNA, 25 bp, Mus musculus
accctttgtggagtccagggctttg

SEQ ID NO: 114881 - DNA, 25 bp, Mus musculus
acccttttcctgactgtttgtatca

SEQ ID NO: 114882 - DNA, 25 bp, Mus musculus
acccttttcctgtctgtttgtatca

SEQ ID NO: 114883 - DNA, 25 bp, Mus musculus
acccttttctcccttgcgatagaga

SEQ ID NO: 114884 - DNA, 25 bp, Mus musculus
acccttttctccgttgcgatagaga

SEQ ID NO: 114885 - DNA, 25 bp, Mus musculus
acccttttctgcacaagctgtagca

SEQ ID NO: 114886 - DNA, 25 bp, Mus musculus
acccttttctgctcaagctgtagca

SEQ ID NO: 114887 - DNA, 25 bp, Mus musculus
acccttttggaaacatgatttgtat

SEQ ID NO: 114888 - DNA, 25 bp, Mus musculus
acccttttggaatcatgatttgtat

SEQ ID NO: 114889 - DNA, 25 bp, Mus musculus
acccttttttcaagacctctgagga

SEQ ID NO: 114890 - DNA, 25 bp, Mus musculus
acccttttttcatgacctctgagga

SEQ ID NO: 114891 - DNA, 25 bp, Mus musculus
accgaaaagcacaaagtctcttctg

SEQ ID NO: 114892 - DNA, 25 bp, Mus musculus
accgaaaagcactaagtctcttctg

SEQ ID NO: 114893 - DNA, 25 bp, Mus musculus
accgaaacagctcttttcacaatag

SEQ ID NO: 114894 - DNA, 25 bp, Mus musculus
accgaaacagctgttttcacaatag

SEQ ID NO: 114895 - DNA, 25 bp, Mus musculus
accgaaacctccagggccaagtgat

SEQ ID NO: 114896 - DNA, 25 bp, Mus musculus
accgaaacctcctgggccaagtgat

SEQ ID NO: 114897 - DNA, 25 bp, Mus musculus
accgaaattttcatcaaaagcagtg

SEQ ID NO: 114898 - DNA, 25 bp, Mus musculus
accgaaattttcttcaaaagcagtg

SEQ ID NO: 114899 - DNA, 25 bp, Mus musculus
accgaactgtctattctttaatact

SEQ ID NO: 114900 - DNA, 25 bp, Mus musculus
accgaactgtcttttctttaatact

SEQ ID NO: 114901 - DNA, 25 bp, Mus musculus
accgaactgtgtcaggcctgcggcc

SEQ ID NO: 114902 - DNA, 25 bp, Mus musculus
accgaactgtgtgaggcctgcggcc

SEQ ID NO: 114903 - DNA, 25 bp, Mus musculus
accgaagagcagcatcgagaagccg

SEQ ID NO: 114904 - DNA, 25 bp, Mus musculus
accgaagagcaggatcgagaagccg

SEQ ID NO: 114905 - DNA, 25 bp, Mus musculus
accgaagagccaagttccgcaggaa

SEQ ID NO: 114906 - DNA, 25 bp, Mus musculus
accgaagagccatgttccgcaggaa

SEQ ID NO: 114907 - DNA, 25 bp, Mus musculus
accgaagccagtctcagtttatgtt

SEQ ID NO: 114908 - DNA, 25 bp, Mus musculus
accgaagccagtgtcagtttatgtt

SEQ ID NO: 114909 - DNA, 25 bp, Mus musculus
accgaagcctacatctcagtggagg

SEQ ID NO: 114910 - DNA, 25 bp, Mus musculus
accgaagcctacttctcagtggagg

SEQ ID NO: 114911 - DNA, 25 bp, Mus musculus
accgaagcgcccagcgagggtagaa

SEQ ID NO: 114912 - DNA, 25 bp, Mus musculus
accgaagcgccctgcgagggtagaa

SEQ ID NO: 114913 - DNA, 25 bp, Mus musculus
accgaaggctttcttctcgttgtca

SEQ ID NO: 114914 - DNA, 25 bp, Mus musculus
accgaaggctttgttctcgttgtca

SEQ ID NO: 114915 - DNA, 25 bp, Mus musculus
accgaagtcactcgtacaagcgcag

SEQ ID NO: 114916 - DNA, 25 bp, Mus musculus
accgaagtcactggtacaagcgcag

SEQ ID NO: 114917 - DNA, 25 bp, Mus musculus
accgaagtggcaccgaccggcgcaa

SEQ ID NO: 114918 - DNA, 25 bp, Mus musculus
accgaagtggcagcgaccggcgcaa

SEQ ID NO: 114919 - DNA, 25 bp, Mus musculus
accgaagtttaacaggcagcctcct

SEQ ID NO: 114920 - DNA, 25 bp, Mus musculus
accgaagtttaagaggcagcctcct

SEQ ID NO: 114921 - DNA, 25 bp, Mus musculus
accgaatactttctggagatcatgg

SEQ ID NO: 114922 - DNA, 25 bp, Mus musculus
accgaatactttgtggagatcatgg

SEQ ID NO: 114923 - DNA, 25 bp, Mus musculus
accgaatccacccagtagtgttcta

SEQ ID NO: 114924 - DNA, 25 bp, Mus musculus
accgaatccaccgagtagtgttcta

SEQ ID NO: 114925 - DNA, 25 bp, Mus musculus
accgaatcgcagacattgctgactt

SEQ ID NO: 114926 - DNA, 25 bp, Mus musculus
accgaatcgcagtcattgctgactt

SEQ ID NO: 114927 - DNA, 25 bp, Mus musculus
accgaatggcaaagtcagagctgca

SEQ ID NO: 114928 - DNA, 25 bp, Mus musculus
accgaatggcaatgtcagagctgca

SEQ ID NO: 114929 - DNA, 25 bp, Mus musculus
accgaattccagattcgaatgccaa

SEQ ID NO: 114930 - DNA, 25 bp, Mus musculus
accgaattccagtttcgaatgccaa

SEQ ID NO: 114931 - DNA, 25 bp, Mus musculus
accgacaacctcaagatcatgactg

SEQ ID NO: 114932 - DNA, 25 bp, Mus musculus
accgacaacctctagatcatgactg

SEQ ID NO: 114933 - DNA, 25 bp, Mus musculus
accgacacgtggctgtgacaaacat

SEQ ID NO: 114934 - DNA, 25 bp, Mus musculus
accgacacgtgggtgtgacaaacat

SEQ ID NO: 114935 - DNA, 25 bp, Mus musculus
accgacactcggattagaccagatc

SEQ ID NO: 114936 - DNA, 25 bp, Mus musculus
accgacactcggtttagaccagatc

SEQ ID NO: 114937 - DNA, 25 bp, Mus musculus
accgacagccggaacgcttttgcca

SEQ ID NO: 114938 - DNA, 25 bp, Mus musculus
accgacagccggtacgcttttgcca

SEQ ID NO: 114939 - DNA, 25 bp, Mus musculus
accgacagtcgacggttatctggga

SEQ ID NO: 114940 - DNA, 25 bp, Mus musculus
accgacagtcgagggttatctggga

SEQ ID NO: 114941 - DNA, 25 bp, Mus musculus
accgacatccatagttttgttctga

SEQ ID NO: 114942 - DNA, 25 bp, Mus musculus
accgacatccatcctcaaggaaggt

SEQ ID NO: 114943 - DNA, 25 bp, Mus musculus
accgacatccatgctcaaggaaggt

SEQ ID NO: 114944 - DNA, 25 bp, Mus musculus
accgacatccattgttttgttctga

SEQ ID NO: 114945 - DNA, 25 bp, Mus musculus
accgacatccctctggtatgtttag

SEQ ID NO: 114946 - DNA, 25 bp, Mus musculus
accgacatccctgtggtatgtttag

SEQ ID NO: 114947 - DNA, 25 bp, Mus musculus
accgaccaagctctatgtgatcatc

SEQ ID NO: 114948 - DNA, 25 bp, Mus musculus
accgaccaagctgtatgtgatcatc

SEQ ID NO: 114949 - DNA, 25 bp, Mus musculus
accgaccctgatcgcattggcgttg

SEQ ID NO: 114950 - DNA, 25 bp, Mus musculus
accgaccctgatggcattggcgttg

SEQ ID NO: 114951 - DNA, 25 bp, Mus musculus
accgacctctatcgttccaaaggca

SEQ ID NO: 114952 - DNA, 25 bp, Mus musculus
accgacctctatggttccaaaggca

SEQ ID NO: 114953 - DNA, 25 bp, Mus musculus
accgacctgctgactgctgttggaa

SEQ ID NO: 114954 - DNA, 25 bp, Mus musculus
accgacctgctgtctgctgttggaa

SEQ ID NO: 114955 - DNA, 25 bp, Mus musculus
accgacgcatggactatgttgctac

SEQ ID NO: 114956 - DNA, 25 bp, Mus musculus
accgacgcatggtctatgttgctac

SEQ ID NO: 114957 - DNA, 25 bp, Mus musculus
accgacgctgacagggatggtgcct

SEQ ID NO: 114958 - DNA, 25 bp, Mus musculus
accgacgctgactgggatggtgcct

SEQ ID NO: 114959 - DNA, 25 bp, Mus musculus
accgacgtgcgacatgtggacatct

SEQ ID NO: 114960 - DNA, 25 bp, Mus musculus
accgacgtgcgagatgtggacatct

SEQ ID NO: 114961 - DNA, 25 bp, Mus musculus
accgacgttaccacgggtgttcatg

SEQ ID NO: 114962 - DNA, 25 bp, Mus musculus
accgacgttacctcgggtgttcatg

SEQ ID NO: 114963 - DNA, 25 bp, Mus musculus
accgacgttccccactcccagcgtg

SEQ ID NO: 114964 - DNA, 25 bp, Mus musculus
accgacgttcccgactcccagcgtg

SEQ ID NO: 114965 - DNA, 25 bp, Mus musculus
accgactcgttcacacatgtggctt

SEQ ID NO: 114966 - DNA, 25 bp, Mus musculus
accgactcgttctcacatgtggctt

SEQ ID NO: 114967 - DNA, 25 bp, Mus musculus
accgacttcaccagataccgttaag

SEQ ID NO: 114968 - DNA, 25 bp, Mus musculus
accgacttcacctgataccgttaag

SEQ ID NO: 114969 - DNA, 25 bp, Mus musculus
accgagaagtcaatggccttcccat

SEQ ID NO: 114970 - DNA, 25 bp, Mus musculus
accgagaagtcattggccttcccat

SEQ ID NO: 114971 - DNA, 25 bp, Mus musculus
accgagaataaccttgagcttttga

SEQ ID NO: 114972 - DNA, 25 bp, Mus musculus
accgagaataacgttgagcttttga

SEQ ID NO: 114973 - DNA, 25 bp, Mus musculus
accgagaatgttccccaaggctgca

SEQ ID NO: 114974 - DNA, 25 bp, Mus musculus
accgagaatgttgcccaaggctgca

SEQ ID NO: 114975 - DNA, 25 bp, Mus musculus
accgagacagtacttttccatgagg

SEQ ID NO: 114976 - DNA, 25 bp, Mus musculus
accgagacagtagttttccatgagg

SEQ ID NO: 114977 - DNA, 25 bp, Mus musculus
accgagaccgtgatcgggatcgaga

SEQ ID NO: 114978 - DNA, 25 bp, Mus musculus
accgagaccgtgttcgggatcgaga

SEQ ID NO: 114979 - DNA, 25 bp, Mus musculus
accgagactccgaggagattgaatg

SEQ ID NO: 114980 - DNA, 25 bp, Mus musculus
accgagactccgtggagattgaatg

SEQ ID NO: 114981 - DNA, 25 bp, Mus musculus
accgagagatggcttgcacaccaaa

SEQ ID NO: 114982 - DNA, 25 bp, Mus musculus
accgagagatgggttgcacaccaaa

SEQ ID NO: 114983 - DNA, 25 bp, Mus musculus
accgagatcctcaaggcgttgatgt

SEQ ID NO: 114984 - DNA, 25 bp, Mus musculus
accgagatcctctaggcgttgatgt

SEQ ID NO: 114985 - DNA, 25 bp, Mus musculus
accgagatgcctcttgtcggaagca

SEQ ID NO: 114986 - DNA, 25 bp, Mus musculus
accgagatgcctgttgtcggaagca

SEQ ID NO: 114987 - DNA, 25 bp, Mus musculus
accgagatttcacgttagcgataat

SEQ ID NO: 114988 - DNA, 25 bp, Mus musculus
accgagatttcaggttagcgataat

SEQ ID NO: 114989 - DNA, 25 bp, Mus musculus
accgagcaacacaagccgctgtaca

SEQ ID NO: 114990 - DNA, 25 bp, Mus musculus
accgagcaacactagccgctgtaca

SEQ ID NO: 114991 - DNA, 25 bp, Mus musculus
accgagcaattcctggcactgattg

SEQ ID NO: 114992 - DNA, 25 bp, Mus musculus
accgagcaattcgtggcactgattg

SEQ ID NO: 114993 - DNA, 25 bp, Mus musculus
accgagcagatgatagactacgtac

SEQ ID NO: 114994 - DNA, 25 bp, Mus musculus
accgagcagatgttagactacgtac

SEQ ID NO: 114995 - DNA, 25 bp, Mus musculus
accgagcagggcctaagaagcatta

SEQ ID NO: 114996 - DNA, 25 bp, Mus musculus
accgagcagggcgtaagaagcatta

SEQ ID NO: 114997 - DNA, 25 bp, Mus musculus
accgagccagcactgacatgtgaca

SEQ ID NO: 114998 - DNA, 25 bp, Mus musculus
accgagccagcagtgacatgtgaca

SEQ ID NO: 114999 - DNA, 25 bp, Mus musculus
accgagcccgagcagtagtcgtctt

SEQ ID NO: 115000 - DNA, 25 bp, Mus musculus
accgagcccgaggagtagtcgtctt

SEQ ID NO: 115001 - DNA, 25 bp, Mus musculus
accgagcctctcctaaaggttgagc

SEQ ID NO: 115002 - DNA, 25 bp, Mus musculus
accgagcctctcgtaaaggttgagc

SEQ ID NO: 115003 - DNA, 25 bp, Mus musculus
accgagctgctgattttgttctcac

SEQ ID NO: 115004 - DNA, 25 bp, Mus musculus
accgagctgctgtttttgttctcac

SEQ ID NO: 115005 - DNA, 25 bp, Mus musculus
accgagctgtatagcctttctatta

SEQ ID NO: 115006 - DNA, 25 bp, Mus musculus
accgagctgtattgcctttctatta

SEQ ID NO: 115007 - DNA, 25 bp, Mus musculus
accgaggacttcaggcgcatgttat

SEQ ID NO: 115008 - DNA, 25 bp, Mus musculus
accgaggacttctggcgcatgttat

SEQ ID NO: 115009 - DNA, 25 bp, Mus musculus
accgagggacagcagcgctcacaat

SEQ ID NO: 115010 - DNA, 25 bp, Mus musculus
accgagggacaggagcgctcacaat

SEQ ID NO: 115011 - DNA, 25 bp, Mus musculus
accgagggagacactagttgacaaa

SEQ ID NO: 115012 - DNA, 25 bp, Mus musculus
accgagggagactctagttgacaaa

SEQ ID NO: 115013 - DNA, 25 bp, Mus musculus
accgagggtcccagaggaccaatgt

SEQ ID NO: 115014 - DNA, 25 bp, Mus musculus
accgagggtccctgaggaccaatgt

SEQ ID NO: 115015 - DNA, 25 bp, Mus musculus
accgaggtcatgacattaggaagtc

SEQ ID NO: 115016 - DNA, 25 bp, Mus musculus
accgaggtcatgtcattaggaagtc

SEQ ID NO: 115017 - DNA, 25 bp, Mus musculus
accgaggtcttcactgttggggaca

SEQ ID NO: 115018 - DNA, 25 bp, Mus musculus
accgaggtcttctctgttggggaca

SEQ ID NO: 115019 - DNA, 25 bp, Mus musculus
accgaggtgactatgactggactga

SEQ ID NO: 115020 - DNA, 25 bp, Mus musculus
accgaggtgactttgactggactga

SEQ ID NO: 115021 - DNA, 25 bp, Mus musculus
accgaggtggctacagccgatttgc

SEQ ID NO: 115022 - DNA, 25 bp, Mus musculus
accgaggtggcttcagccgatttgc

SEQ ID NO: 115023 - DNA, 25 bp, Mus musculus
accgaggttcagcagctcatgcagc

SEQ ID NO: 115024 - DNA, 25 bp, Mus musculus
accgaggttcaggagctcatgcagc

SEQ ID NO: 115025 - DNA, 25 bp, Mus musculus
accgagtcagggatgagtcagctac

SEQ ID NO: 115026 - DNA, 25 bp, Mus musculus
accgagtcagggttgagtcagctac

SEQ ID NO: 115027 - DNA, 25 bp, Mus musculus
accgagtctcctctgtactgaggat

SEQ ID NO: 115028 - DNA, 25 bp, Mus musculus
accgagtctcctgtgtactgaggat

SEQ ID NO: 115029 - DNA, 25 bp, Mus musculus
accgagtcttagagcaggctcgctt

SEQ ID NO: 115030 - DNA, 25 bp, Mus musculus
accgagtcttagtgcaggctcgctt

SEQ ID NO: 115031 - DNA, 25 bp, Mus musculus
accgagtgatcaccagagaatccat

SEQ ID NO: 115032 - DNA, 25 bp, Mus musculus
accgagtgatcagcagagaatccat

SEQ ID NO: 115033 - DNA, 25 bp, Mus musculus
accgagtggcgtactatggcgtccg

SEQ ID NO: 115034 - DNA, 25 bp, Mus musculus
accgagtggcgttctatggcgtccg

SEQ ID NO: 115035 - DNA, 25 bp, Mus musculus
accgagtgtctgaacttgagtgggc

SEQ ID NO: 115036 - DNA, 25 bp, Mus musculus
accgagtgtctgtacttgagtgggc

SEQ ID NO: 115037 - DNA, 25 bp, Mus musculus
accgagttcttgattgaagtctctg

SEQ ID NO: 115038 - DNA, 25 bp, Mus musculus
accgagttcttgtttgaagtctctg

SEQ ID NO: 115039 - DNA, 25 bp, Mus musculus
accgagttgattattatctgagcgc

SEQ ID NO: 115040 - DNA, 25 bp, Mus musculus
accgagttgatttttatctgagcgc

SEQ ID NO: 115041 - DNA, 25 bp, Mus musculus
accgagttgtaaatcaggagatgct

SEQ ID NO: 115042 - DNA, 25 bp, Mus musculus
accgagttgtaattcaggagatgct

SEQ ID NO: 115043 - DNA, 25 bp, Mus musculus
accgataatcttctcttctttacag

SEQ ID NO: 115044 - DNA, 25 bp, Mus musculus
accgataatcttgtcttctttacag

SEQ ID NO: 115045 - DNA, 25 bp, Mus musculus
accgatacatcaatgacaaatttag

SEQ ID NO: 115046 - DNA, 25 bp, Mus musculus
accgatacatcattgacaaatttag

SEQ ID NO: 115047 - DNA, 25 bp, Mus musculus
accgatcataggaccacagaccatg

SEQ ID NO: 115048 - DNA, 25 bp, Mus musculus
accgatcataggtccacagaccatg

SEQ ID NO: 115049 - DNA, 25 bp, Mus musculus
accgatcccagaccttacactgaaa

SEQ ID NO: 115050 - DNA, 25 bp, Mus musculus
accgatcccagagcttacactgaaa

SEQ ID NO: 115051 - DNA, 25 bp, Mus musculus
accgatcccggcaggactcgaggag

SEQ ID NO: 115052 - DNA, 25 bp, Mus musculus
accgatcccggctggactcgaggag

SEQ ID NO: 115053 - DNA, 25 bp, Mus musculus
accgatccctgacctattgctagga

SEQ ID NO: 115054 - DNA, 25 bp, Mus musculus
accgatccctgagctattgctagga

SEQ ID NO: 115055 - DNA, 25 bp, Mus musculus
accgatcctcccaaggagatctcaa

SEQ ID NO: 115056 - DNA, 25 bp, Mus musculus
accgatcctccctaggagatctcaa

SEQ ID NO: 115057 - DNA, 25 bp, Mus musculus
accgatctccgcaagggtgcacgac

SEQ ID NO: 115058 - DNA, 25 bp, Mus musculus
accgatctccgctagggtgcacgac

SEQ ID NO: 115059 - DNA, 25 bp, Mus musculus
accgatctgattctgtgttgaaggc

SEQ ID NO: 115060 - DNA, 25 bp, Mus musculus
accgatctgattgtgtgttgaaggc

SEQ ID NO: 115061 - DNA, 25 bp, Mus musculus
accgatctttcacaggtcttgagtt

SEQ ID NO: 115062 - DNA, 25 bp, Mus musculus
accgatctttcagaggtcttgagtt

SEQ ID NO: 115063 - DNA, 25 bp, Mus musculus
accgatgagtgaagtggctgcaact

SEQ ID NO: 115064 - DNA, 25 bp, Mus musculus
accgatgagtgatgtggctgcaact

SEQ ID NO: 115065 - DNA, 25 bp, Mus musculus
accgatgatatgacacaccttacct

SEQ ID NO: 115066 - DNA, 25 bp, Mus musculus
accgatgatatgtcacaccttacct

SEQ ID NO: 115067 - DNA, 25 bp, Mus musculus
accgatgatgagctagtctacaaca

SEQ ID NO: 115068 - DNA, 25 bp, Mus musculus
accgatgatgaggtagtctacaaca

SEQ ID NO: 115069 - DNA, 25 bp, Mus musculus
accgatgcaatccacagaggtcgcg

SEQ ID NO: 115070 - DNA, 25 bp, Mus musculus
accgatgcaatcgacagaggtcgcg

SEQ ID NO: 115071 - DNA, 25 bp, Mus musculus
accgatgcatctaacctttttcaac

SEQ ID NO: 115072 - DNA, 25 bp, Mus musculus
accgatgcatcttacctttttcaac

SEQ ID NO: 115073 - DNA, 25 bp, Mus musculus
accgatgcttctattctatcctttt

SEQ ID NO: 115074 - DNA, 25 bp, Mus musculus
accgatgcttcttttctatcctttt

SEQ ID NO: 115075 - DNA, 25 bp, Mus musculus
accgatggcattccctttgccctga

SEQ ID NO: 115076 - DNA, 25 bp, Mus musculus
accgatggcattgcctttgccctga

SEQ ID NO: 115077 - DNA, 25 bp, Mus musculus
accgatggctctctggacgtggtgg

SEQ ID NO: 115078 - DNA, 25 bp, Mus musculus
accgatggctctgtggacgtggtgg

SEQ ID NO: 115079 - DNA, 25 bp, Mus musculus
accgatggctggcaatcttggattc

SEQ ID NO: 115080 - DNA, 25 bp, Mus musculus
accgatggctgggaatcttggattc

SEQ ID NO: 115081 - DNA, 25 bp, Mus musculus
accgatggtgaaacccctctgaggg

SEQ ID NO: 115082 - DNA, 25 bp, Mus musculus
accgatggtgaatcccctctgaggg

SEQ ID NO: 115083 - DNA, 25 bp, Mus musculus
accgatggtgacaatccgttgctgt

SEQ ID NO: 115084 - DNA, 25 bp, Mus musculus
accgatggtgactatccgttgctgt

SEQ ID NO: 115085 - DNA, 25 bp, Mus musculus
accgattaatgtatcgccacaataa

SEQ ID NO: 115086 - DNA, 25 bp, Mus musculus
accgattaatgtttcgccacaataa

SEQ ID NO: 115087 - DNA, 25 bp, Mus musculus
accgattcactgaccctttagagac

SEQ ID NO: 115088 - DNA, 25 bp, Mus musculus
accgattcactgtccctttagagac

SEQ ID NO: 115089 - DNA, 25 bp, Mus musculus
accgatttcctacttgaccaggaat

SEQ ID NO: 115090 - DNA, 25 bp, Mus musculus
accgatttcctagttgaccaggaat

SEQ ID NO: 115091 - DNA, 25 bp, Mus musculus
accgattttatcacgaggagctcaa

SEQ ID NO: 115092 - DNA, 25 bp, Mus musculus
accgattttatctcgaggagctcaa

SEQ ID NO: 115093 - DNA, 25 bp, Mus musculus
accgcaaactcccagtcatgcgaat

SEQ ID NO: 115094 - DNA, 25 bp, Mus musculus
accgcaaactccgagtcatgcgaat

SEQ ID NO: 115095 - DNA, 25 bp, Mus musculus
accgcaagaacgagctgaggctgca

SEQ ID NO: 115096 - DNA, 25 bp, Mus musculus
accgcaagaacgtgctgaggctgca

SEQ ID NO: 115097 - DNA, 25 bp, Mus musculus
accgcaaggctgagcagaggtttcc

SEQ ID NO: 115098 - DNA, 25 bp, Mus musculus
accgcaaggctgtgcagaggtttcc

SEQ ID NO: 115099 - DNA, 25 bp, Mus musculus
accgcaagtctgctgaagaggcctt

SEQ ID NO: 115100 - DNA, 25 bp, Mus musculus
accgcaagtctggtgaagaggcctt

SEQ ID NO: 115101 - DNA, 25 bp, Mus musculus
accgcaagttgtcgtggtgcagttt

SEQ ID NO: 115102 - DNA, 25 bp, Mus musculus
accgcaagttgtggtggtgcagttt

SEQ ID NO: 115103 - DNA, 25 bp, Mus musculus
accgcacaagggaacctgagaggag

SEQ ID NO: 115104 - DNA, 25 bp, Mus musculus
accgcacaagggtacctgagaggag

SEQ ID NO: 115105 - DNA, 25 bp, Mus musculus
accgcacacctgcttcatgagttaa

SEQ ID NO: 115106 - DNA, 25 bp, Mus musculus
accgcacacctggttcatgagttaa

SEQ ID NO: 115107 - DNA, 25 bp, Mus musculus
accgcacagatcacagtgggtcaca

SEQ ID NO: 115108 - DNA, 25 bp, Mus musculus
accgcacagatctcagtgggtcaca

SEQ ID NO: 115109 - DNA, 25 bp, Mus musculus
accgcacgcaggaggaagctggttt

SEQ ID NO: 115110 - DNA, 25 bp, Mus musculus
accgcacgcaggtggaagctggttt

SEQ ID NO: 115111 - DNA, 25 bp, Mus musculus
accgcacgcgacaggccgaactggg

SEQ ID NO: 115112 - DNA, 25 bp, Mus musculus
accgcacgcgactggccgaactggg

SEQ ID NO: 115113 - DNA, 25 bp, Mus musculus
accgcacggtgtacgagtcgctgga

SEQ ID NO: 115114 - DNA, 25 bp, Mus musculus
accgcacggtgttcgagtcgctgga

SEQ ID NO: 115115 - DNA, 25 bp, Mus musculus
accgcacgtgccctggtgtaagtaa

SEQ ID NO: 115116 - DNA, 25 bp, Mus musculus
accgcacgtgccgtggtgtaagtaa

SEQ ID NO: 115117 - DNA, 25 bp, Mus musculus
accgcactcagtcttcgtcctgtga

SEQ ID NO: 115118 - DNA, 25 bp, Mus musculus
accgcactcagtgttcgtcctgtga

SEQ ID NO: 115119 - DNA, 25 bp, Mus musculus
accgcactgtgcagaactcataggg

SEQ ID NO: 115120 - DNA, 25 bp, Mus musculus
accgcactgtgctgaactcataggg

SEQ ID NO: 115121 - DNA, 25 bp, Mus musculus
accgcacttggtaaaggcatcttgt

SEQ ID NO: 115122 - DNA, 25 bp, Mus musculus
accgcacttggttaaggcatcttgt

SEQ ID NO: 115123 - DNA, 25 bp, Mus musculus
accgcagaccatccaaagcagatag

SEQ ID NO: 115124 - DNA, 25 bp, Mus musculus
accgcagaccatgcaaagcagatag

SEQ ID NO: 115125 - DNA, 25 bp, Mus musculus
accgcagcacaaatcgcatttctag

SEQ ID NO: 115126 - DNA, 25 bp, Mus musculus
accgcagcacaattcgcatttctag

SEQ ID NO: 115127 - DNA, 25 bp, Mus musculus
accgcagcatatctggagatgaggc

SEQ ID NO: 115128 - DNA, 25 bp, Mus musculus
accgcagcatatgtggagatgaggc

SEQ ID NO: 115129 - DNA, 25 bp, Mus musculus
accgcagcatggaggaggtactagc

SEQ ID NO: 115130 - DNA, 25 bp, Mus musculus
accgcagcatggtggaggtactagc

SEQ ID NO: 115131 - DNA, 25 bp, Mus musculus
accgcagcctgacattatgctcaag

SEQ ID NO: 115132 - DNA, 25 bp, Mus musculus
accgcagcctgagattatgctcaag

SEQ ID NO: 115133 - DNA, 25 bp, Mus musculus
accgcagctcggaagagaccttttg

SEQ ID NO: 115134 - DNA, 25 bp, Mus musculus
accgcagctcggtagagaccttttg

SEQ ID NO: 115135 - DNA, 25 bp, Mus musculus
accgcagctctaacagaacttttat

SEQ ID NO: 115136 - DNA, 25 bp, Mus musculus
accgcagctctatcagaacttttat

SEQ ID NO: 115137 - DNA, 25 bp, Mus musculus
accgcaggatgaaagcccgggcgct

SEQ ID NO: 115138 - DNA, 25 bp, Mus musculus
accgcaggatgatagcccgggcgct

SEQ ID NO: 115139 - DNA, 25 bp, Mus musculus
accgcagtcatccacgcactgtgag

SEQ ID NO: 115140 - DNA, 25 bp, Mus musculus
accgcagtcatcgacgcactgtgag

SEQ ID NO: 115141 - DNA, 25 bp, Mus musculus
accgcagtccgtaccttggataagg

SEQ ID NO: 115142 - DNA, 25 bp, Mus musculus
accgcagtccgttccttggataagg

SEQ ID NO: 115143 - DNA, 25 bp, Mus musculus
accgcataaagtcggtggacacctg

SEQ ID NO: 115144 - DNA, 25 bp, Mus musculus
accgcataaagtgggtggacacctg

SEQ ID NO: 115145 - DNA, 25 bp, Mus musculus
accgcatcacggaagagtcagcatt

SEQ ID NO: 115146 - DNA, 25 bp, Mus musculus
accgcatcacggtagagtcagcatt

SEQ ID NO: 115147 - DNA, 25 bp, Mus musculus
accgcatcagcaaggcagactatgt

SEQ ID NO: 115148 - DNA, 25 bp, Mus musculus
accgcatcagcatggcagactatgt

SEQ ID NO: 115149 - DNA, 25 bp, Mus musculus
accgcatggcttcaggacgtcagga

SEQ ID NO: 115150 - DNA, 25 bp, Mus musculus
accgcatggcttctttgcaaacgct

SEQ ID NO: 115151 - DNA, 25 bp, Mus musculus
accgcatggcttgaggacgtcagga

SEQ ID NO: 115152 - DNA, 25 bp, Mus musculus
accgcatggcttgtttgcaaacgct

SEQ ID NO: 115153 - DNA, 25 bp, Mus musculus
accgcatgtatgagctagacttgaa

SEQ ID NO: 115154 - DNA, 25 bp, Mus musculus
accgcatgtatgtgctagacttgaa

SEQ ID NO: 115155 - DNA, 25 bp, Mus musculus
accgcattagcaatatggttccaat

SEQ ID NO: 115156 - DNA, 25 bp, Mus musculus
accgcattagcattatggttccaat

SEQ ID NO: 115157 - DNA, 25 bp, Mus musculus
accgcattgcccctggagaacagtg

SEQ ID NO: 115158 - DNA, 25 bp, Mus musculus
accgcattgcccgtggagaacagtg

SEQ ID NO: 115159 - DNA, 25 bp, Mus musculus
accgccaacgatcgaatccttaagt

SEQ ID NO: 115160 - DNA, 25 bp, Mus musculus
accgccaacgatggaatccttaagt

SEQ ID NO: 115161 - DNA, 25 bp, Mus musculus
accgccacgtgaaactgtctgagat

SEQ ID NO: 115162 - DNA, 25 bp, Mus musculus
accgccacgtgatactgtctgagat

SEQ ID NO: 115163 - DNA, 25 bp, Mus musculus
accgccagatcaacctggagttgta

SEQ ID NO: 115164 - DNA, 25 bp, Mus musculus
accgccagatcatcctggagttgta

SEQ ID NO: 115165 - DNA, 25 bp, Mus musculus
accgccagatgaaatcgaacagtcg

SEQ ID NO: 115166 - DNA, 25 bp, Mus musculus
accgccagatgatatcgaacagtcg

SEQ ID NO: 115167 - DNA, 25 bp, Mus musculus
accgccaggagaccgtacagctcga

SEQ ID NO: 115168 - DNA, 25 bp, Mus musculus
accgccaggagagcgtacagctcga

SEQ ID NO: 115169 - DNA, 25 bp, Mus musculus
accgccagtctaatgctaacatttg

SEQ ID NO: 115170 - DNA, 25 bp, Mus musculus
accgccagtctattgctaacatttg

SEQ ID NO: 115171 - DNA, 25 bp, Mus musculus
accgccagttctctaggtctgtgga

SEQ ID NO: 115172 - DNA, 25 bp, Mus musculus
accgccagttctgtaggtctgtgga

SEQ ID NO: 115173 - DNA, 25 bp, Mus musculus
accgccatggcccaggaaggcatag

SEQ ID NO: 115174 - DNA, 25 bp, Mus musculus
accgccatggccgaggaaggcatag

SEQ ID NO: 115175 - DNA, 25 bp, Mus musculus
accgccattcctacgtcctttctca

SEQ ID NO: 115176 - DNA, 25 bp, Mus musculus
accgccattccttcgtcctttctca

SEQ ID NO: 115177 - DNA, 25 bp, Mus musculus
accgccattttgattgtgaagtgcc

SEQ ID NO: 115178 - DNA, 25 bp, Mus musculus
accgccattttgtttgtgaagtgcc

SEQ ID NO: 115179 - DNA, 25 bp, Mus musculus
accgcccaagtgactgtgattgtgc

SEQ ID NO: 115180 - DNA, 25 bp, Mus musculus
accgcccaagtgtctgtgattgtgc

SEQ ID NO: 115181 - DNA, 25 bp, Mus musculus
accgcccatcttactgttttgacaa

SEQ ID NO: 115182 - DNA, 25 bp, Mus musculus
accgcccatctttctgttttgacaa

SEQ ID NO: 115183 - DNA, 25 bp, Mus musculus
accgccctacggagagtgaccattt

SEQ ID NO: 115184 - DNA, 25 bp, Mus musculus
accgccctacggtgagtgaccattt

SEQ ID NO: 115185 - DNA, 25 bp, Mus musculus
accgccctagtgcacgctgaaacat

SEQ ID NO: 115186 - DNA, 25 bp, Mus musculus
accgccctagtggacgctgaaacat

SEQ ID NO: 115187 - DNA, 25 bp, Mus musculus
accgccggcttaagaacacttgtgc

SEQ ID NO: 115188 - DNA, 25 bp, Mus musculus
accgccggcttatgaacacttgtgc

SEQ ID NO: 115189 - DNA, 25 bp, Mus musculus
accgccggtgaaaggtggctttgca

SEQ ID NO: 115190 - DNA, 25 bp, Mus musculus
accgccggtgaatggtggctttgca

SEQ ID NO: 115191 - DNA, 25 bp, Mus musculus
accgcctatgcaacctcatgtaagt

SEQ ID NO: 115192 - DNA, 25 bp, Mus musculus
accgcctatgcatcctcatgtaagt

SEQ ID NO: 115193 - DNA, 25 bp, Mus musculus
accgcctcaacaaggaggccatcaa

SEQ ID NO: 115194 - DNA, 25 bp, Mus musculus
accgcctcaacatggaggccatcaa

SEQ ID NO: 115195 - DNA, 25 bp, Mus musculus
accgcctcagtcatcctagatttta

SEQ ID NO: 115196 - DNA, 25 bp, Mus musculus
accgcctcagtcttcctagatttta

SEQ ID NO: 115197 - DNA, 25 bp, Mus musculus
accgcctctgccagctgtctgagaa

SEQ ID NO: 115198 - DNA, 25 bp, Mus musculus
accgcctctgcctgctgtctgagaa

SEQ ID NO: 115199 - DNA, 25 bp, Mus musculus
accgcctctggcagtaaaattactt

SEQ ID NO: 115200 - DNA, 25 bp, Mus musculus
accgcctctggctgtaaaattactt

SEQ ID NO: 115201 - DNA, 25 bp, Mus musculus
accgcctgaaggagcccgctgtgca

SEQ ID NO: 115202 - DNA, 25 bp, Mus musculus
accgcctgaaggtgcccgctgtgca

SEQ ID NO: 115203 - DNA, 25 bp, Mus musculus
accgcctgcagcagttgaagactct

SEQ ID NO: 115204 - DNA, 25 bp, Mus musculus
accgcctgcagctgttgaagactct

SEQ ID NO: 115205 - DNA, 25 bp, Mus musculus
accgcctgcagtatgggcgcgaaga

SEQ ID NO: 115206 - DNA, 25 bp, Mus musculus
accgcctgcagtttgggcgcgaaga

SEQ ID NO: 115207 - DNA, 25 bp, Mus musculus
accgcctggtatctgacattggagc

SEQ ID NO: 115208 - DNA, 25 bp, Mus musculus
accgcctggtatgtgacattggagc

SEQ ID NO: 115209 - DNA, 25 bp, Mus musculus
accgccttcatcatccaggtttcaa

SEQ ID NO: 115210 - DNA, 25 bp, Mus musculus
accgccttcatcttccaggtttcaa

SEQ ID NO: 115211 - DNA, 25 bp, Mus musculus
accgccttgtgtctagagagccatg

SEQ ID NO: 115212 - DNA, 25 bp, Mus musculus
accgccttgtgtgtagagagccatg

SEQ ID NO: 115213 - DNA, 25 bp, Mus musculus
accgcgagcaacacctgttggagga

SEQ ID NO: 115214 - DNA, 25 bp, Mus musculus
accgcgagcaactcctgttggagga

SEQ ID NO: 115215 - DNA, 25 bp, Mus musculus
accgcgaggtccaggacgccatcga

SEQ ID NO: 115216 - DNA, 25 bp, Mus musculus
accgcgaggtcctggacgccatcga

SEQ ID NO: 115217 - DNA, 25 bp, Mus musculus
accgcgcacacaaggtgtatgcata

SEQ ID NO: 115218 - DNA, 25 bp, Mus musculus
accgcgcacacatggtgtatgcata

SEQ ID NO: 115219 - DNA, 25 bp, Mus musculus
accgcgcaggctagacatctaggga

SEQ ID NO: 115220 - DNA, 25 bp, Mus musculus
accgcgcaggcttgacatctaggga

SEQ ID NO: 115221 - DNA, 25 bp, Mus musculus
accgcgcagtacacaacgtcaacgt

SEQ ID NO: 115222 - DNA, 25 bp, Mus musculus
accgcgcagtactcaacgtcaacgt

SEQ ID NO: 115223 - DNA, 25 bp, Mus musculus
accgcgcggctacaaggcagttctt

SEQ ID NO: 115224 - DNA, 25 bp, Mus musculus
accgcgcggctagaaggcagttctt

SEQ ID NO: 115225 - DNA, 25 bp, Mus musculus
accgcgctgttgatggcagctatga

SEQ ID NO: 115226 - DNA, 25 bp, Mus musculus
accgcgctgttgttggcagctatga

SEQ ID NO: 115227 - DNA, 25 bp, Mus musculus
accgcgcttttgcatgcccgggcga

SEQ ID NO: 115228 - DNA, 25 bp, Mus musculus
accgcgcttttggatgcccgggcga

SEQ ID NO: 115229 - DNA, 25 bp, Mus musculus
accgcggtgagacactgggcatcaa

SEQ ID NO: 115230 - DNA, 25 bp, Mus musculus
accgcggtgagagactgggcatcaa

SEQ ID NO: 115231 - DNA, 25 bp, Mus musculus
accgcggtgatgaggtacccaagga

SEQ ID NO: 115232 - DNA, 25 bp, Mus musculus
accgcggtgatgtggtacccaagga

SEQ ID NO: 115233 - DNA, 25 bp, Mus musculus
accgcgtaaccacagcttcttagga

SEQ ID NO: 115234 - DNA, 25 bp, Mus musculus
accgcgtaaccagagcttcttagga

SEQ ID NO: 115235 - DNA, 25 bp, Mus musculus
accgcgtcgtgtacagctgcaggaa

SEQ ID NO: 115236 - DNA, 25 bp, Mus musculus
accgcgtcgtgttcagctgcaggaa

SEQ ID NO: 115237 - DNA, 25 bp, Mus musculus
accgcgtggcacagacaactaagaa

SEQ ID NO: 115238 - DNA, 25 bp, Mus musculus
accgcgtggcactgacaactaagaa

SEQ ID NO: 115239 - DNA, 25 bp, Mus musculus
accgcgtggcctcaagatggcagtc

SEQ ID NO: 115240 - DNA, 25 bp, Mus musculus
accgcgtggcctgaagatggcagtc

SEQ ID NO: 115241 - DNA, 25 bp, Mus musculus
accgcgtggctgcacactgagagtc

SEQ ID NO: 115242 - DNA, 25 bp, Mus musculus
accgcgtggctggacactgagagtc

SEQ ID NO: 115243 - DNA, 25 bp, Mus musculus
accgcgtgtctgagggcttgttcaa

SEQ ID NO: 115244 - DNA, 25 bp, Mus musculus
accgcgtgtctgtgggcttgttcaa

SEQ ID NO: 115245 - DNA, 25 bp, Mus musculus
accgctaagtcccacgctaggtggc

SEQ ID NO: 115246 - DNA, 25 bp, Mus musculus
accgctaagtccgacgctaggtggc

SEQ ID NO: 115247 - DNA, 25 bp, Mus musculus
accgctacacagagagcttgtttaa

SEQ ID NO: 115248 - DNA, 25 bp, Mus musculus
accgctacacagtgagcttgtttaa

SEQ ID NO: 115249 - DNA, 25 bp, Mus musculus
accgctacagccatgatttcaactt

SEQ ID NO: 115250 - DNA, 25 bp, Mus musculus
accgctacagccttgatttcaactt

SEQ ID NO: 115251 - DNA, 25 bp, Mus musculus
accgctaccgaaatcaaaccagcct

SEQ ID NO: 115252 - DNA, 25 bp, Mus musculus
accgctaccgaattcaaaccagcct

SEQ ID NO: 115253 - DNA, 25 bp, Mus musculus
accgctacgacaagggcgcgctgca

SEQ ID NO: 115254 - DNA, 25 bp, Mus musculus
accgctacgacatgggcgcgctgca

SEQ ID NO: 115255 - DNA, 25 bp, Mus musculus
accgctcagcagataggtccatgta

SEQ ID NO: 115256 - DNA, 25 bp, Mus musculus
accgctcagcagttaggtccatgta

SEQ ID NO: 115257 - DNA, 25 bp, Mus musculus
accgctcagggaccttccatgttga

SEQ ID NO: 115258 - DNA, 25 bp, Mus musculus
accgctcagggagcttccatgttga

SEQ ID NO: 115259 - DNA, 25 bp, Mus musculus
accgctccgcacagagtagtttgaa

SEQ ID NO: 115260 - DNA, 25 bp, Mus musculus
accgctccgcactgagtagtttgaa

SEQ ID NO: 115261 - DNA, 25 bp, Mus musculus
accgctcttctcagtgaaacttgat

SEQ ID NO: 115262 - DNA, 25 bp, Mus musculus
accgctcttctctgtgaaacttgat

SEQ ID NO: 115263 - DNA, 25 bp, Mus musculus
accgctgcaaaaacagtggtggtgc

SEQ ID NO: 115264 - DNA, 25 bp, Mus musculus
accgctgcaaaatcagtggtggtgc

SEQ ID NO: 115265 - DNA, 25 bp, Mus musculus
accgctgccgggagcgcaaggaact

SEQ ID NO: 115266 - DNA, 25 bp, Mus musculus
accgctgccgggtgcgcaaggaact

SEQ ID NO: 115267 - DNA, 25 bp, Mus musculus
accgctgcctcgagtgtgtgaagac

SEQ ID NO: 115268 - DNA, 25 bp, Mus musculus
accgctgcctcgtgtgtgtgaagac

SEQ ID NO: 115269 - DNA, 25 bp, Mus musculus
accgctgcgcttcggatttgtgctg

SEQ ID NO: 115270 - DNA, 25 bp, Mus musculus
accgctgcgcttgggatttgtgctg

SEQ ID NO: 115271 - DNA, 25 bp, Mus musculus
accgctgctcaaaatctcaaagtgc

SEQ ID NO: 115272 - DNA, 25 bp, Mus musculus
accgctgctcaatatctcaaagtgc

SEQ ID NO: 115273 - DNA, 25 bp, Mus musculus
accgctgctgagctgtgtggacaca

SEQ ID NO: 115274 - DNA, 25 bp, Mus musculus
accgctgctgaggtgtgtggacaca

SEQ ID NO: 115275 - DNA, 25 bp, Mus musculus
accgctgctgtcatactggctgcac

SEQ ID NO: 115276 - DNA, 25 bp, Mus musculus
accgctgctgtcttactggctgcac

SEQ ID NO: 115277 - DNA, 25 bp, Mus musculus
accgctggtattctgggaggcctct

SEQ ID NO: 115278 - DNA, 25 bp, Mus musculus
accgctggtattgtgggaggcctct

SEQ ID NO: 115279 - DNA, 25 bp, Mus musculus
accgctggtgaaaggagtaccctaa

SEQ ID NO: 115280 - DNA, 25 bp, Mus musculus
accgctggtgaatggagtaccctaa

SEQ ID NO: 115281 - DNA, 25 bp, Mus musculus
accgctggtggcatcccgaatcgac

SEQ ID NO: 115282 - DNA, 25 bp, Mus musculus
accgctggtggcttcccgaatcgac

SEQ ID NO: 115283 - DNA, 25 bp, Mus musculus
accgctggttcacgatctgctcaaa

SEQ ID NO: 115284 - DNA, 25 bp, Mus musculus
accgctggttcaggatctgctcaaa

SEQ ID NO: 115285 - DNA, 25 bp, Mus musculus
accgctggttctcacatacatgtgc

SEQ ID NO: 115286 - DNA, 25 bp, Mus musculus
accgctggttctgacatacatgtgc

SEQ ID NO: 115287 - DNA, 25 bp, Mus musculus
accgctggttggctgaacagttgaa

SEQ ID NO: 115288 - DNA, 25 bp, Mus musculus
accgctggttgggtgaacagttgaa

SEQ ID NO: 115289 - DNA, 25 bp, Mus musculus
accgctgtcttgctatagctactaa

SEQ ID NO: 115290 - DNA, 25 bp, Mus musculus
accgctgtcttggtatagctactaa

SEQ ID NO: 115291 - DNA, 25 bp, Mus musculus
accgctgtgcaccttcagaagataa

SEQ ID NO: 115292 - DNA, 25 bp, Mus musculus
accgctgtgcacgttcagaagataa

SEQ ID NO: 115293 - DNA, 25 bp, Mus musculus
accgctgtgtaacacagtccgtgta

SEQ ID NO: 115294 - DNA, 25 bp, Mus musculus
accgctgtgtaagacagtccgtgta

SEQ ID NO: 115295 - DNA, 25 bp, Mus musculus
accgctgtgtgcaagataccatcaa

SEQ ID NO: 115296 - DNA, 25 bp, Mus musculus
accgctgtgtgctagataccatcaa

SEQ ID NO: 115297 - DNA, 25 bp, Mus musculus
accgctgttaggagcatcgagcacc

SEQ ID NO: 115298 - DNA, 25 bp, Mus musculus
accgctgttaggtgcatcgagcacc

SEQ ID NO: 115299 - DNA, 25 bp, Mus musculus
accgctgttctacgccatgaggaag

SEQ ID NO: 115300 - DNA, 25 bp, Mus musculus
accgctgttctaggccatgaggaag

SEQ ID NO: 115301 - DNA, 25 bp, Mus musculus
accgctgttcttccggagttcaatt

SEQ ID NO: 115302 - DNA, 25 bp, Mus musculus
accgctgttcttgcggagttcaatt

SEQ ID NO: 115303 - DNA, 25 bp, Mus musculus
accgcttcatgccactgaatacgtt

SEQ ID NO: 115304 - DNA, 25 bp, Mus musculus
accgcttcatgcgactgaatacgtt

SEQ ID NO: 115305 - DNA, 25 bp, Mus musculus
accgcttcctaaaccatttgcagaa

SEQ ID NO: 115306 - DNA, 25 bp, Mus musculus
accgcttcctaatccatttgcagaa

SEQ ID NO: 115307 - DNA, 25 bp, Mus musculus
accgcttcctgtctcattagtagtg

SEQ ID NO: 115308 - DNA, 25 bp, Mus musculus
accgcttcctgtgtcattagtagtg

SEQ ID NO: 115309 - DNA, 25 bp, Mus musculus
accgcttggactcttctttttagat

SEQ ID NO: 115310 - DNA, 25 bp, Mus musculus
accgcttggactgttctttttagat

SEQ ID NO: 115311 - DNA, 25 bp, Mus musculus
accgctttatttataatgcctgctt

SEQ ID NO: 115312 - DNA, 25 bp, Mus musculus
accgctttatttttaatgcctgctt

SEQ ID NO: 115313 - DNA, 25 bp, Mus musculus
accgctttgagaactgttatttcct

SEQ ID NO: 115314 - DNA, 25 bp, Mus musculus
accgctttgagatctgttatttcct

SEQ ID NO: 115315 - DNA, 25 bp, Mus musculus
accggaacatacatgcctgcaacat

SEQ ID NO: 115316 - DNA, 25 bp, Mus musculus
accggaacatacttgcctgcaacat

SEQ ID NO: 115317 - DNA, 25 bp, Mus musculus
accggaagaaaaagtgtttgtcatg

SEQ ID NO: 115318 - DNA, 25 bp, Mus musculus
accggaagaaaatgtgtttgtcatg

SEQ ID NO: 115319 - DNA, 25 bp, Mus musculus
accggaagccagcttcatgccaaat

SEQ ID NO: 115320 - DNA, 25 bp, Mus musculus
accggaagccaggttcatgccaaat

SEQ ID NO: 115321 - DNA, 25 bp, Mus musculus
accggaagccccaagtctgcagtga

SEQ ID NO: 115322 - DNA, 25 bp, Mus musculus
accggaagcccctagtctgcagtga

SEQ ID NO: 115323 - DNA, 25 bp, Mus musculus
accggaagcctgcttattgagctga

SEQ ID NO: 115324 - DNA, 25 bp, Mus musculus
accggaagcctggttattgagctga

SEQ ID NO: 115325 - DNA, 25 bp, Mus musculus
accggaagccttctggctggagctt

SEQ ID NO: 115326 - DNA, 25 bp, Mus musculus
accggaagccttgtggctggagctt

SEQ ID NO: 115327 - DNA, 25 bp, Mus musculus
accggaatctctctcagtagcctga

SEQ ID NO: 115328 - DNA, 25 bp, Mus musculus
accggaatctctgtcagtagcctga

SEQ ID NO: 115329 - DNA, 25 bp, Mus musculus
accggaatggacatgtggctgacta

SEQ ID NO: 115330 - DNA, 25 bp, Mus musculus
accggaatggacttgtggctgacta

SEQ ID NO: 115331 - DNA, 25 bp, Mus musculus
accggaatggatcccagcctctagt

SEQ ID NO: 115332 - DNA, 25 bp, Mus musculus
accggaatggatgccagcctctagt

SEQ ID NO: 115333 - DNA, 25 bp, Mus musculus
accggaatgttgattttgcacccct

SEQ ID NO: 115334 - DNA, 25 bp, Mus musculus
accggaatgttgtttttgcacccct

SEQ ID NO: 115335 - DNA, 25 bp, Mus musculus
accggacaccaccagagactaggat

SEQ ID NO: 115336 - DNA, 25 bp, Mus musculus
accggacaccacgagagactaggat

SEQ ID NO: 115337 - DNA, 25 bp, Mus musculus
accggacccggacaggatcttctgt

SEQ ID NO: 115338 - DNA, 25 bp, Mus musculus
accggacccggagaggatcttctgt

SEQ ID NO: 115339 - DNA, 25 bp, Mus musculus
accggaccgctgacttatctggaag

SEQ ID NO: 115340 - DNA, 25 bp, Mus musculus
accggaccgctgtcttatctggaag

SEQ ID NO: 115341 - DNA, 25 bp, Mus musculus
accggacgcattacagaggcggaaa

SEQ ID NO: 115342 - DNA, 25 bp, Mus musculus
accggacgcatttcagaggcggaaa

SEQ ID NO: 115343 - DNA, 25 bp, Mus musculus
accggactctcacagatgcgtttgg

SEQ ID NO: 115344 - DNA, 25 bp, Mus musculus
accggactctcagagatgcgtttgg

SEQ ID NO: 115345 - DNA, 25 bp, Mus musculus
accggactctgcctgaaaactgtat

SEQ ID NO: 115346 - DNA, 25 bp, Mus musculus
accggactctgcgtgaaaactgtat

SEQ ID NO: 115347 - DNA, 25 bp, Mus musculus
accggacttaacatcctgagtgcct

SEQ ID NO: 115348 - DNA, 25 bp, Mus musculus
accggacttaacttcctgagtgcct

SEQ ID NO: 115349 - DNA, 25 bp, Mus musculus
accggagacacgaaggcagcctgat

SEQ ID NO: 115350 - DNA, 25 bp, Mus musculus
accggagacacgtaggcagcctgat

SEQ ID NO: 115351 - DNA, 25 bp, Mus musculus
accggagactgaaggctctgcgcga

SEQ ID NO: 115352 - DNA, 25 bp, Mus musculus
accggagactgatggctctgcgcga

SEQ ID NO: 115353 - DNA, 25 bp, Mus musculus
accggagataaaatgcctttctcaa

SEQ ID NO: 115354 - DNA, 25 bp, Mus musculus
accggagataaattgcctttctcaa

SEQ ID NO: 115355 - DNA, 25 bp, Mus musculus
accggagccacaaacatgctaggca

SEQ ID NO: 115356 - DNA, 25 bp, Mus musculus
accggagccacatacatgctaggca

SEQ ID NO: 115357 - DNA, 25 bp, Mus musculus
accggaggaatgaacactgttatac

SEQ ID NO: 115358 - DNA, 25 bp, Mus musculus
accggaggaatgtacactgttatac

SEQ ID NO: 115359 - DNA, 25 bp, Mus musculus
accggagtgtgaaccttctggcgca

SEQ ID NO: 115360 - DNA, 25 bp, Mus musculus
accggagtgtgatccttctggcgca

SEQ ID NO: 115361 - DNA, 25 bp, Mus musculus
accggagttaacaatgcgcgtgtgt

SEQ ID NO: 115362 - DNA, 25 bp, Mus musculus
accggagttaactatgcgcgtgtgt

SEQ ID NO: 115363 - DNA, 25 bp, Mus musculus
accggagtttatatctgtatatggc

SEQ ID NO: 115364 - DNA, 25 bp, Mus musculus
accggagtttatttctgtatatggc

SEQ ID NO: 115365 - DNA, 25 bp, Mus musculus
accggatccatcagggcacccaagg

SEQ ID NO: 115366 - DNA, 25 bp, Mus musculus
accggatccatctgggcacccaagg

SEQ ID NO: 115367 - DNA, 25 bp, Mus musculus
accggatcttggcagtaaatggatg

SEQ ID NO: 115368 - DNA, 25 bp, Mus musculus
accggatcttgggagtaaatggatg

SEQ ID NO: 115369 - DNA, 25 bp, Mus musculus
accggatgggatacccctggagcgg

SEQ ID NO: 115370 - DNA, 25 bp, Mus musculus
accggatgggattcccctggagcgg

SEQ ID NO: 115371 - DNA, 25 bp, Mus musculus
accggattgtagagagtggcgccca

SEQ ID NO: 115372 - DNA, 25 bp, Mus musculus
accggattgtagtgagtggcgccca

SEQ ID NO: 115373 - DNA, 25 bp, Mus musculus
accggcaactctcagctcattgact

SEQ ID NO: 115374 - DNA, 25 bp, Mus musculus
accggcaactctgagctcattgact

SEQ ID NO: 115375 - DNA, 25 bp, Mus musculus
accggcaagataataatcaacccct

SEQ ID NO: 115376 - DNA, 25 bp, Mus musculus
accggcaagatattaatcaacccct

SEQ ID NO: 115377 - DNA, 25 bp, Mus musculus
accggcaatctgcacacctgaaaaa

SEQ ID NO: 115378 - DNA, 25 bp, Mus musculus
accggcaatctggacacctgaaaaa

SEQ ID NO: 115379 - DNA, 25 bp, Mus musculus
accggcacgagtactggtggcagca

SEQ ID NO: 115380 - DNA, 25 bp, Mus musculus
accggcacgagttctggtggcagca

SEQ ID NO: 115381 - DNA, 25 bp, Mus musculus
accggcactcacaaactgcagtgtg

SEQ ID NO: 115382 - DNA, 25 bp, Mus musculus
accggcactcactaactgcagtgtg

SEQ ID NO: 115383 - DNA, 25 bp, Mus musculus
accggcagagcgaggaaatcaactt

SEQ ID NO: 115384 - DNA, 25 bp, Mus musculus
accggcagagcgtggaaatcaactt

SEQ ID NO: 115385 - DNA, 25 bp, Mus musculus
accggcagcaagctcatggactatg

SEQ ID NO: 115386 - DNA, 25 bp, Mus musculus
accggcagcaaggtcatggactatg

SEQ ID NO: 115387 - DNA, 25 bp, Mus musculus
accggcatgaatactgctctgcaaa

SEQ ID NO: 115388 - DNA, 25 bp, Mus musculus
accggcatgaattctgctctgcaaa

SEQ ID NO: 115389 - DNA, 25 bp, Mus musculus
accggcattgtgagttttcattctc

SEQ ID NO: 115390 - DNA, 25 bp, Mus musculus
accggcattgtgtgttttcattctc

SEQ ID NO: 115391 - DNA, 25 bp, Mus musculus
accggccaaaatcactggcaagggc

SEQ ID NO: 115392 - DNA, 25 bp, Mus musculus
accggccaaaatgactggcaagggc

SEQ ID NO: 115393 - DNA, 25 bp, Mus musculus
accggccaagccagatgtgagtcag

SEQ ID NO: 115394 - DNA, 25 bp, Mus musculus
accggccaagcctgatgtgagtcag

SEQ ID NO: 115395 - DNA, 25 bp, Mus musculus
accggccagataacgcacggtggct

SEQ ID NO: 115396 - DNA, 25 bp, Mus musculus
accggccagatatcgcacggtggct

SEQ ID NO: 115397 - DNA, 25 bp, Mus musculus
accggccagggcattgtcagactgc

SEQ ID NO: 115398 - DNA, 25 bp, Mus musculus
accggccagggctttgtcagactgc

SEQ ID NO: 115399 - DNA, 25 bp, Mus musculus
accggccatgaacttgtcccaggaa

SEQ ID NO: 115400 - DNA, 25 bp, Mus musculus
accggccatgaagttgtcccaggaa

SEQ ID NO: 115401 - DNA, 25 bp, Mus musculus
accggcccaccaacatagaaagctg

SEQ ID NO: 115402 - DNA, 25 bp, Mus musculus
accggcccaccatcatagaaagctg

SEQ ID NO: 115403 - DNA, 25 bp, Mus musculus
accggcccagcaatggcaatggcac

SEQ ID NO: 115404 - DNA, 25 bp, Mus musculus
accggcccagcattggcaatggcac

SEQ ID NO: 115405 - DNA, 25 bp, Mus musculus
accggcccagggatttactatcatt

SEQ ID NO: 115406 - DNA, 25 bp, Mus musculus
accggcccagggttttactatcatt

SEQ ID NO: 115407 - DNA, 25 bp, Mus musculus
accggccccaggaggatatgacatg

SEQ ID NO: 115408 - DNA, 25 bp, Mus musculus
accggccccaggtggatatgacatg

SEQ ID NO: 115409 - DNA, 25 bp, Mus musculus
accggccctactagagacctgcaga

SEQ ID NO: 115410 - DNA, 25 bp, Mus musculus
accggccctacttgagacctgcaga

SEQ ID NO: 115411 - DNA, 25 bp, Mus musculus
accggccctttcagtgccagaagtg

SEQ ID NO: 115412 - DNA, 25 bp, Mus musculus
accggccctttctgtgccagaagtg

SEQ ID NO: 115413 - DNA, 25 bp, Mus musculus
accggcctcaagatggctacatcag

SEQ ID NO: 115414 - DNA, 25 bp, Mus musculus
accggcctcaagttggctacatcag

SEQ ID NO: 115415 - DNA, 25 bp, Mus musculus
accggcctcctgatgattattttag

SEQ ID NO: 115416 - DNA, 25 bp, Mus musculus
accggcctcctgttgattattttag

SEQ ID NO: 115417 - DNA, 25 bp, Mus musculus
accggcctcttcagtctgagaagga

SEQ ID NO: 115418 - DNA, 25 bp, Mus musculus
accggcctcttctgtctgagaagga

SEQ ID NO: 115419 - DNA, 25 bp, Mus musculus
accggcgaaaacatcatcctcaatc

SEQ ID NO: 115420 - DNA, 25 bp, Mus musculus
accggcgaaaacttcatcctcaatc

SEQ ID NO: 115421 - DNA, 25 bp, Mus musculus
accggcgataacacttctactgaag

SEQ ID NO: 115422 - DNA, 25 bp, Mus musculus
accggcgataactcttctactgaag

SEQ ID NO: 115423 - DNA, 25 bp, Mus musculus
accggcgcaaccaaaacactgagga

SEQ ID NO: 115424 - DNA, 25 bp, Mus musculus
accggcgcaacctaaacactgagga

SEQ ID NO: 115425 - DNA, 25 bp, Mus musculus
accggcgctactatggcggcaccga

SEQ ID NO: 115426 - DNA, 25 bp, Mus musculus
accggcgctactttggcggcaccga

SEQ ID NO: 115427 - DNA, 25 bp, Mus musculus
accggcgctgggaagaacatgagac

SEQ ID NO: 115428 - DNA, 25 bp, Mus musculus
accggcgctgggtagaacatgagac

SEQ ID NO: 115429 - DNA, 25 bp, Mus musculus
accggcggattcagatcatgttcat

SEQ ID NO: 115430 - DNA, 25 bp, Mus musculus
accggcggattctgatcatgttcat

SEQ ID NO: 115431 - DNA, 25 bp, Mus musculus
accggcggtggaacctttgtgaacg

SEQ ID NO: 115432 - DNA, 25 bp, Mus musculus
accggcggtggatcctttgtgaacg

SEQ ID NO: 115433 - DNA, 25 bp, Mus musculus
accggcgtgagaccgtaccagtgta

SEQ ID NO: 115434 - DNA, 25 bp, Mus musculus
accggcgtgagagcgtaccagtgta

SEQ ID NO: 115435 - DNA, 25 bp, Mus musculus
accggcgtttccataagctctgtga

SEQ ID NO: 115436 - DNA, 25 bp, Mus musculus
accggcgtttccttaagctctgtga

SEQ ID NO: 115437 - DNA, 25 bp, Mus musculus
accggctagttacgcaccatgtgcc

SEQ ID NO: 115438 - DNA, 25 bp, Mus musculus
accggctagttaggcaccatgtgcc

SEQ ID NO: 115439 - DNA, 25 bp, Mus musculus
accggctcaggtaatcataggcagg

SEQ ID NO: 115440 - DNA, 25 bp, Mus musculus
accggctcaggttatcataggcagg

SEQ ID NO: 115441 - DNA, 25 bp, Mus musculus
accggctcagtcaggatcagtgcta

SEQ ID NO: 115442 - DNA, 25 bp, Mus musculus
accggctcagtctggatcagtgcta

SEQ ID NO: 115443 - DNA, 25 bp, Mus musculus
accggctcccgacatgggactagag

SEQ ID NO: 115444 - DNA, 25 bp, Mus musculus
accggctcccgagatgggactagag

SEQ ID NO: 115445 - DNA, 25 bp, Mus musculus
accggctccgcaagagggaacagat

SEQ ID NO: 115446 - DNA, 25 bp, Mus musculus
accggctccgcatgagggaacagat

SEQ ID NO: 115447 - DNA, 25 bp, Mus musculus
accggctcgctaccttcgaagaggg

SEQ ID NO: 115448 - DNA, 25 bp, Mus musculus
accggctcgctagcttcgaagaggg

SEQ ID NO: 115449 - DNA, 25 bp, Mus musculus
accggctcttacagtcatcaggaac

SEQ ID NO: 115450 - DNA, 25 bp, Mus musculus
accggctcttactgtcatcaggaac

SEQ ID NO: 115451 - DNA, 25 bp, Mus musculus
accggctgacagaggaggacccagt

SEQ ID NO: 115452 - DNA, 25 bp, Mus musculus
accggctgacagtggaggacccagt

SEQ ID NO: 115453 - DNA, 25 bp, Mus musculus
accggctgcgtcatgaagcgggact

SEQ ID NO: 115454 - DNA, 25 bp, Mus musculus
accggctgcgtcttgaagcgggact

SEQ ID NO: 115455 - DNA, 25 bp, Mus musculus
accggctgggatctgctatacatag

SEQ ID NO: 115456 - DNA, 25 bp, Mus musculus
accggctgggatgtgctatacatag

SEQ ID NO: 115457 - DNA, 25 bp, Mus musculus
accggctgttgtaggaaggcttgtc

SEQ ID NO: 115458 - DNA, 25 bp, Mus musculus
accggctgttgttggaaggcttgtc

SEQ ID NO: 115459 - DNA, 25 bp, Mus musculus
accggcttcgccagggaatgcaaag

SEQ ID NO: 115460 - DNA, 25 bp, Mus musculus
accggcttcgcctgggaatgcaaag

SEQ ID NO: 115461 - DNA, 25 bp, Mus musculus
accggcttcgctacagagattttgt

SEQ ID NO: 115462 - DNA, 25 bp, Mus musculus
accggcttcgcttcagagattttgt

SEQ ID NO: 115463 - DNA, 25 bp, Mus musculus
accggctttcttcccaggacttact

SEQ ID NO: 115464 - DNA, 25 bp, Mus musculus
accggctttcttgccaggacttact

SEQ ID NO: 115465 - DNA, 25 bp, Mus musculus
accgggaagaacaggtctcactttg

SEQ ID NO: 115466 - DNA, 25 bp, Mus musculus
accgggaagaactggtctcactttg

SEQ ID NO: 115467 - DNA, 25 bp, Mus musculus
accgggaatcaaagcctggacattg

SEQ ID NO: 115468 - DNA, 25 bp, Mus musculus
accgggaatcaatgcctggacattg

SEQ ID NO: 115469 - DNA, 25 bp, Mus musculus
accgggacaggcacagagacttgga

SEQ ID NO: 115470 - DNA, 25 bp, Mus musculus
accgggacaggctcagagacttgga

SEQ ID NO: 115471 - DNA, 25 bp, Mus musculus
accgggacccacacagggagcagaa

SEQ ID NO: 115472 - DNA, 25 bp, Mus musculus
accgggacccactcagggagcagaa

SEQ ID NO: 115473 - DNA, 25 bp, Mus musculus
accgggacggtgagtgctatcatca

SEQ ID NO: 115474 - DNA, 25 bp, Mus musculus
accgggacggtgtgtgctatcatca

SEQ ID NO: 115475 - DNA, 25 bp, Mus musculus
accgggactctacccagaactgtgg

SEQ ID NO: 115476 - DNA, 25 bp, Mus musculus
accgggactctagccagaactgtgg

SEQ ID NO: 115477 - DNA, 25 bp, Mus musculus
accgggactggtccctgtgccaaga

SEQ ID NO: 115478 - DNA, 25 bp, Mus musculus
accgggactggtgcctgtgccaaga

SEQ ID NO: 115479 - DNA, 25 bp, Mus musculus
accgggagcgagagctcagcctctc

SEQ ID NO: 115480 - DNA, 25 bp, Mus musculus
accgggagcgagtgctcagcctctc

SEQ ID NO: 115481 - DNA, 25 bp, Mus musculus
accgggatggtaagatgataaacac

SEQ ID NO: 115482 - DNA, 25 bp, Mus musculus
accgggatggtatgatgataaacac

SEQ ID NO: 115483 - DNA, 25 bp, Mus musculus
accgggcagctcaactttggtgaag

SEQ ID NO: 115484 - DNA, 25 bp, Mus musculus
accgggcagctctactttggtgaag

SEQ ID NO: 115485 - DNA, 25 bp, Mus musculus
accgggccccgaagtgtgagagaat

SEQ ID NO: 115486 - DNA, 25 bp, Mus musculus
accgggccccgatgtgtgagagaat

SEQ ID NO: 115487 - DNA, 25 bp, Mus musculus
accgggcccctacgatcagatgaag

SEQ ID NO: 115488 - DNA, 25 bp, Mus musculus
accgggcccctaggatcagatgaag

SEQ ID NO: 115489 - DNA, 25 bp, Mus musculus
accgggcctggcaatgactctgctt

SEQ ID NO: 115490 - DNA, 25 bp, Mus musculus
accgggcctggctatgactctgctt

SEQ ID NO: 115491 - DNA, 25 bp, Mus musculus
accgggcggccaaatcgcgacacag

SEQ ID NO: 115492 - DNA, 25 bp, Mus musculus
accgggcggccatatcgcgacacag

SEQ ID NO: 115493 - DNA, 25 bp, Mus musculus
accgggcggtcaagtgtggctactt

SEQ ID NO: 115494 - DNA, 25 bp, Mus musculus
accgggcggtcatgtgtggctactt

SEQ ID NO: 115495 - DNA, 25 bp, Mus musculus
accgggctctagagaactgtcagta

SEQ ID NO: 115496 - DNA, 25 bp, Mus musculus
accgggctctagtgaactgtcagta

SEQ ID NO: 115497 - DNA, 25 bp, Mus musculus
accgggctgcagacgtccgcgttag

SEQ ID NO: 115498 - DNA, 25 bp, Mus musculus
accgggctgcagtcgtccgcgttag

SEQ ID NO: 115499 - DNA, 25 bp, Mus musculus
accgggcttattcctggtaccagca

SEQ ID NO: 115500 - DNA, 25 bp, Mus musculus
accgggcttattgctggtaccagca

SEQ ID NO: 115501 - DNA, 25 bp, Mus musculus
accgggtacagaagtggctggcctt

SEQ ID NO: 115502 - DNA, 25 bp, Mus musculus
accgggtacagatgtggctggcctt

SEQ ID NO: 115503 - DNA, 25 bp, Mus musculus
accgggtcctagacttaacagtgtg

SEQ ID NO: 115504 - DNA, 25 bp, Mus musculus
accgggtcctagtcttaacagtgtg

SEQ ID NO: 115505 - DNA, 25 bp, Mus musculus
accgggtgaattccatccgtgtgga

SEQ ID NO: 115506 - DNA, 25 bp, Mus musculus
accgggtgaattgcatccgtgtgga

SEQ ID NO: 115507 - DNA, 25 bp, Mus musculus
accgggtgcgctctccctttaaatg

SEQ ID NO: 115508 - DNA, 25 bp, Mus musculus
accgggtgcgctgtccctttaaatg

SEQ ID NO: 115509 - DNA, 25 bp, Mus musculus
accgggttctttcttgagcattttg

SEQ ID NO: 115510 - DNA, 25 bp, Mus musculus
accgggttctttgttgagcattttg

SEQ ID NO: 115511 - DNA, 25 bp, Mus musculus
accgggttgcacctattgcatgtac

SEQ ID NO: 115512 - DNA, 25 bp, Mus musculus
accgggttgcacgtattgcatgtac

SEQ ID NO: 115513 - DNA, 25 bp, Mus musculus
accgggtttcggcacttgatgcaat

SEQ ID NO: 115514 - DNA, 25 bp, Mus musculus
accgggtttcgggacttgatgcaat

SEQ ID NO: 115515 - DNA, 25 bp, Mus musculus
accggtaactctcctgtgaaacaat

SEQ ID NO: 115516 - DNA, 25 bp, Mus musculus
accggtaactctgctgtgaaacaat

SEQ ID NO: 115517 - DNA, 25 bp, Mus musculus
accggtactgtcatgaactagtgaa

SEQ ID NO: 115518 - DNA, 25 bp, Mus musculus
accggtactgtcttgaactagtgaa

SEQ ID NO: 115519 - DNA, 25 bp, Mus musculus
accggtacttacatggcacacagag

SEQ ID NO: 115520 - DNA, 25 bp, Mus musculus
accggtacttacttggcacacagag

SEQ ID NO: 115521 - DNA, 25 bp, Mus musculus
accggtcacagcaatcagttccacg

SEQ ID NO: 115522 - DNA, 25 bp, Mus musculus
accggtcacagctatcagttccacg

SEQ ID NO: 115523 - DNA, 25 bp, Mus musculus
accggtccatagctgagagtcctga

SEQ ID NO: 115524 - DNA, 25 bp, Mus musculus
accggtccataggtgagagtcctga

SEQ ID NO: 115525 - DNA, 25 bp, Mus musculus
accggtcgagctactgactgtataa

SEQ ID NO: 115526 - DNA, 25 bp, Mus musculus
accggtcgagcttctgactgtataa

SEQ ID NO: 115527 - DNA, 25 bp, Mus musculus
accggtctctaaccagtgcatctgt

SEQ ID NO: 115528 - DNA, 25 bp, Mus musculus
accggtctctaagcagtgcatctgt

SEQ ID NO: 115529 - DNA, 25 bp, Mus musculus
accggtctgtggaactcattttcat

SEQ ID NO: 115530 - DNA, 25 bp, Mus musculus
accggtctgtggtactcattttcat

SEQ ID NO: 115531 - DNA, 25 bp, Mus musculus
accggtgaccgtaagagatctgggc

SEQ ID NO: 115532 - DNA, 25 bp, Mus musculus
accggtgaccgttagagatctgggc

SEQ ID NO: 115533 - DNA, 25 bp, Mus musculus
accggtgatgagagcaggtttgcac

SEQ ID NO: 115534 - DNA, 25 bp, Mus musculus
accggtgatgagtgcaggtttgcac

SEQ ID NO: 115535 - DNA, 25 bp, Mus musculus
accggtgcttagctttgtcctgctc

SEQ ID NO: 115536 - DNA, 25 bp, Mus musculus
accggtgcttaggtttgtcctgctc

SEQ ID NO: 115537 - DNA, 25 bp, Mus musculus
accggtgggctgcatgaaattcaaa

SEQ ID NO: 115538 - DNA, 25 bp, Mus musculus
accggtgggctggatgaaattcaaa

SEQ ID NO: 115539 - DNA, 25 bp, Mus musculus
accggtgtcgggatctggatgccta

SEQ ID NO: 115540 - DNA, 25 bp, Mus musculus
accggtgtcgggttctggatgccta

SEQ ID NO: 115541 - DNA, 25 bp, Mus musculus
accggtgtctaaacagctgctctgt

SEQ ID NO: 115542 - DNA, 25 bp, Mus musculus
accggtgtctaatcagctgctctgt

SEQ ID NO: 115543 - DNA, 25 bp, Mus musculus
accggtgtgatcctttctatccaag

SEQ ID NO: 115544 - DNA, 25 bp, Mus musculus
accggtgtgatcgtttctatccaag

SEQ ID NO: 115545 - DNA, 25 bp, Mus musculus
accggttcaagaagactctgtagtt

SEQ ID NO: 115546 - DNA, 25 bp, Mus musculus
accggttcaagatgactctgtagtt

SEQ ID NO: 115547 - DNA, 25 bp, Mus musculus
accggtttcctgaaactagcattgt

SEQ ID NO: 115548 - DNA, 25 bp, Mus musculus
accggtttcctgtaactagcattgt

SEQ ID NO: 115549 - DNA, 25 bp, Mus musculus
accgtaagaatactcctgtgtcaga

SEQ ID NO: 115550 - DNA, 25 bp, Mus musculus
accgtaagaatagtcctgtgtcaga

SEQ ID NO: 115551 - DNA, 25 bp, Mus musculus
accgtaagacacctcatgcttctgt

SEQ ID NO: 115552 - DNA, 25 bp, Mus musculus
accgtaagacacgtcatgcttctgt

SEQ ID NO: 115553 - DNA, 25 bp, Mus musculus
accgtaagagcacccagatcgagcc

SEQ ID NO: 115554 - DNA, 25 bp, Mus musculus
accgtaagagcagccagatcgagcc

SEQ ID NO: 115555 - DNA, 25 bp, Mus musculus
accgtaattcttcttagctctcacc

SEQ ID NO: 115556 - DNA, 25 bp, Mus musculus
accgtaattcttgttagctctcacc

SEQ ID NO: 115557 - DNA, 25 bp, Mus musculus
accgtacactggaggaagtctctct

SEQ ID NO: 115558 - DNA, 25 bp, Mus musculus
accgtacactggtggaagtctctct

SEQ ID NO: 115559 - DNA, 25 bp, Mus musculus
accgtacctcctagaactacttcat

SEQ ID NO: 115560 - DNA, 25 bp, Mus musculus
accgtacctccttgaactacttcat

SEQ ID NO: 115561 - DNA, 25 bp, Mus musculus
accgtacctgttacctcgtgacaag

SEQ ID NO: 115562 - DNA, 25 bp, Mus musculus
accgtacctgtttcctcgtgacaag

SEQ ID NO: 115563 - DNA, 25 bp, Mus musculus
accgtacgatttaatcttcttcatt

SEQ ID NO: 115564 - DNA, 25 bp, Mus musculus
accgtacgattttatcttcttcatt

SEQ ID NO: 115565 - DNA, 25 bp, Mus musculus
accgtacgcggcctgaggtacagca

SEQ ID NO: 115566 - DNA, 25 bp, Mus musculus
accgtacgcggcgtgaggtacagca

SEQ ID NO: 115567 - DNA, 25 bp, Mus musculus
accgtacgctggcagacttggctga

SEQ ID NO: 115568 - DNA, 25 bp, Mus musculus
accgtacgctgggagacttggctga

SEQ ID NO: 115569 - DNA, 25 bp, Mus musculus
accgtacggctaattctgtctttag

SEQ ID NO: 115570 - DNA, 25 bp, Mus musculus
accgtacggctatttctgtctttag

SEQ ID NO: 115571 - DNA, 25 bp, Mus musculus
accgtactatgtatgtgtctctatg

SEQ ID NO: 115572 - DNA, 25 bp, Mus musculus
accgtactatgtttgtgtctctatg

SEQ ID NO: 115573 - DNA, 25 bp, Mus musculus
accgtactggatcccatgatgggca

SEQ ID NO: 115574 - DNA, 25 bp, Mus musculus
accgtactggatgccatgatgggca

SEQ ID NO: 115575 - DNA, 25 bp, Mus musculus
accgtagataacattaggaagctct

SEQ ID NO: 115576 - DNA, 25 bp, Mus musculus
accgtagataactttaggaagctct

SEQ ID NO: 115577 - DNA, 25 bp, Mus musculus
accgtagcaggtatatgggaatgat

SEQ ID NO: 115578 - DNA, 25 bp, Mus musculus
accgtagcaggtttatgggaatgat

SEQ ID NO: 115579 - DNA, 25 bp, Mus musculus
accgtagcggaaaagctttccaggt

SEQ ID NO: 115580 - DNA, 25 bp, Mus musculus
accgtagcggaatagctttccaggt

SEQ ID NO: 115581 - DNA, 25 bp, Mus musculus
accgtaggattaaaacacaggcgac

SEQ ID NO: 115582 - DNA, 25 bp, Mus musculus
accgtaggattataacacaggcgac

SEQ ID NO: 115583 - DNA, 25 bp, Mus musculus
accgtatgagcacaaagcagctaaa

SEQ ID NO: 115584 - DNA, 25 bp, Mus musculus
accgtatgagcagaaagcagctaaa

SEQ ID NO: 115585 - DNA, 25 bp, Mus musculus
accgtatgtgtacccagggcaacat

SEQ ID NO: 115586 - DNA, 25 bp, Mus musculus
accgtatgtgtagccagggcaacat

SEQ ID NO: 115587 - DNA, 25 bp, Mus musculus
accgtattttcacgtgtacatttca

SEQ ID NO: 115588 - DNA, 25 bp, Mus musculus
accgtattttcaggtgtacatttca

SEQ ID NO: 115589 - DNA, 25 bp, Mus musculus
accgtcacaacacgaggactttgct

SEQ ID NO: 115590 - DNA, 25 bp, Mus musculus
accgtcacaacaggaggactttgct

SEQ ID NO: 115591 - DNA, 25 bp, Mus musculus
accgtcaccgatacgtatgtgtcaa

SEQ ID NO: 115592 - DNA, 25 bp, Mus musculus
accgtcaccgattcgtatgtgtcaa

SEQ ID NO: 115593 - DNA, 25 bp, Mus musculus
accgtcactcagaccacatagtagg

SEQ ID NO: 115594 - DNA, 25 bp, Mus musculus
accgtcactcagtccacatagtagg

SEQ ID NO: 115595 - DNA, 25 bp, Mus musculus
accgtcaggagcagggactctggct

SEQ ID NO: 115596 - DNA, 25 bp, Mus musculus
accgtcaggagctgggactctggct

SEQ ID NO: 115597 - DNA, 25 bp, Mus musculus
accgtcagtaccagctcagtggtca

SEQ ID NO: 115598 - DNA, 25 bp, Mus musculus
accgtcagtacctgctcagtggtca

SEQ ID NO: 115599 - DNA, 25 bp, Mus musculus
accgtcagtctgatgagagagccct

SEQ ID NO: 115600 - DNA, 25 bp, Mus musculus
accgtcagtctgttgagagagccct

SEQ ID NO: 115601 - DNA, 25 bp, Mus musculus
accgtcatcagcagttcatcaactt

SEQ ID NO: 115602 - DNA, 25 bp, Mus musculus
accgtcatcagctgttcatcaactt

SEQ ID NO: 115603 - DNA, 25 bp, Mus musculus
accgtcattgtcattgccttcagat

SEQ ID NO: 115604 - DNA, 25 bp, Mus musculus
accgtcattgtctttgccttcagat

SEQ ID NO: 115605 - DNA, 25 bp, Mus musculus
accgtccaataccttttgtattatg

SEQ ID NO: 115606 - DNA, 25 bp, Mus musculus
accgtccaatacgttttgtattatg

SEQ ID NO: 115607 - DNA, 25 bp, Mus musculus
accgtccagcttcattaacaatgca

SEQ ID NO: 115608 - DNA, 25 bp, Mus musculus
accgtccagcttgattaacaatgca

SEQ ID NO: 115609 - DNA, 25 bp, Mus musculus
accgtccaggaaactgttgtgtttg

SEQ ID NO: 115610 - DNA, 25 bp, Mus musculus
accgtccaggaatctgttgtgtttg

SEQ ID NO: 115611 - DNA, 25 bp, Mus musculus
accgtccagggactttcctgtgtct

SEQ ID NO: 115612 - DNA, 25 bp, Mus musculus
accgtccagggagtttcctgtgtct

SEQ ID NO: 115613 - DNA, 25 bp, Mus musculus
accgtccagtggcttcactattgag

SEQ ID NO: 115614 - DNA, 25 bp, Mus musculus
accgtccagtgggttcactattgag

SEQ ID NO: 115615 - DNA, 25 bp, Mus musculus
accgtccatactatgtgcatcatag

SEQ ID NO: 115616 - DNA, 25 bp, Mus musculus
accgtccatactttgtgcatcatag

SEQ ID NO: 115617 - DNA, 25 bp, Mus musculus
accgtccatcatctgcgttagaaac

SEQ ID NO: 115618 - DNA, 25 bp, Mus musculus
accgtccatcatgtgcgttagaaac

SEQ ID NO: 115619 - DNA, 25 bp, Mus musculus
accgtcccacgtctggaacagcagt

SEQ ID NO: 115620 - DNA, 25 bp, Mus musculus
accgtcccacgtgtggaacagcagt

SEQ ID NO: 115621 - DNA, 25 bp, Mus musculus
accgtcctcatgctacttgcgggag

SEQ ID NO: 115622 - DNA, 25 bp, Mus musculus
accgtcctcatggtacttgcgggag

SEQ ID NO: 115623 - DNA, 25 bp, Mus musculus
accgtcctggagcctgtgatcctgg

SEQ ID NO: 115624 - DNA, 25 bp, Mus musculus
accgtcctggaggctgtgatcctgg

SEQ ID NO: 115625 - DNA, 25 bp, Mus musculus
accgtcgcaatcctcaaagttcaaa

SEQ ID NO: 115626 - DNA, 25 bp, Mus musculus
accgtcgcaatcgtcaaagttcaaa

SEQ ID NO: 115627 - DNA, 25 bp, Mus musculus
accgtcgcgcgcacatgcggcgccg

SEQ ID NO: 115628 - DNA, 25 bp, Mus musculus
accgtcgcgcgctcatgcggcgccg

SEQ ID NO: 115629 - DNA, 25 bp, Mus musculus
accgtcgtttgcatttatgctgcaa

SEQ ID NO: 115630 - DNA, 25 bp, Mus musculus
accgtcgtttgcttttatgctgcaa

SEQ ID NO: 115631 - DNA, 25 bp, Mus musculus
accgtctatggtacaaggtcccact

SEQ ID NO: 115632 - DNA, 25 bp, Mus musculus
accgtctatggttcaaggtcccact

SEQ ID NO: 115633 - DNA, 25 bp, Mus musculus
accgtctcactgacatctggctgga

SEQ ID NO: 115634 - DNA, 25 bp, Mus musculus
accgtctcactgtcatctggctgga

SEQ ID NO: 115635 - DNA, 25 bp, Mus musculus
accgtctcatgcctagactgtctgt

SEQ ID NO: 115636 - DNA, 25 bp, Mus musculus
accgtctcatgcgtagactgtctgt

SEQ ID NO: 115637 - DNA, 25 bp, Mus musculus
accgtctccataattctggttctag

SEQ ID NO: 115638 - DNA, 25 bp, Mus musculus
accgtctccatatttctggttctag

SEQ ID NO: 115639 - DNA, 25 bp, Mus musculus
accgtctcctcacaaatcggaaggt

SEQ ID NO: 115640 - DNA, 25 bp, Mus musculus
accgtctcctcacgaggaggtggta

SEQ ID NO: 115641 - DNA, 25 bp, Mus musculus
accgtctcctcagaaatcggaaggt

SEQ ID NO: 115642 - DNA, 25 bp, Mus musculus
accgtctcctcaggaggaggtggta

SEQ ID NO: 115643 - DNA, 25 bp, Mus musculus
accgtctctgtccattccaggatta

SEQ ID NO: 115644 - DNA, 25 bp, Mus musculus
accgtctctgtcgattccaggatta

SEQ ID NO: 115645 - DNA, 25 bp, Mus musculus
accgtctctttcacatttgttagtt

SEQ ID NO: 115646 - DNA, 25 bp, Mus musculus
accgtctctttctcatttgttagtt

SEQ ID NO: 115647 - DNA, 25 bp, Mus musculus
accgtctgcagaccgaagatagtaa

SEQ ID NO: 115648 - DNA, 25 bp, Mus musculus
accgtctgcagagcgaagatagtaa

SEQ ID NO: 115649 - DNA, 25 bp, Mus musculus
accgtctgccttcattattgaaaca

SEQ ID NO: 115650 - DNA, 25 bp, Mus musculus
accgtctgccttgattattgaaaca

SEQ ID NO: 115651 - DNA, 25 bp, Mus musculus
accgtctgctggaagagcgcctaga

SEQ ID NO: 115652 - DNA, 25 bp, Mus musculus
accgtctgctggtagagcgcctaga

SEQ ID NO: 115653 - DNA, 25 bp, Mus musculus
accgtctgcttcagaggaaacagat

SEQ ID NO: 115654 - DNA, 25 bp, Mus musculus
accgtctgcttctgaggaaacagat

SEQ ID NO: 115655 - DNA, 25 bp, Mus musculus
accgtctggagcattggtgcactga

SEQ ID NO: 115656 - DNA, 25 bp, Mus musculus
accgtctggagctttggtgcactga

SEQ ID NO: 115657 - DNA, 25 bp, Mus musculus
accgtctgtcagctttgtcagtagg

SEQ ID NO: 115658 - DNA, 25 bp, Mus musculus
accgtctgtcaggtttgtcagtagg

SEQ ID NO: 115659 - DNA, 25 bp, Mus musculus
accgtctgtgggacaagtggaccat

SEQ ID NO: 115660 - DNA, 25 bp, Mus musculus
accgtctgtgggtcaagtggaccat

SEQ ID NO: 115661 - DNA, 25 bp, Mus musculus
accgtctgttgtaacaaccctgcaa

SEQ ID NO: 115662 - DNA, 25 bp, Mus musculus
accgtctgttgttacaaccctgcaa

SEQ ID NO: 115663 - DNA, 25 bp, Mus musculus
accgtcttccaaaggttctgcctca

SEQ ID NO: 115664 - DNA, 25 bp, Mus musculus
accgtcttccaatggttctgcctca

SEQ ID NO: 115665 - DNA, 25 bp, Mus musculus
accgtcttcgttagcccttggccat

SEQ ID NO: 115666 - DNA, 25 bp, Mus musculus
accgtcttcgtttgcccttggccat

SEQ ID NO: 115667 - DNA, 25 bp, Mus musculus
accgtctttgttatcgagatcctca

SEQ ID NO: 115668 - DNA, 25 bp, Mus musculus
accgtctttgttttcgagatcctca

SEQ ID NO: 115669 - DNA, 25 bp, Mus musculus
accgtcttttcacccttgcagatga

SEQ ID NO: 115670 - DNA, 25 bp, Mus musculus
accgtcttttcagccttgcagatga

SEQ ID NO: 115671 - DNA, 25 bp, Mus musculus
accgtgaagctgactatagttccca

SEQ ID NO: 115672 - DNA, 25 bp, Mus musculus
accgtgaagctgtctatagttccca

SEQ ID NO: 115673 - DNA, 25 bp, Mus musculus
accgtgaagtgaccccaggaggcat

SEQ ID NO: 115674 - DNA, 25 bp, Mus musculus
accgtgaagtgagcccaggaggcat

SEQ ID NO: 115675 - DNA, 25 bp, Mus musculus
accgtgaagtggctgttgatctaca

SEQ ID NO: 115676 - DNA, 25 bp, Mus musculus
accgtgaagtgggtgttgatctaca

SEQ ID NO: 115677 - DNA, 25 bp, Mus musculus
accgtgacagctatcatcgtcttgt

SEQ ID NO: 115678 - DNA, 25 bp, Mus musculus
accgtgacagctttcatcgtcttgt

SEQ ID NO: 115679 - DNA, 25 bp, Mus musculus
accgtgaccgagagcgtgaccgaga

SEQ ID NO: 115680 - DNA, 25 bp, Mus musculus
accgtgaccgagtgcgtgaccgaga

SEQ ID NO: 115681 - DNA, 25 bp, Mus musculus
accgtgaccggaagcaggtagcctg

SEQ ID NO: 115682 - DNA, 25 bp, Mus musculus
accgtgaccggatgcaggtagcctg

SEQ ID NO: 115683 - DNA, 25 bp, Mus musculus
accgtgactaatcgccacaaaatta

SEQ ID NO: 115684 - DNA, 25 bp, Mus musculus
accgtgactaatggccacaaaatta

SEQ ID NO: 115685 - DNA, 25 bp, Mus musculus
accgtgagtcgaagaccaggtcagt

SEQ ID NO: 115686 - DNA, 25 bp, Mus musculus
accgtgagtcgatgaccaggtcagt

SEQ ID NO: 115687 - DNA, 25 bp, Mus musculus
accgtgatgcccatcttgcggcggt

SEQ ID NO: 115688 - DNA, 25 bp, Mus musculus
accgtgatgcccttcttgcggcggt

SEQ ID NO: 115689 - DNA, 25 bp, Mus musculus
accgtgattggtactgttctgctgc

SEQ ID NO: 115690 - DNA, 25 bp, Mus musculus
accgtgattggttctgttctgctgc

SEQ ID NO: 115691 - DNA, 25 bp, Mus musculus
accgtgattgtcatcaccctggtga

SEQ ID NO: 115692 - DNA, 25 bp, Mus musculus
accgtgattgtcttcaccctggtga

SEQ ID NO: 115693 - DNA, 25 bp, Mus musculus
accgtgcaggtgctcatcaaccaca

SEQ ID NO: 115694 - DNA, 25 bp, Mus musculus
accgtgcaggtggtcatcaaccaca

SEQ ID NO: 115695 - DNA, 25 bp, Mus musculus
accgtgcatctgcttacctcatggc

SEQ ID NO: 115696 - DNA, 25 bp, Mus musculus
accgtgcatctggttacctcatggc

SEQ ID NO: 115697 - DNA, 25 bp, Mus musculus
accgtgcatgcgaaccaggagaatt

SEQ ID NO: 115698 - DNA, 25 bp, Mus musculus
accgtgcatgcgtaccaggagaatt

SEQ ID NO: 115699 - DNA, 25 bp, Mus musculus
accgtgccaggcagtgacctatgga

SEQ ID NO: 115700 - DNA, 25 bp, Mus musculus
accgtgccaggctgtgacctatgga

SEQ ID NO: 115701 - DNA, 25 bp, Mus musculus
accgtgcccactaaagctgatggct

SEQ ID NO: 115702 - DNA, 25 bp, Mus musculus
accgtgcccacttaagctgatggct

SEQ ID NO: 115703 - DNA, 25 bp, Mus musculus
accgtgccccaacatgactgtattt

SEQ ID NO: 115704 - DNA, 25 bp, Mus musculus
accgtgccccaagatgactgtattt

SEQ ID NO: 115705 - DNA, 25 bp, Mus musculus
accgtgcgtcggattggccgtatga

SEQ ID NO: 115706 - DNA, 25 bp, Mus musculus
accgtgcgtcggtttggccgtatga

SEQ ID NO: 115707 - DNA, 25 bp, Mus musculus
accgtgctagtcactcctggaagag

SEQ ID NO: 115708 - DNA, 25 bp, Mus musculus
accgtgctagtctctcctggaagag

SEQ ID NO: 115709 - DNA, 25 bp, Mus musculus
accgtgctggtcatcgtggagagac

SEQ ID NO: 115710 - DNA, 25 bp, Mus musculus
accgtgctggtcttcgtggagagac

SEQ ID NO: 115711 - DNA, 25 bp, Mus musculus
accgtgctgtacatgtgcagacgca

SEQ ID NO: 115712 - DNA, 25 bp, Mus musculus
accgtgctgtacttgtgcagacgca

SEQ ID NO: 115713 - DNA, 25 bp, Mus musculus
accgtgcttccaaagctgggacaaa

SEQ ID NO: 115714 - DNA, 25 bp, Mus musculus
accgtgcttccatagctgggacaaa

SEQ ID NO: 115715 - DNA, 25 bp, Mus musculus
accgtggacggtctgtgaactgtac

SEQ ID NO: 115716 - DNA, 25 bp, Mus musculus
accgtggacggtgtgtgaactgtac

SEQ ID NO: 115717 - DNA, 25 bp, Mus musculus
accgtggactgcagacgtctgccgg

SEQ ID NO: 115718 - DNA, 25 bp, Mus musculus
accgtggactgctgacgtctgccgg

SEQ ID NO: 115719 - DNA, 25 bp, Mus musculus
accgtggagccccaggacaaatgct

SEQ ID NO: 115720 - DNA, 25 bp, Mus musculus
accgtggagcccgaggacaaatgct

SEQ ID NO: 115721 - DNA, 25 bp, Mus musculus
accgtggatactccatgtgaactat

SEQ ID NO: 115722 - DNA, 25 bp, Mus musculus
accgtggatactgcatgtgaactat

SEQ ID NO: 115723 - DNA, 25 bp, Mus musculus
accgtggcactgctccaggagaagc

SEQ ID NO: 115724 - DNA, 25 bp, Mus musculus
accgtggcactggtccaggagaagc

SEQ ID NO: 115725 - DNA, 25 bp, Mus musculus
accgtggcctcgcaagagacgacaa

SEQ ID NO: 115726 - DNA, 25 bp, Mus musculus
accgtggcctcggaagagacgacaa

SEQ ID NO: 115727 - DNA, 25 bp, Mus musculus
accgtggcctctctagtggctgcat

SEQ ID NO: 115728 - DNA, 25 bp, Mus musculus
accgtggcctctgtagtggctgcat

SEQ ID NO: 115729 - DNA, 25 bp, Mus musculus
accgtggctcaacacaggctatcgt

SEQ ID NO: 115730 - DNA, 25 bp, Mus musculus
accgtggctcaagacaggctatcgt

SEQ ID NO: 115731 - DNA, 25 bp, Mus musculus
accgtgggagttcagtttgtgacat

SEQ ID NO: 115732 - DNA, 25 bp, Mus musculus
accgtgggagttgagtttgtgacat

SEQ ID NO: 115733 - DNA, 25 bp, Mus musculus
accgtgggattgaggccctagccaa

SEQ ID NO: 115734 - DNA, 25 bp, Mus musculus
accgtgggattgtggccctagccaa

SEQ ID NO: 115735 - DNA, 25 bp, Mus musculus
accgtgggctcaatggtgtcaagtt

SEQ ID NO: 115736 - DNA, 25 bp, Mus musculus
accgtgggctcattggtgtcaagtt

SEQ ID NO: 115737 - DNA, 25 bp, Mus musculus
accgtggttcacatatcctagatac

SEQ ID NO: 115738 - DNA, 25 bp, Mus musculus
accgtggttcacttatcctagatac

SEQ ID NO: 115739 - DNA, 25 bp, Mus musculus
accgtggtttacagcgagccagtga

SEQ ID NO: 115740 - DNA, 25 bp, Mus musculus
accgtggtttactgcgagccagtga

SEQ ID NO: 115741 - DNA, 25 bp, Mus musculus
accgtgtagaccaagcatcctgagt

SEQ ID NO: 115742 - DNA, 25 bp, Mus musculus
accgtgtagacctagcatcctgagt

SEQ ID NO: 115743 - DNA, 25 bp, Mus musculus
accgtgtcatgaaacaacagtggac

SEQ ID NO: 115744 - DNA, 25 bp, Mus musculus
accgtgtcatgatacaacagtggac

SEQ ID NO: 115745 - DNA, 25 bp, Mus musculus
accgtgtccagaagatgaatgaagt

SEQ ID NO: 115746 - DNA, 25 bp, Mus musculus
accgtgtccagatgatgaatgaagt

SEQ ID NO: 115747 - DNA, 25 bp, Mus musculus
accgtgtctgaaccgttgcttgtgg

SEQ ID NO: 115748 - DNA, 25 bp, Mus musculus
accgtgtctgaagcgttgcttgtgg

SEQ ID NO: 115749 - DNA, 25 bp, Mus musculus
accgtgtctgtcacttgtcataacg

SEQ ID NO: 115750 - DNA, 25 bp, Mus musculus
accgtgtctgtctcttgtcataacg

SEQ ID NO: 115751 - DNA, 25 bp, Mus musculus
accgtgtgacagatgcctgatcaca

SEQ ID NO: 115752 - DNA, 25 bp, Mus musculus
accgtgtgacagttgcctgatcaca

SEQ ID NO: 115753 - DNA, 25 bp, Mus musculus
accgtgtgcgcaactttggtggcaa

SEQ ID NO: 115754 - DNA, 25 bp, Mus musculus
accgtgtgcgcatctttggtggcaa

SEQ ID NO: 115755 - DNA, 25 bp, Mus musculus
accgtgtggcgcagggacaaggacc

SEQ ID NO: 115756 - DNA, 25 bp, Mus musculus
accgtgtggcgctgggacaaggacc

SEQ ID NO: 115757 - DNA, 25 bp, Mus musculus
accgtgtggcggaccttgagcagac

SEQ ID NO: 115758 - DNA, 25 bp, Mus musculus
accgtgtggcggtccttgagcagac

SEQ ID NO: 115759 - DNA, 25 bp, Mus musculus
accgtgtggtccatgaccgctggaa

SEQ ID NO: 115760 - DNA, 25 bp, Mus musculus
accgtgtggtccttgaccgctggaa

SEQ ID NO: 115761 - DNA, 25 bp, Mus musculus
accgtgtgtcagcacaacgtctgta

SEQ ID NO: 115762 - DNA, 25 bp, Mus musculus
accgtgtgtcaggacaacgtctgta

SEQ ID NO: 115763 - DNA, 25 bp, Mus musculus
accgtgtgtccgcttcagctgaaga

SEQ ID NO: 115764 - DNA, 25 bp, Mus musculus
accgtgtgtccggttcagctgaaga

SEQ ID NO: 115765 - DNA, 25 bp, Mus musculus
accgtgttaggcagctctcactgag

SEQ ID NO: 115766 - DNA, 25 bp, Mus musculus
accgtgttaggctgctctcactgag

SEQ ID NO: 115767 - DNA, 25 bp, Mus musculus
accgtgttcttcatcagcatcgaga

SEQ ID NO: 115768 - DNA, 25 bp, Mus musculus
accgtgttcttcttcagcatcgaga

SEQ ID NO: 115769 - DNA, 25 bp, Mus musculus
accgtgttggcgctaacagttcatt

SEQ ID NO: 115770 - DNA, 25 bp, Mus musculus
accgtgttggcggtaacagttcatt

SEQ ID NO: 115771 - DNA, 25 bp, Mus musculus
accgtgttgtacctcactgtggagc

SEQ ID NO: 115772 - DNA, 25 bp, Mus musculus
accgtgttgtacgtcactgtggagc

SEQ ID NO: 115773 - DNA, 25 bp, Mus musculus
accgttactttcatccaggagcttg

SEQ ID NO: 115774 - DNA, 25 bp, Mus musculus
accgttactttcttccaggagcttg

SEQ ID NO: 115775 - DNA, 25 bp, Mus musculus
accgttccaaacaggcggcgcatct

SEQ ID NO: 115776 - DNA, 25 bp, Mus musculus
accgttccaaactggcggcgcatct

SEQ ID NO: 115777 - DNA, 25 bp, Mus musculus
accgttcctcagatctgtacttaga

SEQ ID NO: 115778 - DNA, 25 bp, Mus musculus
accgttcctcagttctgtacttaga

SEQ ID NO: 115779 - DNA, 25 bp, Mus musculus
accgttctatgaccgcttctctgaa

SEQ ID NO: 115780 - DNA, 25 bp, Mus musculus
accgttctatgagcgcttctctgaa

SEQ ID NO: 115781 - DNA, 25 bp, Mus musculus
accgttctcatgcagaggccttaat

SEQ ID NO: 115782 - DNA, 25 bp, Mus musculus
accgttctcatggagaggccttaat

SEQ ID NO: 115783 - DNA, 25 bp, Mus musculus
accgttctcccaagatgttgctgta

SEQ ID NO: 115784 - DNA, 25 bp, Mus musculus
accgttctcccatgatgttgctgta

SEQ ID NO: 115785 - DNA, 25 bp, Mus musculus
accgttctgtaaattcattccaagg

SEQ ID NO: 115786 - DNA, 25 bp, Mus musculus
accgttctgtaatttcattccaagg

SEQ ID NO: 115787 - DNA, 25 bp, Mus musculus
accgttctgttcagggactggctat

SEQ ID NO: 115788 - DNA, 25 bp, Mus musculus
accgttctgttctgggactggctat

SEQ ID NO: 115789 - DNA, 25 bp, Mus musculus
accgttcttagcctgtccaaacatg

SEQ ID NO: 115790 - DNA, 25 bp, Mus musculus
accgttcttagcgtgtccaaacatg

SEQ ID NO: 115791 - DNA, 25 bp, Mus musculus
accgttcttcagcagtgaactggct

SEQ ID NO: 115792 - DNA, 25 bp, Mus musculus
accgttcttcaggagtgaactggct

SEQ ID NO: 115793 - DNA, 25 bp, Mus musculus
accgttcttttcactctggtggata

SEQ ID NO: 115794 - DNA, 25 bp, Mus musculus
accgttcttttctctctggtggata

SEQ ID NO: 115795 - DNA, 25 bp, Mus musculus
accgttgctgaccttgatcttatgg

SEQ ID NO: 115796 - DNA, 25 bp, Mus musculus
accgttgctgacgttgatcttatgg

SEQ ID NO: 115797 - DNA, 25 bp, Mus musculus
accgttggaggcaggatatctgatc

SEQ ID NO: 115798 - DNA, 25 bp, Mus musculus
accgttggaggctggatatctgatc

SEQ ID NO: 115799 - DNA, 25 bp, Mus musculus
accgttggcactctgttgcacttgg

SEQ ID NO: 115800 - DNA, 25 bp, Mus musculus
accgttggcactgtgttgcacttgg

SEQ ID NO: 115801 - DNA, 25 bp, Mus musculus
accgttgggttgcaaactgccttgg

SEQ ID NO: 115802 - DNA, 25 bp, Mus musculus
accgttgggttggaaactgccttgg

SEQ ID NO: 115803 - DNA, 25 bp, Mus musculus
accgttgtgtggagcacccagaggc

SEQ ID NO: 115804 - DNA, 25 bp, Mus musculus
accgttgtgtggtgcacccagaggc

SEQ ID NO: 115805 - DNA, 25 bp, Mus musculus
accgtttatgaaactctgggctctc

SEQ ID NO: 115806 - DNA, 25 bp, Mus musculus
accgtttatgaatctctgggctctc

SEQ ID NO: 115807 - DNA, 25 bp, Mus musculus
accgtttcagcaagaggcgtgactc

SEQ ID NO: 115808 - DNA, 25 bp, Mus musculus
accgtttcagcatgaggcgtgactc

SEQ ID NO: 115809 - DNA, 25 bp, Mus musculus
accgtttccagacttgttgggcact

SEQ ID NO: 115810 - DNA, 25 bp, Mus musculus
accgtttccagagttgttgggcact

SEQ ID NO: 115811 - DNA, 25 bp, Mus musculus
accgtttccctcaaaagaaatgcat

SEQ ID NO: 115812 - DNA, 25 bp, Mus musculus
accgtttccctctaaagaaatgcat

SEQ ID NO: 115813 - DNA, 25 bp, Mus musculus
accgtttcttgtaggctatagacta

SEQ ID NO: 115814 - DNA, 25 bp, Mus musculus
accgtttcttgttggctatagacta

SEQ ID NO: 115815 - DNA, 25 bp, Mus musculus
acctaaaaccaaacccagctgtgaa

SEQ ID NO: 115816 - DNA, 25 bp, Mus musculus
acctaaaaccaatcccagctgtgaa

SEQ ID NO: 115817 - DNA, 25 bp, Mus musculus
acctaaacatgcatgtaccacacat

SEQ ID NO: 115818 - DNA, 25 bp, Mus musculus
acctaaacatgcttgtaccacacat

SEQ ID NO: 115819 - DNA, 25 bp, Mus musculus
acctaaactttgacatttcccagtg

SEQ ID NO: 115820 - DNA, 25 bp, Mus musculus
acctaaactttgtcatttcccagtg

SEQ ID NO: 115821 - DNA, 25 bp, Mus musculus
acctaaagccttattcagagcatgg

SEQ ID NO: 115822 - DNA, 25 bp, Mus musculus
acctaaagcctttttcagagcatgg

SEQ ID NO: 115823 - DNA, 25 bp, Mus musculus
acctaaagtctgatctcatttcggg

SEQ ID NO: 115824 - DNA, 25 bp, Mus musculus
acctaaagtctgttctcatttcggg

SEQ ID NO: 115825 - DNA, 25 bp, Mus musculus
acctaaatagaaactaagtggcatt

SEQ ID NO: 115826 - DNA, 25 bp, Mus musculus
acctaaatagaatctaagtggcatt

SEQ ID NO: 115827 - DNA, 25 bp, Mus musculus
acctaaatgcacacagattttctga

SEQ ID NO: 115828 - DNA, 25 bp, Mus musculus
acctaaatgcactcagattttctga

SEQ ID NO: 115829 - DNA, 25 bp, Mus musculus
acctaacactagcatttcctcttaa

SEQ ID NO: 115830 - DNA, 25 bp, Mus musculus
acctaacactaggatttcctcttaa

SEQ ID NO: 115831 - DNA, 25 bp, Mus musculus
acctaaccgggcagagacttgctga

SEQ ID NO: 115832 - DNA, 25 bp, Mus musculus
acctaaccgggctgagacttgctga

SEQ ID NO: 115833 - DNA, 25 bp, Mus musculus
acctaacctgacatacaagacggag

SEQ ID NO: 115834 - DNA, 25 bp, Mus musculus
acctaacctgacttacaagacggag

SEQ ID NO: 115835 - DNA, 25 bp, Mus musculus
acctaacctgccagataaagtaatg

SEQ ID NO: 115836 - DNA, 25 bp, Mus musculus
acctaacctgcctgataaagtaatg

SEQ ID NO: 115837 - DNA, 25 bp, Mus musculus
acctaacgcgatcggagtatacact

SEQ ID NO: 115838 - DNA, 25 bp, Mus musculus
acctaacgcgatgggagtatacact

SEQ ID NO: 115839 - DNA, 25 bp, Mus musculus
acctaactatgtatctttggacaag

SEQ ID NO: 115840 - DNA, 25 bp, Mus musculus
acctaactatgtttctttggacaag

SEQ ID NO: 115841 - DNA, 25 bp, Mus musculus
acctaactctgtctcttacttctta

SEQ ID NO: 115842 - DNA, 25 bp, Mus musculus
acctaactctgtgtcttacttctta

SEQ ID NO: 115843 - DNA, 25 bp, Mus musculus
acctaacttctcagtgaggatctgg

SEQ ID NO: 115844 - DNA, 25 bp, Mus musculus
acctaacttctccaccaagatgaaa

SEQ ID NO: 115845 - DNA, 25 bp, Mus musculus
acctaacttctcgaccaagatgaaa

SEQ ID NO: 115846 - DNA, 25 bp, Mus musculus
acctaacttctctgtgaggatctgg

SEQ ID NO: 115847 - DNA, 25 bp, Mus musculus
acctaactttttctgtggctatctt

SEQ ID NO: 115848 - DNA, 25 bp, Mus musculus
acctaactttttgtgtggctatctt

SEQ ID NO: 115849 - DNA, 25 bp, Mus musculus
acctaagaagccatgtcctttgtgc

SEQ ID NO: 115850 - DNA, 25 bp, Mus musculus
acctaagaagccttgtcctttgtgc

SEQ ID NO: 115851 - DNA, 25 bp, Mus musculus
acctaagacagacatgctctctgca

SEQ ID NO: 115852 - DNA, 25 bp, Mus musculus
acctaagacagagatgctctctgca

SEQ ID NO: 115853 - DNA, 25 bp, Mus musculus
acctaagaccatataagtgtgtgtt

SEQ ID NO: 115854 - DNA, 25 bp, Mus musculus
acctaagaccatttaagtgtgtgtt

SEQ ID NO: 115855 - DNA, 25 bp, Mus musculus
acctaagattcgaggctctgggtct

SEQ ID NO: 115856 - DNA, 25 bp, Mus musculus
acctaagattcgtggctctgggtct

SEQ ID NO: 115857 - DNA, 25 bp, Mus musculus
acctaagcagctcacactgtgaaat

SEQ ID NO: 115858 - DNA, 25 bp, Mus musculus
acctaagcagctgacactgtgaaat

SEQ ID NO: 115859 - DNA, 25 bp, Mus musculus
acctaagctgatctcatattgttag

SEQ ID NO: 115860 - DNA, 25 bp, Mus musculus
acctaagctgatgtcatattgttag

SEQ ID NO: 115861 - DNA, 25 bp, Mus musculus
acctaaggacaaagtgcccaaatca

SEQ ID NO: 115862 - DNA, 25 bp, Mus musculus
acctaaggacaatgtgcccaaatca

SEQ ID NO: 115863 - DNA, 25 bp, Mus musculus
acctaaggcctgctacgactatgta

SEQ ID NO: 115864 - DNA, 25 bp, Mus musculus
acctaaggcctggtacgactatgta

SEQ ID NO: 115865 - DNA, 25 bp, Mus musculus
acctaaggccttcatcttttggcaa

SEQ ID NO: 115866 - DNA, 25 bp, Mus musculus
acctaaggccttgatcttttggcaa

SEQ ID NO: 115867 - DNA, 25 bp, Mus musculus
acctaagggttgactgtgatgtttc

SEQ ID NO: 115868 - DNA, 25 bp, Mus musculus
acctaagggttgtctgtgatgtttc

SEQ ID NO: 115869 - DNA, 25 bp, Mus musculus
acctaagtgactctgaatgcgccac

SEQ ID NO: 115870 - DNA, 25 bp, Mus musculus
acctaagtgactgtgaatgcgccac

SEQ ID NO: 115871 - DNA, 25 bp, Mus musculus
acctaagtggctatgaaatgtctat

SEQ ID NO: 115872 - DNA, 25 bp, Mus musculus
acctaagtggctttgaaatgtctat

SEQ ID NO: 115873 - DNA, 25 bp, Mus musculus
acctaagtttataatctgtgttcca

SEQ ID NO: 115874 - DNA, 25 bp, Mus musculus
acctaagtttattatctgtgttcca

SEQ ID NO: 115875 - DNA, 25 bp, Mus musculus
acctaatacaggctcacccttaatt

SEQ ID NO: 115876 - DNA, 25 bp, Mus musculus
acctaatacagggtcacccttaatt

SEQ ID NO: 115877 - DNA, 25 bp, Mus musculus
acctaatcggctctttccttctgat

SEQ ID NO: 115878 - DNA, 25 bp, Mus musculus
acctaatcggctgtttccttctgat

SEQ ID NO: 115879 - DNA, 25 bp, Mus musculus
acctaatctgctctttcattttggc

SEQ ID NO: 115880 - DNA, 25 bp, Mus musculus
acctaatctgctgtttcattttggc

SEQ ID NO: 115881 - DNA, 25 bp, Mus musculus
acctaatggtgaagagtagatcaac

SEQ ID NO: 115882 - DNA, 25 bp, Mus musculus
acctaatggtgatgagtagatcaac

SEQ ID NO: 115883 - DNA, 25 bp, Mus musculus
acctaatgtttaatgagcccctatg

SEQ ID NO: 115884 - DNA, 25 bp, Mus musculus
acctaatgtttattgagcccctatg

SEQ ID NO: 115885 - DNA, 25 bp, Mus musculus
acctaattgaacattctagagctag

SEQ ID NO: 115886 - DNA, 25 bp, Mus musculus
acctaattgaactttctagagctag

SEQ ID NO: 115887 - DNA, 25 bp, Mus musculus
acctaattggtcattctgagtcttg

SEQ ID NO: 115888 - DNA, 25 bp, Mus musculus
acctaattggtctttctgagtcttg

SEQ ID NO: 115889 - DNA, 25 bp, Mus musculus
acctaattgtgtattgtacccaaag

SEQ ID NO: 115890 - DNA, 25 bp, Mus musculus
acctaattgtgttttgtacccaaag

SEQ ID NO: 115891 - DNA, 25 bp, Mus musculus
acctaatttacacgtgaccttcact

SEQ ID NO: 115892 - DNA, 25 bp, Mus musculus
acctaatttacaggtgaccttcact

SEQ ID NO: 115893 - DNA, 25 bp, Mus musculus
acctaatttgttcatgggcactgta

SEQ ID NO: 115894 - DNA, 25 bp, Mus musculus
acctaatttgttgatgggcactgta

SEQ ID NO: 115895 - DNA, 25 bp, Mus musculus
acctaattttgaatacctcgtgtat

SEQ ID NO: 115896 - DNA, 25 bp, Mus musculus
acctaattttgattacctcgtgtat

SEQ ID NO: 115897 - DNA, 25 bp, Mus musculus
acctacaaatggaggcctttcttag

SEQ ID NO: 115898 - DNA, 25 bp, Mus musculus
acctacaaatggtggcctttcttag

SEQ ID NO: 115899 - DNA, 25 bp, Mus musculus
acctacaaccccatcatgagagtga

SEQ ID NO: 115900 - DNA, 25 bp, Mus musculus
acctacaaccccttcatgagagtga

SEQ ID NO: 115901 - DNA, 25 bp, Mus musculus
acctacaagggtactcacaagcact

SEQ ID NO: 115902 - DNA, 25 bp, Mus musculus
acctacaagggttctcacaagcact

SEQ ID NO: 115903 - DNA, 25 bp, Mus musculus
acctacaataggaggtggaattata

SEQ ID NO: 115904 - DNA, 25 bp, Mus musculus
acctacaataggtggtggaattata

SEQ ID NO: 115905 - DNA, 25 bp, Mus musculus
acctacacacccattcaggagatta

SEQ ID NO: 115906 - DNA, 25 bp, Mus musculus
acctacacaccctttcaggagatta

SEQ ID NO: 115907 - DNA, 25 bp, Mus musculus
acctacactaacctgggaaggacag

SEQ ID NO: 115908 - DNA, 25 bp, Mus musculus
acctacactaacgtgggaaggacag

SEQ ID NO: 115909 - DNA, 25 bp, Mus musculus
acctacagacaacaacagctgcctt

SEQ ID NO: 115910 - DNA, 25 bp, Mus musculus
acctacagacaagaacagctgcctt

SEQ ID NO: 115911 - DNA, 25 bp, Mus musculus
acctacagagccattgcctgatgga

SEQ ID NO: 115912 - DNA, 25 bp, Mus musculus
acctacagagcctttgcctgatgga

SEQ ID NO: 115913 - DNA, 25 bp, Mus musculus
acctacagggtgcatcacagccatt

SEQ ID NO: 115914 - DNA, 25 bp, Mus musculus
acctacagggtggatcacagccatt

SEQ ID NO: 115915 - DNA, 25 bp, Mus musculus
acctacagtaccaacaaccatctgg

SEQ ID NO: 115916 - DNA, 25 bp, Mus musculus
acctacagtacctacaaccatctgg

SEQ ID NO: 115917 - DNA, 25 bp, Mus musculus
acctacatcagaataaccctgccag

SEQ ID NO: 115918 - DNA, 25 bp, Mus musculus
acctacatcagattaaccctgccag

SEQ ID NO: 115919 - DNA, 25 bp, Mus musculus
acctaccaaagcagggagtggctgt

SEQ ID NO: 115920 - DNA, 25 bp, Mus musculus
acctaccaaagctgggagtggctgt

SEQ ID NO: 115921 - DNA, 25 bp, Mus musculus
acctaccaagaactgctgagagtga

SEQ ID NO: 115922 - DNA, 25 bp, Mus musculus
acctaccaagaagtgctgagagtga

SEQ ID NO: 115923 - DNA, 25 bp, Mus musculus
acctaccaagccattctcaatgaag

SEQ ID NO: 115924 - DNA, 25 bp, Mus musculus
acctaccaagcctttctcaatgaag

SEQ ID NO: 115925 - DNA, 25 bp, Mus musculus
acctaccacatgaagcacactgctg

SEQ ID NO: 115926 - DNA, 25 bp, Mus musculus
acctaccacatgtagcacactgctg

SEQ ID NO: 115927 - DNA, 25 bp, Mus musculus
acctaccatcaccatttgcttttgt

SEQ ID NO: 115928 - DNA, 25 bp, Mus musculus
acctaccatcacgatttgcttttgt

SEQ ID NO: 115929 - DNA, 25 bp, Mus musculus
acctaccatcttagctaggttccgg

SEQ ID NO: 115930 - DNA, 25 bp, Mus musculus
acctaccatctttgctaggttccgg

SEQ ID NO: 115931 - DNA, 25 bp, Mus musculus
acctaccccaagctttgtgatggac

SEQ ID NO: 115932 - DNA, 25 bp, Mus musculus
acctaccccaaggtttgtgatggac

SEQ ID NO: 115933 - DNA, 25 bp, Mus musculus
acctaccccgatctatggattttga

SEQ ID NO: 115934 - DNA, 25 bp, Mus musculus
acctaccccgatgtatggattttga

SEQ ID NO: 115935 - DNA, 25 bp, Mus musculus
acctaccctaggcactccacagctt

SEQ ID NO: 115936 - DNA, 25 bp, Mus musculus
acctaccctagggactccacagctt

SEQ ID NO: 115937 - DNA, 25 bp, Mus musculus
acctaccctgttacatgaccatgga

SEQ ID NO: 115938 - DNA, 25 bp, Mus musculus
acctaccctgtttcatgaccatgga

SEQ ID NO: 115939 - DNA, 25 bp, Mus musculus
acctaccgaattctcatgttcagca

SEQ ID NO: 115940 - DNA, 25 bp, Mus musculus
acctaccgaattgtcatgttcagca

SEQ ID NO: 115941 - DNA, 25 bp, Mus musculus
acctacctactgccgctgtggtggc

SEQ ID NO: 115942 - DNA, 25 bp, Mus musculus
acctacctactggcgctgtggtggc

SEQ ID NO: 115943 - DNA, 25 bp, Mus musculus
acctacctatatcgcttgctcatgg

SEQ ID NO: 115944 - DNA, 25 bp, Mus musculus
acctacctatatggcttgctcatgg

SEQ ID NO: 115945 - DNA, 25 bp, Mus musculus
acctacctatctattggcagtctac

SEQ ID NO: 115946 - DNA, 25 bp, Mus musculus
acctacctatcttttggcagtctac

SEQ ID NO: 115947 - DNA, 25 bp, Mus musculus
acctacctcaatatctccaagataa

SEQ ID NO: 115948 - DNA, 25 bp, Mus musculus
acctacctcaatttctccaagataa

SEQ ID NO: 115949 - DNA, 25 bp, Mus musculus
acctacctccagaccatggtatttt

SEQ ID NO: 115950 - DNA, 25 bp, Mus musculus
acctacctccagtccatggtatttt

SEQ ID NO: 115951 - DNA, 25 bp, Mus musculus
acctacctcctgatcaacatgtgaa

SEQ ID NO: 115952 - DNA, 25 bp, Mus musculus
acctacctcctgttcaacatgtgaa

SEQ ID NO: 115953 - DNA, 25 bp, Mus musculus
acctacctctgtctttgatggcatc

SEQ ID NO: 115954 - DNA, 25 bp, Mus musculus
acctacctctgtgtttgatggcatc

SEQ ID NO: 115955 - DNA, 25 bp, Mus musculus
acctacctgactcctggccttagaa

SEQ ID NO: 115956 - DNA, 25 bp, Mus musculus
acctacctgactgctggccttagaa

SEQ ID NO: 115957 - DNA, 25 bp, Mus musculus
acctacctggaacttctcagctaag

SEQ ID NO: 115958 - DNA, 25 bp, Mus musculus
acctacctggaagttctcagctaag

SEQ ID NO: 115959 - DNA, 25 bp, Mus musculus
acctacctgtaaatggatactctta

SEQ ID NO: 115960 - DNA, 25 bp, Mus musculus
acctacctgtaattggatactctta

SEQ ID NO: 115961 - DNA, 25 bp, Mus musculus
acctaccttgctagcctggacgtga

SEQ ID NO: 115962 - DNA, 25 bp, Mus musculus
acctaccttgcttgcctggacgtga

SEQ ID NO: 115963 - DNA, 25 bp, Mus musculus
acctaccttgtaatatacatgaaaa

SEQ ID NO: 115964 - DNA, 25 bp, Mus musculus
acctaccttgtattatacatgaaaa

SEQ ID NO: 115965 - DNA, 25 bp, Mus musculus
acctacctttttacctacagcagtg

SEQ ID NO: 115966 - DNA, 25 bp, Mus musculus
acctaccttttttcctacagcagtg

SEQ ID NO: 115967 - DNA, 25 bp, Mus musculus
acctacgatcccagatgcagtgact

SEQ ID NO: 115968 - DNA, 25 bp, Mus musculus
acctacgatccctgatgcagtgact

SEQ ID NO: 115969 - DNA, 25 bp, Mus musculus
acctacggcgttcgtgccatgaatg

SEQ ID NO: 115970 - DNA, 25 bp, Mus musculus
acctacggcgttggtgccatgaatg

SEQ ID NO: 115971 - DNA, 25 bp, Mus musculus
acctacgtcagaaagccactacttg

SEQ ID NO: 115972 - DNA, 25 bp, Mus musculus
acctacgtcagatagccactacttg

SEQ ID NO: 115973 - DNA, 25 bp, Mus musculus
acctacgtctatatggtggccaggc

SEQ ID NO: 115974 - DNA, 25 bp, Mus musculus
acctacgtctatttggtggccaggc

SEQ ID NO: 115975 - DNA, 25 bp, Mus musculus
acctacgtgatgctccacgcgttga

SEQ ID NO: 115976 - DNA, 25 bp, Mus musculus
acctacgtgatggtccacgcgttga

SEQ ID NO: 115977 - DNA, 25 bp, Mus musculus
acctacgtgtggacgttcaggctaa

SEQ ID NO: 115978 - DNA, 25 bp, Mus musculus
acctacgtgtggtcgttcaggctaa

SEQ ID NO: 115979 - DNA, 25 bp, Mus musculus
acctacgtgtgtaatgccaccaacg

SEQ ID NO: 115980 - DNA, 25 bp, Mus musculus
acctacgtgtgttatgccaccaacg

SEQ ID NO: 115981 - DNA, 25 bp, Mus musculus
acctactaattaatacttcttgtat

SEQ ID NO: 115982 - DNA, 25 bp, Mus musculus
acctactaattattacttcttgtat

SEQ ID NO: 115983 - DNA, 25 bp, Mus musculus
acctactacaagagcctgtctacac

SEQ ID NO: 115984 - DNA, 25 bp, Mus musculus
acctactacaagtgcctgtctacac

SEQ ID NO: 115985 - DNA, 25 bp, Mus musculus
acctactacttacttgatactcatg

SEQ ID NO: 115986 - DNA, 25 bp, Mus musculus
acctactacttagttgatactcatg

SEQ ID NO: 115987 - DNA, 25 bp, Mus musculus
acctactactttctggtgatgtacc

SEQ ID NO: 115988 - DNA, 25 bp, Mus musculus
acctactactttgtggtgatgtacc

SEQ ID NO: 115989 - DNA, 25 bp, Mus musculus
acctactataacatccatgtgtgtt

SEQ ID NO: 115990 - DNA, 25 bp, Mus musculus
acctactataacttccatgtgtgtt

SEQ ID NO: 115991 - DNA, 25 bp, Mus musculus
acctactatgcacagggctctggga

SEQ ID NO: 115992 - DNA, 25 bp, Mus musculus
acctactatgcagagggctctggga

SEQ ID NO: 115993 - DNA, 25 bp, Mus musculus
acctactatggcaggatctgttttc

SEQ ID NO: 115994 - DNA, 25 bp, Mus musculus
acctactatggctggatctgttttc

SEQ ID NO: 115995 - DNA, 25 bp, Mus musculus
acctactcctcgatatgtcagcatt

SEQ ID NO: 115996 - DNA, 25 bp, Mus musculus
acctactcctcgttatgtcagcatt

SEQ ID NO: 115997 - DNA, 25 bp, Mus musculus
acctactcctggagggtccgagtga

SEQ ID NO: 115998 - DNA, 25 bp, Mus musculus
acctactcctggtgggtccgagtga

SEQ ID NO: 115999 - DNA, 25 bp, Mus musculus
acctactctcctattctgaaatctt

SEQ ID NO: 116000 - DNA, 25 bp, Mus musculus
acctactctccttttctgaaatctt

SEQ ID NO: 116001 - DNA, 25 bp, Mus musculus
acctactgacgaagctcctcaggag

SEQ ID NO: 116002 - DNA, 25 bp, Mus musculus
acctactgacgatgctcctcaggag

SEQ ID NO: 116003 - DNA, 25 bp, Mus musculus
acctactgactgatgaactgcgctg

SEQ ID NO: 116004 - DNA, 25 bp, Mus musculus
acctactgactgttgaactgcgctg

SEQ ID NO: 116005 - DNA, 25 bp, Mus musculus
acctactgccatacggtgcctgatg

SEQ ID NO: 116006 - DNA, 25 bp, Mus musculus
acctactgccattcggtgcctgatg

SEQ ID NO: 116007 - DNA, 25 bp, Mus musculus
acctactggcggacagaaaagattt

SEQ ID NO: 116008 - DNA, 25 bp, Mus musculus
acctactggcggtcagaaaagattt

SEQ ID NO: 116009 - DNA, 25 bp, Mus musculus
acctactgtctgatatttgctttta

SEQ ID NO: 116010 - DNA, 25 bp, Mus musculus
acctactgtctgttatttgctttta

SEQ ID NO: 116011 - DNA, 25 bp, Mus musculus
acctactgtgtgactatccttatac

SEQ ID NO: 116012 - DNA, 25 bp, Mus musculus
acctactgtgtgctgagagctacct

SEQ ID NO: 116013 - DNA, 25 bp, Mus musculus
acctactgtgtggtgagagctacct

SEQ ID NO: 116014 - DNA, 25 bp, Mus musculus
acctactgtgtgtctatccttatac

SEQ ID NO: 116015 - DNA, 25 bp, Mus musculus
acctactgttccacaggatctctgg

SEQ ID NO: 116016 - DNA, 25 bp, Mus musculus
acctactgttcctcaggatctctgg

SEQ ID NO: 116017 - DNA, 25 bp, Mus musculus
acctacttactaacagctgacatca

SEQ ID NO: 116018 - DNA, 25 bp, Mus musculus
acctacttactatcagctgacatca

SEQ ID NO: 116019 - DNA, 25 bp, Mus musculus
acctacttccctcactttgatgtaa

SEQ ID NO: 116020 - DNA, 25 bp, Mus musculus
acctacttccctgactttgatgtaa

SEQ ID NO: 116021 - DNA, 25 bp, Mus musculus
acctacttggacagtggaacgctgc

SEQ ID NO: 116022 - DNA, 25 bp, Mus musculus
acctacttggactgtggaacgctgc

SEQ ID NO: 116023 - DNA, 25 bp, Mus musculus
acctactttcaaaatgcctgcacta

SEQ ID NO: 116024 - DNA, 25 bp, Mus musculus
acctactttcaatatgcctgcacta

SEQ ID NO: 116025 - DNA, 25 bp, Mus musculus
acctagaactctctaaacctccaag

SEQ ID NO: 116026 - DNA, 25 bp, Mus musculus
acctagaactctgtaaacctccaag

SEQ ID NO: 116027 - DNA, 25 bp, Mus musculus
acctagaagcctcctgcaaccagct

SEQ ID NO: 116028 - DNA, 25 bp, Mus musculus
acctagaagcctgctgcaaccagct

SEQ ID NO: 116029 - DNA, 25 bp, Mus musculus
acctagaagtcactgtgtggccact

SEQ ID NO: 116030 - DNA, 25 bp, Mus musculus
acctagaagtcagtgtgtggccact

SEQ ID NO: 116031 - DNA, 25 bp, Mus musculus
acctagacagtgcttgtgcaagagc

SEQ ID NO: 116032 - DNA, 25 bp, Mus musculus
acctagacagtggttgtgcaagagc

SEQ ID NO: 116033 - DNA, 25 bp, Mus musculus
acctagacctagcactgttagccag

SEQ ID NO: 116034 - DNA, 25 bp, Mus musculus
acctagacctaggactgttagccag

SEQ ID NO: 116035 - DNA, 25 bp, Mus musculus
acctagactactcacagggccttaa

SEQ ID NO: 116036 - DNA, 25 bp, Mus musculus
acctagactactgacagggccttaa

SEQ ID NO: 116037 - DNA, 25 bp, Mus musculus
acctagattcacctgcaggtgacct

SEQ ID NO: 116038 - DNA, 25 bp, Mus musculus
acctagattcacgtgcaggtgacct

SEQ ID NO: 116039 - DNA, 25 bp, Mus musculus
acctagatttctcacgacgagtaat

SEQ ID NO: 116040 - DNA, 25 bp, Mus musculus
acctagatttctgacgacgagtaat

SEQ ID NO: 116041 - DNA, 25 bp, Mus musculus
acctagcaacctattggtaaaccag

SEQ ID NO: 116042 - DNA, 25 bp, Mus musculus
acctagcaaccttttggtaaaccag

SEQ ID NO: 116043 - DNA, 25 bp, Mus musculus
acctagcaagttatcacactggcca

SEQ ID NO: 116044 - DNA, 25 bp, Mus musculus
acctagcaagttttcacactggcca

SEQ ID NO: 116045 - DNA, 25 bp, Mus musculus
acctagcaataacgagctctggaga

SEQ ID NO: 116046 - DNA, 25 bp, Mus musculus
acctagcaataaggagctctggaga

SEQ ID NO: 116047 - DNA, 25 bp, Mus musculus
acctagcagcggatggctttcttta

SEQ ID NO: 116048 - DNA, 25 bp, Mus musculus
acctagcagcggttggctttcttta

SEQ ID NO: 116049 - DNA, 25 bp, Mus musculus
acctagcaggtgcacagcatctcaa

SEQ ID NO: 116050 - DNA, 25 bp, Mus musculus
acctagcaggtggacagcatctcaa

SEQ ID NO: 116051 - DNA, 25 bp, Mus musculus
acctagcatctcaaagggtgccttc

SEQ ID NO: 116052 - DNA, 25 bp, Mus musculus
acctagcatctctaagggtgccttc

SEQ ID NO: 116053 - DNA, 25 bp, Mus musculus
acctagcatcttagacagggtctct

SEQ ID NO: 116054 - DNA, 25 bp, Mus musculus
acctagcatctttgacagggtctct

SEQ ID NO: 116055 - DNA, 25 bp, Mus musculus
acctagccaaacaatcagttgaagt

SEQ ID NO: 116056 - DNA, 25 bp, Mus musculus
acctagccaaactatcagttgaagt

SEQ ID NO: 116057 - DNA, 25 bp, Mus musculus
acctagccagtaagtgtgagtccct

SEQ ID NO: 116058 - DNA, 25 bp, Mus musculus
acctagccagtatgtgtgagtccct

SEQ ID NO: 116059 - DNA, 25 bp, Mus musculus
acctagccatggaggaactcactct

SEQ ID NO: 116060 - DNA, 25 bp, Mus musculus
acctagccatggtggaactcactct

SEQ ID NO: 116061 - DNA, 25 bp, Mus musculus
acctagcccgatattcctgtaatga

SEQ ID NO: 116062 - DNA, 25 bp, Mus musculus
acctagcccgattttcctgtaatga

SEQ ID NO: 116063 - DNA, 25 bp, Mus musculus
acctagcctgatccatgagcgtcaa

SEQ ID NO: 116064 - DNA, 25 bp, Mus musculus
acctagcctgatgcatgagcgtcaa

SEQ ID NO: 116065 - DNA, 25 bp, Mus musculus
acctagcctggaattgtgcataaca

SEQ ID NO: 116066 - DNA, 25 bp, Mus musculus
acctagcctggatttgtgcataaca

SEQ ID NO: 116067 - DNA, 25 bp, Mus musculus
acctagcctggtactctgatttttt

SEQ ID NO: 116068 - DNA, 25 bp, Mus musculus
acctagcctggttctctgatttttt

SEQ ID NO: 116069 - DNA, 25 bp, Mus musculus
acctagcgagctactggatatgttt

SEQ ID NO: 116070 - DNA, 25 bp, Mus musculus
acctagcgagcttctggatatgttt

SEQ ID NO: 116071 - DNA, 25 bp, Mus musculus
acctagctccctaggccaggaatga

SEQ ID NO: 116072 - DNA, 25 bp, Mus musculus
acctagctcccttggccaggaatga

SEQ ID NO: 116073 - DNA, 25 bp, Mus musculus
acctagctgcccagcatgagaattg

SEQ ID NO: 116074 - DNA, 25 bp, Mus musculus
acctagctgccctgcatgagaattg

SEQ ID NO: 116075 - DNA, 25 bp, Mus musculus
acctagctggaaagcccaccagggc

SEQ ID NO: 116076 - DNA, 25 bp, Mus musculus
acctagctggaatgcccaccagggc

SEQ ID NO: 116077 - DNA, 25 bp, Mus musculus
acctagctttgcattctcaaccagc

SEQ ID NO: 116078 - DNA, 25 bp, Mus musculus
acctagctttgctttctcaaccagc

SEQ ID NO: 116079 - DNA, 25 bp, Mus musculus
acctagctttgtactgttgaaatcg

SEQ ID NO: 116080 - DNA, 25 bp, Mus musculus
acctagctttgtctttgccccatgt

SEQ ID NO: 116081 - DNA, 25 bp, Mus musculus
acctagctttgtgtttgccccatgt

SEQ ID NO: 116082 - DNA, 25 bp, Mus musculus
acctagctttgttctgttgaaatcg

SEQ ID NO: 116083 - DNA, 25 bp, Mus musculus
acctagcttttgaagtttagctcct

SEQ ID NO: 116084 - DNA, 25 bp, Mus musculus
acctagcttttgtagtttagctcct

SEQ ID NO: 116085 - DNA, 25 bp, Mus musculus
acctaggaacctctgtcttgtttct

SEQ ID NO: 116086 - DNA, 25 bp, Mus musculus
acctaggaacctgtgtcttgtttct

SEQ ID NO: 116087 - DNA, 25 bp, Mus musculus
acctaggaagtgatcgccttgacta

SEQ ID NO: 116088 - DNA, 25 bp, Mus musculus
acctaggaagtgttcgccttgacta

SEQ ID NO: 116089 - DNA, 25 bp, Mus musculus
acctaggaccatctgtacccgaagc

SEQ ID NO: 116090 - DNA, 25 bp, Mus musculus
acctaggaccatgtgtacccgaagc

SEQ ID NO: 116091 - DNA, 25 bp, Mus musculus
acctaggcacagctttgtattacgc

SEQ ID NO: 116092 - DNA, 25 bp, Mus musculus
acctaggcacaggtttgtattacgc

SEQ ID NO: 116093 - DNA, 25 bp, Mus musculus
acctaggcctctatgctcatatata

SEQ ID NO: 116094 - DNA, 25 bp, Mus musculus
acctaggcctctttgctcatatata

SEQ ID NO: 116095 - DNA, 25 bp, Mus musculus
acctaggccttcctgcacatatgta

SEQ ID NO: 116096 - DNA, 25 bp, Mus musculus
acctaggccttcgtgcacatatgta

SEQ ID NO: 116097 - DNA, 25 bp, Mus musculus
acctaggctataatagaccctgtct

SEQ ID NO: 116098 - DNA, 25 bp, Mus musculus
acctaggctatattagaccctgtct

SEQ ID NO: 116099 - DNA, 25 bp, Mus musculus
acctaggctcagaatggttcctggc

SEQ ID NO: 116100 - DNA, 25 bp, Mus musculus
acctaggctcagtatggttcctggc

SEQ ID NO: 116101 - DNA, 25 bp, Mus musculus
acctaggggcaaccatgtttcctga

SEQ ID NO: 116102 - DNA, 25 bp, Mus musculus
acctaggggcaagcatgtttcctga

SEQ ID NO: 116103 - DNA, 25 bp, Mus musculus
acctagggtctacagccgagagtca

SEQ ID NO: 116104 - DNA, 25 bp, Mus musculus
acctagggtctagagccgagagtca

SEQ ID NO: 116105 - DNA, 25 bp, Mus musculus
acctaggtgtggagtcctagagctt

SEQ ID NO: 116106 - DNA, 25 bp, Mus musculus
acctaggtgtggtgtcctagagctt

SEQ ID NO: 116107 - DNA, 25 bp, Mus musculus
acctaggttagtatctgtctctctc

SEQ ID NO: 116108 - DNA, 25 bp, Mus musculus
acctaggttagtttctgtctctctc

SEQ ID NO: 116109 - DNA, 25 bp, Mus musculus
acctaggttcccattgctttataca

SEQ ID NO: 116110 - DNA, 25 bp, Mus musculus
acctaggttccctttgctttataca

SEQ ID NO: 116111 - DNA, 25 bp, Mus musculus
acctaggttcctagcttatacattt

SEQ ID NO: 116112 - DNA, 25 bp, Mus musculus
acctaggttccttgcttatacattt

SEQ ID NO: 116113 - DNA, 25 bp, Mus musculus
acctaggttcgtcctgcagcagcaa

SEQ ID NO: 116114 - DNA, 25 bp, Mus musculus
acctaggttcgtgctgcagcagcaa

SEQ ID NO: 116115 - DNA, 25 bp, Mus musculus
acctagtaacacagatgactcttct

SEQ ID NO: 116116 - DNA, 25 bp, Mus musculus
acctagtaacactgatgactcttct

SEQ ID NO: 116117 - DNA, 25 bp, Mus musculus
acctagtaggagctgtgaccctgta

SEQ ID NO: 116118 - DNA, 25 bp, Mus musculus
acctagtaggaggtgtgaccctgta

SEQ ID NO: 116119 - DNA, 25 bp, Mus musculus
acctagtcatacagcagcttgatac

SEQ ID NO: 116120 - DNA, 25 bp, Mus musculus
acctagtcatactgcagcttgatac

SEQ ID NO: 116121 - DNA, 25 bp, Mus musculus
acctagtcatcacagggctccactg

SEQ ID NO: 116122 - DNA, 25 bp, Mus musculus
acctagtcatcagagggctccactg

SEQ ID NO: 116123 - DNA, 25 bp, Mus musculus
acctagtccgtgagcagagcaactg

SEQ ID NO: 116124 - DNA, 25 bp, Mus musculus
acctagtccgtgtgcagagcaactg

SEQ ID NO: 116125 - DNA, 25 bp, Mus musculus
acctagtcctgaattatcagagttg

SEQ ID NO: 116126 - DNA, 25 bp, Mus musculus
acctagtcctgatttatcagagttg

SEQ ID NO: 116127 - DNA, 25 bp, Mus musculus
acctagtcttctagggtgacatatt

SEQ ID NO: 116128 - DNA, 25 bp, Mus musculus
acctagtcttcttgggtgacatatt

SEQ ID NO: 116129 - DNA, 25 bp, Mus musculus
acctagtgactcacaagcttgcaga

SEQ ID NO: 116130 - DNA, 25 bp, Mus musculus
acctagtgactctcaagcttgcaga

SEQ ID NO: 116131 - DNA, 25 bp, Mus musculus
acctagtgcaatatccctgcagatg

SEQ ID NO: 116132 - DNA, 25 bp, Mus musculus
acctagtgcaatttccctgcagatg

SEQ ID NO: 116133 - DNA, 25 bp, Mus musculus
acctagtgttatacacatatcataa

SEQ ID NO: 116134 - DNA, 25 bp, Mus musculus
acctagtgttattcacatatcataa

SEQ ID NO: 116135 - DNA, 25 bp, Mus musculus
acctagttgcctcattccctaggac

SEQ ID NO: 116136 - DNA, 25 bp, Mus musculus
acctagttgcctgattccctaggac

SEQ ID NO: 116137 - DNA, 25 bp, Mus musculus
acctagttgtgtagatttctacctg

SEQ ID NO: 116138 - DNA, 25 bp, Mus musculus
acctagttgtgttgatttctacctg

SEQ ID NO: 116139 - DNA, 25 bp, Mus musculus
acctagtttattcctgttggacatt

SEQ ID NO: 116140 - DNA, 25 bp, Mus musculus
acctagtttattgctgttggacatt

SEQ ID NO: 116141 - DNA, 25 bp, Mus musculus
acctagtttcctctaaaagtccatg

SEQ ID NO: 116142 - DNA, 25 bp, Mus musculus
acctagtttcctgtaaaagtccatg

SEQ ID NO: 116143 - DNA, 25 bp, Mus musculus
acctataatcctatgtttgcgttgt

SEQ ID NO: 116144 - DNA, 25 bp, Mus musculus
acctataatcctttgtttgcgttgt

SEQ ID NO: 116145 - DNA, 25 bp, Mus musculus
acctataccaagatgaaccctctgc

SEQ ID NO: 116146 - DNA, 25 bp, Mus musculus
acctataccaagttgaaccctctgc

SEQ ID NO: 116147 - DNA, 25 bp, Mus musculus
acctatacctaccatactgcactgt

SEQ ID NO: 116148 - DNA, 25 bp, Mus musculus
acctatacctacgatactgcactgt

SEQ ID NO: 116149 - DNA, 25 bp, Mus musculus
acctatacctatacctctatctatt

SEQ ID NO: 116150 - DNA, 25 bp, Mus musculus
acctatacctattcctctatctatt

SEQ ID NO: 116151 - DNA, 25 bp, Mus musculus
acctatactgtacatctgggccgag

SEQ ID NO: 116152 - DNA, 25 bp, Mus musculus
acctatactgtagatctgggccgag

SEQ ID NO: 116153 - DNA, 25 bp, Mus musculus
acctatactttgatcagctggaaaa

SEQ ID NO: 116154 - DNA, 25 bp, Mus musculus
acctatactttgttcagctggaaaa

SEQ ID NO: 116155 - DNA, 25 bp, Mus musculus
acctatagccttaagttgtgtgctg

SEQ ID NO: 116156 - DNA, 25 bp, Mus musculus
acctatagcctttagttgtgtgctg

SEQ ID NO: 116157 - DNA, 25 bp, Mus musculus
acctataggcttccatgttcacata

SEQ ID NO: 116158 - DNA, 25 bp, Mus musculus
acctataggcttgcatgttcacata

SEQ ID NO: 116159 - DNA, 25 bp, Mus musculus
acctataggtagctctgtgtttctg

SEQ ID NO: 116160 - DNA, 25 bp, Mus musculus
acctataggtaggtctgtgtttctg

SEQ ID NO: 116161 - DNA, 25 bp, Mus musculus
acctatagtcccatgcacagtaata

SEQ ID NO: 116162 - DNA, 25 bp, Mus musculus
acctatagtcccttgcacagtaata

SEQ ID NO: 116163 - DNA, 25 bp, Mus musculus
acctatataagaacccagtagaagg

SEQ ID NO: 116164 - DNA, 25 bp, Mus musculus
acctatataagatcccagtagaagg

SEQ ID NO: 116165 - DNA, 25 bp, Mus musculus
acctatatcacaaacgtcttctaca

SEQ ID NO: 116166 - DNA, 25 bp, Mus musculus
acctatatcacatacgtcttctaca

SEQ ID NO: 116167 - DNA, 25 bp, Mus musculus
acctatatccccatgttttgtgact

SEQ ID NO: 116168 - DNA, 25 bp, Mus musculus
acctatatccccttgttttgtgact

SEQ ID NO: 116169 - DNA, 25 bp, Mus musculus
acctatatgccacggtgttcccttt

SEQ ID NO: 116170 - DNA, 25 bp, Mus musculus
acctatatgccagggtgttcccttt

SEQ ID NO: 116171 - DNA, 25 bp, Mus musculus
acctatatggacaataggctggccc

SEQ ID NO: 116172 - DNA, 25 bp, Mus musculus
acctatatggactataggctggccc

SEQ ID NO: 116173 - DNA, 25 bp, Mus musculus
acctatatttttctatatgtctgga

SEQ ID NO: 116174 - DNA, 25 bp, Mus musculus
acctatatttttgtatatgtctgga

SEQ ID NO: 116175 - DNA, 25 bp, Mus musculus
acctatcaatagctgtgtttctttt

SEQ ID NO: 116176 - DNA, 25 bp, Mus musculus
acctatcaataggtgtgtttctttt

SEQ ID NO: 116177 - DNA, 25 bp, Mus musculus
acctatcaattgctggagactccgt

SEQ ID NO: 116178 - DNA, 25 bp, Mus musculus
acctatcaattggtggagactccgt

SEQ ID NO: 116179 - DNA, 25 bp, Mus musculus
acctatcaggatacaacgtttgtaa

SEQ ID NO: 116180 - DNA, 25 bp, Mus musculus
acctatcaggattcaacgtttgtaa

SEQ ID NO: 116181 - DNA, 25 bp, Mus musculus
acctatcccagcacagatggcaaga

SEQ ID NO: 116182 - DNA, 25 bp, Mus musculus
acctatcccagctcagatggcaaga

SEQ ID NO: 116183 - DNA, 25 bp, Mus musculus
acctatcccatacacttgatctgaa

SEQ ID NO: 116184 - DNA, 25 bp, Mus musculus
acctatcccatagacttgatctgaa

SEQ ID NO: 116185 - DNA, 25 bp, Mus musculus
acctatcccctgacaatagtttgtg

SEQ ID NO: 116186 - DNA, 25 bp, Mus musculus
acctatcccctgtcaatagtttgtg

SEQ ID NO: 116187 - DNA, 25 bp, Mus musculus
acctatcctggccacgttttagatg

SEQ ID NO: 116188 - DNA, 25 bp, Mus musculus
acctatcctggcgacgttttagatg

SEQ ID NO: 116189 - DNA, 25 bp, Mus musculus
acctatcgcctccaatatgtaattc

SEQ ID NO: 116190 - DNA, 25 bp, Mus musculus
acctatcgcctcgaatatgtaattc

SEQ ID NO: 116191 - DNA, 25 bp, Mus musculus
acctatcggccccaaggatggaatg

SEQ ID NO: 116192 - DNA, 25 bp, Mus musculus
acctatcggcccgaaggatggaatg

SEQ ID NO: 116193 - DNA, 25 bp, Mus musculus
acctatctacccaggctgagaggca

SEQ ID NO: 116194 - DNA, 25 bp, Mus musculus
acctatctaccctggctgagaggca

SEQ ID NO: 116195 - DNA, 25 bp, Mus musculus
acctatctagggaggcatacatctt

SEQ ID NO: 116196 - DNA, 25 bp, Mus musculus
acctatctagggtggcatacatctt

SEQ ID NO: 116197 - DNA, 25 bp, Mus musculus
acctatctcagactccttgacaaga

SEQ ID NO: 116198 - DNA, 25 bp, Mus musculus
acctatctcagagtccttgacaaga

SEQ ID NO: 116199 - DNA, 25 bp, Mus musculus
acctatctccatatttacctcagag

SEQ ID NO: 116200 - DNA, 25 bp, Mus musculus
acctatctccatttttacctcagag

SEQ ID NO: 116201 - DNA, 25 bp, Mus musculus
acctatcttccaaaaatgcggagga

SEQ ID NO: 116202 - DNA, 25 bp, Mus musculus
acctatcttccataaatgcggagga

SEQ ID NO: 116203 - DNA, 25 bp, Mus musculus
acctatgaagtcattggatttgcca

SEQ ID NO: 116204 - DNA, 25 bp, Mus musculus
acctatgaagtctttggatttgcca

SEQ ID NO: 116205 - DNA, 25 bp, Mus musculus
acctatgacaacctgcaacttttgc

SEQ ID NO: 116206 - DNA, 25 bp, Mus musculus
acctatgacaacgtgcaacttttgc

SEQ ID NO: 116207 - DNA, 25 bp, Mus musculus
acctatgacaagattgaccccaaca

SEQ ID NO: 116208 - DNA, 25 bp, Mus musculus
acctatgacaagtttgaccccaaca

SEQ ID NO: 116209 - DNA, 25 bp, Mus musculus
acctatgacaatcctgcggtgacat

SEQ ID NO: 116210 - DNA, 25 bp, Mus musculus
acctatgacaatgctgcggtgacat

SEQ ID NO: 116211 - DNA, 25 bp, Mus musculus
acctatgaggatccccaggctgttg

SEQ ID NO: 116212 - DNA, 25 bp, Mus musculus
acctatgaggatgcccaggctgttg

SEQ ID NO: 116213 - DNA, 25 bp, Mus musculus
acctatgatcatccggcagagggct

SEQ ID NO: 116214 - DNA, 25 bp, Mus musculus
acctatgatcatgcggcagagggct

SEQ ID NO: 116215 - DNA, 25 bp, Mus musculus
acctatgcaagcatcgacttcctgt

SEQ ID NO: 116216 - DNA, 25 bp, Mus musculus
acctatgcaagcttcgacttcctgt

SEQ ID NO: 116217 - DNA, 25 bp, Mus musculus
acctatgcatgtactcagtcctttg

SEQ ID NO: 116218 - DNA, 25 bp, Mus musculus
acctatgcatgttctcagtcctttg

SEQ ID NO: 116219 - DNA, 25 bp, Mus musculus
acctatgccatcaatgtgggtctga

SEQ ID NO: 116220 - DNA, 25 bp, Mus musculus
acctatgccatctatgtgggtctga

SEQ ID NO: 116221 - DNA, 25 bp, Mus musculus
acctatgccattagttttagattga

SEQ ID NO: 116222 - DNA, 25 bp, Mus musculus
acctatgccatttgttttagattga

SEQ ID NO: 116223 - DNA, 25 bp, Mus musculus
acctatgcccatacactggaactag

SEQ ID NO: 116224 - DNA, 25 bp, Mus musculus
acctatgcccattcactggaactag

SEQ ID NO: 116225 - DNA, 25 bp, Mus musculus
acctatgcccggctttctggtagag

SEQ ID NO: 116226 - DNA, 25 bp, Mus musculus
acctatgcccgggtttctggtagag

SEQ ID NO: 116227 - DNA, 25 bp, Mus musculus
acctatgcctggctgctggcaaaag

SEQ ID NO: 116228 - DNA, 25 bp, Mus musculus
acctatgcctgggtgctggcaaaag

SEQ ID NO: 116229 - DNA, 25 bp, Mus musculus
acctatgccttacactagctacaca

SEQ ID NO: 116230 - DNA, 25 bp, Mus musculus
acctatgccttagactagctacaca

SEQ ID NO: 116231 - DNA, 25 bp, Mus musculus
acctatggacagcagctgctctgct

SEQ ID NO: 116232 - DNA, 25 bp, Mus musculus
acctatggacaggagctgctctgct

SEQ ID NO: 116233 - DNA, 25 bp, Mus musculus
acctatgggatcatgttctgtcaga

SEQ ID NO: 116234 - DNA, 25 bp, Mus musculus
acctatgggatcttgttctgtcaga

SEQ ID NO: 116235 - DNA, 25 bp, Mus musculus
acctatgtgaacaggtggtccacag

SEQ ID NO: 116236 - DNA, 25 bp, Mus musculus
acctatgtgaactggtggtccacag

SEQ ID NO: 116237 - DNA, 25 bp, Mus musculus
acctatgtgcataagatttttgaaa

SEQ ID NO: 116238 - DNA, 25 bp, Mus musculus
acctatgtgcattagatttttgaaa

SEQ ID NO: 116239 - DNA, 25 bp, Mus musculus
acctatgtgtgcatttgtccagtca

SEQ ID NO: 116240 - DNA, 25 bp, Mus musculus
acctatgtgtgcttttgtccagtca

SEQ ID NO: 116241 - DNA, 25 bp, Mus musculus
acctatgttgtgacaggcatgcttt

SEQ ID NO: 116242 - DNA, 25 bp, Mus musculus
acctatgttgtgtcaggcatgcttt

SEQ ID NO: 116243 - DNA, 25 bp, Mus musculus
acctattacgtgcatcacaccaata

SEQ ID NO: 116244 - DNA, 25 bp, Mus musculus
acctattacgtggatcacaccaata

SEQ ID NO: 116245 - DNA, 25 bp, Mus musculus
acctattccagccttgatgcaactg

SEQ ID NO: 116246 - DNA, 25 bp, Mus musculus
acctattccagcgttgatgcaactg

SEQ ID NO: 116247 - DNA, 25 bp, Mus musculus
acctattcctgtcaggaccctttca

SEQ ID NO: 116248 - DNA, 25 bp, Mus musculus
acctattcctgtgaggaccctttca

SEQ ID NO: 116249 - DNA, 25 bp, Mus musculus
acctattgcctcacttcaaagacaa

SEQ ID NO: 116250 - DNA, 25 bp, Mus musculus
acctattgcctctcttcaaagacaa

SEQ ID NO: 116251 - DNA, 25 bp, Mus musculus
acctattgcggaattatcatctgga

SEQ ID NO: 116252 - DNA, 25 bp, Mus musculus
acctattgcggatttatcatctgga

SEQ ID NO: 116253 - DNA, 25 bp, Mus musculus
acctattggcccatgaactggcgca

SEQ ID NO: 116254 - DNA, 25 bp, Mus musculus
acctattggcccttgaactggcgca

SEQ ID NO: 116255 - DNA, 25 bp, Mus musculus
acctatttattcattagtttctggg

SEQ ID NO: 116256 - DNA, 25 bp, Mus musculus
acctatttattctttagtttctggg

SEQ ID NO: 116257 - DNA, 25 bp, Mus musculus
acctatttccacacgttcagacagt

SEQ ID NO: 116258 - DNA, 25 bp, Mus musculus
acctatttccactcgttcagacagt

SEQ ID NO: 116259 - DNA, 25 bp, Mus musculus
acctatttccatatacagctgcctg

SEQ ID NO: 116260 - DNA, 25 bp, Mus musculus
acctatttccatttacagctgcctg

SEQ ID NO: 116261 - DNA, 25 bp, Mus musculus
acctattttatccatacccaatctg

SEQ ID NO: 116262 - DNA, 25 bp, Mus musculus
acctattttatcgatacccaatctg

SEQ ID NO: 116263 - DNA, 25 bp, Mus musculus
acctatttttcaagcagattgcaca

SEQ ID NO: 116264 - DNA, 25 bp, Mus musculus
acctatttttcatgcagattgcaca

SEQ ID NO: 116265 - DNA, 25 bp, Mus musculus
acctattttttgaccagcagagact

SEQ ID NO: 116266 - DNA, 25 bp, Mus musculus
acctattttttgtccagcagagact

SEQ ID NO: 116267 - DNA, 25 bp, Mus musculus
acctcaaactcccagcacatagaaa

SEQ ID NO: 116268 - DNA, 25 bp, Mus musculus
acctcaaactccgagcacatagaaa

SEQ ID NO: 116269 - DNA, 25 bp, Mus musculus
acctcaaatgagcatgtggctcccc

SEQ ID NO: 116270 - DNA, 25 bp, Mus musculus
acctcaaatgaggatgtggctcccc

SEQ ID NO: 116271 - DNA, 25 bp, Mus musculus
acctcaacaagtcgacgagtgtact

SEQ ID NO: 116272 - DNA, 25 bp, Mus musculus
acctcaacaagtggacgagtgtact

SEQ ID NO: 116273 - DNA, 25 bp, Mus musculus
acctcaacagtgagacgtcttccaa

SEQ ID NO: 116274 - DNA, 25 bp, Mus musculus
acctcaacagtgtgacgtcttccaa

SEQ ID NO: 116275 - DNA, 25 bp, Mus musculus
acctcaacatttctgggatgtgtgt

SEQ ID NO: 116276 - DNA, 25 bp, Mus musculus
acctcaacatttgtgggatgtgtgt

SEQ ID NO: 116277 - DNA, 25 bp, Mus musculus
acctcaacccaaagaccagtcttaa

SEQ ID NO: 116278 - DNA, 25 bp, Mus musculus
acctcaacccaatgaccagtcttaa

SEQ ID NO: 116279 - DNA, 25 bp, Mus musculus
acctcaaccctgagattgcaggtgt

SEQ ID NO: 116280 - DNA, 25 bp, Mus musculus
acctcaaccctgtgattgcaggtgt

SEQ ID NO: 116281 - DNA, 25 bp, Mus musculus
acctcaacctggcattctgtgttaa

SEQ ID NO: 116282 - DNA, 25 bp, Mus musculus
acctcaacctgggattctgtgttaa

SEQ ID NO: 116283 - DNA, 25 bp, Mus musculus
acctcaactattattggctgcccat

SEQ ID NO: 116284 - DNA, 25 bp, Mus musculus
acctcaactatttttggctgcccat

SEQ ID NO: 116285 - DNA, 25 bp, Mus musculus
acctcaactcttatctggtagcagt

SEQ ID NO: 116286 - DNA, 25 bp, Mus musculus
acctcaactcttttctggtagcagt

SEQ ID NO: 116287 - DNA, 25 bp, Mus musculus
acctcaactgagaccatccagagct

SEQ ID NO: 116288 - DNA, 25 bp, Mus musculus
acctcaactgagtccatccagagct

SEQ ID NO: 116289 - DNA, 25 bp, Mus musculus
acctcaagactgctcttcgttgaag

SEQ ID NO: 116290 - DNA, 25 bp, Mus musculus
acctcaagactggtcttcgttgaag

SEQ ID NO: 116291 - DNA, 25 bp, Mus musculus
acctcaagtcacacctggaagggaa

SEQ ID NO: 116292 - DNA, 25 bp, Mus musculus
acctcaagtcactcctggaagggaa

SEQ ID NO: 116293 - DNA, 25 bp, Mus musculus
acctcaagtgaaagtccttcgcctt

SEQ ID NO: 116294 - DNA, 25 bp, Mus musculus
acctcaagtgaatgtccttcgcctt

SEQ ID NO: 116295 - DNA, 25 bp, Mus musculus
acctcaagtgacatctagggctctt

SEQ ID NO: 116296 - DNA, 25 bp, Mus musculus
acctcaagtgacttctagggctctt

SEQ ID NO: 116297 - DNA, 25 bp, Mus musculus
acctcaatatcaaactaaccgacat

SEQ ID NO: 116298 - DNA, 25 bp, Mus musculus
acctcaatatcatactaaccgacat

SEQ ID NO: 116299 - DNA, 25 bp, Mus musculus
acctcaatcgccacttggtgaatgt

SEQ ID NO: 116300 - DNA, 25 bp, Mus musculus
acctcaatcgcctcttggtgaatgt

SEQ ID NO: 116301 - DNA, 25 bp, Mus musculus
acctcaatggcaaattctgaccctg

SEQ ID NO: 116302 - DNA, 25 bp, Mus musculus
acctcaatggcatattctgaccctg

SEQ ID NO: 116303 - DNA, 25 bp, Mus musculus
acctcaatgtccaaatagcagcctc

SEQ ID NO: 116304 - DNA, 25 bp, Mus musculus
acctcaatgtcctaatagcagcctc

SEQ ID NO: 116305 - DNA, 25 bp, Mus musculus
acctcaattcagatcaggtccttga

SEQ ID NO: 116306 - DNA, 25 bp, Mus musculus
acctcaattcagttcaggtccttga

SEQ ID NO: 116307 - DNA, 25 bp, Mus musculus
acctcaattgaacaacagatgcaag

SEQ ID NO: 116308 - DNA, 25 bp, Mus musculus
acctcaattgaagaacagatgcaag

SEQ ID NO: 116309 - DNA, 25 bp, Mus musculus
acctcacaaaatcagttctgcccag

SEQ ID NO: 116310 - DNA, 25 bp, Mus musculus
acctcacaaaatgagttctgcccag

SEQ ID NO: 116311 - DNA, 25 bp, Mus musculus
acctcacaaaggcatcctcaagaag

SEQ ID NO: 116312 - DNA, 25 bp, Mus musculus
acctcacaaagggatcctcaagaag

SEQ ID NO: 116313 - DNA, 25 bp, Mus musculus
acctcacaaggtacccaaagctaag

SEQ ID NO: 116314 - DNA, 25 bp, Mus musculus
acctcacaaggttcccaaagctaag

SEQ ID NO: 116315 - DNA, 25 bp, Mus musculus
acctcacaatccctaatttaaccat

SEQ ID NO: 116316 - DNA, 25 bp, Mus musculus
acctcacaatccgtaatttaaccat

SEQ ID NO: 116317 - DNA, 25 bp, Mus musculus
acctcacacacacgctgggtgacat

SEQ ID NO: 116318 - DNA, 25 bp, Mus musculus
acctcacacacaggctgggtgacat

SEQ ID NO: 116319 - DNA, 25 bp, Mus musculus
acctcacacagcctgggtatggaag

SEQ ID NO: 116320 - DNA, 25 bp, Mus musculus
acctcacacagcgtgggtatggaag

SEQ ID NO: 116321 - DNA, 25 bp, Mus musculus
acctcacagactagtttgcttgcca

SEQ ID NO: 116322 - DNA, 25 bp, Mus musculus
acctcacagacttgtttgcttgcca

SEQ ID NO: 116323 - DNA, 25 bp, Mus musculus
acctcacaggaacgttgaacaagtg

SEQ ID NO: 116324 - DNA, 25 bp, Mus musculus
acctcacaggaaggttgaacaagtg

SEQ ID NO: 116325 - DNA, 25 bp, Mus musculus
acctcacaggatctagctggctatt

SEQ ID NO: 116326 - DNA, 25 bp, Mus musculus
acctcacaggatgtagctggctatt

SEQ ID NO: 116327 - DNA, 25 bp, Mus musculus
acctcacaggttccccaaatggaag

SEQ ID NO: 116328 - DNA, 25 bp, Mus musculus
acctcacaggttgcccaaatggaag

SEQ ID NO: 116329 - DNA, 25 bp, Mus musculus
acctcacatcctaggtaccagggaa

SEQ ID NO: 116330 - DNA, 25 bp, Mus musculus
acctcacatccttggtaccagggaa

SEQ ID NO: 116331 - DNA, 25 bp, Mus musculus
acctcacatcttcctttctataagg

SEQ ID NO: 116332 - DNA, 25 bp, Mus musculus
acctcacatcttgctttctataagg

SEQ ID NO: 116333 - DNA, 25 bp, Mus musculus
acctcacatgacagatactgtcttg

SEQ ID NO: 116334 - DNA, 25 bp, Mus musculus
acctcacatgactgatactgtcttg

SEQ ID NO: 116335 - DNA, 25 bp, Mus musculus
acctcacattagctggctgatgcca

SEQ ID NO: 116336 - DNA, 25 bp, Mus musculus
acctcacattaggtggctgatgcca

SEQ ID NO: 116337 - DNA, 25 bp, Mus musculus
acctcacattccagtcagcaaattg

SEQ ID NO: 116338 - DNA, 25 bp, Mus musculus
acctcacattcctgtcagcaaattg

SEQ ID NO: 116339 - DNA, 25 bp, Mus musculus
acctcaccaagacggctggagaact

SEQ ID NO: 116340 - DNA, 25 bp, Mus musculus
acctcaccaagagggctggagaact

SEQ ID NO: 116341 - DNA, 25 bp, Mus musculus
acctcaccacagactaactctgaaa

SEQ ID NO: 116342 - DNA, 25 bp, Mus musculus
acctcaccacagtctaactctgaaa

SEQ ID NO: 116343 - DNA, 25 bp, Mus musculus
acctcaccagataatttaattttct

SEQ ID NO: 116344 - DNA, 25 bp, Mus musculus
acctcaccagattatttaattttct

SEQ ID NO: 116345 - DNA, 25 bp, Mus musculus
acctcaccatttctagcttgttgaa

SEQ ID NO: 116346 - DNA, 25 bp, Mus musculus
acctcaccatttgtagcttgttgaa

SEQ ID NO: 116347 - DNA, 25 bp, Mus musculus
acctcacccagcaaaataagtcttg

SEQ ID NO: 116348 - DNA, 25 bp, Mus musculus
acctcacccagctaaataagtcttg

SEQ ID NO: 116349 - DNA, 25 bp, Mus musculus
acctcacctcatctgaaaagtccag

SEQ ID NO: 116350 - DNA, 25 bp, Mus musculus
acctcacctcatgtgaaaagtccag

SEQ ID NO: 116351 - DNA, 25 bp, Mus musculus
acctcacctcggatagcggaaacag

SEQ ID NO: 116352 - DNA, 25 bp, Mus musculus
acctcacctcggttagcggaaacag

SEQ ID NO: 116353 - DNA, 25 bp, Mus musculus
acctcacctgctcatgaggttgaag

SEQ ID NO: 116354 - DNA, 25 bp, Mus musculus
acctcacctgctgatgaggttgaag

SEQ ID NO: 116355 - DNA, 25 bp, Mus musculus
acctcacctgtaaagtcgttctgcg

SEQ ID NO: 116356 - DNA, 25 bp, Mus musculus
acctcacctgtatagtcgttctgcg

SEQ ID NO: 116357 - DNA, 25 bp, Mus musculus
acctcacgcaggattaacatttctc

SEQ ID NO: 116358 - DNA, 25 bp, Mus musculus
acctcacgcaggtttaacatttctc

SEQ ID NO: 116359 - DNA, 25 bp, Mus musculus
acctcacgttgcaggtgctgtagaa

SEQ ID NO: 116360 - DNA, 25 bp, Mus musculus
acctcacgttgctggtgctgtagaa

SEQ ID NO: 116361 - DNA, 25 bp, Mus musculus
acctcactaaggaatatgctctcaa

SEQ ID NO: 116362 - DNA, 25 bp, Mus musculus
acctcactaaggtatatgctctcaa

SEQ ID NO: 116363 - DNA, 25 bp, Mus musculus
acctcactccctactaaagagacta

SEQ ID NO: 116364 - DNA, 25 bp, Mus musculus
acctcactcccttctaaagagacta

SEQ ID NO: 116365 - DNA, 25 bp, Mus musculus
acctcactctttcccttgctttaga

SEQ ID NO: 116366 - DNA, 25 bp, Mus musculus
acctcactctttgccttgctttaga

SEQ ID NO: 116367 - DNA, 25 bp, Mus musculus
acctcactgaatagcatcctgtaga

SEQ ID NO: 116368 - DNA, 25 bp, Mus musculus
acctcactgaattgcatcctgtaga

SEQ ID NO: 116369 - DNA, 25 bp, Mus musculus
acctcactgcttcctgacaggaaga

SEQ ID NO: 116370 - DNA, 25 bp, Mus musculus
acctcactgcttgctgacaggaaga

SEQ ID NO: 116371 - DNA, 25 bp, Mus musculus
acctcactgggacaaagagacgaca

SEQ ID NO: 116372 - DNA, 25 bp, Mus musculus
acctcactgggagaaagagacgaca

SEQ ID NO: 116373 - DNA, 25 bp, Mus musculus
acctcactgggcactaaggtactgt

SEQ ID NO: 116374 - DNA, 25 bp, Mus musculus
acctcactgggctctaaggtactgt

SEQ ID NO: 116375 - DNA, 25 bp, Mus musculus
acctcacttcacacaaaactaattc

SEQ ID NO: 116376 - DNA, 25 bp, Mus musculus
acctcacttcactcaaaactaattc

SEQ ID NO: 116377 - DNA, 25 bp, Mus musculus
acctcactttgcacctctgtaaaat

SEQ ID NO: 116378 - DNA, 25 bp, Mus musculus
acctcactttgctcctctgtaaaat

SEQ ID NO: 116379 - DNA, 25 bp, Mus musculus
acctcactttgtcgtttgagaaatg

SEQ ID NO: 116380 - DNA, 25 bp, Mus musculus
acctcactttgtggtttgagaaatg

SEQ ID NO: 116381 - DNA, 25 bp, Mus musculus
acctcacttttacttaatgtgtgcc

SEQ ID NO: 116382 - DNA, 25 bp, Mus musculus
acctcacttttagttaatgtgtgcc

SEQ ID NO: 116383 - DNA, 25 bp, Mus musculus
acctcagaacagcatccattcttgt

SEQ ID NO: 116384 - DNA, 25 bp, Mus musculus
acctcagaacaggatccattcttgt

SEQ ID NO: 116385 - DNA, 25 bp, Mus musculus
acctcagacaggacccatctaagag

SEQ ID NO: 116386 - DNA, 25 bp, Mus musculus
acctcagacaggtcccatctaagag

SEQ ID NO: 116387 - DNA, 25 bp, Mus musculus
acctcagactcaaactcttgaaagt

SEQ ID NO: 116388 - DNA, 25 bp, Mus musculus
acctcagactcatactcttgaaagt

SEQ ID NO: 116389 - DNA, 25 bp, Mus musculus
acctcagactttctgcagcttttcc

SEQ ID NO: 116390 - DNA, 25 bp, Mus musculus
acctcagactttgtgcagcttttcc

SEQ ID NO: 116391 - DNA, 25 bp, Mus musculus
acctcagagacaatgtttccatttg

SEQ ID NO: 116392 - DNA, 25 bp, Mus musculus
acctcagagacattgtttccatttg

SEQ ID NO: 116393 - DNA, 25 bp, Mus musculus
acctcagaggtcactttcagctcaa

SEQ ID NO: 116394 - DNA, 25 bp, Mus musculus
acctcagaggtctctttcagctcaa

SEQ ID NO: 116395 - DNA, 25 bp, Mus musculus
acctcagagtatatacaacaccatg

SEQ ID NO: 116396 - DNA, 25 bp, Mus musculus
acctcagagtatttacaacaccatg

SEQ ID NO: 116397 - DNA, 25 bp, Mus musculus
acctcagagtgcagttctttgctaa

SEQ ID NO: 116398 - DNA, 25 bp, Mus musculus
acctcagagtgctgttctttgctaa

SEQ ID NO: 116399 - DNA, 25 bp, Mus musculus
acctcagatctcaccttttcaggtg

SEQ ID NO: 116400 - DNA, 25 bp, Mus musculus
acctcagatctctccttttcaggtg

SEQ ID NO: 116401 - DNA, 25 bp, Mus musculus
acctcagatgatatggcttaacgat

SEQ ID NO: 116402 - DNA, 25 bp, Mus musculus
acctcagatgatttggcttaacgat

SEQ ID NO: 116403 - DNA, 25 bp, Mus musculus
acctcagatgcaacttcttggccaa

SEQ ID NO: 116404 - DNA, 25 bp, Mus musculus
acctcagatgcatcttcttggccaa

SEQ ID NO: 116405 - DNA, 25 bp, Mus musculus
acctcagcacatagtaattgtatat

SEQ ID NO: 116406 - DNA, 25 bp, Mus musculus
acctcagcacattgtaattgtatat

SEQ ID NO: 116407 - DNA, 25 bp, Mus musculus
acctcagcactgcttggcattatac

SEQ ID NO: 116408 - DNA, 25 bp, Mus musculus
acctcagcactggttggcattatac

SEQ ID NO: 116409 - DNA, 25 bp, Mus musculus
acctcagcagcaaatttcactcgga

SEQ ID NO: 116410 - DNA, 25 bp, Mus musculus
acctcagcagcatatttcactcgga

SEQ ID NO: 116411 - DNA, 25 bp, Mus musculus
acctcagcagctagcaacatagtat

SEQ ID NO: 116412 - DNA, 25 bp, Mus musculus
acctcagcagcttgcaacatagtat

SEQ ID NO: 116413 - DNA, 25 bp, Mus musculus
acctcagcaggcatgtgagtgcttc

SEQ ID NO: 116414 - DNA, 25 bp, Mus musculus
acctcagcaggcttgtgagtgcttc

SEQ ID NO: 116415 - DNA, 25 bp, Mus musculus
acctcagcaggtagcaccatgtaga

SEQ ID NO: 116416 - DNA, 25 bp, Mus musculus
acctcagcaggttgcaccatgtaga

SEQ ID NO: 116417 - DNA, 25 bp, Mus musculus
acctcagcagtcctgttcctttgta

SEQ ID NO: 116418 - DNA, 25 bp, Mus musculus
acctcagcagtcgtgttcctttgta

SEQ ID NO: 116419 - DNA, 25 bp, Mus musculus
acctcagcagttaccagttactcgg

SEQ ID NO: 116420 - DNA, 25 bp, Mus musculus
acctcagcagtttccagttactcgg

SEQ ID NO: 116421 - DNA, 25 bp, Mus musculus
acctcagcatatcatggtccttacc

SEQ ID NO: 116422 - DNA, 25 bp, Mus musculus
acctcagcatatgatggtccttacc

SEQ ID NO: 116423 - DNA, 25 bp, Mus musculus
acctcagcatggaatatggtcatac

SEQ ID NO: 116424 - DNA, 25 bp, Mus musculus
acctcagcatggtatatggtcatac

SEQ ID NO: 116425 - DNA, 25 bp, Mus musculus
acctcagccactaactgtggctgtg

SEQ ID NO: 116426 - DNA, 25 bp, Mus musculus
acctcagccacttactgtggctgtg

SEQ ID NO: 116427 - DNA, 25 bp, Mus musculus
acctcagccagaccaggatcctgtg

SEQ ID NO: 116428 - DNA, 25 bp, Mus musculus
acctcagccagagcaggatcctgtg

SEQ ID NO: 116429 - DNA, 25 bp, Mus musculus
acctcagccatccattttcttatgt

SEQ ID NO: 116430 - DNA, 25 bp, Mus musculus
acctcagccatcgattttcttatgt

SEQ ID NO: 116431 - DNA, 25 bp, Mus musculus
acctcagccctacttgtccagaagg

SEQ ID NO: 116432 - DNA, 25 bp, Mus musculus
acctcagccctagttgtccagaagg

SEQ ID NO: 116433 - DNA, 25 bp, Mus musculus
acctcagccgcgcacagtgggtaca

SEQ ID NO: 116434 - DNA, 25 bp, Mus musculus
acctcagccgcggacagtgggtaca

SEQ ID NO: 116435 - DNA, 25 bp, Mus musculus
acctcagccgtgaggacactggctg

SEQ ID NO: 116436 - DNA, 25 bp, Mus musculus
acctcagccgtgtggacactggctg

SEQ ID NO: 116437 - DNA, 25 bp, Mus musculus
acctcagcctctactatttgtagac

SEQ ID NO: 116438 - DNA, 25 bp, Mus musculus
acctcagcctcttctatttgtagac

SEQ ID NO: 116439 - DNA, 25 bp, Mus musculus
acctcagcgatcagatcgacctggt

SEQ ID NO: 116440 - DNA, 25 bp, Mus musculus
acctcagcgatctgatcgacctggt

SEQ ID NO: 116441 - DNA, 25 bp, Mus musculus
acctcagcggctccgacctgttgtg

SEQ ID NO: 116442 - DNA, 25 bp, Mus musculus
acctcagcggctgcgacctgttgtg

SEQ ID NO: 116443 - DNA, 25 bp, Mus musculus
acctcagctatcaccttatgtgtaa

SEQ ID NO: 116444 - DNA, 25 bp, Mus musculus
acctcagctatctccttatgtgtaa

SEQ ID NO: 116445 - DNA, 25 bp, Mus musculus
acctcagctcaaagggtcaatgaag

SEQ ID NO: 116446 - DNA, 25 bp, Mus musculus
acctcagctcaatgggtcaatgaag

SEQ ID NO: 116447 - DNA, 25 bp, Mus musculus
acctcagctcagaaagtgcattgcc

SEQ ID NO: 116448 - DNA, 25 bp, Mus musculus
acctcagctcagtaagtgcattgcc

SEQ ID NO: 116449 - DNA, 25 bp, Mus musculus
acctcagctcgaagttccttgttag

SEQ ID NO: 116450 - DNA, 25 bp, Mus musculus
acctcagctcgatgttccttgttag

SEQ ID NO: 116451 - DNA, 25 bp, Mus musculus
acctcagctcgtaaggcaggaagag

SEQ ID NO: 116452 - DNA, 25 bp, Mus musculus
acctcagctcgttaggcaggaagag

SEQ ID NO: 116453 - DNA, 25 bp, Mus musculus
acctcagctctgaactagccttgaa

SEQ ID NO: 116454 - DNA, 25 bp, Mus musculus
acctcagctctgtactagccttgaa

SEQ ID NO: 116455 - DNA, 25 bp, Mus musculus
acctcagctgctcagtaggttgaga

SEQ ID NO: 116456 - DNA, 25 bp, Mus musculus
acctcagctgctgagtaggttgaga

SEQ ID NO: 116457 - DNA, 25 bp, Mus musculus
acctcagctgggatgctcagggaac

SEQ ID NO: 116458 - DNA, 25 bp, Mus musculus
acctcagctgggttgctcagggaac

SEQ ID NO: 116459 - DNA, 25 bp, Mus musculus
acctcagctggtactgtaatgtgac

SEQ ID NO: 116460 - DNA, 25 bp, Mus musculus
acctcagctggttctgtaatgtgac

SEQ ID NO: 116461 - DNA, 25 bp, Mus musculus
acctcagctgtgacagtcggaccaa

SEQ ID NO: 116462 - DNA, 25 bp, Mus musculus
acctcagctgtgtcagtcggaccaa

SEQ ID NO: 116463 - DNA, 25 bp, Mus musculus
acctcagcttttcctgaagaaggac

SEQ ID NO: 116464 - DNA, 25 bp, Mus musculus
acctcagcttttgctgaagaaggac

SEQ ID NO: 116465 - DNA, 25 bp, Mus musculus
acctcaggaattctggtgccagtct

SEQ ID NO: 116466 - DNA, 25 bp, Mus musculus
acctcaggaattgtggtgccagtct

SEQ ID NO: 116467 - DNA, 25 bp, Mus musculus
acctcaggacagaaaagatttacgg

SEQ ID NO: 116468 - DNA, 25 bp, Mus musculus
acctcaggacagtaaagatttacgg

SEQ ID NO: 116469 - DNA, 25 bp, Mus musculus
acctcaggaggcaattacagatacg

SEQ ID NO: 116470 - DNA, 25 bp, Mus musculus
acctcaggaggctattacagatacg

SEQ ID NO: 116471 - DNA, 25 bp, Mus musculus
acctcaggagtgaataagcttttat

SEQ ID NO: 116472 - DNA, 25 bp, Mus musculus
acctcaggagtgtataagcttttat

SEQ ID NO: 116473 - DNA, 25 bp, Mus musculus
acctcagggccaatatggtgcttct

SEQ ID NO: 116474 - DNA, 25 bp, Mus musculus
acctcagggccactagatgaccctg

SEQ ID NO: 116475 - DNA, 25 bp, Mus musculus
acctcagggccagtagatgaccctg

SEQ ID NO: 116476 - DNA, 25 bp, Mus musculus
acctcagggccattatggtgcttct

SEQ ID NO: 116477 - DNA, 25 bp, Mus musculus
acctcagggctgcaggcaagtgtct

SEQ ID NO: 116478 - DNA, 25 bp, Mus musculus
acctcagggctggaggcaagtgtct

SEQ ID NO: 116479 - DNA, 25 bp, Mus musculus
acctcagggtccataaacagtatct

SEQ ID NO: 116480 - DNA, 25 bp, Mus musculus
acctcagggtccttaaacagtatct

SEQ ID NO: 116481 - DNA, 25 bp, Mus musculus
acctcagggtgtagttggtggccat

SEQ ID NO: 116482 - DNA, 25 bp, Mus musculus
acctcagggtgttgttggtggccat

SEQ ID NO: 116483 - DNA, 25 bp, Mus musculus
acctcaggtcctcaatctttaggac

SEQ ID NO: 116484 - DNA, 25 bp, Mus musculus
acctcaggtcctgaatctttaggac

SEQ ID NO: 116485 - DNA, 25 bp, Mus musculus
acctcagtatctcacagcacatcga

SEQ ID NO: 116486 - DNA, 25 bp, Mus musculus
acctcagtatctgacagcacatcga

SEQ ID NO: 116487 - DNA, 25 bp, Mus musculus
acctcagtcatgaaattagtccaaa

SEQ ID NO: 116488 - DNA, 25 bp, Mus musculus
acctcagtcatgtaattagtccaaa

SEQ ID NO: 116489 - DNA, 25 bp, Mus musculus
acctcagtcctgaagacttagggcc

SEQ ID NO: 116490 - DNA, 25 bp, Mus musculus
acctcagtcctgtagacttagggcc

SEQ ID NO: 116491 - DNA, 25 bp, Mus musculus
acctcagtctggaaagccccaaggc

SEQ ID NO: 116492 - DNA, 25 bp, Mus musculus
acctcagtctggtaagccccaaggc

SEQ ID NO: 116493 - DNA, 25 bp, Mus musculus
acctcagtgactaagcaaatgtaat

SEQ ID NO: 116494 - DNA, 25 bp, Mus musculus
acctcagtgacttagcaaatgtaat

SEQ ID NO: 116495 - DNA, 25 bp, Mus musculus
acctcagtgagacagctatgcttgc

SEQ ID NO: 116496 - DNA, 25 bp, Mus musculus
acctcagtgagagagctatgcttgc

SEQ ID NO: 116497 - DNA, 25 bp, Mus musculus
acctcagtgagcctatctatcgtaa

SEQ ID NO: 116498 - DNA, 25 bp, Mus musculus
acctcagtgagcgtatctatcgtaa

SEQ ID NO: 116499 - DNA, 25 bp, Mus musculus
acctcagtgaggatctgttcacagt

SEQ ID NO: 116500 - DNA, 25 bp, Mus musculus
acctcagtgaggttctgttcacagt

SEQ ID NO: 116501 - DNA, 25 bp, Mus musculus
acctcagtgcccctttactgatgaa

SEQ ID NO: 116502 - DNA, 25 bp, Mus musculus
acctcagtgcccgtttactgatgaa

SEQ ID NO: 116503 - DNA, 25 bp, Mus musculus
acctcagtgtgcagttcaactccat

SEQ ID NO: 116504 - DNA, 25 bp, Mus musculus
acctcagtgtgctgttcaactccat

SEQ ID NO: 116505 - DNA, 25 bp, Mus musculus
acctcagtgtttcacattggtcctt

SEQ ID NO: 116506 - DNA, 25 bp, Mus musculus
acctcagtgtttgacattggtcctt

SEQ ID NO: 116507 - DNA, 25 bp, Mus musculus
acctcagttcctaagcgagccaaga

SEQ ID NO: 116508 - DNA, 25 bp, Mus musculus
acctcagttccttagcgagccaaga

SEQ ID NO: 116509 - DNA, 25 bp, Mus musculus
acctcagttctgctcaaagtcacgg

SEQ ID NO: 116510 - DNA, 25 bp, Mus musculus
acctcagttctggtcaaagtcacgg

SEQ ID NO: 116511 - DNA, 25 bp, Mus musculus
acctcagtttgaagatgatgcagac

SEQ ID NO: 116512 - DNA, 25 bp, Mus musculus
acctcagtttgatgatgatgcagac

SEQ ID NO: 116513 - DNA, 25 bp, Mus musculus
acctcataggctccgttgggagcat

SEQ ID NO: 116514 - DNA, 25 bp, Mus musculus
acctcataggctgcgttgggagcat

SEQ ID NO: 116515 - DNA, 25 bp, Mus musculus
acctcatattacaactcttcgcaaa

SEQ ID NO: 116516 - DNA, 25 bp, Mus musculus
acctcatattactactcttcgcaaa

SEQ ID NO: 116517 - DNA, 25 bp, Mus musculus
acctcatcaaaacttacctgcataa

SEQ ID NO: 116518 - DNA, 25 bp, Mus musculus
acctcatcaaaagttacctgcataa

SEQ ID NO: 116519 - DNA, 25 bp, Mus musculus
acctcatcatttcacacgagctgaa

SEQ ID NO: 116520 - DNA, 25 bp, Mus musculus
acctcatcatttgacacgagctgaa

SEQ ID NO: 116521 - DNA, 25 bp, Mus musculus
acctcatccgcaatctgagcaagga

SEQ ID NO: 116522 - DNA, 25 bp, Mus musculus
acctcatccgcattctgagcaagga

SEQ ID NO: 116523 - DNA, 25 bp, Mus musculus
acctcatcctggaatgcagaaccaa

SEQ ID NO: 116524 - DNA, 25 bp, Mus musculus
acctcatcctggtatgcagaaccaa

SEQ ID NO: 116525 - DNA, 25 bp, Mus musculus
acctcatctcttatctcaagcatgg

SEQ ID NO: 116526 - DNA, 25 bp, Mus musculus
acctcatctcttttctcaagcatgg

SEQ ID NO: 116527 - DNA, 25 bp, Mus musculus
acctcatctggtcgccactgtgaat

SEQ ID NO: 116528 - DNA, 25 bp, Mus musculus
acctcatctggtggccactgtgaat

SEQ ID NO: 116529 - DNA, 25 bp, Mus musculus
acctcatctttaccccggcgtggtg

SEQ ID NO: 116530 - DNA, 25 bp, Mus musculus
acctcatctttagcccggcgtggtg

SEQ ID NO: 116531 - DNA, 25 bp, Mus musculus
acctcatgcacaacttcatcttgaa

SEQ ID NO: 116532 - DNA, 25 bp, Mus musculus
acctcatgcacacctgtatactgta

SEQ ID NO: 116533 - DNA, 25 bp, Mus musculus
acctcatgcacagctgtatactgta

SEQ ID NO: 116534 - DNA, 25 bp, Mus musculus
acctcatgcacatcttcatcttgaa

SEQ ID NO: 116535 - DNA, 25 bp, Mus musculus
acctcatgcaggctcaggcagtaaa

SEQ ID NO: 116536 - DNA, 25 bp, Mus musculus
acctcatgcagggtcaggcagtaaa

SEQ ID NO: 116537 - DNA, 25 bp, Mus musculus
acctcatgcctgacaccaagactgg

SEQ ID NO: 116538 - DNA, 25 bp, Mus musculus
acctcatgcctgtcaccaagactgg

SEQ ID NO: 116539 - DNA, 25 bp, Mus musculus
acctcatgctaactggagtatgtgc

SEQ ID NO: 116540 - DNA, 25 bp, Mus musculus
acctcatgctaagtggagtatgtgc

SEQ ID NO: 116541 - DNA, 25 bp, Mus musculus
acctcatggaggctgccggcactgt

SEQ ID NO: 116542 - DNA, 25 bp, Mus musculus
acctcatggagggtgccggcactgt

SEQ ID NO: 116543 - DNA, 25 bp, Mus musculus
acctcatggatcagctggccaagga

SEQ ID NO: 116544 - DNA, 25 bp, Mus musculus
acctcatggatctgctggccaagga

SEQ ID NO: 116545 - DNA, 25 bp, Mus musculus
acctcatggatgagcttggtgtggt

SEQ ID NO: 116546 - DNA, 25 bp, Mus musculus
acctcatggatgtgcttggtgtggt

SEQ ID NO: 116547 - DNA, 25 bp, Mus musculus
acctcatggcccagatatatccaag

SEQ ID NO: 116548 - DNA, 25 bp, Mus musculus
acctcatggccctgatatatccaag

SEQ ID NO: 116549 - DNA, 25 bp, Mus musculus
acctcatggcctacatggcctccaa

SEQ ID NO: 116550 - DNA, 25 bp, Mus musculus
acctcatggccttcatggcctccaa

SEQ ID NO: 116551 - DNA, 25 bp, Mus musculus
acctcatggcgcagtttgtttcaga

SEQ ID NO: 116552 - DNA, 25 bp, Mus musculus
acctcatggcgctgtttgtttcaga

SEQ ID NO: 116553 - DNA, 25 bp, Mus musculus
acctcatggttgatgctacacttct

SEQ ID NO: 116554 - DNA, 25 bp, Mus musculus
acctcatggttgttgctacacttct

SEQ ID NO: 116555 - DNA, 25 bp, Mus musculus
acctcatgtcctaatcagagtgcca

SEQ ID NO: 116556 - DNA, 25 bp, Mus musculus
acctcatgtccttatcagagtgcca

SEQ ID NO: 116557 - DNA, 25 bp, Mus musculus
acctcatgtctcactattcattcta

SEQ ID NO: 116558 - DNA, 25 bp, Mus musculus
acctcatgtctctctattcattcta

SEQ ID NO: 116559 - DNA, 25 bp, Mus musculus
acctcatgtgaccacagttttatgt

SEQ ID NO: 116560 - DNA, 25 bp, Mus musculus
acctcatgtgacgacagttttatgt

SEQ ID NO: 116561 - DNA, 25 bp, Mus musculus
acctcatgtgcacttggcaactgat

SEQ ID NO: 116562 - DNA, 25 bp, Mus musculus
acctcatgtgcagttggcaactgat

SEQ ID NO: 116563 - DNA, 25 bp, Mus musculus
acctcattagaaagcgctgtacact

SEQ ID NO: 116564 - DNA, 25 bp, Mus musculus
acctcattagaatgcgctgtacact

SEQ ID NO: 116565 - DNA, 25 bp, Mus musculus
acctcattcgtgacataagcctgaa

SEQ ID NO: 116566 - DNA, 25 bp, Mus musculus
acctcattcgtgtcataagcctgaa

SEQ ID NO: 116567 - DNA, 25 bp, Mus musculus
acctcattctcccatcttgaaaatt

SEQ ID NO: 116568 - DNA, 25 bp, Mus musculus
acctcattctccgatcttgaaaatt

SEQ ID NO: 116569 - DNA, 25 bp, Mus musculus
acctcattcttcctgaacttcgaaa

SEQ ID NO: 116570 - DNA, 25 bp, Mus musculus
acctcattcttcgtgaacttcgaaa

SEQ ID NO: 116571 - DNA, 25 bp, Mus musculus
acctcattgtccataactgaaatgc

SEQ ID NO: 116572 - DNA, 25 bp, Mus musculus
acctcattgtccttaactgaaatgc

SEQ ID NO: 116573 - DNA, 25 bp, Mus musculus
acctcatttcatccgtatccaggat

SEQ ID NO: 116574 - DNA, 25 bp, Mus musculus
acctcatttcatctgttgtatagac

SEQ ID NO: 116575 - DNA, 25 bp, Mus musculus
acctcatttcatgcgtatccaggat

SEQ ID NO: 116576 - DNA, 25 bp, Mus musculus
acctcatttcatgtgttgtatagac

SEQ ID NO: 116577 - DNA, 25 bp, Mus musculus
acctcatttctaagctgccaaacag

SEQ ID NO: 116578 - DNA, 25 bp, Mus musculus
acctcatttctatgctgccaaacag

SEQ ID NO: 116579 - DNA, 25 bp, Mus musculus
acctcattttaaacctcactctaag

SEQ ID NO: 116580 - DNA, 25 bp, Mus musculus
acctcattttaatcctcactctaag

SEQ ID NO: 116581 - DNA, 25 bp, Mus musculus
acctcattttcaaattggcttgtct

SEQ ID NO: 116582 - DNA, 25 bp, Mus musculus
acctcattttcatattggcttgtct

SEQ ID NO: 116583 - DNA, 25 bp, Mus musculus
acctccaacagtcatctgttctggg

SEQ ID NO: 116584 - DNA, 25 bp, Mus musculus
acctccaacagtgatctgttctggg

SEQ ID NO: 116585 - DNA, 25 bp, Mus musculus
acctccaacgcaatgtggcttttac

SEQ ID NO: 116586 - DNA, 25 bp, Mus musculus
acctccaacgcattgtggcttttac

SEQ ID NO: 116587 - DNA, 25 bp, Mus musculus
acctccaactctcctatttttcagt

SEQ ID NO: 116588 - DNA, 25 bp, Mus musculus
acctccaactctgctatttttcagt

SEQ ID NO: 116589 - DNA, 25 bp, Mus musculus
acctccaacttcaagagaccaggtc

SEQ ID NO: 116590 - DNA, 25 bp, Mus musculus
acctccaacttctagagaccaggtc

SEQ ID NO: 116591 - DNA, 25 bp, Mus musculus
acctccaagcagagaatctgaccaa

SEQ ID NO: 116592 - DNA, 25 bp, Mus musculus
acctccaagcagtgaatctgaccaa

SEQ ID NO: 116593 - DNA, 25 bp, Mus musculus
acctccaagtctcatttttcacata

SEQ ID NO: 116594 - DNA, 25 bp, Mus musculus
acctccaagtctgatttttcacata

SEQ ID NO: 116595 - DNA, 25 bp, Mus musculus
acctccaatactctggcatgtgcgt

SEQ ID NO: 116596 - DNA, 25 bp, Mus musculus
acctccaatactgtggcatgtgcgt

SEQ ID NO: 116597 - DNA, 25 bp, Mus musculus
acctccaattagaccattctttcag

SEQ ID NO: 116598 - DNA, 25 bp, Mus musculus
acctccaattagtccattctttcag

SEQ ID NO: 116599 - DNA, 25 bp, Mus musculus
acctccacacatatgtttgtggcat

SEQ ID NO: 116600 - DNA, 25 bp, Mus musculus
acctccacacatttgtttgtggcat

SEQ ID NO: 116601 - DNA, 25 bp, Mus musculus
acctccaccagcactttgggaattg

SEQ ID NO: 116602 - DNA, 25 bp, Mus musculus
acctccaccagctctttgggaattg

SEQ ID NO: 116603 - DNA, 25 bp, Mus musculus
acctccacctgtaggcagagcaacc

SEQ ID NO: 116604 - DNA, 25 bp, Mus musculus
acctccacctgttggcagagcaacc

SEQ ID NO: 116605 - DNA, 25 bp, Mus musculus
acctccacgaggaggcatgacacag

SEQ ID NO: 116606 - DNA, 25 bp, Mus musculus
acctccacgaggtggcatgacacag

SEQ ID NO: 116607 - DNA, 25 bp, Mus musculus
acctccacgtggagttgatggacta

SEQ ID NO: 116608 - DNA, 25 bp, Mus musculus
acctccacgtggtgttgatggacta

SEQ ID NO: 116609 - DNA, 25 bp, Mus musculus
acctccactgtgagcttagctggaa

SEQ ID NO: 116610 - DNA, 25 bp, Mus musculus
acctccactgtgtgcttagctggaa

SEQ ID NO: 116611 - DNA, 25 bp, Mus musculus
acctccacttcacttgtagagttaa

SEQ ID NO: 116612 - DNA, 25 bp, Mus musculus
acctccacttcagttgtagagttaa

SEQ ID NO: 116613 - DNA, 25 bp, Mus musculus
acctccactttcagagagtcggatg

SEQ ID NO: 116614 - DNA, 25 bp, Mus musculus
acctccactttctgagagtcggatg

SEQ ID NO: 116615 - DNA, 25 bp, Mus musculus
acctccagaagaagtgcgtccacaa

SEQ ID NO: 116616 - DNA, 25 bp, Mus musculus
acctccagaagatgtgcgtccacaa

SEQ ID NO: 116617 - DNA, 25 bp, Mus musculus
acctccagactgagtcttcagggcc

SEQ ID NO: 116618 - DNA, 25 bp, Mus musculus
acctccagactgtgtcttcagggcc

SEQ ID NO: 116619 - DNA, 25 bp, Mus musculus
acctccagataaacttccttcatta

SEQ ID NO: 116620 - DNA, 25 bp, Mus musculus
acctccagataatcttccttcatta

SEQ ID NO: 116621 - DNA, 25 bp, Mus musculus
acctccagccagagttgtgatttac

SEQ ID NO: 116622 - DNA, 25 bp, Mus musculus
acctccagccagtgttgtgatttac

SEQ ID NO: 116623 - DNA, 25 bp, Mus musculus
acctccagcgtaatttatcactacc

SEQ ID NO: 116624 - DNA, 25 bp, Mus musculus
acctccagcgtattttatcactacc

SEQ ID NO: 116625 - DNA, 25 bp, Mus musculus
acctccagctcgacaccatgaactc

SEQ ID NO: 116626 - DNA, 25 bp, Mus musculus
acctccagctcgtcaccatgaactc

SEQ ID NO: 116627 - DNA, 25 bp, Mus musculus
acctccaggacaaagactagagatt

SEQ ID NO: 116628 - DNA, 25 bp, Mus musculus
acctccaggacatagactagagatt

SEQ ID NO: 116629 - DNA, 25 bp, Mus musculus
acctccaggatcatgctggtctttg

SEQ ID NO: 116630 - DNA, 25 bp, Mus musculus
acctccaggatcttgctggtctttg

SEQ ID NO: 116631 - DNA, 25 bp, Mus musculus
acctccaggccaaagtggcttcttt

SEQ ID NO: 116632 - DNA, 25 bp, Mus musculus
acctccaggccaccatatttagaaa

SEQ ID NO: 116633 - DNA, 25 bp, Mus musculus
acctccaggccagcatatttagaaa

SEQ ID NO: 116634 - DNA, 25 bp, Mus musculus
acctccaggccatagtggcttcttt

SEQ ID NO: 116635 - DNA, 25 bp, Mus musculus
acctccagggagcaagtcagcgacc

SEQ ID NO: 116636 - DNA, 25 bp, Mus musculus
acctccagggaggaagtcagcgacc

SEQ ID NO: 116637 - DNA, 25 bp, Mus musculus
acctccagggcaatgagactttgct

SEQ ID NO: 116638 - DNA, 25 bp, Mus musculus
acctccagggcattgagactttgct

SEQ ID NO: 116639 - DNA, 25 bp, Mus musculus
acctccagggccaccgcaagttgtg

SEQ ID NO: 116640 - DNA, 25 bp, Mus musculus
acctccagggcctccgcaagttgtg

SEQ ID NO: 116641 - DNA, 25 bp, Mus musculus
acctccagggtgctcacgggtacat

SEQ ID NO: 116642 - DNA, 25 bp, Mus musculus
acctccagggtggtcacgggtacat

SEQ ID NO: 116643 - DNA, 25 bp, Mus musculus
acctccaggtgtagatctgtacatt

SEQ ID NO: 116644 - DNA, 25 bp, Mus musculus
acctccaggtgttgatctgtacatt

SEQ ID NO: 116645 - DNA, 25 bp, Mus musculus
acctccagtcttctgaagctttaag

SEQ ID NO: 116646 - DNA, 25 bp, Mus musculus
acctccagtcttgtgaagctttaag

SEQ ID NO: 116647 - DNA, 25 bp, Mus musculus
acctccagtgttatggtgactccat

SEQ ID NO: 116648 - DNA, 25 bp, Mus musculus
acctccagtgttttggtgactccat

SEQ ID NO: 116649 - DNA, 25 bp, Mus musculus
acctccatactcatagctgtgttca

SEQ ID NO: 116650 - DNA, 25 bp, Mus musculus
acctccatactcttagctgtgttca

SEQ ID NO: 116651 - DNA, 25 bp, Mus musculus
acctccatattgaagtccatcactg

SEQ ID NO: 116652 - DNA, 25 bp, Mus musculus
acctccatattgtagtccatcactg

SEQ ID NO: 116653 - DNA, 25 bp, Mus musculus
acctccatcctaaacattcctgata

SEQ ID NO: 116654 - DNA, 25 bp, Mus musculus
acctccatcctatacattcctgata

SEQ ID NO: 116655 - DNA, 25 bp, Mus musculus
acctccatgggtcgaacgcagcagc

SEQ ID NO: 116656 - DNA, 25 bp, Mus musculus
acctccatgggtggaacgcagcagc

SEQ ID NO: 116657 - DNA, 25 bp, Mus musculus
acctccattatcacctcttgaaagt

SEQ ID NO: 116658 - DNA, 25 bp, Mus musculus
acctccattatctcctcttgaaagt

SEQ ID NO: 116659 - DNA, 25 bp, Mus musculus
acctccattcgcaattcctttgggc

SEQ ID NO: 116660 - DNA, 25 bp, Mus musculus
acctccattcgctattcctttgggc

SEQ ID NO: 116661 - DNA, 25 bp, Mus musculus
acctccatttgaaactgcttcaggc

SEQ ID NO: 116662 - DNA, 25 bp, Mus musculus
acctccatttgatactgcttcaggc

SEQ ID NO: 116663 - DNA, 25 bp, Mus musculus
acctccatttgcagcccagggaaga

SEQ ID NO: 116664 - DNA, 25 bp, Mus musculus
acctccatttgctgcccagggaaga

SEQ ID NO: 116665 - DNA, 25 bp, Mus musculus
acctcccaaatgctatggactacca

SEQ ID NO: 116666 - DNA, 25 bp, Mus musculus
acctcccaaatgctcgtttgcaggt

SEQ ID NO: 116667 - DNA, 25 bp, Mus musculus
acctcccaaatggtatggactacca

SEQ ID NO: 116668 - DNA, 25 bp, Mus musculus
acctcccaaatggtcgtttgcaggt

SEQ ID NO: 116669 - DNA, 25 bp, Mus musculus
acctcccagattcctctaatgagga

SEQ ID NO: 116670 - DNA, 25 bp, Mus musculus
acctcccagattgctctaatgagga

SEQ ID NO: 116671 - DNA, 25 bp, Mus musculus
acctcccaggaaactgcaaggatag

SEQ ID NO: 116672 - DNA, 25 bp, Mus musculus
acctcccaggaatctgcaaggatag

SEQ ID NO: 116673 - DNA, 25 bp, Mus musculus
acctcccaggagacgctatgttgaa

SEQ ID NO: 116674 - DNA, 25 bp, Mus musculus
acctcccaggagtcgctatgttgaa

SEQ ID NO: 116675 - DNA, 25 bp, Mus musculus
acctcccaggatcgacctcgaagag

SEQ ID NO: 116676 - DNA, 25 bp, Mus musculus
acctcccaggatggacctcgaagag

SEQ ID NO: 116677 - DNA, 25 bp, Mus musculus
acctcccagggtatgtggcactaat

SEQ ID NO: 116678 - DNA, 25 bp, Mus musculus
acctcccagggtttgtggcactaat

SEQ ID NO: 116679 - DNA, 25 bp, Mus musculus
acctcccagtccagaggctttgagc

SEQ ID NO: 116680 - DNA, 25 bp, Mus musculus
acctcccagtcctgaggctttgagc

SEQ ID NO: 116681 - DNA, 25 bp, Mus musculus
acctcccatttgcagttagttcttc

SEQ ID NO: 116682 - DNA, 25 bp, Mus musculus
acctcccatttggagttagttcttc

SEQ ID NO: 116683 - DNA, 25 bp, Mus musculus
acctccccacaaaaccatatgttaa

SEQ ID NO: 116684 - DNA, 25 bp, Mus musculus
acctccccacaataccatatgttaa

SEQ ID NO: 116685 - DNA, 25 bp, Mus musculus
acctccccatagaacagtgtcacgt

SEQ ID NO: 116686 - DNA, 25 bp, Mus musculus
acctccccatagtacagtgtcacgt

SEQ ID NO: 116687 - DNA, 25 bp, Mus musculus
acctcccctctgagatttgttagtt

SEQ ID NO: 116688 - DNA, 25 bp, Mus musculus
acctcccctctgtgatttgttagtt

SEQ ID NO: 116689 - DNA, 25 bp, Mus musculus
acctcccctgtaattctttgagaag

SEQ ID NO: 116690 - DNA, 25 bp, Mus musculus
acctcccctgtatttctttgagaag

SEQ ID NO: 116691 - DNA, 25 bp, Mus musculus
acctcccgagtactgagattcaggc

SEQ ID NO: 116692 - DNA, 25 bp, Mus musculus
acctcccgagtagtgagattcaggc

SEQ ID NO: 116693 - DNA, 25 bp, Mus musculus
acctcccgtgaaagtctgatgacct

SEQ ID NO: 116694 - DNA, 25 bp, Mus musculus
acctcccgtgaatgtctgatgacct

SEQ ID NO: 116695 - DNA, 25 bp, Mus musculus
acctcccgtgacactggctgtttat

SEQ ID NO: 116696 - DNA, 25 bp, Mus musculus
acctcccgtgactctggctgtttat

SEQ ID NO: 116697 - DNA, 25 bp, Mus musculus
acctccctaactatgtactaggctg

SEQ ID NO: 116698 - DNA, 25 bp, Mus musculus
acctccctaactttgtactaggctg

SEQ ID NO: 116699 - DNA, 25 bp, Mus musculus
acctccctactcatctaaaatcagg

SEQ ID NO: 116700 - DNA, 25 bp, Mus musculus
acctccctactcttctaaaatcagg

SEQ ID NO: 116701 - DNA, 25 bp, Mus musculus
acctccctagcactttgtaggagtg

SEQ ID NO: 116702 - DNA, 25 bp, Mus musculus
acctccctagcagtttgtaggagtg

SEQ ID NO: 116703 - DNA, 25 bp, Mus musculus
acctccctaggacacgtggtgtttg

SEQ ID NO: 116704 - DNA, 25 bp, Mus musculus
acctccctaggagacgtggtgtttg

SEQ ID NO: 116705 - DNA, 25 bp, Mus musculus
acctccctctggaaagcaggccgag

SEQ ID NO: 116706 - DNA, 25 bp, Mus musculus
acctccctctggaatggatctattg

SEQ ID NO: 116707 - DNA, 25 bp, Mus musculus
acctccctctggtaagcaggccgag

SEQ ID NO: 116708 - DNA, 25 bp, Mus musculus
acctccctctggtatggatctattg

SEQ ID NO: 116709 - DNA, 25 bp, Mus musculus
acctccctctgtagtgctggctggc

SEQ ID NO: 116710 - DNA, 25 bp, Mus musculus
acctccctctgttgtgctggctggc

SEQ ID NO: 116711 - DNA, 25 bp, Mus musculus
acctccctcttcacagaaaatacta

SEQ ID NO: 116712 - DNA, 25 bp, Mus musculus
acctccctcttctcagaaaatacta

SEQ ID NO: 116713 - DNA, 25 bp, Mus musculus
acctccctgtctcagtgatatgtag

SEQ ID NO: 116714 - DNA, 25 bp, Mus musculus
acctccctgtctgagtgatatgtag

SEQ ID NO: 116715 - DNA, 25 bp, Mus musculus
acctcccttggactagaaactgcat

SEQ ID NO: 116716 - DNA, 25 bp, Mus musculus
acctcccttggagtagaaactgcat

SEQ ID NO: 116717 - DNA, 25 bp, Mus musculus
acctcccttgttcaattcgttgtga

SEQ ID NO: 116718 - DNA, 25 bp, Mus musculus
acctcccttgttgaattcgttgtga

SEQ ID NO: 116719 - DNA, 25 bp, Mus musculus
acctccgagcacaacattgtggctg

SEQ ID NO: 116720 - DNA, 25 bp, Mus musculus
acctccgagcactacattgtggctg

SEQ ID NO: 116721 - DNA, 25 bp, Mus musculus
acctccgaggcaagagttctacctt

SEQ ID NO: 116722 - DNA, 25 bp, Mus musculus
acctccgaggcatgagttctacctt

SEQ ID NO: 116723 - DNA, 25 bp, Mus musculus
acctccgatcatctgctgcacgggt

SEQ ID NO: 116724 - DNA, 25 bp, Mus musculus
acctccgatcatgtgctgcacgggt

SEQ ID NO: 116725 - DNA, 25 bp, Mus musculus
acctccgattgcattctgtgctaaa

SEQ ID NO: 116726 - DNA, 25 bp, Mus musculus
acctccgattgctttctgtgctaaa

SEQ ID NO: 116727 - DNA, 25 bp, Mus musculus
acctccgcgagaagctgcggcagga

SEQ ID NO: 116728 - DNA, 25 bp, Mus musculus
acctccgcgagatgctgcggcagga

SEQ ID NO: 116729 - DNA, 25 bp, Mus musculus
acctccgctgtactgatatcactaa

SEQ ID NO: 116730 - DNA, 25 bp, Mus musculus
acctccgctgtagtgatatcactaa

SEQ ID NO: 116731 - DNA, 25 bp, Mus musculus
acctccgggagcagagacactgggt

SEQ ID NO: 116732 - DNA, 25 bp, Mus musculus
acctccgggagctgagacactgggt

SEQ ID NO: 116733 - DNA, 25 bp, Mus musculus
acctccggtcagcatcaagtctgag

SEQ ID NO: 116734 - DNA, 25 bp, Mus musculus
acctccggtcaggatcaagtctgag

SEQ ID NO: 116735 - DNA, 25 bp, Mus musculus
acctccgttcttctcagagtgtggg

SEQ ID NO: 116736 - DNA, 25 bp, Mus musculus
acctccgttcttgtcagagtgtggg

SEQ ID NO: 116737 - DNA, 25 bp, Mus musculus
acctcctaacagctactgtctaggg

SEQ ID NO: 116738 - DNA, 25 bp, Mus musculus
acctcctaacaggtactgtctaggg

SEQ ID NO: 116739 - DNA, 25 bp, Mus musculus
acctcctaacccattgcttatgtgt

SEQ ID NO: 116740 - DNA, 25 bp, Mus musculus
acctcctaaccctttgcttatgtgt

SEQ ID NO: 116741 - DNA, 25 bp, Mus musculus
acctcctacaggactccatggagat

SEQ ID NO: 116742 - DNA, 25 bp, Mus musculus
acctcctacaggtctccatggagat

SEQ ID NO: 116743 - DNA, 25 bp, Mus musculus
acctcctacttgattaacctgatct

SEQ ID NO: 116744 - DNA, 25 bp, Mus musculus
acctcctacttgtttaacctgatct

SEQ ID NO: 116745 - DNA, 25 bp, Mus musculus
acctcctagagtattgccaccattg

SEQ ID NO: 116746 - DNA, 25 bp, Mus musculus
acctcctagagttttgccaccattg

SEQ ID NO: 116747 - DNA, 25 bp, Mus musculus
acctcctagggtatcgatgtgctgt

SEQ ID NO: 116748 - DNA, 25 bp, Mus musculus
acctcctagggtttcgatgtgctgt

SEQ ID NO: 116749 - DNA, 25 bp, Mus musculus
acctcctatttgcttcatttactct

SEQ ID NO: 116750 - DNA, 25 bp, Mus musculus
acctcctatttggttcatttactct

SEQ ID NO: 116751 - DNA, 25 bp, Mus musculus
acctcctcagctctggtcatcagtt

SEQ ID NO: 116752 - DNA, 25 bp, Mus musculus
acctcctcagctgtggtcatcagtt

SEQ ID NO: 116753 - DNA, 25 bp, Mus musculus
acctcctcagtcagatggtaactct

SEQ ID NO: 116754 - DNA, 25 bp, Mus musculus
acctcctcagtctgatggtaactct

SEQ ID NO: 116755 - DNA, 25 bp, Mus musculus
acctcctcagttctatccaagttgt

SEQ ID NO: 116756 - DNA, 25 bp, Mus musculus
acctcctcagttgtatccaagttgt

SEQ ID NO: 116757 - DNA, 25 bp, Mus musculus
acctcctcatctactgtttcagtgt

SEQ ID NO: 116758 - DNA, 25 bp, Mus musculus
acctcctcatcttctgtttcagtgt

SEQ ID NO: 116759 - DNA, 25 bp, Mus musculus
acctcctccatgactcagtaattga

SEQ ID NO: 116760 - DNA, 25 bp, Mus musculus
acctcctccatgtctcagtaattga

SEQ ID NO: 116761 - DNA, 25 bp, Mus musculus
acctcctccggaacaaacagaagaa

SEQ ID NO: 116762 - DNA, 25 bp, Mus musculus
acctcctccggatcaaacagaagaa

SEQ ID NO: 116763 - DNA, 25 bp, Mus musculus
acctcctcctagacgtcaaattaat

SEQ ID NO: 116764 - DNA, 25 bp, Mus musculus
acctcctcctagtcgtcaaattaat

SEQ ID NO: 116765 - DNA, 25 bp, Mus musculus
acctcctcgacgagctagagtttaa

SEQ ID NO: 116766 - DNA, 25 bp, Mus musculus
acctcctcgacgtgctagagtttaa

SEQ ID NO: 116767 - DNA, 25 bp, Mus musculus
acctcctcggtcactggaggataag

SEQ ID NO: 116768 - DNA, 25 bp, Mus musculus
acctcctcggtctctggaggataag

SEQ ID NO: 116769 - DNA, 25 bp, Mus musculus
acctcctctaggatttcgagactgg

SEQ ID NO: 116770 - DNA, 25 bp, Mus musculus
acctcctctaggttttcgagactgg

SEQ ID NO: 116771 - DNA, 25 bp, Mus musculus
acctcctctcggcaggtaagggagc

SEQ ID NO: 116772 - DNA, 25 bp, Mus musculus
acctcctctcgggaggtaagggagc

SEQ ID NO: 116773 - DNA, 25 bp, Mus musculus
acctcctctgctaatcgtattttat

SEQ ID NO: 116774 - DNA, 25 bp, Mus musculus
acctcctctgcttatcgtattttat

SEQ ID NO: 116775 - DNA, 25 bp, Mus musculus
acctcctcttttcaattaagatttg

SEQ ID NO: 116776 - DNA, 25 bp, Mus musculus
acctcctcttttgaattaagatttg

SEQ ID NO: 116777 - DNA, 25 bp, Mus musculus
acctcctgacataatcaagacctag

SEQ ID NO: 116778 - DNA, 25 bp, Mus musculus
acctcctgacattatcaagacctag

SEQ ID NO: 116779 - DNA, 25 bp, Mus musculus
acctcctgattaatcccaaatgaca

SEQ ID NO: 116780 - DNA, 25 bp, Mus musculus
acctcctgattattcccaaatgaca

SEQ ID NO: 116781 - DNA, 25 bp, Mus musculus
acctcctgccccagttggctggaga

SEQ ID NO: 116782 - DNA, 25 bp, Mus musculus
acctcctgcccctgttggctggaga

SEQ ID NO: 116783 - DNA, 25 bp, Mus musculus
acctcctgccgtcatagttatagac

SEQ ID NO: 116784 - DNA, 25 bp, Mus musculus
acctcctgccgtgatagttatagac

SEQ ID NO: 116785 - DNA, 25 bp, Mus musculus
acctcctgctggcatataccatgag

SEQ ID NO: 116786 - DNA, 25 bp, Mus musculus
acctcctgctgggatataccatgag

SEQ ID NO: 116787 - DNA, 25 bp, Mus musculus
acctcctggatgatagattacaggt

SEQ ID NO: 116788 - DNA, 25 bp, Mus musculus
acctcctggatgttagattacaggt

SEQ ID NO: 116789 - DNA, 25 bp, Mus musculus
acctcctggcagctatgggaactat

SEQ ID NO: 116790 - DNA, 25 bp, Mus musculus
acctcctggcaggtatgggaactat

SEQ ID NO: 116791 - DNA, 25 bp, Mus musculus
acctcctggctaagtcattgcaaca

SEQ ID NO: 116792 - DNA, 25 bp, Mus musculus
acctcctggctatgtcattgcaaca

SEQ ID NO: 116793 - DNA, 25 bp, Mus musculus
acctcctgtggtcaattacgaagaa

SEQ ID NO: 116794 - DNA, 25 bp, Mus musculus
acctcctgtggtgaattacgaagaa

SEQ ID NO: 116795 - DNA, 25 bp, Mus musculus
acctcctgttatatcctctattgaa

SEQ ID NO: 116796 - DNA, 25 bp, Mus musculus
acctcctgttatcgccatcagactt

SEQ ID NO: 116797 - DNA, 25 bp, Mus musculus
acctcctgttatggccatcagactt

SEQ ID NO: 116798 - DNA, 25 bp, Mus musculus
acctcctgttatttcctctattgaa

SEQ ID NO: 116799 - DNA, 25 bp, Mus musculus
acctccttaattctgtctgtagcta

SEQ ID NO: 116800 - DNA, 25 bp, Mus musculus
acctccttaattgtgtctgtagcta

SEQ ID NO: 116801 - DNA, 25 bp, Mus musculus
acctccttcattatctcatttcaag

SEQ ID NO: 116802 - DNA, 25 bp, Mus musculus
acctccttcattttctcatttcaag

SEQ ID NO: 116803 - DNA, 25 bp, Mus musculus
acctccttgaacaacttcataactt

SEQ ID NO: 116804 - DNA, 25 bp, Mus musculus
acctccttgaactacttcataactt

SEQ ID NO: 116805 - DNA, 25 bp, Mus musculus
acctccttgatcacctggcagaagt

SEQ ID NO: 116806 - DNA, 25 bp, Mus musculus
acctccttgatctcctggcagaagt

SEQ ID NO: 116807 - DNA, 25 bp, Mus musculus
acctccttgtgactgctttacaatg

SEQ ID NO: 116808 - DNA, 25 bp, Mus musculus
acctccttgtgagtgctttacaatg

SEQ ID NO: 116809 - DNA, 25 bp, Mus musculus
acctcctttaccacgtaactggatg

SEQ ID NO: 116810 - DNA, 25 bp, Mus musculus
acctcctttacctcgtaactggatg

SEQ ID NO: 116811 - DNA, 25 bp, Mus musculus
acctcctttgcaagtggactctaag

SEQ ID NO: 116812 - DNA, 25 bp, Mus musculus
acctcctttgcatgtggactctaag

SEQ ID NO: 116813 - DNA, 25 bp, Mus musculus
acctccttttacatgccagtgatta

SEQ ID NO: 116814 - DNA, 25 bp, Mus musculus
acctccttttacttgccagtgatta

SEQ ID NO: 116815 - DNA, 25 bp, Mus musculus
acctccttttctctgggaatacctg

SEQ ID NO: 116816 - DNA, 25 bp, Mus musculus
acctccttttctgtgggaatacctg

SEQ ID NO: 116817 - DNA, 25 bp, Mus musculus
acctcgacgagtaggctctgtctca

SEQ ID NO: 116818 - DNA, 25 bp, Mus musculus
acctcgacgagttggctctgtctca

SEQ ID NO: 116819 - DNA, 25 bp, Mus musculus
acctcgactcttagttgttatgtgc

SEQ ID NO: 116820 - DNA, 25 bp, Mus musculus
acctcgactctttgttgttatgtgc

SEQ ID NO: 116821 - DNA, 25 bp, Mus musculus
acctcgagtcatcgtgtatccacag

SEQ ID NO: 116822 - DNA, 25 bp, Mus musculus
acctcgagtcatggtgtatccacag

SEQ ID NO: 116823 - DNA, 25 bp, Mus musculus
acctcgagtgtgacatcagttccct

SEQ ID NO: 116824 - DNA, 25 bp, Mus musculus
acctcgagtgtgtcatcagttccct

SEQ ID NO: 116825 - DNA, 25 bp, Mus musculus
acctcgatccagaccgcccgagatg

SEQ ID NO: 116826 - DNA, 25 bp, Mus musculus
acctcgatccagtccgcccgagatg

SEQ ID NO: 116827 - DNA, 25 bp, Mus musculus
acctcgattggcactgggaccccag

SEQ ID NO: 116828 - DNA, 25 bp, Mus musculus
acctcgattggctctgggaccccag

SEQ ID NO: 116829 - DNA, 25 bp, Mus musculus
acctcgattgtgagtgggcacccat

SEQ ID NO: 116830 - DNA, 25 bp, Mus musculus
acctcgattgtgtgtgggcacccat

SEQ ID NO: 116831 - DNA, 25 bp, Mus musculus
acctcgcactgtactgttgtcgaaa

SEQ ID NO: 116832 - DNA, 25 bp, Mus musculus
acctcgcactgttctgttgtcgaaa

SEQ ID NO: 116833 - DNA, 25 bp, Mus musculus
acctcgcagagcctgctgatgacat

SEQ ID NO: 116834 - DNA, 25 bp, Mus musculus
acctcgcagagcgtgctgatgacat

SEQ ID NO: 116835 - DNA, 25 bp, Mus musculus
acctcgcatgacagtggcggcctga

SEQ ID NO: 116836 - DNA, 25 bp, Mus musculus
acctcgcatgactgtggcggcctga

SEQ ID NO: 116837 - DNA, 25 bp, Mus musculus
acctcgccaaggacaagctctgtgt

SEQ ID NO: 116838 - DNA, 25 bp, Mus musculus
acctcgccaaggtcaagctctgtgt

SEQ ID NO: 116839 - DNA, 25 bp, Mus musculus
acctcgccagctcttgtccttttgt

SEQ ID NO: 116840 - DNA, 25 bp, Mus musculus
acctcgccagctgttgtccttttgt

SEQ ID NO: 116841 - DNA, 25 bp, Mus musculus
acctcgccgtggagcatgtgcaagg

SEQ ID NO: 116842 - DNA, 25 bp, Mus musculus
acctcgccgtggtgcatgtgcaagg

SEQ ID NO: 116843 - DNA, 25 bp, Mus musculus
acctcgcggtgccagactgtgcaga

SEQ ID NO: 116844 - DNA, 25 bp, Mus musculus
acctcgcggtgcgagactgtgcaga

SEQ ID NO: 116845 - DNA, 25 bp, Mus musculus
acctcgcggttgcagtatggagccc

SEQ ID NO: 116846 - DNA, 25 bp, Mus musculus
acctcgcggttggagtatggagccc

SEQ ID NO: 116847 - DNA, 25 bp, Mus musculus
acctcgcgtagactgattcatctca

SEQ ID NO: 116848 - DNA, 25 bp, Mus musculus
acctcgcgtagagtgattcatctca

SEQ ID NO: 116849 - DNA, 25 bp, Mus musculus
acctcgcgttcgctggaggacctga

SEQ ID NO: 116850 - DNA, 25 bp, Mus musculus
acctcgcgttcggtggaggacctga

SEQ ID NO: 116851 - DNA, 25 bp, Mus musculus
acctcgctcaggctaggatccagat

SEQ ID NO: 116852 - DNA, 25 bp, Mus musculus
acctcgctcagggtaggatccagat

SEQ ID NO: 116853 - DNA, 25 bp, Mus musculus
acctcgctcattctcgatgttgaaa

SEQ ID NO: 116854 - DNA, 25 bp, Mus musculus
acctcgctcattgtcgatgttgaaa

SEQ ID NO: 116855 - DNA, 25 bp, Mus musculus
acctcgctcctgcattttcttgatt

SEQ ID NO: 116856 - DNA, 25 bp, Mus musculus
acctcgctcctggattttcttgatt

SEQ ID NO: 116857 - DNA, 25 bp, Mus musculus
acctcgctcggtagatagccagtga

SEQ ID NO: 116858 - DNA, 25 bp, Mus musculus
acctcgctcggttgatagccagtga

SEQ ID NO: 116859 - DNA, 25 bp, Mus musculus
acctcgctctggcagtcaggaagga

SEQ ID NO: 116860 - DNA, 25 bp, Mus musculus
acctcgctctgggagtcaggaagga

SEQ ID NO: 116861 - DNA, 25 bp, Mus musculus
acctcgctgaaacactgggatctgt

SEQ ID NO: 116862 - DNA, 25 bp, Mus musculus
acctcgctgaaagactgggatctgt

SEQ ID NO: 116863 - DNA, 25 bp, Mus musculus
acctcgctgggtcagcacgtcttct

SEQ ID NO: 116864 - DNA, 25 bp, Mus musculus
acctcgctgggtgagcacgtcttct

SEQ ID NO: 116865 - DNA, 25 bp, Mus musculus
acctcgcttgggatctggctagaat

SEQ ID NO: 116866 - DNA, 25 bp, Mus musculus
acctcgcttgggttctggctagaat

SEQ ID NO: 116867 - DNA, 25 bp, Mus musculus
acctcggagcatctgttatcccttc

SEQ ID NO: 116868 - DNA, 25 bp, Mus musculus
acctcggagcatgtgttatcccttc

SEQ ID NO: 116869 - DNA, 25 bp, Mus musculus
acctcggcaccaaattcctgaaaag

SEQ ID NO: 116870 - DNA, 25 bp, Mus musculus
acctcggcaccatattcctgaaaag

SEQ ID NO: 116871 - DNA, 25 bp, Mus musculus
acctcggcatgtactgtagtcactt

SEQ ID NO: 116872 - DNA, 25 bp, Mus musculus
acctcggcatgttctgtagtcactt

SEQ ID NO: 116873 - DNA, 25 bp, Mus musculus
acctcgggatctctacagccacaat

SEQ ID NO: 116874 - DNA, 25 bp, Mus musculus
acctcgggatctgtacagccacaat

SEQ ID NO: 116875 - DNA, 25 bp, Mus musculus
acctcggtccatacatgatggcgtg

SEQ ID NO: 116876 - DNA, 25 bp, Mus musculus
acctcggtccattcatgatggcgtg

SEQ ID NO: 116877 - DNA, 25 bp, Mus musculus
acctcggtgcttcatctctttgatg

SEQ ID NO: 116878 - DNA, 25 bp, Mus musculus
acctcggtgcttgatctctttgatg

SEQ ID NO: 116879 - DNA, 25 bp, Mus musculus
acctcggtgggtcctaacgcagtgt

SEQ ID NO: 116880 - DNA, 25 bp, Mus musculus
acctcggtgggtgctaacgcagtgt

SEQ ID NO: 116881 - DNA, 25 bp, Mus musculus
acctcgtactgtaatccatggctga

SEQ ID NO: 116882 - DNA, 25 bp, Mus musculus
acctcgtactgttatccatggctga

SEQ ID NO: 116883 - DNA, 25 bp, Mus musculus
acctcgtatctgagctcaatagcgc

SEQ ID NO: 116884 - DNA, 25 bp, Mus musculus
acctcgtatctgtgctcaatagcgc

SEQ ID NO: 116885 - DNA, 25 bp, Mus musculus
acctcgtcgtggagagcctcatgtg

SEQ ID NO: 116886 - DNA, 25 bp, Mus musculus
acctcgtcgtggtgagcctcatgtg

SEQ ID NO: 116887 - DNA, 25 bp, Mus musculus
acctcgtctactataagactccaca

SEQ ID NO: 116888 - DNA, 25 bp, Mus musculus
acctcgtctactttaagactccaca

SEQ ID NO: 116889 - DNA, 25 bp, Mus musculus
acctcgtctgtcaagtgggcactat

SEQ ID NO: 116890 - DNA, 25 bp, Mus musculus
acctcgtctgtctagtgggcactat

SEQ ID NO: 116891 - DNA, 25 bp, Mus musculus
acctcgtggtggctctcactatgtg

SEQ ID NO: 116892 - DNA, 25 bp, Mus musculus
acctcgtggtgggtctcactatgtg

SEQ ID NO: 116893 - DNA, 25 bp, Mus musculus
acctcgtggttgctgtgcttagtag

SEQ ID NO: 116894 - DNA, 25 bp, Mus musculus
acctcgtggttggtgtgcttagtag

SEQ ID NO: 116895 - DNA, 25 bp, Mus musculus
acctcgttcattaggatcagctgca

SEQ ID NO: 116896 - DNA, 25 bp, Mus musculus
acctcgttcatttggatcagctgca

SEQ ID NO: 116897 - DNA, 25 bp, Mus musculus
acctcgttgctgacactatggagtg

SEQ ID NO: 116898 - DNA, 25 bp, Mus musculus
acctcgttgctgtcactatggagtg

SEQ ID NO: 116899 - DNA, 25 bp, Mus musculus
acctcgtttactaggactgtcagaa

SEQ ID NO: 116900 - DNA, 25 bp, Mus musculus
acctcgtttacttggactgtcagaa

SEQ ID NO: 116901 - DNA, 25 bp, Mus musculus
acctctaaaagcagcctaggaaact

SEQ ID NO: 116902 - DNA, 25 bp, Mus musculus
acctctaaaagctgcctaggaaact

SEQ ID NO: 116903 - DNA, 25 bp, Mus musculus
acctctaaaccacctttcatattgt

SEQ ID NO: 116904 - DNA, 25 bp, Mus musculus
acctctaaaccagctttcatattgt

SEQ ID NO: 116905 - DNA, 25 bp, Mus musculus
acctctaagtatatggcaggcagat

SEQ ID NO: 116906 - DNA, 25 bp, Mus musculus
acctctaagtatttggcaggcagat

SEQ ID NO: 116907 - DNA, 25 bp, Mus musculus
acctctaatcgaagcactgcagaga

SEQ ID NO: 116908 - DNA, 25 bp, Mus musculus
acctctaatcgatgcactgcagaga

SEQ ID NO: 116909 - DNA, 25 bp, Mus musculus
acctctacaacacattcccaaaatg

SEQ ID NO: 116910 - DNA, 25 bp, Mus musculus
acctctacaacagattcccaaaatg

SEQ ID NO: 116911 - DNA, 25 bp, Mus musculus
acctctactagacctatgctgatct

SEQ ID NO: 116912 - DNA, 25 bp, Mus musculus
acctctactagagctatgctgatct

SEQ ID NO: 116913 - DNA, 25 bp, Mus musculus
acctctactcgactttgtaagatgt

SEQ ID NO: 116914 - DNA, 25 bp, Mus musculus
acctctactcgagtttgtaagatgt

SEQ ID NO: 116915 - DNA, 25 bp, Mus musculus
acctctactgtcctgaaagtctgga

SEQ ID NO: 116916 - DNA, 25 bp, Mus musculus
acctctactgtcgtgaaagtctgga

SEQ ID NO: 116917 - DNA, 25 bp, Mus musculus
acctctagaggtcagcttgctgctt

SEQ ID NO: 116918 - DNA, 25 bp, Mus musculus
acctctagaggtgagcttgctgctt

SEQ ID NO: 116919 - DNA, 25 bp, Mus musculus
acctctagctccatgaagggcttga

SEQ ID NO: 116920 - DNA, 25 bp, Mus musculus
acctctagctccttgaagggcttga

SEQ ID NO: 116921 - DNA, 25 bp, Mus musculus
acctctagctgtccactggactaag

SEQ ID NO: 116922 - DNA, 25 bp, Mus musculus
acctctagctgtgcactggactaag

SEQ ID NO: 116923 - DNA, 25 bp, Mus musculus
acctctaggtatctctcagttttta

SEQ ID NO: 116924 - DNA, 25 bp, Mus musculus
acctctaggtatgtctcagttttta

SEQ ID NO: 116925 - DNA, 25 bp, Mus musculus
acctctagtttcctgtgtgatatcc

SEQ ID NO: 116926 - DNA, 25 bp, Mus musculus
acctctagtttcgtgtgtgatatcc

SEQ ID NO: 116927 - DNA, 25 bp, Mus musculus
acctctataaagctaacccttcaca

SEQ ID NO: 116928 - DNA, 25 bp, Mus musculus
acctctataaaggtaacccttcaca

SEQ ID NO: 116929 - DNA, 25 bp, Mus musculus
acctctatgaccatgtaagatgcag

SEQ ID NO: 116930 - DNA, 25 bp, Mus musculus
acctctatgaccttgtaagatgcag

SEQ ID NO: 116931 - DNA, 25 bp, Mus musculus
acctctatgccaaggtggtggttct

SEQ ID NO: 116932 - DNA, 25 bp, Mus musculus
acctctatgccatggtggtggttct

SEQ ID NO: 116933 - DNA, 25 bp, Mus musculus
acctctcaaactccttatattcctt

SEQ ID NO: 116934 - DNA, 25 bp, Mus musculus
acctctcaaactgcttatattcctt

SEQ ID NO: 116935 - DNA, 25 bp, Mus musculus
acctctcaaaggctgtggctacatg

SEQ ID NO: 116936 - DNA, 25 bp, Mus musculus
acctctcaaagggtgtggctacatg

SEQ ID NO: 116937 - DNA, 25 bp, Mus musculus
acctctcaaggtctaaccagctttt

SEQ ID NO: 116938 - DNA, 25 bp, Mus musculus
acctctcaaggtgtaaccagctttt

SEQ ID NO: 116939 - DNA, 25 bp, Mus musculus
acctctcaattcctcacagtggtaa

SEQ ID NO: 116940 - DNA, 25 bp, Mus musculus
acctctcaattcgtcacagtggtaa

SEQ ID NO: 116941 - DNA, 25 bp, Mus musculus
acctctcacattagctggctcagca

SEQ ID NO: 116942 - DNA, 25 bp, Mus musculus
acctctcacatttgctggctcagca

SEQ ID NO: 116943 - DNA, 25 bp, Mus musculus
acctctcacccaacaatgacaggaa

SEQ ID NO: 116944 - DNA, 25 bp, Mus musculus
acctctcacccatcaatgacaggaa

SEQ ID NO: 116945 - DNA, 25 bp, Mus musculus
acctctcagcataagggttcctttt

SEQ ID NO: 116946 - DNA, 25 bp, Mus musculus
acctctcagcattagggttcctttt

SEQ ID NO: 116947 - DNA, 25 bp, Mus musculus
acctctcataccaccttggtagaga

SEQ ID NO: 116948 - DNA, 25 bp, Mus musculus
acctctcatacctccttggtagaga

SEQ ID NO: 116949 - DNA, 25 bp, Mus musculus
acctctcatggtcctgtacgggctg

SEQ ID NO: 116950 - DNA, 25 bp, Mus musculus
acctctcatggtgctgtacgggctg

SEQ ID NO: 116951 - DNA, 25 bp, Mus musculus
acctctcattgcaggctgttgggtt

SEQ ID NO: 116952 - DNA, 25 bp, Mus musculus
acctctcattgctggctgttgggtt

SEQ ID NO: 116953 - DNA, 25 bp, Mus musculus
acctctcattggcatgttactggct

SEQ ID NO: 116954 - DNA, 25 bp, Mus musculus
acctctcattgggatgttactggct

SEQ ID NO: 116955 - DNA, 25 bp, Mus musculus
acctctccagagctcaggcagatga

SEQ ID NO: 116956 - DNA, 25 bp, Mus musculus
acctctccagaggtcaggcagatga

SEQ ID NO: 116957 - DNA, 25 bp, Mus musculus
acctctccagataggccttttcaga

SEQ ID NO: 116958 - DNA, 25 bp, Mus musculus
acctctccagattggccttttcaga

SEQ ID NO: 116959 - DNA, 25 bp, Mus musculus
acctctccatccctgtatagtttct

SEQ ID NO: 116960 - DNA, 25 bp, Mus musculus
acctctccatccgtgtatagtttct

SEQ ID NO: 116961 - DNA, 25 bp, Mus musculus
acctctcccgccatgggcttgagat

SEQ ID NO: 116962 - DNA, 25 bp, Mus musculus
acctctcccgccttgggcttgagat

SEQ ID NO: 116963 - DNA, 25 bp, Mus musculus
acctctccgcttctgacaaagtcat

SEQ ID NO: 116964 - DNA, 25 bp, Mus musculus
acctctccgcttgtgacaaagtcat

SEQ ID NO: 116965 - DNA, 25 bp, Mus musculus
acctctcctacaaattctttacttg

SEQ ID NO: 116966 - DNA, 25 bp, Mus musculus
acctctcctacatattctttacttg

SEQ ID NO: 116967 - DNA, 25 bp, Mus musculus
acctctcctatcatgtcagacttgg

SEQ ID NO: 116968 - DNA, 25 bp, Mus musculus
acctctcctatcttgtcagacttgg

SEQ ID NO: 116969 - DNA, 25 bp, Mus musculus
acctctcctggcacatgatggagga

SEQ ID NO: 116970 - DNA, 25 bp, Mus musculus
acctctcctggctcatgatggagga

SEQ ID NO: 116971 - DNA, 25 bp, Mus musculus
acctctcctggtaatgacttagtca

SEQ ID NO: 116972 - DNA, 25 bp, Mus musculus
acctctcctggttatgacttagtca

SEQ ID NO: 116973 - DNA, 25 bp, Mus musculus
acctctcgctccaggaaggatcggt

SEQ ID NO: 116974 - DNA, 25 bp, Mus musculus
acctctcgctcctggaaggatcggt

SEQ ID NO: 116975 - DNA, 25 bp, Mus musculus
acctctcgctgccttaggaatggtt

SEQ ID NO: 116976 - DNA, 25 bp, Mus musculus
acctctcgctgcgttaggaatggtt

SEQ ID NO: 116977 - DNA, 25 bp, Mus musculus
acctctcgggctagggcatggaagc

SEQ ID NO: 116978 - DNA, 25 bp, Mus musculus
acctctcgggcttgggcatggaagc

SEQ ID NO: 116979 - DNA, 25 bp, Mus musculus
acctctcgttctaatccgtgcggat

SEQ ID NO: 116980 - DNA, 25 bp, Mus musculus
acctctcgttcttatccgtgcggat

SEQ ID NO: 116981 - DNA, 25 bp, Mus musculus
acctctctacagaggcgtggttgga

SEQ ID NO: 116982 - DNA, 25 bp, Mus musculus
acctctctacagtggcgtggttgga

SEQ ID NO: 116983 - DNA, 25 bp, Mus musculus
acctctctatacctgctttgcaaaa

SEQ ID NO: 116984 - DNA, 25 bp, Mus musculus
acctctctatacgtgctttgcaaaa

SEQ ID NO: 116985 - DNA, 25 bp, Mus musculus
acctctctcaaaccatggaatcctg

SEQ ID NO: 116986 - DNA, 25 bp, Mus musculus
acctctctcaaagcatggaatcctg

SEQ ID NO: 116987 - DNA, 25 bp, Mus musculus
acctctctcactagatcttccagag

SEQ ID NO: 116988 - DNA, 25 bp, Mus musculus
acctctctcacttgatcttccagag

SEQ ID NO: 116989 - DNA, 25 bp, Mus musculus
acctctctccgtctgaatgggttgt

SEQ ID NO: 116990 - DNA, 25 bp, Mus musculus
acctctctccgtgtgaatgggttgt

SEQ ID NO: 116991 - DNA, 25 bp, Mus musculus
acctctctcctgacaatgttatcat

SEQ ID NO: 116992 - DNA, 25 bp, Mus musculus
acctctctcctgtcaatgttatcat

SEQ ID NO: 116993 - DNA, 25 bp, Mus musculus
acctctctcggcctattacagttga

SEQ ID NO: 116994 - DNA, 25 bp, Mus musculus
acctctctcggcgtattacagttga

SEQ ID NO: 116995 - DNA, 25 bp, Mus musculus
acctctctgagcacttcttggagaa

SEQ ID NO: 116996 - DNA, 25 bp, Mus musculus
acctctctgagctcttcttggagaa

SEQ ID NO: 116997 - DNA, 25 bp, Mus musculus
acctctctgaggatctgttttgcaa

SEQ ID NO: 116998 - DNA, 25 bp, Mus musculus
acctctctgaggttctgttttgcaa

SEQ ID NO: 116999 - DNA, 25 bp, Mus musculus
acctctctgcgtacgatgctgagta

SEQ ID NO: 117000 - DNA, 25 bp, Mus musculus
acctctctgcgttcgatgctgagta

SEQ ID NO: 117001 - DNA, 25 bp, Mus musculus
acctctctgctacttattttgaagt

SEQ ID NO: 117002 - DNA, 25 bp, Mus musculus
acctctctgctagttattttgaagt

SEQ ID NO: 117003 - DNA, 25 bp, Mus musculus
acctctctgggcctaaatttccaca

SEQ ID NO: 117004 - DNA, 25 bp, Mus musculus
acctctctgggcgtaaatttccaca

SEQ ID NO: 117005 - DNA, 25 bp, Mus musculus
acctctcttctgctcagggcacaga

SEQ ID NO: 117006 - DNA, 25 bp, Mus musculus
acctctcttctggtcagggcacaga

SEQ ID NO: 117007 - DNA, 25 bp, Mus musculus
acctctcttggaactaagatggctg

SEQ ID NO: 117008 - DNA, 25 bp, Mus musculus
acctctcttggatctaagatggctg

SEQ ID NO: 117009 - DNA, 25 bp, Mus musculus
acctctgaaagtatgttggctgtaa

SEQ ID NO: 117010 - DNA, 25 bp, Mus musculus
acctctgaaagtttgttggctgtaa

SEQ ID NO: 117011 - DNA, 25 bp, Mus musculus
acctctgaagccagcatttctgaac

SEQ ID NO: 117012 - DNA, 25 bp, Mus musculus
acctctgaagcctgcatttctgaac

SEQ ID NO: 117013 - DNA, 25 bp, Mus musculus
acctctgaatgcatctgcactgaac

SEQ ID NO: 117014 - DNA, 25 bp, Mus musculus
acctctgaatgcttctgcactgaac

SEQ ID NO: 117015 - DNA, 25 bp, Mus musculus
acctctgacaagacttcttgggcaa

SEQ ID NO: 117016 - DNA, 25 bp, Mus musculus
acctctgacaagtcttcttgggcaa

SEQ ID NO: 117017 - DNA, 25 bp, Mus musculus
acctctgacatgattgccgaacgac

SEQ ID NO: 117018 - DNA, 25 bp, Mus musculus
acctctgacatgtttgccgaacgac

SEQ ID NO: 117019 - DNA, 25 bp, Mus musculus
acctctgaccttccggtgattacaa

SEQ ID NO: 117020 - DNA, 25 bp, Mus musculus
acctctgaccttgcggtgattacaa

SEQ ID NO: 117021 - DNA, 25 bp, Mus musculus
acctctgacttcaggaactacgtgc

SEQ ID NO: 117022 - DNA, 25 bp, Mus musculus
acctctgacttctggaactacgtgc

SEQ ID NO: 117023 - DNA, 25 bp, Mus musculus
acctctgagacaacttcttgtttct

SEQ ID NO: 117024 - DNA, 25 bp, Mus musculus
acctctgagacatcttcttgtttct

SEQ ID NO: 117025 - DNA, 25 bp, Mus musculus
acctctgagagcattgtcctttaaa

SEQ ID NO: 117026 - DNA, 25 bp, Mus musculus
acctctgagagctttgtcctttaaa

SEQ ID NO: 117027 - DNA, 25 bp, Mus musculus
acctctgagaggacaggcttagaat

SEQ ID NO: 117028 - DNA, 25 bp, Mus musculus
acctctgagaggtcaggcttagaat

SEQ ID NO: 117029 - DNA, 25 bp, Mus musculus
acctctgagcatctctgtcagggtg

SEQ ID NO: 117030 - DNA, 25 bp, Mus musculus
acctctgagcatgtctgtcagggtg

SEQ ID NO: 117031 - DNA, 25 bp, Mus musculus
acctctgagctgacctaaagtattg

SEQ ID NO: 117032 - DNA, 25 bp, Mus musculus
acctctgagctgtcctaaagtattg

SEQ ID NO: 117033 - DNA, 25 bp, Mus musculus
acctctgagtgaacctgcacaagga

SEQ ID NO: 117034 - DNA, 25 bp, Mus musculus
acctctgagtgatcctgcacaagga

SEQ ID NO: 117035 - DNA, 25 bp, Mus musculus
acctctgagtggctaagcagctgtt

SEQ ID NO: 117036 - DNA, 25 bp, Mus musculus
acctctgagtgggtaagcagctgtt

SEQ ID NO: 117037 - DNA, 25 bp, Mus musculus
acctctgatcagaacagtggcgttg

SEQ ID NO: 117038 - DNA, 25 bp, Mus musculus
acctctgatcagtacagtggcgttg

SEQ ID NO: 117039 - DNA, 25 bp, Mus musculus
acctctgatgacattggactcaata

SEQ ID NO: 117040 - DNA, 25 bp, Mus musculus
acctctgatgactttggactcaata

SEQ ID NO: 117041 - DNA, 25 bp, Mus musculus
acctctgattctcctctagtgtaca

SEQ ID NO: 117042 - DNA, 25 bp, Mus musculus
acctctgattctgctctagtgtaca

SEQ ID NO: 117043 - DNA, 25 bp, Mus musculus
acctctgcactgaacttcctataag

SEQ ID NO: 117044 - DNA, 25 bp, Mus musculus
acctctgcactgctgttcatagaac

SEQ ID NO: 117045 - DNA, 25 bp, Mus musculus
acctctgcactggtgttcatagaac

SEQ ID NO: 117046 - DNA, 25 bp, Mus musculus
acctctgcactgtacttcctataag

SEQ ID NO: 117047 - DNA, 25 bp, Mus musculus
acctctgcagcgaccgtagcatgga

SEQ ID NO: 117048 - DNA, 25 bp, Mus musculus
acctctgcagcgtccgtagcatgga

SEQ ID NO: 117049 - DNA, 25 bp, Mus musculus
acctctgcaggtctggtcctcgtgg

SEQ ID NO: 117050 - DNA, 25 bp, Mus musculus
acctctgcaggtgtggtcctcgtgg

SEQ ID NO: 117051 - DNA, 25 bp, Mus musculus
acctctgcatgcacttaactttggc

SEQ ID NO: 117052 - DNA, 25 bp, Mus musculus
acctctgcatgctcttaactttggc

SEQ ID NO: 117053 - DNA, 25 bp, Mus musculus
acctctgcatggattttcttgccaa

SEQ ID NO: 117054 - DNA, 25 bp, Mus musculus
acctctgcatggtttttcttgccaa

SEQ ID NO: 117055 - DNA, 25 bp, Mus musculus
acctctgcccagcttagtagaagtc

SEQ ID NO: 117056 - DNA, 25 bp, Mus musculus
acctctgcccaggttagtagaagtc

SEQ ID NO: 117057 - DNA, 25 bp, Mus musculus
acctctgccccaaacactagagaag

SEQ ID NO: 117058 - DNA, 25 bp, Mus musculus
acctctgccccatacactagagaag

SEQ ID NO: 117059 - DNA, 25 bp, Mus musculus
acctctgccctcatgagaattctaa

SEQ ID NO: 117060 - DNA, 25 bp, Mus musculus
acctctgccctcttgagaattctaa

SEQ ID NO: 117061 - DNA, 25 bp, Mus musculus
acctctgctcctcgattcagataag

SEQ ID NO: 117062 - DNA, 25 bp, Mus musculus
acctctgctcctggattcagataag

SEQ ID NO: 117063 - DNA, 25 bp, Mus musculus
acctctgctcttctgtgtgaattca

SEQ ID NO: 117064 - DNA, 25 bp, Mus musculus
acctctgctcttgtgtgtgaattca

SEQ ID NO: 117065 - DNA, 25 bp, Mus musculus
acctctgctggccatagtcatcatt

SEQ ID NO: 117066 - DNA, 25 bp, Mus musculus
acctctgctggcgatagtcatcatt

SEQ ID NO: 117067 - DNA, 25 bp, Mus musculus
acctctgcttcgctagtgtttctac

SEQ ID NO: 117068 - DNA, 25 bp, Mus musculus
acctctgcttcggtagtgtttctac

SEQ ID NO: 117069 - DNA, 25 bp, Mus musculus
acctctggaagccgcgattgaatgt

SEQ ID NO: 117070 - DNA, 25 bp, Mus musculus
acctctggaagcggcgattgaatgt

SEQ ID NO: 117071 - DNA, 25 bp, Mus musculus
acctctggaggaaatagttagcgtg

SEQ ID NO: 117072 - DNA, 25 bp, Mus musculus
acctctggaggatatagttagcgtg

SEQ ID NO: 117073 - DNA, 25 bp, Mus musculus
acctctggccgaaacagatggctgg

SEQ ID NO: 117074 - DNA, 25 bp, Mus musculus
acctctggccgatacagatggctgg

SEQ ID NO: 117075 - DNA, 25 bp, Mus musculus
acctctggcctaagtactcatgttt

SEQ ID NO: 117076 - DNA, 25 bp, Mus musculus
acctctggcctatgtactcatgttt

SEQ ID NO: 117077 - DNA, 25 bp, Mus musculus
acctctggcttaaactggttctaga

SEQ ID NO: 117078 - DNA, 25 bp, Mus musculus
acctctggcttaacaaccttttatg

SEQ ID NO: 117079 - DNA, 25 bp, Mus musculus
acctctggcttatactggttctaga

SEQ ID NO: 117080 - DNA, 25 bp, Mus musculus
acctctggcttatcaaccttttatg

SEQ ID NO: 117081 - DNA, 25 bp, Mus musculus
acctctgggatgacgtttagtgcct

SEQ ID NO: 117082 - DNA, 25 bp, Mus musculus
acctctgggatgtcgtttagtgcct

SEQ ID NO: 117083 - DNA, 25 bp, Mus musculus
acctctgggcatagtcacttatgga

SEQ ID NO: 117084 - DNA, 25 bp, Mus musculus
acctctgggcattgtcacttatgga

SEQ ID NO: 117085 - DNA, 25 bp, Mus musculus
acctctgggcttccatctatgggag

SEQ ID NO: 117086 - DNA, 25 bp, Mus musculus
acctctgggcttgcatctatgggag

SEQ ID NO: 117087 - DNA, 25 bp, Mus musculus
acctctgggtgaaagcaaatgctgc

SEQ ID NO: 117088 - DNA, 25 bp, Mus musculus
acctctgggtgatagcaaatgctgc

SEQ ID NO: 117089 - DNA, 25 bp, Mus musculus
acctctggtctcagcactaggcagg

SEQ ID NO: 117090 - DNA, 25 bp, Mus musculus
acctctggtctctgcactaggcagg

SEQ ID NO: 117091 - DNA, 25 bp, Mus musculus
acctctggtctgaagtacaagaagt

SEQ ID NO: 117092 - DNA, 25 bp, Mus musculus
acctctggtctgtagtacaagaagt

SEQ ID NO: 117093 - DNA, 25 bp, Mus musculus
acctctggtgatctaactctatcca

SEQ ID NO: 117094 - DNA, 25 bp, Mus musculus
acctctggtgatgtaactctatcca

SEQ ID NO: 117095 - DNA, 25 bp, Mus musculus
acctctggtgtacggagaacatatt

SEQ ID NO: 117096 - DNA, 25 bp, Mus musculus
acctctggtgtagggagaacatatt

SEQ ID NO: 117097 - DNA, 25 bp, Mus musculus
acctctggttgacgctcagtgttta

SEQ ID NO: 117098 - DNA, 25 bp, Mus musculus
acctctggttgaggctcagtgttta

SEQ ID NO: 117099 - DNA, 25 bp, Mus musculus
acctctgtaattatgaagctctctg

SEQ ID NO: 117100 - DNA, 25 bp, Mus musculus
acctctgtaattttgaagctctctg

SEQ ID NO: 117101 - DNA, 25 bp, Mus musculus
acctctgtagataaaccacagtgga

SEQ ID NO: 117102 - DNA, 25 bp, Mus musculus
acctctgtagatctgtctgttccgt

SEQ ID NO: 117103 - DNA, 25 bp, Mus musculus
acctctgtagatgtgtctgttccgt

SEQ ID NO: 117104 - DNA, 25 bp, Mus musculus
acctctgtagattaaccacagtgga

SEQ ID NO: 117105 - DNA, 25 bp, Mus musculus
acctctgtatctcactttctgttgt

SEQ ID NO: 117106 - DNA, 25 bp, Mus musculus
acctctgtatctgactttctgttgt

SEQ ID NO: 117107 - DNA, 25 bp, Mus musculus
acctctgtcaagatcgctgcatttt

SEQ ID NO: 117108 - DNA, 25 bp, Mus musculus
acctctgtcaagttcgctgcatttt

SEQ ID NO: 117109 - DNA, 25 bp, Mus musculus
acctctgtccctctcaacaatattt

SEQ ID NO: 117110 - DNA, 25 bp, Mus musculus
acctctgtccctgtcaacaatattt

SEQ ID NO: 117111 - DNA, 25 bp, Mus musculus
acctctgtctctaagctcagttttt

SEQ ID NO: 117112 - DNA, 25 bp, Mus musculus
acctctgtctcttagctcagttttt

SEQ ID NO: 117113 - DNA, 25 bp, Mus musculus
acctctgtctgtatctgcttctgag

SEQ ID NO: 117114 - DNA, 25 bp, Mus musculus
acctctgtctgtttctgcttctgag

SEQ ID NO: 117115 - DNA, 25 bp, Mus musculus
acctctgtcttgattctttaatcat

SEQ ID NO: 117116 - DNA, 25 bp, Mus musculus
acctctgtcttgtttctttaatcat

SEQ ID NO: 117117 - DNA, 25 bp, Mus musculus
acctctgtgcccaatgccaagctta

SEQ ID NO: 117118 - DNA, 25 bp, Mus musculus
acctctgtgccctatgccaagctta

SEQ ID NO: 117119 - DNA, 25 bp, Mus musculus
acctctgtggccagaaatgtccaaa

SEQ ID NO: 117120 - DNA, 25 bp, Mus musculus
acctctgtggcctgaaatgtccaaa

SEQ ID NO: 117121 - DNA, 25 bp, Mus musculus
acctctgtgggaattgcacaataaa

SEQ ID NO: 117122 - DNA, 25 bp, Mus musculus
acctctgtgggatttgcacaataaa

SEQ ID NO: 117123 - DNA, 25 bp, Mus musculus
acctctgtgggcagtaaacatgtac

SEQ ID NO: 117124 - DNA, 25 bp, Mus musculus
acctctgtgggctgtaaacatgtac

SEQ ID NO: 117125 - DNA, 25 bp, Mus musculus
acctctgtgggtaatcaggcataca

SEQ ID NO: 117126 - DNA, 25 bp, Mus musculus
acctctgtgggttatcaggcataca

SEQ ID NO: 117127 - DNA, 25 bp, Mus musculus
acctctgtgtacagccactgataga

SEQ ID NO: 117128 - DNA, 25 bp, Mus musculus
acctctgtgtactgccactgataga

SEQ ID NO: 117129 - DNA, 25 bp, Mus musculus
acctctgtgtgtctgtcaatgctgt

SEQ ID NO: 117130 - DNA, 25 bp, Mus musculus
acctctgtgtgtgtgtcaatgctgt

SEQ ID NO: 117131 - DNA, 25 bp, Mus musculus
acctctgtgttaatgcttcaaccta

SEQ ID NO: 117132 - DNA, 25 bp, Mus musculus
acctctgtgttattgcttcaaccta

SEQ ID NO: 117133 - DNA, 25 bp, Mus musculus
acctctgttactctcagcctggaat

SEQ ID NO: 117134 - DNA, 25 bp, Mus musculus
acctctgttactgtcagcctggaat

SEQ ID NO: 117135 - DNA, 25 bp, Mus musculus
acctctgttagtcatatgaaacctt

SEQ ID NO: 117136 - DNA, 25 bp, Mus musculus
acctctgttagtgatatgaaacctt

SEQ ID NO: 117137 - DNA, 25 bp, Mus musculus
acctctgttctgctggcatgtgaca

SEQ ID NO: 117138 - DNA, 25 bp, Mus musculus
acctctgttctggtggcatgtgaca

SEQ ID NO: 117139 - DNA, 25 bp, Mus musculus
acctctgttcttcttaagtcgtctc

SEQ ID NO: 117140 - DNA, 25 bp, Mus musculus
acctctgttcttgttaagtcgtctc

SEQ ID NO: 117141 - DNA, 25 bp, Mus musculus
acctctgtttccatctttgtattta

SEQ ID NO: 117142 - DNA, 25 bp, Mus musculus
acctctgtttccttctttgtattta

SEQ ID NO: 117143 - DNA, 25 bp, Mus musculus
acctctgtttgaattctcctggctg

SEQ ID NO: 117144 - DNA, 25 bp, Mus musculus
acctctgtttgatttctcctggctg

SEQ ID NO: 117145 - DNA, 25 bp, Mus musculus
acctcttaagctctgctgggatccg

SEQ ID NO: 117146 - DNA, 25 bp, Mus musculus
acctcttaagctgtgctgggatccg

SEQ ID NO: 117147 - DNA, 25 bp, Mus musculus
acctcttaagggacatcaggcctcg

SEQ ID NO: 117148 - DNA, 25 bp, Mus musculus
acctcttaagggtcatcaggcctcg

SEQ ID NO: 117149 - DNA, 25 bp, Mus musculus
acctcttacctcacttctgtaaata

SEQ ID NO: 117150 - DNA, 25 bp, Mus musculus
acctcttacctctcttctgtaaata

SEQ ID NO: 117151 - DNA, 25 bp, Mus musculus
acctcttagagcacgggttctgcaa

SEQ ID NO: 117152 - DNA, 25 bp, Mus musculus
acctcttagagctcgggttctgcaa

SEQ ID NO: 117153 - DNA, 25 bp, Mus musculus
acctcttagtgcacttaagctgaga

SEQ ID NO: 117154 - DNA, 25 bp, Mus musculus
acctcttagtgctcttaagctgaga

SEQ ID NO: 117155 - DNA, 25 bp, Mus musculus
acctcttattacctccctcaaggag

SEQ ID NO: 117156 - DNA, 25 bp, Mus musculus
acctcttattacgtccctcaaggag

SEQ ID NO: 117157 - DNA, 25 bp, Mus musculus
acctcttcacctataatttctgcag

SEQ ID NO: 117158 - DNA, 25 bp, Mus musculus
acctcttcacctttaatttctgcag

SEQ ID NO: 117159 - DNA, 25 bp, Mus musculus
acctcttcattgcagcgctgttggg

SEQ ID NO: 117160 - DNA, 25 bp, Mus musculus
acctcttcattggagcgctgttggg

SEQ ID NO: 117161 - DNA, 25 bp, Mus musculus
acctcttccaagcagcatggtgtga

SEQ ID NO: 117162 - DNA, 25 bp, Mus musculus
acctcttccaaggagcatggtgtga

SEQ ID NO: 117163 - DNA, 25 bp, Mus musculus
acctcttcctgaaacactttgtgtg

SEQ ID NO: 117164 - DNA, 25 bp, Mus musculus
acctcttcctgatacactttgtgtg

SEQ ID NO: 117165 - DNA, 25 bp, Mus musculus
acctcttcctggcaaaggtgtatat

SEQ ID NO: 117166 - DNA, 25 bp, Mus musculus
acctcttcctgggaaaggtgtatat

SEQ ID NO: 117167 - DNA, 25 bp, Mus musculus
acctcttctagcatctgtatttgct

SEQ ID NO: 117168 - DNA, 25 bp, Mus musculus
acctcttctagcttctgtatttgct

SEQ ID NO: 117169 - DNA, 25 bp, Mus musculus
acctcttctctaccatactcaggaa

SEQ ID NO: 117170 - DNA, 25 bp, Mus musculus
acctcttctctagcatactcaggaa

SEQ ID NO: 117171 - DNA, 25 bp, Mus musculus
acctcttctgctatcacctgaaaag

SEQ ID NO: 117172 - DNA, 25 bp, Mus musculus
acctcttctgctttcacctgaaaag

SEQ ID NO: 117173 - DNA, 25 bp, Mus musculus
acctcttgattcctttatggctttg

SEQ ID NO: 117174 - DNA, 25 bp, Mus musculus
acctcttgattcgtttatggctttg

SEQ ID NO: 117175 - DNA, 25 bp, Mus musculus
acctcttgcacacctgtggtctgca

SEQ ID NO: 117176 - DNA, 25 bp, Mus musculus
acctcttgcacagctgtggtctgca

SEQ ID NO: 117177 - DNA, 25 bp, Mus musculus
acctcttgccacaaaatacccagga

SEQ ID NO: 117178 - DNA, 25 bp, Mus musculus
acctcttgccactaaatacccagga

SEQ ID NO: 117179 - DNA, 25 bp, Mus musculus
acctcttgccagcagtagcagggct

SEQ ID NO: 117180 - DNA, 25 bp, Mus musculus
acctcttgccaggagtagcagggct

SEQ ID NO: 117181 - DNA, 25 bp, Mus musculus
acctcttgctgtctcagtattacca

SEQ ID NO: 117182 - DNA, 25 bp, Mus musculus
acctcttgctgtgtcagtattacca

SEQ ID NO: 117183 - DNA, 25 bp, Mus musculus
acctcttggacgcatggccctaaat

SEQ ID NO: 117184 - DNA, 25 bp, Mus musculus
acctcttggacggatggccctaaat

SEQ ID NO: 117185 - DNA, 25 bp, Mus musculus
acctcttggccaaaatggcctccaa

SEQ ID NO: 117186 - DNA, 25 bp, Mus musculus
acctcttggccacaaggctgcagtg

SEQ ID NO: 117187 - DNA, 25 bp, Mus musculus
acctcttggccagaaggctgcagtg

SEQ ID NO: 117188 - DNA, 25 bp, Mus musculus
acctcttggccataatggcctccaa

SEQ ID NO: 117189 - DNA, 25 bp, Mus musculus
acctcttggctcacagaaacaggct

SEQ ID NO: 117190 - DNA, 25 bp, Mus musculus
acctcttggctctcagaaacaggct

SEQ ID NO: 117191 - DNA, 25 bp, Mus musculus
acctcttggcttacagcggttacaa

SEQ ID NO: 117192 - DNA, 25 bp, Mus musculus
acctcttggcttagggtccagatac

SEQ ID NO: 117193 - DNA, 25 bp, Mus musculus
acctcttggctttcagcggttacaa

SEQ ID NO: 117194 - DNA, 25 bp, Mus musculus
acctcttggctttgggtccagatac

SEQ ID NO: 117195 - DNA, 25 bp, Mus musculus
acctcttggttgaagatctctttca

SEQ ID NO: 117196 - DNA, 25 bp, Mus musculus
acctcttggttgctttatgggcact

SEQ ID NO: 117197 - DNA, 25 bp, Mus musculus
acctcttggttggtttatgggcact

SEQ ID NO: 117198 - DNA, 25 bp, Mus musculus
acctcttggttgtagatctctttca

SEQ ID NO: 117199 - DNA, 25 bp, Mus musculus
acctcttgtagtagttgcagagcaa

SEQ ID NO: 117200 - DNA, 25 bp, Mus musculus
acctcttgtagttgttgcagagcaa

SEQ ID NO: 117201 - DNA, 25 bp, Mus musculus
acctcttgtccaagctttggttcat

SEQ ID NO: 117202 - DNA, 25 bp, Mus musculus
acctcttgtccatgctttggttcat

SEQ ID NO: 117203 - DNA, 25 bp, Mus musculus
acctcttgtgcaaatttttctgtaa

SEQ ID NO: 117204 - DNA, 25 bp, Mus musculus
acctcttgtgcatatttttctgtaa

SEQ ID NO: 117205 - DNA, 25 bp, Mus musculus
acctcttgtgtcagcggacttcctt

SEQ ID NO: 117206 - DNA, 25 bp, Mus musculus
acctcttgtgtctgcggacttcctt

SEQ ID NO: 117207 - DNA, 25 bp, Mus musculus
acctctttaagaacctccacagtga

SEQ ID NO: 117208 - DNA, 25 bp, Mus musculus
acctctttaagatcctccacagtga

SEQ ID NO: 117209 - DNA, 25 bp, Mus musculus
acctctttcaacctgggacgctatg

SEQ ID NO: 117210 - DNA, 25 bp, Mus musculus
acctctttcaacgtgggacgctatg

SEQ ID NO: 117211 - DNA, 25 bp, Mus musculus
acctctttcaccattgccatattga

SEQ ID NO: 117212 - DNA, 25 bp, Mus musculus
acctctttcacctttgccatattga

SEQ ID NO: 117213 - DNA, 25 bp, Mus musculus
acctctttccagctgagtggttata

SEQ ID NO: 117214 - DNA, 25 bp, Mus musculus
acctctttccaggtgagtggttata

SEQ ID NO: 117215 - DNA, 25 bp, Mus musculus
acctctttctgaccttgttaaatat

SEQ ID NO: 117216 - DNA, 25 bp, Mus musculus
acctctttctgagcttgttaaatat

SEQ ID NO: 117217 - DNA, 25 bp, Mus musculus
acctctttctgcagatctctggaaa

SEQ ID NO: 117218 - DNA, 25 bp, Mus musculus
acctctttctgcatggccctggaaa

SEQ ID NO: 117219 - DNA, 25 bp, Mus musculus
acctctttctgctgatctctggaaa

SEQ ID NO: 117220 - DNA, 25 bp, Mus musculus
acctctttctgcttggccctggaaa

SEQ ID NO: 117221 - DNA, 25 bp, Mus musculus
acctctttctgtcagcactttgggt

SEQ ID NO: 117222 - DNA, 25 bp, Mus musculus
acctctttctgtgagcactttgggt

SEQ ID NO: 117223 - DNA, 25 bp, Mus musculus
acctctttcttcacatgtgccagat

SEQ ID NO: 117224 - DNA, 25 bp, Mus musculus
acctctttcttctcatgtgccagat

SEQ ID NO: 117225 - DNA, 25 bp, Mus musculus
acctctttgagcagagcagcgggag

SEQ ID NO: 117226 - DNA, 25 bp, Mus musculus
acctctttgagctgagcagcgggag

SEQ ID NO: 117227 - DNA, 25 bp, Mus musculus
acctctttgatcatgccaagccaaa

SEQ ID NO: 117228 - DNA, 25 bp, Mus musculus
acctctttgatcttgccaagccaaa

SEQ ID NO: 117229 - DNA, 25 bp, Mus musculus
acctctttgtgcatccactctggaa

SEQ ID NO: 117230 - DNA, 25 bp, Mus musculus
acctctttgtgcctcaatttctgta

SEQ ID NO: 117231 - DNA, 25 bp, Mus musculus
acctctttgtgcgtcaatttctgta

SEQ ID NO: 117232 - DNA, 25 bp, Mus musculus
acctctttgtgcttccactctggaa

SEQ ID NO: 117233 - DNA, 25 bp, Mus musculus
acctcttttggtactgtgtgcatat

SEQ ID NO: 117234 - DNA, 25 bp, Mus musculus
acctcttttggttctgtgtgcatat

SEQ ID NO: 117235 - DNA, 25 bp, Mus musculus
acctcttttgtcattggcagtgaaa

SEQ ID NO: 117236 - DNA, 25 bp, Mus musculus
acctcttttgtctttggcagtgaaa

SEQ ID NO: 117237 - DNA, 25 bp, Mus musculus
acctgaaaacagagttcctgaagca

SEQ ID NO: 117238 - DNA, 25 bp, Mus musculus
acctgaaaacagtgttcctgaagca

SEQ ID NO: 117239 - DNA, 25 bp, Mus musculus
acctgaaaacctctctgatgcagca

SEQ ID NO: 117240 - DNA, 25 bp, Mus musculus
acctgaaaacctgtctgatgcagca

SEQ ID NO: 117241 - DNA, 25 bp, Mus musculus
acctgaaacaggagtcagactgacc

SEQ ID NO: 117242 - DNA, 25 bp, Mus musculus
acctgaaacaggtgtcagactgacc

SEQ ID NO: 117243 - DNA, 25 bp, Mus musculus
acctgaaactaactgtatccatttg

SEQ ID NO: 117244 - DNA, 25 bp, Mus musculus
acctgaaactaagtgtatccatttg

SEQ ID NO: 117245 - DNA, 25 bp, Mus musculus
acctgaaactctagtgactcatcct

SEQ ID NO: 117246 - DNA, 25 bp, Mus musculus
acctgaaactcttgtgactcatcct

SEQ ID NO: 117247 - DNA, 25 bp, Mus musculus
acctgaaatctcctgggtgggcctg

SEQ ID NO: 117248 - DNA, 25 bp, Mus musculus
acctgaaatctcgtgggtgggcctg

SEQ ID NO: 117249 - DNA, 25 bp, Mus musculus
acctgaacccagacatgaagccata

SEQ ID NO: 117250 - DNA, 25 bp, Mus musculus
acctgaacccagtcatgaagccata

SEQ ID NO: 117251 - DNA, 25 bp, Mus musculus
acctgaacggcaacaattgagtgtt

SEQ ID NO: 117252 - DNA, 25 bp, Mus musculus
acctgaacggcatcaattgagtgtt

SEQ ID NO: 117253 - DNA, 25 bp, Mus musculus
acctgaactgatcgtatctcgcctc

SEQ ID NO: 117254 - DNA, 25 bp, Mus musculus
acctgaactgatggtatctcgcctc

SEQ ID NO: 117255 - DNA, 25 bp, Mus musculus
acctgaactgtactgcccagaagga

SEQ ID NO: 117256 - DNA, 25 bp, Mus musculus
acctgaactgtagtgcccagaagga

SEQ ID NO: 117257 - DNA, 25 bp, Mus musculus
acctgaactgtgatgttagtctgaa

SEQ ID NO: 117258 - DNA, 25 bp, Mus musculus
acctgaactgtgttgttagtctgaa

SEQ ID NO: 117259 - DNA, 25 bp, Mus musculus
acctgaactttccaaacgtgcaatt

SEQ ID NO: 117260 - DNA, 25 bp, Mus musculus
acctgaactttcgaaacgtgcaatt

SEQ ID NO: 117261 - DNA, 25 bp, Mus musculus
acctgaagaaccacatgcgggtgca

SEQ ID NO: 117262 - DNA, 25 bp, Mus musculus
acctgaagaacctcatgcgggtgca

SEQ ID NO: 117263 - DNA, 25 bp, Mus musculus
acctgaagaagcagcggcggtcttc

SEQ ID NO: 117264 - DNA, 25 bp, Mus musculus
acctgaagaagctgcggcggtcttc

SEQ ID NO: 117265 - DNA, 25 bp, Mus musculus
acctgaagagtgaccatgaacacat

SEQ ID NO: 117266 - DNA, 25 bp, Mus musculus
acctgaagagtgtccatgaacacat

SEQ ID NO: 117267 - DNA, 25 bp, Mus musculus
acctgaagatccacaccggtgacaa

SEQ ID NO: 117268 - DNA, 25 bp, Mus musculus
acctgaagatcctcaccggtgacaa

SEQ ID NO: 117269 - DNA, 25 bp, Mus musculus
acctgaagcagcattacatcgacct

SEQ ID NO: 117270 - DNA, 25 bp, Mus musculus
acctgaagcagctttacatcgacct

SEQ ID NO: 117271 - DNA, 25 bp, Mus musculus
acctgaagccagagttggaagatga

SEQ ID NO: 117272 - DNA, 25 bp, Mus musculus
acctgaagccagtgttggaagatga

SEQ ID NO: 117273 - DNA, 25 bp, Mus musculus
acctgaagcggcaggcctatgtgag

SEQ ID NO: 117274 - DNA, 25 bp, Mus musculus
acctgaagcggctggcctatgtgag

SEQ ID NO: 117275 - DNA, 25 bp, Mus musculus
acctgaaggcatctcccctgaactt

SEQ ID NO: 117276 - DNA, 25 bp, Mus musculus
acctgaaggcatgtcccctgaactt

SEQ ID NO: 117277 - DNA, 25 bp, Mus musculus
acctgaagggcacgatcctcttcaa

SEQ ID NO: 117278 - DNA, 25 bp, Mus musculus
acctgaagggcaggatcctcttcaa

SEQ ID NO: 117279 - DNA, 25 bp, Mus musculus
acctgaagttgcaagttggcagctc

SEQ ID NO: 117280 - DNA, 25 bp, Mus musculus
acctgaagttgctagttggcagctc

SEQ ID NO: 117281 - DNA, 25 bp, Mus musculus
acctgaagttgtctgactgctgcaa

SEQ ID NO: 117282 - DNA, 25 bp, Mus musculus
acctgaagttgtgtgactgctgcaa

SEQ ID NO: 117283 - DNA, 25 bp, Mus musculus
acctgaatacttatggcagcaccct

SEQ ID NO: 117284 - DNA, 25 bp, Mus musculus
acctgaatacttttggcagcaccct

SEQ ID NO: 117285 - DNA, 25 bp, Mus musculus
acctgaatctcgctgcattatgcgg

SEQ ID NO: 117286 - DNA, 25 bp, Mus musculus
acctgaatctcggtgcattatgcgg

SEQ ID NO: 117287 - DNA, 25 bp, Mus musculus
acctgaatctgaatgtgtgcacaag

SEQ ID NO: 117288 - DNA, 25 bp, Mus musculus
acctgaatctgattgtgtgcacaag

SEQ ID NO: 117289 - DNA, 25 bp, Mus musculus
acctgaatgacaacacaaggctggt

SEQ ID NO: 117290 - DNA, 25 bp, Mus musculus
acctgaatgacatcacaaggctggt

SEQ ID NO: 117291 - DNA, 25 bp, Mus musculus
acctgaatgatgagttcctgcctgt

SEQ ID NO: 117292 - DNA, 25 bp, Mus musculus
acctgaatgatgtgttcctgcctgt

SEQ ID NO: 117293 - DNA, 25 bp, Mus musculus
acctgaatgccaatgatattttttt

SEQ ID NO: 117294 - DNA, 25 bp, Mus musculus
acctgaatgccattgatattttttt

SEQ ID NO: 117295 - DNA, 25 bp, Mus musculus
acctgaatgctgaacatctatttga

SEQ ID NO: 117296 - DNA, 25 bp, Mus musculus
acctgaatgctgtacatctatttga

SEQ ID NO: 117297 - DNA, 25 bp, Mus musculus
acctgaatggctattgtagtcagta

SEQ ID NO: 117298 - DNA, 25 bp, Mus musculus
acctgaatggcttttgtagtcagta

SEQ ID NO: 117299 - DNA, 25 bp, Mus musculus
acctgaattattattgcctgccctg

SEQ ID NO: 117300 - DNA, 25 bp, Mus musculus
acctgaattatttttgcctgccctg

SEQ ID NO: 117301 - DNA, 25 bp, Mus musculus
acctgaatttgaatcctaggcccca

SEQ ID NO: 117302 - DNA, 25 bp, Mus musculus
acctgaatttgattcctaggcccca

SEQ ID NO: 117303 - DNA, 25 bp, Mus musculus
acctgacaatgtccacagcagcttg

SEQ ID NO: 117304 - DNA, 25 bp, Mus musculus
acctgacaatgtgcacagcagcttg

SEQ ID NO: 117305 - DNA, 25 bp, Mus musculus
acctgacactgtatctgagatgagc

SEQ ID NO: 117306 - DNA, 25 bp, Mus musculus
acctgacactgtttctgagatgagc

SEQ ID NO: 117307 - DNA, 25 bp, Mus musculus
acctgacagcagctccactggtgga

SEQ ID NO: 117308 - DNA, 25 bp, Mus musculus
acctgacagcaggtccactggtgga

SEQ ID NO: 117309 - DNA, 25 bp, Mus musculus
acctgaccactaattattgctgctt

SEQ ID NO: 117310 - DNA, 25 bp, Mus musculus
acctgaccactatttattgctgctt

SEQ ID NO: 117311 - DNA, 25 bp, Mus musculus
acctgaccagacacagagggcacgg

SEQ ID NO: 117312 - DNA, 25 bp, Mus musculus
acctgaccagactcagagggcacgg

SEQ ID NO: 117313 - DNA, 25 bp, Mus musculus
acctgaccagagaggcatcgtggca

SEQ ID NO: 117314 - DNA, 25 bp, Mus musculus
acctgaccagagtggcatcgtggca

SEQ ID NO: 117315 - DNA, 25 bp, Mus musculus
acctgaccagggatcctctaaggta

SEQ ID NO: 117316 - DNA, 25 bp, Mus musculus
acctgaccagggttcctctaaggta

SEQ ID NO: 117317 - DNA, 25 bp, Mus musculus
acctgaccaggtaagattgttatct

SEQ ID NO: 117318 - DNA, 25 bp, Mus musculus
acctgaccaggttagattgttatct

SEQ ID NO: 117319 - DNA, 25 bp, Mus musculus
acctgaccagtgcttaattaggcca

SEQ ID NO: 117320 - DNA, 25 bp, Mus musculus
acctgaccagtggttaattaggcca

SEQ ID NO: 117321 - DNA, 25 bp, Mus musculus
acctgacccagcctgacacattttt

SEQ ID NO: 117322 - DNA, 25 bp, Mus musculus
acctgacccagcgtgacacattttt

SEQ ID NO: 117323 - DNA, 25 bp, Mus musculus
acctgacccgcccaagaaggatcga

SEQ ID NO: 117324 - DNA, 25 bp, Mus musculus
acctgacccgccgaagaaggatcga

SEQ ID NO: 117325 - DNA, 25 bp, Mus musculus
acctgaccgaataagtgagatccaa

SEQ ID NO: 117326 - DNA, 25 bp, Mus musculus
acctgaccgaattagtgagatccaa

SEQ ID NO: 117327 - DNA, 25 bp, Mus musculus
acctgaccgggtcttggtagcttct

SEQ ID NO: 117328 - DNA, 25 bp, Mus musculus
acctgaccgggtgttggtagcttct

SEQ ID NO: 117329 - DNA, 25 bp, Mus musculus
acctgaccggtcagtaatatgttac

SEQ ID NO: 117330 - DNA, 25 bp, Mus musculus
acctgaccggtctgtaatatgttac

SEQ ID NO: 117331 - DNA, 25 bp, Mus musculus
acctgacctccgaatgctatttgct

SEQ ID NO: 117332 - DNA, 25 bp, Mus musculus
acctgacctccgtatgctatttgct

SEQ ID NO: 117333 - DNA, 25 bp, Mus musculus
acctgacctggcaacgctttatctt

SEQ ID NO: 117334 - DNA, 25 bp, Mus musculus
acctgacctggctacgctttatctt

SEQ ID NO: 117335 - DNA, 25 bp, Mus musculus
acctgacctgtcattctttcatgga

SEQ ID NO: 117336 - DNA, 25 bp, Mus musculus
acctgacctgtctttctttcatgga

SEQ ID NO: 117337 - DNA, 25 bp, Mus musculus
acctgaccttcaacttgtttgttct

SEQ ID NO: 117338 - DNA, 25 bp, Mus musculus
acctgaccttcatcttgtttgttct

SEQ ID NO: 117339 - DNA, 25 bp, Mus musculus
acctgaccttggcagagttcgcact

SEQ ID NO: 117340 - DNA, 25 bp, Mus musculus
acctgaccttgggagagttcgcact

SEQ ID NO: 117341 - DNA, 25 bp, Mus musculus
acctgaccttgtagagattcctgga

SEQ ID NO: 117342 - DNA, 25 bp, Mus musculus
acctgaccttgttgagattcctgga

SEQ ID NO: 117343 - DNA, 25 bp, Mus musculus
acctgacgtcagctttcactgctat

SEQ ID NO: 117344 - DNA, 25 bp, Mus musculus
acctgacgtcaggtttcactgctat

SEQ ID NO: 117345 - DNA, 25 bp, Mus musculus
acctgactaaatctgactggctgca

SEQ ID NO: 117346 - DNA, 25 bp, Mus musculus
acctgactaaatgtgactggctgca

SEQ ID NO: 117347 - DNA, 25 bp, Mus musculus
acctgactaggtactgtgcttttct

SEQ ID NO: 117348 - DNA, 25 bp, Mus musculus
acctgactaggttctgtgcttttct

SEQ ID NO: 117349 - DNA, 25 bp, Mus musculus
acctgactatgacgcatcagatctt

SEQ ID NO: 117350 - DNA, 25 bp, Mus musculus
acctgactatgaggcatcagatctt

SEQ ID NO: 117351 - DNA, 25 bp, Mus musculus
acctgactatgtctggctttggcta

SEQ ID NO: 117352 - DNA, 25 bp, Mus musculus
acctgactatgtgtggctttggcta

SEQ ID NO: 117353 - DNA, 25 bp, Mus musculus
acctgactcagcattaggatcctat

SEQ ID NO: 117354 - DNA, 25 bp, Mus musculus
acctgactcagctttaggatcctat

SEQ ID NO: 117355 - DNA, 25 bp, Mus musculus
acctgactcagtacaagccaaaaga

SEQ ID NO: 117356 - DNA, 25 bp, Mus musculus
acctgactcagttcaagccaaaaga

SEQ ID NO: 117357 - DNA, 25 bp, Mus musculus
acctgactccacaaagccaaattta

SEQ ID NO: 117358 - DNA, 25 bp, Mus musculus
acctgactccactaagccaaattta

SEQ ID NO: 117359 - DNA, 25 bp, Mus musculus
acctgactccatctgtggcatttgt

SEQ ID NO: 117360 - DNA, 25 bp, Mus musculus
acctgactccatgtgtggcatttgt

SEQ ID NO: 117361 - DNA, 25 bp, Mus musculus
acctgactgactactgctccttcta

SEQ ID NO: 117362 - DNA, 25 bp, Mus musculus
acctgactgacttctgctccttcta

SEQ ID NO: 117363 - DNA, 25 bp, Mus musculus
acctgactgcggctcagttgttttc

SEQ ID NO: 117364 - DNA, 25 bp, Mus musculus
acctgactgcgggtcagttgttttc

SEQ ID NO: 117365 - DNA, 25 bp, Mus musculus
acctgactggaaaccttggctattt

SEQ ID NO: 117366 - DNA, 25 bp, Mus musculus
acctgactggaatccttggctattt

SEQ ID NO: 117367 - DNA, 25 bp, Mus musculus
acctgactgtacatttgtttccatt

SEQ ID NO: 117368 - DNA, 25 bp, Mus musculus
acctgactgtacttttgtttccatt

SEQ ID NO: 117369 - DNA, 25 bp, Mus musculus
acctgactgtgcactggacctgaac

SEQ ID NO: 117370 - DNA, 25 bp, Mus musculus
acctgactgtgctctggacctgaac

SEQ ID NO: 117371 - DNA, 25 bp, Mus musculus
acctgactgtgtagtttgtgggcca

SEQ ID NO: 117372 - DNA, 25 bp, Mus musculus
acctgactgtgttgtttgtgggcca

SEQ ID NO: 117373 - DNA, 25 bp, Mus musculus
acctgagaaaccagaccagtgctta

SEQ ID NO: 117374 - DNA, 25 bp, Mus musculus
acctgagaaacctgaccagtgctta

SEQ ID NO: 117375 - DNA, 25 bp, Mus musculus
acctgagaagctagtaacccctgga

SEQ ID NO: 117376 - DNA, 25 bp, Mus musculus
acctgagaagcttgtaacccctgga

SEQ ID NO: 117377 - DNA, 25 bp, Mus musculus
acctgagacacccaaagctcttaaa

SEQ ID NO: 117378 - DNA, 25 bp, Mus musculus
acctgagacaccgaaagctcttaaa

SEQ ID NO: 117379 - DNA, 25 bp, Mus musculus
acctgagacgacctactcggatcga

SEQ ID NO: 117380 - DNA, 25 bp, Mus musculus
acctgagacgacgtactcggatcga

SEQ ID NO: 117381 - DNA, 25 bp, Mus musculus
acctgagagctgacacggccagcag

SEQ ID NO: 117382 - DNA, 25 bp, Mus musculus
acctgagagctgtcacggccagcag

SEQ ID NO: 117383 - DNA, 25 bp, Mus musculus
acctgagagtttccggctgtgaaca

SEQ ID NO: 117384 - DNA, 25 bp, Mus musculus
acctgagagtttgcggctgtgaaca

SEQ ID NO: 117385 - DNA, 25 bp, Mus musculus
acctgagatgtaacatactgcctta

SEQ ID NO: 117386 - DNA, 25 bp, Mus musculus
acctgagatgtatcatactgcctta

SEQ ID NO: 117387 - DNA, 25 bp, Mus musculus
acctgagcagaaataagttgtcctt

SEQ ID NO: 117388 - DNA, 25 bp, Mus musculus
acctgagcagaattaagttgtcctt

SEQ ID NO: 117389 - DNA, 25 bp, Mus musculus
acctgagcaggaagcgcacgggcat

SEQ ID NO: 117390 - DNA, 25 bp, Mus musculus
acctgagcaggatgcgcacgggcat

SEQ ID NO: 117391 - DNA, 25 bp, Mus musculus
acctgagccgcactttgtgggttcc

SEQ ID NO: 117392 - DNA, 25 bp, Mus musculus
acctgagccgcagtttgtgggttcc

SEQ ID NO: 117393 - DNA, 25 bp, Mus musculus
acctgagcctacaagtcatgatgca

SEQ ID NO: 117394 - DNA, 25 bp, Mus musculus
acctgagcctacagccaagggtggc

SEQ ID NO: 117395 - DNA, 25 bp, Mus musculus
acctgagcctacatgagggaggtca

SEQ ID NO: 117396 - DNA, 25 bp, Mus musculus
acctgagcctactagtcatgatgca

SEQ ID NO: 117397 - DNA, 25 bp, Mus musculus
acctgagcctactgccaagggtggc

SEQ ID NO: 117398 - DNA, 25 bp, Mus musculus
acctgagcctacttgagggaggtca

SEQ ID NO: 117399 - DNA, 25 bp, Mus musculus
acctgagcctagagtctggcacaga

SEQ ID NO: 117400 - DNA, 25 bp, Mus musculus
acctgagcctagtgtctggcacaga

SEQ ID NO: 117401 - DNA, 25 bp, Mus musculus
acctgagcgattagatgtcattgac

SEQ ID NO: 117402 - DNA, 25 bp, Mus musculus
acctgagcgatttgatgtcattgac

SEQ ID NO: 117403 - DNA, 25 bp, Mus musculus
acctgagcgcagacctaacacgaaa

SEQ ID NO: 117404 - DNA, 25 bp, Mus musculus
acctgagcgcagtcctaacacgaaa

SEQ ID NO: 117405 - DNA, 25 bp, Mus musculus
acctgagcgctaattcacttaggat

SEQ ID NO: 117406 - DNA, 25 bp, Mus musculus
acctgagcgctatttcacttaggat

SEQ ID NO: 117407 - DNA, 25 bp, Mus musculus
acctgagcgctcaatgggtctgggc

SEQ ID NO: 117408 - DNA, 25 bp, Mus musculus
acctgagcgctctatgggtctgggc

SEQ ID NO: 117409 - DNA, 25 bp, Mus musculus
acctgagcggtgaggatttggttca

SEQ ID NO: 117410 - DNA, 25 bp, Mus musculus
acctgagcggtgtggatttggttca

SEQ ID NO: 117411 - DNA, 25 bp, Mus musculus
acctgagctatgatgattacattca

SEQ ID NO: 117412 - DNA, 25 bp, Mus musculus
acctgagctatgttgattacattca

SEQ ID NO: 117413 - DNA, 25 bp, Mus musculus
acctgagctcagaatctggaaccca

SEQ ID NO: 117414 - DNA, 25 bp, Mus musculus
acctgagctcagtatctggaaccca

SEQ ID NO: 117415 - DNA, 25 bp, Mus musculus
acctgagctcgtccctggtgtgtgt

SEQ ID NO: 117416 - DNA, 25 bp, Mus musculus
acctgagctcgtcgatctggtgatc

SEQ ID NO: 117417 - DNA, 25 bp, Mus musculus
acctgagctcgtgcctggtgtgtgt

SEQ ID NO: 117418 - DNA, 25 bp, Mus musculus
acctgagctcgtggatctggtgatc

SEQ ID NO: 117419 - DNA, 25 bp, Mus musculus
acctgagctgagaatgagtcacctg

SEQ ID NO: 117420 - DNA, 25 bp, Mus musculus
acctgagctgagtatgagtcacctg

SEQ ID NO: 117421 - DNA, 25 bp, Mus musculus
acctgagctgcaaaccaggagaaaa

SEQ ID NO: 117422 - DNA, 25 bp, Mus musculus
acctgagctgcacactggaatggga

SEQ ID NO: 117423 - DNA, 25 bp, Mus musculus
acctgagctgcagactggaatggga

SEQ ID NO: 117424 - DNA, 25 bp, Mus musculus
acctgagctgcataccaggagaaaa

SEQ ID NO: 117425 - DNA, 25 bp, Mus musculus
acctgagctgccaaatgcacagttg

SEQ ID NO: 117426 - DNA, 25 bp, Mus musculus
acctgagctgcctaatgcacagttg

SEQ ID NO: 117427 - DNA, 25 bp, Mus musculus
acctgagcttttagtatcgtgaata

SEQ ID NO: 117428 - DNA, 25 bp, Mus musculus
acctgagctttttgtatcgtgaata

SEQ ID NO: 117429 - DNA, 25 bp, Mus musculus
acctgaggcagcaactacacctgct

SEQ ID NO: 117430 - DNA, 25 bp, Mus musculus
acctgaggcagctactacacctgct

SEQ ID NO: 117431 - DNA, 25 bp, Mus musculus
acctgaggccagaatctgggctgca

SEQ ID NO: 117432 - DNA, 25 bp, Mus musculus
acctgaggccagtatctgggctgca

SEQ ID NO: 117433 - DNA, 25 bp, Mus musculus
acctgaggctgcagggacccgagtt

SEQ ID NO: 117434 - DNA, 25 bp, Mus musculus
acctgaggctgctgggacccgagtt

SEQ ID NO: 117435 - DNA, 25 bp, Mus musculus
acctgagggacgaggtatacaccta

SEQ ID NO: 117436 - DNA, 25 bp, Mus musculus
acctgagggacgtggtatacaccta

SEQ ID NO: 117437 - DNA, 25 bp, Mus musculus
acctgagggcacagtactggccgtg

SEQ ID NO: 117438 - DNA, 25 bp, Mus musculus
acctgagggcactgtactggccgtg

SEQ ID NO: 117439 - DNA, 25 bp, Mus musculus
acctgagggccaagaatctatgttt

SEQ ID NO: 117440 - DNA, 25 bp, Mus musculus
acctgagggccatgaatctatgttt

SEQ ID NO: 117441 - DNA, 25 bp, Mus musculus
acctgagggtgaccgactcctgtac

SEQ ID NO: 117442 - DNA, 25 bp, Mus musculus
acctgagggtgacgacaacctgtcc

SEQ ID NO: 117443 - DNA, 25 bp, Mus musculus
acctgagggtgagcgactcctgtac

SEQ ID NO: 117444 - DNA, 25 bp, Mus musculus
acctgagggtgaggacaacctgtcc

SEQ ID NO: 117445 - DNA, 25 bp, Mus musculus
acctgaggtagcagccgcacctgct

SEQ ID NO: 117446 - DNA, 25 bp, Mus musculus
acctgaggtagctgccgcacctgct

SEQ ID NO: 117447 - DNA, 25 bp, Mus musculus
acctgaggtggcacaagagggcaca

SEQ ID NO: 117448 - DNA, 25 bp, Mus musculus
acctgaggtggctcaagagggcaca

SEQ ID NO: 117449 - DNA, 25 bp, Mus musculus
acctgaggttacatccattgttgct

SEQ ID NO: 117450 - DNA, 25 bp, Mus musculus
acctgaggttacttccattgttgct

SEQ ID NO: 117451 - DNA, 25 bp, Mus musculus
acctgagtacaccactacacgttgg

SEQ ID NO: 117452 - DNA, 25 bp, Mus musculus
acctgagtacacgactacacgttgg

SEQ ID NO: 117453 - DNA, 25 bp, Mus musculus
acctgagtatttcgcacatgatggc

SEQ ID NO: 117454 - DNA, 25 bp, Mus musculus
acctgagtatttggcacatgatggc

SEQ ID NO: 117455 - DNA, 25 bp, Mus musculus
acctgagtcctcagtaagagcgcaa

SEQ ID NO: 117456 - DNA, 25 bp, Mus musculus
acctgagtcctctgtaagagcgcaa

SEQ ID NO: 117457 - DNA, 25 bp, Mus musculus
acctgagtcctgagcaagagcatca

SEQ ID NO: 117458 - DNA, 25 bp, Mus musculus
acctgagtcctgtgcaagagcatca

SEQ ID NO: 117459 - DNA, 25 bp, Mus musculus
acctgagtcggcatagcagctctga

SEQ ID NO: 117460 - DNA, 25 bp, Mus musculus
acctgagtcggcttagcagctctga

SEQ ID NO: 117461 - DNA, 25 bp, Mus musculus
acctgagtgactcttgctcgtcatt

SEQ ID NO: 117462 - DNA, 25 bp, Mus musculus
acctgagtgactgttgctcgtcatt

SEQ ID NO: 117463 - DNA, 25 bp, Mus musculus
acctgagtgatcctgtgacgcacag

SEQ ID NO: 117464 - DNA, 25 bp, Mus musculus
acctgagtgatcgtgtgacgcacag

SEQ ID NO: 117465 - DNA, 25 bp, Mus musculus
acctgagttctaatgctgggacctg

SEQ ID NO: 117466 - DNA, 25 bp, Mus musculus
acctgagttctattgctgggacctg

SEQ ID NO: 117467 - DNA, 25 bp, Mus musculus
acctgagttctcatcccagaatgca

SEQ ID NO: 117468 - DNA, 25 bp, Mus musculus
acctgagttctcttcccagaatgca

SEQ ID NO: 117469 - DNA, 25 bp, Mus musculus
acctgagttcttattgctgctaccg

SEQ ID NO: 117470 - DNA, 25 bp, Mus musculus
acctgagttctttttgctgctaccg

SEQ ID NO: 117471 - DNA, 25 bp, Mus musculus
acctgataaaggatgatgacaacaa

SEQ ID NO: 117472 - DNA, 25 bp, Mus musculus
acctgataaaggttgatgacaacaa

SEQ ID NO: 117473 - DNA, 25 bp, Mus musculus
acctgataaggtcatgtgataagta

SEQ ID NO: 117474 - DNA, 25 bp, Mus musculus
acctgataaggtgatgtgataagta

SEQ ID NO: 117475 - DNA, 25 bp, Mus musculus
acctgataatgcacccactatattt

SEQ ID NO: 117476 - DNA, 25 bp, Mus musculus
acctgataatgctcccactatattt

SEQ ID NO: 117477 - DNA, 25 bp, Mus musculus
acctgataatgtagggactttgatt

SEQ ID NO: 117478 - DNA, 25 bp, Mus musculus
acctgataatgttgggactttgatt

SEQ ID NO: 117479 - DNA, 25 bp, Mus musculus
acctgataccttcttttcagtctag

SEQ ID NO: 117480 - DNA, 25 bp, Mus musculus
acctgataccttgttttcagtctag

SEQ ID NO: 117481 - DNA, 25 bp, Mus musculus
acctgatagactcaccaacctggtg

SEQ ID NO: 117482 - DNA, 25 bp, Mus musculus
acctgatagactgaccaacctggtg

SEQ ID NO: 117483 - DNA, 25 bp, Mus musculus
acctgatagcaacaactggcagtat

SEQ ID NO: 117484 - DNA, 25 bp, Mus musculus
acctgatagcaagaactggcagtat

SEQ ID NO: 117485 - DNA, 25 bp, Mus musculus
acctgataggtgacacgtcatcctt

SEQ ID NO: 117486 - DNA, 25 bp, Mus musculus
acctgataggtgtcacgtcatcctt

SEQ ID NO: 117487 - DNA, 25 bp, Mus musculus
acctgatcactcagggaactggtag

SEQ ID NO: 117488 - DNA, 25 bp, Mus musculus
acctgatcactctgggaactggtag

SEQ ID NO: 117489 - DNA, 25 bp, Mus musculus
acctgatcagtgctctatcattctg

SEQ ID NO: 117490 - DNA, 25 bp, Mus musculus
acctgatcagtggtctatcattctg

SEQ ID NO: 117491 - DNA, 25 bp, Mus musculus
acctgatcccatatacttgtctaga

SEQ ID NO: 117492 - DNA, 25 bp, Mus musculus
acctgatcccatttacttgtctaga

SEQ ID NO: 117493 - DNA, 25 bp, Mus musculus
acctgatcgaggacacgctcaatta

SEQ ID NO: 117494 - DNA, 25 bp, Mus musculus
acctgatcgaggtcacgctcaatta

SEQ ID NO: 117495 - DNA, 25 bp, Mus musculus
acctgatcgcgcagggtagccagag

SEQ ID NO: 117496 - DNA, 25 bp, Mus musculus
acctgatcgcgctgggtagccagag

SEQ ID NO: 117497 - DNA, 25 bp, Mus musculus
acctgatcgttccttagtgttctca

SEQ ID NO: 117498 - DNA, 25 bp, Mus musculus
acctgatcgttcgttagtgttctca

SEQ ID NO: 117499 - DNA, 25 bp, Mus musculus
acctgatcttagcatgctataacag

SEQ ID NO: 117500 - DNA, 25 bp, Mus musculus
acctgatcttaggatgctataacag

SEQ ID NO: 117501 - DNA, 25 bp, Mus musculus
acctgatgacagatatgtggcttgg

SEQ ID NO: 117502 - DNA, 25 bp, Mus musculus
acctgatgacagttatgtggcttgg

SEQ ID NO: 117503 - DNA, 25 bp, Mus musculus
acctgatgatttacggatgtaggag

SEQ ID NO: 117504 - DNA, 25 bp, Mus musculus
acctgatgattttcggatgtaggag

SEQ ID NO: 117505 - DNA, 25 bp, Mus musculus
acctgatgcaggaatggttttgcta

SEQ ID NO: 117506 - DNA, 25 bp, Mus musculus
acctgatgcaggtatggttttgcta

SEQ ID NO: 117507 - DNA, 25 bp, Mus musculus
acctgatgtggaccctgaaggatct

SEQ ID NO: 117508 - DNA, 25 bp, Mus musculus
acctgatgtggagcctgaaggatct

SEQ ID NO: 117509 - DNA, 25 bp, Mus musculus
acctgatgtgtactgcgagactgct

SEQ ID NO: 117510 - DNA, 25 bp, Mus musculus
acctgatgtgtagtgcgagactgct

SEQ ID NO: 117511 - DNA, 25 bp, Mus musculus
acctgattaaagaacggtccatcct

SEQ ID NO: 117512 - DNA, 25 bp, Mus musculus
acctgattaaagtacggtccatcct

SEQ ID NO: 117513 - DNA, 25 bp, Mus musculus
acctgattagtcattcaatatacca

SEQ ID NO: 117514 - DNA, 25 bp, Mus musculus
acctgattagtctttcaatatacca

SEQ ID NO: 117515 - DNA, 25 bp, Mus musculus
acctgattcctcacattgtaaactg

SEQ ID NO: 117516 - DNA, 25 bp, Mus musculus
acctgattcctctcattgtaaactg

SEQ ID NO: 117517 - DNA, 25 bp, Mus musculus
acctgattcctgaatgtaaacagct

SEQ ID NO: 117518 - DNA, 25 bp, Mus musculus
acctgattcctgtatgtaaacagct

SEQ ID NO: 117519 - DNA, 25 bp, Mus musculus
acctgattctgaagccctccatttt

SEQ ID NO: 117520 - DNA, 25 bp, Mus musculus
acctgattctgatgccctccatttt

SEQ ID NO: 117521 - DNA, 25 bp, Mus musculus
acctgattttgaaccctgggacttc

SEQ ID NO: 117522 - DNA, 25 bp, Mus musculus
acctgattttgatccctgggacttc

SEQ ID NO: 117523 - DNA, 25 bp, Mus musculus
acctgcaagaacatactcccgggta

SEQ ID NO: 117524 - DNA, 25 bp, Mus musculus
acctgcaagaacttactcccgggta

SEQ ID NO: 117525 - DNA, 25 bp, Mus musculus
acctgcaagatgcacgcgagccaca

SEQ ID NO: 117526 - DNA, 25 bp, Mus musculus
acctgcaagatggacgcgagccaca

SEQ ID NO: 117527 - DNA, 25 bp, Mus musculus
acctgcaatcccagaattccacagg

SEQ ID NO: 117528 - DNA, 25 bp, Mus musculus
acctgcaatccctgaattccacagg

SEQ ID NO: 117529 - DNA, 25 bp, Mus musculus
acctgcaatcctatcagactttcag

SEQ ID NO: 117530 - DNA, 25 bp, Mus musculus
acctgcaatcctttcagactttcag

SEQ ID NO: 117531 - DNA, 25 bp, Mus musculus
acctgcaatggcatcacatccttgg

SEQ ID NO: 117532 - DNA, 25 bp, Mus musculus
acctgcaatggcttcacatccttgg

SEQ ID NO: 117533 - DNA, 25 bp, Mus musculus
acctgcaattatacccacctgcagt

SEQ ID NO: 117534 - DNA, 25 bp, Mus musculus
acctgcaattattcccacctgcagt

SEQ ID NO: 117535 - DNA, 25 bp, Mus musculus
acctgcacaaatactgtggcttcca

SEQ ID NO: 117536 - DNA, 25 bp, Mus musculus
acctgcacaaattctgtggcttcca

SEQ ID NO: 117537 - DNA, 25 bp, Mus musculus
acctgcacaagtctatcccctggat

SEQ ID NO: 117538 - DNA, 25 bp, Mus musculus
acctgcacaagtgtatcccctggat

SEQ ID NO: 117539 - DNA, 25 bp, Mus musculus
acctgcacacagaagtctaactata

SEQ ID NO: 117540 - DNA, 25 bp, Mus musculus
acctgcacacagtagtctaactata

SEQ ID NO: 117541 - DNA, 25 bp, Mus musculus
acctgcacacatatggcttatagac

SEQ ID NO: 117542 - DNA, 25 bp, Mus musculus
acctgcacacatttggcttatagac

SEQ ID NO: 117543 - DNA, 25 bp, Mus musculus
acctgcacacttatacttcttcctt

SEQ ID NO: 117544 - DNA, 25 bp, Mus musculus
acctgcacacttttacttcttcctt

SEQ ID NO: 117545 - DNA, 25 bp, Mus musculus
acctgcacagcgcaccgggtttcgg

SEQ ID NO: 117546 - DNA, 25 bp, Mus musculus
acctgcacagcggaccgggtttcgg

SEQ ID NO: 117547 - DNA, 25 bp, Mus musculus
acctgcacaggtcggaaattggcat

SEQ ID NO: 117548 - DNA, 25 bp, Mus musculus
acctgcacaggtgggaaattggcat

SEQ ID NO: 117549 - DNA, 25 bp, Mus musculus
acctgcaccaagctggtacactttt

SEQ ID NO: 117550 - DNA, 25 bp, Mus musculus
acctgcaccaaggtggtacactttt

SEQ ID NO: 117551 - DNA, 25 bp, Mus musculus
acctgcaccttcattattcaagctt

SEQ ID NO: 117552 - DNA, 25 bp, Mus musculus
acctgcaccttctttattcaagctt

SEQ ID NO: 117553 - DNA, 25 bp, Mus musculus
acctgcacggcccttctggaagtag

SEQ ID NO: 117554 - DNA, 25 bp, Mus musculus
acctgcacggccgttctggaagtag

SEQ ID NO: 117555 - DNA, 25 bp, Mus musculus
acctgcactcttctcatgtttttgg

SEQ ID NO: 117556 - DNA, 25 bp, Mus musculus
acctgcactcttgtcatgtttttgg

SEQ ID NO: 117557 - DNA, 25 bp, Mus musculus
acctgcactgcaatgagatgacttt

SEQ ID NO: 117558 - DNA, 25 bp, Mus musculus
acctgcactgcattgagatgacttt

SEQ ID NO: 117559 - DNA, 25 bp, Mus musculus
acctgcactttaaaagctcccttta

SEQ ID NO: 117560 - DNA, 25 bp, Mus musculus
acctgcactttataagctcccttta

SEQ ID NO: 117561 - DNA, 25 bp, Mus musculus
acctgcagaaaaagccgatgaacca

SEQ ID NO: 117562 - DNA, 25 bp, Mus musculus
acctgcagaaaatgccgatgaacca

SEQ ID NO: 117563 - DNA, 25 bp, Mus musculus
acctgcagagtacccaatattcttt

SEQ ID NO: 117564 - DNA, 25 bp, Mus musculus
acctgcagagtagccaatattcttt

SEQ ID NO: 117565 - DNA, 25 bp, Mus musculus
acctgcagagtgatcacacctgtgg

SEQ ID NO: 117566 - DNA, 25 bp, Mus musculus
acctgcagagtgttcacacctgtgg

SEQ ID NO: 117567 - DNA, 25 bp, Mus musculus
acctgcagatgtaacagacgttcat

SEQ ID NO: 117568 - DNA, 25 bp, Mus musculus
acctgcagatgttacagacgttcat

SEQ ID NO: 117569 - DNA, 25 bp, Mus musculus
acctgcagcagtaggccgggaaaga

SEQ ID NO: 117570 - DNA, 25 bp, Mus musculus
acctgcagcagttggccgggaaaga

SEQ ID NO: 117571 - DNA, 25 bp, Mus musculus
acctgcagcatgaagtgtccctgga

SEQ ID NO: 117572 - DNA, 25 bp, Mus musculus
acctgcagcatgtagtgtccctgga

SEQ ID NO: 117573 - DNA, 25 bp, Mus musculus
acctgcagccgtcacatggagaaaa

SEQ ID NO: 117574 - DNA, 25 bp, Mus musculus
acctgcagccgtcgtgcatagacct

SEQ ID NO: 117575 - DNA, 25 bp, Mus musculus
acctgcagccgtgacatggagaaaa

SEQ ID NO: 117576 - DNA, 25 bp, Mus musculus
acctgcagccgtggtgcatagacct

SEQ ID NO: 117577 - DNA, 25 bp, Mus musculus
acctgcagcggcatgaagatgagct

SEQ ID NO: 117578 - DNA, 25 bp, Mus musculus
acctgcagcggcttgaagatgagct

SEQ ID NO: 117579 - DNA, 25 bp, Mus musculus
acctgcagcttgatgcctttctgtg

SEQ ID NO: 117580 - DNA, 25 bp, Mus musculus
acctgcagcttgttgcctttctgtg

SEQ ID NO: 117581 - DNA, 25 bp, Mus musculus
acctgcaggcagaggaacatctcaa

SEQ ID NO: 117582 - DNA, 25 bp, Mus musculus
acctgcaggcagtggaacatctcaa

SEQ ID NO: 117583 - DNA, 25 bp, Mus musculus
acctgcaggcatatcattggcgtat

SEQ ID NO: 117584 - DNA, 25 bp, Mus musculus
acctgcaggcatttcattggcgtat

SEQ ID NO: 117585 - DNA, 25 bp, Mus musculus
acctgcaggcctcaactagtcagtt

SEQ ID NO: 117586 - DNA, 25 bp, Mus musculus
acctgcaggcctgaactagtcagtt

SEQ ID NO: 117587 - DNA, 25 bp, Mus musculus
acctgcaggcggaactgatgaaccc

SEQ ID NO: 117588 - DNA, 25 bp, Mus musculus
acctgcaggcggtactgatgaaccc

SEQ ID NO: 117589 - DNA, 25 bp, Mus musculus
acctgcagtaccagccaaaaaggct

SEQ ID NO: 117590 - DNA, 25 bp, Mus musculus
acctgcagtacctgccaaaaaggct

SEQ ID NO: 117591 - DNA, 25 bp, Mus musculus
acctgcagtctgatttatggcaaca

SEQ ID NO: 117592 - DNA, 25 bp, Mus musculus
acctgcagtctgttttatggcaaca

SEQ ID NO: 117593 - DNA, 25 bp, Mus musculus
acctgcagtggcagtatggcgctct

SEQ ID NO: 117594 - DNA, 25 bp, Mus musculus
acctgcagtggctgtatggcgctct

SEQ ID NO: 117595 - DNA, 25 bp, Mus musculus
acctgcatatgaacttgtgattttt

SEQ ID NO: 117596 - DNA, 25 bp, Mus musculus
acctgcatatgatcttgtgattttt

SEQ ID NO: 117597 - DNA, 25 bp, Mus musculus
acctgcatcaaactgtttcaatctt

SEQ ID NO: 117598 - DNA, 25 bp, Mus musculus
acctgcatcaaagtgtttcaatctt

SEQ ID NO: 117599 - DNA, 25 bp, Mus musculus
acctgcatcaggactattggcactc

SEQ ID NO: 117600 - DNA, 25 bp, Mus musculus
acctgcatcaggtctattggcactc

SEQ ID NO: 117601 - DNA, 25 bp, Mus musculus
acctgcatccaaacctttctagtag

SEQ ID NO: 117602 - DNA, 25 bp, Mus musculus
acctgcatccaatcctttctagtag

SEQ ID NO: 117603 - DNA, 25 bp, Mus musculus
acctgcatcgccaagtgtgggactg

SEQ ID NO: 117604 - DNA, 25 bp, Mus musculus
acctgcatcgcctagtgtgggactg

SEQ ID NO: 117605 - DNA, 25 bp, Mus musculus
acctgcatctccagtgggtgacagt

SEQ ID NO: 117606 - DNA, 25 bp, Mus musculus
acctgcatctcctgtgggtgacagt

SEQ ID NO: 117607 - DNA, 25 bp, Mus musculus
acctgcatctctcgagaacacaaaa

SEQ ID NO: 117608 - DNA, 25 bp, Mus musculus
acctgcatctctggagaacacaaaa

SEQ ID NO: 117609 - DNA, 25 bp, Mus musculus
acctgcatctggaagtcctttatga

SEQ ID NO: 117610 - DNA, 25 bp, Mus musculus
acctgcatctggtagtcctttatga

SEQ ID NO: 117611 - DNA, 25 bp, Mus musculus
acctgcatggtacagctggctcaga

SEQ ID NO: 117612 - DNA, 25 bp, Mus musculus
acctgcatggtagagctggctcaga

SEQ ID NO: 117613 - DNA, 25 bp, Mus musculus
acctgcatggtgatcctcgaagaca

SEQ ID NO: 117614 - DNA, 25 bp, Mus musculus
acctgcatggtgttcctcgaagaca

SEQ ID NO: 117615 - DNA, 25 bp, Mus musculus
acctgcatggttcagtcactggtca

SEQ ID NO: 117616 - DNA, 25 bp, Mus musculus
acctgcatggttgagtcactggtca

SEQ ID NO: 117617 - DNA, 25 bp, Mus musculus
acctgcattaaaatcccggtggaag

SEQ ID NO: 117618 - DNA, 25 bp, Mus musculus
acctgcattaaattcccggtggaag

SEQ ID NO: 117619 - DNA, 25 bp, Mus musculus
acctgcattatacctggaataaact

SEQ ID NO: 117620 - DNA, 25 bp, Mus musculus
acctgcattatagctggaataaact

SEQ ID NO: 117621 - DNA, 25 bp, Mus musculus
acctgcattttcctcatccaagaat

SEQ ID NO: 117622 - DNA, 25 bp, Mus musculus
acctgcattttcgtcatccaagaat

SEQ ID NO: 117623 - DNA, 25 bp, Mus musculus
acctgcatttttctattccttacat

SEQ ID NO: 117624 - DNA, 25 bp, Mus musculus
acctgcatttttgtattccttacat

SEQ ID NO: 117625 - DNA, 25 bp, Mus musculus
acctgccaaaccatttgcgttgaga

SEQ ID NO: 117626 - DNA, 25 bp, Mus musculus
acctgccaaaccttttgcgttgaga

SEQ ID NO: 117627 - DNA, 25 bp, Mus musculus
acctgccaagtcagcaatcctgtaa

SEQ ID NO: 117628 - DNA, 25 bp, Mus musculus
acctgccaagtctgcaatcctgtaa

SEQ ID NO: 117629 - DNA, 25 bp, Mus musculus
acctgccacaggacgaagttgtagg

SEQ ID NO: 117630 - DNA, 25 bp, Mus musculus
acctgccacaggtcgaagttgtagg

SEQ ID NO: 117631 - DNA, 25 bp, Mus musculus
acctgccacagtatttagttgagaa

SEQ ID NO: 117632 - DNA, 25 bp, Mus musculus
acctgccacagtttttagttgagaa

SEQ ID NO: 117633 - DNA, 25 bp, Mus musculus
acctgccacctgaggattgtgcctg

SEQ ID NO: 117634 - DNA, 25 bp, Mus musculus
acctgccacctgtggattgtgcctg

SEQ ID NO: 117635 - DNA, 25 bp, Mus musculus
acctgccagatacagagggtacctt

SEQ ID NO: 117636 - DNA, 25 bp, Mus musculus
acctgccagatagagagggtacctt

SEQ ID NO: 117637 - DNA, 25 bp, Mus musculus
acctgccaggatcgaagccatgatg

SEQ ID NO: 117638 - DNA, 25 bp, Mus musculus
acctgccaggatggaagccatgatg

SEQ ID NO: 117639 - DNA, 25 bp, Mus musculus
acctgccaggcccttggcgtatgtg

SEQ ID NO: 117640 - DNA, 25 bp, Mus musculus
acctgccaggccgttggcgtatgtg

SEQ ID NO: 117641 - DNA, 25 bp, Mus musculus
acctgccagtcaattttaagaccag

SEQ ID NO: 117642 - DNA, 25 bp, Mus musculus
acctgccagtcatttttaagaccag

SEQ ID NO: 117643 - DNA, 25 bp, Mus musculus
acctgccatattcattcatccagtg

SEQ ID NO: 117644 - DNA, 25 bp, Mus musculus
acctgccatattgattcatccagtg

SEQ ID NO: 117645 - DNA, 25 bp, Mus musculus
acctgccatcttctatctggaccag

SEQ ID NO: 117646 - DNA, 25 bp, Mus musculus
acctgccatcttgtatctggaccag

SEQ ID NO: 117647 - DNA, 25 bp, Mus musculus
acctgccatggtccctcaggcaata

SEQ ID NO: 117648 - DNA, 25 bp, Mus musculus
acctgccatggtgcctcaggcaata

SEQ ID NO: 117649 - DNA, 25 bp, Mus musculus
acctgcccaagactacctttgtgtt

SEQ ID NO: 117650 - DNA, 25 bp, Mus musculus
acctgcccaagagtacctttgtgtt

SEQ ID NO: 117651 - DNA, 25 bp, Mus musculus
acctgcccaagcaacatcatgtgag

SEQ ID NO: 117652 - DNA, 25 bp, Mus musculus
acctgcccaagctacatcatgtgag

SEQ ID NO: 117653 - DNA, 25 bp, Mus musculus
acctgcccaaggcattcttgagctg

SEQ ID NO: 117654 - DNA, 25 bp, Mus musculus
acctgcccaagggattcttgagctg

SEQ ID NO: 117655 - DNA, 25 bp, Mus musculus
acctgcccagccaagagggctaatt

SEQ ID NO: 117656 - DNA, 25 bp, Mus musculus
acctgcccagcctagagggctaatt

SEQ ID NO: 117657 - DNA, 25 bp, Mus musculus
acctgccccaagaaacagcttttgg

SEQ ID NO: 117658 - DNA, 25 bp, Mus musculus
acctgccccaagtaacagcttttgg

SEQ ID NO: 117659 - DNA, 25 bp, Mus musculus
acctgccccagacatcggtggaagg

SEQ ID NO: 117660 - DNA, 25 bp, Mus musculus
acctgccccagagatcggtggaagg

SEQ ID NO: 117661 - DNA, 25 bp, Mus musculus
acctgccccagcagtctgtatggtt

SEQ ID NO: 117662 - DNA, 25 bp, Mus musculus
acctgccccagctgtctgtatggtt

SEQ ID NO: 117663 - DNA, 25 bp, Mus musculus
acctgccccgccaaagaagatcatg

SEQ ID NO: 117664 - DNA, 25 bp, Mus musculus
acctgccccgcctaagaagatcatg

SEQ ID NO: 117665 - DNA, 25 bp, Mus musculus
acctgcccggcaatcaagaaactct

SEQ ID NO: 117666 - DNA, 25 bp, Mus musculus
acctgcccggcattcaagaaactct

SEQ ID NO: 117667 - DNA, 25 bp, Mus musculus
acctgccctgcaccgggtgggataa

SEQ ID NO: 117668 - DNA, 25 bp, Mus musculus
acctgccctgcagcgggtgggataa

SEQ ID NO: 117669 - DNA, 25 bp, Mus musculus
acctgccctggcaggaagttttcag

SEQ ID NO: 117670 - DNA, 25 bp, Mus musculus
acctgccctggctggaagttttcag

SEQ ID NO: 117671 - DNA, 25 bp, Mus musculus
acctgccctttcctgagagtggaca

SEQ ID NO: 117672 - DNA, 25 bp, Mus musculus
acctgccctttcgtgagagtggaca

SEQ ID NO: 117673 - DNA, 25 bp, Mus musculus
acctgccgagaaagagcgaggaaag

SEQ ID NO: 117674 - DNA, 25 bp, Mus musculus
acctgccgagaatgagcgaggaaag

SEQ ID NO: 117675 - DNA, 25 bp, Mus musculus
acctgccgcaagaccaacaagctgt

SEQ ID NO: 117676 - DNA, 25 bp, Mus musculus
acctgccgcaagtccaacaagctgt

SEQ ID NO: 117677 - DNA, 25 bp, Mus musculus
acctgccgggtcaggatgaatgctg

SEQ ID NO: 117678 - DNA, 25 bp, Mus musculus
acctgccgggtctggatgaatgctg

SEQ ID NO: 117679 - DNA, 25 bp, Mus musculus
acctgccgtagcattcagtaaggtg

SEQ ID NO: 117680 - DNA, 25 bp, Mus musculus
acctgccgtagctttcagtaaggtg

SEQ ID NO: 117681 - DNA, 25 bp, Mus musculus
acctgccgtgccacttgatgagaag

SEQ ID NO: 117682 - DNA, 25 bp, Mus musculus
acctgccgtgcctcttgatgagaag

SEQ ID NO: 117683 - DNA, 25 bp, Mus musculus
acctgccgtgctccatctgggaagt

SEQ ID NO: 117684 - DNA, 25 bp, Mus musculus
acctgccgtgctgcatctgggaagt

SEQ ID NO: 117685 - DNA, 25 bp, Mus musculus
acctgcctagaactcatgtgtaact

SEQ ID NO: 117686 - DNA, 25 bp, Mus musculus
acctgcctagaagtcatgtgtaact

SEQ ID NO: 117687 - DNA, 25 bp, Mus musculus
acctgcctagctagtagaggaccct

SEQ ID NO: 117688 - DNA, 25 bp, Mus musculus
acctgcctagcttgtagaggaccct

SEQ ID NO: 117689 - DNA, 25 bp, Mus musculus
acctgcctagtgatgggaaccatta

SEQ ID NO: 117690 - DNA, 25 bp, Mus musculus
acctgcctagtgttgggaaccatta

SEQ ID NO: 117691 - DNA, 25 bp, Mus musculus
acctgcctataaattatctctgtgt

SEQ ID NO: 117692 - DNA, 25 bp, Mus musculus
acctgcctataatttatctctgtgt

SEQ ID NO: 117693 - DNA, 25 bp, Mus musculus
acctgcctcaggagcaggtggtcca

SEQ ID NO: 117694 - DNA, 25 bp, Mus musculus
acctgcctcaggtgcaggtggtcca

SEQ ID NO: 117695 - DNA, 25 bp, Mus musculus
acctgcctcagtataaccctaacaa

SEQ ID NO: 117696 - DNA, 25 bp, Mus musculus
acctgcctcagtttaaccctaacaa

SEQ ID NO: 117697 - DNA, 25 bp, Mus musculus
acctgcctctcccaggaggaggtag

SEQ ID NO: 117698 - DNA, 25 bp, Mus musculus
acctgcctctccgaggaggaggtag

SEQ ID NO: 117699 - DNA, 25 bp, Mus musculus
acctgcctctggcaggacgtcttga

SEQ ID NO: 117700 - DNA, 25 bp, Mus musculus
acctgcctctgggaggacgtcttga

SEQ ID NO: 117701 - DNA, 25 bp, Mus musculus
acctgcctcttgagcgttaaaatgt

SEQ ID NO: 117702 - DNA, 25 bp, Mus musculus
acctgcctcttgtgcgttaaaatgt

SEQ ID NO: 117703 - DNA, 25 bp, Mus musculus
acctgcctgaggagtcttctgagag

SEQ ID NO: 117704 - DNA, 25 bp, Mus musculus
acctgcctgaggtgtcttctgagag

SEQ ID NO: 117705 - DNA, 25 bp, Mus musculus
acctgcctgagtcatctttagtgcc

SEQ ID NO: 117706 - DNA, 25 bp, Mus musculus
acctgcctgagtcattgagtttgcc

SEQ ID NO: 117707 - DNA, 25 bp, Mus musculus
acctgcctgagtgatctttagtgcc

SEQ ID NO: 117708 - DNA, 25 bp, Mus musculus
acctgcctgagtgattgagtttgcc

SEQ ID NO: 117709 - DNA, 25 bp, Mus musculus
acctgcctgatgcttcaactttttg

SEQ ID NO: 117710 - DNA, 25 bp, Mus musculus
acctgcctgatggttcaactttttg

SEQ ID NO: 117711 - DNA, 25 bp, Mus musculus
acctgcctggacacgtttgcgtttt

SEQ ID NO: 117712 - DNA, 25 bp, Mus musculus
acctgcctggactcgtttgcgtttt

SEQ ID NO: 117713 - DNA, 25 bp, Mus musculus
acctgcctggagctgtctcgacaga

SEQ ID NO: 117714 - DNA, 25 bp, Mus musculus
acctgcctggaggtgtctcgacaga

SEQ ID NO: 117715 - DNA, 25 bp, Mus musculus
acctgcctggccatgtggttacatt

SEQ ID NO: 117716 - DNA, 25 bp, Mus musculus
acctgcctggcccagtttaagcaga

SEQ ID NO: 117717 - DNA, 25 bp, Mus musculus
acctgcctggccgagtttaagcaga

SEQ ID NO: 117718 - DNA, 25 bp, Mus musculus
acctgcctggccttgtggttacatt

SEQ ID NO: 117719 - DNA, 25 bp, Mus musculus
acctgcctgggtcggaatgcaaaca

SEQ ID NO: 117720 - DNA, 25 bp, Mus musculus
acctgcctgggtgggaatgcaaaca

SEQ ID NO: 117721 - DNA, 25 bp, Mus musculus
acctgcctggtgagtttgttgggac

SEQ ID NO: 117722 - DNA, 25 bp, Mus musculus
acctgcctggtgtgtttgttgggac

SEQ ID NO: 117723 - DNA, 25 bp, Mus musculus
acctgcctgtcaagtcatcaggcct

SEQ ID NO: 117724 - DNA, 25 bp, Mus musculus
acctgcctgtcatgtcatcaggcct

SEQ ID NO: 117725 - DNA, 25 bp, Mus musculus
acctgcctgtcgaagagttccaagg

SEQ ID NO: 117726 - DNA, 25 bp, Mus musculus
acctgcctgtcgtagagttccaagg

SEQ ID NO: 117727 - DNA, 25 bp, Mus musculus
acctgcctgttcctgtgtagcatag

SEQ ID NO: 117728 - DNA, 25 bp, Mus musculus
acctgcctgttcgtgtgtagcatag

SEQ ID NO: 117729 - DNA, 25 bp, Mus musculus
acctgccttggcaagcctatttttg

SEQ ID NO: 117730 - DNA, 25 bp, Mus musculus
acctgccttggctagcctatttttg

SEQ ID NO: 117731 - DNA, 25 bp, Mus musculus
acctgccttgttctggtgaagagcc

SEQ ID NO: 117732 - DNA, 25 bp, Mus musculus
acctgccttgttgtggtgaagagcc

SEQ ID NO: 117733 - DNA, 25 bp, Mus musculus
acctgcgagcgtatggcgcacgcga

SEQ ID NO: 117734 - DNA, 25 bp, Mus musculus
acctgcgagcgtttggcgcacgcga

SEQ ID NO: 117735 - DNA, 25 bp, Mus musculus
acctgcgaggtccagagccatctca

SEQ ID NO: 117736 - DNA, 25 bp, Mus musculus
acctgcgaggtcgagagccatctca

SEQ ID NO: 117737 - DNA, 25 bp, Mus musculus
acctgcgattgacgcggtcagcaca

SEQ ID NO: 117738 - DNA, 25 bp, Mus musculus
acctgcgattgactgggcttactac

SEQ ID NO: 117739 - DNA, 25 bp, Mus musculus
acctgcgattgaggcggtcagcaca

SEQ ID NO: 117740 - DNA, 25 bp, Mus musculus
acctgcgattgagtgggcttactac

SEQ ID NO: 117741 - DNA, 25 bp, Mus musculus
acctgcgcaagaagcgcaagcgctt

SEQ ID NO: 117742 - DNA, 25 bp, Mus musculus
acctgcgcaagatgcgcaagcgctt

SEQ ID NO: 117743 - DNA, 25 bp, Mus musculus
acctgcgcacttattaacaccggaa

SEQ ID NO: 117744 - DNA, 25 bp, Mus musculus
acctgcgcactttttaacaccggaa

SEQ ID NO: 117745 - DNA, 25 bp, Mus musculus
acctgcgcaggaccttttttgcgct

SEQ ID NO: 117746 - DNA, 25 bp, Mus musculus
acctgcgcaggagcttttttgcgct

SEQ ID NO: 117747 - DNA, 25 bp, Mus musculus
acctgcgcatggaactgggaatcca

SEQ ID NO: 117748 - DNA, 25 bp, Mus musculus
acctgcgcatggtactgggaatcca

SEQ ID NO: 117749 - DNA, 25 bp, Mus musculus
acctgcgcctgtctttagaacgctt

SEQ ID NO: 117750 - DNA, 25 bp, Mus musculus
acctgcgcctgtgtttagaacgctt

SEQ ID NO: 117751 - DNA, 25 bp, Mus musculus
acctgcggacacattgtgttcaaat

SEQ ID NO: 117752 - DNA, 25 bp, Mus musculus
acctgcggacactttgtgttcaaat

SEQ ID NO: 117753 - DNA, 25 bp, Mus musculus
acctgcggctgtcgaactggtctca

SEQ ID NO: 117754 - DNA, 25 bp, Mus musculus
acctgcggctgtggaactggtctca

SEQ ID NO: 117755 - DNA, 25 bp, Mus musculus
acctgcgggtcaagaagtttcgccg

SEQ ID NO: 117756 - DNA, 25 bp, Mus musculus
acctgcgggtcatgaagtttcgccg

SEQ ID NO: 117757 - DNA, 25 bp, Mus musculus
acctgcggtcgaaagccattgggaa

SEQ ID NO: 117758 - DNA, 25 bp, Mus musculus
acctgcggtcgatagccattgggaa

SEQ ID NO: 117759 - DNA, 25 bp, Mus musculus
acctgcgtatagagtctgatggcca

SEQ ID NO: 117760 - DNA, 25 bp, Mus musculus
acctgcgtatagtgtctgatggcca

SEQ ID NO: 117761 - DNA, 25 bp, Mus musculus
acctgcgtccttcacagcattgtgg

SEQ ID NO: 117762 - DNA, 25 bp, Mus musculus
acctgcgtccttgacagcattgtgg

SEQ ID NO: 117763 - DNA, 25 bp, Mus musculus
acctgcgtgaggacatcactaccca

SEQ ID NO: 117764 - DNA, 25 bp, Mus musculus
acctgcgtgaggtcatcactaccca

SEQ ID NO: 117765 - DNA, 25 bp, Mus musculus
acctgcgtggatctcttactactta

SEQ ID NO: 117766 - DNA, 25 bp, Mus musculus
acctgcgtggatgtcttactactta

SEQ ID NO: 117767 - DNA, 25 bp, Mus musculus
acctgcgtggtaactgactctgtat

SEQ ID NO: 117768 - DNA, 25 bp, Mus musculus
acctgcgtggtatctgactctgtat

SEQ ID NO: 117769 - DNA, 25 bp, Mus musculus
acctgcgtgtctccatcaaagaaga

SEQ ID NO: 117770 - DNA, 25 bp, Mus musculus
acctgcgtgtctgcatcaaagaaga

SEQ ID NO: 117771 - DNA, 25 bp, Mus musculus
acctgcgttcagacctataaggagt

SEQ ID NO: 117772 - DNA, 25 bp, Mus musculus
acctgcgttcagtcctataaggagt

SEQ ID NO: 117773 - DNA, 25 bp, Mus musculus
acctgcgtttagatttattgttgat

SEQ ID NO: 117774 - DNA, 25 bp, Mus musculus
acctgcgtttagttttattgttgat

SEQ ID NO: 117775 - DNA, 25 bp, Mus musculus
acctgctaagttagaccttaattag

SEQ ID NO: 117776 - DNA, 25 bp, Mus musculus
acctgctaagtttgaccttaattag

SEQ ID NO: 117777 - DNA, 25 bp, Mus musculus
acctgctacaagaggatcgcgctgg

SEQ ID NO: 117778 - DNA, 25 bp, Mus musculus
acctgctacaagtggatcgcgctgg

SEQ ID NO: 117779 - DNA, 25 bp, Mus musculus
acctgctacactccttagaaaagac

SEQ ID NO: 117780 - DNA, 25 bp, Mus musculus
acctgctacactgcttagaaaagac

SEQ ID NO: 117781 - DNA, 25 bp, Mus musculus
acctgctacccaaagagattctctg

SEQ ID NO: 117782 - DNA, 25 bp, Mus musculus
acctgctacccatagagattctctg

SEQ ID NO: 117783 - DNA, 25 bp, Mus musculus
acctgctatctgacttctgagaaca

SEQ ID NO: 117784 - DNA, 25 bp, Mus musculus
acctgctatctgtcttctgagaaca

SEQ ID NO: 117785 - DNA, 25 bp, Mus musculus
acctgctcacagcttggctggctcg

SEQ ID NO: 117786 - DNA, 25 bp, Mus musculus
acctgctcacaggttggctggctcg

SEQ ID NO: 117787 - DNA, 25 bp, Mus musculus
acctgctcacatactagtgtagtgg

SEQ ID NO: 117788 - DNA, 25 bp, Mus musculus
acctgctcacatactgcaagagaaa

SEQ ID NO: 117789 - DNA, 25 bp, Mus musculus
acctgctcacattctagtgtagtgg

SEQ ID NO: 117790 - DNA, 25 bp, Mus musculus
acctgctcacattctgcaagagaaa

SEQ ID NO: 117791 - DNA, 25 bp, Mus musculus
acctgctcactcatttatcacttag

SEQ ID NO: 117792 - DNA, 25 bp, Mus musculus
acctgctcactcttttatcacttag

SEQ ID NO: 117793 - DNA, 25 bp, Mus musculus
acctgctcagacaagtctcggaggg

SEQ ID NO: 117794 - DNA, 25 bp, Mus musculus
acctgctcagacagagtcacctgaa

SEQ ID NO: 117795 - DNA, 25 bp, Mus musculus
acctgctcagactagtctcggaggg

SEQ ID NO: 117796 - DNA, 25 bp, Mus musculus
acctgctcagactgagtcacctgaa

SEQ ID NO: 117797 - DNA, 25 bp, Mus musculus
acctgctcaggtcacgtgttaacat

SEQ ID NO: 117798 - DNA, 25 bp, Mus musculus
acctgctcaggtccacatctgtgat

SEQ ID NO: 117799 - DNA, 25 bp, Mus musculus
acctgctcaggtgacgtgttaacat

SEQ ID NO: 117800 - DNA, 25 bp, Mus musculus
acctgctcaggtgcacatctgtgat

SEQ ID NO: 117801 - DNA, 25 bp, Mus musculus
acctgctcatctctacggcagagtt

SEQ ID NO: 117802 - DNA, 25 bp, Mus musculus
acctgctcatctgtacggcagagtt

SEQ ID NO: 117803 - DNA, 25 bp, Mus musculus
acctgctccaaacgcggctggcaag

SEQ ID NO: 117804 - DNA, 25 bp, Mus musculus
acctgctccaaaggcggctggcaag

SEQ ID NO: 117805 - DNA, 25 bp, Mus musculus
acctgctcctctcattggacatgag

SEQ ID NO: 117806 - DNA, 25 bp, Mus musculus
acctgctcctctgattggacatgag

SEQ ID NO: 117807 - DNA, 25 bp, Mus musculus
acctgctccttgcttagctttttca

SEQ ID NO: 117808 - DNA, 25 bp, Mus musculus
acctgctccttggttagctttttca

SEQ ID NO: 117809 - DNA, 25 bp, Mus musculus
acctgctcctttaatgaccatgttc

SEQ ID NO: 117810 - DNA, 25 bp, Mus musculus
acctgctccttttatgaccatgttc

SEQ ID NO: 117811 - DNA, 25 bp, Mus musculus
acctgctcggtgctctggatctgac

SEQ ID NO: 117812 - DNA, 25 bp, Mus musculus
acctgctcggtggtctggatctgac

SEQ ID NO: 117813 - DNA, 25 bp, Mus musculus
acctgctctaaaaacacccagtggg

SEQ ID NO: 117814 - DNA, 25 bp, Mus musculus
acctgctctaaatacacccagtggg

SEQ ID NO: 117815 - DNA, 25 bp, Mus musculus
acctgctctgaacctgggtcctgat

SEQ ID NO: 117816 - DNA, 25 bp, Mus musculus
acctgctctgaagctgggtcctgat

SEQ ID NO: 117817 - DNA, 25 bp, Mus musculus
acctgctctgcacacatcctggatg

SEQ ID NO: 117818 - DNA, 25 bp, Mus musculus
acctgctctgcagacatcctggatg

SEQ ID NO: 117819 - DNA, 25 bp, Mus musculus
acctgctctgtgatacatgagggcc

SEQ ID NO: 117820 - DNA, 25 bp, Mus musculus
acctgctctgtgttacatgagggcc

SEQ ID NO: 117821 - DNA, 25 bp, Mus musculus
acctgctctttgattgaggcccata

SEQ ID NO: 117822 - DNA, 25 bp, Mus musculus
acctgctctttgtttgaggcccata

SEQ ID NO: 117823 - DNA, 25 bp, Mus musculus
acctgctgaactagagtgccacgcg

SEQ ID NO: 117824 - DNA, 25 bp, Mus musculus
acctgctgaacttgagtgccacgcg

SEQ ID NO: 117825 - DNA, 25 bp, Mus musculus
acctgctgagatatcttcccagcct

SEQ ID NO: 117826 - DNA, 25 bp, Mus musculus
acctgctgagatttcttcccagcct

SEQ ID NO: 117827 - DNA, 25 bp, Mus musculus
acctgctgagcaactattgtctaaa

SEQ ID NO: 117828 - DNA, 25 bp, Mus musculus
acctgctgagcatctattgtctaaa

SEQ ID NO: 117829 - DNA, 25 bp, Mus musculus
acctgctgaggtcccaggccaaaat

SEQ ID NO: 117830 - DNA, 25 bp, Mus musculus
acctgctgaggtgccaggccaaaat

SEQ ID NO: 117831 - DNA, 25 bp, Mus musculus
acctgctgagtactgcctgtgggac

SEQ ID NO: 117832 - DNA, 25 bp, Mus musculus
acctgctgagtagtgcctgtgggac

SEQ ID NO: 117833 - DNA, 25 bp, Mus musculus
acctgctgcagcattagtgccttag

SEQ ID NO: 117834 - DNA, 25 bp, Mus musculus
acctgctgcagctttagtgccttag

SEQ ID NO: 117835 - DNA, 25 bp, Mus musculus
acctgctgcattcatcatggccata

SEQ ID NO: 117836 - DNA, 25 bp, Mus musculus
acctgctgcattgatcatggccata

SEQ ID NO: 117837 - DNA, 25 bp, Mus musculus
acctgctgcccaagggatgtgagct

SEQ ID NO: 117838 - DNA, 25 bp, Mus musculus
acctgctgcccatgggatgtgagct

SEQ ID NO: 117839 - DNA, 25 bp, Mus musculus
acctgctgctccctttttattaaca

SEQ ID NO: 117840 - DNA, 25 bp, Mus musculus
acctgctgctccgtttttattaaca

SEQ ID NO: 117841 - DNA, 25 bp, Mus musculus
acctgctgctggagcggaagctgca

SEQ ID NO: 117842 - DNA, 25 bp, Mus musculus
acctgctgctggtgcggaagctgca

SEQ ID NO: 117843 - DNA, 25 bp, Mus musculus
acctgctgctttataaaggcatggg

SEQ ID NO: 117844 - DNA, 25 bp, Mus musculus
acctgctgctttttaaaggcatggg

SEQ ID NO: 117845 - DNA, 25 bp, Mus musculus
acctgctggagaagatttacagact

SEQ ID NO: 117846 - DNA, 25 bp, Mus musculus
acctgctggagatgatttacagact

SEQ ID NO: 117847 - DNA, 25 bp, Mus musculus
acctgctggcacctcagttaagtca

SEQ ID NO: 117848 - DNA, 25 bp, Mus musculus
acctgctggcacgtcagttaagtca

SEQ ID NO: 117849 - DNA, 25 bp, Mus musculus
acctgctggctgaggctgagagaca

SEQ ID NO: 117850 - DNA, 25 bp, Mus musculus
acctgctggctgtggctgagagaca

SEQ ID NO: 117851 - DNA, 25 bp, Mus musculus
acctgctgggctcccagagaggttt

SEQ ID NO: 117852 - DNA, 25 bp, Mus musculus
acctgctgggctgccagagaggttt

SEQ ID NO: 117853 - DNA, 25 bp, Mus musculus
acctgctggtccatcggacagtgag

SEQ ID NO: 117854 - DNA, 25 bp, Mus musculus
acctgctggtccttcggacagtgag

SEQ ID NO: 117855 - DNA, 25 bp, Mus musculus
acctgctggtgcagtcagttaccaa

SEQ ID NO: 117856 - DNA, 25 bp, Mus musculus
acctgctggtgctgtcagttaccaa

SEQ ID NO: 117857 - DNA, 25 bp, Mus musculus
acctgctggttgcatggcttaactt

SEQ ID NO: 117858 - DNA, 25 bp, Mus musculus
acctgctggttggatggcttaactt

SEQ ID NO: 117859 - DNA, 25 bp, Mus musculus
acctgctgtactaacgggacgccct

SEQ ID NO: 117860 - DNA, 25 bp, Mus musculus
acctgctgtacttacgggacgccct

SEQ ID NO: 117861 - DNA, 25 bp, Mus musculus
acctgctgtataaactccaccaatg

SEQ ID NO: 117862 - DNA, 25 bp, Mus musculus
acctgctgtatatactccaccaatg

SEQ ID NO: 117863 - DNA, 25 bp, Mus musculus
acctgctgtctgagcactactgaga

SEQ ID NO: 117864 - DNA, 25 bp, Mus musculus
acctgctgtctgtgcactactgaga

SEQ ID NO: 117865 - DNA, 25 bp, Mus musculus
acctgctgtggtactgagcgcgcac

SEQ ID NO: 117866 - DNA, 25 bp, Mus musculus
acctgctgtggttctgagcgcgcac

SEQ ID NO: 117867 - DNA, 25 bp, Mus musculus
acctgctgttggctaactgtatggg

SEQ ID NO: 117868 - DNA, 25 bp, Mus musculus
acctgctgttgggtaactgtatggg

SEQ ID NO: 117869 - DNA, 25 bp, Mus musculus
acctgctgttgtaacttggcatctg

SEQ ID NO: 117870 - DNA, 25 bp, Mus musculus
acctgctgttgttacttggcatctg

SEQ ID NO: 117871 - DNA, 25 bp, Mus musculus
acctgcttaataacttccaatttct

SEQ ID NO: 117872 - DNA, 25 bp, Mus musculus
acctgcttaatatcttccaatttct

SEQ ID NO: 117873 - DNA, 25 bp, Mus musculus
acctgcttaggcatggctgtggtaa

SEQ ID NO: 117874 - DNA, 25 bp, Mus musculus
acctgcttaggcttggctgtggtaa

SEQ ID NO: 117875 - DNA, 25 bp, Mus musculus
acctgcttagtgctaggctgcatgc

SEQ ID NO: 117876 - DNA, 25 bp, Mus musculus
acctgcttagtggtaggctgcatgc

SEQ ID NO: 117877 - DNA, 25 bp, Mus musculus
acctgcttcagaaaccatgggcatg

SEQ ID NO: 117878 - DNA, 25 bp, Mus musculus
acctgcttcagaaatctaccttgac

SEQ ID NO: 117879 - DNA, 25 bp, Mus musculus
acctgcttcagataccatgggcatg

SEQ ID NO: 117880 - DNA, 25 bp, Mus musculus
acctgcttcagatatctaccttgac

SEQ ID NO: 117881 - DNA, 25 bp, Mus musculus
acctgcttcatcacctgtgagctta

SEQ ID NO: 117882 - DNA, 25 bp, Mus musculus
acctgcttcatctcctgtgagctta

SEQ ID NO: 117883 - DNA, 25 bp, Mus musculus
acctgcttccatacttctatgagat

SEQ ID NO: 117884 - DNA, 25 bp, Mus musculus
acctgcttccatcctgaccattttt

SEQ ID NO: 117885 - DNA, 25 bp, Mus musculus
acctgcttccatgctgaccattttt

SEQ ID NO: 117886 - DNA, 25 bp, Mus musculus
acctgcttccattcttctatgagat

SEQ ID NO: 117887 - DNA, 25 bp, Mus musculus
acctgcttcctgatttactctttga

SEQ ID NO: 117888 - DNA, 25 bp, Mus musculus
acctgcttcctgttttactctttga

SEQ ID NO: 117889 - DNA, 25 bp, Mus musculus
acctgcttcgaaccaaagccgtgga

SEQ ID NO: 117890 - DNA, 25 bp, Mus musculus
acctgcttcgaagcaaagccgtgga

SEQ ID NO: 117891 - DNA, 25 bp, Mus musculus
acctgcttcgagacaaaagtcccaa

SEQ ID NO: 117892 - DNA, 25 bp, Mus musculus
acctgcttcgagtcaaaagtcccaa

SEQ ID NO: 117893 - DNA, 25 bp, Mus musculus
acctgcttctacaaggggaggcaag

SEQ ID NO: 117894 - DNA, 25 bp, Mus musculus
acctgcttctactaggggaggcaag

SEQ ID NO: 117895 - DNA, 25 bp, Mus musculus
acctgcttcttcatagacacagctc

SEQ ID NO: 117896 - DNA, 25 bp, Mus musculus
acctgcttcttcttagacacagctc

SEQ ID NO: 117897 - DNA, 25 bp, Mus musculus
acctgcttgagcacttaactgtgtg

SEQ ID NO: 117898 - DNA, 25 bp, Mus musculus
acctgcttgagctcttaactgtgtg

SEQ ID NO: 117899 - DNA, 25 bp, Mus musculus
acctgcttgcatcgtcttggtgcca

SEQ ID NO: 117900 - DNA, 25 bp, Mus musculus
acctgcttgcatggtcttggtgcca

SEQ ID NO: 117901 - DNA, 25 bp, Mus musculus
acctgcttgcgaaagcctgggcctg

SEQ ID NO: 117902 - DNA, 25 bp, Mus musculus
acctgcttgcgatagcctgggcctg

SEQ ID NO: 117903 - DNA, 25 bp, Mus musculus
acctgcttgctccatatctttaaag

SEQ ID NO: 117904 - DNA, 25 bp, Mus musculus
acctgcttgctcctgtgtatacagc

SEQ ID NO: 117905 - DNA, 25 bp, Mus musculus
acctgcttgctcgatatctttaaag

SEQ ID NO: 117906 - DNA, 25 bp, Mus musculus
acctgcttgctcgtgtgtatacagc

SEQ ID NO: 117907 - DNA, 25 bp, Mus musculus
acctgcttggccactgagaactaaa

SEQ ID NO: 117908 - DNA, 25 bp, Mus musculus
acctgcttggcctctgagaactaaa

SEQ ID NO: 117909 - DNA, 25 bp, Mus musculus
acctgcttgtctagttgttccctga

SEQ ID NO: 117910 - DNA, 25 bp, Mus musculus
acctgcttgtcttgttgttccctga

SEQ ID NO: 117911 - DNA, 25 bp, Mus musculus
acctgctttaaaagctacacatgtt

SEQ ID NO: 117912 - DNA, 25 bp, Mus musculus
acctgctttaaatgctacacatgtt

SEQ ID NO: 117913 - DNA, 25 bp, Mus musculus
acctgctttactcctgttgtctgag

SEQ ID NO: 117914 - DNA, 25 bp, Mus musculus
acctgctttactgctgttgtctgag

SEQ ID NO: 117915 - DNA, 25 bp, Mus musculus
acctgctttgaaattctaagtatgc

SEQ ID NO: 117916 - DNA, 25 bp, Mus musculus
acctgctttgaatttctaagtatgc

SEQ ID NO: 117917 - DNA, 25 bp, Mus musculus
acctgctttgtgaagtgtaacattg

SEQ ID NO: 117918 - DNA, 25 bp, Mus musculus
acctgctttgtgtagtgtaacattg

SEQ ID NO: 117919 - DNA, 25 bp, Mus musculus
acctgcttttacagcctcagtgctg

SEQ ID NO: 117920 - DNA, 25 bp, Mus musculus
acctgcttttactgcctcagtgctg

SEQ ID NO: 117921 - DNA, 25 bp, Mus musculus
acctgctttttgaggctattgtcct

SEQ ID NO: 117922 - DNA, 25 bp, Mus musculus
acctgctttttgtggctattgtcct

SEQ ID NO: 117923 - DNA, 25 bp, Mus musculus
acctggaactcgctttcggcaccat

SEQ ID NO: 117924 - DNA, 25 bp, Mus musculus
acctggaactcggtttcggcaccat

SEQ ID NO: 117925 - DNA, 25 bp, Mus musculus
acctggaacttcctccaaggagata

SEQ ID NO: 117926 - DNA, 25 bp, Mus musculus
acctggaacttcgtccaaggagata

SEQ ID NO: 117927 - DNA, 25 bp, Mus musculus
acctggaagaagatgccgcgctcaa

SEQ ID NO: 117928 - DNA, 25 bp, Mus musculus
acctggaagaagttgccgcgctcaa

SEQ ID NO: 117929 - DNA, 25 bp, Mus musculus
acctggaagacgagctctatgccca

SEQ ID NO: 117930 - DNA, 25 bp, Mus musculus
acctggaagacgtgctctatgccca

SEQ ID NO: 117931 - DNA, 25 bp, Mus musculus
acctggaagcatctgcctgcatgaa

SEQ ID NO: 117932 - DNA, 25 bp, Mus musculus
acctggaagcatgtgcctgcatgaa

SEQ ID NO: 117933 - DNA, 25 bp, Mus musculus
acctggaaggcaccaacggttggaa

SEQ ID NO: 117934 - DNA, 25 bp, Mus musculus
acctggaaggcagcaacggttggaa

SEQ ID NO: 117935 - DNA, 25 bp, Mus musculus
acctggaagtttaagcctagctgtg

SEQ ID NO: 117936 - DNA, 25 bp, Mus musculus
acctggaagttttagcctagctgtg

SEQ ID NO: 117937 - DNA, 25 bp, Mus musculus
acctggaataggcactaatagactg

SEQ ID NO: 117938 - DNA, 25 bp, Mus musculus
acctggaatagggactaatagactg

SEQ ID NO: 117939 - DNA, 25 bp, Mus musculus
acctggaatgaacaaggagcttctg

SEQ ID NO: 117940 - DNA, 25 bp, Mus musculus
acctggaatgaagaaggagcttctg

SEQ ID NO: 117941 - DNA, 25 bp, Mus musculus
acctggaattcaaaaaggcctgcct

SEQ ID NO: 117942 - DNA, 25 bp, Mus musculus
acctggaattcataaaggcctgcct

SEQ ID NO: 117943 - DNA, 25 bp, Mus musculus
acctggacaatgctgcactggccct

SEQ ID NO: 117944 - DNA, 25 bp, Mus musculus
acctggacaatggtgcactggccct

SEQ ID NO: 117945 - DNA, 25 bp, Mus musculus
acctggacacccaacaatgtcatgg

SEQ ID NO: 117946 - DNA, 25 bp, Mus musculus
acctggacaccctacaatgtcatgg

SEQ ID NO: 117947 - DNA, 25 bp, Mus musculus
acctggacaggaacgctggacaggt

SEQ ID NO: 117948 - DNA, 25 bp, Mus musculus
acctggacaggatcgctggacaggt

SEQ ID NO: 117949 - DNA, 25 bp, Mus musculus
acctggacaggtcacagtaaggccc

SEQ ID NO: 117950 - DNA, 25 bp, Mus musculus
acctggacaggtgacagtaaggccc

SEQ ID NO: 117951 - DNA, 25 bp, Mus musculus
acctggacccataatttgccctggg

SEQ ID NO: 117952 - DNA, 25 bp, Mus musculus
acctggacccatcaagtcttcagtt

SEQ ID NO: 117953 - DNA, 25 bp, Mus musculus
acctggacccatgaagtcttcagtt

SEQ ID NO: 117954 - DNA, 25 bp, Mus musculus
acctggacccattatttgccctggg

SEQ ID NO: 117955 - DNA, 25 bp, Mus musculus
acctggactacaaagggtggccctg

SEQ ID NO: 117956 - DNA, 25 bp, Mus musculus
acctggactacatagggtggccctg

SEQ ID NO: 117957 - DNA, 25 bp, Mus musculus
acctggactacgcacggctgcggaa

SEQ ID NO: 117958 - DNA, 25 bp, Mus musculus
acctggactacggacggctgcggaa

SEQ ID NO: 117959 - DNA, 25 bp, Mus musculus
acctggactccacacgtggcgtata

SEQ ID NO: 117960 - DNA, 25 bp, Mus musculus
acctggactccagacgtggcgtata

SEQ ID NO: 117961 - DNA, 25 bp, Mus musculus
acctggactgctactgagtttggga

SEQ ID NO: 117962 - DNA, 25 bp, Mus musculus
acctggactgcttctgagtttggga

SEQ ID NO: 117963 - DNA, 25 bp, Mus musculus
acctggactggcacaacttcggttg

SEQ ID NO: 117964 - DNA, 25 bp, Mus musculus
acctggactggctcaacttcggttg

SEQ ID NO: 117965 - DNA, 25 bp, Mus musculus
acctggactgtccatgagccctgtc

SEQ ID NO: 117966 - DNA, 25 bp, Mus musculus
acctggactgtcgatgagccctgtc

SEQ ID NO: 117967 - DNA, 25 bp, Mus musculus
acctggacttccaccgctgtgagaa

SEQ ID NO: 117968 - DNA, 25 bp, Mus musculus
acctggacttcctccgctgtgagaa

SEQ ID NO: 117969 - DNA, 25 bp, Mus musculus
acctggactttcagtggcctttgaa

SEQ ID NO: 117970 - DNA, 25 bp, Mus musculus
acctggactttctgtggcctttgaa

SEQ ID NO: 117971 - DNA, 25 bp, Mus musculus
acctggagaagtcaagactagtcct

SEQ ID NO: 117972 - DNA, 25 bp, Mus musculus
acctggagaagtgaagactagtcct

SEQ ID NO: 117973 - DNA, 25 bp, Mus musculus
acctggagacatagaagcattagac

SEQ ID NO: 117974 - DNA, 25 bp, Mus musculus
acctggagacattgaagcattagac

SEQ ID NO: 117975 - DNA, 25 bp, Mus musculus
acctggagacctcatgggactagag

SEQ ID NO: 117976 - DNA, 25 bp, Mus musculus
acctggagacctgatgggactagag

SEQ ID NO: 117977 - DNA, 25 bp, Mus musculus
acctggagagctataccaagccttt

SEQ ID NO: 117978 - DNA, 25 bp, Mus musculus
acctggagagctttaccaagccttt

SEQ ID NO: 117979 - DNA, 25 bp, Mus musculus
acctggagatatacgctggagcaat

SEQ ID NO: 117980 - DNA, 25 bp, Mus musculus
acctggagatattcgctggagcaat

SEQ ID NO: 117981 - DNA, 25 bp, Mus musculus
acctggagatccagaggctgcagaa

SEQ ID NO: 117982 - DNA, 25 bp, Mus musculus
acctggagatcctgaggctgcagaa

SEQ ID NO: 117983 - DNA, 25 bp, Mus musculus
acctggagatttcccaaagattcag

SEQ ID NO: 117984 - DNA, 25 bp, Mus musculus
acctggagatttgccaaagattcag

SEQ ID NO: 117985 - DNA, 25 bp, Mus musculus
acctggagcctgatcgctacgacga

SEQ ID NO: 117986 - DNA, 25 bp, Mus musculus
acctggagcctgttcgctacgacga

SEQ ID NO: 117987 - DNA, 25 bp, Mus musculus
acctggagcgacatttatacttgat

SEQ ID NO: 117988 - DNA, 25 bp, Mus musculus
acctggagcgacttttatacttgat

SEQ ID NO: 117989 - DNA, 25 bp, Mus musculus
acctggagcggcactccgacagact

SEQ ID NO: 117990 - DNA, 25 bp, Mus musculus
acctggagcggctctccgacagact

SEQ ID NO: 117991 - DNA, 25 bp, Mus musculus
acctggagctcacgtgtaacctgga

SEQ ID NO: 117992 - DNA, 25 bp, Mus musculus
acctggagctcaggtgtaacctgga

SEQ ID NO: 117993 - DNA, 25 bp, Mus musculus
acctggaggccaaacgcaaagctga

SEQ ID NO: 117994 - DNA, 25 bp, Mus musculus
acctggaggccatacgcaaagctga

SEQ ID NO: 117995 - DNA, 25 bp, Mus musculus
acctggaggctacgcagcttgcaca

SEQ ID NO: 117996 - DNA, 25 bp, Mus musculus
acctggaggctaggcagcttgcaca

SEQ ID NO: 117997 - DNA, 25 bp, Mus musculus
acctggaggcttcttttgagctgtt

SEQ ID NO: 117998 - DNA, 25 bp, Mus musculus
acctggaggcttgttttgagctgtt

SEQ ID NO: 117999 - DNA, 25 bp, Mus musculus
acctggagggtgagctttgcctgct

SEQ ID NO: 118000 - DNA, 25 bp, Mus musculus
acctggagggtgtgctttgcctgct

SEQ ID NO: 118001 - DNA, 25 bp, Mus musculus
acctggaggtctatgcccctaatgt

SEQ ID NO: 118002 - DNA, 25 bp, Mus musculus
acctggaggtctttgcccctaatgt

SEQ ID NO: 118003 - DNA, 25 bp, Mus musculus
acctggagtcggctccttttgtctg

SEQ ID NO: 118004 - DNA, 25 bp, Mus musculus
acctggagtcgggtccttttgtctg

SEQ ID NO: 118005 - DNA, 25 bp, Mus musculus
acctggagtgatatgtgtcttagag

SEQ ID NO: 118006 - DNA, 25 bp, Mus musculus
acctggagtgatttgtgtcttagag

SEQ ID NO: 118007 - DNA, 25 bp, Mus musculus
acctggagtgctctggaactaagtt

SEQ ID NO: 118008 - DNA, 25 bp, Mus musculus
acctggagtgctgtggaactaagtt

SEQ ID NO: 118009 - DNA, 25 bp, Mus musculus
acctggatagttatcaggctttcca

SEQ ID NO: 118010 - DNA, 25 bp, Mus musculus
acctggatagttttcaggctttcca

SEQ ID NO: 118011 - DNA, 25 bp, Mus musculus
acctggatatttcgtgaccttaaat

SEQ ID NO: 118012 - DNA, 25 bp, Mus musculus
acctggatatttggtgaccttaaat

SEQ ID NO: 118013 - DNA, 25 bp, Mus musculus
acctggatccagatgcaaagtttgg

SEQ ID NO: 118014 - DNA, 25 bp, Mus musculus
acctggatccagttgcaaagtttgg

SEQ ID NO: 118015 - DNA, 25 bp, Mus musculus
acctggatctcgatgaggtcacctg

SEQ ID NO: 118016 - DNA, 25 bp, Mus musculus
acctggatctcgttgaggtcacctg

SEQ ID NO: 118017 - DNA, 25 bp, Mus musculus
acctggatgaccaggcttgaacaag

SEQ ID NO: 118018 - DNA, 25 bp, Mus musculus
acctggatgacctggcttgaacaag

SEQ ID NO: 118019 - DNA, 25 bp, Mus musculus
acctggatgagccacatgcgcaaaa

SEQ ID NO: 118020 - DNA, 25 bp, Mus musculus
acctggatgagcgacatgcgcaaaa

SEQ ID NO: 118021 - DNA, 25 bp, Mus musculus
acctggatgctcacaatctgtcggg

SEQ ID NO: 118022 - DNA, 25 bp, Mus musculus
acctggatgctctcaatctgtcggg

SEQ ID NO: 118023 - DNA, 25 bp, Mus musculus
acctggatgcttatgatgtggacac

SEQ ID NO: 118024 - DNA, 25 bp, Mus musculus
acctggatgcttttgatgtggacac

SEQ ID NO: 118025 - DNA, 25 bp, Mus musculus
acctggatggacatggacgggacaa

SEQ ID NO: 118026 - DNA, 25 bp, Mus musculus
acctggatggacttggacgggacaa

SEQ ID NO: 118027 - DNA, 25 bp, Mus musculus
acctggattgtgcagaagacgcctg

SEQ ID NO: 118028 - DNA, 25 bp, Mus musculus
acctggattgtggagaagacgcctg

SEQ ID NO: 118029 - DNA, 25 bp, Mus musculus
acctggcaactgattattgtgacca

SEQ ID NO: 118030 - DNA, 25 bp, Mus musculus
acctggcaactgtttattgtgacca

SEQ ID NO: 118031 - DNA, 25 bp, Mus musculus
acctggcaagccctaaagttgagat

SEQ ID NO: 118032 - DNA, 25 bp, Mus musculus
acctggcaagccgtaaagttgagat

SEQ ID NO: 118033 - DNA, 25 bp, Mus musculus
acctggcaaggtaacgaagtgatgg

SEQ ID NO: 118034 - DNA, 25 bp, Mus musculus
acctggcaaggttacgaagtgatgg

SEQ ID NO: 118035 - DNA, 25 bp, Mus musculus
acctggcaattgattttgttcttga

SEQ ID NO: 118036 - DNA, 25 bp, Mus musculus
acctggcaattgtttttgttcttga

SEQ ID NO: 118037 - DNA, 25 bp, Mus musculus
acctggcacacaaaggcgcttaata

SEQ ID NO: 118038 - DNA, 25 bp, Mus musculus
acctggcacacataggcgcttaata

SEQ ID NO: 118039 - DNA, 25 bp, Mus musculus
acctggcacctaagatcctgggtca

SEQ ID NO: 118040 - DNA, 25 bp, Mus musculus
acctggcacctatgatcctgggtca

SEQ ID NO: 118041 - DNA, 25 bp, Mus musculus
acctggcactagagaatgtggagct

SEQ ID NO: 118042 - DNA, 25 bp, Mus musculus
acctggcactagtgaatgtggagct

SEQ ID NO: 118043 - DNA, 25 bp, Mus musculus
acctggcactcgaggagacgcttgg

SEQ ID NO: 118044 - DNA, 25 bp, Mus musculus
acctggcactcgtggagacgcttgg

SEQ ID NO: 118045 - DNA, 25 bp, Mus musculus
acctggcacttgaaaacgggcagaa

SEQ ID NO: 118046 - DNA, 25 bp, Mus musculus
acctggcacttgtaaacgggcagaa

SEQ ID NO: 118047 - DNA, 25 bp, Mus musculus
acctggcagaccatcagtggaggta

SEQ ID NO: 118048 - DNA, 25 bp, Mus musculus
acctggcagaccttcagtggaggta

SEQ ID NO: 118049 - DNA, 25 bp, Mus musculus
acctggcatgtgagcagatggcaga

SEQ ID NO: 118050 - DNA, 25 bp, Mus musculus
acctggcatgtgtgcagatggcaga

SEQ ID NO: 118051 - DNA, 25 bp, Mus musculus
acctggcattgcacattgctcatga

SEQ ID NO: 118052 - DNA, 25 bp, Mus musculus
acctggcattgctcattgctcatga

SEQ ID NO: 118053 - DNA, 25 bp, Mus musculus
acctggcattttaggggccctcaca

SEQ ID NO: 118054 - DNA, 25 bp, Mus musculus
acctggcatttttggggccctcaca

SEQ ID NO: 118055 - DNA, 25 bp, Mus musculus
acctggccacatactaggtttgtgt

SEQ ID NO: 118056 - DNA, 25 bp, Mus musculus
acctggccacattctaggtttgtgt

SEQ ID NO: 118057 - DNA, 25 bp, Mus musculus
acctggccaccactgagggaaacca

SEQ ID NO: 118058 - DNA, 25 bp, Mus musculus
acctggccaccagtgagggaaacca

SEQ ID NO: 118059 - DNA, 25 bp, Mus musculus
acctggccaggcagcagtacttaca

SEQ ID NO: 118060 - DNA, 25 bp, Mus musculus
acctggccaggctgcagtacttaca

SEQ ID NO: 118061 - DNA, 25 bp, Mus musculus
acctggcccgttaatctagatttgt

SEQ ID NO: 118062 - DNA, 25 bp, Mus musculus
acctggcccgtttatctagatttgt

SEQ ID NO: 118063 - DNA, 25 bp, Mus musculus
acctggccctacatgttgcatgaaa

SEQ ID NO: 118064 - DNA, 25 bp, Mus musculus
acctggccctacttgttgcatgaaa

SEQ ID NO: 118065 - DNA, 25 bp, Mus musculus
acctggccctgcacatgaagaggca

SEQ ID NO: 118066 - DNA, 25 bp, Mus musculus
acctggccctgctcatgaagaggca

SEQ ID NO: 118067 - DNA, 25 bp, Mus musculus
acctggccgtgcaagtaaggtcacc

SEQ ID NO: 118068 - DNA, 25 bp, Mus musculus
acctggccgtgcactttggaaccag

SEQ ID NO: 118069 - DNA, 25 bp, Mus musculus
acctggccgtgctagtaaggtcacc

SEQ ID NO: 118070 - DNA, 25 bp, Mus musculus
acctggccgtgctctttggaaccag

SEQ ID NO: 118071 - DNA, 25 bp, Mus musculus
acctggcctccaaagtttcaatatt

SEQ ID NO: 118072 - DNA, 25 bp, Mus musculus
acctggcctccatagtttcaatatt

SEQ ID NO: 118073 - DNA, 25 bp, Mus musculus
acctggcctcttcatgtgttattgt

SEQ ID NO: 118074 - DNA, 25 bp, Mus musculus
acctggcctcttgatgtgttattgt

SEQ ID NO: 118075 - DNA, 25 bp, Mus musculus
acctggcctgcgaggtttatagtta

SEQ ID NO: 118076 - DNA, 25 bp, Mus musculus
acctggcctgcgtggtttatagtta

SEQ ID NO: 118077 - DNA, 25 bp, Mus musculus
acctggcctggaactcattggagag

SEQ ID NO: 118078 - DNA, 25 bp, Mus musculus
acctggcctggatctcattggagag

SEQ ID NO: 118079 - DNA, 25 bp, Mus musculus
acctggccttgtacgtcttcgtgta

SEQ ID NO: 118080 - DNA, 25 bp, Mus musculus
acctggccttgttcgtcttcgtgta

SEQ ID NO: 118081 - DNA, 25 bp, Mus musculus
acctggcgcggaaacggcacgtgat

SEQ ID NO: 118082 - DNA, 25 bp, Mus musculus
acctggcgcggatacggcacgtgat

SEQ ID NO: 118083 - DNA, 25 bp, Mus musculus
acctggcgctgtcgatgtgatgcac

SEQ ID NO: 118084 - DNA, 25 bp, Mus musculus
acctggcgctgtggatgtgatgcac

SEQ ID NO: 118085 - DNA, 25 bp, Mus musculus
acctggcgttacagagagttcgcta

SEQ ID NO: 118086 - DNA, 25 bp, Mus musculus
acctggcgttactgagagttcgcta

SEQ ID NO: 118087 - DNA, 25 bp, Mus musculus
acctggcgttttcagtttcatcaca

SEQ ID NO: 118088 - DNA, 25 bp, Mus musculus
acctggcgttttgagtttcatcaca

SEQ ID NO: 118089 - DNA, 25 bp, Mus musculus
acctggctaactagggcattgctca

SEQ ID NO: 118090 - DNA, 25 bp, Mus musculus
acctggctaacttgggcattgctca

SEQ ID NO: 118091 - DNA, 25 bp, Mus musculus
acctggctactgagtatctttgtaa

SEQ ID NO: 118092 - DNA, 25 bp, Mus musculus
acctggctactgtgtatctttgtaa

SEQ ID NO: 118093 - DNA, 25 bp, Mus musculus
acctggctagttctactggtaacca

SEQ ID NO: 118094 - DNA, 25 bp, Mus musculus
acctggctagttgtactggtaacca

SEQ ID NO: 118095 - DNA, 25 bp, Mus musculus
acctggctcagcatctgttctgaat

SEQ ID NO: 118096 - DNA, 25 bp, Mus musculus
acctggctcagcttctgttctgaat

SEQ ID NO: 118097 - DNA, 25 bp, Mus musculus
acctggctcagtctcagtctattta

SEQ ID NO: 118098 - DNA, 25 bp, Mus musculus
acctggctcagtgtcagtctattta

SEQ ID NO: 118099 - DNA, 25 bp, Mus musculus
acctggctccatatttcagggtcac

SEQ ID NO: 118100 - DNA, 25 bp, Mus musculus
acctggctccatcaagccctttgta

SEQ ID NO: 118101 - DNA, 25 bp, Mus musculus
acctggctccatgaagccctttgta

SEQ ID NO: 118102 - DNA, 25 bp, Mus musculus
acctggctccatttttcagggtcac

SEQ ID NO: 118103 - DNA, 25 bp, Mus musculus
acctggctcctaagctgtgatatat

SEQ ID NO: 118104 - DNA, 25 bp, Mus musculus
acctggctcctacaggaacactctg

SEQ ID NO: 118105 - DNA, 25 bp, Mus musculus
acctggctcctagaggaacactctg

SEQ ID NO: 118106 - DNA, 25 bp, Mus musculus
acctggctcctatgctgtgatatat

SEQ ID NO: 118107 - DNA, 25 bp, Mus musculus
acctggctctcccactgaggaagca

SEQ ID NO: 118108 - DNA, 25 bp, Mus musculus
acctggctctccgactgaggaagca

SEQ ID NO: 118109 - DNA, 25 bp, Mus musculus
acctggctctgcattaactggaaat

SEQ ID NO: 118110 - DNA, 25 bp, Mus musculus
acctggctctgctttaactggaaat

SEQ ID NO: 118111 - DNA, 25 bp, Mus musculus
acctggctctggctataccaacatt

SEQ ID NO: 118112 - DNA, 25 bp, Mus musculus
acctggctctgggtataccaacatt

SEQ ID NO: 118113 - DNA, 25 bp, Mus musculus
acctggctgactatgagcacttcgt

SEQ ID NO: 118114 - DNA, 25 bp, Mus musculus
acctggctgactttgagcacttcgt

SEQ ID NO: 118115 - DNA, 25 bp, Mus musculus
acctggctgataacgggccatccat

SEQ ID NO: 118116 - DNA, 25 bp, Mus musculus
acctggctgatatcgggccatccat

SEQ ID NO: 118117 - DNA, 25 bp, Mus musculus
acctggctggacaaccgaaatgtgg

SEQ ID NO: 118118 - DNA, 25 bp, Mus musculus
acctggctggactaccgaaatgtgg

SEQ ID NO: 118119 - DNA, 25 bp, Mus musculus
acctggctgggtaggcactcagtaa

SEQ ID NO: 118120 - DNA, 25 bp, Mus musculus
acctggctgggttggcactcagtaa

SEQ ID NO: 118121 - DNA, 25 bp, Mus musculus
acctggctgtacactgtatttttca

SEQ ID NO: 118122 - DNA, 25 bp, Mus musculus
acctggctgtactctgtatttttca

SEQ ID NO: 118123 - DNA, 25 bp, Mus musculus
acctggcttaccaaggctgtcaagg

SEQ ID NO: 118124 - DNA, 25 bp, Mus musculus
acctggcttacctaggctgtcaagg

SEQ ID NO: 118125 - DNA, 25 bp, Mus musculus
acctggcttatgattgttttctaat

SEQ ID NO: 118126 - DNA, 25 bp, Mus musculus
acctggcttatgtttgttttctaat

SEQ ID NO: 118127 - DNA, 25 bp, Mus musculus
acctggcttcaaagttcagtttttt

SEQ ID NO: 118128 - DNA, 25 bp, Mus musculus
acctggcttcaatgttcagtttttt

SEQ ID NO: 118129 - DNA, 25 bp, Mus musculus
acctggcttcagaacactcatgttt

SEQ ID NO: 118130 - DNA, 25 bp, Mus musculus
acctggcttcagtacactcatgttt

SEQ ID NO: 118131 - DNA, 25 bp, Mus musculus
acctggcttccaagaggactgtcac

SEQ ID NO: 118132 - DNA, 25 bp, Mus musculus
acctggcttccatgaggactgtcac

SEQ ID NO: 118133 - DNA, 25 bp, Mus musculus
acctggcttggcacttcagtgtctt

SEQ ID NO: 118134 - DNA, 25 bp, Mus musculus
acctggcttggctcttcagtgtctt

SEQ ID NO: 118135 - DNA, 25 bp, Mus musculus
acctggcttttcacatttcaactcc

SEQ ID NO: 118136 - DNA, 25 bp, Mus musculus
acctggcttttctcatttcaactcc

SEQ ID NO: 118137 - DNA, 25 bp, Mus musculus
acctgggaagctccttttgctctat

SEQ ID NO: 118138 - DNA, 25 bp, Mus musculus
acctgggaagctgcttttgctctat

SEQ ID NO: 118139 - DNA, 25 bp, Mus musculus
acctgggaagtgaggttcttttgag

SEQ ID NO: 118140 - DNA, 25 bp, Mus musculus
acctgggaagtgtggttcttttgag

SEQ ID NO: 118141 - DNA, 25 bp, Mus musculus
acctgggacagcatagtttctcttt

SEQ ID NO: 118142 - DNA, 25 bp, Mus musculus
acctgggacagcttagtttctcttt

SEQ ID NO: 118143 - DNA, 25 bp, Mus musculus
acctgggaccagctctttgtctggg

SEQ ID NO: 118144 - DNA, 25 bp, Mus musculus
acctgggaccaggtctttgtctggg

SEQ ID NO: 118145 - DNA, 25 bp, Mus musculus
acctgggactacctggactggattg

SEQ ID NO: 118146 - DNA, 25 bp, Mus musculus
acctgggactacgtggactggattg

SEQ ID NO: 118147 - DNA, 25 bp, Mus musculus
acctgggagatcacatcatggctct

SEQ ID NO: 118148 - DNA, 25 bp, Mus musculus
acctgggagatctcatcatggctct

SEQ ID NO: 118149 - DNA, 25 bp, Mus musculus
acctgggaggcacggcctacacact

SEQ ID NO: 118150 - DNA, 25 bp, Mus musculus
acctgggaggcagggcctacacact

SEQ ID NO: 118151 - DNA, 25 bp, Mus musculus
acctgggatgccctgattactgtct

SEQ ID NO: 118152 - DNA, 25 bp, Mus musculus
acctgggatgccgtgattactgtct

SEQ ID NO: 118153 - DNA, 25 bp, Mus musculus
acctgggattacaatactggatgat

SEQ ID NO: 118154 - DNA, 25 bp, Mus musculus
acctgggattactatactggatgat

SEQ ID NO: 118155 - DNA, 25 bp, Mus musculus
acctgggatttgactggggaccaag

SEQ ID NO: 118156 - DNA, 25 bp, Mus musculus
acctgggatttgctgtatgagcctt

SEQ ID NO: 118157 - DNA, 25 bp, Mus musculus
acctgggatttggtgtatgagcctt

SEQ ID NO: 118158 - DNA, 25 bp, Mus musculus
acctgggatttgtctggggaccaag

SEQ ID NO: 118159 - DNA, 25 bp, Mus musculus
acctgggcacacaccctgggagtaa

SEQ ID NO: 118160 - DNA, 25 bp, Mus musculus
acctgggcacactccctgggagtaa

SEQ ID NO: 118161 - DNA, 25 bp, Mus musculus
acctgggcaccaaccatgacatgaa

SEQ ID NO: 118162 - DNA, 25 bp, Mus musculus
acctgggcaccatccatgacatgaa

SEQ ID NO: 118163 - DNA, 25 bp, Mus musculus
acctgggcagcaccagtagccaagt

SEQ ID NO: 118164 - DNA, 25 bp, Mus musculus
acctgggcagcagcagtagccaagt

SEQ ID NO: 118165 - DNA, 25 bp, Mus musculus
acctgggcaggaccactggtgacat

SEQ ID NO: 118166 - DNA, 25 bp, Mus musculus
acctgggcaggagcactggtgacat

SEQ ID NO: 118167 - DNA, 25 bp, Mus musculus
acctgggcaggtcagttaatggttt

SEQ ID NO: 118168 - DNA, 25 bp, Mus musculus
acctgggcaggtgagttaatggttt

SEQ ID NO: 118169 - DNA, 25 bp, Mus musculus
acctgggcagttcatgctatgattt

SEQ ID NO: 118170 - DNA, 25 bp, Mus musculus
acctgggcagttgatgctatgattt

SEQ ID NO: 118171 - DNA, 25 bp, Mus musculus
acctgggcatagagaggagaaagtc

SEQ ID NO: 118172 - DNA, 25 bp, Mus musculus
acctgggcatagtgaggagaaagtc

SEQ ID NO: 118173 - DNA, 25 bp, Mus musculus
acctgggcctagacaaaagtcctat

SEQ ID NO: 118174 - DNA, 25 bp, Mus musculus
acctgggcctagtcaaaagtcctat

SEQ ID NO: 118175 - DNA, 25 bp, Mus musculus
acctgggcgaagcacattgggctca

SEQ ID NO: 118176 - DNA, 25 bp, Mus musculus
acctgggcgaaggacattgggctca

SEQ ID NO: 118177 - DNA, 25 bp, Mus musculus
acctgggcgggaagcctgatttgat

SEQ ID NO: 118178 - DNA, 25 bp, Mus musculus
acctgggcgggatgcctgatttgat

SEQ ID NO: 118179 - DNA, 25 bp, Mus musculus
acctgggctaacacaactctttctt

SEQ ID NO: 118180 - DNA, 25 bp, Mus musculus
acctgggctaactcaactctttctt

SEQ ID NO: 118181 - DNA, 25 bp, Mus musculus
acctgggctacacagagctccctgt

SEQ ID NO: 118182 - DNA, 25 bp, Mus musculus
acctgggctacagagagctccctgt

SEQ ID NO: 118183 - DNA, 25 bp, Mus musculus
acctgggctgaccatggctactgaa

SEQ ID NO: 118184 - DNA, 25 bp, Mus musculus
acctgggctgacgatggctactgaa

SEQ ID NO: 118185 - DNA, 25 bp, Mus musculus
acctgggctttaatcactcaaaatg

SEQ ID NO: 118186 - DNA, 25 bp, Mus musculus
acctgggctttattcactcaaaatg

SEQ ID NO: 118187 - DNA, 25 bp, Mus musculus
acctgggtactaatttcatgtgtgt

SEQ ID NO: 118188 - DNA, 25 bp, Mus musculus
acctgggtactattttcatgtgtgt

SEQ ID NO: 118189 - DNA, 25 bp, Mus musculus
acctgggtacttccttggcttctgt

SEQ ID NO: 118190 - DNA, 25 bp, Mus musculus
acctgggtacttgcttggcttctgt

SEQ ID NO: 118191 - DNA, 25 bp, Mus musculus
acctgggtagaacgctgtctgtgcc

SEQ ID NO: 118192 - DNA, 25 bp, Mus musculus
acctgggtagaaggctgtctgtgcc

SEQ ID NO: 118193 - DNA, 25 bp, Mus musculus
acctgggtagtgacagatggatcac

SEQ ID NO: 118194 - DNA, 25 bp, Mus musculus
acctgggtagtgtcagatggatcac

SEQ ID NO: 118195 - DNA, 25 bp, Mus musculus
acctgggtatggcactcagagtcac

SEQ ID NO: 118196 - DNA, 25 bp, Mus musculus
acctgggtatgggactcagagtcac

SEQ ID NO: 118197 - DNA, 25 bp, Mus musculus
acctgggtcactagtccatcaatgt

SEQ ID NO: 118198 - DNA, 25 bp, Mus musculus
acctgggtcacttgtccatcaatgt

SEQ ID NO: 118199 - DNA, 25 bp, Mus musculus
acctgggtcctcagtgaaagcataa

SEQ ID NO: 118200 - DNA, 25 bp, Mus musculus
acctgggtcctctgtgaaagcataa

SEQ ID NO: 118201 - DNA, 25 bp, Mus musculus
acctgggtctggaggtatttctggt

SEQ ID NO: 118202 - DNA, 25 bp, Mus musculus
acctgggtctggtggtatttctggt

SEQ ID NO: 118203 - DNA, 25 bp, Mus musculus
acctgggtgaacaatgggaggcatt

SEQ ID NO: 118204 - DNA, 25 bp, Mus musculus
acctgggtgaactatgggaggcatt

SEQ ID NO: 118205 - DNA, 25 bp, Mus musculus
acctgggtggtaatttgactctcaa

SEQ ID NO: 118206 - DNA, 25 bp, Mus musculus
acctgggtggtattttgactctcaa

SEQ ID NO: 118207 - DNA, 25 bp, Mus musculus
acctgggtgttcagagctgggctac

SEQ ID NO: 118208 - DNA, 25 bp, Mus musculus
acctgggtgttctgagctgggctac

SEQ ID NO: 118209 - DNA, 25 bp, Mus musculus
acctgggttcttcctgtgtggtcca

SEQ ID NO: 118210 - DNA, 25 bp, Mus musculus
acctgggttcttgctgtgtggtcca

SEQ ID NO: 118211 - DNA, 25 bp, Mus musculus
acctgggtttctcctgcacactctt

SEQ ID NO: 118212 - DNA, 25 bp, Mus musculus
acctgggtttctgctgcacactctt

SEQ ID NO: 118213 - DNA, 25 bp, Mus musculus
acctggtaccaaatggcaagccggc

SEQ ID NO: 118214 - DNA, 25 bp, Mus musculus
acctggtaccaattggcaagccggc

SEQ ID NO: 118215 - DNA, 25 bp, Mus musculus
acctggtacctcagggcttggcgtg

SEQ ID NO: 118216 - DNA, 25 bp, Mus musculus
acctggtacctctgggcttggcgtg

SEQ ID NO: 118217 - DNA, 25 bp, Mus musculus
acctggtagcagatgatgcacacac

SEQ ID NO: 118218 - DNA, 25 bp, Mus musculus
acctggtagcagttgatgcacacac

SEQ ID NO: 118219 - DNA, 25 bp, Mus musculus
acctggtagcatccctcttaatgtg

SEQ ID NO: 118220 - DNA, 25 bp, Mus musculus
acctggtagcatgcctcttaatgtg

SEQ ID NO: 118221 - DNA, 25 bp, Mus musculus
acctggtagccacgaacacgactac

SEQ ID NO: 118222 - DNA, 25 bp, Mus musculus
acctggtagccaggaacacgactac

SEQ ID NO: 118223 - DNA, 25 bp, Mus musculus
acctggtatcgtcgtgacgaacgtg

SEQ ID NO: 118224 - DNA, 25 bp, Mus musculus
acctggtatcgtggtgacgaacgtg

SEQ ID NO: 118225 - DNA, 25 bp, Mus musculus
acctggtcactcagacttgatgctt

SEQ ID NO: 118226 - DNA, 25 bp, Mus musculus
acctggtcactctgacttgatgctt

SEQ ID NO: 118227 - DNA, 25 bp, Mus musculus
acctggtcagggactatgctgctac

SEQ ID NO: 118228 - DNA, 25 bp, Mus musculus
acctggtcagggtctatgctgctac

SEQ ID NO: 118229 - DNA, 25 bp, Mus musculus
acctggtcaggtagctttcttacta

SEQ ID NO: 118230 - DNA, 25 bp, Mus musculus
acctggtcaggttgctttcttacta

SEQ ID NO: 118231 - DNA, 25 bp, Mus musculus
acctggtcatgacgaggacacacct

SEQ ID NO: 118232 - DNA, 25 bp, Mus musculus
acctggtcatgaggaggacacacct

SEQ ID NO: 118233 - DNA, 25 bp, Mus musculus
acctggtccactcttttccaaatgt

SEQ ID NO: 118234 - DNA, 25 bp, Mus musculus
acctggtccactgttttccaaatgt

SEQ ID NO: 118235 - DNA, 25 bp, Mus musculus
acctggtccagaagctgattgaact

SEQ ID NO: 118236 - DNA, 25 bp, Mus musculus
acctggtccagatgctgattgaact

SEQ ID NO: 118237 - DNA, 25 bp, Mus musculus
acctggtccatgatgggccaatcaa

SEQ ID NO: 118238 - DNA, 25 bp, Mus musculus
acctggtccatgttgggccaatcaa

SEQ ID NO: 118239 - DNA, 25 bp, Mus musculus
acctggtcccttaggagtggaggca

SEQ ID NO: 118240 - DNA, 25 bp, Mus musculus
acctggtccctttggagtggaggca

SEQ ID NO: 118241 - DNA, 25 bp, Mus musculus
acctggtcctgaagggtgctatctg

SEQ ID NO: 118242 - DNA, 25 bp, Mus musculus
acctggtcctgatgggtgctatctg

SEQ ID NO: 118243 - DNA, 25 bp, Mus musculus
acctggtcctggcaatgtgtcctca

SEQ ID NO: 118244 - DNA, 25 bp, Mus musculus
acctggtcctgggaatgtgtcctca

SEQ ID NO: 118245 - DNA, 25 bp, Mus musculus
acctggtcttaaagctttctcttct

SEQ ID NO: 118246 - DNA, 25 bp, Mus musculus
acctggtcttaatgctttctcttct

SEQ ID NO: 118247 - DNA, 25 bp, Mus musculus
acctggtcttcaagccgcagcattg

SEQ ID NO: 118248 - DNA, 25 bp, Mus musculus
acctggtcttcatgccgcagcattg

SEQ ID NO: 118249 - DNA, 25 bp, Mus musculus
acctggtcttgcaaaatgcctctga

SEQ ID NO: 118250 - DNA, 25 bp, Mus musculus
acctggtcttgctaaatgcctctga

SEQ ID NO: 118251 - DNA, 25 bp, Mus musculus
acctggtgaaatatctctaatccta

SEQ ID NO: 118252 - DNA, 25 bp, Mus musculus
acctggtgaaatttctctaatccta

SEQ ID NO: 118253 - DNA, 25 bp, Mus musculus
acctggtgatagatacgtgcctgta

SEQ ID NO: 118254 - DNA, 25 bp, Mus musculus
acctggtgatagttacgtgcctgta

SEQ ID NO: 118255 - DNA, 25 bp, Mus musculus
acctggtgcgtacccggagatatgt

SEQ ID NO: 118256 - DNA, 25 bp, Mus musculus
acctggtgcgtagccggagatatgt

SEQ ID NO: 118257 - DNA, 25 bp, Mus musculus
acctggtgctcaacggtaacactgg

SEQ ID NO: 118258 - DNA, 25 bp, Mus musculus
acctggtgctcatcggtaacactgg

SEQ ID NO: 118259 - DNA, 25 bp, Mus musculus
acctggtgctccaagtgtttggcta

SEQ ID NO: 118260 - DNA, 25 bp, Mus musculus
acctggtgctcctagtgtttggcta

SEQ ID NO: 118261 - DNA, 25 bp, Mus musculus
acctggtggacgacctgtcgcggct

SEQ ID NO: 118262 - DNA, 25 bp, Mus musculus
acctggtggacgtcctgtcgcggct

SEQ ID NO: 118263 - DNA, 25 bp, Mus musculus
acctggtggctgacgccctggatac

SEQ ID NO: 118264 - DNA, 25 bp, Mus musculus
acctggtggctgtcgccctggatac

SEQ ID NO: 118265 - DNA, 25 bp, Mus musculus
acctggtgtaagaagtggaggcaca

SEQ ID NO: 118266 - DNA, 25 bp, Mus musculus
acctggtgtaagtagtggaggcaca

SEQ ID NO: 118267 - DNA, 25 bp, Mus musculus
acctggtgtgcactttttgcccttt

SEQ ID NO: 118268 - DNA, 25 bp, Mus musculus
acctggtgtgcagtttttgcccttt

SEQ ID NO: 118269 - DNA, 25 bp, Mus musculus
acctggtgttgtcatgtattaagtc

SEQ ID NO: 118270 - DNA, 25 bp, Mus musculus
acctggtgttgtgatgtattaagtc

SEQ ID NO: 118271 - DNA, 25 bp, Mus musculus
acctggttatccaagattagagtag

SEQ ID NO: 118272 - DNA, 25 bp, Mus musculus
acctggttatcctagattagagtag

SEQ ID NO: 118273 - DNA, 25 bp, Mus musculus
acctggttatgcaatgtcctgaaaa

SEQ ID NO: 118274 - DNA, 25 bp, Mus musculus
acctggttatgctatgtcctgaaaa

SEQ ID NO: 118275 - DNA, 25 bp, Mus musculus
acctggttatttctcctatacgtag

SEQ ID NO: 118276 - DNA, 25 bp, Mus musculus
acctggttatttgtcctatacgtag

SEQ ID NO: 118277 - DNA, 25 bp, Mus musculus
acctggttcaccctgtttagactca

SEQ ID NO: 118278 - DNA, 25 bp, Mus musculus
acctggttcaccgtgtttagactca

SEQ ID NO: 118279 - DNA, 25 bp, Mus musculus
acctggttcatgaacacacctgtat

SEQ ID NO: 118280 - DNA, 25 bp, Mus musculus
acctggttcatgtacacacctgtat

SEQ ID NO: 118281 - DNA, 25 bp, Mus musculus
acctggttctttacttacactgtca

SEQ ID NO: 118282 - DNA, 25 bp, Mus musculus
acctggttcttttcttacactgtca

SEQ ID NO: 118283 - DNA, 25 bp, Mus musculus
acctggttgatgagtcaagggccca

SEQ ID NO: 118284 - DNA, 25 bp, Mus musculus
acctggttgatgtgtcaagggccca

SEQ ID NO: 118285 - DNA, 25 bp, Mus musculus
acctggttggatccacttgtcgaga

SEQ ID NO: 118286 - DNA, 25 bp, Mus musculus
acctggttggatgcacttgtcgaga

SEQ ID NO: 118287 - DNA, 25 bp, Mus musculus
acctggttggtcatgcgacagagag

SEQ ID NO: 118288 - DNA, 25 bp, Mus musculus
acctggttggtcttgcgacagagag

SEQ ID NO: 118289 - DNA, 25 bp, Mus musculus
acctggtttaatacttctctttctg

SEQ ID NO: 118290 - DNA, 25 bp, Mus musculus
acctggtttaattcttctctttctg

SEQ ID NO: 118291 - DNA, 25 bp, Mus musculus
acctggtttgtgagaccaaagaggg

SEQ ID NO: 118292 - DNA, 25 bp, Mus musculus
acctggtttgtgtgaccaaagaggg

SEQ ID NO: 118293 - DNA, 25 bp, Mus musculus
acctggttttctctgtacgccacca

SEQ ID NO: 118294 - DNA, 25 bp, Mus musculus
acctggttttctgtgtacgccacca

SEQ ID NO: 118295 - DNA, 25 bp, Mus musculus
acctgtaaatgcatctctcgtggca

SEQ ID NO: 118296 - DNA, 25 bp, Mus musculus
acctgtaaatgcttctctcgtggca

SEQ ID NO: 118297 - DNA, 25 bp, Mus musculus
acctgtaacatacaagtctttacaa

SEQ ID NO: 118298 - DNA, 25 bp, Mus musculus
acctgtaacatagaagtctttacaa

SEQ ID NO: 118299 - DNA, 25 bp, Mus musculus
acctgtaaccgactccatgtggcag

SEQ ID NO: 118300 - DNA, 25 bp, Mus musculus
acctgtaaccgagtccatgtggcag

SEQ ID NO: 118301 - DNA, 25 bp, Mus musculus
acctgtaagggcaggccctgctgcc

SEQ ID NO: 118302 - DNA, 25 bp, Mus musculus
acctgtaagggctggccctgctgcc

SEQ ID NO: 118303 - DNA, 25 bp, Mus musculus
acctgtaatactaccacttgagagg

SEQ ID NO: 118304 - DNA, 25 bp, Mus musculus
acctgtaatacttccacttgagagg

SEQ ID NO: 118305 - DNA, 25 bp, Mus musculus
acctgtaatcccagttactctgaag

SEQ ID NO: 118306 - DNA, 25 bp, Mus musculus
acctgtaatccctgttactctgaag

SEQ ID NO: 118307 - DNA, 25 bp, Mus musculus
acctgtaatctcataatcccaacac

SEQ ID NO: 118308 - DNA, 25 bp, Mus musculus
acctgtaatctcttaatcccaacac

SEQ ID NO: 118309 - DNA, 25 bp, Mus musculus
acctgtaattagcacctgggtggtg

SEQ ID NO: 118310 - DNA, 25 bp, Mus musculus
acctgtaattaggacctgggtggtg

SEQ ID NO: 118311 - DNA, 25 bp, Mus musculus
acctgtacaaaactgacctggcggc

SEQ ID NO: 118312 - DNA, 25 bp, Mus musculus
acctgtacaaaagtgacctggcggc

SEQ ID NO: 118313 - DNA, 25 bp, Mus musculus
acctgtacaacacgttttgctgctg

SEQ ID NO: 118314 - DNA, 25 bp, Mus musculus
acctgtacaacaggttttgctgctg

SEQ ID NO: 118315 - DNA, 25 bp, Mus musculus
acctgtacactgacgtggcgttcaa

SEQ ID NO: 118316 - DNA, 25 bp, Mus musculus
acctgtacactgtcgtggcgttcaa

SEQ ID NO: 118317 - DNA, 25 bp, Mus musculus
acctgtacatacatcccaaagcatt

SEQ ID NO: 118318 - DNA, 25 bp, Mus musculus
acctgtacatacttcccaaagcatt

SEQ ID NO: 118319 - DNA, 25 bp, Mus musculus
acctgtacatatcccagagaacaat

SEQ ID NO: 118320 - DNA, 25 bp, Mus musculus
acctgtacatatgccagagaacaat

SEQ ID NO: 118321 - DNA, 25 bp, Mus musculus
acctgtacattgaactgtgcacccc

SEQ ID NO: 118322 - DNA, 25 bp, Mus musculus
acctgtacattgtactgtgcacccc

SEQ ID NO: 118323 - DNA, 25 bp, Mus musculus
acctgtacgtgccgcggaaatgctc

SEQ ID NO: 118324 - DNA, 25 bp, Mus musculus
acctgtacgtgcggcggaaatgctc

SEQ ID NO: 118325 - DNA, 25 bp, Mus musculus
acctgtactggtcctggattctgca

SEQ ID NO: 118326 - DNA, 25 bp, Mus musculus
acctgtactggtgctggattctgca

SEQ ID NO: 118327 - DNA, 25 bp, Mus musculus
acctgtacttgtatctactgcgcaa

SEQ ID NO: 118328 - DNA, 25 bp, Mus musculus
acctgtacttgtttctactgcgcaa

SEQ ID NO: 118329 - DNA, 25 bp, Mus musculus
acctgtagcaatatcatttcatgtg

SEQ ID NO: 118330 - DNA, 25 bp, Mus musculus
acctgtagcaatttcatttcatgtg

SEQ ID NO: 118331 - DNA, 25 bp, Mus musculus
acctgtagcatccagtgtcttcttt

SEQ ID NO: 118332 - DNA, 25 bp, Mus musculus
acctgtagcatcgagtgtcttcttt

SEQ ID NO: 118333 - DNA, 25 bp, Mus musculus
acctgtagcccacggatcctagctg

SEQ ID NO: 118334 - DNA, 25 bp, Mus musculus
acctgtagcccagggatcctagctg

SEQ ID NO: 118335 - DNA, 25 bp, Mus musculus
acctgtagccttctcaggcgatgtg

SEQ ID NO: 118336 - DNA, 25 bp, Mus musculus
acctgtagccttgtcaggcgatgtg

SEQ ID NO: 118337 - DNA, 25 bp, Mus musculus
acctgtaggagcacccagagactga

SEQ ID NO: 118338 - DNA, 25 bp, Mus musculus
acctgtaggagcattgtgtctgtca

SEQ ID NO: 118339 - DNA, 25 bp, Mus musculus
acctgtaggagctcccagagactga

SEQ ID NO: 118340 - DNA, 25 bp, Mus musculus
acctgtaggagctttgtgtctgtca

SEQ ID NO: 118341 - DNA, 25 bp, Mus musculus
acctgtaggatgcagagactctcta

SEQ ID NO: 118342 - DNA, 25 bp, Mus musculus
acctgtaggatggagagactctcta

SEQ ID NO: 118343 - DNA, 25 bp, Mus musculus
acctgtagggcactgcatctggcac

SEQ ID NO: 118344 - DNA, 25 bp, Mus musculus
acctgtagggcagtgcatctggcac

SEQ ID NO: 118345 - DNA, 25 bp, Mus musculus
acctgtagtctcaacacttgggctc

SEQ ID NO: 118346 - DNA, 25 bp, Mus musculus
acctgtagtctctacacttgggctc

SEQ ID NO: 118347 - DNA, 25 bp, Mus musculus
acctgtatcctgagcctgtgacaaa

SEQ ID NO: 118348 - DNA, 25 bp, Mus musculus
acctgtatcctgtgcctgtgacaaa

SEQ ID NO: 118349 - DNA, 25 bp, Mus musculus
acctgtatctttaagtgctgctctg

SEQ ID NO: 118350 - DNA, 25 bp, Mus musculus
acctgtatctttatagtccgatgtc

SEQ ID NO: 118351 - DNA, 25 bp, Mus musculus
acctgtatcttttagtgctgctctg

SEQ ID NO: 118352 - DNA, 25 bp, Mus musculus
acctgtatctttttagtccgatgtc

SEQ ID NO: 118353 - DNA, 25 bp, Mus musculus
acctgtatgttccagtctttcctga

SEQ ID NO: 118354 - DNA, 25 bp, Mus musculus
acctgtatgttcgagtctttcctga

SEQ ID NO: 118355 - DNA, 25 bp, Mus musculus
acctgtattcttatagtatcctaac

SEQ ID NO: 118356 - DNA, 25 bp, Mus musculus
acctgtattcttatgtgatgcccca

SEQ ID NO: 118357 - DNA, 25 bp, Mus musculus
acctgtattcttttagtatcctaac

SEQ ID NO: 118358 - DNA, 25 bp, Mus musculus
acctgtattcttttgtgatgcccca

SEQ ID NO: 118359 - DNA, 25 bp, Mus musculus
acctgtattgccatccaggcagaga

SEQ ID NO: 118360 - DNA, 25 bp, Mus musculus
acctgtattgccttccaggcagaga

SEQ ID NO: 118361 - DNA, 25 bp, Mus musculus
acctgtcaaatcctatgtagtcaac

SEQ ID NO: 118362 - DNA, 25 bp, Mus musculus
acctgtcaaatcgtatgtagtcaac

SEQ ID NO: 118363 - DNA, 25 bp, Mus musculus
acctgtcaaatgctggtttacatat

SEQ ID NO: 118364 - DNA, 25 bp, Mus musculus
acctgtcaaatggtggtttacatat

SEQ ID NO: 118365 - DNA, 25 bp, Mus musculus
acctgtcaacccaatgctaatttca

SEQ ID NO: 118366 - DNA, 25 bp, Mus musculus
acctgtcaaccctatgctaatttca

SEQ ID NO: 118367 - DNA, 25 bp, Mus musculus
acctgtcacacacaacatcagtgca

SEQ ID NO: 118368 - DNA, 25 bp, Mus musculus
acctgtcacacagaacatcagtgca

SEQ ID NO: 118369 - DNA, 25 bp, Mus musculus
acctgtcaccaacgatcacacttat

SEQ ID NO: 118370 - DNA, 25 bp, Mus musculus
acctgtcaccaaggatcacacttat

SEQ ID NO: 118371 - DNA, 25 bp, Mus musculus
acctgtcatcaaattatcctagtat

SEQ ID NO: 118372 - DNA, 25 bp, Mus musculus
acctgtcatcaatttatcctagtat

SEQ ID NO: 118373 - DNA, 25 bp, Mus musculus
acctgtcatctgctgccacgctgtg

SEQ ID NO: 118374 - DNA, 25 bp, Mus musculus
acctgtcatctggtgccacgctgtg

SEQ ID NO: 118375 - DNA, 25 bp, Mus musculus
acctgtcatgttcgctcctaaggaa

SEQ ID NO: 118376 - DNA, 25 bp, Mus musculus
acctgtcatgttggctcctaaggaa

SEQ ID NO: 118377 - DNA, 25 bp, Mus musculus
acctgtccaaacctgtgatttgtat

SEQ ID NO: 118378 - DNA, 25 bp, Mus musculus
acctgtccaaacgtgtgatttgtat

SEQ ID NO: 118379 - DNA, 25 bp, Mus musculus
acctgtccaaggctgcagatagcag

SEQ ID NO: 118380 - DNA, 25 bp, Mus musculus
acctgtccaagggtgcagatagcag

SEQ ID NO: 118381 - DNA, 25 bp, Mus musculus
acctgtccacagacattaagttcta

SEQ ID NO: 118382 - DNA, 25 bp, Mus musculus
acctgtccacagtcattaagttcta

SEQ ID NO: 118383 - DNA, 25 bp, Mus musculus
acctgtccactcaagaacatagcac

SEQ ID NO: 118384 - DNA, 25 bp, Mus musculus
acctgtccactctagaacatagcac

SEQ ID NO: 118385 - DNA, 25 bp, Mus musculus
acctgtccagtgagcttgtgtttca

SEQ ID NO: 118386 - DNA, 25 bp, Mus musculus
acctgtccagtgtgcttgtgtttca

SEQ ID NO: 118387 - DNA, 25 bp, Mus musculus
acctgtcccagcacaagtgagtcag

SEQ ID NO: 118388 - DNA, 25 bp, Mus musculus
acctgtcccagctcaagtgagtcag

SEQ ID NO: 118389 - DNA, 25 bp, Mus musculus
acctgtcccgttagggactgaacat

SEQ ID NO: 118390 - DNA, 25 bp, Mus musculus
acctgtcccgtttgggactgaacat

SEQ ID NO: 118391 - DNA, 25 bp, Mus musculus
acctgtccgccgagcagctgcagga

SEQ ID NO: 118392 - DNA, 25 bp, Mus musculus
acctgtccgccgtgcagctgcagga

SEQ ID NO: 118393 - DNA, 25 bp, Mus musculus
acctgtccggctatacttgtgtgat

SEQ ID NO: 118394 - DNA, 25 bp, Mus musculus
acctgtccggctttacttgtgtgat

SEQ ID NO: 118395 - DNA, 25 bp, Mus musculus
acctgtccgtggatgtccgatgtaa

SEQ ID NO: 118396 - DNA, 25 bp, Mus musculus
acctgtccgtggttgtccgatgtaa

SEQ ID NO: 118397 - DNA, 25 bp, Mus musculus
acctgtcctgacacaaaagggtaca

SEQ ID NO: 118398 - DNA, 25 bp, Mus musculus
acctgtcctgactcaaaagggtaca

SEQ ID NO: 118399 - DNA, 25 bp, Mus musculus
acctgtcctgctacatgaccataat

SEQ ID NO: 118400 - DNA, 25 bp, Mus musculus
acctgtcctgcttcatgaccataat

SEQ ID NO: 118401 - DNA, 25 bp, Mus musculus
acctgtccttgcctgtctatgtgtg

SEQ ID NO: 118402 - DNA, 25 bp, Mus musculus
acctgtccttgcgtgtctatgtgtg

SEQ ID NO: 118403 - DNA, 25 bp, Mus musculus
acctgtcctttactattttgtctct

SEQ ID NO: 118404 - DNA, 25 bp, Mus musculus
acctgtcctttagtattttgtctct

SEQ ID NO: 118405 - DNA, 25 bp, Mus musculus
acctgtcggaagagaggctccccag

SEQ ID NO: 118406 - DNA, 25 bp, Mus musculus
acctgtcggaagtgaggctccccag

SEQ ID NO: 118407 - DNA, 25 bp, Mus musculus
acctgtcggtttactgtgaccacaa

SEQ ID NO: 118408 - DNA, 25 bp, Mus musculus
acctgtcggttttctgtgaccacaa

SEQ ID NO: 118409 - DNA, 25 bp, Mus musculus
acctgtctcagcaaggactcagttt

SEQ ID NO: 118410 - DNA, 25 bp, Mus musculus
acctgtctcagctaggactcagttt

SEQ ID NO: 118411 - DNA, 25 bp, Mus musculus
acctgtctctctacctaaatccaag

SEQ ID NO: 118412 - DNA, 25 bp, Mus musculus
acctgtctctcttcctaaatccaag

SEQ ID NO: 118413 - DNA, 25 bp, Mus musculus
acctgtctctttccttatggccaga

SEQ ID NO: 118414 - DNA, 25 bp, Mus musculus
acctgtctctttgcttatggccaga

SEQ ID NO: 118415 - DNA, 25 bp, Mus musculus
acctgtctgcataggactatgtaga

SEQ ID NO: 118416 - DNA, 25 bp, Mus musculus
acctgtctgcattggactatgtaga

SEQ ID NO: 118417 - DNA, 25 bp, Mus musculus
acctgtctgccgcaggacactgggc

SEQ ID NO: 118418 - DNA, 25 bp, Mus musculus
acctgtctgccggaggacactgggc

SEQ ID NO: 118419 - DNA, 25 bp, Mus musculus
acctgtctggcaataaggtggacct

SEQ ID NO: 118420 - DNA, 25 bp, Mus musculus
acctgtctggcattaaggtggacct

SEQ ID NO: 118421 - DNA, 25 bp, Mus musculus
acctgtctggcgagagtctgttaat

SEQ ID NO: 118422 - DNA, 25 bp, Mus musculus
acctgtctggcgtgagtctgttaat

SEQ ID NO: 118423 - DNA, 25 bp, Mus musculus
acctgtctggtgaacgctggcttct

SEQ ID NO: 118424 - DNA, 25 bp, Mus musculus
acctgtctggtgtacgctggcttct

SEQ ID NO: 118425 - DNA, 25 bp, Mus musculus
acctgtctgtccctgaatctaaaaa

SEQ ID NO: 118426 - DNA, 25 bp, Mus musculus
acctgtctgtccgtgaatctaaaaa

SEQ ID NO: 118427 - DNA, 25 bp, Mus musculus
acctgtctgtgacaccccatgatgg

SEQ ID NO: 118428 - DNA, 25 bp, Mus musculus
acctgtctgtgagaccccatgatgg

SEQ ID NO: 118429 - DNA, 25 bp, Mus musculus
acctgtctgttgcatctgttttgtt

SEQ ID NO: 118430 - DNA, 25 bp, Mus musculus
acctgtctgttggatctgttttgtt

SEQ ID NO: 118431 - DNA, 25 bp, Mus musculus
acctgtcttcctacctattaaaatg

SEQ ID NO: 118432 - DNA, 25 bp, Mus musculus
acctgtcttccttcctattaaaatg

SEQ ID NO: 118433 - DNA, 25 bp, Mus musculus
acctgtcttctgattagatttcctt

SEQ ID NO: 118434 - DNA, 25 bp, Mus musculus
acctgtcttctgtttagatttcctt

SEQ ID NO: 118435 - DNA, 25 bp, Mus musculus
acctgtcttgagacagttgtgaaag

SEQ ID NO: 118436 - DNA, 25 bp, Mus musculus
acctgtcttgagtcagttgtgaaag

SEQ ID NO: 118437 - DNA, 25 bp, Mus musculus
acctgtcttgatcatgtatccctgc

SEQ ID NO: 118438 - DNA, 25 bp, Mus musculus
acctgtcttgatgatgtatccctgc

SEQ ID NO: 118439 - DNA, 25 bp, Mus musculus
acctgtctttctcgcactagagttt

SEQ ID NO: 118440 - DNA, 25 bp, Mus musculus
acctgtctttctggcactagagttt

SEQ ID NO: 118441 - DNA, 25 bp, Mus musculus
acctgtcttttccaacactttgact

SEQ ID NO: 118442 - DNA, 25 bp, Mus musculus
acctgtcttttcgaacactttgact

SEQ ID NO: 118443 - DNA, 25 bp, Mus musculus
acctgtgaagaactcagaggctcct

SEQ ID NO: 118444 - DNA, 25 bp, Mus musculus
acctgtgaagaagtcagaggctcct

SEQ ID NO: 118445 - DNA, 25 bp, Mus musculus
acctgtgaagtgaggtccatctaaa

SEQ ID NO: 118446 - DNA, 25 bp, Mus musculus
acctgtgaagtgtggtccatctaaa

SEQ ID NO: 118447 - DNA, 25 bp, Mus musculus
acctgtgaatgcctctgctgatgga

SEQ ID NO: 118448 - DNA, 25 bp, Mus musculus
acctgtgaatgcgtctgctgatgga

SEQ ID NO: 118449 - DNA, 25 bp, Mus musculus
acctgtgaattaacagcccggcaac

SEQ ID NO: 118450 - DNA, 25 bp, Mus musculus
acctgtgaattatcagcccggcaac

SEQ ID NO: 118451 - DNA, 25 bp, Mus musculus
acctgtgaccaaaagttaagtagca

SEQ ID NO: 118452 - DNA, 25 bp, Mus musculus
acctgtgaccaatagttaagtagca

SEQ ID NO: 118453 - DNA, 25 bp, Mus musculus
acctgtgaccacaagaaattttgat

SEQ ID NO: 118454 - DNA, 25 bp, Mus musculus
acctgtgaccactagaaattttgat

SEQ ID NO: 118455 - DNA, 25 bp, Mus musculus
acctgtgacccaaaagcctctgcaa

SEQ ID NO: 118456 - DNA, 25 bp, Mus musculus
acctgtgacccataagcctctgcaa

SEQ ID NO: 118457 - DNA, 25 bp, Mus musculus
acctgtgaccctctgctgaggaact

SEQ ID NO: 118458 - DNA, 25 bp, Mus musculus
acctgtgaccctgtgctgaggaact

SEQ ID NO: 118459 - DNA, 25 bp, Mus musculus
acctgtgacgatccctcaggcaata

SEQ ID NO: 118460 - DNA, 25 bp, Mus musculus
acctgtgacgatgcctcaggcaata

SEQ ID NO: 118461 - DNA, 25 bp, Mus musculus
acctgtgacgcccagctgtggatcg

SEQ ID NO: 118462 - DNA, 25 bp, Mus musculus
acctgtgacgccgagctgtggatcg

SEQ ID NO: 118463 - DNA, 25 bp, Mus musculus
acctgtgactataaaatctctctga

SEQ ID NO: 118464 - DNA, 25 bp, Mus musculus
acctgtgactattaaatctctctga

SEQ ID NO: 118465 - DNA, 25 bp, Mus musculus
acctgtgactgcagctccagagaat

SEQ ID NO: 118466 - DNA, 25 bp, Mus musculus
acctgtgactgctgctccagagaat

SEQ ID NO: 118467 - DNA, 25 bp, Mus musculus
acctgtgactgtcccaacatcatca

SEQ ID NO: 118468 - DNA, 25 bp, Mus musculus
acctgtgactgtgccaacatcatca

SEQ ID NO: 118469 - DNA, 25 bp, Mus musculus
acctgtgactttagctgtaagcctt

SEQ ID NO: 118470 - DNA, 25 bp, Mus musculus
acctgtgacttttgctgtaagcctt

SEQ ID NO: 118471 - DNA, 25 bp, Mus musculus
acctgtgagagaactctgtgccatt

SEQ ID NO: 118472 - DNA, 25 bp, Mus musculus
acctgtgagagatctctgtgccatt

SEQ ID NO: 118473 - DNA, 25 bp, Mus musculus
acctgtgagagtaggttctgtccac

SEQ ID NO: 118474 - DNA, 25 bp, Mus musculus
acctgtgagagttggttctgtccac

SEQ ID NO: 118475 - DNA, 25 bp, Mus musculus
acctgtgagatcattgcctgtggcc

SEQ ID NO: 118476 - DNA, 25 bp, Mus musculus
acctgtgagatctttgcctgtggcc

SEQ ID NO: 118477 - DNA, 25 bp, Mus musculus
acctgtgagatgacttctccctcat

SEQ ID NO: 118478 - DNA, 25 bp, Mus musculus
acctgtgagatgtcttctccctcat

SEQ ID NO: 118479 - DNA, 25 bp, Mus musculus
acctgtgagcatctgtttgaatgta

SEQ ID NO: 118480 - DNA, 25 bp, Mus musculus
acctgtgagcatgtgtttgaatgta

SEQ ID NO: 118481 - DNA, 25 bp, Mus musculus
acctgtgagctactgttggctgctg

SEQ ID NO: 118482 - DNA, 25 bp, Mus musculus
acctgtgagctagtgttggctgctg

SEQ ID NO: 118483 - DNA, 25 bp, Mus musculus
acctgtgaggtgatgggacctacct

SEQ ID NO: 118484 - DNA, 25 bp, Mus musculus
acctgtgaggtgttgggacctacct

SEQ ID NO: 118485 - DNA, 25 bp, Mus musculus
acctgtgatcgcaccatccgagttt

SEQ ID NO: 118486 - DNA, 25 bp, Mus musculus
acctgtgatcgctccatccgagttt

SEQ ID NO: 118487 - DNA, 25 bp, Mus musculus
acctgtgatcttcccagaggtttaa

SEQ ID NO: 118488 - DNA, 25 bp, Mus musculus
acctgtgatcttgccagaggtttaa

SEQ ID NO: 118489 - DNA, 25 bp, Mus musculus
acctgtgattccaggtgttagggca

SEQ ID NO: 118490 - DNA, 25 bp, Mus musculus
acctgtgattcctggtgttagggca

SEQ ID NO: 118491 - DNA, 25 bp, Mus musculus
acctgtgatttgcaagtattgtaaa

SEQ ID NO: 118492 - DNA, 25 bp, Mus musculus
acctgtgatttggaagtattgtaaa

SEQ ID NO: 118493 - DNA, 25 bp, Mus musculus
acctgtgcaatgacaacggggccca

SEQ ID NO: 118494 - DNA, 25 bp, Mus musculus
acctgtgcaatgtcaacggggccca

SEQ ID NO: 118495 - DNA, 25 bp, Mus musculus
acctgtgcagcaaaatgaagttcca

SEQ ID NO: 118496 - DNA, 25 bp, Mus musculus
acctgtgcagcactaacaaactgta

SEQ ID NO: 118497 - DNA, 25 bp, Mus musculus
acctgtgcagcagtaacaaactgta

SEQ ID NO: 118498 - DNA, 25 bp, Mus musculus
acctgtgcagcataatgaagttcca

SEQ ID NO: 118499 - DNA, 25 bp, Mus musculus
acctgtgcatacagtgagcgacctt

SEQ ID NO: 118500 - DNA, 25 bp, Mus musculus
acctgtgcatactgtgagcgacctt

SEQ ID NO: 118501 - DNA, 25 bp, Mus musculus
acctgtgcatatagttctgtgtgtg

SEQ ID NO: 118502 - DNA, 25 bp, Mus musculus
acctgtgcatattgttctgtgtgtg

SEQ ID NO: 118503 - DNA, 25 bp, Mus musculus
acctgtgcatttcgcgacttactgt

SEQ ID NO: 118504 - DNA, 25 bp, Mus musculus
acctgtgcatttggcgacttactgt

SEQ ID NO: 118505 - DNA, 25 bp, Mus musculus
acctgtgccagacgctcgcagaata

SEQ ID NO: 118506 - DNA, 25 bp, Mus musculus
acctgtgccagaggctcgcagaata

SEQ ID NO: 118507 - DNA, 25 bp, Mus musculus
acctgtgccagccagtcggcctaag

SEQ ID NO: 118508 - DNA, 25 bp, Mus musculus
acctgtgccagcgagtcggcctaag

SEQ ID NO: 118509 - DNA, 25 bp, Mus musculus
acctgtgccaggcactaatattctg

SEQ ID NO: 118510 - DNA, 25 bp, Mus musculus
acctgtgccagggactaatattctg

SEQ ID NO: 118511 - DNA, 25 bp, Mus musculus
acctgtgcccacagtttactgggaa

SEQ ID NO: 118512 - DNA, 25 bp, Mus musculus
acctgtgcccactgtttactgggaa

SEQ ID NO: 118513 - DNA, 25 bp, Mus musculus
acctgtgcccatcttgaggcattgg

SEQ ID NO: 118514 - DNA, 25 bp, Mus musculus
acctgtgcccatgttgaggcattgg

SEQ ID NO: 118515 - DNA, 25 bp, Mus musculus
acctgtgccgagacaagttctccaa

SEQ ID NO: 118516 - DNA, 25 bp, Mus musculus
acctgtgccgagtcaagttctccaa

SEQ ID NO: 118517 - DNA, 25 bp, Mus musculus
acctgtgcctccaagtgatgttctg

SEQ ID NO: 118518 - DNA, 25 bp, Mus musculus
acctgtgcctcctagtgatgttctg

SEQ ID NO: 118519 - DNA, 25 bp, Mus musculus
acctgtgcctctagcaaatgctgta

SEQ ID NO: 118520 - DNA, 25 bp, Mus musculus
acctgtgcctcttgcaaatgctgta

SEQ ID NO: 118521 - DNA, 25 bp, Mus musculus
acctgtgcggagacactagttctgg

SEQ ID NO: 118522 - DNA, 25 bp, Mus musculus
acctgtgcggagtcactagttctgg

SEQ ID NO: 118523 - DNA, 25 bp, Mus musculus
acctgtgctcatataccgtgtgtgg

SEQ ID NO: 118524 - DNA, 25 bp, Mus musculus
acctgtgctcatttaccgtgtgtgg

SEQ ID NO: 118525 - DNA, 25 bp, Mus musculus
acctgtgctgccctaaagccaaact

SEQ ID NO: 118526 - DNA, 25 bp, Mus musculus
acctgtgctgccgtaaagccaaact

SEQ ID NO: 118527 - DNA, 25 bp, Mus musculus
acctgtgctgttacccttgtagtga

SEQ ID NO: 118528 - DNA, 25 bp, Mus musculus
acctgtgctgtttcccttgtagtga

SEQ ID NO: 118529 - DNA, 25 bp, Mus musculus
acctgtgcttctcagcccagactat

SEQ ID NO: 118530 - DNA, 25 bp, Mus musculus
acctgtgcttctgagcccagactat

SEQ ID NO: 118531 - DNA, 25 bp, Mus musculus
acctgtggaagaatattgttctttt

SEQ ID NO: 118532 - DNA, 25 bp, Mus musculus
acctgtggaagattattgttctttt

SEQ ID NO: 118533 - DNA, 25 bp, Mus musculus
acctgtggaatgctacctgcttcta

SEQ ID NO: 118534 - DNA, 25 bp, Mus musculus
acctgtggaatggtacctgcttcta

SEQ ID NO: 118535 - DNA, 25 bp, Mus musculus
acctgtggaattcgcaacttactgc

SEQ ID NO: 118536 - DNA, 25 bp, Mus musculus
acctgtggaattggcaacttactgc

SEQ ID NO: 118537 - DNA, 25 bp, Mus musculus
acctgtggactgagacttgcagagc

SEQ ID NO: 118538 - DNA, 25 bp, Mus musculus
acctgtggactgtgacttgcagagc

SEQ ID NO: 118539 - DNA, 25 bp, Mus musculus
acctgtggagatacctaagtttcta

SEQ ID NO: 118540 - DNA, 25 bp, Mus musculus
acctgtggagattcctaagtttcta

SEQ ID NO: 118541 - DNA, 25 bp, Mus musculus
acctgtggatccattcatcaactgg

SEQ ID NO: 118542 - DNA, 25 bp, Mus musculus
acctgtggatcctttcatcaactgg

SEQ ID NO: 118543 - DNA, 25 bp, Mus musculus
acctgtggccacctagaagatcagt

SEQ ID NO: 118544 - DNA, 25 bp, Mus musculus
acctgtggccacgtagaagatcagt

SEQ ID NO: 118545 - DNA, 25 bp, Mus musculus
acctgtggctacctgtaccaaagag

SEQ ID NO: 118546 - DNA, 25 bp, Mus musculus
acctgtggctacgtgtaccaaagag

SEQ ID NO: 118547 - DNA, 25 bp, Mus musculus
acctgtggctggaggttctctgctc

SEQ ID NO: 118548 - DNA, 25 bp, Mus musculus
acctgtggctggtggttctctgctc

SEQ ID NO: 118549 - DNA, 25 bp, Mus musculus
acctgtggctgtccatggtacccat

SEQ ID NO: 118550 - DNA, 25 bp, Mus musculus
acctgtggctgtgcatggtacccat

SEQ ID NO: 118551 - DNA, 25 bp, Mus musculus
acctgtggcttcaacatgtcataaa

SEQ ID NO: 118552 - DNA, 25 bp, Mus musculus
acctgtggcttctacatgtcataaa

SEQ ID NO: 118553 - DNA, 25 bp, Mus musculus
acctgtggctttcattctggtgaat

SEQ ID NO: 118554 - DNA, 25 bp, Mus musculus
acctgtggctttgattctggtgaat

SEQ ID NO: 118555 - DNA, 25 bp, Mus musculus
acctgtgggaacctgtgggtcatcc

SEQ ID NO: 118556 - DNA, 25 bp, Mus musculus
acctgtgggaacgtgtgggtcatcc

SEQ ID NO: 118557 - DNA, 25 bp, Mus musculus
acctgtgggcttccaacattatcca

SEQ ID NO: 118558 - DNA, 25 bp, Mus musculus
acctgtgggcttgcaacattatcca

SEQ ID NO: 118559 - DNA, 25 bp, Mus musculus
acctgtgggttcaaaggagctgcaa

SEQ ID NO: 118560 - DNA, 25 bp, Mus musculus
acctgtgggttctaaggagctgcaa

SEQ ID NO: 118561 - DNA, 25 bp, Mus musculus
acctgtggtaccagctcagatttat

SEQ ID NO: 118562 - DNA, 25 bp, Mus musculus
acctgtggtacctgctcagatttat

SEQ ID NO: 118563 - DNA, 25 bp, Mus musculus
acctgtggtcttcctcagagctagt

SEQ ID NO: 118564 - DNA, 25 bp, Mus musculus
acctgtggtcttgctcagagctagt

SEQ ID NO: 118565 - DNA, 25 bp, Mus musculus
acctgtggtgagcttctgcattctt

SEQ ID NO: 118566 - DNA, 25 bp, Mus musculus
acctgtggtgaggttctgcattctt

SEQ ID NO: 118567 - DNA, 25 bp, Mus musculus
acctgtggttagctgtattgactgg

SEQ ID NO: 118568 - DNA, 25 bp, Mus musculus
acctgtggttaggtgtattgactgg

SEQ ID NO: 118569 - DNA, 25 bp, Mus musculus
acctgtgtaagaagctagccgtggc

SEQ ID NO: 118570 - DNA, 25 bp, Mus musculus
acctgtgtaagatgctagccgtggc

SEQ ID NO: 118571 - DNA, 25 bp, Mus musculus
acctgtgtacctcagtctccagaaa

SEQ ID NO: 118572 - DNA, 25 bp, Mus musculus
acctgtgtacctgagtctccagaaa

SEQ ID NO: 118573 - DNA, 25 bp, Mus musculus
acctgtgtactaagcccagcaaaag

SEQ ID NO: 118574 - DNA, 25 bp, Mus musculus
acctgtgtactatgcccagcaaaag

SEQ ID NO: 118575 - DNA, 25 bp, Mus musculus
acctgtgtagtcacagactctggag

SEQ ID NO: 118576 - DNA, 25 bp, Mus musculus
acctgtgtagtctcagactctggag

SEQ ID NO: 118577 - DNA, 25 bp, Mus musculus
acctgtgtcaatcctgtgcatttgt

SEQ ID NO: 118578 - DNA, 25 bp, Mus musculus
acctgtgtcaatgctgtgcatttgt

SEQ ID NO: 118579 - DNA, 25 bp, Mus musculus
acctgtgtccaaccatgtagatgaa

SEQ ID NO: 118580 - DNA, 25 bp, Mus musculus
acctgtgtccaagcatgtagatgaa

SEQ ID NO: 118581 - DNA, 25 bp, Mus musculus
acctgtgtccatatgtggcagcttt

SEQ ID NO: 118582 - DNA, 25 bp, Mus musculus
acctgtgtccatttgtggcagcttt

SEQ ID NO: 118583 - DNA, 25 bp, Mus musculus
acctgtgtctccacatactgacata

SEQ ID NO: 118584 - DNA, 25 bp, Mus musculus
acctgtgtctcctcatactgacata

SEQ ID NO: 118585 - DNA, 25 bp, Mus musculus
acctgtgtgcgtagcaagttctaga

SEQ ID NO: 118586 - DNA, 25 bp, Mus musculus
acctgtgtgcgttgcaagttctaga

SEQ ID NO: 118587 - DNA, 25 bp, Mus musculus
acctgtgtgctcaggagaccaatgt

SEQ ID NO: 118588 - DNA, 25 bp, Mus musculus
acctgtgtgctctggagaccaatgt

SEQ ID NO: 118589 - DNA, 25 bp, Mus musculus
acctgtgtggcaaatggcttctcga

SEQ ID NO: 118590 - DNA, 25 bp, Mus musculus
acctgtgtggcatatggcttctcga

SEQ ID NO: 118591 - DNA, 25 bp, Mus musculus
acctgtgtgtcccttgctggttaga

SEQ ID NO: 118592 - DNA, 25 bp, Mus musculus
acctgtgtgtccgttgctggttaga

SEQ ID NO: 118593 - DNA, 25 bp, Mus musculus
acctgtgttaacacttgtcacactg

SEQ ID NO: 118594 - DNA, 25 bp, Mus musculus
acctgtgttaactcttgtcacactg

SEQ ID NO: 118595 - DNA, 25 bp, Mus musculus
acctgtgttaatctaggcctgtcac

SEQ ID NO: 118596 - DNA, 25 bp, Mus musculus
acctgtgttaatgtaggcctgtcac

SEQ ID NO: 118597 - DNA, 25 bp, Mus musculus
acctgtgttcaacttcaagtactgt

SEQ ID NO: 118598 - DNA, 25 bp, Mus musculus
acctgtgttcaagttcaagtactgt

SEQ ID NO: 118599 - DNA, 25 bp, Mus musculus
acctgtgttccaccctggagtcaag

SEQ ID NO: 118600 - DNA, 25 bp, Mus musculus
acctgtgttccagcctggagtcaag

SEQ ID NO: 118601 - DNA, 25 bp, Mus musculus
acctgtgttcggctgcgataactag

SEQ ID NO: 118602 - DNA, 25 bp, Mus musculus
acctgtgttcgggtgcgataactag

SEQ ID NO: 118603 - DNA, 25 bp, Mus musculus
acctgtgttcttaaactcttggatt

SEQ ID NO: 118604 - DNA, 25 bp, Mus musculus
acctgtgttcttccctattcttagc

SEQ ID NO: 118605 - DNA, 25 bp, Mus musculus
acctgtgttcttgcctattcttagc

SEQ ID NO: 118606 - DNA, 25 bp, Mus musculus
acctgtgttctttaactcttggatt

SEQ ID NO: 118607 - DNA, 25 bp, Mus musculus
acctgtgttggcctagctcctgaaa

SEQ ID NO: 118608 - DNA, 25 bp, Mus musculus
acctgtgttggcgtagctcctgaaa

SEQ ID NO: 118609 - DNA, 25 bp, Mus musculus
acctgtgttgggagtgttttgtcac

SEQ ID NO: 118610 - DNA, 25 bp, Mus musculus
acctgtgttgggtgtgttttgtcac

SEQ ID NO: 118611 - DNA, 25 bp, Mus musculus
acctgtgtttaacctgtttccattg

SEQ ID NO: 118612 - DNA, 25 bp, Mus musculus
acctgtgtttaagctgtttccattg

SEQ ID NO: 118613 - DNA, 25 bp, Mus musculus
acctgtgtttccatgcttcatagat

SEQ ID NO: 118614 - DNA, 25 bp, Mus musculus
acctgtgtttccttgcttcatagat

SEQ ID NO: 118615 - DNA, 25 bp, Mus musculus
acctgttacacccactgtcaataac

SEQ ID NO: 118616 - DNA, 25 bp, Mus musculus
acctgttacaccgactgtcaataac

SEQ ID NO: 118617 - DNA, 25 bp, Mus musculus
acctgttacggaaggtgcttctggg

SEQ ID NO: 118618 - DNA, 25 bp, Mus musculus
acctgttacggatggtgcttctggg

SEQ ID NO: 118619 - DNA, 25 bp, Mus musculus
acctgttatactaaatcatacacta

SEQ ID NO: 118620 - DNA, 25 bp, Mus musculus
acctgttatacttaatcatacacta

SEQ ID NO: 118621 - DNA, 25 bp, Mus musculus
acctgttcaaatcattctgctctga

SEQ ID NO: 118622 - DNA, 25 bp, Mus musculus
acctgttcaaatgattctgctctga

SEQ ID NO: 118623 - DNA, 25 bp, Mus musculus
acctgttcatctagtcattttctca

SEQ ID NO: 118624 - DNA, 25 bp, Mus musculus
acctgttcatcttgtcattttctca

SEQ ID NO: 118625 - DNA, 25 bp, Mus musculus
acctgttcattcctcccagtggaga

SEQ ID NO: 118626 - DNA, 25 bp, Mus musculus
acctgttcattcgtcccagtggaga

SEQ ID NO: 118627 - DNA, 25 bp, Mus musculus
acctgttccagccagggtctaccag

SEQ ID NO: 118628 - DNA, 25 bp, Mus musculus
acctgttccagcgagggtctaccag

SEQ ID NO: 118629 - DNA, 25 bp, Mus musculus
acctgttcccttagacaagctgtag

SEQ ID NO: 118630 - DNA, 25 bp, Mus musculus
acctgttccctttgacaagctgtag

SEQ ID NO: 118631 - DNA, 25 bp, Mus musculus
acctgttctagaagccattcttttt

SEQ ID NO: 118632 - DNA, 25 bp, Mus musculus
acctgttctagatgccattcttttt

SEQ ID NO: 118633 - DNA, 25 bp, Mus musculus
acctgttctgccactgtgaacaaga

SEQ ID NO: 118634 - DNA, 25 bp, Mus musculus
acctgttctgcctctgtgaacaaga

SEQ ID NO: 118635 - DNA, 25 bp, Mus musculus
acctgttgaactcttacgtacattc

SEQ ID NO: 118636 - DNA, 25 bp, Mus musculus
acctgttgaactgttacgtacattc

SEQ ID NO: 118637 - DNA, 25 bp, Mus musculus
acctgttgagctcgattccttaggg

SEQ ID NO: 118638 - DNA, 25 bp, Mus musculus
acctgttgagctggattccttaggg

SEQ ID NO: 118639 - DNA, 25 bp, Mus musculus
acctgttgaggcaggccatcacaaa

SEQ ID NO: 118640 - DNA, 25 bp, Mus musculus
acctgttgaggctggccatcacaaa

SEQ ID NO: 118641 - DNA, 25 bp, Mus musculus
acctgttgatacagcggtgggcatc

SEQ ID NO: 118642 - DNA, 25 bp, Mus musculus
acctgttgatactgcggtgggcatc

SEQ ID NO: 118643 - DNA, 25 bp, Mus musculus
acctgttgccagacagtccaatggg

SEQ ID NO: 118644 - DNA, 25 bp, Mus musculus
acctgttgccagtcagtccaatggg

SEQ ID NO: 118645 - DNA, 25 bp, Mus musculus
acctgttgccggaactgaccagata

SEQ ID NO: 118646 - DNA, 25 bp, Mus musculus
acctgttgccggtactgaccagata

SEQ ID NO: 118647 - DNA, 25 bp, Mus musculus
acctgttgcctgactggtcttaaaa

SEQ ID NO: 118648 - DNA, 25 bp, Mus musculus
acctgttgcctgtctggtcttaaaa

SEQ ID NO: 118649 - DNA, 25 bp, Mus musculus
acctgttgctgtcagggttacctat

SEQ ID NO: 118650 - DNA, 25 bp, Mus musculus
acctgttgctgtgagggttacctat

SEQ ID NO: 118651 - DNA, 25 bp, Mus musculus
acctgttgggacattggatgtgtcc

SEQ ID NO: 118652 - DNA, 25 bp, Mus musculus
acctgttgggactttggatgtgtcc

SEQ ID NO: 118653 - DNA, 25 bp, Mus musculus
acctgttgggttactctgtaggtgc

SEQ ID NO: 118654 - DNA, 25 bp, Mus musculus
acctgttgggtttctctgtaggtgc

SEQ ID NO: 118655 - DNA, 25 bp, Mus musculus
acctgttggttgacttgtttcctgg

SEQ ID NO: 118656 - DNA, 25 bp, Mus musculus
acctgttggttgtcttgtttcctgg

SEQ ID NO: 118657 - DNA, 25 bp, Mus musculus
acctgttgtctgaactttgttgttt

SEQ ID NO: 118658 - DNA, 25 bp, Mus musculus
acctgttgtctgtactttgttgttt

SEQ ID NO: 118659 - DNA, 25 bp, Mus musculus
acctgttgtgtgcattctgtattct

SEQ ID NO: 118660 - DNA, 25 bp, Mus musculus
acctgttgtgtggattctgtattct

SEQ ID NO: 118661 - DNA, 25 bp, Mus musculus
acctgttgtgttctgtagagggcct

SEQ ID NO: 118662 - DNA, 25 bp, Mus musculus
acctgttgtgttgtgtagagggcct

SEQ ID NO: 118663 - DNA, 25 bp, Mus musculus
acctgttgttacaacctttcactga

SEQ ID NO: 118664 - DNA, 25 bp, Mus musculus
acctgttgttactacctttcactga

SEQ ID NO: 118665 - DNA, 25 bp, Mus musculus
acctgtttaattagtaatgtgttgc

SEQ ID NO: 118666 - DNA, 25 bp, Mus musculus
acctgtttaatttgtaatgtgttgc

SEQ ID NO: 118667 - DNA, 25 bp, Mus musculus
acctgtttacaacagactgtgccct

SEQ ID NO: 118668 - DNA, 25 bp, Mus musculus
acctgtttacaagagactgtgccct

SEQ ID NO: 118669 - DNA, 25 bp, Mus musculus
acctgtttacatcaagttactcgcg

SEQ ID NO: 118670 - DNA, 25 bp, Mus musculus
acctgtttacatgaagttactcgcg

SEQ ID NO: 118671 - DNA, 25 bp, Mus musculus
acctgtttccagcacaaactccatg

SEQ ID NO: 118672 - DNA, 25 bp, Mus musculus
acctgtttccaggacaaactccatg

SEQ ID NO: 118673 - DNA, 25 bp, Mus musculus
acctgtttcctacagccttggagaa

SEQ ID NO: 118674 - DNA, 25 bp, Mus musculus
acctgtttcctagagccttggagaa

SEQ ID NO: 118675 - DNA, 25 bp, Mus musculus
acctgtttctgaaccatttgtacca

SEQ ID NO: 118676 - DNA, 25 bp, Mus musculus
acctgtttctgatccatttgtacca

SEQ ID NO: 118677 - DNA, 25 bp, Mus musculus
acctgtttctgtatgacacatgaca

SEQ ID NO: 118678 - DNA, 25 bp, Mus musculus
acctgtttctgtttgacacatgaca

SEQ ID NO: 118679 - DNA, 25 bp, Mus musculus
acctgtttcttcagctgtacttttt

SEQ ID NO: 118680 - DNA, 25 bp, Mus musculus
acctgtttcttcaggattgcttata

SEQ ID NO: 118681 - DNA, 25 bp, Mus musculus
acctgtttcttctgctgtacttttt

SEQ ID NO: 118682 - DNA, 25 bp, Mus musculus
acctgtttcttctggattgcttata

SEQ ID NO: 118683 - DNA, 25 bp, Mus musculus
acctgtttgaacaccataatgctga

SEQ ID NO: 118684 - DNA, 25 bp, Mus musculus
acctgtttgaactccataatgctga

SEQ ID NO: 118685 - DNA, 25 bp, Mus musculus
acctgtttgtagacttggctgctaa

SEQ ID NO: 118686 - DNA, 25 bp, Mus musculus
acctgtttgtagtcttggctgctaa

SEQ ID NO: 118687 - DNA, 25 bp, Mus musculus
acctgtttgttgagtctttggagtc

SEQ ID NO: 118688 - DNA, 25 bp, Mus musculus
acctgtttgttgtgtctttggagtc

SEQ ID NO: 118689 - DNA, 25 bp, Mus musculus
acctgttttaacagcctatgtgtac

SEQ ID NO: 118690 - DNA, 25 bp, Mus musculus
acctgttttaactgcctatgtgtac

SEQ ID NO: 118691 - DNA, 25 bp, Mus musculus
acctgttttcccaggtattgggcat

SEQ ID NO: 118692 - DNA, 25 bp, Mus musculus
acctgttttccctggtattgggcat

SEQ ID NO: 118693 - DNA, 25 bp, Mus musculus
acctgttttcttactgattgttgtg

SEQ ID NO: 118694 - DNA, 25 bp, Mus musculus
acctgttttctttctgattgttgtg

SEQ ID NO: 118695 - DNA, 25 bp, Mus musculus
acctgttttgacctcgtgagtgtca

SEQ ID NO: 118696 - DNA, 25 bp, Mus musculus
acctgttttgacgtcgtgagtgtca

SEQ ID NO: 118697 - DNA, 25 bp, Mus musculus
accttaaaggccactctgtactctt

SEQ ID NO: 118698 - DNA, 25 bp, Mus musculus
accttaaaggcctctctgtactctt

SEQ ID NO: 118699 - DNA, 25 bp, Mus musculus
accttaaattcaagctgcgtgtaaa

SEQ ID NO: 118700 - DNA, 25 bp, Mus musculus
accttaaattcatgctgcgtgtaaa

SEQ ID NO: 118701 - DNA, 25 bp, Mus musculus
accttaacggccagtggctctctca

SEQ ID NO: 118702 - DNA, 25 bp, Mus musculus
accttaacggcctgtggctctctca

SEQ ID NO: 118703 - DNA, 25 bp, Mus musculus
accttaactcttatgaattcctgag

SEQ ID NO: 118704 - DNA, 25 bp, Mus musculus
accttaactcttttgaattcctgag

SEQ ID NO: 118705 - DNA, 25 bp, Mus musculus
accttaagccttactcagatcaaat

SEQ ID NO: 118706 - DNA, 25 bp, Mus musculus
accttaagcctttctcagatcaaat

SEQ ID NO: 118707 - DNA, 25 bp, Mus musculus
accttaaggtggcttcttggttgct

SEQ ID NO: 118708 - DNA, 25 bp, Mus musculus
accttaaggtgggttcttggttgct

SEQ ID NO: 118709 - DNA, 25 bp, Mus musculus
accttaagtggtctctggtggccat

SEQ ID NO: 118710 - DNA, 25 bp, Mus musculus
accttaagtggtgtctggtggccat

SEQ ID NO: 118711 - DNA, 25 bp, Mus musculus
accttaagtgtgaggcatgtgttgc

SEQ ID NO: 118712 - DNA, 25 bp, Mus musculus
accttaagtgtgtggcatgtgttgc

SEQ ID NO: 118713 - DNA, 25 bp, Mus musculus
accttaagttgaacatgagttgtaa

SEQ ID NO: 118714 - DNA, 25 bp, Mus musculus
accttaagttgatcatgagttgtaa

SEQ ID NO: 118715 - DNA, 25 bp, Mus musculus
accttaagtttgcacttcagctccc

SEQ ID NO: 118716 - DNA, 25 bp, Mus musculus
accttaagtttggacttcagctccc

SEQ ID NO: 118717 - DNA, 25 bp, Mus musculus
accttaatgcttatccggtgtgctt

SEQ ID NO: 118718 - DNA, 25 bp, Mus musculus
accttaatgcttttccggtgtgctt

SEQ ID NO: 118719 - DNA, 25 bp, Mus musculus
accttaatgtttctggtctcttcag

SEQ ID NO: 118720 - DNA, 25 bp, Mus musculus
accttaatgtttgtggtctcttcag

SEQ ID NO: 118721 - DNA, 25 bp, Mus musculus
accttaattattaccaatgaacttg

SEQ ID NO: 118722 - DNA, 25 bp, Mus musculus
accttaattatttccaatgaacttg

SEQ ID NO: 118723 - DNA, 25 bp, Mus musculus
accttacactatacacttcacttaa

SEQ ID NO: 118724 - DNA, 25 bp, Mus musculus
accttacactattcacttcacttaa

SEQ ID NO: 118725 - DNA, 25 bp, Mus musculus
accttacattccactgggtcatagc

SEQ ID NO: 118726 - DNA, 25 bp, Mus musculus
accttacattcctctgggtcatagc

SEQ ID NO: 118727 - DNA, 25 bp, Mus musculus
accttaccaaagactctatccattg

SEQ ID NO: 118728 - DNA, 25 bp, Mus musculus
accttaccaaagtctctatccattg

SEQ ID NO: 118729 - DNA, 25 bp, Mus musculus
accttaccaggcatgagagaactca

SEQ ID NO: 118730 - DNA, 25 bp, Mus musculus
accttaccaggcttgagagaactca

SEQ ID NO: 118731 - DNA, 25 bp, Mus musculus
accttaccctgactgactgtgaacc

SEQ ID NO: 118732 - DNA, 25 bp, Mus musculus
accttaccctgagtgactgtgaacc

SEQ ID NO: 118733 - DNA, 25 bp, Mus musculus
accttaccgtgaatccaggcagtgg

SEQ ID NO: 118734 - DNA, 25 bp, Mus musculus
accttaccgtgattccaggcagtgg

SEQ ID NO: 118735 - DNA, 25 bp, Mus musculus
accttacctaccacataagcttgtt

SEQ ID NO: 118736 - DNA, 25 bp, Mus musculus
accttacctacctcataagcttgtt

SEQ ID NO: 118737 - DNA, 25 bp, Mus musculus
accttacgtaatcaccgtgctgggt

SEQ ID NO: 118738 - DNA, 25 bp, Mus musculus
accttacgtaatgaccgtgctgggt

SEQ ID NO: 118739 - DNA, 25 bp, Mus musculus
accttactcctgagactcctcttaa

SEQ ID NO: 118740 - DNA, 25 bp, Mus musculus
accttactcctgtgactcctcttaa

SEQ ID NO: 118741 - DNA, 25 bp, Mus musculus
accttactgctccagatggtccaag

SEQ ID NO: 118742 - DNA, 25 bp, Mus musculus
accttactgctcgagatggtccaag

SEQ ID NO: 118743 - DNA, 25 bp, Mus musculus
accttactttatccatgtttatgac

SEQ ID NO: 118744 - DNA, 25 bp, Mus musculus
accttactttatgcatgtttatgac

SEQ ID NO: 118745 - DNA, 25 bp, Mus musculus
accttagatctcactcagcaacaag

SEQ ID NO: 118746 - DNA, 25 bp, Mus musculus
accttagatctctctcagcaacaag

SEQ ID NO: 118747 - DNA, 25 bp, Mus musculus
accttagatgttagatggccagcac

SEQ ID NO: 118748 - DNA, 25 bp, Mus musculus
accttagatgtttgatggccagcac

SEQ ID NO: 118749 - DNA, 25 bp, Mus musculus
accttagattgtctttcatgagacc

SEQ ID NO: 118750 - DNA, 25 bp, Mus musculus
accttagattgtgtttcatgagacc

SEQ ID NO: 118751 - DNA, 25 bp, Mus musculus
accttagcactaaagaggcactttc

SEQ ID NO: 118752 - DNA, 25 bp, Mus musculus
accttagcactatagaggcactttc

SEQ ID NO: 118753 - DNA, 25 bp, Mus musculus
accttagcattgactggcactgtga

SEQ ID NO: 118754 - DNA, 25 bp, Mus musculus
accttagcattgtctggcactgtga

SEQ ID NO: 118755 - DNA, 25 bp, Mus musculus
accttagccatgctcatcagcttga

SEQ ID NO: 118756 - DNA, 25 bp, Mus musculus
accttagccatggtcatcagcttga

SEQ ID NO: 118757 - DNA, 25 bp, Mus musculus
accttagcggtgcttgctgagcttt

SEQ ID NO: 118758 - DNA, 25 bp, Mus musculus
accttagcggtggttgctgagcttt

SEQ ID NO: 118759 - DNA, 25 bp, Mus musculus
accttagctaatctggtcggtataa

SEQ ID NO: 118760 - DNA, 25 bp, Mus musculus
accttagctaatgtggtcggtataa

SEQ ID NO: 118761 - DNA, 25 bp, Mus musculus
accttagctgtgaactgatatcaaa

SEQ ID NO: 118762 - DNA, 25 bp, Mus musculus
accttagctgtgtactgatatcaaa

SEQ ID NO: 118763 - DNA, 25 bp, Mus musculus
accttagcttgaatatccttctctc

SEQ ID NO: 118764 - DNA, 25 bp, Mus musculus
accttagcttgattatccttctctc

SEQ ID NO: 118765 - DNA, 25 bp, Mus musculus
accttaggcagacgccggagttcca

SEQ ID NO: 118766 - DNA, 25 bp, Mus musculus
accttaggcagaggccggagttcca

SEQ ID NO: 118767 - DNA, 25 bp, Mus musculus
accttagggaccaatgtcaggccct

SEQ ID NO: 118768 - DNA, 25 bp, Mus musculus
accttagggacctatgtcaggccct

SEQ ID NO: 118769 - DNA, 25 bp, Mus musculus
accttagggctacatcctggacatg

SEQ ID NO: 118770 - DNA, 25 bp, Mus musculus
accttagggctagatcctggacatg

SEQ ID NO: 118771 - DNA, 25 bp, Mus musculus
accttagtctgaacaatgttgtgtg

SEQ ID NO: 118772 - DNA, 25 bp, Mus musculus
accttagtctgatcaatgttgtgtg

SEQ ID NO: 118773 - DNA, 25 bp, Mus musculus
accttagtgaggctgtctttagacc

SEQ ID NO: 118774 - DNA, 25 bp, Mus musculus
accttagtgagggtgtctttagacc

SEQ ID NO: 118775 - DNA, 25 bp, Mus musculus
accttagtggccatgaggtagctaa

SEQ ID NO: 118776 - DNA, 25 bp, Mus musculus
accttagtggccttgaggtagctaa

SEQ ID NO: 118777 - DNA, 25 bp, Mus musculus
accttagtgggacatcgtcaccgga

SEQ ID NO: 118778 - DNA, 25 bp, Mus musculus
accttagtgggagatcgtcaccgga

SEQ ID NO: 118779 - DNA, 25 bp, Mus musculus
accttataattcactccacatcaac

SEQ ID NO: 118780 - DNA, 25 bp, Mus musculus
accttataattctctccacatcaac

SEQ ID NO: 118781 - DNA, 25 bp, Mus musculus
accttatacctacaaagttattgct

SEQ ID NO: 118782 - DNA, 25 bp, Mus musculus
accttatacctagaaagttattgct

SEQ ID NO: 118783 - DNA, 25 bp, Mus musculus
accttatacttactttggcattaca

SEQ ID NO: 118784 - DNA, 25 bp, Mus musculus
accttatacttagtttggcattaca

SEQ ID NO: 118785 - DNA, 25 bp, Mus musculus
accttatatggtcatgccttcctgc

SEQ ID NO: 118786 - DNA, 25 bp, Mus musculus
accttatatggtgatgccttcctgc

SEQ ID NO: 118787 - DNA, 25 bp, Mus musculus
accttatcaggtagacgaccgcaga

SEQ ID NO: 118788 - DNA, 25 bp, Mus musculus
accttatcaggttgacgaccgcaga

SEQ ID NO: 118789 - DNA, 25 bp, Mus musculus
accttatcatggctgtacatagact

SEQ ID NO: 118790 - DNA, 25 bp, Mus musculus
accttatcatgggtgtacatagact

SEQ ID NO: 118791 - DNA, 25 bp, Mus musculus
accttatcccacagatcagcatttt

SEQ ID NO: 118792 - DNA, 25 bp, Mus musculus
accttatcccactgatcagcatttt

SEQ ID NO: 118793 - DNA, 25 bp, Mus musculus
accttatcctaaacatattctctac

SEQ ID NO: 118794 - DNA, 25 bp, Mus musculus
accttatcctaatcatattctctac

SEQ ID NO: 118795 - DNA, 25 bp, Mus musculus
accttatctataactctgcttccag

SEQ ID NO: 118796 - DNA, 25 bp, Mus musculus
accttatctatatctctgcttccag

SEQ ID NO: 118797 - DNA, 25 bp, Mus musculus
accttatgagttcgcttttgtctgg

SEQ ID NO: 118798 - DNA, 25 bp, Mus musculus
accttatgagttctgtaactaattt

SEQ ID NO: 118799 - DNA, 25 bp, Mus musculus
accttatgagttggcttttgtctgg

SEQ ID NO: 118800 - DNA, 25 bp, Mus musculus
accttatgagttgtgtaactaattt

SEQ ID NO: 118801 - DNA, 25 bp, Mus musculus
accttatgatctctttggatgatgc

SEQ ID NO: 118802 - DNA, 25 bp, Mus musculus
accttatgatctgtttggatgatgc

SEQ ID NO: 118803 - DNA, 25 bp, Mus musculus
accttatgggtaattggtgctatac

SEQ ID NO: 118804 - DNA, 25 bp, Mus musculus
accttatgggtatttggtgctatac

SEQ ID NO: 118805 - DNA, 25 bp, Mus musculus
accttattccccaactctatgaaat

SEQ ID NO: 118806 - DNA, 25 bp, Mus musculus
accttattcccctactctatgaaat

SEQ ID NO: 118807 - DNA, 25 bp, Mus musculus
accttattgctcatgaaaaacttca

SEQ ID NO: 118808 - DNA, 25 bp, Mus musculus
accttattgctcttgaaaaacttca

SEQ ID NO: 118809 - DNA, 25 bp, Mus musculus
accttcaaaaggagttggagagcga

SEQ ID NO: 118810 - DNA, 25 bp, Mus musculus
accttcaaaaggtgttggagagcga

SEQ ID NO: 118811 - DNA, 25 bp, Mus musculus
accttcaaacacctgcggatcttag

SEQ ID NO: 118812 - DNA, 25 bp, Mus musculus
accttcaaacacgtgcggatcttag

SEQ ID NO: 118813 - DNA, 25 bp, Mus musculus
accttcaacgagacccagatcgagt

SEQ ID NO: 118814 - DNA, 25 bp, Mus musculus
accttcaacgagtcccagatcgagt

SEQ ID NO: 118815 - DNA, 25 bp, Mus musculus
accttcaactgccagtctgggcaaa

SEQ ID NO: 118816 - DNA, 25 bp, Mus musculus
accttcaactgcgagtctgggcaaa

SEQ ID NO: 118817 - DNA, 25 bp, Mus musculus
accttcaagacaacccatgtgctaa

SEQ ID NO: 118818 - DNA, 25 bp, Mus musculus
accttcaagacatcccatgtgctaa

SEQ ID NO: 118819 - DNA, 25 bp, Mus musculus
accttcaaggcccagtctgtggagc

SEQ ID NO: 118820 - DNA, 25 bp, Mus musculus
accttcaaggccgagtctgtggagc

SEQ ID NO: 118821 - DNA, 25 bp, Mus musculus
accttcaagggcctgcatgattgag

SEQ ID NO: 118822 - DNA, 25 bp, Mus musculus
accttcaagggcgtgcatgattgag

SEQ ID NO: 118823 - DNA, 25 bp, Mus musculus
accttcaaggtgagtgtcagattcc

SEQ ID NO: 118824 - DNA, 25 bp, Mus musculus
accttcaaggtgtgtgtcagattcc

SEQ ID NO: 118825 - DNA, 25 bp, Mus musculus
accttcaatacgatgcaatcccagc

SEQ ID NO: 118826 - DNA, 25 bp, Mus musculus
accttcaatacgttgcaatcccagc

SEQ ID NO: 118827 - DNA, 25 bp, Mus musculus
accttcaatgtcactgtcaccatga

SEQ ID NO: 118828 - DNA, 25 bp, Mus musculus
accttcaatgtctctgtcaccatga

SEQ ID NO: 118829 - DNA, 25 bp, Mus musculus
accttcacagcaacagcctttcttt

SEQ ID NO: 118830 - DNA, 25 bp, Mus musculus
accttcacagcatcagcctttcttt

SEQ ID NO: 118831 - DNA, 25 bp, Mus musculus
accttcaccctgcaggcctttgagt

SEQ ID NO: 118832 - DNA, 25 bp, Mus musculus
accttcaccctggaggcctttgagt

SEQ ID NO: 118833 - DNA, 25 bp, Mus musculus
accttcaccgtgaggaacaagtgtc

SEQ ID NO: 118834 - DNA, 25 bp, Mus musculus
accttcaccgtgtggaacaagtgtc

SEQ ID NO: 118835 - DNA, 25 bp, Mus musculus
accttcactatacctgagtttgcaa

SEQ ID NO: 118836 - DNA, 25 bp, Mus musculus
accttcactatagctgagtttgcaa

SEQ ID NO: 118837 - DNA, 25 bp, Mus musculus
accttcactccaatagaagaagaga

SEQ ID NO: 118838 - DNA, 25 bp, Mus musculus
accttcactccattagaagaagaga

SEQ ID NO: 118839 - DNA, 25 bp, Mus musculus
accttcactctcacatcattaaata

SEQ ID NO: 118840 - DNA, 25 bp, Mus musculus
accttcactctctcatcattaaata

SEQ ID NO: 118841 - DNA, 25 bp, Mus musculus
accttcactgctcacctgtgtgaga

SEQ ID NO: 118842 - DNA, 25 bp, Mus musculus
accttcactgctgacctgtgtgaga

SEQ ID NO: 118843 - DNA, 25 bp, Mus musculus
accttcactgttatttctgagaaat

SEQ ID NO: 118844 - DNA, 25 bp, Mus musculus
accttcactgttttttctgagaaat

SEQ ID NO: 118845 - DNA, 25 bp, Mus musculus
accttcagaaggcacacatgtgctt

SEQ ID NO: 118846 - DNA, 25 bp, Mus musculus
accttcagaagggacacatgtgctt

SEQ ID NO: 118847 - DNA, 25 bp, Mus musculus
accttcagagccctagtgctggaag

SEQ ID NO: 118848 - DNA, 25 bp, Mus musculus
accttcagagccgtagtgctggaag

SEQ ID NO: 118849 - DNA, 25 bp, Mus musculus
accttcagagcgatcccagactctt

SEQ ID NO: 118850 - DNA, 25 bp, Mus musculus
accttcagagcgttcccagactctt

SEQ ID NO: 118851 - DNA, 25 bp, Mus musculus
accttcagcagtattacttgtaacg

SEQ ID NO: 118852 - DNA, 25 bp, Mus musculus
accttcagcagttttacttgtaacg

SEQ ID NO: 118853 - DNA, 25 bp, Mus musculus
accttcagccagaggtcaacgctga

SEQ ID NO: 118854 - DNA, 25 bp, Mus musculus
accttcagccagtggtcaacgctga

SEQ ID NO: 118855 - DNA, 25 bp, Mus musculus
accttcagctcacgacatgtcctaa

SEQ ID NO: 118856 - DNA, 25 bp, Mus musculus
accttcagctcaggacatgtcctaa

SEQ ID NO: 118857 - DNA, 25 bp, Mus musculus
accttcaggcaacagctcaaacttg

SEQ ID NO: 118858 - DNA, 25 bp, Mus musculus
accttcaggcaagagctcaaacttg

SEQ ID NO: 118859 - DNA, 25 bp, Mus musculus
accttcagggacaggagctgccttt

SEQ ID NO: 118860 - DNA, 25 bp, Mus musculus
accttcagggactggagctgccttt

SEQ ID NO: 118861 - DNA, 25 bp, Mus musculus
accttcagtgatctggctcagctca

SEQ ID NO: 118862 - DNA, 25 bp, Mus musculus
accttcagtgatgtggctcagctca

SEQ ID NO: 118863 - DNA, 25 bp, Mus musculus
accttcagtgcccagcagtgagcta

SEQ ID NO: 118864 - DNA, 25 bp, Mus musculus
accttcagtgccgagcagtgagcta

SEQ ID NO: 118865 - DNA, 25 bp, Mus musculus
accttcagtgtacattttggaacgg

SEQ ID NO: 118866 - DNA, 25 bp, Mus musculus
accttcagtgtagattttggaacgg

SEQ ID NO: 118867 - DNA, 25 bp, Mus musculus
accttcagtgttcattgtccttttt

SEQ ID NO: 118868 - DNA, 25 bp, Mus musculus
accttcagtgttgattgtccttttt

SEQ ID NO: 118869 - DNA, 25 bp, Mus musculus
accttcagtttcacaatccaagagt

SEQ ID NO: 118870 - DNA, 25 bp, Mus musculus
accttcagtttctcaatccaagagt

SEQ ID NO: 118871 - DNA, 25 bp, Mus musculus
accttcatccagattggacacctta

SEQ ID NO: 118872 - DNA, 25 bp, Mus musculus
accttcatccagtttggacacctta

SEQ ID NO: 118873 - DNA, 25 bp, Mus musculus
accttcatcctgagtggtctgaact

SEQ ID NO: 118874 - DNA, 25 bp, Mus musculus
accttcatcctgtgtggtctgaact

SEQ ID NO: 118875 - DNA, 25 bp, Mus musculus
accttcatcgacaacgggccaggtg

SEQ ID NO: 118876 - DNA, 25 bp, Mus musculus
accttcatcgactacgggccaggtg

SEQ ID NO: 118877 - DNA, 25 bp, Mus musculus
accttcatcgctctagttcaggctg

SEQ ID NO: 118878 - DNA, 25 bp, Mus musculus
accttcatcgctgtagttcaggctg

SEQ ID NO: 118879 - DNA, 25 bp, Mus musculus
accttcatcgtcagggccagtgata

SEQ ID NO: 118880 - DNA, 25 bp, Mus musculus
accttcatcgtctgggccagtgata

SEQ ID NO: 118881 - DNA, 25 bp, Mus musculus
accttcatcttcactcctaaatgac

SEQ ID NO: 118882 - DNA, 25 bp, Mus musculus
accttcatcttctctcctaaatgac

SEQ ID NO: 118883 - DNA, 25 bp, Mus musculus
accttcatgtgaaatctgagcccca

SEQ ID NO: 118884 - DNA, 25 bp, Mus musculus
accttcatgtgatatctgagcccca

SEQ ID NO: 118885 - DNA, 25 bp, Mus musculus
accttcattctgctagagcacctaa

SEQ ID NO: 118886 - DNA, 25 bp, Mus musculus
accttcattctggtagagcacctaa

SEQ ID NO: 118887 - DNA, 25 bp, Mus musculus
accttcattttcatccttggcaatg

SEQ ID NO: 118888 - DNA, 25 bp, Mus musculus
accttcattttcttccttggcaatg

SEQ ID NO: 118889 - DNA, 25 bp, Mus musculus
accttccaaaccagctttgtcaaca

SEQ ID NO: 118890 - DNA, 25 bp, Mus musculus
accttccaaacctgctttgtcaaca

SEQ ID NO: 118891 - DNA, 25 bp, Mus musculus
accttccaccttactattggtagat

SEQ ID NO: 118892 - DNA, 25 bp, Mus musculus
accttccacctttctattggtagat

SEQ ID NO: 118893 - DNA, 25 bp, Mus musculus
accttccactagagtgttacatacc

SEQ ID NO: 118894 - DNA, 25 bp, Mus musculus
accttccactagtgtgttacatacc

SEQ ID NO: 118895 - DNA, 25 bp, Mus musculus
accttccactccagtaataatggga

SEQ ID NO: 118896 - DNA, 25 bp, Mus musculus
accttccactcctgtaataatggga

SEQ ID NO: 118897 - DNA, 25 bp, Mus musculus
accttccagatcacactcaatatca

SEQ ID NO: 118898 - DNA, 25 bp, Mus musculus
accttccagatctcactcaatatca

SEQ ID NO: 118899 - DNA, 25 bp, Mus musculus
accttccaggtcctggtcatgctgg

SEQ ID NO: 118900 - DNA, 25 bp, Mus musculus
accttccaggtcgtggtcatgctgg

SEQ ID NO: 118901 - DNA, 25 bp, Mus musculus
accttccatagcaggtgcccttaga

SEQ ID NO: 118902 - DNA, 25 bp, Mus musculus
accttccatagctggtgcccttaga

SEQ ID NO: 118903 - DNA, 25 bp, Mus musculus
accttccattacatgttctgcattt

SEQ ID NO: 118904 - DNA, 25 bp, Mus musculus
accttccattacttgttctgcattt

SEQ ID NO: 118905 - DNA, 25 bp, Mus musculus
accttcccagagaggatgggagcag

SEQ ID NO: 118906 - DNA, 25 bp, Mus musculus
accttcccagagtggatgggagcag

SEQ ID NO: 118907 - DNA, 25 bp, Mus musculus
accttcccagcaatgagctcagcaa

SEQ ID NO: 118908 - DNA, 25 bp, Mus musculus
accttcccagcattgagctcagcaa

SEQ ID NO: 118909 - DNA, 25 bp, Mus musculus
accttcccagtccttaagcacaaag

SEQ ID NO: 118910 - DNA, 25 bp, Mus musculus
accttcccagtcgttaagcacaaag

SEQ ID NO: 118911 - DNA, 25 bp, Mus musculus
accttcccagtgaaagccatacaaa

SEQ ID NO: 118912 - DNA, 25 bp, Mus musculus
accttcccagtgtaagccatacaaa

SEQ ID NO: 118913 - DNA, 25 bp, Mus musculus
accttcccgagtcttagtcagttat

SEQ ID NO: 118914 - DNA, 25 bp, Mus musculus
accttcccgagtgttagtcagttat

SEQ ID NO: 118915 - DNA, 25 bp, Mus musculus
accttccctatgagtatattctgca

SEQ ID NO: 118916 - DNA, 25 bp, Mus musculus
accttccctatgtgtatattctgca

SEQ ID NO: 118917 - DNA, 25 bp, Mus musculus
accttccgattgcaaggcaccattt

SEQ ID NO: 118918 - DNA, 25 bp, Mus musculus
accttccgattggaaggcaccattt

SEQ ID NO: 118919 - DNA, 25 bp, Mus musculus
accttccggcacatgttacatatgt

SEQ ID NO: 118920 - DNA, 25 bp, Mus musculus
accttccggcacttgttacatatgt

SEQ ID NO: 118921 - DNA, 25 bp, Mus musculus
accttcctaatgctgagatctttca

SEQ ID NO: 118922 - DNA, 25 bp, Mus musculus
accttcctaatggtgagatctttca

SEQ ID NO: 118923 - DNA, 25 bp, Mus musculus
accttcctccacagagcagggaaag

SEQ ID NO: 118924 - DNA, 25 bp, Mus musculus
accttcctccactgagcagggaaag

SEQ ID NO: 118925 - DNA, 25 bp, Mus musculus
accttcctctaactggagtacctgc

SEQ ID NO: 118926 - DNA, 25 bp, Mus musculus
accttcctctaagtggagtacctgc

SEQ ID NO: 118927 - DNA, 25 bp, Mus musculus
accttcctctgcaaacatcagggta

SEQ ID NO: 118928 - DNA, 25 bp, Mus musculus
accttcctctgctaacatcagggta

SEQ ID NO: 118929 - DNA, 25 bp, Mus musculus
accttcctgaaacatgctccagaat

SEQ ID NO: 118930 - DNA, 25 bp, Mus musculus
accttcctgaaagatgctccagaat

SEQ ID NO: 118931 - DNA, 25 bp, Mus musculus
accttcctgactagccttatttatt

SEQ ID NO: 118932 - DNA, 25 bp, Mus musculus
accttcctgacttgccttatttatt

SEQ ID NO: 118933 - DNA, 25 bp, Mus musculus
accttcctgattccacttagcttat

SEQ ID NO: 118934 - DNA, 25 bp, Mus musculus
accttcctgattgcacttagcttat

SEQ ID NO: 118935 - DNA, 25 bp, Mus musculus
accttcctgcctaacacataagcag

SEQ ID NO: 118936 - DNA, 25 bp, Mus musculus
accttcctgccttacacataagcag

SEQ ID NO: 118937 - DNA, 25 bp, Mus musculus
accttcctggacattgaagattgtt

SEQ ID NO: 118938 - DNA, 25 bp, Mus musculus
accttcctggactttgaagattgtt

SEQ ID NO: 118939 - DNA, 25 bp, Mus musculus
accttcctgggaaacttgtgcattg

SEQ ID NO: 118940 - DNA, 25 bp, Mus musculus
accttcctgggatacttgtgcattg

SEQ ID NO: 118941 - DNA, 25 bp, Mus musculus
accttcctggtaacgttgttaaatg

SEQ ID NO: 118942 - DNA, 25 bp, Mus musculus
accttcctggtatcgttgttaaatg

SEQ ID NO: 118943 - DNA, 25 bp, Mus musculus
accttcctgtgccatgtggagtgat

SEQ ID NO: 118944 - DNA, 25 bp, Mus musculus
accttcctgtgcgatgtggagtgat

SEQ ID NO: 118945 - DNA, 25 bp, Mus musculus
accttcctgtgtaataacctgtctg

SEQ ID NO: 118946 - DNA, 25 bp, Mus musculus
accttcctgtgttataacctgtctg

SEQ ID NO: 118947 - DNA, 25 bp, Mus musculus
accttccttaacatctatcgagacc

SEQ ID NO: 118948 - DNA, 25 bp, Mus musculus
accttccttaacttctatcgagacc

SEQ ID NO: 118949 - DNA, 25 bp, Mus musculus
accttccttcttaacatcatgtgtc

SEQ ID NO: 118950 - DNA, 25 bp, Mus musculus
accttccttctttacatcatgtgtc

SEQ ID NO: 118951 - DNA, 25 bp, Mus musculus
accttccttggaagtctgagtgact

SEQ ID NO: 118952 - DNA, 25 bp, Mus musculus
accttccttggatgtctgagtgact

SEQ ID NO: 118953 - DNA, 25 bp, Mus musculus
accttcctttggctgaacattcctg

SEQ ID NO: 118954 - DNA, 25 bp, Mus musculus
accttcctttgggtgaacattcctg

SEQ ID NO: 118955 - DNA, 25 bp, Mus musculus
accttcgacaccatacaagtgaccg

SEQ ID NO: 118956 - DNA, 25 bp, Mus musculus
accttcgacaccttacaagtgaccg

SEQ ID NO: 118957 - DNA, 25 bp, Mus musculus
accttcgacctacctttgtctttgc

SEQ ID NO: 118958 - DNA, 25 bp, Mus musculus
accttcgacctagctttgtctttgc

SEQ ID NO: 118959 - DNA, 25 bp, Mus musculus
accttcgagagtcggagtctggtac

SEQ ID NO: 118960 - DNA, 25 bp, Mus musculus
accttcgagagtgggagtctggtac

SEQ ID NO: 118961 - DNA, 25 bp, Mus musculus
accttcgagcaaaagattgggacct

SEQ ID NO: 118962 - DNA, 25 bp, Mus musculus
accttcgagcaatagattgggacct

SEQ ID NO: 118963 - DNA, 25 bp, Mus musculus
accttcgagtttccgcagtttgaca

SEQ ID NO: 118964 - DNA, 25 bp, Mus musculus
accttcgagtttgcgcagtttgaca

SEQ ID NO: 118965 - DNA, 25 bp, Mus musculus
accttcgcaataaccgctggaggga

SEQ ID NO: 118966 - DNA, 25 bp, Mus musculus
accttcgcaatatccgctggaggga

SEQ ID NO: 118967 - DNA, 25 bp, Mus musculus
accttcgcacaaccggtgtgattga

SEQ ID NO: 118968 - DNA, 25 bp, Mus musculus
accttcgcacaagcggtgtgattga

SEQ ID NO: 118969 - DNA, 25 bp, Mus musculus
accttcgcttgtcttctagtgattt

SEQ ID NO: 118970 - DNA, 25 bp, Mus musculus
accttcgcttgtgttctagtgattt

SEQ ID NO: 118971 - DNA, 25 bp, Mus musculus
accttcggaaggatgatgcgtcaga

SEQ ID NO: 118972 - DNA, 25 bp, Mus musculus
accttcggaaggttgatgcgtcaga

SEQ ID NO: 118973 - DNA, 25 bp, Mus musculus
accttcggtgtgcagagtgccctgc

SEQ ID NO: 118974 - DNA, 25 bp, Mus musculus
accttcggtgtggagagtgccctgc

SEQ ID NO: 118975 - DNA, 25 bp, Mus musculus
accttcgtgacgctgcctttttata

SEQ ID NO: 118976 - DNA, 25 bp, Mus musculus
accttcgtgacggtgcctttttata

SEQ ID NO: 118977 - DNA, 25 bp, Mus musculus
accttcgtggtgatttcttcagatg

SEQ ID NO: 118978 - DNA, 25 bp, Mus musculus
accttcgtggtgttttcttcagatg

SEQ ID NO: 118979 - DNA, 25 bp, Mus musculus
accttctacaacctgatttctgttt

SEQ ID NO: 118980 - DNA, 25 bp, Mus musculus
accttctacaacgtgatttctgttt

SEQ ID NO: 118981 - DNA, 25 bp, Mus musculus
accttctacactaatacatctcacg

SEQ ID NO: 118982 - DNA, 25 bp, Mus musculus
accttctacacttatacatctcacg

SEQ ID NO: 118983 - DNA, 25 bp, Mus musculus
accttctacggccacagacgagcga

SEQ ID NO: 118984 - DNA, 25 bp, Mus musculus
accttctacggcgacagacgagcga

SEQ ID NO: 118985 - DNA, 25 bp, Mus musculus
accttctactccagcgggactaaat

SEQ ID NO: 118986 - DNA, 25 bp, Mus musculus
accttctactcctgcgggactaaat

SEQ ID NO: 118987 - DNA, 25 bp, Mus musculus
accttctagatcaaaccttcatcac

SEQ ID NO: 118988 - DNA, 25 bp, Mus musculus
accttctagatctaaccttcatcac

SEQ ID NO: 118989 - DNA, 25 bp, Mus musculus
accttctatgaaccaagttgatcaa

SEQ ID NO: 118990 - DNA, 25 bp, Mus musculus
accttctatgaagcaagttgatcaa

SEQ ID NO: 118991 - DNA, 25 bp, Mus musculus
accttctcaaacctgactcatcgag

SEQ ID NO: 118992 - DNA, 25 bp, Mus musculus
accttctcaaacgtgactcatcgag

SEQ ID NO: 118993 - DNA, 25 bp, Mus musculus
accttctcatctccacaagctggaa

SEQ ID NO: 118994 - DNA, 25 bp, Mus musculus
accttctcatctgcacaagctggaa

SEQ ID NO: 118995 - DNA, 25 bp, Mus musculus
accttctccaggatcttgagggatt

SEQ ID NO: 118996 - DNA, 25 bp, Mus musculus
accttctccaggttcttgagggatt

SEQ ID NO: 118997 - DNA, 25 bp, Mus musculus
accttctcccagaaacactgtgtgg

SEQ ID NO: 118998 - DNA, 25 bp, Mus musculus
accttctcccagtaacactgtgtgg

SEQ ID NO: 118999 - DNA, 25 bp, Mus musculus
accttctcgtggaagtgtctgtgta

SEQ ID NO: 119000 - DNA, 25 bp, Mus musculus
accttctcgtggtagtgtctgtgta

SEQ ID NO: 119001 - DNA, 25 bp, Mus musculus
accttctctagcagctcgtgctgca

SEQ ID NO: 119002 - DNA, 25 bp, Mus musculus
accttctctagctgctcgtgctgca

SEQ ID NO: 119003 - DNA, 25 bp, Mus musculus
accttctctcccacgtgtttgcttt

SEQ ID NO: 119004 - DNA, 25 bp, Mus musculus
accttctctccctcgtgtttgcttt

SEQ ID NO: 119005 - DNA, 25 bp, Mus musculus
accttctctggacagtgcccggctg

SEQ ID NO: 119006 - DNA, 25 bp, Mus musculus
accttctctggagagtgcccggctg

SEQ ID NO: 119007 - DNA, 25 bp, Mus musculus
accttctctggtatatccagggtct

SEQ ID NO: 119008 - DNA, 25 bp, Mus musculus
accttctctggtttatccagggtct

SEQ ID NO: 119009 - DNA, 25 bp, Mus musculus
accttctcttgcaaagcttgctcag

SEQ ID NO: 119010 - DNA, 25 bp, Mus musculus
accttctcttgctaagcttgctcag

SEQ ID NO: 119011 - DNA, 25 bp, Mus musculus
accttctctttgagctcatattcaa

SEQ ID NO: 119012 - DNA, 25 bp, Mus musculus
accttctctttgtgctcatattcaa

SEQ ID NO: 119013 - DNA, 25 bp, Mus musculus
accttctgaaacaagctgcctttta

SEQ ID NO: 119014 - DNA, 25 bp, Mus musculus
accttctgaaactagctgcctttta

SEQ ID NO: 119015 - DNA, 25 bp, Mus musculus
accttctgaatcacttcacctgtga

SEQ ID NO: 119016 - DNA, 25 bp, Mus musculus
accttctgaatctcttcacctgtga

SEQ ID NO: 119017 - DNA, 25 bp, Mus musculus
accttctgacaccacctggaatgaa

SEQ ID NO: 119018 - DNA, 25 bp, Mus musculus
accttctgacacgacctggaatgaa

SEQ ID NO: 119019 - DNA, 25 bp, Mus musculus
accttctgatggagcaacataaaga

SEQ ID NO: 119020 - DNA, 25 bp, Mus musculus
accttctgatggcagcgcatagaaa

SEQ ID NO: 119021 - DNA, 25 bp, Mus musculus
accttctgatgggagcgcatagaaa

SEQ ID NO: 119022 - DNA, 25 bp, Mus musculus
accttctgatggtgcaacataaaga

SEQ ID NO: 119023 - DNA, 25 bp, Mus musculus
accttctgcagcacatgggtgaggg

SEQ ID NO: 119024 - DNA, 25 bp, Mus musculus
accttctgcagctcatgggtgaggg

SEQ ID NO: 119025 - DNA, 25 bp, Mus musculus
accttctgcaggctatctcaagcaa

SEQ ID NO: 119026 - DNA, 25 bp, Mus musculus
accttctgcagggtatctcaagcaa

SEQ ID NO: 119027 - DNA, 25 bp, Mus musculus
accttctgccaaatatagcttcaaa

SEQ ID NO: 119028 - DNA, 25 bp, Mus musculus
accttctgccaattatagcttcaaa

SEQ ID NO: 119029 - DNA, 25 bp, Mus musculus
accttctgccatctcctcgtgaaaa

SEQ ID NO: 119030 - DNA, 25 bp, Mus musculus
accttctgccatgtcctcgtgaaaa

SEQ ID NO: 119031 - DNA, 25 bp, Mus musculus
accttctgcctactttgagccggat

SEQ ID NO: 119032 - DNA, 25 bp, Mus musculus
accttctgcctagtttgagccggat

SEQ ID NO: 119033 - DNA, 25 bp, Mus musculus
accttctgcggtcgacaaatattta

SEQ ID NO: 119034 - DNA, 25 bp, Mus musculus
accttctgcggtggacaaatattta

SEQ ID NO: 119035 - DNA, 25 bp, Mus musculus
accttctgctttcctggaaaagatg

SEQ ID NO: 119036 - DNA, 25 bp, Mus musculus
accttctgctttgctggaaaagatg

SEQ ID NO: 119037 - DNA, 25 bp, Mus musculus
accttctggtggcaaactccataaa

SEQ ID NO: 119038 - DNA, 25 bp, Mus musculus
accttctggtgggaaactccataaa

SEQ ID NO: 119039 - DNA, 25 bp, Mus musculus
accttctgtagtaggaatcaaaatc

SEQ ID NO: 119040 - DNA, 25 bp, Mus musculus
accttctgtagttggaatcaaaatc

SEQ ID NO: 119041 - DNA, 25 bp, Mus musculus
accttctgtggtcgagggaacctgt

SEQ ID NO: 119042 - DNA, 25 bp, Mus musculus
accttctgtggtggagggaacctgt

SEQ ID NO: 119043 - DNA, 25 bp, Mus musculus
accttctgtttccatttgcctaaca

SEQ ID NO: 119044 - DNA, 25 bp, Mus musculus
accttctgtttcgatttgcctaaca

SEQ ID NO: 119045 - DNA, 25 bp, Mus musculus
accttcttaagccacctaattgttg

SEQ ID NO: 119046 - DNA, 25 bp, Mus musculus
accttcttaagcgacctaattgttg

SEQ ID NO: 119047 - DNA, 25 bp, Mus musculus
accttcttcactctgacccaatgag

SEQ ID NO: 119048 - DNA, 25 bp, Mus musculus
accttcttcactgtgacccaatgag

SEQ ID NO: 119049 - DNA, 25 bp, Mus musculus
accttcttctcaccagcttatggga

SEQ ID NO: 119050 - DNA, 25 bp, Mus musculus
accttcttctcagcagcttatggga

SEQ ID NO: 119051 - DNA, 25 bp, Mus musculus
accttcttctgaaaataactctcaa

SEQ ID NO: 119052 - DNA, 25 bp, Mus musculus
accttcttctgataataactctcaa

SEQ ID NO: 119053 - DNA, 25 bp, Mus musculus
accttcttgtggaatcctgggagca

SEQ ID NO: 119054 - DNA, 25 bp, Mus musculus
accttcttgtggtatcctgggagca

SEQ ID NO: 119055 - DNA, 25 bp, Mus musculus
accttctttctaagttgtggtcaag

SEQ ID NO: 119056 - DNA, 25 bp, Mus musculus
accttctttctatgttgtggtcaag

SEQ ID NO: 119057 - DNA, 25 bp, Mus musculus
accttgaaactgagggctgatcttt

SEQ ID NO: 119058 - DNA, 25 bp, Mus musculus
accttgaaactgtgggctgatcttt

SEQ ID NO: 119059 - DNA, 25 bp, Mus musculus
accttgaaagctctccaccatttgc

SEQ ID NO: 119060 - DNA, 25 bp, Mus musculus
accttgaaagctgtccaccatttgc

SEQ ID NO: 119061 - DNA, 25 bp, Mus musculus
accttgaaccagaggaagctcttca

SEQ ID NO: 119062 - DNA, 25 bp, Mus musculus
accttgaaccagtggaagctcttca

SEQ ID NO: 119063 - DNA, 25 bp, Mus musculus
accttgaacgagaaccacaccaggg

SEQ ID NO: 119064 - DNA, 25 bp, Mus musculus
accttgaacgagtaccacaccaggg

SEQ ID NO: 119065 - DNA, 25 bp, Mus musculus
accttgaacttgagacccttgagcc

SEQ ID NO: 119066 - DNA, 25 bp, Mus musculus
accttgaacttgtgacccttgagcc

SEQ ID NO: 119067 - DNA, 25 bp, Mus musculus
accttgaagtagactgccaggcctg

SEQ ID NO: 119068 - DNA, 25 bp, Mus musculus
accttgaagtagtctgccaggcctg

SEQ ID NO: 119069 - DNA, 25 bp, Mus musculus
accttgaatctaacccacagcatat

SEQ ID NO: 119070 - DNA, 25 bp, Mus musculus
accttgaatctatcccacagcatat

SEQ ID NO: 119071 - DNA, 25 bp, Mus musculus
accttgaatgaacagcttggagctc

SEQ ID NO: 119072 - DNA, 25 bp, Mus musculus
accttgaatgaagagcttggagctc

SEQ ID NO: 119073 - DNA, 25 bp, Mus musculus
accttgaatgatctgctcttctttc

SEQ ID NO: 119074 - DNA, 25 bp, Mus musculus
accttgaatgatgtgctcttctttc

SEQ ID NO: 119075 - DNA, 25 bp, Mus musculus
accttgacacctaccgctatgaaat

SEQ ID NO: 119076 - DNA, 25 bp, Mus musculus
accttgacaccttccgctatgaaat

SEQ ID NO: 119077 - DNA, 25 bp, Mus musculus
accttgacagttatgcatgcgatgc

SEQ ID NO: 119078 - DNA, 25 bp, Mus musculus
accttgacagttcggagcacctaag

SEQ ID NO: 119079 - DNA, 25 bp, Mus musculus
accttgacagttgggagcacctaag

SEQ ID NO: 119080 - DNA, 25 bp, Mus musculus
accttgacagttttgcatgcgatgc

SEQ ID NO: 119081 - DNA, 25 bp, Mus musculus
accttgacattccatgtagccgtag

SEQ ID NO: 119082 - DNA, 25 bp, Mus musculus
accttgacattcgatgtagccgtag

SEQ ID NO: 119083 - DNA, 25 bp, Mus musculus
accttgacttgcacatggttggtgt

SEQ ID NO: 119084 - DNA, 25 bp, Mus musculus
accttgacttgctcatggttggtgt

SEQ ID NO: 119085 - DNA, 25 bp, Mus musculus
accttgacttgtaatttgcactttc

SEQ ID NO: 119086 - DNA, 25 bp, Mus musculus
accttgacttgttatttgcactttc

SEQ ID NO: 119087 - DNA, 25 bp, Mus musculus
accttgactttgaaggcaagcagga

SEQ ID NO: 119088 - DNA, 25 bp, Mus musculus
accttgactttgtaggcaagcagga

SEQ ID NO: 119089 - DNA, 25 bp, Mus musculus
accttgagaggtacagccgcagctt

SEQ ID NO: 119090 - DNA, 25 bp, Mus musculus
accttgagaggttcagccgcagctt

SEQ ID NO: 119091 - DNA, 25 bp, Mus musculus
accttgagccggaagtgacattttt

SEQ ID NO: 119092 - DNA, 25 bp, Mus musculus
accttgagccggtagtgacattttt

SEQ ID NO: 119093 - DNA, 25 bp, Mus musculus
accttgagcggacggtgcctgccaa

SEQ ID NO: 119094 - DNA, 25 bp, Mus musculus
accttgagcggagggtgcctgccaa

SEQ ID NO: 119095 - DNA, 25 bp, Mus musculus
accttgagctcacggccggatcatg

SEQ ID NO: 119096 - DNA, 25 bp, Mus musculus
accttgagctcagggccggatcatg

SEQ ID NO: 119097 - DNA, 25 bp, Mus musculus
accttgaggtggaccgccggatcat

SEQ ID NO: 119098 - DNA, 25 bp, Mus musculus
accttgaggtggtccgccggatcat

SEQ ID NO: 119099 - DNA, 25 bp, Mus musculus
accttgagttgtaggccacctgaca

SEQ ID NO: 119100 - DNA, 25 bp, Mus musculus
accttgagttgttggccacctgaca

SEQ ID NO: 119101 - DNA, 25 bp, Mus musculus
accttgatatttctacagcctatag

SEQ ID NO: 119102 - DNA, 25 bp, Mus musculus
accttgatatttgtacagcctatag

SEQ ID NO: 119103 - DNA, 25 bp, Mus musculus
accttgatctctcctggcatgaaaa

SEQ ID NO: 119104 - DNA, 25 bp, Mus musculus
accttgatctctgctggcatgaaaa

SEQ ID NO: 119105 - DNA, 25 bp, Mus musculus
accttgatgacacaggctggtctga

SEQ ID NO: 119106 - DNA, 25 bp, Mus musculus
accttgatgacagaggctggtctga

SEQ ID NO: 119107 - DNA, 25 bp, Mus musculus
accttgattaccagttagaactttg

SEQ ID NO: 119108 - DNA, 25 bp, Mus musculus
accttgattacctgttagaactttg

SEQ ID NO: 119109 - DNA, 25 bp, Mus musculus
accttgattcctacatgtggaacac

SEQ ID NO: 119110 - DNA, 25 bp, Mus musculus
accttgattccttcatgtggaacac

SEQ ID NO: 119111 - DNA, 25 bp, Mus musculus
accttgcaaggcaattctgtggccc

SEQ ID NO: 119112 - DNA, 25 bp, Mus musculus
accttgcaaggctattctgtggccc

SEQ ID NO: 119113 - DNA, 25 bp, Mus musculus
accttgcaatccactattaccagaa

SEQ ID NO: 119114 - DNA, 25 bp, Mus musculus
accttgcaatcctctattaccagaa

SEQ ID NO: 119115 - DNA, 25 bp, Mus musculus
accttgcacaggatttgcgctataa

SEQ ID NO: 119116 - DNA, 25 bp, Mus musculus
accttgcacaggctcagtgggcata

SEQ ID NO: 119117 - DNA, 25 bp, Mus musculus
accttgcacagggtcagtgggcata

SEQ ID NO: 119118 - DNA, 25 bp, Mus musculus
accttgcacaggttttgcgctataa

SEQ ID NO: 119119 - DNA, 25 bp, Mus musculus
accttgcacctacagatgtcttcta

SEQ ID NO: 119120 - DNA, 25 bp, Mus musculus
accttgcacctagagatgtcttcta

SEQ ID NO: 119121 - DNA, 25 bp, Mus musculus
accttgcactgcactatctggttgg

SEQ ID NO: 119122 - DNA, 25 bp, Mus musculus
accttgcactgctctatctggttgg

SEQ ID NO: 119123 - DNA, 25 bp, Mus musculus
accttgcagaataacctccagtatg

SEQ ID NO: 119124 - DNA, 25 bp, Mus musculus
accttgcagaattacctccagtatg

SEQ ID NO: 119125 - DNA, 25 bp, Mus musculus
accttgcagccccagaagacaagga

SEQ ID NO: 119126 - DNA, 25 bp, Mus musculus
accttgcagcccgagaagacaagga

SEQ ID NO: 119127 - DNA, 25 bp, Mus musculus
accttgcatctgatctggtgcataa

SEQ ID NO: 119128 - DNA, 25 bp, Mus musculus
accttgcatctgttctggtgcataa

SEQ ID NO: 119129 - DNA, 25 bp, Mus musculus
accttgcatgctccgagattctgac

SEQ ID NO: 119130 - DNA, 25 bp, Mus musculus
accttgcatgctgcgagattctgac

SEQ ID NO: 119131 - DNA, 25 bp, Mus musculus
accttgccagctagcagctttgttc

SEQ ID NO: 119132 - DNA, 25 bp, Mus musculus
accttgccagctcgaaatccagtct

SEQ ID NO: 119133 - DNA, 25 bp, Mus musculus
accttgccagctggaaatccagtct

SEQ ID NO: 119134 - DNA, 25 bp, Mus musculus
accttgccagcttgcagctttgttc

SEQ ID NO: 119135 - DNA, 25 bp, Mus musculus
accttgccaggtagacattttttgt

SEQ ID NO: 119136 - DNA, 25 bp, Mus musculus
accttgccaggtatacagattgcct

SEQ ID NO: 119137 - DNA, 25 bp, Mus musculus
accttgccaggttgacattttttgt

SEQ ID NO: 119138 - DNA, 25 bp, Mus musculus
accttgccaggtttacagattgcct

SEQ ID NO: 119139 - DNA, 25 bp, Mus musculus
accttgccagtaaccttacaggtct

SEQ ID NO: 119140 - DNA, 25 bp, Mus musculus
accttgccagtatccttacaggtct

SEQ ID NO: 119141 - DNA, 25 bp, Mus musculus
accttgccagtgaactctcagtatt

SEQ ID NO: 119142 - DNA, 25 bp, Mus musculus
accttgccagtgtactctcagtatt

SEQ ID NO: 119143 - DNA, 25 bp, Mus musculus
accttgcccaacacagagggtgaac

SEQ ID NO: 119144 - DNA, 25 bp, Mus musculus
accttgcccaactcagagggtgaac

SEQ ID NO: 119145 - DNA, 25 bp, Mus musculus
accttgcccagcaacctagagttgg

SEQ ID NO: 119146 - DNA, 25 bp, Mus musculus
accttgcccagctacctagagttgg

SEQ ID NO: 119147 - DNA, 25 bp, Mus musculus
accttgccccagaagaatttcagcg

SEQ ID NO: 119148 - DNA, 25 bp, Mus musculus
accttgccccagtagaatttcagcg

SEQ ID NO: 119149 - DNA, 25 bp, Mus musculus
accttgcccctgcacagaacaatgg

SEQ ID NO: 119150 - DNA, 25 bp, Mus musculus
accttgcccctggacagaacaatgg

SEQ ID NO: 119151 - DNA, 25 bp, Mus musculus
accttgcccggaaactcaacatcaa

SEQ ID NO: 119152 - DNA, 25 bp, Mus musculus
accttgcccggatactcaacatcaa

SEQ ID NO: 119153 - DNA, 25 bp, Mus musculus
accttgccggacagtggtggcacat

SEQ ID NO: 119154 - DNA, 25 bp, Mus musculus
accttgccggactgtggtggcacat

SEQ ID NO: 119155 - DNA, 25 bp, Mus musculus
accttgcctcttccacaaatgtcaa

SEQ ID NO: 119156 - DNA, 25 bp, Mus musculus
accttgcctcttgcacaaatgtcaa

SEQ ID NO: 119157 - DNA, 25 bp, Mus musculus
accttgcctggcactgtagtagaca

SEQ ID NO: 119158 - DNA, 25 bp, Mus musculus
accttgcctggctctgtagtagaca

SEQ ID NO: 119159 - DNA, 25 bp, Mus musculus
accttgcgaaggatcggtgctgagc

SEQ ID NO: 119160 - DNA, 25 bp, Mus musculus
accttgcgaaggttcggtgctgagc

SEQ ID NO: 119161 - DNA, 25 bp, Mus musculus
accttgcgagtgctacacggtaatt

SEQ ID NO: 119162 - DNA, 25 bp, Mus musculus
accttgcgagtggtacacggtaatt

SEQ ID NO: 119163 - DNA, 25 bp, Mus musculus
accttgctagccaggacgtgaagct

SEQ ID NO: 119164 - DNA, 25 bp, Mus musculus
accttgctagcctggacgtgaagct

SEQ ID NO: 119165 - DNA, 25 bp, Mus musculus
accttgctcaggcatggactatgca

SEQ ID NO: 119166 - DNA, 25 bp, Mus musculus
accttgctcagggatggactatgca

SEQ ID NO: 119167 - DNA, 25 bp, Mus musculus
accttgctccttctctctgagacaa

SEQ ID NO: 119168 - DNA, 25 bp, Mus musculus
accttgctccttgtctctgagacaa

SEQ ID NO: 119169 - DNA, 25 bp, Mus musculus
accttgctctagatatgggtgaact

SEQ ID NO: 119170 - DNA, 25 bp, Mus musculus
accttgctctagttatgggtgaact

SEQ ID NO: 119171 - DNA, 25 bp, Mus musculus
accttgctctcgagttggctgtttc

SEQ ID NO: 119172 - DNA, 25 bp, Mus musculus
accttgctctcgtgttggctgtttc

SEQ ID NO: 119173 - DNA, 25 bp, Mus musculus
accttgctcttgagtttcccttaga

SEQ ID NO: 119174 - DNA, 25 bp, Mus musculus
accttgctcttgtgtttcccttaga

SEQ ID NO: 119175 - DNA, 25 bp, Mus musculus
accttgctgagcaggttttgggcag

SEQ ID NO: 119176 - DNA, 25 bp, Mus musculus
accttgctgagctggttttgggcag

SEQ ID NO: 119177 - DNA, 25 bp, Mus musculus
accttgctggcccaggatgatattc

SEQ ID NO: 119178 - DNA, 25 bp, Mus musculus
accttgctggccgaggatgatattc

SEQ ID NO: 119179 - DNA, 25 bp, Mus musculus
accttgctggcgcttcagacaagag

SEQ ID NO: 119180 - DNA, 25 bp, Mus musculus
accttgctggcggttcagacaagag

SEQ ID NO: 119181 - DNA, 25 bp, Mus musculus
accttgctggctctgaagtggcctt

SEQ ID NO: 119182 - DNA, 25 bp, Mus musculus
accttgctggctgtgaagtggcctt

SEQ ID NO: 119183 - DNA, 25 bp, Mus musculus
accttgctggtgaagtctttttata

SEQ ID NO: 119184 - DNA, 25 bp, Mus musculus
accttgctggtgtagtctttttata

SEQ ID NO: 119185 - DNA, 25 bp, Mus musculus
accttgcttgacctctgttggtttt

SEQ ID NO: 119186 - DNA, 25 bp, Mus musculus
accttgcttgacgtctgttggtttt

SEQ ID NO: 119187 - DNA, 25 bp, Mus musculus
accttggacacccatcagtttttgc

SEQ ID NO: 119188 - DNA, 25 bp, Mus musculus
accttggacaccgatcagtttttgc

SEQ ID NO: 119189 - DNA, 25 bp, Mus musculus
accttggaccaactgacggacatga

SEQ ID NO: 119190 - DNA, 25 bp, Mus musculus
accttggaccaagtgacggacatga

SEQ ID NO: 119191 - DNA, 25 bp, Mus musculus
accttggaccgaagcaattttggag

SEQ ID NO: 119192 - DNA, 25 bp, Mus musculus
accttggaccgatgcaattttggag

SEQ ID NO: 119193 - DNA, 25 bp, Mus musculus
accttggaccttccctgagtgataa

SEQ ID NO: 119194 - DNA, 25 bp, Mus musculus
accttggaccttgcctgagtgataa

SEQ ID NO: 119195 - DNA, 25 bp, Mus musculus
accttggactacctgcctaatatgt

SEQ ID NO: 119196 - DNA, 25 bp, Mus musculus
accttggactacgtgcctaatatgt

SEQ ID NO: 119197 - DNA, 25 bp, Mus musculus
accttggactttcctgatttcacgg

SEQ ID NO: 119198 - DNA, 25 bp, Mus musculus
accttggactttgctgatttcacgg

SEQ ID NO: 119199 - DNA, 25 bp, Mus musculus
accttggagactacggtctggaggc

SEQ ID NO: 119200 - DNA, 25 bp, Mus musculus
accttggagacttcggtctggaggc

SEQ ID NO: 119201 - DNA, 25 bp, Mus musculus
accttggcaactcctgttgcataag

SEQ ID NO: 119202 - DNA, 25 bp, Mus musculus
accttggcaactgctgttgcataag

SEQ ID NO: 119203 - DNA, 25 bp, Mus musculus
accttggcaccccagctcttgaatg

SEQ ID NO: 119204 - DNA, 25 bp, Mus musculus
accttggcacccgagctcttgaatg

SEQ ID NO: 119205 - DNA, 25 bp, Mus musculus
accttggcactcagtcttatgtggg

SEQ ID NO: 119206 - DNA, 25 bp, Mus musculus
accttggcactctgtcttatgtggg

SEQ ID NO: 119207 - DNA, 25 bp, Mus musculus
accttggcaggtatagtgtttggag

SEQ ID NO: 119208 - DNA, 25 bp, Mus musculus
accttggcaggtttagtgtttggag

SEQ ID NO: 119209 - DNA, 25 bp, Mus musculus
accttggcatttagggcctcaggga

SEQ ID NO: 119210 - DNA, 25 bp, Mus musculus
accttggcattttgggcctcaggga

SEQ ID NO: 119211 - DNA, 25 bp, Mus musculus
accttggccaagcagcggtacacac

SEQ ID NO: 119212 - DNA, 25 bp, Mus musculus
accttggccaaggagcggtacacac

SEQ ID NO: 119213 - DNA, 25 bp, Mus musculus
accttggccagactttattcctgga

SEQ ID NO: 119214 - DNA, 25 bp, Mus musculus
accttggccagagtttattcctgga

SEQ ID NO: 119215 - DNA, 25 bp, Mus musculus
accttggcccaaatggtgtggtgca

SEQ ID NO: 119216 - DNA, 25 bp, Mus musculus
accttggcccaattggtgtggtgca

SEQ ID NO: 119217 - DNA, 25 bp, Mus musculus
accttggcccagagcctataaaatg

SEQ ID NO: 119218 - DNA, 25 bp, Mus musculus
accttggcccagtgcctataaaatg

SEQ ID NO: 119219 - DNA, 25 bp, Mus musculus
accttggcccctaacttggatgatg

SEQ ID NO: 119220 - DNA, 25 bp, Mus musculus
accttggccccttacttggatgatg

SEQ ID NO: 119221 - DNA, 25 bp, Mus musculus
accttggctactagcagtttatgtt

SEQ ID NO: 119222 - DNA, 25 bp, Mus musculus
accttggctactcggggatgacact

SEQ ID NO: 119223 - DNA, 25 bp, Mus musculus
accttggctactgggggatgacact

SEQ ID NO: 119224 - DNA, 25 bp, Mus musculus
accttggctacttgcagtttatgtt

SEQ ID NO: 119225 - DNA, 25 bp, Mus musculus
accttggctcttaagggctggtgca

SEQ ID NO: 119226 - DNA, 25 bp, Mus musculus
accttggctcttacttgagtaactc

SEQ ID NO: 119227 - DNA, 25 bp, Mus musculus
accttggctctttagggctggtgca

SEQ ID NO: 119228 - DNA, 25 bp, Mus musculus
accttggctctttcttgagtaactc

SEQ ID NO: 119229 - DNA, 25 bp, Mus musculus
accttggctgctacccccattggag

SEQ ID NO: 119230 - DNA, 25 bp, Mus musculus
accttggctgctctgtctaagtgga

SEQ ID NO: 119231 - DNA, 25 bp, Mus musculus
accttggctgctgtgtctaagtgga

SEQ ID NO: 119232 - DNA, 25 bp, Mus musculus
accttggctgcttcccccattggag

SEQ ID NO: 119233 - DNA, 25 bp, Mus musculus
accttggctgtccataatgcctgct

SEQ ID NO: 119234 - DNA, 25 bp, Mus musculus
accttggctgtcgataatgcctgct

SEQ ID NO: 119235 - DNA, 25 bp, Mus musculus
accttggctgtgaagtagccagtac

SEQ ID NO: 119236 - DNA, 25 bp, Mus musculus
accttggctgtgctgaggagcttct

SEQ ID NO: 119237 - DNA, 25 bp, Mus musculus
accttggctgtggtgaggagcttct

SEQ ID NO: 119238 - DNA, 25 bp, Mus musculus
accttggctgtgtagtagccagtac

SEQ ID NO: 119239 - DNA, 25 bp, Mus musculus
accttggcttttacatgcactagac

SEQ ID NO: 119240 - DNA, 25 bp, Mus musculus
accttggctttttcatgcactagac

SEQ ID NO: 119241 - DNA, 25 bp, Mus musculus
accttgggacacatcgcggatggag

SEQ ID NO: 119242 - DNA, 25 bp, Mus musculus
accttgggacacttcgcggatggag

SEQ ID NO: 119243 - DNA, 25 bp, Mus musculus
accttgggagtcaggctctgggaat

SEQ ID NO: 119244 - DNA, 25 bp, Mus musculus
accttgggagtctggctctgggaat

SEQ ID NO: 119245 - DNA, 25 bp, Mus musculus
accttgggcactcagaaaggtggtc

SEQ ID NO: 119246 - DNA, 25 bp, Mus musculus
accttgggcactgagaaaggtggtc

SEQ ID NO: 119247 - DNA, 25 bp, Mus musculus
accttgggcctcatctatagcatga

SEQ ID NO: 119248 - DNA, 25 bp, Mus musculus
accttgggcctcttctatagcatga

SEQ ID NO: 119249 - DNA, 25 bp, Mus musculus
accttgggctgtaaacatgggtcca

SEQ ID NO: 119250 - DNA, 25 bp, Mus musculus
accttgggctgttaacatgggtcca

SEQ ID NO: 119251 - DNA, 25 bp, Mus musculus
accttgggtcccactggaacagcag

SEQ ID NO: 119252 - DNA, 25 bp, Mus musculus
accttgggtccctctggaacagcag

SEQ ID NO: 119253 - DNA, 25 bp, Mus musculus
accttgggttctcaagcttgatctc

SEQ ID NO: 119254 - DNA, 25 bp, Mus musculus
accttgggttctgaagcttgatctc

SEQ ID NO: 119255 - DNA, 25 bp, Mus musculus
accttggtccacaaactctaatcat

SEQ ID NO: 119256 - DNA, 25 bp, Mus musculus
accttggtccactaactctaatcat

SEQ ID NO: 119257 - DNA, 25 bp, Mus musculus
accttggtctcactggattacgaaa

SEQ ID NO: 119258 - DNA, 25 bp, Mus musculus
accttggtctcagtggattacgaaa

SEQ ID NO: 119259 - DNA, 25 bp, Mus musculus
accttggtggtaattggtggcagct

SEQ ID NO: 119260 - DNA, 25 bp, Mus musculus
accttggtggtatttggtggcagct

SEQ ID NO: 119261 - DNA, 25 bp, Mus musculus
accttggtgtacagtggcagcccag

SEQ ID NO: 119262 - DNA, 25 bp, Mus musculus
accttggtgtactgtggcagcccag

SEQ ID NO: 119263 - DNA, 25 bp, Mus musculus
accttggttatcactctctgtgaac

SEQ ID NO: 119264 - DNA, 25 bp, Mus musculus
accttggttatctctctctgtgaac

SEQ ID NO: 119265 - DNA, 25 bp, Mus musculus
accttgtaacatatggagagcactt

SEQ ID NO: 119266 - DNA, 25 bp, Mus musculus
accttgtaacatttggagagcactt

SEQ ID NO: 119267 - DNA, 25 bp, Mus musculus
accttgtaagatatagttcttgctt

SEQ ID NO: 119268 - DNA, 25 bp, Mus musculus
accttgtaagatttagttcttgctt

SEQ ID NO: 119269 - DNA, 25 bp, Mus musculus
accttgtacatcagcagggcaggac

SEQ ID NO: 119270 - DNA, 25 bp, Mus musculus
accttgtacatctgcagggcaggac

SEQ ID NO: 119271 - DNA, 25 bp, Mus musculus
accttgtacggtcagctgcggcctg

SEQ ID NO: 119272 - DNA, 25 bp, Mus musculus
accttgtacggtgagctgcggcctg

SEQ ID NO: 119273 - DNA, 25 bp, Mus musculus
accttgtagccaatactggccttga

SEQ ID NO: 119274 - DNA, 25 bp, Mus musculus
accttgtagccattactggccttga

SEQ ID NO: 119275 - DNA, 25 bp, Mus musculus
accttgtagtgaacgtgctgtccaa

SEQ ID NO: 119276 - DNA, 25 bp, Mus musculus
accttgtagtgatcgtgctgtccaa

SEQ ID NO: 119277 - DNA, 25 bp, Mus musculus
accttgtatctgacaggtcattcac

SEQ ID NO: 119278 - DNA, 25 bp, Mus musculus
accttgtatctgcagctgcctctgt

SEQ ID NO: 119279 - DNA, 25 bp, Mus musculus
accttgtatctggagctgcctctgt

SEQ ID NO: 119280 - DNA, 25 bp, Mus musculus
accttgtatctgtcaggtcattcac

SEQ ID NO: 119281 - DNA, 25 bp, Mus musculus
accttgtcagacacagttccatggg

SEQ ID NO: 119282 - DNA, 25 bp, Mus musculus
accttgtcagactcagttccatggg

SEQ ID NO: 119283 - DNA, 25 bp, Mus musculus
accttgtcatgtacagccgcataca

SEQ ID NO: 119284 - DNA, 25 bp, Mus musculus
accttgtcatgttcagccgcataca

SEQ ID NO: 119285 - DNA, 25 bp, Mus musculus
accttgtcccagcagctagagaatg

SEQ ID NO: 119286 - DNA, 25 bp, Mus musculus
accttgtcccaggagctagagaatg

SEQ ID NO: 119287 - DNA, 25 bp, Mus musculus
accttgtcccgtcttagctctcata

SEQ ID NO: 119288 - DNA, 25 bp, Mus musculus
accttgtcccgtgttagctctcata

SEQ ID NO: 119289 - DNA, 25 bp, Mus musculus
accttgtcctagagttgccatggta

SEQ ID NO: 119290 - DNA, 25 bp, Mus musculus
accttgtcctagtgttgccatggta

SEQ ID NO: 119291 - DNA, 25 bp, Mus musculus
accttgtcctgtctatgcaggtcag

SEQ ID NO: 119292 - DNA, 25 bp, Mus musculus
accttgtcctgtgtatgcaggtcag

SEQ ID NO: 119293 - DNA, 25 bp, Mus musculus
accttgtctaggcaaaccattgagt

SEQ ID NO: 119294 - DNA, 25 bp, Mus musculus
accttgtctagggaaaccattgagt

SEQ ID NO: 119295 - DNA, 25 bp, Mus musculus
accttgtctgataacctctgtttta

SEQ ID NO: 119296 - DNA, 25 bp, Mus musculus
accttgtctgattacctctgtttta

SEQ ID NO: 119297 - DNA, 25 bp, Mus musculus
accttgtctttcatacgctgtttga

SEQ ID NO: 119298 - DNA, 25 bp, Mus musculus
accttgtctttcttacgctgtttga

SEQ ID NO: 119299 - DNA, 25 bp, Mus musculus
accttgtgactaacattgagcctga

SEQ ID NO: 119300 - DNA, 25 bp, Mus musculus
accttgtgactatcattgagcctga

SEQ ID NO: 119301 - DNA, 25 bp, Mus musculus
accttgtgactgcaactcctggtga

SEQ ID NO: 119302 - DNA, 25 bp, Mus musculus
accttgtgactggaactcctggtga

SEQ ID NO: 119303 - DNA, 25 bp, Mus musculus
accttgtgatgcatgatacattcta

SEQ ID NO: 119304 - DNA, 25 bp, Mus musculus
accttgtgatgcttgatacattcta

SEQ ID NO: 119305 - DNA, 25 bp, Mus musculus
accttgtgattgacgagtgtgtgga

SEQ ID NO: 119306 - DNA, 25 bp, Mus musculus
accttgtgattgtcgagtgtgtgga

SEQ ID NO: 119307 - DNA, 25 bp, Mus musculus
accttgtgcctgacatataaatgct

SEQ ID NO: 119308 - DNA, 25 bp, Mus musculus
accttgtgcctgtcatataaatgct

SEQ ID NO: 119309 - DNA, 25 bp, Mus musculus
accttgtgccttcgttttacatctg

SEQ ID NO: 119310 - DNA, 25 bp, Mus musculus
accttgtgccttggttttacatctg

SEQ ID NO: 119311 - DNA, 25 bp, Mus musculus
accttgtggagaacctggacagcct

SEQ ID NO: 119312 - DNA, 25 bp, Mus musculus
accttgtggagatcctggacagcct

SEQ ID NO: 119313 - DNA, 25 bp, Mus musculus
accttgtggcagctttgatatgcgc

SEQ ID NO: 119314 - DNA, 25 bp, Mus musculus
accttgtggcaggtttgatatgcgc

SEQ ID NO: 119315 - DNA, 25 bp, Mus musculus
accttgtggctgattattgagatga

SEQ ID NO: 119316 - DNA, 25 bp, Mus musculus
accttgtggctgtttattgagatga

SEQ ID NO: 119317 - DNA, 25 bp, Mus musculus
accttgtgtgctatttctgtgggag

SEQ ID NO: 119318 - DNA, 25 bp, Mus musculus
accttgtgtgctttttctgtgggag

SEQ ID NO: 119319 - DNA, 25 bp, Mus musculus
accttgtgttctatcaatgctactt

SEQ ID NO: 119320 - DNA, 25 bp, Mus musculus
accttgtgttctttcaatgctactt

SEQ ID NO: 119321 - DNA, 25 bp, Mus musculus
accttgttacacagagagcctccga

SEQ ID NO: 119322 - DNA, 25 bp, Mus musculus
accttgttacactgagagcctccga

SEQ ID NO: 119323 - DNA, 25 bp, Mus musculus
accttgttcactatgagtcagggaa

SEQ ID NO: 119324 - DNA, 25 bp, Mus musculus
accttgttcactttgagtcagggaa

SEQ ID NO: 119325 - DNA, 25 bp, Mus musculus
accttgttcatcatgccccatgtaa

SEQ ID NO: 119326 - DNA, 25 bp, Mus musculus
accttgttcatcttgccccatgtaa

SEQ ID NO: 119327 - DNA, 25 bp, Mus musculus
accttgttgctgactgagatctcgt

SEQ ID NO: 119328 - DNA, 25 bp, Mus musculus
accttgttgctgtctgagatctcgt

SEQ ID NO: 119329 - DNA, 25 bp, Mus musculus
accttgtttcctatgtgacatcctt

SEQ ID NO: 119330 - DNA, 25 bp, Mus musculus
accttgtttcctttgtgacatcctt

SEQ ID NO: 119331 - DNA, 25 bp, Mus musculus
accttgttttcaatgtgtggctgag

SEQ ID NO: 119332 - DNA, 25 bp, Mus musculus
accttgttttcattgtgtggctgag

SEQ ID NO: 119333 - DNA, 25 bp, Mus musculus
accttgttttgcaggttgtttctgt

SEQ ID NO: 119334 - DNA, 25 bp, Mus musculus
accttgttttgctggttgtttctgt

SEQ ID NO: 119335 - DNA, 25 bp, Mus musculus
acctttaaagagatcatccaccata

SEQ ID NO: 119336 - DNA, 25 bp, Mus musculus
acctttaaagagttcatccaccata

SEQ ID NO: 119337 - DNA, 25 bp, Mus musculus
acctttaacttcaaatgtccagcta

SEQ ID NO: 119338 - DNA, 25 bp, Mus musculus
acctttaacttctaatgtccagcta

SEQ ID NO: 119339 - DNA, 25 bp, Mus musculus
acctttaaggccatcactttcatag

SEQ ID NO: 119340 - DNA, 25 bp, Mus musculus
acctttaaggccttcactttcatag

SEQ ID NO: 119341 - DNA, 25 bp, Mus musculus
acctttaattatagcctccctgtat

SEQ ID NO: 119342 - DNA, 25 bp, Mus musculus
acctttaattattgcctccctgtat

SEQ ID NO: 119343 - DNA, 25 bp, Mus musculus
acctttacacccaggttatcacaga

SEQ ID NO: 119344 - DNA, 25 bp, Mus musculus
acctttacaccctggttatcacaga

SEQ ID NO: 119345 - DNA, 25 bp, Mus musculus
acctttacatttctctgtcccagta

SEQ ID NO: 119346 - DNA, 25 bp, Mus musculus
acctttacatttgtctgtcccagta

SEQ ID NO: 119347 - DNA, 25 bp, Mus musculus
acctttactctgacggcagaggctg

SEQ ID NO: 119348 - DNA, 25 bp, Mus musculus
acctttactctgtcggcagaggctg

SEQ ID NO: 119349 - DNA, 25 bp, Mus musculus
acctttagcccaagcagttgggcca

SEQ ID NO: 119350 - DNA, 25 bp, Mus musculus
acctttagcccatgcagttgggcca

SEQ ID NO: 119351 - DNA, 25 bp, Mus musculus
acctttaggcttcgagttcaggaag

SEQ ID NO: 119352 - DNA, 25 bp, Mus musculus
acctttaggcttggagttcaggaag

SEQ ID NO: 119353 - DNA, 25 bp, Mus musculus
acctttaggtctctgcactcagcag

SEQ ID NO: 119354 - DNA, 25 bp, Mus musculus
acctttaggtctgtgcactcagcag

SEQ ID NO: 119355 - DNA, 25 bp, Mus musculus
acctttataatgcatctcgtaacct

SEQ ID NO: 119356 - DNA, 25 bp, Mus musculus
acctttataatggatctcgtaacct

SEQ ID NO: 119357 - DNA, 25 bp, Mus musculus
acctttatagttacagctgtcctgc

SEQ ID NO: 119358 - DNA, 25 bp, Mus musculus
acctttatagtttcagctgtcctgc

SEQ ID NO: 119359 - DNA, 25 bp, Mus musculus
acctttatcgccatggtgattcaga

SEQ ID NO: 119360 - DNA, 25 bp, Mus musculus
acctttatcgccttggtgattcaga

SEQ ID NO: 119361 - DNA, 25 bp, Mus musculus
acctttatctacaccctgatggaga

SEQ ID NO: 119362 - DNA, 25 bp, Mus musculus
acctttatctactccctgatggaga

SEQ ID NO: 119363 - DNA, 25 bp, Mus musculus
acctttatctgtatgcatttgtata

SEQ ID NO: 119364 - DNA, 25 bp, Mus musculus
acctttatctgtttgcatttgtata

SEQ ID NO: 119365 - DNA, 25 bp, Mus musculus
acctttatgggtccatttcttttct

SEQ ID NO: 119366 - DNA, 25 bp, Mus musculus
acctttatgggtctgcctagattcc

SEQ ID NO: 119367 - DNA, 25 bp, Mus musculus
acctttatgggtgcatttcttttct

SEQ ID NO: 119368 - DNA, 25 bp, Mus musculus
acctttatgggtgtgcctagattcc

SEQ ID NO: 119369 - DNA, 25 bp, Mus musculus
acctttattcttcgcactcaagcct

SEQ ID NO: 119370 - DNA, 25 bp, Mus musculus
acctttattcttggcactcaagcct

SEQ ID NO: 119371 - DNA, 25 bp, Mus musculus
acctttatttgaacacattgttgtg

SEQ ID NO: 119372 - DNA, 25 bp, Mus musculus
acctttatttgatcacattgttgtg

SEQ ID NO: 119373 - DNA, 25 bp, Mus musculus
acctttatttgcatctgagttcttg

SEQ ID NO: 119374 - DNA, 25 bp, Mus musculus
acctttatttgcttctgagttcttg

SEQ ID NO: 119375 - DNA, 25 bp, Mus musculus
acctttatttgtcatcaggaccaag

SEQ ID NO: 119376 - DNA, 25 bp, Mus musculus
acctttatttgtgatcaggaccaag

SEQ ID NO: 119377 - DNA, 25 bp, Mus musculus
acctttcaagccacataaatgactt

SEQ ID NO: 119378 - DNA, 25 bp, Mus musculus
acctttcaagcctcataaatgactt

SEQ ID NO: 119379 - DNA, 25 bp, Mus musculus
acctttcaggtcattgatgagtcca

SEQ ID NO: 119380 - DNA, 25 bp, Mus musculus
acctttcaggtctttgatgagtcca

SEQ ID NO: 119381 - DNA, 25 bp, Mus musculus
acctttcaggtgcttagtcacttgt

SEQ ID NO: 119382 - DNA, 25 bp, Mus musculus
acctttcaggtggttagtcacttgt

SEQ ID NO: 119383 - DNA, 25 bp, Mus musculus
acctttcagtaacatgggccatgga

SEQ ID NO: 119384 - DNA, 25 bp, Mus musculus
acctttcagtaagatgggccatgga

SEQ ID NO: 119385 - DNA, 25 bp, Mus musculus
acctttcatatcacctcacaaacaa

SEQ ID NO: 119386 - DNA, 25 bp, Mus musculus
acctttcatatctcctcacaaacaa

SEQ ID NO: 119387 - DNA, 25 bp, Mus musculus
acctttcatggtaccattggctgag

SEQ ID NO: 119388 - DNA, 25 bp, Mus musculus
acctttcatggttccattggctgag

SEQ ID NO: 119389 - DNA, 25 bp, Mus musculus
acctttccagtcactcgacttaaag

SEQ ID NO: 119390 - DNA, 25 bp, Mus musculus
acctttccagtctctcgacttaaag

SEQ ID NO: 119391 - DNA, 25 bp, Mus musculus
acctttccattcacagtactgcttt

SEQ ID NO: 119392 - DNA, 25 bp, Mus musculus
acctttccattctcagtactgcttt

SEQ ID NO: 119393 - DNA, 25 bp, Mus musculus
acctttccattgaggacccagttga

SEQ ID NO: 119394 - DNA, 25 bp, Mus musculus
acctttccattgtggacccagttga

SEQ ID NO: 119395 - DNA, 25 bp, Mus musculus
acctttcccaacatcagcaattaga

SEQ ID NO: 119396 - DNA, 25 bp, Mus musculus
acctttcccaacttcagcaattaga

SEQ ID NO: 119397 - DNA, 25 bp, Mus musculus
acctttcccctgagactgtgaatac

SEQ ID NO: 119398 - DNA, 25 bp, Mus musculus
acctttcccctgtgactgtgaatac

SEQ ID NO: 119399 - DNA, 25 bp, Mus musculus
acctttccctgacgagagatcttaa

SEQ ID NO: 119400 - DNA, 25 bp, Mus musculus
acctttccctgaggagagatcttaa

SEQ ID NO: 119401 - DNA, 25 bp, Mus musculus
acctttcctcagctaggtggactct

SEQ ID NO: 119402 - DNA, 25 bp, Mus musculus
acctttcctcaggtaggtggactct

SEQ ID NO: 119403 - DNA, 25 bp, Mus musculus
acctttcctcttacactctataatt

SEQ ID NO: 119404 - DNA, 25 bp, Mus musculus
acctttcctctttcactctataatt

SEQ ID NO: 119405 - DNA, 25 bp, Mus musculus
acctttcgctatatgctgtttatta

SEQ ID NO: 119406 - DNA, 25 bp, Mus musculus
acctttcgctatttgctgtttatta

SEQ ID NO: 119407 - DNA, 25 bp, Mus musculus
acctttcgtatcattgtccctggag

SEQ ID NO: 119408 - DNA, 25 bp, Mus musculus
acctttcgtatctttgtccctggag

SEQ ID NO: 119409 - DNA, 25 bp, Mus musculus
acctttctacatcagatttgttgga

SEQ ID NO: 119410 - DNA, 25 bp, Mus musculus
acctttctacatgagatttgttgga

SEQ ID NO: 119411 - DNA, 25 bp, Mus musculus
acctttctagtacctataccactga

SEQ ID NO: 119412 - DNA, 25 bp, Mus musculus
acctttctagtagctataccactga

SEQ ID NO: 119413 - DNA, 25 bp, Mus musculus
acctttctagtgctctgtgtggctc

SEQ ID NO: 119414 - DNA, 25 bp, Mus musculus
acctttctagtggtctgtgtggctc

SEQ ID NO: 119415 - DNA, 25 bp, Mus musculus
acctttctcagcagtcagcaaatca

SEQ ID NO: 119416 - DNA, 25 bp, Mus musculus
acctttctcagctgtcagcaaatca

SEQ ID NO: 119417 - DNA, 25 bp, Mus musculus
acctttctctcaccactgtgtggga

SEQ ID NO: 119418 - DNA, 25 bp, Mus musculus
acctttctctcagcactgtgtggga

SEQ ID NO: 119419 - DNA, 25 bp, Mus musculus
acctttctctcgagctggcaattgt

SEQ ID NO: 119420 - DNA, 25 bp, Mus musculus
acctttctctcgagtgcacagtgag

SEQ ID NO: 119421 - DNA, 25 bp, Mus musculus
acctttctctcgtgctggcaattgt

SEQ ID NO: 119422 - DNA, 25 bp, Mus musculus
acctttctctcgtgtgcacagtgag

SEQ ID NO: 119423 - DNA, 25 bp, Mus musculus
acctttctgccacatgagtatctag

SEQ ID NO: 119424 - DNA, 25 bp, Mus musculus
acctttctgccagatgagtatctag

SEQ ID NO: 119425 - DNA, 25 bp, Mus musculus
acctttctgcttctatcccattatt

SEQ ID NO: 119426 - DNA, 25 bp, Mus musculus
acctttctgcttgtatcccattatt

SEQ ID NO: 119427 - DNA, 25 bp, Mus musculus
acctttctgtggactgaggtcctgg

SEQ ID NO: 119428 - DNA, 25 bp, Mus musculus
acctttctgtggtctgaggtcctgg

SEQ ID NO: 119429 - DNA, 25 bp, Mus musculus
acctttcttcagaatagttgcagag

SEQ ID NO: 119430 - DNA, 25 bp, Mus musculus
acctttcttcagtatagttgcagag

SEQ ID NO: 119431 - DNA, 25 bp, Mus musculus
acctttcttcgacatggtgcttgaa

SEQ ID NO: 119432 - DNA, 25 bp, Mus musculus
acctttcttcgagatggtgcttgaa

SEQ ID NO: 119433 - DNA, 25 bp, Mus musculus
acctttcttctcatgacactcaaaa

SEQ ID NO: 119434 - DNA, 25 bp, Mus musculus
acctttcttctcttgacactcaaaa

SEQ ID NO: 119435 - DNA, 25 bp, Mus musculus
acctttcttgctatctggttccaga

SEQ ID NO: 119436 - DNA, 25 bp, Mus musculus
acctttcttgctttctggttccaga

SEQ ID NO: 119437 - DNA, 25 bp, Mus musculus
acctttcttttaactccaccagaga

SEQ ID NO: 119438 - DNA, 25 bp, Mus musculus
acctttcttttatctccaccagaga

SEQ ID NO: 119439 - DNA, 25 bp, Mus musculus
acctttgaacctaccgatgactgga

SEQ ID NO: 119440 - DNA, 25 bp, Mus musculus
acctttgaaccttccgatgactgga

SEQ ID NO: 119441 - DNA, 25 bp, Mus musculus
acctttgacaatacagtggactgaa

SEQ ID NO: 119442 - DNA, 25 bp, Mus musculus
acctttgacaattcagtggactgaa

SEQ ID NO: 119443 - DNA, 25 bp, Mus musculus
acctttgacagtctgcatcttagtg

SEQ ID NO: 119444 - DNA, 25 bp, Mus musculus
acctttgacagtgtgcatcttagtg

SEQ ID NO: 119445 - DNA, 25 bp, Mus musculus
acctttgaccctcgcactgggcagg

SEQ ID NO: 119446 - DNA, 25 bp, Mus musculus
acctttgaccctggcactgggcagg

SEQ ID NO: 119447 - DNA, 25 bp, Mus musculus
acctttgagggacggatgcagtaaa

SEQ ID NO: 119448 - DNA, 25 bp, Mus musculus
acctttgagggagggatgcagtaaa

SEQ ID NO: 119449 - DNA, 25 bp, Mus musculus
acctttgagtacatggctgagagac

SEQ ID NO: 119450 - DNA, 25 bp, Mus musculus
acctttgagtacttggctgagagac

SEQ ID NO: 119451 - DNA, 25 bp, Mus musculus
acctttgatagtcacctgtgatatt

SEQ ID NO: 119452 - DNA, 25 bp, Mus musculus
acctttgatagtgacctgtgatatt

SEQ ID NO: 119453 - DNA, 25 bp, Mus musculus
acctttgatgggattgggtactaag

SEQ ID NO: 119454 - DNA, 25 bp, Mus musculus
acctttgatgggtttgggtactaag

SEQ ID NO: 119455 - DNA, 25 bp, Mus musculus
acctttgcaaagatggtctagaaac

SEQ ID NO: 119456 - DNA, 25 bp, Mus musculus
acctttgcaaagttggtctagaaac

SEQ ID NO: 119457 - DNA, 25 bp, Mus musculus
acctttgcagggagtaccgcacctt

SEQ ID NO: 119458 - DNA, 25 bp, Mus musculus
acctttgcagggtgtaccgcacctt

SEQ ID NO: 119459 - DNA, 25 bp, Mus musculus
acctttgccagtcttatgattgtat

SEQ ID NO: 119460 - DNA, 25 bp, Mus musculus
acctttgccagtgttatgattgtat

SEQ ID NO: 119461 - DNA, 25 bp, Mus musculus
acctttgcctagctctccagagctt

SEQ ID NO: 119462 - DNA, 25 bp, Mus musculus
acctttgcctaggtctccagagctt

SEQ ID NO: 119463 - DNA, 25 bp, Mus musculus
acctttgctcgcacctcagagggac

SEQ ID NO: 119464 - DNA, 25 bp, Mus musculus
acctttgctcgctcctcagagggac

SEQ ID NO: 119465 - DNA, 25 bp, Mus musculus
acctttgctgtaccaccatacaaaa

SEQ ID NO: 119466 - DNA, 25 bp, Mus musculus
acctttgctgtagcaccatacaaaa

SEQ ID NO: 119467 - DNA, 25 bp, Mus musculus
acctttgcttggctgcacatgcaat

SEQ ID NO: 119468 - DNA, 25 bp, Mus musculus
acctttgcttgggtgcacatgcaat

SEQ ID NO: 119469 - DNA, 25 bp, Mus musculus
acctttggactgctgttactgatct

SEQ ID NO: 119470 - DNA, 25 bp, Mus musculus
acctttggactggtgttactgatct

SEQ ID NO: 119471 - DNA, 25 bp, Mus musculus
acctttggagtcctactacctatag

SEQ ID NO: 119472 - DNA, 25 bp, Mus musculus
acctttggagtcgtactacctatag

SEQ ID NO: 119473 - DNA, 25 bp, Mus musculus
acctttggagtgatccttatcggaa

SEQ ID NO: 119474 - DNA, 25 bp, Mus musculus
acctttggagtgttccttatcggaa

SEQ ID NO: 119475 - DNA, 25 bp, Mus musculus
acctttggctcaagctgatggacaa

SEQ ID NO: 119476 - DNA, 25 bp, Mus musculus
acctttggctcatgctgatggacaa

SEQ ID NO: 119477 - DNA, 25 bp, Mus musculus
acctttggctgtacttcagggacat

SEQ ID NO: 119478 - DNA, 25 bp, Mus musculus
acctttggctgttcttcagggacat

SEQ ID NO: 119479 - DNA, 25 bp, Mus musculus
acctttgggaggaacaccctggctg

SEQ ID NO: 119480 - DNA, 25 bp, Mus musculus
acctttgggaggtacaccctggctg

SEQ ID NO: 119481 - DNA, 25 bp, Mus musculus
acctttgggccgaagctggcttaag

SEQ ID NO: 119482 - DNA, 25 bp, Mus musculus
acctttgggccgtagctggcttaag

SEQ ID NO: 119483 - DNA, 25 bp, Mus musculus
acctttgggcgcattgggctgcagc

SEQ ID NO: 119484 - DNA, 25 bp, Mus musculus
acctttgggcgctttgggctgcagc

SEQ ID NO: 119485 - DNA, 25 bp, Mus musculus
acctttggtctgactctccataagt

SEQ ID NO: 119486 - DNA, 25 bp, Mus musculus
acctttggtctgtctctccataagt

SEQ ID NO: 119487 - DNA, 25 bp, Mus musculus
acctttggtgtaactgcatggtcaa

SEQ ID NO: 119488 - DNA, 25 bp, Mus musculus
acctttggtgtatctgcatggtcaa

SEQ ID NO: 119489 - DNA, 25 bp, Mus musculus
acctttggtgtgatgtgtggcgatt

SEQ ID NO: 119490 - DNA, 25 bp, Mus musculus
acctttggtgtgttgtgtggcgatt

SEQ ID NO: 119491 - DNA, 25 bp, Mus musculus
acctttgtcaccaacagtgacgtct

SEQ ID NO: 119492 - DNA, 25 bp, Mus musculus
acctttgtcacctacagtgacgtct

SEQ ID NO: 119493 - DNA, 25 bp, Mus musculus
acctttgtctgacgtctgtctcagt

SEQ ID NO: 119494 - DNA, 25 bp, Mus musculus
acctttgtctgaggtctgtctcagt

SEQ ID NO: 119495 - DNA, 25 bp, Mus musculus
acctttgtctttctgtatctttcca

SEQ ID NO: 119496 - DNA, 25 bp, Mus musculus
acctttgtctttgtgtatctttcca

SEQ ID NO: 119497 - DNA, 25 bp, Mus musculus
acctttgtgcctatctgacggcaga

SEQ ID NO: 119498 - DNA, 25 bp, Mus musculus
acctttgtgcctttctgacggcaga

SEQ ID NO: 119499 - DNA, 25 bp, Mus musculus
acctttgtggagacaaaattgagaa

SEQ ID NO: 119500 - DNA, 25 bp, Mus musculus
acctttgtggagtcaaaattgagaa

SEQ ID NO: 119501 - DNA, 25 bp, Mus musculus
acctttgtggcaacgggcacataca

SEQ ID NO: 119502 - DNA, 25 bp, Mus musculus
acctttgtggcatcgggcacataca

SEQ ID NO: 119503 - DNA, 25 bp, Mus musculus
acctttgtggcgatctgctttctag

SEQ ID NO: 119504 - DNA, 25 bp, Mus musculus
acctttgtggcgttctgctttctag

SEQ ID NO: 119505 - DNA, 25 bp, Mus musculus
acctttgtgtataagagcctcctta

SEQ ID NO: 119506 - DNA, 25 bp, Mus musculus
acctttgtgtattagagcctcctta

SEQ ID NO: 119507 - DNA, 25 bp, Mus musculus
acctttgttatcaagggcttggaag

SEQ ID NO: 119508 - DNA, 25 bp, Mus musculus
acctttgttatctagggcttggaag

SEQ ID NO: 119509 - DNA, 25 bp, Mus musculus
acctttgttcacaaatatctatcta

SEQ ID NO: 119510 - DNA, 25 bp, Mus musculus
acctttgttcactaatatctatcta

SEQ ID NO: 119511 - DNA, 25 bp, Mus musculus
acctttgttcttagggagagcgtat

SEQ ID NO: 119512 - DNA, 25 bp, Mus musculus
acctttgttctttgggagagcgtat

SEQ ID NO: 119513 - DNA, 25 bp, Mus musculus
acctttgtttccattctcactgctg

SEQ ID NO: 119514 - DNA, 25 bp, Mus musculus
acctttgtttcctttctcactgctg

SEQ ID NO: 119515 - DNA, 25 bp, Mus musculus
acctttgttttcatgttattcttcg

SEQ ID NO: 119516 - DNA, 25 bp, Mus musculus
acctttgttttcttgttattcttcg

SEQ ID NO: 119517 - DNA, 25 bp, Mus musculus
accttttaaagcactgctccaagac

SEQ ID NO: 119518 - DNA, 25 bp, Mus musculus
accttttaaagctctgctccaagac

SEQ ID NO: 119519 - DNA, 25 bp, Mus musculus
accttttacatgcactgaatgtggc

SEQ ID NO: 119520 - DNA, 25 bp, Mus musculus
accttttacatggactgaatgtggc

SEQ ID NO: 119521 - DNA, 25 bp, Mus musculus
accttttagcaacctttgattcaca

SEQ ID NO: 119522 - DNA, 25 bp, Mus musculus
accttttagcaagctttgattcaca

SEQ ID NO: 119523 - DNA, 25 bp, Mus musculus
accttttatgacacaatgtgcctta

SEQ ID NO: 119524 - DNA, 25 bp, Mus musculus
accttttatgactcaatgtgcctta

SEQ ID NO: 119525 - DNA, 25 bp, Mus musculus
accttttattatagttgtcttctat

SEQ ID NO: 119526 - DNA, 25 bp, Mus musculus
accttttattattgttgtcttctat

SEQ ID NO: 119527 - DNA, 25 bp, Mus musculus
accttttcagatcccaaatcttcat

SEQ ID NO: 119528 - DNA, 25 bp, Mus musculus
accttttcagatgccaaatcttcat

SEQ ID NO: 119529 - DNA, 25 bp, Mus musculus
accttttccagaagcaaggcctaca

SEQ ID NO: 119530 - DNA, 25 bp, Mus musculus
accttttccagatgcaaggcctaca

SEQ ID NO: 119531 - DNA, 25 bp, Mus musculus
accttttccataactctcgaagcga

SEQ ID NO: 119532 - DNA, 25 bp, Mus musculus
accttttccatatctctcgaagcga

SEQ ID NO: 119533 - DNA, 25 bp, Mus musculus
accttttccttccacatcttgatag

SEQ ID NO: 119534 - DNA, 25 bp, Mus musculus
accttttccttcgacatcttgatag

SEQ ID NO: 119535 - DNA, 25 bp, Mus musculus
accttttctaaaagctgtgcactta

SEQ ID NO: 119536 - DNA, 25 bp, Mus musculus
accttttctaaatgctgtgcactta

SEQ ID NO: 119537 - DNA, 25 bp, Mus musculus
accttttctacaaagctgtctctta

SEQ ID NO: 119538 - DNA, 25 bp, Mus musculus
accttttctacatagctgtctctta

SEQ ID NO: 119539 - DNA, 25 bp, Mus musculus
accttttctactagcacacattgac

SEQ ID NO: 119540 - DNA, 25 bp, Mus musculus
accttttctacttgcacacattgac

SEQ ID NO: 119541 - DNA, 25 bp, Mus musculus
accttttctagtctgctggcattgg

SEQ ID NO: 119542 - DNA, 25 bp, Mus musculus
accttttctagtgtgctggcattgg

SEQ ID NO: 119543 - DNA, 25 bp, Mus musculus
accttttctctcaaattactgttca

SEQ ID NO: 119544 - DNA, 25 bp, Mus musculus
accttttctctctaattactgttca

SEQ ID NO: 119545 - DNA, 25 bp, Mus musculus
accttttctgggagatcttgtggca

SEQ ID NO: 119546 - DNA, 25 bp, Mus musculus
accttttctgggtgatcttgtggca

SEQ ID NO: 119547 - DNA, 25 bp, Mus musculus
accttttctgtaatgttttcactga

SEQ ID NO: 119548 - DNA, 25 bp, Mus musculus
accttttctgtattgttttcactga

SEQ ID NO: 119549 - DNA, 25 bp, Mus musculus
accttttcttctctcgggacgcata

SEQ ID NO: 119550 - DNA, 25 bp, Mus musculus
accttttcttctgtcgggacgcata

SEQ ID NO: 119551 - DNA, 25 bp, Mus musculus
accttttctttcactagatgaaagc

SEQ ID NO: 119552 - DNA, 25 bp, Mus musculus
accttttctttccagtgtgattaca

SEQ ID NO: 119553 - DNA, 25 bp, Mus musculus
accttttctttcgagtgtgattaca

SEQ ID NO: 119554 - DNA, 25 bp, Mus musculus
accttttctttctctagatgaaagc

SEQ ID NO: 119555 - DNA, 25 bp, Mus musculus
accttttgaagtccgtggtgcacat

SEQ ID NO: 119556 - DNA, 25 bp, Mus musculus
accttttgaagtgcgtggtgcacat

SEQ ID NO: 119557 - DNA, 25 bp, Mus musculus
accttttgaatgaagtgattgcagc

SEQ ID NO: 119558 - DNA, 25 bp, Mus musculus
accttttgaatgtagtgattgcagc

SEQ ID NO: 119559 - DNA, 25 bp, Mus musculus
accttttgattaaagagcagggtca

SEQ ID NO: 119560 - DNA, 25 bp, Mus musculus
accttttgattatagagcagggtca

SEQ ID NO: 119561 - DNA, 25 bp, Mus musculus
accttttgcagtcggtcttaaagag

SEQ ID NO: 119562 - DNA, 25 bp, Mus musculus
accttttgcagtctctctgggatca

SEQ ID NO: 119563 - DNA, 25 bp, Mus musculus
accttttgcagtgggtcttaaagag

SEQ ID NO: 119564 - DNA, 25 bp, Mus musculus
accttttgcagtgtctctgggatca

SEQ ID NO: 119565 - DNA, 25 bp, Mus musculus
accttttgccccatgacagtgatcc

SEQ ID NO: 119566 - DNA, 25 bp, Mus musculus
accttttgccccttgacagtgatcc

SEQ ID NO: 119567 - DNA, 25 bp, Mus musculus
accttttgctgaagtggttcaattt

SEQ ID NO: 119568 - DNA, 25 bp, Mus musculus
accttttgctgatgtggttcaattt

SEQ ID NO: 119569 - DNA, 25 bp, Mus musculus
accttttggccaattgcccactagt

SEQ ID NO: 119570 - DNA, 25 bp, Mus musculus
accttttggccatttgcccactagt

SEQ ID NO: 119571 - DNA, 25 bp, Mus musculus
accttttgtgtcatatctgcagcta

SEQ ID NO: 119572 - DNA, 25 bp, Mus musculus
accttttgtgtcttatctgcagcta

SEQ ID NO: 119573 - DNA, 25 bp, Mus musculus
accttttgttacctgtcagacacct

SEQ ID NO: 119574 - DNA, 25 bp, Mus musculus
accttttgttacgtgtcagacacct

SEQ ID NO: 119575 - DNA, 25 bp, Mus musculus
acctttttaatgaatttgcatccac

SEQ ID NO: 119576 - DNA, 25 bp, Mus musculus
acctttttaatgtatttgcatccac

SEQ ID NO: 119577 - DNA, 25 bp, Mus musculus
acctttttacatctccattccttat

SEQ ID NO: 119578 - DNA, 25 bp, Mus musculus
acctttttacatgtccattccttat

SEQ ID NO: 119579 - DNA, 25 bp, Mus musculus
acctttttccatagagtctctcact

SEQ ID NO: 119580 - DNA, 25 bp, Mus musculus
acctttttccattgagtctctcact

SEQ ID NO: 119581 - DNA, 25 bp, Mus musculus
acctttttgagcctctccatgctga

SEQ ID NO: 119582 - DNA, 25 bp, Mus musculus
acctttttgagcgtctccatgctga

SEQ ID NO: 119583 - DNA, 25 bp, Mus musculus
accttttttatgattacctctctga

SEQ ID NO: 119584 - DNA, 25 bp, Mus musculus
accttttttatgtttacctctctga

SEQ ID NO: 119585 - DNA, 25 bp, Mus musculus
accttttttcacatccaatatgaag

SEQ ID NO: 119586 - DNA, 25 bp, Mus musculus
accttttttcacttccaatatgaag

SEQ ID NO: 119587 - DNA, 25 bp, Mus musculus
accttttttcctaatagagctgtga

SEQ ID NO: 119588 - DNA, 25 bp, Mus musculus
accttttttcctctgctgagataga

SEQ ID NO: 119589 - DNA, 25 bp, Mus musculus
accttttttcctgtgctgagataga

SEQ ID NO: 119590 - DNA, 25 bp, Mus musculus
accttttttccttatagagctgtga

SEQ ID NO: 119591 - DNA, 25 bp, Mus musculus
accttttttgcaatctatcccatgt

SEQ ID NO: 119592 - DNA, 25 bp, Mus musculus
accttttttgcattctatcccatgt

SEQ ID NO: 119593 - DNA, 25 bp, Mus musculus
accttttttgttcctttattcatga

SEQ ID NO: 119594 - DNA, 25 bp, Mus musculus
accttttttgttgctttattcatga

SEQ ID NO: 119595 - DNA, 25 bp, Mus musculus
acgaaaaattccagagtgtcacatt

SEQ ID NO: 119596 - DNA, 25 bp, Mus musculus
acgaaaaattcctgagtgtcacatt

SEQ ID NO: 119597 - DNA, 25 bp, Mus musculus
acgaaaacaaatccgctcctgcgag

SEQ ID NO: 119598 - DNA, 25 bp, Mus musculus
acgaaaacaaatgcgctcctgcgag

SEQ ID NO: 119599 - DNA, 25 bp, Mus musculus
acgaaaactgctacaatgttccggg

SEQ ID NO: 119600 - DNA, 25 bp, Mus musculus
acgaaaactgcttcaatgttccggg

SEQ ID NO: 119601 - DNA, 25 bp, Mus musculus
acgaaaactgtgactcccagcggtg

SEQ ID NO: 119602 - DNA, 25 bp, Mus musculus
acgaaaactgtgtctcccagcggtg

SEQ ID NO: 119603 - DNA, 25 bp, Mus musculus
acgaaaagacctagagatactgaca

SEQ ID NO: 119604 - DNA, 25 bp, Mus musculus
acgaaaagaccttgagatactgaca

SEQ ID NO: 119605 - DNA, 25 bp, Mus musculus
acgaaaaggcctcagtctcccagat

SEQ ID NO: 119606 - DNA, 25 bp, Mus musculus
acgaaaaggcctgagtctcccagat

SEQ ID NO: 119607 - DNA, 25 bp, Mus musculus
acgaaaaggtggaggtgcccacgat

SEQ ID NO: 119608 - DNA, 25 bp, Mus musculus
acgaaaaggtggtggtgcccacgat

SEQ ID NO: 119609 - DNA, 25 bp, Mus musculus
acgaaacaacttcccctgtatgtgt

SEQ ID NO: 119610 - DNA, 25 bp, Mus musculus
acgaaacaacttgccctgtatgtgt

SEQ ID NO: 119611 - DNA, 25 bp, Mus musculus
acgaaaccaactacacgctacatgt

SEQ ID NO: 119612 - DNA, 25 bp, Mus musculus
acgaaaccaacttcacgctacatgt

SEQ ID NO: 119613 - DNA, 25 bp, Mus musculus
acgaaaccactgaccagtgcctagt

SEQ ID NO: 119614 - DNA, 25 bp, Mus musculus
acgaaaccactgtccagtgcctagt

SEQ ID NO: 119615 - DNA, 25 bp, Mus musculus
acgaaaccatctacgcaaccctgtg

SEQ ID NO: 119616 - DNA, 25 bp, Mus musculus
acgaaaccatcttcgcaaccctgtg

SEQ ID NO: 119617 - DNA, 25 bp, Mus musculus
acgaaacccttgaagagcttaaatg

SEQ ID NO: 119618 - DNA, 25 bp, Mus musculus
acgaaacccttgtagagcttaaatg

SEQ ID NO: 119619 - DNA, 25 bp, Mus musculus
acgaaacttactaggaaactccatg

SEQ ID NO: 119620 - DNA, 25 bp, Mus musculus
acgaaacttacttggaaactccatg

SEQ ID NO: 119621 - DNA, 25 bp, Mus musculus
acgaaagatgtcaacgtgcccaatc

SEQ ID NO: 119622 - DNA, 25 bp, Mus musculus
acgaaagatgtctacgtgcccaatc

SEQ ID NO: 119623 - DNA, 25 bp, Mus musculus
acgaaaggtcatcacttcatcgtgg

SEQ ID NO: 119624 - DNA, 25 bp, Mus musculus
acgaaaggtcatgacttcatcgtgg

SEQ ID NO: 119625 - DNA, 25 bp, Mus musculus
acgaaagtcaaaacccatgttaact

SEQ ID NO: 119626 - DNA, 25 bp, Mus musculus
acgaaagtcaaatcccatgttaact

SEQ ID NO: 119627 - DNA, 25 bp, Mus musculus
acgaaagtggccaagacaatctcag

SEQ ID NO: 119628 - DNA, 25 bp, Mus musculus
acgaaagtggcctagacaatctcag

SEQ ID NO: 119629 - DNA, 25 bp, Mus musculus
acgaaataaaggatcacttttcaga

SEQ ID NO: 119630 - DNA, 25 bp, Mus musculus
acgaaataaaggttcacttttcaga

SEQ ID NO: 119631 - DNA, 25 bp, Mus musculus
acgaaatcatctcgcaagccgtgtg

SEQ ID NO: 119632 - DNA, 25 bp, Mus musculus
acgaaatcatctggcaagccgtgtg

SEQ ID NO: 119633 - DNA, 25 bp, Mus musculus
acgaaatgtgacattctccaaccac

SEQ ID NO: 119634 - DNA, 25 bp, Mus musculus
acgaaatgtgactttctccaaccac

SEQ ID NO: 119635 - DNA, 25 bp, Mus musculus
acgaaatttcacactctaaaagcaa

SEQ ID NO: 119636 - DNA, 25 bp, Mus musculus
acgaaatttcactctctaaaagcaa

SEQ ID NO: 119637 - DNA, 25 bp, Mus musculus
acgaacaaaggaacagtggctgcta

SEQ ID NO: 119638 - DNA, 25 bp, Mus musculus
acgaacaaaggatcagtggctgcta

SEQ ID NO: 119639 - DNA, 25 bp, Mus musculus
acgaacatagcaaactcctttttat

SEQ ID NO: 119640 - DNA, 25 bp, Mus musculus
acgaacatagcatactcctttttat

SEQ ID NO: 119641 - DNA, 25 bp, Mus musculus
acgaacatctggatcggcgatggag

SEQ ID NO: 119642 - DNA, 25 bp, Mus musculus
acgaacatctggttcggcgatggag

SEQ ID NO: 119643 - DNA, 25 bp, Mus musculus
acgaaccatccgaaatgccatgaag

SEQ ID NO: 119644 - DNA, 25 bp, Mus musculus
acgaaccatccgtaatgccatgaag

SEQ ID NO: 119645 - DNA, 25 bp, Mus musculus
acgaaccttctgacaatggaagcct

SEQ ID NO: 119646 - DNA, 25 bp, Mus musculus
acgaaccttctgtcaatggaagcct

SEQ ID NO: 119647 - DNA, 25 bp, Mus musculus
acgaacgcagtgactcctctcaaag

SEQ ID NO: 119648 - DNA, 25 bp, Mus musculus
acgaacgcagtgtctcctctcaaag

SEQ ID NO: 119649 - DNA, 25 bp, Mus musculus
acgaacggttcacctgagatggcaa

SEQ ID NO: 119650 - DNA, 25 bp, Mus musculus
acgaacggttcagctgagatggcaa

SEQ ID NO: 119651 - DNA, 25 bp, Mus musculus
acgaactacgttctcccgagtgccg

SEQ ID NO: 119652 - DNA, 25 bp, Mus musculus
acgaactacgttgtcccgagtgccg

SEQ ID NO: 119653 - DNA, 25 bp, Mus musculus
acgaactccggtagatcagacaggg

SEQ ID NO: 119654 - DNA, 25 bp, Mus musculus
acgaactccggttgatcagacaggg

SEQ ID NO: 119655 - DNA, 25 bp, Mus musculus
acgaagaatcttcacctcacagaga

SEQ ID NO: 119656 - DNA, 25 bp, Mus musculus
acgaagaatcttgacctcacagaga

SEQ ID NO: 119657 - DNA, 25 bp, Mus musculus
acgaagacctcaatggttccctgga

SEQ ID NO: 119658 - DNA, 25 bp, Mus musculus
acgaagacctcattggttccctgga

SEQ ID NO: 119659 - DNA, 25 bp, Mus musculus
acgaagactccgagtcccctgagac

SEQ ID NO: 119660 - DNA, 25 bp, Mus musculus
acgaagactccgtgtcccctgagac

SEQ ID NO: 119661 - DNA, 25 bp, Mus musculus
acgaagagagacatgtttgccaggt

SEQ ID NO: 119662 - DNA, 25 bp, Mus musculus
acgaagagagacttgtttgccaggt

SEQ ID NO: 119663 - DNA, 25 bp, Mus musculus
acgaagagcgatacagatacaggga

SEQ ID NO: 119664 - DNA, 25 bp, Mus musculus
acgaagagcgattcagatacaggga

SEQ ID NO: 119665 - DNA, 25 bp, Mus musculus
acgaagagcgggagtccagtgcctt

SEQ ID NO: 119666 - DNA, 25 bp, Mus musculus
acgaagagcgggtgtccagtgcctt

SEQ ID NO: 119667 - DNA, 25 bp, Mus musculus
acgaagaggaccctaatctggcttt

SEQ ID NO: 119668 - DNA, 25 bp, Mus musculus
acgaagaggaccgtaatctggcttt

SEQ ID NO: 119669 - DNA, 25 bp, Mus musculus
acgaagaggcggaggctacagttcc

SEQ ID NO: 119670 - DNA, 25 bp, Mus musculus
acgaagaggcggtggctacagttcc

SEQ ID NO: 119671 - DNA, 25 bp, Mus musculus
acgaagaggcttatcctgcagagga

SEQ ID NO: 119672 - DNA, 25 bp, Mus musculus
acgaagaggcttttcctgcagagga

SEQ ID NO: 119673 - DNA, 25 bp, Mus musculus
acgaagatgggtaggctcatgcagc

SEQ ID NO: 119674 - DNA, 25 bp, Mus musculus
acgaagatgggttggctcatgcagc

SEQ ID NO: 119675 - DNA, 25 bp, Mus musculus
acgaagatttgtcacccgggcctca

SEQ ID NO: 119676 - DNA, 25 bp, Mus musculus
acgaagatttgtgacccgggcctca

SEQ ID NO: 119677 - DNA, 25 bp, Mus musculus
acgaagcaatgacaacctggacaaa

SEQ ID NO: 119678 - DNA, 25 bp, Mus musculus
acgaagcaatgagaacctggacaaa

SEQ ID NO: 119679 - DNA, 25 bp, Mus musculus
acgaagccctgcagtcccgaggtgg

SEQ ID NO: 119680 - DNA, 25 bp, Mus musculus
acgaagccctgctgtcccgaggtgg

SEQ ID NO: 119681 - DNA, 25 bp, Mus musculus
acgaagccgacaagctgttctctgt

SEQ ID NO: 119682 - DNA, 25 bp, Mus musculus
acgaagccgacatgctgttctctgt

SEQ ID NO: 119683 - DNA, 25 bp, Mus musculus
acgaagccggacacgctgcagatgc

SEQ ID NO: 119684 - DNA, 25 bp, Mus musculus
acgaagccggactcgctgcagatgc

SEQ ID NO: 119685 - DNA, 25 bp, Mus musculus
acgaagcctcaacttggctgtttca

SEQ ID NO: 119686 - DNA, 25 bp, Mus musculus
acgaagcctcaagttggctgtttca

SEQ ID NO: 119687 - DNA, 25 bp, Mus musculus
acgaagcctgttctaccatttgtta

SEQ ID NO: 119688 - DNA, 25 bp, Mus musculus
acgaagcctgttgtaccatttgtta

SEQ ID NO: 119689 - DNA, 25 bp, Mus musculus
acgaagcgccaccttaaggttgaag

SEQ ID NO: 119690 - DNA, 25 bp, Mus musculus
acgaagcgccacgttaaggttgaag

SEQ ID NO: 119691 - DNA, 25 bp, Mus musculus
acgaagctagagctcccaaggaact

SEQ ID NO: 119692 - DNA, 25 bp, Mus musculus
acgaagctagaggtcccaaggaact

SEQ ID NO: 119693 - DNA, 25 bp, Mus musculus
acgaagctccccaggaacacaagct

SEQ ID NO: 119694 - DNA, 25 bp, Mus musculus
acgaagctcccctggaacacaagct

SEQ ID NO: 119695 - DNA, 25 bp, Mus musculus
acgaagctctctctacattcctgta

SEQ ID NO: 119696 - DNA, 25 bp, Mus musculus
acgaagctctctgtacattcctgta

SEQ ID NO: 119697 - DNA, 25 bp, Mus musculus
acgaagctgctacatgtctggagga

SEQ ID NO: 119698 - DNA, 25 bp, Mus musculus
acgaagctgctagatgtctggagga

SEQ ID NO: 119699 - DNA, 25 bp, Mus musculus
acgaagctgcttcctgtgttgcaca

SEQ ID NO: 119700 - DNA, 25 bp, Mus musculus
acgaagctgcttgctgtgttgcaca

SEQ ID NO: 119701 - DNA, 25 bp, Mus musculus
acgaagcttcaactttccagaaaga

SEQ ID NO: 119702 - DNA, 25 bp, Mus musculus
acgaagcttcaagtttccagaaaga

SEQ ID NO: 119703 - DNA, 25 bp, Mus musculus
acgaaggccttccatgagagctctc

SEQ ID NO: 119704 - DNA, 25 bp, Mus musculus
acgaaggccttcgatgagagctctc

SEQ ID NO: 119705 - DNA, 25 bp, Mus musculus
acgaaggcgttcatggaggctctcc

SEQ ID NO: 119706 - DNA, 25 bp, Mus musculus
acgaaggcgttcttggaggctctcc

SEQ ID NO: 119707 - DNA, 25 bp, Mus musculus
acgaaggcttaaccacagaggagag

SEQ ID NO: 119708 - DNA, 25 bp, Mus musculus
acgaaggcttaagcacagaggagag

SEQ ID NO: 119709 - DNA, 25 bp, Mus musculus
acgaaggctttaatctgctggagct

SEQ ID NO: 119710 - DNA, 25 bp, Mus musculus
acgaaggctttattctgctggagct

SEQ ID NO: 119711 - DNA, 25 bp, Mus musculus
acgaaggtcaagcaggcataatgct

SEQ ID NO: 119712 - DNA, 25 bp, Mus musculus
acgaaggtcaaggaggcataatgct

SEQ ID NO: 119713 - DNA, 25 bp, Mus musculus
acgaaggtgtgcatgtgaccgccca

SEQ ID NO: 119714 - DNA, 25 bp, Mus musculus
acgaaggtgtgcttgtgaccgccca

SEQ ID NO: 119715 - DNA, 25 bp, Mus musculus
acgaagtatgtaagttgttcttttg

SEQ ID NO: 119716 - DNA, 25 bp, Mus musculus
acgaagtatgtatgttgttcttttg

SEQ ID NO: 119717 - DNA, 25 bp, Mus musculus
acgaagtattgacccatgacttttt

SEQ ID NO: 119718 - DNA, 25 bp, Mus musculus
acgaagtattgagccatgacttttt

SEQ ID NO: 119719 - DNA, 25 bp, Mus musculus
acgaagtcatggatgccttccggaa

SEQ ID NO: 119720 - DNA, 25 bp, Mus musculus
acgaagtcatggttgccttccggaa

SEQ ID NO: 119721 - DNA, 25 bp, Mus musculus
acgaagtccttacactgtgtgctaa

SEQ ID NO: 119722 - DNA, 25 bp, Mus musculus
acgaagtccttagactgtgtgctaa

SEQ ID NO: 119723 - DNA, 25 bp, Mus musculus
acgaagtcttccatatcctggccta

SEQ ID NO: 119724 - DNA, 25 bp, Mus musculus
acgaagtcttccttatcctggccta

SEQ ID NO: 119725 - DNA, 25 bp, Mus musculus
acgaagtgccagaccctcttagagg

SEQ ID NO: 119726 - DNA, 25 bp, Mus musculus
acgaagtgccagtccctcttagagg

SEQ ID NO: 119727 - DNA, 25 bp, Mus musculus
acgaagtggactacacaccacgtgt

SEQ ID NO: 119728 - DNA, 25 bp, Mus musculus
acgaagtggacttcacaccacgtgt

SEQ ID NO: 119729 - DNA, 25 bp, Mus musculus
acgaagtgtacgagctgatgcggca

SEQ ID NO: 119730 - DNA, 25 bp, Mus musculus
acgaagtgtacgtgctgatgcggca

SEQ ID NO: 119731 - DNA, 25 bp, Mus musculus
acgaatacaattcctctgtggcctg

SEQ ID NO: 119732 - DNA, 25 bp, Mus musculus
acgaatacaattgctctgtggcctg

SEQ ID NO: 119733 - DNA, 25 bp, Mus musculus
acgaatacagtgctagatgccttgt

SEQ ID NO: 119734 - DNA, 25 bp, Mus musculus
acgaatacagtggtagatgccttgt

SEQ ID NO: 119735 - DNA, 25 bp, Mus musculus
acgaatacggccagtgcaacccaaa

SEQ ID NO: 119736 - DNA, 25 bp, Mus musculus
acgaatacggcctgtgcaacccaaa

SEQ ID NO: 119737 - DNA, 25 bp, Mus musculus
acgaatagttccaggtgtggtagca

SEQ ID NO: 119738 - DNA, 25 bp, Mus musculus
acgaatagttcctggtgtggtagca

SEQ ID NO: 119739 - DNA, 25 bp, Mus musculus
acgaatatacagcagccggcacatt

SEQ ID NO: 119740 - DNA, 25 bp, Mus musculus
acgaatatacaggagccggcacatt

SEQ ID NO: 119741 - DNA, 25 bp, Mus musculus
acgaatatttcccagagactcccct

SEQ ID NO: 119742 - DNA, 25 bp, Mus musculus
acgaatatttccgagagactcccct

SEQ ID NO: 119743 - DNA, 25 bp, Mus musculus
acgaatcctgacagacctagtgcat

SEQ ID NO: 119744 - DNA, 25 bp, Mus musculus
acgaatcctgactgacctagtgcat

SEQ ID NO: 119745 - DNA, 25 bp, Mus musculus
acgaatctccagcttatgtcagtga

SEQ ID NO: 119746 - DNA, 25 bp, Mus musculus
acgaatctccaggttatgtcagtga

SEQ ID NO: 119747 - DNA, 25 bp, Mus musculus
acgaatgatgaaaattttgactgcc

SEQ ID NO: 119748 - DNA, 25 bp, Mus musculus
acgaatgatgaatattttgactgcc

SEQ ID NO: 119749 - DNA, 25 bp, Mus musculus
acgaatgccaagaactgctgtggta

SEQ ID NO: 119750 - DNA, 25 bp, Mus musculus
acgaatgccaagtactgctgtggta

SEQ ID NO: 119751 - DNA, 25 bp, Mus musculus
acgaatggccaaactcttaagaatt

SEQ ID NO: 119752 - DNA, 25 bp, Mus musculus
acgaatggccaatctcttaagaatt

SEQ ID NO: 119753 - DNA, 25 bp, Mus musculus
acgaattcagggagtgctttccttc

SEQ ID NO: 119754 - DNA, 25 bp, Mus musculus
acgaattcagggtgtgctttccttc

SEQ ID NO: 119755 - DNA, 25 bp, Mus musculus
acgaattcgactagatctgcctatt

SEQ ID NO: 119756 - DNA, 25 bp, Mus musculus
acgaattcgacttgatctgcctatt

SEQ ID NO: 119757 - DNA, 25 bp, Mus musculus
acgaattctagacgagggttctcag

SEQ ID NO: 119758 - DNA, 25 bp, Mus musculus
acgaattctagaggagggttctcag

SEQ ID NO: 119759 - DNA, 25 bp, Mus musculus
acgaattggagcctgagaaggactt

SEQ ID NO: 119760 - DNA, 25 bp, Mus musculus
acgaattggagcgtgagaaggactt

SEQ ID NO: 119761 - DNA, 25 bp, Mus musculus
acgaattggcgcacagaatgagagg

SEQ ID NO: 119762 - DNA, 25 bp, Mus musculus
acgaattggcgctcagaatgagagg

SEQ ID NO: 119763 - DNA, 25 bp, Mus musculus
acgaatttccaaagctgatcctcag

SEQ ID NO: 119764 - DNA, 25 bp, Mus musculus
acgaatttccaatgctgatcctcag

SEQ ID NO: 119765 - DNA, 25 bp, Mus musculus
acgaattttctacctcagacaactg

SEQ ID NO: 119766 - DNA, 25 bp, Mus musculus
acgaattttctagctcagacaactg

SEQ ID NO: 119767 - DNA, 25 bp, Mus musculus
acgaatttttctcctatgagtggca

SEQ ID NO: 119768 - DNA, 25 bp, Mus musculus
acgaatttttctgctatgagtggca

SEQ ID NO: 119769 - DNA, 25 bp, Mus musculus
acgaatttttgtatctgggatgatc

SEQ ID NO: 119770 - DNA, 25 bp, Mus musculus
acgaatttttgtttctgggatgatc

SEQ ID NO: 119771 - DNA, 25 bp, Mus musculus
acgacaaaaaggacagcatcgctgt

SEQ ID NO: 119772 - DNA, 25 bp, Mus musculus
acgacaaaaaggtcagcatcgctgt

SEQ ID NO: 119773 - DNA, 25 bp, Mus musculus
acgacaaatggcctctgaacagttg

SEQ ID NO: 119774 - DNA, 25 bp, Mus musculus
acgacaaatggcgtctgaacagttg

SEQ ID NO: 119775 - DNA, 25 bp, Mus musculus
acgacaaccgagacagctgcttggg

SEQ ID NO: 119776 - DNA, 25 bp, Mus musculus
acgacaaccgagtcagctgcttggg

SEQ ID NO: 119777 - DNA, 25 bp, Mus musculus
acgacaacgtgtactcctttgaaga

SEQ ID NO: 119778 - DNA, 25 bp, Mus musculus
acgacaacgtgttctcctttgaaga

SEQ ID NO: 119779 - DNA, 25 bp, Mus musculus
acgacaattgtgagcccattcttta

SEQ ID NO: 119780 - DNA, 25 bp, Mus musculus
acgacaattgtgtgcccattcttta

SEQ ID NO: 119781 - DNA, 25 bp, Mus musculus
acgacacaccgcaggaagaagagga

SEQ ID NO: 119782 - DNA, 25 bp, Mus musculus
acgacacaccgctggaagaagagga

SEQ ID NO: 119783 - DNA, 25 bp, Mus musculus
acgacacctgccagctgtataatga

SEQ ID NO: 119784 - DNA, 25 bp, Mus musculus
acgacacctgcctgctgtataatga

SEQ ID NO: 119785 - DNA, 25 bp, Mus musculus
acgacacgctatcacatcgacatga

SEQ ID NO: 119786 - DNA, 25 bp, Mus musculus
acgacacgctatgacatcgacatga

SEQ ID NO: 119787 - DNA, 25 bp, Mus musculus
acgacacggaggcagaccctagtga

SEQ ID NO: 119788 - DNA, 25 bp, Mus musculus
acgacacggagggagaccctagtga

SEQ ID NO: 119789 - DNA, 25 bp, Mus musculus
acgacactagaacccgtggttcaca

SEQ ID NO: 119790 - DNA, 25 bp, Mus musculus
acgacactagaagccgtggttcaca

SEQ ID NO: 119791 - DNA, 25 bp, Mus musculus
acgacactagcacggacctcacgga

SEQ ID NO: 119792 - DNA, 25 bp, Mus musculus
acgacactagcagggacctcacgga

SEQ ID NO: 119793 - DNA, 25 bp, Mus musculus
acgacactccatacttaaccataag

SEQ ID NO: 119794 - DNA, 25 bp, Mus musculus
acgacactccattcttaaccataag

SEQ ID NO: 119795 - DNA, 25 bp, Mus musculus
acgacactgcagacaagctaccaaa

SEQ ID NO: 119796 - DNA, 25 bp, Mus musculus
acgacactgcagtcaagctaccaaa

SEQ ID NO: 119797 - DNA, 25 bp, Mus musculus
acgacactggaacagttttgagtat

SEQ ID NO: 119798 - DNA, 25 bp, Mus musculus
acgacactggaagagttttgagtat

SEQ ID NO: 119799 - DNA, 25 bp, Mus musculus
acgacactttttctgcatcccagtc

SEQ ID NO: 119800 - DNA, 25 bp, Mus musculus
acgacactttttgtgcatcccagtc

SEQ ID NO: 119801 - DNA, 25 bp, Mus musculus
acgacagaagacaaaggttcctgag

SEQ ID NO: 119802 - DNA, 25 bp, Mus musculus
acgacagaagactaaggttcctgag

SEQ ID NO: 119803 - DNA, 25 bp, Mus musculus
acgacagagcttaggcagcggagca

SEQ ID NO: 119804 - DNA, 25 bp, Mus musculus
acgacagagctttggcagcggagca

SEQ ID NO: 119805 - DNA, 25 bp, Mus musculus
acgacagatagcaattttggaaaac

SEQ ID NO: 119806 - DNA, 25 bp, Mus musculus
acgacagatagctattttggaaaac

SEQ ID NO: 119807 - DNA, 25 bp, Mus musculus
acgacagatcttcactcaacagcaa

SEQ ID NO: 119808 - DNA, 25 bp, Mus musculus
acgacagatcttgactcaacagcaa

SEQ ID NO: 119809 - DNA, 25 bp, Mus musculus
acgacagcatggatcgctgagacca

SEQ ID NO: 119810 - DNA, 25 bp, Mus musculus
acgacagcatggttcgctgagacca

SEQ ID NO: 119811 - DNA, 25 bp, Mus musculus
acgacagcatttctgagctctacac

SEQ ID NO: 119812 - DNA, 25 bp, Mus musculus
acgacagcatttgtgagctctacac

SEQ ID NO: 119813 - DNA, 25 bp, Mus musculus
acgacagccaggcttacccagaata

SEQ ID NO: 119814 - DNA, 25 bp, Mus musculus
acgacagccagggttacccagaata

SEQ ID NO: 119815 - DNA, 25 bp, Mus musculus
acgacagcgaccacttcaaattcaa

SEQ ID NO: 119816 - DNA, 25 bp, Mus musculus
acgacagcgacctcttcaaattcaa

SEQ ID NO: 119817 - DNA, 25 bp, Mus musculus
acgacagcgactccgaggagcccgt

SEQ ID NO: 119818 - DNA, 25 bp, Mus musculus
acgacagcgactgcgaggagcccgt

SEQ ID NO: 119819 - DNA, 25 bp, Mus musculus
acgacagctacgcaccagaagaatg

SEQ ID NO: 119820 - DNA, 25 bp, Mus musculus
acgacagctacggaccagaagaatg

SEQ ID NO: 119821 - DNA, 25 bp, Mus musculus
acgacaggctgtccgttgcatgtaa

SEQ ID NO: 119822 - DNA, 25 bp, Mus musculus
acgacaggctgtgcgttgcatgtaa

SEQ ID NO: 119823 - DNA, 25 bp, Mus musculus
acgacaggtttcatatagtttggct

SEQ ID NO: 119824 - DNA, 25 bp, Mus musculus
acgacaggtttcttatagtttggct

SEQ ID NO: 119825 - DNA, 25 bp, Mus musculus
acgacagtctccataaggcccaagg

SEQ ID NO: 119826 - DNA, 25 bp, Mus musculus
acgacagtctccttaaggcccaagg

SEQ ID NO: 119827 - DNA, 25 bp, Mus musculus
acgacagtgctgagtgtgctccagt

SEQ ID NO: 119828 - DNA, 25 bp, Mus musculus
acgacagtgctgatattgaccaccc

SEQ ID NO: 119829 - DNA, 25 bp, Mus musculus
acgacagtgctgtgtgtgctccagt

SEQ ID NO: 119830 - DNA, 25 bp, Mus musculus
acgacagtgctgttattgaccaccc

SEQ ID NO: 119831 - DNA, 25 bp, Mus musculus
acgacagtttcaaacagggttgcct

SEQ ID NO: 119832 - DNA, 25 bp, Mus musculus
acgacagtttcatacagggttgcct

SEQ ID NO: 119833 - DNA, 25 bp, Mus musculus
acgacagtttccacgtgcccggaga

SEQ ID NO: 119834 - DNA, 25 bp, Mus musculus
acgacagtttcctcgtgcccggaga

SEQ ID NO: 119835 - DNA, 25 bp, Mus musculus
acgacatacttgatgagggttagcc

SEQ ID NO: 119836 - DNA, 25 bp, Mus musculus
acgacatacttgttgagggttagcc

SEQ ID NO: 119837 - DNA, 25 bp, Mus musculus
acgacatgccaaatgtgctactcca

SEQ ID NO: 119838 - DNA, 25 bp, Mus musculus
acgacatgccaattgtgctactcca

SEQ ID NO: 119839 - DNA, 25 bp, Mus musculus
acgacattcaccatgtaaatttctg

SEQ ID NO: 119840 - DNA, 25 bp, Mus musculus
acgacattcaccttgtaaatttctg

SEQ ID NO: 119841 - DNA, 25 bp, Mus musculus
acgacattgaccacagtgacgtgga

SEQ ID NO: 119842 - DNA, 25 bp, Mus musculus
acgacattgacctcagtgacgtgga

SEQ ID NO: 119843 - DNA, 25 bp, Mus musculus
acgacattgatgacaccgtgatatc

SEQ ID NO: 119844 - DNA, 25 bp, Mus musculus
acgacattgatgtcaccgtgatatc

SEQ ID NO: 119845 - DNA, 25 bp, Mus musculus
acgacatttacaacttcttctctcc

SEQ ID NO: 119846 - DNA, 25 bp, Mus musculus
acgacatttacatcttcttctctcc

SEQ ID NO: 119847 - DNA, 25 bp, Mus musculus
acgaccaagttaagttgctccactg

SEQ ID NO: 119848 - DNA, 25 bp, Mus musculus
acgaccaagttatgttgctccactg

SEQ ID NO: 119849 - DNA, 25 bp, Mus musculus
acgaccacacctaaacctacagaat

SEQ ID NO: 119850 - DNA, 25 bp, Mus musculus
acgaccacaccttaacctacagaat

SEQ ID NO: 119851 - DNA, 25 bp, Mus musculus
acgaccagcgccacaagttttggga

SEQ ID NO: 119852 - DNA, 25 bp, Mus musculus
acgaccagcgcctcaagttttggga

SEQ ID NO: 119853 - DNA, 25 bp, Mus musculus
acgaccaggccactgtggcagagca

SEQ ID NO: 119854 - DNA, 25 bp, Mus musculus
acgaccaggccagtgtggcagagca

SEQ ID NO: 119855 - DNA, 25 bp, Mus musculus
acgaccagtggcctgcttggatgca

SEQ ID NO: 119856 - DNA, 25 bp, Mus musculus
acgaccagtggcgtgcttggatgca

SEQ ID NO: 119857 - DNA, 25 bp, Mus musculus
acgacccacaccagtggctttggat

SEQ ID NO: 119858 - DNA, 25 bp, Mus musculus
acgacccacacctgtggctttggat

SEQ ID NO: 119859 - DNA, 25 bp, Mus musculus
acgaccccgttcacaggctgggaat

SEQ ID NO: 119860 - DNA, 25 bp, Mus musculus
acgaccccgttctcaggctgggaat

SEQ ID NO: 119861 - DNA, 25 bp, Mus musculus
acgacccctaaccaatgagtgcttc

SEQ ID NO: 119862 - DNA, 25 bp, Mus musculus
acgacccctaacgaatgagtgcttc

SEQ ID NO: 119863 - DNA, 25 bp, Mus musculus
acgacccctatgaaacttcacagaa

SEQ ID NO: 119864 - DNA, 25 bp, Mus musculus
acgacccctatgtaacttcacagaa

SEQ ID NO: 119865 - DNA, 25 bp, Mus musculus
acgaccctctgtacggcaagctttt

SEQ ID NO: 119866 - DNA, 25 bp, Mus musculus
acgaccctctgttcggcaagctttt

SEQ ID NO: 119867 - DNA, 25 bp, Mus musculus
acgaccctgtgaactacgtgaggca

SEQ ID NO: 119868 - DNA, 25 bp, Mus musculus
acgaccctgtgatctacgtgaggca

SEQ ID NO: 119869 - DNA, 25 bp, Mus musculus
acgaccgatgggaatttgctccgac

SEQ ID NO: 119870 - DNA, 25 bp, Mus musculus
acgaccgatgggtatttgctccgac

SEQ ID NO: 119871 - DNA, 25 bp, Mus musculus
acgaccgccgagagtttgccaagtt

SEQ ID NO: 119872 - DNA, 25 bp, Mus musculus
acgaccgccgagtgtttgccaagtt

SEQ ID NO: 119873 - DNA, 25 bp, Mus musculus
acgaccggccgcaggtgctgtacta

SEQ ID NO: 119874 - DNA, 25 bp, Mus musculus
acgaccggccgctggtgctgtacta

SEQ ID NO: 119875 - DNA, 25 bp, Mus musculus
acgaccggtggtctgtgatctgtac

SEQ ID NO: 119876 - DNA, 25 bp, Mus musculus
acgaccggtggtgtgtgatctgtac

SEQ ID NO: 119877 - DNA, 25 bp, Mus musculus
acgaccggtgtcatgcttttcatga

SEQ ID NO: 119878 - DNA, 25 bp, Mus musculus
acgaccggtgtcttgcttttcatga

SEQ ID NO: 119879 - DNA, 25 bp, Mus musculus
acgaccgtcctcaactgttttgaag

SEQ ID NO: 119880 - DNA, 25 bp, Mus musculus
acgaccgtcctctactgttttgaag

SEQ ID NO: 119881 - DNA, 25 bp, Mus musculus
acgacctaaccaagtattctcacta

SEQ ID NO: 119882 - DNA, 25 bp, Mus musculus
acgacctaaccatgtattctcacta

SEQ ID NO: 119883 - DNA, 25 bp, Mus musculus
acgacctcaaaactcttctgaaaga

SEQ ID NO: 119884 - DNA, 25 bp, Mus musculus
acgacctcaaaagtcttctgaaaga

SEQ ID NO: 119885 - DNA, 25 bp, Mus musculus
acgacctcacgactctgtgtgaaga

SEQ ID NO: 119886 - DNA, 25 bp, Mus musculus
acgacctcacgagtctgtgtgaaga

SEQ ID NO: 119887 - DNA, 25 bp, Mus musculus
acgacctcagctaccttgatgatgt

SEQ ID NO: 119888 - DNA, 25 bp, Mus musculus
acgacctcagcttccttgatgatgt

SEQ ID NO: 119889 - DNA, 25 bp, Mus musculus
acgacctctttgagtactgccagaa

SEQ ID NO: 119890 - DNA, 25 bp, Mus musculus
acgacctctttgtgtactgccagaa

SEQ ID NO: 119891 - DNA, 25 bp, Mus musculus
acgacctgaaccagtgcagactgga

SEQ ID NO: 119892 - DNA, 25 bp, Mus musculus
acgacctgaacctgtgcagactgga

SEQ ID NO: 119893 - DNA, 25 bp, Mus musculus
acgacctgctcaactgtacggcaga

SEQ ID NO: 119894 - DNA, 25 bp, Mus musculus
acgacctgctcatctgtacggcaga

SEQ ID NO: 119895 - DNA, 25 bp, Mus musculus
acgacctggcagaatcacataaaac

SEQ ID NO: 119896 - DNA, 25 bp, Mus musculus
acgacctggcagtatcacataaaac

SEQ ID NO: 119897 - DNA, 25 bp, Mus musculus
acgacctgggccaagaagtttcagt

SEQ ID NO: 119898 - DNA, 25 bp, Mus musculus
acgacctgggcctagaagtttcagt

SEQ ID NO: 119899 - DNA, 25 bp, Mus musculus
acgaccttactgcagtaaccatacc

SEQ ID NO: 119900 - DNA, 25 bp, Mus musculus
acgaccttactggagtaaccatacc

SEQ ID NO: 119901 - DNA, 25 bp, Mus musculus
acgaccttcagcagggacttctggg

SEQ ID NO: 119902 - DNA, 25 bp, Mus musculus
acgaccttcagctgggacttctggg

SEQ ID NO: 119903 - DNA, 25 bp, Mus musculus
acgacgaatgcgagtcgctgcggtc

SEQ ID NO: 119904 - DNA, 25 bp, Mus musculus
acgacgaatgcgtgtcgctgcggtc

SEQ ID NO: 119905 - DNA, 25 bp, Mus musculus
acgacgactccaaggtgggctttga

SEQ ID NO: 119906 - DNA, 25 bp, Mus musculus
acgacgactccatggtgggctttga

SEQ ID NO: 119907 - DNA, 25 bp, Mus musculus
acgacgactgcccttgaaaccaggg

SEQ ID NO: 119908 - DNA, 25 bp, Mus musculus
acgacgactgccgttgaaaccaggg

SEQ ID NO: 119909 - DNA, 25 bp, Mus musculus
acgacgaggaataacctctccagca

SEQ ID NO: 119910 - DNA, 25 bp, Mus musculus
acgacgaggaattacctctccagca

SEQ ID NO: 119911 - DNA, 25 bp, Mus musculus
acgacgcccgcacggacttcgagaa

SEQ ID NO: 119912 - DNA, 25 bp, Mus musculus
acgacgcccgcagggacttcgagaa

SEQ ID NO: 119913 - DNA, 25 bp, Mus musculus
acgacgccggcgagtttgtggacct

SEQ ID NO: 119914 - DNA, 25 bp, Mus musculus
acgacgccggcgtgtttgtggacct

SEQ ID NO: 119915 - DNA, 25 bp, Mus musculus
acgacgcgagatatctccattcggt

SEQ ID NO: 119916 - DNA, 25 bp, Mus musculus
acgacgcgagatttctccattcggt

SEQ ID NO: 119917 - DNA, 25 bp, Mus musculus
acgacgctccgaactgcgggttgcg

SEQ ID NO: 119918 - DNA, 25 bp, Mus musculus
acgacgctccgatctgcgggttgcg

SEQ ID NO: 119919 - DNA, 25 bp, Mus musculus
acgacgctgttcatagttcactaat

SEQ ID NO: 119920 - DNA, 25 bp, Mus musculus
acgacgctgttcttagttcactaat

SEQ ID NO: 119921 - DNA, 25 bp, Mus musculus
acgacggcattaattgggcgacctg

SEQ ID NO: 119922 - DNA, 25 bp, Mus musculus
acgacggcattatttgggcgacctg

SEQ ID NO: 119923 - DNA, 25 bp, Mus musculus
acgacggccccgcactgaatacatt

SEQ ID NO: 119924 - DNA, 25 bp, Mus musculus
acgacggccccggactgaatacatt

SEQ ID NO: 119925 - DNA, 25 bp, Mus musculus
acgacggccgcaatgactttgatga

SEQ ID NO: 119926 - DNA, 25 bp, Mus musculus
acgacggccgcattgactttgatga

SEQ ID NO: 119927 - DNA, 25 bp, Mus musculus
acgacggctccgacagcttcgagga

SEQ ID NO: 119928 - DNA, 25 bp, Mus musculus
acgacggctccgtcagcttcgagga

SEQ ID NO: 119929 - DNA, 25 bp, Mus musculus
acgacggctgcaaatgtagactata

SEQ ID NO: 119930 - DNA, 25 bp, Mus musculus
acgacggctgcatatgtagactata

SEQ ID NO: 119931 - DNA, 25 bp, Mus musculus
acgacggcttccataatggctcctg

SEQ ID NO: 119932 - DNA, 25 bp, Mus musculus
acgacggcttccttaatggctcctg

SEQ ID NO: 119933 - DNA, 25 bp, Mus musculus
acgacggtgaccagtgcttgcttgc

SEQ ID NO: 119934 - DNA, 25 bp, Mus musculus
acgacggtgacctgtgcttgcttgc

SEQ ID NO: 119935 - DNA, 25 bp, Mus musculus
acgacgtactcgcatcgactggcgg

SEQ ID NO: 119936 - DNA, 25 bp, Mus musculus
acgacgtactcggatcgactggcgg

SEQ ID NO: 119937 - DNA, 25 bp, Mus musculus
acgacgtagcagctaaccctgttta

SEQ ID NO: 119938 - DNA, 25 bp, Mus musculus
acgacgtagcaggtaaccctgttta

SEQ ID NO: 119939 - DNA, 25 bp, Mus musculus
acgacgtcatcgctctgtagtgtca

SEQ ID NO: 119940 - DNA, 25 bp, Mus musculus
acgacgtcatcggtctgtagtgtca

SEQ ID NO: 119941 - DNA, 25 bp, Mus musculus
acgacgtctgtactcttatgggaca

SEQ ID NO: 119942 - DNA, 25 bp, Mus musculus
acgacgtctgtagtcttatgggaca

SEQ ID NO: 119943 - DNA, 25 bp, Mus musculus
acgacgtgcctgaaaccatggatgt

SEQ ID NO: 119944 - DNA, 25 bp, Mus musculus
acgacgtgcctgtaaccatggatgt

SEQ ID NO: 119945 - DNA, 25 bp, Mus musculus
acgacgtggagaccccgaatgagcc

SEQ ID NO: 119946 - DNA, 25 bp, Mus musculus
acgacgtggagagcccgaatgagcc

SEQ ID NO: 119947 - DNA, 25 bp, Mus musculus
acgacgtgggctacgtgacctacga

SEQ ID NO: 119948 - DNA, 25 bp, Mus musculus
acgacgtgggcttcgtgacctacga

SEQ ID NO: 119949 - DNA, 25 bp, Mus musculus
acgactaagagcatctcccggactc

SEQ ID NO: 119950 - DNA, 25 bp, Mus musculus
acgactaagagcttctcccggactc

SEQ ID NO: 119951 - DNA, 25 bp, Mus musculus
acgactacaactcaagacgattaag

SEQ ID NO: 119952 - DNA, 25 bp, Mus musculus
acgactacaactgaagacgattaag

SEQ ID NO: 119953 - DNA, 25 bp, Mus musculus
acgactacaatgaacctacactctg

SEQ ID NO: 119954 - DNA, 25 bp, Mus musculus
acgactacaatgtacctacactctg

SEQ ID NO: 119955 - DNA, 25 bp, Mus musculus
acgactacacttcgccatgtctaag

SEQ ID NO: 119956 - DNA, 25 bp, Mus musculus
acgactacacttggccatgtctaag

SEQ ID NO: 119957 - DNA, 25 bp, Mus musculus
acgactactaagctgtctttctagt

SEQ ID NO: 119958 - DNA, 25 bp, Mus musculus
acgactactaaggtgtctttctagt

SEQ ID NO: 119959 - DNA, 25 bp, Mus musculus
acgactacttttccatacagtgaaa

SEQ ID NO: 119960 - DNA, 25 bp, Mus musculus
acgactacttttgcatacagtgaaa

SEQ ID NO: 119961 - DNA, 25 bp, Mus musculus
acgactagtgtaagtcaggtcctca

SEQ ID NO: 119962 - DNA, 25 bp, Mus musculus
acgactagtgtatgtcaggtcctca

SEQ ID NO: 119963 - DNA, 25 bp, Mus musculus
acgactagtgtcaacagcttcaaca

SEQ ID NO: 119964 - DNA, 25 bp, Mus musculus
acgactagtgtctacagcttcaaca

SEQ ID NO: 119965 - DNA, 25 bp, Mus musculus
acgactagttcaatccttctgctca

SEQ ID NO: 119966 - DNA, 25 bp, Mus musculus
acgactagttcattccttctgctca

SEQ ID NO: 119967 - DNA, 25 bp, Mus musculus
acgactatgataacgccgtgctgag

SEQ ID NO: 119968 - DNA, 25 bp, Mus musculus
acgactatgatatcgccgtgctgag

SEQ ID NO: 119969 - DNA, 25 bp, Mus musculus
acgactatgattatactgagacctg

SEQ ID NO: 119970 - DNA, 25 bp, Mus musculus
acgactatgattttactgagacctg

SEQ ID NO: 119971 - DNA, 25 bp, Mus musculus
acgactatgcaactctcccgggcag

SEQ ID NO: 119972 - DNA, 25 bp, Mus musculus
acgactatgcaagtctcccgggcag

SEQ ID NO: 119973 - DNA, 25 bp, Mus musculus
acgactcaagagagtccgcatgctg

SEQ ID NO: 119974 - DNA, 25 bp, Mus musculus
acgactcaagagtgtccgcatgctg

SEQ ID NO: 119975 - DNA, 25 bp, Mus musculus
acgactcaagttatctgtaggcctt

SEQ ID NO: 119976 - DNA, 25 bp, Mus musculus
acgactcaagttttctgtaggcctt

SEQ ID NO: 119977 - DNA, 25 bp, Mus musculus
acgactcacagtctagtttgctaag

SEQ ID NO: 119978 - DNA, 25 bp, Mus musculus
acgactcacagtgtagtttgctaag

SEQ ID NO: 119979 - DNA, 25 bp, Mus musculus
acgactcagacgctactgtcaccag

SEQ ID NO: 119980 - DNA, 25 bp, Mus musculus
acgactcagacggtactgtcaccag

SEQ ID NO: 119981 - DNA, 25 bp, Mus musculus
acgactcataacactgtggctttca

SEQ ID NO: 119982 - DNA, 25 bp, Mus musculus
acgactcataactctgtggctttca

SEQ ID NO: 119983 - DNA, 25 bp, Mus musculus
acgactccatttacctttgtgaagg

SEQ ID NO: 119984 - DNA, 25 bp, Mus musculus
acgactccattttcctttgtgaagg

SEQ ID NO: 119985 - DNA, 25 bp, Mus musculus
acgactctactcagaaaatgaccga

SEQ ID NO: 119986 - DNA, 25 bp, Mus musculus
acgactctactctgaaaatgaccga

SEQ ID NO: 119987 - DNA, 25 bp, Mus musculus
acgactctcttacttctgtgctaaa

SEQ ID NO: 119988 - DNA, 25 bp, Mus musculus
acgactctcttagttctgtgctaaa

SEQ ID NO: 119989 - DNA, 25 bp, Mus musculus
acgactctgtctcggaatggtaggc

SEQ ID NO: 119990 - DNA, 25 bp, Mus musculus
acgactctgtctgggaatggtaggc

SEQ ID NO: 119991 - DNA, 25 bp, Mus musculus
acgactgaccctacctccagaagga

SEQ ID NO: 119992 - DNA, 25 bp, Mus musculus
acgactgacccttcctccagaagga

SEQ ID NO: 119993 - DNA, 25 bp, Mus musculus
acgactgagactacttgcatactac

SEQ ID NO: 119994 - DNA, 25 bp, Mus musculus
acgactgagacttcttgcatactac

SEQ ID NO: 119995 - DNA, 25 bp, Mus musculus
acgactgaggtcacttcacacatgg

SEQ ID NO: 119996 - DNA, 25 bp, Mus musculus
acgactgaggtctcttcacacatgg

SEQ ID NO: 119997 - DNA, 25 bp, Mus musculus
acgactgagtgcagcttggagaaca

SEQ ID NO: 119998 - DNA, 25 bp, Mus musculus
acgactgagtgctgcttggagaaca

SEQ ID NO: 119999 - DNA, 25 bp, Mus musculus
acgactgcagatcgcttggctgtat

SEQ ID NO: 120000 - DNA, 25 bp, Mus musculus
acgactgcagatggcttggctgtat

SEQ ID NO: 120001 - DNA, 25 bp, Mus musculus
acgactgcagtcaacagcgctagaa

SEQ ID NO: 120002 - DNA, 25 bp, Mus musculus
acgactgcagtctacagcgctagaa

SEQ ID NO: 120003 - DNA, 25 bp, Mus musculus
acgactgcgcaactgaacgagccca

SEQ ID NO: 120004 - DNA, 25 bp, Mus musculus
acgactgcgcaagtgaacgagccca

SEQ ID NO: 120005 - DNA, 25 bp, Mus musculus
acgactgcgcgaatacttctccaat

SEQ ID NO: 120006 - DNA, 25 bp, Mus musculus
acgactgcgcgattacttctccaat

SEQ ID NO: 120007 - DNA, 25 bp, Mus musculus
acgactgcggagagaacctctcaga

SEQ ID NO: 120008 - DNA, 25 bp, Mus musculus
acgactgcggagtgaacctctcaga

SEQ ID NO: 120009 - DNA, 25 bp, Mus musculus
acgactgctgccatgtctacagaag

SEQ ID NO: 120010 - DNA, 25 bp, Mus musculus
acgactgctgccttgtctacagaag

SEQ ID NO: 120011 - DNA, 25 bp, Mus musculus
acgactgctgctcgtgtgtattttt

SEQ ID NO: 120012 - DNA, 25 bp, Mus musculus
acgactgctgctggtgtgtattttt

SEQ ID NO: 120013 - DNA, 25 bp, Mus musculus
acgactgctggtcagtggccccaca

SEQ ID NO: 120014 - DNA, 25 bp, Mus musculus
acgactgctggtgagtggccccaca

SEQ ID NO: 120015 - DNA, 25 bp, Mus musculus
acgactggcctgagtgtactttgat

SEQ ID NO: 120016 - DNA, 25 bp, Mus musculus
acgactggcctgtgtgtactttgat

SEQ ID NO: 120017 - DNA, 25 bp, Mus musculus
acgactggcgaccatcagagtgcgg

SEQ ID NO: 120018 - DNA, 25 bp, Mus musculus
acgactggcgacgatcagagtgcgg

SEQ ID NO: 120019 - DNA, 25 bp, Mus musculus
acgactgggcagacgcatgttcttg

SEQ ID NO: 120020 - DNA, 25 bp, Mus musculus
acgactgggcagtcgcatgttcttg

SEQ ID NO: 120021 - DNA, 25 bp, Mus musculus
acgactgtacgtacgaccacatggg

SEQ ID NO: 120022 - DNA, 25 bp, Mus musculus
acgactgtacgtccagctgtaccat

SEQ ID NO: 120023 - DNA, 25 bp, Mus musculus
acgactgtacgtgcagctgtaccat

SEQ ID NO: 120024 - DNA, 25 bp, Mus musculus
acgactgtacgttcgaccacatggg

SEQ ID NO: 120025 - DNA, 25 bp, Mus musculus
acgactgtgaagagctggcgcgaac

SEQ ID NO: 120026 - DNA, 25 bp, Mus musculus
acgactgtgaagtgctggcgcgaac

SEQ ID NO: 120027 - DNA, 25 bp, Mus musculus
acgactgtgatcacccatgtgagga

SEQ ID NO: 120028 - DNA, 25 bp, Mus musculus
acgactgtgatctcccatgtgagga

SEQ ID NO: 120029 - DNA, 25 bp, Mus musculus
acgactgtgcctactgagctctagg

SEQ ID NO: 120030 - DNA, 25 bp, Mus musculus
acgactgtgccttctgagctctagg

SEQ ID NO: 120031 - DNA, 25 bp, Mus musculus
acgactgtggtactgcctatgacat

SEQ ID NO: 120032 - DNA, 25 bp, Mus musculus
acgactgtggtagtgcctatgacat

SEQ ID NO: 120033 - DNA, 25 bp, Mus musculus
acgacttacttgatgaaagccttat

SEQ ID NO: 120034 - DNA, 25 bp, Mus musculus
acgacttacttgttgaaagccttat

SEQ ID NO: 120035 - DNA, 25 bp, Mus musculus
acgacttcaacgacctgagtacctt

SEQ ID NO: 120036 - DNA, 25 bp, Mus musculus
acgacttcaacgtcctgagtacctt

SEQ ID NO: 120037 - DNA, 25 bp, Mus musculus
acgacttcaactccaacatctggga

SEQ ID NO: 120038 - DNA, 25 bp, Mus musculus
acgacttcaactgcaacatctggga

SEQ ID NO: 120039 - DNA, 25 bp, Mus musculus
acgacttcgggcaacggctgagaga

SEQ ID NO: 120040 - DNA, 25 bp, Mus musculus
acgacttcgggctacggctgagaga

SEQ ID NO: 120041 - DNA, 25 bp, Mus musculus
acgacttgaatacctcagtgtccca

SEQ ID NO: 120042 - DNA, 25 bp, Mus musculus
acgacttgaatagctcagtgtccca

SEQ ID NO: 120043 - DNA, 25 bp, Mus musculus
acgacttgagatctatgcccgggaa

SEQ ID NO: 120044 - DNA, 25 bp, Mus musculus
acgacttgagatgtatgcccgggaa

SEQ ID NO: 120045 - DNA, 25 bp, Mus musculus
acgacttgtgcgacttcttcttgtt

SEQ ID NO: 120046 - DNA, 25 bp, Mus musculus
acgacttgtgcgtcttcttcttgtt

SEQ ID NO: 120047 - DNA, 25 bp, Mus musculus
acgacttgttccagtctttaataca

SEQ ID NO: 120048 - DNA, 25 bp, Mus musculus
acgacttgttcctgtctttaataca

SEQ ID NO: 120049 - DNA, 25 bp, Mus musculus
acgactttagtgatcaccagctgag

SEQ ID NO: 120050 - DNA, 25 bp, Mus musculus
acgactttagtgttcaccagctgag

SEQ ID NO: 120051 - DNA, 25 bp, Mus musculus
acgagaaaccgtctggctagagaga

SEQ ID NO: 120052 - DNA, 25 bp, Mus musculus
acgagaaaccgtgtggctagagaga

SEQ ID NO: 120053 - DNA, 25 bp, Mus musculus
acgagaaacgctccaaacccctaga

SEQ ID NO: 120054 - DNA, 25 bp, Mus musculus
acgagaaacgctgcaaacccctaga

SEQ ID NO: 120055 - DNA, 25 bp, Mus musculus
acgagaacccacaaacacactatag

SEQ ID NO: 120056 - DNA, 25 bp, Mus musculus
acgagaacccactaacacactatag

SEQ ID NO: 120057 - DNA, 25 bp, Mus musculus
acgagaacctcactgaaggagaatt

SEQ ID NO: 120058 - DNA, 25 bp, Mus musculus
acgagaacctcagtgaaggagaatt

SEQ ID NO: 120059 - DNA, 25 bp, Mus musculus
acgagaacttctatacctatgccca

SEQ ID NO: 120060 - DNA, 25 bp, Mus musculus
acgagaacttctttacctatgccca

SEQ ID NO: 120061 - DNA, 25 bp, Mus musculus
acgagaagacagctgatcccctaca

SEQ ID NO: 120062 - DNA, 25 bp, Mus musculus
acgagaagacaggtgatcccctaca

SEQ ID NO: 120063 - DNA, 25 bp, Mus musculus
acgagaagatccacaccactggacc

SEQ ID NO: 120064 - DNA, 25 bp, Mus musculus
acgagaagatcctcaccactggacc

SEQ ID NO: 120065 - DNA, 25 bp, Mus musculus
acgagaagatgtccccgctgctgct

SEQ ID NO: 120066 - DNA, 25 bp, Mus musculus
acgagaagatgtgcccgctgctgct

SEQ ID NO: 120067 - DNA, 25 bp, Mus musculus
acgagaagccttccttacctgctga

SEQ ID NO: 120068 - DNA, 25 bp, Mus musculus
acgagaagccttgcttacctgctga

SEQ ID NO: 120069 - DNA, 25 bp, Mus musculus
acgagaagctgtctgtggacctcac

SEQ ID NO: 120070 - DNA, 25 bp, Mus musculus
acgagaagctgtgtgtggacctcac

SEQ ID NO: 120071 - DNA, 25 bp, Mus musculus
acgagaagtttgctgatcggctgct

SEQ ID NO: 120072 - DNA, 25 bp, Mus musculus
acgagaagtttggtgatcggctgct

SEQ ID NO: 120073 - DNA, 25 bp, Mus musculus
acgagaatcggtaactgcatttttc

SEQ ID NO: 120074 - DNA, 25 bp, Mus musculus
acgagaatcggttactgcatttttc

SEQ ID NO: 120075 - DNA, 25 bp, Mus musculus
acgagacaagggaccacaggcacca

SEQ ID NO: 120076 - DNA, 25 bp, Mus musculus
acgagacaagggtccacaggcacca

SEQ ID NO: 120077 - DNA, 25 bp, Mus musculus
acgagacaccatccggaggttgtga

SEQ ID NO: 120078 - DNA, 25 bp, Mus musculus
acgagacaccatgcggaggttgtga

SEQ ID NO: 120079 - DNA, 25 bp, Mus musculus
acgagacacgtaacccttacgggca

SEQ ID NO: 120080 - DNA, 25 bp, Mus musculus
acgagacacgtatcccttacgggca

SEQ ID NO: 120081 - DNA, 25 bp, Mus musculus
acgagacaggcgcagttctttaact

SEQ ID NO: 120082 - DNA, 25 bp, Mus musculus
acgagacaggcggagttctttaact

SEQ ID NO: 120083 - DNA, 25 bp, Mus musculus
acgagacattaaccatcccatggag

SEQ ID NO: 120084 - DNA, 25 bp, Mus musculus
acgagacattaagcatcccatggag

SEQ ID NO: 120085 - DNA, 25 bp, Mus musculus
acgagaccagagagtcgccagagac

SEQ ID NO: 120086 - DNA, 25 bp, Mus musculus
acgagaccagagtgtcgccagagac

SEQ ID NO: 120087 - DNA, 25 bp, Mus musculus
acgagaccctgtctgccagccatgg

SEQ ID NO: 120088 - DNA, 25 bp, Mus musculus
acgagaccctgtgtgccagccatgg

SEQ ID NO: 120089 - DNA, 25 bp, Mus musculus
acgagacgggcaacgccatatctgt

SEQ ID NO: 120090 - DNA, 25 bp, Mus musculus
acgagacgggcatcgccatatctgt

SEQ ID NO: 120091 - DNA, 25 bp, Mus musculus
acgagactccgacgaggagggagct

SEQ ID NO: 120092 - DNA, 25 bp, Mus musculus
acgagactccgaggaggagggagct

SEQ ID NO: 120093 - DNA, 25 bp, Mus musculus
acgagagaccctatgtgatttgtac

SEQ ID NO: 120094 - DNA, 25 bp, Mus musculus
acgagagaccctttgtgatttgtac

SEQ ID NO: 120095 - DNA, 25 bp, Mus musculus
acgagagattttaaccctgagggct

SEQ ID NO: 120096 - DNA, 25 bp, Mus musculus
acgagagatttttaccctgagggct

SEQ ID NO: 120097 - DNA, 25 bp, Mus musculus
acgagagcggctatcttgtttgtgg

SEQ ID NO: 120098 - DNA, 25 bp, Mus musculus
acgagagcggctttcttgtttgtgg

SEQ ID NO: 120099 - DNA, 25 bp, Mus musculus
acgagagctccacgttgtcagtcac

SEQ ID NO: 120100 - DNA, 25 bp, Mus musculus
acgagagctccaggttgtcagtcac

SEQ ID NO: 120101 - DNA, 25 bp, Mus musculus
acgagagctctgcacttgatgcaca

SEQ ID NO: 120102 - DNA, 25 bp, Mus musculus
acgagagctctggacttgatgcaca

SEQ ID NO: 120103 - DNA, 25 bp, Mus musculus
acgagagctgagcatttacacatca

SEQ ID NO: 120104 - DNA, 25 bp, Mus musculus
acgagagctgaggatttacacatca

SEQ ID NO: 120105 - DNA, 25 bp, Mus musculus
acgagaggagatcccctttttatct

SEQ ID NO: 120106 - DNA, 25 bp, Mus musculus
acgagaggagatgccctttttatct

SEQ ID NO: 120107 - DNA, 25 bp, Mus musculus
acgagaggataaaaccaccacagtg

SEQ ID NO: 120108 - DNA, 25 bp, Mus musculus
acgagaggataataccaccacagtg

SEQ ID NO: 120109 - DNA, 25 bp, Mus musculus
acgagaggccatacacctgtgacat

SEQ ID NO: 120110 - DNA, 25 bp, Mus musculus
acgagaggccattcacctgtgacat

SEQ ID NO: 120111 - DNA, 25 bp, Mus musculus
acgagaggccctaggagttgctcct

SEQ ID NO: 120112 - DNA, 25 bp, Mus musculus
acgagaggcccttggagttgctcct

SEQ ID NO: 120113 - DNA, 25 bp, Mus musculus
acgagaggctcaaggctagctttgc

SEQ ID NO: 120114 - DNA, 25 bp, Mus musculus
acgagaggctcatggctagctttgc

SEQ ID NO: 120115 - DNA, 25 bp, Mus musculus
acgagagggttcagatgctcctgtc

SEQ ID NO: 120116 - DNA, 25 bp, Mus musculus
acgagagggttctgatgctcctgtc

SEQ ID NO: 120117 - DNA, 25 bp, Mus musculus
acgagagtactcagaaagttatatt

SEQ ID NO: 120118 - DNA, 25 bp, Mus musculus
acgagagtactctgaaagttatatt

SEQ ID NO: 120119 - DNA, 25 bp, Mus musculus
acgagagtaggcataggcgcagcca

SEQ ID NO: 120120 - DNA, 25 bp, Mus musculus
acgagagtaggcttaggcgcagcca

SEQ ID NO: 120121 - DNA, 25 bp, Mus musculus
acgagagtagttaccaaggactcgg

SEQ ID NO: 120122 - DNA, 25 bp, Mus musculus
acgagagtagtttccaaggactcgg

SEQ ID NO: 120123 - DNA, 25 bp, Mus musculus
acgagagtggtgacccgtcttcaaa

SEQ ID NO: 120124 - DNA, 25 bp, Mus musculus
acgagagtggtgtcccgtcttcaaa

SEQ ID NO: 120125 - DNA, 25 bp, Mus musculus
acgagataaagtcctgtgtgctgat

SEQ ID NO: 120126 - DNA, 25 bp, Mus musculus
acgagataaagtgctgtgtgctgat

SEQ ID NO: 120127 - DNA, 25 bp, Mus musculus
acgagataacccatctcactacaaa

SEQ ID NO: 120128 - DNA, 25 bp, Mus musculus
acgagataacccttctcactacaaa

SEQ ID NO: 120129 - DNA, 25 bp, Mus musculus
acgagatatgctaaagtgctttgtt

SEQ ID NO: 120130 - DNA, 25 bp, Mus musculus
acgagatatgcttaagtgctttgtt

SEQ ID NO: 120131 - DNA, 25 bp, Mus musculus
acgagatcccgcattactggacaaa

SEQ ID NO: 120132 - DNA, 25 bp, Mus musculus
acgagatcccgctttactggacaaa

SEQ ID NO: 120133 - DNA, 25 bp, Mus musculus
acgagatcctgaccacatgaacaat

SEQ ID NO: 120134 - DNA, 25 bp, Mus musculus
acgagatcctgacttttgtgtttta

SEQ ID NO: 120135 - DNA, 25 bp, Mus musculus
acgagatcctgagcacatgaacaat

SEQ ID NO: 120136 - DNA, 25 bp, Mus musculus
acgagatcctgagttttgtgtttta

SEQ ID NO: 120137 - DNA, 25 bp, Mus musculus
acgagatctccacgatcagttccaa

SEQ ID NO: 120138 - DNA, 25 bp, Mus musculus
acgagatctccaggatcagttccaa

SEQ ID NO: 120139 - DNA, 25 bp, Mus musculus
acgagatctgctagtttgtccatat

SEQ ID NO: 120140 - DNA, 25 bp, Mus musculus
acgagatctgcttgtttgtccatat

SEQ ID NO: 120141 - DNA, 25 bp, Mus musculus
acgagatgacgaagcttttggttta

SEQ ID NO: 120142 - DNA, 25 bp, Mus musculus
acgagatgacgatgcttttggttta

SEQ ID NO: 120143 - DNA, 25 bp, Mus musculus
acgagatgtcccagtctgagggtga

SEQ ID NO: 120144 - DNA, 25 bp, Mus musculus
acgagatgtccctgtctgagggtga

SEQ ID NO: 120145 - DNA, 25 bp, Mus musculus
acgagattcagccagacctgcggga

SEQ ID NO: 120146 - DNA, 25 bp, Mus musculus
acgagattcagcgagacctgcggga

SEQ ID NO: 120147 - DNA, 25 bp, Mus musculus
acgagattcttacaccagtgttgcc

SEQ ID NO: 120148 - DNA, 25 bp, Mus musculus
acgagattcttagaccagtgttgcc

SEQ ID NO: 120149 - DNA, 25 bp, Mus musculus
acgagattgaatactatgccaaggt

SEQ ID NO: 120150 - DNA, 25 bp, Mus musculus
acgagattgaattctatgccaaggt

SEQ ID NO: 120151 - DNA, 25 bp, Mus musculus
acgagattgaggaggtgcccaccac

SEQ ID NO: 120152 - DNA, 25 bp, Mus musculus
acgagattgaggtggtgcccaccac

SEQ ID NO: 120153 - DNA, 25 bp, Mus musculus
acgagattgatcaggacacctccga

SEQ ID NO: 120154 - DNA, 25 bp, Mus musculus
acgagattgatctggacacctccga

SEQ ID NO: 120155 - DNA, 25 bp, Mus musculus
acgagcaaatgcagaatctcagttc

SEQ ID NO: 120156 - DNA, 25 bp, Mus musculus
acgagcaaatgctgaatctcagttc

SEQ ID NO: 120157 - DNA, 25 bp, Mus musculus
acgagcaagcagcacaggcagtgaa

SEQ ID NO: 120158 - DNA, 25 bp, Mus musculus
acgagcaagcaggacaggcagtgaa

SEQ ID NO: 120159 - DNA, 25 bp, Mus musculus
acgagcaagctcaccgaacacgaga

SEQ ID NO: 120160 - DNA, 25 bp, Mus musculus
acgagcaagctctccgaacacgaga

SEQ ID NO: 120161 - DNA, 25 bp, Mus musculus
acgagcaatatgactgacctgtact

SEQ ID NO: 120162 - DNA, 25 bp, Mus musculus
acgagcaatatgtctgacctgtact

SEQ ID NO: 120163 - DNA, 25 bp, Mus musculus
acgagcaccctgagacaggaaccaa

SEQ ID NO: 120164 - DNA, 25 bp, Mus musculus
acgagcaccctgtgacaggaaccaa

SEQ ID NO: 120165 - DNA, 25 bp, Mus musculus
acgagcacggtcaggatctggatga

SEQ ID NO: 120166 - DNA, 25 bp, Mus musculus
acgagcacggtctggatctggatga

SEQ ID NO: 120167 - DNA, 25 bp, Mus musculus
acgagcagcgggatctcctctaggc

SEQ ID NO: 120168 - DNA, 25 bp, Mus musculus
acgagcagcgggttctcctctaggc

SEQ ID NO: 120169 - DNA, 25 bp, Mus musculus
acgagcagggaccatttccaggttc

SEQ ID NO: 120170 - DNA, 25 bp, Mus musculus
acgagcagggacgatttccaggttc

SEQ ID NO: 120171 - DNA, 25 bp, Mus musculus
acgagcagttccatgcagacttggg

SEQ ID NO: 120172 - DNA, 25 bp, Mus musculus
acgagcagttccttgcagacttggg

SEQ ID NO: 120173 - DNA, 25 bp, Mus musculus
acgagcatctaaataactgtggtga

SEQ ID NO: 120174 - DNA, 25 bp, Mus musculus
acgagcatctaattaactgtggtga

SEQ ID NO: 120175 - DNA, 25 bp, Mus musculus
acgagcatggacaactgaagaaatt

SEQ ID NO: 120176 - DNA, 25 bp, Mus musculus
acgagcatggactactgaagaaatt

SEQ ID NO: 120177 - DNA, 25 bp, Mus musculus
acgagcatgtaaatcaagcgcagac

SEQ ID NO: 120178 - DNA, 25 bp, Mus musculus
acgagcatgtaattcaagcgcagac

SEQ ID NO: 120179 - DNA, 25 bp, Mus musculus
acgagcattcagagtcctcatctgg

SEQ ID NO: 120180 - DNA, 25 bp, Mus musculus
acgagcattcagtgtcctcatctgg

SEQ ID NO: 120181 - DNA, 25 bp, Mus musculus
acgagcattgccatcttattttact

SEQ ID NO: 120182 - DNA, 25 bp, Mus musculus
acgagcattgccttcttattttact

SEQ ID NO: 120183 - DNA, 25 bp, Mus musculus
acgagccaatcaaagctaccttttt

SEQ ID NO: 120184 - DNA, 25 bp, Mus musculus
acgagccaatcatagctaccttttt

SEQ ID NO: 120185 - DNA, 25 bp, Mus musculus
acgagccacttcatactgttaacaa

SEQ ID NO: 120186 - DNA, 25 bp, Mus musculus
acgagccacttcttactgttaacaa

SEQ ID NO: 120187 - DNA, 25 bp, Mus musculus
acgagccagagcagcggtcccatgg

SEQ ID NO: 120188 - DNA, 25 bp, Mus musculus
acgagccagagcatgtcctgtggac

SEQ ID NO: 120189 - DNA, 25 bp, Mus musculus
acgagccagagctgcggtcccatgg

SEQ ID NO: 120190 - DNA, 25 bp, Mus musculus
acgagccagagcttgtcctgtggac

SEQ ID NO: 120191 - DNA, 25 bp, Mus musculus
acgagccattgcaacatgccaccaa

SEQ ID NO: 120192 - DNA, 25 bp, Mus musculus
acgagccattgctacatgccaccaa

SEQ ID NO: 120193 - DNA, 25 bp, Mus musculus
acgagcccacgtactgtctgtgcaa

SEQ ID NO: 120194 - DNA, 25 bp, Mus musculus
acgagcccacgttctgtctgtgcaa

SEQ ID NO: 120195 - DNA, 25 bp, Mus musculus
acgagccccattcacaaattttgac

SEQ ID NO: 120196 - DNA, 25 bp, Mus musculus
acgagccccattgacaaattttgac

SEQ ID NO: 120197 - DNA, 25 bp, Mus musculus
acgagccgcacaatcgcatggtgga

SEQ ID NO: 120198 - DNA, 25 bp, Mus musculus
acgagccgcacattcgcatggtgga

SEQ ID NO: 120199 - DNA, 25 bp, Mus musculus
acgagcctctagcatcactacacag

SEQ ID NO: 120200 - DNA, 25 bp, Mus musculus
acgagcctctaggatcactacacag

SEQ ID NO: 120201 - DNA, 25 bp, Mus musculus
acgagcgagcttcagtttagcactc

SEQ ID NO: 120202 - DNA, 25 bp, Mus musculus
acgagcgagcttgagtttagcactc

SEQ ID NO: 120203 - DNA, 25 bp, Mus musculus
acgagcgaggacatcccaggtggat

SEQ ID NO: 120204 - DNA, 25 bp, Mus musculus
acgagcgaggacttcccaggtggat

SEQ ID NO: 120205 - DNA, 25 bp, Mus musculus
acgagcgcatcaccaagctagcagg

SEQ ID NO: 120206 - DNA, 25 bp, Mus musculus
acgagcgcatcagcaagctagcagg

SEQ ID NO: 120207 - DNA, 25 bp, Mus musculus
acgagcgcggcaaggaatctcttaa

SEQ ID NO: 120208 - DNA, 25 bp, Mus musculus
acgagcgcggcatggaatctcttaa

SEQ ID NO: 120209 - DNA, 25 bp, Mus musculus
acgagcggtctgatcaggaggctac

SEQ ID NO: 120210 - DNA, 25 bp, Mus musculus
acgagcggtctgttcaggaggctac

SEQ ID NO: 120211 - DNA, 25 bp, Mus musculus
acgagctactgcaggttccaatggg

SEQ ID NO: 120212 - DNA, 25 bp, Mus musculus
acgagctactgctggttccaatggg

SEQ ID NO: 120213 - DNA, 25 bp, Mus musculus
acgagctagtgcaactgaactgttt

SEQ ID NO: 120214 - DNA, 25 bp, Mus musculus
acgagctagtgcattctacttgctg

SEQ ID NO: 120215 - DNA, 25 bp, Mus musculus
acgagctagtgctactgaactgttt

SEQ ID NO: 120216 - DNA, 25 bp, Mus musculus
acgagctagtgctttctacttgctg

SEQ ID NO: 120217 - DNA, 25 bp, Mus musculus
acgagctatcgaagggaggactctt

SEQ ID NO: 120218 - DNA, 25 bp, Mus musculus
acgagctatcgatgggaggactctt

SEQ ID NO: 120219 - DNA, 25 bp, Mus musculus
acgagctcattcacatcatgctgat

SEQ ID NO: 120220 - DNA, 25 bp, Mus musculus
acgagctcattcacgcgtttgacca

SEQ ID NO: 120221 - DNA, 25 bp, Mus musculus
acgagctcattctcatcatgctgat

SEQ ID NO: 120222 - DNA, 25 bp, Mus musculus
acgagctcattctcgcgtttgacca

SEQ ID NO: 120223 - DNA, 25 bp, Mus musculus
acgagctctgagagtgttccattat

SEQ ID NO: 120224 - DNA, 25 bp, Mus musculus
acgagctctgagtgtgttccattat

SEQ ID NO: 120225 - DNA, 25 bp, Mus musculus
acgagctcttcacctactgcgacaa

SEQ ID NO: 120226 - DNA, 25 bp, Mus musculus
acgagctcttcagctactgcgacaa

SEQ ID NO: 120227 - DNA, 25 bp, Mus musculus
acgagctggtctagcgcggctgtcc

SEQ ID NO: 120228 - DNA, 25 bp, Mus musculus
acgagctggtcttgcgcggctgtcc

SEQ ID NO: 120229 - DNA, 25 bp, Mus musculus
acgagctgtcttatacacccttgaa

SEQ ID NO: 120230 - DNA, 25 bp, Mus musculus
acgagctgtcttttacacccttgaa

SEQ ID NO: 120231 - DNA, 25 bp, Mus musculus
acgagcttgtttaaactatcagaac

SEQ ID NO: 120232 - DNA, 25 bp, Mus musculus
acgagcttgttttaactatcagaac

SEQ ID NO: 120233 - DNA, 25 bp, Mus musculus
acgaggaacaacaggtccatgtgtt

SEQ ID NO: 120234 - DNA, 25 bp, Mus musculus
acgaggaacaactggtccatgtgtt

SEQ ID NO: 120235 - DNA, 25 bp, Mus musculus
acgaggaacttcaccgagctgacct

SEQ ID NO: 120236 - DNA, 25 bp, Mus musculus
acgaggaacttcagtggaaactgca

SEQ ID NO: 120237 - DNA, 25 bp, Mus musculus
acgaggaacttctccgagctgacct

SEQ ID NO: 120238 - DNA, 25 bp, Mus musculus
acgaggaacttctgtggaaactgca

SEQ ID NO: 120239 - DNA, 25 bp, Mus musculus
acgaggacaagactcaacctggtgt

SEQ ID NO: 120240 - DNA, 25 bp, Mus musculus
acgaggacaagagtcaacctggtgt

SEQ ID NO: 120241 - DNA, 25 bp, Mus musculus
acgaggaccctacgttttacagcat

SEQ ID NO: 120242 - DNA, 25 bp, Mus musculus
acgaggaccctaggttttacagcat

SEQ ID NO: 120243 - DNA, 25 bp, Mus musculus
acgaggacctttcccacatggaaga

SEQ ID NO: 120244 - DNA, 25 bp, Mus musculus
acgaggacctttgccacatggaaga

SEQ ID NO: 120245 - DNA, 25 bp, Mus musculus
acgaggacgaggacagcagcacaga

SEQ ID NO: 120246 - DNA, 25 bp, Mus musculus
acgaggacgaggactccttccagga

SEQ ID NO: 120247 - DNA, 25 bp, Mus musculus
acgaggacgaggtcagcagcacaga

SEQ ID NO: 120248 - DNA, 25 bp, Mus musculus
acgaggacgaggtctccttccagga

SEQ ID NO: 120249 - DNA, 25 bp, Mus musculus
acgaggagcctcctctggattgtac

SEQ ID NO: 120250 - DNA, 25 bp, Mus musculus
acgaggagcctcgtctggattgtac

SEQ ID NO: 120251 - DNA, 25 bp, Mus musculus
acgaggataccgatcgctgcgagta

SEQ ID NO: 120252 - DNA, 25 bp, Mus musculus
acgaggataccgttcgctgcgagta

SEQ ID NO: 120253 - DNA, 25 bp, Mus musculus
acgaggatattcctactgtgccttc

SEQ ID NO: 120254 - DNA, 25 bp, Mus musculus
acgaggatattcgtactgtgccttc

SEQ ID NO: 120255 - DNA, 25 bp, Mus musculus
acgaggccagtaagagatgctgtca

SEQ ID NO: 120256 - DNA, 25 bp, Mus musculus
acgaggccagtatgagatgctgtca

SEQ ID NO: 120257 - DNA, 25 bp, Mus musculus
acgaggcccggtaccagcagaagct

SEQ ID NO: 120258 - DNA, 25 bp, Mus musculus
acgaggcccggttccagcagaagct

SEQ ID NO: 120259 - DNA, 25 bp, Mus musculus
acgaggcgcatgagttctccaacac

SEQ ID NO: 120260 - DNA, 25 bp, Mus musculus
acgaggcgcatgtgttctccaacac

SEQ ID NO: 120261 - DNA, 25 bp, Mus musculus
acgaggcgctggcttccctcttcag

SEQ ID NO: 120262 - DNA, 25 bp, Mus musculus
acgaggcgctgggttccctcttcag

SEQ ID NO: 120263 - DNA, 25 bp, Mus musculus
acgaggcggccaaactgatgaatgt

SEQ ID NO: 120264 - DNA, 25 bp, Mus musculus
acgaggcggccatactgatgaatgt

SEQ ID NO: 120265 - DNA, 25 bp, Mus musculus
acgaggcggcctcagctatacgtcc

SEQ ID NO: 120266 - DNA, 25 bp, Mus musculus
acgaggcggcctgagctatacgtcc

SEQ ID NO: 120267 - DNA, 25 bp, Mus musculus
acgaggcgtgcaaggaggcatcctc

SEQ ID NO: 120268 - DNA, 25 bp, Mus musculus
acgaggcgtgcatggaggcatcctc

SEQ ID NO: 120269 - DNA, 25 bp, Mus musculus
acgaggctagagacaatgcgtgcaa

SEQ ID NO: 120270 - DNA, 25 bp, Mus musculus
acgaggctagagtcaatgcgtgcaa

SEQ ID NO: 120271 - DNA, 25 bp, Mus musculus
acgaggctctccaggtccaaaaggg

SEQ ID NO: 120272 - DNA, 25 bp, Mus musculus
acgaggctctcctggtccaaaaggg

SEQ ID NO: 120273 - DNA, 25 bp, Mus musculus
acgaggctgcctatgtgctaccagt

SEQ ID NO: 120274 - DNA, 25 bp, Mus musculus
acgaggctgcctttgtgctaccagt

SEQ ID NO: 120275 - DNA, 25 bp, Mus musculus
acgaggcttcctcacagagagagat

SEQ ID NO: 120276 - DNA, 25 bp, Mus musculus
acgaggcttcctgacagagagagat

SEQ ID NO: 120277 - DNA, 25 bp, Mus musculus
acgagggaagatatgacacggattt

SEQ ID NO: 120278 - DNA, 25 bp, Mus musculus
acgagggaagatttgacacggattt

SEQ ID NO: 120279 - DNA, 25 bp, Mus musculus
acgagggacagtcttctggagctct

SEQ ID NO: 120280 - DNA, 25 bp, Mus musculus
acgagggacagtgttctggagctct

SEQ ID NO: 120281 - DNA, 25 bp, Mus musculus
acgagggagccccacggcacagtaa

SEQ ID NO: 120282 - DNA, 25 bp, Mus musculus
acgagggagcccgacggcacagtaa

SEQ ID NO: 120283 - DNA, 25 bp, Mus musculus
acgagggatgtgaggtgctctcaga

SEQ ID NO: 120284 - DNA, 25 bp, Mus musculus
acgagggatgtgtggtgctctcaga

SEQ ID NO: 120285 - DNA, 25 bp, Mus musculus
acgagggcaagcagctctacacctt

SEQ ID NO: 120286 - DNA, 25 bp, Mus musculus
acgagggcaagctgctctacacctt

SEQ ID NO: 120287 - DNA, 25 bp, Mus musculus
acgagggcacagctcgcagtgtact

SEQ ID NO: 120288 - DNA, 25 bp, Mus musculus
acgagggcacaggtcgcagtgtact

SEQ ID NO: 120289 - DNA, 25 bp, Mus musculus
acgagggcatttaccgggagcgcct

SEQ ID NO: 120290 - DNA, 25 bp, Mus musculus
acgagggcattttccgggagcgcct

SEQ ID NO: 120291 - DNA, 25 bp, Mus musculus
acgagggcgagccagagcacgcagt

SEQ ID NO: 120292 - DNA, 25 bp, Mus musculus
acgagggcgagcgagagcacgcagt

SEQ ID NO: 120293 - DNA, 25 bp, Mus musculus
acgagggctcttctgttaaggcaaa

SEQ ID NO: 120294 - DNA, 25 bp, Mus musculus
acgagggctcttgtgttaaggcaaa

SEQ ID NO: 120295 - DNA, 25 bp, Mus musculus
acgagggctggtacatggcctttac

SEQ ID NO: 120296 - DNA, 25 bp, Mus musculus
acgagggctggttcatggcctttac

SEQ ID NO: 120297 - DNA, 25 bp, Mus musculus
acgagggctttgagctcatcggcga

SEQ ID NO: 120298 - DNA, 25 bp, Mus musculus
acgagggctttgtgctcatcggcga

SEQ ID NO: 120299 - DNA, 25 bp, Mus musculus
acgagggtcacccactgagtgcttt

SEQ ID NO: 120300 - DNA, 25 bp, Mus musculus
acgagggtcaccgactgagtgcttt

SEQ ID NO: 120301 - DNA, 25 bp, Mus musculus
acgaggtcaacaacgatgagctatt

SEQ ID NO: 120302 - DNA, 25 bp, Mus musculus
acgaggtcaacatcgatgagctatt

SEQ ID NO: 120303 - DNA, 25 bp, Mus musculus
acgaggtcactcctggatttccgca

SEQ ID NO: 120304 - DNA, 25 bp, Mus musculus
acgaggtcactcgtggatttccgca

SEQ ID NO: 120305 - DNA, 25 bp, Mus musculus
acgaggtcagagacactggcccctg

SEQ ID NO: 120306 - DNA, 25 bp, Mus musculus
acgaggtcagagtcactggcccctg

SEQ ID NO: 120307 - DNA, 25 bp, Mus musculus
acgaggtccagactcttctgcatcc

SEQ ID NO: 120308 - DNA, 25 bp, Mus musculus
acgaggtccagagtcttctgcatcc

SEQ ID NO: 120309 - DNA, 25 bp, Mus musculus
acgaggtgaccgagtggctcgcaca

SEQ ID NO: 120310 - DNA, 25 bp, Mus musculus
acgaggtgaccgtgtggctcgcaca

SEQ ID NO: 120311 - DNA, 25 bp, Mus musculus
acgaggtgcacgaggccaaaatcca

SEQ ID NO: 120312 - DNA, 25 bp, Mus musculus
acgaggtgcacgtggccaaaatcca

SEQ ID NO: 120313 - DNA, 25 bp, Mus musculus
acgaggtgcctgcttacgctgtatc

SEQ ID NO: 120314 - DNA, 25 bp, Mus musculus
acgaggtgcctggttacgctgtatc

SEQ ID NO: 120315 - DNA, 25 bp, Mus musculus
acgaggtggcccctgttctcaatct

SEQ ID NO: 120316 - DNA, 25 bp, Mus musculus
acgaggtggcccgtgttctcaatct

SEQ ID NO: 120317 - DNA, 25 bp, Mus musculus
acgaggtgtcctacctggacgtgca

SEQ ID NO: 120318 - DNA, 25 bp, Mus musculus
acgaggtgtccttcctggacgtgca

SEQ ID NO: 120319 - DNA, 25 bp, Mus musculus
acgaggttcccactcaagaggacat
